United States Patent 10,058,623 (COMPOSITIONS AND METHODS FOR MODULATING UTRN EXPRESSION) - sequence listing, part 10

SEQ ID NO: 340688 - DNA, 15 bp, Homo sapiens
cccagaatgtatatt

SEQ ID NO: 340689 - DNA, 15 bp, Homo sapiens
ccagaatgtatattt

SEQ ID NO: 340690 - DNA, 15 bp, Homo sapiens
cagaatgtatatttg

SEQ ID NO: 340691 - DNA, 15 bp, Homo sapiens
agaatgtatatttga

SEQ ID NO: 340692 - DNA, 15 bp, Homo sapiens
gaatgtatatttgac

SEQ ID NO: 340693 - DNA, 15 bp, Homo sapiens
aatgtatatttgact

SEQ ID NO: 340694 - DNA, 15 bp, Homo sapiens
atgtatatttgactt

SEQ ID NO: 340695 - DNA, 15 bp, Homo sapiens
tgtatatttgacttt

SEQ ID NO: 340696 - DNA, 15 bp, Homo sapiens
gtatatttgactttg

SEQ ID NO: 340697 - DNA, 15 bp, Homo sapiens
tatatttgactttgc

SEQ ID NO: 340698 - DNA, 15 bp, Homo sapiens
atatttgactttgca

SEQ ID NO: 340699 - DNA, 15 bp, Homo sapiens
tatttgactttgcaa

SEQ ID NO: 340700 - DNA, 15 bp, Homo sapiens
atttgactttgcaaa

SEQ ID NO: 340701 - DNA, 15 bp, Homo sapiens
tttgactttgcaaag

SEQ ID NO: 340702 - DNA, 15 bp, Homo sapiens
ttgactttgcaaagg

SEQ ID NO: 340703 - DNA, 15 bp, Homo sapiens
tgactttgcaaaggg

SEQ ID NO: 340704 - DNA, 15 bp, Homo sapiens
gactttgcaaaggga

SEQ ID NO: 340705 - DNA, 15 bp, Homo sapiens
actttgcaaagggaa

SEQ ID NO: 340706 - DNA, 15 bp, Homo sapiens
ctttgcaaagggaaa

SEQ ID NO: 340707 - DNA, 15 bp, Homo sapiens
tttgcaaagggaaaa

SEQ ID NO: 340708 - DNA, 15 bp, Homo sapiens
ttgcaaagggaaaag

SEQ ID NO: 340709 - DNA, 15 bp, Homo sapiens
tgcaaagggaaaagg

SEQ ID NO: 340710 - DNA, 15 bp, Homo sapiens
gcaaagggaaaaggc

SEQ ID NO: 340711 - DNA, 15 bp, Homo sapiens
caaagggaaaaggct

SEQ ID NO: 340712 - DNA, 15 bp, Homo sapiens
aaagggaaaaggctt

SEQ ID NO: 340713 - DNA, 15 bp, Homo sapiens
aagggaaaaggcttg

SEQ ID NO: 340714 - DNA, 15 bp, Homo sapiens
agggaaaaggcttgt

SEQ ID NO: 340715 - DNA, 15 bp, Homo sapiens
gggaaaaggcttgta

SEQ ID NO: 340716 - DNA, 15 bp, Homo sapiens
ggaaaaggcttgtag

SEQ ID NO: 340717 - DNA, 15 bp, Homo sapiens
gaaaaggcttgtagg

SEQ ID NO: 340718 - DNA, 15 bp, Homo sapiens
aaaaggcttgtagga

SEQ ID NO: 340719 - DNA, 15 bp, Homo sapiens
aaaggcttgtaggaa

SEQ ID NO: 340720 - DNA, 15 bp, Homo sapiens
aaggcttgtaggaat

SEQ ID NO: 340721 - DNA, 15 bp, Homo sapiens
aggcttgtaggaata

SEQ ID NO: 340722 - DNA, 15 bp, Homo sapiens
ggcttgtaggaataa

SEQ ID NO: 340723 - DNA, 15 bp, Homo sapiens
gcttgtaggaataat

SEQ ID NO: 340724 - DNA, 15 bp, Homo sapiens
cttgtaggaataatg

SEQ ID NO: 340725 - DNA, 15 bp, Homo sapiens
ttgtaggaataatgc

SEQ ID NO: 340726 - DNA, 15 bp, Homo sapiens
tgtaggaataatgct

SEQ ID NO: 340727 - DNA, 15 bp, Homo sapiens
gtaggaataatgctg

SEQ ID NO: 340728 - DNA, 15 bp, Homo sapiens
taggaataatgctgt

SEQ ID NO: 340729 - DNA, 15 bp, Homo sapiens
aggaataatgctgtg

SEQ ID NO: 340730 - DNA, 15 bp, Homo sapiens
ggaataatgctgtgt

SEQ ID NO: 340731 - DNA, 15 bp, Homo sapiens
gaataatgctgtgtt

SEQ ID NO: 340732 - DNA, 15 bp, Homo sapiens
aataatgctgtgttc

SEQ ID NO: 340733 - DNA, 15 bp, Homo sapiens
ataatgctgtgttcc

SEQ ID NO: 340734 - DNA, 15 bp, Homo sapiens
taatgctgtgttccc

SEQ ID NO: 340735 - DNA, 15 bp, Homo sapiens
aatgctgtgttcccc

SEQ ID NO: 340736 - DNA, 15 bp, Homo sapiens
atgctgtgttcccca

SEQ ID NO: 340737 - DNA, 15 bp, Homo sapiens
tgctgtgttccccac

SEQ ID NO: 340738 - DNA, 15 bp, Homo sapiens
gctgtgttccccacg

SEQ ID NO: 340739 - DNA, 15 bp, Homo sapiens
ctgtgttccccacgg

SEQ ID NO: 340740 - DNA, 15 bp, Homo sapiens
tgtgttccccacgga

SEQ ID NO: 340741 - DNA, 15 bp, Homo sapiens
gtgttccccacggac

SEQ ID NO: 340742 - DNA, 15 bp, Homo sapiens
tgttccccacggaca

SEQ ID NO: 340743 - DNA, 15 bp, Homo sapiens
gttccccacggacag

SEQ ID NO: 340744 - DNA, 15 bp, Homo sapiens
ttccccacggacagg

SEQ ID NO: 340745 - DNA, 15 bp, Homo sapiens
tccccacggacaggc

SEQ ID NO: 340746 - DNA, 15 bp, Homo sapiens
ccccacggacaggct

SEQ ID NO: 340747 - DNA, 15 bp, Homo sapiens
cccacggacaggctg

SEQ ID NO: 340748 - DNA, 15 bp, Homo sapiens
ccacggacaggctgc

SEQ ID NO: 340749 - DNA, 15 bp, Homo sapiens
cacggacaggctgca

SEQ ID NO: 340750 - DNA, 15 bp, Homo sapiens
acggacaggctgcac

SEQ ID NO: 340751 - DNA, 15 bp, Homo sapiens
cggacaggctgcacg

SEQ ID NO: 340752 - DNA, 15 bp, Homo sapiens
ggacaggctgcacga

SEQ ID NO: 340753 - DNA, 15 bp, Homo sapiens
gacaggctgcacgat

SEQ ID NO: 340754 - DNA, 15 bp, Homo sapiens
acaggctgcacgatg

SEQ ID NO: 340755 - DNA, 15 bp, Homo sapiens
caggctgcacgatgt

SEQ ID NO: 340756 - DNA, 15 bp, Homo sapiens
aggctgcacgatgtg

SEQ ID NO: 340757 - DNA, 15 bp, Homo sapiens
ggctgcacgatgtgc

SEQ ID NO: 340758 - DNA, 15 bp, Homo sapiens
gctgcacgatgtgct

SEQ ID NO: 340759 - DNA, 15 bp, Homo sapiens
ctgcacgatgtgctg

SEQ ID NO: 340760 - DNA, 15 bp, Homo sapiens
tgcacgatgtgctga

SEQ ID NO: 340761 - DNA, 15 bp, Homo sapiens
gcacgatgtgctgat

SEQ ID NO: 340762 - DNA, 15 bp, Homo sapiens
cacgatgtgctgatg

SEQ ID NO: 340763 - DNA, 15 bp, Homo sapiens
acgatgtgctgatgg

SEQ ID NO: 340764 - DNA, 15 bp, Homo sapiens
cgatgtgctgatgga

SEQ ID NO: 340765 - DNA, 15 bp, Homo sapiens
gatgtgctgatggaa

SEQ ID NO: 340766 - DNA, 15 bp, Homo sapiens
atgtgctgatggaac

SEQ ID NO: 340767 - DNA, 15 bp, Homo sapiens
tgtgctgatggaact

SEQ ID NO: 340768 - DNA, 15 bp, Homo sapiens
gtgctgatggaactg

SEQ ID NO: 340769 - DNA, 15 bp, Homo sapiens
tgctgatggaactgc

SEQ ID NO: 340770 - DNA, 15 bp, Homo sapiens
gctgatggaactgca

SEQ ID NO: 340771 - DNA, 15 bp, Homo sapiens
ctgatggaactgcag

SEQ ID NO: 340772 - DNA, 15 bp, Homo sapiens
tgatggaactgcaga

SEQ ID NO: 340773 - DNA, 15 bp, Homo sapiens
gatggaactgcagaa

SEQ ID NO: 340774 - DNA, 15 bp, Homo sapiens
atggaactgcagaag

SEQ ID NO: 340775 - DNA, 15 bp, Homo sapiens
tggaactgcagaaga

SEQ ID NO: 340776 - DNA, 15 bp, Homo sapiens
ggaactgcagaagaa

SEQ ID NO: 340777 - DNA, 15 bp, Homo sapiens
gaactgcagaagaag

SEQ ID NO: 340778 - DNA, 15 bp, Homo sapiens
aactgcagaagaagc

SEQ ID NO: 340779 - DNA, 15 bp, Homo sapiens
actgcagaagaagca

SEQ ID NO: 340780 - DNA, 15 bp, Homo sapiens
ctgcagaagaagcaa

SEQ ID NO: 340781 - DNA, 15 bp, Homo sapiens
tgcagaagaagcaac

SEQ ID NO: 340782 - DNA, 15 bp, Homo sapiens
gcagaagaagcaact

SEQ ID NO: 340783 - DNA, 15 bp, Homo sapiens
cagaagaagcaactg

SEQ ID NO: 340784 - DNA, 15 bp, Homo sapiens
agaagaagcaactgc

SEQ ID NO: 340785 - DNA, 15 bp, Homo sapiens
gaagaagcaactgca

SEQ ID NO: 340786 - DNA, 15 bp, Homo sapiens
aagaagcaactgcag

SEQ ID NO: 340787 - DNA, 15 bp, Homo sapiens
gaagcaactgcagca

SEQ ID NO: 340788 - DNA, 15 bp, Homo sapiens
aagcaactgcagcag

SEQ ID NO: 340789 - DNA, 15 bp, Homo sapiens
agcaactgcagcagc

SEQ ID NO: 340790 - DNA, 15 bp, Homo sapiens
gcaactgcagcagct

SEQ ID NO: 340791 - DNA, 15 bp, Homo sapiens
caactgcagcagctc

SEQ ID NO: 340792 - DNA, 15 bp, Homo sapiens
aactgcagcagctct

SEQ ID NO: 340793 - DNA, 15 bp, Homo sapiens
actgcagcagctctc

SEQ ID NO: 340794 - DNA, 15 bp, Homo sapiens
ctgcagcagctctcc

SEQ ID NO: 340795 - DNA, 15 bp, Homo sapiens
tgcagcagctctccg

SEQ ID NO: 340796 - DNA, 15 bp, Homo sapiens
gcagcagctctccgc

SEQ ID NO: 340797 - DNA, 15 bp, Homo sapiens
cagcagctctccgcc

SEQ ID NO: 340798 - DNA, 15 bp, Homo sapiens
agcagctctccgcct

SEQ ID NO: 340799 - DNA, 15 bp, Homo sapiens
gcagctctccgcctg

SEQ ID NO: 340800 - DNA, 15 bp, Homo sapiens
cagctctccgcctgg

SEQ ID NO: 340801 - DNA, 15 bp, Homo sapiens
agctctccgcctggt

SEQ ID NO: 340802 - DNA, 15 bp, Homo sapiens
gctctccgcctggtt

SEQ ID NO: 340803 - DNA, 15 bp, Homo sapiens
ctctccgcctggtta

SEQ ID NO: 340804 - DNA, 15 bp, Homo sapiens
tctccgcctggttaa

SEQ ID NO: 340805 - DNA, 15 bp, Homo sapiens
ctccgcctggttaac

SEQ ID NO: 340806 - DNA, 15 bp, Homo sapiens
tccgcctggttaaca

SEQ ID NO: 340807 - DNA, 15 bp, Homo sapiens
ccgcctggttaacac

SEQ ID NO: 340808 - DNA, 15 bp, Homo sapiens
cgcctggttaacact

SEQ ID NO: 340809 - DNA, 15 bp, Homo sapiens
gcctggttaacactc

SEQ ID NO: 340810 - DNA, 15 bp, Homo sapiens
cctggttaacactca

SEQ ID NO: 340811 - DNA, 15 bp, Homo sapiens
ctggttaacactcac

SEQ ID NO: 340812 - DNA, 15 bp, Homo sapiens
tggttaacactcaca

SEQ ID NO: 340813 - DNA, 15 bp, Homo sapiens
ggttaacactcacag

SEQ ID NO: 340814 - DNA, 15 bp, Homo sapiens
gttaacactcacaga

SEQ ID NO: 340815 - DNA, 15 bp, Homo sapiens
ttaacactcacagag

SEQ ID NO: 340816 - DNA, 15 bp, Homo sapiens
taacactcacagagg

SEQ ID NO: 340817 - DNA, 15 bp, Homo sapiens
aacactcacagagga

SEQ ID NO: 340818 - DNA, 15 bp, Homo sapiens
acactcacagaggag

SEQ ID NO: 340819 - DNA, 15 bp, Homo sapiens
cactcacagaggagc

SEQ ID NO: 340820 - DNA, 15 bp, Homo sapiens
actcacagaggagcg

SEQ ID NO: 340821 - DNA, 15 bp, Homo sapiens
ctcacagaggagcgc

SEQ ID NO: 340822 - DNA, 15 bp, Homo sapiens
tcacagaggagcgca

SEQ ID NO: 340823 - DNA, 15 bp, Homo sapiens
cacagaggagcgcat

SEQ ID NO: 340824 - DNA, 15 bp, Homo sapiens
acagaggagcgcatt

SEQ ID NO: 340825 - DNA, 15 bp, Homo sapiens
cagaggagcgcattc

SEQ ID NO: 340826 - DNA, 15 bp, Homo sapiens
agaggagcgcattca

SEQ ID NO: 340827 - DNA, 15 bp, Homo sapiens
gaggagcgcattcag

SEQ ID NO: 340828 - DNA, 15 bp, Homo sapiens
aggagcgcattcaga

SEQ ID NO: 340829 - DNA, 15 bp, Homo sapiens
ggagcgcattcagaa

SEQ ID NO: 340830 - DNA, 15 bp, Homo sapiens
gagcgcattcagaag

SEQ ID NO: 340831 - DNA, 15 bp, Homo sapiens
agcgcattcagaaga

SEQ ID NO: 340832 - DNA, 15 bp, Homo sapiens
gcgcattcagaagat

SEQ ID NO: 340833 - DNA, 15 bp, Homo sapiens
cgcattcagaagatg

SEQ ID NO: 340834 - DNA, 15 bp, Homo sapiens
gcattcagaagatgg

SEQ ID NO: 340835 - DNA, 15 bp, Homo sapiens
cattcagaagatgga

SEQ ID NO: 340836 - DNA, 15 bp, Homo sapiens
attcagaagatggaa

SEQ ID NO: 340837 - DNA, 15 bp, Homo sapiens
ttcagaagatggaaa

SEQ ID NO: 340838 - DNA, 15 bp, Homo sapiens
tcagaagatggaaac

SEQ ID NO: 340839 - DNA, 15 bp, Homo sapiens
cagaagatggaaact

SEQ ID NO: 340840 - DNA, 15 bp, Homo sapiens
agaagatggaaactt

SEQ ID NO: 340841 - DNA, 15 bp, Homo sapiens
gaagatggaaacttg

SEQ ID NO: 340842 - DNA, 15 bp, Homo sapiens
aagatggaaacttgc

SEQ ID NO: 340843 - DNA, 15 bp, Homo sapiens
agatggaaacttgcc

SEQ ID NO: 340844 - DNA, 15 bp, Homo sapiens
gatggaaacttgccc

SEQ ID NO: 340845 - DNA, 15 bp, Homo sapiens
atggaaacttgcccc

SEQ ID NO: 340846 - DNA, 15 bp, Homo sapiens
tggaaacttgccccc

SEQ ID NO: 340847 - DNA, 15 bp, Homo sapiens
ggaaacttgccccct

SEQ ID NO: 340848 - DNA, 15 bp, Homo sapiens
gaaacttgccccctg

SEQ ID NO: 340849 - DNA, 15 bp, Homo sapiens
aaacttgccccctgg

SEQ ID NO: 340850 - DNA, 15 bp, Homo sapiens
aacttgccccctgga

SEQ ID NO: 340851 - DNA, 15 bp, Homo sapiens
acttgccccctggat

SEQ ID NO: 340852 - DNA, 15 bp, Homo sapiens
cttgccccctggatg

SEQ ID NO: 340853 - DNA, 15 bp, Homo sapiens
ttgccccctggatga

SEQ ID NO: 340854 - DNA, 15 bp, Homo sapiens
tgccccctggatgat

SEQ ID NO: 340855 - DNA, 15 bp, Homo sapiens
gccccctggatgatg

SEQ ID NO: 340856 - DNA, 15 bp, Homo sapiens
ccccctggatgatga

SEQ ID NO: 340857 - DNA, 15 bp, Homo sapiens
cccctggatgatgat

SEQ ID NO: 340858 - DNA, 15 bp, Homo sapiens
ccctggatgatgatg

SEQ ID NO: 340859 - DNA, 15 bp, Homo sapiens
cctggatgatgatgt

SEQ ID NO: 340860 - DNA, 15 bp, Homo sapiens
ctggatgatgatgta

SEQ ID NO: 340861 - DNA, 15 bp, Homo sapiens
tggatgatgatgtaa

SEQ ID NO: 340862 - DNA, 15 bp, Homo sapiens
ggatgatgatgtaaa

SEQ ID NO: 340863 - DNA, 15 bp, Homo sapiens
gatgatgatgtaaaa

SEQ ID NO: 340864 - DNA, 15 bp, Homo sapiens
atgatgatgtaaaat

SEQ ID NO: 340865 - DNA, 15 bp, Homo sapiens
tgatgatgtaaaatc

SEQ ID NO: 340866 - DNA, 15 bp, Homo sapiens
gatgatgtaaaatct

SEQ ID NO: 340867 - DNA, 15 bp, Homo sapiens
atgatgtaaaatctc

SEQ ID NO: 340868 - DNA, 15 bp, Homo sapiens
tgatgtaaaatctct

SEQ ID NO: 340869 - DNA, 15 bp, Homo sapiens
gatgtaaaatctcta

SEQ ID NO: 340870 - DNA, 15 bp, Homo sapiens
atgtaaaatctctac

SEQ ID NO: 340871 - DNA, 15 bp, Homo sapiens
tgtaaaatctctaca

SEQ ID NO: 340872 - DNA, 15 bp, Homo sapiens
gtaaaatctctacaa

SEQ ID NO: 340873 - DNA, 15 bp, Homo sapiens
taaaatctctacaaa

SEQ ID NO: 340874 - DNA, 15 bp, Homo sapiens
aaaatctctacaaaa

SEQ ID NO: 340875 - DNA, 15 bp, Homo sapiens
aaatctctacaaaag

SEQ ID NO: 340876 - DNA, 15 bp, Homo sapiens
aatctctacaaaagc

SEQ ID NO: 340877 - DNA, 15 bp, Homo sapiens
atctctacaaaagct

SEQ ID NO: 340878 - DNA, 15 bp, Homo sapiens
tctctacaaaagctg

SEQ ID NO: 340879 - DNA, 15 bp, Homo sapiens
ctctacaaaagctgc

SEQ ID NO: 340880 - DNA, 15 bp, Homo sapiens
tctacaaaagctgct

SEQ ID NO: 340881 - DNA, 15 bp, Homo sapiens
ctacaaaagctgcta

SEQ ID NO: 340882 - DNA, 15 bp, Homo sapiens
tacaaaagctgctag

SEQ ID NO: 340883 - DNA, 15 bp, Homo sapiens
acaaaagctgctaga

SEQ ID NO: 340884 - DNA, 15 bp, Homo sapiens
caaaagctgctagaa

SEQ ID NO: 340885 - DNA, 15 bp, Homo sapiens
aaaagctgctagaag

SEQ ID NO: 340886 - DNA, 15 bp, Homo sapiens
aaagctgctagaaga

SEQ ID NO: 340887 - DNA, 15 bp, Homo sapiens
aagctgctagaagaa

SEQ ID NO: 340888 - DNA, 15 bp, Homo sapiens
agctgctagaagaac

SEQ ID NO: 340889 - DNA, 15 bp, Homo sapiens
gctgctagaagaaca

SEQ ID NO: 340890 - DNA, 15 bp, Homo sapiens
ctgctagaagaacat

SEQ ID NO: 340891 - DNA, 15 bp, Homo sapiens
tgctagaagaacata

SEQ ID NO: 340892 - DNA, 15 bp, Homo sapiens
gctagaagaacataa

SEQ ID NO: 340893 - DNA, 15 bp, Homo sapiens
ctagaagaacataaa

SEQ ID NO: 340894 - DNA, 15 bp, Homo sapiens
tagaagaacataaag

SEQ ID NO: 340895 - DNA, 15 bp, Homo sapiens
agaagaacataaagt

SEQ ID NO: 340896 - DNA, 15 bp, Homo sapiens
gaagaacataaagta

SEQ ID NO: 340897 - DNA, 15 bp, Homo sapiens
aagaacataaagtaa

SEQ ID NO: 340898 - DNA, 15 bp, Homo sapiens
agaacataaagtaaa

SEQ ID NO: 340899 - DNA, 15 bp, Homo sapiens
gaacataaagtaaat

SEQ ID NO: 340900 - DNA, 15 bp, Homo sapiens
aacataaagtaaatc

SEQ ID NO: 340901 - DNA, 15 bp, Homo sapiens
acataaagtaaatct

SEQ ID NO: 340902 - DNA, 15 bp, Homo sapiens
cataaagtaaatctg

SEQ ID NO: 340903 - DNA, 15 bp, Homo sapiens
ataaagtaaatctgt

SEQ ID NO: 340904 - DNA, 15 bp, Homo sapiens
taaagtaaatctgtc

SEQ ID NO: 340905 - DNA, 15 bp, Homo sapiens
aaagtaaatctgtct

SEQ ID NO: 340906 - DNA, 15 bp, Homo sapiens
aagtaaatctgtctc

SEQ ID NO: 340907 - DNA, 15 bp, Homo sapiens
agtaaatctgtctca

SEQ ID NO: 340908 - DNA, 15 bp, Homo sapiens
gtaaatctgtctcat

SEQ ID NO: 340909 - DNA, 15 bp, Homo sapiens
taaatctgtctcata

SEQ ID NO: 340910 - DNA, 15 bp, Homo sapiens
aaatctgtctcatat

SEQ ID NO: 340911 - DNA, 15 bp, Homo sapiens
aatctgtctcatatt

SEQ ID NO: 340912 - DNA, 15 bp, Homo sapiens
atctgtctcatattt

SEQ ID NO: 340913 - DNA, 15 bp, Homo sapiens
tctgtctcatatttc

SEQ ID NO: 340914 - DNA, 15 bp, Homo sapiens
ctgtctcatatttct

SEQ ID NO: 340915 - DNA, 15 bp, Homo sapiens
tgtctcatatttctt

SEQ ID NO: 340916 - DNA, 15 bp, Homo sapiens
gtctcatatttcttc

SEQ ID NO: 340917 - DNA, 15 bp, Homo sapiens
tctcatatttcttcg

SEQ ID NO: 340918 - DNA, 15 bp, Homo sapiens
ctcatatttcttcga

SEQ ID NO: 340919 - DNA, 15 bp, Homo sapiens
tcatatttcttcgat

SEQ ID NO: 340920 - DNA, 15 bp, Homo sapiens
catatttcttcgata

SEQ ID NO: 340921 - DNA, 15 bp, Homo sapiens
atatttcttcgatac

SEQ ID NO: 340922 - DNA, 15 bp, Homo sapiens
tatttcttcgatacc

SEQ ID NO: 340923 - DNA, 15 bp, Homo sapiens
atttcttcgatacct

SEQ ID NO: 340924 - DNA, 15 bp, Homo sapiens
tttcttcgatacctt

SEQ ID NO: 340925 - DNA, 15 bp, Homo sapiens
ttcttcgatacctta

SEQ ID NO: 340926 - DNA, 15 bp, Homo sapiens
tcttcgataccttat

SEQ ID NO: 340927 - DNA, 15 bp, Homo sapiens
cttcgataccttatc

SEQ ID NO: 340928 - DNA, 15 bp, Homo sapiens
ttcgataccttatca

SEQ ID NO: 340929 - DNA, 15 bp, Homo sapiens
tcgataccttatcaa

SEQ ID NO: 340930 - DNA, 15 bp, Homo sapiens
cgataccttatcaaa

SEQ ID NO: 340931 - DNA, 15 bp, Homo sapiens
gataccttatcaaat

SEQ ID NO: 340932 - DNA, 15 bp, Homo sapiens
ataccttatcaaata

SEQ ID NO: 340933 - DNA, 15 bp, Homo sapiens
taccttatcaaatat

SEQ ID NO: 340934 - DNA, 15 bp, Homo sapiens
accttatcaaatatg

SEQ ID NO: 340935 - DNA, 15 bp, Homo sapiens
ccttatcaaatatga

SEQ ID NO: 340936 - DNA, 15 bp, Homo sapiens
cttatcaaatatgaa

SEQ ID NO: 340937 - DNA, 15 bp, Homo sapiens
ttatcaaatatgaaa

SEQ ID NO: 340938 - DNA, 15 bp, Homo sapiens
tatcaaatatgaaag

SEQ ID NO: 340939 - DNA, 15 bp, Homo sapiens
atcaaatatgaaaga

SEQ ID NO: 340940 - DNA, 15 bp, Homo sapiens
tcaaatatgaaagag

SEQ ID NO: 340941 - DNA, 15 bp, Homo sapiens
caaatatgaaagagc

SEQ ID NO: 340942 - DNA, 15 bp, Homo sapiens
aaatatgaaagagca

SEQ ID NO: 340943 - DNA, 15 bp, Homo sapiens
aatatgaaagagcag

SEQ ID NO: 340944 - DNA, 15 bp, Homo sapiens
atatgaaagagcagc

SEQ ID NO: 340945 - DNA, 15 bp, Homo sapiens
tatgaaagagcagca

SEQ ID NO: 340946 - DNA, 15 bp, Homo sapiens
atgaaagagcagcac

SEQ ID NO: 340947 - DNA, 15 bp, Homo sapiens
tgaaagagcagcact

SEQ ID NO: 340948 - DNA, 15 bp, Homo sapiens
gaaagagcagcactt

SEQ ID NO: 340949 - DNA, 15 bp, Homo sapiens
aaagagcagcactta

SEQ ID NO: 340950 - DNA, 15 bp, Homo sapiens
aagagcagcacttag

SEQ ID NO: 340951 - DNA, 15 bp, Homo sapiens
agagcagcacttagc

SEQ ID NO: 340952 - DNA, 15 bp, Homo sapiens
gagcagcacttagca

SEQ ID NO: 340953 - DNA, 15 bp, Homo sapiens
agcagcacttagcat

SEQ ID NO: 340954 - DNA, 15 bp, Homo sapiens
gcagcacttagcatc

SEQ ID NO: 340955 - DNA, 15 bp, Homo sapiens
cagcacttagcatct

SEQ ID NO: 340956 - DNA, 15 bp, Homo sapiens
agcacttagcatctc

SEQ ID NO: 340957 - DNA, 15 bp, Homo sapiens
gcacttagcatctca

SEQ ID NO: 340958 - DNA, 15 bp, Homo sapiens
cacttagcatctcag

SEQ ID NO: 340959 - DNA, 15 bp, Homo sapiens
acttagcatctcaga

SEQ ID NO: 340960 - DNA, 15 bp, Homo sapiens
cttagcatctcagag

SEQ ID NO: 340961 - DNA, 15 bp, Homo sapiens
ttagcatctcagagg

SEQ ID NO: 340962 - DNA, 15 bp, Homo sapiens
tagcatctcagaggc

SEQ ID NO: 340963 - DNA, 15 bp, Homo sapiens
agcatctcagaggct

SEQ ID NO: 340964 - DNA, 15 bp, Homo sapiens
gcatctcagaggctg

SEQ ID NO: 340965 - DNA, 15 bp, Homo sapiens
catctcagaggctga

SEQ ID NO: 340966 - DNA, 15 bp, Homo sapiens
atctcagaggctgat

SEQ ID NO: 340967 - DNA, 15 bp, Homo sapiens
tctcagaggctgatg

SEQ ID NO: 340968 - DNA, 15 bp, Homo sapiens
ctcagaggctgatga

SEQ ID NO: 340969 - DNA, 15 bp, Homo sapiens
tcagaggctgatgac

SEQ ID NO: 340970 - DNA, 15 bp, Homo sapiens
cagaggctgatgaca

SEQ ID NO: 340971 - DNA, 15 bp, Homo sapiens
agaggctgatgacat

SEQ ID NO: 340972 - DNA, 15 bp, Homo sapiens
gaggctgatgacatc

SEQ ID NO: 340973 - DNA, 15 bp, Homo sapiens
aggctgatgacatct

SEQ ID NO: 340974 - DNA, 15 bp, Homo sapiens
ggctgatgacatcta

SEQ ID NO: 340975 - DNA, 15 bp, Homo sapiens
gctgatgacatctat

SEQ ID NO: 340976 - DNA, 15 bp, Homo sapiens
ctgatgacatctatc

SEQ ID NO: 340977 - DNA, 15 bp, Homo sapiens
tgatgacatctatcg

SEQ ID NO: 340978 - DNA, 15 bp, Homo sapiens
gatgacatctatcgt

SEQ ID NO: 340979 - DNA, 15 bp, Homo sapiens
atgacatctatcgtt

SEQ ID NO: 340980 - DNA, 15 bp, Homo sapiens
tgacatctatcgtta

SEQ ID NO: 340981 - DNA, 15 bp, Homo sapiens
gacatctatcgttaa

SEQ ID NO: 340982 - DNA, 15 bp, Homo sapiens
acatctatcgttaac

SEQ ID NO: 340983 - DNA, 15 bp, Homo sapiens
catctatcgttaaca

SEQ ID NO: 340984 - DNA, 15 bp, Homo sapiens
atctatcgttaacat

SEQ ID NO: 340985 - DNA, 15 bp, Homo sapiens
tctatcgttaacatg

SEQ ID NO: 340986 - DNA, 15 bp, Homo sapiens
ctatcgttaacatga

SEQ ID NO: 340987 - DNA, 15 bp, Homo sapiens
tatcgttaacatgaa

SEQ ID NO: 340988 - DNA, 15 bp, Homo sapiens
atcgttaacatgaag

SEQ ID NO: 340989 - DNA, 15 bp, Homo sapiens
tcgttaacatgaagt

SEQ ID NO: 340990 - DNA, 15 bp, Homo sapiens
cgttaacatgaagtt

SEQ ID NO: 340991 - DNA, 15 bp, Homo sapiens
gttaacatgaagttg

SEQ ID NO: 340992 - DNA, 15 bp, Homo sapiens
ttaacatgaagttgg

SEQ ID NO: 340993 - DNA, 15 bp, Homo sapiens
taacatgaagttggg

SEQ ID NO: 340994 - DNA, 15 bp, Homo sapiens
aacatgaagttggga

SEQ ID NO: 340995 - DNA, 15 bp, Homo sapiens
acatgaagttgggac

SEQ ID NO: 340996 - DNA, 15 bp, Homo sapiens
catgaagttgggaca

SEQ ID NO: 340997 - DNA, 15 bp, Homo sapiens
atgaagttgggacac

SEQ ID NO: 340998 - DNA, 15 bp, Homo sapiens
tgaagttgggacact

SEQ ID NO: 340999 - DNA, 15 bp, Homo sapiens
gaagttgggacactt

SEQ ID NO: 341000 - DNA, 15 bp, Homo sapiens
aagttgggacacttc

SEQ ID NO: 341001 - DNA, 15 bp, Homo sapiens
agttgggacacttct

SEQ ID NO: 341002 - DNA, 15 bp, Homo sapiens
gttgggacacttctt

SEQ ID NO: 341003 - DNA, 15 bp, Homo sapiens
ttgggacacttcttc

SEQ ID NO: 341004 - DNA, 15 bp, Homo sapiens
tgggacacttcttca

SEQ ID NO: 341005 - DNA, 15 bp, Homo sapiens
gggacacttcttcag

SEQ ID NO: 341006 - DNA, 15 bp, Homo sapiens
ggacacttcttcagg

SEQ ID NO: 341007 - DNA, 15 bp, Homo sapiens
gacacttcttcaggg

SEQ ID NO: 341008 - DNA, 15 bp, Homo sapiens
acacttcttcagggt

SEQ ID NO: 341009 - DNA, 15 bp, Homo sapiens
cacttcttcagggtt

SEQ ID NO: 341010 - DNA, 15 bp, Homo sapiens
acttcttcagggttg

SEQ ID NO: 341011 - DNA, 15 bp, Homo sapiens
cttcttcagggttgt

SEQ ID NO: 341012 - DNA, 15 bp, Homo sapiens
ttcttcagggttgtc

SEQ ID NO: 341013 - DNA, 15 bp, Homo sapiens
tcttcagggttgtct

SEQ ID NO: 341014 - DNA, 15 bp, Homo sapiens
cttcagggttgtctt

SEQ ID NO: 341015 - DNA, 15 bp, Homo sapiens
ttcagggttgtcttc

SEQ ID NO: 341016 - DNA, 15 bp, Homo sapiens
tcagggttgtcttca

SEQ ID NO: 341017 - DNA, 15 bp, Homo sapiens
cagggttgtcttcat

SEQ ID NO: 341018 - DNA, 15 bp, Homo sapiens
agggttgtcttcatt

SEQ ID NO: 341019 - DNA, 15 bp, Homo sapiens
gggttgtcttcattt

SEQ ID NO: 341020 - DNA, 15 bp, Homo sapiens
ggttgtcttcattta

SEQ ID NO: 341021 - DNA, 15 bp, Homo sapiens
gttgtcttcatttag

SEQ ID NO: 341022 - DNA, 15 bp, Homo sapiens
ttgtcttcatttagc

SEQ ID NO: 341023 - DNA, 15 bp, Homo sapiens
tgtcttcatttagca

SEQ ID NO: 341024 - DNA, 15 bp, Homo sapiens
gtcttcatttagcag

SEQ ID NO: 341025 - DNA, 15 bp, Homo sapiens
tcttcatttagcagc

SEQ ID NO: 341026 - DNA, 15 bp, Homo sapiens
cttcatttagcagct

SEQ ID NO: 341027 - DNA, 15 bp, Homo sapiens
ttcatttagcagctc

SEQ ID NO: 341028 - DNA, 15 bp, Homo sapiens
tcatttagcagctca

SEQ ID NO: 341029 - DNA, 15 bp, Homo sapiens
catttagcagctcac

SEQ ID NO: 341030 - DNA, 15 bp, Homo sapiens
atttagcagctcaca

SEQ ID NO: 341031 - DNA, 15 bp, Homo sapiens
tttagcagctcacag

SEQ ID NO: 341032 - DNA, 15 bp, Homo sapiens
ttagcagctcacagg

SEQ ID NO: 341033 - DNA, 15 bp, Homo sapiens
tagcagctcacaggg

SEQ ID NO: 341034 - DNA, 15 bp, Homo sapiens
agcagctcacagggt

SEQ ID NO: 341035 - DNA, 15 bp, Homo sapiens
gcagctcacagggtg

SEQ ID NO: 341036 - DNA, 15 bp, Homo sapiens
cagctcacagggtgg

SEQ ID NO: 341037 - DNA, 15 bp, Homo sapiens
agctcacagggtgga

SEQ ID NO: 341038 - DNA, 15 bp, Homo sapiens
gctcacagggtggaa

SEQ ID NO: 341039 - DNA, 15 bp, Homo sapiens
ctcacagggtggaat

SEQ ID NO: 341040 - DNA, 15 bp, Homo sapiens
tcacagggtggaatt

SEQ ID NO: 341041 - DNA, 15 bp, Homo sapiens
cacagggtggaattg

SEQ ID NO: 341042 - DNA, 15 bp, Homo sapiens
acagggtggaattga

SEQ ID NO: 341043 - DNA, 15 bp, Homo sapiens
cagggtggaattgat

SEQ ID NO: 341044 - DNA, 15 bp, Homo sapiens
agggtggaattgata

SEQ ID NO: 341045 - DNA, 15 bp, Homo sapiens
gggtggaattgatag

SEQ ID NO: 341046 - DNA, 15 bp, Homo sapiens
ggtggaattgataga

SEQ ID NO: 341047 - DNA, 15 bp, Homo sapiens
gtggaattgatagag

SEQ ID NO: 341048 - DNA, 15 bp, Homo sapiens
tggaattgatagaga

SEQ ID NO: 341049 - DNA, 15 bp, Homo sapiens
ggaattgatagagat

SEQ ID NO: 341050 - DNA, 15 bp, Homo sapiens
gaattgatagagatg

SEQ ID NO: 341051 - DNA, 15 bp, Homo sapiens
aattgatagagatga

SEQ ID NO: 341052 - DNA, 15 bp, Homo sapiens
attgatagagatgag

SEQ ID NO: 341053 - DNA, 15 bp, Homo sapiens
ttgatagagatgaga

SEQ ID NO: 341054 - DNA, 15 bp, Homo sapiens
tgatagagatgagac

SEQ ID NO: 341055 - DNA, 15 bp, Homo sapiens
gatagagatgagact

SEQ ID NO: 341056 - DNA, 15 bp, Homo sapiens
atagagatgagactt

SEQ ID NO: 341057 - DNA, 15 bp, Homo sapiens
tagagatgagacttt

SEQ ID NO: 341058 - DNA, 15 bp, Homo sapiens
agagatgagactttt

SEQ ID NO: 341059 - DNA, 15 bp, Homo sapiens
gagatgagacttttc

SEQ ID NO: 341060 - DNA, 15 bp, Homo sapiens
agatgagacttttct

SEQ ID NO: 341061 - DNA, 15 bp, Homo sapiens
gatgagacttttctg

SEQ ID NO: 341062 - DNA, 15 bp, Homo sapiens
atgagacttttctga

SEQ ID NO: 341063 - DNA, 15 bp, Homo sapiens
tgagacttttctgag

SEQ ID NO: 341064 - DNA, 15 bp, Homo sapiens
gagacttttctgagc

SEQ ID NO: 341065 - DNA, 15 bp, Homo sapiens
agacttttctgagcc

SEQ ID NO: 341066 - DNA, 15 bp, Homo sapiens
gacttttctgagcca

SEQ ID NO: 341067 - DNA, 15 bp, Homo sapiens
acttttctgagccag

SEQ ID NO: 341068 - DNA, 15 bp, Homo sapiens
cttttctgagccagg

SEQ ID NO: 341069 - DNA, 15 bp, Homo sapiens
ttttctgagccaggg

SEQ ID NO: 341070 - DNA, 15 bp, Homo sapiens
tttctgagccaggga

SEQ ID NO: 341071 - DNA, 15 bp, Homo sapiens
ttctgagccagggat

SEQ ID NO: 341072 - DNA, 15 bp, Homo sapiens
tctgagccagggata

SEQ ID NO: 341073 - DNA, 15 bp, Homo sapiens
ctgagccagggataa

SEQ ID NO: 341074 - DNA, 15 bp, Homo sapiens
tgagccagggataaa

SEQ ID NO: 341075 - DNA, 15 bp, Homo sapiens
gagccagggataaaa

SEQ ID NO: 341076 - DNA, 15 bp, Homo sapiens
agccagggataaaag

SEQ ID NO: 341077 - DNA, 15 bp, Homo sapiens
gccagggataaaagg

SEQ ID NO: 341078 - DNA, 15 bp, Homo sapiens
ccagggataaaaggg

SEQ ID NO: 341079 - DNA, 15 bp, Homo sapiens
cagggataaaagggc

SEQ ID NO: 341080 - DNA, 15 bp, Homo sapiens
agggataaaagggca

SEQ ID NO: 341081 - DNA, 15 bp, Homo sapiens
gggataaaagggcac

SEQ ID NO: 341082 - DNA, 15 bp, Homo sapiens
ggataaaagggcacg

SEQ ID NO: 341083 - DNA, 15 bp, Homo sapiens
gataaaagggcacgg

SEQ ID NO: 341084 - DNA, 15 bp, Homo sapiens
ataaaagggcacggt

SEQ ID NO: 341085 - DNA, 15 bp, Homo sapiens
taaaagggcacggta

SEQ ID NO: 341086 - DNA, 15 bp, Homo sapiens
aaaagggcacggtaa

SEQ ID NO: 341087 - DNA, 15 bp, Homo sapiens
aaagggcacggtaaa

SEQ ID NO: 341088 - DNA, 15 bp, Homo sapiens
aagggcacggtaaaa

SEQ ID NO: 341089 - DNA, 15 bp, Homo sapiens
agggcacggtaaaat

SEQ ID NO: 341090 - DNA, 15 bp, Homo sapiens
gggcacggtaaaatt

SEQ ID NO: 341091 - DNA, 15 bp, Homo sapiens
ggcacggtaaaattt

SEQ ID NO: 341092 - DNA, 15 bp, Homo sapiens
gcacggtaaaatttt

SEQ ID NO: 341093 - DNA, 15 bp, Homo sapiens
cacggtaaaatttta

SEQ ID NO: 341094 - DNA, 15 bp, Homo sapiens
acggtaaaattttat

SEQ ID NO: 341095 - DNA, 15 bp, Homo sapiens
cggtaaaattttata

SEQ ID NO: 341096 - DNA, 15 bp, Homo sapiens
ggtaaaattttatat

SEQ ID NO: 341097 - DNA, 15 bp, Homo sapiens
gtaaaattttatatg

SEQ ID NO: 341098 - DNA, 15 bp, Homo sapiens
taaaattttatatgt

SEQ ID NO: 341099 - DNA, 15 bp, Homo sapiens
aaaattttatatgtg

SEQ ID NO: 341100 - DNA, 15 bp, Homo sapiens
aaattttatatgtga

SEQ ID NO: 341101 - DNA, 15 bp, Homo sapiens
aattttatatgtgat

SEQ ID NO: 341102 - DNA, 15 bp, Homo sapiens
attttatatgtgatg

SEQ ID NO: 341103 - DNA, 15 bp, Homo sapiens
ttttatatgtgatgt

SEQ ID NO: 341104 - DNA, 15 bp, Homo sapiens
tttatatgtgatgtg

SEQ ID NO: 341105 - DNA, 15 bp, Homo sapiens
ttatatgtgatgtgc

SEQ ID NO: 341106 - DNA, 15 bp, Homo sapiens
tatatgtgatgtgca

SEQ ID NO: 341107 - DNA, 15 bp, Homo sapiens
atatgtgatgtgcag

SEQ ID NO: 341108 - DNA, 15 bp, Homo sapiens
tatgtgatgtgcagt

SEQ ID NO: 341109 - DNA, 15 bp, Homo sapiens
atgtgatgtgcagtt

SEQ ID NO: 341110 - DNA, 15 bp, Homo sapiens
tgtgatgtgcagttt

SEQ ID NO: 341111 - DNA, 15 bp, Homo sapiens
gtgatgtgcagtttt

SEQ ID NO: 341112 - DNA, 15 bp, Homo sapiens
tgatgtgcagttttc

SEQ ID NO: 341113 - DNA, 15 bp, Homo sapiens
gatgtgcagttttct

SEQ ID NO: 341114 - DNA, 15 bp, Homo sapiens
atgtgcagttttctt

SEQ ID NO: 341115 - DNA, 15 bp, Homo sapiens
tgtgcagttttcttt

SEQ ID NO: 341116 - DNA, 15 bp, Homo sapiens
gtgcagttttctttt

SEQ ID NO: 341117 - DNA, 15 bp, Homo sapiens
tgcagttttcttttg

SEQ ID NO: 341118 - DNA, 15 bp, Homo sapiens
gcagttttcttttga

SEQ ID NO: 341119 - DNA, 15 bp, Homo sapiens
cagttttcttttgaa

SEQ ID NO: 341120 - DNA, 15 bp, Homo sapiens
agttttcttttgaaa

SEQ ID NO: 341121 - DNA, 15 bp, Homo sapiens
gttttcttttgaaag

SEQ ID NO: 341122 - DNA, 15 bp, Homo sapiens
ttttcttttgaaagt

SEQ ID NO: 341123 - DNA, 15 bp, Homo sapiens
tttcttttgaaagta

SEQ ID NO: 341124 - DNA, 15 bp, Homo sapiens
ttcttttgaaagtac

SEQ ID NO: 341125 - DNA, 15 bp, Homo sapiens
tcttttgaaagtaca

SEQ ID NO: 341126 - DNA, 15 bp, Homo sapiens
cttttgaaagtacat

SEQ ID NO: 341127 - DNA, 15 bp, Homo sapiens
ttttgaaagtacata

SEQ ID NO: 341128 - DNA, 15 bp, Homo sapiens
tttgaaagtacatag

SEQ ID NO: 341129 - DNA, 15 bp, Homo sapiens
ttgaaagtacatagc

SEQ ID NO: 341130 - DNA, 15 bp, Homo sapiens
tgaaagtacatagct

SEQ ID NO: 341131 - DNA, 15 bp, Homo sapiens
gaaagtacatagctt

SEQ ID NO: 341132 - DNA, 15 bp, Homo sapiens
aaagtacatagcttt

SEQ ID NO: 341133 - DNA, 15 bp, Homo sapiens
aagtacatagctttc

SEQ ID NO: 341134 - DNA, 15 bp, Homo sapiens
agtacatagctttca

SEQ ID NO: 341135 - DNA, 15 bp, Homo sapiens
gtacatagctttcat

SEQ ID NO: 341136 - DNA, 15 bp, Homo sapiens
tacatagctttcata

SEQ ID NO: 341137 - DNA, 15 bp, Homo sapiens
acatagctttcatac

SEQ ID NO: 341138 - DNA, 15 bp, Homo sapiens
catagctttcataca

SEQ ID NO: 341139 - DNA, 15 bp, Homo sapiens
atagctttcatacaa

SEQ ID NO: 341140 - DNA, 15 bp, Homo sapiens
tagctttcatacaac

SEQ ID NO: 341141 - DNA, 15 bp, Homo sapiens
agctttcatacaact

SEQ ID NO: 341142 - DNA, 15 bp, Homo sapiens
gctttcatacaactg

SEQ ID NO: 341143 - DNA, 15 bp, Homo sapiens
ctttcatacaactgg

SEQ ID NO: 341144 - DNA, 15 bp, Homo sapiens
tttcatacaactgga

SEQ ID NO: 341145 - DNA, 15 bp, Homo sapiens
ttcatacaactggag

SEQ ID NO: 341146 - DNA, 15 bp, Homo sapiens
tcatacaactggaga

SEQ ID NO: 341147 - DNA, 15 bp, Homo sapiens
catacaactggagaa

SEQ ID NO: 341148 - DNA, 15 bp, Homo sapiens
atacaactggagaag

SEQ ID NO: 341149 - DNA, 15 bp, Homo sapiens
tacaactggagaagg

SEQ ID NO: 341150 - DNA, 15 bp, Homo sapiens
acaactggagaaggg

SEQ ID NO: 341151 - DNA, 15 bp, Homo sapiens
caactggagaagggt

SEQ ID NO: 341152 - DNA, 15 bp, Homo sapiens
aactggagaagggtt

SEQ ID NO: 341153 - DNA, 15 bp, Homo sapiens
actggagaagggttc

SEQ ID NO: 341154 - DNA, 15 bp, Homo sapiens
ctggagaagggttct

SEQ ID NO: 341155 - DNA, 15 bp, Homo sapiens
tggagaagggttctt

SEQ ID NO: 341156 - DNA, 15 bp, Homo sapiens
ggagaagggttcttt

SEQ ID NO: 341157 - DNA, 15 bp, Homo sapiens
gagaagggttctttt

SEQ ID NO: 341158 - DNA, 15 bp, Homo sapiens
agaagggttcttttg

SEQ ID NO: 341159 - DNA, 15 bp, Homo sapiens
gaagggttcttttgg

SEQ ID NO: 341160 - DNA, 15 bp, Homo sapiens
aagggttcttttggc

SEQ ID NO: 341161 - DNA, 15 bp, Homo sapiens
agggttcttttggcc

SEQ ID NO: 341162 - DNA, 15 bp, Homo sapiens
gggttcttttggccc

SEQ ID NO: 341163 - DNA, 15 bp, Homo sapiens
ggttcttttggccct

SEQ ID NO: 341164 - DNA, 15 bp, Homo sapiens
gttcttttggccctc

SEQ ID NO: 341165 - DNA, 15 bp, Homo sapiens
ttcttttggccctct

SEQ ID NO: 341166 - DNA, 15 bp, Homo sapiens
tcttttggccctcta

SEQ ID NO: 341167 - DNA, 15 bp, Homo sapiens
cttttggccctctaa

SEQ ID NO: 341168 - DNA, 15 bp, Homo sapiens
ttttggccctctaag

SEQ ID NO: 341169 - DNA, 15 bp, Homo sapiens
tttggccctctaagt

SEQ ID NO: 341170 - DNA, 15 bp, Homo sapiens
ttggccctctaagtg

SEQ ID NO: 341171 - DNA, 15 bp, Homo sapiens
tggccctctaagtgg

SEQ ID NO: 341172 - DNA, 15 bp, Homo sapiens
ggccctctaagtggc

SEQ ID NO: 341173 - DNA, 15 bp, Homo sapiens
gccctctaagtggct

SEQ ID NO: 341174 - DNA, 15 bp, Homo sapiens
ccctctaagtggcta

SEQ ID NO: 341175 - DNA, 15 bp, Homo sapiens
cctctaagtggctaa

SEQ ID NO: 341176 - DNA, 15 bp, Homo sapiens
ctctaagtggctaag

SEQ ID NO: 341177 - DNA, 15 bp, Homo sapiens
tctaagtggctaaga

SEQ ID NO: 341178 - DNA, 15 bp, Homo sapiens
ctaagtggctaagaa

SEQ ID NO: 341179 - DNA, 15 bp, Homo sapiens
taagtggctaagaac

SEQ ID NO: 341180 - DNA, 15 bp, Homo sapiens
aagtggctaagaacc

SEQ ID NO: 341181 - DNA, 15 bp, Homo sapiens
agtggctaagaaccc

SEQ ID NO: 341182 - DNA, 15 bp, Homo sapiens
gtggctaagaaccca

SEQ ID NO: 341183 - DNA, 15 bp, Homo sapiens
tggctaagaacccaa

SEQ ID NO: 341184 - DNA, 15 bp, Homo sapiens
ggctaagaacccaag

SEQ ID NO: 341185 - DNA, 15 bp, Homo sapiens
gctaagaacccaagc

SEQ ID NO: 341186 - DNA, 15 bp, Homo sapiens
ctaagaacccaagca

SEQ ID NO: 341187 - DNA, 15 bp, Homo sapiens
taagaacccaagcat

SEQ ID NO: 341188 - DNA, 15 bp, Homo sapiens
aagaacccaagcatg

SEQ ID NO: 341189 - DNA, 15 bp, Homo sapiens
agaacccaagcatgt

SEQ ID NO: 341190 - DNA, 15 bp, Homo sapiens
gaacccaagcatgtt

SEQ ID NO: 341191 - DNA, 15 bp, Homo sapiens
aacccaagcatgttg

SEQ ID NO: 341192 - DNA, 15 bp, Homo sapiens
acccaagcatgttgg

SEQ ID NO: 341193 - DNA, 15 bp, Homo sapiens
cccaagcatgttggc

SEQ ID NO: 341194 - DNA, 15 bp, Homo sapiens
ccaagcatgttggcg

SEQ ID NO: 341195 - DNA, 15 bp, Homo sapiens
caagcatgttggcgt

SEQ ID NO: 341196 - DNA, 15 bp, Homo sapiens
aagcatgttggcgtt

SEQ ID NO: 341197 - DNA, 15 bp, Homo sapiens
agcatgttggcgttc

SEQ ID NO: 341198 - DNA, 15 bp, Homo sapiens
gcatgttggcgttca

SEQ ID NO: 341199 - DNA, 15 bp, Homo sapiens
catgttggcgttcac

SEQ ID NO: 341200 - DNA, 15 bp, Homo sapiens
atgttggcgttcaca

SEQ ID NO: 341201 - DNA, 15 bp, Homo sapiens
tgttggcgttcacat

SEQ ID NO: 341202 - DNA, 15 bp, Homo sapiens
gttggcgttcacatg

SEQ ID NO: 341203 - DNA, 15 bp, Homo sapiens
ttggcgttcacatgg

SEQ ID NO: 341204 - DNA, 15 bp, Homo sapiens
tggcgttcacatggt

SEQ ID NO: 341205 - DNA, 15 bp, Homo sapiens
ggcgttcacatggtg

SEQ ID NO: 341206 - DNA, 15 bp, Homo sapiens
gcgttcacatggtgt

SEQ ID NO: 341207 - DNA, 15 bp, Homo sapiens
cgttcacatggtgtg

SEQ ID NO: 341208 - DNA, 15 bp, Homo sapiens
gttcacatggtgtgt

SEQ ID NO: 341209 - DNA, 15 bp, Homo sapiens
ttcacatggtgtgtg

SEQ ID NO: 341210 - DNA, 15 bp, Homo sapiens
tcacatggtgtgtgg

SEQ ID NO: 341211 - DNA, 15 bp, Homo sapiens
cacatggtgtgtggg

SEQ ID NO: 341212 - DNA, 15 bp, Homo sapiens
acatggtgtgtgggt

SEQ ID NO: 341213 - DNA, 15 bp, Homo sapiens
catggtgtgtgggtg

SEQ ID NO: 341214 - DNA, 15 bp, Homo sapiens
atggtgtgtgggtga

SEQ ID NO: 341215 - DNA, 15 bp, Homo sapiens
tggtgtgtgggtgaa

SEQ ID NO: 341216 - DNA, 15 bp, Homo sapiens
ggtgtgtgggtgaag

SEQ ID NO: 341217 - DNA, 15 bp, Homo sapiens
gtgtgtgggtgaaga

SEQ ID NO: 341218 - DNA, 15 bp, Homo sapiens
tgtgtgggtgaagag

SEQ ID NO: 341219 - DNA, 15 bp, Homo sapiens
gtgtgggtgaagagc

SEQ ID NO: 341220 - DNA, 15 bp, Homo sapiens
tgtgggtgaagagca

SEQ ID NO: 341221 - DNA, 15 bp, Homo sapiens
gtgggtgaagagcaa

SEQ ID NO: 341222 - DNA, 15 bp, Homo sapiens
tgggtgaagagcaaa

SEQ ID NO: 341223 - DNA, 15 bp, Homo sapiens
gggtgaagagcaaat

SEQ ID NO: 341224 - DNA, 15 bp, Homo sapiens
ggtgaagagcaaatt

SEQ ID NO: 341225 - DNA, 15 bp, Homo sapiens
gtgaagagcaaattc

SEQ ID NO: 341226 - DNA, 15 bp, Homo sapiens
tgaagagcaaattct

SEQ ID NO: 341227 - DNA, 15 bp, Homo sapiens
gaagagcaaattctt

SEQ ID NO: 341228 - DNA, 15 bp, Homo sapiens
aagagcaaattcttc

SEQ ID NO: 341229 - DNA, 15 bp, Homo sapiens
agagcaaattcttcg

SEQ ID NO: 341230 - DNA, 15 bp, Homo sapiens
gagcaaattcttcgt

SEQ ID NO: 341231 - DNA, 15 bp, Homo sapiens
agcaaattcttcgtc

SEQ ID NO: 341232 - DNA, 15 bp, Homo sapiens
gcaaattcttcgtct

SEQ ID NO: 341233 - DNA, 15 bp, Homo sapiens
caaattcttcgtcta

SEQ ID NO: 341234 - DNA, 15 bp, Homo sapiens
aaattcttcgtctat

SEQ ID NO: 341235 - DNA, 15 bp, Homo sapiens
aattcttcgtctatg

SEQ ID NO: 341236 - DNA, 15 bp, Homo sapiens
attcttcgtctatga

SEQ ID NO: 341237 - DNA, 15 bp, Homo sapiens
ttcttcgtctatgat

SEQ ID NO: 341238 - DNA, 15 bp, Homo sapiens
tcttcgtctatgatt

SEQ ID NO: 341239 - DNA, 15 bp, Homo sapiens
cttcgtctatgattc

SEQ ID NO: 341240 - DNA, 15 bp, Homo sapiens
ttcgtctatgattca

SEQ ID NO: 341241 - DNA, 15 bp, Homo sapiens
tcgtctatgattcag

SEQ ID NO: 341242 - DNA, 15 bp, Homo sapiens
cgtctatgattcagg

SEQ ID NO: 341243 - DNA, 15 bp, Homo sapiens
gtctatgattcagga

SEQ ID NO: 341244 - DNA, 15 bp, Homo sapiens
tctatgattcaggaa

SEQ ID NO: 341245 - DNA, 15 bp, Homo sapiens
ctatgattcaggaaa

SEQ ID NO: 341246 - DNA, 15 bp, Homo sapiens
tatgattcaggaaag

SEQ ID NO: 341247 - DNA, 15 bp, Homo sapiens
atgattcaggaaagc

SEQ ID NO: 341248 - DNA, 15 bp, Homo sapiens
tgattcaggaaagcg

SEQ ID NO: 341249 - DNA, 15 bp, Homo sapiens
gattcaggaaagcgt

SEQ ID NO: 341250 - DNA, 15 bp, Homo sapiens
attcaggaaagcgtc

SEQ ID NO: 341251 - DNA, 15 bp, Homo sapiens
ttcaggaaagcgtca

SEQ ID NO: 341252 - DNA, 15 bp, Homo sapiens
tcaggaaagcgtcag

SEQ ID NO: 341253 - DNA, 15 bp, Homo sapiens
caggaaagcgtcagg

SEQ ID NO: 341254 - DNA, 15 bp, Homo sapiens
aggaaagcgtcaggc

SEQ ID NO: 341255 - DNA, 15 bp, Homo sapiens
ggaaagcgtcaggca

SEQ ID NO: 341256 - DNA, 15 bp, Homo sapiens
gaaagcgtcaggcat

SEQ ID NO: 341257 - DNA, 15 bp, Homo sapiens
aaagcgtcaggcatt

SEQ ID NO: 341258 - DNA, 15 bp, Homo sapiens
aagcgtcaggcatta

SEQ ID NO: 341259 - DNA, 15 bp, Homo sapiens
agcgtcaggcattaa

SEQ ID NO: 341260 - DNA, 15 bp, Homo sapiens
gcgtcaggcattaag

SEQ ID NO: 341261 - DNA, 15 bp, Homo sapiens
cgtcaggcattaagt

SEQ ID NO: 341262 - DNA, 15 bp, Homo sapiens
gtcaggcattaagtt

SEQ ID NO: 341263 - DNA, 15 bp, Homo sapiens
tcaggcattaagtta

SEQ ID NO: 341264 - DNA, 15 bp, Homo sapiens
caggcattaagttag

SEQ ID NO: 341265 - DNA, 15 bp, Homo sapiens
aggcattaagttagg

SEQ ID NO: 341266 - DNA, 15 bp, Homo sapiens
ggcattaagttagga

SEQ ID NO: 341267 - DNA, 15 bp, Homo sapiens
gcattaagttaggaa

SEQ ID NO: 341268 - DNA, 15 bp, Homo sapiens
cattaagttaggaac

SEQ ID NO: 341269 - DNA, 15 bp, Homo sapiens
attaagttaggaacc

SEQ ID NO: 341270 - DNA, 15 bp, Homo sapiens
ttaagttaggaacca

SEQ ID NO: 341271 - DNA, 15 bp, Homo sapiens
taagttaggaaccaa

SEQ ID NO: 341272 - DNA, 15 bp, Homo sapiens
aagttaggaaccaaa

SEQ ID NO: 341273 - DNA, 15 bp, Homo sapiens
agttaggaaccaaaa

SEQ ID NO: 341274 - DNA, 15 bp, Homo sapiens
gttaggaaccaaaat

SEQ ID NO: 341275 - DNA, 15 bp, Homo sapiens
ttaggaaccaaaatt

SEQ ID NO: 341276 - DNA, 15 bp, Homo sapiens
taggaaccaaaattg

SEQ ID NO: 341277 - DNA, 15 bp, Homo sapiens
aggaaccaaaattgg

SEQ ID NO: 341278 - DNA, 15 bp, Homo sapiens
ggaaccaaaattggg

SEQ ID NO: 341279 - DNA, 15 bp, Homo sapiens
gaaccaaaattgggt

SEQ ID NO: 341280 - DNA, 15 bp, Homo sapiens
aaccaaaattgggtg

SEQ ID NO: 341281 - DNA, 15 bp, Homo sapiens
accaaaattgggtgg

SEQ ID NO: 341282 - DNA, 15 bp, Homo sapiens
ccaaaattgggtggg

SEQ ID NO: 341283 - DNA, 15 bp, Homo sapiens
caaaattgggtgggc

SEQ ID NO: 341284 - DNA, 15 bp, Homo sapiens
aaaattgggtgggca

SEQ ID NO: 341285 - DNA, 15 bp, Homo sapiens
aaattgggtgggcaa

SEQ ID NO: 341286 - DNA, 15 bp, Homo sapiens
aattgggtgggcaat

SEQ ID NO: 341287 - DNA, 15 bp, Homo sapiens
attgggtgggcaatt

SEQ ID NO: 341288 - DNA, 15 bp, Homo sapiens
ttgggtgggcaattt

SEQ ID NO: 341289 - DNA, 15 bp, Homo sapiens
tgggtgggcaattta

SEQ ID NO: 341290 - DNA, 15 bp, Homo sapiens
gggtgggcaatttaa

SEQ ID NO: 341291 - DNA, 15 bp, Homo sapiens
ggtgggcaatttaat

SEQ ID NO: 341292 - DNA, 15 bp, Homo sapiens
gtgggcaatttaatt

SEQ ID NO: 341293 - DNA, 15 bp, Homo sapiens
tgggcaatttaattt

SEQ ID NO: 341294 - DNA, 15 bp, Homo sapiens
gggcaatttaatttg

SEQ ID NO: 341295 - DNA, 15 bp, Homo sapiens
ggcaatttaatttgg

SEQ ID NO: 341296 - DNA, 15 bp, Homo sapiens
gcaatttaatttggt

SEQ ID NO: 341297 - DNA, 15 bp, Homo sapiens
caatttaatttggtc

SEQ ID NO: 341298 - DNA, 15 bp, Homo sapiens
aatttaatttggtca

SEQ ID NO: 341299 - DNA, 15 bp, Homo sapiens
atttaatttggtcac

SEQ ID NO: 341300 - DNA, 15 bp, Homo sapiens
tttaatttggtcaca

SEQ ID NO: 341301 - DNA, 15 bp, Homo sapiens
ttaatttggtcacaa

SEQ ID NO: 341302 - DNA, 15 bp, Homo sapiens
taatttggtcacaag

SEQ ID NO: 341303 - DNA, 15 bp, Homo sapiens
aatttggtcacaagt

SEQ ID NO: 341304 - DNA, 15 bp, Homo sapiens
atttggtcacaagtc

SEQ ID NO: 341305 - DNA, 15 bp, Homo sapiens
tttggtcacaagtct

SEQ ID NO: 341306 - DNA, 15 bp, Homo sapiens
ttggtcacaagtcta

SEQ ID NO: 341307 - DNA, 15 bp, Homo sapiens
tggtcacaagtctag

SEQ ID NO: 341308 - DNA, 15 bp, Homo sapiens
ggtcacaagtctagg

SEQ ID NO: 341309 - DNA, 15 bp, Homo sapiens
gtcacaagtctagga

SEQ ID NO: 341310 - DNA, 15 bp, Homo sapiens
tcacaagtctaggag

SEQ ID NO: 341311 - DNA, 15 bp, Homo sapiens
cacaagtctaggaga

SEQ ID NO: 341312 - DNA, 15 bp, Homo sapiens
acaagtctaggagat

SEQ ID NO: 341313 - DNA, 15 bp, Homo sapiens
caagtctaggagata

SEQ ID NO: 341314 - DNA, 15 bp, Homo sapiens
aagtctaggagataa

SEQ ID NO: 341315 - DNA, 15 bp, Homo sapiens
agtctaggagataaa

SEQ ID NO: 341316 - DNA, 15 bp, Homo sapiens
gtctaggagataaac

SEQ ID NO: 341317 - DNA, 15 bp, Homo sapiens
tctaggagataaact

SEQ ID NO: 341318 - DNA, 15 bp, Homo sapiens
ctaggagataaactt

SEQ ID NO: 341319 - DNA, 15 bp, Homo sapiens
taggagataaacttt

SEQ ID NO: 341320 - DNA, 15 bp, Homo sapiens
aggagataaactttt

SEQ ID NO: 341321 - DNA, 15 bp, Homo sapiens
ggagataaacttttc

SEQ ID NO: 341322 - DNA, 15 bp, Homo sapiens
gagataaacttttca

SEQ ID NO: 341323 - DNA, 15 bp, Homo sapiens
agataaacttttcat

SEQ ID NO: 341324 - DNA, 15 bp, Homo sapiens
gataaacttttcata

SEQ ID NO: 341325 - DNA, 15 bp, Homo sapiens
ataaacttttcatag

SEQ ID NO: 341326 - DNA, 15 bp, Homo sapiens
taaacttttcatagt

SEQ ID NO: 341327 - DNA, 15 bp, Homo sapiens
aaacttttcatagtc

SEQ ID NO: 341328 - DNA, 15 bp, Homo sapiens
aacttttcatagtca

SEQ ID NO: 341329 - DNA, 15 bp, Homo sapiens
acttttcatagtcaa

SEQ ID NO: 341330 - DNA, 15 bp, Homo sapiens
cttttcatagtcaag

SEQ ID NO: 341331 - DNA, 15 bp, Homo sapiens
ttttcatagtcaaga

SEQ ID NO: 341332 - DNA, 15 bp, Homo sapiens
tttcatagtcaagat

SEQ ID NO: 341333 - DNA, 15 bp, Homo sapiens
ttcatagtcaagata

SEQ ID NO: 341334 - DNA, 15 bp, Homo sapiens
tcatagtcaagataa

SEQ ID NO: 341335 - DNA, 15 bp, Homo sapiens
catagtcaagataag

SEQ ID NO: 341336 - DNA, 15 bp, Homo sapiens
atagtcaagataagg

SEQ ID NO: 341337 - DNA, 15 bp, Homo sapiens
tagtcaagataagga

SEQ ID NO: 341338 - DNA, 15 bp, Homo sapiens
agtcaagataaggaa

SEQ ID NO: 341339 - DNA, 15 bp, Homo sapiens
gtcaagataaggaaa

SEQ ID NO: 341340 - DNA, 15 bp, Homo sapiens
tcaagataaggaaag

SEQ ID NO: 341341 - DNA, 15 bp, Homo sapiens
caagataaggaaaga

SEQ ID NO: 341342 - DNA, 15 bp, Homo sapiens
aagataaggaaagat

SEQ ID NO: 341343 - DNA, 15 bp, Homo sapiens
agataaggaaagata

SEQ ID NO: 341344 - DNA, 15 bp, Homo sapiens
gataaggaaagatag

SEQ ID NO: 341345 - DNA, 15 bp, Homo sapiens
ataaggaaagataga

SEQ ID NO: 341346 - DNA, 15 bp, Homo sapiens
taaggaaagatagaa

SEQ ID NO: 341347 - DNA, 15 bp, Homo sapiens
aaggaaagatagaat

SEQ ID NO: 341348 - DNA, 15 bp, Homo sapiens
aggaaagatagaata

SEQ ID NO: 341349 - DNA, 15 bp, Homo sapiens
ggaaagatagaataa

SEQ ID NO: 341350 - DNA, 15 bp, Homo sapiens
gaaagatagaataaa

SEQ ID NO: 341351 - DNA, 15 bp, Homo sapiens
aaagatagaataaaa

SEQ ID NO: 341352 - DNA, 15 bp, Homo sapiens
aagatagaataaaat

SEQ ID NO: 341353 - DNA, 15 bp, Homo sapiens
agatagaataaaata

SEQ ID NO: 341354 - DNA, 15 bp, Homo sapiens
gatagaataaaatat

SEQ ID NO: 341355 - DNA, 15 bp, Homo sapiens
atagaataaaatatg

SEQ ID NO: 341356 - DNA, 15 bp, Homo sapiens
tagaataaaatatgc

SEQ ID NO: 341357 - DNA, 15 bp, Homo sapiens
agaataaaatatgct

SEQ ID NO: 341358 - DNA, 15 bp, Homo sapiens
gaataaaatatgctc

SEQ ID NO: 341359 - DNA, 15 bp, Homo sapiens
aataaaatatgctct

SEQ ID NO: 341360 - DNA, 15 bp, Homo sapiens
ataaaatatgctctc

SEQ ID NO: 341361 - DNA, 15 bp, Homo sapiens
taaaatatgctctct

SEQ ID NO: 341362 - DNA, 15 bp, Homo sapiens
aaaatatgctctctg

SEQ ID NO: 341363 - DNA, 15 bp, Homo sapiens
aaatatgctctctgt

SEQ ID NO: 341364 - DNA, 15 bp, Homo sapiens
aatatgctctctgta

SEQ ID NO: 341365 - DNA, 15 bp, Homo sapiens
atatgctctctgtaa

SEQ ID NO: 341366 - DNA, 15 bp, Homo sapiens
tatgctctctgtaaa

SEQ ID NO: 341367 - DNA, 15 bp, Homo sapiens
atgctctctgtaaat

SEQ ID NO: 341368 - DNA, 15 bp, Homo sapiens
tgctctctgtaaatt

SEQ ID NO: 341369 - DNA, 15 bp, Homo sapiens
gctctctgtaaattg

SEQ ID NO: 341370 - DNA, 15 bp, Homo sapiens
ctctctgtaaattga

SEQ ID NO: 341371 - DNA, 15 bp, Homo sapiens
tctctgtaaattgaa

SEQ ID NO: 341372 - DNA, 15 bp, Homo sapiens
ctctgtaaattgaag

SEQ ID NO: 341373 - DNA, 15 bp, Homo sapiens
tctgtaaattgaaga

SEQ ID NO: 341374 - DNA, 15 bp, Homo sapiens
ctgtaaattgaagac

SEQ ID NO: 341375 - DNA, 15 bp, Homo sapiens
tgtaaattgaagact

SEQ ID NO: 341376 - DNA, 15 bp, Homo sapiens
gtaaattgaagactt

SEQ ID NO: 341377 - DNA, 15 bp, Homo sapiens
taaattgaagacttt

SEQ ID NO: 341378 - DNA, 15 bp, Homo sapiens
aaattgaagactttt

SEQ ID NO: 341379 - DNA, 15 bp, Homo sapiens
aattgaagactttta

SEQ ID NO: 341380 - DNA, 15 bp, Homo sapiens
attgaagacttttat

SEQ ID NO: 341381 - DNA, 15 bp, Homo sapiens
ttgaagacttttatt

SEQ ID NO: 341382 - DNA, 15 bp, Homo sapiens
tgaagacttttattg

SEQ ID NO: 341383 - DNA, 15 bp, Homo sapiens
gaagacttttattga

SEQ ID NO: 341384 - DNA, 15 bp, Homo sapiens
aagacttttattgat

SEQ ID NO: 341385 - DNA, 15 bp, Homo sapiens
agacttttattgatc

SEQ ID NO: 341386 - DNA, 15 bp, Homo sapiens
gacttttattgatca

SEQ ID NO: 341387 - DNA, 15 bp, Homo sapiens
acttttattgatcag

SEQ ID NO: 341388 - DNA, 15 bp, Homo sapiens
cttttattgatcagt

SEQ ID NO: 341389 - DNA, 15 bp, Homo sapiens
ttttattgatcagtg

SEQ ID NO: 341390 - DNA, 15 bp, Homo sapiens
tttattgatcagtga

SEQ ID NO: 341391 - DNA, 15 bp, Homo sapiens
ttattgatcagtgaa

SEQ ID NO: 341392 - DNA, 15 bp, Homo sapiens
tattgatcagtgaaa

SEQ ID NO: 341393 - DNA, 15 bp, Homo sapiens
attgatcagtgaaac

SEQ ID NO: 341394 - DNA, 15 bp, Homo sapiens
ttgatcagtgaaaca

SEQ ID NO: 341395 - DNA, 15 bp, Homo sapiens
tgatcagtgaaacat

SEQ ID NO: 341396 - DNA, 15 bp, Homo sapiens
gatcagtgaaacatt

SEQ ID NO: 341397 - DNA, 15 bp, Homo sapiens
atcagtgaaacattg

SEQ ID NO: 341398 - DNA, 15 bp, Homo sapiens
tcagtgaaacattga

SEQ ID NO: 341399 - DNA, 15 bp, Homo sapiens
cagtgaaacattgag

SEQ ID NO: 341400 - DNA, 15 bp, Homo sapiens
agtgaaacattgagg

SEQ ID NO: 341401 - DNA, 15 bp, Homo sapiens
gtgaaacattgaggt

SEQ ID NO: 341402 - DNA, 15 bp, Homo sapiens
tgaaacattgaggta

SEQ ID NO: 341403 - DNA, 15 bp, Homo sapiens
gaaacattgaggtaa

SEQ ID NO: 341404 - DNA, 15 bp, Homo sapiens
aaacattgaggtaac

SEQ ID NO: 341405 - DNA, 15 bp, Homo sapiens
aacattgaggtaact

SEQ ID NO: 341406 - DNA, 15 bp, Homo sapiens
acattgaggtaacta

SEQ ID NO: 341407 - DNA, 15 bp, Homo sapiens
cattgaggtaactaa

SEQ ID NO: 341408 - DNA, 15 bp, Homo sapiens
attgaggtaactaat

SEQ ID NO: 341409 - DNA, 15 bp, Homo sapiens
ttgaggtaactaata

SEQ ID NO: 341410 - DNA, 15 bp, Homo sapiens
tgaggtaactaatat

SEQ ID NO: 341411 - DNA, 15 bp, Homo sapiens
gaggtaactaatatg

SEQ ID NO: 341412 - DNA, 15 bp, Homo sapiens
aggtaactaatatgt

SEQ ID NO: 341413 - DNA, 15 bp, Homo sapiens
ggtaactaatatgta

SEQ ID NO: 341414 - DNA, 15 bp, Homo sapiens
gtaactaatatgtaa

SEQ ID NO: 341415 - DNA, 15 bp, Homo sapiens
taactaatatgtaaa

SEQ ID NO: 341416 - DNA, 15 bp, Homo sapiens
aactaatatgtaaaa

SEQ ID NO: 341417 - DNA, 15 bp, Homo sapiens
actaatatgtaaaac

SEQ ID NO: 341418 - DNA, 15 bp, Homo sapiens
ctaatatgtaaaact

SEQ ID NO: 341419 - DNA, 15 bp, Homo sapiens
taatatgtaaaactt

SEQ ID NO: 341420 - DNA, 15 bp, Homo sapiens
aatatgtaaaacttt

SEQ ID NO: 341421 - DNA, 15 bp, Homo sapiens
atatgtaaaacttta

SEQ ID NO: 341422 - DNA, 15 bp, Homo sapiens
tatgtaaaactttag

SEQ ID NO: 341423 - DNA, 15 bp, Homo sapiens
atgtaaaactttagg

SEQ ID NO: 341424 - DNA, 15 bp, Homo sapiens
tgtaaaactttagga

SEQ ID NO: 341425 - DNA, 15 bp, Homo sapiens
gtaaaactttaggaa

SEQ ID NO: 341426 - DNA, 15 bp, Homo sapiens
taaaactttaggaat

SEQ ID NO: 341427 - DNA, 15 bp, Homo sapiens
aaaactttaggaata

SEQ ID NO: 341428 - DNA, 15 bp, Homo sapiens
aaactttaggaatac

SEQ ID NO: 341429 - DNA, 15 bp, Homo sapiens
aactttaggaataca

SEQ ID NO: 341430 - DNA, 15 bp, Homo sapiens
actttaggaatacat

SEQ ID NO: 341431 - DNA, 15 bp, Homo sapiens
ctttaggaatacatt

SEQ ID NO: 341432 - DNA, 15 bp, Homo sapiens
tttaggaatacatta

SEQ ID NO: 341433 - DNA, 15 bp, Homo sapiens
ttaggaatacattaa

SEQ ID NO: 341434 - DNA, 15 bp, Homo sapiens
taggaatacattaaa

SEQ ID NO: 341435 - DNA, 15 bp, Homo sapiens
aggaatacattaaac

SEQ ID NO: 341436 - DNA, 15 bp, Homo sapiens
ggaatacattaaaca

SEQ ID NO: 341437 - DNA, 15 bp, Homo sapiens
gaatacattaaacac

SEQ ID NO: 341438 - DNA, 15 bp, Homo sapiens
aatacattaaacaca

SEQ ID NO: 341439 - DNA, 15 bp, Homo sapiens
atacattaaacacaa

SEQ ID NO: 341440 - DNA, 15 bp, Homo sapiens
tacattaaacacaac

SEQ ID NO: 341441 - DNA, 15 bp, Homo sapiens
acattaaacacaact

SEQ ID NO: 341442 - DNA, 15 bp, Homo sapiens
cattaaacacaactc

SEQ ID NO: 341443 - DNA, 15 bp, Homo sapiens
attaaacacaactct

SEQ ID NO: 341444 - DNA, 15 bp, Homo sapiens
ttaaacacaactctg

SEQ ID NO: 341445 - DNA, 15 bp, Homo sapiens
taaacacaactctga

SEQ ID NO: 341446 - DNA, 15 bp, Homo sapiens
aaacacaactctgag

SEQ ID NO: 341447 - DNA, 15 bp, Homo sapiens
aacacaactctgaga

SEQ ID NO: 341448 - DNA, 15 bp, Homo sapiens
acacaactctgagaa

SEQ ID NO: 341449 - DNA, 15 bp, Homo sapiens
cacaactctgagaag

SEQ ID NO: 341450 - DNA, 15 bp, Homo sapiens
acaactctgagaagc

SEQ ID NO: 341451 - DNA, 15 bp, Homo sapiens
caactctgagaagca

SEQ ID NO: 341452 - DNA, 15 bp, Homo sapiens
aactctgagaagcat

SEQ ID NO: 341453 - DNA, 15 bp, Homo sapiens
actctgagaagcatt

SEQ ID NO: 341454 - DNA, 15 bp, Homo sapiens
ctctgagaagcattt

SEQ ID NO: 341455 - DNA, 15 bp, Homo sapiens
tctgagaagcatttg

SEQ ID NO: 341456 - DNA, 15 bp, Homo sapiens
ctgagaagcatttga

SEQ ID NO: 341457 - DNA, 15 bp, Homo sapiens
tgagaagcatttgag

SEQ ID NO: 341458 - DNA, 15 bp, Homo sapiens
gagaagcatttgaga

SEQ ID NO: 341459 - DNA, 15 bp, Homo sapiens
agaagcatttgagaa

SEQ ID NO: 341460 - DNA, 15 bp, Homo sapiens
gaagcatttgagaac

SEQ ID NO: 341461 - DNA, 15 bp, Homo sapiens
aagcatttgagaaca

SEQ ID NO: 341462 - DNA, 15 bp, Homo sapiens
agcatttgagaacac

SEQ ID NO: 341463 - DNA, 15 bp, Homo sapiens
gcatttgagaacact

SEQ ID NO: 341464 - DNA, 15 bp, Homo sapiens
catttgagaacacta

SEQ ID NO: 341465 - DNA, 15 bp, Homo sapiens
atttgagaacactat

SEQ ID NO: 341466 - DNA, 15 bp, Homo sapiens
tttgagaacactatt

SEQ ID NO: 341467 - DNA, 15 bp, Homo sapiens
ttgagaacactattg

SEQ ID NO: 341468 - DNA, 15 bp, Homo sapiens
tgagaacactattga

SEQ ID NO: 341469 - DNA, 15 bp, Homo sapiens
gagaacactattgat

SEQ ID NO: 341470 - DNA, 15 bp, Homo sapiens
agaacactattgata

SEQ ID NO: 341471 - DNA, 15 bp, Homo sapiens
gaacactattgatag

SEQ ID NO: 341472 - DNA, 15 bp, Homo sapiens
aacactattgatagt

SEQ ID NO: 341473 - DNA, 15 bp, Homo sapiens
acactattgatagta

SEQ ID NO: 341474 - DNA, 15 bp, Homo sapiens
cactattgatagtat

SEQ ID NO: 341475 - DNA, 15 bp, Homo sapiens
actattgatagtatt

SEQ ID NO: 341476 - DNA, 15 bp, Homo sapiens
ctattgatagtattt

SEQ ID NO: 341477 - DNA, 15 bp, Homo sapiens
tattgatagtattta

SEQ ID NO: 341478 - DNA, 15 bp, Homo sapiens
attgatagtatttaa

SEQ ID NO: 341479 - DNA, 15 bp, Homo sapiens
ttgatagtatttaaa

SEQ ID NO: 341480 - DNA, 15 bp, Homo sapiens
tgatagtatttaaat

SEQ ID NO: 341481 - DNA, 15 bp, Homo sapiens
gatagtatttaaata

SEQ ID NO: 341482 - DNA, 15 bp, Homo sapiens
atagtatttaaataa

SEQ ID NO: 341483 - DNA, 15 bp, Homo sapiens
tagtatttaaataaa

SEQ ID NO: 341484 - DNA, 15 bp, Homo sapiens
agtatttaaataaat

SEQ ID NO: 341485 - DNA, 15 bp, Homo sapiens
gtatttaaataaatt

SEQ ID NO: 341486 - DNA, 15 bp, Homo sapiens
tatttaaataaattt

SEQ ID NO: 341487 - DNA, 15 bp, Homo sapiens
atttaaataaatttt

SEQ ID NO: 341488 - DNA, 15 bp, Homo sapiens
tttaaataaattttc

SEQ ID NO: 341489 - DNA, 15 bp, Homo sapiens
ttaaataaattttct

SEQ ID NO: 341490 - DNA, 15 bp, Homo sapiens
taaataaattttctt

SEQ ID NO: 341491 - DNA, 15 bp, Homo sapiens
aaataaattttcttt

SEQ ID NO: 341492 - DNA, 15 bp, Homo sapiens
aataaattttctttc

SEQ ID NO: 341493 - DNA, 15 bp, Homo sapiens
ataaattttctttct

SEQ ID NO: 341494 - DNA, 15 bp, Homo sapiens
taaattttctttctt

SEQ ID NO: 341495 - DNA, 15 bp, Homo sapiens
tcttttttttgagat

SEQ ID NO: 341496 - DNA, 15 bp, Homo sapiens
cttttttttgagatg

SEQ ID NO: 341497 - DNA, 15 bp, Homo sapiens
cacccaggctggagg

SEQ ID NO: 341498 - DNA, 15 bp, Homo sapiens
acccaggctggaggg

SEQ ID NO: 341499 - DNA, 15 bp, Homo sapiens
cccaggctggagggc

SEQ ID NO: 341500 - DNA, 15 bp, Homo sapiens
ccaggctggagggca

SEQ ID NO: 341501 - DNA, 15 bp, Homo sapiens
caggctggagggcaa

SEQ ID NO: 341502 - DNA, 15 bp, Homo sapiens
aggctggagggcaat

SEQ ID NO: 341503 - DNA, 15 bp, Homo sapiens
ggctggagggcaatg

SEQ ID NO: 341504 - DNA, 15 bp, Homo sapiens
gctggagggcaatgg

SEQ ID NO: 341505 - DNA, 15 bp, Homo sapiens
ctggagggcaatggc

SEQ ID NO: 341506 - DNA, 15 bp, Homo sapiens
tggagggcaatggca

SEQ ID NO: 341507 - DNA, 15 bp, Homo sapiens
ggagggcaatggcaa

SEQ ID NO: 341508 - DNA, 15 bp, Homo sapiens
gagggcaatggcaaa

SEQ ID NO: 341509 - DNA, 15 bp, Homo sapiens
agggcaatggcaaaa

SEQ ID NO: 341510 - DNA, 15 bp, Homo sapiens
gggcaatggcaaaat

SEQ ID NO: 341511 - DNA, 15 bp, Homo sapiens
ggcaatggcaaaatc

SEQ ID NO: 341512 - DNA, 15 bp, Homo sapiens
gcaatggcaaaatct

SEQ ID NO: 341513 - DNA, 15 bp, Homo sapiens
caatggcaaaatctc

SEQ ID NO: 341514 - DNA, 15 bp, Homo sapiens
aatggcaaaatctca

SEQ ID NO: 341515 - DNA, 15 bp, Homo sapiens
atggcaaaatctcag

SEQ ID NO: 341516 - DNA, 15 bp, Homo sapiens
tggcaaaatctcagc

SEQ ID NO: 341517 - DNA, 15 bp, Homo sapiens
ggcaaaatctcagct

SEQ ID NO: 341518 - DNA, 15 bp, Homo sapiens
gcaaaatctcagctc

SEQ ID NO: 341519 - DNA, 15 bp, Homo sapiens
caaaatctcagctca

SEQ ID NO: 341520 - DNA, 15 bp, Homo sapiens
aaaatctcagctcac

SEQ ID NO: 341521 - DNA, 15 bp, Homo sapiens
aaatctcagctcact

SEQ ID NO: 341522 - DNA, 15 bp, Homo sapiens
aatctcagctcactg

SEQ ID NO: 341523 - DNA, 15 bp, Homo sapiens
ctcagctcactgcac

SEQ ID NO: 341524 - DNA, 15 bp, Homo sapiens
tcagctcactgcacc

SEQ ID NO: 341525 - DNA, 15 bp, Homo sapiens
cagctcactgcaccc

SEQ ID NO: 341526 - DNA, 15 bp, Homo sapiens
agctcactgcaccct

SEQ ID NO: 341527 - DNA, 15 bp, Homo sapiens
gctcactgcaccctc

SEQ ID NO: 341528 - DNA, 15 bp, Homo sapiens
ctcactgcaccctct

SEQ ID NO: 341529 - DNA, 15 bp, Homo sapiens
tcactgcaccctctg

SEQ ID NO: 341530 - DNA, 15 bp, Homo sapiens
cactgcaccctctgc

SEQ ID NO: 341531 - DNA, 15 bp, Homo sapiens
actgcaccctctgcc

SEQ ID NO: 341532 - DNA, 15 bp, Homo sapiens
ctgcaccctctgcct

SEQ ID NO: 341533 - DNA, 15 bp, Homo sapiens
tgcaccctctgcctc

SEQ ID NO: 341534 - DNA, 15 bp, Homo sapiens
gcaccctctgcctcc

SEQ ID NO: 341535 - DNA, 15 bp, Homo sapiens
caccctctgcctcct

SEQ ID NO: 341536 - DNA, 15 bp, Homo sapiens
accctctgcctcctg

SEQ ID NO: 341537 - DNA, 15 bp, Homo sapiens
ccctctgcctcctgg

SEQ ID NO: 341538 - DNA, 15 bp, Homo sapiens
ttctcccacctcagt

SEQ ID NO: 341539 - DNA, 15 bp, Homo sapiens
tctcccacctcagtc

SEQ ID NO: 341540 - DNA, 15 bp, Homo sapiens
tgggactacaggcgt

SEQ ID NO: 341541 - DNA, 15 bp, Homo sapiens
gggactacaggcgtg

SEQ ID NO: 341542 - DNA, 15 bp, Homo sapiens
ggactacaggcgtgt

SEQ ID NO: 341543 - DNA, 15 bp, Homo sapiens
gactacaggcgtgtg

SEQ ID NO: 341544 - DNA, 15 bp, Homo sapiens
actacaggcgtgtgc

SEQ ID NO: 341545 - DNA, 15 bp, Homo sapiens
ctacaggcgtgtgcc

SEQ ID NO: 341546 - DNA, 15 bp, Homo sapiens
tacaggcgtgtgcca

SEQ ID NO: 341547 - DNA, 15 bp, Homo sapiens
acaggcgtgtgccac

SEQ ID NO: 341548 - DNA, 15 bp, Homo sapiens
caggcgtgtgccacc

SEQ ID NO: 341549 - DNA, 15 bp, Homo sapiens
aggcgtgtgccacca

SEQ ID NO: 341550 - DNA, 15 bp, Homo sapiens
ggcgtgtgccaccac

SEQ ID NO: 341551 - DNA, 15 bp, Homo sapiens
gcgtgtgccaccaca

SEQ ID NO: 341552 - DNA, 15 bp, Homo sapiens
cgtgtgccaccacac

SEQ ID NO: 341553 - DNA, 15 bp, Homo sapiens
ttttttgtatttttt

SEQ ID NO: 341554 - DNA, 15 bp, Homo sapiens
tttttgtattttttg

SEQ ID NO: 341555 - DNA, 15 bp, Homo sapiens
ttttgtattttttgt

SEQ ID NO: 341556 - DNA, 15 bp, Homo sapiens
tttgtattttttgta

SEQ ID NO: 341557 - DNA, 15 bp, Homo sapiens
ttgtattttttgtat

SEQ ID NO: 341558 - DNA, 15 bp, Homo sapiens
tgtattttttgtatt

SEQ ID NO: 341559 - DNA, 15 bp, Homo sapiens
gtattttttgtattt

SEQ ID NO: 341560 - DNA, 15 bp, Homo sapiens
tattttttgtatttt

SEQ ID NO: 341561 - DNA, 15 bp, Homo sapiens
tatttttagtaaagt

SEQ ID NO: 341562 - DNA, 15 bp, Homo sapiens
atttttagtaaagtc

SEQ ID NO: 341563 - DNA, 15 bp, Homo sapiens
tttttagtaaagtca

SEQ ID NO: 341564 - DNA, 15 bp, Homo sapiens
ttttagtaaagtcag

SEQ ID NO: 341565 - DNA, 15 bp, Homo sapiens
tttagtaaagtcagg

SEQ ID NO: 341566 - DNA, 15 bp, Homo sapiens
ttagtaaagtcaggg

SEQ ID NO: 341567 - DNA, 15 bp, Homo sapiens
tagtaaagtcagggt

SEQ ID NO: 341568 - DNA, 15 bp, Homo sapiens
agtaaagtcagggtt

SEQ ID NO: 341569 - DNA, 15 bp, Homo sapiens
gtaaagtcagggttt

SEQ ID NO: 341570 - DNA, 15 bp, Homo sapiens
taaagtcagggtttc

SEQ ID NO: 341571 - DNA, 15 bp, Homo sapiens
aaagtcagggtttca

SEQ ID NO: 341572 - DNA, 15 bp, Homo sapiens
aagtcagggtttcac

SEQ ID NO: 341573 - DNA, 15 bp, Homo sapiens
agtcagggtttcacc

SEQ ID NO: 341574 - DNA, 15 bp, Homo sapiens
gtcagggtttcacca

SEQ ID NO: 341575 - DNA, 15 bp, Homo sapiens
tcagggtttcaccat

SEQ ID NO: 341576 - DNA, 15 bp, Homo sapiens
cagggtttcaccatg

SEQ ID NO: 341577 - DNA, 15 bp, Homo sapiens
agggtttcaccatgt

SEQ ID NO: 341578 - DNA, 15 bp, Homo sapiens
tgatccgcctgcctt

SEQ ID NO: 341579 - DNA, 15 bp, Homo sapiens
gatccgcctgccttg

SEQ ID NO: 341580 - DNA, 15 bp, Homo sapiens
atccgcctgccttgg

SEQ ID NO: 341581 - DNA, 15 bp, Homo sapiens
tccgcctgccttggg

SEQ ID NO: 341582 - DNA, 15 bp, Homo sapiens
ccgcctgccttgggt

SEQ ID NO: 341583 - DNA, 15 bp, Homo sapiens
cgcctgccttgggtt

SEQ ID NO: 341584 - DNA, 15 bp, Homo sapiens
gcctgccttgggttc

SEQ ID NO: 341585 - DNA, 15 bp, Homo sapiens
cctgccttgggttcc

SEQ ID NO: 341586 - DNA, 15 bp, Homo sapiens
ctgccttgggttccc

SEQ ID NO: 341587 - DNA, 15 bp, Homo sapiens
tgccttgggttccca

SEQ ID NO: 341588 - DNA, 15 bp, Homo sapiens
gccttgggttcccaa

SEQ ID NO: 341589 - DNA, 15 bp, Homo sapiens
ccttgggttcccaaa

SEQ ID NO: 341590 - DNA, 15 bp, Homo sapiens
cttgggttcccaaag

SEQ ID NO: 341591 - DNA, 15 bp, Homo sapiens
ttgggttcccaaagt

SEQ ID NO: 341592 - DNA, 15 bp, Homo sapiens
tgggttcccaaagtg

SEQ ID NO: 341593 - DNA, 15 bp, Homo sapiens
gggttcccaaagtgc

SEQ ID NO: 341594 - DNA, 15 bp, Homo sapiens
ggttcccaaagtgct

SEQ ID NO: 341595 - DNA, 15 bp, Homo sapiens
gttcccaaagtgctg

SEQ ID NO: 341596 - DNA, 15 bp, Homo sapiens
caccatgcccagcct

SEQ ID NO: 341597 - DNA, 15 bp, Homo sapiens
accatgcccagccta

SEQ ID NO: 341598 - DNA, 15 bp, Homo sapiens
ccatgcccagcctat

SEQ ID NO: 341599 - DNA, 15 bp, Homo sapiens
catgcccagcctata

SEQ ID NO: 341600 - DNA, 15 bp, Homo sapiens
atgcccagcctataa

SEQ ID NO: 341601 - DNA, 15 bp, Homo sapiens
tgcccagcctataaa

SEQ ID NO: 341602 - DNA, 15 bp, Homo sapiens
gcccagcctataaat

SEQ ID NO: 341603 - DNA, 15 bp, Homo sapiens
cccagcctataaatt

SEQ ID NO: 341604 - DNA, 15 bp, Homo sapiens
ccagcctataaattt

SEQ ID NO: 341605 - DNA, 15 bp, Homo sapiens
cagcctataaatttt

SEQ ID NO: 341606 - DNA, 15 bp, Homo sapiens
agcctataaattttc

SEQ ID NO: 341607 - DNA, 15 bp, Homo sapiens
gcctataaattttct

SEQ ID NO: 341608 - DNA, 15 bp, Homo sapiens
cctataaattttcta

SEQ ID NO: 341609 - DNA, 15 bp, Homo sapiens
ctataaattttctat

SEQ ID NO: 341610 - DNA, 15 bp, Homo sapiens
tataaattttctata

SEQ ID NO: 341611 - DNA, 15 bp, Homo sapiens
ataaattttctatac

SEQ ID NO: 341612 - DNA, 15 bp, Homo sapiens
taaattttctataca

SEQ ID NO: 341613 - DNA, 15 bp, Homo sapiens
aaattttctatacac

SEQ ID NO: 341614 - DNA, 15 bp, Homo sapiens
aattttctatacaca

SEQ ID NO: 341615 - DNA, 15 bp, Homo sapiens
attttctatacacat

SEQ ID NO: 341616 - DNA, 15 bp, Homo sapiens
ttttctatacacatg

SEQ ID NO: 341617 - DNA, 15 bp, Homo sapiens
tttctatacacatgt

SEQ ID NO: 341618 - DNA, 15 bp, Homo sapiens
ttctatacacatgta

SEQ ID NO: 341619 - DNA, 15 bp, Homo sapiens
tctatacacatgtat

SEQ ID NO: 341620 - DNA, 15 bp, Homo sapiens
ctatacacatgtatc

SEQ ID NO: 341621 - DNA, 15 bp, Homo sapiens
tatacacatgtatcc

SEQ ID NO: 341622 - DNA, 15 bp, Homo sapiens
atacacatgtatcca

SEQ ID NO: 341623 - DNA, 15 bp, Homo sapiens
tacacatgtatccaa

SEQ ID NO: 341624 - DNA, 15 bp, Homo sapiens
acacatgtatccaat

SEQ ID NO: 341625 - DNA, 15 bp, Homo sapiens
cacatgtatccaatg

SEQ ID NO: 341626 - DNA, 15 bp, Homo sapiens
acatgtatccaatga

SEQ ID NO: 341627 - DNA, 15 bp, Homo sapiens
catgtatccaatgac

SEQ ID NO: 341628 - DNA, 15 bp, Homo sapiens
atgtatccaatgact

SEQ ID NO: 341629 - DNA, 15 bp, Homo sapiens
tgtatccaatgacta

SEQ ID NO: 341630 - DNA, 15 bp, Homo sapiens
gtatccaatgactat

SEQ ID NO: 341631 - DNA, 15 bp, Homo sapiens
tatccaatgactatg

SEQ ID NO: 341632 - DNA, 15 bp, Homo sapiens
atccaatgactatgc

SEQ ID NO: 341633 - DNA, 15 bp, Homo sapiens
tccaatgactatgct

SEQ ID NO: 341634 - DNA, 15 bp, Homo sapiens
ccaatgactatgctc

SEQ ID NO: 341635 - DNA, 15 bp, Homo sapiens
caatgactatgctct

SEQ ID NO: 341636 - DNA, 15 bp, Homo sapiens
aatgactatgctctt

SEQ ID NO: 341637 - DNA, 15 bp, Homo sapiens
atgactatgctcttc

SEQ ID NO: 341638 - DNA, 15 bp, Homo sapiens
tgactatgctcttcc

SEQ ID NO: 341639 - DNA, 15 bp, Homo sapiens
gactatgctcttccc

SEQ ID NO: 341640 - DNA, 15 bp, Homo sapiens
actatgctcttccca

SEQ ID NO: 341641 - DNA, 15 bp, Homo sapiens
ctatgctcttcccat

SEQ ID NO: 341642 - DNA, 15 bp, Homo sapiens
tatgctcttcccatg

SEQ ID NO: 341643 - DNA, 15 bp, Homo sapiens
atgctcttcccatgg

SEQ ID NO: 341644 - DNA, 15 bp, Homo sapiens
tgctcttcccatgga

SEQ ID NO: 341645 - DNA, 15 bp, Homo sapiens
gctcttcccatggaa

SEQ ID NO: 341646 - DNA, 15 bp, Homo sapiens
ctcttcccatggaaa

SEQ ID NO: 341647 - DNA, 15 bp, Homo sapiens
tcttcccatggaaaa

SEQ ID NO: 341648 - DNA, 15 bp, Homo sapiens
cttcccatggaaaag

SEQ ID NO: 341649 - DNA, 15 bp, Homo sapiens
ttcccatggaaaagg

SEQ ID NO: 341650 - DNA, 15 bp, Homo sapiens
tcccatggaaaaggc

SEQ ID NO: 341651 - DNA, 15 bp, Homo sapiens
cccatggaaaaggcg

SEQ ID NO: 341652 - DNA, 15 bp, Homo sapiens
ccatggaaaaggcga

SEQ ID NO: 341653 - DNA, 15 bp, Homo sapiens
catggaaaaggcgag

SEQ ID NO: 341654 - DNA, 15 bp, Homo sapiens
atggaaaaggcgaga

SEQ ID NO: 341655 - DNA, 15 bp, Homo sapiens
tggaaaaggcgagag

SEQ ID NO: 341656 - DNA, 15 bp, Homo sapiens
ggaaaaggcgagaga

SEQ ID NO: 341657 - DNA, 15 bp, Homo sapiens
gaaaaggcgagagaa

SEQ ID NO: 341658 - DNA, 15 bp, Homo sapiens
aaaaggcgagagaat

SEQ ID NO: 341659 - DNA, 15 bp, Homo sapiens
aaaggcgagagaatc

SEQ ID NO: 341660 - DNA, 15 bp, Homo sapiens
aaggcgagagaatct

SEQ ID NO: 341661 - DNA, 15 bp, Homo sapiens
aggcgagagaatcta

SEQ ID NO: 341662 - DNA, 15 bp, Homo sapiens
ggcgagagaatctaa

SEQ ID NO: 341663 - DNA, 15 bp, Homo sapiens
gcgagagaatctaag

SEQ ID NO: 341664 - DNA, 15 bp, Homo sapiens
cgagagaatctaagg

SEQ ID NO: 341665 - DNA, 15 bp, Homo sapiens
gagagaatctaaggt

SEQ ID NO: 341666 - DNA, 15 bp, Homo sapiens
agagaatctaaggtg

SEQ ID NO: 341667 - DNA, 15 bp, Homo sapiens
gagaatctaaggtgt

SEQ ID NO: 341668 - DNA, 15 bp, Homo sapiens
agaatctaaggtgtc

SEQ ID NO: 341669 - DNA, 15 bp, Homo sapiens
gaatctaaggtgtcc

SEQ ID NO: 341670 - DNA, 15 bp, Homo sapiens
aatctaaggtgtcca

SEQ ID NO: 341671 - DNA, 15 bp, Homo sapiens
atctaaggtgtccat

SEQ ID NO: 341672 - DNA, 15 bp, Homo sapiens
tctaaggtgtccata

SEQ ID NO: 341673 - DNA, 15 bp, Homo sapiens
ctaaggtgtccatac

SEQ ID NO: 341674 - DNA, 15 bp, Homo sapiens
taaggtgtccatact

SEQ ID NO: 341675 - DNA, 15 bp, Homo sapiens
aaggtgtccatactt

SEQ ID NO: 341676 - DNA, 15 bp, Homo sapiens
aggtgtccatacttc

SEQ ID NO: 341677 - DNA, 15 bp, Homo sapiens
ggtgtccatacttct

SEQ ID NO: 341678 - DNA, 15 bp, Homo sapiens
gtgtccatacttctt

SEQ ID NO: 341679 - DNA, 15 bp, Homo sapiens
tgtccatacttcttt

SEQ ID NO: 341680 - DNA, 15 bp, Homo sapiens
gtccatacttcttta

SEQ ID NO: 341681 - DNA, 15 bp, Homo sapiens
tccatacttctttaa

SEQ ID NO: 341682 - DNA, 15 bp, Homo sapiens
ccatacttctttaac

SEQ ID NO: 341683 - DNA, 15 bp, Homo sapiens
catacttctttaact

SEQ ID NO: 341684 - DNA, 15 bp, Homo sapiens
atacttctttaactg

SEQ ID NO: 341685 - DNA, 15 bp, Homo sapiens
tacttctttaactgc

SEQ ID NO: 341686 - DNA, 15 bp, Homo sapiens
acttctttaactgct

SEQ ID NO: 341687 - DNA, 15 bp, Homo sapiens
cttctttaactgctt

SEQ ID NO: 341688 - DNA, 15 bp, Homo sapiens
ttctttaactgcttt

SEQ ID NO: 341689 - DNA, 15 bp, Homo sapiens
tctttaactgcttta

SEQ ID NO: 341690 - DNA, 15 bp, Homo sapiens
ctttaactgctttat

SEQ ID NO: 341691 - DNA, 15 bp, Homo sapiens
tttaactgctttatt

SEQ ID NO: 341692 - DNA, 15 bp, Homo sapiens
ttaactgctttattg

SEQ ID NO: 341693 - DNA, 15 bp, Homo sapiens
taactgctttattgg

SEQ ID NO: 341694 - DNA, 15 bp, Homo sapiens
aactgctttattggg

SEQ ID NO: 341695 - DNA, 15 bp, Homo sapiens
actgctttattgggt

SEQ ID NO: 341696 - DNA, 15 bp, Homo sapiens
ctgctttattgggta

SEQ ID NO: 341697 - DNA, 15 bp, Homo sapiens
tgctttattgggtag

SEQ ID NO: 341698 - DNA, 15 bp, Homo sapiens
gctttattgggtagc

SEQ ID NO: 341699 - DNA, 15 bp, Homo sapiens
ctttattgggtagct

SEQ ID NO: 341700 - DNA, 15 bp, Homo sapiens
tttattgggtagcta

SEQ ID NO: 341701 - DNA, 15 bp, Homo sapiens
ttattgggtagctaa

SEQ ID NO: 341702 - DNA, 15 bp, Homo sapiens
tattgggtagctaat

SEQ ID NO: 341703 - DNA, 15 bp, Homo sapiens
attgggtagctaatc

SEQ ID NO: 341704 - DNA, 15 bp, Homo sapiens
ttgggtagctaatca

SEQ ID NO: 341705 - DNA, 15 bp, Homo sapiens
tgggtagctaatcag

SEQ ID NO: 341706 - DNA, 15 bp, Homo sapiens
gggtagctaatcaga

SEQ ID NO: 341707 - DNA, 15 bp, Homo sapiens
ggtagctaatcagag

SEQ ID NO: 341708 - DNA, 15 bp, Homo sapiens
gtagctaatcagagt

SEQ ID NO: 341709 - DNA, 15 bp, Homo sapiens
tagctaatcagagta

SEQ ID NO: 341710 - DNA, 15 bp, Homo sapiens
agctaatcagagtaa

SEQ ID NO: 341711 - DNA, 15 bp, Homo sapiens
gctaatcagagtaac

SEQ ID NO: 341712 - DNA, 15 bp, Homo sapiens
ctaatcagagtaact

SEQ ID NO: 341713 - DNA, 15 bp, Homo sapiens
taatcagagtaactt

SEQ ID NO: 341714 - DNA, 15 bp, Homo sapiens
aatcagagtaacttt

SEQ ID NO: 341715 - DNA, 15 bp, Homo sapiens
atcagagtaactttt

SEQ ID NO: 341716 - DNA, 15 bp, Homo sapiens
tcagagtaacttttg

SEQ ID NO: 341717 - DNA, 15 bp, Homo sapiens
cagagtaacttttga

SEQ ID NO: 341718 - DNA, 15 bp, Homo sapiens
agagtaacttttgac

SEQ ID NO: 341719 - DNA, 15 bp, Homo sapiens
gagtaacttttgact

SEQ ID NO: 341720 - DNA, 15 bp, Homo sapiens
agtaacttttgacta

SEQ ID NO: 341721 - DNA, 15 bp, Homo sapiens
gtaacttttgactat

SEQ ID NO: 341722 - DNA, 15 bp, Homo sapiens
taacttttgactatc

SEQ ID NO: 341723 - DNA, 15 bp, Homo sapiens
aacttttgactatcg

SEQ ID NO: 341724 - DNA, 15 bp, Homo sapiens
acttttgactatcgt

SEQ ID NO: 341725 - DNA, 15 bp, Homo sapiens
cttttgactatcgtg

SEQ ID NO: 341726 - DNA, 15 bp, Homo sapiens
ttttgactatcgtgt

SEQ ID NO: 341727 - DNA, 15 bp, Homo sapiens
tttgactatcgtgta

SEQ ID NO: 341728 - DNA, 15 bp, Homo sapiens
ttgactatcgtgtag

SEQ ID NO: 341729 - DNA, 15 bp, Homo sapiens
tgactatcgtgtagc

SEQ ID NO: 341730 - DNA, 15 bp, Homo sapiens
gactatcgtgtagca

SEQ ID NO: 341731 - DNA, 15 bp, Homo sapiens
actatcgtgtagcat

SEQ ID NO: 341732 - DNA, 15 bp, Homo sapiens
ctatcgtgtagcatt

SEQ ID NO: 341733 - DNA, 15 bp, Homo sapiens
tatcgtgtagcattc

SEQ ID NO: 341734 - DNA, 15 bp, Homo sapiens
atcgtgtagcattct

SEQ ID NO: 341735 - DNA, 15 bp, Homo sapiens
tcgtgtagcattcta

SEQ ID NO: 341736 - DNA, 15 bp, Homo sapiens
cgtgtagcattctac

SEQ ID NO: 341737 - DNA, 15 bp, Homo sapiens
gtgtagcattctact

SEQ ID NO: 341738 - DNA, 15 bp, Homo sapiens
tgtagcattctactt

SEQ ID NO: 341739 - DNA, 15 bp, Homo sapiens
gtagcattctactta

SEQ ID NO: 341740 - DNA, 15 bp, Homo sapiens
tagcattctacttat

SEQ ID NO: 341741 - DNA, 15 bp, Homo sapiens
agcattctacttatc

SEQ ID NO: 341742 - DNA, 15 bp, Homo sapiens
gcattctacttatct

SEQ ID NO: 341743 - DNA, 15 bp, Homo sapiens
cattctacttatctc

SEQ ID NO: 341744 - DNA, 15 bp, Homo sapiens
attctacttatctct

SEQ ID NO: 341745 - DNA, 15 bp, Homo sapiens
ttctacttatctctt

SEQ ID NO: 341746 - DNA, 15 bp, Homo sapiens
tctacttatctcttt

SEQ ID NO: 341747 - DNA, 15 bp, Homo sapiens
ctacttatctcttta

SEQ ID NO: 341748 - DNA, 15 bp, Homo sapiens
tacttatctctttat

SEQ ID NO: 341749 - DNA, 15 bp, Homo sapiens
acttatctctttata

SEQ ID NO: 341750 - DNA, 15 bp, Homo sapiens
cttatctctttatac

SEQ ID NO: 341751 - DNA, 15 bp, Homo sapiens
ttatctctttatact

SEQ ID NO: 341752 - DNA, 15 bp, Homo sapiens
tatctctttatactg

SEQ ID NO: 341753 - DNA, 15 bp, Homo sapiens
atctctttatactgt

SEQ ID NO: 341754 - DNA, 15 bp, Homo sapiens
tctctttatactgtc

SEQ ID NO: 341755 - DNA, 15 bp, Homo sapiens
ctctttatactgtcc

SEQ ID NO: 341756 - DNA, 15 bp, Homo sapiens
tctttatactgtcct

SEQ ID NO: 341757 - DNA, 15 bp, Homo sapiens
ctttatactgtccta

SEQ ID NO: 341758 - DNA, 15 bp, Homo sapiens
tttatactgtcctac

SEQ ID NO: 341759 - DNA, 15 bp, Homo sapiens
ttatactgtcctaca

SEQ ID NO: 341760 - DNA, 15 bp, Homo sapiens
tatactgtcctacac

SEQ ID NO: 341761 - DNA, 15 bp, Homo sapiens
atactgtcctacact

SEQ ID NO: 341762 - DNA, 15 bp, Homo sapiens
tactgtcctacacta

SEQ ID NO: 341763 - DNA, 15 bp, Homo sapiens
actgtcctacactag

SEQ ID NO: 341764 - DNA, 15 bp, Homo sapiens
ctgtcctacactaga

SEQ ID NO: 341765 - DNA, 15 bp, Homo sapiens
tgtcctacactagat

SEQ ID NO: 341766 - DNA, 15 bp, Homo sapiens
gtcctacactagata

SEQ ID NO: 341767 - DNA, 15 bp, Homo sapiens
tcctacactagataa

SEQ ID NO: 341768 - DNA, 15 bp, Homo sapiens
cctacactagataaa

SEQ ID NO: 341769 - DNA, 15 bp, Homo sapiens
ctacactagataaaa

SEQ ID NO: 341770 - DNA, 15 bp, Homo sapiens
tacactagataaaat

SEQ ID NO: 341771 - DNA, 15 bp, Homo sapiens
acactagataaaatg

SEQ ID NO: 341772 - DNA, 15 bp, Homo sapiens
cactagataaaatga

SEQ ID NO: 341773 - DNA, 15 bp, Homo sapiens
actagataaaatgat

SEQ ID NO: 341774 - DNA, 15 bp, Homo sapiens
ctagataaaatgatc

SEQ ID NO: 341775 - DNA, 15 bp, Homo sapiens
tagataaaatgatct

SEQ ID NO: 341776 - DNA, 15 bp, Homo sapiens
agataaaatgatctc

SEQ ID NO: 341777 - DNA, 15 bp, Homo sapiens
gataaaatgatctct

SEQ ID NO: 341778 - DNA, 15 bp, Homo sapiens
ataaaatgatctctg

SEQ ID NO: 341779 - DNA, 15 bp, Homo sapiens
taaaatgatctctga

SEQ ID NO: 341780 - DNA, 15 bp, Homo sapiens
aaaatgatctctgac

SEQ ID NO: 341781 - DNA, 15 bp, Homo sapiens
aaatgatctctgact

SEQ ID NO: 341782 - DNA, 15 bp, Homo sapiens
aatgatctctgactt

SEQ ID NO: 341783 - DNA, 15 bp, Homo sapiens
atgatctctgacttg

SEQ ID NO: 341784 - DNA, 15 bp, Homo sapiens
tgatctctgacttgg

SEQ ID NO: 341785 - DNA, 15 bp, Homo sapiens
gatctctgacttggt

SEQ ID NO: 341786 - DNA, 15 bp, Homo sapiens
atctctgacttggtt

SEQ ID NO: 341787 - DNA, 15 bp, Homo sapiens
tctctgacttggttt

SEQ ID NO: 341788 - DNA, 15 bp, Homo sapiens
ctctgacttggttta

SEQ ID NO: 341789 - DNA, 15 bp, Homo sapiens
tctgacttggtttat

SEQ ID NO: 341790 - DNA, 15 bp, Homo sapiens
ctgacttggtttatt

SEQ ID NO: 341791 - DNA, 15 bp, Homo sapiens
tgacttggtttattt

SEQ ID NO: 341792 - DNA, 15 bp, Homo sapiens
gacttggtttattta

SEQ ID NO: 341793 - DNA, 15 bp, Homo sapiens
acttggtttatttaa

SEQ ID NO: 341794 - DNA, 15 bp, Homo sapiens
cttggtttatttaag

SEQ ID NO: 341795 - DNA, 15 bp, Homo sapiens
ttggtttatttaagc

SEQ ID NO: 341796 - DNA, 15 bp, Homo sapiens
tggtttatttaagct

SEQ ID NO: 341797 - DNA, 15 bp, Homo sapiens
ggtttatttaagctc

SEQ ID NO: 341798 - DNA, 15 bp, Homo sapiens
gtttatttaagctct

SEQ ID NO: 341799 - DNA, 15 bp, Homo sapiens
tttatttaagctctg

SEQ ID NO: 341800 - DNA, 15 bp, Homo sapiens
ttatttaagctctgg

SEQ ID NO: 341801 - DNA, 15 bp, Homo sapiens
tatttaagctctgga

SEQ ID NO: 341802 - DNA, 15 bp, Homo sapiens
atttaagctctggac

SEQ ID NO: 341803 - DNA, 15 bp, Homo sapiens
tttaagctctggact

SEQ ID NO: 341804 - DNA, 15 bp, Homo sapiens
ttaagctctggactt

SEQ ID NO: 341805 - DNA, 15 bp, Homo sapiens
taagctctggacttt

SEQ ID NO: 341806 - DNA, 15 bp, Homo sapiens
aagctctggactttt

SEQ ID NO: 341807 - DNA, 15 bp, Homo sapiens
agctctggacttttt

SEQ ID NO: 341808 - DNA, 15 bp, Homo sapiens
gctctggactttttt

SEQ ID NO: 341809 - DNA, 15 bp, Homo sapiens
ctctggacttttttg

SEQ ID NO: 341810 - DNA, 15 bp, Homo sapiens
tctggacttttttgc

SEQ ID NO: 341811 - DNA, 15 bp, Homo sapiens
ctggacttttttgct

SEQ ID NO: 341812 - DNA, 15 bp, Homo sapiens
tggacttttttgctt

SEQ ID NO: 341813 - DNA, 15 bp, Homo sapiens
ggacttttttgcttt

SEQ ID NO: 341814 - DNA, 15 bp, Homo sapiens
gacttttttgcttta

SEQ ID NO: 341815 - DNA, 15 bp, Homo sapiens
acttttttgctttac

SEQ ID NO: 341816 - DNA, 15 bp, Homo sapiens
cttttttgctttacc

SEQ ID NO: 341817 - DNA, 15 bp, Homo sapiens
ttttttgctttacca

SEQ ID NO: 341818 - DNA, 15 bp, Homo sapiens
tttttgctttaccac

SEQ ID NO: 341819 - DNA, 15 bp, Homo sapiens
ttttgctttaccact

SEQ ID NO: 341820 - DNA, 15 bp, Homo sapiens
tttgctttaccactt

SEQ ID NO: 341821 - DNA, 15 bp, Homo sapiens
ttgctttaccacttc

SEQ ID NO: 341822 - DNA, 15 bp, Homo sapiens
tgctttaccacttct

SEQ ID NO: 341823 - DNA, 15 bp, Homo sapiens
gctttaccacttcta

SEQ ID NO: 341824 - DNA, 15 bp, Homo sapiens
ctttaccacttctac

SEQ ID NO: 341825 - DNA, 15 bp, Homo sapiens
tttaccacttctaca

SEQ ID NO: 341826 - DNA, 15 bp, Homo sapiens
ttaccacttctacat

SEQ ID NO: 341827 - DNA, 15 bp, Homo sapiens
taccacttctacatt

SEQ ID NO: 341828 - DNA, 15 bp, Homo sapiens
accacttctacattt

SEQ ID NO: 341829 - DNA, 15 bp, Homo sapiens
ccacttctacatttt

SEQ ID NO: 341830 - DNA, 15 bp, Homo sapiens
cacttctacattttt

SEQ ID NO: 341831 - DNA, 15 bp, Homo sapiens
acttctacatttttg

SEQ ID NO: 341832 - DNA, 15 bp, Homo sapiens
cttctacatttttgt

SEQ ID NO: 341833 - DNA, 15 bp, Homo sapiens
ttctacatttttgta

SEQ ID NO: 341834 - DNA, 15 bp, Homo sapiens
tctacatttttgtat

SEQ ID NO: 341835 - DNA, 15 bp, Homo sapiens
ctacatttttgtatt

SEQ ID NO: 341836 - DNA, 15 bp, Homo sapiens
tacatttttgtatta

SEQ ID NO: 341837 - DNA, 15 bp, Homo sapiens
acatttttgtattaa

SEQ ID NO: 341838 - DNA, 15 bp, Homo sapiens
catttttgtattaat

SEQ ID NO: 341839 - DNA, 15 bp, Homo sapiens
atttttgtattaatt

SEQ ID NO: 341840 - DNA, 15 bp, Homo sapiens
tttttgtattaattc

SEQ ID NO: 341841 - DNA, 15 bp, Homo sapiens
ttttgtattaattcc

SEQ ID NO: 341842 - DNA, 15 bp, Homo sapiens
tttgtattaattcct

SEQ ID NO: 341843 - DNA, 15 bp, Homo sapiens
ttgtattaattccta

SEQ ID NO: 341844 - DNA, 15 bp, Homo sapiens
tgtattaattcctag

SEQ ID NO: 341845 - DNA, 15 bp, Homo sapiens
gtattaattcctagt

SEQ ID NO: 341846 - DNA, 15 bp, Homo sapiens
tattaattcctagta

SEQ ID NO: 341847 - DNA, 15 bp, Homo sapiens
attaattcctagtat

SEQ ID NO: 341848 - DNA, 15 bp, Homo sapiens
ttaattcctagtatg

SEQ ID NO: 341849 - DNA, 15 bp, Homo sapiens
taattcctagtatgg

SEQ ID NO: 341850 - DNA, 15 bp, Homo sapiens
aattcctagtatgga

SEQ ID NO: 341851 - DNA, 15 bp, Homo sapiens
attcctagtatggac

SEQ ID NO: 341852 - DNA, 15 bp, Homo sapiens
ttcctagtatggaca

SEQ ID NO: 341853 - DNA, 15 bp, Homo sapiens
tcctagtatggacac

SEQ ID NO: 341854 - DNA, 15 bp, Homo sapiens
cctagtatggacact

SEQ ID NO: 341855 - DNA, 15 bp, Homo sapiens
ctagtatggacactc

SEQ ID NO: 341856 - DNA, 15 bp, Homo sapiens
tagtatggacactca

SEQ ID NO: 341857 - DNA, 15 bp, Homo sapiens
agtatggacactcaa

SEQ ID NO: 341858 - DNA, 15 bp, Homo sapiens
gtatggacactcaac

SEQ ID NO: 341859 - DNA, 15 bp, Homo sapiens
tatggacactcaact

SEQ ID NO: 341860 - DNA, 15 bp, Homo sapiens
atggacactcaactc

SEQ ID NO: 341861 - DNA, 15 bp, Homo sapiens
tggacactcaactcc

SEQ ID NO: 341862 - DNA, 15 bp, Homo sapiens
ggacactcaactcct

SEQ ID NO: 341863 - DNA, 15 bp, Homo sapiens
gacactcaactcctt

SEQ ID NO: 341864 - DNA, 15 bp, Homo sapiens
acactcaactccttt

SEQ ID NO: 341865 - DNA, 15 bp, Homo sapiens
cactcaactccttta

SEQ ID NO: 341866 - DNA, 15 bp, Homo sapiens
actcaactcctttat

SEQ ID NO: 341867 - DNA, 15 bp, Homo sapiens
ctcaactcctttatg

SEQ ID NO: 341868 - DNA, 15 bp, Homo sapiens
tcaactcctttatgc

SEQ ID NO: 341869 - DNA, 15 bp, Homo sapiens
caactcctttatgct

SEQ ID NO: 341870 - DNA, 15 bp, Homo sapiens
aactcctttatgcta

SEQ ID NO: 341871 - DNA, 15 bp, Homo sapiens
actcctttatgctat

SEQ ID NO: 341872 - DNA, 15 bp, Homo sapiens
ctcctttatgctata

SEQ ID NO: 341873 - DNA, 15 bp, Homo sapiens
tcctttatgctataa

SEQ ID NO: 341874 - DNA, 15 bp, Homo sapiens
cctttatgctataaa

SEQ ID NO: 341875 - DNA, 15 bp, Homo sapiens
ctttatgctataaat

SEQ ID NO: 341876 - DNA, 15 bp, Homo sapiens
tttatgctataaatt

SEQ ID NO: 341877 - DNA, 15 bp, Homo sapiens
ttatgctataaattc

SEQ ID NO: 341878 - DNA, 15 bp, Homo sapiens
tatgctataaattct

SEQ ID NO: 341879 - DNA, 15 bp, Homo sapiens
atgctataaattctg

SEQ ID NO: 341880 - DNA, 15 bp, Homo sapiens
tgctataaattctga

SEQ ID NO: 341881 - DNA, 15 bp, Homo sapiens
gctataaattctgag

SEQ ID NO: 341882 - DNA, 15 bp, Homo sapiens
ctataaattctgagg

SEQ ID NO: 341883 - DNA, 15 bp, Homo sapiens
tataaattctgaggg

SEQ ID NO: 341884 - DNA, 15 bp, Homo sapiens
ataaattctgaggga

SEQ ID NO: 341885 - DNA, 15 bp, Homo sapiens
taaattctgagggag

SEQ ID NO: 341886 - DNA, 15 bp, Homo sapiens
aaattctgagggagg

SEQ ID NO: 341887 - DNA, 15 bp, Homo sapiens
aattctgagggaggg

SEQ ID NO: 341888 - DNA, 15 bp, Homo sapiens
attctgagggagggc

SEQ ID NO: 341889 - DNA, 15 bp, Homo sapiens
ttctgagggagggcc

SEQ ID NO: 341890 - DNA, 15 bp, Homo sapiens
tctgagggagggcca

SEQ ID NO: 341891 - DNA, 15 bp, Homo sapiens
ctgagggagggccag

SEQ ID NO: 341892 - DNA, 15 bp, Homo sapiens
tgagggagggccaga

SEQ ID NO: 341893 - DNA, 15 bp, Homo sapiens
gagggagggccagaa

SEQ ID NO: 341894 - DNA, 15 bp, Homo sapiens
agggagggccagaac

SEQ ID NO: 341895 - DNA, 15 bp, Homo sapiens
gggagggccagaact

SEQ ID NO: 341896 - DNA, 15 bp, Homo sapiens
ggagggccagaactt

SEQ ID NO: 341897 - DNA, 15 bp, Homo sapiens
gagggccagaacttg

SEQ ID NO: 341898 - DNA, 15 bp, Homo sapiens
agggccagaacttga

SEQ ID NO: 341899 - DNA, 15 bp, Homo sapiens
gggccagaacttgaa

SEQ ID NO: 341900 - DNA, 15 bp, Homo sapiens
ggccagaacttgaat

SEQ ID NO: 341901 - DNA, 15 bp, Homo sapiens
gccagaacttgaata

SEQ ID NO: 341902 - DNA, 15 bp, Homo sapiens
ccagaacttgaataa

SEQ ID NO: 341903 - DNA, 15 bp, Homo sapiens
cagaacttgaataaa

SEQ ID NO: 341904 - DNA, 15 bp, Homo sapiens
agaacttgaataaaa

SEQ ID NO: 341905 - DNA, 15 bp, Homo sapiens
gaacttgaataaaag

SEQ ID NO: 341906 - DNA, 15 bp, Homo sapiens
aacttgaataaaagt

SEQ ID NO: 341907 - DNA, 15 bp, Homo sapiens
acttgaataaaagtg

SEQ ID NO: 341908 - DNA, 15 bp, Homo sapiens
cttgaataaaagtgg

SEQ ID NO: 341909 - DNA, 15 bp, Homo sapiens
ttgaataaaagtggt

SEQ ID NO: 341910 - DNA, 15 bp, Homo sapiens
tgaataaaagtggtg

SEQ ID NO: 341911 - DNA, 15 bp, Homo sapiens
gaataaaagtggtga

SEQ ID NO: 341912 - DNA, 15 bp, Homo sapiens
aataaaagtggtgat

SEQ ID NO: 341913 - DNA, 15 bp, Homo sapiens
ataaaagtggtgata

SEQ ID NO: 341914 - DNA, 15 bp, Homo sapiens
taaaagtggtgatat

SEQ ID NO: 341915 - DNA, 15 bp, Homo sapiens
aaaagtggtgatatc

SEQ ID NO: 341916 - DNA, 15 bp, Homo sapiens
aaagtggtgatatct

SEQ ID NO: 341917 - DNA, 15 bp, Homo sapiens
aagtggtgatatctc

SEQ ID NO: 341918 - DNA, 15 bp, Homo sapiens
agtggtgatatctcc

SEQ ID NO: 341919 - DNA, 15 bp, Homo sapiens
gtggtgatatctcca

SEQ ID NO: 341920 - DNA, 15 bp, Homo sapiens
tggtgatatctccat

SEQ ID NO: 341921 - DNA, 15 bp, Homo sapiens
ggtgatatctccatt

SEQ ID NO: 341922 - DNA, 15 bp, Homo sapiens
gtgatatctccattt

SEQ ID NO: 341923 - DNA, 15 bp, Homo sapiens
tgatatctccatttg

SEQ ID NO: 341924 - DNA, 15 bp, Homo sapiens
gatatctccatttgc

SEQ ID NO: 341925 - DNA, 15 bp, Homo sapiens
atatctccatttgca

SEQ ID NO: 341926 - DNA, 15 bp, Homo sapiens
tatctccatttgcag

SEQ ID NO: 341927 - DNA, 15 bp, Homo sapiens
atctccatttgcagt

SEQ ID NO: 341928 - DNA, 15 bp, Homo sapiens
tctccatttgcagtc

SEQ ID NO: 341929 - DNA, 15 bp, Homo sapiens
ctccatttgcagtct

SEQ ID NO: 341930 - DNA, 15 bp, Homo sapiens
tccatttgcagtctg

SEQ ID NO: 341931 - DNA, 15 bp, Homo sapiens
ccatttgcagtctgt

SEQ ID NO: 341932 - DNA, 15 bp, Homo sapiens
catttgcagtctgtt

SEQ ID NO: 341933 - DNA, 15 bp, Homo sapiens
atttgcagtctgtta

SEQ ID NO: 341934 - DNA, 15 bp, Homo sapiens
tttgcagtctgttat

SEQ ID NO: 341935 - DNA, 15 bp, Homo sapiens
ttgcagtctgttata

SEQ ID NO: 341936 - DNA, 15 bp, Homo sapiens
tgcagtctgttataa

SEQ ID NO: 341937 - DNA, 15 bp, Homo sapiens
gcagtctgttataac

SEQ ID NO: 341938 - DNA, 15 bp, Homo sapiens
cagtctgttataaca

SEQ ID NO: 341939 - DNA, 15 bp, Homo sapiens
agtctgttataacac

SEQ ID NO: 341940 - DNA, 15 bp, Homo sapiens
gtctgttataacact

SEQ ID NO: 341941 - DNA, 15 bp, Homo sapiens
tctgttataacactg

SEQ ID NO: 341942 - DNA, 15 bp, Homo sapiens
ctgttataacactgc

SEQ ID NO: 341943 - DNA, 15 bp, Homo sapiens
tgttataacactgca

SEQ ID NO: 341944 - DNA, 15 bp, Homo sapiens
gttataacactgcat

SEQ ID NO: 341945 - DNA, 15 bp, Homo sapiens
ttataacactgcatc

SEQ ID NO: 341946 - DNA, 15 bp, Homo sapiens
tataacactgcatcc

SEQ ID NO: 341947 - DNA, 15 bp, Homo sapiens
ataacactgcatcct

SEQ ID NO: 341948 - DNA, 15 bp, Homo sapiens
taacactgcatcctc

SEQ ID NO: 341949 - DNA, 15 bp, Homo sapiens
aacactgcatcctca

SEQ ID NO: 341950 - DNA, 15 bp, Homo sapiens
acactgcatcctcaa

SEQ ID NO: 341951 - DNA, 15 bp, Homo sapiens
cactgcatcctcaaa

SEQ ID NO: 341952 - DNA, 15 bp, Homo sapiens
actgcatcctcaaac

SEQ ID NO: 341953 - DNA, 15 bp, Homo sapiens
ctgcatcctcaaact

SEQ ID NO: 341954 - DNA, 15 bp, Homo sapiens
tgcatcctcaaactg

SEQ ID NO: 341955 - DNA, 15 bp, Homo sapiens
gcatcctcaaactgc

SEQ ID NO: 341956 - DNA, 15 bp, Homo sapiens
catcctcaaactgcc

SEQ ID NO: 341957 - DNA, 15 bp, Homo sapiens
atcctcaaactgcct

SEQ ID NO: 341958 - DNA, 15 bp, Homo sapiens
tcctcaaactgcctt

SEQ ID NO: 341959 - DNA, 15 bp, Homo sapiens
cctcaaactgccttt

SEQ ID NO: 341960 - DNA, 15 bp, Homo sapiens
ctcaaactgcctttg

SEQ ID NO: 341961 - DNA, 15 bp, Homo sapiens
tcaaactgcctttgt

SEQ ID NO: 341962 - DNA, 15 bp, Homo sapiens
caaactgcctttgtt

SEQ ID NO: 341963 - DNA, 15 bp, Homo sapiens
aaactgcctttgttg

SEQ ID NO: 341964 - DNA, 15 bp, Homo sapiens
aactgcctttgttga

SEQ ID NO: 341965 - DNA, 15 bp, Homo sapiens
actgcctttgttgat

SEQ ID NO: 341966 - DNA, 15 bp, Homo sapiens
ctgcctttgttgata

SEQ ID NO: 341967 - DNA, 15 bp, Homo sapiens
tgcctttgttgataa

SEQ ID NO: 341968 - DNA, 15 bp, Homo sapiens
gcctttgttgataat

SEQ ID NO: 341969 - DNA, 15 bp, Homo sapiens
cctttgttgataatg

SEQ ID NO: 341970 - DNA, 15 bp, Homo sapiens
ctttgttgataatgg

SEQ ID NO: 341971 - DNA, 15 bp, Homo sapiens
tttgttgataatgga

SEQ ID NO: 341972 - DNA, 15 bp, Homo sapiens
ttgttgataatggaa

SEQ ID NO: 341973 - DNA, 15 bp, Homo sapiens
tgttgataatggaat

SEQ ID NO: 341974 - DNA, 15 bp, Homo sapiens
gttgataatggaatg

SEQ ID NO: 341975 - DNA, 15 bp, Homo sapiens
ttgataatggaatgt

SEQ ID NO: 341976 - DNA, 15 bp, Homo sapiens
tgataatggaatgta

SEQ ID NO: 341977 - DNA, 15 bp, Homo sapiens
gataatggaatgtaa

SEQ ID NO: 341978 - DNA, 15 bp, Homo sapiens
ataatggaatgtaaa

SEQ ID NO: 341979 - DNA, 15 bp, Homo sapiens
taatggaatgtaaag

SEQ ID NO: 341980 - DNA, 15 bp, Homo sapiens
aatggaatgtaaaga

SEQ ID NO: 341981 - DNA, 15 bp, Homo sapiens
atggaatgtaaagat

SEQ ID NO: 341982 - DNA, 15 bp, Homo sapiens
tggaatgtaaagatg

SEQ ID NO: 341983 - DNA, 15 bp, Homo sapiens
ggaatgtaaagatgt

SEQ ID NO: 341984 - DNA, 15 bp, Homo sapiens
gaatgtaaagatgta

SEQ ID NO: 341985 - DNA, 15 bp, Homo sapiens
aatgtaaagatgtat

SEQ ID NO: 341986 - DNA, 15 bp, Homo sapiens
atgtaaagatgtata

SEQ ID NO: 341987 - DNA, 15 bp, Homo sapiens
tgtaaagatgtataa

SEQ ID NO: 341988 - DNA, 15 bp, Homo sapiens
gtaaagatgtataat

SEQ ID NO: 341989 - DNA, 15 bp, Homo sapiens
taaagatgtataata

SEQ ID NO: 341990 - DNA, 15 bp, Homo sapiens
aaagatgtataatag

SEQ ID NO: 341991 - DNA, 15 bp, Homo sapiens
aagatgtataatagg

SEQ ID NO: 341992 - DNA, 15 bp, Homo sapiens
agatgtataatagga

SEQ ID NO: 341993 - DNA, 15 bp, Homo sapiens
gatgtataataggat

SEQ ID NO: 341994 - DNA, 15 bp, Homo sapiens
atgtataataggatt

SEQ ID NO: 341995 - DNA, 15 bp, Homo sapiens
tgtataataggatta

SEQ ID NO: 341996 - DNA, 15 bp, Homo sapiens
gtataataggattag

SEQ ID NO: 341997 - DNA, 15 bp, Homo sapiens
tataataggattagt

SEQ ID NO: 341998 - DNA, 15 bp, Homo sapiens
ataataggattagtt

SEQ ID NO: 341999 - DNA, 15 bp, Homo sapiens
taataggattagttt

SEQ ID NO: 342000 - DNA, 15 bp, Homo sapiens
aataggattagtttc

SEQ ID NO: 342001 - DNA, 15 bp, Homo sapiens
ataggattagtttca

SEQ ID NO: 342002 - DNA, 15 bp, Homo sapiens
taggattagtttcat

SEQ ID NO: 342003 - DNA, 15 bp, Homo sapiens
aggattagtttcatt

SEQ ID NO: 342004 - DNA, 15 bp, Homo sapiens
ggattagtttcatta

SEQ ID NO: 342005 - DNA, 15 bp, Homo sapiens
gattagtttcattag

SEQ ID NO: 342006 - DNA, 15 bp, Homo sapiens
attagtttcattagt

SEQ ID NO: 342007 - DNA, 15 bp, Homo sapiens
ttagtttcattagta

SEQ ID NO: 342008 - DNA, 15 bp, Homo sapiens
tagtttcattagtag

SEQ ID NO: 342009 - DNA, 15 bp, Homo sapiens
agtttcattagtaga

SEQ ID NO: 342010 - DNA, 15 bp, Homo sapiens
gtttcattagtagaa

SEQ ID NO: 342011 - DNA, 15 bp, Homo sapiens
tttcattagtagaac

SEQ ID NO: 342012 - DNA, 15 bp, Homo sapiens
ttcattagtagaaca

SEQ ID NO: 342013 - DNA, 15 bp, Homo sapiens
tcattagtagaacag

SEQ ID NO: 342014 - DNA, 15 bp, Homo sapiens
cattagtagaacagt

SEQ ID NO: 342015 - DNA, 15 bp, Homo sapiens
attagtagaacagtt

SEQ ID NO: 342016 - DNA, 15 bp, Homo sapiens
ttagtagaacagtta

SEQ ID NO: 342017 - DNA, 15 bp, Homo sapiens
tagtagaacagttag

SEQ ID NO: 342018 - DNA, 15 bp, Homo sapiens
agtagaacagttagg

SEQ ID NO: 342019 - DNA, 15 bp, Homo sapiens
gtagaacagttaggg

SEQ ID NO: 342020 - DNA, 15 bp, Homo sapiens
tagaacagttagggt

SEQ ID NO: 342021 - DNA, 15 bp, Homo sapiens
agaacagttagggta

SEQ ID NO: 342022 - DNA, 15 bp, Homo sapiens
gaacagttagggtaa

SEQ ID NO: 342023 - DNA, 15 bp, Homo sapiens
aacagttagggtaat

SEQ ID NO: 342024 - DNA, 15 bp, Homo sapiens
acagttagggtaatg

SEQ ID NO: 342025 - DNA, 15 bp, Homo sapiens
cagttagggtaatga

SEQ ID NO: 342026 - DNA, 15 bp, Homo sapiens
agttagggtaatgat

SEQ ID NO: 342027 - DNA, 15 bp, Homo sapiens
gttagggtaatgatt

SEQ ID NO: 342028 - DNA, 15 bp, Homo sapiens
ttagggtaatgattg

SEQ ID NO: 342029 - DNA, 15 bp, Homo sapiens
tagggtaatgattgg

SEQ ID NO: 342030 - DNA, 15 bp, Homo sapiens
agggtaatgattgga

SEQ ID NO: 342031 - DNA, 15 bp, Homo sapiens
gggtaatgattggaa

SEQ ID NO: 342032 - DNA, 15 bp, Homo sapiens
ggtaatgattggaaa

SEQ ID NO: 342033 - DNA, 15 bp, Homo sapiens
gtaatgattggaaat

SEQ ID NO: 342034 - DNA, 15 bp, Homo sapiens
taatgattggaaatt

SEQ ID NO: 342035 - DNA, 15 bp, Homo sapiens
aatgattggaaattt

SEQ ID NO: 342036 - DNA, 15 bp, Homo sapiens
atgattggaaattta

SEQ ID NO: 342037 - DNA, 15 bp, Homo sapiens
tgattggaaatttaa

SEQ ID NO: 342038 - DNA, 15 bp, Homo sapiens
gattggaaatttaaa

SEQ ID NO: 342039 - DNA, 15 bp, Homo sapiens
attggaaatttaaat

SEQ ID NO: 342040 - DNA, 15 bp, Homo sapiens
ttggaaatttaaata

SEQ ID NO: 342041 - DNA, 15 bp, Homo sapiens
tggaaatttaaatat

SEQ ID NO: 342042 - DNA, 15 bp, Homo sapiens
ggaaatttaaatatg

SEQ ID NO: 342043 - DNA, 15 bp, Homo sapiens
gaaatttaaatatga

SEQ ID NO: 342044 - DNA, 15 bp, Homo sapiens
aaatttaaatatgat

SEQ ID NO: 342045 - DNA, 15 bp, Homo sapiens
aatttaaatatgatg

SEQ ID NO: 342046 - DNA, 15 bp, Homo sapiens
atttaaatatgatgc

SEQ ID NO: 342047 - DNA, 15 bp, Homo sapiens
tttaaatatgatgcc

SEQ ID NO: 342048 - DNA, 15 bp, Homo sapiens
ttaaatatgatgcct

SEQ ID NO: 342049 - DNA, 15 bp, Homo sapiens
taaatatgatgcctc

SEQ ID NO: 342050 - DNA, 15 bp, Homo sapiens
aaatatgatgcctca

SEQ ID NO: 342051 - DNA, 15 bp, Homo sapiens
aatatgatgcctcat

SEQ ID NO: 342052 - DNA, 15 bp, Homo sapiens
atatgatgcctcatt

SEQ ID NO: 342053 - DNA, 15 bp, Homo sapiens
tatgatgcctcatta

SEQ ID NO: 342054 - DNA, 15 bp, Homo sapiens
atgatgcctcattaa

SEQ ID NO: 342055 - DNA, 15 bp, Homo sapiens
tgatgcctcattaac

SEQ ID NO: 342056 - DNA, 15 bp, Homo sapiens
gatgcctcattaact

SEQ ID NO: 342057 - DNA, 15 bp, Homo sapiens
atgcctcattaactg

SEQ ID NO: 342058 - DNA, 15 bp, Homo sapiens
tgcctcattaactgt

SEQ ID NO: 342059 - DNA, 15 bp, Homo sapiens
gcctcattaactgtc

SEQ ID NO: 342060 - DNA, 15 bp, Homo sapiens
cctcattaactgtcc

SEQ ID NO: 342061 - DNA, 15 bp, Homo sapiens
ctcattaactgtcct

SEQ ID NO: 342062 - DNA, 15 bp, Homo sapiens
tcattaactgtcctt

SEQ ID NO: 342063 - DNA, 15 bp, Homo sapiens
cattaactgtcctta

SEQ ID NO: 342064 - DNA, 15 bp, Homo sapiens
attaactgtccttaa

SEQ ID NO: 342065 - DNA, 15 bp, Homo sapiens
ttaactgtccttaat

SEQ ID NO: 342066 - DNA, 15 bp, Homo sapiens
taactgtccttaatt

SEQ ID NO: 342067 - DNA, 15 bp, Homo sapiens
aactgtccttaatta

SEQ ID NO: 342068 - DNA, 15 bp, Homo sapiens
actgtccttaattac

SEQ ID NO: 342069 - DNA, 15 bp, Homo sapiens
ctgtccttaattact

SEQ ID NO: 342070 - DNA, 15 bp, Homo sapiens
tgtccttaattacta

SEQ ID NO: 342071 - DNA, 15 bp, Homo sapiens
gtccttaattactat

SEQ ID NO: 342072 - DNA, 15 bp, Homo sapiens
tccttaattactatt

SEQ ID NO: 342073 - DNA, 15 bp, Homo sapiens
ccttaattactattg

SEQ ID NO: 342074 - DNA, 15 bp, Homo sapiens
cttaattactattga

SEQ ID NO: 342075 - DNA, 15 bp, Homo sapiens
ttaattactattgac

SEQ ID NO: 342076 - DNA, 15 bp, Homo sapiens
taattactattgaca

SEQ ID NO: 342077 - DNA, 15 bp, Homo sapiens
aattactattgacaa

SEQ ID NO: 342078 - DNA, 15 bp, Homo sapiens
attactattgacaac

SEQ ID NO: 342079 - DNA, 15 bp, Homo sapiens
ttactattgacaact

SEQ ID NO: 342080 - DNA, 15 bp, Homo sapiens
tactattgacaactg

SEQ ID NO: 342081 - DNA, 15 bp, Homo sapiens
actattgacaactga

SEQ ID NO: 342082 - DNA, 15 bp, Homo sapiens
ctattgacaactgag

SEQ ID NO: 342083 - DNA, 15 bp, Homo sapiens
tattgacaactgagt

SEQ ID NO: 342084 - DNA, 15 bp, Homo sapiens
attgacaactgagtg

SEQ ID NO: 342085 - DNA, 15 bp, Homo sapiens
ttgacaactgagtgc

SEQ ID NO: 342086 - DNA, 15 bp, Homo sapiens
tgacaactgagtgcg

SEQ ID NO: 342087 - DNA, 15 bp, Homo sapiens
gacaactgagtgcgt

SEQ ID NO: 342088 - DNA, 15 bp, Homo sapiens
acaactgagtgcgtt

SEQ ID NO: 342089 - DNA, 15 bp, Homo sapiens
caactgagtgcgttt

SEQ ID NO: 342090 - DNA, 15 bp, Homo sapiens
aactgagtgcgtttt

SEQ ID NO: 342091 - DNA, 15 bp, Homo sapiens
actgagtgcgtttta

SEQ ID NO: 342092 - DNA, 15 bp, Homo sapiens
ctgagtgcgttttaa

SEQ ID NO: 342093 - DNA, 15 bp, Homo sapiens
tgagtgcgttttaaa

SEQ ID NO: 342094 - DNA, 15 bp, Homo sapiens
gagtgcgttttaaat

SEQ ID NO: 342095 - DNA, 15 bp, Homo sapiens
agtgcgttttaaata

SEQ ID NO: 342096 - DNA, 15 bp, Homo sapiens
gtgcgttttaaatag

SEQ ID NO: 342097 - DNA, 15 bp, Homo sapiens
tgcgttttaaatagg

SEQ ID NO: 342098 - DNA, 15 bp, Homo sapiens
gcgttttaaataggt

SEQ ID NO: 342099 - DNA, 15 bp, Homo sapiens
cgttttaaataggta

SEQ ID NO: 342100 - DNA, 15 bp, Homo sapiens
gttttaaataggtaa

SEQ ID NO: 342101 - DNA, 15 bp, Homo sapiens
ttttaaataggtaaa

SEQ ID NO: 342102 - DNA, 15 bp, Homo sapiens
tttaaataggtaaat

SEQ ID NO: 342103 - DNA, 15 bp, Homo sapiens
ttaaataggtaaatg

SEQ ID NO: 342104 - DNA, 15 bp, Homo sapiens
taaataggtaaatgt

SEQ ID NO: 342105 - DNA, 15 bp, Homo sapiens
aaataggtaaatgtg

SEQ ID NO: 342106 - DNA, 15 bp, Homo sapiens
aataggtaaatgtga

SEQ ID NO: 342107 - DNA, 15 bp, Homo sapiens
ataggtaaatgtgaa

SEQ ID NO: 342108 - DNA, 15 bp, Homo sapiens
taggtaaatgtgaaa

SEQ ID NO: 342109 - DNA, 15 bp, Homo sapiens
aggtaaatgtgaaag

SEQ ID NO: 342110 - DNA, 15 bp, Homo sapiens
ggtaaatgtgaaagt

SEQ ID NO: 342111 - DNA, 15 bp, Homo sapiens
gtaaatgtgaaagta

SEQ ID NO: 342112 - DNA, 15 bp, Homo sapiens
taaatgtgaaagtag

SEQ ID NO: 342113 - DNA, 15 bp, Homo sapiens
aaatgtgaaagtaga

SEQ ID NO: 342114 - DNA, 15 bp, Homo sapiens
aatgtgaaagtagaa

SEQ ID NO: 342115 - DNA, 15 bp, Homo sapiens
atgtgaaagtagaaa

SEQ ID NO: 342116 - DNA, 15 bp, Homo sapiens
tgtgaaagtagaaat

SEQ ID NO: 342117 - DNA, 15 bp, Homo sapiens
gtgaaagtagaaata

SEQ ID NO: 342118 - DNA, 15 bp, Homo sapiens
tgaaagtagaaataa

SEQ ID NO: 342119 - DNA, 15 bp, Homo sapiens
gaaagtagaaataat

SEQ ID NO: 342120 - DNA, 15 bp, Homo sapiens
aaagtagaaataatg

SEQ ID NO: 342121 - DNA, 15 bp, Homo sapiens
aagtagaaataatgg

SEQ ID NO: 342122 - DNA, 15 bp, Homo sapiens
agtagaaataatggt

SEQ ID NO: 342123 - DNA, 15 bp, Homo sapiens
gtagaaataatggtt

SEQ ID NO: 342124 - DNA, 15 bp, Homo sapiens
tagaaataatggttt

SEQ ID NO: 342125 - DNA, 15 bp, Homo sapiens
agaaataatggttta

SEQ ID NO: 342126 - DNA, 15 bp, Homo sapiens
gaaataatggtttat

SEQ ID NO: 342127 - DNA, 15 bp, Homo sapiens
aaataatggtttatc

SEQ ID NO: 342128 - DNA, 15 bp, Homo sapiens
aataatggtttatct

SEQ ID NO: 342129 - DNA, 15 bp, Homo sapiens
ataatggtttatctt

SEQ ID NO: 342130 - DNA, 15 bp, Homo sapiens
taatggtttatctta

SEQ ID NO: 342131 - DNA, 15 bp, Homo sapiens
aatggtttatcttaa

SEQ ID NO: 342132 - DNA, 15 bp, Homo sapiens
atggtttatcttaat

SEQ ID NO: 342133 - DNA, 15 bp, Homo sapiens
tggtttatcttaatt

SEQ ID NO: 342134 - DNA, 15 bp, Homo sapiens
ggtttatcttaattt

SEQ ID NO: 342135 - DNA, 15 bp, Homo sapiens
gtttatcttaatttt

SEQ ID NO: 342136 - DNA, 15 bp, Homo sapiens
tttatcttaattttt

SEQ ID NO: 342137 - DNA, 15 bp, Homo sapiens
ttatcttaatttttt

SEQ ID NO: 342138 - DNA, 15 bp, Homo sapiens
tatcttaattttttt

SEQ ID NO: 342139 - DNA, 15 bp, Homo sapiens
atcttaatttttttc

SEQ ID NO: 342140 - DNA, 15 bp, Homo sapiens
tcttaatttttttct

SEQ ID NO: 342141 - DNA, 15 bp, Homo sapiens
cttaatttttttctc

SEQ ID NO: 342142 - DNA, 15 bp, Homo sapiens
ttaatttttttctct

SEQ ID NO: 342143 - DNA, 15 bp, Homo sapiens
taatttttttctcta

SEQ ID NO: 342144 - DNA, 15 bp, Homo sapiens
aatttttttctctag

SEQ ID NO: 342145 - DNA, 15 bp, Homo sapiens
atttttttctctaga

SEQ ID NO: 342146 - DNA, 15 bp, Homo sapiens
tttttttctctagag

SEQ ID NO: 342147 - DNA, 15 bp, Homo sapiens
ttttttctctagagt

SEQ ID NO: 342148 - DNA, 15 bp, Homo sapiens
tttttctctagagtt

SEQ ID NO: 342149 - DNA, 15 bp, Homo sapiens
ttttctctagagttt

SEQ ID NO: 342150 - DNA, 15 bp, Homo sapiens
tttctctagagtttg

SEQ ID NO: 342151 - DNA, 15 bp, Homo sapiens
ttctctagagtttgc

SEQ ID NO: 342152 - DNA, 15 bp, Homo sapiens
tctctagagtttgca

SEQ ID NO: 342153 - DNA, 15 bp, Homo sapiens
ctctagagtttgcaa

SEQ ID NO: 342154 - DNA, 15 bp, Homo sapiens
tctagagtttgcaaa

SEQ ID NO: 342155 - DNA, 15 bp, Homo sapiens
ctagagtttgcaaag

SEQ ID NO: 342156 - DNA, 15 bp, Homo sapiens
tagagtttgcaaagt

SEQ ID NO: 342157 - DNA, 15 bp, Homo sapiens
agagtttgcaaagtg

SEQ ID NO: 342158 - DNA, 15 bp, Homo sapiens
gagtttgcaaagtga

SEQ ID NO: 342159 - DNA, 15 bp, Homo sapiens
agtttgcaaagtgat

SEQ ID NO: 342160 - DNA, 15 bp, Homo sapiens
gtttgcaaagtgatc

SEQ ID NO: 342161 - DNA, 15 bp, Homo sapiens
tttgcaaagtgatct

SEQ ID NO: 342162 - DNA, 15 bp, Homo sapiens
ttgcaaagtgatctt

SEQ ID NO: 342163 - DNA, 15 bp, Homo sapiens
tgcaaagtgatcttg

SEQ ID NO: 342164 - DNA, 15 bp, Homo sapiens
gcaaagtgatcttga

SEQ ID NO: 342165 - DNA, 15 bp, Homo sapiens
caaagtgatcttgag

SEQ ID NO: 342166 - DNA, 15 bp, Homo sapiens
aaagtgatcttgagg

SEQ ID NO: 342167 - DNA, 15 bp, Homo sapiens
aagtgatcttgaggc

SEQ ID NO: 342168 - DNA, 15 bp, Homo sapiens
agtgatcttgaggct

SEQ ID NO: 342169 - DNA, 15 bp, Homo sapiens
gtgatcttgaggctg

SEQ ID NO: 342170 - DNA, 15 bp, Homo sapiens
tgatcttgaggctga

SEQ ID NO: 342171 - DNA, 15 bp, Homo sapiens
gatcttgaggctgaa

SEQ ID NO: 342172 - DNA, 15 bp, Homo sapiens
atcttgaggctgaac

SEQ ID NO: 342173 - DNA, 15 bp, Homo sapiens
tcttgaggctgaaca

SEQ ID NO: 342174 - DNA, 15 bp, Homo sapiens
cttgaggctgaacag

SEQ ID NO: 342175 - DNA, 15 bp, Homo sapiens
ttgaggctgaacagg

SEQ ID NO: 342176 - DNA, 15 bp, Homo sapiens
tgaggctgaacaggt

SEQ ID NO: 342177 - DNA, 15 bp, Homo sapiens
gaggctgaacaggtg

SEQ ID NO: 342178 - DNA, 15 bp, Homo sapiens
aggctgaacaggtga

SEQ ID NO: 342179 - DNA, 15 bp, Homo sapiens
ggctgaacaggtgaa

SEQ ID NO: 342180 - DNA, 15 bp, Homo sapiens
gctgaacaggtgaaa

SEQ ID NO: 342181 - DNA, 15 bp, Homo sapiens
ctgaacaggtgaaag

SEQ ID NO: 342182 - DNA, 15 bp, Homo sapiens
tgaacaggtgaaagt

SEQ ID NO: 342183 - DNA, 15 bp, Homo sapiens
gaacaggtgaaagta

SEQ ID NO: 342184 - DNA, 15 bp, Homo sapiens
aacaggtgaaagtaa

SEQ ID NO: 342185 - DNA, 15 bp, Homo sapiens
acaggtgaaagtaaa

SEQ ID NO: 342186 - DNA, 15 bp, Homo sapiens
caggtgaaagtaaat

SEQ ID NO: 342187 - DNA, 15 bp, Homo sapiens
aggtgaaagtaaatt

SEQ ID NO: 342188 - DNA, 15 bp, Homo sapiens
ggtgaaagtaaattc

SEQ ID NO: 342189 - DNA, 15 bp, Homo sapiens
gtgaaagtaaattca

SEQ ID NO: 342190 - DNA, 15 bp, Homo sapiens
tgaaagtaaattcac

SEQ ID NO: 342191 - DNA, 15 bp, Homo sapiens
gaaagtaaattcact

SEQ ID NO: 342192 - DNA, 15 bp, Homo sapiens
aaagtaaattcacta

SEQ ID NO: 342193 - DNA, 15 bp, Homo sapiens
aagtaaattcactaa

SEQ ID NO: 342194 - DNA, 15 bp, Homo sapiens
agtaaattcactaac

SEQ ID NO: 342195 - DNA, 15 bp, Homo sapiens
gtaaattcactaact

SEQ ID NO: 342196 - DNA, 15 bp, Homo sapiens
taaattcactaactc

SEQ ID NO: 342197 - DNA, 15 bp, Homo sapiens
aaattcactaactca

SEQ ID NO: 342198 - DNA, 15 bp, Homo sapiens
aattcactaactcac

SEQ ID NO: 342199 - DNA, 15 bp, Homo sapiens
attcactaactcaca

SEQ ID NO: 342200 - DNA, 15 bp, Homo sapiens
ttcactaactcacat

SEQ ID NO: 342201 - DNA, 15 bp, Homo sapiens
tcactaactcacatg

SEQ ID NO: 342202 - DNA, 15 bp, Homo sapiens
cactaactcacatgg

SEQ ID NO: 342203 - DNA, 15 bp, Homo sapiens
actaactcacatggt

SEQ ID NO: 342204 - DNA, 15 bp, Homo sapiens
ctaactcacatggtg

SEQ ID NO: 342205 - DNA, 15 bp, Homo sapiens
taactcacatggtgg

SEQ ID NO: 342206 - DNA, 15 bp, Homo sapiens
aactcacatggtggt

SEQ ID NO: 342207 - DNA, 15 bp, Homo sapiens
actcacatggtggtc

SEQ ID NO: 342208 - DNA, 15 bp, Homo sapiens
ctcacatggtggtca

SEQ ID NO: 342209 - DNA, 15 bp, Homo sapiens
tcacatggtggtcat

SEQ ID NO: 342210 - DNA, 15 bp, Homo sapiens
cacatggtggtcatt

SEQ ID NO: 342211 - DNA, 15 bp, Homo sapiens
acatggtggtcattg

SEQ ID NO: 342212 - DNA, 15 bp, Homo sapiens
catggtggtcattgt

SEQ ID NO: 342213 - DNA, 15 bp, Homo sapiens
atggtggtcattgtt

SEQ ID NO: 342214 - DNA, 15 bp, Homo sapiens
tggtggtcattgttg

SEQ ID NO: 342215 - DNA, 15 bp, Homo sapiens
ggtggtcattgttga

SEQ ID NO: 342216 - DNA, 15 bp, Homo sapiens
gtggtcattgttgat

SEQ ID NO: 342217 - DNA, 15 bp, Homo sapiens
tggtcattgttgatg

SEQ ID NO: 342218 - DNA, 15 bp, Homo sapiens
ggtcattgttgatga

SEQ ID NO: 342219 - DNA, 15 bp, Homo sapiens
gtcattgttgatgaa

SEQ ID NO: 342220 - DNA, 15 bp, Homo sapiens
tcattgttgatgaaa

SEQ ID NO: 342221 - DNA, 15 bp, Homo sapiens
cattgttgatgaaaa

SEQ ID NO: 342222 - DNA, 15 bp, Homo sapiens
attgttgatgaaaac

SEQ ID NO: 342223 - DNA, 15 bp, Homo sapiens
ttgttgatgaaaaca

SEQ ID NO: 342224 - DNA, 15 bp, Homo sapiens
tgttgatgaaaacag

SEQ ID NO: 342225 - DNA, 15 bp, Homo sapiens
gttgatgaaaacagt

SEQ ID NO: 342226 - DNA, 15 bp, Homo sapiens
ttgatgaaaacagtg

SEQ ID NO: 342227 - DNA, 15 bp, Homo sapiens
tgatgaaaacagtgg

SEQ ID NO: 342228 - DNA, 15 bp, Homo sapiens
gatgaaaacagtggt

SEQ ID NO: 342229 - DNA, 15 bp, Homo sapiens
atgaaaacagtggtg

SEQ ID NO: 342230 - DNA, 15 bp, Homo sapiens
tgaaaacagtggtga

SEQ ID NO: 342231 - DNA, 15 bp, Homo sapiens
gaaaacagtggtgag

SEQ ID NO: 342232 - DNA, 15 bp, Homo sapiens
aaaacagtggtgaga

SEQ ID NO: 342233 - DNA, 15 bp, Homo sapiens
aaacagtggtgagag

SEQ ID NO: 342234 - DNA, 15 bp, Homo sapiens
aacagtggtgagagt

SEQ ID NO: 342235 - DNA, 15 bp, Homo sapiens
acagtggtgagagtg

SEQ ID NO: 342236 - DNA, 15 bp, Homo sapiens
cagtggtgagagtgc

SEQ ID NO: 342237 - DNA, 15 bp, Homo sapiens
agtggtgagagtgct

SEQ ID NO: 342238 - DNA, 15 bp, Homo sapiens
gtggtgagagtgcta

SEQ ID NO: 342239 - DNA, 15 bp, Homo sapiens
tggtgagagtgctac

SEQ ID NO: 342240 - DNA, 15 bp, Homo sapiens
ggtgagagtgctaca

SEQ ID NO: 342241 - DNA, 15 bp, Homo sapiens
gtgagagtgctacag

SEQ ID NO: 342242 - DNA, 15 bp, Homo sapiens
tgagagtgctacagc

SEQ ID NO: 342243 - DNA, 15 bp, Homo sapiens
gagagtgctacagct

SEQ ID NO: 342244 - DNA, 15 bp, Homo sapiens
agagtgctacagcta

SEQ ID NO: 342245 - DNA, 15 bp, Homo sapiens
gagtgctacagctat

SEQ ID NO: 342246 - DNA, 15 bp, Homo sapiens
agtgctacagctatc

SEQ ID NO: 342247 - DNA, 15 bp, Homo sapiens
gtgctacagctatcc

SEQ ID NO: 342248 - DNA, 15 bp, Homo sapiens
tgctacagctatcct

SEQ ID NO: 342249 - DNA, 15 bp, Homo sapiens
gctacagctatccta

SEQ ID NO: 342250 - DNA, 15 bp, Homo sapiens
ctacagctatcctag

SEQ ID NO: 342251 - DNA, 15 bp, Homo sapiens
tacagctatcctaga

SEQ ID NO: 342252 - DNA, 15 bp, Homo sapiens
acagctatcctagaa

SEQ ID NO: 342253 - DNA, 15 bp, Homo sapiens
cagctatcctagaag

SEQ ID NO: 342254 - DNA, 15 bp, Homo sapiens
agctatcctagaaga

SEQ ID NO: 342255 - DNA, 15 bp, Homo sapiens
gctatcctagaagac

SEQ ID NO: 342256 - DNA, 15 bp, Homo sapiens
ctatcctagaagacc

SEQ ID NO: 342257 - DNA, 15 bp, Homo sapiens
tatcctagaagacca

SEQ ID NO: 342258 - DNA, 15 bp, Homo sapiens
atcctagaagaccag

SEQ ID NO: 342259 - DNA, 15 bp, Homo sapiens
tcctagaagaccagt

SEQ ID NO: 342260 - DNA, 15 bp, Homo sapiens
cctagaagaccagtt

SEQ ID NO: 342261 - DNA, 15 bp, Homo sapiens
ctagaagaccagtta

SEQ ID NO: 342262 - DNA, 15 bp, Homo sapiens
tagaagaccagttac

SEQ ID NO: 342263 - DNA, 15 bp, Homo sapiens
agaagaccagttaca

SEQ ID NO: 342264 - DNA, 15 bp, Homo sapiens
gaagaccagttacag

SEQ ID NO: 342265 - DNA, 15 bp, Homo sapiens
aagaccagttacagg

SEQ ID NO: 342266 - DNA, 15 bp, Homo sapiens
agaccagttacaggt

SEQ ID NO: 342267 - DNA, 15 bp, Homo sapiens
gaccagttacaggta

SEQ ID NO: 342268 - DNA, 15 bp, Homo sapiens
accagttacaggtaa

SEQ ID NO: 342269 - DNA, 15 bp, Homo sapiens
ccagttacaggtaag

SEQ ID NO: 342270 - DNA, 15 bp, Homo sapiens
cagttacaggtaaga

SEQ ID NO: 342271 - DNA, 15 bp, Homo sapiens
agttacaggtaagag

SEQ ID NO: 342272 - DNA, 15 bp, Homo sapiens
gttacaggtaagagt

SEQ ID NO: 342273 - DNA, 15 bp, Homo sapiens
ttacaggtaagagtg

SEQ ID NO: 342274 - DNA, 15 bp, Homo sapiens
tacaggtaagagtgc

SEQ ID NO: 342275 - DNA, 15 bp, Homo sapiens
acaggtaagagtgct

SEQ ID NO: 342276 - DNA, 15 bp, Homo sapiens
caggtaagagtgctg

SEQ ID NO: 342277 - DNA, 15 bp, Homo sapiens
aggtaagagtgctgt

SEQ ID NO: 342278 - DNA, 15 bp, Homo sapiens
ggtaagagtgctgta

SEQ ID NO: 342279 - DNA, 15 bp, Homo sapiens
gtaagagtgctgtaa

SEQ ID NO: 342280 - DNA, 15 bp, Homo sapiens
taagagtgctgtaaa

SEQ ID NO: 342281 - DNA, 15 bp, Homo sapiens
aagagtgctgtaaag

SEQ ID NO: 342282 - DNA, 15 bp, Homo sapiens
agagtgctgtaaagt

SEQ ID NO: 342283 - DNA, 15 bp, Homo sapiens
gagtgctgtaaagtt

SEQ ID NO: 342284 - DNA, 15 bp, Homo sapiens
agtgctgtaaagttg

SEQ ID NO: 342285 - DNA, 15 bp, Homo sapiens
gtgctgtaaagttgg

SEQ ID NO: 342286 - DNA, 15 bp, Homo sapiens
tgctgtaaagttgga

SEQ ID NO: 342287 - DNA, 15 bp, Homo sapiens
gctgtaaagttggat

SEQ ID NO: 342288 - DNA, 15 bp, Homo sapiens
ctgtaaagttggata

SEQ ID NO: 342289 - DNA, 15 bp, Homo sapiens
tgtaaagttggataa

SEQ ID NO: 342290 - DNA, 15 bp, Homo sapiens
gtaaagttggataat

SEQ ID NO: 342291 - DNA, 15 bp, Homo sapiens
taaagttggataatc

SEQ ID NO: 342292 - DNA, 15 bp, Homo sapiens
aaagttggataatcc

SEQ ID NO: 342293 - DNA, 15 bp, Homo sapiens
aagttggataatcct

SEQ ID NO: 342294 - DNA, 15 bp, Homo sapiens
agttggataatcctg

SEQ ID NO: 342295 - DNA, 15 bp, Homo sapiens
gttggataatcctga

SEQ ID NO: 342296 - DNA, 15 bp, Homo sapiens
ttggataatcctgag

SEQ ID NO: 342297 - DNA, 15 bp, Homo sapiens
tggataatcctgagg

SEQ ID NO: 342298 - DNA, 15 bp, Homo sapiens
ggataatcctgaggg

SEQ ID NO: 342299 - DNA, 15 bp, Homo sapiens
gataatcctgaggga

SEQ ID NO: 342300 - DNA, 15 bp, Homo sapiens
ataatcctgagggac

SEQ ID NO: 342301 - DNA, 15 bp, Homo sapiens
taatcctgagggacc

SEQ ID NO: 342302 - DNA, 15 bp, Homo sapiens
aatcctgagggacct

SEQ ID NO: 342303 - DNA, 15 bp, Homo sapiens
atcctgagggacctg

SEQ ID NO: 342304 - DNA, 15 bp, Homo sapiens
tcctgagggacctgt

SEQ ID NO: 342305 - DNA, 15 bp, Homo sapiens
cctgagggacctgtg

SEQ ID NO: 342306 - DNA, 15 bp, Homo sapiens
ctgagggacctgtgg

SEQ ID NO: 342307 - DNA, 15 bp, Homo sapiens
tgagggacctgtggt

SEQ ID NO: 342308 - DNA, 15 bp, Homo sapiens
gagggacctgtggtc

SEQ ID NO: 342309 - DNA, 15 bp, Homo sapiens
agggacctgtggtct

SEQ ID NO: 342310 - DNA, 15 bp, Homo sapiens
gggacctgtggtctg

SEQ ID NO: 342311 - DNA, 15 bp, Homo sapiens
ggacctgtggtctga

SEQ ID NO: 342312 - DNA, 15 bp, Homo sapiens
gacctgtggtctgag

SEQ ID NO: 342313 - DNA, 15 bp, Homo sapiens
acctgtggtctgaga

SEQ ID NO: 342314 - DNA, 15 bp, Homo sapiens
cctgtggtctgagac

SEQ ID NO: 342315 - DNA, 15 bp, Homo sapiens
ctgtggtctgagacc

SEQ ID NO: 342316 - DNA, 15 bp, Homo sapiens
tgtggtctgagaccc

SEQ ID NO: 342317 - DNA, 15 bp, Homo sapiens
gtggtctgagaccca

SEQ ID NO: 342318 - DNA, 15 bp, Homo sapiens
tggtctgagacccaa

SEQ ID NO: 342319 - DNA, 15 bp, Homo sapiens
ggtctgagacccaat

SEQ ID NO: 342320 - DNA, 15 bp, Homo sapiens
gtctgagacccaatt

SEQ ID NO: 342321 - DNA, 15 bp, Homo sapiens
tctgagacccaatta

SEQ ID NO: 342322 - DNA, 15 bp, Homo sapiens
ctgagacccaattac

SEQ ID NO: 342323 - DNA, 15 bp, Homo sapiens
tgagacccaattaca

SEQ ID NO: 342324 - DNA, 15 bp, Homo sapiens
gagacccaattacat

SEQ ID NO: 342325 - DNA, 15 bp, Homo sapiens
agacccaattacata

SEQ ID NO: 342326 - DNA, 15 bp, Homo sapiens
gacccaattacatat

SEQ ID NO: 342327 - DNA, 15 bp, Homo sapiens
acccaattacatatt

SEQ ID NO: 342328 - DNA, 15 bp, Homo sapiens
cccaattacatattg

SEQ ID NO: 342329 - DNA, 15 bp, Homo sapiens
ccaattacatattgc

SEQ ID NO: 342330 - DNA, 15 bp, Homo sapiens
caattacatattgcc

SEQ ID NO: 342331 - DNA, 15 bp, Homo sapiens
aattacatattgccc

SEQ ID NO: 342332 - DNA, 15 bp, Homo sapiens
attacatattgccct

SEQ ID NO: 342333 - DNA, 15 bp, Homo sapiens
ttacatattgccctt

SEQ ID NO: 342334 - DNA, 15 bp, Homo sapiens
tacatattgcccttg

SEQ ID NO: 342335 - DNA, 15 bp, Homo sapiens
acatattgcccttgt

SEQ ID NO: 342336 - DNA, 15 bp, Homo sapiens
catattgcccttgtt

SEQ ID NO: 342337 - DNA, 15 bp, Homo sapiens
atattgcccttgttc

SEQ ID NO: 342338 - DNA, 15 bp, Homo sapiens
tattgcccttgttct

SEQ ID NO: 342339 - DNA, 15 bp, Homo sapiens
attgcccttgttctt

SEQ ID NO: 342340 - DNA, 15 bp, Homo sapiens
ttgcccttgttcttc

SEQ ID NO: 342341 - DNA, 15 bp, Homo sapiens
tgcccttgttcttca

SEQ ID NO: 342342 - DNA, 15 bp, Homo sapiens
gcccttgttcttcat

SEQ ID NO: 342343 - DNA, 15 bp, Homo sapiens
cccttgttcttcatg

SEQ ID NO: 342344 - DNA, 15 bp, Homo sapiens
ccttgttcttcatgt

SEQ ID NO: 342345 - DNA, 15 bp, Homo sapiens
cttgttcttcatgtc

SEQ ID NO: 342346 - DNA, 15 bp, Homo sapiens
ttgttcttcatgtcc

SEQ ID NO: 342347 - DNA, 15 bp, Homo sapiens
tgttcttcatgtcct

SEQ ID NO: 342348 - DNA, 15 bp, Homo sapiens
gttcttcatgtcctt

SEQ ID NO: 342349 - DNA, 15 bp, Homo sapiens
ttcttcatgtccttt

SEQ ID NO: 342350 - DNA, 15 bp, Homo sapiens
tcttcatgtcctttc

SEQ ID NO: 342351 - DNA, 15 bp, Homo sapiens
cttcatgtcctttct

SEQ ID NO: 342352 - DNA, 15 bp, Homo sapiens
ttcatgtcctttctc

SEQ ID NO: 342353 - DNA, 15 bp, Homo sapiens
tcatgtcctttctca

SEQ ID NO: 342354 - DNA, 15 bp, Homo sapiens
catgtcctttctcat

SEQ ID NO: 342355 - DNA, 15 bp, Homo sapiens
atgtcctttctcatt

SEQ ID NO: 342356 - DNA, 15 bp, Homo sapiens
tgtcctttctcattc

SEQ ID NO: 342357 - DNA, 15 bp, Homo sapiens
gtcctttctcattct

SEQ ID NO: 342358 - DNA, 15 bp, Homo sapiens
tcctttctcattctt

SEQ ID NO: 342359 - DNA, 15 bp, Homo sapiens
cctttctcattcttt

SEQ ID NO: 342360 - DNA, 15 bp, Homo sapiens
ctttctcattcttta

SEQ ID NO: 342361 - DNA, 15 bp, Homo sapiens
tttctcattctttat

SEQ ID NO: 342362 - DNA, 15 bp, Homo sapiens
ttctcattctttatc

SEQ ID NO: 342363 - DNA, 15 bp, Homo sapiens
tctcattctttatcc

SEQ ID NO: 342364 - DNA, 15 bp, Homo sapiens
ctcattctttatcca

SEQ ID NO: 342365 - DNA, 15 bp, Homo sapiens
tcattctttatccag

SEQ ID NO: 342366 - DNA, 15 bp, Homo sapiens
cattctttatccaga

SEQ ID NO: 342367 - DNA, 15 bp, Homo sapiens
attctttatccagaa

SEQ ID NO: 342368 - DNA, 15 bp, Homo sapiens
ttctttatccagaag

SEQ ID NO: 342369 - DNA, 15 bp, Homo sapiens
tctttatccagaagg

SEQ ID NO: 342370 - DNA, 15 bp, Homo sapiens
ctttatccagaaggg

SEQ ID NO: 342371 - DNA, 15 bp, Homo sapiens
tttatccagaagggt

SEQ ID NO: 342372 - DNA, 15 bp, Homo sapiens
ttatccagaagggta

SEQ ID NO: 342373 - DNA, 15 bp, Homo sapiens
tatccagaagggtag

SEQ ID NO: 342374 - DNA, 15 bp, Homo sapiens
atccagaagggtaga

SEQ ID NO: 342375 - DNA, 15 bp, Homo sapiens
tccagaagggtagaa

SEQ ID NO: 342376 - DNA, 15 bp, Homo sapiens
ccagaagggtagaaa

SEQ ID NO: 342377 - DNA, 15 bp, Homo sapiens
cagaagggtagaaaa

SEQ ID NO: 342378 - DNA, 15 bp, Homo sapiens
agaagggtagaaaaa

SEQ ID NO: 342379 - DNA, 15 bp, Homo sapiens
gaagggtagaaaaac

SEQ ID NO: 342380 - DNA, 15 bp, Homo sapiens
aagggtagaaaaacc

SEQ ID NO: 342381 - DNA, 15 bp, Homo sapiens
agggtagaaaaacct

SEQ ID NO: 342382 - DNA, 15 bp, Homo sapiens
gggtagaaaaaccta

SEQ ID NO: 342383 - DNA, 15 bp, Homo sapiens
ggtagaaaaacctac

SEQ ID NO: 342384 - DNA, 15 bp, Homo sapiens
gtagaaaaacctacc

SEQ ID NO: 342385 - DNA, 15 bp, Homo sapiens
tagaaaaacctacct

SEQ ID NO: 342386 - DNA, 15 bp, Homo sapiens
agaaaaacctacctt

SEQ ID NO: 342387 - DNA, 15 bp, Homo sapiens
gaaaaacctaccttt

SEQ ID NO: 342388 - DNA, 15 bp, Homo sapiens
aaaaacctacctttg

SEQ ID NO: 342389 - DNA, 15 bp, Homo sapiens
aaaacctacctttga

SEQ ID NO: 342390 - DNA, 15 bp, Homo sapiens
aaacctacctttgat

SEQ ID NO: 342391 - DNA, 15 bp, Homo sapiens
aacctacctttgatt

SEQ ID NO: 342392 - DNA, 15 bp, Homo sapiens
acctacctttgattg

SEQ ID NO: 342393 - DNA, 15 bp, Homo sapiens
cctacctttgattgt

SEQ ID NO: 342394 - DNA, 15 bp, Homo sapiens
ctacctttgattgta

SEQ ID NO: 342395 - DNA, 15 bp, Homo sapiens
tacctttgattgtac

SEQ ID NO: 342396 - DNA, 15 bp, Homo sapiens
acctttgattgtact

SEQ ID NO: 342397 - DNA, 15 bp, Homo sapiens
cctttgattgtactt

SEQ ID NO: 342398 - DNA, 15 bp, Homo sapiens
ctttgattgtacttc

SEQ ID NO: 342399 - DNA, 15 bp, Homo sapiens
tttgattgtacttct

SEQ ID NO: 342400 - DNA, 15 bp, Homo sapiens
ttgattgtacttctc

SEQ ID NO: 342401 - DNA, 15 bp, Homo sapiens
tgattgtacttctca

SEQ ID NO: 342402 - DNA, 15 bp, Homo sapiens
gattgtacttctcag

SEQ ID NO: 342403 - DNA, 15 bp, Homo sapiens
attgtacttctcagt

SEQ ID NO: 342404 - DNA, 15 bp, Homo sapiens
ttgtacttctcagtt

SEQ ID NO: 342405 - DNA, 15 bp, Homo sapiens
tgtacttctcagttg

SEQ ID NO: 342406 - DNA, 15 bp, Homo sapiens
gtacttctcagttgg

SEQ ID NO: 342407 - DNA, 15 bp, Homo sapiens
tacttctcagttggg

SEQ ID NO: 342408 - DNA, 15 bp, Homo sapiens
acttctcagttgggg

SEQ ID NO: 342409 - DNA, 15 bp, Homo sapiens
cttctcagttggggt

SEQ ID NO: 342410 - DNA, 15 bp, Homo sapiens
ttctcagttggggtt

SEQ ID NO: 342411 - DNA, 15 bp, Homo sapiens
tctcagttggggttc

SEQ ID NO: 342412 - DNA, 15 bp, Homo sapiens
ctcagttggggttct

SEQ ID NO: 342413 - DNA, 15 bp, Homo sapiens
tcagttggggttcta

SEQ ID NO: 342414 - DNA, 15 bp, Homo sapiens
cagttggggttctac

SEQ ID NO: 342415 - DNA, 15 bp, Homo sapiens
agttggggttctaca

SEQ ID NO: 342416 - DNA, 15 bp, Homo sapiens
gttggggttctacag

SEQ ID NO: 342417 - DNA, 15 bp, Homo sapiens
ttggggttctacagt

SEQ ID NO: 342418 - DNA, 15 bp, Homo sapiens
tggggttctacagtg

SEQ ID NO: 342419 - DNA, 15 bp, Homo sapiens
ggggttctacagtgt

SEQ ID NO: 342420 - DNA, 15 bp, Homo sapiens
gggttctacagtgtg

SEQ ID NO: 342421 - DNA, 15 bp, Homo sapiens
ggttctacagtgtgt

SEQ ID NO: 342422 - DNA, 15 bp, Homo sapiens
gttctacagtgtgtg

SEQ ID NO: 342423 - DNA, 15 bp, Homo sapiens
ttctacagtgtgtgg

SEQ ID NO: 342424 - DNA, 15 bp, Homo sapiens
tctacagtgtgtggg

SEQ ID NO: 342425 - DNA, 15 bp, Homo sapiens
ctacagtgtgtgggc

SEQ ID NO: 342426 - DNA, 15 bp, Homo sapiens
tacagtgtgtgggct

SEQ ID NO: 342427 - DNA, 15 bp, Homo sapiens
acagtgtgtgggcta

SEQ ID NO: 342428 - DNA, 15 bp, Homo sapiens
cagtgtgtgggctac

SEQ ID NO: 342429 - DNA, 15 bp, Homo sapiens
agtgtgtgggctaca

SEQ ID NO: 342430 - DNA, 15 bp, Homo sapiens
gtgtgtgggctacag

SEQ ID NO: 342431 - DNA, 15 bp, Homo sapiens
tgtgtgggctacagg

SEQ ID NO: 342432 - DNA, 15 bp, Homo sapiens
gtgtgggctacagga

SEQ ID NO: 342433 - DNA, 15 bp, Homo sapiens
tgtgggctacaggag

SEQ ID NO: 342434 - DNA, 15 bp, Homo sapiens
gtgggctacaggagt

SEQ ID NO: 342435 - DNA, 15 bp, Homo sapiens
tgggctacaggagta

SEQ ID NO: 342436 - DNA, 15 bp, Homo sapiens
gggctacaggagtac

SEQ ID NO: 342437 - DNA, 15 bp, Homo sapiens
ggctacaggagtacc

SEQ ID NO: 342438 - DNA, 15 bp, Homo sapiens
gctacaggagtaccc

SEQ ID NO: 342439 - DNA, 15 bp, Homo sapiens
ctacaggagtaccca

SEQ ID NO: 342440 - DNA, 15 bp, Homo sapiens
tacaggagtacccag

SEQ ID NO: 342441 - DNA, 15 bp, Homo sapiens
acaggagtacccagg

SEQ ID NO: 342442 - DNA, 15 bp, Homo sapiens
caggagtacccaggt

SEQ ID NO: 342443 - DNA, 15 bp, Homo sapiens
aggagtacccaggta

SEQ ID NO: 342444 - DNA, 15 bp, Homo sapiens
ggagtacccaggtat

SEQ ID NO: 342445 - DNA, 15 bp, Homo sapiens
gagtacccaggtatt

SEQ ID NO: 342446 - DNA, 15 bp, Homo sapiens
agtacccaggtattg

SEQ ID NO: 342447 - DNA, 15 bp, Homo sapiens
gtacccaggtattga

SEQ ID NO: 342448 - DNA, 15 bp, Homo sapiens
tacccaggtattgat

SEQ ID NO: 342449 - DNA, 15 bp, Homo sapiens
acccaggtattgatt

SEQ ID NO: 342450 - DNA, 15 bp, Homo sapiens
cccaggtattgattc

SEQ ID NO: 342451 - DNA, 15 bp, Homo sapiens
ccaggtattgattcc

SEQ ID NO: 342452 - DNA, 15 bp, Homo sapiens
caggtattgattcct

SEQ ID NO: 342453 - DNA, 15 bp, Homo sapiens
aggtattgattcctt

SEQ ID NO: 342454 - DNA, 15 bp, Homo sapiens
ggtattgattccttt

SEQ ID NO: 342455 - DNA, 15 bp, Homo sapiens
gtattgattccttta

SEQ ID NO: 342456 - DNA, 15 bp, Homo sapiens
tattgattcctttac

SEQ ID NO: 342457 - DNA, 15 bp, Homo sapiens
attgattcctttact

SEQ ID NO: 342458 - DNA, 15 bp, Homo sapiens
ttgattcctttactt

SEQ ID NO: 342459 - DNA, 15 bp, Homo sapiens
tgattcctttacttc

SEQ ID NO: 342460 - DNA, 15 bp, Homo sapiens
gattcctttacttca

SEQ ID NO: 342461 - DNA, 15 bp, Homo sapiens
attcctttacttcag

SEQ ID NO: 342462 - DNA, 15 bp, Homo sapiens
ttcctttacttcagc

SEQ ID NO: 342463 - DNA, 15 bp, Homo sapiens
tcctttacttcagct

SEQ ID NO: 342464 - DNA, 15 bp, Homo sapiens
cctttacttcagctc

SEQ ID NO: 342465 - DNA, 15 bp, Homo sapiens
ctttacttcagctct

SEQ ID NO: 342466 - DNA, 15 bp, Homo sapiens
tttacttcagctctt

SEQ ID NO: 342467 - DNA, 15 bp, Homo sapiens
ttacttcagctcttg

SEQ ID NO: 342468 - DNA, 15 bp, Homo sapiens
tacttcagctcttgg

SEQ ID NO: 342469 - DNA, 15 bp, Homo sapiens
acttcagctcttggg

SEQ ID NO: 342470 - DNA, 15 bp, Homo sapiens
cttcagctcttgggg

SEQ ID NO: 342471 - DNA, 15 bp, Homo sapiens
ttcagctcttggggt

SEQ ID NO: 342472 - DNA, 15 bp, Homo sapiens
tcagctcttggggtg

SEQ ID NO: 342473 - DNA, 15 bp, Homo sapiens
cagctcttggggtga

SEQ ID NO: 342474 - DNA, 15 bp, Homo sapiens
agctcttggggtgaa

SEQ ID NO: 342475 - DNA, 15 bp, Homo sapiens
gctcttggggtgaat

SEQ ID NO: 342476 - DNA, 15 bp, Homo sapiens
ctcttggggtgaatg

SEQ ID NO: 342477 - DNA, 15 bp, Homo sapiens
tcttggggtgaatgg

SEQ ID NO: 342478 - DNA, 15 bp, Homo sapiens
cttggggtgaatgga

SEQ ID NO: 342479 - DNA, 15 bp, Homo sapiens
ttggggtgaatggat

SEQ ID NO: 342480 - DNA, 15 bp, Homo sapiens
tggggtgaatggatg

SEQ ID NO: 342481 - DNA, 15 bp, Homo sapiens
ggggtgaatggatgg

SEQ ID NO: 342482 - DNA, 15 bp, Homo sapiens
gggtgaatggatggg

SEQ ID NO: 342483 - DNA, 15 bp, Homo sapiens
ggtgaatggatgggg

SEQ ID NO: 342484 - DNA, 15 bp, Homo sapiens
gtgaatggatggggc

SEQ ID NO: 342485 - DNA, 15 bp, Homo sapiens
tgaatggatggggct

SEQ ID NO: 342486 - DNA, 15 bp, Homo sapiens
gaatggatggggctg

SEQ ID NO: 342487 - DNA, 15 bp, Homo sapiens
aatggatggggctgg

SEQ ID NO: 342488 - DNA, 15 bp, Homo sapiens
atggatggggctggt

SEQ ID NO: 342489 - DNA, 15 bp, Homo sapiens
tggatggggctggtt

SEQ ID NO: 342490 - DNA, 15 bp, Homo sapiens
ggatggggctggttg

SEQ ID NO: 342491 - DNA, 15 bp, Homo sapiens
gatggggctggttgc

SEQ ID NO: 342492 - DNA, 15 bp, Homo sapiens
atggggctggttgca

SEQ ID NO: 342493 - DNA, 15 bp, Homo sapiens
tggggctggttgcag

SEQ ID NO: 342494 - DNA, 15 bp, Homo sapiens
ggggctggttgcagt

SEQ ID NO: 342495 - DNA, 15 bp, Homo sapiens
gggctggttgcagtc

SEQ ID NO: 342496 - DNA, 15 bp, Homo sapiens
ggctggttgcagtcc

SEQ ID NO: 342497 - DNA, 15 bp, Homo sapiens
gctggttgcagtccc

SEQ ID NO: 342498 - DNA, 15 bp, Homo sapiens
ctggttgcagtcccc

SEQ ID NO: 342499 - DNA, 15 bp, Homo sapiens
tggttgcagtcccca

SEQ ID NO: 342500 - DNA, 15 bp, Homo sapiens
ggttgcagtccccag

SEQ ID NO: 342501 - DNA, 15 bp, Homo sapiens
gttgcagtccccagc

SEQ ID NO: 342502 - DNA, 15 bp, Homo sapiens
ttgcagtccccagct

SEQ ID NO: 342503 - DNA, 15 bp, Homo sapiens
tgcagtccccagctt

SEQ ID NO: 342504 - DNA, 15 bp, Homo sapiens
gcagtccccagcttc

SEQ ID NO: 342505 - DNA, 15 bp, Homo sapiens
cagtccccagcttcc

SEQ ID NO: 342506 - DNA, 15 bp, Homo sapiens
agtccccagcttcct

SEQ ID NO: 342507 - DNA, 15 bp, Homo sapiens
gtccccagcttcctt

SEQ ID NO: 342508 - DNA, 15 bp, Homo sapiens
tccccagcttccttg

SEQ ID NO: 342509 - DNA, 15 bp, Homo sapiens
ccccagcttccttgt

SEQ ID NO: 342510 - DNA, 15 bp, Homo sapiens
cccagcttccttgtg

SEQ ID NO: 342511 - DNA, 15 bp, Homo sapiens
ccagcttccttgtgc

SEQ ID NO: 342512 - DNA, 15 bp, Homo sapiens
cagcttccttgtgca

SEQ ID NO: 342513 - DNA, 15 bp, Homo sapiens
agcttccttgtgcat

SEQ ID NO: 342514 - DNA, 15 bp, Homo sapiens
gcttccttgtgcata

SEQ ID NO: 342515 - DNA, 15 bp, Homo sapiens
cttccttgtgcataa

SEQ ID NO: 342516 - DNA, 15 bp, Homo sapiens
ttccttgtgcataat

SEQ ID NO: 342517 - DNA, 15 bp, Homo sapiens
tccttgtgcataatg

SEQ ID NO: 342518 - DNA, 15 bp, Homo sapiens
ccttgtgcataatga

SEQ ID NO: 342519 - DNA, 15 bp, Homo sapiens
cttgtgcataatgac

SEQ ID NO: 342520 - DNA, 15 bp, Homo sapiens
ttgtgcataatgaca

SEQ ID NO: 342521 - DNA, 15 bp, Homo sapiens
tgtgcataatgacaa

SEQ ID NO: 342522 - DNA, 15 bp, Homo sapiens
gtgcataatgacaag

SEQ ID NO: 342523 - DNA, 15 bp, Homo sapiens
tgcataatgacaaga

SEQ ID NO: 342524 - DNA, 15 bp, Homo sapiens
gcataatgacaagat

SEQ ID NO: 342525 - DNA, 15 bp, Homo sapiens
cataatgacaagatt

SEQ ID NO: 342526 - DNA, 15 bp, Homo sapiens
ataatgacaagattt

SEQ ID NO: 342527 - DNA, 15 bp, Homo sapiens
taatgacaagatttg

SEQ ID NO: 342528 - DNA, 15 bp, Homo sapiens
aatgacaagatttgg

SEQ ID NO: 342529 - DNA, 15 bp, Homo sapiens
atgacaagatttgga

SEQ ID NO: 342530 - DNA, 15 bp, Homo sapiens
tgacaagatttggaa

SEQ ID NO: 342531 - DNA, 15 bp, Homo sapiens
gacaagatttggaag

SEQ ID NO: 342532 - DNA, 15 bp, Homo sapiens
acaagatttggaagc

SEQ ID NO: 342533 - DNA, 15 bp, Homo sapiens
caagatttggaagca

SEQ ID NO: 342534 - DNA, 15 bp, Homo sapiens
aagatttggaagcac

SEQ ID NO: 342535 - DNA, 15 bp, Homo sapiens
tgaggcaggtggatc

SEQ ID NO: 342536 - DNA, 15 bp, Homo sapiens
ggcaggtggatcact

SEQ ID NO: 342537 - DNA, 15 bp, Homo sapiens
gcaggtggatcactt

SEQ ID NO: 342538 - DNA, 15 bp, Homo sapiens
ggtggatcacttgaa

SEQ ID NO: 342539 - DNA, 15 bp, Homo sapiens
gtggatcacttgaag

SEQ ID NO: 342540 - DNA, 15 bp, Homo sapiens
tggatcacttgaagt

SEQ ID NO: 342541 - DNA, 15 bp, Homo sapiens
ggatcacttgaagtc

SEQ ID NO: 342542 - DNA, 15 bp, Homo sapiens
gttcaagactagccc

SEQ ID NO: 342543 - DNA, 15 bp, Homo sapiens
ttcaagactagcccg

SEQ ID NO: 342544 - DNA, 15 bp, Homo sapiens
tcaagactagcccgg

SEQ ID NO: 342545 - DNA, 15 bp, Homo sapiens
caagactagcccggc

SEQ ID NO: 342546 - DNA, 15 bp, Homo sapiens
aagactagcccggcc

SEQ ID NO: 342547 - DNA, 15 bp, Homo sapiens
agactagcccggcca

SEQ ID NO: 342548 - DNA, 15 bp, Homo sapiens
gactagcccggccaa

SEQ ID NO: 342549 - DNA, 15 bp, Homo sapiens
actagcccggccaac

SEQ ID NO: 342550 - DNA, 15 bp, Homo sapiens
ctagcccggccaaca

SEQ ID NO: 342551 - DNA, 15 bp, Homo sapiens
tagcccggccaacat

SEQ ID NO: 342552 - DNA, 15 bp, Homo sapiens
agcccggccaacata

SEQ ID NO: 342553 - DNA, 15 bp, Homo sapiens
gcccggccaacatag

SEQ ID NO: 342554 - DNA, 15 bp, Homo sapiens
cccggccaacatagt

SEQ ID NO: 342555 - DNA, 15 bp, Homo sapiens
ccggccaacatagtg

SEQ ID NO: 342556 - DNA, 15 bp, Homo sapiens
cggccaacatagtga

SEQ ID NO: 342557 - DNA, 15 bp, Homo sapiens
catagtgaaaccccg

SEQ ID NO: 342558 - DNA, 15 bp, Homo sapiens
atagtgaaaccccgt

SEQ ID NO: 342559 - DNA, 15 bp, Homo sapiens
tagtgaaaccccgtc

SEQ ID NO: 342560 - DNA, 15 bp, Homo sapiens
agtgaaaccccgtct

SEQ ID NO: 342561 - DNA, 15 bp, Homo sapiens
tgaaaccccgtctcc

SEQ ID NO: 342562 - DNA, 15 bp, Homo sapiens
aaccccgtctccact

SEQ ID NO: 342563 - DNA, 15 bp, Homo sapiens
accccgtctccacta

SEQ ID NO: 342564 - DNA, 15 bp, Homo sapiens
ccccgtctccactaa

SEQ ID NO: 342565 - DNA, 15 bp, Homo sapiens
cccgtctccactaaa

SEQ ID NO: 342566 - DNA, 15 bp, Homo sapiens
ccgtctccactaaaa

SEQ ID NO: 342567 - DNA, 15 bp, Homo sapiens
cgtctccactaaaaa

SEQ ID NO: 342568 - DNA, 15 bp, Homo sapiens
gtctccactaaaaat

SEQ ID NO: 342569 - DNA, 15 bp, Homo sapiens
tctccactaaaaata

SEQ ID NO: 342570 - DNA, 15 bp, Homo sapiens
ctccactaaaaatat

SEQ ID NO: 342571 - DNA, 15 bp, Homo sapiens
tccactaaaaatata

SEQ ID NO: 342572 - DNA, 15 bp, Homo sapiens
ccactaaaaatataa

SEQ ID NO: 342573 - DNA, 15 bp, Homo sapiens
cactaaaaatataaa

SEQ ID NO: 342574 - DNA, 15 bp, Homo sapiens
aaaaatataaaaata

SEQ ID NO: 342575 - DNA, 15 bp, Homo sapiens
aaaatataaaaataa

SEQ ID NO: 342576 - DNA, 15 bp, Homo sapiens
aaatataaaaataag

SEQ ID NO: 342577 - DNA, 15 bp, Homo sapiens
aatataaaaataagc

SEQ ID NO: 342578 - DNA, 15 bp, Homo sapiens
atataaaaataagcc

SEQ ID NO: 342579 - DNA, 15 bp, Homo sapiens
tataaaaataagcca

SEQ ID NO: 342580 - DNA, 15 bp, Homo sapiens
ataaaaataagccag

SEQ ID NO: 342581 - DNA, 15 bp, Homo sapiens
taaaaataagccagg

SEQ ID NO: 342582 - DNA, 15 bp, Homo sapiens
aaaaataagccaggt

SEQ ID NO: 342583 - DNA, 15 bp, Homo sapiens
aaaataagccaggtg

SEQ ID NO: 342584 - DNA, 15 bp, Homo sapiens
aaataagccaggtgt

SEQ ID NO: 342585 - DNA, 15 bp, Homo sapiens
aataagccaggtgtg

SEQ ID NO: 342586 - DNA, 15 bp, Homo sapiens
ataagccaggtgtgg

SEQ ID NO: 342587 - DNA, 15 bp, Homo sapiens
taagccaggtgtggc

SEQ ID NO: 342588 - DNA, 15 bp, Homo sapiens
aagccaggtgtggcg

SEQ ID NO: 342589 - DNA, 15 bp, Homo sapiens
agccaggtgtggcgg

SEQ ID NO: 342590 - DNA, 15 bp, Homo sapiens
gccaggtgtggcggt

SEQ ID NO: 342591 - DNA, 15 bp, Homo sapiens
ccaggtgtggcggtg

SEQ ID NO: 342592 - DNA, 15 bp, Homo sapiens
caggtgtggcggtgg

SEQ ID NO: 342593 - DNA, 15 bp, Homo sapiens
aggtgtggcggtggg

SEQ ID NO: 342594 - DNA, 15 bp, Homo sapiens
ggtgtggcggtgggt

SEQ ID NO: 342595 - DNA, 15 bp, Homo sapiens
gtgtggcggtgggtg

SEQ ID NO: 342596 - DNA, 15 bp, Homo sapiens
tgtggcggtgggtgc

SEQ ID NO: 342597 - DNA, 15 bp, Homo sapiens
gtggcggtgggtgcc

SEQ ID NO: 342598 - DNA, 15 bp, Homo sapiens
tggcggtgggtgcct

SEQ ID NO: 342599 - DNA, 15 bp, Homo sapiens
ggcggtgggtgcctg

SEQ ID NO: 342600 - DNA, 15 bp, Homo sapiens
gcggtgggtgcctgt

SEQ ID NO: 342601 - DNA, 15 bp, Homo sapiens
cggtgggtgcctgta

SEQ ID NO: 342602 - DNA, 15 bp, Homo sapiens
ggtgggtgcctgtaa

SEQ ID NO: 342603 - DNA, 15 bp, Homo sapiens
gtgggtgcctgtaat

SEQ ID NO: 342604 - DNA, 15 bp, Homo sapiens
tgggtgcctgtaatc

SEQ ID NO: 342605 - DNA, 15 bp, Homo sapiens
gggtgcctgtaatcc

SEQ ID NO: 342606 - DNA, 15 bp, Homo sapiens
gcaggagaattgctg

SEQ ID NO: 342607 - DNA, 15 bp, Homo sapiens
caggagaattgctgg

SEQ ID NO: 342608 - DNA, 15 bp, Homo sapiens
aggagaattgctgga

SEQ ID NO: 342609 - DNA, 15 bp, Homo sapiens
ggagaattgctggaa

SEQ ID NO: 342610 - DNA, 15 bp, Homo sapiens
gagaattgctggaac

SEQ ID NO: 342611 - DNA, 15 bp, Homo sapiens
agaattgctggaacc

SEQ ID NO: 342612 - DNA, 15 bp, Homo sapiens
gaattgctggaaccc

SEQ ID NO: 342613 - DNA, 15 bp, Homo sapiens
aattgctggaaccca

SEQ ID NO: 342614 - DNA, 15 bp, Homo sapiens
attgctggaacccag

SEQ ID NO: 342615 - DNA, 15 bp, Homo sapiens
ttgctggaacccagg

SEQ ID NO: 342616 - DNA, 15 bp, Homo sapiens
tgctggaacccagga

SEQ ID NO: 342617 - DNA, 15 bp, Homo sapiens
gctggaacccaggag

SEQ ID NO: 342618 - DNA, 15 bp, Homo sapiens
ctggaacccaggagg

SEQ ID NO: 342619 - DNA, 15 bp, Homo sapiens
tggaacccaggaggc

SEQ ID NO: 342620 - DNA, 15 bp, Homo sapiens
ggaacccaggaggca

SEQ ID NO: 342621 - DNA, 15 bp, Homo sapiens
gcagtgagccgagac

SEQ ID NO: 342622 - DNA, 15 bp, Homo sapiens
cagtgagccgagact

SEQ ID NO: 342623 - DNA, 15 bp, Homo sapiens
agtgagccgagactg

SEQ ID NO: 342624 - DNA, 15 bp, Homo sapiens
gtgagccgagactgt

SEQ ID NO: 342625 - DNA, 15 bp, Homo sapiens
tgagccgagactgtg

SEQ ID NO: 342626 - DNA, 15 bp, Homo sapiens
gagccgagactgtgc

SEQ ID NO: 342627 - DNA, 15 bp, Homo sapiens
agccgagactgtgcc

SEQ ID NO: 342628 - DNA, 15 bp, Homo sapiens
gccgagactgtgcca

SEQ ID NO: 342629 - DNA, 15 bp, Homo sapiens
ccgagactgtgccac

SEQ ID NO: 342630 - DNA, 15 bp, Homo sapiens
cgagactgtgccact

SEQ ID NO: 342631 - DNA, 15 bp, Homo sapiens
gagactgtgccactg

SEQ ID NO: 342632 - DNA, 15 bp, Homo sapiens
agactgtgccactgc

SEQ ID NO: 342633 - DNA, 15 bp, Homo sapiens
gactgtgccactgca

SEQ ID NO: 342634 - DNA, 15 bp, Homo sapiens
actgtgccactgcac

SEQ ID NO: 342635 - DNA, 15 bp, Homo sapiens
ctgtgccactgcact

SEQ ID NO: 342636 - DNA, 15 bp, Homo sapiens
cagcctgggagacaa

SEQ ID NO: 342637 - DNA, 15 bp, Homo sapiens
agcctgggagacaag

SEQ ID NO: 342638 - DNA, 15 bp, Homo sapiens
gcctgggagacaaga

SEQ ID NO: 342639 - DNA, 15 bp, Homo sapiens
cctgggagacaagag

SEQ ID NO: 342640 - DNA, 15 bp, Homo sapiens
ctgggagacaagagc

SEQ ID NO: 342641 - DNA, 15 bp, Homo sapiens
tgggagacaagagcg

SEQ ID NO: 342642 - DNA, 15 bp, Homo sapiens
gggagacaagagcga

SEQ ID NO: 342643 - DNA, 15 bp, Homo sapiens
ggagacaagagcgag

SEQ ID NO: 342644 - DNA, 15 bp, Homo sapiens
gagacaagagcgaga

SEQ ID NO: 342645 - DNA, 15 bp, Homo sapiens
agacaagagcgagac

SEQ ID NO: 342646 - DNA, 15 bp, Homo sapiens
gacaagagcgagact

SEQ ID NO: 342647 - DNA, 15 bp, Homo sapiens
acaagagcgagactc

SEQ ID NO: 342648 - DNA, 15 bp, Homo sapiens
caagagcgagactcc

SEQ ID NO: 342649 - DNA, 15 bp, Homo sapiens
aagagcgagactccc

SEQ ID NO: 342650 - DNA, 15 bp, Homo sapiens
agagcgagactccct

SEQ ID NO: 342651 - DNA, 15 bp, Homo sapiens
gagcgagactccctc

SEQ ID NO: 342652 - DNA, 15 bp, Homo sapiens
agcgagactccctct

SEQ ID NO: 342653 - DNA, 15 bp, Homo sapiens
gcgagactccctctc

SEQ ID NO: 342654 - DNA, 15 bp, Homo sapiens
cgagactccctctca

SEQ ID NO: 342655 - DNA, 15 bp, Homo sapiens
gagactccctctcaa

SEQ ID NO: 342656 - DNA, 15 bp, Homo sapiens
aaaaaaaaaagcaaa

SEQ ID NO: 342657 - DNA, 15 bp, Homo sapiens
aaaaaaaaagcaaat

SEQ ID NO: 342658 - DNA, 15 bp, Homo sapiens
aaaaaaaagcaaata

SEQ ID NO: 342659 - DNA, 15 bp, Homo sapiens
aaaaaaagcaaatac

SEQ ID NO: 342660 - DNA, 15 bp, Homo sapiens
aaaaaagcaaatact

SEQ ID NO: 342661 - DNA, 15 bp, Homo sapiens
aaaaagcaaatactc

SEQ ID NO: 342662 - DNA, 15 bp, Homo sapiens
aaaagcaaatactct

SEQ ID NO: 342663 - DNA, 15 bp, Homo sapiens
aaagcaaatactcta

SEQ ID NO: 342664 - DNA, 15 bp, Homo sapiens
aagcaaatactctat

SEQ ID NO: 342665 - DNA, 15 bp, Homo sapiens
agcaaatactctatt

SEQ ID NO: 342666 - DNA, 15 bp, Homo sapiens
gcaaatactctattc

SEQ ID NO: 342667 - DNA, 15 bp, Homo sapiens
caaatactctattcc

SEQ ID NO: 342668 - DNA, 15 bp, Homo sapiens
aaatactctattccc

SEQ ID NO: 342669 - DNA, 15 bp, Homo sapiens
aatactctattccca

SEQ ID NO: 342670 - DNA, 15 bp, Homo sapiens
atactctattcccac

SEQ ID NO: 342671 - DNA, 15 bp, Homo sapiens
tactctattcccaca

SEQ ID NO: 342672 - DNA, 15 bp, Homo sapiens
actctattcccacat

SEQ ID NO: 342673 - DNA, 15 bp, Homo sapiens
ctctattcccacatc

SEQ ID NO: 342674 - DNA, 15 bp, Homo sapiens
tctattcccacatct

SEQ ID NO: 342675 - DNA, 15 bp, Homo sapiens
ctattcccacatctc

SEQ ID NO: 342676 - DNA, 15 bp, Homo sapiens
tattcccacatctct

SEQ ID NO: 342677 - DNA, 15 bp, Homo sapiens
attcccacatctctc

SEQ ID NO: 342678 - DNA, 15 bp, Homo sapiens
ttcccacatctctca

SEQ ID NO: 342679 - DNA, 15 bp, Homo sapiens
tcccacatctctcag

SEQ ID NO: 342680 - DNA, 15 bp, Homo sapiens
cccacatctctcagt

SEQ ID NO: 342681 - DNA, 15 bp, Homo sapiens
ccacatctctcagtg

SEQ ID NO: 342682 - DNA, 15 bp, Homo sapiens
cacatctctcagtgt

SEQ ID NO: 342683 - DNA, 15 bp, Homo sapiens
acatctctcagtgtc

SEQ ID NO: 342684 - DNA, 15 bp, Homo sapiens
catctctcagtgtcc

SEQ ID NO: 342685 - DNA, 15 bp, Homo sapiens
atctctcagtgtcca

SEQ ID NO: 342686 - DNA, 15 bp, Homo sapiens
tctctcagtgtccat

SEQ ID NO: 342687 - DNA, 15 bp, Homo sapiens
ctctcagtgtccatt

SEQ ID NO: 342688 - DNA, 15 bp, Homo sapiens
ctcagtgtccatttt

SEQ ID NO: 342689 - DNA, 15 bp, Homo sapiens
tcagtgtccattttg

SEQ ID NO: 342690 - DNA, 15 bp, Homo sapiens
cagtgtccattttga

SEQ ID NO: 342691 - DNA, 15 bp, Homo sapiens
agtgtccattttgat

SEQ ID NO: 342692 - DNA, 15 bp, Homo sapiens
gtgtccattttgatt

SEQ ID NO: 342693 - DNA, 15 bp, Homo sapiens
tgtccattttgattc

SEQ ID NO: 342694 - DNA, 15 bp, Homo sapiens
gtccattttgattct

SEQ ID NO: 342695 - DNA, 15 bp, Homo sapiens
tccattttgattctt

SEQ ID NO: 342696 - DNA, 15 bp, Homo sapiens
ccattttgattcttt

SEQ ID NO: 342697 - DNA, 15 bp, Homo sapiens
cattttgattctttt

SEQ ID NO: 342698 - DNA, 15 bp, Homo sapiens
attttgattctttta

SEQ ID NO: 342699 - DNA, 15 bp, Homo sapiens
tttgattcttttaaa

SEQ ID NO: 342700 - DNA, 15 bp, Homo sapiens
ttgattcttttaaat

SEQ ID NO: 342701 - DNA, 15 bp, Homo sapiens
tgattcttttaaatg

SEQ ID NO: 342702 - DNA, 15 bp, Homo sapiens
gattcttttaaatgc

SEQ ID NO: 342703 - DNA, 15 bp, Homo sapiens
attcttttaaatgca

SEQ ID NO: 342704 - DNA, 15 bp, Homo sapiens
ttcttttaaatgcat

SEQ ID NO: 342705 - DNA, 15 bp, Homo sapiens
tcttttaaatgcatt

SEQ ID NO: 342706 - DNA, 15 bp, Homo sapiens
cttttaaatgcattt

SEQ ID NO: 342707 - DNA, 15 bp, Homo sapiens
ttttaaatgcatttc

SEQ ID NO: 342708 - DNA, 15 bp, Homo sapiens
tttaaatgcatttca

SEQ ID NO: 342709 - DNA, 15 bp, Homo sapiens
ttaaatgcatttcat

SEQ ID NO: 342710 - DNA, 15 bp, Homo sapiens
taaatgcatttcatt

SEQ ID NO: 342711 - DNA, 15 bp, Homo sapiens
aaatgcatttcattt

SEQ ID NO: 342712 - DNA, 15 bp, Homo sapiens
aatgcatttcatttc

SEQ ID NO: 342713 - DNA, 15 bp, Homo sapiens
atgcatttcatttcc

SEQ ID NO: 342714 - DNA, 15 bp, Homo sapiens
tgcatttcatttcca

SEQ ID NO: 342715 - DNA, 15 bp, Homo sapiens
gcatttcatttccat

SEQ ID NO: 342716 - DNA, 15 bp, Homo sapiens
catttcatttccatc

SEQ ID NO: 342717 - DNA, 15 bp, Homo sapiens
atttcatttccatct

SEQ ID NO: 342718 - DNA, 15 bp, Homo sapiens
tttcatttccatcta

SEQ ID NO: 342719 - DNA, 15 bp, Homo sapiens
ttcatttccatctat

SEQ ID NO: 342720 - DNA, 15 bp, Homo sapiens
tcatttccatctata

SEQ ID NO: 342721 - DNA, 15 bp, Homo sapiens
catttccatctataa

SEQ ID NO: 342722 - DNA, 15 bp, Homo sapiens
atttccatctataag

SEQ ID NO: 342723 - DNA, 15 bp, Homo sapiens
tttccatctataaga

SEQ ID NO: 342724 - DNA, 15 bp, Homo sapiens
ttccatctataagaa

SEQ ID NO: 342725 - DNA, 15 bp, Homo sapiens
tccatctataagaag

SEQ ID NO: 342726 - DNA, 15 bp, Homo sapiens
ccatctataagaagc

SEQ ID NO: 342727 - DNA, 15 bp, Homo sapiens
catctataagaagca

SEQ ID NO: 342728 - DNA, 15 bp, Homo sapiens
atctataagaagcaa

SEQ ID NO: 342729 - DNA, 15 bp, Homo sapiens
tctataagaagcaac

SEQ ID NO: 342730 - DNA, 15 bp, Homo sapiens
ctataagaagcaact

SEQ ID NO: 342731 - DNA, 15 bp, Homo sapiens
tataagaagcaacta

SEQ ID NO: 342732 - DNA, 15 bp, Homo sapiens
ataagaagcaactat

SEQ ID NO: 342733 - DNA, 15 bp, Homo sapiens
taagaagcaactata

SEQ ID NO: 342734 - DNA, 15 bp, Homo sapiens
aagaagcaactatat

SEQ ID NO: 342735 - DNA, 15 bp, Homo sapiens
agaagcaactatatt

SEQ ID NO: 342736 - DNA, 15 bp, Homo sapiens
gaagcaactatattc

SEQ ID NO: 342737 - DNA, 15 bp, Homo sapiens
aagcaactatattct

SEQ ID NO: 342738 - DNA, 15 bp, Homo sapiens
agcaactatattctc

SEQ ID NO: 342739 - DNA, 15 bp, Homo sapiens
gcaactatattctct

SEQ ID NO: 342740 - DNA, 15 bp, Homo sapiens
caactatattctctt

SEQ ID NO: 342741 - DNA, 15 bp, Homo sapiens
aactatattctcttc

SEQ ID NO: 342742 - DNA, 15 bp, Homo sapiens
actatattctcttca

SEQ ID NO: 342743 - DNA, 15 bp, Homo sapiens
ctatattctcttcag

SEQ ID NO: 342744 - DNA, 15 bp, Homo sapiens
tatattctcttcagg

SEQ ID NO: 342745 - DNA, 15 bp, Homo sapiens
atattctcttcaggg

SEQ ID NO: 342746 - DNA, 15 bp, Homo sapiens
tattctcttcagggg

SEQ ID NO: 342747 - DNA, 15 bp, Homo sapiens
attctcttcagggga

SEQ ID NO: 342748 - DNA, 15 bp, Homo sapiens
ttctcttcaggggaa

SEQ ID NO: 342749 - DNA, 15 bp, Homo sapiens
tctcttcaggggaaa

SEQ ID NO: 342750 - DNA, 15 bp, Homo sapiens
ctcttcaggggaaaa

SEQ ID NO: 342751 - DNA, 15 bp, Homo sapiens
tcttcaggggaaaaa

SEQ ID NO: 342752 - DNA, 15 bp, Homo sapiens
cttcaggggaaaaaa

SEQ ID NO: 342753 - DNA, 15 bp, Homo sapiens
ttcaggggaaaaaac

SEQ ID NO: 342754 - DNA, 15 bp, Homo sapiens
tcaggggaaaaaact

SEQ ID NO: 342755 - DNA, 15 bp, Homo sapiens
caggggaaaaaactc

SEQ ID NO: 342756 - DNA, 15 bp, Homo sapiens
aggggaaaaaactca

SEQ ID NO: 342757 - DNA, 15 bp, Homo sapiens
ggggaaaaaactcaa

SEQ ID NO: 342758 - DNA, 15 bp, Homo sapiens
gggaaaaaactcaag

SEQ ID NO: 342759 - DNA, 15 bp, Homo sapiens
ggaaaaaactcaagt

SEQ ID NO: 342760 - DNA, 15 bp, Homo sapiens
gaaaaaactcaagtg

SEQ ID NO: 342761 - DNA, 15 bp, Homo sapiens
aaaaaactcaagtgt

SEQ ID NO: 342762 - DNA, 15 bp, Homo sapiens
aaaaactcaagtgtg

SEQ ID NO: 342763 - DNA, 15 bp, Homo sapiens
aaaactcaagtgtgt

SEQ ID NO: 342764 - DNA, 15 bp, Homo sapiens
aaactcaagtgtgtg

SEQ ID NO: 342765 - DNA, 15 bp, Homo sapiens
aactcaagtgtgtga

SEQ ID NO: 342766 - DNA, 15 bp, Homo sapiens
actcaagtgtgtgat

SEQ ID NO: 342767 - DNA, 15 bp, Homo sapiens
ctcaagtgtgtgatg

SEQ ID NO: 342768 - DNA, 15 bp, Homo sapiens
tcaagtgtgtgatgt

SEQ ID NO: 342769 - DNA, 15 bp, Homo sapiens
caagtgtgtgatgtt

SEQ ID NO: 342770 - DNA, 15 bp, Homo sapiens
aagtgtgtgatgttt

SEQ ID NO: 342771 - DNA, 15 bp, Homo sapiens
agtgtgtgatgtttt

SEQ ID NO: 342772 - DNA, 15 bp, Homo sapiens
gtgtgtgatgttttg

SEQ ID NO: 342773 - DNA, 15 bp, Homo sapiens
tgtgtgatgttttgt

SEQ ID NO: 342774 - DNA, 15 bp, Homo sapiens
gtgtgatgttttgtg

SEQ ID NO: 342775 - DNA, 15 bp, Homo sapiens
tgtgatgttttgtgg

SEQ ID NO: 342776 - DNA, 15 bp, Homo sapiens
gtgatgttttgtggc

SEQ ID NO: 342777 - DNA, 15 bp, Homo sapiens
tgatgttttgtggct

SEQ ID NO: 342778 - DNA, 15 bp, Homo sapiens
gatgttttgtggctt

SEQ ID NO: 342779 - DNA, 15 bp, Homo sapiens
atgttttgtggctta

SEQ ID NO: 342780 - DNA, 15 bp, Homo sapiens
tgttttgtggcttac

SEQ ID NO: 342781 - DNA, 15 bp, Homo sapiens
gttttgtggcttact

SEQ ID NO: 342782 - DNA, 15 bp, Homo sapiens
ttttgtggcttacta

SEQ ID NO: 342783 - DNA, 15 bp, Homo sapiens
tttgtggcttactaa

SEQ ID NO: 342784 - DNA, 15 bp, Homo sapiens
ttgtggcttactaaa

SEQ ID NO: 342785 - DNA, 15 bp, Homo sapiens
tgtggcttactaaat

SEQ ID NO: 342786 - DNA, 15 bp, Homo sapiens
gtggcttactaaata

SEQ ID NO: 342787 - DNA, 15 bp, Homo sapiens
tggcttactaaatat

SEQ ID NO: 342788 - DNA, 15 bp, Homo sapiens
ggcttactaaatatg

SEQ ID NO: 342789 - DNA, 15 bp, Homo sapiens
gcttactaaatatgg

SEQ ID NO: 342790 - DNA, 15 bp, Homo sapiens
cttactaaatatggt

SEQ ID NO: 342791 - DNA, 15 bp, Homo sapiens
ttactaaatatggtg

SEQ ID NO: 342792 - DNA, 15 bp, Homo sapiens
tactaaatatggtgg

SEQ ID NO: 342793 - DNA, 15 bp, Homo sapiens
actaaatatggtggc

SEQ ID NO: 342794 - DNA, 15 bp, Homo sapiens
ctaaatatggtggca

SEQ ID NO: 342795 - DNA, 15 bp, Homo sapiens
taaatatggtggcag

SEQ ID NO: 342796 - DNA, 15 bp, Homo sapiens
aaatatggtggcaga

SEQ ID NO: 342797 - DNA, 15 bp, Homo sapiens
aatatggtggcagat

SEQ ID NO: 342798 - DNA, 15 bp, Homo sapiens
atatggtggcagata

SEQ ID NO: 342799 - DNA, 15 bp, Homo sapiens
tatggtggcagatag

SEQ ID NO: 342800 - DNA, 15 bp, Homo sapiens
atggtggcagatagt

SEQ ID NO: 342801 - DNA, 15 bp, Homo sapiens
tggtggcagatagtt

SEQ ID NO: 342802 - DNA, 15 bp, Homo sapiens
ggtggcagatagttg

SEQ ID NO: 342803 - DNA, 15 bp, Homo sapiens
gtggcagatagttgc

SEQ ID NO: 342804 - DNA, 15 bp, Homo sapiens
tggcagatagttgca

SEQ ID NO: 342805 - DNA, 15 bp, Homo sapiens
ggcagatagttgcag

SEQ ID NO: 342806 - DNA, 15 bp, Homo sapiens
gcagatagttgcaga

SEQ ID NO: 342807 - DNA, 15 bp, Homo sapiens
cagatagttgcagaa

SEQ ID NO: 342808 - DNA, 15 bp, Homo sapiens
agatagttgcagaat

SEQ ID NO: 342809 - DNA, 15 bp, Homo sapiens
gatagttgcagaatt

SEQ ID NO: 342810 - DNA, 15 bp, Homo sapiens
atagttgcagaattt

SEQ ID NO: 342811 - DNA, 15 bp, Homo sapiens
tagttgcagaatttg

SEQ ID NO: 342812 - DNA, 15 bp, Homo sapiens
agttgcagaatttgt

SEQ ID NO: 342813 - DNA, 15 bp, Homo sapiens
gttgcagaatttgtc

SEQ ID NO: 342814 - DNA, 15 bp, Homo sapiens
ttgcagaatttgtcc

SEQ ID NO: 342815 - DNA, 15 bp, Homo sapiens
tgcagaatttgtcca

SEQ ID NO: 342816 - DNA, 15 bp, Homo sapiens
gcagaatttgtccaa

SEQ ID NO: 342817 - DNA, 15 bp, Homo sapiens
cagaatttgtccaaa

SEQ ID NO: 342818 - DNA, 15 bp, Homo sapiens
agaatttgtccaaat

SEQ ID NO: 342819 - DNA, 15 bp, Homo sapiens
gaatttgtccaaata

SEQ ID NO: 342820 - DNA, 15 bp, Homo sapiens
aatttgtccaaatat

SEQ ID NO: 342821 - DNA, 15 bp, Homo sapiens
atttgtccaaatata

SEQ ID NO: 342822 - DNA, 15 bp, Homo sapiens
tttgtccaaatataa

SEQ ID NO: 342823 - DNA, 15 bp, Homo sapiens
ttgtccaaatataaa

SEQ ID NO: 342824 - DNA, 15 bp, Homo sapiens
tgtccaaatataaat

SEQ ID NO: 342825 - DNA, 15 bp, Homo sapiens
gtccaaatataaatt

SEQ ID NO: 342826 - DNA, 15 bp, Homo sapiens
tccaaatataaattg

SEQ ID NO: 342827 - DNA, 15 bp, Homo sapiens
ccaaatataaattgt

SEQ ID NO: 342828 - DNA, 15 bp, Homo sapiens
caaatataaattgtt

SEQ ID NO: 342829 - DNA, 15 bp, Homo sapiens
aaatataaattgtta

SEQ ID NO: 342830 - DNA, 15 bp, Homo sapiens
aatataaattgttaa

SEQ ID NO: 342831 - DNA, 15 bp, Homo sapiens
atataaattgttaat

SEQ ID NO: 342832 - DNA, 15 bp, Homo sapiens
tataaattgttaatg

SEQ ID NO: 342833 - DNA, 15 bp, Homo sapiens
ataaattgttaatga

SEQ ID NO: 342834 - DNA, 15 bp, Homo sapiens
taaattgttaatgac

SEQ ID NO: 342835 - DNA, 15 bp, Homo sapiens
aaattgttaatgact

SEQ ID NO: 342836 - DNA, 15 bp, Homo sapiens
aattgttaatgacta

SEQ ID NO: 342837 - DNA, 15 bp, Homo sapiens
attgttaatgactac

SEQ ID NO: 342838 - DNA, 15 bp, Homo sapiens
ttgttaatgactact

SEQ ID NO: 342839 - DNA, 15 bp, Homo sapiens
tgttaatgactactt

SEQ ID NO: 342840 - DNA, 15 bp, Homo sapiens
gttaatgactacttc

SEQ ID NO: 342841 - DNA, 15 bp, Homo sapiens
ttaatgactacttcc

SEQ ID NO: 342842 - DNA, 15 bp, Homo sapiens
taatgactacttccc

SEQ ID NO: 342843 - DNA, 15 bp, Homo sapiens
aatgactacttcccc

SEQ ID NO: 342844 - DNA, 15 bp, Homo sapiens
atgactacttccccc

SEQ ID NO: 342845 - DNA, 15 bp, Homo sapiens
tgactacttcccccc

SEQ ID NO: 342846 - DNA, 15 bp, Homo sapiens
gactacttccccccc

SEQ ID NO: 342847 - DNA, 15 bp, Homo sapiens
actacttcccccccc

SEQ ID NO: 342848 - DNA, 15 bp, Homo sapiens
ctacttccccccccg

SEQ ID NO: 342849 - DNA, 15 bp, Homo sapiens
tacttccccccccgc

SEQ ID NO: 342850 - DNA, 15 bp, Homo sapiens
acttccccccccgcc

SEQ ID NO: 342851 - DNA, 15 bp, Homo sapiens
cttccccccccgccc

SEQ ID NO: 342852 - DNA, 15 bp, Homo sapiens
ttccccccccgccct

SEQ ID NO: 342853 - DNA, 15 bp, Homo sapiens
tccccccccgccctc

SEQ ID NO: 342854 - DNA, 15 bp, Homo sapiens
ccccccccgccctca

SEQ ID NO: 342855 - DNA, 15 bp, Homo sapiens
cccccccgccctcaa

SEQ ID NO: 342856 - DNA, 15 bp, Homo sapiens
ccccccgccctcaat

SEQ ID NO: 342857 - DNA, 15 bp, Homo sapiens
cccccgccctcaatc

SEQ ID NO: 342858 - DNA, 15 bp, Homo sapiens
ccccgccctcaatct

SEQ ID NO: 342859 - DNA, 15 bp, Homo sapiens
cccgccctcaatctg

SEQ ID NO: 342860 - DNA, 15 bp, Homo sapiens
ccgccctcaatctgt

SEQ ID NO: 342861 - DNA, 15 bp, Homo sapiens
cgccctcaatctgtg

SEQ ID NO: 342862 - DNA, 15 bp, Homo sapiens
gccctcaatctgtgg

SEQ ID NO: 342863 - DNA, 15 bp, Homo sapiens
ccctcaatctgtggt

SEQ ID NO: 342864 - DNA, 15 bp, Homo sapiens
cctcaatctgtggtc

SEQ ID NO: 342865 - DNA, 15 bp, Homo sapiens
ctcaatctgtggtca

SEQ ID NO: 342866 - DNA, 15 bp, Homo sapiens
tcaatctgtggtcag

SEQ ID NO: 342867 - DNA, 15 bp, Homo sapiens
caatctgtggtcaga

SEQ ID NO: 342868 - DNA, 15 bp, Homo sapiens
aatctgtggtcagat

SEQ ID NO: 342869 - DNA, 15 bp, Homo sapiens
atctgtggtcagatt

SEQ ID NO: 342870 - DNA, 15 bp, Homo sapiens
tctgtggtcagattt

SEQ ID NO: 342871 - DNA, 15 bp, Homo sapiens
ctgtggtcagatttt

SEQ ID NO: 342872 - DNA, 15 bp, Homo sapiens
tgtggtcagattttt

SEQ ID NO: 342873 - DNA, 15 bp, Homo sapiens
gtggtcagatttttc

SEQ ID NO: 342874 - DNA, 15 bp, Homo sapiens
tggtcagatttttct

SEQ ID NO: 342875 - DNA, 15 bp, Homo sapiens
ggtcagatttttctt

SEQ ID NO: 342876 - DNA, 15 bp, Homo sapiens
gtcagatttttctta

SEQ ID NO: 342877 - DNA, 15 bp, Homo sapiens
tcagatttttcttat

SEQ ID NO: 342878 - DNA, 15 bp, Homo sapiens
cagatttttcttatt

SEQ ID NO: 342879 - DNA, 15 bp, Homo sapiens
agatttttcttatta

SEQ ID NO: 342880 - DNA, 15 bp, Homo sapiens
gatttttcttattag

SEQ ID NO: 342881 - DNA, 15 bp, Homo sapiens
atttttcttattagg

SEQ ID NO: 342882 - DNA, 15 bp, Homo sapiens
tttttcttattagga

SEQ ID NO: 342883 - DNA, 15 bp, Homo sapiens
ttttcttattaggaa

SEQ ID NO: 342884 - DNA, 15 bp, Homo sapiens
tttcttattaggaat

SEQ ID NO: 342885 - DNA, 15 bp, Homo sapiens
ttcttattaggaatc

SEQ ID NO: 342886 - DNA, 15 bp, Homo sapiens
tcttattaggaatca

SEQ ID NO: 342887 - DNA, 15 bp, Homo sapiens
cttattaggaatcac

SEQ ID NO: 342888 - DNA, 15 bp, Homo sapiens
ttattaggaatcaca

SEQ ID NO: 342889 - DNA, 15 bp, Homo sapiens
tattaggaatcacaa

SEQ ID NO: 342890 - DNA, 15 bp, Homo sapiens
attaggaatcacaaa

SEQ ID NO: 342891 - DNA, 15 bp, Homo sapiens
ttaggaatcacaaaa

SEQ ID NO: 342892 - DNA, 15 bp, Homo sapiens
taggaatcacaaaag

SEQ ID NO: 342893 - DNA, 15 bp, Homo sapiens
aggaatcacaaaagg

SEQ ID NO: 342894 - DNA, 15 bp, Homo sapiens
ggaatcacaaaaggg

SEQ ID NO: 342895 - DNA, 15 bp, Homo sapiens
gaatcacaaaaggga

SEQ ID NO: 342896 - DNA, 15 bp, Homo sapiens
aatcacaaaagggac

SEQ ID NO: 342897 - DNA, 15 bp, Homo sapiens
atcacaaaagggacc

SEQ ID NO: 342898 - DNA, 15 bp, Homo sapiens
tcacaaaagggacct

SEQ ID NO: 342899 - DNA, 15 bp, Homo sapiens
cacaaaagggacctg

SEQ ID NO: 342900 - DNA, 15 bp, Homo sapiens
acaaaagggacctga

SEQ ID NO: 342901 - DNA, 15 bp, Homo sapiens
caaaagggacctgat

SEQ ID NO: 342902 - DNA, 15 bp, Homo sapiens
aaaagggacctgatt

SEQ ID NO: 342903 - DNA, 15 bp, Homo sapiens
aaagggacctgattc

SEQ ID NO: 342904 - DNA, 15 bp, Homo sapiens
aagggacctgattct

SEQ ID NO: 342905 - DNA, 15 bp, Homo sapiens
agggacctgattctg

SEQ ID NO: 342906 - DNA, 15 bp, Homo sapiens
gggacctgattctga

SEQ ID NO: 342907 - DNA, 15 bp, Homo sapiens
ggacctgattctgat

SEQ ID NO: 342908 - DNA, 15 bp, Homo sapiens
gacctgattctgatt

SEQ ID NO: 342909 - DNA, 15 bp, Homo sapiens
acctgattctgattt

SEQ ID NO: 342910 - DNA, 15 bp, Homo sapiens
cctgattctgattta

SEQ ID NO: 342911 - DNA, 15 bp, Homo sapiens
ctgattctgatttat

SEQ ID NO: 342912 - DNA, 15 bp, Homo sapiens
tgattctgatttatg

SEQ ID NO: 342913 - DNA, 15 bp, Homo sapiens
gattctgatttatga

SEQ ID NO: 342914 - DNA, 15 bp, Homo sapiens
attctgatttatgaa

SEQ ID NO: 342915 - DNA, 15 bp, Homo sapiens
ttctgatttatgaaa

SEQ ID NO: 342916 - DNA, 15 bp, Homo sapiens
tctgatttatgaaat

SEQ ID NO: 342917 - DNA, 15 bp, Homo sapiens
ctgatttatgaaatg

SEQ ID NO: 342918 - DNA, 15 bp, Homo sapiens
tgatttatgaaatgt

SEQ ID NO: 342919 - DNA, 15 bp, Homo sapiens
gatttatgaaatgtt

SEQ ID NO: 342920 - DNA, 15 bp, Homo sapiens
atttatgaaatgttt

SEQ ID NO: 342921 - DNA, 15 bp, Homo sapiens
tttatgaaatgttta

SEQ ID NO: 342922 - DNA, 15 bp, Homo sapiens
ttatgaaatgtttac

SEQ ID NO: 342923 - DNA, 15 bp, Homo sapiens
tatgaaatgtttaca

SEQ ID NO: 342924 - DNA, 15 bp, Homo sapiens
atgaaatgtttacat

SEQ ID NO: 342925 - DNA, 15 bp, Homo sapiens
tgaaatgtttacatt

SEQ ID NO: 342926 - DNA, 15 bp, Homo sapiens
gaaatgtttacattt

SEQ ID NO: 342927 - DNA, 15 bp, Homo sapiens
aaatgtttacatttc

SEQ ID NO: 342928 - DNA, 15 bp, Homo sapiens
aatgtttacatttca

SEQ ID NO: 342929 - DNA, 15 bp, Homo sapiens
atgtttacatttcat

SEQ ID NO: 342930 - DNA, 15 bp, Homo sapiens
tgtttacatttcatg

SEQ ID NO: 342931 - DNA, 15 bp, Homo sapiens
gtttacatttcatgt

SEQ ID NO: 342932 - DNA, 15 bp, Homo sapiens
tttacatttcatgtt

SEQ ID NO: 342933 - DNA, 15 bp, Homo sapiens
ttacatttcatgtta

SEQ ID NO: 342934 - DNA, 15 bp, Homo sapiens
tacatttcatgttac

SEQ ID NO: 342935 - DNA, 15 bp, Homo sapiens
acatttcatgttaca

SEQ ID NO: 342936 - DNA, 15 bp, Homo sapiens
catttcatgttacaa

SEQ ID NO: 342937 - DNA, 15 bp, Homo sapiens
atttcatgttacaaa

SEQ ID NO: 342938 - DNA, 15 bp, Homo sapiens
tttcatgttacaaat

SEQ ID NO: 342939 - DNA, 15 bp, Homo sapiens
ttcatgttacaaata

SEQ ID NO: 342940 - DNA, 15 bp, Homo sapiens
tcatgttacaaatat

SEQ ID NO: 342941 - DNA, 15 bp, Homo sapiens
catgttacaaatatt

SEQ ID NO: 342942 - DNA, 15 bp, Homo sapiens
atgttacaaatattt

SEQ ID NO: 342943 - DNA, 15 bp, Homo sapiens
tgttacaaatattta

SEQ ID NO: 342944 - DNA, 15 bp, Homo sapiens
gttacaaatatttac

SEQ ID NO: 342945 - DNA, 15 bp, Homo sapiens
ttacaaatatttaca

SEQ ID NO: 342946 - DNA, 15 bp, Homo sapiens
tacaaatatttacat

SEQ ID NO: 342947 - DNA, 15 bp, Homo sapiens
acaaatatttacatt

SEQ ID NO: 342948 - DNA, 15 bp, Homo sapiens
caaatatttacattt

SEQ ID NO: 342949 - DNA, 15 bp, Homo sapiens
aaatatttacatttc

SEQ ID NO: 342950 - DNA, 15 bp, Homo sapiens
aatatttacatttca

SEQ ID NO: 342951 - DNA, 15 bp, Homo sapiens
atatttacatttcac

SEQ ID NO: 342952 - DNA, 15 bp, Homo sapiens
tatttacatttcact

SEQ ID NO: 342953 - DNA, 15 bp, Homo sapiens
atttacatttcactt

SEQ ID NO: 342954 - DNA, 15 bp, Homo sapiens
tttacatttcacttt

SEQ ID NO: 342955 - DNA, 15 bp, Homo sapiens
ttacatttcacttta

SEQ ID NO: 342956 - DNA, 15 bp, Homo sapiens
tacatttcactttat

SEQ ID NO: 342957 - DNA, 15 bp, Homo sapiens
acatttcactttata

SEQ ID NO: 342958 - DNA, 15 bp, Homo sapiens
catttcactttataa

SEQ ID NO: 342959 - DNA, 15 bp, Homo sapiens
atttcactttataaa

SEQ ID NO: 342960 - DNA, 15 bp, Homo sapiens
tttcactttataaat

SEQ ID NO: 342961 - DNA, 15 bp, Homo sapiens
ttcactttataaata

SEQ ID NO: 342962 - DNA, 15 bp, Homo sapiens
tcactttataaatat

SEQ ID NO: 342963 - DNA, 15 bp, Homo sapiens
cactttataaatatt

SEQ ID NO: 342964 - DNA, 15 bp, Homo sapiens
actttataaatattt

SEQ ID NO: 342965 - DNA, 15 bp, Homo sapiens
ctttataaatattta

SEQ ID NO: 342966 - DNA, 15 bp, Homo sapiens
tttataaatatttat

SEQ ID NO: 342967 - DNA, 15 bp, Homo sapiens
ttataaatatttatg

SEQ ID NO: 342968 - DNA, 15 bp, Homo sapiens
tataaatatttatgt

SEQ ID NO: 342969 - DNA, 15 bp, Homo sapiens
ataaatatttatgtt

SEQ ID NO: 342970 - DNA, 15 bp, Homo sapiens
taaatatttatgttt

SEQ ID NO: 342971 - DNA, 15 bp, Homo sapiens
aaatatttatgttta

SEQ ID NO: 342972 - DNA, 15 bp, Homo sapiens
aatatttatgtttat

SEQ ID NO: 342973 - DNA, 15 bp, Homo sapiens
atatttatgtttatt

SEQ ID NO: 342974 - DNA, 15 bp, Homo sapiens
tatttatgtttattg

SEQ ID NO: 342975 - DNA, 15 bp, Homo sapiens
atttatgtttattgt

SEQ ID NO: 342976 - DNA, 15 bp, Homo sapiens
tttatgtttattgtg

SEQ ID NO: 342977 - DNA, 15 bp, Homo sapiens
ttatgtttattgtga

SEQ ID NO: 342978 - DNA, 15 bp, Homo sapiens
tatgtttattgtgaa

SEQ ID NO: 342979 - DNA, 15 bp, Homo sapiens
atgtttattgtgaac

SEQ ID NO: 342980 - DNA, 15 bp, Homo sapiens
tgtttattgtgaacc

SEQ ID NO: 342981 - DNA, 15 bp, Homo sapiens
gtttattgtgaacct

SEQ ID NO: 342982 - DNA, 15 bp, Homo sapiens
tttattgtgaacctt

SEQ ID NO: 342983 - DNA, 15 bp, Homo sapiens
ttattgtgaaccttg

SEQ ID NO: 342984 - DNA, 15 bp, Homo sapiens
tattgtgaaccttgt

SEQ ID NO: 342985 - DNA, 15 bp, Homo sapiens
attgtgaaccttgta

SEQ ID NO: 342986 - DNA, 15 bp, Homo sapiens
ttgtgaaccttgtat

SEQ ID NO: 342987 - DNA, 15 bp, Homo sapiens
tgtgaaccttgtatt

SEQ ID NO: 342988 - DNA, 15 bp, Homo sapiens
gtgaaccttgtattt

SEQ ID NO: 342989 - DNA, 15 bp, Homo sapiens
tgaaccttgtattta

SEQ ID NO: 342990 - DNA, 15 bp, Homo sapiens
gaaccttgtatttag

SEQ ID NO: 342991 - DNA, 15 bp, Homo sapiens
aaccttgtatttagg

SEQ ID NO: 342992 - DNA, 15 bp, Homo sapiens
accttgtatttaggc

SEQ ID NO: 342993 - DNA, 15 bp, Homo sapiens
ccttgtatttaggcc

SEQ ID NO: 342994 - DNA, 15 bp, Homo sapiens
cttgtatttaggcca

SEQ ID NO: 342995 - DNA, 15 bp, Homo sapiens
ttgtatttaggccaa

SEQ ID NO: 342996 - DNA, 15 bp, Homo sapiens
tgtatttaggccaaa

SEQ ID NO: 342997 - DNA, 15 bp, Homo sapiens
gtatttaggccaaaa

SEQ ID NO: 342998 - DNA, 15 bp, Homo sapiens
tatttaggccaaaaa

SEQ ID NO: 342999 - DNA, 15 bp, Homo sapiens
atttaggccaaaaag

SEQ ID NO: 343000 - DNA, 15 bp, Homo sapiens
tttaggccaaaaagt

SEQ ID NO: 343001 - DNA, 15 bp, Homo sapiens
ttaggccaaaaagtc

SEQ ID NO: 343002 - DNA, 15 bp, Homo sapiens
taggccaaaaagtct

SEQ ID NO: 343003 - DNA, 15 bp, Homo sapiens
aggccaaaaagtctc

SEQ ID NO: 343004 - DNA, 15 bp, Homo sapiens
ggccaaaaagtctca

SEQ ID NO: 343005 - DNA, 15 bp, Homo sapiens
gccaaaaagtctcag

SEQ ID NO: 343006 - DNA, 15 bp, Homo sapiens
ccaaaaagtctcaga

SEQ ID NO: 343007 - DNA, 15 bp, Homo sapiens
caaaaagtctcagaa

SEQ ID NO: 343008 - DNA, 15 bp, Homo sapiens
aaaaagtctcagaat

SEQ ID NO: 343009 - DNA, 15 bp, Homo sapiens
aaaagtctcagaata

SEQ ID NO: 343010 - DNA, 15 bp, Homo sapiens
aaagtctcagaatag

SEQ ID NO: 343011 - DNA, 15 bp, Homo sapiens
aagtctcagaatagt

SEQ ID NO: 343012 - DNA, 15 bp, Homo sapiens
agtctcagaatagtt

SEQ ID NO: 343013 - DNA, 15 bp, Homo sapiens
gtctcagaatagtta

SEQ ID NO: 343014 - DNA, 15 bp, Homo sapiens
tctcagaatagttaa

SEQ ID NO: 343015 - DNA, 15 bp, Homo sapiens
ctcagaatagttaaa

SEQ ID NO: 343016 - DNA, 15 bp, Homo sapiens
tcagaatagttaaaa

SEQ ID NO: 343017 - DNA, 15 bp, Homo sapiens
cagaatagttaaaat

SEQ ID NO: 343018 - DNA, 15 bp, Homo sapiens
agaatagttaaaatt

SEQ ID NO: 343019 - DNA, 15 bp, Homo sapiens
gaatagttaaaattt

SEQ ID NO: 343020 - DNA, 15 bp, Homo sapiens
aatagttaaaatttt

SEQ ID NO: 343021 - DNA, 15 bp, Homo sapiens
atagttaaaatttta

SEQ ID NO: 343022 - DNA, 15 bp, Homo sapiens
tagttaaaattttac

SEQ ID NO: 343023 - DNA, 15 bp, Homo sapiens
agttaaaattttact

SEQ ID NO: 343024 - DNA, 15 bp, Homo sapiens
gttaaaattttactt

SEQ ID NO: 343025 - DNA, 15 bp, Homo sapiens
ttaaaattttacttc

SEQ ID NO: 343026 - DNA, 15 bp, Homo sapiens
taaaattttacttca

SEQ ID NO: 343027 - DNA, 15 bp, Homo sapiens
aaaattttacttcaa

SEQ ID NO: 343028 - DNA, 15 bp, Homo sapiens
aaattttacttcaat

SEQ ID NO: 343029 - DNA, 15 bp, Homo sapiens
aattttacttcaata

SEQ ID NO: 343030 - DNA, 15 bp, Homo sapiens
attttacttcaataa

SEQ ID NO: 343031 - DNA, 15 bp, Homo sapiens
ttttacttcaataat

SEQ ID NO: 343032 - DNA, 15 bp, Homo sapiens
tttacttcaataatg

SEQ ID NO: 343033 - DNA, 15 bp, Homo sapiens
ttacttcaataatga

SEQ ID NO: 343034 - DNA, 15 bp, Homo sapiens
tacttcaataatgac

SEQ ID NO: 343035 - DNA, 15 bp, Homo sapiens
acttcaataatgaca

SEQ ID NO: 343036 - DNA, 15 bp, Homo sapiens
cttcaataatgacag

SEQ ID NO: 343037 - DNA, 15 bp, Homo sapiens
ttcaataatgacagt

SEQ ID NO: 343038 - DNA, 15 bp, Homo sapiens
tcaataatgacagta

SEQ ID NO: 343039 - DNA, 15 bp, Homo sapiens
caataatgacagtag

SEQ ID NO: 343040 - DNA, 15 bp, Homo sapiens
aataatgacagtaga

SEQ ID NO: 343041 - DNA, 15 bp, Homo sapiens
ataatgacagtagaa

SEQ ID NO: 343042 - DNA, 15 bp, Homo sapiens
taatgacagtagaaa

SEQ ID NO: 343043 - DNA, 15 bp, Homo sapiens
aatgacagtagaaag

SEQ ID NO: 343044 - DNA, 15 bp, Homo sapiens
atgacagtagaaagg

SEQ ID NO: 343045 - DNA, 15 bp, Homo sapiens
tgacagtagaaaggc

SEQ ID NO: 343046 - DNA, 15 bp, Homo sapiens
gacagtagaaaggct

SEQ ID NO: 343047 - DNA, 15 bp, Homo sapiens
acagtagaaaggctg

SEQ ID NO: 343048 - DNA, 15 bp, Homo sapiens
cagtagaaaggctgg

SEQ ID NO: 343049 - DNA, 15 bp, Homo sapiens
agtagaaaggctggg

SEQ ID NO: 343050 - DNA, 15 bp, Homo sapiens
gtagaaaggctgggc

SEQ ID NO: 343051 - DNA, 15 bp, Homo sapiens
tagaaaggctgggcg

SEQ ID NO: 343052 - DNA, 15 bp, Homo sapiens
agaaaggctgggcgc

SEQ ID NO: 343053 - DNA, 15 bp, Homo sapiens
gaaaggctgggcgcg

SEQ ID NO: 343054 - DNA, 15 bp, Homo sapiens
aaaggctgggcgcgg

SEQ ID NO: 343055 - DNA, 15 bp, Homo sapiens
aggctgggcgcggtg

SEQ ID NO: 343056 - DNA, 15 bp, Homo sapiens
ggctgggcgcggtgg

SEQ ID NO: 343057 - DNA, 15 bp, Homo sapiens
gctgggcgcggtgga

SEQ ID NO: 343058 - DNA, 15 bp, Homo sapiens
ctgggcgcggtggat

SEQ ID NO: 343059 - DNA, 15 bp, Homo sapiens
tgggcgcggtggatc

SEQ ID NO: 343060 - DNA, 15 bp, Homo sapiens
gggcgcggtggatca

SEQ ID NO: 343061 - DNA, 15 bp, Homo sapiens
ggcgcggtggatcac

SEQ ID NO: 343062 - DNA, 15 bp, Homo sapiens
gcgcggtggatcacg

SEQ ID NO: 343063 - DNA, 15 bp, Homo sapiens
cgcggtggatcacgc

SEQ ID NO: 343064 - DNA, 15 bp, Homo sapiens
gcggtggatcacgct

SEQ ID NO: 343065 - DNA, 15 bp, Homo sapiens
cggtggatcacgctt

SEQ ID NO: 343066 - DNA, 15 bp, Homo sapiens
ggtggatcacgcttg

SEQ ID NO: 343067 - DNA, 15 bp, Homo sapiens
gtggatcacgcttgt

SEQ ID NO: 343068 - DNA, 15 bp, Homo sapiens
tggatcacgcttgta

SEQ ID NO: 343069 - DNA, 15 bp, Homo sapiens
ggatcacgcttgtaa

SEQ ID NO: 343070 - DNA, 15 bp, Homo sapiens
gatcacgcttgtaat

SEQ ID NO: 343071 - DNA, 15 bp, Homo sapiens
atcacgcttgtaatc

SEQ ID NO: 343072 - DNA, 15 bp, Homo sapiens
tcacgcttgtaatcc

SEQ ID NO: 343073 - DNA, 15 bp, Homo sapiens
cacgcttgtaatccc

SEQ ID NO: 343074 - DNA, 15 bp, Homo sapiens
acgcttgtaatccca

SEQ ID NO: 343075 - DNA, 15 bp, Homo sapiens
cacttgaggtcagac

SEQ ID NO: 343076 - DNA, 15 bp, Homo sapiens
acttgaggtcagacc

SEQ ID NO: 343077 - DNA, 15 bp, Homo sapiens
cttgaggtcagacca

SEQ ID NO: 343078 - DNA, 15 bp, Homo sapiens
ttgaggtcagaccaa

SEQ ID NO: 343079 - DNA, 15 bp, Homo sapiens
tgaggtcagaccaac

SEQ ID NO: 343080 - DNA, 15 bp, Homo sapiens
gaggtcagaccaaca

SEQ ID NO: 343081 - DNA, 15 bp, Homo sapiens
aggtcagaccaacat

SEQ ID NO: 343082 - DNA, 15 bp, Homo sapiens
ggtcagaccaacatg

SEQ ID NO: 343083 - DNA, 15 bp, Homo sapiens
gtcagaccaacatgt

SEQ ID NO: 343084 - DNA, 15 bp, Homo sapiens
tcagaccaacatgtt

SEQ ID NO: 343085 - DNA, 15 bp, Homo sapiens
cagaccaacatgttg

SEQ ID NO: 343086 - DNA, 15 bp, Homo sapiens
agaccaacatgttga

SEQ ID NO: 343087 - DNA, 15 bp, Homo sapiens
gaccaacatgttgaa

SEQ ID NO: 343088 - DNA, 15 bp, Homo sapiens
accaacatgttgaaa

SEQ ID NO: 343089 - DNA, 15 bp, Homo sapiens
ccaacatgttgaaac

SEQ ID NO: 343090 - DNA, 15 bp, Homo sapiens
caacatgttgaaacc

SEQ ID NO: 343091 - DNA, 15 bp, Homo sapiens
aacatgttgaaacct

SEQ ID NO: 343092 - DNA, 15 bp, Homo sapiens
acatgttgaaacctg

SEQ ID NO: 343093 - DNA, 15 bp, Homo sapiens
catgttgaaacctgt

SEQ ID NO: 343094 - DNA, 15 bp, Homo sapiens
atgttgaaacctgtc

SEQ ID NO: 343095 - DNA, 15 bp, Homo sapiens
tgttgaaacctgtct

SEQ ID NO: 343096 - DNA, 15 bp, Homo sapiens
gttgaaacctgtctc

SEQ ID NO: 343097 - DNA, 15 bp, Homo sapiens
ttgaaacctgtctct

SEQ ID NO: 343098 - DNA, 15 bp, Homo sapiens
tgaaacctgtctcta

SEQ ID NO: 343099 - DNA, 15 bp, Homo sapiens
gaaacctgtctctac

SEQ ID NO: 343100 - DNA, 15 bp, Homo sapiens
aaacctgtctctact

SEQ ID NO: 343101 - DNA, 15 bp, Homo sapiens
aacctgtctctacta

SEQ ID NO: 343102 - DNA, 15 bp, Homo sapiens
acctgtctctactaa

SEQ ID NO: 343103 - DNA, 15 bp, Homo sapiens
tctctactaaaaatg

SEQ ID NO: 343104 - DNA, 15 bp, Homo sapiens
ctctactaaaaatgc

SEQ ID NO: 343105 - DNA, 15 bp, Homo sapiens
tctactaaaaatgca

SEQ ID NO: 343106 - DNA, 15 bp, Homo sapiens
ctactaaaaatgcaa

SEQ ID NO: 343107 - DNA, 15 bp, Homo sapiens
tactaaaaatgcaaa

SEQ ID NO: 343108 - DNA, 15 bp, Homo sapiens
actaaaaatgcaaaa

SEQ ID NO: 343109 - DNA, 15 bp, Homo sapiens
ctaaaaatgcaaaaa

SEQ ID NO: 343110 - DNA, 15 bp, Homo sapiens
taaaaatgcaaaaaa

SEQ ID NO: 343111 - DNA, 15 bp, Homo sapiens
aaaaatgcaaaaaat

SEQ ID NO: 343112 - DNA, 15 bp, Homo sapiens
aaaatgcaaaaaatt

SEQ ID NO: 343113 - DNA, 15 bp, Homo sapiens
aaatgcaaaaaatta

SEQ ID NO: 343114 - DNA, 15 bp, Homo sapiens
aatgcaaaaaattag

SEQ ID NO: 343115 - DNA, 15 bp, Homo sapiens
atgcaaaaaattagc

SEQ ID NO: 343116 - DNA, 15 bp, Homo sapiens
tgcaaaaaattagcc

SEQ ID NO: 343117 - DNA, 15 bp, Homo sapiens
gcaaaaaattagcca

SEQ ID NO: 343118 - DNA, 15 bp, Homo sapiens
caaaaaattagccag

SEQ ID NO: 343119 - DNA, 15 bp, Homo sapiens
aaaattagccaggcc

SEQ ID NO: 343120 - DNA, 15 bp, Homo sapiens
aaattagccaggcct

SEQ ID NO: 343121 - DNA, 15 bp, Homo sapiens
aattagccaggcctg

SEQ ID NO: 343122 - DNA, 15 bp, Homo sapiens
attagccaggcctgc

SEQ ID NO: 343123 - DNA, 15 bp, Homo sapiens
ttagccaggcctgca

SEQ ID NO: 343124 - DNA, 15 bp, Homo sapiens
tagccaggcctgcag

SEQ ID NO: 343125 - DNA, 15 bp, Homo sapiens
agccaggcctgcagt

SEQ ID NO: 343126 - DNA, 15 bp, Homo sapiens
gccaggcctgcagtg

SEQ ID NO: 343127 - DNA, 15 bp, Homo sapiens
ccaggcctgcagtgg

SEQ ID NO: 343128 - DNA, 15 bp, Homo sapiens
caggcctgcagtggg

SEQ ID NO: 343129 - DNA, 15 bp, Homo sapiens
aggcctgcagtgggc

SEQ ID NO: 343130 - DNA, 15 bp, Homo sapiens
ggcctgcagtgggca

SEQ ID NO: 343131 - DNA, 15 bp, Homo sapiens
gcctgcagtgggcac

SEQ ID NO: 343132 - DNA, 15 bp, Homo sapiens
cctgcagtgggcacc

SEQ ID NO: 343133 - DNA, 15 bp, Homo sapiens
ctgcagtgggcacct

SEQ ID NO: 343134 - DNA, 15 bp, Homo sapiens
tgcagtgggcacctg

SEQ ID NO: 343135 - DNA, 15 bp, Homo sapiens
gcagtgggcacctgt

SEQ ID NO: 343136 - DNA, 15 bp, Homo sapiens
cagtgggcacctgta

SEQ ID NO: 343137 - DNA, 15 bp, Homo sapiens
agtgggcacctgtaa

SEQ ID NO: 343138 - DNA, 15 bp, Homo sapiens
cctgtaatcccagcc

SEQ ID NO: 343139 - DNA, 15 bp, Homo sapiens
ctgtaatcccagcca

SEQ ID NO: 343140 - DNA, 15 bp, Homo sapiens
tgtaatcccagccac

SEQ ID NO: 343141 - DNA, 15 bp, Homo sapiens
gtaatcccagccact

SEQ ID NO: 343142 - DNA, 15 bp, Homo sapiens
taatcccagccactc

SEQ ID NO: 343143 - DNA, 15 bp, Homo sapiens
aatcccagccactca

SEQ ID NO: 343144 - DNA, 15 bp, Homo sapiens
atcccagccactcag

SEQ ID NO: 343145 - DNA, 15 bp, Homo sapiens
tcccagccactcagg

SEQ ID NO: 343146 - DNA, 15 bp, Homo sapiens
cccagccactcagga

SEQ ID NO: 343147 - DNA, 15 bp, Homo sapiens
ccagccactcaggag

SEQ ID NO: 343148 - DNA, 15 bp, Homo sapiens
cagccactcaggagg

SEQ ID NO: 343149 - DNA, 15 bp, Homo sapiens
agccactcaggaggc

SEQ ID NO: 343150 - DNA, 15 bp, Homo sapiens
gccactcaggaggct

SEQ ID NO: 343151 - DNA, 15 bp, Homo sapiens
ccactcaggaggcta

SEQ ID NO: 343152 - DNA, 15 bp, Homo sapiens
cactcaggaggctat

SEQ ID NO: 343153 - DNA, 15 bp, Homo sapiens
actcaggaggctatg

SEQ ID NO: 343154 - DNA, 15 bp, Homo sapiens
ctcaggaggctatgg

SEQ ID NO: 343155 - DNA, 15 bp, Homo sapiens
tcaggaggctatgga

SEQ ID NO: 343156 - DNA, 15 bp, Homo sapiens
caggaggctatggag

SEQ ID NO: 343157 - DNA, 15 bp, Homo sapiens
aggaggctatggagg

SEQ ID NO: 343158 - DNA, 15 bp, Homo sapiens
ggaggctatggaggc

SEQ ID NO: 343159 - DNA, 15 bp, Homo sapiens
gaggctatggaggca

SEQ ID NO: 343160 - DNA, 15 bp, Homo sapiens
aggctatggaggcag

SEQ ID NO: 343161 - DNA, 15 bp, Homo sapiens
ggctatggaggcagg

SEQ ID NO: 343162 - DNA, 15 bp, Homo sapiens
gctatggaggcagga

SEQ ID NO: 343163 - DNA, 15 bp, Homo sapiens
ctatggaggcaggag

SEQ ID NO: 343164 - DNA, 15 bp, Homo sapiens
tatggaggcaggaga

SEQ ID NO: 343165 - DNA, 15 bp, Homo sapiens
atggaggcaggagaa

SEQ ID NO: 343166 - DNA, 15 bp, Homo sapiens
tggaggcaggagaat

SEQ ID NO: 343167 - DNA, 15 bp, Homo sapiens
ggaggcaggagaatt

SEQ ID NO: 343168 - DNA, 15 bp, Homo sapiens
gaattgcttgaaccc

SEQ ID NO: 343169 - DNA, 15 bp, Homo sapiens
aattgcttgaaccca

SEQ ID NO: 343170 - DNA, 15 bp, Homo sapiens
attgcttgaacccag

SEQ ID NO: 343171 - DNA, 15 bp, Homo sapiens
ttgcttgaacccagg

SEQ ID NO: 343172 - DNA, 15 bp, Homo sapiens
tgcttgaacccagga

SEQ ID NO: 343173 - DNA, 15 bp, Homo sapiens
ccaggaagcagaggt

SEQ ID NO: 343174 - DNA, 15 bp, Homo sapiens
caggaagcagaggtt

SEQ ID NO: 343175 - DNA, 15 bp, Homo sapiens
aggaagcagaggttg

SEQ ID NO: 343176 - DNA, 15 bp, Homo sapiens
ggaagcagaggttgc

SEQ ID NO: 343177 - DNA, 15 bp, Homo sapiens
gaagcagaggttgca

SEQ ID NO: 343178 - DNA, 15 bp, Homo sapiens
aagcagaggttgcag

SEQ ID NO: 343179 - DNA, 15 bp, Homo sapiens
agcagaggttgcagt

SEQ ID NO: 343180 - DNA, 15 bp, Homo sapiens
agaggttgcagtgat

SEQ ID NO: 343181 - DNA, 15 bp, Homo sapiens
gaggttgcagtgatc

SEQ ID NO: 343182 - DNA, 15 bp, Homo sapiens
aggttgcagtgatcc

SEQ ID NO: 343183 - DNA, 15 bp, Homo sapiens
ggttgcagtgatccg

SEQ ID NO: 343184 - DNA, 15 bp, Homo sapiens
gttgcagtgatccga

SEQ ID NO: 343185 - DNA, 15 bp, Homo sapiens
ttgcagtgatccgag

SEQ ID NO: 343186 - DNA, 15 bp, Homo sapiens
tgcagtgatccgaga

SEQ ID NO: 343187 - DNA, 15 bp, Homo sapiens
gcagtgatccgagat

SEQ ID NO: 343188 - DNA, 15 bp, Homo sapiens
cagtgatccgagatg

SEQ ID NO: 343189 - DNA, 15 bp, Homo sapiens
agtgatccgagatgg

SEQ ID NO: 343190 - DNA, 15 bp, Homo sapiens
gtgatccgagatggc

SEQ ID NO: 343191 - DNA, 15 bp, Homo sapiens
tgatccgagatggca

SEQ ID NO: 343192 - DNA, 15 bp, Homo sapiens
gatccgagatggcac

SEQ ID NO: 343193 - DNA, 15 bp, Homo sapiens
atccgagatggcacc

SEQ ID NO: 343194 - DNA, 15 bp, Homo sapiens
tccgagatggcacca

SEQ ID NO: 343195 - DNA, 15 bp, Homo sapiens
ccgagatggcaccac

SEQ ID NO: 343196 - DNA, 15 bp, Homo sapiens
cgagatggcaccact

SEQ ID NO: 343197 - DNA, 15 bp, Homo sapiens
actgcactccagtct

SEQ ID NO: 343198 - DNA, 15 bp, Homo sapiens
ctgcactccagtctg

SEQ ID NO: 343199 - DNA, 15 bp, Homo sapiens
tgcactccagtctgg

SEQ ID NO: 343200 - DNA, 15 bp, Homo sapiens
cagtctgggtgacag

SEQ ID NO: 343201 - DNA, 15 bp, Homo sapiens
agtctgggtgacaga

SEQ ID NO: 343202 - DNA, 15 bp, Homo sapiens
gtctgggtgacagag

SEQ ID NO: 343203 - DNA, 15 bp, Homo sapiens
tctgggtgacagagt

SEQ ID NO: 343204 - DNA, 15 bp, Homo sapiens
tctgtctcaaaaaat

SEQ ID NO: 343205 - DNA, 15 bp, Homo sapiens
ctgtctcaaaaaata

SEQ ID NO: 343206 - DNA, 15 bp, Homo sapiens
tgtctcaaaaaataa

SEQ ID NO: 343207 - DNA, 15 bp, Homo sapiens
gtctcaaaaaataaa

SEQ ID NO: 343208 - DNA, 15 bp, Homo sapiens
tctcaaaaaataaaa

SEQ ID NO: 343209 - DNA, 15 bp, Homo sapiens
ctcaaaaaataaaaa

SEQ ID NO: 343210 - DNA, 15 bp, Homo sapiens
tcaaaaaataaaaat

SEQ ID NO: 343211 - DNA, 15 bp, Homo sapiens
aaaaataaaaataat

SEQ ID NO: 343212 - DNA, 15 bp, Homo sapiens
aaaataaaaataata

SEQ ID NO: 343213 - DNA, 15 bp, Homo sapiens
aaataaaaataatag

SEQ ID NO: 343214 - DNA, 15 bp, Homo sapiens
aataaaaataatagt

SEQ ID NO: 343215 - DNA, 15 bp, Homo sapiens
ataaaaataatagta

SEQ ID NO: 343216 - DNA, 15 bp, Homo sapiens
taaaaataatagtaa

SEQ ID NO: 343217 - DNA, 15 bp, Homo sapiens
aaaaataatagtaat

SEQ ID NO: 343218 - DNA, 15 bp, Homo sapiens
aaaataatagtaata

SEQ ID NO: 343219 - DNA, 15 bp, Homo sapiens
aaataatagtaatag

SEQ ID NO: 343220 - DNA, 15 bp, Homo sapiens
aataatagtaatagt

SEQ ID NO: 343221 - DNA, 15 bp, Homo sapiens
ataatagtaatagta

SEQ ID NO: 343222 - DNA, 15 bp, Homo sapiens
taatagtaatagtaa

SEQ ID NO: 343223 - DNA, 15 bp, Homo sapiens
aatagtaatagtaat

SEQ ID NO: 343224 - DNA, 15 bp, Homo sapiens
atagtaatagtaata

SEQ ID NO: 343225 - DNA, 15 bp, Homo sapiens
tagtaatagtaataa

SEQ ID NO: 343226 - DNA, 15 bp, Homo sapiens
agtaatagtaataat

SEQ ID NO: 343227 - DNA, 15 bp, Homo sapiens
gtaatagtaataatt

SEQ ID NO: 343228 - DNA, 15 bp, Homo sapiens
taatagtaataattg

SEQ ID NO: 343229 - DNA, 15 bp, Homo sapiens
aatagtaataattgc

SEQ ID NO: 343230 - DNA, 15 bp, Homo sapiens
atagtaataattgca

SEQ ID NO: 343231 - DNA, 15 bp, Homo sapiens
tagtaataattgcag

SEQ ID NO: 343232 - DNA, 15 bp, Homo sapiens
agtaataattgcagt

SEQ ID NO: 343233 - DNA, 15 bp, Homo sapiens
gtaataattgcagta

SEQ ID NO: 343234 - DNA, 15 bp, Homo sapiens
taataattgcagtag

SEQ ID NO: 343235 - DNA, 15 bp, Homo sapiens
aataattgcagtaga

SEQ ID NO: 343236 - DNA, 15 bp, Homo sapiens
ataattgcagtagaa

SEQ ID NO: 343237 - DNA, 15 bp, Homo sapiens
taattgcagtagaag

SEQ ID NO: 343238 - DNA, 15 bp, Homo sapiens
aattgcagtagaaga

SEQ ID NO: 343239 - DNA, 15 bp, Homo sapiens
attgcagtagaagac

SEQ ID NO: 343240 - DNA, 15 bp, Homo sapiens
ttgcagtagaagaca

SEQ ID NO: 343241 - DNA, 15 bp, Homo sapiens
tgcagtagaagacat

SEQ ID NO: 343242 - DNA, 15 bp, Homo sapiens
gcagtagaagacatc

SEQ ID NO: 343243 - DNA, 15 bp, Homo sapiens
cagtagaagacatcg

SEQ ID NO: 343244 - DNA, 15 bp, Homo sapiens
agtagaagacatcga

SEQ ID NO: 343245 - DNA, 15 bp, Homo sapiens
gtagaagacatcgat

SEQ ID NO: 343246 - DNA, 15 bp, Homo sapiens
tagaagacatcgatt

SEQ ID NO: 343247 - DNA, 15 bp, Homo sapiens
agaagacatcgattg

SEQ ID NO: 343248 - DNA, 15 bp, Homo sapiens
gaagacatcgattgc

SEQ ID NO: 343249 - DNA, 15 bp, Homo sapiens
aagacatcgattgct

SEQ ID NO: 343250 - DNA, 15 bp, Homo sapiens
agacatcgattgcta

SEQ ID NO: 343251 - DNA, 15 bp, Homo sapiens
gacatcgattgctag

SEQ ID NO: 343252 - DNA, 15 bp, Homo sapiens
acatcgattgctaga

SEQ ID NO: 343253 - DNA, 15 bp, Homo sapiens
catcgattgctagag

SEQ ID NO: 343254 - DNA, 15 bp, Homo sapiens
atcgattgctagaga

SEQ ID NO: 343255 - DNA, 15 bp, Homo sapiens
tcgattgctagagaa

SEQ ID NO: 343256 - DNA, 15 bp, Homo sapiens
cgattgctagagaaa

SEQ ID NO: 343257 - DNA, 15 bp, Homo sapiens
gattgctagagaaaa

SEQ ID NO: 343258 - DNA, 15 bp, Homo sapiens
attgctagagaaaac

SEQ ID NO: 343259 - DNA, 15 bp, Homo sapiens
ttgctagagaaaacc

SEQ ID NO: 343260 - DNA, 15 bp, Homo sapiens
tgctagagaaaacca

SEQ ID NO: 343261 - DNA, 15 bp, Homo sapiens
gctagagaaaaccat

SEQ ID NO: 343262 - DNA, 15 bp, Homo sapiens
ctagagaaaaccatt

SEQ ID NO: 343263 - DNA, 15 bp, Homo sapiens
tagagaaaaccattg

SEQ ID NO: 343264 - DNA, 15 bp, Homo sapiens
agagaaaaccattgt

SEQ ID NO: 343265 - DNA, 15 bp, Homo sapiens
gagaaaaccattgtg

SEQ ID NO: 343266 - DNA, 15 bp, Homo sapiens
agaaaaccattgtgt

SEQ ID NO: 343267 - DNA, 15 bp, Homo sapiens
gaaaaccattgtgtt

SEQ ID NO: 343268 - DNA, 15 bp, Homo sapiens
aaaaccattgtgtta

SEQ ID NO: 343269 - DNA, 15 bp, Homo sapiens
aaaccattgtgttac

SEQ ID NO: 343270 - DNA, 15 bp, Homo sapiens
aaccattgtgttact

SEQ ID NO: 343271 - DNA, 15 bp, Homo sapiens
accattgtgttactc

SEQ ID NO: 343272 - DNA, 15 bp, Homo sapiens
ccattgtgttactct

SEQ ID NO: 343273 - DNA, 15 bp, Homo sapiens
cattgtgttactctt

SEQ ID NO: 343274 - DNA, 15 bp, Homo sapiens
attgtgttactcttc

SEQ ID NO: 343275 - DNA, 15 bp, Homo sapiens
ttgtgttactcttct

SEQ ID NO: 343276 - DNA, 15 bp, Homo sapiens
tgtgttactcttcta

SEQ ID NO: 343277 - DNA, 15 bp, Homo sapiens
gtgttactcttctat

SEQ ID NO: 343278 - DNA, 15 bp, Homo sapiens
tgttactcttctatc

SEQ ID NO: 343279 - DNA, 15 bp, Homo sapiens
gttactcttctatcc

SEQ ID NO: 343280 - DNA, 15 bp, Homo sapiens
ttactcttctatcca

SEQ ID NO: 343281 - DNA, 15 bp, Homo sapiens
tactcttctatccag

SEQ ID NO: 343282 - DNA, 15 bp, Homo sapiens
actcttctatccagt

SEQ ID NO: 343283 - DNA, 15 bp, Homo sapiens
ctcttctatccagta

SEQ ID NO: 343284 - DNA, 15 bp, Homo sapiens
tcttctatccagtaa

SEQ ID NO: 343285 - DNA, 15 bp, Homo sapiens
cttctatccagtaaa

SEQ ID NO: 343286 - DNA, 15 bp, Homo sapiens
ttctatccagtaaag

SEQ ID NO: 343287 - DNA, 15 bp, Homo sapiens
tctatccagtaaagt

SEQ ID NO: 343288 - DNA, 15 bp, Homo sapiens
ctatccagtaaagta

SEQ ID NO: 343289 - DNA, 15 bp, Homo sapiens
tatccagtaaagtaa

SEQ ID NO: 343290 - DNA, 15 bp, Homo sapiens
atccagtaaagtaat

SEQ ID NO: 343291 - DNA, 15 bp, Homo sapiens
tccagtaaagtaatt

SEQ ID NO: 343292 - DNA, 15 bp, Homo sapiens
ccagtaaagtaattg

SEQ ID NO: 343293 - DNA, 15 bp, Homo sapiens
cagtaaagtaattgc

SEQ ID NO: 343294 - DNA, 15 bp, Homo sapiens
agtaaagtaattgca

SEQ ID NO: 343295 - DNA, 15 bp, Homo sapiens
gtaaagtaattgcaa

SEQ ID NO: 343296 - DNA, 15 bp, Homo sapiens
taaagtaattgcaaa

SEQ ID NO: 343297 - DNA, 15 bp, Homo sapiens
aaagtaattgcaaat

SEQ ID NO: 343298 - DNA, 15 bp, Homo sapiens
aagtaattgcaaatt

SEQ ID NO: 343299 - DNA, 15 bp, Homo sapiens
agtaattgcaaattt

SEQ ID NO: 343300 - DNA, 15 bp, Homo sapiens
gtaattgcaaatttg

SEQ ID NO: 343301 - DNA, 15 bp, Homo sapiens
taattgcaaatttgg

SEQ ID NO: 343302 - DNA, 15 bp, Homo sapiens
aattgcaaatttgga

SEQ ID NO: 343303 - DNA, 15 bp, Homo sapiens
attgcaaatttggaa

SEQ ID NO: 343304 - DNA, 15 bp, Homo sapiens
ttgcaaatttggaaa

SEQ ID NO: 343305 - DNA, 15 bp, Homo sapiens
tgcaaatttggaaat

SEQ ID NO: 343306 - DNA, 15 bp, Homo sapiens
gcaaatttggaaata

SEQ ID NO: 343307 - DNA, 15 bp, Homo sapiens
caaatttggaaataa

SEQ ID NO: 343308 - DNA, 15 bp, Homo sapiens
aaatttggaaataat

SEQ ID NO: 343309 - DNA, 15 bp, Homo sapiens
aatttggaaataatt

SEQ ID NO: 343310 - DNA, 15 bp, Homo sapiens
atttggaaataattt

SEQ ID NO: 343311 - DNA, 15 bp, Homo sapiens
tttggaaataatttt

SEQ ID NO: 343312 - DNA, 15 bp, Homo sapiens
ttggaaataatttta

SEQ ID NO: 343313 - DNA, 15 bp, Homo sapiens
tggaaataattttaa

SEQ ID NO: 343314 - DNA, 15 bp, Homo sapiens
ggaaataattttaat

SEQ ID NO: 343315 - DNA, 15 bp, Homo sapiens
gaaataattttaatt

SEQ ID NO: 343316 - DNA, 15 bp, Homo sapiens
aaataattttaattt

SEQ ID NO: 343317 - DNA, 15 bp, Homo sapiens
aataattttaatttg

SEQ ID NO: 343318 - DNA, 15 bp, Homo sapiens
ataattttaatttga

SEQ ID NO: 343319 - DNA, 15 bp, Homo sapiens
taattttaatttgat

SEQ ID NO: 343320 - DNA, 15 bp, Homo sapiens
aattttaatttgatg

SEQ ID NO: 343321 - DNA, 15 bp, Homo sapiens
attttaatttgatga

SEQ ID NO: 343322 - DNA, 15 bp, Homo sapiens
ttttaatttgatgat

SEQ ID NO: 343323 - DNA, 15 bp, Homo sapiens
tttaatttgatgata

SEQ ID NO: 343324 - DNA, 15 bp, Homo sapiens
ttaatttgatgataa

SEQ ID NO: 343325 - DNA, 15 bp, Homo sapiens
taatttgatgataaa

SEQ ID NO: 343326 - DNA, 15 bp, Homo sapiens
aatttgatgataaaa

SEQ ID NO: 343327 - DNA, 15 bp, Homo sapiens
atttgatgataaaaa

SEQ ID NO: 343328 - DNA, 15 bp, Homo sapiens
tttgatgataaaaaa

SEQ ID NO: 343329 - DNA, 15 bp, Homo sapiens
ttgatgataaaaaac

SEQ ID NO: 343330 - DNA, 15 bp, Homo sapiens
tgatgataaaaaaca

SEQ ID NO: 343331 - DNA, 15 bp, Homo sapiens
gatgataaaaaacag

SEQ ID NO: 343332 - DNA, 15 bp, Homo sapiens
atgataaaaaacagt

SEQ ID NO: 343333 - DNA, 15 bp, Homo sapiens
tgataaaaaacagtt

SEQ ID NO: 343334 - DNA, 15 bp, Homo sapiens
gataaaaaacagttt

SEQ ID NO: 343335 - DNA, 15 bp, Homo sapiens
ataaaaaacagttta

SEQ ID NO: 343336 - DNA, 15 bp, Homo sapiens
taaaaaacagtttaa

SEQ ID NO: 343337 - DNA, 15 bp, Homo sapiens
aaaaaacagtttaaa

SEQ ID NO: 343338 - DNA, 15 bp, Homo sapiens
aaaaacagtttaaaa

SEQ ID NO: 343339 - DNA, 15 bp, Homo sapiens
aaaacagtttaaaaa

SEQ ID NO: 343340 - DNA, 15 bp, Homo sapiens
aaacagtttaaaaat

SEQ ID NO: 343341 - DNA, 15 bp, Homo sapiens
aacagtttaaaaata

SEQ ID NO: 343342 - DNA, 15 bp, Homo sapiens
acagtttaaaaatag

SEQ ID NO: 343343 - DNA, 15 bp, Homo sapiens
cagtttaaaaataga

SEQ ID NO: 343344 - DNA, 15 bp, Homo sapiens
agtttaaaaatagag

SEQ ID NO: 343345 - DNA, 15 bp, Homo sapiens
gtttaaaaatagagt

SEQ ID NO: 343346 - DNA, 15 bp, Homo sapiens
tttaaaaatagagtg

SEQ ID NO: 343347 - DNA, 15 bp, Homo sapiens
ttaaaaatagagtgc

SEQ ID NO: 343348 - DNA, 15 bp, Homo sapiens
taaaaatagagtgct

SEQ ID NO: 343349 - DNA, 15 bp, Homo sapiens
aaaaatagagtgcta

SEQ ID NO: 343350 - DNA, 15 bp, Homo sapiens
aaaatagagtgctag

SEQ ID NO: 343351 - DNA, 15 bp, Homo sapiens
aaatagagtgctagt

SEQ ID NO: 343352 - DNA, 15 bp, Homo sapiens
aatagagtgctagta

SEQ ID NO: 343353 - DNA, 15 bp, Homo sapiens
atagagtgctagtat

SEQ ID NO: 343354 - DNA, 15 bp, Homo sapiens
tagagtgctagtatt

SEQ ID NO: 343355 - DNA, 15 bp, Homo sapiens
agagtgctagtattt

SEQ ID NO: 343356 - DNA, 15 bp, Homo sapiens
gagtgctagtatttc

SEQ ID NO: 343357 - DNA, 15 bp, Homo sapiens
agtgctagtatttca

SEQ ID NO: 343358 - DNA, 15 bp, Homo sapiens
gtgctagtatttcag

SEQ ID NO: 343359 - DNA, 15 bp, Homo sapiens
tgctagtatttcagt

SEQ ID NO: 343360 - DNA, 15 bp, Homo sapiens
gctagtatttcagtc

SEQ ID NO: 343361 - DNA, 15 bp, Homo sapiens
ctagtatttcagtca

SEQ ID NO: 343362 - DNA, 15 bp, Homo sapiens
tagtatttcagtcac

SEQ ID NO: 343363 - DNA, 15 bp, Homo sapiens
agtatttcagtcact

SEQ ID NO: 343364 - DNA, 15 bp, Homo sapiens
gtatttcagtcactt

SEQ ID NO: 343365 - DNA, 15 bp, Homo sapiens
tatttcagtcacttg

SEQ ID NO: 343366 - DNA, 15 bp, Homo sapiens
atttcagtcacttgt

SEQ ID NO: 343367 - DNA, 15 bp, Homo sapiens
tttcagtcacttgta

SEQ ID NO: 343368 - DNA, 15 bp, Homo sapiens
ttcagtcacttgtac

SEQ ID NO: 343369 - DNA, 15 bp, Homo sapiens
tcagtcacttgtacc

SEQ ID NO: 343370 - DNA, 15 bp, Homo sapiens
cagtcacttgtacca

SEQ ID NO: 343371 - DNA, 15 bp, Homo sapiens
agtcacttgtaccac

SEQ ID NO: 343372 - DNA, 15 bp, Homo sapiens
gtcacttgtaccact

SEQ ID NO: 343373 - DNA, 15 bp, Homo sapiens
tcacttgtaccactt

SEQ ID NO: 343374 - DNA, 15 bp, Homo sapiens
cacttgtaccacttt

SEQ ID NO: 343375 - DNA, 15 bp, Homo sapiens
acttgtaccacttta

SEQ ID NO: 343376 - DNA, 15 bp, Homo sapiens
cttgtaccactttag

SEQ ID NO: 343377 - DNA, 15 bp, Homo sapiens
ttgtaccactttagg

SEQ ID NO: 343378 - DNA, 15 bp, Homo sapiens
tgtaccactttaggt

SEQ ID NO: 343379 - DNA, 15 bp, Homo sapiens
gtaccactttaggtt

SEQ ID NO: 343380 - DNA, 15 bp, Homo sapiens
taccactttaggttt

SEQ ID NO: 343381 - DNA, 15 bp, Homo sapiens
accactttaggtttt

SEQ ID NO: 343382 - DNA, 15 bp, Homo sapiens
ccactttaggtttta

SEQ ID NO: 343383 - DNA, 15 bp, Homo sapiens
cactttaggttttaa

SEQ ID NO: 343384 - DNA, 15 bp, Homo sapiens
actttaggttttaaa

SEQ ID NO: 343385 - DNA, 15 bp, Homo sapiens
ctttaggttttaaac

SEQ ID NO: 343386 - DNA, 15 bp, Homo sapiens
tttaggttttaaact

SEQ ID NO: 343387 - DNA, 15 bp, Homo sapiens
ttaggttttaaactg

SEQ ID NO: 343388 - DNA, 15 bp, Homo sapiens
taggttttaaactga

SEQ ID NO: 343389 - DNA, 15 bp, Homo sapiens
aggttttaaactgac

SEQ ID NO: 343390 - DNA, 15 bp, Homo sapiens
ggttttaaactgacc

SEQ ID NO: 343391 - DNA, 15 bp, Homo sapiens
gttttaaactgacct

SEQ ID NO: 343392 - DNA, 15 bp, Homo sapiens
ttttaaactgacctt

SEQ ID NO: 343393 - DNA, 15 bp, Homo sapiens
tttaaactgaccttt

SEQ ID NO: 343394 - DNA, 15 bp, Homo sapiens
ttaaactgacctttc

SEQ ID NO: 343395 - DNA, 15 bp, Homo sapiens
taaactgacctttca

SEQ ID NO: 343396 - DNA, 15 bp, Homo sapiens
aaactgacctttcat

SEQ ID NO: 343397 - DNA, 15 bp, Homo sapiens
aactgacctttcatc

SEQ ID NO: 343398 - DNA, 15 bp, Homo sapiens
actgacctttcatcg

SEQ ID NO: 343399 - DNA, 15 bp, Homo sapiens
ctgacctttcatcgt

SEQ ID NO: 343400 - DNA, 15 bp, Homo sapiens
tgacctttcatcgtg

SEQ ID NO: 343401 - DNA, 15 bp, Homo sapiens
gacctttcatcgtgt

SEQ ID NO: 343402 - DNA, 15 bp, Homo sapiens
acctttcatcgtgtt

SEQ ID NO: 343403 - DNA, 15 bp, Homo sapiens
cctttcatcgtgttc

SEQ ID NO: 343404 - DNA, 15 bp, Homo sapiens
ctttcatcgtgttct

SEQ ID NO: 343405 - DNA, 15 bp, Homo sapiens
tttcatcgtgttcta

SEQ ID NO: 343406 - DNA, 15 bp, Homo sapiens
ttcatcgtgttctat

SEQ ID NO: 343407 - DNA, 15 bp, Homo sapiens
tcatcgtgttctata

SEQ ID NO: 343408 - DNA, 15 bp, Homo sapiens
catcgtgttctataa

SEQ ID NO: 343409 - DNA, 15 bp, Homo sapiens
atcgtgttctataat

SEQ ID NO: 343410 - DNA, 15 bp, Homo sapiens
tcgtgttctataatg

SEQ ID NO: 343411 - DNA, 15 bp, Homo sapiens
cgtgttctataatga

SEQ ID NO: 343412 - DNA, 15 bp, Homo sapiens
gtgttctataatgat

SEQ ID NO: 343413 - DNA, 15 bp, Homo sapiens
tgttctataatgatc

SEQ ID NO: 343414 - DNA, 15 bp, Homo sapiens
gttctataatgatct

SEQ ID NO: 343415 - DNA, 15 bp, Homo sapiens
ttctataatgatctg

SEQ ID NO: 343416 - DNA, 15 bp, Homo sapiens
tctataatgatctga

SEQ ID NO: 343417 - DNA, 15 bp, Homo sapiens
ctataatgatctgac

SEQ ID NO: 343418 - DNA, 15 bp, Homo sapiens
tataatgatctgaca

SEQ ID NO: 343419 - DNA, 15 bp, Homo sapiens
ataatgatctgacat

SEQ ID NO: 343420 - DNA, 15 bp, Homo sapiens
taatgatctgacatt

SEQ ID NO: 343421 - DNA, 15 bp, Homo sapiens
aatgatctgacattt

SEQ ID NO: 343422 - DNA, 15 bp, Homo sapiens
atgatctgacatttt

SEQ ID NO: 343423 - DNA, 15 bp, Homo sapiens
tgatctgacatttta

SEQ ID NO: 343424 - DNA, 15 bp, Homo sapiens
gatctgacattttaa

SEQ ID NO: 343425 - DNA, 15 bp, Homo sapiens
atctgacattttaac

SEQ ID NO: 343426 - DNA, 15 bp, Homo sapiens
tctgacattttaact

SEQ ID NO: 343427 - DNA, 15 bp, Homo sapiens
ctgacattttaacta

SEQ ID NO: 343428 - DNA, 15 bp, Homo sapiens
tgacattttaactat

SEQ ID NO: 343429 - DNA, 15 bp, Homo sapiens
gacattttaactata

SEQ ID NO: 343430 - DNA, 15 bp, Homo sapiens
acattttaactatac

SEQ ID NO: 343431 - DNA, 15 bp, Homo sapiens
cattttaactatacc

SEQ ID NO: 343432 - DNA, 15 bp, Homo sapiens
attttaactatacct

SEQ ID NO: 343433 - DNA, 15 bp, Homo sapiens
ttttaactatacctt

SEQ ID NO: 343434 - DNA, 15 bp, Homo sapiens
tttaactataccttt

SEQ ID NO: 343435 - DNA, 15 bp, Homo sapiens
ttaactatacctttt

SEQ ID NO: 343436 - DNA, 15 bp, Homo sapiens
taactataccttttg

SEQ ID NO: 343437 - DNA, 15 bp, Homo sapiens
aactataccttttgt

SEQ ID NO: 343438 - DNA, 15 bp, Homo sapiens
actataccttttgtg

SEQ ID NO: 343439 - DNA, 15 bp, Homo sapiens
ctataccttttgtgt

SEQ ID NO: 343440 - DNA, 15 bp, Homo sapiens
tataccttttgtgtg

SEQ ID NO: 343441 - DNA, 15 bp, Homo sapiens
ataccttttgtgtgt

SEQ ID NO: 343442 - DNA, 15 bp, Homo sapiens
taccttttgtgtgtg

SEQ ID NO: 343443 - DNA, 15 bp, Homo sapiens
accttttgtgtgtgt

SEQ ID NO: 343444 - DNA, 15 bp, Homo sapiens
ccttttgtgtgtgtg

SEQ ID NO: 343445 - DNA, 15 bp, Homo sapiens
cttttgtgtgtgtgt

SEQ ID NO: 343446 - DNA, 15 bp, Homo sapiens
gtgtgtgtgtgtact

SEQ ID NO: 343447 - DNA, 15 bp, Homo sapiens
tgtgtgtgtgtactg

SEQ ID NO: 343448 - DNA, 15 bp, Homo sapiens
gtgtgtgtgtactgt

SEQ ID NO: 343449 - DNA, 15 bp, Homo sapiens
tgtgtgtgtactgtc

SEQ ID NO: 343450 - DNA, 15 bp, Homo sapiens
gtgtgtgtactgtct

SEQ ID NO: 343451 - DNA, 15 bp, Homo sapiens
tgtgtgtactgtcta

SEQ ID NO: 343452 - DNA, 15 bp, Homo sapiens
gtgtgtactgtctac

SEQ ID NO: 343453 - DNA, 15 bp, Homo sapiens
tgtgtactgtctaca

SEQ ID NO: 343454 - DNA, 15 bp, Homo sapiens
gtgtactgtctacat

SEQ ID NO: 343455 - DNA, 15 bp, Homo sapiens
tgtactgtctacatg

SEQ ID NO: 343456 - DNA, 15 bp, Homo sapiens
gtactgtctacatgt

SEQ ID NO: 343457 - DNA, 15 bp, Homo sapiens
tactgtctacatgtt

SEQ ID NO: 343458 - DNA, 15 bp, Homo sapiens
actgtctacatgttc

SEQ ID NO: 343459 - DNA, 15 bp, Homo sapiens
ctgtctacatgttct

SEQ ID NO: 343460 - DNA, 15 bp, Homo sapiens
tgtctacatgttctg

SEQ ID NO: 343461 - DNA, 15 bp, Homo sapiens
gtctacatgttctgt

SEQ ID NO: 343462 - DNA, 15 bp, Homo sapiens
tctacatgttctgtc

SEQ ID NO: 343463 - DNA, 15 bp, Homo sapiens
ctacatgttctgtct

SEQ ID NO: 343464 - DNA, 15 bp, Homo sapiens
tacatgttctgtctg

SEQ ID NO: 343465 - DNA, 15 bp, Homo sapiens
acatgttctgtctga

SEQ ID NO: 343466 - DNA, 15 bp, Homo sapiens
catgttctgtctgat

SEQ ID NO: 343467 - DNA, 15 bp, Homo sapiens
atgttctgtctgatg

SEQ ID NO: 343468 - DNA, 15 bp, Homo sapiens
tgttctgtctgatgg

SEQ ID NO: 343469 - DNA, 15 bp, Homo sapiens
gttctgtctgatggc

SEQ ID NO: 343470 - DNA, 15 bp, Homo sapiens
ttctgtctgatggca

SEQ ID NO: 343471 - DNA, 15 bp, Homo sapiens
tctgtctgatggcat

SEQ ID NO: 343472 - DNA, 15 bp, Homo sapiens
ctgtctgatggcatc

SEQ ID NO: 343473 - DNA, 15 bp, Homo sapiens
tgtctgatggcatca

SEQ ID NO: 343474 - DNA, 15 bp, Homo sapiens
gtctgatggcatcat

SEQ ID NO: 343475 - DNA, 15 bp, Homo sapiens
tctgatggcatcatt

SEQ ID NO: 343476 - DNA, 15 bp, Homo sapiens
ctgatggcatcatta

SEQ ID NO: 343477 - DNA, 15 bp, Homo sapiens
tgatggcatcattat

SEQ ID NO: 343478 - DNA, 15 bp, Homo sapiens
gatggcatcattatt

SEQ ID NO: 343479 - DNA, 15 bp, Homo sapiens
atggcatcattattt

SEQ ID NO: 343480 - DNA, 15 bp, Homo sapiens
tggcatcattattta

SEQ ID NO: 343481 - DNA, 15 bp, Homo sapiens
ggcatcattatttat

SEQ ID NO: 343482 - DNA, 15 bp, Homo sapiens
gcatcattatttatg

SEQ ID NO: 343483 - DNA, 15 bp, Homo sapiens
catcattatttatgt

SEQ ID NO: 343484 - DNA, 15 bp, Homo sapiens
atcattatttatgtg

SEQ ID NO: 343485 - DNA, 15 bp, Homo sapiens
tcattatttatgtgc

SEQ ID NO: 343486 - DNA, 15 bp, Homo sapiens
cattatttatgtgca

SEQ ID NO: 343487 - DNA, 15 bp, Homo sapiens
attatttatgtgcat

SEQ ID NO: 343488 - DNA, 15 bp, Homo sapiens
ttatttatgtgcata

SEQ ID NO: 343489 - DNA, 15 bp, Homo sapiens
tatttatgtgcatat

SEQ ID NO: 343490 - DNA, 15 bp, Homo sapiens
atttatgtgcatatc

SEQ ID NO: 343491 - DNA, 15 bp, Homo sapiens
tttatgtgcatatct

SEQ ID NO: 343492 - DNA, 15 bp, Homo sapiens
ttatgtgcatatctt

SEQ ID NO: 343493 - DNA, 15 bp, Homo sapiens
tatgtgcatatctta

SEQ ID NO: 343494 - DNA, 15 bp, Homo sapiens
atgtgcatatcttac

SEQ ID NO: 343495 - DNA, 15 bp, Homo sapiens
tgtgcatatcttacc

SEQ ID NO: 343496 - DNA, 15 bp, Homo sapiens
gtgcatatcttacca

SEQ ID NO: 343497 - DNA, 15 bp, Homo sapiens
tgcatatcttaccag

SEQ ID NO: 343498 - DNA, 15 bp, Homo sapiens
gcatatcttaccagc

SEQ ID NO: 343499 - DNA, 15 bp, Homo sapiens
catatcttaccagcc

SEQ ID NO: 343500 - DNA, 15 bp, Homo sapiens
atatcttaccagcct

SEQ ID NO: 343501 - DNA, 15 bp, Homo sapiens
tatcttaccagcctc

SEQ ID NO: 343502 - DNA, 15 bp, Homo sapiens
atcttaccagcctca

SEQ ID NO: 343503 - DNA, 15 bp, Homo sapiens
tcttaccagcctcac

SEQ ID NO: 343504 - DNA, 15 bp, Homo sapiens
cttaccagcctcact

SEQ ID NO: 343505 - DNA, 15 bp, Homo sapiens
ttaccagcctcacta

SEQ ID NO: 343506 - DNA, 15 bp, Homo sapiens
taccagcctcactag

SEQ ID NO: 343507 - DNA, 15 bp, Homo sapiens
accagcctcactaga

SEQ ID NO: 343508 - DNA, 15 bp, Homo sapiens
ccagcctcactagac

SEQ ID NO: 343509 - DNA, 15 bp, Homo sapiens
cagcctcactagact

SEQ ID NO: 343510 - DNA, 15 bp, Homo sapiens
agcctcactagactg

SEQ ID NO: 343511 - DNA, 15 bp, Homo sapiens
gcctcactagactga

SEQ ID NO: 343512 - DNA, 15 bp, Homo sapiens
cctcactagactgag

SEQ ID NO: 343513 - DNA, 15 bp, Homo sapiens
ctcactagactgagg

SEQ ID NO: 343514 - DNA, 15 bp, Homo sapiens
tcactagactgagga

SEQ ID NO: 343515 - DNA, 15 bp, Homo sapiens
cactagactgaggac

SEQ ID NO: 343516 - DNA, 15 bp, Homo sapiens
actagactgaggaca

SEQ ID NO: 343517 - DNA, 15 bp, Homo sapiens
ctagactgaggacag

SEQ ID NO: 343518 - DNA, 15 bp, Homo sapiens
tagactgaggacagt

SEQ ID NO: 343519 - DNA, 15 bp, Homo sapiens
agactgaggacagta

SEQ ID NO: 343520 - DNA, 15 bp, Homo sapiens
gactgaggacagtat

SEQ ID NO: 343521 - DNA, 15 bp, Homo sapiens
actgaggacagtatc

SEQ ID NO: 343522 - DNA, 15 bp, Homo sapiens
ctgaggacagtatcc

SEQ ID NO: 343523 - DNA, 15 bp, Homo sapiens
tgaggacagtatcca

SEQ ID NO: 343524 - DNA, 15 bp, Homo sapiens
gaggacagtatccat

SEQ ID NO: 343525 - DNA, 15 bp, Homo sapiens
aggacagtatccatt

SEQ ID NO: 343526 - DNA, 15 bp, Homo sapiens
ggacagtatccattg

SEQ ID NO: 343527 - DNA, 15 bp, Homo sapiens
gacagtatccattgg

SEQ ID NO: 343528 - DNA, 15 bp, Homo sapiens
acagtatccattggg

SEQ ID NO: 343529 - DNA, 15 bp, Homo sapiens
cagtatccattgggg

SEQ ID NO: 343530 - DNA, 15 bp, Homo sapiens
agtatccattggggg

SEQ ID NO: 343531 - DNA, 15 bp, Homo sapiens
gtatccattgggggg

SEQ ID NO: 343532 - DNA, 15 bp, Homo sapiens
tatccattggggggt

SEQ ID NO: 343533 - DNA, 15 bp, Homo sapiens
atccattggggggtg

SEQ ID NO: 343534 - DNA, 15 bp, Homo sapiens
tccattggggggtga

SEQ ID NO: 343535 - DNA, 15 bp, Homo sapiens
ccattggggggtgaa

SEQ ID NO: 343536 - DNA, 15 bp, Homo sapiens
cattggggggtgaaa

SEQ ID NO: 343537 - DNA, 15 bp, Homo sapiens
attggggggtgaaat

SEQ ID NO: 343538 - DNA, 15 bp, Homo sapiens
ttggggggtgaaata

SEQ ID NO: 343539 - DNA, 15 bp, Homo sapiens
tggggggtgaaatat

SEQ ID NO: 343540 - DNA, 15 bp, Homo sapiens
ggggggtgaaatata

SEQ ID NO: 343541 - DNA, 15 bp, Homo sapiens
gggggtgaaatatag

SEQ ID NO: 343542 - DNA, 15 bp, Homo sapiens
ggggtgaaatataga

SEQ ID NO: 343543 - DNA, 15 bp, Homo sapiens
gggtgaaatatagag

SEQ ID NO: 343544 - DNA, 15 bp, Homo sapiens
ggtgaaatatagagg

SEQ ID NO: 343545 - DNA, 15 bp, Homo sapiens
gtgaaatatagaggc

SEQ ID NO: 343546 - DNA, 15 bp, Homo sapiens
tgaaatatagaggca

SEQ ID NO: 343547 - DNA, 15 bp, Homo sapiens
gaaatatagaggcaa

SEQ ID NO: 343548 - DNA, 15 bp, Homo sapiens
aaatatagaggcaag

SEQ ID NO: 343549 - DNA, 15 bp, Homo sapiens
aatatagaggcaagg

SEQ ID NO: 343550 - DNA, 15 bp, Homo sapiens
atatagaggcaagga

SEQ ID NO: 343551 - DNA, 15 bp, Homo sapiens
tatagaggcaaggaa

SEQ ID NO: 343552 - DNA, 15 bp, Homo sapiens
atagaggcaaggaat

SEQ ID NO: 343553 - DNA, 15 bp, Homo sapiens
tagaggcaaggaata

SEQ ID NO: 343554 - DNA, 15 bp, Homo sapiens
agaggcaaggaatag

SEQ ID NO: 343555 - DNA, 15 bp, Homo sapiens
gaggcaaggaatagt

SEQ ID NO: 343556 - DNA, 15 bp, Homo sapiens
aggcaaggaatagtt

SEQ ID NO: 343557 - DNA, 15 bp, Homo sapiens
ggcaaggaatagttg

SEQ ID NO: 343558 - DNA, 15 bp, Homo sapiens
gcaaggaatagttgt

SEQ ID NO: 343559 - DNA, 15 bp, Homo sapiens
caaggaatagttgtt

SEQ ID NO: 343560 - DNA, 15 bp, Homo sapiens
aaggaatagttgtta

SEQ ID NO: 343561 - DNA, 15 bp, Homo sapiens
aggaatagttgttaa

SEQ ID NO: 343562 - DNA, 15 bp, Homo sapiens
ggaatagttgttaaa

SEQ ID NO: 343563 - DNA, 15 bp, Homo sapiens
gaatagttgttaaat

SEQ ID NO: 343564 - DNA, 15 bp, Homo sapiens
aatagttgttaaata

SEQ ID NO: 343565 - DNA, 15 bp, Homo sapiens
atagttgttaaatat

SEQ ID NO: 343566 - DNA, 15 bp, Homo sapiens
tagttgttaaatatt

SEQ ID NO: 343567 - DNA, 15 bp, Homo sapiens
agttgttaaatattt

SEQ ID NO: 343568 - DNA, 15 bp, Homo sapiens
gttgttaaatattta

SEQ ID NO: 343569 - DNA, 15 bp, Homo sapiens
ttgttaaatatttaa

SEQ ID NO: 343570 - DNA, 15 bp, Homo sapiens
tgttaaatatttaat

SEQ ID NO: 343571 - DNA, 15 bp, Homo sapiens
gttaaatatttaatt

SEQ ID NO: 343572 - DNA, 15 bp, Homo sapiens
ttaaatatttaattc

SEQ ID NO: 343573 - DNA, 15 bp, Homo sapiens
taaatatttaattca

SEQ ID NO: 343574 - DNA, 15 bp, Homo sapiens
aaatatttaattcat

SEQ ID NO: 343575 - DNA, 15 bp, Homo sapiens
aatatttaattcata

SEQ ID NO: 343576 - DNA, 15 bp, Homo sapiens
atatttaattcataa

SEQ ID NO: 343577 - DNA, 15 bp, Homo sapiens
tatttaattcataaa

SEQ ID NO: 343578 - DNA, 15 bp, Homo sapiens
atttaattcataaat

SEQ ID NO: 343579 - DNA, 15 bp, Homo sapiens
tttaattcataaata

SEQ ID NO: 343580 - DNA, 15 bp, Homo sapiens
ttaattcataaataa

SEQ ID NO: 343581 - DNA, 15 bp, Homo sapiens
taattcataaataaa

SEQ ID NO: 343582 - DNA, 15 bp, Homo sapiens
aattcataaataaaa

SEQ ID NO: 343583 - DNA, 15 bp, Homo sapiens
attcataaataaaat

SEQ ID NO: 343584 - DNA, 15 bp, Homo sapiens
ttcataaataaaatt

SEQ ID NO: 343585 - DNA, 15 bp, Homo sapiens
tcataaataaaattg

SEQ ID NO: 343586 - DNA, 15 bp, Homo sapiens
cataaataaaattgc

SEQ ID NO: 343587 - DNA, 15 bp, Homo sapiens
ataaataaaattgct

SEQ ID NO: 343588 - DNA, 15 bp, Homo sapiens
taaataaaattgctg

SEQ ID NO: 343589 - DNA, 15 bp, Homo sapiens
aaataaaattgctga

SEQ ID NO: 343590 - DNA, 15 bp, Homo sapiens
aataaaattgctgag

SEQ ID NO: 343591 - DNA, 15 bp, Homo sapiens
ataaaattgctgaga

SEQ ID NO: 343592 - DNA, 15 bp, Homo sapiens
taaaattgctgagaa

SEQ ID NO: 343593 - DNA, 15 bp, Homo sapiens
aaaattgctgagaaa

SEQ ID NO: 343594 - DNA, 15 bp, Homo sapiens
aaattgctgagaaag

SEQ ID NO: 343595 - DNA, 15 bp, Homo sapiens
aattgctgagaaaga

SEQ ID NO: 343596 - DNA, 15 bp, Homo sapiens
attgctgagaaagaa

SEQ ID NO: 343597 - DNA, 15 bp, Homo sapiens
ttgctgagaaagaat

SEQ ID NO: 343598 - DNA, 15 bp, Homo sapiens
tgctgagaaagaatt

SEQ ID NO: 343599 - DNA, 15 bp, Homo sapiens
gctgagaaagaattg

SEQ ID NO: 343600 - DNA, 15 bp, Homo sapiens
ctgagaaagaattga

SEQ ID NO: 343601 - DNA, 15 bp, Homo sapiens
tgagaaagaattgat

SEQ ID NO: 343602 - DNA, 15 bp, Homo sapiens
gagaaagaattgatt

SEQ ID NO: 343603 - DNA, 15 bp, Homo sapiens
agaaagaattgattc

SEQ ID NO: 343604 - DNA, 15 bp, Homo sapiens
gaaagaattgattcc

SEQ ID NO: 343605 - DNA, 15 bp, Homo sapiens
aaagaattgattccg

SEQ ID NO: 343606 - DNA, 15 bp, Homo sapiens
aagaattgattccgt

SEQ ID NO: 343607 - DNA, 15 bp, Homo sapiens
agaattgattccgtt

SEQ ID NO: 343608 - DNA, 15 bp, Homo sapiens
gaattgattccgttg

SEQ ID NO: 343609 - DNA, 15 bp, Homo sapiens
aattgattccgttgc

SEQ ID NO: 343610 - DNA, 15 bp, Homo sapiens
attgattccgttgca

SEQ ID NO: 343611 - DNA, 15 bp, Homo sapiens
ttgattccgttgcaa

SEQ ID NO: 343612 - DNA, 15 bp, Homo sapiens
tgattccgttgcaaa

SEQ ID NO: 343613 - DNA, 15 bp, Homo sapiens
gattccgttgcaaat

SEQ ID NO: 343614 - DNA, 15 bp, Homo sapiens
attccgttgcaaata

SEQ ID NO: 343615 - DNA, 15 bp, Homo sapiens
ttccgttgcaaatac

SEQ ID NO: 343616 - DNA, 15 bp, Homo sapiens
tccgttgcaaataca

SEQ ID NO: 343617 - DNA, 15 bp, Homo sapiens
ccgttgcaaatacag

SEQ ID NO: 343618 - DNA, 15 bp, Homo sapiens
cgttgcaaatacaga

SEQ ID NO: 343619 - DNA, 15 bp, Homo sapiens
gttgcaaatacagaa

SEQ ID NO: 343620 - DNA, 15 bp, Homo sapiens
ttgcaaatacagaac

SEQ ID NO: 343621 - DNA, 15 bp, Homo sapiens
tgcaaatacagaacc

SEQ ID NO: 343622 - DNA, 15 bp, Homo sapiens
gcaaatacagaacca

SEQ ID NO: 343623 - DNA, 15 bp, Homo sapiens
caaatacagaaccaa

SEQ ID NO: 343624 - DNA, 15 bp, Homo sapiens
aaatacagaaccaag

SEQ ID NO: 343625 - DNA, 15 bp, Homo sapiens
aatacagaaccaagt

SEQ ID NO: 343626 - DNA, 15 bp, Homo sapiens
atacagaaccaagtt

SEQ ID NO: 343627 - DNA, 15 bp, Homo sapiens
tacagaaccaagttg

SEQ ID NO: 343628 - DNA, 15 bp, Homo sapiens
acagaaccaagttgt

SEQ ID NO: 343629 - DNA, 15 bp, Homo sapiens
cagaaccaagttgtt

SEQ ID NO: 343630 - DNA, 15 bp, Homo sapiens
agaaccaagttgttt

SEQ ID NO: 343631 - DNA, 15 bp, Homo sapiens
gaaccaagttgtttt

SEQ ID NO: 343632 - DNA, 15 bp, Homo sapiens
aaccaagttgttttc

SEQ ID NO: 343633 - DNA, 15 bp, Homo sapiens
accaagttgttttcc

SEQ ID NO: 343634 - DNA, 15 bp, Homo sapiens
ccaagttgttttcct

SEQ ID NO: 343635 - DNA, 15 bp, Homo sapiens
caagttgttttcctc

SEQ ID NO: 343636 - DNA, 15 bp, Homo sapiens
aagttgttttcctcc

SEQ ID NO: 343637 - DNA, 15 bp, Homo sapiens
agttgttttcctccc

SEQ ID NO: 343638 - DNA, 15 bp, Homo sapiens
gttgttttcctccct

SEQ ID NO: 343639 - DNA, 15 bp, Homo sapiens
ttgttttcctcccta

SEQ ID NO: 343640 - DNA, 15 bp, Homo sapiens
tgttttcctccctac

SEQ ID NO: 343641 - DNA, 15 bp, Homo sapiens
gttttcctccctact

SEQ ID NO: 343642 - DNA, 15 bp, Homo sapiens
ttttcctccctacta

SEQ ID NO: 343643 - DNA, 15 bp, Homo sapiens
tttcctccctactaa

SEQ ID NO: 343644 - DNA, 15 bp, Homo sapiens
ttcctccctactaaa

SEQ ID NO: 343645 - DNA, 15 bp, Homo sapiens
tcctccctactaaat

SEQ ID NO: 343646 - DNA, 15 bp, Homo sapiens
cctccctactaaata

SEQ ID NO: 343647 - DNA, 15 bp, Homo sapiens
ctccctactaaatag

SEQ ID NO: 343648 - DNA, 15 bp, Homo sapiens
tccctactaaataga

SEQ ID NO: 343649 - DNA, 15 bp, Homo sapiens
ccctactaaatagaa

SEQ ID NO: 343650 - DNA, 15 bp, Homo sapiens
cctactaaatagaaa

SEQ ID NO: 343651 - DNA, 15 bp, Homo sapiens
ctactaaatagaaaa

SEQ ID NO: 343652 - DNA, 15 bp, Homo sapiens
tactaaatagaaaag

SEQ ID NO: 343653 - DNA, 15 bp, Homo sapiens
actaaatagaaaagg

SEQ ID NO: 343654 - DNA, 15 bp, Homo sapiens
ctaaatagaaaaggg

SEQ ID NO: 343655 - DNA, 15 bp, Homo sapiens
taaatagaaaagggt

SEQ ID NO: 343656 - DNA, 15 bp, Homo sapiens
aaatagaaaagggtt

SEQ ID NO: 343657 - DNA, 15 bp, Homo sapiens
aatagaaaagggttt

SEQ ID NO: 343658 - DNA, 15 bp, Homo sapiens
atagaaaagggtttc

SEQ ID NO: 343659 - DNA, 15 bp, Homo sapiens
tagaaaagggtttcc

SEQ ID NO: 343660 - DNA, 15 bp, Homo sapiens
agaaaagggtttcca

SEQ ID NO: 343661 - DNA, 15 bp, Homo sapiens
gaaaagggtttccac

SEQ ID NO: 343662 - DNA, 15 bp, Homo sapiens
aaaagggtttccacc

SEQ ID NO: 343663 - DNA, 15 bp, Homo sapiens
aaagggtttccaccc

SEQ ID NO: 343664 - DNA, 15 bp, Homo sapiens
aagggtttccaccct

SEQ ID NO: 343665 - DNA, 15 bp, Homo sapiens
agggtttccacccta

SEQ ID NO: 343666 - DNA, 15 bp, Homo sapiens
gggtttccaccctaa

SEQ ID NO: 343667 - DNA, 15 bp, Homo sapiens
ggtttccaccctaaa

SEQ ID NO: 343668 - DNA, 15 bp, Homo sapiens
gtttccaccctaaat

SEQ ID NO: 343669 - DNA, 15 bp, Homo sapiens
tttccaccctaaatg

SEQ ID NO: 343670 - DNA, 15 bp, Homo sapiens
ttccaccctaaatgc

SEQ ID NO: 343671 - DNA, 15 bp, Homo sapiens
tccaccctaaatgct

SEQ ID NO: 343672 - DNA, 15 bp, Homo sapiens
ccaccctaaatgcta

SEQ ID NO: 343673 - DNA, 15 bp, Homo sapiens
caccctaaatgctac

SEQ ID NO: 343674 - DNA, 15 bp, Homo sapiens
accctaaatgctaca

SEQ ID NO: 343675 - DNA, 15 bp, Homo sapiens
ccctaaatgctacat

SEQ ID NO: 343676 - DNA, 15 bp, Homo sapiens
cctaaatgctacatt

SEQ ID NO: 343677 - DNA, 15 bp, Homo sapiens
ctaaatgctacattt

SEQ ID NO: 343678 - DNA, 15 bp, Homo sapiens
taaatgctacatttt

SEQ ID NO: 343679 - DNA, 15 bp, Homo sapiens
aatgctacattttgg

SEQ ID NO: 343680 - DNA, 15 bp, Homo sapiens
atgctacattttggg

SEQ ID NO: 343681 - DNA, 15 bp, Homo sapiens
tgctacattttggga

SEQ ID NO: 343682 - DNA, 15 bp, Homo sapiens
gctacattttgggag

SEQ ID NO: 343683 - DNA, 15 bp, Homo sapiens
ctacattttgggaga

SEQ ID NO: 343684 - DNA, 15 bp, Homo sapiens
tacattttgggagaa

SEQ ID NO: 343685 - DNA, 15 bp, Homo sapiens
acattttgggagaaa

SEQ ID NO: 343686 - DNA, 15 bp, Homo sapiens
cattttgggagaaat

SEQ ID NO: 343687 - DNA, 15 bp, Homo sapiens
attttgggagaaatt

SEQ ID NO: 343688 - DNA, 15 bp, Homo sapiens
ttttgggagaaatta

SEQ ID NO: 343689 - DNA, 15 bp, Homo sapiens
tttgggagaaattat

SEQ ID NO: 343690 - DNA, 15 bp, Homo sapiens
ttgggagaaattatc

SEQ ID NO: 343691 - DNA, 15 bp, Homo sapiens
tgggagaaattatca

SEQ ID NO: 343692 - DNA, 15 bp, Homo sapiens
gggagaaattatcac

SEQ ID NO: 343693 - DNA, 15 bp, Homo sapiens
ggagaaattatcaca

SEQ ID NO: 343694 - DNA, 15 bp, Homo sapiens
gagaaattatcacaa

SEQ ID NO: 343695 - DNA, 15 bp, Homo sapiens
agaaattatcacaat

SEQ ID NO: 343696 - DNA, 15 bp, Homo sapiens
gaaattatcacaatg

SEQ ID NO: 343697 - DNA, 15 bp, Homo sapiens
aaattatcacaatgt

SEQ ID NO: 343698 - DNA, 15 bp, Homo sapiens
aattatcacaatgta

SEQ ID NO: 343699 - DNA, 15 bp, Homo sapiens
attatcacaatgtag

SEQ ID NO: 343700 - DNA, 15 bp, Homo sapiens
ttatcacaatgtagc

SEQ ID NO: 343701 - DNA, 15 bp, Homo sapiens
tatcacaatgtagct

SEQ ID NO: 343702 - DNA, 15 bp, Homo sapiens
atcacaatgtagcta

SEQ ID NO: 343703 - DNA, 15 bp, Homo sapiens
tcacaatgtagctac

SEQ ID NO: 343704 - DNA, 15 bp, Homo sapiens
cacaatgtagctacg

SEQ ID NO: 343705 - DNA, 15 bp, Homo sapiens
acaatgtagctacgg

SEQ ID NO: 343706 - DNA, 15 bp, Homo sapiens
caatgtagctacggt

SEQ ID NO: 343707 - DNA, 15 bp, Homo sapiens
aatgtagctacggtt

SEQ ID NO: 343708 - DNA, 15 bp, Homo sapiens
atgtagctacggttg

SEQ ID NO: 343709 - DNA, 15 bp, Homo sapiens
tgtagctacggttgt

SEQ ID NO: 343710 - DNA, 15 bp, Homo sapiens
gtagctacggttgtt

SEQ ID NO: 343711 - DNA, 15 bp, Homo sapiens
tagctacggttgttt

SEQ ID NO: 343712 - DNA, 15 bp, Homo sapiens
agctacggttgtttt

SEQ ID NO: 343713 - DNA, 15 bp, Homo sapiens
gctacggttgttttc

SEQ ID NO: 343714 - DNA, 15 bp, Homo sapiens
ctacggttgttttcc

SEQ ID NO: 343715 - DNA, 15 bp, Homo sapiens
tacggttgttttcca

SEQ ID NO: 343716 - DNA, 15 bp, Homo sapiens
acggttgttttccat

SEQ ID NO: 343717 - DNA, 15 bp, Homo sapiens
cggttgttttccatc

SEQ ID NO: 343718 - DNA, 15 bp, Homo sapiens
ggttgttttccatcc

SEQ ID NO: 343719 - DNA, 15 bp, Homo sapiens
gttgttttccatccc

SEQ ID NO: 343720 - DNA, 15 bp, Homo sapiens
ttgttttccatccct

SEQ ID NO: 343721 - DNA, 15 bp, Homo sapiens
tgttttccatccctt

SEQ ID NO: 343722 - DNA, 15 bp, Homo sapiens
gttttccatcccttc

SEQ ID NO: 343723 - DNA, 15 bp, Homo sapiens
ttttccatcccttct

SEQ ID NO: 343724 - DNA, 15 bp, Homo sapiens
tttccatcccttctt

SEQ ID NO: 343725 - DNA, 15 bp, Homo sapiens
ttccatcccttcttc

SEQ ID NO: 343726 - DNA, 15 bp, Homo sapiens
tccatcccttcttca

SEQ ID NO: 343727 - DNA, 15 bp, Homo sapiens
ccatcccttcttcag

SEQ ID NO: 343728 - DNA, 15 bp, Homo sapiens
catcccttcttcagg

SEQ ID NO: 343729 - DNA, 15 bp, Homo sapiens
atcccttcttcagga

SEQ ID NO: 343730 - DNA, 15 bp, Homo sapiens
tcccttcttcaggat

SEQ ID NO: 343731 - DNA, 15 bp, Homo sapiens
cccttcttcaggatt

SEQ ID NO: 343732 - DNA, 15 bp, Homo sapiens
ccttcttcaggatta

SEQ ID NO: 343733 - DNA, 15 bp, Homo sapiens
cttcttcaggattat

SEQ ID NO: 343734 - DNA, 15 bp, Homo sapiens
ttcttcaggattatc

SEQ ID NO: 343735 - DNA, 15 bp, Homo sapiens
tcttcaggattatct

SEQ ID NO: 343736 - DNA, 15 bp, Homo sapiens
cttcaggattatctc

SEQ ID NO: 343737 - DNA, 15 bp, Homo sapiens
ttcaggattatctct

SEQ ID NO: 343738 - DNA, 15 bp, Homo sapiens
tcaggattatctctc

SEQ ID NO: 343739 - DNA, 15 bp, Homo sapiens
caggattatctctct

SEQ ID NO: 343740 - DNA, 15 bp, Homo sapiens
aggattatctctcta

SEQ ID NO: 343741 - DNA, 15 bp, Homo sapiens
ggattatctctctac

SEQ ID NO: 343742 - DNA, 15 bp, Homo sapiens
gattatctctctaca

SEQ ID NO: 343743 - DNA, 15 bp, Homo sapiens
attatctctctacat

SEQ ID NO: 343744 - DNA, 15 bp, Homo sapiens
ttatctctctacatg

SEQ ID NO: 343745 - DNA, 15 bp, Homo sapiens
tatctctctacatga

SEQ ID NO: 343746 - DNA, 15 bp, Homo sapiens
atctctctacatgac

SEQ ID NO: 343747 - DNA, 15 bp, Homo sapiens
tctctctacatgact

SEQ ID NO: 343748 - DNA, 15 bp, Homo sapiens
ctctctacatgactg

SEQ ID NO: 343749 - DNA, 15 bp, Homo sapiens
tctctacatgactga

SEQ ID NO: 343750 - DNA, 15 bp, Homo sapiens
ctctacatgactgaa

SEQ ID NO: 343751 - DNA, 15 bp, Homo sapiens
tctacatgactgaat

SEQ ID NO: 343752 - DNA, 15 bp, Homo sapiens
ctacatgactgaata

SEQ ID NO: 343753 - DNA, 15 bp, Homo sapiens
tacatgactgaatat

SEQ ID NO: 343754 - DNA, 15 bp, Homo sapiens
acatgactgaatatc

SEQ ID NO: 343755 - DNA, 15 bp, Homo sapiens
catgactgaatatcc

SEQ ID NO: 343756 - DNA, 15 bp, Homo sapiens
atgactgaatatcct

SEQ ID NO: 343757 - DNA, 15 bp, Homo sapiens
tgactgaatatcctc

SEQ ID NO: 343758 - DNA, 15 bp, Homo sapiens
gactgaatatcctct

SEQ ID NO: 343759 - DNA, 15 bp, Homo sapiens
actgaatatcctctg

SEQ ID NO: 343760 - DNA, 15 bp, Homo sapiens
ctgaatatcctctgc

SEQ ID NO: 343761 - DNA, 15 bp, Homo sapiens
tgaatatcctctgct

SEQ ID NO: 343762 - DNA, 15 bp, Homo sapiens
gaatatcctctgctt

SEQ ID NO: 343763 - DNA, 15 bp, Homo sapiens
aatatcctctgctta

SEQ ID NO: 343764 - DNA, 15 bp, Homo sapiens
atatcctctgcttag

SEQ ID NO: 343765 - DNA, 15 bp, Homo sapiens
tatcctctgcttaga

SEQ ID NO: 343766 - DNA, 15 bp, Homo sapiens
atcctctgcttagaa

SEQ ID NO: 343767 - DNA, 15 bp, Homo sapiens
tcctctgcttagaaa

SEQ ID NO: 343768 - DNA, 15 bp, Homo sapiens
cctctgcttagaaaa

SEQ ID NO: 343769 - DNA, 15 bp, Homo sapiens
ctctgcttagaaaac

SEQ ID NO: 343770 - DNA, 15 bp, Homo sapiens
tctgcttagaaaaca

SEQ ID NO: 343771 - DNA, 15 bp, Homo sapiens
ctgcttagaaaacac

SEQ ID NO: 343772 - DNA, 15 bp, Homo sapiens
tgcttagaaaacaca

SEQ ID NO: 343773 - DNA, 15 bp, Homo sapiens
gcttagaaaacacac

SEQ ID NO: 343774 - DNA, 15 bp, Homo sapiens
cttagaaaacacaca

SEQ ID NO: 343775 - DNA, 15 bp, Homo sapiens
ttagaaaacacacat

SEQ ID NO: 343776 - DNA, 15 bp, Homo sapiens
tagaaaacacacatt

SEQ ID NO: 343777 - DNA, 15 bp, Homo sapiens
agaaaacacacattg

SEQ ID NO: 343778 - DNA, 15 bp, Homo sapiens
gaaaacacacattgt

SEQ ID NO: 343779 - DNA, 15 bp, Homo sapiens
aaaacacacattgtt

SEQ ID NO: 343780 - DNA, 15 bp, Homo sapiens
aaacacacattgttg

SEQ ID NO: 343781 - DNA, 15 bp, Homo sapiens
aacacacattgttgt

SEQ ID NO: 343782 - DNA, 15 bp, Homo sapiens
acacacattgttgtc

SEQ ID NO: 343783 - DNA, 15 bp, Homo sapiens
cacacattgttgtcc

SEQ ID NO: 343784 - DNA, 15 bp, Homo sapiens
acacattgttgtcca

SEQ ID NO: 343785 - DNA, 15 bp, Homo sapiens
cacattgttgtccaa

SEQ ID NO: 343786 - DNA, 15 bp, Homo sapiens
acattgttgtccaat

SEQ ID NO: 343787 - DNA, 15 bp, Homo sapiens
cattgttgtccaatg

SEQ ID NO: 343788 - DNA, 15 bp, Homo sapiens
attgttgtccaatga

SEQ ID NO: 343789 - DNA, 15 bp, Homo sapiens
ttgttgtccaatgaa

SEQ ID NO: 343790 - DNA, 15 bp, Homo sapiens
tgttgtccaatgaag

SEQ ID NO: 343791 - DNA, 15 bp, Homo sapiens
gttgtccaatgaagt

SEQ ID NO: 343792 - DNA, 15 bp, Homo sapiens
ttgtccaatgaagtt

SEQ ID NO: 343793 - DNA, 15 bp, Homo sapiens
tgtccaatgaagttg

SEQ ID NO: 343794 - DNA, 15 bp, Homo sapiens
gtccaatgaagttga

SEQ ID NO: 343795 - DNA, 15 bp, Homo sapiens
tccaatgaagttgaa

SEQ ID NO: 343796 - DNA, 15 bp, Homo sapiens
ccaatgaagttgaaa

SEQ ID NO: 343797 - DNA, 15 bp, Homo sapiens
caatgaagttgaaaa

SEQ ID NO: 343798 - DNA, 15 bp, Homo sapiens
aatgaagttgaaaaa

SEQ ID NO: 343799 - DNA, 15 bp, Homo sapiens
atgaagttgaaaaat

SEQ ID NO: 343800 - DNA, 15 bp, Homo sapiens
tgaagttgaaaaatc

SEQ ID NO: 343801 - DNA, 15 bp, Homo sapiens
gaagttgaaaaatct

SEQ ID NO: 343802 - DNA, 15 bp, Homo sapiens
aagttgaaaaatctt

SEQ ID NO: 343803 - DNA, 15 bp, Homo sapiens
agttgaaaaatcttt

SEQ ID NO: 343804 - DNA, 15 bp, Homo sapiens
gttgaaaaatcttta

SEQ ID NO: 343805 - DNA, 15 bp, Homo sapiens
ttgaaaaatctttat

SEQ ID NO: 343806 - DNA, 15 bp, Homo sapiens
tgaaaaatctttata

SEQ ID NO: 343807 - DNA, 15 bp, Homo sapiens
gaaaaatctttatat

SEQ ID NO: 343808 - DNA, 15 bp, Homo sapiens
aaaaatctttatatg

SEQ ID NO: 343809 - DNA, 15 bp, Homo sapiens
aaaatctttatatgg

SEQ ID NO: 343810 - DNA, 15 bp, Homo sapiens
aaatctttatatggg

SEQ ID NO: 343811 - DNA, 15 bp, Homo sapiens
aatctttatatgggc

SEQ ID NO: 343812 - DNA, 15 bp, Homo sapiens
atctttatatgggct

SEQ ID NO: 343813 - DNA, 15 bp, Homo sapiens
tctttatatgggctt

SEQ ID NO: 343814 - DNA, 15 bp, Homo sapiens
ctttatatgggcttt

SEQ ID NO: 343815 - DNA, 15 bp, Homo sapiens
tttatatgggctttg

SEQ ID NO: 343816 - DNA, 15 bp, Homo sapiens
ttatatgggctttgg

SEQ ID NO: 343817 - DNA, 15 bp, Homo sapiens
tatatgggctttggg

SEQ ID NO: 343818 - DNA, 15 bp, Homo sapiens
atatgggctttgggt

SEQ ID NO: 343819 - DNA, 15 bp, Homo sapiens
tatgggctttgggtg

SEQ ID NO: 343820 - DNA, 15 bp, Homo sapiens
atgggctttgggtgc

SEQ ID NO: 343821 - DNA, 15 bp, Homo sapiens
tgggctttgggtgct

SEQ ID NO: 343822 - DNA, 15 bp, Homo sapiens
gggctttgggtgctc

SEQ ID NO: 343823 - DNA, 15 bp, Homo sapiens
ggctttgggtgctct

SEQ ID NO: 343824 - DNA, 15 bp, Homo sapiens
gctttgggtgctctt

SEQ ID NO: 343825 - DNA, 15 bp, Homo sapiens
ctttgggtgctcttc

SEQ ID NO: 343826 - DNA, 15 bp, Homo sapiens
tttgggtgctcttca

SEQ ID NO: 343827 - DNA, 15 bp, Homo sapiens
ttgggtgctcttcag

SEQ ID NO: 343828 - DNA, 15 bp, Homo sapiens
tgggtgctcttcaga

SEQ ID NO: 343829 - DNA, 15 bp, Homo sapiens
gggtgctcttcagac

SEQ ID NO: 343830 - DNA, 15 bp, Homo sapiens
ggtgctcttcagact

SEQ ID NO: 343831 - DNA, 15 bp, Homo sapiens
gtgctcttcagactc

SEQ ID NO: 343832 - DNA, 15 bp, Homo sapiens
tgctcttcagactcc

SEQ ID NO: 343833 - DNA, 15 bp, Homo sapiens
gctcttcagactccc

SEQ ID NO: 343834 - DNA, 15 bp, Homo sapiens
ctcttcagactccct

SEQ ID NO: 343835 - DNA, 15 bp, Homo sapiens
tcttcagactccctc

SEQ ID NO: 343836 - DNA, 15 bp, Homo sapiens
cttcagactccctcc

SEQ ID NO: 343837 - DNA, 15 bp, Homo sapiens
ttcagactccctcct

SEQ ID NO: 343838 - DNA, 15 bp, Homo sapiens
tcagactccctcctt

SEQ ID NO: 343839 - DNA, 15 bp, Homo sapiens
cagactccctccttt

SEQ ID NO: 343840 - DNA, 15 bp, Homo sapiens
agactccctccttta

SEQ ID NO: 343841 - DNA, 15 bp, Homo sapiens
gactccctcctttaa

SEQ ID NO: 343842 - DNA, 15 bp, Homo sapiens
actccctcctttaat

SEQ ID NO: 343843 - DNA, 15 bp, Homo sapiens
ctccctcctttaatc

SEQ ID NO: 343844 - DNA, 15 bp, Homo sapiens
tccctcctttaatca

SEQ ID NO: 343845 - DNA, 15 bp, Homo sapiens
ccctcctttaatcat

SEQ ID NO: 343846 - DNA, 15 bp, Homo sapiens
cctcctttaatcata

SEQ ID NO: 343847 - DNA, 15 bp, Homo sapiens
ctcctttaatcataa

SEQ ID NO: 343848 - DNA, 15 bp, Homo sapiens
tcctttaatcataat

SEQ ID NO: 343849 - DNA, 15 bp, Homo sapiens
cctttaatcataatt

SEQ ID NO: 343850 - DNA, 15 bp, Homo sapiens
ctttaatcataattg

SEQ ID NO: 343851 - DNA, 15 bp, Homo sapiens
tttaatcataattgc

SEQ ID NO: 343852 - DNA, 15 bp, Homo sapiens
ttaatcataattgct

SEQ ID NO: 343853 - DNA, 15 bp, Homo sapiens
taatcataattgctg

SEQ ID NO: 343854 - DNA, 15 bp, Homo sapiens
aatcataattgctgt

SEQ ID NO: 343855 - DNA, 15 bp, Homo sapiens
atcataattgctgtt

SEQ ID NO: 343856 - DNA, 15 bp, Homo sapiens
tcataattgctgttg

SEQ ID NO: 343857 - DNA, 15 bp, Homo sapiens
cataattgctgttga

SEQ ID NO: 343858 - DNA, 15 bp, Homo sapiens
ataattgctgttgaa

SEQ ID NO: 343859 - DNA, 15 bp, Homo sapiens
taattgctgttgaac

SEQ ID NO: 343860 - DNA, 15 bp, Homo sapiens
aattgctgttgaacc

SEQ ID NO: 343861 - DNA, 15 bp, Homo sapiens
attgctgttgaacct

SEQ ID NO: 343862 - DNA, 15 bp, Homo sapiens
ttgctgttgaacctt

SEQ ID NO: 343863 - DNA, 15 bp, Homo sapiens
tgctgttgaaccttg

SEQ ID NO: 343864 - DNA, 15 bp, Homo sapiens
gctgttgaaccttga

SEQ ID NO: 343865 - DNA, 15 bp, Homo sapiens
ctgttgaaccttgaa

SEQ ID NO: 343866 - DNA, 15 bp, Homo sapiens
tgttgaaccttgaat

SEQ ID NO: 343867 - DNA, 15 bp, Homo sapiens
gttgaaccttgaatg

SEQ ID NO: 343868 - DNA, 15 bp, Homo sapiens
ttgaaccttgaatgc

SEQ ID NO: 343869 - DNA, 15 bp, Homo sapiens
tgaaccttgaatgct

SEQ ID NO: 343870 - DNA, 15 bp, Homo sapiens
gaaccttgaatgcta

SEQ ID NO: 343871 - DNA, 15 bp, Homo sapiens
aaccttgaatgctag

SEQ ID NO: 343872 - DNA, 15 bp, Homo sapiens
accttgaatgctagt

SEQ ID NO: 343873 - DNA, 15 bp, Homo sapiens
ccttgaatgctagtg

SEQ ID NO: 343874 - DNA, 15 bp, Homo sapiens
cttgaatgctagtgt

SEQ ID NO: 343875 - DNA, 15 bp, Homo sapiens
ttgaatgctagtgtg

SEQ ID NO: 343876 - DNA, 15 bp, Homo sapiens
tgaatgctagtgtgg

SEQ ID NO: 343877 - DNA, 15 bp, Homo sapiens
gaatgctagtgtgga

SEQ ID NO: 343878 - DNA, 15 bp, Homo sapiens
aatgctagtgtggat

SEQ ID NO: 343879 - DNA, 15 bp, Homo sapiens
atgctagtgtggatt

SEQ ID NO: 343880 - DNA, 15 bp, Homo sapiens
tgctagtgtggattt

SEQ ID NO: 343881 - DNA, 15 bp, Homo sapiens
gctagtgtggatttc

SEQ ID NO: 343882 - DNA, 15 bp, Homo sapiens
ctagtgtggatttcc

SEQ ID NO: 343883 - DNA, 15 bp, Homo sapiens
tagtgtggatttcct

SEQ ID NO: 343884 - DNA, 15 bp, Homo sapiens
agtgtggatttccta

SEQ ID NO: 343885 - DNA, 15 bp, Homo sapiens
gtgtggatttcctac

SEQ ID NO: 343886 - DNA, 15 bp, Homo sapiens
tgtggatttcctaca

SEQ ID NO: 343887 - DNA, 15 bp, Homo sapiens
gtggatttcctacat

SEQ ID NO: 343888 - DNA, 15 bp, Homo sapiens
tggatttcctacatg

SEQ ID NO: 343889 - DNA, 15 bp, Homo sapiens
ggatttcctacatga

SEQ ID NO: 343890 - DNA, 15 bp, Homo sapiens
gatttcctacatgat

SEQ ID NO: 343891 - DNA, 15 bp, Homo sapiens
atttcctacatgatg

SEQ ID NO: 343892 - DNA, 15 bp, Homo sapiens
tttcctacatgatgc

SEQ ID NO: 343893 - DNA, 15 bp, Homo sapiens
ttcctacatgatgcc

SEQ ID NO: 343894 - DNA, 15 bp, Homo sapiens
tcctacatgatgcca

SEQ ID NO: 343895 - DNA, 15 bp, Homo sapiens
cctacatgatgccat

SEQ ID NO: 343896 - DNA, 15 bp, Homo sapiens
ctacatgatgccatg

SEQ ID NO: 343897 - DNA, 15 bp, Homo sapiens
tacatgatgccatgg

SEQ ID NO: 343898 - DNA, 15 bp, Homo sapiens
acatgatgccatgga

SEQ ID NO: 343899 - DNA, 15 bp, Homo sapiens
catgatgccatggaa

SEQ ID NO: 343900 - DNA, 15 bp, Homo sapiens
atgatgccatggaaa

SEQ ID NO: 343901 - DNA, 15 bp, Homo sapiens
tgatgccatggaaaa

SEQ ID NO: 343902 - DNA, 15 bp, Homo sapiens
gatgccatggaaaac

SEQ ID NO: 343903 - DNA, 15 bp, Homo sapiens
atgccatggaaaaca

SEQ ID NO: 343904 - DNA, 15 bp, Homo sapiens
tgccatggaaaacac

SEQ ID NO: 343905 - DNA, 15 bp, Homo sapiens
gccatggaaaacact

SEQ ID NO: 343906 - DNA, 15 bp, Homo sapiens
ccatggaaaacactg

SEQ ID NO: 343907 - DNA, 15 bp, Homo sapiens
catggaaaacactgg

SEQ ID NO: 343908 - DNA, 15 bp, Homo sapiens
atggaaaacactggt

SEQ ID NO: 343909 - DNA, 15 bp, Homo sapiens
tggaaaacactggtt

SEQ ID NO: 343910 - DNA, 15 bp, Homo sapiens
ggaaaacactggttt

SEQ ID NO: 343911 - DNA, 15 bp, Homo sapiens
gaaaacactggtttt

SEQ ID NO: 343912 - DNA, 15 bp, Homo sapiens
aaaacactggttttg

SEQ ID NO: 343913 - DNA, 15 bp, Homo sapiens
aaacactggttttgg

SEQ ID NO: 343914 - DNA, 15 bp, Homo sapiens
aacactggttttggg

SEQ ID NO: 343915 - DNA, 15 bp, Homo sapiens
acactggttttgggg

SEQ ID NO: 343916 - DNA, 15 bp, Homo sapiens
cactggttttggggt

SEQ ID NO: 343917 - DNA, 15 bp, Homo sapiens
actggttttggggtg

SEQ ID NO: 343918 - DNA, 15 bp, Homo sapiens
ctggttttggggtgt

SEQ ID NO: 343919 - DNA, 15 bp, Homo sapiens
tggttttggggtgtg

SEQ ID NO: 343920 - DNA, 15 bp, Homo sapiens
ggttttggggtgtgg

SEQ ID NO: 343921 - DNA, 15 bp, Homo sapiens
gttttggggtgtgga

SEQ ID NO: 343922 - DNA, 15 bp, Homo sapiens
ttttggggtgtggac

SEQ ID NO: 343923 - DNA, 15 bp, Homo sapiens
tttggggtgtggacc

SEQ ID NO: 343924 - DNA, 15 bp, Homo sapiens
ttggggtgtggaccc

SEQ ID NO: 343925 - DNA, 15 bp, Homo sapiens
tggggtgtggaccct

SEQ ID NO: 343926 - DNA, 15 bp, Homo sapiens
ggggtgtggaccctg

SEQ ID NO: 343927 - DNA, 15 bp, Homo sapiens
gggtgtggaccctgg

SEQ ID NO: 343928 - DNA, 15 bp, Homo sapiens
ggtgtggaccctgga

SEQ ID NO: 343929 - DNA, 15 bp, Homo sapiens
gtgtggaccctggac

SEQ ID NO: 343930 - DNA, 15 bp, Homo sapiens
tgtggaccctggacc

SEQ ID NO: 343931 - DNA, 15 bp, Homo sapiens
gtggaccctggaccc

SEQ ID NO: 343932 - DNA, 15 bp, Homo sapiens
tggaccctggaccca

SEQ ID NO: 343933 - DNA, 15 bp, Homo sapiens
ggaccctggacccag

SEQ ID NO: 343934 - DNA, 15 bp, Homo sapiens
gaccctggacccagc

SEQ ID NO: 343935 - DNA, 15 bp, Homo sapiens
accctggacccagct

SEQ ID NO: 343936 - DNA, 15 bp, Homo sapiens
ccctggacccagctc

SEQ ID NO: 343937 - DNA, 15 bp, Homo sapiens
cctggacccagctct

SEQ ID NO: 343938 - DNA, 15 bp, Homo sapiens
ctggacccagctctg

SEQ ID NO: 343939 - DNA, 15 bp, Homo sapiens
tggacccagctctgc

SEQ ID NO: 343940 - DNA, 15 bp, Homo sapiens
ggacccagctctgcc

SEQ ID NO: 343941 - DNA, 15 bp, Homo sapiens
gacccagctctgcca

SEQ ID NO: 343942 - DNA, 15 bp, Homo sapiens
acccagctctgccat

SEQ ID NO: 343943 - DNA, 15 bp, Homo sapiens
cccagctctgccatt

SEQ ID NO: 343944 - DNA, 15 bp, Homo sapiens
ccagctctgccatta

SEQ ID NO: 343945 - DNA, 15 bp, Homo sapiens
cagctctgccattaa

SEQ ID NO: 343946 - DNA, 15 bp, Homo sapiens
agctctgccattaac

SEQ ID NO: 343947 - DNA, 15 bp, Homo sapiens
gctctgccattaact

SEQ ID NO: 343948 - DNA, 15 bp, Homo sapiens
ctctgccattaacta

SEQ ID NO: 343949 - DNA, 15 bp, Homo sapiens
tctgccattaactat

SEQ ID NO: 343950 - DNA, 15 bp, Homo sapiens
ctgccattaactatc

SEQ ID NO: 343951 - DNA, 15 bp, Homo sapiens
tgccattaactatcc

SEQ ID NO: 343952 - DNA, 15 bp, Homo sapiens
gccattaactatcca

SEQ ID NO: 343953 - DNA, 15 bp, Homo sapiens
ccattaactatccaa

SEQ ID NO: 343954 - DNA, 15 bp, Homo sapiens
cattaactatccaag

SEQ ID NO: 343955 - DNA, 15 bp, Homo sapiens
attaactatccaagt

SEQ ID NO: 343956 - DNA, 15 bp, Homo sapiens
ttaactatccaagtg

SEQ ID NO: 343957 - DNA, 15 bp, Homo sapiens
taactatccaagtga

SEQ ID NO: 343958 - DNA, 15 bp, Homo sapiens
aactatccaagtgat

SEQ ID NO: 343959 - DNA, 15 bp, Homo sapiens
actatccaagtgatc

SEQ ID NO: 343960 - DNA, 15 bp, Homo sapiens
ctatccaagtgatct

SEQ ID NO: 343961 - DNA, 15 bp, Homo sapiens
tatccaagtgatctg

SEQ ID NO: 343962 - DNA, 15 bp, Homo sapiens
atccaagtgatctgg

SEQ ID NO: 343963 - DNA, 15 bp, Homo sapiens
tccaagtgatctggg

SEQ ID NO: 343964 - DNA, 15 bp, Homo sapiens
ccaagtgatctggga

SEQ ID NO: 343965 - DNA, 15 bp, Homo sapiens
caagtgatctgggac

SEQ ID NO: 343966 - DNA, 15 bp, Homo sapiens
aagtgatctgggaca

SEQ ID NO: 343967 - DNA, 15 bp, Homo sapiens
agtgatctgggacat

SEQ ID NO: 343968 - DNA, 15 bp, Homo sapiens
gtgatctgggacatg

SEQ ID NO: 343969 - DNA, 15 bp, Homo sapiens
tgatctgggacatgt

SEQ ID NO: 343970 - DNA, 15 bp, Homo sapiens
gatctgggacatgta

SEQ ID NO: 343971 - DNA, 15 bp, Homo sapiens
atctgggacatgtaa

SEQ ID NO: 343972 - DNA, 15 bp, Homo sapiens
tctgggacatgtaac

SEQ ID NO: 343973 - DNA, 15 bp, Homo sapiens
ctgggacatgtaact

SEQ ID NO: 343974 - DNA, 15 bp, Homo sapiens
tgggacatgtaactt

SEQ ID NO: 343975 - DNA, 15 bp, Homo sapiens
gggacatgtaacttg

SEQ ID NO: 343976 - DNA, 15 bp, Homo sapiens
ggacatgtaacttga

SEQ ID NO: 343977 - DNA, 15 bp, Homo sapiens
gacatgtaacttgac

SEQ ID NO: 343978 - DNA, 15 bp, Homo sapiens
acatgtaacttgact

SEQ ID NO: 343979 - DNA, 15 bp, Homo sapiens
catgtaacttgactt

SEQ ID NO: 343980 - DNA, 15 bp, Homo sapiens
atgtaacttgacttc

SEQ ID NO: 343981 - DNA, 15 bp, Homo sapiens
tgtaacttgacttct

SEQ ID NO: 343982 - DNA, 15 bp, Homo sapiens
gtaacttgacttctc

SEQ ID NO: 343983 - DNA, 15 bp, Homo sapiens
taacttgacttctct

SEQ ID NO: 343984 - DNA, 15 bp, Homo sapiens
aacttgacttctctt

SEQ ID NO: 343985 - DNA, 15 bp, Homo sapiens
acttgacttctcttt

SEQ ID NO: 343986 - DNA, 15 bp, Homo sapiens
cttgacttctctttc

SEQ ID NO: 343987 - DNA, 15 bp, Homo sapiens
ttgacttctctttcc

SEQ ID NO: 343988 - DNA, 15 bp, Homo sapiens
tgacttctctttcct

SEQ ID NO: 343989 - DNA, 15 bp, Homo sapiens
gacttctctttcctt

SEQ ID NO: 343990 - DNA, 15 bp, Homo sapiens
acttctctttccttc

SEQ ID NO: 343991 - DNA, 15 bp, Homo sapiens
cttctctttccttcc

SEQ ID NO: 343992 - DNA, 15 bp, Homo sapiens
ttctctttccttcct

SEQ ID NO: 343993 - DNA, 15 bp, Homo sapiens
tctctttccttcctt

SEQ ID NO: 343994 - DNA, 15 bp, Homo sapiens
ctctttccttccttt

SEQ ID NO: 343995 - DNA, 15 bp, Homo sapiens
tctttccttcctttc

SEQ ID NO: 343996 - DNA, 15 bp, Homo sapiens
ctttccttcctttct

SEQ ID NO: 343997 - DNA, 15 bp, Homo sapiens
tttccttcctttcta

SEQ ID NO: 343998 - DNA, 15 bp, Homo sapiens
ttccttcctttctaa

SEQ ID NO: 343999 - DNA, 15 bp, Homo sapiens
tccttcctttctaaa

SEQ ID NO: 344000 - DNA, 15 bp, Homo sapiens
ccttcctttctaaaa

SEQ ID NO: 344001 - DNA, 15 bp, Homo sapiens
cttcctttctaaaat

SEQ ID NO: 344002 - DNA, 15 bp, Homo sapiens
ttcctttctaaaatg

SEQ ID NO: 344003 - DNA, 15 bp, Homo sapiens
tcctttctaaaatga

SEQ ID NO: 344004 - DNA, 15 bp, Homo sapiens
cctttctaaaatgag

SEQ ID NO: 344005 - DNA, 15 bp, Homo sapiens
ctttctaaaatgagg

SEQ ID NO: 344006 - DNA, 15 bp, Homo sapiens
tttctaaaatgaggg

SEQ ID NO: 344007 - DNA, 15 bp, Homo sapiens
ttctaaaatgagggg

SEQ ID NO: 344008 - DNA, 15 bp, Homo sapiens
tctaaaatgaggggc

SEQ ID NO: 344009 - DNA, 15 bp, Homo sapiens
ctaaaatgaggggct

SEQ ID NO: 344010 - DNA, 15 bp, Homo sapiens
taaaatgaggggctg

SEQ ID NO: 344011 - DNA, 15 bp, Homo sapiens
aaaatgaggggctgg

SEQ ID NO: 344012 - DNA, 15 bp, Homo sapiens
aaatgaggggctggg

SEQ ID NO: 344013 - DNA, 15 bp, Homo sapiens
aatgaggggctggga

SEQ ID NO: 344014 - DNA, 15 bp, Homo sapiens
atgaggggctgggac

SEQ ID NO: 344015 - DNA, 15 bp, Homo sapiens
tgaggggctgggaca

SEQ ID NO: 344016 - DNA, 15 bp, Homo sapiens
gaggggctgggacaa

SEQ ID NO: 344017 - DNA, 15 bp, Homo sapiens
aggggctgggacaag

SEQ ID NO: 344018 - DNA, 15 bp, Homo sapiens
ggggctgggacaaga

SEQ ID NO: 344019 - DNA, 15 bp, Homo sapiens
gggctgggacaagac

SEQ ID NO: 344020 - DNA, 15 bp, Homo sapiens
ggctgggacaagaca

SEQ ID NO: 344021 - DNA, 15 bp, Homo sapiens
gctgggacaagacaa

SEQ ID NO: 344022 - DNA, 15 bp, Homo sapiens
ctgggacaagacaat

SEQ ID NO: 344023 - DNA, 15 bp, Homo sapiens
tgggacaagacaatc

SEQ ID NO: 344024 - DNA, 15 bp, Homo sapiens
gggacaagacaatct

SEQ ID NO: 344025 - DNA, 15 bp, Homo sapiens
ggacaagacaatctc

SEQ ID NO: 344026 - DNA, 15 bp, Homo sapiens
gacaagacaatctcc

SEQ ID NO: 344027 - DNA, 15 bp, Homo sapiens
acaagacaatctccg

SEQ ID NO: 344028 - DNA, 15 bp, Homo sapiens
caagacaatctccga

SEQ ID NO: 344029 - DNA, 15 bp, Homo sapiens
aagacaatctccgag

SEQ ID NO: 344030 - DNA, 15 bp, Homo sapiens
agacaatctccgagc

SEQ ID NO: 344031 - DNA, 15 bp, Homo sapiens
gacaatctccgagct

SEQ ID NO: 344032 - DNA, 15 bp, Homo sapiens
acaatctccgagctt

SEQ ID NO: 344033 - DNA, 15 bp, Homo sapiens
caatctccgagctta

SEQ ID NO: 344034 - DNA, 15 bp, Homo sapiens
aatctccgagcttac

SEQ ID NO: 344035 - DNA, 15 bp, Homo sapiens
atctccgagcttact

SEQ ID NO: 344036 - DNA, 15 bp, Homo sapiens
tctccgagcttactt

SEQ ID NO: 344037 - DNA, 15 bp, Homo sapiens
ctccgagcttacttc

SEQ ID NO: 344038 - DNA, 15 bp, Homo sapiens
tccgagcttacttct

SEQ ID NO: 344039 - DNA, 15 bp, Homo sapiens
ccgagcttacttctg

SEQ ID NO: 344040 - DNA, 15 bp, Homo sapiens
cgagcttacttctgc

SEQ ID NO: 344041 - DNA, 15 bp, Homo sapiens
gagcttacttctgcc

SEQ ID NO: 344042 - DNA, 15 bp, Homo sapiens
agcttacttctgcct

SEQ ID NO: 344043 - DNA, 15 bp, Homo sapiens
gcttacttctgcctc

SEQ ID NO: 344044 - DNA, 15 bp, Homo sapiens
cttacttctgcctct

SEQ ID NO: 344045 - DNA, 15 bp, Homo sapiens
ttacttctgcctcta

SEQ ID NO: 344046 - DNA, 15 bp, Homo sapiens
tacttctgcctctag

SEQ ID NO: 344047 - DNA, 15 bp, Homo sapiens
acttctgcctctagg

SEQ ID NO: 344048 - DNA, 15 bp, Homo sapiens
cttctgcctctagga

SEQ ID NO: 344049 - DNA, 15 bp, Homo sapiens
ttctgcctctaggaa

SEQ ID NO: 344050 - DNA, 15 bp, Homo sapiens
tctgcctctaggaag

SEQ ID NO: 344051 - DNA, 15 bp, Homo sapiens
ctgcctctaggaagt

SEQ ID NO: 344052 - DNA, 15 bp, Homo sapiens
tgcctctaggaagtt

SEQ ID NO: 344053 - DNA, 15 bp, Homo sapiens
gcctctaggaagttg

SEQ ID NO: 344054 - DNA, 15 bp, Homo sapiens
cctctaggaagttgt

SEQ ID NO: 344055 - DNA, 15 bp, Homo sapiens
ctctaggaagttgta

SEQ ID NO: 344056 - DNA, 15 bp, Homo sapiens
tctaggaagttgtaa

SEQ ID NO: 344057 - DNA, 15 bp, Homo sapiens
ctaggaagttgtaat

SEQ ID NO: 344058 - DNA, 15 bp, Homo sapiens
taggaagttgtaatg

SEQ ID NO: 344059 - DNA, 15 bp, Homo sapiens
aggaagttgtaatgt

SEQ ID NO: 344060 - DNA, 15 bp, Homo sapiens
ggaagttgtaatgta

SEQ ID NO: 344061 - DNA, 15 bp, Homo sapiens
gaagttgtaatgtaa

SEQ ID NO: 344062 - DNA, 15 bp, Homo sapiens
aagttgtaatgtaat

SEQ ID NO: 344063 - DNA, 15 bp, Homo sapiens
agttgtaatgtaatt

SEQ ID NO: 344064 - DNA, 15 bp, Homo sapiens
gttgtaatgtaattc

SEQ ID NO: 344065 - DNA, 15 bp, Homo sapiens
ttgtaatgtaattcc

SEQ ID NO: 344066 - DNA, 15 bp, Homo sapiens
tgtaatgtaattcct

SEQ ID NO: 344067 - DNA, 15 bp, Homo sapiens
gtaatgtaattcctt

SEQ ID NO: 344068 - DNA, 15 bp, Homo sapiens
taatgtaattccttt

SEQ ID NO: 344069 - DNA, 15 bp, Homo sapiens
aatgtaattcctttg

SEQ ID NO: 344070 - DNA, 15 bp, Homo sapiens
atgtaattcctttgg

SEQ ID NO: 344071 - DNA, 15 bp, Homo sapiens
tgtaattcctttgga

SEQ ID NO: 344072 - DNA, 15 bp, Homo sapiens
gtaattcctttggag

SEQ ID NO: 344073 - DNA, 15 bp, Homo sapiens
taattcctttggaga

SEQ ID NO: 344074 - DNA, 15 bp, Homo sapiens
aattcctttggagac

SEQ ID NO: 344075 - DNA, 15 bp, Homo sapiens
attcctttggagact

SEQ ID NO: 344076 - DNA, 15 bp, Homo sapiens
ttcctttggagactt

SEQ ID NO: 344077 - DNA, 15 bp, Homo sapiens
tcctttggagacttg

SEQ ID NO: 344078 - DNA, 15 bp, Homo sapiens
cctttggagacttgc

SEQ ID NO: 344079 - DNA, 15 bp, Homo sapiens
ctttggagacttgca

SEQ ID NO: 344080 - DNA, 15 bp, Homo sapiens
tttggagacttgcat

SEQ ID NO: 344081 - DNA, 15 bp, Homo sapiens
ttggagacttgcata

SEQ ID NO: 344082 - DNA, 15 bp, Homo sapiens
tggagacttgcatag

SEQ ID NO: 344083 - DNA, 15 bp, Homo sapiens
ggagacttgcatagt

SEQ ID NO: 344084 - DNA, 15 bp, Homo sapiens
gagacttgcatagtt

SEQ ID NO: 344085 - DNA, 15 bp, Homo sapiens
agacttgcatagttg

SEQ ID NO: 344086 - DNA, 15 bp, Homo sapiens
gacttgcatagttgg

SEQ ID NO: 344087 - DNA, 15 bp, Homo sapiens
acttgcatagttgga

SEQ ID NO: 344088 - DNA, 15 bp, Homo sapiens
cttgcatagttggat

SEQ ID NO: 344089 - DNA, 15 bp, Homo sapiens
ttgcatagttggatt

SEQ ID NO: 344090 - DNA, 15 bp, Homo sapiens
tgcatagttggattt

SEQ ID NO: 344091 - DNA, 15 bp, Homo sapiens
gcatagttggatttt

SEQ ID NO: 344092 - DNA, 15 bp, Homo sapiens
catagttggattttc

SEQ ID NO: 344093 - DNA, 15 bp, Homo sapiens
atagttggattttcc

SEQ ID NO: 344094 - DNA, 15 bp, Homo sapiens
tagttggattttccc

SEQ ID NO: 344095 - DNA, 15 bp, Homo sapiens
agttggattttccct

SEQ ID NO: 344096 - DNA, 15 bp, Homo sapiens
gttggattttccctt

SEQ ID NO: 344097 - DNA, 15 bp, Homo sapiens
ttggattttcccttt

SEQ ID NO: 344098 - DNA, 15 bp, Homo sapiens
tggattttccctttt

SEQ ID NO: 344099 - DNA, 15 bp, Homo sapiens
ggattttcccttttc

SEQ ID NO: 344100 - DNA, 15 bp, Homo sapiens
gattttcccttttcc

SEQ ID NO: 344101 - DNA, 15 bp, Homo sapiens
attttcccttttccc

SEQ ID NO: 344102 - DNA, 15 bp, Homo sapiens
ttttcccttttccct

SEQ ID NO: 344103 - DNA, 15 bp, Homo sapiens
tttcccttttccctc

SEQ ID NO: 344104 - DNA, 15 bp, Homo sapiens
ttcccttttccctcc

SEQ ID NO: 344105 - DNA, 15 bp, Homo sapiens
tcccttttccctcca

SEQ ID NO: 344106 - DNA, 15 bp, Homo sapiens
cccttttccctccac

SEQ ID NO: 344107 - DNA, 15 bp, Homo sapiens
ccttttccctccacc

SEQ ID NO: 344108 - DNA, 15 bp, Homo sapiens
cttttccctccacct

SEQ ID NO: 344109 - DNA, 15 bp, Homo sapiens
ttttccctccaccta

SEQ ID NO: 344110 - DNA, 15 bp, Homo sapiens
tttccctccacctat

SEQ ID NO: 344111 - DNA, 15 bp, Homo sapiens
ttccctccacctatc

SEQ ID NO: 344112 - DNA, 15 bp, Homo sapiens
tccctccacctatct

SEQ ID NO: 344113 - DNA, 15 bp, Homo sapiens
ccctccacctatctc

SEQ ID NO: 344114 - DNA, 15 bp, Homo sapiens
cctccacctatctcc

SEQ ID NO: 344115 - DNA, 15 bp, Homo sapiens
ctccacctatctcct

SEQ ID NO: 344116 - DNA, 15 bp, Homo sapiens
tccacctatctcctt

SEQ ID NO: 344117 - DNA, 15 bp, Homo sapiens
ccacctatctccttg

SEQ ID NO: 344118 - DNA, 15 bp, Homo sapiens
cacctatctccttga

SEQ ID NO: 344119 - DNA, 15 bp, Homo sapiens
acctatctccttgag

SEQ ID NO: 344120 - DNA, 15 bp, Homo sapiens
cctatctccttgaga

SEQ ID NO: 344121 - DNA, 15 bp, Homo sapiens
ctatctccttgagaa

SEQ ID NO: 344122 - DNA, 15 bp, Homo sapiens
tatctccttgagaat

SEQ ID NO: 344123 - DNA, 15 bp, Homo sapiens
atctccttgagaatt

SEQ ID NO: 344124 - DNA, 15 bp, Homo sapiens
tctccttgagaatta

SEQ ID NO: 344125 - DNA, 15 bp, Homo sapiens
ctccttgagaattag

SEQ ID NO: 344126 - DNA, 15 bp, Homo sapiens
tccttgagaattagg

SEQ ID NO: 344127 - DNA, 15 bp, Homo sapiens
ccttgagaattaggt

SEQ ID NO: 344128 - DNA, 15 bp, Homo sapiens
cttgagaattaggtt

SEQ ID NO: 344129 - DNA, 15 bp, Homo sapiens
ttgagaattaggttt

SEQ ID NO: 344130 - DNA, 15 bp, Homo sapiens
tgagaattaggttta

SEQ ID NO: 344131 - DNA, 15 bp, Homo sapiens
gagaattaggtttag

SEQ ID NO: 344132 - DNA, 15 bp, Homo sapiens
agaattaggtttagt

SEQ ID NO: 344133 - DNA, 15 bp, Homo sapiens
gaattaggtttagtt

SEQ ID NO: 344134 - DNA, 15 bp, Homo sapiens
aattaggtttagttc

SEQ ID NO: 344135 - DNA, 15 bp, Homo sapiens
attaggtttagttcc

SEQ ID NO: 344136 - DNA, 15 bp, Homo sapiens
ttaggtttagttccc

SEQ ID NO: 344137 - DNA, 15 bp, Homo sapiens
taggtttagttccct

SEQ ID NO: 344138 - DNA, 15 bp, Homo sapiens
aggtttagttcccta

SEQ ID NO: 344139 - DNA, 15 bp, Homo sapiens
ggtttagttccctag

SEQ ID NO: 344140 - DNA, 15 bp, Homo sapiens
gtttagttccctagg

SEQ ID NO: 344141 - DNA, 15 bp, Homo sapiens
tttagttccctaggt

SEQ ID NO: 344142 - DNA, 15 bp, Homo sapiens
ttagttccctaggta

SEQ ID NO: 344143 - DNA, 15 bp, Homo sapiens
tagttccctaggtat

SEQ ID NO: 344144 - DNA, 15 bp, Homo sapiens
agttccctaggtatg

SEQ ID NO: 344145 - DNA, 15 bp, Homo sapiens
gttccctaggtatga

SEQ ID NO: 344146 - DNA, 15 bp, Homo sapiens
ttccctaggtatgag

SEQ ID NO: 344147 - DNA, 15 bp, Homo sapiens
tccctaggtatgagg

SEQ ID NO: 344148 - DNA, 15 bp, Homo sapiens
ccctaggtatgaggc

SEQ ID NO: 344149 - DNA, 15 bp, Homo sapiens
cctaggtatgaggct

SEQ ID NO: 344150 - DNA, 15 bp, Homo sapiens
ctaggtatgaggcta

SEQ ID NO: 344151 - DNA, 15 bp, Homo sapiens
taggtatgaggctaa

SEQ ID NO: 344152 - DNA, 15 bp, Homo sapiens
aggtatgaggctaat

SEQ ID NO: 344153 - DNA, 15 bp, Homo sapiens
ggtatgaggctaatg

SEQ ID NO: 344154 - DNA, 15 bp, Homo sapiens
gtatgaggctaatgt

SEQ ID NO: 344155 - DNA, 15 bp, Homo sapiens
tatgaggctaatgtc

SEQ ID NO: 344156 - DNA, 15 bp, Homo sapiens
atgaggctaatgtct

SEQ ID NO: 344157 - DNA, 15 bp, Homo sapiens
tgaggctaatgtctg

SEQ ID NO: 344158 - DNA, 15 bp, Homo sapiens
gaggctaatgtctga

SEQ ID NO: 344159 - DNA, 15 bp, Homo sapiens
aggctaatgtctgat

SEQ ID NO: 344160 - DNA, 15 bp, Homo sapiens
ggctaatgtctgatt

SEQ ID NO: 344161 - DNA, 15 bp, Homo sapiens
gctaatgtctgattg

SEQ ID NO: 344162 - DNA, 15 bp, Homo sapiens
ctaatgtctgattgt

SEQ ID NO: 344163 - DNA, 15 bp, Homo sapiens
taatgtctgattgtt

SEQ ID NO: 344164 - DNA, 15 bp, Homo sapiens
aatgtctgattgttc

SEQ ID NO: 344165 - DNA, 15 bp, Homo sapiens
atgtctgattgttct

SEQ ID NO: 344166 - DNA, 15 bp, Homo sapiens
tgtctgattgttctg

SEQ ID NO: 344167 - DNA, 15 bp, Homo sapiens
gtctgattgttctgt

SEQ ID NO: 344168 - DNA, 15 bp, Homo sapiens
tctgattgttctgtt

SEQ ID NO: 344169 - DNA, 15 bp, Homo sapiens
ctgattgttctgtta

SEQ ID NO: 344170 - DNA, 15 bp, Homo sapiens
tgattgttctgttac

SEQ ID NO: 344171 - DNA, 15 bp, Homo sapiens
gattgttctgttaca

SEQ ID NO: 344172 - DNA, 15 bp, Homo sapiens
attgttctgttacaa

SEQ ID NO: 344173 - DNA, 15 bp, Homo sapiens
ttgttctgttacaaa

SEQ ID NO: 344174 - DNA, 15 bp, Homo sapiens
tgttctgttacaaat

SEQ ID NO: 344175 - DNA, 15 bp, Homo sapiens
gttctgttacaaatc

SEQ ID NO: 344176 - DNA, 15 bp, Homo sapiens
ttctgttacaaatct

SEQ ID NO: 344177 - DNA, 15 bp, Homo sapiens
tctgttacaaatctg

SEQ ID NO: 344178 - DNA, 15 bp, Homo sapiens
ctgttacaaatctga

SEQ ID NO: 344179 - DNA, 15 bp, Homo sapiens
tgttacaaatctgag

SEQ ID NO: 344180 - DNA, 15 bp, Homo sapiens
gttacaaatctgaga

SEQ ID NO: 344181 - DNA, 15 bp, Homo sapiens
ttacaaatctgagaa

SEQ ID NO: 344182 - DNA, 15 bp, Homo sapiens
acaaatctgagaagg

SEQ ID NO: 344183 - DNA, 15 bp, Homo sapiens
caaatctgagaagga

SEQ ID NO: 344184 - DNA, 15 bp, Homo sapiens
aaatctgagaaggat

SEQ ID NO: 344185 - DNA, 15 bp, Homo sapiens
aatctgagaaggata

SEQ ID NO: 344186 - DNA, 15 bp, Homo sapiens
atctgagaaggataa

SEQ ID NO: 344187 - DNA, 15 bp, Homo sapiens
tctgagaaggataat

SEQ ID NO: 344188 - DNA, 15 bp, Homo sapiens
ctgagaaggataata

SEQ ID NO: 344189 - DNA, 15 bp, Homo sapiens
tgagaaggataatat

SEQ ID NO: 344190 - DNA, 15 bp, Homo sapiens
gagaaggataatatt

SEQ ID NO: 344191 - DNA, 15 bp, Homo sapiens
agaaggataatattt

SEQ ID NO: 344192 - DNA, 15 bp, Homo sapiens
gaaggataatatttt

SEQ ID NO: 344193 - DNA, 15 bp, Homo sapiens
aaggataatatttta

SEQ ID NO: 344194 - DNA, 15 bp, Homo sapiens
aggataatattttaa

SEQ ID NO: 344195 - DNA, 15 bp, Homo sapiens
ggataatattttaaa

SEQ ID NO: 344196 - DNA, 15 bp, Homo sapiens
gataatattttaaag

SEQ ID NO: 344197 - DNA, 15 bp, Homo sapiens
ataatattttaaaga

SEQ ID NO: 344198 - DNA, 15 bp, Homo sapiens
taatattttaaagaa

SEQ ID NO: 344199 - DNA, 15 bp, Homo sapiens
aatattttaaagaaa

SEQ ID NO: 344200 - DNA, 15 bp, Homo sapiens
atattttaaagaaag

SEQ ID NO: 344201 - DNA, 15 bp, Homo sapiens
tattttaaagaaagg

SEQ ID NO: 344202 - DNA, 15 bp, Homo sapiens
attttaaagaaaggt

SEQ ID NO: 344203 - DNA, 15 bp, Homo sapiens
ttttaaagaaaggta

SEQ ID NO: 344204 - DNA, 15 bp, Homo sapiens
tttaaagaaaggtat

SEQ ID NO: 344205 - DNA, 15 bp, Homo sapiens
ttaaagaaaggtatc

SEQ ID NO: 344206 - DNA, 15 bp, Homo sapiens
taaagaaaggtatct

SEQ ID NO: 344207 - DNA, 15 bp, Homo sapiens
aaagaaaggtatctt

SEQ ID NO: 344208 - DNA, 15 bp, Homo sapiens
aagaaaggtatcttt

SEQ ID NO: 344209 - DNA, 15 bp, Homo sapiens
agaaaggtatctttc

SEQ ID NO: 344210 - DNA, 15 bp, Homo sapiens
gaaaggtatctttct

SEQ ID NO: 344211 - DNA, 15 bp, Homo sapiens
aaaggtatctttctg

SEQ ID NO: 344212 - DNA, 15 bp, Homo sapiens
aaggtatctttctgg

SEQ ID NO: 344213 - DNA, 15 bp, Homo sapiens
aggtatctttctggg

SEQ ID NO: 344214 - DNA, 15 bp, Homo sapiens
ggtatctttctgggt

SEQ ID NO: 344215 - DNA, 15 bp, Homo sapiens
gtatctttctgggtc

SEQ ID NO: 344216 - DNA, 15 bp, Homo sapiens
tatctttctgggtca

SEQ ID NO: 344217 - DNA, 15 bp, Homo sapiens
atctttctgggtcat

SEQ ID NO: 344218 - DNA, 15 bp, Homo sapiens
tctttctgggtcatt

SEQ ID NO: 344219 - DNA, 15 bp, Homo sapiens
ctttctgggtcattt

SEQ ID NO: 344220 - DNA, 15 bp, Homo sapiens
tttctgggtcatttg

SEQ ID NO: 344221 - DNA, 15 bp, Homo sapiens
ttctgggtcatttgt

SEQ ID NO: 344222 - DNA, 15 bp, Homo sapiens
tctgggtcatttgtg

SEQ ID NO: 344223 - DNA, 15 bp, Homo sapiens
ctgggtcatttgtgc

SEQ ID NO: 344224 - DNA, 15 bp, Homo sapiens
tgggtcatttgtgcc

SEQ ID NO: 344225 - DNA, 15 bp, Homo sapiens
gggtcatttgtgcct

SEQ ID NO: 344226 - DNA, 15 bp, Homo sapiens
ggtcatttgtgcctc

SEQ ID NO: 344227 - DNA, 15 bp, Homo sapiens
gtcatttgtgcctca

SEQ ID NO: 344228 - DNA, 15 bp, Homo sapiens
tcatttgtgcctcag

SEQ ID NO: 344229 - DNA, 15 bp, Homo sapiens
catttgtgcctcaga

SEQ ID NO: 344230 - DNA, 15 bp, Homo sapiens
atttgtgcctcagac

SEQ ID NO: 344231 - DNA, 15 bp, Homo sapiens
tttgtgcctcagact

SEQ ID NO: 344232 - DNA, 15 bp, Homo sapiens
ttgtgcctcagactt

SEQ ID NO: 344233 - DNA, 15 bp, Homo sapiens
tgtgcctcagactta

SEQ ID NO: 344234 - DNA, 15 bp, Homo sapiens
gtgcctcagacttag

SEQ ID NO: 344235 - DNA, 15 bp, Homo sapiens
tgcctcagacttagg

SEQ ID NO: 344236 - DNA, 15 bp, Homo sapiens
gcctcagacttaggt

SEQ ID NO: 344237 - DNA, 15 bp, Homo sapiens
cctcagacttaggtg

SEQ ID NO: 344238 - DNA, 15 bp, Homo sapiens
ctcagacttaggtgt

SEQ ID NO: 344239 - DNA, 15 bp, Homo sapiens
tcagacttaggtgtt

SEQ ID NO: 344240 - DNA, 15 bp, Homo sapiens
cagacttaggtgttt

SEQ ID NO: 344241 - DNA, 15 bp, Homo sapiens
agacttaggtgtttg

SEQ ID NO: 344242 - DNA, 15 bp, Homo sapiens
gacttaggtgtttga

SEQ ID NO: 344243 - DNA, 15 bp, Homo sapiens
acttaggtgtttgaa

SEQ ID NO: 344244 - DNA, 15 bp, Homo sapiens
cttaggtgtttgaag

SEQ ID NO: 344245 - DNA, 15 bp, Homo sapiens
ttaggtgtttgaagg

SEQ ID NO: 344246 - DNA, 15 bp, Homo sapiens
taggtgtttgaaggc

SEQ ID NO: 344247 - DNA, 15 bp, Homo sapiens
aggtgtttgaaggcc

SEQ ID NO: 344248 - DNA, 15 bp, Homo sapiens
ggtgtttgaaggcct

SEQ ID NO: 344249 - DNA, 15 bp, Homo sapiens
gtgtttgaaggcctt

SEQ ID NO: 344250 - DNA, 15 bp, Homo sapiens
tgtttgaaggccttc

SEQ ID NO: 344251 - DNA, 15 bp, Homo sapiens
gtttgaaggccttct

SEQ ID NO: 344252 - DNA, 15 bp, Homo sapiens
tttgaaggccttctt

SEQ ID NO: 344253 - DNA, 15 bp, Homo sapiens
ttgaaggccttctta

SEQ ID NO: 344254 - DNA, 15 bp, Homo sapiens
tgaaggccttcttat

SEQ ID NO: 344255 - DNA, 15 bp, Homo sapiens
gaaggccttcttatc

SEQ ID NO: 344256 - DNA, 15 bp, Homo sapiens
aaggccttcttatcc

SEQ ID NO: 344257 - DNA, 15 bp, Homo sapiens
aggccttcttatccc

SEQ ID NO: 344258 - DNA, 15 bp, Homo sapiens
ggccttcttatcccc

SEQ ID NO: 344259 - DNA, 15 bp, Homo sapiens
gccttcttatcccca

SEQ ID NO: 344260 - DNA, 15 bp, Homo sapiens
ccttcttatccccat

SEQ ID NO: 344261 - DNA, 15 bp, Homo sapiens
cttcttatccccatg

SEQ ID NO: 344262 - DNA, 15 bp, Homo sapiens
ttcttatccccatgt

SEQ ID NO: 344263 - DNA, 15 bp, Homo sapiens
tcttatccccatgta

SEQ ID NO: 344264 - DNA, 15 bp, Homo sapiens
cttatccccatgtaa

SEQ ID NO: 344265 - DNA, 15 bp, Homo sapiens
ttatccccatgtaag

SEQ ID NO: 344266 - DNA, 15 bp, Homo sapiens
tatccccatgtaagg

SEQ ID NO: 344267 - DNA, 15 bp, Homo sapiens
atccccatgtaaggg

SEQ ID NO: 344268 - DNA, 15 bp, Homo sapiens
tccccatgtaagggt

SEQ ID NO: 344269 - DNA, 15 bp, Homo sapiens
ccccatgtaagggtg

SEQ ID NO: 344270 - DNA, 15 bp, Homo sapiens
cccatgtaagggtga

SEQ ID NO: 344271 - DNA, 15 bp, Homo sapiens
ccatgtaagggtgaa

SEQ ID NO: 344272 - DNA, 15 bp, Homo sapiens
catgtaagggtgaag

SEQ ID NO: 344273 - DNA, 15 bp, Homo sapiens
atgtaagggtgaagc

SEQ ID NO: 344274 - DNA, 15 bp, Homo sapiens
tgtaagggtgaagcc

SEQ ID NO: 344275 - DNA, 15 bp, Homo sapiens
gtaagggtgaagcct

SEQ ID NO: 344276 - DNA, 15 bp, Homo sapiens
taagggtgaagcctc

SEQ ID NO: 344277 - DNA, 15 bp, Homo sapiens
aagggtgaagcctct

SEQ ID NO: 344278 - DNA, 15 bp, Homo sapiens
agggtgaagcctcta

SEQ ID NO: 344279 - DNA, 15 bp, Homo sapiens
gggtgaagcctctaa

SEQ ID NO: 344280 - DNA, 15 bp, Homo sapiens
ggtgaagcctctaat

SEQ ID NO: 344281 - DNA, 15 bp, Homo sapiens
gtgaagcctctaata

SEQ ID NO: 344282 - DNA, 15 bp, Homo sapiens
tgaagcctctaataa

SEQ ID NO: 344283 - DNA, 15 bp, Homo sapiens
gaagcctctaataaa

SEQ ID NO: 344284 - DNA, 15 bp, Homo sapiens
aagcctctaataaaa

SEQ ID NO: 344285 - DNA, 15 bp, Homo sapiens
agcctctaataaaat

SEQ ID NO: 344286 - DNA, 15 bp, Homo sapiens
gcctctaataaaata

SEQ ID NO: 344287 - DNA, 15 bp, Homo sapiens
cctctaataaaataa

SEQ ID NO: 344288 - DNA, 15 bp, Homo sapiens
ctctaataaaataaa

SEQ ID NO: 344289 - DNA, 15 bp, Homo sapiens
tctaataaaataaaa

SEQ ID NO: 344290 - DNA, 15 bp, Homo sapiens
ctaataaaataaaag

SEQ ID NO: 344291 - DNA, 15 bp, Homo sapiens
taataaaataaaagt

SEQ ID NO: 344292 - DNA, 15 bp, Homo sapiens
aataaaataaaagtt

SEQ ID NO: 344293 - DNA, 15 bp, Homo sapiens
ataaaataaaagtta

SEQ ID NO: 344294 - DNA, 15 bp, Homo sapiens
taaaataaaagttag

SEQ ID NO: 344295 - DNA, 15 bp, Homo sapiens
aaaataaaagttaga

SEQ ID NO: 344296 - DNA, 15 bp, Homo sapiens
aaataaaagttagaa

SEQ ID NO: 344297 - DNA, 15 bp, Homo sapiens
aataaaagttagaaa

SEQ ID NO: 344298 - DNA, 15 bp, Homo sapiens
ataaaagttagaaat

SEQ ID NO: 344299 - DNA, 15 bp, Homo sapiens
taaaagttagaaatt

SEQ ID NO: 344300 - DNA, 15 bp, Homo sapiens
aaaagttagaaattt

SEQ ID NO: 344301 - DNA, 15 bp, Homo sapiens
aaagttagaaatttg

SEQ ID NO: 344302 - DNA, 15 bp, Homo sapiens
aagttagaaatttgg

SEQ ID NO: 344303 - DNA, 15 bp, Homo sapiens
agttagaaatttgga

SEQ ID NO: 344304 - DNA, 15 bp, Homo sapiens
gttagaaatttggat

SEQ ID NO: 344305 - DNA, 15 bp, Homo sapiens
ttagaaatttggatg

SEQ ID NO: 344306 - DNA, 15 bp, Homo sapiens
tagaaatttggatgc

SEQ ID NO: 344307 - DNA, 15 bp, Homo sapiens
agaaatttggatgca

SEQ ID NO: 344308 - DNA, 15 bp, Homo sapiens
gaaatttggatgcat

SEQ ID NO: 344309 - DNA, 15 bp, Homo sapiens
aaatttggatgcatg

SEQ ID NO: 344310 - DNA, 15 bp, Homo sapiens
aatttggatgcatga

SEQ ID NO: 344311 - DNA, 15 bp, Homo sapiens
atttggatgcatgat

SEQ ID NO: 344312 - DNA, 15 bp, Homo sapiens
tttggatgcatgatt

SEQ ID NO: 344313 - DNA, 15 bp, Homo sapiens
ttggatgcatgattt

SEQ ID NO: 344314 - DNA, 15 bp, Homo sapiens
tggatgcatgattta

SEQ ID NO: 344315 - DNA, 15 bp, Homo sapiens
ggatgcatgatttaa

SEQ ID NO: 344316 - DNA, 15 bp, Homo sapiens
gatgcatgatttaat

SEQ ID NO: 344317 - DNA, 15 bp, Homo sapiens
atgcatgatttaatt

SEQ ID NO: 344318 - DNA, 15 bp, Homo sapiens
tgcatgatttaattg

SEQ ID NO: 344319 - DNA, 15 bp, Homo sapiens
gcatgatttaattga

SEQ ID NO: 344320 - DNA, 15 bp, Homo sapiens
catgatttaattgaa

SEQ ID NO: 344321 - DNA, 15 bp, Homo sapiens
atgatttaattgaat

SEQ ID NO: 344322 - DNA, 15 bp, Homo sapiens
tgatttaattgaatt

SEQ ID NO: 344323 - DNA, 15 bp, Homo sapiens
gatttaattgaatta

SEQ ID NO: 344324 - DNA, 15 bp, Homo sapiens
atttaattgaattac

SEQ ID NO: 344325 - DNA, 15 bp, Homo sapiens
tttaattgaattacc

SEQ ID NO: 344326 - DNA, 15 bp, Homo sapiens
ttaattgaattacca

SEQ ID NO: 344327 - DNA, 15 bp, Homo sapiens
taattgaattaccaa

SEQ ID NO: 344328 - DNA, 15 bp, Homo sapiens
aattgaattaccaaa

SEQ ID NO: 344329 - DNA, 15 bp, Homo sapiens
attgaattaccaaat

SEQ ID NO: 344330 - DNA, 15 bp, Homo sapiens
ttgaattaccaaatg

SEQ ID NO: 344331 - DNA, 15 bp, Homo sapiens
tgaattaccaaatga

SEQ ID NO: 344332 - DNA, 15 bp, Homo sapiens
gaattaccaaatgat

SEQ ID NO: 344333 - DNA, 15 bp, Homo sapiens
aattaccaaatgatt

SEQ ID NO: 344334 - DNA, 15 bp, Homo sapiens
attaccaaatgattt

SEQ ID NO: 344335 - DNA, 15 bp, Homo sapiens
ttaccaaatgatttt

SEQ ID NO: 344336 - DNA, 15 bp, Homo sapiens
taccaaatgattttg

SEQ ID NO: 344337 - DNA, 15 bp, Homo sapiens
accaaatgattttgc

SEQ ID NO: 344338 - DNA, 15 bp, Homo sapiens
ccaaatgattttgca

SEQ ID NO: 344339 - DNA, 15 bp, Homo sapiens
caaatgattttgcag

SEQ ID NO: 344340 - DNA, 15 bp, Homo sapiens
aaatgattttgcaga

SEQ ID NO: 344341 - DNA, 15 bp, Homo sapiens
aatgattttgcagat

SEQ ID NO: 344342 - DNA, 15 bp, Homo sapiens
atgattttgcagata

SEQ ID NO: 344343 - DNA, 15 bp, Homo sapiens
tgattttgcagataa

SEQ ID NO: 344344 - DNA, 15 bp, Homo sapiens
gattttgcagataaa

SEQ ID NO: 344345 - DNA, 15 bp, Homo sapiens
attttgcagataaag

SEQ ID NO: 344346 - DNA, 15 bp, Homo sapiens
ttttgcagataaagt

SEQ ID NO: 344347 - DNA, 15 bp, Homo sapiens
tttgcagataaagtt

SEQ ID NO: 344348 - DNA, 15 bp, Homo sapiens
ttgcagataaagttc

SEQ ID NO: 344349 - DNA, 15 bp, Homo sapiens
tgcagataaagttca

SEQ ID NO: 344350 - DNA, 15 bp, Homo sapiens
gcagataaagttcaa

SEQ ID NO: 344351 - DNA, 15 bp, Homo sapiens
cagataaagttcaac

SEQ ID NO: 344352 - DNA, 15 bp, Homo sapiens
agataaagttcaact

SEQ ID NO: 344353 - DNA, 15 bp, Homo sapiens
gataaagttcaactt

SEQ ID NO: 344354 - DNA, 15 bp, Homo sapiens
ataaagttcaacttt

SEQ ID NO: 344355 - DNA, 15 bp, Homo sapiens
taaagttcaactttt

SEQ ID NO: 344356 - DNA, 15 bp, Homo sapiens
aaagttcaacttttg

SEQ ID NO: 344357 - DNA, 15 bp, Homo sapiens
aagttcaacttttgt

SEQ ID NO: 344358 - DNA, 15 bp, Homo sapiens
agttcaacttttgtt

SEQ ID NO: 344359 - DNA, 15 bp, Homo sapiens
gttcaacttttgtta

SEQ ID NO: 344360 - DNA, 15 bp, Homo sapiens
ttcaacttttgttat

SEQ ID NO: 344361 - DNA, 15 bp, Homo sapiens
tcaacttttgttatt

SEQ ID NO: 344362 - DNA, 15 bp, Homo sapiens
caacttttgttatta

SEQ ID NO: 344363 - DNA, 15 bp, Homo sapiens
aacttttgttattac

SEQ ID NO: 344364 - DNA, 15 bp, Homo sapiens
acttttgttattact

SEQ ID NO: 344365 - DNA, 15 bp, Homo sapiens
cttttgttattactt

SEQ ID NO: 344366 - DNA, 15 bp, Homo sapiens
ttttgttattacttg

SEQ ID NO: 344367 - DNA, 15 bp, Homo sapiens
tttgttattacttgt

SEQ ID NO: 344368 - DNA, 15 bp, Homo sapiens
ttgttattacttgta

SEQ ID NO: 344369 - DNA, 15 bp, Homo sapiens
tgttattacttgtag

SEQ ID NO: 344370 - DNA, 15 bp, Homo sapiens
gttattacttgtagt

SEQ ID NO: 344371 - DNA, 15 bp, Homo sapiens
ttattacttgtagtg

SEQ ID NO: 344372 - DNA, 15 bp, Homo sapiens
tattacttgtagtgc

SEQ ID NO: 344373 - DNA, 15 bp, Homo sapiens
attacttgtagtgct

SEQ ID NO: 344374 - DNA, 15 bp, Homo sapiens
ttacttgtagtgctt

SEQ ID NO: 344375 - DNA, 15 bp, Homo sapiens
tacttgtagtgcttg

SEQ ID NO: 344376 - DNA, 15 bp, Homo sapiens
acttgtagtgcttgt

SEQ ID NO: 344377 - DNA, 15 bp, Homo sapiens
cttgtagtgcttgtt

SEQ ID NO: 344378 - DNA, 15 bp, Homo sapiens
ttgtagtgcttgttg

SEQ ID NO: 344379 - DNA, 15 bp, Homo sapiens
tgtagtgcttgttga

SEQ ID NO: 344380 - DNA, 15 bp, Homo sapiens
gtagtgcttgttgaa

SEQ ID NO: 344381 - DNA, 15 bp, Homo sapiens
tagtgcttgttgaaa

SEQ ID NO: 344382 - DNA, 15 bp, Homo sapiens
agtgcttgttgaaag

SEQ ID NO: 344383 - DNA, 15 bp, Homo sapiens
gtgcttgttgaaagc

SEQ ID NO: 344384 - DNA, 15 bp, Homo sapiens
tgcttgttgaaagct

SEQ ID NO: 344385 - DNA, 15 bp, Homo sapiens
gcttgttgaaagctt

SEQ ID NO: 344386 - DNA, 15 bp, Homo sapiens
cttgttgaaagcttg

SEQ ID NO: 344387 - DNA, 15 bp, Homo sapiens
ttgttgaaagcttgg

SEQ ID NO: 344388 - DNA, 15 bp, Homo sapiens
tgttgaaagcttggt

SEQ ID NO: 344389 - DNA, 15 bp, Homo sapiens
gttgaaagcttggtt

SEQ ID NO: 344390 - DNA, 15 bp, Homo sapiens
ttgaaagcttggtta

SEQ ID NO: 344391 - DNA, 15 bp, Homo sapiens
tgaaagcttggttaa

SEQ ID NO: 344392 - DNA, 15 bp, Homo sapiens
gaaagcttggttaac

SEQ ID NO: 344393 - DNA, 15 bp, Homo sapiens
aaagcttggttaacc

SEQ ID NO: 344394 - DNA, 15 bp, Homo sapiens
aagcttggttaaccg

SEQ ID NO: 344395 - DNA, 15 bp, Homo sapiens
agcttggttaaccga

SEQ ID NO: 344396 - DNA, 15 bp, Homo sapiens
gcttggttaaccgaa

SEQ ID NO: 344397 - DNA, 15 bp, Homo sapiens
cttggttaaccgaaa

SEQ ID NO: 344398 - DNA, 15 bp, Homo sapiens
ttggttaaccgaaaa

SEQ ID NO: 344399 - DNA, 15 bp, Homo sapiens
tggttaaccgaaaaa

SEQ ID NO: 344400 - DNA, 15 bp, Homo sapiens
ggttaaccgaaaaag

SEQ ID NO: 344401 - DNA, 15 bp, Homo sapiens
gttaaccgaaaaaga

SEQ ID NO: 344402 - DNA, 15 bp, Homo sapiens
ttaaccgaaaaagaa

SEQ ID NO: 344403 - DNA, 15 bp, Homo sapiens
taaccgaaaaagaag

SEQ ID NO: 344404 - DNA, 15 bp, Homo sapiens
aaccgaaaaagaaga

SEQ ID NO: 344405 - DNA, 15 bp, Homo sapiens
accgaaaaagaagag

SEQ ID NO: 344406 - DNA, 15 bp, Homo sapiens
ccgaaaaagaagagg

SEQ ID NO: 344407 - DNA, 15 bp, Homo sapiens
cgaaaaagaagaggc

SEQ ID NO: 344408 - DNA, 15 bp, Homo sapiens
gaaaaagaagaggct

SEQ ID NO: 344409 - DNA, 15 bp, Homo sapiens
aaaaagaagaggctt

SEQ ID NO: 344410 - DNA, 15 bp, Homo sapiens
aaaagaagaggcttt

SEQ ID NO: 344411 - DNA, 15 bp, Homo sapiens
aaagaagaggcttta

SEQ ID NO: 344412 - DNA, 15 bp, Homo sapiens
aagaagaggctttaa

SEQ ID NO: 344413 - DNA, 15 bp, Homo sapiens
agaagaggctttaaa

SEQ ID NO: 344414 - DNA, 15 bp, Homo sapiens
gaagaggctttaaat

SEQ ID NO: 344415 - DNA, 15 bp, Homo sapiens
aagaggctttaaata

SEQ ID NO: 344416 - DNA, 15 bp, Homo sapiens
agaggctttaaataa

SEQ ID NO: 344417 - DNA, 15 bp, Homo sapiens
gaggctttaaataaa

SEQ ID NO: 344418 - DNA, 15 bp, Homo sapiens
aggctttaaataaag

SEQ ID NO: 344419 - DNA, 15 bp, Homo sapiens
ggctttaaataaagt

SEQ ID NO: 344420 - DNA, 15 bp, Homo sapiens
gctttaaataaagtc

SEQ ID NO: 344421 - DNA, 15 bp, Homo sapiens
ctttaaataaagtcc

SEQ ID NO: 344422 - DNA, 15 bp, Homo sapiens
tttaaataaagtcca

SEQ ID NO: 344423 - DNA, 15 bp, Homo sapiens
ttaaataaagtccag

SEQ ID NO: 344424 - DNA, 15 bp, Homo sapiens
taaataaagtccaga

SEQ ID NO: 344425 - DNA, 15 bp, Homo sapiens
aaataaagtccagac

SEQ ID NO: 344426 - DNA, 15 bp, Homo sapiens
aataaagtccagaca

SEQ ID NO: 344427 - DNA, 15 bp, Homo sapiens
ataaagtccagacaa

SEQ ID NO: 344428 - DNA, 15 bp, Homo sapiens
taaagtccagacaag

SEQ ID NO: 344429 - DNA, 15 bp, Homo sapiens
aaagtccagacaagc

SEQ ID NO: 344430 - DNA, 15 bp, Homo sapiens
aagtccagacaagca

SEQ ID NO: 344431 - DNA, 15 bp, Homo sapiens
agtccagacaagcaa

SEQ ID NO: 344432 - DNA, 15 bp, Homo sapiens
gtccagacaagcaac

SEQ ID NO: 344433 - DNA, 15 bp, Homo sapiens
tccagacaagcaact

SEQ ID NO: 344434 - DNA, 15 bp, Homo sapiens
ccagacaagcaactt

SEQ ID NO: 344435 - DNA, 15 bp, Homo sapiens
cagacaagcaacttc

SEQ ID NO: 344436 - DNA, 15 bp, Homo sapiens
agacaagcaacttca

SEQ ID NO: 344437 - DNA, 15 bp, Homo sapiens
gacaagcaacttcaa

SEQ ID NO: 344438 - DNA, 15 bp, Homo sapiens
acaagcaacttcaaa

SEQ ID NO: 344439 - DNA, 15 bp, Homo sapiens
caagcaacttcaaag

SEQ ID NO: 344440 - DNA, 15 bp, Homo sapiens
aagcaacttcaaaga

SEQ ID NO: 344441 - DNA, 15 bp, Homo sapiens
agcaacttcaaagac

SEQ ID NO: 344442 - DNA, 15 bp, Homo sapiens
gcaacttcaaagacc

SEQ ID NO: 344443 - DNA, 15 bp, Homo sapiens
caacttcaaagacca

SEQ ID NO: 344444 - DNA, 15 bp, Homo sapiens
aacttcaaagaccaa

SEQ ID NO: 344445 - DNA, 15 bp, Homo sapiens
acttcaaagaccaaa

SEQ ID NO: 344446 - DNA, 15 bp, Homo sapiens
cttcaaagaccaaaa

SEQ ID NO: 344447 - DNA, 15 bp, Homo sapiens
ttcaaagaccaaaag

SEQ ID NO: 344448 - DNA, 15 bp, Homo sapiens
tcaaagaccaaaagg

SEQ ID NO: 344449 - DNA, 15 bp, Homo sapiens
caaagaccaaaagga

SEQ ID NO: 344450 - DNA, 15 bp, Homo sapiens
aaagaccaaaaggaa

SEQ ID NO: 344451 - DNA, 15 bp, Homo sapiens
aagaccaaaaggaac

SEQ ID NO: 344452 - DNA, 15 bp, Homo sapiens
agaccaaaaggaact

SEQ ID NO: 344453 - DNA, 15 bp, Homo sapiens
gaccaaaaggaacta

SEQ ID NO: 344454 - DNA, 15 bp, Homo sapiens
accaaaaggaactaa

SEQ ID NO: 344455 - DNA, 15 bp, Homo sapiens
ccaaaaggaactaag

SEQ ID NO: 344456 - DNA, 15 bp, Homo sapiens
caaaaggaactaagt

SEQ ID NO: 344457 - DNA, 15 bp, Homo sapiens
aaaaggaactaagtg

SEQ ID NO: 344458 - DNA, 15 bp, Homo sapiens
aaaggaactaagtgt

SEQ ID NO: 344459 - DNA, 15 bp, Homo sapiens
aaggaactaagtgtc

SEQ ID NO: 344460 - DNA, 15 bp, Homo sapiens
aggaactaagtgtca

SEQ ID NO: 344461 - DNA, 15 bp, Homo sapiens
ggaactaagtgtcag

SEQ ID NO: 344462 - DNA, 15 bp, Homo sapiens
gaactaagtgtcagt

SEQ ID NO: 344463 - DNA, 15 bp, Homo sapiens
aactaagtgtcagtg

SEQ ID NO: 344464 - DNA, 15 bp, Homo sapiens
actaagtgtcagtgt

SEQ ID NO: 344465 - DNA, 15 bp, Homo sapiens
ctaagtgtcagtgtt

SEQ ID NO: 344466 - DNA, 15 bp, Homo sapiens
taagtgtcagtgttc

SEQ ID NO: 344467 - DNA, 15 bp, Homo sapiens
aagtgtcagtgttcg

SEQ ID NO: 344468 - DNA, 15 bp, Homo sapiens
agtgtcagtgttcga

SEQ ID NO: 344469 - DNA, 15 bp, Homo sapiens
gtgtcagtgttcgac

SEQ ID NO: 344470 - DNA, 15 bp, Homo sapiens
tgtcagtgttcgacg

SEQ ID NO: 344471 - DNA, 15 bp, Homo sapiens
gtcagtgttcgacgt

SEQ ID NO: 344472 - DNA, 15 bp, Homo sapiens
tcagtgttcgacgtc

SEQ ID NO: 344473 - DNA, 15 bp, Homo sapiens
cagtgttcgacgtct

SEQ ID NO: 344474 - DNA, 15 bp, Homo sapiens
agtgttcgacgtctg

SEQ ID NO: 344475 - DNA, 15 bp, Homo sapiens
gtgttcgacgtctgg

SEQ ID NO: 344476 - DNA, 15 bp, Homo sapiens
tgttcgacgtctggc

SEQ ID NO: 344477 - DNA, 15 bp, Homo sapiens
gttcgacgtctggct

SEQ ID NO: 344478 - DNA, 15 bp, Homo sapiens
ttcgacgtctggctg

SEQ ID NO: 344479 - DNA, 15 bp, Homo sapiens
tcgacgtctggctgt

SEQ ID NO: 344480 - DNA, 15 bp, Homo sapiens
cgacgtctggctgta

SEQ ID NO: 344481 - DNA, 15 bp, Homo sapiens
gacgtctggctgtaa

SEQ ID NO: 344482 - DNA, 15 bp, Homo sapiens
acgtctggctgtaag

SEQ ID NO: 344483 - DNA, 15 bp, Homo sapiens
cgtctggctgtaagt

SEQ ID NO: 344484 - DNA, 15 bp, Homo sapiens
gtctggctgtaagtg

SEQ ID NO: 344485 - DNA, 15 bp, Homo sapiens
tctggctgtaagtga

SEQ ID NO: 344486 - DNA, 15 bp, Homo sapiens
ctggctgtaagtgat

SEQ ID NO: 344487 - DNA, 15 bp, Homo sapiens
tggctgtaagtgatg

SEQ ID NO: 344488 - DNA, 15 bp, Homo sapiens
ggctgtaagtgatgg

SEQ ID NO: 344489 - DNA, 15 bp, Homo sapiens
gctgtaagtgatggg

SEQ ID NO: 344490 - DNA, 15 bp, Homo sapiens
ctgtaagtgatgggg

SEQ ID NO: 344491 - DNA, 15 bp, Homo sapiens
tgtaagtgatggggt

SEQ ID NO: 344492 - DNA, 15 bp, Homo sapiens
gtaagtgatggggtt

SEQ ID NO: 344493 - DNA, 15 bp, Homo sapiens
taagtgatggggttg

SEQ ID NO: 344494 - DNA, 15 bp, Homo sapiens
aagtgatggggttgt

SEQ ID NO: 344495 - DNA, 15 bp, Homo sapiens
agtgatggggttgtc

SEQ ID NO: 344496 - DNA, 15 bp, Homo sapiens
gtgatggggttgtca

SEQ ID NO: 344497 - DNA, 15 bp, Homo sapiens
tgatggggttgtcag

SEQ ID NO: 344498 - DNA, 15 bp, Homo sapiens
gatggggttgtcagc

SEQ ID NO: 344499 - DNA, 15 bp, Homo sapiens
atggggttgtcagca

SEQ ID NO: 344500 - DNA, 15 bp, Homo sapiens
tggggttgtcagcat

SEQ ID NO: 344501 - DNA, 15 bp, Homo sapiens
ggggttgtcagcatc

SEQ ID NO: 344502 - DNA, 15 bp, Homo sapiens
gggttgtcagcatct

SEQ ID NO: 344503 - DNA, 15 bp, Homo sapiens
ggttgtcagcatctg

SEQ ID NO: 344504 - DNA, 15 bp, Homo sapiens
gttgtcagcatctgt

SEQ ID NO: 344505 - DNA, 15 bp, Homo sapiens
ttgtcagcatctgtg

SEQ ID NO: 344506 - DNA, 15 bp, Homo sapiens
tgtcagcatctgtgt

SEQ ID NO: 344507 - DNA, 15 bp, Homo sapiens
gtcagcatctgtgtt

SEQ ID NO: 344508 - DNA, 15 bp, Homo sapiens
tcagcatctgtgttg

SEQ ID NO: 344509 - DNA, 15 bp, Homo sapiens
cagcatctgtgttgt

SEQ ID NO: 344510 - DNA, 15 bp, Homo sapiens
agcatctgtgttgta

SEQ ID NO: 344511 - DNA, 15 bp, Homo sapiens
gcatctgtgttgtaa

SEQ ID NO: 344512 - DNA, 15 bp, Homo sapiens
catctgtgttgtaag

SEQ ID NO: 344513 - DNA, 15 bp, Homo sapiens
atctgtgttgtaagc

SEQ ID NO: 344514 - DNA, 15 bp, Homo sapiens
tctgtgttgtaagcc

SEQ ID NO: 344515 - DNA, 15 bp, Homo sapiens
ctgtgttgtaagcct

SEQ ID NO: 344516 - DNA, 15 bp, Homo sapiens
tgtgttgtaagccta

SEQ ID NO: 344517 - DNA, 15 bp, Homo sapiens
gtgttgtaagcctat

SEQ ID NO: 344518 - DNA, 15 bp, Homo sapiens
tgttgtaagcctatg

SEQ ID NO: 344519 - DNA, 15 bp, Homo sapiens
gttgtaagcctatga

SEQ ID NO: 344520 - DNA, 15 bp, Homo sapiens
ttgtaagcctatgat

SEQ ID NO: 344521 - DNA, 15 bp, Homo sapiens
tgtaagcctatgata

SEQ ID NO: 344522 - DNA, 15 bp, Homo sapiens
gtaagcctatgatat

SEQ ID NO: 344523 - DNA, 15 bp, Homo sapiens
taagcctatgatatc

SEQ ID NO: 344524 - DNA, 15 bp, Homo sapiens
aagcctatgatatct

SEQ ID NO: 344525 - DNA, 15 bp, Homo sapiens
agcctatgatatctt

SEQ ID NO: 344526 - DNA, 15 bp, Homo sapiens
gcctatgatatctta

SEQ ID NO: 344527 - DNA, 15 bp, Homo sapiens
cctatgatatcttaa

SEQ ID NO: 344528 - DNA, 15 bp, Homo sapiens
ctatgatatcttaat

SEQ ID NO: 344529 - DNA, 15 bp, Homo sapiens
tatgatatcttaatg

SEQ ID NO: 344530 - DNA, 15 bp, Homo sapiens
atgatatcttaatgt

SEQ ID NO: 344531 - DNA, 15 bp, Homo sapiens
tgatatcttaatgtt

SEQ ID NO: 344532 - DNA, 15 bp, Homo sapiens
gatatcttaatgttt

SEQ ID NO: 344533 - DNA, 15 bp, Homo sapiens
atatcttaatgtttt

SEQ ID NO: 344534 - DNA, 15 bp, Homo sapiens
tatcttaatgtttta

SEQ ID NO: 344535 - DNA, 15 bp, Homo sapiens
atcttaatgttttat

SEQ ID NO: 344536 - DNA, 15 bp, Homo sapiens
tcttaatgttttata

SEQ ID NO: 344537 - DNA, 15 bp, Homo sapiens
cttaatgttttatag

SEQ ID NO: 344538 - DNA, 15 bp, Homo sapiens
ttaatgttttatagc

SEQ ID NO: 344539 - DNA, 15 bp, Homo sapiens
taatgttttatagct

SEQ ID NO: 344540 - DNA, 15 bp, Homo sapiens
aatgttttatagcta

SEQ ID NO: 344541 - DNA, 15 bp, Homo sapiens
atgttttatagctaa

SEQ ID NO: 344542 - DNA, 15 bp, Homo sapiens
tgttttatagctaat

SEQ ID NO: 344543 - DNA, 15 bp, Homo sapiens
gttttatagctaatg

SEQ ID NO: 344544 - DNA, 15 bp, Homo sapiens
ttttatagctaatgg

SEQ ID NO: 344545 - DNA, 15 bp, Homo sapiens
tttatagctaatggt

SEQ ID NO: 344546 - DNA, 15 bp, Homo sapiens
ttatagctaatggtt

SEQ ID NO: 344547 - DNA, 15 bp, Homo sapiens
tatagctaatggtta

SEQ ID NO: 344548 - DNA, 15 bp, Homo sapiens
atagctaatggttag

SEQ ID NO: 344549 - DNA, 15 bp, Homo sapiens
tagctaatggttagt

SEQ ID NO: 344550 - DNA, 15 bp, Homo sapiens
agctaatggttagta

SEQ ID NO: 344551 - DNA, 15 bp, Homo sapiens
gctaatggttagtag

SEQ ID NO: 344552 - DNA, 15 bp, Homo sapiens
ctaatggttagtaga

SEQ ID NO: 344553 - DNA, 15 bp, Homo sapiens
taatggttagtagaa

SEQ ID NO: 344554 - DNA, 15 bp, Homo sapiens
aatggttagtagaat

SEQ ID NO: 344555 - DNA, 15 bp, Homo sapiens
atggttagtagaatt

SEQ ID NO: 344556 - DNA, 15 bp, Homo sapiens
tggttagtagaattt

SEQ ID NO: 344557 - DNA, 15 bp, Homo sapiens
ggttagtagaattta

SEQ ID NO: 344558 - DNA, 15 bp, Homo sapiens
gttagtagaatttag

SEQ ID NO: 344559 - DNA, 15 bp, Homo sapiens
ttagtagaatttagt

SEQ ID NO: 344560 - DNA, 15 bp, Homo sapiens
tagtagaatttagtg

SEQ ID NO: 344561 - DNA, 15 bp, Homo sapiens
agtagaatttagtga

SEQ ID NO: 344562 - DNA, 15 bp, Homo sapiens
gtagaatttagtgaa

SEQ ID NO: 344563 - DNA, 15 bp, Homo sapiens
tagaatttagtgaat

SEQ ID NO: 344564 - DNA, 15 bp, Homo sapiens
agaatttagtgaatg

SEQ ID NO: 344565 - DNA, 15 bp, Homo sapiens
gaatttagtgaatgc

SEQ ID NO: 344566 - DNA, 15 bp, Homo sapiens
aatttagtgaatgca

SEQ ID NO: 344567 - DNA, 15 bp, Homo sapiens
atttagtgaatgcag

SEQ ID NO: 344568 - DNA, 15 bp, Homo sapiens
tttagtgaatgcaga

SEQ ID NO: 344569 - DNA, 15 bp, Homo sapiens
ttagtgaatgcagat

SEQ ID NO: 344570 - DNA, 15 bp, Homo sapiens
tagtgaatgcagatt

SEQ ID NO: 344571 - DNA, 15 bp, Homo sapiens
agtgaatgcagatta

SEQ ID NO: 344572 - DNA, 15 bp, Homo sapiens
gtgaatgcagattac

SEQ ID NO: 344573 - DNA, 15 bp, Homo sapiens
tgaatgcagattaca

SEQ ID NO: 344574 - DNA, 15 bp, Homo sapiens
gaatgcagattacag

SEQ ID NO: 344575 - DNA, 15 bp, Homo sapiens
aatgcagattacagc

SEQ ID NO: 344576 - DNA, 15 bp, Homo sapiens
atgcagattacagct

SEQ ID NO: 344577 - DNA, 15 bp, Homo sapiens
tgcagattacagctc

SEQ ID NO: 344578 - DNA, 15 bp, Homo sapiens
gcagattacagctca

SEQ ID NO: 344579 - DNA, 15 bp, Homo sapiens
cagattacagctcat

SEQ ID NO: 344580 - DNA, 15 bp, Homo sapiens
agattacagctcatt

SEQ ID NO: 344581 - DNA, 15 bp, Homo sapiens
gattacagctcatta

SEQ ID NO: 344582 - DNA, 15 bp, Homo sapiens
attacagctcattac

SEQ ID NO: 344583 - DNA, 15 bp, Homo sapiens
ttacagctcattacc

SEQ ID NO: 344584 - DNA, 15 bp, Homo sapiens
tacagctcattacct

SEQ ID NO: 344585 - DNA, 15 bp, Homo sapiens
acagctcattaccta

SEQ ID NO: 344586 - DNA, 15 bp, Homo sapiens
cagctcattacctag

SEQ ID NO: 344587 - DNA, 15 bp, Homo sapiens
agctcattacctagc

SEQ ID NO: 344588 - DNA, 15 bp, Homo sapiens
gctcattacctagca

SEQ ID NO: 344589 - DNA, 15 bp, Homo sapiens
ctcattacctagcat

SEQ ID NO: 344590 - DNA, 15 bp, Homo sapiens
tcattacctagcatt

SEQ ID NO: 344591 - DNA, 15 bp, Homo sapiens
cattacctagcatta

SEQ ID NO: 344592 - DNA, 15 bp, Homo sapiens
attacctagcattag

SEQ ID NO: 344593 - DNA, 15 bp, Homo sapiens
ttacctagcattaga

SEQ ID NO: 344594 - DNA, 15 bp, Homo sapiens
tacctagcattagac

SEQ ID NO: 344595 - DNA, 15 bp, Homo sapiens
acctagcattagact

SEQ ID NO: 344596 - DNA, 15 bp, Homo sapiens
cctagcattagactg

SEQ ID NO: 344597 - DNA, 15 bp, Homo sapiens
ctagcattagactgc

SEQ ID NO: 344598 - DNA, 15 bp, Homo sapiens
tagcattagactgct

SEQ ID NO: 344599 - DNA, 15 bp, Homo sapiens
agcattagactgctg

SEQ ID NO: 344600 - DNA, 15 bp, Homo sapiens
gcattagactgctgc

SEQ ID NO: 344601 - DNA, 15 bp, Homo sapiens
cattagactgctgcc

SEQ ID NO: 344602 - DNA, 15 bp, Homo sapiens
attagactgctgccc

SEQ ID NO: 344603 - DNA, 15 bp, Homo sapiens
ttagactgctgccct

SEQ ID NO: 344604 - DNA, 15 bp, Homo sapiens
tagactgctgccctg

SEQ ID NO: 344605 - DNA, 15 bp, Homo sapiens
agactgctgccctgt

SEQ ID NO: 344606 - DNA, 15 bp, Homo sapiens
gactgctgccctgta

SEQ ID NO: 344607 - DNA, 15 bp, Homo sapiens
actgctgccctgtaa

SEQ ID NO: 344608 - DNA, 15 bp, Homo sapiens
ctgctgccctgtaac

SEQ ID NO: 344609 - DNA, 15 bp, Homo sapiens
tgctgccctgtaaca

SEQ ID NO: 344610 - DNA, 15 bp, Homo sapiens
gctgccctgtaacaa

SEQ ID NO: 344611 - DNA, 15 bp, Homo sapiens
ctgccctgtaacaat

SEQ ID NO: 344612 - DNA, 15 bp, Homo sapiens
tgccctgtaacaatc

SEQ ID NO: 344613 - DNA, 15 bp, Homo sapiens
gccctgtaacaatct

SEQ ID NO: 344614 - DNA, 15 bp, Homo sapiens
ccctgtaacaatctg

SEQ ID NO: 344615 - DNA, 15 bp, Homo sapiens
cctgtaacaatctgg

SEQ ID NO: 344616 - DNA, 15 bp, Homo sapiens
ctgtaacaatctgga

SEQ ID NO: 344617 - DNA, 15 bp, Homo sapiens
tgtaacaatctggaa

SEQ ID NO: 344618 - DNA, 15 bp, Homo sapiens
gtaacaatctggaac

SEQ ID NO: 344619 - DNA, 15 bp, Homo sapiens
taacaatctggaacc

SEQ ID NO: 344620 - DNA, 15 bp, Homo sapiens
aacaatctggaacca

SEQ ID NO: 344621 - DNA, 15 bp, Homo sapiens
acaatctggaaccac

SEQ ID NO: 344622 - DNA, 15 bp, Homo sapiens
caatctggaaccacg

SEQ ID NO: 344623 - DNA, 15 bp, Homo sapiens
aatctggaaccacga

SEQ ID NO: 344624 - DNA, 15 bp, Homo sapiens
atctggaaccacgag

SEQ ID NO: 344625 - DNA, 15 bp, Homo sapiens
tctggaaccacgagt

SEQ ID NO: 344626 - DNA, 15 bp, Homo sapiens
ctggaaccacgagtc

SEQ ID NO: 344627 - DNA, 15 bp, Homo sapiens
tggaaccacgagtct

SEQ ID NO: 344628 - DNA, 15 bp, Homo sapiens
ggaaccacgagtctt

SEQ ID NO: 344629 - DNA, 15 bp, Homo sapiens
gaaccacgagtctta

SEQ ID NO: 344630 - DNA, 15 bp, Homo sapiens
aaccacgagtcttac

SEQ ID NO: 344631 - DNA, 15 bp, Homo sapiens
accacgagtcttacc

SEQ ID NO: 344632 - DNA, 15 bp, Homo sapiens
ccacgagtcttacct

SEQ ID NO: 344633 - DNA, 15 bp, Homo sapiens
cacgagtcttacctt

SEQ ID NO: 344634 - DNA, 15 bp, Homo sapiens
acgagtcttaccttt

SEQ ID NO: 344635 - DNA, 15 bp, Homo sapiens
cgagtcttacctttt

SEQ ID NO: 344636 - DNA, 15 bp, Homo sapiens
gagtcttacctttta

SEQ ID NO: 344637 - DNA, 15 bp, Homo sapiens
agtcttaccttttag

SEQ ID NO: 344638 - DNA, 15 bp, Homo sapiens
gtcttaccttttagc

SEQ ID NO: 344639 - DNA, 15 bp, Homo sapiens
tcttaccttttagca

SEQ ID NO: 344640 - DNA, 15 bp, Homo sapiens
cttaccttttagcat

SEQ ID NO: 344641 - DNA, 15 bp, Homo sapiens
ttaccttttagcata

SEQ ID NO: 344642 - DNA, 15 bp, Homo sapiens
taccttttagcatag

SEQ ID NO: 344643 - DNA, 15 bp, Homo sapiens
accttttagcatagt

SEQ ID NO: 344644 - DNA, 15 bp, Homo sapiens
ccttttagcatagtg

SEQ ID NO: 344645 - DNA, 15 bp, Homo sapiens
cttttagcatagtga

SEQ ID NO: 344646 - DNA, 15 bp, Homo sapiens
ttttagcatagtgaa

SEQ ID NO: 344647 - DNA, 15 bp, Homo sapiens
tttagcatagtgaac

SEQ ID NO: 344648 - DNA, 15 bp, Homo sapiens
ttagcatagtgaact

SEQ ID NO: 344649 - DNA, 15 bp, Homo sapiens
tagcatagtgaactg

SEQ ID NO: 344650 - DNA, 15 bp, Homo sapiens
agcatagtgaactgc

SEQ ID NO: 344651 - DNA, 15 bp, Homo sapiens
gcatagtgaactgca

SEQ ID NO: 344652 - DNA, 15 bp, Homo sapiens
catagtgaactgcaa

SEQ ID NO: 344653 - DNA, 15 bp, Homo sapiens
atagtgaactgcaaa

SEQ ID NO: 344654 - DNA, 15 bp, Homo sapiens
tagtgaactgcaaag

SEQ ID NO: 344655 - DNA, 15 bp, Homo sapiens
agtgaactgcaaagc

SEQ ID NO: 344656 - DNA, 15 bp, Homo sapiens
gtgaactgcaaagca

SEQ ID NO: 344657 - DNA, 15 bp, Homo sapiens
tgaactgcaaagcat

SEQ ID NO: 344658 - DNA, 15 bp, Homo sapiens
gaactgcaaagcatg

SEQ ID NO: 344659 - DNA, 15 bp, Homo sapiens
aactgcaaagcatgt

SEQ ID NO: 344660 - DNA, 15 bp, Homo sapiens
actgcaaagcatgta

SEQ ID NO: 344661 - DNA, 15 bp, Homo sapiens
ctgcaaagcatgtac

SEQ ID NO: 344662 - DNA, 15 bp, Homo sapiens
tgcaaagcatgtaca

SEQ ID NO: 344663 - DNA, 15 bp, Homo sapiens
gcaaagcatgtacat

SEQ ID NO: 344664 - DNA, 15 bp, Homo sapiens
caaagcatgtacatt

SEQ ID NO: 344665 - DNA, 15 bp, Homo sapiens
aaagcatgtacattt

SEQ ID NO: 344666 - DNA, 15 bp, Homo sapiens
aagcatgtacatttt

SEQ ID NO: 344667 - DNA, 15 bp, Homo sapiens
agcatgtacatttta

SEQ ID NO: 344668 - DNA, 15 bp, Homo sapiens
gcatgtacattttac

SEQ ID NO: 344669 - DNA, 15 bp, Homo sapiens
catgtacattttact

SEQ ID NO: 344670 - DNA, 15 bp, Homo sapiens
atgtacattttacta

SEQ ID NO: 344671 - DNA, 15 bp, Homo sapiens
tgtacattttactat

SEQ ID NO: 344672 - DNA, 15 bp, Homo sapiens
gtacattttactata

SEQ ID NO: 344673 - DNA, 15 bp, Homo sapiens
tacattttactataa

SEQ ID NO: 344674 - DNA, 15 bp, Homo sapiens
acattttactataaa

SEQ ID NO: 344675 - DNA, 15 bp, Homo sapiens
cattttactataaaa

SEQ ID NO: 344676 - DNA, 15 bp, Homo sapiens
attttactataaaag

SEQ ID NO: 344677 - DNA, 15 bp, Homo sapiens
ttttactataaaaga

SEQ ID NO: 344678 - DNA, 15 bp, Homo sapiens
tttactataaaagat

SEQ ID NO: 344679 - DNA, 15 bp, Homo sapiens
ttactataaaagata

SEQ ID NO: 344680 - DNA, 15 bp, Homo sapiens
tactataaaagatac

SEQ ID NO: 344681 - DNA, 15 bp, Homo sapiens
actataaaagataca

SEQ ID NO: 344682 - DNA, 15 bp, Homo sapiens
ctataaaagatacat

SEQ ID NO: 344683 - DNA, 15 bp, Homo sapiens
tataaaagatacatg

SEQ ID NO: 344684 - DNA, 15 bp, Homo sapiens
ataaaagatacatgt

SEQ ID NO: 344685 - DNA, 15 bp, Homo sapiens
taaaagatacatgtt

SEQ ID NO: 344686 - DNA, 15 bp, Homo sapiens
aaaagatacatgttt

SEQ ID NO: 344687 - DNA, 15 bp, Homo sapiens
aaagatacatgttta

SEQ ID NO: 344688 - DNA, 15 bp, Homo sapiens
aagatacatgtttaa

SEQ ID NO: 344689 - DNA, 15 bp, Homo sapiens
agatacatgtttaaa

SEQ ID NO: 344690 - DNA, 15 bp, Homo sapiens
gatacatgtttaaaa

SEQ ID NO: 344691 - DNA, 15 bp, Homo sapiens
atacatgtttaaaat

SEQ ID NO: 344692 - DNA, 15 bp, Homo sapiens
tacatgtttaaaatt

SEQ ID NO: 344693 - DNA, 15 bp, Homo sapiens
acatgtttaaaattt

SEQ ID NO: 344694 - DNA, 15 bp, Homo sapiens
catgtttaaaatttt

SEQ ID NO: 344695 - DNA, 15 bp, Homo sapiens
atgtttaaaattttt

SEQ ID NO: 344696 - DNA, 15 bp, Homo sapiens
tgtttaaaatttttg

SEQ ID NO: 344697 - DNA, 15 bp, Homo sapiens
gtttaaaatttttgg

SEQ ID NO: 344698 - DNA, 15 bp, Homo sapiens
tttaaaatttttggc

SEQ ID NO: 344699 - DNA, 15 bp, Homo sapiens
ttaaaatttttggct

SEQ ID NO: 344700 - DNA, 15 bp, Homo sapiens
taaaatttttggctg

SEQ ID NO: 344701 - DNA, 15 bp, Homo sapiens
aaaatttttggctgg

SEQ ID NO: 344702 - DNA, 15 bp, Homo sapiens
aaatttttggctggg

SEQ ID NO: 344703 - DNA, 15 bp, Homo sapiens
aatttttggctgggg

SEQ ID NO: 344704 - DNA, 15 bp, Homo sapiens
atttttggctgggga

SEQ ID NO: 344705 - DNA, 15 bp, Homo sapiens
tttttggctggggaa

SEQ ID NO: 344706 - DNA, 15 bp, Homo sapiens
ttttggctggggaac

SEQ ID NO: 344707 - DNA, 15 bp, Homo sapiens
tttggctggggaaca

SEQ ID NO: 344708 - DNA, 15 bp, Homo sapiens
ttggctggggaacag

SEQ ID NO: 344709 - DNA, 15 bp, Homo sapiens
tggctggggaacaga

SEQ ID NO: 344710 - DNA, 15 bp, Homo sapiens
ggctggggaacagaa

SEQ ID NO: 344711 - DNA, 15 bp, Homo sapiens
gctggggaacagaaa

SEQ ID NO: 344712 - DNA, 15 bp, Homo sapiens
ctggggaacagaaag

SEQ ID NO: 344713 - DNA, 15 bp, Homo sapiens
tggggaacagaaaga

SEQ ID NO: 344714 - DNA, 15 bp, Homo sapiens
ggggaacagaaagac

SEQ ID NO: 344715 - DNA, 15 bp, Homo sapiens
gggaacagaaagaca

SEQ ID NO: 344716 - DNA, 15 bp, Homo sapiens
ggaacagaaagacaa

SEQ ID NO: 344717 - DNA, 15 bp, Homo sapiens
gaacagaaagacaaa

SEQ ID NO: 344718 - DNA, 15 bp, Homo sapiens
aacagaaagacaaag

SEQ ID NO: 344719 - DNA, 15 bp, Homo sapiens
acagaaagacaaagt

SEQ ID NO: 344720 - DNA, 15 bp, Homo sapiens
cagaaagacaaagtc

SEQ ID NO: 344721 - DNA, 15 bp, Homo sapiens
agaaagacaaagtcc

SEQ ID NO: 344722 - DNA, 15 bp, Homo sapiens
gaaagacaaagtcct

SEQ ID NO: 344723 - DNA, 15 bp, Homo sapiens
aaagacaaagtcctg

SEQ ID NO: 344724 - DNA, 15 bp, Homo sapiens
aagacaaagtcctgt

SEQ ID NO: 344725 - DNA, 15 bp, Homo sapiens
agacaaagtcctgtt

SEQ ID NO: 344726 - DNA, 15 bp, Homo sapiens
gacaaagtcctgtta

SEQ ID NO: 344727 - DNA, 15 bp, Homo sapiens
acaaagtcctgttaa

SEQ ID NO: 344728 - DNA, 15 bp, Homo sapiens
caaagtcctgttaaa

SEQ ID NO: 344729 - DNA, 15 bp, Homo sapiens
aaagtcctgttaaaa

SEQ ID NO: 344730 - DNA, 15 bp, Homo sapiens
aagtcctgttaaaaa

SEQ ID NO: 344731 - DNA, 15 bp, Homo sapiens
agtcctgttaaaaag

SEQ ID NO: 344732 - DNA, 15 bp, Homo sapiens
gtcctgttaaaaaga

SEQ ID NO: 344733 - DNA, 15 bp, Homo sapiens
tcctgttaaaaagag

SEQ ID NO: 344734 - DNA, 15 bp, Homo sapiens
cctgttaaaaagagt

SEQ ID NO: 344735 - DNA, 15 bp, Homo sapiens
ctgttaaaaagagtc

SEQ ID NO: 344736 - DNA, 15 bp, Homo sapiens
tgttaaaaagagtca

SEQ ID NO: 344737 - DNA, 15 bp, Homo sapiens
gttaaaaagagtcat

SEQ ID NO: 344738 - DNA, 15 bp, Homo sapiens
ttaaaaagagtcatc

SEQ ID NO: 344739 - DNA, 15 bp, Homo sapiens
taaaaagagtcatct

SEQ ID NO: 344740 - DNA, 15 bp, Homo sapiens
aaaaagagtcatcta

SEQ ID NO: 344741 - DNA, 15 bp, Homo sapiens
aaaagagtcatctaa

SEQ ID NO: 344742 - DNA, 15 bp, Homo sapiens
aaagagtcatctaat

SEQ ID NO: 344743 - DNA, 15 bp, Homo sapiens
aagagtcatctaata

SEQ ID NO: 344744 - DNA, 15 bp, Homo sapiens
agagtcatctaataa

SEQ ID NO: 344745 - DNA, 15 bp, Homo sapiens
gagtcatctaataaa

SEQ ID NO: 344746 - DNA, 15 bp, Homo sapiens
agtcatctaataaat

SEQ ID NO: 344747 - DNA, 15 bp, Homo sapiens
gtcatctaataaata

SEQ ID NO: 344748 - DNA, 15 bp, Homo sapiens
tcatctaataaatat

SEQ ID NO: 344749 - DNA, 15 bp, Homo sapiens
catctaataaatatc

SEQ ID NO: 344750 - DNA, 15 bp, Homo sapiens
atctaataaatatct

SEQ ID NO: 344751 - DNA, 15 bp, Homo sapiens
tctaataaatatctg

SEQ ID NO: 344752 - DNA, 15 bp, Homo sapiens
ctaataaatatctga

SEQ ID NO: 344753 - DNA, 15 bp, Homo sapiens
taataaatatctgaa

SEQ ID NO: 344754 - DNA, 15 bp, Homo sapiens
aataaatatctgaaa

SEQ ID NO: 344755 - DNA, 15 bp, Homo sapiens
ataaatatctgaaat

SEQ ID NO: 344756 - DNA, 15 bp, Homo sapiens
taaatatctgaaata

SEQ ID NO: 344757 - DNA, 15 bp, Homo sapiens
aaatatctgaaatac

SEQ ID NO: 344758 - DNA, 15 bp, Homo sapiens
aatatctgaaatact

SEQ ID NO: 344759 - DNA, 15 bp, Homo sapiens
atatctgaaatacta

SEQ ID NO: 344760 - DNA, 15 bp, Homo sapiens
tatctgaaatactag

SEQ ID NO: 344761 - DNA, 15 bp, Homo sapiens
atctgaaatactaga

SEQ ID NO: 344762 - DNA, 15 bp, Homo sapiens
tctgaaatactagat

SEQ ID NO: 344763 - DNA, 15 bp, Homo sapiens
ctgaaatactagatt

SEQ ID NO: 344764 - DNA, 15 bp, Homo sapiens
tgaaatactagattt

SEQ ID NO: 344765 - DNA, 15 bp, Homo sapiens
gaaatactagatttt

SEQ ID NO: 344766 - DNA, 15 bp, Homo sapiens
aaatactagattttg

SEQ ID NO: 344767 - DNA, 15 bp, Homo sapiens
aatactagattttga

SEQ ID NO: 344768 - DNA, 15 bp, Homo sapiens
atactagattttgaa

SEQ ID NO: 344769 - DNA, 15 bp, Homo sapiens
tactagattttgaag

SEQ ID NO: 344770 - DNA, 15 bp, Homo sapiens
actagattttgaagg

SEQ ID NO: 344771 - DNA, 15 bp, Homo sapiens
ctagattttgaagga

SEQ ID NO: 344772 - DNA, 15 bp, Homo sapiens
tagattttgaaggaa

SEQ ID NO: 344773 - DNA, 15 bp, Homo sapiens
agattttgaaggaag

SEQ ID NO: 344774 - DNA, 15 bp, Homo sapiens
gattttgaaggaaga

SEQ ID NO: 344775 - DNA, 15 bp, Homo sapiens
attttgaaggaagac

SEQ ID NO: 344776 - DNA, 15 bp, Homo sapiens
ttttgaaggaagaca

SEQ ID NO: 344777 - DNA, 15 bp, Homo sapiens
tttgaaggaagacat

SEQ ID NO: 344778 - DNA, 15 bp, Homo sapiens
ttgaaggaagacatg

SEQ ID NO: 344779 - DNA, 15 bp, Homo sapiens
tgaaggaagacatgg

SEQ ID NO: 344780 - DNA, 15 bp, Homo sapiens
gaaggaagacatgga

SEQ ID NO: 344781 - DNA, 15 bp, Homo sapiens
aaggaagacatggaa

SEQ ID NO: 344782 - DNA, 15 bp, Homo sapiens
aggaagacatggaaa

SEQ ID NO: 344783 - DNA, 15 bp, Homo sapiens
ggaagacatggaaat

SEQ ID NO: 344784 - DNA, 15 bp, Homo sapiens
gaagacatggaaatg

SEQ ID NO: 344785 - DNA, 15 bp, Homo sapiens
aagacatggaaatga

SEQ ID NO: 344786 - DNA, 15 bp, Homo sapiens
agacatggaaatgaa

SEQ ID NO: 344787 - DNA, 15 bp, Homo sapiens
gacatggaaatgaag

SEQ ID NO: 344788 - DNA, 15 bp, Homo sapiens
acatggaaatgaagc

SEQ ID NO: 344789 - DNA, 15 bp, Homo sapiens
catggaaatgaagcg

SEQ ID NO: 344790 - DNA, 15 bp, Homo sapiens
atggaaatgaagcgt

SEQ ID NO: 344791 - DNA, 15 bp, Homo sapiens
tggaaatgaagcgtc

SEQ ID NO: 344792 - DNA, 15 bp, Homo sapiens
ggaaatgaagcgtca

SEQ ID NO: 344793 - DNA, 15 bp, Homo sapiens
gaaatgaagcgtcaa

SEQ ID NO: 344794 - DNA, 15 bp, Homo sapiens
aaatgaagcgtcaaa

SEQ ID NO: 344795 - DNA, 15 bp, Homo sapiens
aatgaagcgtcaaac

SEQ ID NO: 344796 - DNA, 15 bp, Homo sapiens
atgaagcgtcaaaca

SEQ ID NO: 344797 - DNA, 15 bp, Homo sapiens
tgaagcgtcaaacat

SEQ ID NO: 344798 - DNA, 15 bp, Homo sapiens
gaagcgtcaaacatt

SEQ ID NO: 344799 - DNA, 15 bp, Homo sapiens
aagcgtcaaacattg

SEQ ID NO: 344800 - DNA, 15 bp, Homo sapiens
agcgtcaaacattgg

SEQ ID NO: 344801 - DNA, 15 bp, Homo sapiens
gcgtcaaacattgga

SEQ ID NO: 344802 - DNA, 15 bp, Homo sapiens
cgtcaaacattggat

SEQ ID NO: 344803 - DNA, 15 bp, Homo sapiens
gtcaaacattggatc

SEQ ID NO: 344804 - DNA, 15 bp, Homo sapiens
tcaaacattggatca

SEQ ID NO: 344805 - DNA, 15 bp, Homo sapiens
caaacattggatcag

SEQ ID NO: 344806 - DNA, 15 bp, Homo sapiens
aaacattggatcagc

SEQ ID NO: 344807 - DNA, 15 bp, Homo sapiens
aacattggatcagct

SEQ ID NO: 344808 - DNA, 15 bp, Homo sapiens
acattggatcagctg

SEQ ID NO: 344809 - DNA, 15 bp, Homo sapiens
cattggatcagctga

SEQ ID NO: 344810 - DNA, 15 bp, Homo sapiens
attggatcagctgag

SEQ ID NO: 344811 - DNA, 15 bp, Homo sapiens
ttggatcagctgagt

SEQ ID NO: 344812 - DNA, 15 bp, Homo sapiens
tggatcagctgagtg

SEQ ID NO: 344813 - DNA, 15 bp, Homo sapiens
ggatcagctgagtga

SEQ ID NO: 344814 - DNA, 15 bp, Homo sapiens
gatcagctgagtgag

SEQ ID NO: 344815 - DNA, 15 bp, Homo sapiens
atcagctgagtgaga

SEQ ID NO: 344816 - DNA, 15 bp, Homo sapiens
tcagctgagtgagat

SEQ ID NO: 344817 - DNA, 15 bp, Homo sapiens
cagctgagtgagatt

SEQ ID NO: 344818 - DNA, 15 bp, Homo sapiens
agctgagtgagattg

SEQ ID NO: 344819 - DNA, 15 bp, Homo sapiens
gctgagtgagattgg

SEQ ID NO: 344820 - DNA, 15 bp, Homo sapiens
ctgagtgagattggc

SEQ ID NO: 344821 - DNA, 15 bp, Homo sapiens
tgagtgagattggcc

SEQ ID NO: 344822 - DNA, 15 bp, Homo sapiens
gagtgagattggcca

SEQ ID NO: 344823 - DNA, 15 bp, Homo sapiens
agtgagattggccag

SEQ ID NO: 344824 - DNA, 15 bp, Homo sapiens
gtgagattggccagg

SEQ ID NO: 344825 - DNA, 15 bp, Homo sapiens
tgagattggccagga

SEQ ID NO: 344826 - DNA, 15 bp, Homo sapiens
gagattggccaggat

SEQ ID NO: 344827 - DNA, 15 bp, Homo sapiens
agattggccaggatg

SEQ ID NO: 344828 - DNA, 15 bp, Homo sapiens
gattggccaggatgt

SEQ ID NO: 344829 - DNA, 15 bp, Homo sapiens
attggccaggatgtg

SEQ ID NO: 344830 - DNA, 15 bp, Homo sapiens
ttggccaggatgtgg

SEQ ID NO: 344831 - DNA, 15 bp, Homo sapiens
tggccaggatgtggg

SEQ ID NO: 344832 - DNA, 15 bp, Homo sapiens
ggccaggatgtggga

SEQ ID NO: 344833 - DNA, 15 bp, Homo sapiens
gccaggatgtgggac

SEQ ID NO: 344834 - DNA, 15 bp, Homo sapiens
ccaggatgtgggaca

SEQ ID NO: 344835 - DNA, 15 bp, Homo sapiens
caggatgtgggacaa

SEQ ID NO: 344836 - DNA, 15 bp, Homo sapiens
aggatgtgggacaat

SEQ ID NO: 344837 - DNA, 15 bp, Homo sapiens
ggatgtgggacaatt

SEQ ID NO: 344838 - DNA, 15 bp, Homo sapiens
gatgtgggacaatta

SEQ ID NO: 344839 - DNA, 15 bp, Homo sapiens
atgtgggacaattac

SEQ ID NO: 344840 - DNA, 15 bp, Homo sapiens
tgtgggacaattact

SEQ ID NO: 344841 - DNA, 15 bp, Homo sapiens
gtgggacaattactt

SEQ ID NO: 344842 - DNA, 15 bp, Homo sapiens
tgggacaattacttg

SEQ ID NO: 344843 - DNA, 15 bp, Homo sapiens
gggacaattacttga

SEQ ID NO: 344844 - DNA, 15 bp, Homo sapiens
ggacaattacttgat

SEQ ID NO: 344845 - DNA, 15 bp, Homo sapiens
gacaattacttgata

SEQ ID NO: 344846 - DNA, 15 bp, Homo sapiens
acaattacttgataa

SEQ ID NO: 344847 - DNA, 15 bp, Homo sapiens
caattacttgataat

SEQ ID NO: 344848 - DNA, 15 bp, Homo sapiens
aattacttgataatt

SEQ ID NO: 344849 - DNA, 15 bp, Homo sapiens
attacttgataattc

SEQ ID NO: 344850 - DNA, 15 bp, Homo sapiens
ttacttgataattcc

SEQ ID NO: 344851 - DNA, 15 bp, Homo sapiens
tacttgataattcca

SEQ ID NO: 344852 - DNA, 15 bp, Homo sapiens
acttgataattccaa

SEQ ID NO: 344853 - DNA, 15 bp, Homo sapiens
cttgataattccaag

SEQ ID NO: 344854 - DNA, 15 bp, Homo sapiens
ttgataattccaagg

SEQ ID NO: 344855 - DNA, 15 bp, Homo sapiens
tgataattccaaggc

SEQ ID NO: 344856 - DNA, 15 bp, Homo sapiens
gataattccaaggca

SEQ ID NO: 344857 - DNA, 15 bp, Homo sapiens
ataattccaaggcat

SEQ ID NO: 344858 - DNA, 15 bp, Homo sapiens
taattccaaggcatc

SEQ ID NO: 344859 - DNA, 15 bp, Homo sapiens
aattccaaggcatct

SEQ ID NO: 344860 - DNA, 15 bp, Homo sapiens
attccaaggcatcta

SEQ ID NO: 344861 - DNA, 15 bp, Homo sapiens
ttccaaggcatctaa

SEQ ID NO: 344862 - DNA, 15 bp, Homo sapiens
tccaaggcatctaag

SEQ ID NO: 344863 - DNA, 15 bp, Homo sapiens
ccaaggcatctaaga

SEQ ID NO: 344864 - DNA, 15 bp, Homo sapiens
caaggcatctaagaa

SEQ ID NO: 344865 - DNA, 15 bp, Homo sapiens
aaggcatctaagaag

SEQ ID NO: 344866 - DNA, 15 bp, Homo sapiens
aggcatctaagaaga

SEQ ID NO: 344867 - DNA, 15 bp, Homo sapiens
ggcatctaagaagat

SEQ ID NO: 344868 - DNA, 15 bp, Homo sapiens
gcatctaagaagatc

SEQ ID NO: 344869 - DNA, 15 bp, Homo sapiens
catctaagaagatca

SEQ ID NO: 344870 - DNA, 15 bp, Homo sapiens
atctaagaagatcaa

SEQ ID NO: 344871 - DNA, 15 bp, Homo sapiens
tctaagaagatcaac

SEQ ID NO: 344872 - DNA, 15 bp, Homo sapiens
ctaagaagatcaaca

SEQ ID NO: 344873 - DNA, 15 bp, Homo sapiens
taagaagatcaacag

SEQ ID NO: 344874 - DNA, 15 bp, Homo sapiens
aagaagatcaacagt

SEQ ID NO: 344875 - DNA, 15 bp, Homo sapiens
agaagatcaacagtg

SEQ ID NO: 344876 - DNA, 15 bp, Homo sapiens
gaagatcaacagtga

SEQ ID NO: 344877 - DNA, 15 bp, Homo sapiens
aagatcaacagtgac

SEQ ID NO: 344878 - DNA, 15 bp, Homo sapiens
agatcaacagtgact

SEQ ID NO: 344879 - DNA, 15 bp, Homo sapiens
gatcaacagtgactc

SEQ ID NO: 344880 - DNA, 15 bp, Homo sapiens
atcaacagtgactca

SEQ ID NO: 344881 - DNA, 15 bp, Homo sapiens
tcaacagtgactcag

SEQ ID NO: 344882 - DNA, 15 bp, Homo sapiens
caacagtgactcaga

SEQ ID NO: 344883 - DNA, 15 bp, Homo sapiens
aacagtgactcagag

SEQ ID NO: 344884 - DNA, 15 bp, Homo sapiens
acagtgactcagagg

SEQ ID NO: 344885 - DNA, 15 bp, Homo sapiens
cagtgactcagagga

SEQ ID NO: 344886 - DNA, 15 bp, Homo sapiens
agtgactcagaggaa

SEQ ID NO: 344887 - DNA, 15 bp, Homo sapiens
gtgactcagaggaac

SEQ ID NO: 344888 - DNA, 15 bp, Homo sapiens
tgactcagaggaact

SEQ ID NO: 344889 - DNA, 15 bp, Homo sapiens
gactcagaggaactg

SEQ ID NO: 344890 - DNA, 15 bp, Homo sapiens
actcagaggaactga

SEQ ID NO: 344891 - DNA, 15 bp, Homo sapiens
ctcagaggaactgac

SEQ ID NO: 344892 - DNA, 15 bp, Homo sapiens
tcagaggaactgact

SEQ ID NO: 344893 - DNA, 15 bp, Homo sapiens
cagaggaactgactc

SEQ ID NO: 344894 - DNA, 15 bp, Homo sapiens
agaggaactgactca

SEQ ID NO: 344895 - DNA, 15 bp, Homo sapiens
gaggaactgactcaa

SEQ ID NO: 344896 - DNA, 15 bp, Homo sapiens
aggaactgactcaaa

SEQ ID NO: 344897 - DNA, 15 bp, Homo sapiens
ggaactgactcaaag

SEQ ID NO: 344898 - DNA, 15 bp, Homo sapiens
gaactgactcaaaga

SEQ ID NO: 344899 - DNA, 15 bp, Homo sapiens
aactgactcaaagat

SEQ ID NO: 344900 - DNA, 15 bp, Homo sapiens
actgactcaaagatg

SEQ ID NO: 344901 - DNA, 15 bp, Homo sapiens
ctgactcaaagatgg

SEQ ID NO: 344902 - DNA, 15 bp, Homo sapiens
tgactcaaagatggg

SEQ ID NO: 344903 - DNA, 15 bp, Homo sapiens
gactcaaagatggga

SEQ ID NO: 344904 - DNA, 15 bp, Homo sapiens
actcaaagatgggat

SEQ ID NO: 344905 - DNA, 15 bp, Homo sapiens
ctcaaagatgggatt

SEQ ID NO: 344906 - DNA, 15 bp, Homo sapiens
tcaaagatgggattc

SEQ ID NO: 344907 - DNA, 15 bp, Homo sapiens
caaagatgggattct

SEQ ID NO: 344908 - DNA, 15 bp, Homo sapiens
aaagatgggattctt

SEQ ID NO: 344909 - DNA, 15 bp, Homo sapiens
aagatgggattcttt

SEQ ID NO: 344910 - DNA, 15 bp, Homo sapiens
agatgggattctttg

SEQ ID NO: 344911 - DNA, 15 bp, Homo sapiens
gatgggattctttgg

SEQ ID NO: 344912 - DNA, 15 bp, Homo sapiens
atgggattctttggt

SEQ ID NO: 344913 - DNA, 15 bp, Homo sapiens
tgggattctttggtt

SEQ ID NO: 344914 - DNA, 15 bp, Homo sapiens
gggattctttggttc

SEQ ID NO: 344915 - DNA, 15 bp, Homo sapiens
ggattctttggttca

SEQ ID NO: 344916 - DNA, 15 bp, Homo sapiens
gattctttggttcag

SEQ ID NO: 344917 - DNA, 15 bp, Homo sapiens
attctttggttcaga

SEQ ID NO: 344918 - DNA, 15 bp, Homo sapiens
ttctttggttcagag

SEQ ID NO: 344919 - DNA, 15 bp, Homo sapiens
tctttggttcagaga

SEQ ID NO: 344920 - DNA, 15 bp, Homo sapiens
ctttggttcagagac

SEQ ID NO: 344921 - DNA, 15 bp, Homo sapiens
tttggttcagagact

SEQ ID NO: 344922 - DNA, 15 bp, Homo sapiens
ttggttcagagacta

SEQ ID NO: 344923 - DNA, 15 bp, Homo sapiens
tggttcagagactag

SEQ ID NO: 344924 - DNA, 15 bp, Homo sapiens
ggttcagagactaga

SEQ ID NO: 344925 - DNA, 15 bp, Homo sapiens
gttcagagactagaa

SEQ ID NO: 344926 - DNA, 15 bp, Homo sapiens
ttcagagactagaag

SEQ ID NO: 344927 - DNA, 15 bp, Homo sapiens
tcagagactagaaga

SEQ ID NO: 344928 - DNA, 15 bp, Homo sapiens
cagagactagaagat

SEQ ID NO: 344929 - DNA, 15 bp, Homo sapiens
agagactagaagatt

SEQ ID NO: 344930 - DNA, 15 bp, Homo sapiens
gagactagaagattc

SEQ ID NO: 344931 - DNA, 15 bp, Homo sapiens
agactagaagattcc

SEQ ID NO: 344932 - DNA, 15 bp, Homo sapiens
gactagaagattcct

SEQ ID NO: 344933 - DNA, 15 bp, Homo sapiens
actagaagattcctc

SEQ ID NO: 344934 - DNA, 15 bp, Homo sapiens
ctagaagattcctcc

SEQ ID NO: 344935 - DNA, 15 bp, Homo sapiens
tagaagattcctcca

SEQ ID NO: 344936 - DNA, 15 bp, Homo sapiens
agaagattcctccaa

SEQ ID NO: 344937 - DNA, 15 bp, Homo sapiens
gaagattcctccaac

SEQ ID NO: 344938 - DNA, 15 bp, Homo sapiens
aagattcctccaacc

SEQ ID NO: 344939 - DNA, 15 bp, Homo sapiens
agattcctccaacca

SEQ ID NO: 344940 - DNA, 15 bp, Homo sapiens
gattcctccaaccag

SEQ ID NO: 344941 - DNA, 15 bp, Homo sapiens
attcctccaaccagg

SEQ ID NO: 344942 - DNA, 15 bp, Homo sapiens
ttcctccaaccaggt

SEQ ID NO: 344943 - DNA, 15 bp, Homo sapiens
tcctccaaccaggta

SEQ ID NO: 344944 - DNA, 15 bp, Homo sapiens
cctccaaccaggtac

SEQ ID NO: 344945 - DNA, 15 bp, Homo sapiens
ctccaaccaggtact

SEQ ID NO: 344946 - DNA, 15 bp, Homo sapiens
tccaaccaggtactt

SEQ ID NO: 344947 - DNA, 15 bp, Homo sapiens
ccaaccaggtacttt

SEQ ID NO: 344948 - DNA, 15 bp, Homo sapiens
caaccaggtactttt

SEQ ID NO: 344949 - DNA, 15 bp, Homo sapiens
aaccaggtacttttt

SEQ ID NO: 344950 - DNA, 15 bp, Homo sapiens
accaggtactttttg

SEQ ID NO: 344951 - DNA, 15 bp, Homo sapiens
ccaggtactttttga

SEQ ID NO: 344952 - DNA, 15 bp, Homo sapiens
caggtactttttgat

SEQ ID NO: 344953 - DNA, 15 bp, Homo sapiens
aggtactttttgatt

SEQ ID NO: 344954 - DNA, 15 bp, Homo sapiens
ggtactttttgattt

SEQ ID NO: 344955 - DNA, 15 bp, Homo sapiens
gtactttttgatttg

SEQ ID NO: 344956 - DNA, 15 bp, Homo sapiens
tactttttgatttgg

SEQ ID NO: 344957 - DNA, 15 bp, Homo sapiens
actttttgatttgga

SEQ ID NO: 344958 - DNA, 15 bp, Homo sapiens
ctttttgatttggat

SEQ ID NO: 344959 - DNA, 15 bp, Homo sapiens
tttttgatttggatc

SEQ ID NO: 344960 - DNA, 15 bp, Homo sapiens
ttttgatttggatca

SEQ ID NO: 344961 - DNA, 15 bp, Homo sapiens
tttgatttggatcat

SEQ ID NO: 344962 - DNA, 15 bp, Homo sapiens
ttgatttggatcata

SEQ ID NO: 344963 - DNA, 15 bp, Homo sapiens
tgatttggatcatat

SEQ ID NO: 344964 - DNA, 15 bp, Homo sapiens
gatttggatcatatg

SEQ ID NO: 344965 - DNA, 15 bp, Homo sapiens
atttggatcatatgt

SEQ ID NO: 344966 - DNA, 15 bp, Homo sapiens
tttggatcatatgtt

SEQ ID NO: 344967 - DNA, 15 bp, Homo sapiens
ttggatcatatgttg

SEQ ID NO: 344968 - DNA, 15 bp, Homo sapiens
tggatcatatgttgt

SEQ ID NO: 344969 - DNA, 15 bp, Homo sapiens
ggatcatatgttgtg

SEQ ID NO: 344970 - DNA, 15 bp, Homo sapiens
gatcatatgttgtgc

SEQ ID NO: 344971 - DNA, 15 bp, Homo sapiens
atcatatgttgtgcc

SEQ ID NO: 344972 - DNA, 15 bp, Homo sapiens
tcatatgttgtgcca

SEQ ID NO: 344973 - DNA, 15 bp, Homo sapiens
catatgttgtgccat

SEQ ID NO: 344974 - DNA, 15 bp, Homo sapiens
atatgttgtgccatg

SEQ ID NO: 344975 - DNA, 15 bp, Homo sapiens
tatgttgtgccatga

SEQ ID NO: 344976 - DNA, 15 bp, Homo sapiens
atgttgtgccatgaa

SEQ ID NO: 344977 - DNA, 15 bp, Homo sapiens
tgttgtgccatgaag

SEQ ID NO: 344978 - DNA, 15 bp, Homo sapiens
gttgtgccatgaagt

SEQ ID NO: 344979 - DNA, 15 bp, Homo sapiens
ttgtgccatgaagta

SEQ ID NO: 344980 - DNA, 15 bp, Homo sapiens
tgtgccatgaagtaa

SEQ ID NO: 344981 - DNA, 15 bp, Homo sapiens
gtgccatgaagtaaa

SEQ ID NO: 344982 - DNA, 15 bp, Homo sapiens
tgccatgaagtaaac

SEQ ID NO: 344983 - DNA, 15 bp, Homo sapiens
gccatgaagtaaaca

SEQ ID NO: 344984 - DNA, 15 bp, Homo sapiens
ccatgaagtaaacat

SEQ ID NO: 344985 - DNA, 15 bp, Homo sapiens
catgaagtaaacatt

SEQ ID NO: 344986 - DNA, 15 bp, Homo sapiens
atgaagtaaacattt

SEQ ID NO: 344987 - DNA, 15 bp, Homo sapiens
tgaagtaaacattta

SEQ ID NO: 344988 - DNA, 15 bp, Homo sapiens
gaagtaaacatttaa

SEQ ID NO: 344989 - DNA, 15 bp, Homo sapiens
aagtaaacatttaaa

SEQ ID NO: 344990 - DNA, 15 bp, Homo sapiens
agtaaacatttaaaa

SEQ ID NO: 344991 - DNA, 15 bp, Homo sapiens
gtaaacatttaaaat

SEQ ID NO: 344992 - DNA, 15 bp, Homo sapiens
taaacatttaaaatt

SEQ ID NO: 344993 - DNA, 15 bp, Homo sapiens
aaacatttaaaattt

SEQ ID NO: 344994 - DNA, 15 bp, Homo sapiens
aacatttaaaattta

SEQ ID NO: 344995 - DNA, 15 bp, Homo sapiens
acatttaaaatttaa

SEQ ID NO: 344996 - DNA, 15 bp, Homo sapiens
catttaaaatttaaa

SEQ ID NO: 344997 - DNA, 15 bp, Homo sapiens
atttaaaatttaaat

SEQ ID NO: 344998 - DNA, 15 bp, Homo sapiens
tttaaaatttaaatg

SEQ ID NO: 344999 - DNA, 15 bp, Homo sapiens
ttaaaatttaaatgt

SEQ ID NO: 345000 - DNA, 15 bp, Homo sapiens
taaaatttaaatgtt

SEQ ID NO: 345001 - DNA, 15 bp, Homo sapiens
aaaatttaaatgttc

SEQ ID NO: 345002 - DNA, 15 bp, Homo sapiens
aaatttaaatgttca

SEQ ID NO: 345003 - DNA, 15 bp, Homo sapiens
aatttaaatgttcag

SEQ ID NO: 345004 - DNA, 15 bp, Homo sapiens
atttaaatgttcagg

SEQ ID NO: 345005 - DNA, 15 bp, Homo sapiens
tttaaatgttcaggt

SEQ ID NO: 345006 - DNA, 15 bp, Homo sapiens
ttaaatgttcaggtt

SEQ ID NO: 345007 - DNA, 15 bp, Homo sapiens
taaatgttcaggtta

SEQ ID NO: 345008 - DNA, 15 bp, Homo sapiens
aaatgttcaggttag

SEQ ID NO: 345009 - DNA, 15 bp, Homo sapiens
aatgttcaggttagt

SEQ ID NO: 345010 - DNA, 15 bp, Homo sapiens
atgttcaggttagtt

SEQ ID NO: 345011 - DNA, 15 bp, Homo sapiens
tgttcaggttagttt

SEQ ID NO: 345012 - DNA, 15 bp, Homo sapiens
gttcaggttagtttt

SEQ ID NO: 345013 - DNA, 15 bp, Homo sapiens
ttcaggttagtttta

SEQ ID NO: 345014 - DNA, 15 bp, Homo sapiens
tcaggttagttttaa

SEQ ID NO: 345015 - DNA, 15 bp, Homo sapiens
caggttagttttaat

SEQ ID NO: 345016 - DNA, 15 bp, Homo sapiens
aggttagttttaatt

SEQ ID NO: 345017 - DNA, 15 bp, Homo sapiens
ggttagttttaattt

SEQ ID NO: 345018 - DNA, 15 bp, Homo sapiens
gttagttttaatttg

SEQ ID NO: 345019 - DNA, 15 bp, Homo sapiens
ttagttttaatttgt

SEQ ID NO: 345020 - DNA, 15 bp, Homo sapiens
tagttttaatttgta

SEQ ID NO: 345021 - DNA, 15 bp, Homo sapiens
agttttaatttgtat

SEQ ID NO: 345022 - DNA, 15 bp, Homo sapiens
gttttaatttgtatg

SEQ ID NO: 345023 - DNA, 15 bp, Homo sapiens
ttttaatttgtatga

SEQ ID NO: 345024 - DNA, 15 bp, Homo sapiens
tttaatttgtatgaa

SEQ ID NO: 345025 - DNA, 15 bp, Homo sapiens
ttaatttgtatgaaa

SEQ ID NO: 345026 - DNA, 15 bp, Homo sapiens
taatttgtatgaaat

SEQ ID NO: 345027 - DNA, 15 bp, Homo sapiens
aatttgtatgaaata

SEQ ID NO: 345028 - DNA, 15 bp, Homo sapiens
atttgtatgaaataa

SEQ ID NO: 345029 - DNA, 15 bp, Homo sapiens
ttgtatgaaataaac

SEQ ID NO: 345030 - DNA, 15 bp, Homo sapiens
tgtatgaaataaact

SEQ ID NO: 345031 - DNA, 15 bp, Homo sapiens
gtatgaaataaacta

SEQ ID NO: 345032 - DNA, 15 bp, Homo sapiens
tatgaaataaactaa

SEQ ID NO: 345033 - DNA, 15 bp, Homo sapiens
atgaaataaactaaa

SEQ ID NO: 345034 - DNA, 15 bp, Homo sapiens
tgaaataaactaaaa

SEQ ID NO: 345035 - DNA, 15 bp, Homo sapiens
gaaataaactaaaaa

SEQ ID NO: 345036 - DNA, 15 bp, Homo sapiens
aaataaactaaaaag

SEQ ID NO: 345037 - DNA, 15 bp, Homo sapiens
aataaactaaaaagt

SEQ ID NO: 345038 - DNA, 15 bp, Homo sapiens
ataaactaaaaagtt

SEQ ID NO: 345039 - DNA, 15 bp, Homo sapiens
taaactaaaaagttg

SEQ ID NO: 345040 - DNA, 15 bp, Homo sapiens
aaactaaaaagttgt

SEQ ID NO: 345041 - DNA, 15 bp, Homo sapiens
aactaaaaagttgtt

SEQ ID NO: 345042 - DNA, 15 bp, Homo sapiens
actaaaaagttgttt

SEQ ID NO: 345043 - DNA, 15 bp, Homo sapiens
ctaaaaagttgtttc

SEQ ID NO: 345044 - DNA, 15 bp, Homo sapiens
taaaaagttgtttcc

SEQ ID NO: 345045 - DNA, 15 bp, Homo sapiens
aaaaagttgtttcct

SEQ ID NO: 345046 - DNA, 15 bp, Homo sapiens
aaaagttgtttcctt

SEQ ID NO: 345047 - DNA, 15 bp, Homo sapiens
aaagttgtttcctta

SEQ ID NO: 345048 - DNA, 15 bp, Homo sapiens
aagttgtttccttac

SEQ ID NO: 345049 - DNA, 15 bp, Homo sapiens
agttgtttccttaca

SEQ ID NO: 345050 - DNA, 15 bp, Homo sapiens
gttgtttccttacac

SEQ ID NO: 345051 - DNA, 15 bp, Homo sapiens
ttgtttccttacacc

SEQ ID NO: 345052 - DNA, 15 bp, Homo sapiens
tgtttccttacacct

SEQ ID NO: 345053 - DNA, 15 bp, Homo sapiens
gtttccttacacctg

SEQ ID NO: 345054 - DNA, 15 bp, Homo sapiens
tttccttacacctga

SEQ ID NO: 345055 - DNA, 15 bp, Homo sapiens
ttccttacacctgat

SEQ ID NO: 345056 - DNA, 15 bp, Homo sapiens
tccttacacctgatg

SEQ ID NO: 345057 - DNA, 15 bp, Homo sapiens
ccttacacctgatga

SEQ ID NO: 345058 - DNA, 15 bp, Homo sapiens
cttacacctgatgaa

SEQ ID NO: 345059 - DNA, 15 bp, Homo sapiens
ttacacctgatgaaa

SEQ ID NO: 345060 - DNA, 15 bp, Homo sapiens
tacacctgatgaaaa

SEQ ID NO: 345061 - DNA, 15 bp, Homo sapiens
acacctgatgaaaaa

SEQ ID NO: 345062 - DNA, 15 bp, Homo sapiens
cacctgatgaaaaat

SEQ ID NO: 345063 - DNA, 15 bp, Homo sapiens
acctgatgaaaaatt

SEQ ID NO: 345064 - DNA, 15 bp, Homo sapiens
cctgatgaaaaattg

SEQ ID NO: 345065 - DNA, 15 bp, Homo sapiens
ctgatgaaaaattga

SEQ ID NO: 345066 - DNA, 15 bp, Homo sapiens
tgatgaaaaattgac

SEQ ID NO: 345067 - DNA, 15 bp, Homo sapiens
gatgaaaaattgaca

SEQ ID NO: 345068 - DNA, 15 bp, Homo sapiens
atgaaaaattgacat

SEQ ID NO: 345069 - DNA, 15 bp, Homo sapiens
tgaaaaattgacatg

SEQ ID NO: 345070 - DNA, 15 bp, Homo sapiens
gaaaaattgacatgt

SEQ ID NO: 345071 - DNA, 15 bp, Homo sapiens
aaaaattgacatgtg

SEQ ID NO: 345072 - DNA, 15 bp, Homo sapiens
aaaattgacatgtga

SEQ ID NO: 345073 - DNA, 15 bp, Homo sapiens
aaattgacatgtgaa

SEQ ID NO: 345074 - DNA, 15 bp, Homo sapiens
aattgacatgtgaaa

SEQ ID NO: 345075 - DNA, 15 bp, Homo sapiens
attgacatgtgaaaa

SEQ ID NO: 345076 - DNA, 15 bp, Homo sapiens
ttgacatgtgaaaat

SEQ ID NO: 345077 - DNA, 15 bp, Homo sapiens
tgacatgtgaaaatc

SEQ ID NO: 345078 - DNA, 15 bp, Homo sapiens
gacatgtgaaaatca

SEQ ID NO: 345079 - DNA, 15 bp, Homo sapiens
acatgtgaaaatcac

SEQ ID NO: 345080 - DNA, 15 bp, Homo sapiens
catgtgaaaatcacc

SEQ ID NO: 345081 - DNA, 15 bp, Homo sapiens
atgtgaaaatcacct

SEQ ID NO: 345082 - DNA, 15 bp, Homo sapiens
tgtgaaaatcacctt

SEQ ID NO: 345083 - DNA, 15 bp, Homo sapiens
gtgaaaatcaccttc

SEQ ID NO: 345084 - DNA, 15 bp, Homo sapiens
tgaaaatcaccttca

SEQ ID NO: 345085 - DNA, 15 bp, Homo sapiens
gaaaatcaccttcag

SEQ ID NO: 345086 - DNA, 15 bp, Homo sapiens
aaaatcaccttcagt

SEQ ID NO: 345087 - DNA, 15 bp, Homo sapiens
aaatcaccttcagtt

SEQ ID NO: 345088 - DNA, 15 bp, Homo sapiens
aatcaccttcagttt

SEQ ID NO: 345089 - DNA, 15 bp, Homo sapiens
atcaccttcagtttt

SEQ ID NO: 345090 - DNA, 15 bp, Homo sapiens
tcaccttcagttttc

SEQ ID NO: 345091 - DNA, 15 bp, Homo sapiens
caccttcagttttct

SEQ ID NO: 345092 - DNA, 15 bp, Homo sapiens
accttcagttttcta

SEQ ID NO: 345093 - DNA, 15 bp, Homo sapiens
ccttcagttttctaa

SEQ ID NO: 345094 - DNA, 15 bp, Homo sapiens
cttcagttttctaaa

SEQ ID NO: 345095 - DNA, 15 bp, Homo sapiens
ttcagttttctaaag

SEQ ID NO: 345096 - DNA, 15 bp, Homo sapiens
tcagttttctaaagt

SEQ ID NO: 345097 - DNA, 15 bp, Homo sapiens
cagttttctaaagta

SEQ ID NO: 345098 - DNA, 15 bp, Homo sapiens
agttttctaaagtaa

SEQ ID NO: 345099 - DNA, 15 bp, Homo sapiens
gttttctaaagtaag

SEQ ID NO: 345100 - DNA, 15 bp, Homo sapiens
ttttctaaagtaagt

SEQ ID NO: 345101 - DNA, 15 bp, Homo sapiens
tttctaaagtaagtt

SEQ ID NO: 345102 - DNA, 15 bp, Homo sapiens
ttctaaagtaagttt

SEQ ID NO: 345103 - DNA, 15 bp, Homo sapiens
tctaaagtaagtttt

SEQ ID NO: 345104 - DNA, 15 bp, Homo sapiens
ctaaagtaagtttta

SEQ ID NO: 345105 - DNA, 15 bp, Homo sapiens
taaagtaagttttaa

SEQ ID NO: 345106 - DNA, 15 bp, Homo sapiens
aaagtaagttttaat

SEQ ID NO: 345107 - DNA, 15 bp, Homo sapiens
aagtaagttttaata

SEQ ID NO: 345108 - DNA, 15 bp, Homo sapiens
agtaagttttaatag

SEQ ID NO: 345109 - DNA, 15 bp, Homo sapiens
gtaagttttaataga

SEQ ID NO: 345110 - DNA, 15 bp, Homo sapiens
taagttttaatagat

SEQ ID NO: 345111 - DNA, 15 bp, Homo sapiens
aagttttaatagatt

SEQ ID NO: 345112 - DNA, 15 bp, Homo sapiens
agttttaatagatta

SEQ ID NO: 345113 - DNA, 15 bp, Homo sapiens
gttttaatagattat

SEQ ID NO: 345114 - DNA, 15 bp, Homo sapiens
ttttaatagattatc

SEQ ID NO: 345115 - DNA, 15 bp, Homo sapiens
tttaatagattatct

SEQ ID NO: 345116 - DNA, 15 bp, Homo sapiens
ttaatagattatctt

SEQ ID NO: 345117 - DNA, 15 bp, Homo sapiens
taatagattatctta

SEQ ID NO: 345118 - DNA, 15 bp, Homo sapiens
aatagattatcttaa

SEQ ID NO: 345119 - DNA, 15 bp, Homo sapiens
atagattatcttaat

SEQ ID NO: 345120 - DNA, 15 bp, Homo sapiens
tagattatcttaata

SEQ ID NO: 345121 - DNA, 15 bp, Homo sapiens
agattatcttaatat

SEQ ID NO: 345122 - DNA, 15 bp, Homo sapiens
gattatcttaatatc

SEQ ID NO: 345123 - DNA, 15 bp, Homo sapiens
attatcttaatatcc

SEQ ID NO: 345124 - DNA, 15 bp, Homo sapiens
ttatcttaatatcct

SEQ ID NO: 345125 - DNA, 15 bp, Homo sapiens
tatcttaatatccta

SEQ ID NO: 345126 - DNA, 15 bp, Homo sapiens
atcttaatatcctat

SEQ ID NO: 345127 - DNA, 15 bp, Homo sapiens
tcttaatatcctata

SEQ ID NO: 345128 - DNA, 15 bp, Homo sapiens
cttaatatcctataa

SEQ ID NO: 345129 - DNA, 15 bp, Homo sapiens
ttaatatcctataat

SEQ ID NO: 345130 - DNA, 15 bp, Homo sapiens
taatatcctataatt

SEQ ID NO: 345131 - DNA, 15 bp, Homo sapiens
aatatcctataattt

SEQ ID NO: 345132 - DNA, 15 bp, Homo sapiens
atatcctataattta

SEQ ID NO: 345133 - DNA, 15 bp, Homo sapiens
tatcctataatttaa

SEQ ID NO: 345134 - DNA, 15 bp, Homo sapiens
atcctataatttaat

SEQ ID NO: 345135 - DNA, 15 bp, Homo sapiens
tcctataatttaatt

SEQ ID NO: 345136 - DNA, 15 bp, Homo sapiens
cctataatttaattt

SEQ ID NO: 345137 - DNA, 15 bp, Homo sapiens
ctataatttaattta

SEQ ID NO: 345138 - DNA, 15 bp, Homo sapiens
tataatttaatttat

SEQ ID NO: 345139 - DNA, 15 bp, Homo sapiens
ataatttaatttata

SEQ ID NO: 345140 - DNA, 15 bp, Homo sapiens
taatttaatttatag

SEQ ID NO: 345141 - DNA, 15 bp, Homo sapiens
aatttaatttatagt

SEQ ID NO: 345142 - DNA, 15 bp, Homo sapiens
atttaatttatagta

SEQ ID NO: 345143 - DNA, 15 bp, Homo sapiens
tttaatttatagtaa

SEQ ID NO: 345144 - DNA, 15 bp, Homo sapiens
ttaatttatagtaac

SEQ ID NO: 345145 - DNA, 15 bp, Homo sapiens
taatttatagtaact

SEQ ID NO: 345146 - DNA, 15 bp, Homo sapiens
aatttatagtaactg

SEQ ID NO: 345147 - DNA, 15 bp, Homo sapiens
atttatagtaactga

SEQ ID NO: 345148 - DNA, 15 bp, Homo sapiens
tttatagtaactgat

SEQ ID NO: 345149 - DNA, 15 bp, Homo sapiens
ttatagtaactgatt

SEQ ID NO: 345150 - DNA, 15 bp, Homo sapiens
tatagtaactgatta

SEQ ID NO: 345151 - DNA, 15 bp, Homo sapiens
atagtaactgattat

SEQ ID NO: 345152 - DNA, 15 bp, Homo sapiens
tagtaactgattata

SEQ ID NO: 345153 - DNA, 15 bp, Homo sapiens
agtaactgattatac

SEQ ID NO: 345154 - DNA, 15 bp, Homo sapiens
gtaactgattatact

SEQ ID NO: 345155 - DNA, 15 bp, Homo sapiens
taactgattatactt

SEQ ID NO: 345156 - DNA, 15 bp, Homo sapiens
aactgattatactta

SEQ ID NO: 345157 - DNA, 15 bp, Homo sapiens
actgattatacttag

SEQ ID NO: 345158 - DNA, 15 bp, Homo sapiens
ctgattatacttagc

SEQ ID NO: 345159 - DNA, 15 bp, Homo sapiens
tgattatacttagcc

SEQ ID NO: 345160 - DNA, 15 bp, Homo sapiens
gattatacttagcca

SEQ ID NO: 345161 - DNA, 15 bp, Homo sapiens
attatacttagccaa

SEQ ID NO: 345162 - DNA, 15 bp, Homo sapiens
ttatacttagccaat

SEQ ID NO: 345163 - DNA, 15 bp, Homo sapiens
tatacttagccaata

SEQ ID NO: 345164 - DNA, 15 bp, Homo sapiens
atacttagccaataa

SEQ ID NO: 345165 - DNA, 15 bp, Homo sapiens
tacttagccaataaa

SEQ ID NO: 345166 - DNA, 15 bp, Homo sapiens
acttagccaataaat

SEQ ID NO: 345167 - DNA, 15 bp, Homo sapiens
cttagccaataaata

SEQ ID NO: 345168 - DNA, 15 bp, Homo sapiens
ttagccaataaataa

SEQ ID NO: 345169 - DNA, 15 bp, Homo sapiens
tagccaataaataat

SEQ ID NO: 345170 - DNA, 15 bp, Homo sapiens
agccaataaataatc

SEQ ID NO: 345171 - DNA, 15 bp, Homo sapiens
gccaataaataatct

SEQ ID NO: 345172 - DNA, 15 bp, Homo sapiens
ccaataaataatctt

SEQ ID NO: 345173 - DNA, 15 bp, Homo sapiens
caataaataatctta

SEQ ID NO: 345174 - DNA, 15 bp, Homo sapiens
aataaataatcttaa

SEQ ID NO: 345175 - DNA, 15 bp, Homo sapiens
ataaataatcttaac

SEQ ID NO: 345176 - DNA, 15 bp, Homo sapiens
taaataatcttaaca

SEQ ID NO: 345177 - DNA, 15 bp, Homo sapiens
aaataatcttaacat

SEQ ID NO: 345178 - DNA, 15 bp, Homo sapiens
aataatcttaacatc

SEQ ID NO: 345179 - DNA, 15 bp, Homo sapiens
ataatcttaacatct

SEQ ID NO: 345180 - DNA, 15 bp, Homo sapiens
taatcttaacatctt

SEQ ID NO: 345181 - DNA, 15 bp, Homo sapiens
aatcttaacatctta

SEQ ID NO: 345182 - DNA, 15 bp, Homo sapiens
atcttaacatcttaa

SEQ ID NO: 345183 - DNA, 15 bp, Homo sapiens
tcttaacatcttaaa

SEQ ID NO: 345184 - DNA, 15 bp, Homo sapiens
cttaacatcttaaat

SEQ ID NO: 345185 - DNA, 15 bp, Homo sapiens
ttaacatcttaaatc

SEQ ID NO: 345186 - DNA, 15 bp, Homo sapiens
taacatcttaaatct

SEQ ID NO: 345187 - DNA, 15 bp, Homo sapiens
aacatcttaaatctt

SEQ ID NO: 345188 - DNA, 15 bp, Homo sapiens
acatcttaaatctta

SEQ ID NO: 345189 - DNA, 15 bp, Homo sapiens
catcttaaatcttaa

SEQ ID NO: 345190 - DNA, 15 bp, Homo sapiens
atcttaaatcttaag

SEQ ID NO: 345191 - DNA, 15 bp, Homo sapiens
tcttaaatcttaagt

SEQ ID NO: 345192 - DNA, 15 bp, Homo sapiens
cttaaatcttaagta

SEQ ID NO: 345193 - DNA, 15 bp, Homo sapiens
ttaaatcttaagtaa

SEQ ID NO: 345194 - DNA, 15 bp, Homo sapiens
taaatcttaagtaat

SEQ ID NO: 345195 - DNA, 15 bp, Homo sapiens
aaatcttaagtaatc

SEQ ID NO: 345196 - DNA, 15 bp, Homo sapiens
aatcttaagtaatct

SEQ ID NO: 345197 - DNA, 15 bp, Homo sapiens
atcttaagtaatctt

SEQ ID NO: 345198 - DNA, 15 bp, Homo sapiens
tcttaagtaatctta

SEQ ID NO: 345199 - DNA, 15 bp, Homo sapiens
cttaagtaatcttat

SEQ ID NO: 345200 - DNA, 15 bp, Homo sapiens
ttaagtaatcttatt

SEQ ID NO: 345201 - DNA, 15 bp, Homo sapiens
taagtaatcttatta

SEQ ID NO: 345202 - DNA, 15 bp, Homo sapiens
aagtaatcttattaa

SEQ ID NO: 345203 - DNA, 15 bp, Homo sapiens
agtaatcttattaat

SEQ ID NO: 345204 - DNA, 15 bp, Homo sapiens
gtaatcttattaatc

SEQ ID NO: 345205 - DNA, 15 bp, Homo sapiens
taatcttattaatct

SEQ ID NO: 345206 - DNA, 15 bp, Homo sapiens
aatcttattaatctt

SEQ ID NO: 345207 - DNA, 15 bp, Homo sapiens
atcttattaatctta

SEQ ID NO: 345208 - DNA, 15 bp, Homo sapiens
tcttattaatcttaa

SEQ ID NO: 345209 - DNA, 15 bp, Homo sapiens
cttattaatcttaaa

SEQ ID NO: 345210 - DNA, 15 bp, Homo sapiens
ttattaatcttaaaa

SEQ ID NO: 345211 - DNA, 15 bp, Homo sapiens
tattaatcttaaaaa

SEQ ID NO: 345212 - DNA, 15 bp, Homo sapiens
attaatcttaaaaat

SEQ ID NO: 345213 - DNA, 15 bp, Homo sapiens
ttaatcttaaaaata

SEQ ID NO: 345214 - DNA, 15 bp, Homo sapiens
taatcttaaaaatat

SEQ ID NO: 345215 - DNA, 15 bp, Homo sapiens
aatcttaaaaatatt

SEQ ID NO: 345216 - DNA, 15 bp, Homo sapiens
atcttaaaaatattt

SEQ ID NO: 345217 - DNA, 15 bp, Homo sapiens
tcttaaaaatatttt

SEQ ID NO: 345218 - DNA, 15 bp, Homo sapiens
cttaaaaatatttta

SEQ ID NO: 345219 - DNA, 15 bp, Homo sapiens
ttaaaaatattttaa

SEQ ID NO: 345220 - DNA, 15 bp, Homo sapiens
taaaaatattttaat

SEQ ID NO: 345221 - DNA, 15 bp, Homo sapiens
aaaaatattttaatg

SEQ ID NO: 345222 - DNA, 15 bp, Homo sapiens
aaaatattttaatga

SEQ ID NO: 345223 - DNA, 15 bp, Homo sapiens
aaatattttaatgaa

SEQ ID NO: 345224 - DNA, 15 bp, Homo sapiens
aatattttaatgaat

SEQ ID NO: 345225 - DNA, 15 bp, Homo sapiens
atattttaatgaatt

SEQ ID NO: 345226 - DNA, 15 bp, Homo sapiens
tattttaatgaatta

SEQ ID NO: 345227 - DNA, 15 bp, Homo sapiens
attttaatgaattag

SEQ ID NO: 345228 - DNA, 15 bp, Homo sapiens
ttttaatgaattagt

SEQ ID NO: 345229 - DNA, 15 bp, Homo sapiens
tttaatgaattagtc

SEQ ID NO: 345230 - DNA, 15 bp, Homo sapiens
ttaatgaattagtca

SEQ ID NO: 345231 - DNA, 15 bp, Homo sapiens
taatgaattagtcaa

SEQ ID NO: 345232 - DNA, 15 bp, Homo sapiens
aatgaattagtcaaa

SEQ ID NO: 345233 - DNA, 15 bp, Homo sapiens
atgaattagtcaaac

SEQ ID NO: 345234 - DNA, 15 bp, Homo sapiens
tgaattagtcaaaca

SEQ ID NO: 345235 - DNA, 15 bp, Homo sapiens
gaattagtcaaacat

SEQ ID NO: 345236 - DNA, 15 bp, Homo sapiens
aattagtcaaacata

SEQ ID NO: 345237 - DNA, 15 bp, Homo sapiens
attagtcaaacataa

SEQ ID NO: 345238 - DNA, 15 bp, Homo sapiens
ttagtcaaacataaa

SEQ ID NO: 345239 - DNA, 15 bp, Homo sapiens
tagtcaaacataaaa

SEQ ID NO: 345240 - DNA, 15 bp, Homo sapiens
agtcaaacataaaac

SEQ ID NO: 345241 - DNA, 15 bp, Homo sapiens
gtcaaacataaaaca

SEQ ID NO: 345242 - DNA, 15 bp, Homo sapiens
tcaaacataaaacat

SEQ ID NO: 345243 - DNA, 15 bp, Homo sapiens
caaacataaaacatt

SEQ ID NO: 345244 - DNA, 15 bp, Homo sapiens
aaacataaaacattg

SEQ ID NO: 345245 - DNA, 15 bp, Homo sapiens
aacataaaacattgg

SEQ ID NO: 345246 - DNA, 15 bp, Homo sapiens
acataaaacattggt

SEQ ID NO: 345247 - DNA, 15 bp, Homo sapiens
cataaaacattggtt

SEQ ID NO: 345248 - DNA, 15 bp, Homo sapiens
ataaaacattggttt

SEQ ID NO: 345249 - DNA, 15 bp, Homo sapiens
taaaacattggtttg

SEQ ID NO: 345250 - DNA, 15 bp, Homo sapiens
aaaacattggtttgt

SEQ ID NO: 345251 - DNA, 15 bp, Homo sapiens
aaacattggtttgta

SEQ ID NO: 345252 - DNA, 15 bp, Homo sapiens
aacattggtttgtag

SEQ ID NO: 345253 - DNA, 15 bp, Homo sapiens
acattggtttgtaga

SEQ ID NO: 345254 - DNA, 15 bp, Homo sapiens
cattggtttgtagac

SEQ ID NO: 345255 - DNA, 15 bp, Homo sapiens
attggtttgtagaca

SEQ ID NO: 345256 - DNA, 15 bp, Homo sapiens
ttggtttgtagacag

SEQ ID NO: 345257 - DNA, 15 bp, Homo sapiens
tggtttgtagacaga

SEQ ID NO: 345258 - DNA, 15 bp, Homo sapiens
ggtttgtagacagat

SEQ ID NO: 345259 - DNA, 15 bp, Homo sapiens
gtttgtagacagata

SEQ ID NO: 345260 - DNA, 15 bp, Homo sapiens
tttgtagacagatat

SEQ ID NO: 345261 - DNA, 15 bp, Homo sapiens
ttgtagacagatatt

SEQ ID NO: 345262 - DNA, 15 bp, Homo sapiens
tgtagacagatattc

SEQ ID NO: 345263 - DNA, 15 bp, Homo sapiens
gtagacagatattct

SEQ ID NO: 345264 - DNA, 15 bp, Homo sapiens
tagacagatattctt

SEQ ID NO: 345265 - DNA, 15 bp, Homo sapiens
agacagatattctta

SEQ ID NO: 345266 - DNA, 15 bp, Homo sapiens
gacagatattcttag

SEQ ID NO: 345267 - DNA, 15 bp, Homo sapiens
acagatattcttagc

SEQ ID NO: 345268 - DNA, 15 bp, Homo sapiens
cagatattcttagca

SEQ ID NO: 345269 - DNA, 15 bp, Homo sapiens
agatattcttagcag

SEQ ID NO: 345270 - DNA, 15 bp, Homo sapiens
gatattcttagcagc

SEQ ID NO: 345271 - DNA, 15 bp, Homo sapiens
atattcttagcagca

SEQ ID NO: 345272 - DNA, 15 bp, Homo sapiens
tattcttagcagcat

SEQ ID NO: 345273 - DNA, 15 bp, Homo sapiens
attcttagcagcatt

SEQ ID NO: 345274 - DNA, 15 bp, Homo sapiens
ttcttagcagcatta

SEQ ID NO: 345275 - DNA, 15 bp, Homo sapiens
tcttagcagcattat

SEQ ID NO: 345276 - DNA, 15 bp, Homo sapiens
cttagcagcattatt

SEQ ID NO: 345277 - DNA, 15 bp, Homo sapiens
ttagcagcattattt

SEQ ID NO: 345278 - DNA, 15 bp, Homo sapiens
tagcagcattattta

SEQ ID NO: 345279 - DNA, 15 bp, Homo sapiens
agcagcattatttat

SEQ ID NO: 345280 - DNA, 15 bp, Homo sapiens
gcagcattatttata

SEQ ID NO: 345281 - DNA, 15 bp, Homo sapiens
cagcattatttataa

SEQ ID NO: 345282 - DNA, 15 bp, Homo sapiens
agcattatttataat

SEQ ID NO: 345283 - DNA, 15 bp, Homo sapiens
gcattatttataata

SEQ ID NO: 345284 - DNA, 15 bp, Homo sapiens
cattatttataatag

SEQ ID NO: 345285 - DNA, 15 bp, Homo sapiens
attatttataatagc

SEQ ID NO: 345286 - DNA, 15 bp, Homo sapiens
ttatttataatagcc

SEQ ID NO: 345287 - DNA, 15 bp, Homo sapiens
tatttataatagcca

SEQ ID NO: 345288 - DNA, 15 bp, Homo sapiens
atttataatagccaa

SEQ ID NO: 345289 - DNA, 15 bp, Homo sapiens
tttataatagccaaa

SEQ ID NO: 345290 - DNA, 15 bp, Homo sapiens
ttataatagccaaaa

SEQ ID NO: 345291 - DNA, 15 bp, Homo sapiens
tataatagccaaaaa

SEQ ID NO: 345292 - DNA, 15 bp, Homo sapiens
tagccaaaaagtgga

SEQ ID NO: 345293 - DNA, 15 bp, Homo sapiens
agccaaaaagtggaa

SEQ ID NO: 345294 - DNA, 15 bp, Homo sapiens
gccaaaaagtggaac

SEQ ID NO: 345295 - DNA, 15 bp, Homo sapiens
ccaaaaagtggaaca

SEQ ID NO: 345296 - DNA, 15 bp, Homo sapiens
caaaaagtggaacaa

SEQ ID NO: 345297 - DNA, 15 bp, Homo sapiens
aaaaagtggaacaac

SEQ ID NO: 345298 - DNA, 15 bp, Homo sapiens
aaaagtggaacaact

SEQ ID NO: 345299 - DNA, 15 bp, Homo sapiens
aaagtggaacaactc

SEQ ID NO: 345300 - DNA, 15 bp, Homo sapiens
aagtggaacaactca

SEQ ID NO: 345301 - DNA, 15 bp, Homo sapiens
agtggaacaactcaa

SEQ ID NO: 345302 - DNA, 15 bp, Homo sapiens
gtggaacaactcaaa

SEQ ID NO: 345303 - DNA, 15 bp, Homo sapiens
tggaacaactcaaat

SEQ ID NO: 345304 - DNA, 15 bp, Homo sapiens
ggaacaactcaaata

SEQ ID NO: 345305 - DNA, 15 bp, Homo sapiens
gaacaactcaaatat

SEQ ID NO: 345306 - DNA, 15 bp, Homo sapiens
aacaactcaaatatc

SEQ ID NO: 345307 - DNA, 15 bp, Homo sapiens
acaactcaaatatcc

SEQ ID NO: 345308 - DNA, 15 bp, Homo sapiens
caactcaaatatcca

SEQ ID NO: 345309 - DNA, 15 bp, Homo sapiens
aactcaaatatccat

SEQ ID NO: 345310 - DNA, 15 bp, Homo sapiens
actcaaatatccata

SEQ ID NO: 345311 - DNA, 15 bp, Homo sapiens
ctcaaatatccatac

SEQ ID NO: 345312 - DNA, 15 bp, Homo sapiens
tcaaatatccataca

SEQ ID NO: 345313 - DNA, 15 bp, Homo sapiens
caaatatccatacac

SEQ ID NO: 345314 - DNA, 15 bp, Homo sapiens
aaatatccatacaca

SEQ ID NO: 345315 - DNA, 15 bp, Homo sapiens
aatatccatacacag

SEQ ID NO: 345316 - DNA, 15 bp, Homo sapiens
atatccatacacaga

SEQ ID NO: 345317 - DNA, 15 bp, Homo sapiens
tatccatacacagat

SEQ ID NO: 345318 - DNA, 15 bp, Homo sapiens
atccatacacagatg

SEQ ID NO: 345319 - DNA, 15 bp, Homo sapiens
tccatacacagatga

SEQ ID NO: 345320 - DNA, 15 bp, Homo sapiens
ccatacacagatgaa

SEQ ID NO: 345321 - DNA, 15 bp, Homo sapiens
catacacagatgaat

SEQ ID NO: 345322 - DNA, 15 bp, Homo sapiens
atacacagatgaatg

SEQ ID NO: 345323 - DNA, 15 bp, Homo sapiens
tacacagatgaatgg

SEQ ID NO: 345324 - DNA, 15 bp, Homo sapiens
acacagatgaatgga

SEQ ID NO: 345325 - DNA, 15 bp, Homo sapiens
cacagatgaatggat

SEQ ID NO: 345326 - DNA, 15 bp, Homo sapiens
acagatgaatggata

SEQ ID NO: 345327 - DNA, 15 bp, Homo sapiens
cagatgaatggataa

SEQ ID NO: 345328 - DNA, 15 bp, Homo sapiens
agatgaatggataaa

SEQ ID NO: 345329 - DNA, 15 bp, Homo sapiens
gatgaatggataaac

SEQ ID NO: 345330 - DNA, 15 bp, Homo sapiens
atgaatggataaaca

SEQ ID NO: 345331 - DNA, 15 bp, Homo sapiens
ataaacaaaatgtgg

SEQ ID NO: 345332 - DNA, 15 bp, Homo sapiens
taaacaaaatgtggt

SEQ ID NO: 345333 - DNA, 15 bp, Homo sapiens
aaacaaaatgtggtg

SEQ ID NO: 345334 - DNA, 15 bp, Homo sapiens
aacaaaatgtggtgt

SEQ ID NO: 345335 - DNA, 15 bp, Homo sapiens
acaaaatgtggtgta

SEQ ID NO: 345336 - DNA, 15 bp, Homo sapiens
caaaatgtggtgtat

SEQ ID NO: 345337 - DNA, 15 bp, Homo sapiens
aaaatgtggtgtatg

SEQ ID NO: 345338 - DNA, 15 bp, Homo sapiens
aaatgtggtgtatgc

SEQ ID NO: 345339 - DNA, 15 bp, Homo sapiens
aatgtggtgtatgca

SEQ ID NO: 345340 - DNA, 15 bp, Homo sapiens
atgtggtgtatgcat

SEQ ID NO: 345341 - DNA, 15 bp, Homo sapiens
tgtggtgtatgcata

SEQ ID NO: 345342 - DNA, 15 bp, Homo sapiens
gtggtgtatgcatac

SEQ ID NO: 345343 - DNA, 15 bp, Homo sapiens
tggtgtatgcataca

SEQ ID NO: 345344 - DNA, 15 bp, Homo sapiens
ggtgtatgcatacaa

SEQ ID NO: 345345 - DNA, 15 bp, Homo sapiens
gtgtatgcatacaat

SEQ ID NO: 345346 - DNA, 15 bp, Homo sapiens
tgtatgcatacaata

SEQ ID NO: 345347 - DNA, 15 bp, Homo sapiens
gtatgcatacaatat

SEQ ID NO: 345348 - DNA, 15 bp, Homo sapiens
tatgcatacaatatt

SEQ ID NO: 345349 - DNA, 15 bp, Homo sapiens
atgcatacaatatta

SEQ ID NO: 345350 - DNA, 15 bp, Homo sapiens
tgcatacaatattat

SEQ ID NO: 345351 - DNA, 15 bp, Homo sapiens
gcatacaatattatc

SEQ ID NO: 345352 - DNA, 15 bp, Homo sapiens
catacaatattatct

SEQ ID NO: 345353 - DNA, 15 bp, Homo sapiens
atacaatattatctg

SEQ ID NO: 345354 - DNA, 15 bp, Homo sapiens
tacaatattatctga

SEQ ID NO: 345355 - DNA, 15 bp, Homo sapiens
acaatattatctgat

SEQ ID NO: 345356 - DNA, 15 bp, Homo sapiens
caatattatctgata

SEQ ID NO: 345357 - DNA, 15 bp, Homo sapiens
aatattatctgataa

SEQ ID NO: 345358 - DNA, 15 bp, Homo sapiens
atattatctgataat

SEQ ID NO: 345359 - DNA, 15 bp, Homo sapiens
tattatctgataata

SEQ ID NO: 345360 - DNA, 15 bp, Homo sapiens
attatctgataatac

SEQ ID NO: 345361 - DNA, 15 bp, Homo sapiens
ttatctgataataca

SEQ ID NO: 345362 - DNA, 15 bp, Homo sapiens
tatctgataatacaa

SEQ ID NO: 345363 - DNA, 15 bp, Homo sapiens
atctgataatacaaa

SEQ ID NO: 345364 - DNA, 15 bp, Homo sapiens
tctgataatacaaaa

SEQ ID NO: 345365 - DNA, 15 bp, Homo sapiens
ctgataatacaaaag

SEQ ID NO: 345366 - DNA, 15 bp, Homo sapiens
tgataatacaaaaga

SEQ ID NO: 345367 - DNA, 15 bp, Homo sapiens
gataatacaaaagaa

SEQ ID NO: 345368 - DNA, 15 bp, Homo sapiens
ataatacaaaagaac

SEQ ID NO: 345369 - DNA, 15 bp, Homo sapiens
taatacaaaagaacg

SEQ ID NO: 345370 - DNA, 15 bp, Homo sapiens
aatacaaaagaacga

SEQ ID NO: 345371 - DNA, 15 bp, Homo sapiens
atacaaaagaacgaa

SEQ ID NO: 345372 - DNA, 15 bp, Homo sapiens
tacaaaagaacgaag

SEQ ID NO: 345373 - DNA, 15 bp, Homo sapiens
acaaaagaacgaagt

SEQ ID NO: 345374 - DNA, 15 bp, Homo sapiens
caaaagaacgaagta

SEQ ID NO: 345375 - DNA, 15 bp, Homo sapiens
aaaagaacgaagtat

SEQ ID NO: 345376 - DNA, 15 bp, Homo sapiens
aaagaacgaagtatt

SEQ ID NO: 345377 - DNA, 15 bp, Homo sapiens
aagaacgaagtattg

SEQ ID NO: 345378 - DNA, 15 bp, Homo sapiens
agaacgaagtattga

SEQ ID NO: 345379 - DNA, 15 bp, Homo sapiens
gaacgaagtattgac

SEQ ID NO: 345380 - DNA, 15 bp, Homo sapiens
aacgaagtattgaca

SEQ ID NO: 345381 - DNA, 15 bp, Homo sapiens
acgaagtattgacac

SEQ ID NO: 345382 - DNA, 15 bp, Homo sapiens
cgaagtattgacaca

SEQ ID NO: 345383 - DNA, 15 bp, Homo sapiens
gaagtattgacacat

SEQ ID NO: 345384 - DNA, 15 bp, Homo sapiens
aagtattgacacatg

SEQ ID NO: 345385 - DNA, 15 bp, Homo sapiens
agtattgacacatgc

SEQ ID NO: 345386 - DNA, 15 bp, Homo sapiens
gtattgacacatgct

SEQ ID NO: 345387 - DNA, 15 bp, Homo sapiens
tattgacacatgcta

SEQ ID NO: 345388 - DNA, 15 bp, Homo sapiens
attgacacatgctac

SEQ ID NO: 345389 - DNA, 15 bp, Homo sapiens
ttgacacatgctaca

SEQ ID NO: 345390 - DNA, 15 bp, Homo sapiens
tgacacatgctacaa

SEQ ID NO: 345391 - DNA, 15 bp, Homo sapiens
acatgctacaacata

SEQ ID NO: 345392 - DNA, 15 bp, Homo sapiens
catgctacaacatag

SEQ ID NO: 345393 - DNA, 15 bp, Homo sapiens
atgctacaacataga

SEQ ID NO: 345394 - DNA, 15 bp, Homo sapiens
tgctacaacatagat

SEQ ID NO: 345395 - DNA, 15 bp, Homo sapiens
gctacaacatagatg

SEQ ID NO: 345396 - DNA, 15 bp, Homo sapiens
ctacaacatagatga

SEQ ID NO: 345397 - DNA, 15 bp, Homo sapiens
tacaacatagatgaa

SEQ ID NO: 345398 - DNA, 15 bp, Homo sapiens
acaacatagatgaac

SEQ ID NO: 345399 - DNA, 15 bp, Homo sapiens
caacatagatgaacc

SEQ ID NO: 345400 - DNA, 15 bp, Homo sapiens
aacatagatgaacct

SEQ ID NO: 345401 - DNA, 15 bp, Homo sapiens
acatagatgaacctt

SEQ ID NO: 345402 - DNA, 15 bp, Homo sapiens
catagatgaaccttg

SEQ ID NO: 345403 - DNA, 15 bp, Homo sapiens
atagatgaaccttga

SEQ ID NO: 345404 - DNA, 15 bp, Homo sapiens
tagatgaaccttgaa

SEQ ID NO: 345405 - DNA, 15 bp, Homo sapiens
agatgaaccttgaaa

SEQ ID NO: 345406 - DNA, 15 bp, Homo sapiens
gatgaaccttgaaaa

SEQ ID NO: 345407 - DNA, 15 bp, Homo sapiens
atgaaccttgaaaac

SEQ ID NO: 345408 - DNA, 15 bp, Homo sapiens
tgaaccttgaaaaca

SEQ ID NO: 345409 - DNA, 15 bp, Homo sapiens
gaaccttgaaaacac

SEQ ID NO: 345410 - DNA, 15 bp, Homo sapiens
aaccttgaaaacact

SEQ ID NO: 345411 - DNA, 15 bp, Homo sapiens
accttgaaaacacta

SEQ ID NO: 345412 - DNA, 15 bp, Homo sapiens
ccttgaaaacactat

SEQ ID NO: 345413 - DNA, 15 bp, Homo sapiens
cttgaaaacactatg

SEQ ID NO: 345414 - DNA, 15 bp, Homo sapiens
ttgaaaacactatgc

SEQ ID NO: 345415 - DNA, 15 bp, Homo sapiens
tgaaaacactatgct

SEQ ID NO: 345416 - DNA, 15 bp, Homo sapiens
gaaaacactatgcta

SEQ ID NO: 345417 - DNA, 15 bp, Homo sapiens
aaaacactatgctaa

SEQ ID NO: 345418 - DNA, 15 bp, Homo sapiens
aaacactatgctaag

SEQ ID NO: 345419 - DNA, 15 bp, Homo sapiens
aacactatgctaagt

SEQ ID NO: 345420 - DNA, 15 bp, Homo sapiens
acactatgctaagta

SEQ ID NO: 345421 - DNA, 15 bp, Homo sapiens
cactatgctaagtat

SEQ ID NO: 345422 - DNA, 15 bp, Homo sapiens
actatgctaagtata

SEQ ID NO: 345423 - DNA, 15 bp, Homo sapiens
ctatgctaagtataa

SEQ ID NO: 345424 - DNA, 15 bp, Homo sapiens
tatgctaagtataag

SEQ ID NO: 345425 - DNA, 15 bp, Homo sapiens
atgctaagtataaga

SEQ ID NO: 345426 - DNA, 15 bp, Homo sapiens
tgctaagtataagaa

SEQ ID NO: 345427 - DNA, 15 bp, Homo sapiens
gctaagtataagaag

SEQ ID NO: 345428 - DNA, 15 bp, Homo sapiens
ctaagtataagaagc

SEQ ID NO: 345429 - DNA, 15 bp, Homo sapiens
taagtataagaagcc

SEQ ID NO: 345430 - DNA, 15 bp, Homo sapiens
aagtataagaagcca

SEQ ID NO: 345431 - DNA, 15 bp, Homo sapiens
agtataagaagccaa

SEQ ID NO: 345432 - DNA, 15 bp, Homo sapiens
gtataagaagccaat

SEQ ID NO: 345433 - DNA, 15 bp, Homo sapiens
tataagaagccaatc

SEQ ID NO: 345434 - DNA, 15 bp, Homo sapiens
ataagaagccaatcg

SEQ ID NO: 345435 - DNA, 15 bp, Homo sapiens
taagaagccaatcgc

SEQ ID NO: 345436 - DNA, 15 bp, Homo sapiens
aagaagccaatcgca

SEQ ID NO: 345437 - DNA, 15 bp, Homo sapiens
agaagccaatcgcaa

SEQ ID NO: 345438 - DNA, 15 bp, Homo sapiens
gaagccaatcgcaag

SEQ ID NO: 345439 - DNA, 15 bp, Homo sapiens
aagccaatcgcaaga

SEQ ID NO: 345440 - DNA, 15 bp, Homo sapiens
agccaatcgcaagat

SEQ ID NO: 345441 - DNA, 15 bp, Homo sapiens
gccaatcgcaagatt

SEQ ID NO: 345442 - DNA, 15 bp, Homo sapiens
ccaatcgcaagatta

SEQ ID NO: 345443 - DNA, 15 bp, Homo sapiens
caatcgcaagattat

SEQ ID NO: 345444 - DNA, 15 bp, Homo sapiens
aatcgcaagattata

SEQ ID NO: 345445 - DNA, 15 bp, Homo sapiens
atcgcaagattatat

SEQ ID NO: 345446 - DNA, 15 bp, Homo sapiens
tcgcaagattatata

SEQ ID NO: 345447 - DNA, 15 bp, Homo sapiens
cgcaagattatatac

SEQ ID NO: 345448 - DNA, 15 bp, Homo sapiens
gcaagattatatacg

SEQ ID NO: 345449 - DNA, 15 bp, Homo sapiens
caagattatatacgc

SEQ ID NO: 345450 - DNA, 15 bp, Homo sapiens
aagattatatacgct

SEQ ID NO: 345451 - DNA, 15 bp, Homo sapiens
agattatatacgcta

SEQ ID NO: 345452 - DNA, 15 bp, Homo sapiens
gattatatacgctat

SEQ ID NO: 345453 - DNA, 15 bp, Homo sapiens
attatatacgctatg

SEQ ID NO: 345454 - DNA, 15 bp, Homo sapiens
ttatatacgctatga

SEQ ID NO: 345455 - DNA, 15 bp, Homo sapiens
tatatacgctatgat

SEQ ID NO: 345456 - DNA, 15 bp, Homo sapiens
atatacgctatgatt

SEQ ID NO: 345457 - DNA, 15 bp, Homo sapiens
tatacgctatgattc

SEQ ID NO: 345458 - DNA, 15 bp, Homo sapiens
atacgctatgattcc

SEQ ID NO: 345459 - DNA, 15 bp, Homo sapiens
tacgctatgattcca

SEQ ID NO: 345460 - DNA, 15 bp, Homo sapiens
acgctatgattccat

SEQ ID NO: 345461 - DNA, 15 bp, Homo sapiens
cgctatgattccatt

SEQ ID NO: 345462 - DNA, 15 bp, Homo sapiens
gctatgattccattc

SEQ ID NO: 345463 - DNA, 15 bp, Homo sapiens
ctatgattccattca

SEQ ID NO: 345464 - DNA, 15 bp, Homo sapiens
tatgattccattcat

SEQ ID NO: 345465 - DNA, 15 bp, Homo sapiens
atgattccattcata

SEQ ID NO: 345466 - DNA, 15 bp, Homo sapiens
tgattccattcatag

SEQ ID NO: 345467 - DNA, 15 bp, Homo sapiens
gattccattcatagg

SEQ ID NO: 345468 - DNA, 15 bp, Homo sapiens
attccattcatagga

SEQ ID NO: 345469 - DNA, 15 bp, Homo sapiens
ttccattcataggaa

SEQ ID NO: 345470 - DNA, 15 bp, Homo sapiens
tccattcataggaaa

SEQ ID NO: 345471 - DNA, 15 bp, Homo sapiens
ccattcataggaaat

SEQ ID NO: 345472 - DNA, 15 bp, Homo sapiens
cattcataggaaatg

SEQ ID NO: 345473 - DNA, 15 bp, Homo sapiens
attcataggaaatgt

SEQ ID NO: 345474 - DNA, 15 bp, Homo sapiens
ttcataggaaatgtc

SEQ ID NO: 345475 - DNA, 15 bp, Homo sapiens
tcataggaaatgtcc

SEQ ID NO: 345476 - DNA, 15 bp, Homo sapiens
cataggaaatgtcca

SEQ ID NO: 345477 - DNA, 15 bp, Homo sapiens
ataggaaatgtccac

SEQ ID NO: 345478 - DNA, 15 bp, Homo sapiens
taggaaatgtccaca

SEQ ID NO: 345479 - DNA, 15 bp, Homo sapiens
aggaaatgtccacaa

SEQ ID NO: 345480 - DNA, 15 bp, Homo sapiens
ggaaatgtccacaag

SEQ ID NO: 345481 - DNA, 15 bp, Homo sapiens
gaaatgtccacaagg

SEQ ID NO: 345482 - DNA, 15 bp, Homo sapiens
aaatgtccacaaggg

SEQ ID NO: 345483 - DNA, 15 bp, Homo sapiens
aatgtccacaagggg

SEQ ID NO: 345484 - DNA, 15 bp, Homo sapiens
atgtccacaagggga

SEQ ID NO: 345485 - DNA, 15 bp, Homo sapiens
tgtccacaaggggaa

SEQ ID NO: 345486 - DNA, 15 bp, Homo sapiens
gtccacaaggggaaa

SEQ ID NO: 345487 - DNA, 15 bp, Homo sapiens
tccacaaggggaaaa

SEQ ID NO: 345488 - DNA, 15 bp, Homo sapiens
ccacaaggggaaaat

SEQ ID NO: 345489 - DNA, 15 bp, Homo sapiens
cacaaggggaaaatc

SEQ ID NO: 345490 - DNA, 15 bp, Homo sapiens
acaaggggaaaatcc

SEQ ID NO: 345491 - DNA, 15 bp, Homo sapiens
caaggggaaaatcca

SEQ ID NO: 345492 - DNA, 15 bp, Homo sapiens
aaggggaaaatccac

SEQ ID NO: 345493 - DNA, 15 bp, Homo sapiens
aggggaaaatccaca

SEQ ID NO: 345494 - DNA, 15 bp, Homo sapiens
ggggaaaatccacag

SEQ ID NO: 345495 - DNA, 15 bp, Homo sapiens
gggaaaatccacaga

SEQ ID NO: 345496 - DNA, 15 bp, Homo sapiens
ggaaaatccacagag

SEQ ID NO: 345497 - DNA, 15 bp, Homo sapiens
gaaaatccacagaga

SEQ ID NO: 345498 - DNA, 15 bp, Homo sapiens
aaaatccacagagat

SEQ ID NO: 345499 - DNA, 15 bp, Homo sapiens
aaatccacagagata

SEQ ID NO: 345500 - DNA, 15 bp, Homo sapiens
aatccacagagatag

SEQ ID NO: 345501 - DNA, 15 bp, Homo sapiens
atccacagagataga

SEQ ID NO: 345502 - DNA, 15 bp, Homo sapiens
tccacagagatagaa

SEQ ID NO: 345503 - DNA, 15 bp, Homo sapiens
ccacagagatagaaa

SEQ ID NO: 345504 - DNA, 15 bp, Homo sapiens
cacagagatagaaag

SEQ ID NO: 345505 - DNA, 15 bp, Homo sapiens
acagagatagaaagt

SEQ ID NO: 345506 - DNA, 15 bp, Homo sapiens
cagagatagaaagta

SEQ ID NO: 345507 - DNA, 15 bp, Homo sapiens
agagatagaaagtaa

SEQ ID NO: 345508 - DNA, 15 bp, Homo sapiens
gagatagaaagtaaa

SEQ ID NO: 345509 - DNA, 15 bp, Homo sapiens
agatagaaagtaaat

SEQ ID NO: 345510 - DNA, 15 bp, Homo sapiens
gatagaaagtaaatg

SEQ ID NO: 345511 - DNA, 15 bp, Homo sapiens
atagaaagtaaatgc

SEQ ID NO: 345512 - DNA, 15 bp, Homo sapiens
tagaaagtaaatgca

SEQ ID NO: 345513 - DNA, 15 bp, Homo sapiens
agaaagtaaatgcat

SEQ ID NO: 345514 - DNA, 15 bp, Homo sapiens
gaaagtaaatgcatg

SEQ ID NO: 345515 - DNA, 15 bp, Homo sapiens
aaagtaaatgcatgg

SEQ ID NO: 345516 - DNA, 15 bp, Homo sapiens
aagtaaatgcatggt

SEQ ID NO: 345517 - DNA, 15 bp, Homo sapiens
agtaaatgcatggtt

SEQ ID NO: 345518 - DNA, 15 bp, Homo sapiens
gtaaatgcatggttg

SEQ ID NO: 345519 - DNA, 15 bp, Homo sapiens
taaatgcatggttgc

SEQ ID NO: 345520 - DNA, 15 bp, Homo sapiens
aaatgcatggttgcc

SEQ ID NO: 345521 - DNA, 15 bp, Homo sapiens
aatgcatggttgcca

SEQ ID NO: 345522 - DNA, 15 bp, Homo sapiens
atgcatggttgccac

SEQ ID NO: 345523 - DNA, 15 bp, Homo sapiens
tgcatggttgccact

SEQ ID NO: 345524 - DNA, 15 bp, Homo sapiens
gcatggttgccactg

SEQ ID NO: 345525 - DNA, 15 bp, Homo sapiens
catggttgccactgg

SEQ ID NO: 345526 - DNA, 15 bp, Homo sapiens
atggttgccactggt

SEQ ID NO: 345527 - DNA, 15 bp, Homo sapiens
tggttgccactggtg

SEQ ID NO: 345528 - DNA, 15 bp, Homo sapiens
ggttgccactggtgg

SEQ ID NO: 345529 - DNA, 15 bp, Homo sapiens
gttgccactggtggg

SEQ ID NO: 345530 - DNA, 15 bp, Homo sapiens
ttgccactggtggga

SEQ ID NO: 345531 - DNA, 15 bp, Homo sapiens
tgccactggtgggag

SEQ ID NO: 345532 - DNA, 15 bp, Homo sapiens
gccactggtgggagt

SEQ ID NO: 345533 - DNA, 15 bp, Homo sapiens
ccactggtgggagtg

SEQ ID NO: 345534 - DNA, 15 bp, Homo sapiens
cactggtgggagtgg

SEQ ID NO: 345535 - DNA, 15 bp, Homo sapiens
actggtgggagtggg

SEQ ID NO: 345536 - DNA, 15 bp, Homo sapiens
ctggtgggagtgggg

SEQ ID NO: 345537 - DNA, 15 bp, Homo sapiens
tggtgggagtgggga

SEQ ID NO: 345538 - DNA, 15 bp, Homo sapiens
ggtgggagtggggaa

SEQ ID NO: 345539 - DNA, 15 bp, Homo sapiens
gtgggagtggggaat

SEQ ID NO: 345540 - DNA, 15 bp, Homo sapiens
tgggagtggggaatg

SEQ ID NO: 345541 - DNA, 15 bp, Homo sapiens
gggagtggggaatgg

SEQ ID NO: 345542 - DNA, 15 bp, Homo sapiens
ggagtggggaatggg

SEQ ID NO: 345543 - DNA, 15 bp, Homo sapiens
gagtggggaatgggg

SEQ ID NO: 345544 - DNA, 15 bp, Homo sapiens
agtggggaatgggga

SEQ ID NO: 345545 - DNA, 15 bp, Homo sapiens
gtggggaatggggag

SEQ ID NO: 345546 - DNA, 15 bp, Homo sapiens
tggggaatggggagt

SEQ ID NO: 345547 - DNA, 15 bp, Homo sapiens
ggggaatggggagtg

SEQ ID NO: 345548 - DNA, 15 bp, Homo sapiens
gggaatggggagtgt

SEQ ID NO: 345549 - DNA, 15 bp, Homo sapiens
ggaatggggagtgtt

SEQ ID NO: 345550 - DNA, 15 bp, Homo sapiens
gaatggggagtgttg

SEQ ID NO: 345551 - DNA, 15 bp, Homo sapiens
aatggggagtgttgg

SEQ ID NO: 345552 - DNA, 15 bp, Homo sapiens
atggggagtgttggt

SEQ ID NO: 345553 - DNA, 15 bp, Homo sapiens
tggggagtgttggtt

SEQ ID NO: 345554 - DNA, 15 bp, Homo sapiens
ggggagtgttggttt

SEQ ID NO: 345555 - DNA, 15 bp, Homo sapiens
gggagtgttggttta

SEQ ID NO: 345556 - DNA, 15 bp, Homo sapiens
ggagtgttggtttat

SEQ ID NO: 345557 - DNA, 15 bp, Homo sapiens
gagtgttggtttatg

SEQ ID NO: 345558 - DNA, 15 bp, Homo sapiens
agtgttggtttatgg

SEQ ID NO: 345559 - DNA, 15 bp, Homo sapiens
gtgttggtttatggc

SEQ ID NO: 345560 - DNA, 15 bp, Homo sapiens
tgttggtttatggct

SEQ ID NO: 345561 - DNA, 15 bp, Homo sapiens
gttggtttatggcta

SEQ ID NO: 345562 - DNA, 15 bp, Homo sapiens
ttggtttatggctat

SEQ ID NO: 345563 - DNA, 15 bp, Homo sapiens
tggtttatggctatg

SEQ ID NO: 345564 - DNA, 15 bp, Homo sapiens
ggtttatggctatgg

SEQ ID NO: 345565 - DNA, 15 bp, Homo sapiens
gtttatggctatggg

SEQ ID NO: 345566 - DNA, 15 bp, Homo sapiens
tttatggctatggga

SEQ ID NO: 345567 - DNA, 15 bp, Homo sapiens
ttatggctatgggat

SEQ ID NO: 345568 - DNA, 15 bp, Homo sapiens
tatggctatgggatt

SEQ ID NO: 345569 - DNA, 15 bp, Homo sapiens
atggctatgggattt

SEQ ID NO: 345570 - DNA, 15 bp, Homo sapiens
tggctatgggatttc

SEQ ID NO: 345571 - DNA, 15 bp, Homo sapiens
ggctatgggatttct

SEQ ID NO: 345572 - DNA, 15 bp, Homo sapiens
gctatgggatttctt

SEQ ID NO: 345573 - DNA, 15 bp, Homo sapiens
ctatgggatttcttt

SEQ ID NO: 345574 - DNA, 15 bp, Homo sapiens
tatgggatttctttt

SEQ ID NO: 345575 - DNA, 15 bp, Homo sapiens
atgggatttcttttt

SEQ ID NO: 345576 - DNA, 15 bp, Homo sapiens
tgggatttctttttg

SEQ ID NO: 345577 - DNA, 15 bp, Homo sapiens
gggatttctttttgg

SEQ ID NO: 345578 - DNA, 15 bp, Homo sapiens
ggatttctttttggg

SEQ ID NO: 345579 - DNA, 15 bp, Homo sapiens
gatttctttttgggg

SEQ ID NO: 345580 - DNA, 15 bp, Homo sapiens
atttctttttggggt

SEQ ID NO: 345581 - DNA, 15 bp, Homo sapiens
tttctttttggggtg

SEQ ID NO: 345582 - DNA, 15 bp, Homo sapiens
ttctttttggggtga

SEQ ID NO: 345583 - DNA, 15 bp, Homo sapiens
tctttttggggtgat

SEQ ID NO: 345584 - DNA, 15 bp, Homo sapiens
ctttttggggtgata

SEQ ID NO: 345585 - DNA, 15 bp, Homo sapiens
tttttggggtgataa

SEQ ID NO: 345586 - DNA, 15 bp, Homo sapiens
ttttggggtgataaa

SEQ ID NO: 345587 - DNA, 15 bp, Homo sapiens
tttggggtgataaaa

SEQ ID NO: 345588 - DNA, 15 bp, Homo sapiens
ttggggtgataaaat

SEQ ID NO: 345589 - DNA, 15 bp, Homo sapiens
tggggtgataaaatg

SEQ ID NO: 345590 - DNA, 15 bp, Homo sapiens
ggggtgataaaatgt

SEQ ID NO: 345591 - DNA, 15 bp, Homo sapiens
gggtgataaaatgtt

SEQ ID NO: 345592 - DNA, 15 bp, Homo sapiens
ggtgataaaatgttc

SEQ ID NO: 345593 - DNA, 15 bp, Homo sapiens
gtgataaaatgttct

SEQ ID NO: 345594 - DNA, 15 bp, Homo sapiens
tgataaaatgttctg

SEQ ID NO: 345595 - DNA, 15 bp, Homo sapiens
gataaaatgttctgg

SEQ ID NO: 345596 - DNA, 15 bp, Homo sapiens
ataaaatgttctgga

SEQ ID NO: 345597 - DNA, 15 bp, Homo sapiens
taaaatgttctggag

SEQ ID NO: 345598 - DNA, 15 bp, Homo sapiens
aaaatgttctggaga

SEQ ID NO: 345599 - DNA, 15 bp, Homo sapiens
aaatgttctggagac

SEQ ID NO: 345600 - DNA, 15 bp, Homo sapiens
aatgttctggagaca

SEQ ID NO: 345601 - DNA, 15 bp, Homo sapiens
atgttctggagacag

SEQ ID NO: 345602 - DNA, 15 bp, Homo sapiens
tgttctggagacaga

SEQ ID NO: 345603 - DNA, 15 bp, Homo sapiens
gttctggagacagac

SEQ ID NO: 345604 - DNA, 15 bp, Homo sapiens
ttctggagacagact

SEQ ID NO: 345605 - DNA, 15 bp, Homo sapiens
tctggagacagactg

SEQ ID NO: 345606 - DNA, 15 bp, Homo sapiens
ctggagacagactgt

SEQ ID NO: 345607 - DNA, 15 bp, Homo sapiens
tggagacagactgtg

SEQ ID NO: 345608 - DNA, 15 bp, Homo sapiens
ggagacagactgtga

SEQ ID NO: 345609 - DNA, 15 bp, Homo sapiens
gagacagactgtgag

SEQ ID NO: 345610 - DNA, 15 bp, Homo sapiens
agacagactgtgagg

SEQ ID NO: 345611 - DNA, 15 bp, Homo sapiens
gacagactgtgagga

SEQ ID NO: 345612 - DNA, 15 bp, Homo sapiens
acagactgtgaggat

SEQ ID NO: 345613 - DNA, 15 bp, Homo sapiens
cagactgtgaggatg

SEQ ID NO: 345614 - DNA, 15 bp, Homo sapiens
agactgtgaggatga

SEQ ID NO: 345615 - DNA, 15 bp, Homo sapiens
gactgtgaggatgat

SEQ ID NO: 345616 - DNA, 15 bp, Homo sapiens
actgtgaggatgatt

SEQ ID NO: 345617 - DNA, 15 bp, Homo sapiens
ctgtgaggatgatta

SEQ ID NO: 345618 - DNA, 15 bp, Homo sapiens
tgtgaggatgattat

SEQ ID NO: 345619 - DNA, 15 bp, Homo sapiens
gtgaggatgattata

SEQ ID NO: 345620 - DNA, 15 bp, Homo sapiens
tgaggatgattatac

SEQ ID NO: 345621 - DNA, 15 bp, Homo sapiens
gaggatgattataca

SEQ ID NO: 345622 - DNA, 15 bp, Homo sapiens
aggatgattatacaa

SEQ ID NO: 345623 - DNA, 15 bp, Homo sapiens
ggatgattatacaac

SEQ ID NO: 345624 - DNA, 15 bp, Homo sapiens
gatgattatacaact

SEQ ID NO: 345625 - DNA, 15 bp, Homo sapiens
atgattatacaactg

SEQ ID NO: 345626 - DNA, 15 bp, Homo sapiens
tgattatacaactgt

SEQ ID NO: 345627 - DNA, 15 bp, Homo sapiens
gattatacaactgta

SEQ ID NO: 345628 - DNA, 15 bp, Homo sapiens
attatacaactgtat

SEQ ID NO: 345629 - DNA, 15 bp, Homo sapiens
ttatacaactgtata

SEQ ID NO: 345630 - DNA, 15 bp, Homo sapiens
tatacaactgtataa

SEQ ID NO: 345631 - DNA, 15 bp, Homo sapiens
atacaactgtataaa

SEQ ID NO: 345632 - DNA, 15 bp, Homo sapiens
tacaactgtataaat

SEQ ID NO: 345633 - DNA, 15 bp, Homo sapiens
acaactgtataaatg

SEQ ID NO: 345634 - DNA, 15 bp, Homo sapiens
caactgtataaatgt

SEQ ID NO: 345635 - DNA, 15 bp, Homo sapiens
aactgtataaatgtg

SEQ ID NO: 345636 - DNA, 15 bp, Homo sapiens
actgtataaatgtgc

SEQ ID NO: 345637 - DNA, 15 bp, Homo sapiens
ctgtataaatgtgct

SEQ ID NO: 345638 - DNA, 15 bp, Homo sapiens
tgtataaatgtgcta

SEQ ID NO: 345639 - DNA, 15 bp, Homo sapiens
gtataaatgtgctaa

SEQ ID NO: 345640 - DNA, 15 bp, Homo sapiens
tataaatgtgctaat

SEQ ID NO: 345641 - DNA, 15 bp, Homo sapiens
ataaatgtgctaata

SEQ ID NO: 345642 - DNA, 15 bp, Homo sapiens
taaatgtgctaataa

SEQ ID NO: 345643 - DNA, 15 bp, Homo sapiens
aaatgtgctaataac

SEQ ID NO: 345644 - DNA, 15 bp, Homo sapiens
aatgtgctaataacc

SEQ ID NO: 345645 - DNA, 15 bp, Homo sapiens
atgtgctaataacca

SEQ ID NO: 345646 - DNA, 15 bp, Homo sapiens
tgtgctaataaccat

SEQ ID NO: 345647 - DNA, 15 bp, Homo sapiens
gtgctaataaccatt

SEQ ID NO: 345648 - DNA, 15 bp, Homo sapiens
tgctaataaccatta

SEQ ID NO: 345649 - DNA, 15 bp, Homo sapiens
gctaataaccattaa

SEQ ID NO: 345650 - DNA, 15 bp, Homo sapiens
ctaataaccattaaa

SEQ ID NO: 345651 - DNA, 15 bp, Homo sapiens
taataaccattaaat

SEQ ID NO: 345652 - DNA, 15 bp, Homo sapiens
aataaccattaaatt

SEQ ID NO: 345653 - DNA, 15 bp, Homo sapiens
ataaccattaaattg

SEQ ID NO: 345654 - DNA, 15 bp, Homo sapiens
taaccattaaattgt

SEQ ID NO: 345655 - DNA, 15 bp, Homo sapiens
aaccattaaattgtg

SEQ ID NO: 345656 - DNA, 15 bp, Homo sapiens
accattaaattgtgt

SEQ ID NO: 345657 - DNA, 15 bp, Homo sapiens
ccattaaattgtgta

SEQ ID NO: 345658 - DNA, 15 bp, Homo sapiens
cattaaattgtgtat

SEQ ID NO: 345659 - DNA, 15 bp, Homo sapiens
attaaattgtgtatt

SEQ ID NO: 345660 - DNA, 15 bp, Homo sapiens
ttaaattgtgtattt

SEQ ID NO: 345661 - DNA, 15 bp, Homo sapiens
taaattgtgtatttc

SEQ ID NO: 345662 - DNA, 15 bp, Homo sapiens
aaattgtgtatttca

SEQ ID NO: 345663 - DNA, 15 bp, Homo sapiens
aattgtgtatttcaa

SEQ ID NO: 345664 - DNA, 15 bp, Homo sapiens
attgtgtatttcaaa

SEQ ID NO: 345665 - DNA, 15 bp, Homo sapiens
ttgtgtatttcaaag

SEQ ID NO: 345666 - DNA, 15 bp, Homo sapiens
tgtgtatttcaaaga

SEQ ID NO: 345667 - DNA, 15 bp, Homo sapiens
gtgtatttcaaagaa

SEQ ID NO: 345668 - DNA, 15 bp, Homo sapiens
tgtatttcaaagaaa

SEQ ID NO: 345669 - DNA, 15 bp, Homo sapiens
gtatttcaaagaaag

SEQ ID NO: 345670 - DNA, 15 bp, Homo sapiens
tatttcaaagaaaga

SEQ ID NO: 345671 - DNA, 15 bp, Homo sapiens
atttcaaagaaagaa

SEQ ID NO: 345672 - DNA, 15 bp, Homo sapiens
tttcaaagaaagaat

SEQ ID NO: 345673 - DNA, 15 bp, Homo sapiens
ttcaaagaaagaatt

SEQ ID NO: 345674 - DNA, 15 bp, Homo sapiens
tcaaagaaagaattt

SEQ ID NO: 345675 - DNA, 15 bp, Homo sapiens
caaagaaagaatttt

SEQ ID NO: 345676 - DNA, 15 bp, Homo sapiens
aaagaaagaatttta

SEQ ID NO: 345677 - DNA, 15 bp, Homo sapiens
aagaaagaattttat

SEQ ID NO: 345678 - DNA, 15 bp, Homo sapiens
agaaagaattttata

SEQ ID NO: 345679 - DNA, 15 bp, Homo sapiens
gaaagaattttatag

SEQ ID NO: 345680 - DNA, 15 bp, Homo sapiens
aaagaattttatagc

SEQ ID NO: 345681 - DNA, 15 bp, Homo sapiens
aagaattttatagca

SEQ ID NO: 345682 - DNA, 15 bp, Homo sapiens
agaattttatagcat

SEQ ID NO: 345683 - DNA, 15 bp, Homo sapiens
gaattttatagcatg

SEQ ID NO: 345684 - DNA, 15 bp, Homo sapiens
aattttatagcatgt

SEQ ID NO: 345685 - DNA, 15 bp, Homo sapiens
attttatagcatgtg

SEQ ID NO: 345686 - DNA, 15 bp, Homo sapiens
ttttatagcatgtga

SEQ ID NO: 345687 - DNA, 15 bp, Homo sapiens
tttatagcatgtgaa

SEQ ID NO: 345688 - DNA, 15 bp, Homo sapiens
ttatagcatgtgaat

SEQ ID NO: 345689 - DNA, 15 bp, Homo sapiens
tatagcatgtgaatt

SEQ ID NO: 345690 - DNA, 15 bp, Homo sapiens
atagcatgtgaatta

SEQ ID NO: 345691 - DNA, 15 bp, Homo sapiens
tagcatgtgaattac

SEQ ID NO: 345692 - DNA, 15 bp, Homo sapiens
agcatgtgaattaca

SEQ ID NO: 345693 - DNA, 15 bp, Homo sapiens
gcatgtgaattacat

SEQ ID NO: 345694 - DNA, 15 bp, Homo sapiens
catgtgaattacatc

SEQ ID NO: 345695 - DNA, 15 bp, Homo sapiens
atgtgaattacatct

SEQ ID NO: 345696 - DNA, 15 bp, Homo sapiens
tgtgaattacatctc

SEQ ID NO: 345697 - DNA, 15 bp, Homo sapiens
gtgaattacatctca

SEQ ID NO: 345698 - DNA, 15 bp, Homo sapiens
tgaattacatctcaa

SEQ ID NO: 345699 - DNA, 15 bp, Homo sapiens
gaattacatctcaat

SEQ ID NO: 345700 - DNA, 15 bp, Homo sapiens
aattacatctcaatg

SEQ ID NO: 345701 - DNA, 15 bp, Homo sapiens
attacatctcaatga

SEQ ID NO: 345702 - DNA, 15 bp, Homo sapiens
ttacatctcaatgaa

SEQ ID NO: 345703 - DNA, 15 bp, Homo sapiens
tacatctcaatgaag

SEQ ID NO: 345704 - DNA, 15 bp, Homo sapiens
acatctcaatgaagc

SEQ ID NO: 345705 - DNA, 15 bp, Homo sapiens
catctcaatgaagct

SEQ ID NO: 345706 - DNA, 15 bp, Homo sapiens
atctcaatgaagctg

SEQ ID NO: 345707 - DNA, 15 bp, Homo sapiens
tctcaatgaagctgt

SEQ ID NO: 345708 - DNA, 15 bp, Homo sapiens
ctcaatgaagctgtt

SEQ ID NO: 345709 - DNA, 15 bp, Homo sapiens
tcaatgaagctgtta

SEQ ID NO: 345710 - DNA, 15 bp, Homo sapiens
caatgaagctgttat

SEQ ID NO: 345711 - DNA, 15 bp, Homo sapiens
aatgaagctgttata

SEQ ID NO: 345712 - DNA, 15 bp, Homo sapiens
atgaagctgttataa

SEQ ID NO: 345713 - DNA, 15 bp, Homo sapiens
tgaagctgttataaa

SEQ ID NO: 345714 - DNA, 15 bp, Homo sapiens
gaagctgttataaac

SEQ ID NO: 345715 - DNA, 15 bp, Homo sapiens
aagctgttataaaca

SEQ ID NO: 345716 - DNA, 15 bp, Homo sapiens
agctgttataaacat

SEQ ID NO: 345717 - DNA, 15 bp, Homo sapiens
gctgttataaacatt

SEQ ID NO: 345718 - DNA, 15 bp, Homo sapiens
ctgttataaacattg

SEQ ID NO: 345719 - DNA, 15 bp, Homo sapiens
tgttataaacattga

SEQ ID NO: 345720 - DNA, 15 bp, Homo sapiens
gttataaacattgaa

SEQ ID NO: 345721 - DNA, 15 bp, Homo sapiens
ttataaacattgaaa

SEQ ID NO: 345722 - DNA, 15 bp, Homo sapiens
tataaacattgaaat

SEQ ID NO: 345723 - DNA, 15 bp, Homo sapiens
ataaacattgaaatt

SEQ ID NO: 345724 - DNA, 15 bp, Homo sapiens
taaacattgaaattt

SEQ ID NO: 345725 - DNA, 15 bp, Homo sapiens
aaacattgaaatttt

SEQ ID NO: 345726 - DNA, 15 bp, Homo sapiens
aacattgaaattttg

SEQ ID NO: 345727 - DNA, 15 bp, Homo sapiens
acattgaaattttgg

SEQ ID NO: 345728 - DNA, 15 bp, Homo sapiens
cattgaaattttgga

SEQ ID NO: 345729 - DNA, 15 bp, Homo sapiens
attgaaattttggat

SEQ ID NO: 345730 - DNA, 15 bp, Homo sapiens
ttgaaattttggatg

SEQ ID NO: 345731 - DNA, 15 bp, Homo sapiens
tgaaattttggatgg

SEQ ID NO: 345732 - DNA, 15 bp, Homo sapiens
gaaattttggatggc

SEQ ID NO: 345733 - DNA, 15 bp, Homo sapiens
aaattttggatggct

SEQ ID NO: 345734 - DNA, 15 bp, Homo sapiens
aattttggatggctt

SEQ ID NO: 345735 - DNA, 15 bp, Homo sapiens
attttggatggcttt

SEQ ID NO: 345736 - DNA, 15 bp, Homo sapiens
ttttggatggctttt

SEQ ID NO: 345737 - DNA, 15 bp, Homo sapiens
tttggatggctttta

SEQ ID NO: 345738 - DNA, 15 bp, Homo sapiens
ttggatggcttttat

SEQ ID NO: 345739 - DNA, 15 bp, Homo sapiens
tggatggcttttatt

SEQ ID NO: 345740 - DNA, 15 bp, Homo sapiens
ggatggcttttattt

SEQ ID NO: 345741 - DNA, 15 bp, Homo sapiens
gatggcttttatttc

SEQ ID NO: 345742 - DNA, 15 bp, Homo sapiens
atggcttttatttca

SEQ ID NO: 345743 - DNA, 15 bp, Homo sapiens
tggcttttatttcag

SEQ ID NO: 345744 - DNA, 15 bp, Homo sapiens
ggcttttatttcagg

SEQ ID NO: 345745 - DNA, 15 bp, Homo sapiens
gcttttatttcaggt

SEQ ID NO: 345746 - DNA, 15 bp, Homo sapiens
cttttatttcaggtg

SEQ ID NO: 345747 - DNA, 15 bp, Homo sapiens
ttttatttcaggtga

SEQ ID NO: 345748 - DNA, 15 bp, Homo sapiens
tttatttcaggtgac

SEQ ID NO: 345749 - DNA, 15 bp, Homo sapiens
ttatttcaggtgact

SEQ ID NO: 345750 - DNA, 15 bp, Homo sapiens
tatttcaggtgactc

SEQ ID NO: 345751 - DNA, 15 bp, Homo sapiens
atttcaggtgactca

SEQ ID NO: 345752 - DNA, 15 bp, Homo sapiens
tttcaggtgactcag

SEQ ID NO: 345753 - DNA, 15 bp, Homo sapiens
ttcaggtgactcagg

SEQ ID NO: 345754 - DNA, 15 bp, Homo sapiens
tcaggtgactcaggc

SEQ ID NO: 345755 - DNA, 15 bp, Homo sapiens
caggtgactcaggct

SEQ ID NO: 345756 - DNA, 15 bp, Homo sapiens
aggtgactcaggctg

SEQ ID NO: 345757 - DNA, 15 bp, Homo sapiens
ggtgactcaggctgt

SEQ ID NO: 345758 - DNA, 15 bp, Homo sapiens
gtgactcaggctgta

SEQ ID NO: 345759 - DNA, 15 bp, Homo sapiens
tgactcaggctgtag

SEQ ID NO: 345760 - DNA, 15 bp, Homo sapiens
gactcaggctgtagc

SEQ ID NO: 345761 - DNA, 15 bp, Homo sapiens
actcaggctgtagca

SEQ ID NO: 345762 - DNA, 15 bp, Homo sapiens
ctcaggctgtagcaa

SEQ ID NO: 345763 - DNA, 15 bp, Homo sapiens
tcaggctgtagcaaa

SEQ ID NO: 345764 - DNA, 15 bp, Homo sapiens
caggctgtagcaaag

SEQ ID NO: 345765 - DNA, 15 bp, Homo sapiens
aggctgtagcaaagc

SEQ ID NO: 345766 - DNA, 15 bp, Homo sapiens
ggctgtagcaaagct

SEQ ID NO: 345767 - DNA, 15 bp, Homo sapiens
gctgtagcaaagctg

SEQ ID NO: 345768 - DNA, 15 bp, Homo sapiens
ctgtagcaaagctgg

SEQ ID NO: 345769 - DNA, 15 bp, Homo sapiens
tgtagcaaagctggg

SEQ ID NO: 345770 - DNA, 15 bp, Homo sapiens
gtagcaaagctgggg

SEQ ID NO: 345771 - DNA, 15 bp, Homo sapiens
tagcaaagctgggga

SEQ ID NO: 345772 - DNA, 15 bp, Homo sapiens
agcaaagctggggat

SEQ ID NO: 345773 - DNA, 15 bp, Homo sapiens
gcaaagctggggatg

SEQ ID NO: 345774 - DNA, 15 bp, Homo sapiens
caaagctggggatgt

SEQ ID NO: 345775 - DNA, 15 bp, Homo sapiens
aaagctggggatgtc

SEQ ID NO: 345776 - DNA, 15 bp, Homo sapiens
aagctggggatgtct

SEQ ID NO: 345777 - DNA, 15 bp, Homo sapiens
agctggggatgtctc

SEQ ID NO: 345778 - DNA, 15 bp, Homo sapiens
gctggggatgtctca

SEQ ID NO: 345779 - DNA, 15 bp, Homo sapiens
ctggggatgtctcag

SEQ ID NO: 345780 - DNA, 15 bp, Homo sapiens
tggggatgtctcaga

SEQ ID NO: 345781 - DNA, 15 bp, Homo sapiens
ggggatgtctcagat

SEQ ID NO: 345782 - DNA, 15 bp, Homo sapiens
gggatgtctcagatt

SEQ ID NO: 345783 - DNA, 15 bp, Homo sapiens
ggatgtctcagattc

SEQ ID NO: 345784 - DNA, 15 bp, Homo sapiens
gatgtctcagattcc

SEQ ID NO: 345785 - DNA, 15 bp, Homo sapiens
atgtctcagattcct

SEQ ID NO: 345786 - DNA, 15 bp, Homo sapiens
tgtctcagattcctc

SEQ ID NO: 345787 - DNA, 15 bp, Homo sapiens
gtctcagattcctca

SEQ ID NO: 345788 - DNA, 15 bp, Homo sapiens
tctcagattcctcag

SEQ ID NO: 345789 - DNA, 15 bp, Homo sapiens
ctcagattcctcaga

SEQ ID NO: 345790 - DNA, 15 bp, Homo sapiens
tcagattcctcagaa

SEQ ID NO: 345791 - DNA, 15 bp, Homo sapiens
cagattcctcagaag

SEQ ID NO: 345792 - DNA, 15 bp, Homo sapiens
agattcctcagaagg

SEQ ID NO: 345793 - DNA, 15 bp, Homo sapiens
gattcctcagaagga

SEQ ID NO: 345794 - DNA, 15 bp, Homo sapiens
attcctcagaaggac

SEQ ID NO: 345795 - DNA, 15 bp, Homo sapiens
ttcctcagaaggacc

SEQ ID NO: 345796 - DNA, 15 bp, Homo sapiens
tcctcagaaggacct

SEQ ID NO: 345797 - DNA, 15 bp, Homo sapiens
cctcagaaggacctt

SEQ ID NO: 345798 - DNA, 15 bp, Homo sapiens
ctcagaaggaccttt

SEQ ID NO: 345799 - DNA, 15 bp, Homo sapiens
tcagaaggacctttt

SEQ ID NO: 345800 - DNA, 15 bp, Homo sapiens
cagaaggaccttttg

SEQ ID NO: 345801 - DNA, 15 bp, Homo sapiens
agaaggaccttttgg

SEQ ID NO: 345802 - DNA, 15 bp, Homo sapiens
gaaggaccttttgga

SEQ ID NO: 345803 - DNA, 15 bp, Homo sapiens
aaggaccttttggag

SEQ ID NO: 345804 - DNA, 15 bp, Homo sapiens
aggaccttttggaga

SEQ ID NO: 345805 - DNA, 15 bp, Homo sapiens
ggaccttttggagac

SEQ ID NO: 345806 - DNA, 15 bp, Homo sapiens
gaccttttggagact

SEQ ID NO: 345807 - DNA, 15 bp, Homo sapiens
accttttggagactg

SEQ ID NO: 345808 - DNA, 15 bp, Homo sapiens
ccttttggagactgt

SEQ ID NO: 345809 - DNA, 15 bp, Homo sapiens
cttttggagactgtt

SEQ ID NO: 345810 - DNA, 15 bp, Homo sapiens
ttttggagactgttc

SEQ ID NO: 345811 - DNA, 15 bp, Homo sapiens
tttggagactgttcg

SEQ ID NO: 345812 - DNA, 15 bp, Homo sapiens
ttggagactgttcgt

SEQ ID NO: 345813 - DNA, 15 bp, Homo sapiens
tggagactgttcgtg

SEQ ID NO: 345814 - DNA, 15 bp, Homo sapiens
ggagactgttcgtgt

SEQ ID NO: 345815 - DNA, 15 bp, Homo sapiens
gagactgttcgtgta

SEQ ID NO: 345816 - DNA, 15 bp, Homo sapiens
agactgttcgtgtaa

SEQ ID NO: 345817 - DNA, 15 bp, Homo sapiens
gactgttcgtgtaag

SEQ ID NO: 345818 - DNA, 15 bp, Homo sapiens
actgttcgtgtaaga

SEQ ID NO: 345819 - DNA, 15 bp, Homo sapiens
ctgttcgtgtaagag

SEQ ID NO: 345820 - DNA, 15 bp, Homo sapiens
tgttcgtgtaagaga

SEQ ID NO: 345821 - DNA, 15 bp, Homo sapiens
gttcgtgtaagagaa

SEQ ID NO: 345822 - DNA, 15 bp, Homo sapiens
ttcgtgtaagagaac

SEQ ID NO: 345823 - DNA, 15 bp, Homo sapiens
tcgtgtaagagaaca

SEQ ID NO: 345824 - DNA, 15 bp, Homo sapiens
cgtgtaagagaacaa

SEQ ID NO: 345825 - DNA, 15 bp, Homo sapiens
gtgtaagagaacaag

SEQ ID NO: 345826 - DNA, 15 bp, Homo sapiens
tgtaagagaacaagc

SEQ ID NO: 345827 - DNA, 15 bp, Homo sapiens
gtaagagaacaagca

SEQ ID NO: 345828 - DNA, 15 bp, Homo sapiens
taagagaacaagcaa

SEQ ID NO: 345829 - DNA, 15 bp, Homo sapiens
aagagaacaagcaat

SEQ ID NO: 345830 - DNA, 15 bp, Homo sapiens
agagaacaagcaatt

SEQ ID NO: 345831 - DNA, 15 bp, Homo sapiens
gagaacaagcaatta

SEQ ID NO: 345832 - DNA, 15 bp, Homo sapiens
agaacaagcaattac

SEQ ID NO: 345833 - DNA, 15 bp, Homo sapiens
gaacaagcaattaca

SEQ ID NO: 345834 - DNA, 15 bp, Homo sapiens
aacaagcaattacaa

SEQ ID NO: 345835 - DNA, 15 bp, Homo sapiens
acaagcaattacaaa

SEQ ID NO: 345836 - DNA, 15 bp, Homo sapiens
caagcaattacaaaa

SEQ ID NO: 345837 - DNA, 15 bp, Homo sapiens
aagcaattacaaaaa

SEQ ID NO: 345838 - DNA, 15 bp, Homo sapiens
agcaattacaaaaaa

SEQ ID NO: 345839 - DNA, 15 bp, Homo sapiens
gcaattacaaaaaaa

SEQ ID NO: 345840 - DNA, 15 bp, Homo sapiens
caattacaaaaaaat

SEQ ID NO: 345841 - DNA, 15 bp, Homo sapiens
aattacaaaaaaatc

SEQ ID NO: 345842 - DNA, 15 bp, Homo sapiens
attacaaaaaaatct

SEQ ID NO: 345843 - DNA, 15 bp, Homo sapiens
ttacaaaaaaatcta

SEQ ID NO: 345844 - DNA, 15 bp, Homo sapiens
tacaaaaaaatctaa

SEQ ID NO: 345845 - DNA, 15 bp, Homo sapiens
acaaaaaaatctaag

SEQ ID NO: 345846 - DNA, 15 bp, Homo sapiens
caaaaaaatctaagc

SEQ ID NO: 345847 - DNA, 15 bp, Homo sapiens
aaaaaaatctaagca

SEQ ID NO: 345848 - DNA, 15 bp, Homo sapiens
aaaaaatctaagcag

SEQ ID NO: 345849 - DNA, 15 bp, Homo sapiens
aaaaatctaagcagg

SEQ ID NO: 345850 - DNA, 15 bp, Homo sapiens
aaaatctaagcagga

SEQ ID NO: 345851 - DNA, 15 bp, Homo sapiens
aaatctaagcaggaa

SEQ ID NO: 345852 - DNA, 15 bp, Homo sapiens
aatctaagcaggaac

SEQ ID NO: 345853 - DNA, 15 bp, Homo sapiens
atctaagcaggaact

SEQ ID NO: 345854 - DNA, 15 bp, Homo sapiens
tctaagcaggaactg

SEQ ID NO: 345855 - DNA, 15 bp, Homo sapiens
ctaagcaggaactgc

SEQ ID NO: 345856 - DNA, 15 bp, Homo sapiens
taagcaggaactgcc

SEQ ID NO: 345857 - DNA, 15 bp, Homo sapiens
aagcaggaactgcct

SEQ ID NO: 345858 - DNA, 15 bp, Homo sapiens
agcaggaactgcctc

SEQ ID NO: 345859 - DNA, 15 bp, Homo sapiens
gcaggaactgcctcc

SEQ ID NO: 345860 - DNA, 15 bp, Homo sapiens
caggaactgcctcct

SEQ ID NO: 345861 - DNA, 15 bp, Homo sapiens
aggaactgcctcctc

SEQ ID NO: 345862 - DNA, 15 bp, Homo sapiens
ggaactgcctcctcc

SEQ ID NO: 345863 - DNA, 15 bp, Homo sapiens
gaactgcctcctcct

SEQ ID NO: 345864 - DNA, 15 bp, Homo sapiens
aactgcctcctcctc

SEQ ID NO: 345865 - DNA, 15 bp, Homo sapiens
actgcctcctcctcc

SEQ ID NO: 345866 - DNA, 15 bp, Homo sapiens
ctgcctcctcctcct

SEQ ID NO: 345867 - DNA, 15 bp, Homo sapiens
tgcctcctcctcctc

SEQ ID NO: 345868 - DNA, 15 bp, Homo sapiens
gcctcctcctcctcc

SEQ ID NO: 345869 - DNA, 15 bp, Homo sapiens
cctcctcctcctccc

SEQ ID NO: 345870 - DNA, 15 bp, Homo sapiens
ctcctcctcctcccc

SEQ ID NO: 345871 - DNA, 15 bp, Homo sapiens
tcctcctcctccccc

SEQ ID NO: 345872 - DNA, 15 bp, Homo sapiens
cctcctcctccccca

SEQ ID NO: 345873 - DNA, 15 bp, Homo sapiens
ctcctcctcccccaa

SEQ ID NO: 345874 - DNA, 15 bp, Homo sapiens
tcctcctcccccaaa

SEQ ID NO: 345875 - DNA, 15 bp, Homo sapiens
cctcctcccccaaag

SEQ ID NO: 345876 - DNA, 15 bp, Homo sapiens
ctcctcccccaaaga

SEQ ID NO: 345877 - DNA, 15 bp, Homo sapiens
tcctcccccaaagaa

SEQ ID NO: 345878 - DNA, 15 bp, Homo sapiens
cctcccccaaagaag

SEQ ID NO: 345879 - DNA, 15 bp, Homo sapiens
ctcccccaaagaaga

SEQ ID NO: 345880 - DNA, 15 bp, Homo sapiens
tcccccaaagaagag

SEQ ID NO: 345881 - DNA, 15 bp, Homo sapiens
cccccaaagaagaga

SEQ ID NO: 345882 - DNA, 15 bp, Homo sapiens
ccccaaagaagagac

SEQ ID NO: 345883 - DNA, 15 bp, Homo sapiens
cccaaagaagagaca

SEQ ID NO: 345884 - DNA, 15 bp, Homo sapiens
ccaaagaagagacag

SEQ ID NO: 345885 - DNA, 15 bp, Homo sapiens
caaagaagagacaga

SEQ ID NO: 345886 - DNA, 15 bp, Homo sapiens
aaagaagagacagat

SEQ ID NO: 345887 - DNA, 15 bp, Homo sapiens
aagaagagacagatc

SEQ ID NO: 345888 - DNA, 15 bp, Homo sapiens
agaagagacagatcc

SEQ ID NO: 345889 - DNA, 15 bp, Homo sapiens
gaagagacagatcca

SEQ ID NO: 345890 - DNA, 15 bp, Homo sapiens
aagagacagatccat

SEQ ID NO: 345891 - DNA, 15 bp, Homo sapiens
agagacagatccatg

SEQ ID NO: 345892 - DNA, 15 bp, Homo sapiens
gagacagatccatgt

SEQ ID NO: 345893 - DNA, 15 bp, Homo sapiens
agacagatccatgtg

SEQ ID NO: 345894 - DNA, 15 bp, Homo sapiens
gacagatccatgtgg

SEQ ID NO: 345895 - DNA, 15 bp, Homo sapiens
acagatccatgtgga

SEQ ID NO: 345896 - DNA, 15 bp, Homo sapiens
cagatccatgtggat

SEQ ID NO: 345897 - DNA, 15 bp, Homo sapiens
agatccatgtggata

SEQ ID NO: 345898 - DNA, 15 bp, Homo sapiens
gatccatgtggatat

SEQ ID NO: 345899 - DNA, 15 bp, Homo sapiens
atccatgtggatatt

SEQ ID NO: 345900 - DNA, 15 bp, Homo sapiens
tccatgtggatattg

SEQ ID NO: 345901 - DNA, 15 bp, Homo sapiens
ccatgtggatattga

SEQ ID NO: 345902 - DNA, 15 bp, Homo sapiens
catgtggatattgaa

SEQ ID NO: 345903 - DNA, 15 bp, Homo sapiens
atgtggatattgaag

SEQ ID NO: 345904 - DNA, 15 bp, Homo sapiens
tgtggatattgaagc

SEQ ID NO: 345905 - DNA, 15 bp, Homo sapiens
gtggatattgaagct

SEQ ID NO: 345906 - DNA, 15 bp, Homo sapiens
tggatattgaagcta

SEQ ID NO: 345907 - DNA, 15 bp, Homo sapiens
ggatattgaagctaa

SEQ ID NO: 345908 - DNA, 15 bp, Homo sapiens
gatattgaagctaag

SEQ ID NO: 345909 - DNA, 15 bp, Homo sapiens
atattgaagctaaga

SEQ ID NO: 345910 - DNA, 15 bp, Homo sapiens
tattgaagctaagaa

SEQ ID NO: 345911 - DNA, 15 bp, Homo sapiens
attgaagctaagaaa

SEQ ID NO: 345912 - DNA, 15 bp, Homo sapiens
ttgaagctaagaaaa

SEQ ID NO: 345913 - DNA, 15 bp, Homo sapiens
tgaagctaagaaaaa

SEQ ID NO: 345914 - DNA, 15 bp, Homo sapiens
gaagctaagaaaaag

SEQ ID NO: 345915 - DNA, 15 bp, Homo sapiens
aagctaagaaaaagt

SEQ ID NO: 345916 - DNA, 15 bp, Homo sapiens
agctaagaaaaagtg

SEQ ID NO: 345917 - DNA, 15 bp, Homo sapiens
gctaagaaaaagtga

SEQ ID NO: 345918 - DNA, 15 bp, Homo sapiens
ctaagaaaaagtgag

SEQ ID NO: 345919 - DNA, 15 bp, Homo sapiens
taagaaaaagtgaga

SEQ ID NO: 345920 - DNA, 15 bp, Homo sapiens
aagaaaaagtgagaa

SEQ ID NO: 345921 - DNA, 15 bp, Homo sapiens
agaaaaagtgagaag

SEQ ID NO: 345922 - DNA, 15 bp, Homo sapiens
gaaaaagtgagaaga

SEQ ID NO: 345923 - DNA, 15 bp, Homo sapiens
aaaaagtgagaagag

SEQ ID NO: 345924 - DNA, 15 bp, Homo sapiens
aaaagtgagaagaga

SEQ ID NO: 345925 - DNA, 15 bp, Homo sapiens
aaagtgagaagagat

SEQ ID NO: 345926 - DNA, 15 bp, Homo sapiens
aagtgagaagagata

SEQ ID NO: 345927 - DNA, 15 bp, Homo sapiens
agtgagaagagatag

SEQ ID NO: 345928 - DNA, 15 bp, Homo sapiens
gtgagaagagataga

SEQ ID NO: 345929 - DNA, 15 bp, Homo sapiens
tgagaagagatagag

SEQ ID NO: 345930 - DNA, 15 bp, Homo sapiens
gagaagagatagaga

SEQ ID NO: 345931 - DNA, 15 bp, Homo sapiens
agaagagatagagaa

SEQ ID NO: 345932 - DNA, 15 bp, Homo sapiens
aagagatagagaaat

SEQ ID NO: 345933 - DNA, 15 bp, Homo sapiens
agagatagagaaatt

SEQ ID NO: 345934 - DNA, 15 bp, Homo sapiens
gagatagagaaattg

SEQ ID NO: 345935 - DNA, 15 bp, Homo sapiens
agatagagaaattgt

SEQ ID NO: 345936 - DNA, 15 bp, Homo sapiens
gatagagaaattgtt

SEQ ID NO: 345937 - DNA, 15 bp, Homo sapiens
atagagaaattgttc

SEQ ID NO: 345938 - DNA, 15 bp, Homo sapiens
tagagaaattgttca

SEQ ID NO: 345939 - DNA, 15 bp, Homo sapiens
agagaaattgttcaa

SEQ ID NO: 345940 - DNA, 15 bp, Homo sapiens
gagaaattgttcaaa

SEQ ID NO: 345941 - DNA, 15 bp, Homo sapiens
agaaattgttcaaat

SEQ ID NO: 345942 - DNA, 15 bp, Homo sapiens
gaaattgttcaaatc

SEQ ID NO: 345943 - DNA, 15 bp, Homo sapiens
aaattgttcaaatcc

SEQ ID NO: 345944 - DNA, 15 bp, Homo sapiens
aattgttcaaatcca

SEQ ID NO: 345945 - DNA, 15 bp, Homo sapiens
attgttcaaatccaa

SEQ ID NO: 345946 - DNA, 15 bp, Homo sapiens
ttgttcaaatccaat

SEQ ID NO: 345947 - DNA, 15 bp, Homo sapiens
tgttcaaatccaata

SEQ ID NO: 345948 - DNA, 15 bp, Homo sapiens
gttcaaatccaatat

SEQ ID NO: 345949 - DNA, 15 bp, Homo sapiens
ttcaaatccaatatt

SEQ ID NO: 345950 - DNA, 15 bp, Homo sapiens
tcaaatccaatattg

SEQ ID NO: 345951 - DNA, 15 bp, Homo sapiens
caaatccaatattgc

SEQ ID NO: 345952 - DNA, 15 bp, Homo sapiens
aaatccaatattgca

SEQ ID NO: 345953 - DNA, 15 bp, Homo sapiens
aatccaatattgcac

SEQ ID NO: 345954 - DNA, 15 bp, Homo sapiens
atccaatattgcaca

SEQ ID NO: 345955 - DNA, 15 bp, Homo sapiens
tccaatattgcacat

SEQ ID NO: 345956 - DNA, 15 bp, Homo sapiens
ccaatattgcacata

SEQ ID NO: 345957 - DNA, 15 bp, Homo sapiens
caatattgcacatac

SEQ ID NO: 345958 - DNA, 15 bp, Homo sapiens
aatattgcacatact

SEQ ID NO: 345959 - DNA, 15 bp, Homo sapiens
atattgcacatacta

SEQ ID NO: 345960 - DNA, 15 bp, Homo sapiens
tattgcacatactat

SEQ ID NO: 345961 - DNA, 15 bp, Homo sapiens
attgcacatactata

SEQ ID NO: 345962 - DNA, 15 bp, Homo sapiens
ttgcacatactatat

SEQ ID NO: 345963 - DNA, 15 bp, Homo sapiens
tgcacatactatatt

SEQ ID NO: 345964 - DNA, 15 bp, Homo sapiens
gcacatactatattt

SEQ ID NO: 345965 - DNA, 15 bp, Homo sapiens
cacatactatatttt

SEQ ID NO: 345966 - DNA, 15 bp, Homo sapiens
acatactatattttc

SEQ ID NO: 345967 - DNA, 15 bp, Homo sapiens
catactatattttct

SEQ ID NO: 345968 - DNA, 15 bp, Homo sapiens
atactatattttcta

SEQ ID NO: 345969 - DNA, 15 bp, Homo sapiens
tactatattttctac

SEQ ID NO: 345970 - DNA, 15 bp, Homo sapiens
actatattttctact

SEQ ID NO: 345971 - DNA, 15 bp, Homo sapiens
ctatattttctactt

SEQ ID NO: 345972 - DNA, 15 bp, Homo sapiens
tatattttctacttg

SEQ ID NO: 345973 - DNA, 15 bp, Homo sapiens
atattttctacttgg

SEQ ID NO: 345974 - DNA, 15 bp, Homo sapiens
tattttctacttggt

SEQ ID NO: 345975 - DNA, 15 bp, Homo sapiens
attttctacttggtg

SEQ ID NO: 345976 - DNA, 15 bp, Homo sapiens
ttttctacttggtgc

SEQ ID NO: 345977 - DNA, 15 bp, Homo sapiens
tttctacttggtgcc

SEQ ID NO: 345978 - DNA, 15 bp, Homo sapiens
ttctacttggtgcct

SEQ ID NO: 345979 - DNA, 15 bp, Homo sapiens
tctacttggtgccta

SEQ ID NO: 345980 - DNA, 15 bp, Homo sapiens
ctacttggtgcctat

SEQ ID NO: 345981 - DNA, 15 bp, Homo sapiens
tacttggtgcctatt

SEQ ID NO: 345982 - DNA, 15 bp, Homo sapiens
acttggtgcctattt

SEQ ID NO: 345983 - DNA, 15 bp, Homo sapiens
cttggtgcctatttt

SEQ ID NO: 345984 - DNA, 15 bp, Homo sapiens
ttggtgcctattttg

SEQ ID NO: 345985 - DNA, 15 bp, Homo sapiens
tggtgcctattttgt

SEQ ID NO: 345986 - DNA, 15 bp, Homo sapiens
ggtgcctattttgta

SEQ ID NO: 345987 - DNA, 15 bp, Homo sapiens
gtgcctattttgtac

SEQ ID NO: 345988 - DNA, 15 bp, Homo sapiens
tgcctattttgtact

SEQ ID NO: 345989 - DNA, 15 bp, Homo sapiens
gcctattttgtacta

SEQ ID NO: 345990 - DNA, 15 bp, Homo sapiens
cctattttgtactaa

SEQ ID NO: 345991 - DNA, 15 bp, Homo sapiens
ctattttgtactaat

SEQ ID NO: 345992 - DNA, 15 bp, Homo sapiens
tattttgtactaatc

SEQ ID NO: 345993 - DNA, 15 bp, Homo sapiens
attttgtactaatca

SEQ ID NO: 345994 - DNA, 15 bp, Homo sapiens
ttttgtactaatcat

SEQ ID NO: 345995 - DNA, 15 bp, Homo sapiens
tttgtactaatcatt

SEQ ID NO: 345996 - DNA, 15 bp, Homo sapiens
ttgtactaatcatta

SEQ ID NO: 345997 - DNA, 15 bp, Homo sapiens
tgtactaatcattaa

SEQ ID NO: 345998 - DNA, 15 bp, Homo sapiens
gtactaatcattaat

SEQ ID NO: 345999 - DNA, 15 bp, Homo sapiens
tactaatcattaatc

SEQ ID NO: 346000 - DNA, 15 bp, Homo sapiens
actaatcattaatca

SEQ ID NO: 346001 - DNA, 15 bp, Homo sapiens
ctaatcattaatcat

SEQ ID NO: 346002 - DNA, 15 bp, Homo sapiens
taatcattaatcata

SEQ ID NO: 346003 - DNA, 15 bp, Homo sapiens
aatcattaatcatag

SEQ ID NO: 346004 - DNA, 15 bp, Homo sapiens
atcattaatcatagg

SEQ ID NO: 346005 - DNA, 15 bp, Homo sapiens
tcattaatcataggc

SEQ ID NO: 346006 - DNA, 15 bp, Homo sapiens
cattaatcataggca

SEQ ID NO: 346007 - DNA, 15 bp, Homo sapiens
attaatcataggcaa

SEQ ID NO: 346008 - DNA, 15 bp, Homo sapiens
ttaatcataggcaaa

SEQ ID NO: 346009 - DNA, 15 bp, Homo sapiens
taatcataggcaaat

SEQ ID NO: 346010 - DNA, 15 bp, Homo sapiens
aatcataggcaaatc

SEQ ID NO: 346011 - DNA, 15 bp, Homo sapiens
atcataggcaaatct

SEQ ID NO: 346012 - DNA, 15 bp, Homo sapiens
tcataggcaaatcta

SEQ ID NO: 346013 - DNA, 15 bp, Homo sapiens
cataggcaaatctag

SEQ ID NO: 346014 - DNA, 15 bp, Homo sapiens
ataggcaaatctaga

SEQ ID NO: 346015 - DNA, 15 bp, Homo sapiens
taggcaaatctagac

SEQ ID NO: 346016 - DNA, 15 bp, Homo sapiens
aggcaaatctagaca

SEQ ID NO: 346017 - DNA, 15 bp, Homo sapiens
ggcaaatctagacat

SEQ ID NO: 346018 - DNA, 15 bp, Homo sapiens
gcaaatctagacata

SEQ ID NO: 346019 - DNA, 15 bp, Homo sapiens
caaatctagacataa

SEQ ID NO: 346020 - DNA, 15 bp, Homo sapiens
aaatctagacataat

SEQ ID NO: 346021 - DNA, 15 bp, Homo sapiens
aatctagacataata

SEQ ID NO: 346022 - DNA, 15 bp, Homo sapiens
atctagacataataa

SEQ ID NO: 346023 - DNA, 15 bp, Homo sapiens
tctagacataataag

SEQ ID NO: 346024 - DNA, 15 bp, Homo sapiens
ctagacataataagt

SEQ ID NO: 346025 - DNA, 15 bp, Homo sapiens
tagacataataagta

SEQ ID NO: 346026 - DNA, 15 bp, Homo sapiens
agacataataagtat

SEQ ID NO: 346027 - DNA, 15 bp, Homo sapiens
gacataataagtatt

SEQ ID NO: 346028 - DNA, 15 bp, Homo sapiens
acataataagtatta

SEQ ID NO: 346029 - DNA, 15 bp, Homo sapiens
cataataagtattat

SEQ ID NO: 346030 - DNA, 15 bp, Homo sapiens
ataataagtattatt

SEQ ID NO: 346031 - DNA, 15 bp, Homo sapiens
taataagtattatta

SEQ ID NO: 346032 - DNA, 15 bp, Homo sapiens
aataagtattattat

SEQ ID NO: 346033 - DNA, 15 bp, Homo sapiens
ataagtattattatt

SEQ ID NO: 346034 - DNA, 15 bp, Homo sapiens
taagtattattatta

SEQ ID NO: 346035 - DNA, 15 bp, Homo sapiens
aagtattattattat

SEQ ID NO: 346036 - DNA, 15 bp, Homo sapiens
agtattattattatg

SEQ ID NO: 346037 - DNA, 15 bp, Homo sapiens
gtattattattatga

SEQ ID NO: 346038 - DNA, 15 bp, Homo sapiens
tattattattatgaa

SEQ ID NO: 346039 - DNA, 15 bp, Homo sapiens
attattattatgaaa

SEQ ID NO: 346040 - DNA, 15 bp, Homo sapiens
ttattattatgaaaa

SEQ ID NO: 346041 - DNA, 15 bp, Homo sapiens
tattattatgaaaag

SEQ ID NO: 346042 - DNA, 15 bp, Homo sapiens
attattatgaaaagt

SEQ ID NO: 346043 - DNA, 15 bp, Homo sapiens
ttattatgaaaagtc

SEQ ID NO: 346044 - DNA, 15 bp, Homo sapiens
attatgaaaagtcaa

SEQ ID NO: 346045 - DNA, 15 bp, Homo sapiens
ttatgaaaagtcaac

SEQ ID NO: 346046 - DNA, 15 bp, Homo sapiens
tatgaaaagtcaact

SEQ ID NO: 346047 - DNA, 15 bp, Homo sapiens
atgaaaagtcaacta

SEQ ID NO: 346048 - DNA, 15 bp, Homo sapiens
tgaaaagtcaactac

SEQ ID NO: 346049 - DNA, 15 bp, Homo sapiens
gaaaagtcaactact

SEQ ID NO: 346050 - DNA, 15 bp, Homo sapiens
aaaagtcaactactg

SEQ ID NO: 346051 - DNA, 15 bp, Homo sapiens
aaagtcaactactga

SEQ ID NO: 346052 - DNA, 15 bp, Homo sapiens
aagtcaactactgaa

SEQ ID NO: 346053 - DNA, 15 bp, Homo sapiens
agtcaactactgaac

SEQ ID NO: 346054 - DNA, 15 bp, Homo sapiens
gtcaactactgaacc

SEQ ID NO: 346055 - DNA, 15 bp, Homo sapiens
tcaactactgaacca

SEQ ID NO: 346056 - DNA, 15 bp, Homo sapiens
caactactgaaccac

SEQ ID NO: 346057 - DNA, 15 bp, Homo sapiens
aactactgaaccact

SEQ ID NO: 346058 - DNA, 15 bp, Homo sapiens
actactgaaccactc

SEQ ID NO: 346059 - DNA, 15 bp, Homo sapiens
ctactgaaccactca

SEQ ID NO: 346060 - DNA, 15 bp, Homo sapiens
tactgaaccactcac

SEQ ID NO: 346061 - DNA, 15 bp, Homo sapiens
actgaaccactcact

SEQ ID NO: 346062 - DNA, 15 bp, Homo sapiens
ctgaaccactcactg

SEQ ID NO: 346063 - DNA, 15 bp, Homo sapiens
tgaaccactcactgc

SEQ ID NO: 346064 - DNA, 15 bp, Homo sapiens
gaaccactcactgcc

SEQ ID NO: 346065 - DNA, 15 bp, Homo sapiens
aaccactcactgccc

SEQ ID NO: 346066 - DNA, 15 bp, Homo sapiens
accactcactgcccc

SEQ ID NO: 346067 - DNA, 15 bp, Homo sapiens
ccactcactgcccct

SEQ ID NO: 346068 - DNA, 15 bp, Homo sapiens
cactcactgcccctg

SEQ ID NO: 346069 - DNA, 15 bp, Homo sapiens
actcactgcccctgt

SEQ ID NO: 346070 - DNA, 15 bp, Homo sapiens
ctcactgcccctgtc

SEQ ID NO: 346071 - DNA, 15 bp, Homo sapiens
tcactgcccctgtct

SEQ ID NO: 346072 - DNA, 15 bp, Homo sapiens
cactgcccctgtctt

SEQ ID NO: 346073 - DNA, 15 bp, Homo sapiens
actgcccctgtcttc

SEQ ID NO: 346074 - DNA, 15 bp, Homo sapiens
ctgcccctgtcttct

SEQ ID NO: 346075 - DNA, 15 bp, Homo sapiens
tgcccctgtcttctg

SEQ ID NO: 346076 - DNA, 15 bp, Homo sapiens
gcccctgtcttctga

SEQ ID NO: 346077 - DNA, 15 bp, Homo sapiens
cccctgtcttctgaa

SEQ ID NO: 346078 - DNA, 15 bp, Homo sapiens
ccctgtcttctgaat

SEQ ID NO: 346079 - DNA, 15 bp, Homo sapiens
cctgtcttctgaata

SEQ ID NO: 346080 - DNA, 15 bp, Homo sapiens
ctgtcttctgaatat

SEQ ID NO: 346081 - DNA, 15 bp, Homo sapiens
tgtcttctgaatatt

SEQ ID NO: 346082 - DNA, 15 bp, Homo sapiens
gtcttctgaatattc

SEQ ID NO: 346083 - DNA, 15 bp, Homo sapiens
tcttctgaatattct

SEQ ID NO: 346084 - DNA, 15 bp, Homo sapiens
cttctgaatattcta

SEQ ID NO: 346085 - DNA, 15 bp, Homo sapiens
ttctgaatattctac

SEQ ID NO: 346086 - DNA, 15 bp, Homo sapiens
tctgaatattctact

SEQ ID NO: 346087 - DNA, 15 bp, Homo sapiens
ctgaatattctactt

SEQ ID NO: 346088 - DNA, 15 bp, Homo sapiens
tgaatattctacttg

SEQ ID NO: 346089 - DNA, 15 bp, Homo sapiens
gaatattctacttgg

SEQ ID NO: 346090 - DNA, 15 bp, Homo sapiens
aatattctacttggc

SEQ ID NO: 346091 - DNA, 15 bp, Homo sapiens
atattctacttggca

SEQ ID NO: 346092 - DNA, 15 bp, Homo sapiens
tattctacttggcac

SEQ ID NO: 346093 - DNA, 15 bp, Homo sapiens
attctacttggcact

SEQ ID NO: 346094 - DNA, 15 bp, Homo sapiens
ttctacttggcacta

SEQ ID NO: 346095 - DNA, 15 bp, Homo sapiens
tctacttggcactag

SEQ ID NO: 346096 - DNA, 15 bp, Homo sapiens
ctacttggcactagc

SEQ ID NO: 346097 - DNA, 15 bp, Homo sapiens
tacttggcactagct

SEQ ID NO: 346098 - DNA, 15 bp, Homo sapiens
acttggcactagcta

SEQ ID NO: 346099 - DNA, 15 bp, Homo sapiens
cttggcactagctaa

SEQ ID NO: 346100 - DNA, 15 bp, Homo sapiens
ttggcactagctaag

SEQ ID NO: 346101 - DNA, 15 bp, Homo sapiens
tggcactagctaagc

SEQ ID NO: 346102 - DNA, 15 bp, Homo sapiens
ggcactagctaagca

SEQ ID NO: 346103 - DNA, 15 bp, Homo sapiens
gcactagctaagcat

SEQ ID NO: 346104 - DNA, 15 bp, Homo sapiens
cactagctaagcatc

SEQ ID NO: 346105 - DNA, 15 bp, Homo sapiens
actagctaagcatcc

SEQ ID NO: 346106 - DNA, 15 bp, Homo sapiens
ctagctaagcatcca

SEQ ID NO: 346107 - DNA, 15 bp, Homo sapiens
tagctaagcatccaa

SEQ ID NO: 346108 - DNA, 15 bp, Homo sapiens
agctaagcatccaaa

SEQ ID NO: 346109 - DNA, 15 bp, Homo sapiens
gctaagcatccaaat

SEQ ID NO: 346110 - DNA, 15 bp, Homo sapiens
ctaagcatccaaatt

SEQ ID NO: 346111 - DNA, 15 bp, Homo sapiens
taagcatccaaattt

SEQ ID NO: 346112 - DNA, 15 bp, Homo sapiens
aagcatccaaatttt

SEQ ID NO: 346113 - DNA, 15 bp, Homo sapiens
agcatccaaattttc

SEQ ID NO: 346114 - DNA, 15 bp, Homo sapiens
gcatccaaattttct

SEQ ID NO: 346115 - DNA, 15 bp, Homo sapiens
catccaaattttctt

SEQ ID NO: 346116 - DNA, 15 bp, Homo sapiens
atccaaattttcttg

SEQ ID NO: 346117 - DNA, 15 bp, Homo sapiens
tccaaattttcttgg

SEQ ID NO: 346118 - DNA, 15 bp, Homo sapiens
ccaaattttcttgga

SEQ ID NO: 346119 - DNA, 15 bp, Homo sapiens
caaattttcttggat

SEQ ID NO: 346120 - DNA, 15 bp, Homo sapiens
aaattttcttggatg

SEQ ID NO: 346121 - DNA, 15 bp, Homo sapiens
aattttcttggatga

SEQ ID NO: 346122 - DNA, 15 bp, Homo sapiens
attttcttggatgat

SEQ ID NO: 346123 - DNA, 15 bp, Homo sapiens
ttttcttggatgatt

SEQ ID NO: 346124 - DNA, 15 bp, Homo sapiens
tttcttggatgattt

SEQ ID NO: 346125 - DNA, 15 bp, Homo sapiens
ttcttggatgatttt

SEQ ID NO: 346126 - DNA, 15 bp, Homo sapiens
tcttggatgatttta

SEQ ID NO: 346127 - DNA, 15 bp, Homo sapiens
cttggatgattttat

SEQ ID NO: 346128 - DNA, 15 bp, Homo sapiens
ttggatgattttatt

SEQ ID NO: 346129 - DNA, 15 bp, Homo sapiens
tggatgattttattt

SEQ ID NO: 346130 - DNA, 15 bp, Homo sapiens
ggatgattttattta

SEQ ID NO: 346131 - DNA, 15 bp, Homo sapiens
gatgattttatttat

SEQ ID NO: 346132 - DNA, 15 bp, Homo sapiens
atgattttatttatc

SEQ ID NO: 346133 - DNA, 15 bp, Homo sapiens
tgattttatttatcc

SEQ ID NO: 346134 - DNA, 15 bp, Homo sapiens
gattttatttatcct

SEQ ID NO: 346135 - DNA, 15 bp, Homo sapiens
attttatttatcctg

SEQ ID NO: 346136 - DNA, 15 bp, Homo sapiens
ttttatttatcctgt

SEQ ID NO: 346137 - DNA, 15 bp, Homo sapiens
tttatttatcctgtg

SEQ ID NO: 346138 - DNA, 15 bp, Homo sapiens
ttatttatcctgtgt

SEQ ID NO: 346139 - DNA, 15 bp, Homo sapiens
tatttatcctgtgtt

SEQ ID NO: 346140 - DNA, 15 bp, Homo sapiens
atttatcctgtgttc

SEQ ID NO: 346141 - DNA, 15 bp, Homo sapiens
tttatcctgtgttca

SEQ ID NO: 346142 - DNA, 15 bp, Homo sapiens
ttatcctgtgttcaa

SEQ ID NO: 346143 - DNA, 15 bp, Homo sapiens
tatcctgtgttcaat

SEQ ID NO: 346144 - DNA, 15 bp, Homo sapiens
atcctgtgttcaatt

SEQ ID NO: 346145 - DNA, 15 bp, Homo sapiens
tcctgtgttcaattg

SEQ ID NO: 346146 - DNA, 15 bp, Homo sapiens
cctgtgttcaattgg

SEQ ID NO: 346147 - DNA, 15 bp, Homo sapiens
ctgtgttcaattggg

SEQ ID NO: 346148 - DNA, 15 bp, Homo sapiens
tgtgttcaattggga

SEQ ID NO: 346149 - DNA, 15 bp, Homo sapiens
gtgttcaattgggag

SEQ ID NO: 346150 - DNA, 15 bp, Homo sapiens
tgttcaattgggaga

SEQ ID NO: 346151 - DNA, 15 bp, Homo sapiens
gttcaattgggagaa

SEQ ID NO: 346152 - DNA, 15 bp, Homo sapiens
ttcaattgggagaac

SEQ ID NO: 346153 - DNA, 15 bp, Homo sapiens
tcaattgggagaact

SEQ ID NO: 346154 - DNA, 15 bp, Homo sapiens
caattgggagaactt

SEQ ID NO: 346155 - DNA, 15 bp, Homo sapiens
aattgggagaacttt

SEQ ID NO: 346156 - DNA, 15 bp, Homo sapiens
attgggagaactttg

SEQ ID NO: 346157 - DNA, 15 bp, Homo sapiens
ttgggagaactttgt

SEQ ID NO: 346158 - DNA, 15 bp, Homo sapiens
tgggagaactttgtg

SEQ ID NO: 346159 - DNA, 15 bp, Homo sapiens
gggagaactttgtga

SEQ ID NO: 346160 - DNA, 15 bp, Homo sapiens
ggagaactttgtgat

SEQ ID NO: 346161 - DNA, 15 bp, Homo sapiens
gagaactttgtgatc

SEQ ID NO: 346162 - DNA, 15 bp, Homo sapiens
agaactttgtgatcg

SEQ ID NO: 346163 - DNA, 15 bp, Homo sapiens
gaactttgtgatcga

SEQ ID NO: 346164 - DNA, 15 bp, Homo sapiens
aactttgtgatcgaa

SEQ ID NO: 346165 - DNA, 15 bp, Homo sapiens
actttgtgatcgaag

SEQ ID NO: 346166 - DNA, 15 bp, Homo sapiens
ctttgtgatcgaagc

SEQ ID NO: 346167 - DNA, 15 bp, Homo sapiens
tttgtgatcgaagct

SEQ ID NO: 346168 - DNA, 15 bp, Homo sapiens
ttgtgatcgaagctt

SEQ ID NO: 346169 - DNA, 15 bp, Homo sapiens
tgtgatcgaagcttt

SEQ ID NO: 346170 - DNA, 15 bp, Homo sapiens
gtgatcgaagctttc

SEQ ID NO: 346171 - DNA, 15 bp, Homo sapiens
tgatcgaagctttct

SEQ ID NO: 346172 - DNA, 15 bp, Homo sapiens
gatcgaagctttctt

SEQ ID NO: 346173 - DNA, 15 bp, Homo sapiens
atcgaagctttcttt

SEQ ID NO: 346174 - DNA, 15 bp, Homo sapiens
tcgaagctttctttc

SEQ ID NO: 346175 - DNA, 15 bp, Homo sapiens
cgaagctttctttct

SEQ ID NO: 346176 - DNA, 15 bp, Homo sapiens
gaagctttctttctt

SEQ ID NO: 346177 - DNA, 15 bp, Homo sapiens
aagctttctttcttc

SEQ ID NO: 346178 - DNA, 15 bp, Homo sapiens
agctttctttcttcc

SEQ ID NO: 346179 - DNA, 15 bp, Homo sapiens
gctttctttcttcct

SEQ ID NO: 346180 - DNA, 15 bp, Homo sapiens
ctttctttcttcctt

SEQ ID NO: 346181 - DNA, 15 bp, Homo sapiens
tttctttcttccttt

SEQ ID NO: 346182 - DNA, 15 bp, Homo sapiens
ttctttcttcctttc

SEQ ID NO: 346183 - DNA, 15 bp, Homo sapiens
tctttcttcctttcc

SEQ ID NO: 346184 - DNA, 15 bp, Homo sapiens
ctttcttcctttccc

SEQ ID NO: 346185 - DNA, 15 bp, Homo sapiens
tttcttcctttccca

SEQ ID NO: 346186 - DNA, 15 bp, Homo sapiens
ttcttcctttcccat

SEQ ID NO: 346187 - DNA, 15 bp, Homo sapiens
tcttcctttcccatt

SEQ ID NO: 346188 - DNA, 15 bp, Homo sapiens
cttcctttcccatta

SEQ ID NO: 346189 - DNA, 15 bp, Homo sapiens
ttcctttcccattat

SEQ ID NO: 346190 - DNA, 15 bp, Homo sapiens
tcctttcccattatt

SEQ ID NO: 346191 - DNA, 15 bp, Homo sapiens
cctttcccattattc

SEQ ID NO: 346192 - DNA, 15 bp, Homo sapiens
ctttcccattattct

SEQ ID NO: 346193 - DNA, 15 bp, Homo sapiens
tttcccattattctc

SEQ ID NO: 346194 - DNA, 15 bp, Homo sapiens
ttcccattattctcc

SEQ ID NO: 346195 - DNA, 15 bp, Homo sapiens
tcccattattctcct

SEQ ID NO: 346196 - DNA, 15 bp, Homo sapiens
cccattattctcctt

SEQ ID NO: 346197 - DNA, 15 bp, Homo sapiens
ccattattctccttg

SEQ ID NO: 346198 - DNA, 15 bp, Homo sapiens
cattattctccttgg

SEQ ID NO: 346199 - DNA, 15 bp, Homo sapiens
attattctccttgga

SEQ ID NO: 346200 - DNA, 15 bp, Homo sapiens
ttattctccttggaa

SEQ ID NO: 346201 - DNA, 15 bp, Homo sapiens
tattctccttggaag

SEQ ID NO: 346202 - DNA, 15 bp, Homo sapiens
attctccttggaagg

SEQ ID NO: 346203 - DNA, 15 bp, Homo sapiens
ttctccttggaagga

SEQ ID NO: 346204 - DNA, 15 bp, Homo sapiens
tctccttggaaggat

SEQ ID NO: 346205 - DNA, 15 bp, Homo sapiens
ctccttggaaggata

SEQ ID NO: 346206 - DNA, 15 bp, Homo sapiens
tccttggaaggatat

SEQ ID NO: 346207 - DNA, 15 bp, Homo sapiens
ccttggaaggatatg

SEQ ID NO: 346208 - DNA, 15 bp, Homo sapiens
cttggaaggatatga

SEQ ID NO: 346209 - DNA, 15 bp, Homo sapiens
ttggaaggatatgat

SEQ ID NO: 346210 - DNA, 15 bp, Homo sapiens
tggaaggatatgatt

SEQ ID NO: 346211 - DNA, 15 bp, Homo sapiens
ggaaggatatgattg

SEQ ID NO: 346212 - DNA, 15 bp, Homo sapiens
gaaggatatgattgt

SEQ ID NO: 346213 - DNA, 15 bp, Homo sapiens
aaggatatgattgtc

SEQ ID NO: 346214 - DNA, 15 bp, Homo sapiens
aggatatgattgtcc

SEQ ID NO: 346215 - DNA, 15 bp, Homo sapiens
ggatatgattgtcca

SEQ ID NO: 346216 - DNA, 15 bp, Homo sapiens
gatatgattgtccat

SEQ ID NO: 346217 - DNA, 15 bp, Homo sapiens
atatgattgtccatg

SEQ ID NO: 346218 - DNA, 15 bp, Homo sapiens
tatgattgtccatga

SEQ ID NO: 346219 - DNA, 15 bp, Homo sapiens
atgattgtccatgac

SEQ ID NO: 346220 - DNA, 15 bp, Homo sapiens
tgattgtccatgact

SEQ ID NO: 346221 - DNA, 15 bp, Homo sapiens
gattgtccatgactg

SEQ ID NO: 346222 - DNA, 15 bp, Homo sapiens
attgtccatgactgt

SEQ ID NO: 346223 - DNA, 15 bp, Homo sapiens
ttgtccatgactgtc

SEQ ID NO: 346224 - DNA, 15 bp, Homo sapiens
tgtccatgactgtct

SEQ ID NO: 346225 - DNA, 15 bp, Homo sapiens
gtccatgactgtctt

SEQ ID NO: 346226 - DNA, 15 bp, Homo sapiens
tccatgactgtcttt

SEQ ID NO: 346227 - DNA, 15 bp, Homo sapiens
ccatgactgtctttt

SEQ ID NO: 346228 - DNA, 15 bp, Homo sapiens
catgactgtcttttt

SEQ ID NO: 346229 - DNA, 15 bp, Homo sapiens
atgactgtcttttta

SEQ ID NO: 346230 - DNA, 15 bp, Homo sapiens
tgactgtctttttat

SEQ ID NO: 346231 - DNA, 15 bp, Homo sapiens
gactgtctttttatt

SEQ ID NO: 346232 - DNA, 15 bp, Homo sapiens
actgtctttttattc

SEQ ID NO: 346233 - DNA, 15 bp, Homo sapiens
ctgtctttttattct

SEQ ID NO: 346234 - DNA, 15 bp, Homo sapiens
tgtctttttattctt

SEQ ID NO: 346235 - DNA, 15 bp, Homo sapiens
gtctttttattcttt

SEQ ID NO: 346236 - DNA, 15 bp, Homo sapiens
tctttttattctttc

SEQ ID NO: 346237 - DNA, 15 bp, Homo sapiens
ctttttattctttct

SEQ ID NO: 346238 - DNA, 15 bp, Homo sapiens
tttttattctttctt

SEQ ID NO: 346239 - DNA, 15 bp, Homo sapiens
ttttattctttcttt

SEQ ID NO: 346240 - DNA, 15 bp, Homo sapiens
tttattctttctttc

SEQ ID NO: 346241 - DNA, 15 bp, Homo sapiens
ttattctttctttca

SEQ ID NO: 346242 - DNA, 15 bp, Homo sapiens
tattctttctttcac

SEQ ID NO: 346243 - DNA, 15 bp, Homo sapiens
attctttctttcact

SEQ ID NO: 346244 - DNA, 15 bp, Homo sapiens
ttctttctttcactg

SEQ ID NO: 346245 - DNA, 15 bp, Homo sapiens
tctttctttcactgt

SEQ ID NO: 346246 - DNA, 15 bp, Homo sapiens
ctttctttcactgtc

SEQ ID NO: 346247 - DNA, 15 bp, Homo sapiens
tttctttcactgtca

SEQ ID NO: 346248 - DNA, 15 bp, Homo sapiens
ttctttcactgtcac

SEQ ID NO: 346249 - DNA, 15 bp, Homo sapiens
tctttcactgtcaca

SEQ ID NO: 346250 - DNA, 15 bp, Homo sapiens
ctttcactgtcacaa

SEQ ID NO: 346251 - DNA, 15 bp, Homo sapiens
tttcactgtcacaac

SEQ ID NO: 346252 - DNA, 15 bp, Homo sapiens
ttcactgtcacaact

SEQ ID NO: 346253 - DNA, 15 bp, Homo sapiens
tcactgtcacaactc

SEQ ID NO: 346254 - DNA, 15 bp, Homo sapiens
cactgtcacaactcg

SEQ ID NO: 346255 - DNA, 15 bp, Homo sapiens
actgtcacaactcga

SEQ ID NO: 346256 - DNA, 15 bp, Homo sapiens
ctgtcacaactcgac

SEQ ID NO: 346257 - DNA, 15 bp, Homo sapiens
tgtcacaactcgaca

SEQ ID NO: 346258 - DNA, 15 bp, Homo sapiens
gtcacaactcgacag

SEQ ID NO: 346259 - DNA, 15 bp, Homo sapiens
tcacaactcgacagt

SEQ ID NO: 346260 - DNA, 15 bp, Homo sapiens
cacaactcgacagtg

SEQ ID NO: 346261 - DNA, 15 bp, Homo sapiens
acaactcgacagtga

SEQ ID NO: 346262 - DNA, 15 bp, Homo sapiens
caactcgacagtgac

SEQ ID NO: 346263 - DNA, 15 bp, Homo sapiens
aactcgacagtgacc

SEQ ID NO: 346264 - DNA, 15 bp, Homo sapiens
actcgacagtgacct

SEQ ID NO: 346265 - DNA, 15 bp, Homo sapiens
ctcgacagtgacctc

SEQ ID NO: 346266 - DNA, 15 bp, Homo sapiens
tcgacagtgacctcc

SEQ ID NO: 346267 - DNA, 15 bp, Homo sapiens
cgacagtgacctcct

SEQ ID NO: 346268 - DNA, 15 bp, Homo sapiens
gacagtgacctcctc

SEQ ID NO: 346269 - DNA, 15 bp, Homo sapiens
acagtgacctcctca

SEQ ID NO: 346270 - DNA, 15 bp, Homo sapiens
cagtgacctcctcag

SEQ ID NO: 346271 - DNA, 15 bp, Homo sapiens
agtgacctcctcagt

SEQ ID NO: 346272 - DNA, 15 bp, Homo sapiens
gtgacctcctcagtc

SEQ ID NO: 346273 - DNA, 15 bp, Homo sapiens
tgacctcctcagtct

SEQ ID NO: 346274 - DNA, 15 bp, Homo sapiens
gacctcctcagtctt

SEQ ID NO: 346275 - DNA, 15 bp, Homo sapiens
acctcctcagtcttt

SEQ ID NO: 346276 - DNA, 15 bp, Homo sapiens
cctcctcagtctttg

SEQ ID NO: 346277 - DNA, 15 bp, Homo sapiens
ctcctcagtctttga

SEQ ID NO: 346278 - DNA, 15 bp, Homo sapiens
tcctcagtctttgaa

SEQ ID NO: 346279 - DNA, 15 bp, Homo sapiens
cctcagtctttgaat

SEQ ID NO: 346280 - DNA, 15 bp, Homo sapiens
ctcagtctttgaata

SEQ ID NO: 346281 - DNA, 15 bp, Homo sapiens
tcagtctttgaatat

SEQ ID NO: 346282 - DNA, 15 bp, Homo sapiens
cagtctttgaatata

SEQ ID NO: 346283 - DNA, 15 bp, Homo sapiens
agtctttgaatatag

SEQ ID NO: 346284 - DNA, 15 bp, Homo sapiens
gtctttgaatatagc

SEQ ID NO: 346285 - DNA, 15 bp, Homo sapiens
tctttgaatatagct

SEQ ID NO: 346286 - DNA, 15 bp, Homo sapiens
ctttgaatatagctt

SEQ ID NO: 346287 - DNA, 15 bp, Homo sapiens
tttgaatatagcttc

SEQ ID NO: 346288 - DNA, 15 bp, Homo sapiens
ttgaatatagcttcc

SEQ ID NO: 346289 - DNA, 15 bp, Homo sapiens
tgaatatagcttccc

SEQ ID NO: 346290 - DNA, 15 bp, Homo sapiens
gaatatagcttcccc

SEQ ID NO: 346291 - DNA, 15 bp, Homo sapiens
aatatagcttcccca

SEQ ID NO: 346292 - DNA, 15 bp, Homo sapiens
atatagcttccccag

SEQ ID NO: 346293 - DNA, 15 bp, Homo sapiens
tatagcttccccagt

SEQ ID NO: 346294 - DNA, 15 bp, Homo sapiens
atagcttccccagtt

SEQ ID NO: 346295 - DNA, 15 bp, Homo sapiens
tagcttccccagttt

SEQ ID NO: 346296 - DNA, 15 bp, Homo sapiens
agcttccccagtttt

SEQ ID NO: 346297 - DNA, 15 bp, Homo sapiens
gcttccccagttttt

SEQ ID NO: 346298 - DNA, 15 bp, Homo sapiens
cttccccagttttta

SEQ ID NO: 346299 - DNA, 15 bp, Homo sapiens
ttccccagtttttat

SEQ ID NO: 346300 - DNA, 15 bp, Homo sapiens
tccccagtttttatt

SEQ ID NO: 346301 - DNA, 15 bp, Homo sapiens
ccccagtttttattg

SEQ ID NO: 346302 - DNA, 15 bp, Homo sapiens
cccagtttttattgt

SEQ ID NO: 346303 - DNA, 15 bp, Homo sapiens
ccagtttttattgtc

SEQ ID NO: 346304 - DNA, 15 bp, Homo sapiens
cagtttttattgtca

SEQ ID NO: 346305 - DNA, 15 bp, Homo sapiens
agtttttattgtcag

SEQ ID NO: 346306 - DNA, 15 bp, Homo sapiens
gtttttattgtcaga

SEQ ID NO: 346307 - DNA, 15 bp, Homo sapiens
tttttattgtcagaa

SEQ ID NO: 346308 - DNA, 15 bp, Homo sapiens
ttttattgtcagaaa

SEQ ID NO: 346309 - DNA, 15 bp, Homo sapiens
tttattgtcagaaag

SEQ ID NO: 346310 - DNA, 15 bp, Homo sapiens
ttattgtcagaaagt

SEQ ID NO: 346311 - DNA, 15 bp, Homo sapiens
tattgtcagaaagtg

SEQ ID NO: 346312 - DNA, 15 bp, Homo sapiens
attgtcagaaagtgc

SEQ ID NO: 346313 - DNA, 15 bp, Homo sapiens
ttgtcagaaagtgca

SEQ ID NO: 346314 - DNA, 15 bp, Homo sapiens
tgtcagaaagtgcag

SEQ ID NO: 346315 - DNA, 15 bp, Homo sapiens
gtcagaaagtgcagg

SEQ ID NO: 346316 - DNA, 15 bp, Homo sapiens
tcagaaagtgcaggg

SEQ ID NO: 346317 - DNA, 15 bp, Homo sapiens
cagaaagtgcagggg

SEQ ID NO: 346318 - DNA, 15 bp, Homo sapiens
agaaagtgcagggga

SEQ ID NO: 346319 - DNA, 15 bp, Homo sapiens
gaaagtgcaggggat

SEQ ID NO: 346320 - DNA, 15 bp, Homo sapiens
aaagtgcaggggatc

SEQ ID NO: 346321 - DNA, 15 bp, Homo sapiens
aagtgcaggggatcc

SEQ ID NO: 346322 - DNA, 15 bp, Homo sapiens
agtgcaggggatcct

SEQ ID NO: 346323 - DNA, 15 bp, Homo sapiens
gtgcaggggatcctt

SEQ ID NO: 346324 - DNA, 15 bp, Homo sapiens
tgcaggggatcctta

SEQ ID NO: 346325 - DNA, 15 bp, Homo sapiens
gcaggggatccttaa

SEQ ID NO: 346326 - DNA, 15 bp, Homo sapiens
caggggatccttaac

SEQ ID NO: 346327 - DNA, 15 bp, Homo sapiens
aggggatccttaacc

SEQ ID NO: 346328 - DNA, 15 bp, Homo sapiens
ggggatccttaacca

SEQ ID NO: 346329 - DNA, 15 bp, Homo sapiens
gggatccttaaccat

SEQ ID NO: 346330 - DNA, 15 bp, Homo sapiens
ggatccttaaccatt

SEQ ID NO: 346331 - DNA, 15 bp, Homo sapiens
gatccttaaccattc

SEQ ID NO: 346332 - DNA, 15 bp, Homo sapiens
atccttaaccattcc

SEQ ID NO: 346333 - DNA, 15 bp, Homo sapiens
ggtcctatgttttgt

SEQ ID NO: 346334 - DNA, 15 bp, Homo sapiens
gtcctatgttttgta

SEQ ID NO: 346335 - DNA, 15 bp, Homo sapiens
tcctatgttttgtaa

SEQ ID NO: 346336 - DNA, 15 bp, Homo sapiens
cctatgttttgtaaa

SEQ ID NO: 346337 - DNA, 15 bp, Homo sapiens
ctatgttttgtaaac

SEQ ID NO: 346338 - DNA, 15 bp, Homo sapiens
tatgttttgtaaacg

SEQ ID NO: 346339 - DNA, 15 bp, Homo sapiens
atgttttgtaaacgt

SEQ ID NO: 346340 - DNA, 15 bp, Homo sapiens
tgttttgtaaacgtt

SEQ ID NO: 346341 - DNA, 15 bp, Homo sapiens
gttttgtaaacgttt

SEQ ID NO: 346342 - DNA, 15 bp, Homo sapiens
ttttgtaaacgtttc

SEQ ID NO: 346343 - DNA, 15 bp, Homo sapiens
tttgtaaacgtttcc

SEQ ID NO: 346344 - DNA, 15 bp, Homo sapiens
ttgtaaacgtttccc

SEQ ID NO: 346345 - DNA, 15 bp, Homo sapiens
tgtaaacgtttccct

SEQ ID NO: 346346 - DNA, 15 bp, Homo sapiens
gtaaacgtttccctt

SEQ ID NO: 346347 - DNA, 15 bp, Homo sapiens
taaacgtttcccttg

SEQ ID NO: 346348 - DNA, 15 bp, Homo sapiens
aaacgtttcccttga

SEQ ID NO: 346349 - DNA, 15 bp, Homo sapiens
aacgtttcccttgat

SEQ ID NO: 346350 - DNA, 15 bp, Homo sapiens
acgtttcccttgatt

SEQ ID NO: 346351 - DNA, 15 bp, Homo sapiens
cgtttcccttgattc

SEQ ID NO: 346352 - DNA, 15 bp, Homo sapiens
gtttcccttgattcc

SEQ ID NO: 346353 - DNA, 15 bp, Homo sapiens
tttcccttgattcca

SEQ ID NO: 346354 - DNA, 15 bp, Homo sapiens
ttcccttgattccaa

SEQ ID NO: 346355 - DNA, 15 bp, Homo sapiens
tcccttgattccaat

SEQ ID NO: 346356 - DNA, 15 bp, Homo sapiens
cccttgattccaata

SEQ ID NO: 346357 - DNA, 15 bp, Homo sapiens
ccttgattccaatag

SEQ ID NO: 346358 - DNA, 15 bp, Homo sapiens
cttgattccaatagt

SEQ ID NO: 346359 - DNA, 15 bp, Homo sapiens
ttgattccaatagtg

SEQ ID NO: 346360 - DNA, 15 bp, Homo sapiens
tgattccaatagtga

SEQ ID NO: 346361 - DNA, 15 bp, Homo sapiens
gattccaatagtgat

SEQ ID NO: 346362 - DNA, 15 bp, Homo sapiens
attccaatagtgata

SEQ ID NO: 346363 - DNA, 15 bp, Homo sapiens
ttccaatagtgatag

SEQ ID NO: 346364 - DNA, 15 bp, Homo sapiens
tccaatagtgataga

SEQ ID NO: 346365 - DNA, 15 bp, Homo sapiens
ccaatagtgatagac

SEQ ID NO: 346366 - DNA, 15 bp, Homo sapiens
caatagtgatagact

SEQ ID NO: 346367 - DNA, 15 bp, Homo sapiens
aatagtgatagactg

SEQ ID NO: 346368 - DNA, 15 bp, Homo sapiens
atagtgatagactga

SEQ ID NO: 346369 - DNA, 15 bp, Homo sapiens
tagtgatagactgag

SEQ ID NO: 346370 - DNA, 15 bp, Homo sapiens
agtgatagactgaga

SEQ ID NO: 346371 - DNA, 15 bp, Homo sapiens
gtgatagactgagaa

SEQ ID NO: 346372 - DNA, 15 bp, Homo sapiens
tgatagactgagaag

SEQ ID NO: 346373 - DNA, 15 bp, Homo sapiens
gatagactgagaagt

SEQ ID NO: 346374 - DNA, 15 bp, Homo sapiens
atagactgagaagtg

SEQ ID NO: 346375 - DNA, 15 bp, Homo sapiens
tagactgagaagtgt

SEQ ID NO: 346376 - DNA, 15 bp, Homo sapiens
agactgagaagtgta

SEQ ID NO: 346377 - DNA, 15 bp, Homo sapiens
gactgagaagtgtaa

SEQ ID NO: 346378 - DNA, 15 bp, Homo sapiens
actgagaagtgtaaa

SEQ ID NO: 346379 - DNA, 15 bp, Homo sapiens
ctgagaagtgtaaag

SEQ ID NO: 346380 - DNA, 15 bp, Homo sapiens
tgagaagtgtaaagt

SEQ ID NO: 346381 - DNA, 15 bp, Homo sapiens
gagaagtgtaaagtc

SEQ ID NO: 346382 - DNA, 15 bp, Homo sapiens
agaagtgtaaagtca

SEQ ID NO: 346383 - DNA, 15 bp, Homo sapiens
gaagtgtaaagtcaa

SEQ ID NO: 346384 - DNA, 15 bp, Homo sapiens
aagtgtaaagtcaag

SEQ ID NO: 346385 - DNA, 15 bp, Homo sapiens
agtgtaaagtcaagt

SEQ ID NO: 346386 - DNA, 15 bp, Homo sapiens
gtgtaaagtcaagtg

SEQ ID NO: 346387 - DNA, 15 bp, Homo sapiens
tgtaaagtcaagtga

SEQ ID NO: 346388 - DNA, 15 bp, Homo sapiens
gtaaagtcaagtgag

SEQ ID NO: 346389 - DNA, 15 bp, Homo sapiens
taaagtcaagtgaga

SEQ ID NO: 346390 - DNA, 15 bp, Homo sapiens
aaagtcaagtgagac

SEQ ID NO: 346391 - DNA, 15 bp, Homo sapiens
aagtcaagtgagact

SEQ ID NO: 346392 - DNA, 15 bp, Homo sapiens
agtcaagtgagactg

SEQ ID NO: 346393 - DNA, 15 bp, Homo sapiens
gtcaagtgagactga

SEQ ID NO: 346394 - DNA, 15 bp, Homo sapiens
tcaagtgagactgag

SEQ ID NO: 346395 - DNA, 15 bp, Homo sapiens
caagtgagactgagt

SEQ ID NO: 346396 - DNA, 15 bp, Homo sapiens
aagtgagactgagtg

SEQ ID NO: 346397 - DNA, 15 bp, Homo sapiens
agtgagactgagtgg

SEQ ID NO: 346398 - DNA, 15 bp, Homo sapiens
gtgagactgagtggc

SEQ ID NO: 346399 - DNA, 15 bp, Homo sapiens
tgagactgagtggca

SEQ ID NO: 346400 - DNA, 15 bp, Homo sapiens
gagactgagtggcag

SEQ ID NO: 346401 - DNA, 15 bp, Homo sapiens
agactgagtggcagg

SEQ ID NO: 346402 - DNA, 15 bp, Homo sapiens
gactgagtggcagga

SEQ ID NO: 346403 - DNA, 15 bp, Homo sapiens
actgagtggcaggaa

SEQ ID NO: 346404 - DNA, 15 bp, Homo sapiens
ctgagtggcaggaat

SEQ ID NO: 346405 - DNA, 15 bp, Homo sapiens
tgagtggcaggaatg

SEQ ID NO: 346406 - DNA, 15 bp, Homo sapiens
gagtggcaggaatgt

SEQ ID NO: 346407 - DNA, 15 bp, Homo sapiens
agtggcaggaatgtg

SEQ ID NO: 346408 - DNA, 15 bp, Homo sapiens
gtggcaggaatgtgt

SEQ ID NO: 346409 - DNA, 15 bp, Homo sapiens
tggcaggaatgtgtt

SEQ ID NO: 346410 - DNA, 15 bp, Homo sapiens
ggcaggaatgtgttc

SEQ ID NO: 346411 - DNA, 15 bp, Homo sapiens
gcaggaatgtgttct

SEQ ID NO: 346412 - DNA, 15 bp, Homo sapiens
caggaatgtgttcta

SEQ ID NO: 346413 - DNA, 15 bp, Homo sapiens
aggaatgtgttctat

SEQ ID NO: 346414 - DNA, 15 bp, Homo sapiens
ggaatgtgttctatg

SEQ ID NO: 346415 - DNA, 15 bp, Homo sapiens
gaatgtgttctatgt

SEQ ID NO: 346416 - DNA, 15 bp, Homo sapiens
aatgtgttctatgtt

SEQ ID NO: 346417 - DNA, 15 bp, Homo sapiens
atgtgttctatgttc

SEQ ID NO: 346418 - DNA, 15 bp, Homo sapiens
tgtgttctatgttct

SEQ ID NO: 346419 - DNA, 15 bp, Homo sapiens
gtgttctatgttctc

SEQ ID NO: 346420 - DNA, 15 bp, Homo sapiens
tgttctatgttctcc

SEQ ID NO: 346421 - DNA, 15 bp, Homo sapiens
gttctatgttctccc

SEQ ID NO: 346422 - DNA, 15 bp, Homo sapiens
ttctatgttctccct

SEQ ID NO: 346423 - DNA, 15 bp, Homo sapiens
tctatgttctccctt

SEQ ID NO: 346424 - DNA, 15 bp, Homo sapiens
ctatgttctcccttt

SEQ ID NO: 346425 - DNA, 15 bp, Homo sapiens
tatgttctccctttt

SEQ ID NO: 346426 - DNA, 15 bp, Homo sapiens
atgttctccctttta

SEQ ID NO: 346427 - DNA, 15 bp, Homo sapiens
tgttctcccttttag

SEQ ID NO: 346428 - DNA, 15 bp, Homo sapiens
gttctcccttttaga

SEQ ID NO: 346429 - DNA, 15 bp, Homo sapiens
ttctcccttttagac

SEQ ID NO: 346430 - DNA, 15 bp, Homo sapiens
tctcccttttagaca

SEQ ID NO: 346431 - DNA, 15 bp, Homo sapiens
ctcccttttagacaa

SEQ ID NO: 346432 - DNA, 15 bp, Homo sapiens
tcccttttagacaat

SEQ ID NO: 346433 - DNA, 15 bp, Homo sapiens
cccttttagacaatt

SEQ ID NO: 346434 - DNA, 15 bp, Homo sapiens
ccttttagacaatta

SEQ ID NO: 346435 - DNA, 15 bp, Homo sapiens
cttttagacaattaa

SEQ ID NO: 346436 - DNA, 15 bp, Homo sapiens
ttttagacaattaat

SEQ ID NO: 346437 - DNA, 15 bp, Homo sapiens
tttagacaattaata

SEQ ID NO: 346438 - DNA, 15 bp, Homo sapiens
ttagacaattaataa

SEQ ID NO: 346439 - DNA, 15 bp, Homo sapiens
tagacaattaataaa

SEQ ID NO: 346440 - DNA, 15 bp, Homo sapiens
agacaattaataaag

SEQ ID NO: 346441 - DNA, 15 bp, Homo sapiens
gacaattaataaagt

SEQ ID NO: 346442 - DNA, 15 bp, Homo sapiens
acaattaataaagtg

SEQ ID NO: 346443 - DNA, 15 bp, Homo sapiens
caattaataaagtga

SEQ ID NO: 346444 - DNA, 15 bp, Homo sapiens
aattaataaagtgat

SEQ ID NO: 346445 - DNA, 15 bp, Homo sapiens
attaataaagtgatc

SEQ ID NO: 346446 - DNA, 15 bp, Homo sapiens
ttaataaagtgatct

SEQ ID NO: 346447 - DNA, 15 bp, Homo sapiens
taataaagtgatctt

SEQ ID NO: 346448 - DNA, 15 bp, Homo sapiens
aataaagtgatcttc

SEQ ID NO: 346449 - DNA, 15 bp, Homo sapiens
ataaagtgatcttct

SEQ ID NO: 346450 - DNA, 15 bp, Homo sapiens
taaagtgatcttctg

SEQ ID NO: 346451 - DNA, 15 bp, Homo sapiens
aaagtgatcttctgt

SEQ ID NO: 346452 - DNA, 15 bp, Homo sapiens
aagtgatcttctgtt

SEQ ID NO: 346453 - DNA, 15 bp, Homo sapiens
agtgatcttctgttg

SEQ ID NO: 346454 - DNA, 15 bp, Homo sapiens
gtgatcttctgttga

SEQ ID NO: 346455 - DNA, 15 bp, Homo sapiens
tgatcttctgttgat

SEQ ID NO: 346456 - DNA, 15 bp, Homo sapiens
gatcttctgttgatt

SEQ ID NO: 346457 - DNA, 15 bp, Homo sapiens
atcttctgttgattt

SEQ ID NO: 346458 - DNA, 15 bp, Homo sapiens
tcttctgttgatttt

SEQ ID NO: 346459 - DNA, 15 bp, Homo sapiens
cttctgttgattttg

SEQ ID NO: 346460 - DNA, 15 bp, Homo sapiens
ttctgttgattttgc

SEQ ID NO: 346461 - DNA, 15 bp, Homo sapiens
tctgttgattttgcc

SEQ ID NO: 346462 - DNA, 15 bp, Homo sapiens
ctgttgattttgcct

SEQ ID NO: 346463 - DNA, 15 bp, Homo sapiens
tgttgattttgcctt

SEQ ID NO: 346464 - DNA, 15 bp, Homo sapiens
gttgattttgccttt

SEQ ID NO: 346465 - DNA, 15 bp, Homo sapiens
ttgattttgcctttt

SEQ ID NO: 346466 - DNA, 15 bp, Homo sapiens
tgattttgccttttg

SEQ ID NO: 346467 - DNA, 15 bp, Homo sapiens
gattttgccttttga

SEQ ID NO: 346468 - DNA, 15 bp, Homo sapiens
attttgccttttgac

SEQ ID NO: 346469 - DNA, 15 bp, Homo sapiens
ttttgccttttgact

SEQ ID NO: 346470 - DNA, 15 bp, Homo sapiens
tttgccttttgacta

SEQ ID NO: 346471 - DNA, 15 bp, Homo sapiens
ttgccttttgactag

SEQ ID NO: 346472 - DNA, 15 bp, Homo sapiens
tgccttttgactagt

SEQ ID NO: 346473 - DNA, 15 bp, Homo sapiens
gccttttgactagtc

SEQ ID NO: 346474 - DNA, 15 bp, Homo sapiens
ccttttgactagtca

SEQ ID NO: 346475 - DNA, 15 bp, Homo sapiens
cttttgactagtcac

SEQ ID NO: 346476 - DNA, 15 bp, Homo sapiens
ttttgactagtcacc

SEQ ID NO: 346477 - DNA, 15 bp, Homo sapiens
tttgactagtcacct

SEQ ID NO: 346478 - DNA, 15 bp, Homo sapiens
ttgactagtcacctt

SEQ ID NO: 346479 - DNA, 15 bp, Homo sapiens
tgactagtcaccttc

SEQ ID NO: 346480 - DNA, 15 bp, Homo sapiens
gactagtcaccttct

SEQ ID NO: 346481 - DNA, 15 bp, Homo sapiens
actagtcaccttcta

SEQ ID NO: 346482 - DNA, 15 bp, Homo sapiens
ctagtcaccttctaa

SEQ ID NO: 346483 - DNA, 15 bp, Homo sapiens
tagtcaccttctaag

SEQ ID NO: 346484 - DNA, 15 bp, Homo sapiens
agtcaccttctaaga

SEQ ID NO: 346485 - DNA, 15 bp, Homo sapiens
gtcaccttctaagaa

SEQ ID NO: 346486 - DNA, 15 bp, Homo sapiens
tcaccttctaagaac

SEQ ID NO: 346487 - DNA, 15 bp, Homo sapiens
caccttctaagaact

SEQ ID NO: 346488 - DNA, 15 bp, Homo sapiens
accttctaagaactc

SEQ ID NO: 346489 - DNA, 15 bp, Homo sapiens
ccttctaagaactct

SEQ ID NO: 346490 - DNA, 15 bp, Homo sapiens
cttctaagaactctg

SEQ ID NO: 346491 - DNA, 15 bp, Homo sapiens
ttctaagaactctgt

SEQ ID NO: 346492 - DNA, 15 bp, Homo sapiens
tctaagaactctgtg

SEQ ID NO: 346493 - DNA, 15 bp, Homo sapiens
ctaagaactctgtgt

SEQ ID NO: 346494 - DNA, 15 bp, Homo sapiens
taagaactctgtgtt

SEQ ID NO: 346495 - DNA, 15 bp, Homo sapiens
aagaactctgtgttt

SEQ ID NO: 346496 - DNA, 15 bp, Homo sapiens
agaactctgtgtttt

SEQ ID NO: 346497 - DNA, 15 bp, Homo sapiens
gaactctgtgtttta

SEQ ID NO: 346498 - DNA, 15 bp, Homo sapiens
aactctgtgttttat

SEQ ID NO: 346499 - DNA, 15 bp, Homo sapiens
actctgtgttttata

SEQ ID NO: 346500 - DNA, 15 bp, Homo sapiens
ctctgtgttttatag

SEQ ID NO: 346501 - DNA, 15 bp, Homo sapiens
tctgtgttttataga

SEQ ID NO: 346502 - DNA, 15 bp, Homo sapiens
ctgtgttttatagaa

SEQ ID NO: 346503 - DNA, 15 bp, Homo sapiens
tgtgttttatagaaa

SEQ ID NO: 346504 - DNA, 15 bp, Homo sapiens
gtgttttatagaaat

SEQ ID NO: 346505 - DNA, 15 bp, Homo sapiens
tgttttatagaaata

SEQ ID NO: 346506 - DNA, 15 bp, Homo sapiens
gttttatagaaatag

SEQ ID NO: 346507 - DNA, 15 bp, Homo sapiens
ttttatagaaataga

SEQ ID NO: 346508 - DNA, 15 bp, Homo sapiens
tttatagaaatagaa

SEQ ID NO: 346509 - DNA, 15 bp, Homo sapiens
ttatagaaatagaaa

SEQ ID NO: 346510 - DNA, 15 bp, Homo sapiens
tatagaaatagaaaa

SEQ ID NO: 346511 - DNA, 15 bp, Homo sapiens
atagaaatagaaaat

SEQ ID NO: 346512 - DNA, 15 bp, Homo sapiens
tagaaatagaaaatt

SEQ ID NO: 346513 - DNA, 15 bp, Homo sapiens
agaaatagaaaattt

SEQ ID NO: 346514 - DNA, 15 bp, Homo sapiens
gaaatagaaaatttt

SEQ ID NO: 346515 - DNA, 15 bp, Homo sapiens
aaatagaaaatttta

SEQ ID NO: 346516 - DNA, 15 bp, Homo sapiens
aatagaaaattttaa

SEQ ID NO: 346517 - DNA, 15 bp, Homo sapiens
atagaaaattttaaa

SEQ ID NO: 346518 - DNA, 15 bp, Homo sapiens
tagaaaattttaaac

SEQ ID NO: 346519 - DNA, 15 bp, Homo sapiens
agaaaattttaaact

SEQ ID NO: 346520 - DNA, 15 bp, Homo sapiens
gaaaattttaaactc

SEQ ID NO: 346521 - DNA, 15 bp, Homo sapiens
aaaattttaaactct

SEQ ID NO: 346522 - DNA, 15 bp, Homo sapiens
aaattttaaactctg

SEQ ID NO: 346523 - DNA, 15 bp, Homo sapiens
aattttaaactctgg

SEQ ID NO: 346524 - DNA, 15 bp, Homo sapiens
attttaaactctgga

SEQ ID NO: 346525 - DNA, 15 bp, Homo sapiens
ttttaaactctggat

SEQ ID NO: 346526 - DNA, 15 bp, Homo sapiens
tttaaactctggatc

SEQ ID NO: 346527 - DNA, 15 bp, Homo sapiens
ttaaactctggatct

SEQ ID NO: 346528 - DNA, 15 bp, Homo sapiens
taaactctggatctc

SEQ ID NO: 346529 - DNA, 15 bp, Homo sapiens
aaactctggatctct

SEQ ID NO: 346530 - DNA, 15 bp, Homo sapiens
aactctggatctctg

SEQ ID NO: 346531 - DNA, 15 bp, Homo sapiens
actctggatctctgg

SEQ ID NO: 346532 - DNA, 15 bp, Homo sapiens
ctctggatctctggg

SEQ ID NO: 346533 - DNA, 15 bp, Homo sapiens
tctggatctctggga

SEQ ID NO: 346534 - DNA, 15 bp, Homo sapiens
ctggatctctgggag

SEQ ID NO: 346535 - DNA, 15 bp, Homo sapiens
tggatctctgggagt

SEQ ID NO: 346536 - DNA, 15 bp, Homo sapiens
ggatctctgggagta

SEQ ID NO: 346537 - DNA, 15 bp, Homo sapiens
gatctctgggagtaa

SEQ ID NO: 346538 - DNA, 15 bp, Homo sapiens
atctctgggagtaaa

SEQ ID NO: 346539 - DNA, 15 bp, Homo sapiens
tctctgggagtaaaa

SEQ ID NO: 346540 - DNA, 15 bp, Homo sapiens
ctctgggagtaaaac

SEQ ID NO: 346541 - DNA, 15 bp, Homo sapiens
tctgggagtaaaaca

SEQ ID NO: 346542 - DNA, 15 bp, Homo sapiens
ctgggagtaaaacaa

SEQ ID NO: 346543 - DNA, 15 bp, Homo sapiens
tgggagtaaaacaac

SEQ ID NO: 346544 - DNA, 15 bp, Homo sapiens
gggagtaaaacaact

SEQ ID NO: 346545 - DNA, 15 bp, Homo sapiens
ggagtaaaacaacta

SEQ ID NO: 346546 - DNA, 15 bp, Homo sapiens
gagtaaaacaactat

SEQ ID NO: 346547 - DNA, 15 bp, Homo sapiens
agtaaaacaactatt

SEQ ID NO: 346548 - DNA, 15 bp, Homo sapiens
gtaaaacaactattt

SEQ ID NO: 346549 - DNA, 15 bp, Homo sapiens
taaaacaactatttt

SEQ ID NO: 346550 - DNA, 15 bp, Homo sapiens
aaaacaactattttt

SEQ ID NO: 346551 - DNA, 15 bp, Homo sapiens
aaacaactattttta

SEQ ID NO: 346552 - DNA, 15 bp, Homo sapiens
aacaactatttttaa

SEQ ID NO: 346553 - DNA, 15 bp, Homo sapiens
acaactatttttaaa

SEQ ID NO: 346554 - DNA, 15 bp, Homo sapiens
caactatttttaaag

SEQ ID NO: 346555 - DNA, 15 bp, Homo sapiens
aactatttttaaaga

SEQ ID NO: 346556 - DNA, 15 bp, Homo sapiens
actatttttaaagac

SEQ ID NO: 346557 - DNA, 15 bp, Homo sapiens
ctatttttaaagaca

SEQ ID NO: 346558 - DNA, 15 bp, Homo sapiens
tatttttaaagacaa

SEQ ID NO: 346559 - DNA, 15 bp, Homo sapiens
atttttaaagacaat

SEQ ID NO: 346560 - DNA, 15 bp, Homo sapiens
tttttaaagacaatg

SEQ ID NO: 346561 - DNA, 15 bp, Homo sapiens
tttaaagacaatgtg

SEQ ID NO: 346562 - DNA, 15 bp, Homo sapiens
ttaaagacaatgtgc

SEQ ID NO: 346563 - DNA, 15 bp, Homo sapiens
taaagacaatgtgca

SEQ ID NO: 346564 - DNA, 15 bp, Homo sapiens
aaagacaatgtgcag

SEQ ID NO: 346565 - DNA, 15 bp, Homo sapiens
aagacaatgtgcagt

SEQ ID NO: 346566 - DNA, 15 bp, Homo sapiens
agacaatgtgcagtt

SEQ ID NO: 346567 - DNA, 15 bp, Homo sapiens
gacaatgtgcagttt

SEQ ID NO: 346568 - DNA, 15 bp, Homo sapiens
acaatgtgcagtttt

SEQ ID NO: 346569 - DNA, 15 bp, Homo sapiens
caatgtgcagttttc

SEQ ID NO: 346570 - DNA, 15 bp, Homo sapiens
aatgtgcagttttcc

SEQ ID NO: 346571 - DNA, 15 bp, Homo sapiens
atgtgcagttttcct

SEQ ID NO: 346572 - DNA, 15 bp, Homo sapiens
tgtgcagttttcctt

SEQ ID NO: 346573 - DNA, 15 bp, Homo sapiens
gtgcagttttccttt

SEQ ID NO: 346574 - DNA, 15 bp, Homo sapiens
tgcagttttcctttt

SEQ ID NO: 346575 - DNA, 15 bp, Homo sapiens
gcagttttcctttta

SEQ ID NO: 346576 - DNA, 15 bp, Homo sapiens
cagttttccttttat

SEQ ID NO: 346577 - DNA, 15 bp, Homo sapiens
agttttccttttata

SEQ ID NO: 346578 - DNA, 15 bp, Homo sapiens
gttttccttttataa

SEQ ID NO: 346579 - DNA, 15 bp, Homo sapiens
ttttccttttataag

SEQ ID NO: 346580 - DNA, 15 bp, Homo sapiens
tttccttttataaga

SEQ ID NO: 346581 - DNA, 15 bp, Homo sapiens
ttccttttataagat

SEQ ID NO: 346582 - DNA, 15 bp, Homo sapiens
tccttttataagatg

SEQ ID NO: 346583 - DNA, 15 bp, Homo sapiens
ccttttataagatgt

SEQ ID NO: 346584 - DNA, 15 bp, Homo sapiens
cttttataagatgta

SEQ ID NO: 346585 - DNA, 15 bp, Homo sapiens
ttttataagatgtaa

SEQ ID NO: 346586 - DNA, 15 bp, Homo sapiens
tttataagatgtaaa

SEQ ID NO: 346587 - DNA, 15 bp, Homo sapiens
ttataagatgtaaat

SEQ ID NO: 346588 - DNA, 15 bp, Homo sapiens
tataagatgtaaatt

SEQ ID NO: 346589 - DNA, 15 bp, Homo sapiens
ataagatgtaaattg

SEQ ID NO: 346590 - DNA, 15 bp, Homo sapiens
taagatgtaaattgt

SEQ ID NO: 346591 - DNA, 15 bp, Homo sapiens
aagatgtaaattgtg

SEQ ID NO: 346592 - DNA, 15 bp, Homo sapiens
agatgtaaattgtgt

SEQ ID NO: 346593 - DNA, 15 bp, Homo sapiens
gatgtaaattgtgtt

SEQ ID NO: 346594 - DNA, 15 bp, Homo sapiens
atgtaaattgtgttt

SEQ ID NO: 346595 - DNA, 15 bp, Homo sapiens
tgtaaattgtgtttg

SEQ ID NO: 346596 - DNA, 15 bp, Homo sapiens
gtaaattgtgtttga

SEQ ID NO: 346597 - DNA, 15 bp, Homo sapiens
taaattgtgtttgaa

SEQ ID NO: 346598 - DNA, 15 bp, Homo sapiens
aaattgtgtttgaat

SEQ ID NO: 346599 - DNA, 15 bp, Homo sapiens
aattgtgtttgaatc

SEQ ID NO: 346600 - DNA, 15 bp, Homo sapiens
attgtgtttgaatca

SEQ ID NO: 346601 - DNA, 15 bp, Homo sapiens
ttgtgtttgaatcat

SEQ ID NO: 346602 - DNA, 15 bp, Homo sapiens
tgtgtttgaatcatt

SEQ ID NO: 346603 - DNA, 15 bp, Homo sapiens
gtgtttgaatcatta

SEQ ID NO: 346604 - DNA, 15 bp, Homo sapiens
tgtttgaatcattac

SEQ ID NO: 346605 - DNA, 15 bp, Homo sapiens
gtttgaatcattacc

SEQ ID NO: 346606 - DNA, 15 bp, Homo sapiens
tttgaatcattaccg

SEQ ID NO: 346607 - DNA, 15 bp, Homo sapiens
ttgaatcattaccgg

SEQ ID NO: 346608 - DNA, 15 bp, Homo sapiens
tgaatcattaccggg

SEQ ID NO: 346609 - DNA, 15 bp, Homo sapiens
gaatcattaccgggc

SEQ ID NO: 346610 - DNA, 15 bp, Homo sapiens
aatcattaccgggca

SEQ ID NO: 346611 - DNA, 15 bp, Homo sapiens
atcattaccgggcat

SEQ ID NO: 346612 - DNA, 15 bp, Homo sapiens
tcattaccgggcatc

SEQ ID NO: 346613 - DNA, 15 bp, Homo sapiens
cattaccgggcatca

SEQ ID NO: 346614 - DNA, 15 bp, Homo sapiens
attaccgggcatcac

SEQ ID NO: 346615 - DNA, 15 bp, Homo sapiens
ttaccgggcatcact

SEQ ID NO: 346616 - DNA, 15 bp, Homo sapiens
taccgggcatcactg

SEQ ID NO: 346617 - DNA, 15 bp, Homo sapiens
accgggcatcactgt

SEQ ID NO: 346618 - DNA, 15 bp, Homo sapiens
ccgggcatcactgta

SEQ ID NO: 346619 - DNA, 15 bp, Homo sapiens
cgggcatcactgtaa

SEQ ID NO: 346620 - DNA, 15 bp, Homo sapiens
gggcatcactgtaac

SEQ ID NO: 346621 - DNA, 15 bp, Homo sapiens
ggcatcactgtaacc

SEQ ID NO: 346622 - DNA, 15 bp, Homo sapiens
gcatcactgtaacca

SEQ ID NO: 346623 - DNA, 15 bp, Homo sapiens
catcactgtaaccag

SEQ ID NO: 346624 - DNA, 15 bp, Homo sapiens
atcactgtaaccagc

SEQ ID NO: 346625 - DNA, 15 bp, Homo sapiens
tcactgtaaccagca

SEQ ID NO: 346626 - DNA, 15 bp, Homo sapiens
cactgtaaccagcaa

SEQ ID NO: 346627 - DNA, 15 bp, Homo sapiens
actgtaaccagcaat

SEQ ID NO: 346628 - DNA, 15 bp, Homo sapiens
ctgtaaccagcaata

SEQ ID NO: 346629 - DNA, 15 bp, Homo sapiens
tgtaaccagcaatat

SEQ ID NO: 346630 - DNA, 15 bp, Homo sapiens
gtaaccagcaatatc

SEQ ID NO: 346631 - DNA, 15 bp, Homo sapiens
taaccagcaatatct

SEQ ID NO: 346632 - DNA, 15 bp, Homo sapiens
aaccagcaatatctc

SEQ ID NO: 346633 - DNA, 15 bp, Homo sapiens
accagcaatatctca

SEQ ID NO: 346634 - DNA, 15 bp, Homo sapiens
ccagcaatatctcag

SEQ ID NO: 346635 - DNA, 15 bp, Homo sapiens
cagcaatatctcagg

SEQ ID NO: 346636 - DNA, 15 bp, Homo sapiens
agcaatatctcagga

SEQ ID NO: 346637 - DNA, 15 bp, Homo sapiens
gcaatatctcaggat

SEQ ID NO: 346638 - DNA, 15 bp, Homo sapiens
caatatctcaggatt

SEQ ID NO: 346639 - DNA, 15 bp, Homo sapiens
aatatctcaggatta

SEQ ID NO: 346640 - DNA, 15 bp, Homo sapiens
atatctcaggattag

SEQ ID NO: 346641 - DNA, 15 bp, Homo sapiens
tatctcaggattaga

SEQ ID NO: 346642 - DNA, 15 bp, Homo sapiens
atctcaggattagag

SEQ ID NO: 346643 - DNA, 15 bp, Homo sapiens
tctcaggattagaga

SEQ ID NO: 346644 - DNA, 15 bp, Homo sapiens
ctcaggattagagaa

SEQ ID NO: 346645 - DNA, 15 bp, Homo sapiens
tcaggattagagaaa

SEQ ID NO: 346646 - DNA, 15 bp, Homo sapiens
caggattagagaaag

SEQ ID NO: 346647 - DNA, 15 bp, Homo sapiens
aggattagagaaagg

SEQ ID NO: 346648 - DNA, 15 bp, Homo sapiens
ggattagagaaaggg

SEQ ID NO: 346649 - DNA, 15 bp, Homo sapiens
gattagagaaaggga

SEQ ID NO: 346650 - DNA, 15 bp, Homo sapiens
attagagaaagggag

SEQ ID NO: 346651 - DNA, 15 bp, Homo sapiens
ttagagaaagggaga

SEQ ID NO: 346652 - DNA, 15 bp, Homo sapiens
tagagaaagggagat

SEQ ID NO: 346653 - DNA, 15 bp, Homo sapiens
agagaaagggagatt

SEQ ID NO: 346654 - DNA, 15 bp, Homo sapiens
gagaaagggagattc

SEQ ID NO: 346655 - DNA, 15 bp, Homo sapiens
agaaagggagattca

SEQ ID NO: 346656 - DNA, 15 bp, Homo sapiens
gaaagggagattcag

SEQ ID NO: 346657 - DNA, 15 bp, Homo sapiens
aaagggagattcaga

SEQ ID NO: 346658 - DNA, 15 bp, Homo sapiens
aagggagattcagat

SEQ ID NO: 346659 - DNA, 15 bp, Homo sapiens
agggagattcagatg

SEQ ID NO: 346660 - DNA, 15 bp, Homo sapiens
gggagattcagatgt

SEQ ID NO: 346661 - DNA, 15 bp, Homo sapiens
ggagattcagatgtt

SEQ ID NO: 346662 - DNA, 15 bp, Homo sapiens
gagattcagatgttt

SEQ ID NO: 346663 - DNA, 15 bp, Homo sapiens
agattcagatgttta

SEQ ID NO: 346664 - DNA, 15 bp, Homo sapiens
gattcagatgtttaa

SEQ ID NO: 346665 - DNA, 15 bp, Homo sapiens
attcagatgtttaaa

SEQ ID NO: 346666 - DNA, 15 bp, Homo sapiens
ttcagatgtttaaaa

SEQ ID NO: 346667 - DNA, 15 bp, Homo sapiens
tcagatgtttaaaat

SEQ ID NO: 346668 - DNA, 15 bp, Homo sapiens
cagatgtttaaaatt

SEQ ID NO: 346669 - DNA, 15 bp, Homo sapiens
agatgtttaaaattg

SEQ ID NO: 346670 - DNA, 15 bp, Homo sapiens
gatgtttaaaattgg

SEQ ID NO: 346671 - DNA, 15 bp, Homo sapiens
atgtttaaaattggt

SEQ ID NO: 346672 - DNA, 15 bp, Homo sapiens
tgtttaaaattggtt

SEQ ID NO: 346673 - DNA, 15 bp, Homo sapiens
gtttaaaattggttt

SEQ ID NO: 346674 - DNA, 15 bp, Homo sapiens
tttaaaattggttta

SEQ ID NO: 346675 - DNA, 15 bp, Homo sapiens
ttaaaattggtttaa

SEQ ID NO: 346676 - DNA, 15 bp, Homo sapiens
taaaattggtttaaa

SEQ ID NO: 346677 - DNA, 15 bp, Homo sapiens
aaaattggtttaaag

SEQ ID NO: 346678 - DNA, 15 bp, Homo sapiens
aaattggtttaaaga

SEQ ID NO: 346679 - DNA, 15 bp, Homo sapiens
aattggtttaaagag

SEQ ID NO: 346680 - DNA, 15 bp, Homo sapiens
attggtttaaagagg

SEQ ID NO: 346681 - DNA, 15 bp, Homo sapiens
ttggtttaaagaggc

SEQ ID NO: 346682 - DNA, 15 bp, Homo sapiens
tggtttaaagaggca

SEQ ID NO: 346683 - DNA, 15 bp, Homo sapiens
ggtttaaagaggcaa

SEQ ID NO: 346684 - DNA, 15 bp, Homo sapiens
gtttaaagaggcaaa

SEQ ID NO: 346685 - DNA, 15 bp, Homo sapiens
tttaaagaggcaaaa

SEQ ID NO: 346686 - DNA, 15 bp, Homo sapiens
ttaaagaggcaaaat

SEQ ID NO: 346687 - DNA, 15 bp, Homo sapiens
taaagaggcaaaatg

SEQ ID NO: 346688 - DNA, 15 bp, Homo sapiens
aaagaggcaaaatga

SEQ ID NO: 346689 - DNA, 15 bp, Homo sapiens
aagaggcaaaatgaa

SEQ ID NO: 346690 - DNA, 15 bp, Homo sapiens
agaggcaaaatgaat

SEQ ID NO: 346691 - DNA, 15 bp, Homo sapiens
gaggcaaaatgaatg

SEQ ID NO: 346692 - DNA, 15 bp, Homo sapiens
aggcaaaatgaatgg

SEQ ID NO: 346693 - DNA, 15 bp, Homo sapiens
ggcaaaatgaatggc

SEQ ID NO: 346694 - DNA, 15 bp, Homo sapiens
gcaaaatgaatggct

SEQ ID NO: 346695 - DNA, 15 bp, Homo sapiens
caaaatgaatggctt

SEQ ID NO: 346696 - DNA, 15 bp, Homo sapiens
aaaatgaatggcttg

SEQ ID NO: 346697 - DNA, 15 bp, Homo sapiens
aaatgaatggcttgt

SEQ ID NO: 346698 - DNA, 15 bp, Homo sapiens
aatgaatggcttgta

SEQ ID NO: 346699 - DNA, 15 bp, Homo sapiens
atgaatggcttgtaa

SEQ ID NO: 346700 - DNA, 15 bp, Homo sapiens
tgaatggcttgtaag

SEQ ID NO: 346701 - DNA, 15 bp, Homo sapiens
gaatggcttgtaaga

SEQ ID NO: 346702 - DNA, 15 bp, Homo sapiens
aatggcttgtaagac

SEQ ID NO: 346703 - DNA, 15 bp, Homo sapiens
atggcttgtaagaca

SEQ ID NO: 346704 - DNA, 15 bp, Homo sapiens
tggcttgtaagacat

SEQ ID NO: 346705 - DNA, 15 bp, Homo sapiens
ggcttgtaagacatt

SEQ ID NO: 346706 - DNA, 15 bp, Homo sapiens
gcttgtaagacattg

SEQ ID NO: 346707 - DNA, 15 bp, Homo sapiens
cttgtaagacattgt

SEQ ID NO: 346708 - DNA, 15 bp, Homo sapiens
ttgtaagacattgtc

SEQ ID NO: 346709 - DNA, 15 bp, Homo sapiens
tgtaagacattgtca

SEQ ID NO: 346710 - DNA, 15 bp, Homo sapiens
gtaagacattgtcag

SEQ ID NO: 346711 - DNA, 15 bp, Homo sapiens
taagacattgtcagt

SEQ ID NO: 346712 - DNA, 15 bp, Homo sapiens
aagacattgtcagtg

SEQ ID NO: 346713 - DNA, 15 bp, Homo sapiens
agacattgtcagtga

SEQ ID NO: 346714 - DNA, 15 bp, Homo sapiens
gacattgtcagtgaa

SEQ ID NO: 346715 - DNA, 15 bp, Homo sapiens
acattgtcagtgaaa

SEQ ID NO: 346716 - DNA, 15 bp, Homo sapiens
cattgtcagtgaaaa

SEQ ID NO: 346717 - DNA, 15 bp, Homo sapiens
attgtcagtgaaaaa

SEQ ID NO: 346718 - DNA, 15 bp, Homo sapiens
ttgtcagtgaaaaaa

SEQ ID NO: 346719 - DNA, 15 bp, Homo sapiens
tgtcagtgaaaaaat

SEQ ID NO: 346720 - DNA, 15 bp, Homo sapiens
gtcagtgaaaaaata

SEQ ID NO: 346721 - DNA, 15 bp, Homo sapiens
tcagtgaaaaaataa

SEQ ID NO: 346722 - DNA, 15 bp, Homo sapiens
cagtgaaaaaataac

SEQ ID NO: 346723 - DNA, 15 bp, Homo sapiens
agtgaaaaaataact

SEQ ID NO: 346724 - DNA, 15 bp, Homo sapiens
gtgaaaaaataactg

SEQ ID NO: 346725 - DNA, 15 bp, Homo sapiens
tgaaaaaataactga

SEQ ID NO: 346726 - DNA, 15 bp, Homo sapiens
gaaaaaataactgaa

SEQ ID NO: 346727 - DNA, 15 bp, Homo sapiens
aaaaaataactgaag

SEQ ID NO: 346728 - DNA, 15 bp, Homo sapiens
aaaaataactgaagt

SEQ ID NO: 346729 - DNA, 15 bp, Homo sapiens
aaaataactgaagtt

SEQ ID NO: 346730 - DNA, 15 bp, Homo sapiens
aaataactgaagttg

SEQ ID NO: 346731 - DNA, 15 bp, Homo sapiens
aataactgaagttgt

SEQ ID NO: 346732 - DNA, 15 bp, Homo sapiens
ataactgaagttgtt

SEQ ID NO: 346733 - DNA, 15 bp, Homo sapiens
taactgaagttgttt

SEQ ID NO: 346734 - DNA, 15 bp, Homo sapiens
aactgaagttgtttt

SEQ ID NO: 346735 - DNA, 15 bp, Homo sapiens
actgaagttgtttta

SEQ ID NO: 346736 - DNA, 15 bp, Homo sapiens
ctgaagttgttttaa

SEQ ID NO: 346737 - DNA, 15 bp, Homo sapiens
tgaagttgttttaac

SEQ ID NO: 346738 - DNA, 15 bp, Homo sapiens
gaagttgttttaacc

SEQ ID NO: 346739 - DNA, 15 bp, Homo sapiens
aagttgttttaaccg

SEQ ID NO: 346740 - DNA, 15 bp, Homo sapiens
agttgttttaaccgc

SEQ ID NO: 346741 - DNA, 15 bp, Homo sapiens
gttgttttaaccgcc

SEQ ID NO: 346742 - DNA, 15 bp, Homo sapiens
ttgttttaaccgccc

SEQ ID NO: 346743 - DNA, 15 bp, Homo sapiens
tgttttaaccgccct

SEQ ID NO: 346744 - DNA, 15 bp, Homo sapiens
gttttaaccgccctt

SEQ ID NO: 346745 - DNA, 15 bp, Homo sapiens
ttttaaccgcccttg

SEQ ID NO: 346746 - DNA, 15 bp, Homo sapiens
tttaaccgcccttgt

SEQ ID NO: 346747 - DNA, 15 bp, Homo sapiens
ttaaccgcccttgtt

SEQ ID NO: 346748 - DNA, 15 bp, Homo sapiens
taaccgcccttgttc

SEQ ID NO: 346749 - DNA, 15 bp, Homo sapiens
aaccgcccttgttct

SEQ ID NO: 346750 - DNA, 15 bp, Homo sapiens
accgcccttgttctt

SEQ ID NO: 346751 - DNA, 15 bp, Homo sapiens
ccgcccttgttcttg

SEQ ID NO: 346752 - DNA, 15 bp, Homo sapiens
cgcccttgttcttga

SEQ ID NO: 346753 - DNA, 15 bp, Homo sapiens
gcccttgttcttgaa

SEQ ID NO: 346754 - DNA, 15 bp, Homo sapiens
cccttgttcttgaag

SEQ ID NO: 346755 - DNA, 15 bp, Homo sapiens
ccttgttcttgaagt

SEQ ID NO: 346756 - DNA, 15 bp, Homo sapiens
cttgttcttgaagtg

SEQ ID NO: 346757 - DNA, 15 bp, Homo sapiens
ttgttcttgaagtga

SEQ ID NO: 346758 - DNA, 15 bp, Homo sapiens
tgttcttgaagtgag

SEQ ID NO: 346759 - DNA, 15 bp, Homo sapiens
gttcttgaagtgagc

SEQ ID NO: 346760 - DNA, 15 bp, Homo sapiens
ttcttgaagtgagca

SEQ ID NO: 346761 - DNA, 15 bp, Homo sapiens
tcttgaagtgagcac

SEQ ID NO: 346762 - DNA, 15 bp, Homo sapiens
cttgaagtgagcacc

SEQ ID NO: 346763 - DNA, 15 bp, Homo sapiens
ttgaagtgagcacct

SEQ ID NO: 346764 - DNA, 15 bp, Homo sapiens
tgaagtgagcacctc

SEQ ID NO: 346765 - DNA, 15 bp, Homo sapiens
gaagtgagcacctct

SEQ ID NO: 346766 - DNA, 15 bp, Homo sapiens
aagtgagcacctctt

SEQ ID NO: 346767 - DNA, 15 bp, Homo sapiens
agtgagcacctcttt

SEQ ID NO: 346768 - DNA, 15 bp, Homo sapiens
gtgagcacctctttc

SEQ ID NO: 346769 - DNA, 15 bp, Homo sapiens
tgagcacctctttcc

SEQ ID NO: 346770 - DNA, 15 bp, Homo sapiens
gagcacctctttcca

SEQ ID NO: 346771 - DNA, 15 bp, Homo sapiens
agcacctctttccag

SEQ ID NO: 346772 - DNA, 15 bp, Homo sapiens
gcacctctttccagt

SEQ ID NO: 346773 - DNA, 15 bp, Homo sapiens
cacctctttccagtt

SEQ ID NO: 346774 - DNA, 15 bp, Homo sapiens
acctctttccagttt

SEQ ID NO: 346775 - DNA, 15 bp, Homo sapiens
cctctttccagtttt

SEQ ID NO: 346776 - DNA, 15 bp, Homo sapiens
ctctttccagttttc

SEQ ID NO: 346777 - DNA, 15 bp, Homo sapiens
tctttccagttttct

SEQ ID NO: 346778 - DNA, 15 bp, Homo sapiens
ctttccagttttcta

SEQ ID NO: 346779 - DNA, 15 bp, Homo sapiens
tttccagttttctag

SEQ ID NO: 346780 - DNA, 15 bp, Homo sapiens
ttccagttttctaga

SEQ ID NO: 346781 - DNA, 15 bp, Homo sapiens
tccagttttctagat

SEQ ID NO: 346782 - DNA, 15 bp, Homo sapiens
ccagttttctagatg

SEQ ID NO: 346783 - DNA, 15 bp, Homo sapiens
cagttttctagatga

SEQ ID NO: 346784 - DNA, 15 bp, Homo sapiens
agttttctagatgag

SEQ ID NO: 346785 - DNA, 15 bp, Homo sapiens
gttttctagatgagt

SEQ ID NO: 346786 - DNA, 15 bp, Homo sapiens
ttttctagatgagta

SEQ ID NO: 346787 - DNA, 15 bp, Homo sapiens
tttctagatgagtag

SEQ ID NO: 346788 - DNA, 15 bp, Homo sapiens
ttctagatgagtagt

SEQ ID NO: 346789 - DNA, 15 bp, Homo sapiens
tctagatgagtagtg

SEQ ID NO: 346790 - DNA, 15 bp, Homo sapiens
ctagatgagtagtgg

SEQ ID NO: 346791 - DNA, 15 bp, Homo sapiens
tagatgagtagtggt

SEQ ID NO: 346792 - DNA, 15 bp, Homo sapiens
agatgagtagtggta

SEQ ID NO: 346793 - DNA, 15 bp, Homo sapiens
gatgagtagtggtaa

SEQ ID NO: 346794 - DNA, 15 bp, Homo sapiens
atgagtagtggtaat

SEQ ID NO: 346795 - DNA, 15 bp, Homo sapiens
tgagtagtggtaatt

SEQ ID NO: 346796 - DNA, 15 bp, Homo sapiens
gagtagtggtaattt

SEQ ID NO: 346797 - DNA, 15 bp, Homo sapiens
agtagtggtaatttt

SEQ ID NO: 346798 - DNA, 15 bp, Homo sapiens
gtagtggtaattttc

SEQ ID NO: 346799 - DNA, 15 bp, Homo sapiens
tagtggtaattttcc

SEQ ID NO: 346800 - DNA, 15 bp, Homo sapiens
agtggtaattttcca

SEQ ID NO: 346801 - DNA, 15 bp, Homo sapiens
gtggtaattttccat

SEQ ID NO: 346802 - DNA, 15 bp, Homo sapiens
tggtaattttccatc

SEQ ID NO: 346803 - DNA, 15 bp, Homo sapiens
ggtaattttccatct

SEQ ID NO: 346804 - DNA, 15 bp, Homo sapiens
gtaattttccatctc

SEQ ID NO: 346805 - DNA, 15 bp, Homo sapiens
taattttccatctca

SEQ ID NO: 346806 - DNA, 15 bp, Homo sapiens
aattttccatctcag

SEQ ID NO: 346807 - DNA, 15 bp, Homo sapiens
attttccatctcaga

SEQ ID NO: 346808 - DNA, 15 bp, Homo sapiens
ttttccatctcagaa

SEQ ID NO: 346809 - DNA, 15 bp, Homo sapiens
tttccatctcagaaa

SEQ ID NO: 346810 - DNA, 15 bp, Homo sapiens
ttccatctcagaaat

SEQ ID NO: 346811 - DNA, 15 bp, Homo sapiens
tccatctcagaaatt

SEQ ID NO: 346812 - DNA, 15 bp, Homo sapiens
ccatctcagaaattt

SEQ ID NO: 346813 - DNA, 15 bp, Homo sapiens
catctcagaaatttt

SEQ ID NO: 346814 - DNA, 15 bp, Homo sapiens
atctcagaaatttta

SEQ ID NO: 346815 - DNA, 15 bp, Homo sapiens
tctcagaaattttat

SEQ ID NO: 346816 - DNA, 15 bp, Homo sapiens
ctcagaaattttatt

SEQ ID NO: 346817 - DNA, 15 bp, Homo sapiens
tcagaaattttattt

SEQ ID NO: 346818 - DNA, 15 bp, Homo sapiens
cagaaattttattta

SEQ ID NO: 346819 - DNA, 15 bp, Homo sapiens
agaaattttatttac

SEQ ID NO: 346820 - DNA, 15 bp, Homo sapiens
gaaattttatttacc

SEQ ID NO: 346821 - DNA, 15 bp, Homo sapiens
aaattttatttacct

SEQ ID NO: 346822 - DNA, 15 bp, Homo sapiens
aattttatttaccta

SEQ ID NO: 346823 - DNA, 15 bp, Homo sapiens
attttatttacctac

SEQ ID NO: 346824 - DNA, 15 bp, Homo sapiens
ttttatttacctact

SEQ ID NO: 346825 - DNA, 15 bp, Homo sapiens
tttatttacctactt

SEQ ID NO: 346826 - DNA, 15 bp, Homo sapiens
ttatttacctactta

SEQ ID NO: 346827 - DNA, 15 bp, Homo sapiens
tatttacctacttaa

SEQ ID NO: 346828 - DNA, 15 bp, Homo sapiens
atttacctacttaat

SEQ ID NO: 346829 - DNA, 15 bp, Homo sapiens
tttacctacttaatt

SEQ ID NO: 346830 - DNA, 15 bp, Homo sapiens
ttacctacttaattt

SEQ ID NO: 346831 - DNA, 15 bp, Homo sapiens
tacctacttaatttt

SEQ ID NO: 346832 - DNA, 15 bp, Homo sapiens
acctacttaattttc

SEQ ID NO: 346833 - DNA, 15 bp, Homo sapiens
cctacttaattttct

SEQ ID NO: 346834 - DNA, 15 bp, Homo sapiens
ctacttaattttctt

SEQ ID NO: 346835 - DNA, 15 bp, Homo sapiens
tacttaattttcttc

SEQ ID NO: 346836 - DNA, 15 bp, Homo sapiens
acttaattttcttcc

SEQ ID NO: 346837 - DNA, 15 bp, Homo sapiens
cttaattttcttcct

SEQ ID NO: 346838 - DNA, 15 bp, Homo sapiens
ttaattttcttcctt

SEQ ID NO: 346839 - DNA, 15 bp, Homo sapiens
taattttcttccttg

SEQ ID NO: 346840 - DNA, 15 bp, Homo sapiens
aattttcttccttga

SEQ ID NO: 346841 - DNA, 15 bp, Homo sapiens
attttcttccttgat

SEQ ID NO: 346842 - DNA, 15 bp, Homo sapiens
ttttcttccttgatt

SEQ ID NO: 346843 - DNA, 15 bp, Homo sapiens
tttcttccttgatta

SEQ ID NO: 346844 - DNA, 15 bp, Homo sapiens
ttcttccttgattag

SEQ ID NO: 346845 - DNA, 15 bp, Homo sapiens
tcttccttgattagt

SEQ ID NO: 346846 - DNA, 15 bp, Homo sapiens
cttccttgattagta

SEQ ID NO: 346847 - DNA, 15 bp, Homo sapiens
ttccttgattagtat

SEQ ID NO: 346848 - DNA, 15 bp, Homo sapiens
tccttgattagtatg

SEQ ID NO: 346849 - DNA, 15 bp, Homo sapiens
ccttgattagtatga

SEQ ID NO: 346850 - DNA, 15 bp, Homo sapiens
cttgattagtatgaa

SEQ ID NO: 346851 - DNA, 15 bp, Homo sapiens
ttgattagtatgaat

SEQ ID NO: 346852 - DNA, 15 bp, Homo sapiens
tgattagtatgaatt

SEQ ID NO: 346853 - DNA, 15 bp, Homo sapiens
gattagtatgaattg

SEQ ID NO: 346854 - DNA, 15 bp, Homo sapiens
attagtatgaattgt

SEQ ID NO: 346855 - DNA, 15 bp, Homo sapiens
ttagtatgaattgtc

SEQ ID NO: 346856 - DNA, 15 bp, Homo sapiens
tagtatgaattgtcc

SEQ ID NO: 346857 - DNA, 15 bp, Homo sapiens
agtatgaattgtcca

SEQ ID NO: 346858 - DNA, 15 bp, Homo sapiens
gtatgaattgtccaa

SEQ ID NO: 346859 - DNA, 15 bp, Homo sapiens
tatgaattgtccaac

SEQ ID NO: 346860 - DNA, 15 bp, Homo sapiens
atgaattgtccaaca

SEQ ID NO: 346861 - DNA, 15 bp, Homo sapiens
tgaattgtccaacat

SEQ ID NO: 346862 - DNA, 15 bp, Homo sapiens
gaattgtccaacata

SEQ ID NO: 346863 - DNA, 15 bp, Homo sapiens
aattgtccaacataa

SEQ ID NO: 346864 - DNA, 15 bp, Homo sapiens
attgtccaacataaa

SEQ ID NO: 346865 - DNA, 15 bp, Homo sapiens
ttgtccaacataaag

SEQ ID NO: 346866 - DNA, 15 bp, Homo sapiens
tgtccaacataaaga

SEQ ID NO: 346867 - DNA, 15 bp, Homo sapiens
gtccaacataaagat

SEQ ID NO: 346868 - DNA, 15 bp, Homo sapiens
tccaacataaagatg

SEQ ID NO: 346869 - DNA, 15 bp, Homo sapiens
ccaacataaagatga

SEQ ID NO: 346870 - DNA, 15 bp, Homo sapiens
caacataaagatgat

SEQ ID NO: 346871 - DNA, 15 bp, Homo sapiens
aacataaagatgatg

SEQ ID NO: 346872 - DNA, 15 bp, Homo sapiens
acataaagatgatgt

SEQ ID NO: 346873 - DNA, 15 bp, Homo sapiens
cataaagatgatgtg

SEQ ID NO: 346874 - DNA, 15 bp, Homo sapiens
ataaagatgatgtgg

SEQ ID NO: 346875 - DNA, 15 bp, Homo sapiens
taaagatgatgtggc

SEQ ID NO: 346876 - DNA, 15 bp, Homo sapiens
aaagatgatgtggct

SEQ ID NO: 346877 - DNA, 15 bp, Homo sapiens
aagatgatgtggctg

SEQ ID NO: 346878 - DNA, 15 bp, Homo sapiens
agatgatgtggctgg

SEQ ID NO: 346879 - DNA, 15 bp, Homo sapiens
gatgatgtggctggt

SEQ ID NO: 346880 - DNA, 15 bp, Homo sapiens
atgatgtggctggtg

SEQ ID NO: 346881 - DNA, 15 bp, Homo sapiens
tgatgtggctggtgt

SEQ ID NO: 346882 - DNA, 15 bp, Homo sapiens
gatgtggctggtgtt

SEQ ID NO: 346883 - DNA, 15 bp, Homo sapiens
atgtggctggtgtta

SEQ ID NO: 346884 - DNA, 15 bp, Homo sapiens
tgtggctggtgttac

SEQ ID NO: 346885 - DNA, 15 bp, Homo sapiens
gtggctggtgttact

SEQ ID NO: 346886 - DNA, 15 bp, Homo sapiens
tggctggtgttacta

SEQ ID NO: 346887 - DNA, 15 bp, Homo sapiens
ggctggtgttactat

SEQ ID NO: 346888 - DNA, 15 bp, Homo sapiens
gctggtgttactatt

SEQ ID NO: 346889 - DNA, 15 bp, Homo sapiens
ctggtgttactattc

SEQ ID NO: 346890 - DNA, 15 bp, Homo sapiens
tggtgttactattcc

SEQ ID NO: 346891 - DNA, 15 bp, Homo sapiens
ggtgttactattcct

SEQ ID NO: 346892 - DNA, 15 bp, Homo sapiens
gtgttactattcctt

SEQ ID NO: 346893 - DNA, 15 bp, Homo sapiens
tgttactattccttt

SEQ ID NO: 346894 - DNA, 15 bp, Homo sapiens
gttactattcctttg

SEQ ID NO: 346895 - DNA, 15 bp, Homo sapiens
ttactattcctttgc

SEQ ID NO: 346896 - DNA, 15 bp, Homo sapiens
tactattcctttgcc

SEQ ID NO: 346897 - DNA, 15 bp, Homo sapiens
actattcctttgcct

SEQ ID NO: 346898 - DNA, 15 bp, Homo sapiens
ctattcctttgcctg

SEQ ID NO: 346899 - DNA, 15 bp, Homo sapiens
tattcctttgcctgc

SEQ ID NO: 346900 - DNA, 15 bp, Homo sapiens
attcctttgcctgcc

SEQ ID NO: 346901 - DNA, 15 bp, Homo sapiens
ttcctttgcctgcct

SEQ ID NO: 346902 - DNA, 15 bp, Homo sapiens
tcctttgcctgccta

SEQ ID NO: 346903 - DNA, 15 bp, Homo sapiens
cctttgcctgcctag

SEQ ID NO: 346904 - DNA, 15 bp, Homo sapiens
ctttgcctgcctaga

SEQ ID NO: 346905 - DNA, 15 bp, Homo sapiens
tttgcctgcctagaa

SEQ ID NO: 346906 - DNA, 15 bp, Homo sapiens
ttgcctgcctagaat

SEQ ID NO: 346907 - DNA, 15 bp, Homo sapiens
tgcctgcctagaata

SEQ ID NO: 346908 - DNA, 15 bp, Homo sapiens
gcctgcctagaatag

SEQ ID NO: 346909 - DNA, 15 bp, Homo sapiens
cctgcctagaataga

SEQ ID NO: 346910 - DNA, 15 bp, Homo sapiens
ctgcctagaatagaa

SEQ ID NO: 346911 - DNA, 15 bp, Homo sapiens
tgcctagaatagaaa

SEQ ID NO: 346912 - DNA, 15 bp, Homo sapiens
gcctagaatagaaat

SEQ ID NO: 346913 - DNA, 15 bp, Homo sapiens
cctagaatagaaatg

SEQ ID NO: 346914 - DNA, 15 bp, Homo sapiens
ctagaatagaaatga

SEQ ID NO: 346915 - DNA, 15 bp, Homo sapiens
tagaatagaaatgat

SEQ ID NO: 346916 - DNA, 15 bp, Homo sapiens
agaatagaaatgatg

SEQ ID NO: 346917 - DNA, 15 bp, Homo sapiens
gaatagaaatgatgg

SEQ ID NO: 346918 - DNA, 15 bp, Homo sapiens
aatagaaatgatggg

SEQ ID NO: 346919 - DNA, 15 bp, Homo sapiens
atagaaatgatgggg

SEQ ID NO: 346920 - DNA, 15 bp, Homo sapiens
tagaaatgatggggc

SEQ ID NO: 346921 - DNA, 15 bp, Homo sapiens
agaaatgatggggca

SEQ ID NO: 346922 - DNA, 15 bp, Homo sapiens
gaaatgatggggcag

SEQ ID NO: 346923 - DNA, 15 bp, Homo sapiens
aaatgatggggcagg

SEQ ID NO: 346924 - DNA, 15 bp, Homo sapiens
aatgatggggcaggg

SEQ ID NO: 346925 - DNA, 15 bp, Homo sapiens
atgatggggcagggg

SEQ ID NO: 346926 - DNA, 15 bp, Homo sapiens
tgatggggcaggggc

SEQ ID NO: 346927 - DNA, 15 bp, Homo sapiens
gatggggcaggggca

SEQ ID NO: 346928 - DNA, 15 bp, Homo sapiens
atggggcaggggcat

SEQ ID NO: 346929 - DNA, 15 bp, Homo sapiens
tggggcaggggcatg

SEQ ID NO: 346930 - DNA, 15 bp, Homo sapiens
ggggcaggggcatga

SEQ ID NO: 346931 - DNA, 15 bp, Homo sapiens
gggcaggggcatgac

SEQ ID NO: 346932 - DNA, 15 bp, Homo sapiens
ggcaggggcatgacc

SEQ ID NO: 346933 - DNA, 15 bp, Homo sapiens
gcaggggcatgaccc

SEQ ID NO: 346934 - DNA, 15 bp, Homo sapiens
caggggcatgaccca

SEQ ID NO: 346935 - DNA, 15 bp, Homo sapiens
aggggcatgacccat

SEQ ID NO: 346936 - DNA, 15 bp, Homo sapiens
ggggcatgacccata

SEQ ID NO: 346937 - DNA, 15 bp, Homo sapiens
gggcatgacccatat

SEQ ID NO: 346938 - DNA, 15 bp, Homo sapiens
ggcatgacccatatc

SEQ ID NO: 346939 - DNA, 15 bp, Homo sapiens
gcatgacccatatct

SEQ ID NO: 346940 - DNA, 15 bp, Homo sapiens
catgacccatatctc

SEQ ID NO: 346941 - DNA, 15 bp, Homo sapiens
atgacccatatctcc

SEQ ID NO: 346942 - DNA, 15 bp, Homo sapiens
tgacccatatctcca

SEQ ID NO: 346943 - DNA, 15 bp, Homo sapiens
gacccatatctccat

SEQ ID NO: 346944 - DNA, 15 bp, Homo sapiens
acccatatctccatt

SEQ ID NO: 346945 - DNA, 15 bp, Homo sapiens
cccatatctccattg

SEQ ID NO: 346946 - DNA, 15 bp, Homo sapiens
ccatatctccattgt

SEQ ID NO: 346947 - DNA, 15 bp, Homo sapiens
catatctccattgtt

SEQ ID NO: 346948 - DNA, 15 bp, Homo sapiens
atatctccattgttc

SEQ ID NO: 346949 - DNA, 15 bp, Homo sapiens
tatctccattgttca

SEQ ID NO: 346950 - DNA, 15 bp, Homo sapiens
atctccattgttcat

SEQ ID NO: 346951 - DNA, 15 bp, Homo sapiens
tctccattgttcata

SEQ ID NO: 346952 - DNA, 15 bp, Homo sapiens
ctccattgttcatat

SEQ ID NO: 346953 - DNA, 15 bp, Homo sapiens
tccattgttcatatt

SEQ ID NO: 346954 - DNA, 15 bp, Homo sapiens
ccattgttcatattg

SEQ ID NO: 346955 - DNA, 15 bp, Homo sapiens
cattgttcatattgt

SEQ ID NO: 346956 - DNA, 15 bp, Homo sapiens
attgttcatattgtt

SEQ ID NO: 346957 - DNA, 15 bp, Homo sapiens
ttgttcatattgtta

SEQ ID NO: 346958 - DNA, 15 bp, Homo sapiens
tgttcatattgttag

SEQ ID NO: 346959 - DNA, 15 bp, Homo sapiens
gttcatattgttagg

SEQ ID NO: 346960 - DNA, 15 bp, Homo sapiens
ttcatattgttagga

SEQ ID NO: 346961 - DNA, 15 bp, Homo sapiens
tcatattgttaggaa

SEQ ID NO: 346962 - DNA, 15 bp, Homo sapiens
catattgttaggaaa

SEQ ID NO: 346963 - DNA, 15 bp, Homo sapiens
atattgttaggaaaa

SEQ ID NO: 346964 - DNA, 15 bp, Homo sapiens
tattgttaggaaaat

SEQ ID NO: 346965 - DNA, 15 bp, Homo sapiens
attgttaggaaaatg

SEQ ID NO: 346966 - DNA, 15 bp, Homo sapiens
ttgttaggaaaatgg

SEQ ID NO: 346967 - DNA, 15 bp, Homo sapiens
tgttaggaaaatggt

SEQ ID NO: 346968 - DNA, 15 bp, Homo sapiens
gttaggaaaatggtg

SEQ ID NO: 346969 - DNA, 15 bp, Homo sapiens
ttaggaaaatggtga

SEQ ID NO: 346970 - DNA, 15 bp, Homo sapiens
taggaaaatggtgat

SEQ ID NO: 346971 - DNA, 15 bp, Homo sapiens
aggaaaatggtgatt

SEQ ID NO: 346972 - DNA, 15 bp, Homo sapiens
ggaaaatggtgattt

SEQ ID NO: 346973 - DNA, 15 bp, Homo sapiens
gaaaatggtgatttg

SEQ ID NO: 346974 - DNA, 15 bp, Homo sapiens
aaaatggtgatttgt

SEQ ID NO: 346975 - DNA, 15 bp, Homo sapiens
aaatggtgatttgtt

SEQ ID NO: 346976 - DNA, 15 bp, Homo sapiens
aatggtgatttgttt

SEQ ID NO: 346977 - DNA, 15 bp, Homo sapiens
atggtgatttgtttt

SEQ ID NO: 346978 - DNA, 15 bp, Homo sapiens
tggtgatttgttttg

SEQ ID NO: 346979 - DNA, 15 bp, Homo sapiens
ggtgatttgttttgt

SEQ ID NO: 346980 - DNA, 15 bp, Homo sapiens
gtgatttgttttgta

SEQ ID NO: 346981 - DNA, 15 bp, Homo sapiens
tgatttgttttgtat

SEQ ID NO: 346982 - DNA, 15 bp, Homo sapiens
gatttgttttgtata

SEQ ID NO: 346983 - DNA, 15 bp, Homo sapiens
atttgttttgtatac

SEQ ID NO: 346984 - DNA, 15 bp, Homo sapiens
tttgttttgtatact

SEQ ID NO: 346985 - DNA, 15 bp, Homo sapiens
ttgttttgtatactc

SEQ ID NO: 346986 - DNA, 15 bp, Homo sapiens
tgttttgtatactct

SEQ ID NO: 346987 - DNA, 15 bp, Homo sapiens
gttttgtatactctc

SEQ ID NO: 346988 - DNA, 15 bp, Homo sapiens
ttttgtatactctcc

SEQ ID NO: 346989 - DNA, 15 bp, Homo sapiens
tttgtatactctccc

SEQ ID NO: 346990 - DNA, 15 bp, Homo sapiens
ttgtatactctcccc

SEQ ID NO: 346991 - DNA, 15 bp, Homo sapiens
tgtatactctcccca

SEQ ID NO: 346992 - DNA, 15 bp, Homo sapiens
gtatactctccccat

SEQ ID NO: 346993 - DNA, 15 bp, Homo sapiens
tatactctccccatt

SEQ ID NO: 346994 - DNA, 15 bp, Homo sapiens
atactctccccatta

SEQ ID NO: 346995 - DNA, 15 bp, Homo sapiens
tactctccccattaa

SEQ ID NO: 346996 - DNA, 15 bp, Homo sapiens
actctccccattaac

SEQ ID NO: 346997 - DNA, 15 bp, Homo sapiens
ctctccccattaaca

SEQ ID NO: 346998 - DNA, 15 bp, Homo sapiens
tctccccattaacag

SEQ ID NO: 346999 - DNA, 15 bp, Homo sapiens
ctccccattaacagg

SEQ ID NO: 347000 - DNA, 15 bp, Homo sapiens
tccccattaacaggg

SEQ ID NO: 347001 - DNA, 15 bp, Homo sapiens
ccccattaacagggg

SEQ ID NO: 347002 - DNA, 15 bp, Homo sapiens
cccattaacaggggt

SEQ ID NO: 347003 - DNA, 15 bp, Homo sapiens
ccattaacaggggta

SEQ ID NO: 347004 - DNA, 15 bp, Homo sapiens
cattaacaggggtaa

SEQ ID NO: 347005 - DNA, 15 bp, Homo sapiens
attaacaggggtaat

SEQ ID NO: 347006 - DNA, 15 bp, Homo sapiens
ttaacaggggtaatg

SEQ ID NO: 347007 - DNA, 15 bp, Homo sapiens
taacaggggtaatgc

SEQ ID NO: 347008 - DNA, 15 bp, Homo sapiens
aacaggggtaatgca

SEQ ID NO: 347009 - DNA, 15 bp, Homo sapiens
acaggggtaatgcag

SEQ ID NO: 347010 - DNA, 15 bp, Homo sapiens
caggggtaatgcagc

SEQ ID NO: 347011 - DNA, 15 bp, Homo sapiens
aggggtaatgcagca

SEQ ID NO: 347012 - DNA, 15 bp, Homo sapiens
ggggtaatgcagcat

SEQ ID NO: 347013 - DNA, 15 bp, Homo sapiens
gggtaatgcagcatg

SEQ ID NO: 347014 - DNA, 15 bp, Homo sapiens
ggtaatgcagcatgg

SEQ ID NO: 347015 - DNA, 15 bp, Homo sapiens
gtaatgcagcatggc

SEQ ID NO: 347016 - DNA, 15 bp, Homo sapiens
taatgcagcatggct

SEQ ID NO: 347017 - DNA, 15 bp, Homo sapiens
aatgcagcatggctt

SEQ ID NO: 347018 - DNA, 15 bp, Homo sapiens
atgcagcatggcttg

SEQ ID NO: 347019 - DNA, 15 bp, Homo sapiens
tgcagcatggcttgt

SEQ ID NO: 347020 - DNA, 15 bp, Homo sapiens
gcagcatggcttgtg

SEQ ID NO: 347021 - DNA, 15 bp, Homo sapiens
cagcatggcttgtgg

SEQ ID NO: 347022 - DNA, 15 bp, Homo sapiens
agcatggcttgtggt

SEQ ID NO: 347023 - DNA, 15 bp, Homo sapiens
gcatggcttgtggtg

SEQ ID NO: 347024 - DNA, 15 bp, Homo sapiens
catggcttgtggtgt

SEQ ID NO: 347025 - DNA, 15 bp, Homo sapiens
atggcttgtggtgtg

SEQ ID NO: 347026 - DNA, 15 bp, Homo sapiens
tggcttgtggtgtga

SEQ ID NO: 347027 - DNA, 15 bp, Homo sapiens
ggcttgtggtgtgaa

SEQ ID NO: 347028 - DNA, 15 bp, Homo sapiens
gcttgtggtgtgaat

SEQ ID NO: 347029 - DNA, 15 bp, Homo sapiens
cttgtggtgtgaatg

SEQ ID NO: 347030 - DNA, 15 bp, Homo sapiens
ttgtggtgtgaatgc

SEQ ID NO: 347031 - DNA, 15 bp, Homo sapiens
tgtggtgtgaatgct

SEQ ID NO: 347032 - DNA, 15 bp, Homo sapiens
gtggtgtgaatgctt

SEQ ID NO: 347033 - DNA, 15 bp, Homo sapiens
tggtgtgaatgcttt

SEQ ID NO: 347034 - DNA, 15 bp, Homo sapiens
ggtgtgaatgctttg

SEQ ID NO: 347035 - DNA, 15 bp, Homo sapiens
gtgtgaatgctttgc

SEQ ID NO: 347036 - DNA, 15 bp, Homo sapiens
tgtgaatgctttgct

SEQ ID NO: 347037 - DNA, 15 bp, Homo sapiens
gtgaatgctttgctt

SEQ ID NO: 347038 - DNA, 15 bp, Homo sapiens
tgaatgctttgctta

SEQ ID NO: 347039 - DNA, 15 bp, Homo sapiens
gaatgctttgcttat

SEQ ID NO: 347040 - DNA, 15 bp, Homo sapiens
aatgctttgcttatg

SEQ ID NO: 347041 - DNA, 15 bp, Homo sapiens
atgctttgcttatgt

SEQ ID NO: 347042 - DNA, 15 bp, Homo sapiens
tgctttgcttatgtc

SEQ ID NO: 347043 - DNA, 15 bp, Homo sapiens
gctttgcttatgtct

SEQ ID NO: 347044 - DNA, 15 bp, Homo sapiens
ctttgcttatgtctc

SEQ ID NO: 347045 - DNA, 15 bp, Homo sapiens
tttgcttatgtctca

SEQ ID NO: 347046 - DNA, 15 bp, Homo sapiens
ttgcttatgtctcat

SEQ ID NO: 347047 - DNA, 15 bp, Homo sapiens
tgcttatgtctcata

SEQ ID NO: 347048 - DNA, 15 bp, Homo sapiens
gcttatgtctcatat

SEQ ID NO: 347049 - DNA, 15 bp, Homo sapiens
cttatgtctcatatt

SEQ ID NO: 347050 - DNA, 15 bp, Homo sapiens
ttatgtctcatattc

SEQ ID NO: 347051 - DNA, 15 bp, Homo sapiens
tatgtctcatattct

SEQ ID NO: 347052 - DNA, 15 bp, Homo sapiens
atgtctcatattctc

SEQ ID NO: 347053 - DNA, 15 bp, Homo sapiens
tgtctcatattctct

SEQ ID NO: 347054 - DNA, 15 bp, Homo sapiens
gtctcatattctctt

SEQ ID NO: 347055 - DNA, 15 bp, Homo sapiens
tctcatattctctta

SEQ ID NO: 347056 - DNA, 15 bp, Homo sapiens
ctcatattctcttac

SEQ ID NO: 347057 - DNA, 15 bp, Homo sapiens
tcatattctcttacc

SEQ ID NO: 347058 - DNA, 15 bp, Homo sapiens
catattctcttacct

SEQ ID NO: 347059 - DNA, 15 bp, Homo sapiens
atattctcttacctg

SEQ ID NO: 347060 - DNA, 15 bp, Homo sapiens
tattctcttacctga

SEQ ID NO: 347061 - DNA, 15 bp, Homo sapiens
attctcttacctgag

SEQ ID NO: 347062 - DNA, 15 bp, Homo sapiens
ttctcttacctgaga

SEQ ID NO: 347063 - DNA, 15 bp, Homo sapiens
tctcttacctgagag

SEQ ID NO: 347064 - DNA, 15 bp, Homo sapiens
ctcttacctgagaga

SEQ ID NO: 347065 - DNA, 15 bp, Homo sapiens
tcttacctgagagat

SEQ ID NO: 347066 - DNA, 15 bp, Homo sapiens
cttacctgagagatg

SEQ ID NO: 347067 - DNA, 15 bp, Homo sapiens
ttacctgagagatgg

SEQ ID NO: 347068 - DNA, 15 bp, Homo sapiens
tacctgagagatggt

SEQ ID NO: 347069 - DNA, 15 bp, Homo sapiens
acctgagagatggtg

SEQ ID NO: 347070 - DNA, 15 bp, Homo sapiens
cctgagagatggtgg

SEQ ID NO: 347071 - DNA, 15 bp, Homo sapiens
ctgagagatggtggt

SEQ ID NO: 347072 - DNA, 15 bp, Homo sapiens
tgagagatggtggtg

SEQ ID NO: 347073 - DNA, 15 bp, Homo sapiens
gagagatggtggtga

SEQ ID NO: 347074 - DNA, 15 bp, Homo sapiens
agagatggtggtgaa

SEQ ID NO: 347075 - DNA, 15 bp, Homo sapiens
gagatggtggtgaac

SEQ ID NO: 347076 - DNA, 15 bp, Homo sapiens
agatggtggtgaaca

SEQ ID NO: 347077 - DNA, 15 bp, Homo sapiens
gatggtggtgaacag

SEQ ID NO: 347078 - DNA, 15 bp, Homo sapiens
atggtggtgaacagt

SEQ ID NO: 347079 - DNA, 15 bp, Homo sapiens
tggtggtgaacagtg

SEQ ID NO: 347080 - DNA, 15 bp, Homo sapiens
ggtggtgaacagtga

SEQ ID NO: 347081 - DNA, 15 bp, Homo sapiens
gtggtgaacagtgaa

SEQ ID NO: 347082 - DNA, 15 bp, Homo sapiens
tggtgaacagtgaac

SEQ ID NO: 347083 - DNA, 15 bp, Homo sapiens
ggtgaacagtgaact

SEQ ID NO: 347084 - DNA, 15 bp, Homo sapiens
gtgaacagtgaactt

SEQ ID NO: 347085 - DNA, 15 bp, Homo sapiens
tgaacagtgaacttc

SEQ ID NO: 347086 - DNA, 15 bp, Homo sapiens
gaacagtgaacttct

SEQ ID NO: 347087 - DNA, 15 bp, Homo sapiens
aacagtgaacttctg

SEQ ID NO: 347088 - DNA, 15 bp, Homo sapiens
acagtgaacttctgc

SEQ ID NO: 347089 - DNA, 15 bp, Homo sapiens
cagtgaacttctgca

SEQ ID NO: 347090 - DNA, 15 bp, Homo sapiens
agtgaacttctgcaa

SEQ ID NO: 347091 - DNA, 15 bp, Homo sapiens
gtgaacttctgcaat

SEQ ID NO: 347092 - DNA, 15 bp, Homo sapiens
tgaacttctgcaatt

SEQ ID NO: 347093 - DNA, 15 bp, Homo sapiens
gaacttctgcaattg

SEQ ID NO: 347094 - DNA, 15 bp, Homo sapiens
aacttctgcaattga

SEQ ID NO: 347095 - DNA, 15 bp, Homo sapiens
acttctgcaattgac

SEQ ID NO: 347096 - DNA, 15 bp, Homo sapiens
cttctgcaattgaca

SEQ ID NO: 347097 - DNA, 15 bp, Homo sapiens
ttctgcaattgacat

SEQ ID NO: 347098 - DNA, 15 bp, Homo sapiens
tctgcaattgacata

SEQ ID NO: 347099 - DNA, 15 bp, Homo sapiens
ctgcaattgacatag

SEQ ID NO: 347100 - DNA, 15 bp, Homo sapiens
tgcaattgacatagg

SEQ ID NO: 347101 - DNA, 15 bp, Homo sapiens
gcaattgacataggt

SEQ ID NO: 347102 - DNA, 15 bp, Homo sapiens
caattgacataggtg

SEQ ID NO: 347103 - DNA, 15 bp, Homo sapiens
aattgacataggtga

SEQ ID NO: 347104 - DNA, 15 bp, Homo sapiens
attgacataggtgac

SEQ ID NO: 347105 - DNA, 15 bp, Homo sapiens
ttgacataggtgaca

SEQ ID NO: 347106 - DNA, 15 bp, Homo sapiens
tgacataggtgacac

SEQ ID NO: 347107 - DNA, 15 bp, Homo sapiens
gacataggtgacaca

SEQ ID NO: 347108 - DNA, 15 bp, Homo sapiens
acataggtgacacat

SEQ ID NO: 347109 - DNA, 15 bp, Homo sapiens
cataggtgacacatt

SEQ ID NO: 347110 - DNA, 15 bp, Homo sapiens
ataggtgacacattc

SEQ ID NO: 347111 - DNA, 15 bp, Homo sapiens
taggtgacacattca

SEQ ID NO: 347112 - DNA, 15 bp, Homo sapiens
aggtgacacattcaa

SEQ ID NO: 347113 - DNA, 15 bp, Homo sapiens
gtgacacattcaaat

SEQ ID NO: 347114 - DNA, 15 bp, Homo sapiens
tgacacattcaaatg

SEQ ID NO: 347115 - DNA, 15 bp, Homo sapiens
gacacattcaaatga

SEQ ID NO: 347116 - DNA, 15 bp, Homo sapiens
acacattcaaatgac

SEQ ID NO: 347117 - DNA, 15 bp, Homo sapiens
cacattcaaatgaca

SEQ ID NO: 347118 - DNA, 15 bp, Homo sapiens
acattcaaatgacag

SEQ ID NO: 347119 - DNA, 15 bp, Homo sapiens
cattcaaatgacagc

SEQ ID NO: 347120 - DNA, 15 bp, Homo sapiens
attcaaatgacagca

SEQ ID NO: 347121 - DNA, 15 bp, Homo sapiens
ttcaaatgacagcat

SEQ ID NO: 347122 - DNA, 15 bp, Homo sapiens
tcaaatgacagcatg

SEQ ID NO: 347123 - DNA, 15 bp, Homo sapiens
caaatgacagcatga

SEQ ID NO: 347124 - DNA, 15 bp, Homo sapiens
aaatgacagcatgat

SEQ ID NO: 347125 - DNA, 15 bp, Homo sapiens
aatgacagcatgata

SEQ ID NO: 347126 - DNA, 15 bp, Homo sapiens
atgacagcatgatat

SEQ ID NO: 347127 - DNA, 15 bp, Homo sapiens
tgacagcatgatatg

SEQ ID NO: 347128 - DNA, 15 bp, Homo sapiens
gacagcatgatatgc

SEQ ID NO: 347129 - DNA, 15 bp, Homo sapiens
acagcatgatatgcc

SEQ ID NO: 347130 - DNA, 15 bp, Homo sapiens
cagcatgatatgccc

SEQ ID NO: 347131 - DNA, 15 bp, Homo sapiens
agcatgatatgccct

SEQ ID NO: 347132 - DNA, 15 bp, Homo sapiens
gcatgatatgccctc

SEQ ID NO: 347133 - DNA, 15 bp, Homo sapiens
catgatatgccctca

SEQ ID NO: 347134 - DNA, 15 bp, Homo sapiens
atgatatgccctcat

SEQ ID NO: 347135 - DNA, 15 bp, Homo sapiens
tgatatgccctcatt

SEQ ID NO: 347136 - DNA, 15 bp, Homo sapiens
gatatgccctcattt

SEQ ID NO: 347137 - DNA, 15 bp, Homo sapiens
atatgccctcattta

SEQ ID NO: 347138 - DNA, 15 bp, Homo sapiens
tatgccctcatttat

SEQ ID NO: 347139 - DNA, 15 bp, Homo sapiens
atgccctcatttatg

SEQ ID NO: 347140 - DNA, 15 bp, Homo sapiens
tgccctcatttatga

SEQ ID NO: 347141 - DNA, 15 bp, Homo sapiens
gccctcatttatgat

SEQ ID NO: 347142 - DNA, 15 bp, Homo sapiens
ccctcatttatgatt

SEQ ID NO: 347143 - DNA, 15 bp, Homo sapiens
cctcatttatgattt

SEQ ID NO: 347144 - DNA, 15 bp, Homo sapiens
ctcatttatgatttt

SEQ ID NO: 347145 - DNA, 15 bp, Homo sapiens
tcatttatgattttc

SEQ ID NO: 347146 - DNA, 15 bp, Homo sapiens
catttatgattttca

SEQ ID NO: 347147 - DNA, 15 bp, Homo sapiens
atttatgattttcag

SEQ ID NO: 347148 - DNA, 15 bp, Homo sapiens
tttatgattttcagt

SEQ ID NO: 347149 - DNA, 15 bp, Homo sapiens
ttatgattttcagta

SEQ ID NO: 347150 - DNA, 15 bp, Homo sapiens
tatgattttcagtag

SEQ ID NO: 347151 - DNA, 15 bp, Homo sapiens
atgattttcagtaga

SEQ ID NO: 347152 - DNA, 15 bp, Homo sapiens
tgattttcagtagac

SEQ ID NO: 347153 - DNA, 15 bp, Homo sapiens
gattttcagtagaca

SEQ ID NO: 347154 - DNA, 15 bp, Homo sapiens
attttcagtagacac

SEQ ID NO: 347155 - DNA, 15 bp, Homo sapiens
ttttcagtagacaca

SEQ ID NO: 347156 - DNA, 15 bp, Homo sapiens
tttcagtagacacag

SEQ ID NO: 347157 - DNA, 15 bp, Homo sapiens
ttcagtagacacagt

SEQ ID NO: 347158 - DNA, 15 bp, Homo sapiens
tcagtagacacagtg

SEQ ID NO: 347159 - DNA, 15 bp, Homo sapiens
cagtagacacagtgt

SEQ ID NO: 347160 - DNA, 15 bp, Homo sapiens
agtagacacagtgta

SEQ ID NO: 347161 - DNA, 15 bp, Homo sapiens
gtagacacagtgtat

SEQ ID NO: 347162 - DNA, 15 bp, Homo sapiens
tagacacagtgtatt

SEQ ID NO: 347163 - DNA, 15 bp, Homo sapiens
agacacagtgtatta

SEQ ID NO: 347164 - DNA, 15 bp, Homo sapiens
gacacagtgtattat

SEQ ID NO: 347165 - DNA, 15 bp, Homo sapiens
acacagtgtattata

SEQ ID NO: 347166 - DNA, 15 bp, Homo sapiens
cacagtgtattataa

SEQ ID NO: 347167 - DNA, 15 bp, Homo sapiens
acagtgtattataaa

SEQ ID NO: 347168 - DNA, 15 bp, Homo sapiens
cagtgtattataaaa

SEQ ID NO: 347169 - DNA, 15 bp, Homo sapiens
agtgtattataaaaa

SEQ ID NO: 347170 - DNA, 15 bp, Homo sapiens
gtgtattataaaaat

SEQ ID NO: 347171 - DNA, 15 bp, Homo sapiens
tgtattataaaaatt

SEQ ID NO: 347172 - DNA, 15 bp, Homo sapiens
gtattataaaaattt

SEQ ID NO: 347173 - DNA, 15 bp, Homo sapiens
tattataaaaatttt

SEQ ID NO: 347174 - DNA, 15 bp, Homo sapiens
attataaaaattttc

SEQ ID NO: 347175 - DNA, 15 bp, Homo sapiens
ttataaaaattttca

SEQ ID NO: 347176 - DNA, 15 bp, Homo sapiens
tataaaaattttcaa

SEQ ID NO: 347177 - DNA, 15 bp, Homo sapiens
ataaaaattttcaaa

SEQ ID NO: 347178 - DNA, 15 bp, Homo sapiens
taaaaattttcaaag

SEQ ID NO: 347179 - DNA, 15 bp, Homo sapiens
aaaaattttcaaagt

SEQ ID NO: 347180 - DNA, 15 bp, Homo sapiens
aaaattttcaaagtt

SEQ ID NO: 347181 - DNA, 15 bp, Homo sapiens
aaattttcaaagttg

SEQ ID NO: 347182 - DNA, 15 bp, Homo sapiens
aattttcaaagttgc

SEQ ID NO: 347183 - DNA, 15 bp, Homo sapiens
attttcaaagttgca

SEQ ID NO: 347184 - DNA, 15 bp, Homo sapiens
ttttcaaagttgcat

SEQ ID NO: 347185 - DNA, 15 bp, Homo sapiens
tttcaaagttgcatt

SEQ ID NO: 347186 - DNA, 15 bp, Homo sapiens
ttcaaagttgcattg

SEQ ID NO: 347187 - DNA, 15 bp, Homo sapiens
tcaaagttgcattgt

SEQ ID NO: 347188 - DNA, 15 bp, Homo sapiens
caaagttgcattgtc

SEQ ID NO: 347189 - DNA, 15 bp, Homo sapiens
aaagttgcattgtct

SEQ ID NO: 347190 - DNA, 15 bp, Homo sapiens
aagttgcattgtctg

SEQ ID NO: 347191 - DNA, 15 bp, Homo sapiens
agttgcattgtctgt

SEQ ID NO: 347192 - DNA, 15 bp, Homo sapiens
gttgcattgtctgtg

SEQ ID NO: 347193 - DNA, 15 bp, Homo sapiens
ttgcattgtctgtgg

SEQ ID NO: 347194 - DNA, 15 bp, Homo sapiens
tgcattgtctgtgga

SEQ ID NO: 347195 - DNA, 15 bp, Homo sapiens
gcattgtctgtggat

SEQ ID NO: 347196 - DNA, 15 bp, Homo sapiens
cattgtctgtggatc

SEQ ID NO: 347197 - DNA, 15 bp, Homo sapiens
attgtctgtggatca

SEQ ID NO: 347198 - DNA, 15 bp, Homo sapiens
ttgtctgtggatcat

SEQ ID NO: 347199 - DNA, 15 bp, Homo sapiens
tgtctgtggatcata

SEQ ID NO: 347200 - DNA, 15 bp, Homo sapiens
gtctgtggatcatac

SEQ ID NO: 347201 - DNA, 15 bp, Homo sapiens
tctgtggatcataca

SEQ ID NO: 347202 - DNA, 15 bp, Homo sapiens
ctgtggatcatacat

SEQ ID NO: 347203 - DNA, 15 bp, Homo sapiens
tgtggatcatacatg

SEQ ID NO: 347204 - DNA, 15 bp, Homo sapiens
gtggatcatacatga

SEQ ID NO: 347205 - DNA, 15 bp, Homo sapiens
tggatcatacatgac

SEQ ID NO: 347206 - DNA, 15 bp, Homo sapiens
ggatcatacatgact

SEQ ID NO: 347207 - DNA, 15 bp, Homo sapiens
gatcatacatgactt

SEQ ID NO: 347208 - DNA, 15 bp, Homo sapiens
atcatacatgacttt

SEQ ID NO: 347209 - DNA, 15 bp, Homo sapiens
tcatacatgactttt

SEQ ID NO: 347210 - DNA, 15 bp, Homo sapiens
catacatgacttttt

SEQ ID NO: 347211 - DNA, 15 bp, Homo sapiens
atacatgactttttg

SEQ ID NO: 347212 - DNA, 15 bp, Homo sapiens
tacatgactttttgt

SEQ ID NO: 347213 - DNA, 15 bp, Homo sapiens
acatgactttttgtt

SEQ ID NO: 347214 - DNA, 15 bp, Homo sapiens
catgactttttgttt

SEQ ID NO: 347215 - DNA, 15 bp, Homo sapiens
atgactttttgtttt

SEQ ID NO: 347216 - DNA, 15 bp, Homo sapiens
tgactttttgttttt

SEQ ID NO: 347217 - DNA, 15 bp, Homo sapiens
gactttttgttttta

SEQ ID NO: 347218 - DNA, 15 bp, Homo sapiens
actttttgtttttat

SEQ ID NO: 347219 - DNA, 15 bp, Homo sapiens
ctttttgtttttatg

SEQ ID NO: 347220 - DNA, 15 bp, Homo sapiens
tttttgtttttatgc

SEQ ID NO: 347221 - DNA, 15 bp, Homo sapiens
ttttgtttttatgcc

SEQ ID NO: 347222 - DNA, 15 bp, Homo sapiens
tttgtttttatgcct

SEQ ID NO: 347223 - DNA, 15 bp, Homo sapiens
ttgtttttatgcctt

SEQ ID NO: 347224 - DNA, 15 bp, Homo sapiens
tgtttttatgccttt

SEQ ID NO: 347225 - DNA, 15 bp, Homo sapiens
gtttttatgcctttg

SEQ ID NO: 347226 - DNA, 15 bp, Homo sapiens
tttttatgcctttgt

SEQ ID NO: 347227 - DNA, 15 bp, Homo sapiens
ttttatgcctttgtt

SEQ ID NO: 347228 - DNA, 15 bp, Homo sapiens
tttatgcctttgttt

SEQ ID NO: 347229 - DNA, 15 bp, Homo sapiens
ttatgcctttgtttt

SEQ ID NO: 347230 - DNA, 15 bp, Homo sapiens
tatgcctttgttttt

SEQ ID NO: 347231 - DNA, 15 bp, Homo sapiens
atgcctttgtttttt

SEQ ID NO: 347232 - DNA, 15 bp, Homo sapiens
tgcctttgtttttta

SEQ ID NO: 347233 - DNA, 15 bp, Homo sapiens
gcctttgttttttag

SEQ ID NO: 347234 - DNA, 15 bp, Homo sapiens
cctttgttttttagt

SEQ ID NO: 347235 - DNA, 15 bp, Homo sapiens
ctttgttttttagtt

SEQ ID NO: 347236 - DNA, 15 bp, Homo sapiens
tttgttttttagttc

SEQ ID NO: 347237 - DNA, 15 bp, Homo sapiens
ttgttttttagttca

SEQ ID NO: 347238 - DNA, 15 bp, Homo sapiens
tgttttttagttcaa

SEQ ID NO: 347239 - DNA, 15 bp, Homo sapiens
gttttttagttcaag

SEQ ID NO: 347240 - DNA, 15 bp, Homo sapiens
ttttttagttcaagc

SEQ ID NO: 347241 - DNA, 15 bp, Homo sapiens
tttttagttcaagct

SEQ ID NO: 347242 - DNA, 15 bp, Homo sapiens
ttttagttcaagctc

SEQ ID NO: 347243 - DNA, 15 bp, Homo sapiens
tttagttcaagctct

SEQ ID NO: 347244 - DNA, 15 bp, Homo sapiens
ttagttcaagctctc

SEQ ID NO: 347245 - DNA, 15 bp, Homo sapiens
tagttcaagctctca

SEQ ID NO: 347246 - DNA, 15 bp, Homo sapiens
agttcaagctctcat

SEQ ID NO: 347247 - DNA, 15 bp, Homo sapiens
gttcaagctctcatt

SEQ ID NO: 347248 - DNA, 15 bp, Homo sapiens
ttcaagctctcatta

SEQ ID NO: 347249 - DNA, 15 bp, Homo sapiens
tcaagctctcattat

SEQ ID NO: 347250 - DNA, 15 bp, Homo sapiens
caagctctcattatc

SEQ ID NO: 347251 - DNA, 15 bp, Homo sapiens
aagctctcattatcc

SEQ ID NO: 347252 - DNA, 15 bp, Homo sapiens
agctctcattatcct

SEQ ID NO: 347253 - DNA, 15 bp, Homo sapiens
gctctcattatcctg

SEQ ID NO: 347254 - DNA, 15 bp, Homo sapiens
ctctcattatcctgg

SEQ ID NO: 347255 - DNA, 15 bp, Homo sapiens
tctcattatcctgga

SEQ ID NO: 347256 - DNA, 15 bp, Homo sapiens
ctcattatcctggat

SEQ ID NO: 347257 - DNA, 15 bp, Homo sapiens
tcattatcctggatt

SEQ ID NO: 347258 - DNA, 15 bp, Homo sapiens
cattatcctggattt

SEQ ID NO: 347259 - DNA, 15 bp, Homo sapiens
attatcctggatttt

SEQ ID NO: 347260 - DNA, 15 bp, Homo sapiens
ttatcctggattttg

SEQ ID NO: 347261 - DNA, 15 bp, Homo sapiens
tatcctggattttga

SEQ ID NO: 347262 - DNA, 15 bp, Homo sapiens
atcctggattttgat

SEQ ID NO: 347263 - DNA, 15 bp, Homo sapiens
tcctggattttgatc

SEQ ID NO: 347264 - DNA, 15 bp, Homo sapiens
cctggattttgatca

SEQ ID NO: 347265 - DNA, 15 bp, Homo sapiens
ctggattttgatcat

SEQ ID NO: 347266 - DNA, 15 bp, Homo sapiens
tggattttgatcata

SEQ ID NO: 347267 - DNA, 15 bp, Homo sapiens
ggattttgatcatat

SEQ ID NO: 347268 - DNA, 15 bp, Homo sapiens
gattttgatcatata

SEQ ID NO: 347269 - DNA, 15 bp, Homo sapiens
attttgatcatatat

SEQ ID NO: 347270 - DNA, 15 bp, Homo sapiens
ttttgatcatatatg

SEQ ID NO: 347271 - DNA, 15 bp, Homo sapiens
tttgatcatatatgt

SEQ ID NO: 347272 - DNA, 15 bp, Homo sapiens
ttgatcatatatgtt

SEQ ID NO: 347273 - DNA, 15 bp, Homo sapiens
tgatcatatatgttt

SEQ ID NO: 347274 - DNA, 15 bp, Homo sapiens
gatcatatatgttta

SEQ ID NO: 347275 - DNA, 15 bp, Homo sapiens
atcatatatgtttat

SEQ ID NO: 347276 - DNA, 15 bp, Homo sapiens
tcatatatgtttata

SEQ ID NO: 347277 - DNA, 15 bp, Homo sapiens
catatatgtttataa

SEQ ID NO: 347278 - DNA, 15 bp, Homo sapiens
atatatgtttataaa

SEQ ID NO: 347279 - DNA, 15 bp, Homo sapiens
tatatgtttataaag

SEQ ID NO: 347280 - DNA, 15 bp, Homo sapiens
atatgtttataaagc

SEQ ID NO: 347281 - DNA, 15 bp, Homo sapiens
tatgtttataaagca

SEQ ID NO: 347282 - DNA, 15 bp, Homo sapiens
atgtttataaagcag

SEQ ID NO: 347283 - DNA, 15 bp, Homo sapiens
tgtttataaagcagg

SEQ ID NO: 347284 - DNA, 15 bp, Homo sapiens
gtttataaagcagga

SEQ ID NO: 347285 - DNA, 15 bp, Homo sapiens
tttataaagcaggat

SEQ ID NO: 347286 - DNA, 15 bp, Homo sapiens
ttataaagcaggatt

SEQ ID NO: 347287 - DNA, 15 bp, Homo sapiens
tataaagcaggattg

SEQ ID NO: 347288 - DNA, 15 bp, Homo sapiens
ataaagcaggattgt

SEQ ID NO: 347289 - DNA, 15 bp, Homo sapiens
taaagcaggattgtt

SEQ ID NO: 347290 - DNA, 15 bp, Homo sapiens
aaagcaggattgttt

SEQ ID NO: 347291 - DNA, 15 bp, Homo sapiens
aagcaggattgtttt

SEQ ID NO: 347292 - DNA, 15 bp, Homo sapiens
agcaggattgtttta

SEQ ID NO: 347293 - DNA, 15 bp, Homo sapiens
gcaggattgttttat

SEQ ID NO: 347294 - DNA, 15 bp, Homo sapiens
caggattgttttatt

SEQ ID NO: 347295 - DNA, 15 bp, Homo sapiens
aggattgttttattg

SEQ ID NO: 347296 - DNA, 15 bp, Homo sapiens
ggattgttttattgc

SEQ ID NO: 347297 - DNA, 15 bp, Homo sapiens
gattgttttattgct

SEQ ID NO: 347298 - DNA, 15 bp, Homo sapiens
attgttttattgctt

SEQ ID NO: 347299 - DNA, 15 bp, Homo sapiens
ttgttttattgcttt

SEQ ID NO: 347300 - DNA, 15 bp, Homo sapiens
tgttttattgctttc

SEQ ID NO: 347301 - DNA, 15 bp, Homo sapiens
gttttattgctttcc

SEQ ID NO: 347302 - DNA, 15 bp, Homo sapiens
ttttattgctttcct

SEQ ID NO: 347303 - DNA, 15 bp, Homo sapiens
tttattgctttccta

SEQ ID NO: 347304 - DNA, 15 bp, Homo sapiens
ttattgctttcctac

SEQ ID NO: 347305 - DNA, 15 bp, Homo sapiens
tattgctttcctact

SEQ ID NO: 347306 - DNA, 15 bp, Homo sapiens
attgctttcctactc

SEQ ID NO: 347307 - DNA, 15 bp, Homo sapiens
ttgctttcctactca

SEQ ID NO: 347308 - DNA, 15 bp, Homo sapiens
tgctttcctactcaa

SEQ ID NO: 347309 - DNA, 15 bp, Homo sapiens
gctttcctactcaat

SEQ ID NO: 347310 - DNA, 15 bp, Homo sapiens
ctttcctactcaata

SEQ ID NO: 347311 - DNA, 15 bp, Homo sapiens
tttcctactcaataa

SEQ ID NO: 347312 - DNA, 15 bp, Homo sapiens
ttcctactcaataaa

SEQ ID NO: 347313 - DNA, 15 bp, Homo sapiens
tcctactcaataaaa

SEQ ID NO: 347314 - DNA, 15 bp, Homo sapiens
cctactcaataaaaa

SEQ ID NO: 347315 - DNA, 15 bp, Homo sapiens
ctactcaataaaaat

SEQ ID NO: 347316 - DNA, 15 bp, Homo sapiens
tactcaataaaaatg

SEQ ID NO: 347317 - DNA, 15 bp, Homo sapiens
actcaataaaaatgt

SEQ ID NO: 347318 - DNA, 15 bp, Homo sapiens
ctcaataaaaatgtg

SEQ ID NO: 347319 - DNA, 15 bp, Homo sapiens
tcaataaaaatgtga

SEQ ID NO: 347320 - DNA, 15 bp, Homo sapiens
caataaaaatgtgaa

SEQ ID NO: 347321 - DNA, 15 bp, Homo sapiens
aataaaaatgtgaag

SEQ ID NO: 347322 - DNA, 15 bp, Homo sapiens
ataaaaatgtgaagc

SEQ ID NO: 347323 - DNA, 15 bp, Homo sapiens
taaaaatgtgaagcc

SEQ ID NO: 347324 - DNA, 15 bp, Homo sapiens
aaaaatgtgaagcca

SEQ ID NO: 347325 - DNA, 15 bp, Homo sapiens
aaaatgtgaagccat

SEQ ID NO: 347326 - DNA, 15 bp, Homo sapiens
aaatgtgaagccatc

SEQ ID NO: 347327 - DNA, 15 bp, Homo sapiens
aatgtgaagccatcc

SEQ ID NO: 347328 - DNA, 15 bp, Homo sapiens
atgtgaagccatcct

SEQ ID NO: 347329 - DNA, 15 bp, Homo sapiens
tgtgaagccatcctt

SEQ ID NO: 347330 - DNA, 15 bp, Homo sapiens
gtgaagccatccttt

SEQ ID NO: 347331 - DNA, 15 bp, Homo sapiens
tgaagccatcctttt

SEQ ID NO: 347332 - DNA, 15 bp, Homo sapiens
gaagccatccttttg

SEQ ID NO: 347333 - DNA, 15 bp, Homo sapiens
aagccatccttttgg

SEQ ID NO: 347334 - DNA, 15 bp, Homo sapiens
agccatccttttggt

SEQ ID NO: 347335 - DNA, 15 bp, Homo sapiens
gccatccttttggta

SEQ ID NO: 347336 - DNA, 15 bp, Homo sapiens
ccatccttttggtat

SEQ ID NO: 347337 - DNA, 15 bp, Homo sapiens
catccttttggtatg

SEQ ID NO: 347338 - DNA, 15 bp, Homo sapiens
atccttttggtatgc

SEQ ID NO: 347339 - DNA, 15 bp, Homo sapiens
tccttttggtatgca

SEQ ID NO: 347340 - DNA, 15 bp, Homo sapiens
ccttttggtatgcat

SEQ ID NO: 347341 - DNA, 15 bp, Homo sapiens
cttttggtatgcatg

SEQ ID NO: 347342 - DNA, 15 bp, Homo sapiens
ttttggtatgcatgt

SEQ ID NO: 347343 - DNA, 15 bp, Homo sapiens
tttggtatgcatgtt

SEQ ID NO: 347344 - DNA, 15 bp, Homo sapiens
ttggtatgcatgttt

SEQ ID NO: 347345 - DNA, 15 bp, Homo sapiens
tggtatgcatgtttt

SEQ ID NO: 347346 - DNA, 15 bp, Homo sapiens
ggtatgcatgttttc

SEQ ID NO: 347347 - DNA, 15 bp, Homo sapiens
gtatgcatgttttcc

SEQ ID NO: 347348 - DNA, 15 bp, Homo sapiens
tatgcatgttttcct

SEQ ID NO: 347349 - DNA, 15 bp, Homo sapiens
atgcatgttttcctc

SEQ ID NO: 347350 - DNA, 15 bp, Homo sapiens
tgcatgttttcctcc

SEQ ID NO: 347351 - DNA, 15 bp, Homo sapiens
gcatgttttcctccg

SEQ ID NO: 347352 - DNA, 15 bp, Homo sapiens
catgttttcctccga

SEQ ID NO: 347353 - DNA, 15 bp, Homo sapiens
atgttttcctccgaa

SEQ ID NO: 347354 - DNA, 15 bp, Homo sapiens
tgttttcctccgaat

SEQ ID NO: 347355 - DNA, 15 bp, Homo sapiens
gttttcctccgaata

SEQ ID NO: 347356 - DNA, 15 bp, Homo sapiens
ttttcctccgaatag

SEQ ID NO: 347357 - DNA, 15 bp, Homo sapiens
tttcctccgaataga

SEQ ID NO: 347358 - DNA, 15 bp, Homo sapiens
ttcctccgaatagaa

SEQ ID NO: 347359 - DNA, 15 bp, Homo sapiens
tcctccgaatagaaa

SEQ ID NO: 347360 - DNA, 15 bp, Homo sapiens
cctccgaatagaaag

SEQ ID NO: 347361 - DNA, 15 bp, Homo sapiens
ctccgaatagaaaga

SEQ ID NO: 347362 - DNA, 15 bp, Homo sapiens
tccgaatagaaagat

SEQ ID NO: 347363 - DNA, 15 bp, Homo sapiens
ccgaatagaaagatt

SEQ ID NO: 347364 - DNA, 15 bp, Homo sapiens
cgaatagaaagattc

SEQ ID NO: 347365 - DNA, 15 bp, Homo sapiens
gaatagaaagattcc

SEQ ID NO: 347366 - DNA, 15 bp, Homo sapiens
aatagaaagattcct

SEQ ID NO: 347367 - DNA, 15 bp, Homo sapiens
atagaaagattcctt

SEQ ID NO: 347368 - DNA, 15 bp, Homo sapiens
tagaaagattccttt

SEQ ID NO: 347369 - DNA, 15 bp, Homo sapiens
agaaagattcctttg

SEQ ID NO: 347370 - DNA, 15 bp, Homo sapiens
gaaagattcctttga

SEQ ID NO: 347371 - DNA, 15 bp, Homo sapiens
aaagattcctttgaa

SEQ ID NO: 347372 - DNA, 15 bp, Homo sapiens
aagattcctttgaag

SEQ ID NO: 347373 - DNA, 15 bp, Homo sapiens
agattcctttgaaga

SEQ ID NO: 347374 - DNA, 15 bp, Homo sapiens
gattcctttgaagat

SEQ ID NO: 347375 - DNA, 15 bp, Homo sapiens
attcctttgaagatt

SEQ ID NO: 347376 - DNA, 15 bp, Homo sapiens
ttcctttgaagattt

SEQ ID NO: 347377 - DNA, 15 bp, Homo sapiens
tcctttgaagatttc

SEQ ID NO: 347378 - DNA, 15 bp, Homo sapiens
cctttgaagatttcc

SEQ ID NO: 347379 - DNA, 15 bp, Homo sapiens
ctttgaagatttccc

SEQ ID NO: 347380 - DNA, 15 bp, Homo sapiens
tttgaagatttccca

SEQ ID NO: 347381 - DNA, 15 bp, Homo sapiens
ttgaagatttcccat

SEQ ID NO: 347382 - DNA, 15 bp, Homo sapiens
tgaagatttcccata

SEQ ID NO: 347383 - DNA, 15 bp, Homo sapiens
gaagatttcccatac

SEQ ID NO: 347384 - DNA, 15 bp, Homo sapiens
aagatttcccatact

SEQ ID NO: 347385 - DNA, 15 bp, Homo sapiens
agatttcccatactt

SEQ ID NO: 347386 - DNA, 15 bp, Homo sapiens
gatttcccatacttt

SEQ ID NO: 347387 - DNA, 15 bp, Homo sapiens
atttcccatactttt

SEQ ID NO: 347388 - DNA, 15 bp, Homo sapiens
tttcccatacttttt

SEQ ID NO: 347389 - DNA, 15 bp, Homo sapiens
ttcccatactttttc

SEQ ID NO: 347390 - DNA, 15 bp, Homo sapiens
tcccatactttttca

SEQ ID NO: 347391 - DNA, 15 bp, Homo sapiens
cccatactttttcat

SEQ ID NO: 347392 - DNA, 15 bp, Homo sapiens
ccatactttttcata

SEQ ID NO: 347393 - DNA, 15 bp, Homo sapiens
catactttttcatag

SEQ ID NO: 347394 - DNA, 15 bp, Homo sapiens
atactttttcatagt

SEQ ID NO: 347395 - DNA, 15 bp, Homo sapiens
tactttttcatagtc

SEQ ID NO: 347396 - DNA, 15 bp, Homo sapiens
actttttcatagtca

SEQ ID NO: 347397 - DNA, 15 bp, Homo sapiens
ctttttcatagtcat

SEQ ID NO: 347398 - DNA, 15 bp, Homo sapiens
tttttcatagtcatt

SEQ ID NO: 347399 - DNA, 15 bp, Homo sapiens
ttttcatagtcattt

SEQ ID NO: 347400 - DNA, 15 bp, Homo sapiens
tttcatagtcatttt

SEQ ID NO: 347401 - DNA, 15 bp, Homo sapiens
ttcatagtcatttta

SEQ ID NO: 347402 - DNA, 15 bp, Homo sapiens
tcatagtcattttag

SEQ ID NO: 347403 - DNA, 15 bp, Homo sapiens
catagtcattttaga

SEQ ID NO: 347404 - DNA, 15 bp, Homo sapiens
atagtcattttagag

SEQ ID NO: 347405 - DNA, 15 bp, Homo sapiens
tagtcattttagagg

SEQ ID NO: 347406 - DNA, 15 bp, Homo sapiens
agtcattttagagga

SEQ ID NO: 347407 - DNA, 15 bp, Homo sapiens
gtcattttagaggat

SEQ ID NO: 347408 - DNA, 15 bp, Homo sapiens
tcattttagaggatt

SEQ ID NO: 347409 - DNA, 15 bp, Homo sapiens
cattttagaggattt

SEQ ID NO: 347410 - DNA, 15 bp, Homo sapiens
attttagaggatttg

SEQ ID NO: 347411 - DNA, 15 bp, Homo sapiens
ttttagaggatttga

SEQ ID NO: 347412 - DNA, 15 bp, Homo sapiens
tttagaggatttgaa

SEQ ID NO: 347413 - DNA, 15 bp, Homo sapiens
ttagaggatttgaag

SEQ ID NO: 347414 - DNA, 15 bp, Homo sapiens
tagaggatttgaagg

SEQ ID NO: 347415 - DNA, 15 bp, Homo sapiens
agaggatttgaaggt

SEQ ID NO: 347416 - DNA, 15 bp, Homo sapiens
gaggatttgaaggta

SEQ ID NO: 347417 - DNA, 15 bp, Homo sapiens
aggatttgaaggtat

SEQ ID NO: 347418 - DNA, 15 bp, Homo sapiens
ggatttgaaggtatt

SEQ ID NO: 347419 - DNA, 15 bp, Homo sapiens
gatttgaaggtattt

SEQ ID NO: 347420 - DNA, 15 bp, Homo sapiens
atttgaaggtatttt

SEQ ID NO: 347421 - DNA, 15 bp, Homo sapiens
tttgaaggtatttta

SEQ ID NO: 347422 - DNA, 15 bp, Homo sapiens
ttgaaggtattttag

SEQ ID NO: 347423 - DNA, 15 bp, Homo sapiens
tgaaggtattttaga

SEQ ID NO: 347424 - DNA, 15 bp, Homo sapiens
gaaggtattttagat

SEQ ID NO: 347425 - DNA, 15 bp, Homo sapiens
aaggtattttagatt

SEQ ID NO: 347426 - DNA, 15 bp, Homo sapiens
aggtattttagatta

SEQ ID NO: 347427 - DNA, 15 bp, Homo sapiens
ggtattttagattaa

SEQ ID NO: 347428 - DNA, 15 bp, Homo sapiens
gtattttagattaag

SEQ ID NO: 347429 - DNA, 15 bp, Homo sapiens
tattttagattaagg

SEQ ID NO: 347430 - DNA, 15 bp, Homo sapiens
attttagattaaggg

SEQ ID NO: 347431 - DNA, 15 bp, Homo sapiens
ttttagattaaggga

SEQ ID NO: 347432 - DNA, 15 bp, Homo sapiens
tttagattaagggaa

SEQ ID NO: 347433 - DNA, 15 bp, Homo sapiens
ttagattaagggaag

SEQ ID NO: 347434 - DNA, 15 bp, Homo sapiens
tagattaagggaagg

SEQ ID NO: 347435 - DNA, 15 bp, Homo sapiens
agattaagggaagga

SEQ ID NO: 347436 - DNA, 15 bp, Homo sapiens
gattaagggaaggac

SEQ ID NO: 347437 - DNA, 15 bp, Homo sapiens
attaagggaaggact

SEQ ID NO: 347438 - DNA, 15 bp, Homo sapiens
ttaagggaaggacta

SEQ ID NO: 347439 - DNA, 15 bp, Homo sapiens
taagggaaggactat

SEQ ID NO: 347440 - DNA, 15 bp, Homo sapiens
aagggaaggactatg

SEQ ID NO: 347441 - DNA, 15 bp, Homo sapiens
agggaaggactatga

SEQ ID NO: 347442 - DNA, 15 bp, Homo sapiens
gggaaggactatgat

SEQ ID NO: 347443 - DNA, 15 bp, Homo sapiens
ggaaggactatgata

SEQ ID NO: 347444 - DNA, 15 bp, Homo sapiens
gaaggactatgataa

SEQ ID NO: 347445 - DNA, 15 bp, Homo sapiens
aaggactatgataaa

SEQ ID NO: 347446 - DNA, 15 bp, Homo sapiens
aggactatgataaaa

SEQ ID NO: 347447 - DNA, 15 bp, Homo sapiens
ggactatgataaaac

SEQ ID NO: 347448 - DNA, 15 bp, Homo sapiens
gactatgataaaacc

SEQ ID NO: 347449 - DNA, 15 bp, Homo sapiens
actatgataaaacct

SEQ ID NO: 347450 - DNA, 15 bp, Homo sapiens
ctatgataaaaccta

SEQ ID NO: 347451 - DNA, 15 bp, Homo sapiens
tatgataaaacctat

SEQ ID NO: 347452 - DNA, 15 bp, Homo sapiens
atgataaaacctatt

SEQ ID NO: 347453 - DNA, 15 bp, Homo sapiens
tgataaaacctatta

SEQ ID NO: 347454 - DNA, 15 bp, Homo sapiens
gataaaacctattat

SEQ ID NO: 347455 - DNA, 15 bp, Homo sapiens
ataaaacctattatt

SEQ ID NO: 347456 - DNA, 15 bp, Homo sapiens
taaaacctattatta

SEQ ID NO: 347457 - DNA, 15 bp, Homo sapiens
aaaacctattattat

SEQ ID NO: 347458 - DNA, 15 bp, Homo sapiens
aaacctattattata

SEQ ID NO: 347459 - DNA, 15 bp, Homo sapiens
aacctattattatat

SEQ ID NO: 347460 - DNA, 15 bp, Homo sapiens
acctattattatata

SEQ ID NO: 347461 - DNA, 15 bp, Homo sapiens
cctattattatatat

SEQ ID NO: 347462 - DNA, 15 bp, Homo sapiens
ctattattatatatg

SEQ ID NO: 347463 - DNA, 15 bp, Homo sapiens
tattattatatatga

SEQ ID NO: 347464 - DNA, 15 bp, Homo sapiens
attattatatatgac

SEQ ID NO: 347465 - DNA, 15 bp, Homo sapiens
ttattatatatgact

SEQ ID NO: 347466 - DNA, 15 bp, Homo sapiens
tattatatatgactt

SEQ ID NO: 347467 - DNA, 15 bp, Homo sapiens
attatatatgacttt

SEQ ID NO: 347468 - DNA, 15 bp, Homo sapiens
ttatatatgacttta

SEQ ID NO: 347469 - DNA, 15 bp, Homo sapiens
tatatatgactttat

SEQ ID NO: 347470 - DNA, 15 bp, Homo sapiens
atatatgactttatt

SEQ ID NO: 347471 - DNA, 15 bp, Homo sapiens
tatatgactttatta

SEQ ID NO: 347472 - DNA, 15 bp, Homo sapiens
atatgactttattat

SEQ ID NO: 347473 - DNA, 15 bp, Homo sapiens
tatgactttattatt

SEQ ID NO: 347474 - DNA, 15 bp, Homo sapiens
atgactttattattt

SEQ ID NO: 347475 - DNA, 15 bp, Homo sapiens
tgactttattatttt

SEQ ID NO: 347476 - DNA, 15 bp, Homo sapiens
gactttattattttt

SEQ ID NO: 347477 - DNA, 15 bp, Homo sapiens
actttattattttta

SEQ ID NO: 347478 - DNA, 15 bp, Homo sapiens
ctttattatttttag

SEQ ID NO: 347479 - DNA, 15 bp, Homo sapiens
tttattatttttagg

SEQ ID NO: 347480 - DNA, 15 bp, Homo sapiens
ttattatttttagga

SEQ ID NO: 347481 - DNA, 15 bp, Homo sapiens
tattatttttaggaa

SEQ ID NO: 347482 - DNA, 15 bp, Homo sapiens
attatttttaggaac

SEQ ID NO: 347483 - DNA, 15 bp, Homo sapiens
ttatttttaggaaca

SEQ ID NO: 347484 - DNA, 15 bp, Homo sapiens
tatttttaggaacat

SEQ ID NO: 347485 - DNA, 15 bp, Homo sapiens
atttttaggaacatt

SEQ ID NO: 347486 - DNA, 15 bp, Homo sapiens
tttttaggaacattc

SEQ ID NO: 347487 - DNA, 15 bp, Homo sapiens
ttttaggaacattct

SEQ ID NO: 347488 - DNA, 15 bp, Homo sapiens
tttaggaacattctc

SEQ ID NO: 347489 - DNA, 15 bp, Homo sapiens
ttaggaacattctct

SEQ ID NO: 347490 - DNA, 15 bp, Homo sapiens
taggaacattctcta

SEQ ID NO: 347491 - DNA, 15 bp, Homo sapiens
aggaacattctctac

SEQ ID NO: 347492 - DNA, 15 bp, Homo sapiens
ggaacattctctact

SEQ ID NO: 347493 - DNA, 15 bp, Homo sapiens
gaacattctctactt

SEQ ID NO: 347494 - DNA, 15 bp, Homo sapiens
aacattctctacttt

SEQ ID NO: 347495 - DNA, 15 bp, Homo sapiens
acattctctactttt

SEQ ID NO: 347496 - DNA, 15 bp, Homo sapiens
cattctctacttttc

SEQ ID NO: 347497 - DNA, 15 bp, Homo sapiens
attctctacttttca

SEQ ID NO: 347498 - DNA, 15 bp, Homo sapiens
ttctctacttttcaa

SEQ ID NO: 347499 - DNA, 15 bp, Homo sapiens
tctctacttttcaaa

SEQ ID NO: 347500 - DNA, 15 bp, Homo sapiens
ctctacttttcaaaa

SEQ ID NO: 347501 - DNA, 15 bp, Homo sapiens
tctacttttcaaaaa

SEQ ID NO: 347502 - DNA, 15 bp, Homo sapiens
ctacttttcaaaaat

SEQ ID NO: 347503 - DNA, 15 bp, Homo sapiens
tacttttcaaaaata

SEQ ID NO: 347504 - DNA, 15 bp, Homo sapiens
acttttcaaaaatat

SEQ ID NO: 347505 - DNA, 15 bp, Homo sapiens
cttttcaaaaatatc

SEQ ID NO: 347506 - DNA, 15 bp, Homo sapiens
ttttcaaaaatatcg

SEQ ID NO: 347507 - DNA, 15 bp, Homo sapiens
tttcaaaaatatcgg

SEQ ID NO: 347508 - DNA, 15 bp, Homo sapiens
ttcaaaaatatcgga

SEQ ID NO: 347509 - DNA, 15 bp, Homo sapiens
tcaaaaatatcggac

SEQ ID NO: 347510 - DNA, 15 bp, Homo sapiens
caaaaatatcggaca

SEQ ID NO: 347511 - DNA, 15 bp, Homo sapiens
aaaaatatcggacaa

SEQ ID NO: 347512 - DNA, 15 bp, Homo sapiens
aaaatatcggacaaa

SEQ ID NO: 347513 - DNA, 15 bp, Homo sapiens
aaatatcggacaaat

SEQ ID NO: 347514 - DNA, 15 bp, Homo sapiens
aatatcggacaaata

SEQ ID NO: 347515 - DNA, 15 bp, Homo sapiens
atatcggacaaataa

SEQ ID NO: 347516 - DNA, 15 bp, Homo sapiens
tatcggacaaataaa

SEQ ID NO: 347517 - DNA, 15 bp, Homo sapiens
atcggacaaataaaa

SEQ ID NO: 347518 - DNA, 15 bp, Homo sapiens
tcggacaaataaaat

SEQ ID NO: 347519 - DNA, 15 bp, Homo sapiens
cggacaaataaaatg

SEQ ID NO: 347520 - DNA, 15 bp, Homo sapiens
ggacaaataaaatga

SEQ ID NO: 347521 - DNA, 15 bp, Homo sapiens
gacaaataaaatgat

SEQ ID NO: 347522 - DNA, 15 bp, Homo sapiens
acaaataaaatgata

SEQ ID NO: 347523 - DNA, 15 bp, Homo sapiens
caaataaaatgataa

SEQ ID NO: 347524 - DNA, 15 bp, Homo sapiens
aaataaaatgataag

SEQ ID NO: 347525 - DNA, 15 bp, Homo sapiens
aataaaatgataaga

SEQ ID NO: 347526 - DNA, 15 bp, Homo sapiens
ataaaatgataagat

SEQ ID NO: 347527 - DNA, 15 bp, Homo sapiens
taaaatgataagatt

SEQ ID NO: 347528 - DNA, 15 bp, Homo sapiens
aaaatgataagattt

SEQ ID NO: 347529 - DNA, 15 bp, Homo sapiens
aaatgataagatttc

SEQ ID NO: 347530 - DNA, 15 bp, Homo sapiens
aatgataagatttca

SEQ ID NO: 347531 - DNA, 15 bp, Homo sapiens
atgataagatttcag

SEQ ID NO: 347532 - DNA, 15 bp, Homo sapiens
tgataagatttcagt

SEQ ID NO: 347533 - DNA, 15 bp, Homo sapiens
gataagatttcagta

SEQ ID NO: 347534 - DNA, 15 bp, Homo sapiens
ataagatttcagtaa

SEQ ID NO: 347535 - DNA, 15 bp, Homo sapiens
taagatttcagtaat

SEQ ID NO: 347536 - DNA, 15 bp, Homo sapiens
aagatttcagtaata

SEQ ID NO: 347537 - DNA, 15 bp, Homo sapiens
agatttcagtaataa

SEQ ID NO: 347538 - DNA, 15 bp, Homo sapiens
gatttcagtaataaa

SEQ ID NO: 347539 - DNA, 15 bp, Homo sapiens
atttcagtaataaaa

SEQ ID NO: 347540 - DNA, 15 bp, Homo sapiens
tttcagtaataaaaa

SEQ ID NO: 347541 - DNA, 15 bp, Homo sapiens
cagtaataaaaatgg

SEQ ID NO: 347542 - DNA, 15 bp, Homo sapiens
agtaataaaaatggt

SEQ ID NO: 347543 - DNA, 15 bp, Homo sapiens
gtaataaaaatggtg

SEQ ID NO: 347544 - DNA, 15 bp, Homo sapiens
taataaaaatggtgg

SEQ ID NO: 347545 - DNA, 15 bp, Homo sapiens
aataaaaatggtggc

SEQ ID NO: 347546 - DNA, 15 bp, Homo sapiens
ataaaaatggtggca

SEQ ID NO: 347547 - DNA, 15 bp, Homo sapiens
taaaaatggtggcat

SEQ ID NO: 347548 - DNA, 15 bp, Homo sapiens
aaaaatggtggcatt

SEQ ID NO: 347549 - DNA, 15 bp, Homo sapiens
aaaatggtggcattg

SEQ ID NO: 347550 - DNA, 15 bp, Homo sapiens
aaatggtggcattgt

SEQ ID NO: 347551 - DNA, 15 bp, Homo sapiens
aatggtggcattgtt

SEQ ID NO: 347552 - DNA, 15 bp, Homo sapiens
atggtggcattgttt

SEQ ID NO: 347553 - DNA, 15 bp, Homo sapiens
tggtggcattgtttt

SEQ ID NO: 347554 - DNA, 15 bp, Homo sapiens
ggtggcattgttttc

SEQ ID NO: 347555 - DNA, 15 bp, Homo sapiens
gtggcattgttttcc

SEQ ID NO: 347556 - DNA, 15 bp, Homo sapiens
tggcattgttttccc

SEQ ID NO: 347557 - DNA, 15 bp, Homo sapiens
ggcattgttttccct

SEQ ID NO: 347558 - DNA, 15 bp, Homo sapiens
gcattgttttccctg

SEQ ID NO: 347559 - DNA, 15 bp, Homo sapiens
cattgttttccctga

SEQ ID NO: 347560 - DNA, 15 bp, Homo sapiens
attgttttccctgat

SEQ ID NO: 347561 - DNA, 15 bp, Homo sapiens
ttgttttccctgatg

SEQ ID NO: 347562 - DNA, 15 bp, Homo sapiens
tgttttccctgatgt

SEQ ID NO: 347563 - DNA, 15 bp, Homo sapiens
gttttccctgatgtg

SEQ ID NO: 347564 - DNA, 15 bp, Homo sapiens
ttttccctgatgtgt

SEQ ID NO: 347565 - DNA, 15 bp, Homo sapiens
tttccctgatgtgtt

SEQ ID NO: 347566 - DNA, 15 bp, Homo sapiens
ttccctgatgtgttt

SEQ ID NO: 347567 - DNA, 15 bp, Homo sapiens
tccctgatgtgtttc

SEQ ID NO: 347568 - DNA, 15 bp, Homo sapiens
ccctgatgtgtttct

SEQ ID NO: 347569 - DNA, 15 bp, Homo sapiens
cctgatgtgtttcta

SEQ ID NO: 347570 - DNA, 15 bp, Homo sapiens
ctgatgtgtttctaa

SEQ ID NO: 347571 - DNA, 15 bp, Homo sapiens
tgatgtgtttctaaa

SEQ ID NO: 347572 - DNA, 15 bp, Homo sapiens
gatgtgtttctaaag

SEQ ID NO: 347573 - DNA, 15 bp, Homo sapiens
atgtgtttctaaagt

SEQ ID NO: 347574 - DNA, 15 bp, Homo sapiens
tgtgtttctaaagta

SEQ ID NO: 347575 - DNA, 15 bp, Homo sapiens
gtgtttctaaagtag

SEQ ID NO: 347576 - DNA, 15 bp, Homo sapiens
tgtttctaaagtaga

SEQ ID NO: 347577 - DNA, 15 bp, Homo sapiens
gtttctaaagtagat

SEQ ID NO: 347578 - DNA, 15 bp, Homo sapiens
tttctaaagtagatc

SEQ ID NO: 347579 - DNA, 15 bp, Homo sapiens
ttctaaagtagatca

SEQ ID NO: 347580 - DNA, 15 bp, Homo sapiens
tctaaagtagatcat

SEQ ID NO: 347581 - DNA, 15 bp, Homo sapiens
ctaaagtagatcatc

SEQ ID NO: 347582 - DNA, 15 bp, Homo sapiens
taaagtagatcatct

SEQ ID NO: 347583 - DNA, 15 bp, Homo sapiens
aaagtagatcatctt

SEQ ID NO: 347584 - DNA, 15 bp, Homo sapiens
aagtagatcatctta

SEQ ID NO: 347585 - DNA, 15 bp, Homo sapiens
agtagatcatcttat

SEQ ID NO: 347586 - DNA, 15 bp, Homo sapiens
gtagatcatcttatt

SEQ ID NO: 347587 - DNA, 15 bp, Homo sapiens
tagatcatcttattg

SEQ ID NO: 347588 - DNA, 15 bp, Homo sapiens
agatcatcttattgc

SEQ ID NO: 347589 - DNA, 15 bp, Homo sapiens
gatcatcttattgct

SEQ ID NO: 347590 - DNA, 15 bp, Homo sapiens
atcatcttattgctg

SEQ ID NO: 347591 - DNA, 15 bp, Homo sapiens
tcatcttattgctgc

SEQ ID NO: 347592 - DNA, 15 bp, Homo sapiens
catcttattgctgcc

SEQ ID NO: 347593 - DNA, 15 bp, Homo sapiens
atcttattgctgcct

SEQ ID NO: 347594 - DNA, 15 bp, Homo sapiens
tcttattgctgcctc

SEQ ID NO: 347595 - DNA, 15 bp, Homo sapiens
cttattgctgcctca

SEQ ID NO: 347596 - DNA, 15 bp, Homo sapiens
ttattgctgcctcag

SEQ ID NO: 347597 - DNA, 15 bp, Homo sapiens
tattgctgcctcagt

SEQ ID NO: 347598 - DNA, 15 bp, Homo sapiens
attgctgcctcagtc

SEQ ID NO: 347599 - DNA, 15 bp, Homo sapiens
ttgctgcctcagtct

SEQ ID NO: 347600 - DNA, 15 bp, Homo sapiens
tgctgcctcagtctt

SEQ ID NO: 347601 - DNA, 15 bp, Homo sapiens
gctgcctcagtcttt

SEQ ID NO: 347602 - DNA, 15 bp, Homo sapiens
ctgcctcagtctttt

SEQ ID NO: 347603 - DNA, 15 bp, Homo sapiens
tgcctcagtcttttg

SEQ ID NO: 347604 - DNA, 15 bp, Homo sapiens
gcctcagtcttttgg

SEQ ID NO: 347605 - DNA, 15 bp, Homo sapiens
cctcagtcttttggt

SEQ ID NO: 347606 - DNA, 15 bp, Homo sapiens
ctcagtcttttggta

SEQ ID NO: 347607 - DNA, 15 bp, Homo sapiens
tcagtcttttggtat

SEQ ID NO: 347608 - DNA, 15 bp, Homo sapiens
cagtcttttggtatt

SEQ ID NO: 347609 - DNA, 15 bp, Homo sapiens
agtcttttggtattt

SEQ ID NO: 347610 - DNA, 15 bp, Homo sapiens
gtcttttggtatttg

SEQ ID NO: 347611 - DNA, 15 bp, Homo sapiens
tcttttggtatttgc

SEQ ID NO: 347612 - DNA, 15 bp, Homo sapiens
cttttggtatttgct

SEQ ID NO: 347613 - DNA, 15 bp, Homo sapiens
ttttggtatttgctt

SEQ ID NO: 347614 - DNA, 15 bp, Homo sapiens
tttggtatttgctta

SEQ ID NO: 347615 - DNA, 15 bp, Homo sapiens
ttggtatttgcttat

SEQ ID NO: 347616 - DNA, 15 bp, Homo sapiens
tggtatttgcttatt

SEQ ID NO: 347617 - DNA, 15 bp, Homo sapiens
ggtatttgcttattt

SEQ ID NO: 347618 - DNA, 15 bp, Homo sapiens
gtatttgcttattta

SEQ ID NO: 347619 - DNA, 15 bp, Homo sapiens
tatttgcttatttat

SEQ ID NO: 347620 - DNA, 15 bp, Homo sapiens
atttgcttatttatg

SEQ ID NO: 347621 - DNA, 15 bp, Homo sapiens
tttgcttatttatgt

SEQ ID NO: 347622 - DNA, 15 bp, Homo sapiens
ttgcttatttatgtg

SEQ ID NO: 347623 - DNA, 15 bp, Homo sapiens
tgcttatttatgtgc

SEQ ID NO: 347624 - DNA, 15 bp, Homo sapiens
gcttatttatgtgca

SEQ ID NO: 347625 - DNA, 15 bp, Homo sapiens
cttatttatgtgcaa

SEQ ID NO: 347626 - DNA, 15 bp, Homo sapiens
ttatttatgtgcaag

SEQ ID NO: 347627 - DNA, 15 bp, Homo sapiens
tatttatgtgcaagg

SEQ ID NO: 347628 - DNA, 15 bp, Homo sapiens
atttatgtgcaaggt

SEQ ID NO: 347629 - DNA, 15 bp, Homo sapiens
tttatgtgcaaggtc

SEQ ID NO: 347630 - DNA, 15 bp, Homo sapiens
ttatgtgcaaggtct

SEQ ID NO: 347631 - DNA, 15 bp, Homo sapiens
tatgtgcaaggtctc

SEQ ID NO: 347632 - DNA, 15 bp, Homo sapiens
atgtgcaaggtctcc

SEQ ID NO: 347633 - DNA, 15 bp, Homo sapiens
tgtgcaaggtctcca

SEQ ID NO: 347634 - DNA, 15 bp, Homo sapiens
gtgcaaggtctccag

SEQ ID NO: 347635 - DNA, 15 bp, Homo sapiens
tgcaaggtctccagt

SEQ ID NO: 347636 - DNA, 15 bp, Homo sapiens
gcaaggtctccagtg

SEQ ID NO: 347637 - DNA, 15 bp, Homo sapiens
caaggtctccagtgg

SEQ ID NO: 347638 - DNA, 15 bp, Homo sapiens
aaggtctccagtggg

SEQ ID NO: 347639 - DNA, 15 bp, Homo sapiens
aggtctccagtgggc

SEQ ID NO: 347640 - DNA, 15 bp, Homo sapiens
ggtctccagtgggct

SEQ ID NO: 347641 - DNA, 15 bp, Homo sapiens
gtctccagtgggctt

SEQ ID NO: 347642 - DNA, 15 bp, Homo sapiens
tctccagtgggcttg

SEQ ID NO: 347643 - DNA, 15 bp, Homo sapiens
ctccagtgggcttgc

SEQ ID NO: 347644 - DNA, 15 bp, Homo sapiens
tccagtgggcttgct

SEQ ID NO: 347645 - DNA, 15 bp, Homo sapiens
ccagtgggcttgctg

SEQ ID NO: 347646 - DNA, 15 bp, Homo sapiens
cagtgggcttgctga

SEQ ID NO: 347647 - DNA, 15 bp, Homo sapiens
agtgggcttgctgat

SEQ ID NO: 347648 - DNA, 15 bp, Homo sapiens
gtgggcttgctgatg

SEQ ID NO: 347649 - DNA, 15 bp, Homo sapiens
tgggcttgctgatgc

SEQ ID NO: 347650 - DNA, 15 bp, Homo sapiens
gggcttgctgatgct

SEQ ID NO: 347651 - DNA, 15 bp, Homo sapiens
ggcttgctgatgctt

SEQ ID NO: 347652 - DNA, 15 bp, Homo sapiens
gcttgctgatgcttc

SEQ ID NO: 347653 - DNA, 15 bp, Homo sapiens
cttgctgatgcttct

SEQ ID NO: 347654 - DNA, 15 bp, Homo sapiens
ttgctgatgcttcta

SEQ ID NO: 347655 - DNA, 15 bp, Homo sapiens
tgctgatgcttctag

SEQ ID NO: 347656 - DNA, 15 bp, Homo sapiens
gctgatgcttctaga

SEQ ID NO: 347657 - DNA, 15 bp, Homo sapiens
ctgatgcttctagag

SEQ ID NO: 347658 - DNA, 15 bp, Homo sapiens
tgatgcttctagagc

SEQ ID NO: 347659 - DNA, 15 bp, Homo sapiens
gatgcttctagagcc

SEQ ID NO: 347660 - DNA, 15 bp, Homo sapiens
atgcttctagagcct

SEQ ID NO: 347661 - DNA, 15 bp, Homo sapiens
tgcttctagagcctg

SEQ ID NO: 347662 - DNA, 15 bp, Homo sapiens
gcttctagagcctgg

SEQ ID NO: 347663 - DNA, 15 bp, Homo sapiens
cttctagagcctggc

SEQ ID NO: 347664 - DNA, 15 bp, Homo sapiens
ttctagagcctggct

SEQ ID NO: 347665 - DNA, 15 bp, Homo sapiens
tctagagcctggctg

SEQ ID NO: 347666 - DNA, 15 bp, Homo sapiens
ctagagcctggctgc

SEQ ID NO: 347667 - DNA, 15 bp, Homo sapiens
tagagcctggctgct

SEQ ID NO: 347668 - DNA, 15 bp, Homo sapiens
agagcctggctgctg

SEQ ID NO: 347669 - DNA, 15 bp, Homo sapiens
gagcctggctgctgg

SEQ ID NO: 347670 - DNA, 15 bp, Homo sapiens
agcctggctgctggc

SEQ ID NO: 347671 - DNA, 15 bp, Homo sapiens
gcctggctgctggct

SEQ ID NO: 347672 - DNA, 15 bp, Homo sapiens
cctggctgctggctt

SEQ ID NO: 347673 - DNA, 15 bp, Homo sapiens
ctggctgctggctta

SEQ ID NO: 347674 - DNA, 15 bp, Homo sapiens
tggctgctggcttaa

SEQ ID NO: 347675 - DNA, 15 bp, Homo sapiens
ggctgctggcttaat

SEQ ID NO: 347676 - DNA, 15 bp, Homo sapiens
gctgctggcttaata

SEQ ID NO: 347677 - DNA, 15 bp, Homo sapiens
ctgctggcttaatat

SEQ ID NO: 347678 - DNA, 15 bp, Homo sapiens
tgctggcttaatatt

SEQ ID NO: 347679 - DNA, 15 bp, Homo sapiens
gctggcttaatattc

SEQ ID NO: 347680 - DNA, 15 bp, Homo sapiens
ctggcttaatattcc

SEQ ID NO: 347681 - DNA, 15 bp, Homo sapiens
tggcttaatattcct

SEQ ID NO: 347682 - DNA, 15 bp, Homo sapiens
ggcttaatattcctg

SEQ ID NO: 347683 - DNA, 15 bp, Homo sapiens
gcttaatattcctgc

SEQ ID NO: 347684 - DNA, 15 bp, Homo sapiens
cttaatattcctgca

SEQ ID NO: 347685 - DNA, 15 bp, Homo sapiens
ttaatattcctgcac

SEQ ID NO: 347686 - DNA, 15 bp, Homo sapiens
taatattcctgcact

SEQ ID NO: 347687 - DNA, 15 bp, Homo sapiens
aatattcctgcactc

SEQ ID NO: 347688 - DNA, 15 bp, Homo sapiens
atattcctgcactca

SEQ ID NO: 347689 - DNA, 15 bp, Homo sapiens
tattcctgcactcac

SEQ ID NO: 347690 - DNA, 15 bp, Homo sapiens
attcctgcactcacc

SEQ ID NO: 347691 - DNA, 15 bp, Homo sapiens
ttcctgcactcacca

SEQ ID NO: 347692 - DNA, 15 bp, Homo sapiens
tcctgcactcaccag

SEQ ID NO: 347693 - DNA, 15 bp, Homo sapiens
cctgcactcaccagg

SEQ ID NO: 347694 - DNA, 15 bp, Homo sapiens
ctgcactcaccaggt

SEQ ID NO: 347695 - DNA, 15 bp, Homo sapiens
tgcactcaccaggtt

SEQ ID NO: 347696 - DNA, 15 bp, Homo sapiens
gcactcaccaggttg

SEQ ID NO: 347697 - DNA, 15 bp, Homo sapiens
cactcaccaggttgc

SEQ ID NO: 347698 - DNA, 15 bp, Homo sapiens
actcaccaggttgct

SEQ ID NO: 347699 - DNA, 15 bp, Homo sapiens
ctcaccaggttgctt

SEQ ID NO: 347700 - DNA, 15 bp, Homo sapiens
tcaccaggttgcttc

SEQ ID NO: 347701 - DNA, 15 bp, Homo sapiens
caccaggttgcttcc

SEQ ID NO: 347702 - DNA, 15 bp, Homo sapiens
accaggttgcttccc

SEQ ID NO: 347703 - DNA, 15 bp, Homo sapiens
ccaggttgcttccca

SEQ ID NO: 347704 - DNA, 15 bp, Homo sapiens
caggttgcttcccag

SEQ ID NO: 347705 - DNA, 15 bp, Homo sapiens
aggttgcttcccagc

SEQ ID NO: 347706 - DNA, 15 bp, Homo sapiens
ggttgcttcccagca

SEQ ID NO: 347707 - DNA, 15 bp, Homo sapiens
gttgcttcccagcat

SEQ ID NO: 347708 - DNA, 15 bp, Homo sapiens
ttgcttcccagcata

SEQ ID NO: 347709 - DNA, 15 bp, Homo sapiens
tgcttcccagcataa

SEQ ID NO: 347710 - DNA, 15 bp, Homo sapiens
gcttcccagcataag

SEQ ID NO: 347711 - DNA, 15 bp, Homo sapiens
cttcccagcataagg

SEQ ID NO: 347712 - DNA, 15 bp, Homo sapiens
ttcccagcataaggc

SEQ ID NO: 347713 - DNA, 15 bp, Homo sapiens
tcccagcataaggca

SEQ ID NO: 347714 - DNA, 15 bp, Homo sapiens
cccagcataaggcat

SEQ ID NO: 347715 - DNA, 15 bp, Homo sapiens
ccagcataaggcatc

SEQ ID NO: 347716 - DNA, 15 bp, Homo sapiens
cagcataaggcatcc

SEQ ID NO: 347717 - DNA, 15 bp, Homo sapiens
agcataaggcatcct

SEQ ID NO: 347718 - DNA, 15 bp, Homo sapiens
gcataaggcatcctc

SEQ ID NO: 347719 - DNA, 15 bp, Homo sapiens
cataaggcatcctcg

SEQ ID NO: 347720 - DNA, 15 bp, Homo sapiens
ataaggcatcctcgc

SEQ ID NO: 347721 - DNA, 15 bp, Homo sapiens
taaggcatcctcgcc

SEQ ID NO: 347722 - DNA, 15 bp, Homo sapiens
aaggcatcctcgcca

SEQ ID NO: 347723 - DNA, 15 bp, Homo sapiens
aggcatcctcgccat

SEQ ID NO: 347724 - DNA, 15 bp, Homo sapiens
ggcatcctcgccatt

SEQ ID NO: 347725 - DNA, 15 bp, Homo sapiens
gcatcctcgccattc

SEQ ID NO: 347726 - DNA, 15 bp, Homo sapiens
catcctcgccattca

SEQ ID NO: 347727 - DNA, 15 bp, Homo sapiens
atcctcgccattcat

SEQ ID NO: 347728 - DNA, 15 bp, Homo sapiens
tcctcgccattcatt

SEQ ID NO: 347729 - DNA, 15 bp, Homo sapiens
cctcgccattcattt

SEQ ID NO: 347730 - DNA, 15 bp, Homo sapiens
ctcgccattcatttt

SEQ ID NO: 347731 - DNA, 15 bp, Homo sapiens
tcgccattcattttt

SEQ ID NO: 347732 - DNA, 15 bp, Homo sapiens
cgccattcatttttt

SEQ ID NO: 347733 - DNA, 15 bp, Homo sapiens
gccattcatttttta

SEQ ID NO: 347734 - DNA, 15 bp, Homo sapiens
ccattcattttttaa

SEQ ID NO: 347735 - DNA, 15 bp, Homo sapiens
cattcattttttaat

SEQ ID NO: 347736 - DNA, 15 bp, Homo sapiens
tcattttttaattta

SEQ ID NO: 347737 - DNA, 15 bp, Homo sapiens
cattttttaatttat

SEQ ID NO: 347738 - DNA, 15 bp, Homo sapiens
attttttaatttata

SEQ ID NO: 347739 - DNA, 15 bp, Homo sapiens
ttttttaatttatat

SEQ ID NO: 347740 - DNA, 15 bp, Homo sapiens
tttttaatttatatg

SEQ ID NO: 347741 - DNA, 15 bp, Homo sapiens
ttttaatttatatga

SEQ ID NO: 347742 - DNA, 15 bp, Homo sapiens
tttaatttatatgac

SEQ ID NO: 347743 - DNA, 15 bp, Homo sapiens
ttaatttatatgaca

SEQ ID NO: 347744 - DNA, 15 bp, Homo sapiens
taatttatatgacac

SEQ ID NO: 347745 - DNA, 15 bp, Homo sapiens
aatttatatgacact

SEQ ID NO: 347746 - DNA, 15 bp, Homo sapiens
atttatatgacactg

SEQ ID NO: 347747 - DNA, 15 bp, Homo sapiens
tttatatgacactgt

SEQ ID NO: 347748 - DNA, 15 bp, Homo sapiens
ttatatgacactgtg

SEQ ID NO: 347749 - DNA, 15 bp, Homo sapiens
tatatgacactgtgc

SEQ ID NO: 347750 - DNA, 15 bp, Homo sapiens
atatgacactgtgct

SEQ ID NO: 347751 - DNA, 15 bp, Homo sapiens
tatgacactgtgctt

SEQ ID NO: 347752 - DNA, 15 bp, Homo sapiens
atgacactgtgcttt

SEQ ID NO: 347753 - DNA, 15 bp, Homo sapiens
tgacactgtgctttg

SEQ ID NO: 347754 - DNA, 15 bp, Homo sapiens
gacactgtgctttgg

SEQ ID NO: 347755 - DNA, 15 bp, Homo sapiens
acactgtgctttggt

SEQ ID NO: 347756 - DNA, 15 bp, Homo sapiens
cactgtgctttggtc

SEQ ID NO: 347757 - DNA, 15 bp, Homo sapiens
actgtgctttggtca

SEQ ID NO: 347758 - DNA, 15 bp, Homo sapiens
ctgtgctttggtcac

SEQ ID NO: 347759 - DNA, 15 bp, Homo sapiens
tgtgctttggtcacc

SEQ ID NO: 347760 - DNA, 15 bp, Homo sapiens
gtgctttggtcacca

SEQ ID NO: 347761 - DNA, 15 bp, Homo sapiens
tgctttggtcaccaa

SEQ ID NO: 347762 - DNA, 15 bp, Homo sapiens
gctttggtcaccaag

SEQ ID NO: 347763 - DNA, 15 bp, Homo sapiens
ctttggtcaccaaga

SEQ ID NO: 347764 - DNA, 15 bp, Homo sapiens
tttggtcaccaagac

SEQ ID NO: 347765 - DNA, 15 bp, Homo sapiens
ttggtcaccaagacc

SEQ ID NO: 347766 - DNA, 15 bp, Homo sapiens
tggtcaccaagacct

SEQ ID NO: 347767 - DNA, 15 bp, Homo sapiens
ggtcaccaagacctg

SEQ ID NO: 347768 - DNA, 15 bp, Homo sapiens
gtcaccaagacctga

SEQ ID NO: 347769 - DNA, 15 bp, Homo sapiens
tcaccaagacctgag

SEQ ID NO: 347770 - DNA, 15 bp, Homo sapiens
caccaagacctgagc

SEQ ID NO: 347771 - DNA, 15 bp, Homo sapiens
accaagacctgagct

SEQ ID NO: 347772 - DNA, 15 bp, Homo sapiens
ccaagacctgagctg

SEQ ID NO: 347773 - DNA, 15 bp, Homo sapiens
caagacctgagctgc

SEQ ID NO: 347774 - DNA, 15 bp, Homo sapiens
aagacctgagctgcc

SEQ ID NO: 347775 - DNA, 15 bp, Homo sapiens
agacctgagctgcct

SEQ ID NO: 347776 - DNA, 15 bp, Homo sapiens
gacctgagctgcctc

SEQ ID NO: 347777 - DNA, 15 bp, Homo sapiens
acctgagctgcctcc

SEQ ID NO: 347778 - DNA, 15 bp, Homo sapiens
cctgagctgcctcct

SEQ ID NO: 347779 - DNA, 15 bp, Homo sapiens
ctgagctgcctccta

SEQ ID NO: 347780 - DNA, 15 bp, Homo sapiens
tgagctgcctcctag

SEQ ID NO: 347781 - DNA, 15 bp, Homo sapiens
gagctgcctcctagt

SEQ ID NO: 347782 - DNA, 15 bp, Homo sapiens
agctgcctcctagtt

SEQ ID NO: 347783 - DNA, 15 bp, Homo sapiens
gctgcctcctagttt

SEQ ID NO: 347784 - DNA, 15 bp, Homo sapiens
ctgcctcctagtttt

SEQ ID NO: 347785 - DNA, 15 bp, Homo sapiens
tgcctcctagttttt

SEQ ID NO: 347786 - DNA, 15 bp, Homo sapiens
gcctcctagtttttc

SEQ ID NO: 347787 - DNA, 15 bp, Homo sapiens
cctcctagtttttct

SEQ ID NO: 347788 - DNA, 15 bp, Homo sapiens
ctcctagtttttcta

SEQ ID NO: 347789 - DNA, 15 bp, Homo sapiens
tcctagtttttctag

SEQ ID NO: 347790 - DNA, 15 bp, Homo sapiens
cctagtttttctagc

SEQ ID NO: 347791 - DNA, 15 bp, Homo sapiens
ctagtttttctagcc

SEQ ID NO: 347792 - DNA, 15 bp, Homo sapiens
tagtttttctagcca

SEQ ID NO: 347793 - DNA, 15 bp, Homo sapiens
agtttttctagccag

SEQ ID NO: 347794 - DNA, 15 bp, Homo sapiens
gtttttctagccagc

SEQ ID NO: 347795 - DNA, 15 bp, Homo sapiens
tttttctagccagct

SEQ ID NO: 347796 - DNA, 15 bp, Homo sapiens
ttttctagccagctt

SEQ ID NO: 347797 - DNA, 15 bp, Homo sapiens
tttctagccagcttt

SEQ ID NO: 347798 - DNA, 15 bp, Homo sapiens
ttctagccagctttc

SEQ ID NO: 347799 - DNA, 15 bp, Homo sapiens
tctagccagctttct

SEQ ID NO: 347800 - DNA, 15 bp, Homo sapiens
ctagccagctttctt

SEQ ID NO: 347801 - DNA, 15 bp, Homo sapiens
tagccagctttcttt

SEQ ID NO: 347802 - DNA, 15 bp, Homo sapiens
agccagctttctttt

SEQ ID NO: 347803 - DNA, 15 bp, Homo sapiens
gccagctttcttttt

SEQ ID NO: 347804 - DNA, 15 bp, Homo sapiens
ccagctttctttttt

SEQ ID NO: 347805 - DNA, 15 bp, Homo sapiens
cagctttcttttttt

SEQ ID NO: 347806 - DNA, 15 bp, Homo sapiens
agctttctttttttc

SEQ ID NO: 347807 - DNA, 15 bp, Homo sapiens
gctttctttttttct

SEQ ID NO: 347808 - DNA, 15 bp, Homo sapiens
tttctttttttctta

SEQ ID NO: 347809 - DNA, 15 bp, Homo sapiens
ttctttttttcttag

SEQ ID NO: 347810 - DNA, 15 bp, Homo sapiens
tctttttttcttagg

SEQ ID NO: 347811 - DNA, 15 bp, Homo sapiens
ctttttttcttagga

SEQ ID NO: 347812 - DNA, 15 bp, Homo sapiens
tttttttcttaggac

SEQ ID NO: 347813 - DNA, 15 bp, Homo sapiens
tttttcttaggacaa

SEQ ID NO: 347814 - DNA, 15 bp, Homo sapiens
ttttcttaggacaaa

SEQ ID NO: 347815 - DNA, 15 bp, Homo sapiens
tttcttaggacaaag

SEQ ID NO: 347816 - DNA, 15 bp, Homo sapiens
ttcttaggacaaagg

SEQ ID NO: 347817 - DNA, 15 bp, Homo sapiens
tcttaggacaaaggg

SEQ ID NO: 347818 - DNA, 15 bp, Homo sapiens
cttaggacaaagggt

SEQ ID NO: 347819 - DNA, 15 bp, Homo sapiens
ttaggacaaagggtc

SEQ ID NO: 347820 - DNA, 15 bp, Homo sapiens
taggacaaagggtct

SEQ ID NO: 347821 - DNA, 15 bp, Homo sapiens
aggacaaagggtctt

SEQ ID NO: 347822 - DNA, 15 bp, Homo sapiens
ggacaaagggtcttc

SEQ ID NO: 347823 - DNA, 15 bp, Homo sapiens
gacaaagggtcttct

SEQ ID NO: 347824 - DNA, 15 bp, Homo sapiens
acaaagggtcttctt

SEQ ID NO: 347825 - DNA, 15 bp, Homo sapiens
caaagggtcttcttt

SEQ ID NO: 347826 - DNA, 15 bp, Homo sapiens
aaagggtcttctttc

SEQ ID NO: 347827 - DNA, 15 bp, Homo sapiens
aagggtcttctttct

SEQ ID NO: 347828 - DNA, 15 bp, Homo sapiens
agggtcttctttctg

SEQ ID NO: 347829 - DNA, 15 bp, Homo sapiens
gggtcttctttctga

SEQ ID NO: 347830 - DNA, 15 bp, Homo sapiens
ggtcttctttctgaa

SEQ ID NO: 347831 - DNA, 15 bp, Homo sapiens
gtcttctttctgaag

SEQ ID NO: 347832 - DNA, 15 bp, Homo sapiens
tcttctttctgaagt

SEQ ID NO: 347833 - DNA, 15 bp, Homo sapiens
cttctttctgaagtc

SEQ ID NO: 347834 - DNA, 15 bp, Homo sapiens
ttctttctgaagtcg

SEQ ID NO: 347835 - DNA, 15 bp, Homo sapiens
tctttctgaagtcgg

SEQ ID NO: 347836 - DNA, 15 bp, Homo sapiens
ctttctgaagtcggg

SEQ ID NO: 347837 - DNA, 15 bp, Homo sapiens
tttctgaagtcgggc

SEQ ID NO: 347838 - DNA, 15 bp, Homo sapiens
ttctgaagtcgggcc

SEQ ID NO: 347839 - DNA, 15 bp, Homo sapiens
tctgaagtcgggcct

SEQ ID NO: 347840 - DNA, 15 bp, Homo sapiens
ctgaagtcgggccta

SEQ ID NO: 347841 - DNA, 15 bp, Homo sapiens
tgaagtcgggcctag

SEQ ID NO: 347842 - DNA, 15 bp, Homo sapiens
gaagtcgggcctaga

SEQ ID NO: 347843 - DNA, 15 bp, Homo sapiens
aagtcgggcctagac

SEQ ID NO: 347844 - DNA, 15 bp, Homo sapiens
agtcgggcctagaca

SEQ ID NO: 347845 - DNA, 15 bp, Homo sapiens
gtcgggcctagacag

SEQ ID NO: 347846 - DNA, 15 bp, Homo sapiens
tcgggcctagacaga

SEQ ID NO: 347847 - DNA, 15 bp, Homo sapiens
cgggcctagacagat

SEQ ID NO: 347848 - DNA, 15 bp, Homo sapiens
gggcctagacagatc

SEQ ID NO: 347849 - DNA, 15 bp, Homo sapiens
ggcctagacagatca

SEQ ID NO: 347850 - DNA, 15 bp, Homo sapiens
gcctagacagatcaa

SEQ ID NO: 347851 - DNA, 15 bp, Homo sapiens
cctagacagatcaag

SEQ ID NO: 347852 - DNA, 15 bp, Homo sapiens
ctagacagatcaagg

SEQ ID NO: 347853 - DNA, 15 bp, Homo sapiens
tagacagatcaaggt

SEQ ID NO: 347854 - DNA, 15 bp, Homo sapiens
agacagatcaaggta

SEQ ID NO: 347855 - DNA, 15 bp, Homo sapiens
gacagatcaaggtag

SEQ ID NO: 347856 - DNA, 15 bp, Homo sapiens
acagatcaaggtagt

SEQ ID NO: 347857 - DNA, 15 bp, Homo sapiens
cagatcaaggtagtt

SEQ ID NO: 347858 - DNA, 15 bp, Homo sapiens
agatcaaggtagttg

SEQ ID NO: 347859 - DNA, 15 bp, Homo sapiens
gatcaaggtagttga

SEQ ID NO: 347860 - DNA, 15 bp, Homo sapiens
atcaaggtagttgat

SEQ ID NO: 347861 - DNA, 15 bp, Homo sapiens
tcaaggtagttgatc

SEQ ID NO: 347862 - DNA, 15 bp, Homo sapiens
caaggtagttgatct

SEQ ID NO: 347863 - DNA, 15 bp, Homo sapiens
aaggtagttgatctt

SEQ ID NO: 347864 - DNA, 15 bp, Homo sapiens
aggtagttgatctta

SEQ ID NO: 347865 - DNA, 15 bp, Homo sapiens
ggtagttgatcttat

SEQ ID NO: 347866 - DNA, 15 bp, Homo sapiens
gtagttgatcttatt

SEQ ID NO: 347867 - DNA, 15 bp, Homo sapiens
tagttgatcttattt

SEQ ID NO: 347868 - DNA, 15 bp, Homo sapiens
agttgatcttatttc

SEQ ID NO: 347869 - DNA, 15 bp, Homo sapiens
gttgatcttatttca

SEQ ID NO: 347870 - DNA, 15 bp, Homo sapiens
ttgatcttatttcac

SEQ ID NO: 347871 - DNA, 15 bp, Homo sapiens
tgatcttatttcact

SEQ ID NO: 347872 - DNA, 15 bp, Homo sapiens
gatcttatttcactg

SEQ ID NO: 347873 - DNA, 15 bp, Homo sapiens
atcttatttcactgg

SEQ ID NO: 347874 - DNA, 15 bp, Homo sapiens
tcttatttcactggt

SEQ ID NO: 347875 - DNA, 15 bp, Homo sapiens
cttatttcactggtt

SEQ ID NO: 347876 - DNA, 15 bp, Homo sapiens
ttatttcactggttc

SEQ ID NO: 347877 - DNA, 15 bp, Homo sapiens
tatttcactggttca

SEQ ID NO: 347878 - DNA, 15 bp, Homo sapiens
atttcactggttcag

SEQ ID NO: 347879 - DNA, 15 bp, Homo sapiens
tttcactggttcagg

SEQ ID NO: 347880 - DNA, 15 bp, Homo sapiens
ttcactggttcaggt

SEQ ID NO: 347881 - DNA, 15 bp, Homo sapiens
tcactggttcaggtg

SEQ ID NO: 347882 - DNA, 15 bp, Homo sapiens
cactggttcaggtga

SEQ ID NO: 347883 - DNA, 15 bp, Homo sapiens
actggttcaggtgat

SEQ ID NO: 347884 - DNA, 15 bp, Homo sapiens
ctggttcaggtgata

SEQ ID NO: 347885 - DNA, 15 bp, Homo sapiens
tggttcaggtgataa

SEQ ID NO: 347886 - DNA, 15 bp, Homo sapiens
ggttcaggtgataaa

SEQ ID NO: 347887 - DNA, 15 bp, Homo sapiens
gttcaggtgataaac

SEQ ID NO: 347888 - DNA, 15 bp, Homo sapiens
ttcaggtgataaact

SEQ ID NO: 347889 - DNA, 15 bp, Homo sapiens
tcaggtgataaacta

SEQ ID NO: 347890 - DNA, 15 bp, Homo sapiens
caggtgataaactag

SEQ ID NO: 347891 - DNA, 15 bp, Homo sapiens
aggtgataaactagc

SEQ ID NO: 347892 - DNA, 15 bp, Homo sapiens
ggtgataaactagca

SEQ ID NO: 347893 - DNA, 15 bp, Homo sapiens
gtgataaactagcag

SEQ ID NO: 347894 - DNA, 15 bp, Homo sapiens
tgataaactagcaga

SEQ ID NO: 347895 - DNA, 15 bp, Homo sapiens
gataaactagcagag

SEQ ID NO: 347896 - DNA, 15 bp, Homo sapiens
ataaactagcagagt

SEQ ID NO: 347897 - DNA, 15 bp, Homo sapiens
taaactagcagagta

SEQ ID NO: 347898 - DNA, 15 bp, Homo sapiens
aaactagcagagtag

SEQ ID NO: 347899 - DNA, 15 bp, Homo sapiens
aactagcagagtaga

SEQ ID NO: 347900 - DNA, 15 bp, Homo sapiens
actagcagagtagaa

SEQ ID NO: 347901 - DNA, 15 bp, Homo sapiens
ctagcagagtagaag

SEQ ID NO: 347902 - DNA, 15 bp, Homo sapiens
tagcagagtagaagc

SEQ ID NO: 347903 - DNA, 15 bp, Homo sapiens
agcagagtagaagca

SEQ ID NO: 347904 - DNA, 15 bp, Homo sapiens
gcagagtagaagcat

SEQ ID NO: 347905 - DNA, 15 bp, Homo sapiens
cagagtagaagcatg

SEQ ID NO: 347906 - DNA, 15 bp, Homo sapiens
agagtagaagcatgg

SEQ ID NO: 347907 - DNA, 15 bp, Homo sapiens
gagtagaagcatggc

SEQ ID NO: 347908 - DNA, 15 bp, Homo sapiens
agtagaagcatggca

SEQ ID NO: 347909 - DNA, 15 bp, Homo sapiens
gtagaagcatggcat

SEQ ID NO: 347910 - DNA, 15 bp, Homo sapiens
tagaagcatggcatg

SEQ ID NO: 347911 - DNA, 15 bp, Homo sapiens
agaagcatggcatgg

SEQ ID NO: 347912 - DNA, 15 bp, Homo sapiens
gaagcatggcatgga

SEQ ID NO: 347913 - DNA, 15 bp, Homo sapiens
aagcatggcatggat

SEQ ID NO: 347914 - DNA, 15 bp, Homo sapiens
agcatggcatggatg

SEQ ID NO: 347915 - DNA, 15 bp, Homo sapiens
gcatggcatggatgg

SEQ ID NO: 347916 - DNA, 15 bp, Homo sapiens
catggcatggatgga

SEQ ID NO: 347917 - DNA, 15 bp, Homo sapiens
atggcatggatggaa

SEQ ID NO: 347918 - DNA, 15 bp, Homo sapiens
tggcatggatggaaa

SEQ ID NO: 347919 - DNA, 15 bp, Homo sapiens
ggcatggatggaaac

SEQ ID NO: 347920 - DNA, 15 bp, Homo sapiens
gcatggatggaaaca

SEQ ID NO: 347921 - DNA, 15 bp, Homo sapiens
catggatggaaacat

SEQ ID NO: 347922 - DNA, 15 bp, Homo sapiens
atggatggaaacata

SEQ ID NO: 347923 - DNA, 15 bp, Homo sapiens
tggatggaaacatat

SEQ ID NO: 347924 - DNA, 15 bp, Homo sapiens
ggatggaaacatata

SEQ ID NO: 347925 - DNA, 15 bp, Homo sapiens
gatggaaacatatat

SEQ ID NO: 347926 - DNA, 15 bp, Homo sapiens
atggaaacatatatt

SEQ ID NO: 347927 - DNA, 15 bp, Homo sapiens
tggaaacatatatta

SEQ ID NO: 347928 - DNA, 15 bp, Homo sapiens
ggaaacatatattat

SEQ ID NO: 347929 - DNA, 15 bp, Homo sapiens
gaaacatatattatc

SEQ ID NO: 347930 - DNA, 15 bp, Homo sapiens
aaacatatattatct

SEQ ID NO: 347931 - DNA, 15 bp, Homo sapiens
aacatatattatcta

SEQ ID NO: 347932 - DNA, 15 bp, Homo sapiens
acatatattatctag

SEQ ID NO: 347933 - DNA, 15 bp, Homo sapiens
catatattatctaga

SEQ ID NO: 347934 - DNA, 15 bp, Homo sapiens
atatattatctagaa

SEQ ID NO: 347935 - DNA, 15 bp, Homo sapiens
tatattatctagaaa

SEQ ID NO: 347936 - DNA, 15 bp, Homo sapiens
atattatctagaaaa

SEQ ID NO: 347937 - DNA, 15 bp, Homo sapiens
tattatctagaaaag

SEQ ID NO: 347938 - DNA, 15 bp, Homo sapiens
attatctagaaaagg

SEQ ID NO: 347939 - DNA, 15 bp, Homo sapiens
ttatctagaaaaggc

SEQ ID NO: 347940 - DNA, 15 bp, Homo sapiens
tatctagaaaaggca

SEQ ID NO: 347941 - DNA, 15 bp, Homo sapiens
atctagaaaaggcag

SEQ ID NO: 347942 - DNA, 15 bp, Homo sapiens
tctagaaaaggcagt

SEQ ID NO: 347943 - DNA, 15 bp, Homo sapiens
ctagaaaaggcagtg

SEQ ID NO: 347944 - DNA, 15 bp, Homo sapiens
tagaaaaggcagtgg

SEQ ID NO: 347945 - DNA, 15 bp, Homo sapiens
agaaaaggcagtggc

SEQ ID NO: 347946 - DNA, 15 bp, Homo sapiens
gaaaaggcagtggct

SEQ ID NO: 347947 - DNA, 15 bp, Homo sapiens
aaaaggcagtggctg

SEQ ID NO: 347948 - DNA, 15 bp, Homo sapiens
aaaggcagtggctga

SEQ ID NO: 347949 - DNA, 15 bp, Homo sapiens
aaggcagtggctgaa

SEQ ID NO: 347950 - DNA, 15 bp, Homo sapiens
aggcagtggctgaag

SEQ ID NO: 347951 - DNA, 15 bp, Homo sapiens
ggcagtggctgaagt

SEQ ID NO: 347952 - DNA, 15 bp, Homo sapiens
gcagtggctgaagtt

SEQ ID NO: 347953 - DNA, 15 bp, Homo sapiens
cagtggctgaagttc

SEQ ID NO: 347954 - DNA, 15 bp, Homo sapiens
agtggctgaagttct

SEQ ID NO: 347955 - DNA, 15 bp, Homo sapiens
gtggctgaagttcta

SEQ ID NO: 347956 - DNA, 15 bp, Homo sapiens
tggctgaagttctac

SEQ ID NO: 347957 - DNA, 15 bp, Homo sapiens
ggctgaagttctact

SEQ ID NO: 347958 - DNA, 15 bp, Homo sapiens
gctgaagttctactg

SEQ ID NO: 347959 - DNA, 15 bp, Homo sapiens
ctgaagttctactga

SEQ ID NO: 347960 - DNA, 15 bp, Homo sapiens
tgaagttctactgat

SEQ ID NO: 347961 - DNA, 15 bp, Homo sapiens
gaagttctactgatg

SEQ ID NO: 347962 - DNA, 15 bp, Homo sapiens
aagttctactgatgt

SEQ ID NO: 347963 - DNA, 15 bp, Homo sapiens
agttctactgatgtg

SEQ ID NO: 347964 - DNA, 15 bp, Homo sapiens
gttctactgatgtgc

SEQ ID NO: 347965 - DNA, 15 bp, Homo sapiens
ttctactgatgtgcc

SEQ ID NO: 347966 - DNA, 15 bp, Homo sapiens
tctactgatgtgcct

SEQ ID NO: 347967 - DNA, 15 bp, Homo sapiens
ctactgatgtgcctg

SEQ ID NO: 347968 - DNA, 15 bp, Homo sapiens
tactgatgtgcctga

SEQ ID NO: 347969 - DNA, 15 bp, Homo sapiens
actgatgtgcctgaa

SEQ ID NO: 347970 - DNA, 15 bp, Homo sapiens
ctgatgtgcctgaat

SEQ ID NO: 347971 - DNA, 15 bp, Homo sapiens
tgatgtgcctgaatc

SEQ ID NO: 347972 - DNA, 15 bp, Homo sapiens
gatgtgcctgaatcg

SEQ ID NO: 347973 - DNA, 15 bp, Homo sapiens
atgtgcctgaatcgt

SEQ ID NO: 347974 - DNA, 15 bp, Homo sapiens
tgtgcctgaatcgtt

SEQ ID NO: 347975 - DNA, 15 bp, Homo sapiens
gtgcctgaatcgtta

SEQ ID NO: 347976 - DNA, 15 bp, Homo sapiens
tgcctgaatcgttat

SEQ ID NO: 347977 - DNA, 15 bp, Homo sapiens
gcctgaatcgttatt

SEQ ID NO: 347978 - DNA, 15 bp, Homo sapiens
cctgaatcgttattt

SEQ ID NO: 347979 - DNA, 15 bp, Homo sapiens
ctgaatcgttatttt

SEQ ID NO: 347980 - DNA, 15 bp, Homo sapiens
tgaatcgttatttta

SEQ ID NO: 347981 - DNA, 15 bp, Homo sapiens
gaatcgttattttaa

SEQ ID NO: 347982 - DNA, 15 bp, Homo sapiens
aatcgttattttaaa

SEQ ID NO: 347983 - DNA, 15 bp, Homo sapiens
atcgttattttaaaa

SEQ ID NO: 347984 - DNA, 15 bp, Homo sapiens
tcgttattttaaaat

SEQ ID NO: 347985 - DNA, 15 bp, Homo sapiens
cgttattttaaaatg

SEQ ID NO: 347986 - DNA, 15 bp, Homo sapiens
gttattttaaaatgt

SEQ ID NO: 347987 - DNA, 15 bp, Homo sapiens
ttattttaaaatgtc

SEQ ID NO: 347988 - DNA, 15 bp, Homo sapiens
tattttaaaatgtct

SEQ ID NO: 347989 - DNA, 15 bp, Homo sapiens
attttaaaatgtctt

SEQ ID NO: 347990 - DNA, 15 bp, Homo sapiens
tttaaaatgtctttc

SEQ ID NO: 347991 - DNA, 15 bp, Homo sapiens
ttaaaatgtctttct

SEQ ID NO: 347992 - DNA, 15 bp, Homo sapiens
taaaatgtctttctt

SEQ ID NO: 347993 - DNA, 15 bp, Homo sapiens
aaaatgtctttcttc

SEQ ID NO: 347994 - DNA, 15 bp, Homo sapiens
aaatgtctttcttct

SEQ ID NO: 347995 - DNA, 15 bp, Homo sapiens
aatgtctttcttctt

SEQ ID NO: 347996 - DNA, 15 bp, Homo sapiens
atgtctttcttcttt

SEQ ID NO: 347997 - DNA, 15 bp, Homo sapiens
tgtctttcttctttg

SEQ ID NO: 347998 - DNA, 15 bp, Homo sapiens
gtctttcttctttgt

SEQ ID NO: 347999 - DNA, 15 bp, Homo sapiens
tctttcttctttgtt

SEQ ID NO: 348000 - DNA, 15 bp, Homo sapiens
ctttcttctttgttc

SEQ ID NO: 348001 - DNA, 15 bp, Homo sapiens
tttcttctttgttca

SEQ ID NO: 348002 - DNA, 15 bp, Homo sapiens
ttcttctttgttcaa

SEQ ID NO: 348003 - DNA, 15 bp, Homo sapiens
tcttctttgttcaag

SEQ ID NO: 348004 - DNA, 15 bp, Homo sapiens
cttctttgttcaagg

SEQ ID NO: 348005 - DNA, 15 bp, Homo sapiens
ttctttgttcaagga

SEQ ID NO: 348006 - DNA, 15 bp, Homo sapiens
tctttgttcaaggaa

SEQ ID NO: 348007 - DNA, 15 bp, Homo sapiens
ctttgttcaaggaat

SEQ ID NO: 348008 - DNA, 15 bp, Homo sapiens
tttgttcaaggaatt

SEQ ID NO: 348009 - DNA, 15 bp, Homo sapiens
ttgttcaaggaattg

SEQ ID NO: 348010 - DNA, 15 bp, Homo sapiens
tgttcaaggaattga

SEQ ID NO: 348011 - DNA, 15 bp, Homo sapiens
gttcaaggaattgaa

SEQ ID NO: 348012 - DNA, 15 bp, Homo sapiens
ttcaaggaattgaaa

SEQ ID NO: 348013 - DNA, 15 bp, Homo sapiens
tcaaggaattgaaat

SEQ ID NO: 348014 - DNA, 15 bp, Homo sapiens
caaggaattgaaata

SEQ ID NO: 348015 - DNA, 15 bp, Homo sapiens
aaggaattgaaataa

SEQ ID NO: 348016 - DNA, 15 bp, Homo sapiens
aggaattgaaataaa

SEQ ID NO: 348017 - DNA, 15 bp, Homo sapiens
ggaattgaaataaac

SEQ ID NO: 348018 - DNA, 15 bp, Homo sapiens
gaattgaaataaaca

SEQ ID NO: 348019 - DNA, 15 bp, Homo sapiens
aattgaaataaacat

SEQ ID NO: 348020 - DNA, 15 bp, Homo sapiens
attgaaataaacatc

SEQ ID NO: 348021 - DNA, 15 bp, Homo sapiens
ttgaaataaacatca

SEQ ID NO: 348022 - DNA, 15 bp, Homo sapiens
tgaaataaacatcat

SEQ ID NO: 348023 - DNA, 15 bp, Homo sapiens
gaaataaacatcatt

SEQ ID NO: 348024 - DNA, 15 bp, Homo sapiens
aaataaacatcatta

SEQ ID NO: 348025 - DNA, 15 bp, Homo sapiens
aataaacatcattat

SEQ ID NO: 348026 - DNA, 15 bp, Homo sapiens
ataaacatcattatt

SEQ ID NO: 348027 - DNA, 15 bp, Homo sapiens
taaacatcattattt

SEQ ID NO: 348028 - DNA, 15 bp, Homo sapiens
aaacatcattatttt

SEQ ID NO: 348029 - DNA, 15 bp, Homo sapiens
aacatcattattttt

SEQ ID NO: 348030 - DNA, 15 bp, Homo sapiens
acatcattattttta

SEQ ID NO: 348031 - DNA, 15 bp, Homo sapiens
catcattatttttaa

SEQ ID NO: 348032 - DNA, 15 bp, Homo sapiens
atcattatttttaag

SEQ ID NO: 348033 - DNA, 15 bp, Homo sapiens
tcattatttttaagt

SEQ ID NO: 348034 - DNA, 15 bp, Homo sapiens
cattatttttaagtg

SEQ ID NO: 348035 - DNA, 15 bp, Homo sapiens
attatttttaagtgc

SEQ ID NO: 348036 - DNA, 15 bp, Homo sapiens
ttatttttaagtgca

SEQ ID NO: 348037 - DNA, 15 bp, Homo sapiens
tatttttaagtgcat

SEQ ID NO: 348038 - DNA, 15 bp, Homo sapiens
atttttaagtgcatc

SEQ ID NO: 348039 - DNA, 15 bp, Homo sapiens
tttttaagtgcatca

SEQ ID NO: 348040 - DNA, 15 bp, Homo sapiens
ttttaagtgcatcat

SEQ ID NO: 348041 - DNA, 15 bp, Homo sapiens
tttaagtgcatcatt

SEQ ID NO: 348042 - DNA, 15 bp, Homo sapiens
ttaagtgcatcatta

SEQ ID NO: 348043 - DNA, 15 bp, Homo sapiens
taagtgcatcattat

SEQ ID NO: 348044 - DNA, 15 bp, Homo sapiens
aagtgcatcattata

SEQ ID NO: 348045 - DNA, 15 bp, Homo sapiens
agtgcatcattataa

SEQ ID NO: 348046 - DNA, 15 bp, Homo sapiens
gtgcatcattataaa

SEQ ID NO: 348047 - DNA, 15 bp, Homo sapiens
tgcatcattataaat

SEQ ID NO: 348048 - DNA, 15 bp, Homo sapiens
gcatcattataaatt

SEQ ID NO: 348049 - DNA, 15 bp, Homo sapiens
catcattataaattt

SEQ ID NO: 348050 - DNA, 15 bp, Homo sapiens
atcattataaatttt

SEQ ID NO: 348051 - DNA, 15 bp, Homo sapiens
tcattataaattttt

SEQ ID NO: 348052 - DNA, 15 bp, Homo sapiens
cattataaatttttg

SEQ ID NO: 348053 - DNA, 15 bp, Homo sapiens
attataaatttttgt

SEQ ID NO: 348054 - DNA, 15 bp, Homo sapiens
ttataaatttttgtt

SEQ ID NO: 348055 - DNA, 15 bp, Homo sapiens
tataaatttttgttg

SEQ ID NO: 348056 - DNA, 15 bp, Homo sapiens
ataaatttttgttgt

SEQ ID NO: 348057 - DNA, 15 bp, Homo sapiens
taaatttttgttgtt

SEQ ID NO: 348058 - DNA, 15 bp, Homo sapiens
aaatttttgttgttg

SEQ ID NO: 348059 - DNA, 15 bp, Homo sapiens
aatttttgttgttgt

SEQ ID NO: 348060 - DNA, 15 bp, Homo sapiens
atttttgttgttgta

SEQ ID NO: 348061 - DNA, 15 bp, Homo sapiens
tttttgttgttgtat

SEQ ID NO: 348062 - DNA, 15 bp, Homo sapiens
ttttgttgttgtatt

SEQ ID NO: 348063 - DNA, 15 bp, Homo sapiens
tttgttgttgtatta

SEQ ID NO: 348064 - DNA, 15 bp, Homo sapiens
ttgttgttgtattaa

SEQ ID NO: 348065 - DNA, 15 bp, Homo sapiens
tgttgttgtattaaa

SEQ ID NO: 348066 - DNA, 15 bp, Homo sapiens
gttgttgtattaaaa

SEQ ID NO: 348067 - DNA, 15 bp, Homo sapiens
ttgttgtattaaaag

SEQ ID NO: 348068 - DNA, 15 bp, Homo sapiens
tgttgtattaaaagg

SEQ ID NO: 348069 - DNA, 15 bp, Homo sapiens
gttgtattaaaaggg

SEQ ID NO: 348070 - DNA, 15 bp, Homo sapiens
ttgtattaaaaggga

SEQ ID NO: 348071 - DNA, 15 bp, Homo sapiens
tgtattaaaagggac

SEQ ID NO: 348072 - DNA, 15 bp, Homo sapiens
gtattaaaagggact

SEQ ID NO: 348073 - DNA, 15 bp, Homo sapiens
tattaaaagggactt

SEQ ID NO: 348074 - DNA, 15 bp, Homo sapiens
attaaaagggactta

SEQ ID NO: 348075 - DNA, 15 bp, Homo sapiens
ttaaaagggacttaa

SEQ ID NO: 348076 - DNA, 15 bp, Homo sapiens
taaaagggacttaag

SEQ ID NO: 348077 - DNA, 15 bp, Homo sapiens
aaaagggacttaaga

SEQ ID NO: 348078 - DNA, 15 bp, Homo sapiens
aaagggacttaagaa

SEQ ID NO: 348079 - DNA, 15 bp, Homo sapiens
aagggacttaagaaa

SEQ ID NO: 348080 - DNA, 15 bp, Homo sapiens
agggacttaagaaag

SEQ ID NO: 348081 - DNA, 15 bp, Homo sapiens
gggacttaagaaagt

SEQ ID NO: 348082 - DNA, 15 bp, Homo sapiens
ggacttaagaaagtg

SEQ ID NO: 348083 - DNA, 15 bp, Homo sapiens
gacttaagaaagtga

SEQ ID NO: 348084 - DNA, 15 bp, Homo sapiens
acttaagaaagtgat

SEQ ID NO: 348085 - DNA, 15 bp, Homo sapiens
cttaagaaagtgatc

SEQ ID NO: 348086 - DNA, 15 bp, Homo sapiens
ttaagaaagtgatca

SEQ ID NO: 348087 - DNA, 15 bp, Homo sapiens
taagaaagtgatcat

SEQ ID NO: 348088 - DNA, 15 bp, Homo sapiens
aagaaagtgatcatt

SEQ ID NO: 348089 - DNA, 15 bp, Homo sapiens
agaaagtgatcatta

SEQ ID NO: 348090 - DNA, 15 bp, Homo sapiens
gaaagtgatcattat

SEQ ID NO: 348091 - DNA, 15 bp, Homo sapiens
aaagtgatcattatg

SEQ ID NO: 348092 - DNA, 15 bp, Homo sapiens
aagtgatcattatgt

SEQ ID NO: 348093 - DNA, 15 bp, Homo sapiens
agtgatcattatgtg

SEQ ID NO: 348094 - DNA, 15 bp, Homo sapiens
gtgatcattatgtgt

SEQ ID NO: 348095 - DNA, 15 bp, Homo sapiens
tgatcattatgtgtg

SEQ ID NO: 348096 - DNA, 15 bp, Homo sapiens
gatcattatgtgtga

SEQ ID NO: 348097 - DNA, 15 bp, Homo sapiens
atcattatgtgtgac

SEQ ID NO: 348098 - DNA, 15 bp, Homo sapiens
tcattatgtgtgaca

SEQ ID NO: 348099 - DNA, 15 bp, Homo sapiens
cattatgtgtgacat

SEQ ID NO: 348100 - DNA, 15 bp, Homo sapiens
attatgtgtgacatt

SEQ ID NO: 348101 - DNA, 15 bp, Homo sapiens
ttatgtgtgacattg

SEQ ID NO: 348102 - DNA, 15 bp, Homo sapiens
tatgtgtgacattgc

SEQ ID NO: 348103 - DNA, 15 bp, Homo sapiens
atgtgtgacattgcc

SEQ ID NO: 348104 - DNA, 15 bp, Homo sapiens
tgtgtgacattgcct

SEQ ID NO: 348105 - DNA, 15 bp, Homo sapiens
gtgtgacattgcctc

SEQ ID NO: 348106 - DNA, 15 bp, Homo sapiens
tgtgacattgcctca

SEQ ID NO: 348107 - DNA, 15 bp, Homo sapiens
gtgacattgcctcac

SEQ ID NO: 348108 - DNA, 15 bp, Homo sapiens
tgacattgcctcact

SEQ ID NO: 348109 - DNA, 15 bp, Homo sapiens
gacattgcctcacta

SEQ ID NO: 348110 - DNA, 15 bp, Homo sapiens
acattgcctcactat

SEQ ID NO: 348111 - DNA, 15 bp, Homo sapiens
cattgcctcactatt

SEQ ID NO: 348112 - DNA, 15 bp, Homo sapiens
attgcctcactattc

SEQ ID NO: 348113 - DNA, 15 bp, Homo sapiens
ttgcctcactattct

SEQ ID NO: 348114 - DNA, 15 bp, Homo sapiens
tgcctcactattctg

SEQ ID NO: 348115 - DNA, 15 bp, Homo sapiens
gcctcactattctga

SEQ ID NO: 348116 - DNA, 15 bp, Homo sapiens
cctcactattctgag

SEQ ID NO: 348117 - DNA, 15 bp, Homo sapiens
ctcactattctgagt

SEQ ID NO: 348118 - DNA, 15 bp, Homo sapiens
tcactattctgagtg

SEQ ID NO: 348119 - DNA, 15 bp, Homo sapiens
cactattctgagtgt

SEQ ID NO: 348120 - DNA, 15 bp, Homo sapiens
actattctgagtgtt

SEQ ID NO: 348121 - DNA, 15 bp, Homo sapiens
ctattctgagtgtta

SEQ ID NO: 348122 - DNA, 15 bp, Homo sapiens
tattctgagtgttag

SEQ ID NO: 348123 - DNA, 15 bp, Homo sapiens
attctgagtgttaga

SEQ ID NO: 348124 - DNA, 15 bp, Homo sapiens
ttctgagtgttagaa

SEQ ID NO: 348125 - DNA, 15 bp, Homo sapiens
tctgagtgttagaat

SEQ ID NO: 348126 - DNA, 15 bp, Homo sapiens
ctgagtgttagaatg

SEQ ID NO: 348127 - DNA, 15 bp, Homo sapiens
tgagtgttagaatgt

SEQ ID NO: 348128 - DNA, 15 bp, Homo sapiens
gagtgttagaatgtt

SEQ ID NO: 348129 - DNA, 15 bp, Homo sapiens
agtgttagaatgttc

SEQ ID NO: 348130 - DNA, 15 bp, Homo sapiens
gtgttagaatgttca

SEQ ID NO: 348131 - DNA, 15 bp, Homo sapiens
tgttagaatgttcag

SEQ ID NO: 348132 - DNA, 15 bp, Homo sapiens
gttagaatgttcaga

SEQ ID NO: 348133 - DNA, 15 bp, Homo sapiens
ttagaatgttcagaa

SEQ ID NO: 348134 - DNA, 15 bp, Homo sapiens
tagaatgttcagaat

SEQ ID NO: 348135 - DNA, 15 bp, Homo sapiens
agaatgttcagaata

SEQ ID NO: 348136 - DNA, 15 bp, Homo sapiens
gaatgttcagaataa

SEQ ID NO: 348137 - DNA, 15 bp, Homo sapiens
aatgttcagaataaa

SEQ ID NO: 348138 - DNA, 15 bp, Homo sapiens
atgttcagaataaat

SEQ ID NO: 348139 - DNA, 15 bp, Homo sapiens
tgttcagaataaatt

SEQ ID NO: 348140 - DNA, 15 bp, Homo sapiens
gttcagaataaattc

SEQ ID NO: 348141 - DNA, 15 bp, Homo sapiens
ttcagaataaattca

SEQ ID NO: 348142 - DNA, 15 bp, Homo sapiens
tcagaataaattcaa

SEQ ID NO: 348143 - DNA, 15 bp, Homo sapiens
cagaataaattcaag

SEQ ID NO: 348144 - DNA, 15 bp, Homo sapiens
agaataaattcaaga

SEQ ID NO: 348145 - DNA, 15 bp, Homo sapiens
gaataaattcaagac

SEQ ID NO: 348146 - DNA, 15 bp, Homo sapiens
aataaattcaagaca

SEQ ID NO: 348147 - DNA, 15 bp, Homo sapiens
ataaattcaagacac

SEQ ID NO: 348148 - DNA, 15 bp, Homo sapiens
taaattcaagacaca

SEQ ID NO: 348149 - DNA, 15 bp, Homo sapiens
aaattcaagacacat

SEQ ID NO: 348150 - DNA, 15 bp, Homo sapiens
aattcaagacacatt

SEQ ID NO: 348151 - DNA, 15 bp, Homo sapiens
attcaagacacattt

SEQ ID NO: 348152 - DNA, 15 bp, Homo sapiens
ttcaagacacatttt

SEQ ID NO: 348153 - DNA, 15 bp, Homo sapiens
tcaagacacattttg

SEQ ID NO: 348154 - DNA, 15 bp, Homo sapiens
caagacacattttgt

SEQ ID NO: 348155 - DNA, 15 bp, Homo sapiens
aagacacattttgta

SEQ ID NO: 348156 - DNA, 15 bp, Homo sapiens
agacacattttgtaa

SEQ ID NO: 348157 - DNA, 15 bp, Homo sapiens
gacacattttgtaat

SEQ ID NO: 348158 - DNA, 15 bp, Homo sapiens
acacattttgtaata

SEQ ID NO: 348159 - DNA, 15 bp, Homo sapiens
cacattttgtaatat

SEQ ID NO: 348160 - DNA, 15 bp, Homo sapiens
acattttgtaatata

SEQ ID NO: 348161 - DNA, 15 bp, Homo sapiens
cattttgtaatatat

SEQ ID NO: 348162 - DNA, 15 bp, Homo sapiens
attttgtaatatata

SEQ ID NO: 348163 - DNA, 15 bp, Homo sapiens
ttttgtaatatatag

SEQ ID NO: 348164 - DNA, 15 bp, Homo sapiens
tttgtaatatataga

SEQ ID NO: 348165 - DNA, 15 bp, Homo sapiens
ttgtaatatatagac

SEQ ID NO: 348166 - DNA, 15 bp, Homo sapiens
tgtaatatatagact

SEQ ID NO: 348167 - DNA, 15 bp, Homo sapiens
gtaatatatagactg

SEQ ID NO: 348168 - DNA, 15 bp, Homo sapiens
taatatatagactgt

SEQ ID NO: 348169 - DNA, 15 bp, Homo sapiens
aatatatagactgtt

SEQ ID NO: 348170 - DNA, 15 bp, Homo sapiens
atatatagactgttt

SEQ ID NO: 348171 - DNA, 15 bp, Homo sapiens
tatatagactgtttg

SEQ ID NO: 348172 - DNA, 15 bp, Homo sapiens
atatagactgtttgc

SEQ ID NO: 348173 - DNA, 15 bp, Homo sapiens
tatagactgtttgct

SEQ ID NO: 348174 - DNA, 15 bp, Homo sapiens
atagactgtttgctt

SEQ ID NO: 348175 - DNA, 15 bp, Homo sapiens
tagactgtttgcttg

SEQ ID NO: 348176 - DNA, 15 bp, Homo sapiens
agactgtttgcttgt

SEQ ID NO: 348177 - DNA, 15 bp, Homo sapiens
gactgtttgcttgtt

SEQ ID NO: 348178 - DNA, 15 bp, Homo sapiens
actgtttgcttgttt

SEQ ID NO: 348179 - DNA, 15 bp, Homo sapiens
ctgtttgcttgtttt

SEQ ID NO: 348180 - DNA, 15 bp, Homo sapiens
tgtttgcttgttttt

SEQ ID NO: 348181 - DNA, 15 bp, Homo sapiens
gtttgcttgtttttc

SEQ ID NO: 348182 - DNA, 15 bp, Homo sapiens
tttgcttgtttttca

SEQ ID NO: 348183 - DNA, 15 bp, Homo sapiens
ttgcttgtttttcat

SEQ ID NO: 348184 - DNA, 15 bp, Homo sapiens
tgcttgtttttcatg

SEQ ID NO: 348185 - DNA, 15 bp, Homo sapiens
gcttgtttttcatgt

SEQ ID NO: 348186 - DNA, 15 bp, Homo sapiens
cttgtttttcatgtc

SEQ ID NO: 348187 - DNA, 15 bp, Homo sapiens
ttgtttttcatgtct

SEQ ID NO: 348188 - DNA, 15 bp, Homo sapiens
tgtttttcatgtctg

SEQ ID NO: 348189 - DNA, 15 bp, Homo sapiens
gtttttcatgtctgc

SEQ ID NO: 348190 - DNA, 15 bp, Homo sapiens
tttttcatgtctgca

SEQ ID NO: 348191 - DNA, 15 bp, Homo sapiens
ttttcatgtctgcat

SEQ ID NO: 348192 - DNA, 15 bp, Homo sapiens
tttcatgtctgcata

SEQ ID NO: 348193 - DNA, 15 bp, Homo sapiens
ttcatgtctgcatag

SEQ ID NO: 348194 - DNA, 15 bp, Homo sapiens
tcatgtctgcataga

SEQ ID NO: 348195 - DNA, 15 bp, Homo sapiens
catgtctgcatagaa

SEQ ID NO: 348196 - DNA, 15 bp, Homo sapiens
atgtctgcatagaag

SEQ ID NO: 348197 - DNA, 15 bp, Homo sapiens
tgtctgcatagaagg

SEQ ID NO: 348198 - DNA, 15 bp, Homo sapiens
gtctgcatagaaggc

SEQ ID NO: 348199 - DNA, 15 bp, Homo sapiens
tctgcatagaaggcc

SEQ ID NO: 348200 - DNA, 15 bp, Homo sapiens
ctgcatagaaggcct

SEQ ID NO: 348201 - DNA, 15 bp, Homo sapiens
tgcatagaaggcctt

SEQ ID NO: 348202 - DNA, 15 bp, Homo sapiens
gcatagaaggccttc

SEQ ID NO: 348203 - DNA, 15 bp, Homo sapiens
catagaaggccttcc

SEQ ID NO: 348204 - DNA, 15 bp, Homo sapiens
atagaaggccttcct

SEQ ID NO: 348205 - DNA, 15 bp, Homo sapiens
tagaaggccttccta

SEQ ID NO: 348206 - DNA, 15 bp, Homo sapiens
agaaggccttcctac

SEQ ID NO: 348207 - DNA, 15 bp, Homo sapiens
gaaggccttcctact

SEQ ID NO: 348208 - DNA, 15 bp, Homo sapiens
aaggccttcctactg

SEQ ID NO: 348209 - DNA, 15 bp, Homo sapiens
aggccttcctactga

SEQ ID NO: 348210 - DNA, 15 bp, Homo sapiens
ggccttcctactgaa

SEQ ID NO: 348211 - DNA, 15 bp, Homo sapiens
gccttcctactgaag

SEQ ID NO: 348212 - DNA, 15 bp, Homo sapiens
ccttcctactgaaga

SEQ ID NO: 348213 - DNA, 15 bp, Homo sapiens
cttcctactgaagaa

SEQ ID NO: 348214 - DNA, 15 bp, Homo sapiens
ttcctactgaagaaa

SEQ ID NO: 348215 - DNA, 15 bp, Homo sapiens
tcctactgaagaaat

SEQ ID NO: 348216 - DNA, 15 bp, Homo sapiens
cctactgaagaaata

SEQ ID NO: 348217 - DNA, 15 bp, Homo sapiens
ctactgaagaaataa

SEQ ID NO: 348218 - DNA, 15 bp, Homo sapiens
tactgaagaaataaa

SEQ ID NO: 348219 - DNA, 15 bp, Homo sapiens
actgaagaaataaaa

SEQ ID NO: 348220 - DNA, 15 bp, Homo sapiens
ctgaagaaataaaaa

SEQ ID NO: 348221 - DNA, 15 bp, Homo sapiens
tgaagaaataaaaaa

SEQ ID NO: 348222 - DNA, 15 bp, Homo sapiens
gaagaaataaaaaat

SEQ ID NO: 348223 - DNA, 15 bp, Homo sapiens
aagaaataaaaaatg

SEQ ID NO: 348224 - DNA, 15 bp, Homo sapiens
agaaataaaaaatgt

SEQ ID NO: 348225 - DNA, 15 bp, Homo sapiens
gaaataaaaaatgtt

SEQ ID NO: 348226 - DNA, 15 bp, Homo sapiens
aaataaaaaatgttc

SEQ ID NO: 348227 - DNA, 15 bp, Homo sapiens
aataaaaaatgttct

SEQ ID NO: 348228 - DNA, 15 bp, Homo sapiens
ataaaaaatgttctg

SEQ ID NO: 348229 - DNA, 15 bp, Homo sapiens
taaaaaatgttctgg

SEQ ID NO: 348230 - DNA, 15 bp, Homo sapiens
aaaaaatgttctgga

SEQ ID NO: 348231 - DNA, 15 bp, Homo sapiens
aaaaatgttctggag

SEQ ID NO: 348232 - DNA, 15 bp, Homo sapiens
aaatgttctggagaa

SEQ ID NO: 348233 - DNA, 15 bp, Homo sapiens
aatgttctggagaag

SEQ ID NO: 348234 - DNA, 15 bp, Homo sapiens
atgttctggagaagg

SEQ ID NO: 348235 - DNA, 15 bp, Homo sapiens
tgttctggagaaggt

SEQ ID NO: 348236 - DNA, 15 bp, Homo sapiens
gttctggagaaggtt

SEQ ID NO: 348237 - DNA, 15 bp, Homo sapiens
ttctggagaaggttt

SEQ ID NO: 348238 - DNA, 15 bp, Homo sapiens
tctggagaaggtttc

SEQ ID NO: 348239 - DNA, 15 bp, Homo sapiens
ctggagaaggtttca

SEQ ID NO: 348240 - DNA, 15 bp, Homo sapiens
tggagaaggtttcat

SEQ ID NO: 348241 - DNA, 15 bp, Homo sapiens
ggagaaggtttcatc

SEQ ID NO: 348242 - DNA, 15 bp, Homo sapiens
gagaaggtttcatca

SEQ ID NO: 348243 - DNA, 15 bp, Homo sapiens
agaaggtttcatcag

SEQ ID NO: 348244 - DNA, 15 bp, Homo sapiens
gaaggtttcatcaga

SEQ ID NO: 348245 - DNA, 15 bp, Homo sapiens
aaggtttcatcagaa

SEQ ID NO: 348246 - DNA, 15 bp, Homo sapiens
aggtttcatcagaat

SEQ ID NO: 348247 - DNA, 15 bp, Homo sapiens
ggtttcatcagaatg

SEQ ID NO: 348248 - DNA, 15 bp, Homo sapiens
gtttcatcagaatgg

SEQ ID NO: 348249 - DNA, 15 bp, Homo sapiens
tttcatcagaatgga

SEQ ID NO: 348250 - DNA, 15 bp, Homo sapiens
ttcatcagaatggaa

SEQ ID NO: 348251 - DNA, 15 bp, Homo sapiens
tcatcagaatggaag

SEQ ID NO: 348252 - DNA, 15 bp, Homo sapiens
catcagaatggaaga

SEQ ID NO: 348253 - DNA, 15 bp, Homo sapiens
atcagaatggaagaa

SEQ ID NO: 348254 - DNA, 15 bp, Homo sapiens
tcagaatggaagaat

SEQ ID NO: 348255 - DNA, 15 bp, Homo sapiens
cagaatggaagaatg

SEQ ID NO: 348256 - DNA, 15 bp, Homo sapiens
agaatggaagaatgt

SEQ ID NO: 348257 - DNA, 15 bp, Homo sapiens
gaatggaagaatgta

SEQ ID NO: 348258 - DNA, 15 bp, Homo sapiens
aatggaagaatgtat

SEQ ID NO: 348259 - DNA, 15 bp, Homo sapiens
atggaagaatgtatc

SEQ ID NO: 348260 - DNA, 15 bp, Homo sapiens
tggaagaatgtatct

SEQ ID NO: 348261 - DNA, 15 bp, Homo sapiens
ggaagaatgtatctc

SEQ ID NO: 348262 - DNA, 15 bp, Homo sapiens
gaagaatgtatctca

SEQ ID NO: 348263 - DNA, 15 bp, Homo sapiens
aagaatgtatctcaa

SEQ ID NO: 348264 - DNA, 15 bp, Homo sapiens
agaatgtatctcaac

SEQ ID NO: 348265 - DNA, 15 bp, Homo sapiens
gaatgtatctcaaca

SEQ ID NO: 348266 - DNA, 15 bp, Homo sapiens
aatgtatctcaacat

SEQ ID NO: 348267 - DNA, 15 bp, Homo sapiens
atgtatctcaacatt

SEQ ID NO: 348268 - DNA, 15 bp, Homo sapiens
tgtatctcaacattt

SEQ ID NO: 348269 - DNA, 15 bp, Homo sapiens
gtatctcaacatttg

SEQ ID NO: 348270 - DNA, 15 bp, Homo sapiens
tatctcaacatttgg

SEQ ID NO: 348271 - DNA, 15 bp, Homo sapiens
atctcaacatttgga

SEQ ID NO: 348272 - DNA, 15 bp, Homo sapiens
tctcaacatttggaa

SEQ ID NO: 348273 - DNA, 15 bp, Homo sapiens
ctcaacatttggaag

SEQ ID NO: 348274 - DNA, 15 bp, Homo sapiens
tcaacatttggaaga

SEQ ID NO: 348275 - DNA, 15 bp, Homo sapiens
caacatttggaagat

SEQ ID NO: 348276 - DNA, 15 bp, Homo sapiens
aacatttggaagatc

SEQ ID NO: 348277 - DNA, 15 bp, Homo sapiens
acatttggaagatct

SEQ ID NO: 348278 - DNA, 15 bp, Homo sapiens
catttggaagatcta

SEQ ID NO: 348279 - DNA, 15 bp, Homo sapiens
atttggaagatctag

SEQ ID NO: 348280 - DNA, 15 bp, Homo sapiens
tttggaagatctaga

SEQ ID NO: 348281 - DNA, 15 bp, Homo sapiens
ttggaagatctagaa

SEQ ID NO: 348282 - DNA, 15 bp, Homo sapiens
tggaagatctagaaa

SEQ ID NO: 348283 - DNA, 15 bp, Homo sapiens
ggaagatctagaaag

SEQ ID NO: 348284 - DNA, 15 bp, Homo sapiens
gaagatctagaaaga

SEQ ID NO: 348285 - DNA, 15 bp, Homo sapiens
aagatctagaaagaa

SEQ ID NO: 348286 - DNA, 15 bp, Homo sapiens
agatctagaaagaaa

SEQ ID NO: 348287 - DNA, 15 bp, Homo sapiens
gatctagaaagaaag

SEQ ID NO: 348288 - DNA, 15 bp, Homo sapiens
atctagaaagaaaga

SEQ ID NO: 348289 - DNA, 15 bp, Homo sapiens
tctagaaagaaagat

SEQ ID NO: 348290 - DNA, 15 bp, Homo sapiens
ctagaaagaaagatt

SEQ ID NO: 348291 - DNA, 15 bp, Homo sapiens
tagaaagaaagattc

SEQ ID NO: 348292 - DNA, 15 bp, Homo sapiens
agaaagaaagattca

SEQ ID NO: 348293 - DNA, 15 bp, Homo sapiens
gaaagaaagattcag

SEQ ID NO: 348294 - DNA, 15 bp, Homo sapiens
aaagaaagattcagc

SEQ ID NO: 348295 - DNA, 15 bp, Homo sapiens
aagaaagattcagct

SEQ ID NO: 348296 - DNA, 15 bp, Homo sapiens
agaaagattcagcta

SEQ ID NO: 348297 - DNA, 15 bp, Homo sapiens
gaaagattcagctac

SEQ ID NO: 348298 - DNA, 15 bp, Homo sapiens
aaagattcagctaca

SEQ ID NO: 348299 - DNA, 15 bp, Homo sapiens
aagattcagctacag

SEQ ID NO: 348300 - DNA, 15 bp, Homo sapiens
agattcagctacagg

SEQ ID NO: 348301 - DNA, 15 bp, Homo sapiens
gattcagctacagga

SEQ ID NO: 348302 - DNA, 15 bp, Homo sapiens
attcagctacaggaa

SEQ ID NO: 348303 - DNA, 15 bp, Homo sapiens
ttcagctacaggaag

SEQ ID NO: 348304 - DNA, 15 bp, Homo sapiens
tcagctacaggaaga

SEQ ID NO: 348305 - DNA, 15 bp, Homo sapiens
cagctacaggaagat

SEQ ID NO: 348306 - DNA, 15 bp, Homo sapiens
agctacaggaagata

SEQ ID NO: 348307 - DNA, 15 bp, Homo sapiens
gctacaggaagatat

SEQ ID NO: 348308 - DNA, 15 bp, Homo sapiens
ctacaggaagatata

SEQ ID NO: 348309 - DNA, 15 bp, Homo sapiens
tacaggaagatataa

SEQ ID NO: 348310 - DNA, 15 bp, Homo sapiens
acaggaagatataaa

SEQ ID NO: 348311 - DNA, 15 bp, Homo sapiens
caggaagatataaat

SEQ ID NO: 348312 - DNA, 15 bp, Homo sapiens
aggaagatataaatg

SEQ ID NO: 348313 - DNA, 15 bp, Homo sapiens
ggaagatataaatgc

SEQ ID NO: 348314 - DNA, 15 bp, Homo sapiens
gaagatataaatgct

SEQ ID NO: 348315 - DNA, 15 bp, Homo sapiens
aagatataaatgctt

SEQ ID NO: 348316 - DNA, 15 bp, Homo sapiens
agatataaatgctta

SEQ ID NO: 348317 - DNA, 15 bp, Homo sapiens
gatataaatgcttat

SEQ ID NO: 348318 - DNA, 15 bp, Homo sapiens
atataaatgcttatt

SEQ ID NO: 348319 - DNA, 15 bp, Homo sapiens
tataaatgcttattt

SEQ ID NO: 348320 - DNA, 15 bp, Homo sapiens
ataaatgcttatttc

SEQ ID NO: 348321 - DNA, 15 bp, Homo sapiens
taaatgcttatttca

SEQ ID NO: 348322 - DNA, 15 bp, Homo sapiens
aaatgcttatttcaa

SEQ ID NO: 348323 - DNA, 15 bp, Homo sapiens
aatgcttatttcaag

SEQ ID NO: 348324 - DNA, 15 bp, Homo sapiens
atgcttatttcaagc

SEQ ID NO: 348325 - DNA, 15 bp, Homo sapiens
tgcttatttcaagca

SEQ ID NO: 348326 - DNA, 15 bp, Homo sapiens
gcttatttcaagcag

SEQ ID NO: 348327 - DNA, 15 bp, Homo sapiens
cttatttcaagcagc

SEQ ID NO: 348328 - DNA, 15 bp, Homo sapiens
ttatttcaagcagct

SEQ ID NO: 348329 - DNA, 15 bp, Homo sapiens
tatttcaagcagctt

SEQ ID NO: 348330 - DNA, 15 bp, Homo sapiens
atttcaagcagcttg

SEQ ID NO: 348331 - DNA, 15 bp, Homo sapiens
tttcaagcagcttga

SEQ ID NO: 348332 - DNA, 15 bp, Homo sapiens
ttcaagcagcttgat

SEQ ID NO: 348333 - DNA, 15 bp, Homo sapiens
tcaagcagcttgatg

SEQ ID NO: 348334 - DNA, 15 bp, Homo sapiens
caagcagcttgatga

SEQ ID NO: 348335 - DNA, 15 bp, Homo sapiens
aagcagcttgatgag

SEQ ID NO: 348336 - DNA, 15 bp, Homo sapiens
agcagcttgatgagc

SEQ ID NO: 348337 - DNA, 15 bp, Homo sapiens
gcagcttgatgagct

SEQ ID NO: 348338 - DNA, 15 bp, Homo sapiens
cagcttgatgagctt

SEQ ID NO: 348339 - DNA, 15 bp, Homo sapiens
agcttgatgagcttg

SEQ ID NO: 348340 - DNA, 15 bp, Homo sapiens
gcttgatgagcttga

SEQ ID NO: 348341 - DNA, 15 bp, Homo sapiens
cttgatgagcttgaa

SEQ ID NO: 348342 - DNA, 15 bp, Homo sapiens
ttgatgagcttgaaa

SEQ ID NO: 348343 - DNA, 15 bp, Homo sapiens
tgatgagcttgaaaa

SEQ ID NO: 348344 - DNA, 15 bp, Homo sapiens
gatgagcttgaaaag

SEQ ID NO: 348345 - DNA, 15 bp, Homo sapiens
atgagcttgaaaagg

SEQ ID NO: 348346 - DNA, 15 bp, Homo sapiens
tgagcttgaaaaggt

SEQ ID NO: 348347 - DNA, 15 bp, Homo sapiens
gagcttgaaaaggtc

SEQ ID NO: 348348 - DNA, 15 bp, Homo sapiens
agcttgaaaaggtca

SEQ ID NO: 348349 - DNA, 15 bp, Homo sapiens
gcttgaaaaggtcat

SEQ ID NO: 348350 - DNA, 15 bp, Homo sapiens
cttgaaaaggtcatc

SEQ ID NO: 348351 - DNA, 15 bp, Homo sapiens
ttgaaaaggtcatca

SEQ ID NO: 348352 - DNA, 15 bp, Homo sapiens
tgaaaaggtcatcaa

SEQ ID NO: 348353 - DNA, 15 bp, Homo sapiens
gaaaaggtcatcaag

SEQ ID NO: 348354 - DNA, 15 bp, Homo sapiens
aaaaggtcatcaaga

SEQ ID NO: 348355 - DNA, 15 bp, Homo sapiens
aaaggtcatcaagac

SEQ ID NO: 348356 - DNA, 15 bp, Homo sapiens
aaggtcatcaagaca

SEQ ID NO: 348357 - DNA, 15 bp, Homo sapiens
aggtcatcaagacaa

SEQ ID NO: 348358 - DNA, 15 bp, Homo sapiens
ggtcatcaagacaaa

SEQ ID NO: 348359 - DNA, 15 bp, Homo sapiens
gtcatcaagacaaag

SEQ ID NO: 348360 - DNA, 15 bp, Homo sapiens
tcatcaagacaaagg

SEQ ID NO: 348361 - DNA, 15 bp, Homo sapiens
catcaagacaaagga

SEQ ID NO: 348362 - DNA, 15 bp, Homo sapiens
atcaagacaaaggag

SEQ ID NO: 348363 - DNA, 15 bp, Homo sapiens
tcaagacaaaggagg

SEQ ID NO: 348364 - DNA, 15 bp, Homo sapiens
caagacaaaggagga

SEQ ID NO: 348365 - DNA, 15 bp, Homo sapiens
aagacaaaggaggag

SEQ ID NO: 348366 - DNA, 15 bp, Homo sapiens
agacaaaggaggagt

SEQ ID NO: 348367 - DNA, 15 bp, Homo sapiens
gacaaaggaggagtg

SEQ ID NO: 348368 - DNA, 15 bp, Homo sapiens
acaaaggaggagtgg

SEQ ID NO: 348369 - DNA, 15 bp, Homo sapiens
caaaggaggagtggg

SEQ ID NO: 348370 - DNA, 15 bp, Homo sapiens
aaaggaggagtgggt

SEQ ID NO: 348371 - DNA, 15 bp, Homo sapiens
aaggaggagtgggta

SEQ ID NO: 348372 - DNA, 15 bp, Homo sapiens
aggaggagtgggtaa

SEQ ID NO: 348373 - DNA, 15 bp, Homo sapiens
ggaggagtgggtaaa

SEQ ID NO: 348374 - DNA, 15 bp, Homo sapiens
gaggagtgggtaaaa

SEQ ID NO: 348375 - DNA, 15 bp, Homo sapiens
aggagtgggtaaaac

SEQ ID NO: 348376 - DNA, 15 bp, Homo sapiens
ggagtgggtaaaaca

SEQ ID NO: 348377 - DNA, 15 bp, Homo sapiens
gagtgggtaaaacac

SEQ ID NO: 348378 - DNA, 15 bp, Homo sapiens
agtgggtaaaacaca

SEQ ID NO: 348379 - DNA, 15 bp, Homo sapiens
gtgggtaaaacacac

SEQ ID NO: 348380 - DNA, 15 bp, Homo sapiens
tgggtaaaacacact

SEQ ID NO: 348381 - DNA, 15 bp, Homo sapiens
gggtaaaacacactt

SEQ ID NO: 348382 - DNA, 15 bp, Homo sapiens
ggtaaaacacacttc

SEQ ID NO: 348383 - DNA, 15 bp, Homo sapiens
gtaaaacacacttcc

SEQ ID NO: 348384 - DNA, 15 bp, Homo sapiens
taaaacacacttcca

SEQ ID NO: 348385 - DNA, 15 bp, Homo sapiens
aaaacacacttccat

SEQ ID NO: 348386 - DNA, 15 bp, Homo sapiens
aaacacacttccatt

SEQ ID NO: 348387 - DNA, 15 bp, Homo sapiens
aacacacttccattt

SEQ ID NO: 348388 - DNA, 15 bp, Homo sapiens
acacacttccatttc

SEQ ID NO: 348389 - DNA, 15 bp, Homo sapiens
cacacttccatttct

SEQ ID NO: 348390 - DNA, 15 bp, Homo sapiens
acacttccatttctg

SEQ ID NO: 348391 - DNA, 15 bp, Homo sapiens
cacttccatttctga

SEQ ID NO: 348392 - DNA, 15 bp, Homo sapiens
acttccatttctgaa

SEQ ID NO: 348393 - DNA, 15 bp, Homo sapiens
cttccatttctgaat

SEQ ID NO: 348394 - DNA, 15 bp, Homo sapiens
ttccatttctgaatc

SEQ ID NO: 348395 - DNA, 15 bp, Homo sapiens
tccatttctgaatct

SEQ ID NO: 348396 - DNA, 15 bp, Homo sapiens
ccatttctgaatctt

SEQ ID NO: 348397 - DNA, 15 bp, Homo sapiens
catttctgaatcttc

SEQ ID NO: 348398 - DNA, 15 bp, Homo sapiens
atttctgaatcttcc

SEQ ID NO: 348399 - DNA, 15 bp, Homo sapiens
tttctgaatcttccc

SEQ ID NO: 348400 - DNA, 15 bp, Homo sapiens
ttctgaatcttcccg

SEQ ID NO: 348401 - DNA, 15 bp, Homo sapiens
tctgaatcttcccgg

SEQ ID NO: 348402 - DNA, 15 bp, Homo sapiens
ctgaatcttcccggc

SEQ ID NO: 348403 - DNA, 15 bp, Homo sapiens
tgaatcttcccggca

SEQ ID NO: 348404 - DNA, 15 bp, Homo sapiens
gaatcttcccggcag

SEQ ID NO: 348405 - DNA, 15 bp, Homo sapiens
aatcttcccggcagt

SEQ ID NO: 348406 - DNA, 15 bp, Homo sapiens
atcttcccggcagtc

SEQ ID NO: 348407 - DNA, 15 bp, Homo sapiens
tcttcccggcagtcc

SEQ ID NO: 348408 - DNA, 15 bp, Homo sapiens
cttcccggcagtcct

SEQ ID NO: 348409 - DNA, 15 bp, Homo sapiens
ttcccggcagtcctt

SEQ ID NO: 348410 - DNA, 15 bp, Homo sapiens
tcccggcagtccttg

SEQ ID NO: 348411 - DNA, 15 bp, Homo sapiens
cccggcagtccttgc

SEQ ID NO: 348412 - DNA, 15 bp, Homo sapiens
ccggcagtccttgcc

SEQ ID NO: 348413 - DNA, 15 bp, Homo sapiens
cggcagtccttgcca

SEQ ID NO: 348414 - DNA, 15 bp, Homo sapiens
ggcagtccttgccaa

SEQ ID NO: 348415 - DNA, 15 bp, Homo sapiens
gcagtccttgccaag

SEQ ID NO: 348416 - DNA, 15 bp, Homo sapiens
cagtccttgccaagc

SEQ ID NO: 348417 - DNA, 15 bp, Homo sapiens
agtccttgccaagct

SEQ ID NO: 348418 - DNA, 15 bp, Homo sapiens
gtccttgccaagctt

SEQ ID NO: 348419 - DNA, 15 bp, Homo sapiens
tccttgccaagcttg

SEQ ID NO: 348420 - DNA, 15 bp, Homo sapiens
ccttgccaagcttga

SEQ ID NO: 348421 - DNA, 15 bp, Homo sapiens
cttgccaagcttgaa

SEQ ID NO: 348422 - DNA, 15 bp, Homo sapiens
ttgccaagcttgaag

SEQ ID NO: 348423 - DNA, 15 bp, Homo sapiens
tgccaagcttgaagg

SEQ ID NO: 348424 - DNA, 15 bp, Homo sapiens
gccaagcttgaagga

SEQ ID NO: 348425 - DNA, 15 bp, Homo sapiens
ccaagcttgaaggat

SEQ ID NO: 348426 - DNA, 15 bp, Homo sapiens
caagcttgaaggatt

SEQ ID NO: 348427 - DNA, 15 bp, Homo sapiens
aagcttgaaggattc

SEQ ID NO: 348428 - DNA, 15 bp, Homo sapiens
agcttgaaggattcc

SEQ ID NO: 348429 - DNA, 15 bp, Homo sapiens
gcttgaaggattcct

SEQ ID NO: 348430 - DNA, 15 bp, Homo sapiens
cttgaaggattcctg

SEQ ID NO: 348431 - DNA, 15 bp, Homo sapiens
ttgaaggattcctgt

SEQ ID NO: 348432 - DNA, 15 bp, Homo sapiens
tgaaggattcctgtc

SEQ ID NO: 348433 - DNA, 15 bp, Homo sapiens
gaaggattcctgtca

SEQ ID NO: 348434 - DNA, 15 bp, Homo sapiens
aaggattcctgtcag

SEQ ID NO: 348435 - DNA, 15 bp, Homo sapiens
aggattcctgtcagg

SEQ ID NO: 348436 - DNA, 15 bp, Homo sapiens
ggattcctgtcaggt

SEQ ID NO: 348437 - DNA, 15 bp, Homo sapiens
gattcctgtcaggta

SEQ ID NO: 348438 - DNA, 15 bp, Homo sapiens
attcctgtcaggtaa

SEQ ID NO: 348439 - DNA, 15 bp, Homo sapiens
ttcctgtcaggtaag

SEQ ID NO: 348440 - DNA, 15 bp, Homo sapiens
tcctgtcaggtaagg

SEQ ID NO: 348441 - DNA, 15 bp, Homo sapiens
cctgtcaggtaagga

SEQ ID NO: 348442 - DNA, 15 bp, Homo sapiens
ctgtcaggtaaggag

SEQ ID NO: 348443 - DNA, 15 bp, Homo sapiens
tgtcaggtaaggagc

SEQ ID NO: 348444 - DNA, 15 bp, Homo sapiens
gtcaggtaaggagcc

SEQ ID NO: 348445 - DNA, 15 bp, Homo sapiens
tcaggtaaggagcca

SEQ ID NO: 348446 - DNA, 15 bp, Homo sapiens
caggtaaggagccaa

SEQ ID NO: 348447 - DNA, 15 bp, Homo sapiens
aggtaaggagccaac

SEQ ID NO: 348448 - DNA, 15 bp, Homo sapiens
ggtaaggagccaacg

SEQ ID NO: 348449 - DNA, 15 bp, Homo sapiens
gtaaggagccaacgg

SEQ ID NO: 348450 - DNA, 15 bp, Homo sapiens
taaggagccaacggt

SEQ ID NO: 348451 - DNA, 15 bp, Homo sapiens
aaggagccaacggtc

SEQ ID NO: 348452 - DNA, 15 bp, Homo sapiens
aggagccaacggtct

SEQ ID NO: 348453 - DNA, 15 bp, Homo sapiens
ggagccaacggtctg

SEQ ID NO: 348454 - DNA, 15 bp, Homo sapiens
gagccaacggtctgg

SEQ ID NO: 348455 - DNA, 15 bp, Homo sapiens
agccaacggtctgga

SEQ ID NO: 348456 - DNA, 15 bp, Homo sapiens
gccaacggtctggaa

SEQ ID NO: 348457 - DNA, 15 bp, Homo sapiens
ccaacggtctggaaa

SEQ ID NO: 348458 - DNA, 15 bp, Homo sapiens
caacggtctggaaag

SEQ ID NO: 348459 - DNA, 15 bp, Homo sapiens
aacggtctggaaagt

SEQ ID NO: 348460 - DNA, 15 bp, Homo sapiens
acggtctggaaagtg

SEQ ID NO: 348461 - DNA, 15 bp, Homo sapiens
cggtctggaaagtgg

SEQ ID NO: 348462 - DNA, 15 bp, Homo sapiens
ggtctggaaagtgga

SEQ ID NO: 348463 - DNA, 15 bp, Homo sapiens
gtctggaaagtggag

SEQ ID NO: 348464 - DNA, 15 bp, Homo sapiens
tctggaaagtggagg

SEQ ID NO: 348465 - DNA, 15 bp, Homo sapiens
ctggaaagtggagga

SEQ ID NO: 348466 - DNA, 15 bp, Homo sapiens
tggaaagtggaggaa

SEQ ID NO: 348467 - DNA, 15 bp, Homo sapiens
ggaaagtggaggaat

SEQ ID NO: 348468 - DNA, 15 bp, Homo sapiens
gaaagtggaggaatt

SEQ ID NO: 348469 - DNA, 15 bp, Homo sapiens
aaagtggaggaattc

SEQ ID NO: 348470 - DNA, 15 bp, Homo sapiens
aagtggaggaattct

SEQ ID NO: 348471 - DNA, 15 bp, Homo sapiens
agtggaggaattcta

SEQ ID NO: 348472 - DNA, 15 bp, Homo sapiens
gtggaggaattctat

SEQ ID NO: 348473 - DNA, 15 bp, Homo sapiens
tggaggaattctatg

SEQ ID NO: 348474 - DNA, 15 bp, Homo sapiens
ggaggaattctatgt

SEQ ID NO: 348475 - DNA, 15 bp, Homo sapiens
gaggaattctatgtg

SEQ ID NO: 348476 - DNA, 15 bp, Homo sapiens
aggaattctatgtgc

SEQ ID NO: 348477 - DNA, 15 bp, Homo sapiens
ggaattctatgtgca

SEQ ID NO: 348478 - DNA, 15 bp, Homo sapiens
gaattctatgtgcag

SEQ ID NO: 348479 - DNA, 15 bp, Homo sapiens
aattctatgtgcagt

SEQ ID NO: 348480 - DNA, 15 bp, Homo sapiens
attctatgtgcagtt

SEQ ID NO: 348481 - DNA, 15 bp, Homo sapiens
ttctatgtgcagttc

SEQ ID NO: 348482 - DNA, 15 bp, Homo sapiens
tctatgtgcagttcc

SEQ ID NO: 348483 - DNA, 15 bp, Homo sapiens
ctatgtgcagttcca

SEQ ID NO: 348484 - DNA, 15 bp, Homo sapiens
tatgtgcagttccag

SEQ ID NO: 348485 - DNA, 15 bp, Homo sapiens
atgtgcagttccaga

SEQ ID NO: 348486 - DNA, 15 bp, Homo sapiens
tgtgcagttccagag

SEQ ID NO: 348487 - DNA, 15 bp, Homo sapiens
gtgcagttccagagt

SEQ ID NO: 348488 - DNA, 15 bp, Homo sapiens
tgcagttccagagtt

SEQ ID NO: 348489 - DNA, 15 bp, Homo sapiens
gcagttccagagtta

SEQ ID NO: 348490 - DNA, 15 bp, Homo sapiens
cagttccagagttaa

SEQ ID NO: 348491 - DNA, 15 bp, Homo sapiens
agttccagagttaag

SEQ ID NO: 348492 - DNA, 15 bp, Homo sapiens
gttccagagttaagg

SEQ ID NO: 348493 - DNA, 15 bp, Homo sapiens
ttccagagttaagga

SEQ ID NO: 348494 - DNA, 15 bp, Homo sapiens
tccagagttaaggag

SEQ ID NO: 348495 - DNA, 15 bp, Homo sapiens
ccagagttaaggagg

SEQ ID NO: 348496 - DNA, 15 bp, Homo sapiens
cagagttaaggaggg

SEQ ID NO: 348497 - DNA, 15 bp, Homo sapiens
agagttaaggagggc

SEQ ID NO: 348498 - DNA, 15 bp, Homo sapiens
gagttaaggagggct

SEQ ID NO: 348499 - DNA, 15 bp, Homo sapiens
agttaaggagggctt

SEQ ID NO: 348500 - DNA, 15 bp, Homo sapiens
gttaaggagggcttc

SEQ ID NO: 348501 - DNA, 15 bp, Homo sapiens
ttaaggagggcttct

SEQ ID NO: 348502 - DNA, 15 bp, Homo sapiens
taaggagggcttctc

SEQ ID NO: 348503 - DNA, 15 bp, Homo sapiens
aaggagggcttctcg

SEQ ID NO: 348504 - DNA, 15 bp, Homo sapiens
aggagggcttctcgt

SEQ ID NO: 348505 - DNA, 15 bp, Homo sapiens
ggagggcttctcgta

SEQ ID NO: 348506 - DNA, 15 bp, Homo sapiens
gagggcttctcgtat

SEQ ID NO: 348507 - DNA, 15 bp, Homo sapiens
agggcttctcgtatc

SEQ ID NO: 348508 - DNA, 15 bp, Homo sapiens
gggcttctcgtatca

SEQ ID NO: 348509 - DNA, 15 bp, Homo sapiens
ggcttctcgtatcat

SEQ ID NO: 348510 - DNA, 15 bp, Homo sapiens
gcttctcgtatcatg

SEQ ID NO: 348511 - DNA, 15 bp, Homo sapiens
cttctcgtatcatga

SEQ ID NO: 348512 - DNA, 15 bp, Homo sapiens
ttctcgtatcatgaa

SEQ ID NO: 348513 - DNA, 15 bp, Homo sapiens
tctcgtatcatgaac

SEQ ID NO: 348514 - DNA, 15 bp, Homo sapiens
ctcgtatcatgaact

SEQ ID NO: 348515 - DNA, 15 bp, Homo sapiens
tcgtatcatgaactt

SEQ ID NO: 348516 - DNA, 15 bp, Homo sapiens
cgtatcatgaacttt

SEQ ID NO: 348517 - DNA, 15 bp, Homo sapiens
gtatcatgaacttta

SEQ ID NO: 348518 - DNA, 15 bp, Homo sapiens
tatcatgaactttaa

SEQ ID NO: 348519 - DNA, 15 bp, Homo sapiens
atcatgaactttaag

SEQ ID NO: 348520 - DNA, 15 bp, Homo sapiens
tcatgaactttaagt

SEQ ID NO: 348521 - DNA, 15 bp, Homo sapiens
catgaactttaagtt

SEQ ID NO: 348522 - DNA, 15 bp, Homo sapiens
atgaactttaagtta

SEQ ID NO: 348523 - DNA, 15 bp, Homo sapiens
tgaactttaagttaa

SEQ ID NO: 348524 - DNA, 15 bp, Homo sapiens
gaactttaagttaat

SEQ ID NO: 348525 - DNA, 15 bp, Homo sapiens
aactttaagttaatg

SEQ ID NO: 348526 - DNA, 15 bp, Homo sapiens
actttaagttaatgc

SEQ ID NO: 348527 - DNA, 15 bp, Homo sapiens
ctttaagttaatgct

SEQ ID NO: 348528 - DNA, 15 bp, Homo sapiens
tttaagttaatgctg

SEQ ID NO: 348529 - DNA, 15 bp, Homo sapiens
ttaagttaatgctgc

SEQ ID NO: 348530 - DNA, 15 bp, Homo sapiens
taagttaatgctgcc

SEQ ID NO: 348531 - DNA, 15 bp, Homo sapiens
aagttaatgctgccc

SEQ ID NO: 348532 - DNA, 15 bp, Homo sapiens
agttaatgctgccct

SEQ ID NO: 348533 - DNA, 15 bp, Homo sapiens
gttaatgctgccctg

SEQ ID NO: 348534 - DNA, 15 bp, Homo sapiens
ttaatgctgccctga

SEQ ID NO: 348535 - DNA, 15 bp, Homo sapiens
taatgctgccctgat

SEQ ID NO: 348536 - DNA, 15 bp, Homo sapiens
aatgctgccctgatt

SEQ ID NO: 348537 - DNA, 15 bp, Homo sapiens
atgctgccctgatta

SEQ ID NO: 348538 - DNA, 15 bp, Homo sapiens
tgctgccctgattaa

SEQ ID NO: 348539 - DNA, 15 bp, Homo sapiens
gctgccctgattaac

SEQ ID NO: 348540 - DNA, 15 bp, Homo sapiens
ctgccctgattaact

SEQ ID NO: 348541 - DNA, 15 bp, Homo sapiens
tgccctgattaactt

SEQ ID NO: 348542 - DNA, 15 bp, Homo sapiens
gccctgattaacttc

SEQ ID NO: 348543 - DNA, 15 bp, Homo sapiens
ccctgattaacttcc

SEQ ID NO: 348544 - DNA, 15 bp, Homo sapiens
cctgattaacttcct

SEQ ID NO: 348545 - DNA, 15 bp, Homo sapiens
ctgattaacttcctg

SEQ ID NO: 348546 - DNA, 15 bp, Homo sapiens
tgattaacttcctgt

SEQ ID NO: 348547 - DNA, 15 bp, Homo sapiens
gattaacttcctgtg

SEQ ID NO: 348548 - DNA, 15 bp, Homo sapiens
attaacttcctgtga

SEQ ID NO: 348549 - DNA, 15 bp, Homo sapiens
ttaacttcctgtgag

SEQ ID NO: 348550 - DNA, 15 bp, Homo sapiens
taacttcctgtgagg

SEQ ID NO: 348551 - DNA, 15 bp, Homo sapiens
aacttcctgtgagga

SEQ ID NO: 348552 - DNA, 15 bp, Homo sapiens
acttcctgtgaggat

SEQ ID NO: 348553 - DNA, 15 bp, Homo sapiens
cttcctgtgaggatg

SEQ ID NO: 348554 - DNA, 15 bp, Homo sapiens
ttcctgtgaggatgt

SEQ ID NO: 348555 - DNA, 15 bp, Homo sapiens
tcctgtgaggatgtt

SEQ ID NO: 348556 - DNA, 15 bp, Homo sapiens
cctgtgaggatgttc

SEQ ID NO: 348557 - DNA, 15 bp, Homo sapiens
ctgtgaggatgttca

SEQ ID NO: 348558 - DNA, 15 bp, Homo sapiens
tgtgaggatgttcat

SEQ ID NO: 348559 - DNA, 15 bp, Homo sapiens
gtgaggatgttcatc

SEQ ID NO: 348560 - DNA, 15 bp, Homo sapiens
tgaggatgttcatct

SEQ ID NO: 348561 - DNA, 15 bp, Homo sapiens
gaggatgttcatctt

SEQ ID NO: 348562 - DNA, 15 bp, Homo sapiens
aggatgttcatcttc

SEQ ID NO: 348563 - DNA, 15 bp, Homo sapiens
ggatgttcatcttca

SEQ ID NO: 348564 - DNA, 15 bp, Homo sapiens
gatgttcatcttcag

SEQ ID NO: 348565 - DNA, 15 bp, Homo sapiens
atgttcatcttcagt

SEQ ID NO: 348566 - DNA, 15 bp, Homo sapiens
tgttcatcttcagtg

SEQ ID NO: 348567 - DNA, 15 bp, Homo sapiens
gttcatcttcagtga

SEQ ID NO: 348568 - DNA, 15 bp, Homo sapiens
ttcatcttcagtgag

SEQ ID NO: 348569 - DNA, 15 bp, Homo sapiens
tcatcttcagtgagt

SEQ ID NO: 348570 - DNA, 15 bp, Homo sapiens
catcttcagtgagtt

SEQ ID NO: 348571 - DNA, 15 bp, Homo sapiens
atcttcagtgagttg

SEQ ID NO: 348572 - DNA, 15 bp, Homo sapiens
tcttcagtgagttgt

SEQ ID NO: 348573 - DNA, 15 bp, Homo sapiens
cttcagtgagttgtg

SEQ ID NO: 348574 - DNA, 15 bp, Homo sapiens
ttcagtgagttgtgt

SEQ ID NO: 348575 - DNA, 15 bp, Homo sapiens
tcagtgagttgtgtg

SEQ ID NO: 348576 - DNA, 15 bp, Homo sapiens
cagtgagttgtgtga

SEQ ID NO: 348577 - DNA, 15 bp, Homo sapiens
agtgagttgtgtgac

SEQ ID NO: 348578 - DNA, 15 bp, Homo sapiens
gtgagttgtgtgacc

SEQ ID NO: 348579 - DNA, 15 bp, Homo sapiens
tgagttgtgtgaccg

SEQ ID NO: 348580 - DNA, 15 bp, Homo sapiens
gagttgtgtgaccgt

SEQ ID NO: 348581 - DNA, 15 bp, Homo sapiens
agttgtgtgaccgta

SEQ ID NO: 348582 - DNA, 15 bp, Homo sapiens
gttgtgtgaccgtat

SEQ ID NO: 348583 - DNA, 15 bp, Homo sapiens
ttgtgtgaccgtatt

SEQ ID NO: 348584 - DNA, 15 bp, Homo sapiens
tgtgtgaccgtattt

SEQ ID NO: 348585 - DNA, 15 bp, Homo sapiens
gtgtgaccgtatttt

SEQ ID NO: 348586 - DNA, 15 bp, Homo sapiens
tgtgaccgtattttc

SEQ ID NO: 348587 - DNA, 15 bp, Homo sapiens
gtgaccgtattttct

SEQ ID NO: 348588 - DNA, 15 bp, Homo sapiens
tgaccgtattttctc

SEQ ID NO: 348589 - DNA, 15 bp, Homo sapiens
gaccgtattttctct

SEQ ID NO: 348590 - DNA, 15 bp, Homo sapiens
accgtattttctctt

SEQ ID NO: 348591 - DNA, 15 bp, Homo sapiens
ccgtattttctcttc

SEQ ID NO: 348592 - DNA, 15 bp, Homo sapiens
cgtattttctcttcc

SEQ ID NO: 348593 - DNA, 15 bp, Homo sapiens
gtattttctcttcct

SEQ ID NO: 348594 - DNA, 15 bp, Homo sapiens
tattttctcttcctt

SEQ ID NO: 348595 - DNA, 15 bp, Homo sapiens
attttctcttcctta

SEQ ID NO: 348596 - DNA, 15 bp, Homo sapiens
ttttctcttccttag

SEQ ID NO: 348597 - DNA, 15 bp, Homo sapiens
tttctcttccttagc

SEQ ID NO: 348598 - DNA, 15 bp, Homo sapiens
ttctcttccttagcg

SEQ ID NO: 348599 - DNA, 15 bp, Homo sapiens
tctcttccttagcgg

SEQ ID NO: 348600 - DNA, 15 bp, Homo sapiens
ctcttccttagcggg

SEQ ID NO: 348601 - DNA, 15 bp, Homo sapiens
tcttccttagcggga

SEQ ID NO: 348602 - DNA, 15 bp, Homo sapiens
cttccttagcgggaa

SEQ ID NO: 348603 - DNA, 15 bp, Homo sapiens
ttccttagcgggaat

SEQ ID NO: 348604 - DNA, 15 bp, Homo sapiens
tccttagcgggaatt

SEQ ID NO: 348605 - DNA, 15 bp, Homo sapiens
ccttagcgggaattg

SEQ ID NO: 348606 - DNA, 15 bp, Homo sapiens
cttagcgggaattga

SEQ ID NO: 348607 - DNA, 15 bp, Homo sapiens
ttagcgggaattgac

SEQ ID NO: 348608 - DNA, 15 bp, Homo sapiens
tagcgggaattgaca

SEQ ID NO: 348609 - DNA, 15 bp, Homo sapiens
agcgggaattgacaa

SEQ ID NO: 348610 - DNA, 15 bp, Homo sapiens
gcgggaattgacaaa

SEQ ID NO: 348611 - DNA, 15 bp, Homo sapiens
cgggaattgacaaat

SEQ ID NO: 348612 - DNA, 15 bp, Homo sapiens
gggaattgacaaatc

SEQ ID NO: 348613 - DNA, 15 bp, Homo sapiens
ggaattgacaaatct

SEQ ID NO: 348614 - DNA, 15 bp, Homo sapiens
gaattgacaaatctt

SEQ ID NO: 348615 - DNA, 15 bp, Homo sapiens
aattgacaaatcttc

SEQ ID NO: 348616 - DNA, 15 bp, Homo sapiens
attgacaaatcttct

SEQ ID NO: 348617 - DNA, 15 bp, Homo sapiens
ttgacaaatcttctt

SEQ ID NO: 348618 - DNA, 15 bp, Homo sapiens
tgacaaatcttcttg

SEQ ID NO: 348619 - DNA, 15 bp, Homo sapiens
gacaaatcttcttgg

SEQ ID NO: 348620 - DNA, 15 bp, Homo sapiens
acaaatcttcttggc

SEQ ID NO: 348621 - DNA, 15 bp, Homo sapiens
caaatcttcttggcc

SEQ ID NO: 348622 - DNA, 15 bp, Homo sapiens
aaatcttcttggcct

SEQ ID NO: 348623 - DNA, 15 bp, Homo sapiens
aatcttcttggcctt

SEQ ID NO: 348624 - DNA, 15 bp, Homo sapiens
atcttcttggccttc

SEQ ID NO: 348625 - DNA, 15 bp, Homo sapiens
tcttcttggccttca

SEQ ID NO: 348626 - DNA, 15 bp, Homo sapiens
cttcttggccttcac

SEQ ID NO: 348627 - DNA, 15 bp, Homo sapiens
ttcttggccttcacc

SEQ ID NO: 348628 - DNA, 15 bp, Homo sapiens
tcttggccttcaccc

SEQ ID NO: 348629 - DNA, 15 bp, Homo sapiens
cttggccttcacccc

SEQ ID NO: 348630 - DNA, 15 bp, Homo sapiens
ttggccttcacccca

SEQ ID NO: 348631 - DNA, 15 bp, Homo sapiens
tggccttcaccccaa

SEQ ID NO: 348632 - DNA, 15 bp, Homo sapiens
ggccttcaccccaaa

SEQ ID NO: 348633 - DNA, 15 bp, Homo sapiens
gccttcaccccaaaa

SEQ ID NO: 348634 - DNA, 15 bp, Homo sapiens
ccttcaccccaaaat

SEQ ID NO: 348635 - DNA, 15 bp, Homo sapiens
cttcaccccaaaatt

SEQ ID NO: 348636 - DNA, 15 bp, Homo sapiens
ttcaccccaaaattg

SEQ ID NO: 348637 - DNA, 15 bp, Homo sapiens
tcaccccaaaattga

SEQ ID NO: 348638 - DNA, 15 bp, Homo sapiens
caccccaaaattgaa

SEQ ID NO: 348639 - DNA, 15 bp, Homo sapiens
accccaaaattgaaa

SEQ ID NO: 348640 - DNA, 15 bp, Homo sapiens
ccccaaaattgaaat

SEQ ID NO: 348641 - DNA, 15 bp, Homo sapiens
cccaaaattgaaatg

SEQ ID NO: 348642 - DNA, 15 bp, Homo sapiens
ccaaaattgaaatgg

SEQ ID NO: 348643 - DNA, 15 bp, Homo sapiens
caaaattgaaatggc

SEQ ID NO: 348644 - DNA, 15 bp, Homo sapiens
aaaattgaaatggct

SEQ ID NO: 348645 - DNA, 15 bp, Homo sapiens
aaattgaaatggctc

SEQ ID NO: 348646 - DNA, 15 bp, Homo sapiens
aattgaaatggctcg

SEQ ID NO: 348647 - DNA, 15 bp, Homo sapiens
attgaaatggctcgt

SEQ ID NO: 348648 - DNA, 15 bp, Homo sapiens
ttgaaatggctcgtg

SEQ ID NO: 348649 - DNA, 15 bp, Homo sapiens
tgaaatggctcgtgc

SEQ ID NO: 348650 - DNA, 15 bp, Homo sapiens
gaaatggctcgtgca

SEQ ID NO: 348651 - DNA, 15 bp, Homo sapiens
aaatggctcgtgcaa

SEQ ID NO: 348652 - DNA, 15 bp, Homo sapiens
aatggctcgtgcaag

SEQ ID NO: 348653 - DNA, 15 bp, Homo sapiens
atggctcgtgcaagc

SEQ ID NO: 348654 - DNA, 15 bp, Homo sapiens
tggctcgtgcaagct

SEQ ID NO: 348655 - DNA, 15 bp, Homo sapiens
ggctcgtgcaagctg

SEQ ID NO: 348656 - DNA, 15 bp, Homo sapiens
gctcgtgcaagctgc

SEQ ID NO: 348657 - DNA, 15 bp, Homo sapiens
ctcgtgcaagctgct

SEQ ID NO: 348658 - DNA, 15 bp, Homo sapiens
tcgtgcaagctgctc

SEQ ID NO: 348659 - DNA, 15 bp, Homo sapiens
cgtgcaagctgctcg

SEQ ID NO: 348660 - DNA, 15 bp, Homo sapiens
gtgcaagctgctcgg

SEQ ID NO: 348661 - DNA, 15 bp, Homo sapiens
tgcaagctgctcggc

SEQ ID NO: 348662 - DNA, 15 bp, Homo sapiens
gcaagctgctcggcc

SEQ ID NO: 348663 - DNA, 15 bp, Homo sapiens
caagctgctcggccc

SEQ ID NO: 348664 - DNA, 15 bp, Homo sapiens
aagctgctcggccct

SEQ ID NO: 348665 - DNA, 15 bp, Homo sapiens
agctgctcggccctg

SEQ ID NO: 348666 - DNA, 15 bp, Homo sapiens
gctgctcggccctga

SEQ ID NO: 348667 - DNA, 15 bp, Homo sapiens
ctgctcggccctgat

SEQ ID NO: 348668 - DNA, 15 bp, Homo sapiens
tgctcggccctgatg

SEQ ID NO: 348669 - DNA, 15 bp, Homo sapiens
gctcggccctgatgt

SEQ ID NO: 348670 - DNA, 15 bp, Homo sapiens
ctcggccctgatgtc

SEQ ID NO: 348671 - DNA, 15 bp, Homo sapiens
tcggccctgatgtct

SEQ ID NO: 348672 - DNA, 15 bp, Homo sapiens
cggccctgatgtctc

SEQ ID NO: 348673 - DNA, 15 bp, Homo sapiens
ggccctgatgtctca

SEQ ID NO: 348674 - DNA, 15 bp, Homo sapiens
gccctgatgtctcag

SEQ ID NO: 348675 - DNA, 15 bp, Homo sapiens
ccctgatgtctcagc

SEQ ID NO: 348676 - DNA, 15 bp, Homo sapiens
cctgatgtctcagcc

SEQ ID NO: 348677 - DNA, 15 bp, Homo sapiens
ctgatgtctcagcct

SEQ ID NO: 348678 - DNA, 15 bp, Homo sapiens
tgatgtctcagcctt

SEQ ID NO: 348679 - DNA, 15 bp, Homo sapiens
gatgtctcagccttc

SEQ ID NO: 348680 - DNA, 15 bp, Homo sapiens
atgtctcagccttct

SEQ ID NO: 348681 - DNA, 15 bp, Homo sapiens
tgtctcagccttctg

SEQ ID NO: 348682 - DNA, 15 bp, Homo sapiens
gtctcagccttctgc

SEQ ID NO: 348683 - DNA, 15 bp, Homo sapiens
tctcagccttctgcc

SEQ ID NO: 348684 - DNA, 15 bp, Homo sapiens
ctcagccttctgccc

SEQ ID NO: 348685 - DNA, 15 bp, Homo sapiens
tcagccttctgcccc

SEQ ID NO: 348686 - DNA, 15 bp, Homo sapiens
cagccttctgcccca

SEQ ID NO: 348687 - DNA, 15 bp, Homo sapiens
agccttctgccccag

SEQ ID NO: 348688 - DNA, 15 bp, Homo sapiens
gccttctgccccaga

SEQ ID NO: 348689 - DNA, 15 bp, Homo sapiens
ccttctgccccagat

SEQ ID NO: 348690 - DNA, 15 bp, Homo sapiens
cttctgccccagatt

SEQ ID NO: 348691 - DNA, 15 bp, Homo sapiens
ttctgccccagattt

SEQ ID NO: 348692 - DNA, 15 bp, Homo sapiens
tctgccccagatttt

SEQ ID NO: 348693 - DNA, 15 bp, Homo sapiens
ctgccccagattttg

SEQ ID NO: 348694 - DNA, 15 bp, Homo sapiens
tgccccagattttgt

SEQ ID NO: 348695 - DNA, 15 bp, Homo sapiens
gccccagattttgtc

SEQ ID NO: 348696 - DNA, 15 bp, Homo sapiens
ccccagattttgtcc

SEQ ID NO: 348697 - DNA, 15 bp, Homo sapiens
cccagattttgtcca

SEQ ID NO: 348698 - DNA, 15 bp, Homo sapiens
ccagattttgtccag

SEQ ID NO: 348699 - DNA, 15 bp, Homo sapiens
cagattttgtccagc

SEQ ID NO: 348700 - DNA, 15 bp, Homo sapiens
agattttgtccagcg

SEQ ID NO: 348701 - DNA, 15 bp, Homo sapiens
gattttgtccagcgg

SEQ ID NO: 348702 - DNA, 15 bp, Homo sapiens
attttgtccagcggg

SEQ ID NO: 348703 - DNA, 15 bp, Homo sapiens
ttttgtccagcgggg

SEQ ID NO: 348704 - DNA, 15 bp, Homo sapiens
tttgtccagcggggc

SEQ ID NO: 348705 - DNA, 15 bp, Homo sapiens
ttgtccagcggggct

SEQ ID NO: 348706 - DNA, 15 bp, Homo sapiens
tgtccagcggggctt

SEQ ID NO: 348707 - DNA, 15 bp, Homo sapiens
gtccagcggggcttc

SEQ ID NO: 348708 - DNA, 15 bp, Homo sapiens
tccagcggggcttcg

SEQ ID NO: 348709 - DNA, 15 bp, Homo sapiens
ccagcggggcttcga

SEQ ID NO: 348710 - DNA, 15 bp, Homo sapiens
cagcggggcttcgat

SEQ ID NO: 348711 - DNA, 15 bp, Homo sapiens
agcggggcttcgata

SEQ ID NO: 348712 - DNA, 15 bp, Homo sapiens
gcggggcttcgatag

SEQ ID NO: 348713 - DNA, 15 bp, Homo sapiens
cggggcttcgatagc

SEQ ID NO: 348714 - DNA, 15 bp, Homo sapiens
ggggcttcgatagct

SEQ ID NO: 348715 - DNA, 15 bp, Homo sapiens
gggcttcgatagctt

SEQ ID NO: 348716 - DNA, 15 bp, Homo sapiens
ggcttcgatagcttt

SEQ ID NO: 348717 - DNA, 15 bp, Homo sapiens
gcttcgatagctttc

SEQ ID NO: 348718 - DNA, 15 bp, Homo sapiens
cttcgatagctttct

SEQ ID NO: 348719 - DNA, 15 bp, Homo sapiens
ttcgatagctttctg

SEQ ID NO: 348720 - DNA, 15 bp, Homo sapiens
tcgatagctttctgg

SEQ ID NO: 348721 - DNA, 15 bp, Homo sapiens
cgatagctttctggg

SEQ ID NO: 348722 - DNA, 15 bp, Homo sapiens
gatagctttctgggc

SEQ ID NO: 348723 - DNA, 15 bp, Homo sapiens
atagctttctgggcc

SEQ ID NO: 348724 - DNA, 15 bp, Homo sapiens
tagctttctgggccg

SEQ ID NO: 348725 - DNA, 15 bp, Homo sapiens
agctttctgggccgc

SEQ ID NO: 348726 - DNA, 15 bp, Homo sapiens
gctttctgggccgct

SEQ ID NO: 348727 - DNA, 15 bp, Homo sapiens
ctttctgggccgcta

SEQ ID NO: 348728 - DNA, 15 bp, Homo sapiens
tttctgggccgctac

SEQ ID NO: 348729 - DNA, 15 bp, Homo sapiens
ttctgggccgctacc

SEQ ID NO: 348730 - DNA, 15 bp, Homo sapiens
tctgggccgctacca

SEQ ID NO: 348731 - DNA, 15 bp, Homo sapiens
ctgggccgctaccaa

SEQ ID NO: 348732 - DNA, 15 bp, Homo sapiens
tgggccgctaccaag

SEQ ID NO: 348733 - DNA, 15 bp, Homo sapiens
gggccgctaccaagc

SEQ ID NO: 348734 - DNA, 15 bp, Homo sapiens
ggccgctaccaagct

SEQ ID NO: 348735 - DNA, 15 bp, Homo sapiens
gccgctaccaagctg

SEQ ID NO: 348736 - DNA, 15 bp, Homo sapiens
ccgctaccaagctgt

SEQ ID NO: 348737 - DNA, 15 bp, Homo sapiens
cgctaccaagctgta

SEQ ID NO: 348738 - DNA, 15 bp, Homo sapiens
gctaccaagctgtac

SEQ ID NO: 348739 - DNA, 15 bp, Homo sapiens
ctaccaagctgtaca

SEQ ID NO: 348740 - DNA, 15 bp, Homo sapiens
taccaagctgtacaa

SEQ ID NO: 348741 - DNA, 15 bp, Homo sapiens
accaagctgtacaag

SEQ ID NO: 348742 - DNA, 15 bp, Homo sapiens
ccaagctgtacaaga

SEQ ID NO: 348743 - DNA, 15 bp, Homo sapiens
caagctgtacaagag

SEQ ID NO: 348744 - DNA, 15 bp, Homo sapiens
aagctgtacaagagg

SEQ ID NO: 348745 - DNA, 15 bp, Homo sapiens
agctgtacaagaggc

SEQ ID NO: 348746 - DNA, 15 bp, Homo sapiens
gctgtacaagaggct

SEQ ID NO: 348747 - DNA, 15 bp, Homo sapiens
ctgtacaagaggctg

SEQ ID NO: 348748 - DNA, 15 bp, Homo sapiens
tgtacaagaggctgt

SEQ ID NO: 348749 - DNA, 15 bp, Homo sapiens
gtacaagaggctgta

SEQ ID NO: 348750 - DNA, 15 bp, Homo sapiens
tacaagaggctgtag

SEQ ID NO: 348751 - DNA, 15 bp, Homo sapiens
acaagaggctgtaga

SEQ ID NO: 348752 - DNA, 15 bp, Homo sapiens
caagaggctgtagag

SEQ ID NO: 348753 - DNA, 15 bp, Homo sapiens
aagaggctgtagagg

SEQ ID NO: 348754 - DNA, 15 bp, Homo sapiens
agaggctgtagagga

SEQ ID NO: 348755 - DNA, 15 bp, Homo sapiens
gaggctgtagaggat

SEQ ID NO: 348756 - DNA, 15 bp, Homo sapiens
aggctgtagaggatc

SEQ ID NO: 348757 - DNA, 15 bp, Homo sapiens
ggctgtagaggatcg

SEQ ID NO: 348758 - DNA, 15 bp, Homo sapiens
gctgtagaggatcgt

SEQ ID NO: 348759 - DNA, 15 bp, Homo sapiens
ctgtagaggatcgtc

SEQ ID NO: 348760 - DNA, 15 bp, Homo sapiens
tgtagaggatcgtca

SEQ ID NO: 348761 - DNA, 15 bp, Homo sapiens
gtagaggatcgtcaa

SEQ ID NO: 348762 - DNA, 15 bp, Homo sapiens
tagaggatcgtcaac

SEQ ID NO: 348763 - DNA, 15 bp, Homo sapiens
agaggatcgtcaaca

SEQ ID NO: 348764 - DNA, 15 bp, Homo sapiens
gaggatcgtcaacaa

SEQ ID NO: 348765 - DNA, 15 bp, Homo sapiens
aggatcgtcaacaac

SEQ ID NO: 348766 - DNA, 15 bp, Homo sapiens
ggatcgtcaacaaca

SEQ ID NO: 348767 - DNA, 15 bp, Homo sapiens
gatcgtcaacaacat

SEQ ID NO: 348768 - DNA, 15 bp, Homo sapiens
atcgtcaacaacatc

SEQ ID NO: 348769 - DNA, 15 bp, Homo sapiens
tcgtcaacaacatct

SEQ ID NO: 348770 - DNA, 15 bp, Homo sapiens
cgtcaacaacatcta

SEQ ID NO: 348771 - DNA, 15 bp, Homo sapiens
gtcaacaacatctag

SEQ ID NO: 348772 - DNA, 15 bp, Homo sapiens
tcaacaacatctaga

SEQ ID NO: 348773 - DNA, 15 bp, Homo sapiens
caacaacatctagag

SEQ ID NO: 348774 - DNA, 15 bp, Homo sapiens
aacaacatctagaga

SEQ ID NO: 348775 - DNA, 15 bp, Homo sapiens
acaacatctagagaa

SEQ ID NO: 348776 - DNA, 15 bp, Homo sapiens
caacatctagagaat

SEQ ID NO: 348777 - DNA, 15 bp, Homo sapiens
aacatctagagaatg

SEQ ID NO: 348778 - DNA, 15 bp, Homo sapiens
acatctagagaatgg

SEQ ID NO: 348779 - DNA, 15 bp, Homo sapiens
catctagagaatggt

SEQ ID NO: 348780 - DNA, 15 bp, Homo sapiens
atctagagaatggta

SEQ ID NO: 348781 - DNA, 15 bp, Homo sapiens
tctagagaatggtaa

SEQ ID NO: 348782 - DNA, 15 bp, Homo sapiens
ctagagaatggtaaa

SEQ ID NO: 348783 - DNA, 15 bp, Homo sapiens
tagagaatggtaaac

SEQ ID NO: 348784 - DNA, 15 bp, Homo sapiens
agagaatggtaaacc

SEQ ID NO: 348785 - DNA, 15 bp, Homo sapiens
gagaatggtaaaccc

SEQ ID NO: 348786 - DNA, 15 bp, Homo sapiens
agaatggtaaaccca

SEQ ID NO: 348787 - DNA, 15 bp, Homo sapiens
gaatggtaaacccaa

SEQ ID NO: 348788 - DNA, 15 bp, Homo sapiens
aatggtaaacccaac

SEQ ID NO: 348789 - DNA, 15 bp, Homo sapiens
atggtaaacccaaca

SEQ ID NO: 348790 - DNA, 15 bp, Homo sapiens
tggtaaacccaacaa

SEQ ID NO: 348791 - DNA, 15 bp, Homo sapiens
ggtaaacccaacaat

SEQ ID NO: 348792 - DNA, 15 bp, Homo sapiens
gtaaacccaacaatt

SEQ ID NO: 348793 - DNA, 15 bp, Homo sapiens
taaacccaacaattt

SEQ ID NO: 348794 - DNA, 15 bp, Homo sapiens
aaacccaacaatttt

SEQ ID NO: 348795 - DNA, 15 bp, Homo sapiens
aacccaacaatttta

SEQ ID NO: 348796 - DNA, 15 bp, Homo sapiens
acccaacaattttaa

SEQ ID NO: 348797 - DNA, 15 bp, Homo sapiens
cccaacaattttaaa

SEQ ID NO: 348798 - DNA, 15 bp, Homo sapiens
ccaacaattttaaaa

SEQ ID NO: 348799 - DNA, 15 bp, Homo sapiens
caacaattttaaaat

SEQ ID NO: 348800 - DNA, 15 bp, Homo sapiens
aacaattttaaaatc

SEQ ID NO: 348801 - DNA, 15 bp, Homo sapiens
acaattttaaaatct

SEQ ID NO: 348802 - DNA, 15 bp, Homo sapiens
caattttaaaatctc

SEQ ID NO: 348803 - DNA, 15 bp, Homo sapiens
aattttaaaatctcc

SEQ ID NO: 348804 - DNA, 15 bp, Homo sapiens
attttaaaatctcct

SEQ ID NO: 348805 - DNA, 15 bp, Homo sapiens
ttttaaaatctcctg

SEQ ID NO: 348806 - DNA, 15 bp, Homo sapiens
tttaaaatctcctgt

SEQ ID NO: 348807 - DNA, 15 bp, Homo sapiens
ttaaaatctcctgtc

SEQ ID NO: 348808 - DNA, 15 bp, Homo sapiens
taaaatctcctgtct

SEQ ID NO: 348809 - DNA, 15 bp, Homo sapiens
aaaatctcctgtctc

SEQ ID NO: 348810 - DNA, 15 bp, Homo sapiens
aaatctcctgtctca

SEQ ID NO: 348811 - DNA, 15 bp, Homo sapiens
aatctcctgtctcag

SEQ ID NO: 348812 - DNA, 15 bp, Homo sapiens
atctcctgtctcagt

SEQ ID NO: 348813 - DNA, 15 bp, Homo sapiens
tctcctgtctcagtt

SEQ ID NO: 348814 - DNA, 15 bp, Homo sapiens
ctcctgtctcagttt

SEQ ID NO: 348815 - DNA, 15 bp, Homo sapiens
tcctgtctcagtttg

SEQ ID NO: 348816 - DNA, 15 bp, Homo sapiens
cctgtctcagtttgc

SEQ ID NO: 348817 - DNA, 15 bp, Homo sapiens
ctgtctcagtttgcc

SEQ ID NO: 348818 - DNA, 15 bp, Homo sapiens
tgtctcagtttgcct

SEQ ID NO: 348819 - DNA, 15 bp, Homo sapiens
gtctcagtttgcctt

SEQ ID NO: 348820 - DNA, 15 bp, Homo sapiens
tctcagtttgcctta

SEQ ID NO: 348821 - DNA, 15 bp, Homo sapiens
ctcagtttgccttaa

SEQ ID NO: 348822 - DNA, 15 bp, Homo sapiens
tcagtttgccttaat

SEQ ID NO: 348823 - DNA, 15 bp, Homo sapiens
cagtttgccttaatg

SEQ ID NO: 348824 - DNA, 15 bp, Homo sapiens
agtttgccttaatgt

SEQ ID NO: 348825 - DNA, 15 bp, Homo sapiens
gtttgccttaatgta

SEQ ID NO: 348826 - DNA, 15 bp, Homo sapiens
tttgccttaatgtaa

SEQ ID NO: 348827 - DNA, 15 bp, Homo sapiens
ttgccttaatgtaaa

SEQ ID NO: 348828 - DNA, 15 bp, Homo sapiens
tgccttaatgtaaac

SEQ ID NO: 348829 - DNA, 15 bp, Homo sapiens
gccttaatgtaaaca

SEQ ID NO: 348830 - DNA, 15 bp, Homo sapiens
ccttaatgtaaacat

SEQ ID NO: 348831 - DNA, 15 bp, Homo sapiens
cttaatgtaaacatg

SEQ ID NO: 348832 - DNA, 15 bp, Homo sapiens
ttaatgtaaacatga

SEQ ID NO: 348833 - DNA, 15 bp, Homo sapiens
taatgtaaacatgac

SEQ ID NO: 348834 - DNA, 15 bp, Homo sapiens
aatgtaaacatgact

SEQ ID NO: 348835 - DNA, 15 bp, Homo sapiens
atgtaaacatgactc

SEQ ID NO: 348836 - DNA, 15 bp, Homo sapiens
tgtaaacatgactcc

SEQ ID NO: 348837 - DNA, 15 bp, Homo sapiens
gtaaacatgactccc

SEQ ID NO: 348838 - DNA, 15 bp, Homo sapiens
taaacatgactccca

SEQ ID NO: 348839 - DNA, 15 bp, Homo sapiens
aaacatgactcccaa

SEQ ID NO: 348840 - DNA, 15 bp, Homo sapiens
aacatgactcccaac

SEQ ID NO: 348841 - DNA, 15 bp, Homo sapiens
acatgactcccaaca

SEQ ID NO: 348842 - DNA, 15 bp, Homo sapiens
catgactcccaacat

SEQ ID NO: 348843 - DNA, 15 bp, Homo sapiens
atgactcccaacatt

SEQ ID NO: 348844 - DNA, 15 bp, Homo sapiens
tgactcccaacattt

SEQ ID NO: 348845 - DNA, 15 bp, Homo sapiens
gactcccaacattta

SEQ ID NO: 348846 - DNA, 15 bp, Homo sapiens
actcccaacatttag

SEQ ID NO: 348847 - DNA, 15 bp, Homo sapiens
ctcccaacatttaga

SEQ ID NO: 348848 - DNA, 15 bp, Homo sapiens
tcccaacatttagaa

SEQ ID NO: 348849 - DNA, 15 bp, Homo sapiens
cccaacatttagaac

SEQ ID NO: 348850 - DNA, 15 bp, Homo sapiens
ccaacatttagaact

SEQ ID NO: 348851 - DNA, 15 bp, Homo sapiens
caacatttagaactt

SEQ ID NO: 348852 - DNA, 15 bp, Homo sapiens
aacatttagaacttg

SEQ ID NO: 348853 - DNA, 15 bp, Homo sapiens
acatttagaacttga

SEQ ID NO: 348854 - DNA, 15 bp, Homo sapiens
catttagaacttgag

SEQ ID NO: 348855 - DNA, 15 bp, Homo sapiens
atttagaacttgagt

SEQ ID NO: 348856 - DNA, 15 bp, Homo sapiens
tttagaacttgagta

SEQ ID NO: 348857 - DNA, 15 bp, Homo sapiens
ttagaacttgagtac

SEQ ID NO: 348858 - DNA, 15 bp, Homo sapiens
tagaacttgagtaca

SEQ ID NO: 348859 - DNA, 15 bp, Homo sapiens
agaacttgagtacac

SEQ ID NO: 348860 - DNA, 15 bp, Homo sapiens
gaacttgagtacact

SEQ ID NO: 348861 - DNA, 15 bp, Homo sapiens
aacttgagtacactt

SEQ ID NO: 348862 - DNA, 15 bp, Homo sapiens
acttgagtacacttg

SEQ ID NO: 348863 - DNA, 15 bp, Homo sapiens
cttgagtacacttgc

SEQ ID NO: 348864 - DNA, 15 bp, Homo sapiens
ttgagtacacttgct

SEQ ID NO: 348865 - DNA, 15 bp, Homo sapiens
tgagtacacttgctt

SEQ ID NO: 348866 - DNA, 15 bp, Homo sapiens
gagtacacttgcttg

SEQ ID NO: 348867 - DNA, 15 bp, Homo sapiens
agtacacttgcttgc

SEQ ID NO: 348868 - DNA, 15 bp, Homo sapiens
gtacacttgcttgct

SEQ ID NO: 348869 - DNA, 15 bp, Homo sapiens
tacacttgcttgctt

SEQ ID NO: 348870 - DNA, 15 bp, Homo sapiens
acacttgcttgcttt

SEQ ID NO: 348871 - DNA, 15 bp, Homo sapiens
cacttgcttgctttg

SEQ ID NO: 348872 - DNA, 15 bp, Homo sapiens
acttgcttgctttgc

SEQ ID NO: 348873 - DNA, 15 bp, Homo sapiens
cttgcttgctttgca

SEQ ID NO: 348874 - DNA, 15 bp, Homo sapiens
ttgcttgctttgcac

SEQ ID NO: 348875 - DNA, 15 bp, Homo sapiens
tgcttgctttgcacc

SEQ ID NO: 348876 - DNA, 15 bp, Homo sapiens
gcttgctttgcacca

SEQ ID NO: 348877 - DNA, 15 bp, Homo sapiens
cttgctttgcaccaa

SEQ ID NO: 348878 - DNA, 15 bp, Homo sapiens
ttgctttgcaccaac

SEQ ID NO: 348879 - DNA, 15 bp, Homo sapiens
tgctttgcaccaacc

SEQ ID NO: 348880 - DNA, 15 bp, Homo sapiens
gctttgcaccaacct

SEQ ID NO: 348881 - DNA, 15 bp, Homo sapiens
ctttgcaccaacctt

SEQ ID NO: 348882 - DNA, 15 bp, Homo sapiens
tttgcaccaaccttc

SEQ ID NO: 348883 - DNA, 15 bp, Homo sapiens
ttgcaccaaccttct

SEQ ID NO: 348884 - DNA, 15 bp, Homo sapiens
tgcaccaaccttctc

SEQ ID NO: 348885 - DNA, 15 bp, Homo sapiens
gcaccaaccttctcc

SEQ ID NO: 348886 - DNA, 15 bp, Homo sapiens
caccaaccttctcca

SEQ ID NO: 348887 - DNA, 15 bp, Homo sapiens
accaaccttctccat

SEQ ID NO: 348888 - DNA, 15 bp, Homo sapiens
ccaaccttctccatt

SEQ ID NO: 348889 - DNA, 15 bp, Homo sapiens
caaccttctccattt

SEQ ID NO: 348890 - DNA, 15 bp, Homo sapiens
aaccttctccatttt

SEQ ID NO: 348891 - DNA, 15 bp, Homo sapiens
accttctccattttc

SEQ ID NO: 348892 - DNA, 15 bp, Homo sapiens
ccttctccattttcc

SEQ ID NO: 348893 - DNA, 15 bp, Homo sapiens
cttctccattttcct

SEQ ID NO: 348894 - DNA, 15 bp, Homo sapiens
ttctccattttcctt

SEQ ID NO: 348895 - DNA, 15 bp, Homo sapiens
tctccattttccttt

SEQ ID NO: 348896 - DNA, 15 bp, Homo sapiens
ctccattttcctttg

SEQ ID NO: 348897 - DNA, 15 bp, Homo sapiens
tccattttcctttgt

SEQ ID NO: 348898 - DNA, 15 bp, Homo sapiens
ccattttcctttgtg

SEQ ID NO: 348899 - DNA, 15 bp, Homo sapiens
cattttcctttgtgc

SEQ ID NO: 348900 - DNA, 15 bp, Homo sapiens
attttcctttgtgcc

SEQ ID NO: 348901 - DNA, 15 bp, Homo sapiens
ttttcctttgtgcct

SEQ ID NO: 348902 - DNA, 15 bp, Homo sapiens
tttcctttgtgcctg

SEQ ID NO: 348903 - DNA, 15 bp, Homo sapiens
ttcctttgtgcctgt

SEQ ID NO: 348904 - DNA, 15 bp, Homo sapiens
tcctttgtgcctgta

SEQ ID NO: 348905 - DNA, 15 bp, Homo sapiens
cctttgtgcctgtat

SEQ ID NO: 348906 - DNA, 15 bp, Homo sapiens
ctttgtgcctgtatt

SEQ ID NO: 348907 - DNA, 15 bp, Homo sapiens
tttgtgcctgtattg

SEQ ID NO: 348908 - DNA, 15 bp, Homo sapiens
ttgtgcctgtattgt

SEQ ID NO: 348909 - DNA, 15 bp, Homo sapiens
tgtgcctgtattgtt

SEQ ID NO: 348910 - DNA, 15 bp, Homo sapiens
gtgcctgtattgttc

SEQ ID NO: 348911 - DNA, 15 bp, Homo sapiens
tgcctgtattgttca

SEQ ID NO: 348912 - DNA, 15 bp, Homo sapiens
gcctgtattgttcaa

SEQ ID NO: 348913 - DNA, 15 bp, Homo sapiens
cctgtattgttcaaa

SEQ ID NO: 348914 - DNA, 15 bp, Homo sapiens
ctgtattgttcaaag

SEQ ID NO: 348915 - DNA, 15 bp, Homo sapiens
tgtattgttcaaagt

SEQ ID NO: 348916 - DNA, 15 bp, Homo sapiens
gtattgttcaaagtc

SEQ ID NO: 348917 - DNA, 15 bp, Homo sapiens
tattgttcaaagtct

SEQ ID NO: 348918 - DNA, 15 bp, Homo sapiens
attgttcaaagtctt

SEQ ID NO: 348919 - DNA, 15 bp, Homo sapiens
ttgttcaaagtctta

SEQ ID NO: 348920 - DNA, 15 bp, Homo sapiens
tgttcaaagtcttaa

SEQ ID NO: 348921 - DNA, 15 bp, Homo sapiens
gttcaaagtcttaaa

SEQ ID NO: 348922 - DNA, 15 bp, Homo sapiens
ttcaaagtcttaaag

SEQ ID NO: 348923 - DNA, 15 bp, Homo sapiens
tcaaagtcttaaagt

SEQ ID NO: 348924 - DNA, 15 bp, Homo sapiens
caaagtcttaaagtc

SEQ ID NO: 348925 - DNA, 15 bp, Homo sapiens
aaagtcttaaagtct

SEQ ID NO: 348926 - DNA, 15 bp, Homo sapiens
aagtcttaaagtctt

SEQ ID NO: 348927 - DNA, 15 bp, Homo sapiens
agtcttaaagtcttc

SEQ ID NO: 348928 - DNA, 15 bp, Homo sapiens
gtcttaaagtcttct

SEQ ID NO: 348929 - DNA, 15 bp, Homo sapiens
tcttaaagtcttctg

SEQ ID NO: 348930 - DNA, 15 bp, Homo sapiens
cttaaagtcttctgt

SEQ ID NO: 348931 - DNA, 15 bp, Homo sapiens
ttaaagtcttctgta

SEQ ID NO: 348932 - DNA, 15 bp, Homo sapiens
taaagtcttctgtat

SEQ ID NO: 348933 - DNA, 15 bp, Homo sapiens
aaagtcttctgtatt

SEQ ID NO: 348934 - DNA, 15 bp, Homo sapiens
aagtcttctgtattc

SEQ ID NO: 348935 - DNA, 15 bp, Homo sapiens
agtcttctgtattca

SEQ ID NO: 348936 - DNA, 15 bp, Homo sapiens
gtcttctgtattcag

SEQ ID NO: 348937 - DNA, 15 bp, Homo sapiens
tcttctgtattcaga

SEQ ID NO: 348938 - DNA, 15 bp, Homo sapiens
cttctgtattcagat

SEQ ID NO: 348939 - DNA, 15 bp, Homo sapiens
ttctgtattcagatt

SEQ ID NO: 348940 - DNA, 15 bp, Homo sapiens
tctgtattcagattc

SEQ ID NO: 348941 - DNA, 15 bp, Homo sapiens
ctgtattcagattct

SEQ ID NO: 348942 - DNA, 15 bp, Homo sapiens
tgtattcagattctt

SEQ ID NO: 348943 - DNA, 15 bp, Homo sapiens
gtattcagattcttt

SEQ ID NO: 348944 - DNA, 15 bp, Homo sapiens
tattcagattctttt

SEQ ID NO: 348945 - DNA, 15 bp, Homo sapiens
attcagattcttttc

SEQ ID NO: 348946 - DNA, 15 bp, Homo sapiens
ttcagattcttttcc

SEQ ID NO: 348947 - DNA, 15 bp, Homo sapiens
tcagattcttttcca

SEQ ID NO: 348948 - DNA, 15 bp, Homo sapiens
cagattcttttccag

SEQ ID NO: 348949 - DNA, 15 bp, Homo sapiens
agattcttttccaga

SEQ ID NO: 348950 - DNA, 15 bp, Homo sapiens
gattcttttccagat

SEQ ID NO: 348951 - DNA, 15 bp, Homo sapiens
attcttttccagatt

SEQ ID NO: 348952 - DNA, 15 bp, Homo sapiens
ttcttttccagattc

SEQ ID NO: 348953 - DNA, 15 bp, Homo sapiens
tcttttccagattca

SEQ ID NO: 348954 - DNA, 15 bp, Homo sapiens
cttttccagattcac

SEQ ID NO: 348955 - DNA, 15 bp, Homo sapiens
ttttccagattcaca

SEQ ID NO: 348956 - DNA, 15 bp, Homo sapiens
tttccagattcacac

SEQ ID NO: 348957 - DNA, 15 bp, Homo sapiens
ttccagattcacacc

SEQ ID NO: 348958 - DNA, 15 bp, Homo sapiens
tccagattcacacct

SEQ ID NO: 348959 - DNA, 15 bp, Homo sapiens
ccagattcacacctt

SEQ ID NO: 348960 - DNA, 15 bp, Homo sapiens
cagattcacaccttt

SEQ ID NO: 348961 - DNA, 15 bp, Homo sapiens
agattcacacctttt

SEQ ID NO: 348962 - DNA, 15 bp, Homo sapiens
gattcacaccttttt

SEQ ID NO: 348963 - DNA, 15 bp, Homo sapiens
attcacacctttttg

SEQ ID NO: 348964 - DNA, 15 bp, Homo sapiens
ttcacacctttttgt

SEQ ID NO: 348965 - DNA, 15 bp, Homo sapiens
tcacacctttttgta

SEQ ID NO: 348966 - DNA, 15 bp, Homo sapiens
cacacctttttgtaa

SEQ ID NO: 348967 - DNA, 15 bp, Homo sapiens
acacctttttgtaaa

SEQ ID NO: 348968 - DNA, 15 bp, Homo sapiens
cacctttttgtaaac

SEQ ID NO: 348969 - DNA, 15 bp, Homo sapiens
acctttttgtaaaca

SEQ ID NO: 348970 - DNA, 15 bp, Homo sapiens
cctttttgtaaacat

SEQ ID NO: 348971 - DNA, 15 bp, Homo sapiens
ctttttgtaaacata

SEQ ID NO: 348972 - DNA, 15 bp, Homo sapiens
tttttgtaaacatac

SEQ ID NO: 348973 - DNA, 15 bp, Homo sapiens
ttttgtaaacataca

SEQ ID NO: 348974 - DNA, 15 bp, Homo sapiens
tttgtaaacatacaa

SEQ ID NO: 348975 - DNA, 15 bp, Homo sapiens
ttgtaaacatacaag

SEQ ID NO: 348976 - DNA, 15 bp, Homo sapiens
tgtaaacatacaagc

SEQ ID NO: 348977 - DNA, 15 bp, Homo sapiens
gtaaacatacaagca

SEQ ID NO: 348978 - DNA, 15 bp, Homo sapiens
taaacatacaagcaa

SEQ ID NO: 348979 - DNA, 15 bp, Homo sapiens
aaacatacaagcaag

SEQ ID NO: 348980 - DNA, 15 bp, Homo sapiens
aacatacaagcaagt

SEQ ID NO: 348981 - DNA, 15 bp, Homo sapiens
acatacaagcaagtt

SEQ ID NO: 348982 - DNA, 15 bp, Homo sapiens
catacaagcaagttt

SEQ ID NO: 348983 - DNA, 15 bp, Homo sapiens
atacaagcaagtttc

SEQ ID NO: 348984 - DNA, 15 bp, Homo sapiens
tacaagcaagtttca

SEQ ID NO: 348985 - DNA, 15 bp, Homo sapiens
acaagcaagtttcac

SEQ ID NO: 348986 - DNA, 15 bp, Homo sapiens
caagcaagtttcaca

SEQ ID NO: 348987 - DNA, 15 bp, Homo sapiens
aagcaagtttcacat

SEQ ID NO: 348988 - DNA, 15 bp, Homo sapiens
agcaagtttcacatt

SEQ ID NO: 348989 - DNA, 15 bp, Homo sapiens
gcaagtttcacattc

SEQ ID NO: 348990 - DNA, 15 bp, Homo sapiens
caagtttcacattct

SEQ ID NO: 348991 - DNA, 15 bp, Homo sapiens
aagtttcacattctc

SEQ ID NO: 348992 - DNA, 15 bp, Homo sapiens
agtttcacattctct

SEQ ID NO: 348993 - DNA, 15 bp, Homo sapiens
gtttcacattctcta

SEQ ID NO: 348994 - DNA, 15 bp, Homo sapiens
tttcacattctctaa

SEQ ID NO: 348995 - DNA, 15 bp, Homo sapiens
ttcacattctctaaa

SEQ ID NO: 348996 - DNA, 15 bp, Homo sapiens
tcacattctctaaaa

SEQ ID NO: 348997 - DNA, 15 bp, Homo sapiens
cacattctctaaaat

SEQ ID NO: 348998 - DNA, 15 bp, Homo sapiens
acattctctaaaatt

SEQ ID NO: 348999 - DNA, 15 bp, Homo sapiens
cattctctaaaattg

SEQ ID NO: 349000 - DNA, 15 bp, Homo sapiens
attctctaaaattgt

SEQ ID NO: 349001 - DNA, 15 bp, Homo sapiens
ttctctaaaattgtg

SEQ ID NO: 349002 - DNA, 15 bp, Homo sapiens
tctctaaaattgtgt

SEQ ID NO: 349003 - DNA, 15 bp, Homo sapiens
ctctaaaattgtgtc

SEQ ID NO: 349004 - DNA, 15 bp, Homo sapiens
tctaaaattgtgtca

SEQ ID NO: 349005 - DNA, 15 bp, Homo sapiens
ctaaaattgtgtcag

SEQ ID NO: 349006 - DNA, 15 bp, Homo sapiens
taaaattgtgtcagt

SEQ ID NO: 349007 - DNA, 15 bp, Homo sapiens
aaaattgtgtcagta

SEQ ID NO: 349008 - DNA, 15 bp, Homo sapiens
aaattgtgtcagtag

SEQ ID NO: 349009 - DNA, 15 bp, Homo sapiens
aattgtgtcagtagg

SEQ ID NO: 349010 - DNA, 15 bp, Homo sapiens
attgtgtcagtagga

SEQ ID NO: 349011 - DNA, 15 bp, Homo sapiens
ttgtgtcagtaggat

SEQ ID NO: 349012 - DNA, 15 bp, Homo sapiens
tgtgtcagtaggata

SEQ ID NO: 349013 - DNA, 15 bp, Homo sapiens
gtgtcagtaggatat

SEQ ID NO: 349014 - DNA, 15 bp, Homo sapiens
tgtcagtaggatata

SEQ ID NO: 349015 - DNA, 15 bp, Homo sapiens
gtcagtaggatataa

SEQ ID NO: 349016 - DNA, 15 bp, Homo sapiens
tcagtaggatataat

SEQ ID NO: 349017 - DNA, 15 bp, Homo sapiens
cagtaggatataata

SEQ ID NO: 349018 - DNA, 15 bp, Homo sapiens
agtaggatataataa

SEQ ID NO: 349019 - DNA, 15 bp, Homo sapiens
gtaggatataataat

SEQ ID NO: 349020 - DNA, 15 bp, Homo sapiens
taggatataataata

SEQ ID NO: 349021 - DNA, 15 bp, Homo sapiens
aggatataataataa

SEQ ID NO: 349022 - DNA, 15 bp, Homo sapiens
ggatataataataat

SEQ ID NO: 349023 - DNA, 15 bp, Homo sapiens
gatataataataatt

SEQ ID NO: 349024 - DNA, 15 bp, Homo sapiens
atataataataattt

SEQ ID NO: 349025 - DNA, 15 bp, Homo sapiens
tataataataatttt

SEQ ID NO: 349026 - DNA, 15 bp, Homo sapiens
ataataataattttt

SEQ ID NO: 349027 - DNA, 15 bp, Homo sapiens
taataataatttttt

SEQ ID NO: 349028 - DNA, 15 bp, Homo sapiens
aataataattttttt

SEQ ID NO: 349029 - DNA, 15 bp, Homo sapiens
ataataatttttttt

SEQ ID NO: 349030 - DNA, 15 bp, Homo sapiens
taataattttttttt

SEQ ID NO: 349031 - DNA, 15 bp, Homo sapiens
aataatttttttttt

SEQ ID NO: 349032 - DNA, 15 bp, Homo sapiens
taatttttttttttg

SEQ ID NO: 349033 - DNA, 15 bp, Homo sapiens
aatttttttttttgt

SEQ ID NO: 349034 - DNA, 15 bp, Homo sapiens
atttttttttttgta

SEQ ID NO: 349035 - DNA, 15 bp, Homo sapiens
ttttttttttgtagc

SEQ ID NO: 349036 - DNA, 15 bp, Homo sapiens
tttttttttgtagct

SEQ ID NO: 349037 - DNA, 15 bp, Homo sapiens
ttttttttgtagcta

SEQ ID NO: 349038 - DNA, 15 bp, Homo sapiens
tttttttgtagctac

SEQ ID NO: 349039 - DNA, 15 bp, Homo sapiens
ttttttgtagctaca

SEQ ID NO: 349040 - DNA, 15 bp, Homo sapiens
tttttgtagctacag

SEQ ID NO: 349041 - DNA, 15 bp, Homo sapiens
ttttgtagctacagg

SEQ ID NO: 349042 - DNA, 15 bp, Homo sapiens
tttgtagctacagga

SEQ ID NO: 349043 - DNA, 15 bp, Homo sapiens
ttgtagctacaggat

SEQ ID NO: 349044 - DNA, 15 bp, Homo sapiens
tgtagctacaggatc

SEQ ID NO: 349045 - DNA, 15 bp, Homo sapiens
gtagctacaggatct

SEQ ID NO: 349046 - DNA, 15 bp, Homo sapiens
tagctacaggatctc

SEQ ID NO: 349047 - DNA, 15 bp, Homo sapiens
agctacaggatctca

SEQ ID NO: 349048 - DNA, 15 bp, Homo sapiens
gctacaggatctcac

SEQ ID NO: 349049 - DNA, 15 bp, Homo sapiens
ctacaggatctcact

SEQ ID NO: 349050 - DNA, 15 bp, Homo sapiens
tacaggatctcactc

SEQ ID NO: 349051 - DNA, 15 bp, Homo sapiens
acaggatctcactct

SEQ ID NO: 349052 - DNA, 15 bp, Homo sapiens
caggatctcactctg

SEQ ID NO: 349053 - DNA, 15 bp, Homo sapiens
aggatctcactctgt

SEQ ID NO: 349054 - DNA, 15 bp, Homo sapiens
ggatctcactctgtc

SEQ ID NO: 349055 - DNA, 15 bp, Homo sapiens
gatctcactctgtca

SEQ ID NO: 349056 - DNA, 15 bp, Homo sapiens
atctcactctgtcac

SEQ ID NO: 349057 - DNA, 15 bp, Homo sapiens
cccaggctggagagc

SEQ ID NO: 349058 - DNA, 15 bp, Homo sapiens
ccaggctggagagca

SEQ ID NO: 349059 - DNA, 15 bp, Homo sapiens
caggctggagagcag

SEQ ID NO: 349060 - DNA, 15 bp, Homo sapiens
aggctggagagcagt

SEQ ID NO: 349061 - DNA, 15 bp, Homo sapiens
ggctggagagcagtg

SEQ ID NO: 349062 - DNA, 15 bp, Homo sapiens
gctggagagcagtgg

SEQ ID NO: 349063 - DNA, 15 bp, Homo sapiens
ctggagagcagtggt

SEQ ID NO: 349064 - DNA, 15 bp, Homo sapiens
tggagagcagtggtg

SEQ ID NO: 349065 - DNA, 15 bp, Homo sapiens
ggagagcagtggtgc

SEQ ID NO: 349066 - DNA, 15 bp, Homo sapiens
gagagcagtggtgca

SEQ ID NO: 349067 - DNA, 15 bp, Homo sapiens
agagcagtggtgcaa

SEQ ID NO: 349068 - DNA, 15 bp, Homo sapiens
gagcagtggtgcaat

SEQ ID NO: 349069 - DNA, 15 bp, Homo sapiens
agcagtggtgcaatc

SEQ ID NO: 349070 - DNA, 15 bp, Homo sapiens
gcagtggtgcaatca

SEQ ID NO: 349071 - DNA, 15 bp, Homo sapiens
cagtggtgcaatcat

SEQ ID NO: 349072 - DNA, 15 bp, Homo sapiens
agtggtgcaatcata

SEQ ID NO: 349073 - DNA, 15 bp, Homo sapiens
gtggtgcaatcatag

SEQ ID NO: 349074 - DNA, 15 bp, Homo sapiens
tggtgcaatcatagc

SEQ ID NO: 349075 - DNA, 15 bp, Homo sapiens
ggtgcaatcatagct

SEQ ID NO: 349076 - DNA, 15 bp, Homo sapiens
gtgcaatcatagctg

SEQ ID NO: 349077 - DNA, 15 bp, Homo sapiens
tgcaatcatagctgc

SEQ ID NO: 349078 - DNA, 15 bp, Homo sapiens
gcaatcatagctgca

SEQ ID NO: 349079 - DNA, 15 bp, Homo sapiens
caatcatagctgcag

SEQ ID NO: 349080 - DNA, 15 bp, Homo sapiens
aatcatagctgcagt

SEQ ID NO: 349081 - DNA, 15 bp, Homo sapiens
atcatagctgcagtc

SEQ ID NO: 349082 - DNA, 15 bp, Homo sapiens
tcatagctgcagtct

SEQ ID NO: 349083 - DNA, 15 bp, Homo sapiens
catagctgcagtctt

SEQ ID NO: 349084 - DNA, 15 bp, Homo sapiens
atagctgcagtcttg

SEQ ID NO: 349085 - DNA, 15 bp, Homo sapiens
tagctgcagtcttga

SEQ ID NO: 349086 - DNA, 15 bp, Homo sapiens
agctgcagtcttgac

SEQ ID NO: 349087 - DNA, 15 bp, Homo sapiens
gctgcagtcttgacc

SEQ ID NO: 349088 - DNA, 15 bp, Homo sapiens
cagtcttgacctcct

SEQ ID NO: 349089 - DNA, 15 bp, Homo sapiens
agtcttgacctcctg

SEQ ID NO: 349090 - DNA, 15 bp, Homo sapiens
tcttgacctcctggg

SEQ ID NO: 349091 - DNA, 15 bp, Homo sapiens
cttgacctcctgggt

SEQ ID NO: 349092 - DNA, 15 bp, Homo sapiens
ttgacctcctgggtt

SEQ ID NO: 349093 - DNA, 15 bp, Homo sapiens
tgacctcctgggttt

SEQ ID NO: 349094 - DNA, 15 bp, Homo sapiens
gacctcctgggtttc

SEQ ID NO: 349095 - DNA, 15 bp, Homo sapiens
acctcctgggtttca

SEQ ID NO: 349096 - DNA, 15 bp, Homo sapiens
cctcctgggtttcag

SEQ ID NO: 349097 - DNA, 15 bp, Homo sapiens
ctcctgggtttcagt

SEQ ID NO: 349098 - DNA, 15 bp, Homo sapiens
tcctgggtttcagtg

SEQ ID NO: 349099 - DNA, 15 bp, Homo sapiens
cctgggtttcagtgg

SEQ ID NO: 349100 - DNA, 15 bp, Homo sapiens
ctgggtttcagtggt

SEQ ID NO: 349101 - DNA, 15 bp, Homo sapiens
tgggtttcagtggtc

SEQ ID NO: 349102 - DNA, 15 bp, Homo sapiens
gggtttcagtggtcc

SEQ ID NO: 349103 - DNA, 15 bp, Homo sapiens
ggtttcagtggtcct

SEQ ID NO: 349104 - DNA, 15 bp, Homo sapiens
gtttcagtggtcctt

SEQ ID NO: 349105 - DNA, 15 bp, Homo sapiens
tttcagtggtccttc

SEQ ID NO: 349106 - DNA, 15 bp, Homo sapiens
ttcagtggtccttct

SEQ ID NO: 349107 - DNA, 15 bp, Homo sapiens
tcagtggtccttctg

SEQ ID NO: 349108 - DNA, 15 bp, Homo sapiens
cagtggtccttctgc

SEQ ID NO: 349109 - DNA, 15 bp, Homo sapiens
agtggtccttctgcc

SEQ ID NO: 349110 - DNA, 15 bp, Homo sapiens
gtggtccttctgcct

SEQ ID NO: 349111 - DNA, 15 bp, Homo sapiens
tggtccttctgcctc

SEQ ID NO: 349112 - DNA, 15 bp, Homo sapiens
ggtccttctgcctca

SEQ ID NO: 349113 - DNA, 15 bp, Homo sapiens
gtccttctgcctcag

SEQ ID NO: 349114 - DNA, 15 bp, Homo sapiens
tccttctgcctcagc

SEQ ID NO: 349115 - DNA, 15 bp, Homo sapiens
ccttctgcctcagcc

SEQ ID NO: 349116 - DNA, 15 bp, Homo sapiens
ttctgcctcagccta

SEQ ID NO: 349117 - DNA, 15 bp, Homo sapiens
tctgcctcagcctac

SEQ ID NO: 349118 - DNA, 15 bp, Homo sapiens
ctgcctcagcctact

SEQ ID NO: 349119 - DNA, 15 bp, Homo sapiens
tgcctcagcctactg

SEQ ID NO: 349120 - DNA, 15 bp, Homo sapiens
gcctcagcctactga

SEQ ID NO: 349121 - DNA, 15 bp, Homo sapiens
cctcagcctactgag

SEQ ID NO: 349122 - DNA, 15 bp, Homo sapiens
ctcagcctactgagt

SEQ ID NO: 349123 - DNA, 15 bp, Homo sapiens
tcagcctactgagta

SEQ ID NO: 349124 - DNA, 15 bp, Homo sapiens
cagcctactgagtag

SEQ ID NO: 349125 - DNA, 15 bp, Homo sapiens
agcctactgagtagc

SEQ ID NO: 349126 - DNA, 15 bp, Homo sapiens
gcctactgagtagct

SEQ ID NO: 349127 - DNA, 15 bp, Homo sapiens
cctactgagtagctg

SEQ ID NO: 349128 - DNA, 15 bp, Homo sapiens
ctactgagtagctgg

SEQ ID NO: 349129 - DNA, 15 bp, Homo sapiens
tactgagtagctggg

SEQ ID NO: 349130 - DNA, 15 bp, Homo sapiens
actgagtagctggga

SEQ ID NO: 349131 - DNA, 15 bp, Homo sapiens
ggactacaggcatgc

SEQ ID NO: 349132 - DNA, 15 bp, Homo sapiens
gactacaggcatgca

SEQ ID NO: 349133 - DNA, 15 bp, Homo sapiens
actacaggcatgcac

SEQ ID NO: 349134 - DNA, 15 bp, Homo sapiens
ctacaggcatgcacc

SEQ ID NO: 349135 - DNA, 15 bp, Homo sapiens
caccatgcctggctg

SEQ ID NO: 349136 - DNA, 15 bp, Homo sapiens
accatgcctggctgg

SEQ ID NO: 349137 - DNA, 15 bp, Homo sapiens
ccatgcctggctggt

SEQ ID NO: 349138 - DNA, 15 bp, Homo sapiens
catgcctggctggtt

SEQ ID NO: 349139 - DNA, 15 bp, Homo sapiens
atgcctggctggttt

SEQ ID NO: 349140 - DNA, 15 bp, Homo sapiens
tgcctggctggtttt

SEQ ID NO: 349141 - DNA, 15 bp, Homo sapiens
gcctggctggttttt

SEQ ID NO: 349142 - DNA, 15 bp, Homo sapiens
cctggctggtttttt

SEQ ID NO: 349143 - DNA, 15 bp, Homo sapiens
ctggctggtttttta

SEQ ID NO: 349144 - DNA, 15 bp, Homo sapiens
tggctggttttttat

SEQ ID NO: 349145 - DNA, 15 bp, Homo sapiens
ggctggttttttatt

SEQ ID NO: 349146 - DNA, 15 bp, Homo sapiens
gctggttttttattt

SEQ ID NO: 349147 - DNA, 15 bp, Homo sapiens
ctggttttttatttt

SEQ ID NO: 349148 - DNA, 15 bp, Homo sapiens
tggttttttattttt

SEQ ID NO: 349149 - DNA, 15 bp, Homo sapiens
ggttttttattttta

SEQ ID NO: 349150 - DNA, 15 bp, Homo sapiens
gttttttatttttag

SEQ ID NO: 349151 - DNA, 15 bp, Homo sapiens
ttttttatttttagt

SEQ ID NO: 349152 - DNA, 15 bp, Homo sapiens
tttttatttttagta

SEQ ID NO: 349153 - DNA, 15 bp, Homo sapiens
ttttatttttagtag

SEQ ID NO: 349154 - DNA, 15 bp, Homo sapiens
tttatttttagtaga

SEQ ID NO: 349155 - DNA, 15 bp, Homo sapiens
ttatttttagtagag

SEQ ID NO: 349156 - DNA, 15 bp, Homo sapiens
tatttttagtagagc

SEQ ID NO: 349157 - DNA, 15 bp, Homo sapiens
atttttagtagagcc

SEQ ID NO: 349158 - DNA, 15 bp, Homo sapiens
tttttagtagagcca

SEQ ID NO: 349159 - DNA, 15 bp, Homo sapiens
ttttagtagagccag

SEQ ID NO: 349160 - DNA, 15 bp, Homo sapiens
tttagtagagccagg

SEQ ID NO: 349161 - DNA, 15 bp, Homo sapiens
ttagtagagccaggg

SEQ ID NO: 349162 - DNA, 15 bp, Homo sapiens
tagtagagccagggt

SEQ ID NO: 349163 - DNA, 15 bp, Homo sapiens
agtagagccagggtc

SEQ ID NO: 349164 - DNA, 15 bp, Homo sapiens
gtagagccagggtct

SEQ ID NO: 349165 - DNA, 15 bp, Homo sapiens
tagagccagggtcta

SEQ ID NO: 349166 - DNA, 15 bp, Homo sapiens
agagccagggtctag

SEQ ID NO: 349167 - DNA, 15 bp, Homo sapiens
gagccagggtctagc

SEQ ID NO: 349168 - DNA, 15 bp, Homo sapiens
agccagggtctagct

SEQ ID NO: 349169 - DNA, 15 bp, Homo sapiens
gccagggtctagcta

SEQ ID NO: 349170 - DNA, 15 bp, Homo sapiens
ccagggtctagctat

SEQ ID NO: 349171 - DNA, 15 bp, Homo sapiens
cagggtctagctatg

SEQ ID NO: 349172 - DNA, 15 bp, Homo sapiens
agggtctagctatgt

SEQ ID NO: 349173 - DNA, 15 bp, Homo sapiens
gggtctagctatgtt

SEQ ID NO: 349174 - DNA, 15 bp, Homo sapiens
ggtctagctatgttg

SEQ ID NO: 349175 - DNA, 15 bp, Homo sapiens
gtctagctatgttgc

SEQ ID NO: 349176 - DNA, 15 bp, Homo sapiens
tctagctatgttgcc

SEQ ID NO: 349177 - DNA, 15 bp, Homo sapiens
ctagctatgttgccc

SEQ ID NO: 349178 - DNA, 15 bp, Homo sapiens
tagctatgttgccca

SEQ ID NO: 349179 - DNA, 15 bp, Homo sapiens
agctatgttgcccac

SEQ ID NO: 349180 - DNA, 15 bp, Homo sapiens
gctatgttgcccacg

SEQ ID NO: 349181 - DNA, 15 bp, Homo sapiens
ctatgttgcccacgc

SEQ ID NO: 349182 - DNA, 15 bp, Homo sapiens
tatgttgcccacgct

SEQ ID NO: 349183 - DNA, 15 bp, Homo sapiens
atgttgcccacgctg

SEQ ID NO: 349184 - DNA, 15 bp, Homo sapiens
tgttgcccacgctgg

SEQ ID NO: 349185 - DNA, 15 bp, Homo sapiens
gttgcccacgctggt

SEQ ID NO: 349186 - DNA, 15 bp, Homo sapiens
ttgcccacgctggtc

SEQ ID NO: 349187 - DNA, 15 bp, Homo sapiens
tgcccacgctggtct

SEQ ID NO: 349188 - DNA, 15 bp, Homo sapiens
gcccacgctggtcta

SEQ ID NO: 349189 - DNA, 15 bp, Homo sapiens
cccacgctggtctag

SEQ ID NO: 349190 - DNA, 15 bp, Homo sapiens
ccacgctggtctaga

SEQ ID NO: 349191 - DNA, 15 bp, Homo sapiens
cacgctggtctagaa

SEQ ID NO: 349192 - DNA, 15 bp, Homo sapiens
acgctggtctagaac

SEQ ID NO: 349193 - DNA, 15 bp, Homo sapiens
cgctggtctagaact

SEQ ID NO: 349194 - DNA, 15 bp, Homo sapiens
gctggtctagaactc

SEQ ID NO: 349195 - DNA, 15 bp, Homo sapiens
ctggtctagaactcc

SEQ ID NO: 349196 - DNA, 15 bp, Homo sapiens
tggtctagaactcct

SEQ ID NO: 349197 - DNA, 15 bp, Homo sapiens
ggtctagaactcctg

SEQ ID NO: 349198 - DNA, 15 bp, Homo sapiens
gtctagaactcctgg

SEQ ID NO: 349199 - DNA, 15 bp, Homo sapiens
tctagaactcctggg

SEQ ID NO: 349200 - DNA, 15 bp, Homo sapiens
ctagaactcctgggc

SEQ ID NO: 349201 - DNA, 15 bp, Homo sapiens
tagaactcctgggct

SEQ ID NO: 349202 - DNA, 15 bp, Homo sapiens
agaactcctgggctc

SEQ ID NO: 349203 - DNA, 15 bp, Homo sapiens
gctcaagtgatcttc

SEQ ID NO: 349204 - DNA, 15 bp, Homo sapiens
ctcaagtgatcttcc

SEQ ID NO: 349205 - DNA, 15 bp, Homo sapiens
tcaagtgatcttccc

SEQ ID NO: 349206 - DNA, 15 bp, Homo sapiens
caagtgatcttccca

SEQ ID NO: 349207 - DNA, 15 bp, Homo sapiens
aagtgatcttcccac

SEQ ID NO: 349208 - DNA, 15 bp, Homo sapiens
agtgatcttcccacc

SEQ ID NO: 349209 - DNA, 15 bp, Homo sapiens
ttcccacctcagcct

SEQ ID NO: 349210 - DNA, 15 bp, Homo sapiens
cacctcagcctccca

SEQ ID NO: 349211 - DNA, 15 bp, Homo sapiens
acctcagcctcccaa

SEQ ID NO: 349212 - DNA, 15 bp, Homo sapiens
cagcctcccaaaata

SEQ ID NO: 349213 - DNA, 15 bp, Homo sapiens
agcctcccaaaataa

SEQ ID NO: 349214 - DNA, 15 bp, Homo sapiens
gcctcccaaaataac

SEQ ID NO: 349215 - DNA, 15 bp, Homo sapiens
cctcccaaaataaca

SEQ ID NO: 349216 - DNA, 15 bp, Homo sapiens
ctcccaaaataacag

SEQ ID NO: 349217 - DNA, 15 bp, Homo sapiens
tcccaaaataacagg

SEQ ID NO: 349218 - DNA, 15 bp, Homo sapiens
cccaaaataacaggt

SEQ ID NO: 349219 - DNA, 15 bp, Homo sapiens
ccaaaataacaggtg

SEQ ID NO: 349220 - DNA, 15 bp, Homo sapiens
caaaataacaggtgt

SEQ ID NO: 349221 - DNA, 15 bp, Homo sapiens
aaaataacaggtgta

SEQ ID NO: 349222 - DNA, 15 bp, Homo sapiens
aaataacaggtgtaa

SEQ ID NO: 349223 - DNA, 15 bp, Homo sapiens
aataacaggtgtaag

SEQ ID NO: 349224 - DNA, 15 bp, Homo sapiens
ataacaggtgtaagc

SEQ ID NO: 349225 - DNA, 15 bp, Homo sapiens
taacaggtgtaagcc

SEQ ID NO: 349226 - DNA, 15 bp, Homo sapiens
aacaggtgtaagcca

SEQ ID NO: 349227 - DNA, 15 bp, Homo sapiens
acaggtgtaagccat

SEQ ID NO: 349228 - DNA, 15 bp, Homo sapiens
caggtgtaagccatt

SEQ ID NO: 349229 - DNA, 15 bp, Homo sapiens
aggtgtaagccatta

SEQ ID NO: 349230 - DNA, 15 bp, Homo sapiens
ggtgtaagccattat

SEQ ID NO: 349231 - DNA, 15 bp, Homo sapiens
gtgtaagccattata

SEQ ID NO: 349232 - DNA, 15 bp, Homo sapiens
tgtaagccattataa

SEQ ID NO: 349233 - DNA, 15 bp, Homo sapiens
gtaagccattataac

SEQ ID NO: 349234 - DNA, 15 bp, Homo sapiens
taagccattataaca

SEQ ID NO: 349235 - DNA, 15 bp, Homo sapiens
aagccattataacag

SEQ ID NO: 349236 - DNA, 15 bp, Homo sapiens
agccattataacagg

SEQ ID NO: 349237 - DNA, 15 bp, Homo sapiens
gccattataacaggt

SEQ ID NO: 349238 - DNA, 15 bp, Homo sapiens
ccattataacaggtg

SEQ ID NO: 349239 - DNA, 15 bp, Homo sapiens
cattataacaggtga

SEQ ID NO: 349240 - DNA, 15 bp, Homo sapiens
attataacaggtgat

SEQ ID NO: 349241 - DNA, 15 bp, Homo sapiens
ttataacaggtgata

SEQ ID NO: 349242 - DNA, 15 bp, Homo sapiens
tataacaggtgatat

SEQ ID NO: 349243 - DNA, 15 bp, Homo sapiens
ataacaggtgatata

SEQ ID NO: 349244 - DNA, 15 bp, Homo sapiens
taacaggtgatataa

SEQ ID NO: 349245 - DNA, 15 bp, Homo sapiens
aacaggtgatataac

SEQ ID NO: 349246 - DNA, 15 bp, Homo sapiens
acaggtgatataaca

SEQ ID NO: 349247 - DNA, 15 bp, Homo sapiens
caggtgatataacag

SEQ ID NO: 349248 - DNA, 15 bp, Homo sapiens
aggtgatataacagc

SEQ ID NO: 349249 - DNA, 15 bp, Homo sapiens
ggtgatataacagcc

SEQ ID NO: 349250 - DNA, 15 bp, Homo sapiens
gtgatataacagcct

SEQ ID NO: 349251 - DNA, 15 bp, Homo sapiens
tgatataacagcctc

SEQ ID NO: 349252 - DNA, 15 bp, Homo sapiens
gatataacagcctcc

SEQ ID NO: 349253 - DNA, 15 bp, Homo sapiens
atataacagcctccc

SEQ ID NO: 349254 - DNA, 15 bp, Homo sapiens
tataacagcctccca

SEQ ID NO: 349255 - DNA, 15 bp, Homo sapiens
ataacagcctcccaa

SEQ ID NO: 349256 - DNA, 15 bp, Homo sapiens
taacagcctcccaaa

SEQ ID NO: 349257 - DNA, 15 bp, Homo sapiens
aacagcctcccaaaa

SEQ ID NO: 349258 - DNA, 15 bp, Homo sapiens
acagcctcccaaaat

SEQ ID NO: 349259 - DNA, 15 bp, Homo sapiens
aaaataacaggtgtt

SEQ ID NO: 349260 - DNA, 15 bp, Homo sapiens
aaataacaggtgtta

SEQ ID NO: 349261 - DNA, 15 bp, Homo sapiens
aataacaggtgttag

SEQ ID NO: 349262 - DNA, 15 bp, Homo sapiens
ataacaggtgttagg

SEQ ID NO: 349263 - DNA, 15 bp, Homo sapiens
taacaggtgttaggc

SEQ ID NO: 349264 - DNA, 15 bp, Homo sapiens
aacaggtgttaggca

SEQ ID NO: 349265 - DNA, 15 bp, Homo sapiens
acaggtgttaggcaa

SEQ ID NO: 349266 - DNA, 15 bp, Homo sapiens
caggtgttaggcaaa

SEQ ID NO: 349267 - DNA, 15 bp, Homo sapiens
aggtgttaggcaaaa

SEQ ID NO: 349268 - DNA, 15 bp, Homo sapiens
ggtgttaggcaaaat

SEQ ID NO: 349269 - DNA, 15 bp, Homo sapiens
gtgttaggcaaaata

SEQ ID NO: 349270 - DNA, 15 bp, Homo sapiens
tgttaggcaaaataa

SEQ ID NO: 349271 - DNA, 15 bp, Homo sapiens
gttaggcaaaataac

SEQ ID NO: 349272 - DNA, 15 bp, Homo sapiens
ttaggcaaaataaca

SEQ ID NO: 349273 - DNA, 15 bp, Homo sapiens
taggcaaaataacag

SEQ ID NO: 349274 - DNA, 15 bp, Homo sapiens
aggcaaaataacaga

SEQ ID NO: 349275 - DNA, 15 bp, Homo sapiens
ggcaaaataacagat

SEQ ID NO: 349276 - DNA, 15 bp, Homo sapiens
gcaaaataacagatg

SEQ ID NO: 349277 - DNA, 15 bp, Homo sapiens
caaaataacagatgt

SEQ ID NO: 349278 - DNA, 15 bp, Homo sapiens
aaataacagatgtta

SEQ ID NO: 349279 - DNA, 15 bp, Homo sapiens
aataacagatgttag

SEQ ID NO: 349280 - DNA, 15 bp, Homo sapiens
ataacagatgttagc

SEQ ID NO: 349281 - DNA, 15 bp, Homo sapiens
taacagatgttagcc

SEQ ID NO: 349282 - DNA, 15 bp, Homo sapiens
aacagatgttagcct

SEQ ID NO: 349283 - DNA, 15 bp, Homo sapiens
acagatgttagcctc

SEQ ID NO: 349284 - DNA, 15 bp, Homo sapiens
cagatgttagcctcc

SEQ ID NO: 349285 - DNA, 15 bp, Homo sapiens
agatgttagcctccc

SEQ ID NO: 349286 - DNA, 15 bp, Homo sapiens
gatgttagcctccca

SEQ ID NO: 349287 - DNA, 15 bp, Homo sapiens
atgttagcctcccaa

SEQ ID NO: 349288 - DNA, 15 bp, Homo sapiens
tgttagcctcccaaa

SEQ ID NO: 349289 - DNA, 15 bp, Homo sapiens
gttagcctcccaaaa

SEQ ID NO: 349290 - DNA, 15 bp, Homo sapiens
ttagcctcccaaaat

SEQ ID NO: 349291 - DNA, 15 bp, Homo sapiens
tagcctcccaaaata

SEQ ID NO: 349292 - DNA, 15 bp, Homo sapiens
agcctcccaaaatac

SEQ ID NO: 349293 - DNA, 15 bp, Homo sapiens
gcctcccaaaatacc

SEQ ID NO: 349294 - DNA, 15 bp, Homo sapiens
cctcccaaaatacca

SEQ ID NO: 349295 - DNA, 15 bp, Homo sapiens
ctcccaaaataccag

SEQ ID NO: 349296 - DNA, 15 bp, Homo sapiens
tcccaaaataccagg

SEQ ID NO: 349297 - DNA, 15 bp, Homo sapiens
cccaaaataccaggg

SEQ ID NO: 349298 - DNA, 15 bp, Homo sapiens
ccaaaataccaggga

SEQ ID NO: 349299 - DNA, 15 bp, Homo sapiens
caaaataccagggat

SEQ ID NO: 349300 - DNA, 15 bp, Homo sapiens
aaaataccagggata

SEQ ID NO: 349301 - DNA, 15 bp, Homo sapiens
aaataccagggataa

SEQ ID NO: 349302 - DNA, 15 bp, Homo sapiens
aataccagggataac

SEQ ID NO: 349303 - DNA, 15 bp, Homo sapiens
ataccagggataaca

SEQ ID NO: 349304 - DNA, 15 bp, Homo sapiens
taccagggataacag

SEQ ID NO: 349305 - DNA, 15 bp, Homo sapiens
accagggataacagg

SEQ ID NO: 349306 - DNA, 15 bp, Homo sapiens
ccagggataacaggt

SEQ ID NO: 349307 - DNA, 15 bp, Homo sapiens
cagggataacaggtg

SEQ ID NO: 349308 - DNA, 15 bp, Homo sapiens
agggataacaggtgt

SEQ ID NO: 349309 - DNA, 15 bp, Homo sapiens
gggataacaggtgtc

SEQ ID NO: 349310 - DNA, 15 bp, Homo sapiens
ggataacaggtgtca

SEQ ID NO: 349311 - DNA, 15 bp, Homo sapiens
gataacaggtgtcag

SEQ ID NO: 349312 - DNA, 15 bp, Homo sapiens
ataacaggtgtcagc

SEQ ID NO: 349313 - DNA, 15 bp, Homo sapiens
taacaggtgtcagcc

SEQ ID NO: 349314 - DNA, 15 bp, Homo sapiens
aacaggtgtcagcca

SEQ ID NO: 349315 - DNA, 15 bp, Homo sapiens
acaggtgtcagccat

SEQ ID NO: 349316 - DNA, 15 bp, Homo sapiens
caggtgtcagccatt

SEQ ID NO: 349317 - DNA, 15 bp, Homo sapiens
aggtgtcagccattg

SEQ ID NO: 349318 - DNA, 15 bp, Homo sapiens
ggtgtcagccattgt

SEQ ID NO: 349319 - DNA, 15 bp, Homo sapiens
gtgtcagccattgta

SEQ ID NO: 349320 - DNA, 15 bp, Homo sapiens
tgtcagccattgtac

SEQ ID NO: 349321 - DNA, 15 bp, Homo sapiens
gtcagccattgtacc

SEQ ID NO: 349322 - DNA, 15 bp, Homo sapiens
tcagccattgtacct

SEQ ID NO: 349323 - DNA, 15 bp, Homo sapiens
cagccattgtacctg

SEQ ID NO: 349324 - DNA, 15 bp, Homo sapiens
agccattgtacctga

SEQ ID NO: 349325 - DNA, 15 bp, Homo sapiens
gccattgtacctgac

SEQ ID NO: 349326 - DNA, 15 bp, Homo sapiens
ccattgtacctgacc

SEQ ID NO: 349327 - DNA, 15 bp, Homo sapiens
cattgtacctgacct

SEQ ID NO: 349328 - DNA, 15 bp, Homo sapiens
attgtacctgacctg

SEQ ID NO: 349329 - DNA, 15 bp, Homo sapiens
ttgtacctgacctgg

SEQ ID NO: 349330 - DNA, 15 bp, Homo sapiens
tgtacctgacctgga

SEQ ID NO: 349331 - DNA, 15 bp, Homo sapiens
gtacctgacctggat

SEQ ID NO: 349332 - DNA, 15 bp, Homo sapiens
tacctgacctggata

SEQ ID NO: 349333 - DNA, 15 bp, Homo sapiens
acctgacctggatat

SEQ ID NO: 349334 - DNA, 15 bp, Homo sapiens
cctgacctggatata

SEQ ID NO: 349335 - DNA, 15 bp, Homo sapiens
ctgacctggatataa

SEQ ID NO: 349336 - DNA, 15 bp, Homo sapiens
tgacctggatataat

SEQ ID NO: 349337 - DNA, 15 bp, Homo sapiens
gacctggatataatg

SEQ ID NO: 349338 - DNA, 15 bp, Homo sapiens
acctggatataatga

SEQ ID NO: 349339 - DNA, 15 bp, Homo sapiens
cctggatataatgat

SEQ ID NO: 349340 - DNA, 15 bp, Homo sapiens
ctggatataatgatt

SEQ ID NO: 349341 - DNA, 15 bp, Homo sapiens
tggatataatgattt

SEQ ID NO: 349342 - DNA, 15 bp, Homo sapiens
ggatataatgatttt

SEQ ID NO: 349343 - DNA, 15 bp, Homo sapiens
gatataatgattttt

SEQ ID NO: 349344 - DNA, 15 bp, Homo sapiens
atataatgattttta

SEQ ID NO: 349345 - DNA, 15 bp, Homo sapiens
tataatgatttttaa

SEQ ID NO: 349346 - DNA, 15 bp, Homo sapiens
ataatgatttttaaa

SEQ ID NO: 349347 - DNA, 15 bp, Homo sapiens
taatgatttttaaag

SEQ ID NO: 349348 - DNA, 15 bp, Homo sapiens
aatgatttttaaaga

SEQ ID NO: 349349 - DNA, 15 bp, Homo sapiens
atgatttttaaagat

SEQ ID NO: 349350 - DNA, 15 bp, Homo sapiens
tgatttttaaagatt

SEQ ID NO: 349351 - DNA, 15 bp, Homo sapiens
gatttttaaagattt

SEQ ID NO: 349352 - DNA, 15 bp, Homo sapiens
atttttaaagatttt

SEQ ID NO: 349353 - DNA, 15 bp, Homo sapiens
tttttaaagattttt

SEQ ID NO: 349354 - DNA, 15 bp, Homo sapiens
ttttaaagatttttt

SEQ ID NO: 349355 - DNA, 15 bp, Homo sapiens
tttaaagattttttt

SEQ ID NO: 349356 - DNA, 15 bp, Homo sapiens
ttaaagatttttttt

SEQ ID NO: 349357 - DNA, 15 bp, Homo sapiens
taaagattttttttt

SEQ ID NO: 349358 - DNA, 15 bp, Homo sapiens
aaagatttttttttt

SEQ ID NO: 349359 - DNA, 15 bp, Homo sapiens
aagattttttttttt

SEQ ID NO: 349360 - DNA, 15 bp, Homo sapiens
agatttttttttttt

SEQ ID NO: 349361 - DNA, 15 bp, Homo sapiens
ttttttttttgagaa

SEQ ID NO: 349362 - DNA, 15 bp, Homo sapiens
tttttttttgagaaa

SEQ ID NO: 349363 - DNA, 15 bp, Homo sapiens
ttttttttgagaaac

SEQ ID NO: 349364 - DNA, 15 bp, Homo sapiens
tttttttgagaaaca

SEQ ID NO: 349365 - DNA, 15 bp, Homo sapiens
ttttttgagaaacag

SEQ ID NO: 349366 - DNA, 15 bp, Homo sapiens
tttttgagaaacagg

SEQ ID NO: 349367 - DNA, 15 bp, Homo sapiens
ttttgagaaacaggt

SEQ ID NO: 349368 - DNA, 15 bp, Homo sapiens
tttgagaaacaggtg

SEQ ID NO: 349369 - DNA, 15 bp, Homo sapiens
ttgagaaacaggtgc

SEQ ID NO: 349370 - DNA, 15 bp, Homo sapiens
tgagaaacaggtgca

SEQ ID NO: 349371 - DNA, 15 bp, Homo sapiens
gagaaacaggtgcaa

SEQ ID NO: 349372 - DNA, 15 bp, Homo sapiens
agaaacaggtgcaat

SEQ ID NO: 349373 - DNA, 15 bp, Homo sapiens
gaaacaggtgcaatt

SEQ ID NO: 349374 - DNA, 15 bp, Homo sapiens
aaacaggtgcaattt

SEQ ID NO: 349375 - DNA, 15 bp, Homo sapiens
aacaggtgcaatttc

SEQ ID NO: 349376 - DNA, 15 bp, Homo sapiens
acaggtgcaatttct

SEQ ID NO: 349377 - DNA, 15 bp, Homo sapiens
caggtgcaatttctt

SEQ ID NO: 349378 - DNA, 15 bp, Homo sapiens
aggtgcaatttcttc

SEQ ID NO: 349379 - DNA, 15 bp, Homo sapiens
ggtgcaatttcttcc

SEQ ID NO: 349380 - DNA, 15 bp, Homo sapiens
gtgcaatttcttcct

SEQ ID NO: 349381 - DNA, 15 bp, Homo sapiens
tgcaatttcttcctt

SEQ ID NO: 349382 - DNA, 15 bp, Homo sapiens
gcaatttcttccttt

SEQ ID NO: 349383 - DNA, 15 bp, Homo sapiens
caatttcttcctttg

SEQ ID NO: 349384 - DNA, 15 bp, Homo sapiens
aatttcttcctttgg

SEQ ID NO: 349385 - DNA, 15 bp, Homo sapiens
atttcttcctttggt

SEQ ID NO: 349386 - DNA, 15 bp, Homo sapiens
tttcttcctttggtt

SEQ ID NO: 349387 - DNA, 15 bp, Homo sapiens
ttcttcctttggttg

SEQ ID NO: 349388 - DNA, 15 bp, Homo sapiens
tcttcctttggttga

SEQ ID NO: 349389 - DNA, 15 bp, Homo sapiens
cttcctttggttgag

SEQ ID NO: 349390 - DNA, 15 bp, Homo sapiens
ttcctttggttgagg

SEQ ID NO: 349391 - DNA, 15 bp, Homo sapiens
tcctttggttgagga

SEQ ID NO: 349392 - DNA, 15 bp, Homo sapiens
cctttggttgaggag

SEQ ID NO: 349393 - DNA, 15 bp, Homo sapiens
ctttggttgaggagg

SEQ ID NO: 349394 - DNA, 15 bp, Homo sapiens
tttggttgaggaggc

SEQ ID NO: 349395 - DNA, 15 bp, Homo sapiens
ttggttgaggaggcc

SEQ ID NO: 349396 - DNA, 15 bp, Homo sapiens
tggttgaggaggcca

SEQ ID NO: 349397 - DNA, 15 bp, Homo sapiens
ggttgaggaggccac

SEQ ID NO: 349398 - DNA, 15 bp, Homo sapiens
gttgaggaggccact

SEQ ID NO: 349399 - DNA, 15 bp, Homo sapiens
ttgaggaggccactt

SEQ ID NO: 349400 - DNA, 15 bp, Homo sapiens
tgaggaggccactta

SEQ ID NO: 349401 - DNA, 15 bp, Homo sapiens
gaggaggccacttaa

SEQ ID NO: 349402 - DNA, 15 bp, Homo sapiens
aggaggccacttaat

SEQ ID NO: 349403 - DNA, 15 bp, Homo sapiens
ggaggccacttaata

SEQ ID NO: 349404 - DNA, 15 bp, Homo sapiens
gaggccacttaatat

SEQ ID NO: 349405 - DNA, 15 bp, Homo sapiens
aggccacttaatatc

SEQ ID NO: 349406 - DNA, 15 bp, Homo sapiens
ggccacttaatatca

SEQ ID NO: 349407 - DNA, 15 bp, Homo sapiens
gccacttaatatcat

SEQ ID NO: 349408 - DNA, 15 bp, Homo sapiens
ccacttaatatcatt

SEQ ID NO: 349409 - DNA, 15 bp, Homo sapiens
cacttaatatcattg

SEQ ID NO: 349410 - DNA, 15 bp, Homo sapiens
acttaatatcattgc

SEQ ID NO: 349411 - DNA, 15 bp, Homo sapiens
cttaatatcattgct

SEQ ID NO: 349412 - DNA, 15 bp, Homo sapiens
ttaatatcattgcta

SEQ ID NO: 349413 - DNA, 15 bp, Homo sapiens
taatatcattgctag

SEQ ID NO: 349414 - DNA, 15 bp, Homo sapiens
aatatcattgctagg

SEQ ID NO: 349415 - DNA, 15 bp, Homo sapiens
atatcattgctagga

SEQ ID NO: 349416 - DNA, 15 bp, Homo sapiens
tatcattgctaggag

SEQ ID NO: 349417 - DNA, 15 bp, Homo sapiens
atcattgctaggagg

SEQ ID NO: 349418 - DNA, 15 bp, Homo sapiens
tcattgctaggagga

SEQ ID NO: 349419 - DNA, 15 bp, Homo sapiens
cattgctaggaggat

SEQ ID NO: 349420 - DNA, 15 bp, Homo sapiens
attgctaggaggatc

SEQ ID NO: 349421 - DNA, 15 bp, Homo sapiens
ttgctaggaggatca

SEQ ID NO: 349422 - DNA, 15 bp, Homo sapiens
tgctaggaggatcaa

SEQ ID NO: 349423 - DNA, 15 bp, Homo sapiens
gctaggaggatcaaa

SEQ ID NO: 349424 - DNA, 15 bp, Homo sapiens
ctaggaggatcaaaa

SEQ ID NO: 349425 - DNA, 15 bp, Homo sapiens
taggaggatcaaaat

SEQ ID NO: 349426 - DNA, 15 bp, Homo sapiens
aggaggatcaaaatg

SEQ ID NO: 349427 - DNA, 15 bp, Homo sapiens
ggaggatcaaaatga

SEQ ID NO: 349428 - DNA, 15 bp, Homo sapiens
gaggatcaaaatgaa

SEQ ID NO: 349429 - DNA, 15 bp, Homo sapiens
aggatcaaaatgaat

SEQ ID NO: 349430 - DNA, 15 bp, Homo sapiens
ggatcaaaatgaatg

SEQ ID NO: 349431 - DNA, 15 bp, Homo sapiens
gatcaaaatgaatga

SEQ ID NO: 349432 - DNA, 15 bp, Homo sapiens
atcaaaatgaatgat

SEQ ID NO: 349433 - DNA, 15 bp, Homo sapiens
tcaaaatgaatgatc

SEQ ID NO: 349434 - DNA, 15 bp, Homo sapiens
caaaatgaatgatcc

SEQ ID NO: 349435 - DNA, 15 bp, Homo sapiens
aaaatgaatgatccc

SEQ ID NO: 349436 - DNA, 15 bp, Homo sapiens
aaatgaatgatccct

SEQ ID NO: 349437 - DNA, 15 bp, Homo sapiens
aatgaatgatccctt

SEQ ID NO: 349438 - DNA, 15 bp, Homo sapiens
atgaatgatccctta

SEQ ID NO: 349439 - DNA, 15 bp, Homo sapiens
tgaatgatcccttac

SEQ ID NO: 349440 - DNA, 15 bp, Homo sapiens
gaatgatcccttact

SEQ ID NO: 349441 - DNA, 15 bp, Homo sapiens
aatgatcccttactt

SEQ ID NO: 349442 - DNA, 15 bp, Homo sapiens
atgatcccttacttc

SEQ ID NO: 349443 - DNA, 15 bp, Homo sapiens
tgatcccttacttct

SEQ ID NO: 349444 - DNA, 15 bp, Homo sapiens
gatcccttacttctg

SEQ ID NO: 349445 - DNA, 15 bp, Homo sapiens
atcccttacttctgt

SEQ ID NO: 349446 - DNA, 15 bp, Homo sapiens
tcccttacttctgtt

SEQ ID NO: 349447 - DNA, 15 bp, Homo sapiens
cccttacttctgttt

SEQ ID NO: 349448 - DNA, 15 bp, Homo sapiens
ccttacttctgtttc

SEQ ID NO: 349449 - DNA, 15 bp, Homo sapiens
cttacttctgtttcc

SEQ ID NO: 349450 - DNA, 15 bp, Homo sapiens
ttacttctgtttcct

SEQ ID NO: 349451 - DNA, 15 bp, Homo sapiens
tacttctgtttcctc

SEQ ID NO: 349452 - DNA, 15 bp, Homo sapiens
acttctgtttcctca

SEQ ID NO: 349453 - DNA, 15 bp, Homo sapiens
cttctgtttcctcaa

SEQ ID NO: 349454 - DNA, 15 bp, Homo sapiens
ttctgtttcctcaaa

SEQ ID NO: 349455 - DNA, 15 bp, Homo sapiens
tctgtttcctcaaaa

SEQ ID NO: 349456 - DNA, 15 bp, Homo sapiens
ctgtttcctcaaaat

SEQ ID NO: 349457 - DNA, 15 bp, Homo sapiens
tgtttcctcaaaata

SEQ ID NO: 349458 - DNA, 15 bp, Homo sapiens
gtttcctcaaaatag

SEQ ID NO: 349459 - DNA, 15 bp, Homo sapiens
tttcctcaaaatagt

SEQ ID NO: 349460 - DNA, 15 bp, Homo sapiens
ttcctcaaaatagtt

SEQ ID NO: 349461 - DNA, 15 bp, Homo sapiens
tcctcaaaatagtta

SEQ ID NO: 349462 - DNA, 15 bp, Homo sapiens
cctcaaaatagttaa

SEQ ID NO: 349463 - DNA, 15 bp, Homo sapiens
ctcaaaatagttaaa

SEQ ID NO: 349464 - DNA, 15 bp, Homo sapiens
tcaaaatagttaaag

SEQ ID NO: 349465 - DNA, 15 bp, Homo sapiens
caaaatagttaaagt

SEQ ID NO: 349466 - DNA, 15 bp, Homo sapiens
aaaatagttaaagtt

SEQ ID NO: 349467 - DNA, 15 bp, Homo sapiens
aaatagttaaagttt

SEQ ID NO: 349468 - DNA, 15 bp, Homo sapiens
aatagttaaagtttt

SEQ ID NO: 349469 - DNA, 15 bp, Homo sapiens
atagttaaagttttg

SEQ ID NO: 349470 - DNA, 15 bp, Homo sapiens
tagttaaagttttgg

SEQ ID NO: 349471 - DNA, 15 bp, Homo sapiens
agttaaagttttggc

SEQ ID NO: 349472 - DNA, 15 bp, Homo sapiens
gttaaagttttggca

SEQ ID NO: 349473 - DNA, 15 bp, Homo sapiens
ttaaagttttggcag

SEQ ID NO: 349474 - DNA, 15 bp, Homo sapiens
taaagttttggcagt

SEQ ID NO: 349475 - DNA, 15 bp, Homo sapiens
aaagttttggcagtc

SEQ ID NO: 349476 - DNA, 15 bp, Homo sapiens
aagttttggcagtct

SEQ ID NO: 349477 - DNA, 15 bp, Homo sapiens
agttttggcagtctc

SEQ ID NO: 349478 - DNA, 15 bp, Homo sapiens
gttttggcagtctca

SEQ ID NO: 349479 - DNA, 15 bp, Homo sapiens
ttttggcagtctcat

SEQ ID NO: 349480 - DNA, 15 bp, Homo sapiens
tttggcagtctcata

SEQ ID NO: 349481 - DNA, 15 bp, Homo sapiens
ttggcagtctcatac

SEQ ID NO: 349482 - DNA, 15 bp, Homo sapiens
tggcagtctcatact

SEQ ID NO: 349483 - DNA, 15 bp, Homo sapiens
ggcagtctcatactg

SEQ ID NO: 349484 - DNA, 15 bp, Homo sapiens
gcagtctcatactgt

SEQ ID NO: 349485 - DNA, 15 bp, Homo sapiens
cagtctcatactgtc

SEQ ID NO: 349486 - DNA, 15 bp, Homo sapiens
agtctcatactgtct

SEQ ID NO: 349487 - DNA, 15 bp, Homo sapiens
gtctcatactgtctt

SEQ ID NO: 349488 - DNA, 15 bp, Homo sapiens
tctcatactgtcttt

SEQ ID NO: 349489 - DNA, 15 bp, Homo sapiens
ctcatactgtctttt

SEQ ID NO: 349490 - DNA, 15 bp, Homo sapiens
tcatactgtctttta

SEQ ID NO: 349491 - DNA, 15 bp, Homo sapiens
catactgtcttttaa

SEQ ID NO: 349492 - DNA, 15 bp, Homo sapiens
atactgtcttttaaa

SEQ ID NO: 349493 - DNA, 15 bp, Homo sapiens
tactgtcttttaaaa

SEQ ID NO: 349494 - DNA, 15 bp, Homo sapiens
actgtcttttaaaag

SEQ ID NO: 349495 - DNA, 15 bp, Homo sapiens
ctgtcttttaaaaga

SEQ ID NO: 349496 - DNA, 15 bp, Homo sapiens
tgtcttttaaaagaa

SEQ ID NO: 349497 - DNA, 15 bp, Homo sapiens
gtcttttaaaagaaa

SEQ ID NO: 349498 - DNA, 15 bp, Homo sapiens
tcttttaaaagaaat

SEQ ID NO: 349499 - DNA, 15 bp, Homo sapiens
cttttaaaagaaatc

SEQ ID NO: 349500 - DNA, 15 bp, Homo sapiens
ttttaaaagaaatca

SEQ ID NO: 349501 - DNA, 15 bp, Homo sapiens
tttaaaagaaatcat

SEQ ID NO: 349502 - DNA, 15 bp, Homo sapiens
ttaaaagaaatcata

SEQ ID NO: 349503 - DNA, 15 bp, Homo sapiens
taaaagaaatcatat

SEQ ID NO: 349504 - DNA, 15 bp, Homo sapiens
aaaagaaatcatatt

SEQ ID NO: 349505 - DNA, 15 bp, Homo sapiens
aaagaaatcatattc

SEQ ID NO: 349506 - DNA, 15 bp, Homo sapiens
aagaaatcatattcc

SEQ ID NO: 349507 - DNA, 15 bp, Homo sapiens
agaaatcatattcca

SEQ ID NO: 349508 - DNA, 15 bp, Homo sapiens
gaaatcatattccac

SEQ ID NO: 349509 - DNA, 15 bp, Homo sapiens
aaatcatattccact

SEQ ID NO: 349510 - DNA, 15 bp, Homo sapiens
aatcatattccactg

SEQ ID NO: 349511 - DNA, 15 bp, Homo sapiens
atcatattccactgt

SEQ ID NO: 349512 - DNA, 15 bp, Homo sapiens
tcatattccactgtc

SEQ ID NO: 349513 - DNA, 15 bp, Homo sapiens
catattccactgtca

SEQ ID NO: 349514 - DNA, 15 bp, Homo sapiens
atattccactgtcag

SEQ ID NO: 349515 - DNA, 15 bp, Homo sapiens
tattccactgtcaga

SEQ ID NO: 349516 - DNA, 15 bp, Homo sapiens
attccactgtcagat

SEQ ID NO: 349517 - DNA, 15 bp, Homo sapiens
ttccactgtcagatt

SEQ ID NO: 349518 - DNA, 15 bp, Homo sapiens
tccactgtcagattc

SEQ ID NO: 349519 - DNA, 15 bp, Homo sapiens
ccactgtcagattca

SEQ ID NO: 349520 - DNA, 15 bp, Homo sapiens
cactgtcagattcag

SEQ ID NO: 349521 - DNA, 15 bp, Homo sapiens
actgtcagattcaga

SEQ ID NO: 349522 - DNA, 15 bp, Homo sapiens
ctgtcagattcagaa

SEQ ID NO: 349523 - DNA, 15 bp, Homo sapiens
tgtcagattcagaaa

SEQ ID NO: 349524 - DNA, 15 bp, Homo sapiens
gtcagattcagaaaa

SEQ ID NO: 349525 - DNA, 15 bp, Homo sapiens
tcagattcagaaaaa

SEQ ID NO: 349526 - DNA, 15 bp, Homo sapiens
cagattcagaaaaat

SEQ ID NO: 349527 - DNA, 15 bp, Homo sapiens
agattcagaaaaatt

SEQ ID NO: 349528 - DNA, 15 bp, Homo sapiens
gattcagaaaaattt

SEQ ID NO: 349529 - DNA, 15 bp, Homo sapiens
attcagaaaaatttt

SEQ ID NO: 349530 - DNA, 15 bp, Homo sapiens
ttcagaaaaatttta

SEQ ID NO: 349531 - DNA, 15 bp, Homo sapiens
tcagaaaaattttag

SEQ ID NO: 349532 - DNA, 15 bp, Homo sapiens
cagaaaaattttaga

SEQ ID NO: 349533 - DNA, 15 bp, Homo sapiens
agaaaaattttagag

SEQ ID NO: 349534 - DNA, 15 bp, Homo sapiens
gaaaaattttagagt

SEQ ID NO: 349535 - DNA, 15 bp, Homo sapiens
aaaaattttagagtt

SEQ ID NO: 349536 - DNA, 15 bp, Homo sapiens
aaaattttagagttc

SEQ ID NO: 349537 - DNA, 15 bp, Homo sapiens
aaattttagagttct

SEQ ID NO: 349538 - DNA, 15 bp, Homo sapiens
aattttagagttctt

SEQ ID NO: 349539 - DNA, 15 bp, Homo sapiens
attttagagttctta

SEQ ID NO: 349540 - DNA, 15 bp, Homo sapiens
ttttagagttcttac

SEQ ID NO: 349541 - DNA, 15 bp, Homo sapiens
tttagagttcttact

SEQ ID NO: 349542 - DNA, 15 bp, Homo sapiens
ttagagttcttactt

SEQ ID NO: 349543 - DNA, 15 bp, Homo sapiens
tagagttcttacttt

SEQ ID NO: 349544 - DNA, 15 bp, Homo sapiens
agagttcttactttt

SEQ ID NO: 349545 - DNA, 15 bp, Homo sapiens
gagttcttacttttg

SEQ ID NO: 349546 - DNA, 15 bp, Homo sapiens
agttcttacttttgg

SEQ ID NO: 349547 - DNA, 15 bp, Homo sapiens
gttcttacttttgga

SEQ ID NO: 349548 - DNA, 15 bp, Homo sapiens
ttcttacttttggaa

SEQ ID NO: 349549 - DNA, 15 bp, Homo sapiens
tcttacttttggaat

SEQ ID NO: 349550 - DNA, 15 bp, Homo sapiens
cttacttttggaata

SEQ ID NO: 349551 - DNA, 15 bp, Homo sapiens
ttacttttggaatac

SEQ ID NO: 349552 - DNA, 15 bp, Homo sapiens
tacttttggaataca

SEQ ID NO: 349553 - DNA, 15 bp, Homo sapiens
acttttggaatacac

SEQ ID NO: 349554 - DNA, 15 bp, Homo sapiens
cttttggaatacact

SEQ ID NO: 349555 - DNA, 15 bp, Homo sapiens
ttttggaatacactt

SEQ ID NO: 349556 - DNA, 15 bp, Homo sapiens
tttggaatacacttg

SEQ ID NO: 349557 - DNA, 15 bp, Homo sapiens
ttggaatacacttgg

SEQ ID NO: 349558 - DNA, 15 bp, Homo sapiens
tggaatacacttggt

SEQ ID NO: 349559 - DNA, 15 bp, Homo sapiens
ggaatacacttggtt

SEQ ID NO: 349560 - DNA, 15 bp, Homo sapiens
gaatacacttggttt

SEQ ID NO: 349561 - DNA, 15 bp, Homo sapiens
aatacacttggtttt

SEQ ID NO: 349562 - DNA, 15 bp, Homo sapiens
atacacttggttttg

SEQ ID NO: 349563 - DNA, 15 bp, Homo sapiens
tacacttggttttgg

SEQ ID NO: 349564 - DNA, 15 bp, Homo sapiens
acacttggttttgga

SEQ ID NO: 349565 - DNA, 15 bp, Homo sapiens
cacttggttttggaa

SEQ ID NO: 349566 - DNA, 15 bp, Homo sapiens
acttggttttggaag

SEQ ID NO: 349567 - DNA, 15 bp, Homo sapiens
cttggttttggaagg

SEQ ID NO: 349568 - DNA, 15 bp, Homo sapiens
ttggttttggaaggt

SEQ ID NO: 349569 - DNA, 15 bp, Homo sapiens
tggttttggaaggtt

SEQ ID NO: 349570 - DNA, 15 bp, Homo sapiens
ggttttggaaggttc

SEQ ID NO: 349571 - DNA, 15 bp, Homo sapiens
gttttggaaggttca

SEQ ID NO: 349572 - DNA, 15 bp, Homo sapiens
ttttggaaggttcac

SEQ ID NO: 349573 - DNA, 15 bp, Homo sapiens
tttggaaggttcact

SEQ ID NO: 349574 - DNA, 15 bp, Homo sapiens
ttggaaggttcactg

SEQ ID NO: 349575 - DNA, 15 bp, Homo sapiens
tggaaggttcactgt

SEQ ID NO: 349576 - DNA, 15 bp, Homo sapiens
ggaaggttcactgtt

SEQ ID NO: 349577 - DNA, 15 bp, Homo sapiens
gaaggttcactgtta

SEQ ID NO: 349578 - DNA, 15 bp, Homo sapiens
aaggttcactgttaa

SEQ ID NO: 349579 - DNA, 15 bp, Homo sapiens
aggttcactgttaaa

SEQ ID NO: 349580 - DNA, 15 bp, Homo sapiens
ggttcactgttaaag

SEQ ID NO: 349581 - DNA, 15 bp, Homo sapiens
gttcactgttaaaga

SEQ ID NO: 349582 - DNA, 15 bp, Homo sapiens
ttcactgttaaagat

SEQ ID NO: 349583 - DNA, 15 bp, Homo sapiens
tcactgttaaagatt

SEQ ID NO: 349584 - DNA, 15 bp, Homo sapiens
cactgttaaagattt

SEQ ID NO: 349585 - DNA, 15 bp, Homo sapiens
actgttaaagatttt

SEQ ID NO: 349586 - DNA, 15 bp, Homo sapiens
ctgttaaagattttg

SEQ ID NO: 349587 - DNA, 15 bp, Homo sapiens
tgttaaagattttga

SEQ ID NO: 349588 - DNA, 15 bp, Homo sapiens
gttaaagattttgaa

SEQ ID NO: 349589 - DNA, 15 bp, Homo sapiens
ttaaagattttgaaa

SEQ ID NO: 349590 - DNA, 15 bp, Homo sapiens
taaagattttgaaag

SEQ ID NO: 349591 - DNA, 15 bp, Homo sapiens
aaagattttgaaagc

SEQ ID NO: 349592 - DNA, 15 bp, Homo sapiens
aagattttgaaagct

SEQ ID NO: 349593 - DNA, 15 bp, Homo sapiens
agattttgaaagctc

SEQ ID NO: 349594 - DNA, 15 bp, Homo sapiens
gattttgaaagctca

SEQ ID NO: 349595 - DNA, 15 bp, Homo sapiens
attttgaaagctcat

SEQ ID NO: 349596 - DNA, 15 bp, Homo sapiens
ttttgaaagctcatc

SEQ ID NO: 349597 - DNA, 15 bp, Homo sapiens
tttgaaagctcatcc

SEQ ID NO: 349598 - DNA, 15 bp, Homo sapiens
ttgaaagctcatccc

SEQ ID NO: 349599 - DNA, 15 bp, Homo sapiens
tgaaagctcatccct

SEQ ID NO: 349600 - DNA, 15 bp, Homo sapiens
gaaagctcatccctc

SEQ ID NO: 349601 - DNA, 15 bp, Homo sapiens
aaagctcatccctcc

SEQ ID NO: 349602 - DNA, 15 bp, Homo sapiens
aagctcatccctcct

SEQ ID NO: 349603 - DNA, 15 bp, Homo sapiens
agctcatccctccta

SEQ ID NO: 349604 - DNA, 15 bp, Homo sapiens
gctcatccctcctac

SEQ ID NO: 349605 - DNA, 15 bp, Homo sapiens
ctcatccctcctacg

SEQ ID NO: 349606 - DNA, 15 bp, Homo sapiens
tcatccctcctacgt

SEQ ID NO: 349607 - DNA, 15 bp, Homo sapiens
catccctcctacgtt

SEQ ID NO: 349608 - DNA, 15 bp, Homo sapiens
atccctcctacgtta

SEQ ID NO: 349609 - DNA, 15 bp, Homo sapiens
tccctcctacgttac

SEQ ID NO: 349610 - DNA, 15 bp, Homo sapiens
ccctcctacgttaca

SEQ ID NO: 349611 - DNA, 15 bp, Homo sapiens
cctcctacgttacac

SEQ ID NO: 349612 - DNA, 15 bp, Homo sapiens
ctcctacgttacact

SEQ ID NO: 349613 - DNA, 15 bp, Homo sapiens
tcctacgttacacta

SEQ ID NO: 349614 - DNA, 15 bp, Homo sapiens
cctacgttacactat

SEQ ID NO: 349615 - DNA, 15 bp, Homo sapiens
ctacgttacactatt

SEQ ID NO: 349616 - DNA, 15 bp, Homo sapiens
tacgttacactattt

SEQ ID NO: 349617 - DNA, 15 bp, Homo sapiens
acgttacactattta

SEQ ID NO: 349618 - DNA, 15 bp, Homo sapiens
cgttacactatttac

SEQ ID NO: 349619 - DNA, 15 bp, Homo sapiens
gttacactatttact

SEQ ID NO: 349620 - DNA, 15 bp, Homo sapiens
ttacactatttactt

SEQ ID NO: 349621 - DNA, 15 bp, Homo sapiens
tacactatttacttc

SEQ ID NO: 349622 - DNA, 15 bp, Homo sapiens
acactatttacttcc

SEQ ID NO: 349623 - DNA, 15 bp, Homo sapiens
cactatttacttcct

SEQ ID NO: 349624 - DNA, 15 bp, Homo sapiens
actatttacttccta

SEQ ID NO: 349625 - DNA, 15 bp, Homo sapiens
ctatttacttcctag

SEQ ID NO: 349626 - DNA, 15 bp, Homo sapiens
tatttacttcctagc

SEQ ID NO: 349627 - DNA, 15 bp, Homo sapiens
atttacttcctagct

SEQ ID NO: 349628 - DNA, 15 bp, Homo sapiens
tttacttcctagctg

SEQ ID NO: 349629 - DNA, 15 bp, Homo sapiens
ttacttcctagctgc

SEQ ID NO: 349630 - DNA, 15 bp, Homo sapiens
tacttcctagctgcc

SEQ ID NO: 349631 - DNA, 15 bp, Homo sapiens
acttcctagctgcca

SEQ ID NO: 349632 - DNA, 15 bp, Homo sapiens
cttcctagctgccat

SEQ ID NO: 349633 - DNA, 15 bp, Homo sapiens
ttcctagctgccatt

SEQ ID NO: 349634 - DNA, 15 bp, Homo sapiens
tcctagctgccattt

SEQ ID NO: 349635 - DNA, 15 bp, Homo sapiens
cctagctgccatttg

SEQ ID NO: 349636 - DNA, 15 bp, Homo sapiens
ctagctgccatttga

SEQ ID NO: 349637 - DNA, 15 bp, Homo sapiens
tagctgccatttgag

SEQ ID NO: 349638 - DNA, 15 bp, Homo sapiens
agctgccatttgagt

SEQ ID NO: 349639 - DNA, 15 bp, Homo sapiens
gctgccatttgagtt

SEQ ID NO: 349640 - DNA, 15 bp, Homo sapiens
ctgccatttgagtta

SEQ ID NO: 349641 - DNA, 15 bp, Homo sapiens
tgccatttgagttag

SEQ ID NO: 349642 - DNA, 15 bp, Homo sapiens
gccatttgagttagg

SEQ ID NO: 349643 - DNA, 15 bp, Homo sapiens
ccatttgagttagga

SEQ ID NO: 349644 - DNA, 15 bp, Homo sapiens
catttgagttaggaa

SEQ ID NO: 349645 - DNA, 15 bp, Homo sapiens
atttgagttaggaac

SEQ ID NO: 349646 - DNA, 15 bp, Homo sapiens
tttgagttaggaact

SEQ ID NO: 349647 - DNA, 15 bp, Homo sapiens
ttgagttaggaactg

SEQ ID NO: 349648 - DNA, 15 bp, Homo sapiens
tgagttaggaactgt

SEQ ID NO: 349649 - DNA, 15 bp, Homo sapiens
gagttaggaactgtg

SEQ ID NO: 349650 - DNA, 15 bp, Homo sapiens
agttaggaactgtgt

SEQ ID NO: 349651 - DNA, 15 bp, Homo sapiens
gttaggaactgtgtt

SEQ ID NO: 349652 - DNA, 15 bp, Homo sapiens
ttaggaactgtgttg

SEQ ID NO: 349653 - DNA, 15 bp, Homo sapiens
taggaactgtgttgc

SEQ ID NO: 349654 - DNA, 15 bp, Homo sapiens
aggaactgtgttgca

SEQ ID NO: 349655 - DNA, 15 bp, Homo sapiens
ggaactgtgttgcat

SEQ ID NO: 349656 - DNA, 15 bp, Homo sapiens
gaactgtgttgcatt

SEQ ID NO: 349657 - DNA, 15 bp, Homo sapiens
aactgtgttgcattg

SEQ ID NO: 349658 - DNA, 15 bp, Homo sapiens
actgtgttgcattgt

SEQ ID NO: 349659 - DNA, 15 bp, Homo sapiens
ctgtgttgcattgtg

SEQ ID NO: 349660 - DNA, 15 bp, Homo sapiens
tgtgttgcattgtgc

SEQ ID NO: 349661 - DNA, 15 bp, Homo sapiens
gtgttgcattgtgca

SEQ ID NO: 349662 - DNA, 15 bp, Homo sapiens
tgttgcattgtgcat

SEQ ID NO: 349663 - DNA, 15 bp, Homo sapiens
gttgcattgtgcatt

SEQ ID NO: 349664 - DNA, 15 bp, Homo sapiens
ttgcattgtgcatta

SEQ ID NO: 349665 - DNA, 15 bp, Homo sapiens
tgcattgtgcattat

SEQ ID NO: 349666 - DNA, 15 bp, Homo sapiens
gcattgtgcattatt

SEQ ID NO: 349667 - DNA, 15 bp, Homo sapiens
cattgtgcattattt

SEQ ID NO: 349668 - DNA, 15 bp, Homo sapiens
attgtgcattatttt

SEQ ID NO: 349669 - DNA, 15 bp, Homo sapiens
ttgtgcattattttg

SEQ ID NO: 349670 - DNA, 15 bp, Homo sapiens
tgtgcattattttgt

SEQ ID NO: 349671 - DNA, 15 bp, Homo sapiens
gtgcattattttgtg

SEQ ID NO: 349672 - DNA, 15 bp, Homo sapiens
tgcattattttgtga

SEQ ID NO: 349673 - DNA, 15 bp, Homo sapiens
gcattattttgtgaa

SEQ ID NO: 349674 - DNA, 15 bp, Homo sapiens
cattattttgtgaaa

SEQ ID NO: 349675 - DNA, 15 bp, Homo sapiens
attattttgtgaaat

SEQ ID NO: 349676 - DNA, 15 bp, Homo sapiens
ttattttgtgaaatg

SEQ ID NO: 349677 - DNA, 15 bp, Homo sapiens
tattttgtgaaatgc

SEQ ID NO: 349678 - DNA, 15 bp, Homo sapiens
attttgtgaaatgca

SEQ ID NO: 349679 - DNA, 15 bp, Homo sapiens
ttttgtgaaatgcat

SEQ ID NO: 349680 - DNA, 15 bp, Homo sapiens
tttgtgaaatgcatt

SEQ ID NO: 349681 - DNA, 15 bp, Homo sapiens
ttgtgaaatgcattg

SEQ ID NO: 349682 - DNA, 15 bp, Homo sapiens
tgtgaaatgcattga

SEQ ID NO: 349683 - DNA, 15 bp, Homo sapiens
gtgaaatgcattgag

SEQ ID NO: 349684 - DNA, 15 bp, Homo sapiens
tgaaatgcattgagc

SEQ ID NO: 349685 - DNA, 15 bp, Homo sapiens
gaaatgcattgagca

SEQ ID NO: 349686 - DNA, 15 bp, Homo sapiens
aaatgcattgagcat

SEQ ID NO: 349687 - DNA, 15 bp, Homo sapiens
aatgcattgagcatt

SEQ ID NO: 349688 - DNA, 15 bp, Homo sapiens
atgcattgagcattg

SEQ ID NO: 349689 - DNA, 15 bp, Homo sapiens
tgcattgagcattgt

SEQ ID NO: 349690 - DNA, 15 bp, Homo sapiens
gcattgagcattgtg

SEQ ID NO: 349691 - DNA, 15 bp, Homo sapiens
cattgagcattgtgt

SEQ ID NO: 349692 - DNA, 15 bp, Homo sapiens
attgagcattgtgtg

SEQ ID NO: 349693 - DNA, 15 bp, Homo sapiens
ttgagcattgtgtga

SEQ ID NO: 349694 - DNA, 15 bp, Homo sapiens
tgagcattgtgtgaa

SEQ ID NO: 349695 - DNA, 15 bp, Homo sapiens
gagcattgtgtgaaa

SEQ ID NO: 349696 - DNA, 15 bp, Homo sapiens
agcattgtgtgaaat

SEQ ID NO: 349697 - DNA, 15 bp, Homo sapiens
gcattgtgtgaaatg

SEQ ID NO: 349698 - DNA, 15 bp, Homo sapiens
cattgtgtgaaatgc

SEQ ID NO: 349699 - DNA, 15 bp, Homo sapiens
attgtgtgaaatgct

SEQ ID NO: 349700 - DNA, 15 bp, Homo sapiens
ttgtgtgaaatgctc

SEQ ID NO: 349701 - DNA, 15 bp, Homo sapiens
tgtgtgaaatgctcc

SEQ ID NO: 349702 - DNA, 15 bp, Homo sapiens
gtgtgaaatgctcca

SEQ ID NO: 349703 - DNA, 15 bp, Homo sapiens
tgtgaaatgctccac

SEQ ID NO: 349704 - DNA, 15 bp, Homo sapiens
gtgaaatgctccaca

SEQ ID NO: 349705 - DNA, 15 bp, Homo sapiens
tgaaatgctccacat

SEQ ID NO: 349706 - DNA, 15 bp, Homo sapiens
gaaatgctccacatg

SEQ ID NO: 349707 - DNA, 15 bp, Homo sapiens
aaatgctccacatgt

SEQ ID NO: 349708 - DNA, 15 bp, Homo sapiens
aatgctccacatgta

SEQ ID NO: 349709 - DNA, 15 bp, Homo sapiens
atgctccacatgtaa

SEQ ID NO: 349710 - DNA, 15 bp, Homo sapiens
tgctccacatgtaac

SEQ ID NO: 349711 - DNA, 15 bp, Homo sapiens
gctccacatgtaacc

SEQ ID NO: 349712 - DNA, 15 bp, Homo sapiens
ctccacatgtaaccc

SEQ ID NO: 349713 - DNA, 15 bp, Homo sapiens
tccacatgtaaccca

SEQ ID NO: 349714 - DNA, 15 bp, Homo sapiens
ccacatgtaacccag

SEQ ID NO: 349715 - DNA, 15 bp, Homo sapiens
cacatgtaacccagc

SEQ ID NO: 349716 - DNA, 15 bp, Homo sapiens
acatgtaacccagcc

SEQ ID NO: 349717 - DNA, 15 bp, Homo sapiens
catgtaacccagcct

SEQ ID NO: 349718 - DNA, 15 bp, Homo sapiens
atgtaacccagccta

SEQ ID NO: 349719 - DNA, 15 bp, Homo sapiens
tgtaacccagcctaa

SEQ ID NO: 349720 - DNA, 15 bp, Homo sapiens
gtaacccagcctaac

SEQ ID NO: 349721 - DNA, 15 bp, Homo sapiens
taacccagcctaact

SEQ ID NO: 349722 - DNA, 15 bp, Homo sapiens
aacccagcctaactt

SEQ ID NO: 349723 - DNA, 15 bp, Homo sapiens
acccagcctaacttc

SEQ ID NO: 349724 - DNA, 15 bp, Homo sapiens
cccagcctaacttca

SEQ ID NO: 349725 - DNA, 15 bp, Homo sapiens
ccagcctaacttcag

SEQ ID NO: 349726 - DNA, 15 bp, Homo sapiens
cagcctaacttcagc

SEQ ID NO: 349727 - DNA, 15 bp, Homo sapiens
agcctaacttcagca

SEQ ID NO: 349728 - DNA, 15 bp, Homo sapiens
gcctaacttcagcaa

SEQ ID NO: 349729 - DNA, 15 bp, Homo sapiens
cctaacttcagcaat

SEQ ID NO: 349730 - DNA, 15 bp, Homo sapiens
ctaacttcagcaatt

SEQ ID NO: 349731 - DNA, 15 bp, Homo sapiens
taacttcagcaattg

SEQ ID NO: 349732 - DNA, 15 bp, Homo sapiens
aacttcagcaattgt

SEQ ID NO: 349733 - DNA, 15 bp, Homo sapiens
acttcagcaattgta

SEQ ID NO: 349734 - DNA, 15 bp, Homo sapiens
cttcagcaattgtag

SEQ ID NO: 349735 - DNA, 15 bp, Homo sapiens
ttcagcaattgtaga

SEQ ID NO: 349736 - DNA, 15 bp, Homo sapiens
tcagcaattgtagat

SEQ ID NO: 349737 - DNA, 15 bp, Homo sapiens
cagcaattgtagatt

SEQ ID NO: 349738 - DNA, 15 bp, Homo sapiens
agcaattgtagattg

SEQ ID NO: 349739 - DNA, 15 bp, Homo sapiens
gcaattgtagattgt

SEQ ID NO: 349740 - DNA, 15 bp, Homo sapiens
caattgtagattgtg

SEQ ID NO: 349741 - DNA, 15 bp, Homo sapiens
aattgtagattgtgt

SEQ ID NO: 349742 - DNA, 15 bp, Homo sapiens
attgtagattgtgtg

SEQ ID NO: 349743 - DNA, 15 bp, Homo sapiens
ttgtagattgtgtga

SEQ ID NO: 349744 - DNA, 15 bp, Homo sapiens
tgtagattgtgtgat

SEQ ID NO: 349745 - DNA, 15 bp, Homo sapiens
gtagattgtgtgatg

SEQ ID NO: 349746 - DNA, 15 bp, Homo sapiens
tagattgtgtgatga

SEQ ID NO: 349747 - DNA, 15 bp, Homo sapiens
agattgtgtgatgac

SEQ ID NO: 349748 - DNA, 15 bp, Homo sapiens
gattgtgtgatgact

SEQ ID NO: 349749 - DNA, 15 bp, Homo sapiens
attgtgtgatgactg

SEQ ID NO: 349750 - DNA, 15 bp, Homo sapiens
ttgtgtgatgactgg

SEQ ID NO: 349751 - DNA, 15 bp, Homo sapiens
tgtgtgatgactgga

SEQ ID NO: 349752 - DNA, 15 bp, Homo sapiens
gtgtgatgactggaa

SEQ ID NO: 349753 - DNA, 15 bp, Homo sapiens
tgtgatgactggaag

SEQ ID NO: 349754 - DNA, 15 bp, Homo sapiens
gtgatgactggaagt

SEQ ID NO: 349755 - DNA, 15 bp, Homo sapiens
tgatgactggaagtg

SEQ ID NO: 349756 - DNA, 15 bp, Homo sapiens
gatgactggaagtgt

SEQ ID NO: 349757 - DNA, 15 bp, Homo sapiens
atgactggaagtgtc

SEQ ID NO: 349758 - DNA, 15 bp, Homo sapiens
tgactggaagtgtct

SEQ ID NO: 349759 - DNA, 15 bp, Homo sapiens
gactggaagtgtctg

SEQ ID NO: 349760 - DNA, 15 bp, Homo sapiens
actggaagtgtctgt

SEQ ID NO: 349761 - DNA, 15 bp, Homo sapiens
ctggaagtgtctgta

SEQ ID NO: 349762 - DNA, 15 bp, Homo sapiens
tggaagtgtctgtat

SEQ ID NO: 349763 - DNA, 15 bp, Homo sapiens
ggaagtgtctgtatg

SEQ ID NO: 349764 - DNA, 15 bp, Homo sapiens
gaagtgtctgtatgt

SEQ ID NO: 349765 - DNA, 15 bp, Homo sapiens
aagtgtctgtatgtg

SEQ ID NO: 349766 - DNA, 15 bp, Homo sapiens
agtgtctgtatgtgt

SEQ ID NO: 349767 - DNA, 15 bp, Homo sapiens
gtgtctgtatgtgtg

SEQ ID NO: 349768 - DNA, 15 bp, Homo sapiens
tgtctgtatgtgtgc

SEQ ID NO: 349769 - DNA, 15 bp, Homo sapiens
gtctgtatgtgtgca

SEQ ID NO: 349770 - DNA, 15 bp, Homo sapiens
tctgtatgtgtgcat

SEQ ID NO: 349771 - DNA, 15 bp, Homo sapiens
ctgtatgtgtgcatg

SEQ ID NO: 349772 - DNA, 15 bp, Homo sapiens
tgtatgtgtgcatgc

SEQ ID NO: 349773 - DNA, 15 bp, Homo sapiens
gtatgtgtgcatgct

SEQ ID NO: 349774 - DNA, 15 bp, Homo sapiens
tatgtgtgcatgcta

SEQ ID NO: 349775 - DNA, 15 bp, Homo sapiens
atgtgtgcatgctag

SEQ ID NO: 349776 - DNA, 15 bp, Homo sapiens
tgtgtgcatgctagg

SEQ ID NO: 349777 - DNA, 15 bp, Homo sapiens
gtgtgcatgctaggc

SEQ ID NO: 349778 - DNA, 15 bp, Homo sapiens
tgtgcatgctaggca

SEQ ID NO: 349779 - DNA, 15 bp, Homo sapiens
gtgcatgctaggcaa

SEQ ID NO: 349780 - DNA, 15 bp, Homo sapiens
tgcatgctaggcaaa

SEQ ID NO: 349781 - DNA, 15 bp, Homo sapiens
gcatgctaggcaaat

SEQ ID NO: 349782 - DNA, 15 bp, Homo sapiens
catgctaggcaaatg

SEQ ID NO: 349783 - DNA, 15 bp, Homo sapiens
atgctaggcaaatgt

SEQ ID NO: 349784 - DNA, 15 bp, Homo sapiens
tgctaggcaaatgtg

SEQ ID NO: 349785 - DNA, 15 bp, Homo sapiens
gctaggcaaatgtgt

SEQ ID NO: 349786 - DNA, 15 bp, Homo sapiens
ctaggcaaatgtgtc

SEQ ID NO: 349787 - DNA, 15 bp, Homo sapiens
taggcaaatgtgtcg

SEQ ID NO: 349788 - DNA, 15 bp, Homo sapiens
aggcaaatgtgtcgt

SEQ ID NO: 349789 - DNA, 15 bp, Homo sapiens
ggcaaatgtgtcgta

SEQ ID NO: 349790 - DNA, 15 bp, Homo sapiens
gcaaatgtgtcgtat

SEQ ID NO: 349791 - DNA, 15 bp, Homo sapiens
caaatgtgtcgtatt

SEQ ID NO: 349792 - DNA, 15 bp, Homo sapiens
aaatgtgtcgtattg

SEQ ID NO: 349793 - DNA, 15 bp, Homo sapiens
aatgtgtcgtattgc

SEQ ID NO: 349794 - DNA, 15 bp, Homo sapiens
atgtgtcgtattgcc

SEQ ID NO: 349795 - DNA, 15 bp, Homo sapiens
tgtgtcgtattgcct

SEQ ID NO: 349796 - DNA, 15 bp, Homo sapiens
gtgtcgtattgcctt

SEQ ID NO: 349797 - DNA, 15 bp, Homo sapiens
tgtcgtattgccttt

SEQ ID NO: 349798 - DNA, 15 bp, Homo sapiens
gtcgtattgcctttc

SEQ ID NO: 349799 - DNA, 15 bp, Homo sapiens
tcgtattgcctttct

SEQ ID NO: 349800 - DNA, 15 bp, Homo sapiens
cgtattgcctttctt

SEQ ID NO: 349801 - DNA, 15 bp, Homo sapiens
gtattgcctttcttc

SEQ ID NO: 349802 - DNA, 15 bp, Homo sapiens
tattgcctttcttct

SEQ ID NO: 349803 - DNA, 15 bp, Homo sapiens
attgcctttcttctg

SEQ ID NO: 349804 - DNA, 15 bp, Homo sapiens
ttgcctttcttctga

SEQ ID NO: 349805 - DNA, 15 bp, Homo sapiens
tgcctttcttctgaa

SEQ ID NO: 349806 - DNA, 15 bp, Homo sapiens
gcctttcttctgaaa

SEQ ID NO: 349807 - DNA, 15 bp, Homo sapiens
cctttcttctgaaag

SEQ ID NO: 349808 - DNA, 15 bp, Homo sapiens
ctttcttctgaaagt

SEQ ID NO: 349809 - DNA, 15 bp, Homo sapiens
tttcttctgaaagtg

SEQ ID NO: 349810 - DNA, 15 bp, Homo sapiens
ttcttctgaaagtgc

SEQ ID NO: 349811 - DNA, 15 bp, Homo sapiens
tcttctgaaagtgca

SEQ ID NO: 349812 - DNA, 15 bp, Homo sapiens
cttctgaaagtgcat

SEQ ID NO: 349813 - DNA, 15 bp, Homo sapiens
ttctgaaagtgcatc

SEQ ID NO: 349814 - DNA, 15 bp, Homo sapiens
tctgaaagtgcatct

SEQ ID NO: 349815 - DNA, 15 bp, Homo sapiens
ctgaaagtgcatctg

SEQ ID NO: 349816 - DNA, 15 bp, Homo sapiens
tgaaagtgcatctgg

SEQ ID NO: 349817 - DNA, 15 bp, Homo sapiens
gaaagtgcatctgga

SEQ ID NO: 349818 - DNA, 15 bp, Homo sapiens
aaagtgcatctggac

SEQ ID NO: 349819 - DNA, 15 bp, Homo sapiens
aagtgcatctggaca

SEQ ID NO: 349820 - DNA, 15 bp, Homo sapiens
agtgcatctggacag

SEQ ID NO: 349821 - DNA, 15 bp, Homo sapiens
gtgcatctggacagc

SEQ ID NO: 349822 - DNA, 15 bp, Homo sapiens
tgcatctggacagca

SEQ ID NO: 349823 - DNA, 15 bp, Homo sapiens
gcatctggacagcat

SEQ ID NO: 349824 - DNA, 15 bp, Homo sapiens
catctggacagcatg

SEQ ID NO: 349825 - DNA, 15 bp, Homo sapiens
atctggacagcatgt

SEQ ID NO: 349826 - DNA, 15 bp, Homo sapiens
tctggacagcatgtc

SEQ ID NO: 349827 - DNA, 15 bp, Homo sapiens
ctggacagcatgtct

SEQ ID NO: 349828 - DNA, 15 bp, Homo sapiens
tggacagcatgtctt

SEQ ID NO: 349829 - DNA, 15 bp, Homo sapiens
ggacagcatgtcttt

SEQ ID NO: 349830 - DNA, 15 bp, Homo sapiens
gacagcatgtctttg

SEQ ID NO: 349831 - DNA, 15 bp, Homo sapiens
acagcatgtctttgt

SEQ ID NO: 349832 - DNA, 15 bp, Homo sapiens
cagcatgtctttgtt

SEQ ID NO: 349833 - DNA, 15 bp, Homo sapiens
agcatgtctttgttc

SEQ ID NO: 349834 - DNA, 15 bp, Homo sapiens
gcatgtctttgttcc

SEQ ID NO: 349835 - DNA, 15 bp, Homo sapiens
catgtctttgttcct

SEQ ID NO: 349836 - DNA, 15 bp, Homo sapiens
atgtctttgttcctt

SEQ ID NO: 349837 - DNA, 15 bp, Homo sapiens
tgtctttgttccttg

SEQ ID NO: 349838 - DNA, 15 bp, Homo sapiens
gtctttgttccttga

SEQ ID NO: 349839 - DNA, 15 bp, Homo sapiens
tctttgttccttgaa

SEQ ID NO: 349840 - DNA, 15 bp, Homo sapiens
ctttgttccttgaat

SEQ ID NO: 349841 - DNA, 15 bp, Homo sapiens
tttgttccttgaatt

SEQ ID NO: 349842 - DNA, 15 bp, Homo sapiens
ttgttccttgaattc

SEQ ID NO: 349843 - DNA, 15 bp, Homo sapiens
tgttccttgaattca

SEQ ID NO: 349844 - DNA, 15 bp, Homo sapiens
gttccttgaattcag

SEQ ID NO: 349845 - DNA, 15 bp, Homo sapiens
ttccttgaattcagt

SEQ ID NO: 349846 - DNA, 15 bp, Homo sapiens
tccttgaattcagtt

SEQ ID NO: 349847 - DNA, 15 bp, Homo sapiens
ccttgaattcagtta

SEQ ID NO: 349848 - DNA, 15 bp, Homo sapiens
cttgaattcagttat

SEQ ID NO: 349849 - DNA, 15 bp, Homo sapiens
ttgaattcagttatg

SEQ ID NO: 349850 - DNA, 15 bp, Homo sapiens
tgaattcagttatgt

SEQ ID NO: 349851 - DNA, 15 bp, Homo sapiens
gaattcagttatgtg

SEQ ID NO: 349852 - DNA, 15 bp, Homo sapiens
aattcagttatgtga

SEQ ID NO: 349853 - DNA, 15 bp, Homo sapiens
attcagttatgtgaa

SEQ ID NO: 349854 - DNA, 15 bp, Homo sapiens
ttcagttatgtgaaa

SEQ ID NO: 349855 - DNA, 15 bp, Homo sapiens
tcagttatgtgaaat

SEQ ID NO: 349856 - DNA, 15 bp, Homo sapiens
cagttatgtgaaata

SEQ ID NO: 349857 - DNA, 15 bp, Homo sapiens
agttatgtgaaatat

SEQ ID NO: 349858 - DNA, 15 bp, Homo sapiens
gttatgtgaaatatg

SEQ ID NO: 349859 - DNA, 15 bp, Homo sapiens
ttatgtgaaatatgt

SEQ ID NO: 349860 - DNA, 15 bp, Homo sapiens
tatgtgaaatatgtc

SEQ ID NO: 349861 - DNA, 15 bp, Homo sapiens
atgtgaaatatgtct

SEQ ID NO: 349862 - DNA, 15 bp, Homo sapiens
tgtgaaatatgtctt

SEQ ID NO: 349863 - DNA, 15 bp, Homo sapiens
gtgaaatatgtcttt

SEQ ID NO: 349864 - DNA, 15 bp, Homo sapiens
tgaaatatgtctttg

SEQ ID NO: 349865 - DNA, 15 bp, Homo sapiens
gaaatatgtctttga

SEQ ID NO: 349866 - DNA, 15 bp, Homo sapiens
aaatatgtctttgag

SEQ ID NO: 349867 - DNA, 15 bp, Homo sapiens
aatatgtctttgagg

SEQ ID NO: 349868 - DNA, 15 bp, Homo sapiens
atatgtctttgaggg

SEQ ID NO: 349869 - DNA, 15 bp, Homo sapiens
tatgtctttgagggt

SEQ ID NO: 349870 - DNA, 15 bp, Homo sapiens
atgtctttgagggta

SEQ ID NO: 349871 - DNA, 15 bp, Homo sapiens
tgtctttgagggtac

SEQ ID NO: 349872 - DNA, 15 bp, Homo sapiens
gtctttgagggtacc

SEQ ID NO: 349873 - DNA, 15 bp, Homo sapiens
tctttgagggtacct

SEQ ID NO: 349874 - DNA, 15 bp, Homo sapiens
ctttgagggtacctc

SEQ ID NO: 349875 - DNA, 15 bp, Homo sapiens
tttgagggtacctct

SEQ ID NO: 349876 - DNA, 15 bp, Homo sapiens
ttgagggtacctctt

SEQ ID NO: 349877 - DNA, 15 bp, Homo sapiens
tgagggtacctcttt

SEQ ID NO: 349878 - DNA, 15 bp, Homo sapiens
gagggtacctctttc

SEQ ID NO: 349879 - DNA, 15 bp, Homo sapiens
agggtacctctttct

SEQ ID NO: 349880 - DNA, 15 bp, Homo sapiens
gggtacctctttctc

SEQ ID NO: 349881 - DNA, 15 bp, Homo sapiens
ggtacctctttctcc

SEQ ID NO: 349882 - DNA, 15 bp, Homo sapiens
gtacctctttctcca

SEQ ID NO: 349883 - DNA, 15 bp, Homo sapiens
tacctctttctccac

SEQ ID NO: 349884 - DNA, 15 bp, Homo sapiens
acctctttctccact

SEQ ID NO: 349885 - DNA, 15 bp, Homo sapiens
cctctttctccactt

SEQ ID NO: 349886 - DNA, 15 bp, Homo sapiens
ctctttctccactta

SEQ ID NO: 349887 - DNA, 15 bp, Homo sapiens
tctttctccacttat

SEQ ID NO: 349888 - DNA, 15 bp, Homo sapiens
ctttctccacttatt

SEQ ID NO: 349889 - DNA, 15 bp, Homo sapiens
tttctccacttattg

SEQ ID NO: 349890 - DNA, 15 bp, Homo sapiens
ttctccacttattgg

SEQ ID NO: 349891 - DNA, 15 bp, Homo sapiens
tctccacttattggt

SEQ ID NO: 349892 - DNA, 15 bp, Homo sapiens
ctccacttattggta

SEQ ID NO: 349893 - DNA, 15 bp, Homo sapiens
tccacttattggtac

SEQ ID NO: 349894 - DNA, 15 bp, Homo sapiens
ccacttattggtaca

SEQ ID NO: 349895 - DNA, 15 bp, Homo sapiens
cacttattggtacaa

SEQ ID NO: 349896 - DNA, 15 bp, Homo sapiens
acttattggtacaag

SEQ ID NO: 349897 - DNA, 15 bp, Homo sapiens
cttattggtacaagc

SEQ ID NO: 349898 - DNA, 15 bp, Homo sapiens
ttattggtacaagct

SEQ ID NO: 349899 - DNA, 15 bp, Homo sapiens
tattggtacaagctg

SEQ ID NO: 349900 - DNA, 15 bp, Homo sapiens
attggtacaagctgt

SEQ ID NO: 349901 - DNA, 15 bp, Homo sapiens
ttggtacaagctgtg

SEQ ID NO: 349902 - DNA, 15 bp, Homo sapiens
tggtacaagctgtgc

SEQ ID NO: 349903 - DNA, 15 bp, Homo sapiens
ggtacaagctgtgct

SEQ ID NO: 349904 - DNA, 15 bp, Homo sapiens
gtacaagctgtgctt

SEQ ID NO: 349905 - DNA, 15 bp, Homo sapiens
tacaagctgtgcttt

SEQ ID NO: 349906 - DNA, 15 bp, Homo sapiens
acaagctgtgctttc

SEQ ID NO: 349907 - DNA, 15 bp, Homo sapiens
caagctgtgctttca

SEQ ID NO: 349908 - DNA, 15 bp, Homo sapiens
aagctgtgctttcac

SEQ ID NO: 349909 - DNA, 15 bp, Homo sapiens
agctgtgctttcact

SEQ ID NO: 349910 - DNA, 15 bp, Homo sapiens
gctgtgctttcactt

SEQ ID NO: 349911 - DNA, 15 bp, Homo sapiens
ctgtgctttcacttt

SEQ ID NO: 349912 - DNA, 15 bp, Homo sapiens
tgtgctttcactttt

SEQ ID NO: 349913 - DNA, 15 bp, Homo sapiens
gtgctttcacttttg

SEQ ID NO: 349914 - DNA, 15 bp, Homo sapiens
tgctttcacttttga

SEQ ID NO: 349915 - DNA, 15 bp, Homo sapiens
gctttcacttttgac

SEQ ID NO: 349916 - DNA, 15 bp, Homo sapiens
ctttcacttttgaca

SEQ ID NO: 349917 - DNA, 15 bp, Homo sapiens
tttcacttttgacaa

SEQ ID NO: 349918 - DNA, 15 bp, Homo sapiens
ttcacttttgacaag

SEQ ID NO: 349919 - DNA, 15 bp, Homo sapiens
tcacttttgacaagg

SEQ ID NO: 349920 - DNA, 15 bp, Homo sapiens
cacttttgacaagga

SEQ ID NO: 349921 - DNA, 15 bp, Homo sapiens
acttttgacaaggat

SEQ ID NO: 349922 - DNA, 15 bp, Homo sapiens
cttttgacaaggatc

SEQ ID NO: 349923 - DNA, 15 bp, Homo sapiens
ttttgacaaggatca

SEQ ID NO: 349924 - DNA, 15 bp, Homo sapiens
tttgacaaggatcag

SEQ ID NO: 349925 - DNA, 15 bp, Homo sapiens
ttgacaaggatcagt

SEQ ID NO: 349926 - DNA, 15 bp, Homo sapiens
tgacaaggatcagta

SEQ ID NO: 349927 - DNA, 15 bp, Homo sapiens
gacaaggatcagtag

SEQ ID NO: 349928 - DNA, 15 bp, Homo sapiens
acaaggatcagtagg

SEQ ID NO: 349929 - DNA, 15 bp, Homo sapiens
caaggatcagtaggc

SEQ ID NO: 349930 - DNA, 15 bp, Homo sapiens
aaggatcagtaggca

SEQ ID NO: 349931 - DNA, 15 bp, Homo sapiens
aggatcagtaggcag

SEQ ID NO: 349932 - DNA, 15 bp, Homo sapiens
ggatcagtaggcagt

SEQ ID NO: 349933 - DNA, 15 bp, Homo sapiens
gatcagtaggcagtt

SEQ ID NO: 349934 - DNA, 15 bp, Homo sapiens
atcagtaggcagttt

SEQ ID NO: 349935 - DNA, 15 bp, Homo sapiens
tcagtaggcagttta

SEQ ID NO: 349936 - DNA, 15 bp, Homo sapiens
cagtaggcagtttaa

SEQ ID NO: 349937 - DNA, 15 bp, Homo sapiens
agtaggcagtttaac

SEQ ID NO: 349938 - DNA, 15 bp, Homo sapiens
gtaggcagtttaact

SEQ ID NO: 349939 - DNA, 15 bp, Homo sapiens
taggcagtttaactt

SEQ ID NO: 349940 - DNA, 15 bp, Homo sapiens
aggcagtttaacttt

SEQ ID NO: 349941 - DNA, 15 bp, Homo sapiens
ggcagtttaactttt

SEQ ID NO: 349942 - DNA, 15 bp, Homo sapiens
gcagtttaacttttg

SEQ ID NO: 349943 - DNA, 15 bp, Homo sapiens
cagtttaacttttgc

SEQ ID NO: 349944 - DNA, 15 bp, Homo sapiens
agtttaacttttgct

SEQ ID NO: 349945 - DNA, 15 bp, Homo sapiens
gtttaacttttgctg

SEQ ID NO: 349946 - DNA, 15 bp, Homo sapiens
tttaacttttgctgc

SEQ ID NO: 349947 - DNA, 15 bp, Homo sapiens
ttaacttttgctgct

SEQ ID NO: 349948 - DNA, 15 bp, Homo sapiens
taacttttgctgcta

SEQ ID NO: 349949 - DNA, 15 bp, Homo sapiens
aacttttgctgctag

SEQ ID NO: 349950 - DNA, 15 bp, Homo sapiens
acttttgctgctagt

SEQ ID NO: 349951 - DNA, 15 bp, Homo sapiens
cttttgctgctagtt

SEQ ID NO: 349952 - DNA, 15 bp, Homo sapiens
ttttgctgctagttg

SEQ ID NO: 349953 - DNA, 15 bp, Homo sapiens
tttgctgctagttgg

SEQ ID NO: 349954 - DNA, 15 bp, Homo sapiens
ttgctgctagttggt

SEQ ID NO: 349955 - DNA, 15 bp, Homo sapiens
tgctgctagttggtt

SEQ ID NO: 349956 - DNA, 15 bp, Homo sapiens
gctgctagttggttt

SEQ ID NO: 349957 - DNA, 15 bp, Homo sapiens
ctgctagttggtttc

SEQ ID NO: 349958 - DNA, 15 bp, Homo sapiens
tgctagttggtttca

SEQ ID NO: 349959 - DNA, 15 bp, Homo sapiens
gctagttggtttcac

SEQ ID NO: 349960 - DNA, 15 bp, Homo sapiens
ctagttggtttcacc

SEQ ID NO: 349961 - DNA, 15 bp, Homo sapiens
tagttggtttcacct

SEQ ID NO: 349962 - DNA, 15 bp, Homo sapiens
agttggtttcacctc

SEQ ID NO: 349963 - DNA, 15 bp, Homo sapiens
gttggtttcacctct

SEQ ID NO: 349964 - DNA, 15 bp, Homo sapiens
ttggtttcacctctt

SEQ ID NO: 349965 - DNA, 15 bp, Homo sapiens
tggtttcacctcttt

SEQ ID NO: 349966 - DNA, 15 bp, Homo sapiens
ggtttcacctctttg

SEQ ID NO: 349967 - DNA, 15 bp, Homo sapiens
gtttcacctctttgt

SEQ ID NO: 349968 - DNA, 15 bp, Homo sapiens
tttcacctctttgtg

SEQ ID NO: 349969 - DNA, 15 bp, Homo sapiens
ttcacctctttgtgc

SEQ ID NO: 349970 - DNA, 15 bp, Homo sapiens
tcacctctttgtgct

SEQ ID NO: 349971 - DNA, 15 bp, Homo sapiens
cacctctttgtgctt

SEQ ID NO: 349972 - DNA, 15 bp, Homo sapiens
acctctttgtgcttc

SEQ ID NO: 349973 - DNA, 15 bp, Homo sapiens
cctctttgtgcttca

SEQ ID NO: 349974 - DNA, 15 bp, Homo sapiens
ctctttgtgcttcaa

SEQ ID NO: 349975 - DNA, 15 bp, Homo sapiens
tctttgtgcttcaag

SEQ ID NO: 349976 - DNA, 15 bp, Homo sapiens
ctttgtgcttcaaga

SEQ ID NO: 349977 - DNA, 15 bp, Homo sapiens
tttgtgcttcaagag

SEQ ID NO: 349978 - DNA, 15 bp, Homo sapiens
ttgtgcttcaagaga

SEQ ID NO: 349979 - DNA, 15 bp, Homo sapiens
tgtgcttcaagagaa

SEQ ID NO: 349980 - DNA, 15 bp, Homo sapiens
gtgcttcaagagaac

SEQ ID NO: 349981 - DNA, 15 bp, Homo sapiens
tgcttcaagagaact

SEQ ID NO: 349982 - DNA, 15 bp, Homo sapiens
gcttcaagagaactc

SEQ ID NO: 349983 - DNA, 15 bp, Homo sapiens
cttcaagagaactca

SEQ ID NO: 349984 - DNA, 15 bp, Homo sapiens
ttcaagagaactcac

SEQ ID NO: 349985 - DNA, 15 bp, Homo sapiens
tcaagagaactcact

SEQ ID NO: 349986 - DNA, 15 bp, Homo sapiens
caagagaactcactt

SEQ ID NO: 349987 - DNA, 15 bp, Homo sapiens
aagagaactcacttc

SEQ ID NO: 349988 - DNA, 15 bp, Homo sapiens
agagaactcacttcc

SEQ ID NO: 349989 - DNA, 15 bp, Homo sapiens
gagaactcacttcct

SEQ ID NO: 349990 - DNA, 15 bp, Homo sapiens
agaactcacttcctt

SEQ ID NO: 349991 - DNA, 15 bp, Homo sapiens
gaactcacttccttt

SEQ ID NO: 349992 - DNA, 15 bp, Homo sapiens
aactcacttcctttc

SEQ ID NO: 349993 - DNA, 15 bp, Homo sapiens
actcacttcctttcc

SEQ ID NO: 349994 - DNA, 15 bp, Homo sapiens
ctcacttcctttcca

SEQ ID NO: 349995 - DNA, 15 bp, Homo sapiens
tcacttcctttccac

SEQ ID NO: 349996 - DNA, 15 bp, Homo sapiens
cacttcctttccacg

SEQ ID NO: 349997 - DNA, 15 bp, Homo sapiens
acttcctttccacgc

SEQ ID NO: 349998 - DNA, 15 bp, Homo sapiens
cttcctttccacgca

SEQ ID NO: 349999 - DNA, 15 bp, Homo sapiens
ttcctttccacgcaa

SEQ ID NO: 350000 - DNA, 15 bp, Homo sapiens
tcctttccacgcaag

SEQ ID NO: 350001 - DNA, 15 bp, Homo sapiens
cctttccacgcaagt

SEQ ID NO: 350002 - DNA, 15 bp, Homo sapiens
ctttccacgcaagtg

SEQ ID NO: 350003 - DNA, 15 bp, Homo sapiens
tttccacgcaagtgt

SEQ ID NO: 350004 - DNA, 15 bp, Homo sapiens
ttccacgcaagtgtt

SEQ ID NO: 350005 - DNA, 15 bp, Homo sapiens
tccacgcaagtgtta

SEQ ID NO: 350006 - DNA, 15 bp, Homo sapiens
ccacgcaagtgttac

SEQ ID NO: 350007 - DNA, 15 bp, Homo sapiens
cacgcaagtgttact

SEQ ID NO: 350008 - DNA, 15 bp, Homo sapiens
acgcaagtgttactt

SEQ ID NO: 350009 - DNA, 15 bp, Homo sapiens
cgcaagtgttacttc

SEQ ID NO: 350010 - DNA, 15 bp, Homo sapiens
gcaagtgttacttct

SEQ ID NO: 350011 - DNA, 15 bp, Homo sapiens
caagtgttacttctg

SEQ ID NO: 350012 - DNA, 15 bp, Homo sapiens
aagtgttacttctgt

SEQ ID NO: 350013 - DNA, 15 bp, Homo sapiens
agtgttacttctgtg

SEQ ID NO: 350014 - DNA, 15 bp, Homo sapiens
gtgttacttctgtga

SEQ ID NO: 350015 - DNA, 15 bp, Homo sapiens
tgttacttctgtgat

SEQ ID NO: 350016 - DNA, 15 bp, Homo sapiens
gttacttctgtgata

SEQ ID NO: 350017 - DNA, 15 bp, Homo sapiens
ttacttctgtgatat

SEQ ID NO: 350018 - DNA, 15 bp, Homo sapiens
tacttctgtgatatt

SEQ ID NO: 350019 - DNA, 15 bp, Homo sapiens
acttctgtgatattt

SEQ ID NO: 350020 - DNA, 15 bp, Homo sapiens
cttctgtgatatttt

SEQ ID NO: 350021 - DNA, 15 bp, Homo sapiens
ttctgtgatattttt

SEQ ID NO: 350022 - DNA, 15 bp, Homo sapiens
tctgtgatattttta

SEQ ID NO: 350023 - DNA, 15 bp, Homo sapiens
ctgtgatatttttac

SEQ ID NO: 350024 - DNA, 15 bp, Homo sapiens
tgtgatatttttaca

SEQ ID NO: 350025 - DNA, 15 bp, Homo sapiens
gtgatatttttacat

SEQ ID NO: 350026 - DNA, 15 bp, Homo sapiens
tgatatttttacatt

SEQ ID NO: 350027 - DNA, 15 bp, Homo sapiens
gatatttttacatta

SEQ ID NO: 350028 - DNA, 15 bp, Homo sapiens
atatttttacattag

SEQ ID NO: 350029 - DNA, 15 bp, Homo sapiens
tatttttacattagt

SEQ ID NO: 350030 - DNA, 15 bp, Homo sapiens
atttttacattagtg

SEQ ID NO: 350031 - DNA, 15 bp, Homo sapiens
tttttacattagtga

SEQ ID NO: 350032 - DNA, 15 bp, Homo sapiens
ttttacattagtgac

SEQ ID NO: 350033 - DNA, 15 bp, Homo sapiens
tttacattagtgact

SEQ ID NO: 350034 - DNA, 15 bp, Homo sapiens
ttacattagtgactg

SEQ ID NO: 350035 - DNA, 15 bp, Homo sapiens
tacattagtgactga

SEQ ID NO: 350036 - DNA, 15 bp, Homo sapiens
acattagtgactgag

SEQ ID NO: 350037 - DNA, 15 bp, Homo sapiens
cattagtgactgagg

SEQ ID NO: 350038 - DNA, 15 bp, Homo sapiens
attagtgactgaggt

SEQ ID NO: 350039 - DNA, 15 bp, Homo sapiens
ttagtgactgaggta

SEQ ID NO: 350040 - DNA, 15 bp, Homo sapiens
tagtgactgaggtag

SEQ ID NO: 350041 - DNA, 15 bp, Homo sapiens
agtgactgaggtaga

SEQ ID NO: 350042 - DNA, 15 bp, Homo sapiens
gtgactgaggtagac

SEQ ID NO: 350043 - DNA, 15 bp, Homo sapiens
tgactgaggtagaca

SEQ ID NO: 350044 - DNA, 15 bp, Homo sapiens
gactgaggtagacac

SEQ ID NO: 350045 - DNA, 15 bp, Homo sapiens
actgaggtagacact

SEQ ID NO: 350046 - DNA, 15 bp, Homo sapiens
ctgaggtagacactg

SEQ ID NO: 350047 - DNA, 15 bp, Homo sapiens
tgaggtagacactgt

SEQ ID NO: 350048 - DNA, 15 bp, Homo sapiens
gaggtagacactgtt

SEQ ID NO: 350049 - DNA, 15 bp, Homo sapiens
aggtagacactgttc

SEQ ID NO: 350050 - DNA, 15 bp, Homo sapiens
ggtagacactgttcc

SEQ ID NO: 350051 - DNA, 15 bp, Homo sapiens
gtagacactgttcca

SEQ ID NO: 350052 - DNA, 15 bp, Homo sapiens
tagacactgttccag

SEQ ID NO: 350053 - DNA, 15 bp, Homo sapiens
agacactgttccagc

SEQ ID NO: 350054 - DNA, 15 bp, Homo sapiens
gacactgttccagct

SEQ ID NO: 350055 - DNA, 15 bp, Homo sapiens
acactgttccagctg

SEQ ID NO: 350056 - DNA, 15 bp, Homo sapiens
cactgttccagctgg

SEQ ID NO: 350057 - DNA, 15 bp, Homo sapiens
actgttccagctggc

SEQ ID NO: 350058 - DNA, 15 bp, Homo sapiens
ctgttccagctggct

SEQ ID NO: 350059 - DNA, 15 bp, Homo sapiens
tgttccagctggctg

SEQ ID NO: 350060 - DNA, 15 bp, Homo sapiens
gttccagctggctgt

SEQ ID NO: 350061 - DNA, 15 bp, Homo sapiens
ttccagctggctgtt

SEQ ID NO: 350062 - DNA, 15 bp, Homo sapiens
tccagctggctgttc

SEQ ID NO: 350063 - DNA, 15 bp, Homo sapiens
ccagctggctgttca

SEQ ID NO: 350064 - DNA, 15 bp, Homo sapiens
cagctggctgttcag

SEQ ID NO: 350065 - DNA, 15 bp, Homo sapiens
agctggctgttcagt

SEQ ID NO: 350066 - DNA, 15 bp, Homo sapiens
gctggctgttcagtc

SEQ ID NO: 350067 - DNA, 15 bp, Homo sapiens
ctggctgttcagtca

SEQ ID NO: 350068 - DNA, 15 bp, Homo sapiens
tggctgttcagtcat

SEQ ID NO: 350069 - DNA, 15 bp, Homo sapiens
ggctgttcagtcatt

SEQ ID NO: 350070 - DNA, 15 bp, Homo sapiens
gctgttcagtcatta

SEQ ID NO: 350071 - DNA, 15 bp, Homo sapiens
ctgttcagtcattat

SEQ ID NO: 350072 - DNA, 15 bp, Homo sapiens
tgttcagtcattatt

SEQ ID NO: 350073 - DNA, 15 bp, Homo sapiens
gttcagtcattattt

SEQ ID NO: 350074 - DNA, 15 bp, Homo sapiens
ttcagtcattatttc

SEQ ID NO: 350075 - DNA, 15 bp, Homo sapiens
tcagtcattatttct

SEQ ID NO: 350076 - DNA, 15 bp, Homo sapiens
cagtcattatttctc

SEQ ID NO: 350077 - DNA, 15 bp, Homo sapiens
agtcattatttctca

SEQ ID NO: 350078 - DNA, 15 bp, Homo sapiens
gtcattatttctcag

SEQ ID NO: 350079 - DNA, 15 bp, Homo sapiens
tcattatttctcagg

SEQ ID NO: 350080 - DNA, 15 bp, Homo sapiens
cattatttctcaggg

SEQ ID NO: 350081 - DNA, 15 bp, Homo sapiens
attatttctcagggt

SEQ ID NO: 350082 - DNA, 15 bp, Homo sapiens
ttatttctcagggta

SEQ ID NO: 350083 - DNA, 15 bp, Homo sapiens
tatttctcagggtac

SEQ ID NO: 350084 - DNA, 15 bp, Homo sapiens
atttctcagggtacc

SEQ ID NO: 350085 - DNA, 15 bp, Homo sapiens
tttctcagggtacct

SEQ ID NO: 350086 - DNA, 15 bp, Homo sapiens
ttctcagggtacctg

SEQ ID NO: 350087 - DNA, 15 bp, Homo sapiens
tctcagggtacctgg

SEQ ID NO: 350088 - DNA, 15 bp, Homo sapiens
ctcagggtacctggg

SEQ ID NO: 350089 - DNA, 15 bp, Homo sapiens
tcagggtacctgggc

SEQ ID NO: 350090 - DNA, 15 bp, Homo sapiens
cagggtacctgggca

SEQ ID NO: 350091 - DNA, 15 bp, Homo sapiens
agggtacctgggcag

SEQ ID NO: 350092 - DNA, 15 bp, Homo sapiens
gggtacctgggcagc

SEQ ID NO: 350093 - DNA, 15 bp, Homo sapiens
ggtacctgggcagca

SEQ ID NO: 350094 - DNA, 15 bp, Homo sapiens
gtacctgggcagcat

SEQ ID NO: 350095 - DNA, 15 bp, Homo sapiens
tacctgggcagcatg

SEQ ID NO: 350096 - DNA, 15 bp, Homo sapiens
acctgggcagcatgg

SEQ ID NO: 350097 - DNA, 15 bp, Homo sapiens
cctgggcagcatggt

SEQ ID NO: 350098 - DNA, 15 bp, Homo sapiens
ctgggcagcatggtg

SEQ ID NO: 350099 - DNA, 15 bp, Homo sapiens
tgggcagcatggtgg

SEQ ID NO: 350100 - DNA, 15 bp, Homo sapiens
gggcagcatggtggc

SEQ ID NO: 350101 - DNA, 15 bp, Homo sapiens
ggcagcatggtggca

SEQ ID NO: 350102 - DNA, 15 bp, Homo sapiens
gcagcatggtggcag

SEQ ID NO: 350103 - DNA, 15 bp, Homo sapiens
cagcatggtggcagt

SEQ ID NO: 350104 - DNA, 15 bp, Homo sapiens
agcatggtggcagta

SEQ ID NO: 350105 - DNA, 15 bp, Homo sapiens
gcatggtggcagtat

SEQ ID NO: 350106 - DNA, 15 bp, Homo sapiens
catggtggcagtatt

SEQ ID NO: 350107 - DNA, 15 bp, Homo sapiens
atggtggcagtattt

SEQ ID NO: 350108 - DNA, 15 bp, Homo sapiens
tggtggcagtatttc

SEQ ID NO: 350109 - DNA, 15 bp, Homo sapiens
ggtggcagtatttcc

SEQ ID NO: 350110 - DNA, 15 bp, Homo sapiens
gtggcagtatttcca

SEQ ID NO: 350111 - DNA, 15 bp, Homo sapiens
tggcagtatttccat

SEQ ID NO: 350112 - DNA, 15 bp, Homo sapiens
ggcagtatttccata

SEQ ID NO: 350113 - DNA, 15 bp, Homo sapiens
gcagtatttccatat

SEQ ID NO: 350114 - DNA, 15 bp, Homo sapiens
cagtatttccatata

SEQ ID NO: 350115 - DNA, 15 bp, Homo sapiens
agtatttccatataa

SEQ ID NO: 350116 - DNA, 15 bp, Homo sapiens
gtatttccatataat

SEQ ID NO: 350117 - DNA, 15 bp, Homo sapiens
tatttccatataatc

SEQ ID NO: 350118 - DNA, 15 bp, Homo sapiens
atttccatataatct

SEQ ID NO: 350119 - DNA, 15 bp, Homo sapiens
tttccatataatctc

SEQ ID NO: 350120 - DNA, 15 bp, Homo sapiens
catataatctcctcc

SEQ ID NO: 350121 - DNA, 15 bp, Homo sapiens
atataatctcctcca

SEQ ID NO: 350122 - DNA, 15 bp, Homo sapiens
tataatctcctccac

SEQ ID NO: 350123 - DNA, 15 bp, Homo sapiens
ataatctcctccact

SEQ ID NO: 350124 - DNA, 15 bp, Homo sapiens
taatctcctccactc

SEQ ID NO: 350125 - DNA, 15 bp, Homo sapiens
aatctcctccactct

SEQ ID NO: 350126 - DNA, 15 bp, Homo sapiens
atctcctccactctg

SEQ ID NO: 350127 - DNA, 15 bp, Homo sapiens
tctcctccactctgg

SEQ ID NO: 350128 - DNA, 15 bp, Homo sapiens
ctcctccactctgga

SEQ ID NO: 350129 - DNA, 15 bp, Homo sapiens
tcctccactctggac

SEQ ID NO: 350130 - DNA, 15 bp, Homo sapiens
cctccactctggacc

SEQ ID NO: 350131 - DNA, 15 bp, Homo sapiens
ctccactctggacct

SEQ ID NO: 350132 - DNA, 15 bp, Homo sapiens
tccactctggacctg

SEQ ID NO: 350133 - DNA, 15 bp, Homo sapiens
ccactctggacctgg

SEQ ID NO: 350134 - DNA, 15 bp, Homo sapiens
cactctggacctggg

SEQ ID NO: 350135 - DNA, 15 bp, Homo sapiens
actctggacctgggt

SEQ ID NO: 350136 - DNA, 15 bp, Homo sapiens
ctctggacctgggtt

SEQ ID NO: 350137 - DNA, 15 bp, Homo sapiens
tctggacctgggttt

SEQ ID NO: 350138 - DNA, 15 bp, Homo sapiens
ctggacctgggtttg

SEQ ID NO: 350139 - DNA, 15 bp, Homo sapiens
tggacctgggtttgt

SEQ ID NO: 350140 - DNA, 15 bp, Homo sapiens
ggacctgggtttgtc

SEQ ID NO: 350141 - DNA, 15 bp, Homo sapiens
gacctgggtttgtct

SEQ ID NO: 350142 - DNA, 15 bp, Homo sapiens
acctgggtttgtcta

SEQ ID NO: 350143 - DNA, 15 bp, Homo sapiens
cctgggtttgtctac

SEQ ID NO: 350144 - DNA, 15 bp, Homo sapiens
ctgggtttgtctaca

SEQ ID NO: 350145 - DNA, 15 bp, Homo sapiens
tgggtttgtctacac

SEQ ID NO: 350146 - DNA, 15 bp, Homo sapiens
gggtttgtctacacg

SEQ ID NO: 350147 - DNA, 15 bp, Homo sapiens
ggtttgtctacacgg

SEQ ID NO: 350148 - DNA, 15 bp, Homo sapiens
gtttgtctacacggt

SEQ ID NO: 350149 - DNA, 15 bp, Homo sapiens
tttgtctacacggtg

SEQ ID NO: 350150 - DNA, 15 bp, Homo sapiens
ttgtctacacggtgg

SEQ ID NO: 350151 - DNA, 15 bp, Homo sapiens
tgtctacacggtgga

SEQ ID NO: 350152 - DNA, 15 bp, Homo sapiens
gtctacacggtggag

SEQ ID NO: 350153 - DNA, 15 bp, Homo sapiens
tctacacggtggagc

SEQ ID NO: 350154 - DNA, 15 bp, Homo sapiens
ctacacggtggagct

SEQ ID NO: 350155 - DNA, 15 bp, Homo sapiens
tacacggtggagctt

SEQ ID NO: 350156 - DNA, 15 bp, Homo sapiens
acacggtggagctta

SEQ ID NO: 350157 - DNA, 15 bp, Homo sapiens
cacggtggagcttac

SEQ ID NO: 350158 - DNA, 15 bp, Homo sapiens
acggtggagcttaca

SEQ ID NO: 350159 - DNA, 15 bp, Homo sapiens
cggtggagcttacag

SEQ ID NO: 350160 - DNA, 15 bp, Homo sapiens
ggtggagcttacagc

SEQ ID NO: 350161 - DNA, 15 bp, Homo sapiens
gtggagcttacagca

SEQ ID NO: 350162 - DNA, 15 bp, Homo sapiens
tggagcttacagcaa

SEQ ID NO: 350163 - DNA, 15 bp, Homo sapiens
ggagcttacagcaag

SEQ ID NO: 350164 - DNA, 15 bp, Homo sapiens
gagcttacagcaaga

SEQ ID NO: 350165 - DNA, 15 bp, Homo sapiens
agcttacagcaagac

SEQ ID NO: 350166 - DNA, 15 bp, Homo sapiens
gcttacagcaagact

SEQ ID NO: 350167 - DNA, 15 bp, Homo sapiens
cttacagcaagactg

SEQ ID NO: 350168 - DNA, 15 bp, Homo sapiens
ttacagcaagactgg

SEQ ID NO: 350169 - DNA, 15 bp, Homo sapiens
tacagcaagactggt

SEQ ID NO: 350170 - DNA, 15 bp, Homo sapiens
acagcaagactggtt

SEQ ID NO: 350171 - DNA, 15 bp, Homo sapiens
cagcaagactggttg

SEQ ID NO: 350172 - DNA, 15 bp, Homo sapiens
agcaagactggttga

SEQ ID NO: 350173 - DNA, 15 bp, Homo sapiens
gcaagactggttgaa

SEQ ID NO: 350174 - DNA, 15 bp, Homo sapiens
caagactggttgaag

SEQ ID NO: 350175 - DNA, 15 bp, Homo sapiens
aagactggttgaagg

SEQ ID NO: 350176 - DNA, 15 bp, Homo sapiens
agactggttgaaggg

SEQ ID NO: 350177 - DNA, 15 bp, Homo sapiens
gactggttgaaggga

SEQ ID NO: 350178 - DNA, 15 bp, Homo sapiens
actggttgaagggat

SEQ ID NO: 350179 - DNA, 15 bp, Homo sapiens
ctggttgaagggatc

SEQ ID NO: 350180 - DNA, 15 bp, Homo sapiens
tggttgaagggatct

SEQ ID NO: 350181 - DNA, 15 bp, Homo sapiens
ggttgaagggatctt

SEQ ID NO: 350182 - DNA, 15 bp, Homo sapiens
gttgaagggatcttt

SEQ ID NO: 350183 - DNA, 15 bp, Homo sapiens
ttgaagggatctttg

SEQ ID NO: 350184 - DNA, 15 bp, Homo sapiens
tgaagggatctttgt

SEQ ID NO: 350185 - DNA, 15 bp, Homo sapiens
gaagggatctttgtt

SEQ ID NO: 350186 - DNA, 15 bp, Homo sapiens
aagggatctttgttt

SEQ ID NO: 350187 - DNA, 15 bp, Homo sapiens
agggatctttgtttt

SEQ ID NO: 350188 - DNA, 15 bp, Homo sapiens
gggatctttgttttc

SEQ ID NO: 350189 - DNA, 15 bp, Homo sapiens
ggatctttgttttct

SEQ ID NO: 350190 - DNA, 15 bp, Homo sapiens
gatctttgttttctt

SEQ ID NO: 350191 - DNA, 15 bp, Homo sapiens
atctttgttttcttt

SEQ ID NO: 350192 - DNA, 15 bp, Homo sapiens
tctttgttttctttt

SEQ ID NO: 350193 - DNA, 15 bp, Homo sapiens
ctttgttttctttta

SEQ ID NO: 350194 - DNA, 15 bp, Homo sapiens
tttgttttcttttat

SEQ ID NO: 350195 - DNA, 15 bp, Homo sapiens
ttgttttcttttatt

SEQ ID NO: 350196 - DNA, 15 bp, Homo sapiens
tgttttcttttattc

SEQ ID NO: 350197 - DNA, 15 bp, Homo sapiens
gttttcttttattct

SEQ ID NO: 350198 - DNA, 15 bp, Homo sapiens
ttttcttttattctt

SEQ ID NO: 350199 - DNA, 15 bp, Homo sapiens
tttcttttattcttt

SEQ ID NO: 350200 - DNA, 15 bp, Homo sapiens
ttcttttattctttg

SEQ ID NO: 350201 - DNA, 15 bp, Homo sapiens
tcttttattctttgt

SEQ ID NO: 350202 - DNA, 15 bp, Homo sapiens
cttttattctttgtg

SEQ ID NO: 350203 - DNA, 15 bp, Homo sapiens
ttttattctttgtgt

SEQ ID NO: 350204 - DNA, 15 bp, Homo sapiens
tttattctttgtgta

SEQ ID NO: 350205 - DNA, 15 bp, Homo sapiens
ttattctttgtgtag

SEQ ID NO: 350206 - DNA, 15 bp, Homo sapiens
tattctttgtgtagc

SEQ ID NO: 350207 - DNA, 15 bp, Homo sapiens
attctttgtgtagct

SEQ ID NO: 350208 - DNA, 15 bp, Homo sapiens
ttctttgtgtagctg

SEQ ID NO: 350209 - DNA, 15 bp, Homo sapiens
tctttgtgtagctgt

SEQ ID NO: 350210 - DNA, 15 bp, Homo sapiens
ctttgtgtagctgtt

SEQ ID NO: 350211 - DNA, 15 bp, Homo sapiens
tttgtgtagctgtta

SEQ ID NO: 350212 - DNA, 15 bp, Homo sapiens
ttgtgtagctgttaa

SEQ ID NO: 350213 - DNA, 15 bp, Homo sapiens
tgtgtagctgttaag

SEQ ID NO: 350214 - DNA, 15 bp, Homo sapiens
gtgtagctgttaagg

SEQ ID NO: 350215 - DNA, 15 bp, Homo sapiens
tgtagctgttaagga

SEQ ID NO: 350216 - DNA, 15 bp, Homo sapiens
gtagctgttaaggaa

SEQ ID NO: 350217 - DNA, 15 bp, Homo sapiens
tagctgttaaggaag

SEQ ID NO: 350218 - DNA, 15 bp, Homo sapiens
agctgttaaggaaga

SEQ ID NO: 350219 - DNA, 15 bp, Homo sapiens
gctgttaaggaagag

SEQ ID NO: 350220 - DNA, 15 bp, Homo sapiens
ctgttaaggaagagg

SEQ ID NO: 350221 - DNA, 15 bp, Homo sapiens
tgttaaggaagagga

SEQ ID NO: 350222 - DNA, 15 bp, Homo sapiens
gttaaggaagaggag

SEQ ID NO: 350223 - DNA, 15 bp, Homo sapiens
ttaaggaagaggaga

SEQ ID NO: 350224 - DNA, 15 bp, Homo sapiens
taaggaagaggagat

SEQ ID NO: 350225 - DNA, 15 bp, Homo sapiens
aaggaagaggagatt

SEQ ID NO: 350226 - DNA, 15 bp, Homo sapiens
aggaagaggagatta

SEQ ID NO: 350227 - DNA, 15 bp, Homo sapiens
ggaagaggagattat

SEQ ID NO: 350228 - DNA, 15 bp, Homo sapiens
gaagaggagattata

SEQ ID NO: 350229 - DNA, 15 bp, Homo sapiens
aagaggagattatat

SEQ ID NO: 350230 - DNA, 15 bp, Homo sapiens
agaggagattatatg

SEQ ID NO: 350231 - DNA, 15 bp, Homo sapiens
gagattatatggaac

SEQ ID NO: 350232 - DNA, 15 bp, Homo sapiens
agattatatggaaca

SEQ ID NO: 350233 - DNA, 15 bp, Homo sapiens
gattatatggaacaa

SEQ ID NO: 350234 - DNA, 15 bp, Homo sapiens
attatatggaacaaa

SEQ ID NO: 350235 - DNA, 15 bp, Homo sapiens
ttatatggaacaaaa

SEQ ID NO: 350236 - DNA, 15 bp, Homo sapiens
tatatggaacaaaag

SEQ ID NO: 350237 - DNA, 15 bp, Homo sapiens
atatggaacaaaagg

SEQ ID NO: 350238 - DNA, 15 bp, Homo sapiens
tatggaacaaaaggg

SEQ ID NO: 350239 - DNA, 15 bp, Homo sapiens
atggaacaaaaggga

SEQ ID NO: 350240 - DNA, 15 bp, Homo sapiens
tggaacaaaagggac

SEQ ID NO: 350241 - DNA, 15 bp, Homo sapiens
ggaacaaaagggaca

SEQ ID NO: 350242 - DNA, 15 bp, Homo sapiens
gaacaaaagggacat

SEQ ID NO: 350243 - DNA, 15 bp, Homo sapiens
aacaaaagggacatt

SEQ ID NO: 350244 - DNA, 15 bp, Homo sapiens
acaaaagggacattg

SEQ ID NO: 350245 - DNA, 15 bp, Homo sapiens
caaaagggacattgt

SEQ ID NO: 350246 - DNA, 15 bp, Homo sapiens
aaaagggacattgtt

SEQ ID NO: 350247 - DNA, 15 bp, Homo sapiens
aaagggacattgttg

SEQ ID NO: 350248 - DNA, 15 bp, Homo sapiens
aagggacattgttgt

SEQ ID NO: 350249 - DNA, 15 bp, Homo sapiens
agggacattgttgtt

SEQ ID NO: 350250 - DNA, 15 bp, Homo sapiens
gggacattgttgttc

SEQ ID NO: 350251 - DNA, 15 bp, Homo sapiens
ggacattgttgttcc

SEQ ID NO: 350252 - DNA, 15 bp, Homo sapiens
gacattgttgttcca

SEQ ID NO: 350253 - DNA, 15 bp, Homo sapiens
acattgttgttccat

SEQ ID NO: 350254 - DNA, 15 bp, Homo sapiens
cattgttgttccatc

SEQ ID NO: 350255 - DNA, 15 bp, Homo sapiens
attgttgttccatct

SEQ ID NO: 350256 - DNA, 15 bp, Homo sapiens
ttgttgttccatctt

SEQ ID NO: 350257 - DNA, 15 bp, Homo sapiens
tgttgttccatcttc

SEQ ID NO: 350258 - DNA, 15 bp, Homo sapiens
gttgttccatcttca

SEQ ID NO: 350259 - DNA, 15 bp, Homo sapiens
ttgttccatcttcag

SEQ ID NO: 350260 - DNA, 15 bp, Homo sapiens
tgttccatcttcaga

SEQ ID NO: 350261 - DNA, 15 bp, Homo sapiens
gttccatcttcagag

SEQ ID NO: 350262 - DNA, 15 bp, Homo sapiens
ttccatcttcagaga

SEQ ID NO: 350263 - DNA, 15 bp, Homo sapiens
tccatcttcagagag

SEQ ID NO: 350264 - DNA, 15 bp, Homo sapiens
ccatcttcagagaga

SEQ ID NO: 350265 - DNA, 15 bp, Homo sapiens
catcttcagagagac

SEQ ID NO: 350266 - DNA, 15 bp, Homo sapiens
atcttcagagagaca

SEQ ID NO: 350267 - DNA, 15 bp, Homo sapiens
tcttcagagagacat

SEQ ID NO: 350268 - DNA, 15 bp, Homo sapiens
cttcagagagacatt

SEQ ID NO: 350269 - DNA, 15 bp, Homo sapiens
ttcagagagacattt

SEQ ID NO: 350270 - DNA, 15 bp, Homo sapiens
tcagagagacatttc

SEQ ID NO: 350271 - DNA, 15 bp, Homo sapiens
cagagagacatttca

SEQ ID NO: 350272 - DNA, 15 bp, Homo sapiens
agagagacatttcat

SEQ ID NO: 350273 - DNA, 15 bp, Homo sapiens
gagagacatttcatc

SEQ ID NO: 350274 - DNA, 15 bp, Homo sapiens
agagacatttcatca

SEQ ID NO: 350275 - DNA, 15 bp, Homo sapiens
gagacatttcatcat

SEQ ID NO: 350276 - DNA, 15 bp, Homo sapiens
agacatttcatcatg

SEQ ID NO: 350277 - DNA, 15 bp, Homo sapiens
gacatttcatcatga

SEQ ID NO: 350278 - DNA, 15 bp, Homo sapiens
acatttcatcatgaa

SEQ ID NO: 350279 - DNA, 15 bp, Homo sapiens
catttcatcatgaag

SEQ ID NO: 350280 - DNA, 15 bp, Homo sapiens
atttcatcatgaaga

SEQ ID NO: 350281 - DNA, 15 bp, Homo sapiens
tttcatcatgaagaa

SEQ ID NO: 350282 - DNA, 15 bp, Homo sapiens
ttcatcatgaagaaa

SEQ ID NO: 350283 - DNA, 15 bp, Homo sapiens
tcatcatgaagaaat

SEQ ID NO: 350284 - DNA, 15 bp, Homo sapiens
catcatgaagaaatg

SEQ ID NO: 350285 - DNA, 15 bp, Homo sapiens
atcatgaagaaatga

SEQ ID NO: 350286 - DNA, 15 bp, Homo sapiens
tcatgaagaaatgaa

SEQ ID NO: 350287 - DNA, 15 bp, Homo sapiens
catgaagaaatgaag

SEQ ID NO: 350288 - DNA, 15 bp, Homo sapiens
atgaagaaatgaaga

SEQ ID NO: 350289 - DNA, 15 bp, Homo sapiens
tgaagaaatgaagaa

SEQ ID NO: 350290 - DNA, 15 bp, Homo sapiens
gaagaaatgaagaaa

SEQ ID NO: 350291 - DNA, 15 bp, Homo sapiens
agaaatgaagaaaaa

SEQ ID NO: 350292 - DNA, 15 bp, Homo sapiens
gaaatgaagaaaaat

SEQ ID NO: 350293 - DNA, 15 bp, Homo sapiens
aaatgaagaaaaatt

SEQ ID NO: 350294 - DNA, 15 bp, Homo sapiens
aatgaagaaaaatta

SEQ ID NO: 350295 - DNA, 15 bp, Homo sapiens
atgaagaaaaattat

SEQ ID NO: 350296 - DNA, 15 bp, Homo sapiens
tgaagaaaaattata

SEQ ID NO: 350297 - DNA, 15 bp, Homo sapiens
gaagaaaaattatag

SEQ ID NO: 350298 - DNA, 15 bp, Homo sapiens
aagaaaaattatagt

SEQ ID NO: 350299 - DNA, 15 bp, Homo sapiens
agaaaaattatagtg

SEQ ID NO: 350300 - DNA, 15 bp, Homo sapiens
gaaaaattatagtgg

SEQ ID NO: 350301 - DNA, 15 bp, Homo sapiens
aaaaattatagtggg

SEQ ID NO: 350302 - DNA, 15 bp, Homo sapiens
aaaattatagtgggt

SEQ ID NO: 350303 - DNA, 15 bp, Homo sapiens
aaattatagtgggtt

SEQ ID NO: 350304 - DNA, 15 bp, Homo sapiens
aattatagtgggtta

SEQ ID NO: 350305 - DNA, 15 bp, Homo sapiens
attatagtgggttag

SEQ ID NO: 350306 - DNA, 15 bp, Homo sapiens
ttatagtgggttagt

SEQ ID NO: 350307 - DNA, 15 bp, Homo sapiens
tatagtgggttagtt

SEQ ID NO: 350308 - DNA, 15 bp, Homo sapiens
atagtgggttagtta

SEQ ID NO: 350309 - DNA, 15 bp, Homo sapiens
tagtgggttagttaa

SEQ ID NO: 350310 - DNA, 15 bp, Homo sapiens
agtgggttagttaat

SEQ ID NO: 350311 - DNA, 15 bp, Homo sapiens
gtgggttagttaata

SEQ ID NO: 350312 - DNA, 15 bp, Homo sapiens
tgggttagttaatat

SEQ ID NO: 350313 - DNA, 15 bp, Homo sapiens
gggttagttaatatt

SEQ ID NO: 350314 - DNA, 15 bp, Homo sapiens
ggttagttaatattt

SEQ ID NO: 350315 - DNA, 15 bp, Homo sapiens
gttagttaatatttc

SEQ ID NO: 350316 - DNA, 15 bp, Homo sapiens
ttagttaatatttca

SEQ ID NO: 350317 - DNA, 15 bp, Homo sapiens
tagttaatatttcaa

SEQ ID NO: 350318 - DNA, 15 bp, Homo sapiens
agttaatatttcaaa

SEQ ID NO: 350319 - DNA, 15 bp, Homo sapiens
gttaatatttcaaac

SEQ ID NO: 350320 - DNA, 15 bp, Homo sapiens
ttaatatttcaaacg

SEQ ID NO: 350321 - DNA, 15 bp, Homo sapiens
taatatttcaaacgt

SEQ ID NO: 350322 - DNA, 15 bp, Homo sapiens
aatatttcaaacgtc

SEQ ID NO: 350323 - DNA, 15 bp, Homo sapiens
atatttcaaacgtca

SEQ ID NO: 350324 - DNA, 15 bp, Homo sapiens
tatttcaaacgtcaa

SEQ ID NO: 350325 - DNA, 15 bp, Homo sapiens
atttcaaacgtcaac

SEQ ID NO: 350326 - DNA, 15 bp, Homo sapiens
tttcaaacgtcaaca

SEQ ID NO: 350327 - DNA, 15 bp, Homo sapiens
ttcaaacgtcaacat

SEQ ID NO: 350328 - DNA, 15 bp, Homo sapiens
tcaaacgtcaacatc

SEQ ID NO: 350329 - DNA, 15 bp, Homo sapiens
caaacgtcaacatcc

SEQ ID NO: 350330 - DNA, 15 bp, Homo sapiens
aaacgtcaacatccg

SEQ ID NO: 350331 - DNA, 15 bp, Homo sapiens
aacgtcaacatccgc

SEQ ID NO: 350332 - DNA, 15 bp, Homo sapiens
acgtcaacatccgca

SEQ ID NO: 350333 - DNA, 15 bp, Homo sapiens
cgtcaacatccgcag

SEQ ID NO: 350334 - DNA, 15 bp, Homo sapiens
gtcaacatccgcagg

SEQ ID NO: 350335 - DNA, 15 bp, Homo sapiens
tcaacatccgcagga

SEQ ID NO: 350336 - DNA, 15 bp, Homo sapiens
caacatccgcaggaa

SEQ ID NO: 350337 - DNA, 15 bp, Homo sapiens
aacatccgcaggaat

SEQ ID NO: 350338 - DNA, 15 bp, Homo sapiens
acatccgcaggaatg

SEQ ID NO: 350339 - DNA, 15 bp, Homo sapiens
catccgcaggaatga

SEQ ID NO: 350340 - DNA, 15 bp, Homo sapiens
atccgcaggaatgaa

SEQ ID NO: 350341 - DNA, 15 bp, Homo sapiens
tccgcaggaatgaag

SEQ ID NO: 350342 - DNA, 15 bp, Homo sapiens
ccgcaggaatgaagt

SEQ ID NO: 350343 - DNA, 15 bp, Homo sapiens
cgcaggaatgaagtc

SEQ ID NO: 350344 - DNA, 15 bp, Homo sapiens
gcaggaatgaagtca

SEQ ID NO: 350345 - DNA, 15 bp, Homo sapiens
caggaatgaagtcac

SEQ ID NO: 350346 - DNA, 15 bp, Homo sapiens
aggaatgaagtcact

SEQ ID NO: 350347 - DNA, 15 bp, Homo sapiens
ggaatgaagtcactg

SEQ ID NO: 350348 - DNA, 15 bp, Homo sapiens
gaatgaagtcactgt

SEQ ID NO: 350349 - DNA, 15 bp, Homo sapiens
aatgaagtcactgtc

SEQ ID NO: 350350 - DNA, 15 bp, Homo sapiens
atgaagtcactgtct

SEQ ID NO: 350351 - DNA, 15 bp, Homo sapiens
tgaagtcactgtctg

SEQ ID NO: 350352 - DNA, 15 bp, Homo sapiens
gaagtcactgtctga

SEQ ID NO: 350353 - DNA, 15 bp, Homo sapiens
aagtcactgtctgac

SEQ ID NO: 350354 - DNA, 15 bp, Homo sapiens
agtcactgtctgact

SEQ ID NO: 350355 - DNA, 15 bp, Homo sapiens
gtcactgtctgactc

SEQ ID NO: 350356 - DNA, 15 bp, Homo sapiens
tcactgtctgactct

SEQ ID NO: 350357 - DNA, 15 bp, Homo sapiens
cactgtctgactctc

SEQ ID NO: 350358 - DNA, 15 bp, Homo sapiens
actgtctgactctca

SEQ ID NO: 350359 - DNA, 15 bp, Homo sapiens
ctgtctgactctcag

SEQ ID NO: 350360 - DNA, 15 bp, Homo sapiens
tgtctgactctcaga

SEQ ID NO: 350361 - DNA, 15 bp, Homo sapiens
gtctgactctcagaa

SEQ ID NO: 350362 - DNA, 15 bp, Homo sapiens
tctgactctcagaaa

SEQ ID NO: 350363 - DNA, 15 bp, Homo sapiens
ctgactctcagaaat

SEQ ID NO: 350364 - DNA, 15 bp, Homo sapiens
tgactctcagaaatg

SEQ ID NO: 350365 - DNA, 15 bp, Homo sapiens
gactctcagaaatgc

SEQ ID NO: 350366 - DNA, 15 bp, Homo sapiens
actctcagaaatgcc

SEQ ID NO: 350367 - DNA, 15 bp, Homo sapiens
ctctcagaaatgcca

SEQ ID NO: 350368 - DNA, 15 bp, Homo sapiens
tctcagaaatgccaa

SEQ ID NO: 350369 - DNA, 15 bp, Homo sapiens
ctcagaaatgccaat

SEQ ID NO: 350370 - DNA, 15 bp, Homo sapiens
tcagaaatgccaatg

SEQ ID NO: 350371 - DNA, 15 bp, Homo sapiens
cagaaatgccaatgg

SEQ ID NO: 350372 - DNA, 15 bp, Homo sapiens
agaaatgccaatgga

SEQ ID NO: 350373 - DNA, 15 bp, Homo sapiens
gaaatgccaatggaa

SEQ ID NO: 350374 - DNA, 15 bp, Homo sapiens
aaatgccaatggaat

SEQ ID NO: 350375 - DNA, 15 bp, Homo sapiens
aatgccaatggaatg

SEQ ID NO: 350376 - DNA, 15 bp, Homo sapiens
atgccaatggaatga

SEQ ID NO: 350377 - DNA, 15 bp, Homo sapiens
tgccaatggaatgat

SEQ ID NO: 350378 - DNA, 15 bp, Homo sapiens
gccaatggaatgatc

SEQ ID NO: 350379 - DNA, 15 bp, Homo sapiens
ccaatggaatgatct

SEQ ID NO: 350380 - DNA, 15 bp, Homo sapiens
caatggaatgatcta

SEQ ID NO: 350381 - DNA, 15 bp, Homo sapiens
aatggaatgatctat

SEQ ID NO: 350382 - DNA, 15 bp, Homo sapiens
atggaatgatctatg

SEQ ID NO: 350383 - DNA, 15 bp, Homo sapiens
tggaatgatctatgt

SEQ ID NO: 350384 - DNA, 15 bp, Homo sapiens
ggaatgatctatgtt

SEQ ID NO: 350385 - DNA, 15 bp, Homo sapiens
gaatgatctatgttg

SEQ ID NO: 350386 - DNA, 15 bp, Homo sapiens
aatgatctatgttgt

SEQ ID NO: 350387 - DNA, 15 bp, Homo sapiens
atgatctatgttgtt

SEQ ID NO: 350388 - DNA, 15 bp, Homo sapiens
tgatctatgttgtta

SEQ ID NO: 350389 - DNA, 15 bp, Homo sapiens
gatctatgttgttaa

SEQ ID NO: 350390 - DNA, 15 bp, Homo sapiens
atctatgttgttaat

SEQ ID NO: 350391 - DNA, 15 bp, Homo sapiens
tctatgttgttaatt

SEQ ID NO: 350392 - DNA, 15 bp, Homo sapiens
ctatgttgttaatta

SEQ ID NO: 350393 - DNA, 15 bp, Homo sapiens
tatgttgttaattaa

SEQ ID NO: 350394 - DNA, 15 bp, Homo sapiens
atgttgttaattaac

SEQ ID NO: 350395 - DNA, 15 bp, Homo sapiens
tgttgttaattaaca

SEQ ID NO: 350396 - DNA, 15 bp, Homo sapiens
gttgttaattaacag

SEQ ID NO: 350397 - DNA, 15 bp, Homo sapiens
ttgttaattaacaga

SEQ ID NO: 350398 - DNA, 15 bp, Homo sapiens
tgttaattaacagag

SEQ ID NO: 350399 - DNA, 15 bp, Homo sapiens
gttaattaacagaga

SEQ ID NO: 350400 - DNA, 15 bp, Homo sapiens
ttaattaacagagac

SEQ ID NO: 350401 - DNA, 15 bp, Homo sapiens
taattaacagagacc

SEQ ID NO: 350402 - DNA, 15 bp, Homo sapiens
aattaacagagaccc

SEQ ID NO: 350403 - DNA, 15 bp, Homo sapiens
attaacagagaccct

SEQ ID NO: 350404 - DNA, 15 bp, Homo sapiens
ttaacagagaccctt

SEQ ID NO: 350405 - DNA, 15 bp, Homo sapiens
taacagagacccttt

SEQ ID NO: 350406 - DNA, 15 bp, Homo sapiens
aacagagaccctttt

SEQ ID NO: 350407 - DNA, 15 bp, Homo sapiens
acagagaccctttta

SEQ ID NO: 350408 - DNA, 15 bp, Homo sapiens
cagagacccttttac

SEQ ID NO: 350409 - DNA, 15 bp, Homo sapiens
agagacccttttaca

SEQ ID NO: 350410 - DNA, 15 bp, Homo sapiens
gagacccttttacat

SEQ ID NO: 350411 - DNA, 15 bp, Homo sapiens
agacccttttacatt

SEQ ID NO: 350412 - DNA, 15 bp, Homo sapiens
gacccttttacattt

SEQ ID NO: 350413 - DNA, 15 bp, Homo sapiens
acccttttacatttt

SEQ ID NO: 350414 - DNA, 15 bp, Homo sapiens
cccttttacatttta

SEQ ID NO: 350415 - DNA, 15 bp, Homo sapiens
ccttttacattttaa

SEQ ID NO: 350416 - DNA, 15 bp, Homo sapiens
cttttacattttaat

SEQ ID NO: 350417 - DNA, 15 bp, Homo sapiens
ttttacattttaatc

SEQ ID NO: 350418 - DNA, 15 bp, Homo sapiens
tttacattttaatca

SEQ ID NO: 350419 - DNA, 15 bp, Homo sapiens
ttacattttaatcat

SEQ ID NO: 350420 - DNA, 15 bp, Homo sapiens
tacattttaatcatg

SEQ ID NO: 350421 - DNA, 15 bp, Homo sapiens
acattttaatcatgg

SEQ ID NO: 350422 - DNA, 15 bp, Homo sapiens
cattttaatcatggg

SEQ ID NO: 350423 - DNA, 15 bp, Homo sapiens
attttaatcatgggg

SEQ ID NO: 350424 - DNA, 15 bp, Homo sapiens
ttttaatcatggggt

SEQ ID NO: 350425 - DNA, 15 bp, Homo sapiens
tttaatcatggggtc

SEQ ID NO: 350426 - DNA, 15 bp, Homo sapiens
ttaatcatggggtct

SEQ ID NO: 350427 - DNA, 15 bp, Homo sapiens
taatcatggggtctc

SEQ ID NO: 350428 - DNA, 15 bp, Homo sapiens
aatcatggggtctcc

SEQ ID NO: 350429 - DNA, 15 bp, Homo sapiens
atcatggggtctcct

SEQ ID NO: 350430 - DNA, 15 bp, Homo sapiens
tcatggggtctcctt

SEQ ID NO: 350431 - DNA, 15 bp, Homo sapiens
catggggtctccttt

SEQ ID NO: 350432 - DNA, 15 bp, Homo sapiens
atggggtctcctttg

SEQ ID NO: 350433 - DNA, 15 bp, Homo sapiens
tggggtctcctttgc

SEQ ID NO: 350434 - DNA, 15 bp, Homo sapiens
ggggtctcctttgcc

SEQ ID NO: 350435 - DNA, 15 bp, Homo sapiens
gggtctcctttgcca

SEQ ID NO: 350436 - DNA, 15 bp, Homo sapiens
ggtctcctttgccat

SEQ ID NO: 350437 - DNA, 15 bp, Homo sapiens
gtctcctttgccatg

SEQ ID NO: 350438 - DNA, 15 bp, Homo sapiens
tctcctttgccatgt

SEQ ID NO: 350439 - DNA, 15 bp, Homo sapiens
ctcctttgccatgta

SEQ ID NO: 350440 - DNA, 15 bp, Homo sapiens
tcctttgccatgtat

SEQ ID NO: 350441 - DNA, 15 bp, Homo sapiens
cctttgccatgtatt

SEQ ID NO: 350442 - DNA, 15 bp, Homo sapiens
ctttgccatgtattg

SEQ ID NO: 350443 - DNA, 15 bp, Homo sapiens
tttgccatgtattgg

SEQ ID NO: 350444 - DNA, 15 bp, Homo sapiens
ttgccatgtattgga

SEQ ID NO: 350445 - DNA, 15 bp, Homo sapiens
tgccatgtattggaa

SEQ ID NO: 350446 - DNA, 15 bp, Homo sapiens
gccatgtattggaat

SEQ ID NO: 350447 - DNA, 15 bp, Homo sapiens
ccatgtattggaatt

SEQ ID NO: 350448 - DNA, 15 bp, Homo sapiens
catgtattggaattc

SEQ ID NO: 350449 - DNA, 15 bp, Homo sapiens
atgtattggaattca

SEQ ID NO: 350450 - DNA, 15 bp, Homo sapiens
tgtattggaattcat

SEQ ID NO: 350451 - DNA, 15 bp, Homo sapiens
gtattggaattcatt

SEQ ID NO: 350452 - DNA, 15 bp, Homo sapiens
tattggaattcattt

SEQ ID NO: 350453 - DNA, 15 bp, Homo sapiens
attggaattcattta

SEQ ID NO: 350454 - DNA, 15 bp, Homo sapiens
ttggaattcatttag

SEQ ID NO: 350455 - DNA, 15 bp, Homo sapiens
tggaattcatttagg

SEQ ID NO: 350456 - DNA, 15 bp, Homo sapiens
ggaattcatttagga

SEQ ID NO: 350457 - DNA, 15 bp, Homo sapiens
gaattcatttaggat

SEQ ID NO: 350458 - DNA, 15 bp, Homo sapiens
aattcatttaggata

SEQ ID NO: 350459 - DNA, 15 bp, Homo sapiens
attcatttaggataa

SEQ ID NO: 350460 - DNA, 15 bp, Homo sapiens
ttcatttaggataat

SEQ ID NO: 350461 - DNA, 15 bp, Homo sapiens
tcatttaggataatg

SEQ ID NO: 350462 - DNA, 15 bp, Homo sapiens
catttaggataatgg

SEQ ID NO: 350463 - DNA, 15 bp, Homo sapiens
atttaggataatggt

SEQ ID NO: 350464 - DNA, 15 bp, Homo sapiens
tttaggataatggtc

SEQ ID NO: 350465 - DNA, 15 bp, Homo sapiens
ttaggataatggtct

SEQ ID NO: 350466 - DNA, 15 bp, Homo sapiens
taggataatggtcta

SEQ ID NO: 350467 - DNA, 15 bp, Homo sapiens
aggataatggtctat

SEQ ID NO: 350468 - DNA, 15 bp, Homo sapiens
ggataatggtctatg

SEQ ID NO: 350469 - DNA, 15 bp, Homo sapiens
gataatggtctatgt

SEQ ID NO: 350470 - DNA, 15 bp, Homo sapiens
ataatggtctatgta

SEQ ID NO: 350471 - DNA, 15 bp, Homo sapiens
taatggtctatgtaa

SEQ ID NO: 350472 - DNA, 15 bp, Homo sapiens
aatggtctatgtaat

SEQ ID NO: 350473 - DNA, 15 bp, Homo sapiens
atggtctatgtaata

SEQ ID NO: 350474 - DNA, 15 bp, Homo sapiens
tggtctatgtaataa

SEQ ID NO: 350475 - DNA, 15 bp, Homo sapiens
ggtctatgtaataat

SEQ ID NO: 350476 - DNA, 15 bp, Homo sapiens
gtctatgtaataata

SEQ ID NO: 350477 - DNA, 15 bp, Homo sapiens
tctatgtaataatat

SEQ ID NO: 350478 - DNA, 15 bp, Homo sapiens
ctatgtaataatatt

SEQ ID NO: 350479 - DNA, 15 bp, Homo sapiens
tatgtaataatattg

SEQ ID NO: 350480 - DNA, 15 bp, Homo sapiens
atgtaataatattgg

SEQ ID NO: 350481 - DNA, 15 bp, Homo sapiens
tgtaataatattggt

SEQ ID NO: 350482 - DNA, 15 bp, Homo sapiens
gtaataatattggtt

SEQ ID NO: 350483 - DNA, 15 bp, Homo sapiens
taataatattggttc

SEQ ID NO: 350484 - DNA, 15 bp, Homo sapiens
aataatattggttcc

SEQ ID NO: 350485 - DNA, 15 bp, Homo sapiens
ataatattggttcct

SEQ ID NO: 350486 - DNA, 15 bp, Homo sapiens
taatattggttccta

SEQ ID NO: 350487 - DNA, 15 bp, Homo sapiens
aatattggttcctaa

SEQ ID NO: 350488 - DNA, 15 bp, Homo sapiens
atattggttcctaat

SEQ ID NO: 350489 - DNA, 15 bp, Homo sapiens
tattggttcctaata

SEQ ID NO: 350490 - DNA, 15 bp, Homo sapiens
attggttcctaatat

SEQ ID NO: 350491 - DNA, 15 bp, Homo sapiens
ttggttcctaatatg

SEQ ID NO: 350492 - DNA, 15 bp, Homo sapiens
tggttcctaatatga

SEQ ID NO: 350493 - DNA, 15 bp, Homo sapiens
ggttcctaatatgat

SEQ ID NO: 350494 - DNA, 15 bp, Homo sapiens
gttcctaatatgatt

SEQ ID NO: 350495 - DNA, 15 bp, Homo sapiens
ttcctaatatgattt

SEQ ID NO: 350496 - DNA, 15 bp, Homo sapiens
tcctaatatgatttt

SEQ ID NO: 350497 - DNA, 15 bp, Homo sapiens
cctaatatgattttt

SEQ ID NO: 350498 - DNA, 15 bp, Homo sapiens
ctaatatgatttttt

SEQ ID NO: 350499 - DNA, 15 bp, Homo sapiens
taatatgattttttc

SEQ ID NO: 350500 - DNA, 15 bp, Homo sapiens
aatatgattttttca

SEQ ID NO: 350501 - DNA, 15 bp, Homo sapiens
atatgattttttcaa

SEQ ID NO: 350502 - DNA, 15 bp, Homo sapiens
tatgattttttcaaa

SEQ ID NO: 350503 - DNA, 15 bp, Homo sapiens
atgattttttcaaac

SEQ ID NO: 350504 - DNA, 15 bp, Homo sapiens
tgattttttcaaact

SEQ ID NO: 350505 - DNA, 15 bp, Homo sapiens
gattttttcaaacta

SEQ ID NO: 350506 - DNA, 15 bp, Homo sapiens
attttttcaaactaa

SEQ ID NO: 350507 - DNA, 15 bp, Homo sapiens
ttttttcaaactaaa

SEQ ID NO: 350508 - DNA, 15 bp, Homo sapiens
tttttcaaactaaat

SEQ ID NO: 350509 - DNA, 15 bp, Homo sapiens
ttttcaaactaaata

SEQ ID NO: 350510 - DNA, 15 bp, Homo sapiens
tttcaaactaaatat

SEQ ID NO: 350511 - DNA, 15 bp, Homo sapiens
ttcaaactaaatatt

SEQ ID NO: 350512 - DNA, 15 bp, Homo sapiens
tcaaactaaatattt

SEQ ID NO: 350513 - DNA, 15 bp, Homo sapiens
caaactaaatatttt

SEQ ID NO: 350514 - DNA, 15 bp, Homo sapiens
aaactaaatattttt

SEQ ID NO: 350515 - DNA, 15 bp, Homo sapiens
aactaaatattttta

SEQ ID NO: 350516 - DNA, 15 bp, Homo sapiens
aaatatttttaaata

SEQ ID NO: 350517 - DNA, 15 bp, Homo sapiens
aatatttttaaataa

SEQ ID NO: 350518 - DNA, 15 bp, Homo sapiens
atatttttaaataaa

SEQ ID NO: 350519 - DNA, 15 bp, Homo sapiens
tatttttaaataaac

SEQ ID NO: 350520 - DNA, 15 bp, Homo sapiens
atttttaaataaaca

SEQ ID NO: 350521 - DNA, 15 bp, Homo sapiens
tttttaaataaacag

SEQ ID NO: 350522 - DNA, 15 bp, Homo sapiens
ttttaaataaacaga

SEQ ID NO: 350523 - DNA, 15 bp, Homo sapiens
tttaaataaacagaa

SEQ ID NO: 350524 - DNA, 15 bp, Homo sapiens
ttaaataaacagaac

SEQ ID NO: 350525 - DNA, 15 bp, Homo sapiens
taaataaacagaact

SEQ ID NO: 350526 - DNA, 15 bp, Homo sapiens
aaataaacagaactg

SEQ ID NO: 350527 - DNA, 15 bp, Homo sapiens
aataaacagaactga

SEQ ID NO: 350528 - DNA, 15 bp, Homo sapiens
ataaacagaactgaa

SEQ ID NO: 350529 - DNA, 15 bp, Homo sapiens
taaacagaactgaag

SEQ ID NO: 350530 - DNA, 15 bp, Homo sapiens
aaacagaactgaagg

SEQ ID NO: 350531 - DNA, 15 bp, Homo sapiens
aacagaactgaaggg

SEQ ID NO: 350532 - DNA, 15 bp, Homo sapiens
acagaactgaagggc

SEQ ID NO: 350533 - DNA, 15 bp, Homo sapiens
cagaactgaagggcc

SEQ ID NO: 350534 - DNA, 15 bp, Homo sapiens
agaactgaagggcca

SEQ ID NO: 350535 - DNA, 15 bp, Homo sapiens
gaactgaagggccaa

SEQ ID NO: 350536 - DNA, 15 bp, Homo sapiens
aactgaagggccaac

SEQ ID NO: 350537 - DNA, 15 bp, Homo sapiens
actgaagggccaacc

SEQ ID NO: 350538 - DNA, 15 bp, Homo sapiens
ctgaagggccaacct

SEQ ID NO: 350539 - DNA, 15 bp, Homo sapiens
tgaagggccaacctg

SEQ ID NO: 350540 - DNA, 15 bp, Homo sapiens
gaagggccaacctgg

SEQ ID NO: 350541 - DNA, 15 bp, Homo sapiens
aagggccaacctgga

SEQ ID NO: 350542 - DNA, 15 bp, Homo sapiens
agggccaacctggac

SEQ ID NO: 350543 - DNA, 15 bp, Homo sapiens
gggccaacctggaca

SEQ ID NO: 350544 - DNA, 15 bp, Homo sapiens
ggccaacctggacat

SEQ ID NO: 350545 - DNA, 15 bp, Homo sapiens
gccaacctggacatg

SEQ ID NO: 350546 - DNA, 15 bp, Homo sapiens
ccaacctggacatgc

SEQ ID NO: 350547 - DNA, 15 bp, Homo sapiens
caacctggacatgca

SEQ ID NO: 350548 - DNA, 15 bp, Homo sapiens
aacctggacatgcat

SEQ ID NO: 350549 - DNA, 15 bp, Homo sapiens
acctggacatgcata

SEQ ID NO: 350550 - DNA, 15 bp, Homo sapiens
cctggacatgcatat

SEQ ID NO: 350551 - DNA, 15 bp, Homo sapiens
ctggacatgcatatc

SEQ ID NO: 350552 - DNA, 15 bp, Homo sapiens
tggacatgcatatct

SEQ ID NO: 350553 - DNA, 15 bp, Homo sapiens
ggacatgcatatctg

SEQ ID NO: 350554 - DNA, 15 bp, Homo sapiens
gacatgcatatctgg

SEQ ID NO: 350555 - DNA, 15 bp, Homo sapiens
acatgcatatctgga

SEQ ID NO: 350556 - DNA, 15 bp, Homo sapiens
catgcatatctggaa

SEQ ID NO: 350557 - DNA, 15 bp, Homo sapiens
atgcatatctggaaa

SEQ ID NO: 350558 - DNA, 15 bp, Homo sapiens
tgcatatctggaaac

SEQ ID NO: 350559 - DNA, 15 bp, Homo sapiens
gcatatctggaaaca

SEQ ID NO: 350560 - DNA, 15 bp, Homo sapiens
catatctggaaacat

SEQ ID NO: 350561 - DNA, 15 bp, Homo sapiens
atatctggaaacatt

SEQ ID NO: 350562 - DNA, 15 bp, Homo sapiens
tatctggaaacattg

SEQ ID NO: 350563 - DNA, 15 bp, Homo sapiens
atctggaaacattga

SEQ ID NO: 350564 - DNA, 15 bp, Homo sapiens
tctggaaacattgaa

SEQ ID NO: 350565 - DNA, 15 bp, Homo sapiens
ctggaaacattgaaa

SEQ ID NO: 350566 - DNA, 15 bp, Homo sapiens
tggaaacattgaaaa

SEQ ID NO: 350567 - DNA, 15 bp, Homo sapiens
ggaaacattgaaaac

SEQ ID NO: 350568 - DNA, 15 bp, Homo sapiens
gaaacattgaaaaca

SEQ ID NO: 350569 - DNA, 15 bp, Homo sapiens
aaacattgaaaacac

SEQ ID NO: 350570 - DNA, 15 bp, Homo sapiens
aacattgaaaacact

SEQ ID NO: 350571 - DNA, 15 bp, Homo sapiens
acattgaaaacactg

SEQ ID NO: 350572 - DNA, 15 bp, Homo sapiens
cattgaaaacactga

SEQ ID NO: 350573 - DNA, 15 bp, Homo sapiens
attgaaaacactgaa

SEQ ID NO: 350574 - DNA, 15 bp, Homo sapiens
ttgaaaacactgaaa

SEQ ID NO: 350575 - DNA, 15 bp, Homo sapiens
tgaaaacactgaaag

SEQ ID NO: 350576 - DNA, 15 bp, Homo sapiens
gaaaacactgaaaga

SEQ ID NO: 350577 - DNA, 15 bp, Homo sapiens
aaaacactgaaagat

SEQ ID NO: 350578 - DNA, 15 bp, Homo sapiens
aaacactgaaagatg

SEQ ID NO: 350579 - DNA, 15 bp, Homo sapiens
aacactgaaagatgt

SEQ ID NO: 350580 - DNA, 15 bp, Homo sapiens
acactgaaagatgtg

SEQ ID NO: 350581 - DNA, 15 bp, Homo sapiens
cactgaaagatgtgc

SEQ ID NO: 350582 - DNA, 15 bp, Homo sapiens
actgaaagatgtgct

SEQ ID NO: 350583 - DNA, 15 bp, Homo sapiens
ctgaaagatgtgcta

SEQ ID NO: 350584 - DNA, 15 bp, Homo sapiens
tgaaagatgtgctaa

SEQ ID NO: 350585 - DNA, 15 bp, Homo sapiens
gaaagatgtgctaaa

SEQ ID NO: 350586 - DNA, 15 bp, Homo sapiens
aaagatgtgctaaat

SEQ ID NO: 350587 - DNA, 15 bp, Homo sapiens
aagatgtgctaaatg

SEQ ID NO: 350588 - DNA, 15 bp, Homo sapiens
agatgtgctaaatga

SEQ ID NO: 350589 - DNA, 15 bp, Homo sapiens
gatgtgctaaatgat

SEQ ID NO: 350590 - DNA, 15 bp, Homo sapiens
atgtgctaaatgatt

SEQ ID NO: 350591 - DNA, 15 bp, Homo sapiens
tgtgctaaatgattc

SEQ ID NO: 350592 - DNA, 15 bp, Homo sapiens
gtgctaaatgattca

SEQ ID NO: 350593 - DNA, 15 bp, Homo sapiens
tgctaaatgattcag

SEQ ID NO: 350594 - DNA, 15 bp, Homo sapiens
gctaaatgattcaga

SEQ ID NO: 350595 - DNA, 15 bp, Homo sapiens
ctaaatgattcagaa

SEQ ID NO: 350596 - DNA, 15 bp, Homo sapiens
taaatgattcagaaa

SEQ ID NO: 350597 - DNA, 15 bp, Homo sapiens
aaatgattcagaaaa

SEQ ID NO: 350598 - DNA, 15 bp, Homo sapiens
aatgattcagaaaat

SEQ ID NO: 350599 - DNA, 15 bp, Homo sapiens
atgattcagaaaata

SEQ ID NO: 350600 - DNA, 15 bp, Homo sapiens
tgattcagaaaataa

SEQ ID NO: 350601 - DNA, 15 bp, Homo sapiens
gattcagaaaataag

SEQ ID NO: 350602 - DNA, 15 bp, Homo sapiens
attcagaaaataagg

SEQ ID NO: 350603 - DNA, 15 bp, Homo sapiens
ttcagaaaataaggc

SEQ ID NO: 350604 - DNA, 15 bp, Homo sapiens
tcagaaaataaggcc

SEQ ID NO: 350605 - DNA, 15 bp, Homo sapiens
cagaaaataaggccc

SEQ ID NO: 350606 - DNA, 15 bp, Homo sapiens
agaaaataaggccca

SEQ ID NO: 350607 - DNA, 15 bp, Homo sapiens
gaaaataaggcccag

SEQ ID NO: 350608 - DNA, 15 bp, Homo sapiens
aaaataaggcccagg

SEQ ID NO: 350609 - DNA, 15 bp, Homo sapiens
aaataaggcccaggt

SEQ ID NO: 350610 - DNA, 15 bp, Homo sapiens
aataaggcccaggtg

SEQ ID NO: 350611 - DNA, 15 bp, Homo sapiens
ataaggcccaggtgt

SEQ ID NO: 350612 - DNA, 15 bp, Homo sapiens
taaggcccaggtgtc

SEQ ID NO: 350613 - DNA, 15 bp, Homo sapiens
aaggcccaggtgtct

SEQ ID NO: 350614 - DNA, 15 bp, Homo sapiens
aggcccaggtgtctc

SEQ ID NO: 350615 - DNA, 15 bp, Homo sapiens
ggcccaggtgtctct

SEQ ID NO: 350616 - DNA, 15 bp, Homo sapiens
gcccaggtgtctctg

SEQ ID NO: 350617 - DNA, 15 bp, Homo sapiens
cccaggtgtctctga

SEQ ID NO: 350618 - DNA, 15 bp, Homo sapiens
ccaggtgtctctgaa

SEQ ID NO: 350619 - DNA, 15 bp, Homo sapiens
caggtgtctctgaat

SEQ ID NO: 350620 - DNA, 15 bp, Homo sapiens
aggtgtctctgaatg

SEQ ID NO: 350621 - DNA, 15 bp, Homo sapiens
ggtgtctctgaatgt

SEQ ID NO: 350622 - DNA, 15 bp, Homo sapiens
gtgtctctgaatgtc

SEQ ID NO: 350623 - DNA, 15 bp, Homo sapiens
tgtctctgaatgtcc

SEQ ID NO: 350624 - DNA, 15 bp, Homo sapiens
gtctctgaatgtcct

SEQ ID NO: 350625 - DNA, 15 bp, Homo sapiens
tctctgaatgtcctt

SEQ ID NO: 350626 - DNA, 15 bp, Homo sapiens
ctctgaatgtcctta

SEQ ID NO: 350627 - DNA, 15 bp, Homo sapiens
tctgaatgtccttaa

SEQ ID NO: 350628 - DNA, 15 bp, Homo sapiens
ctgaatgtccttaat

SEQ ID NO: 350629 - DNA, 15 bp, Homo sapiens
tgaatgtccttaatg

SEQ ID NO: 350630 - DNA, 15 bp, Homo sapiens
gaatgtccttaatga

SEQ ID NO: 350631 - DNA, 15 bp, Homo sapiens
aatgtccttaatgat

SEQ ID NO: 350632 - DNA, 15 bp, Homo sapiens
atgtccttaatgatc

SEQ ID NO: 350633 - DNA, 15 bp, Homo sapiens
tgtccttaatgatct

SEQ ID NO: 350634 - DNA, 15 bp, Homo sapiens
gtccttaatgatctt

SEQ ID NO: 350635 - DNA, 15 bp, Homo sapiens
tccttaatgatcttg

SEQ ID NO: 350636 - DNA, 15 bp, Homo sapiens
ccttaatgatcttgc

SEQ ID NO: 350637 - DNA, 15 bp, Homo sapiens
cttaatgatcttgcc

SEQ ID NO: 350638 - DNA, 15 bp, Homo sapiens
ttaatgatcttgcca

SEQ ID NO: 350639 - DNA, 15 bp, Homo sapiens
taatgatcttgccaa

SEQ ID NO: 350640 - DNA, 15 bp, Homo sapiens
aatgatcttgccaag

SEQ ID NO: 350641 - DNA, 15 bp, Homo sapiens
atgatcttgccaagg

SEQ ID NO: 350642 - DNA, 15 bp, Homo sapiens
tgatcttgccaaggt

SEQ ID NO: 350643 - DNA, 15 bp, Homo sapiens
gatcttgccaaggtg

SEQ ID NO: 350644 - DNA, 15 bp, Homo sapiens
atcttgccaaggtgg

SEQ ID NO: 350645 - DNA, 15 bp, Homo sapiens
tcttgccaaggtgga

SEQ ID NO: 350646 - DNA, 15 bp, Homo sapiens
cttgccaaggtggag

SEQ ID NO: 350647 - DNA, 15 bp, Homo sapiens
ttgccaaggtggaga

SEQ ID NO: 350648 - DNA, 15 bp, Homo sapiens
tgccaaggtggagaa

SEQ ID NO: 350649 - DNA, 15 bp, Homo sapiens
gccaaggtggagaag

SEQ ID NO: 350650 - DNA, 15 bp, Homo sapiens
ccaaggtggagaagg

SEQ ID NO: 350651 - DNA, 15 bp, Homo sapiens
caaggtggagaaggc

SEQ ID NO: 350652 - DNA, 15 bp, Homo sapiens
aaggtggagaaggcc

SEQ ID NO: 350653 - DNA, 15 bp, Homo sapiens
aggtggagaaggccc

SEQ ID NO: 350654 - DNA, 15 bp, Homo sapiens
ggtggagaaggccct

SEQ ID NO: 350655 - DNA, 15 bp, Homo sapiens
gtggagaaggccctg

SEQ ID NO: 350656 - DNA, 15 bp, Homo sapiens
tggagaaggccctgc

SEQ ID NO: 350657 - DNA, 15 bp, Homo sapiens
ggagaaggccctgca

SEQ ID NO: 350658 - DNA, 15 bp, Homo sapiens
gagaaggccctgcaa

SEQ ID NO: 350659 - DNA, 15 bp, Homo sapiens
agaaggccctgcaag

SEQ ID NO: 350660 - DNA, 15 bp, Homo sapiens
gaaggccctgcaaga

SEQ ID NO: 350661 - DNA, 15 bp, Homo sapiens
aaggccctgcaagaa

SEQ ID NO: 350662 - DNA, 15 bp, Homo sapiens
aggccctgcaagaaa

SEQ ID NO: 350663 - DNA, 15 bp, Homo sapiens
ggccctgcaagaaaa

SEQ ID NO: 350664 - DNA, 15 bp, Homo sapiens
gccctgcaagaaaaa

SEQ ID NO: 350665 - DNA, 15 bp, Homo sapiens
ccctgcaagaaaaaa

SEQ ID NO: 350666 - DNA, 15 bp, Homo sapiens
cctgcaagaaaaaaa

SEQ ID NO: 350667 - DNA, 15 bp, Homo sapiens
ctgcaagaaaaaaag

SEQ ID NO: 350668 - DNA, 15 bp, Homo sapiens
tgcaagaaaaaaagg

SEQ ID NO: 350669 - DNA, 15 bp, Homo sapiens
gcaagaaaaaaaggt

SEQ ID NO: 350670 - DNA, 15 bp, Homo sapiens
caagaaaaaaaggta

SEQ ID NO: 350671 - DNA, 15 bp, Homo sapiens
aagaaaaaaaggtaa

SEQ ID NO: 350672 - DNA, 15 bp, Homo sapiens
agaaaaaaaggtaac

SEQ ID NO: 350673 - DNA, 15 bp, Homo sapiens
gaaaaaaaggtaaca

SEQ ID NO: 350674 - DNA, 15 bp, Homo sapiens
aaaaaaaggtaacat

SEQ ID NO: 350675 - DNA, 15 bp, Homo sapiens
aaaaaaggtaacata

SEQ ID NO: 350676 - DNA, 15 bp, Homo sapiens
aaaaaggtaacatat

SEQ ID NO: 350677 - DNA, 15 bp, Homo sapiens
aaaaggtaacatata

SEQ ID NO: 350678 - DNA, 15 bp, Homo sapiens
aaaggtaacatatat

SEQ ID NO: 350679 - DNA, 15 bp, Homo sapiens
aaggtaacatatatc

SEQ ID NO: 350680 - DNA, 15 bp, Homo sapiens
aggtaacatatatct

SEQ ID NO: 350681 - DNA, 15 bp, Homo sapiens
ggtaacatatatctt

SEQ ID NO: 350682 - DNA, 15 bp, Homo sapiens
gtaacatatatcttc

SEQ ID NO: 350683 - DNA, 15 bp, Homo sapiens
taacatatatcttcc

SEQ ID NO: 350684 - DNA, 15 bp, Homo sapiens
aacatatatcttcca

SEQ ID NO: 350685 - DNA, 15 bp, Homo sapiens
acatatatcttccat

SEQ ID NO: 350686 - DNA, 15 bp, Homo sapiens
catatatcttccatg

SEQ ID NO: 350687 - DNA, 15 bp, Homo sapiens
atatatcttccatgt

SEQ ID NO: 350688 - DNA, 15 bp, Homo sapiens
tatatcttccatgtt

SEQ ID NO: 350689 - DNA, 15 bp, Homo sapiens
atatcttccatgtta

SEQ ID NO: 350690 - DNA, 15 bp, Homo sapiens
tatcttccatgttag

SEQ ID NO: 350691 - DNA, 15 bp, Homo sapiens
atcttccatgttaga

SEQ ID NO: 350692 - DNA, 15 bp, Homo sapiens
tcttccatgttagaa

SEQ ID NO: 350693 - DNA, 15 bp, Homo sapiens
cttccatgttagaac

SEQ ID NO: 350694 - DNA, 15 bp, Homo sapiens
ttccatgttagaact

SEQ ID NO: 350695 - DNA, 15 bp, Homo sapiens
tccatgttagaactc

SEQ ID NO: 350696 - DNA, 15 bp, Homo sapiens
ccatgttagaactct

SEQ ID NO: 350697 - DNA, 15 bp, Homo sapiens
catgttagaactcta

SEQ ID NO: 350698 - DNA, 15 bp, Homo sapiens
atgttagaactctag

SEQ ID NO: 350699 - DNA, 15 bp, Homo sapiens
tgttagaactctagc

SEQ ID NO: 350700 - DNA, 15 bp, Homo sapiens
gttagaactctagcg

SEQ ID NO: 350701 - DNA, 15 bp, Homo sapiens
ttagaactctagcgc

SEQ ID NO: 350702 - DNA, 15 bp, Homo sapiens
tagaactctagcgct

SEQ ID NO: 350703 - DNA, 15 bp, Homo sapiens
agaactctagcgctt

SEQ ID NO: 350704 - DNA, 15 bp, Homo sapiens
gaactctagcgcttc

SEQ ID NO: 350705 - DNA, 15 bp, Homo sapiens
aactctagcgcttct

SEQ ID NO: 350706 - DNA, 15 bp, Homo sapiens
actctagcgcttctt

SEQ ID NO: 350707 - DNA, 15 bp, Homo sapiens
ctctagcgcttcttc

SEQ ID NO: 350708 - DNA, 15 bp, Homo sapiens
tctagcgcttcttct

SEQ ID NO: 350709 - DNA, 15 bp, Homo sapiens
ctagcgcttcttcta

SEQ ID NO: 350710 - DNA, 15 bp, Homo sapiens
tagcgcttcttctaa

SEQ ID NO: 350711 - DNA, 15 bp, Homo sapiens
agcgcttcttctaat

SEQ ID NO: 350712 - DNA, 15 bp, Homo sapiens
gcgcttcttctaata

SEQ ID NO: 350713 - DNA, 15 bp, Homo sapiens
cgcttcttctaatat

SEQ ID NO: 350714 - DNA, 15 bp, Homo sapiens
gcttcttctaatatc

SEQ ID NO: 350715 - DNA, 15 bp, Homo sapiens
cttcttctaatatct

SEQ ID NO: 350716 - DNA, 15 bp, Homo sapiens
ttcttctaatatctc

SEQ ID NO: 350717 - DNA, 15 bp, Homo sapiens
tcttctaatatctcc

SEQ ID NO: 350718 - DNA, 15 bp, Homo sapiens
cttctaatatctcct

SEQ ID NO: 350719 - DNA, 15 bp, Homo sapiens
ttctaatatctcctc

SEQ ID NO: 350720 - DNA, 15 bp, Homo sapiens
tctaatatctcctct

SEQ ID NO: 350721 - DNA, 15 bp, Homo sapiens
ctaatatctcctctt

SEQ ID NO: 350722 - DNA, 15 bp, Homo sapiens
taatatctcctctta

SEQ ID NO: 350723 - DNA, 15 bp, Homo sapiens
aatatctcctcttac

SEQ ID NO: 350724 - DNA, 15 bp, Homo sapiens
atatctcctcttaca

SEQ ID NO: 350725 - DNA, 15 bp, Homo sapiens
tatctcctcttacat

SEQ ID NO: 350726 - DNA, 15 bp, Homo sapiens
atctcctcttacata

SEQ ID NO: 350727 - DNA, 15 bp, Homo sapiens
tctcctcttacatat

SEQ ID NO: 350728 - DNA, 15 bp, Homo sapiens
ctcctcttacatatt

SEQ ID NO: 350729 - DNA, 15 bp, Homo sapiens
tcctcttacatattt

SEQ ID NO: 350730 - DNA, 15 bp, Homo sapiens
cctcttacatatttt

SEQ ID NO: 350731 - DNA, 15 bp, Homo sapiens
ctcttacatattttg

SEQ ID NO: 350732 - DNA, 15 bp, Homo sapiens
tcttacatattttga

SEQ ID NO: 350733 - DNA, 15 bp, Homo sapiens
cttacatattttgaa

SEQ ID NO: 350734 - DNA, 15 bp, Homo sapiens
ttacatattttgaaa

SEQ ID NO: 350735 - DNA, 15 bp, Homo sapiens
tacatattttgaaat

SEQ ID NO: 350736 - DNA, 15 bp, Homo sapiens
acatattttgaaatg

SEQ ID NO: 350737 - DNA, 15 bp, Homo sapiens
catattttgaaatgt

SEQ ID NO: 350738 - DNA, 15 bp, Homo sapiens
atattttgaaatgtt

SEQ ID NO: 350739 - DNA, 15 bp, Homo sapiens
tattttgaaatgttt

SEQ ID NO: 350740 - DNA, 15 bp, Homo sapiens
attttgaaatgtttt

SEQ ID NO: 350741 - DNA, 15 bp, Homo sapiens
ttttgaaatgttttt

SEQ ID NO: 350742 - DNA, 15 bp, Homo sapiens
tttgaaatgtttttt

SEQ ID NO: 350743 - DNA, 15 bp, Homo sapiens
ttgaaatgttttttc

SEQ ID NO: 350744 - DNA, 15 bp, Homo sapiens
tgaaatgttttttca

SEQ ID NO: 350745 - DNA, 15 bp, Homo sapiens
gaaatgttttttcag

SEQ ID NO: 350746 - DNA, 15 bp, Homo sapiens
aaatgttttttcaga

SEQ ID NO: 350747 - DNA, 15 bp, Homo sapiens
aatgttttttcagag

SEQ ID NO: 350748 - DNA, 15 bp, Homo sapiens
atgttttttcagaga

SEQ ID NO: 350749 - DNA, 15 bp, Homo sapiens
tgttttttcagagat

SEQ ID NO: 350750 - DNA, 15 bp, Homo sapiens
gttttttcagagatt

SEQ ID NO: 350751 - DNA, 15 bp, Homo sapiens
ttttttcagagatta

SEQ ID NO: 350752 - DNA, 15 bp, Homo sapiens
tttttcagagattaa

SEQ ID NO: 350753 - DNA, 15 bp, Homo sapiens
cagagattaaaaaaa

SEQ ID NO: 350754 - DNA, 15 bp, Homo sapiens
agagattaaaaaaaa

SEQ ID NO: 350755 - DNA, 15 bp, Homo sapiens
gagattaaaaaaaaa

SEQ ID NO: 350756 - DNA, 15 bp, Homo sapiens
agattaaaaaaaaag

SEQ ID NO: 350757 - DNA, 15 bp, Homo sapiens
gattaaaaaaaaagt

SEQ ID NO: 350758 - DNA, 15 bp, Homo sapiens
attaaaaaaaaagtt

SEQ ID NO: 350759 - DNA, 15 bp, Homo sapiens
ttaaaaaaaaagttg

SEQ ID NO: 350760 - DNA, 15 bp, Homo sapiens
taaaaaaaaagttgg

SEQ ID NO: 350761 - DNA, 15 bp, Homo sapiens
aaaaaaaaagttggt

SEQ ID NO: 350762 - DNA, 15 bp, Homo sapiens
aaaaaaaagttggtc

SEQ ID NO: 350763 - DNA, 15 bp, Homo sapiens
aaaaaaagttggtca

SEQ ID NO: 350764 - DNA, 15 bp, Homo sapiens
aaaaaagttggtcag

SEQ ID NO: 350765 - DNA, 15 bp, Homo sapiens
aaaaagttggtcagt

SEQ ID NO: 350766 - DNA, 15 bp, Homo sapiens
aaaagttggtcagtt

SEQ ID NO: 350767 - DNA, 15 bp, Homo sapiens
aaagttggtcagttt

SEQ ID NO: 350768 - DNA, 15 bp, Homo sapiens
aagttggtcagtttt

SEQ ID NO: 350769 - DNA, 15 bp, Homo sapiens
agttggtcagttttg

SEQ ID NO: 350770 - DNA, 15 bp, Homo sapiens
gttggtcagttttgt

SEQ ID NO: 350771 - DNA, 15 bp, Homo sapiens
ttggtcagttttgtt

SEQ ID NO: 350772 - DNA, 15 bp, Homo sapiens
tggtcagttttgttc

SEQ ID NO: 350773 - DNA, 15 bp, Homo sapiens
ggtcagttttgttca

SEQ ID NO: 350774 - DNA, 15 bp, Homo sapiens
gtcagttttgttcat

SEQ ID NO: 350775 - DNA, 15 bp, Homo sapiens
tcagttttgttcatc

SEQ ID NO: 350776 - DNA, 15 bp, Homo sapiens
cagttttgttcatca

SEQ ID NO: 350777 - DNA, 15 bp, Homo sapiens
agttttgttcatcat

SEQ ID NO: 350778 - DNA, 15 bp, Homo sapiens
gttttgttcatcatt

SEQ ID NO: 350779 - DNA, 15 bp, Homo sapiens
ttttgttcatcattg

SEQ ID NO: 350780 - DNA, 15 bp, Homo sapiens
tttgttcatcattgg

SEQ ID NO: 350781 - DNA, 15 bp, Homo sapiens
ttgttcatcattggt

SEQ ID NO: 350782 - DNA, 15 bp, Homo sapiens
tgttcatcattggtg

SEQ ID NO: 350783 - DNA, 15 bp, Homo sapiens
gttcatcattggtgc

SEQ ID NO: 350784 - DNA, 15 bp, Homo sapiens
ttcatcattggtgca

SEQ ID NO: 350785 - DNA, 15 bp, Homo sapiens
tcatcattggtgcaa

SEQ ID NO: 350786 - DNA, 15 bp, Homo sapiens
catcattggtgcaaa

SEQ ID NO: 350787 - DNA, 15 bp, Homo sapiens
atcattggtgcaaaa

SEQ ID NO: 350788 - DNA, 15 bp, Homo sapiens
tcattggtgcaaaaa

SEQ ID NO: 350789 - DNA, 15 bp, Homo sapiens
cattggtgcaaaaat

SEQ ID NO: 350790 - DNA, 15 bp, Homo sapiens
attggtgcaaaaatg

SEQ ID NO: 350791 - DNA, 15 bp, Homo sapiens
ttggtgcaaaaatgt

SEQ ID NO: 350792 - DNA, 15 bp, Homo sapiens
tggtgcaaaaatgtg

SEQ ID NO: 350793 - DNA, 15 bp, Homo sapiens
ggtgcaaaaatgtgt

SEQ ID NO: 350794 - DNA, 15 bp, Homo sapiens
gtgcaaaaatgtgtt

SEQ ID NO: 350795 - DNA, 15 bp, Homo sapiens
tgcaaaaatgtgttt

SEQ ID NO: 350796 - DNA, 15 bp, Homo sapiens
gcaaaaatgtgttta

SEQ ID NO: 350797 - DNA, 15 bp, Homo sapiens
caaaaatgtgtttat

SEQ ID NO: 350798 - DNA, 15 bp, Homo sapiens
aaaaatgtgtttatg

SEQ ID NO: 350799 - DNA, 15 bp, Homo sapiens
aaaatgtgtttatga

SEQ ID NO: 350800 - DNA, 15 bp, Homo sapiens
aaatgtgtttatgat

SEQ ID NO: 350801 - DNA, 15 bp, Homo sapiens
aatgtgtttatgatt

SEQ ID NO: 350802 - DNA, 15 bp, Homo sapiens
atgtgtttatgattt

SEQ ID NO: 350803 - DNA, 15 bp, Homo sapiens
tgtgtttatgatttg

SEQ ID NO: 350804 - DNA, 15 bp, Homo sapiens
gtgtttatgatttga

SEQ ID NO: 350805 - DNA, 15 bp, Homo sapiens
tgtttatgatttgag

SEQ ID NO: 350806 - DNA, 15 bp, Homo sapiens
gtttatgatttgagg

SEQ ID NO: 350807 - DNA, 15 bp, Homo sapiens
tttatgatttgaggg

SEQ ID NO: 350808 - DNA, 15 bp, Homo sapiens
ttatgatttgagggt

SEQ ID NO: 350809 - DNA, 15 bp, Homo sapiens
tatgatttgagggtt

SEQ ID NO: 350810 - DNA, 15 bp, Homo sapiens
atgatttgagggtta

SEQ ID NO: 350811 - DNA, 15 bp, Homo sapiens
tgatttgagggttag

SEQ ID NO: 350812 - DNA, 15 bp, Homo sapiens
gatttgagggttagt

SEQ ID NO: 350813 - DNA, 15 bp, Homo sapiens
atttgagggttagtt

SEQ ID NO: 350814 - DNA, 15 bp, Homo sapiens
tttgagggttagttt

SEQ ID NO: 350815 - DNA, 15 bp, Homo sapiens
ttgagggttagtttg

SEQ ID NO: 350816 - DNA, 15 bp, Homo sapiens
tgagggttagtttga

SEQ ID NO: 350817 - DNA, 15 bp, Homo sapiens
gagggttagtttgac

SEQ ID NO: 350818 - DNA, 15 bp, Homo sapiens
agggttagtttgacc

SEQ ID NO: 350819 - DNA, 15 bp, Homo sapiens
gggttagtttgacct

SEQ ID NO: 350820 - DNA, 15 bp, Homo sapiens
ggttagtttgacctc

SEQ ID NO: 350821 - DNA, 15 bp, Homo sapiens
gttagtttgacctca

SEQ ID NO: 350822 - DNA, 15 bp, Homo sapiens
ttagtttgacctcac

SEQ ID NO: 350823 - DNA, 15 bp, Homo sapiens
tagtttgacctcaca

SEQ ID NO: 350824 - DNA, 15 bp, Homo sapiens
agtttgacctcacat

SEQ ID NO: 350825 - DNA, 15 bp, Homo sapiens
gtttgacctcacata

SEQ ID NO: 350826 - DNA, 15 bp, Homo sapiens
tttgacctcacataa

SEQ ID NO: 350827 - DNA, 15 bp, Homo sapiens
ttgacctcacataaa

SEQ ID NO: 350828 - DNA, 15 bp, Homo sapiens
tgacctcacataaaa

SEQ ID NO: 350829 - DNA, 15 bp, Homo sapiens
gacctcacataaaag

SEQ ID NO: 350830 - DNA, 15 bp, Homo sapiens
acctcacataaaaga

SEQ ID NO: 350831 - DNA, 15 bp, Homo sapiens
cctcacataaaagaa

SEQ ID NO: 350832 - DNA, 15 bp, Homo sapiens
ctcacataaaagaaa

SEQ ID NO: 350833 - DNA, 15 bp, Homo sapiens
tcacataaaagaaag

SEQ ID NO: 350834 - DNA, 15 bp, Homo sapiens
cacataaaagaaagt

SEQ ID NO: 350835 - DNA, 15 bp, Homo sapiens
acataaaagaaagta

SEQ ID NO: 350836 - DNA, 15 bp, Homo sapiens
cataaaagaaagtac

SEQ ID NO: 350837 - DNA, 15 bp, Homo sapiens
ataaaagaaagtaca

SEQ ID NO: 350838 - DNA, 15 bp, Homo sapiens
taaaagaaagtacag

SEQ ID NO: 350839 - DNA, 15 bp, Homo sapiens
aaaagaaagtacagt

SEQ ID NO: 350840 - DNA, 15 bp, Homo sapiens
aaagaaagtacagtt

SEQ ID NO: 350841 - DNA, 15 bp, Homo sapiens
aagaaagtacagtta

SEQ ID NO: 350842 - DNA, 15 bp, Homo sapiens
agaaagtacagttat

SEQ ID NO: 350843 - DNA, 15 bp, Homo sapiens
gaaagtacagttatt

SEQ ID NO: 350844 - DNA, 15 bp, Homo sapiens
aaagtacagttatta

SEQ ID NO: 350845 - DNA, 15 bp, Homo sapiens
aagtacagttattaa

SEQ ID NO: 350846 - DNA, 15 bp, Homo sapiens
agtacagttattaaa

SEQ ID NO: 350847 - DNA, 15 bp, Homo sapiens
gtacagttattaaaa

SEQ ID NO: 350848 - DNA, 15 bp, Homo sapiens
tacagttattaaaaa

SEQ ID NO: 350849 - DNA, 15 bp, Homo sapiens
acagttattaaaaat

SEQ ID NO: 350850 - DNA, 15 bp, Homo sapiens
cagttattaaaaatt

SEQ ID NO: 350851 - DNA, 15 bp, Homo sapiens
agttattaaaaattt

SEQ ID NO: 350852 - DNA, 15 bp, Homo sapiens
gttattaaaaatttt

SEQ ID NO: 350853 - DNA, 15 bp, Homo sapiens
ttattaaaaattttt

SEQ ID NO: 350854 - DNA, 15 bp, Homo sapiens
tattaaaaatttttt

SEQ ID NO: 350855 - DNA, 15 bp, Homo sapiens
attaaaaattttttc

SEQ ID NO: 350856 - DNA, 15 bp, Homo sapiens
ttaaaaattttttca

SEQ ID NO: 350857 - DNA, 15 bp, Homo sapiens
taaaaattttttcat

SEQ ID NO: 350858 - DNA, 15 bp, Homo sapiens
aaaaattttttcata

SEQ ID NO: 350859 - DNA, 15 bp, Homo sapiens
aaaattttttcatag

SEQ ID NO: 350860 - DNA, 15 bp, Homo sapiens
aaattttttcataga

SEQ ID NO: 350861 - DNA, 15 bp, Homo sapiens
aattttttcatagaa

SEQ ID NO: 350862 - DNA, 15 bp, Homo sapiens
attttttcatagaag

SEQ ID NO: 350863 - DNA, 15 bp, Homo sapiens
ttttttcatagaaga

SEQ ID NO: 350864 - DNA, 15 bp, Homo sapiens
tttttcatagaagaa

SEQ ID NO: 350865 - DNA, 15 bp, Homo sapiens
ttttcatagaagaaa

SEQ ID NO: 350866 - DNA, 15 bp, Homo sapiens
tttcatagaagaaaa

SEQ ID NO: 350867 - DNA, 15 bp, Homo sapiens
ttcatagaagaaaag

SEQ ID NO: 350868 - DNA, 15 bp, Homo sapiens
tcatagaagaaaagc

SEQ ID NO: 350869 - DNA, 15 bp, Homo sapiens
catagaagaaaagca

SEQ ID NO: 350870 - DNA, 15 bp, Homo sapiens
atagaagaaaagcat

SEQ ID NO: 350871 - DNA, 15 bp, Homo sapiens
tagaagaaaagcata

SEQ ID NO: 350872 - DNA, 15 bp, Homo sapiens
agaagaaaagcatat

SEQ ID NO: 350873 - DNA, 15 bp, Homo sapiens
gaagaaaagcatatt

SEQ ID NO: 350874 - DNA, 15 bp, Homo sapiens
aagaaaagcatattt

SEQ ID NO: 350875 - DNA, 15 bp, Homo sapiens
agaaaagcatatttt

SEQ ID NO: 350876 - DNA, 15 bp, Homo sapiens
gaaaagcatattttc

SEQ ID NO: 350877 - DNA, 15 bp, Homo sapiens
aaaagcatattttct

SEQ ID NO: 350878 - DNA, 15 bp, Homo sapiens
aaagcatattttctc

SEQ ID NO: 350879 - DNA, 15 bp, Homo sapiens
aagcatattttctcc

SEQ ID NO: 350880 - DNA, 15 bp, Homo sapiens
agcatattttctcct

SEQ ID NO: 350881 - DNA, 15 bp, Homo sapiens
gcatattttctcctt

SEQ ID NO: 350882 - DNA, 15 bp, Homo sapiens
catattttctccttc

SEQ ID NO: 350883 - DNA, 15 bp, Homo sapiens
atattttctccttct

SEQ ID NO: 350884 - DNA, 15 bp, Homo sapiens
tattttctccttctg

SEQ ID NO: 350885 - DNA, 15 bp, Homo sapiens
attttctccttctgc

SEQ ID NO: 350886 - DNA, 15 bp, Homo sapiens
ttttctccttctgct

SEQ ID NO: 350887 - DNA, 15 bp, Homo sapiens
tttctccttctgctg

SEQ ID NO: 350888 - DNA, 15 bp, Homo sapiens
ttctccttctgctgt

SEQ ID NO: 350889 - DNA, 15 bp, Homo sapiens
tctccttctgctgtg

SEQ ID NO: 350890 - DNA, 15 bp, Homo sapiens
ctccttctgctgtga

SEQ ID NO: 350891 - DNA, 15 bp, Homo sapiens
tccttctgctgtgat

SEQ ID NO: 350892 - DNA, 15 bp, Homo sapiens
ccttctgctgtgatt

SEQ ID NO: 350893 - DNA, 15 bp, Homo sapiens
cttctgctgtgatta

SEQ ID NO: 350894 - DNA, 15 bp, Homo sapiens
ttctgctgtgattag

SEQ ID NO: 350895 - DNA, 15 bp, Homo sapiens
tctgctgtgattagc

SEQ ID NO: 350896 - DNA, 15 bp, Homo sapiens
ctgctgtgattagct

SEQ ID NO: 350897 - DNA, 15 bp, Homo sapiens
tgctgtgattagctt

SEQ ID NO: 350898 - DNA, 15 bp, Homo sapiens
gctgtgattagctta

SEQ ID NO: 350899 - DNA, 15 bp, Homo sapiens
ctgtgattagcttaa

SEQ ID NO: 350900 - DNA, 15 bp, Homo sapiens
tgtgattagcttaaa

SEQ ID NO: 350901 - DNA, 15 bp, Homo sapiens
gtgattagcttaaaa

SEQ ID NO: 350902 - DNA, 15 bp, Homo sapiens
tgattagcttaaaat

SEQ ID NO: 350903 - DNA, 15 bp, Homo sapiens
gattagcttaaaatt

SEQ ID NO: 350904 - DNA, 15 bp, Homo sapiens
attagcttaaaattc

SEQ ID NO: 350905 - DNA, 15 bp, Homo sapiens
ttagcttaaaattct

SEQ ID NO: 350906 - DNA, 15 bp, Homo sapiens
tagcttaaaattctc

SEQ ID NO: 350907 - DNA, 15 bp, Homo sapiens
agcttaaaattctca

SEQ ID NO: 350908 - DNA, 15 bp, Homo sapiens
gcttaaaattctcaa

SEQ ID NO: 350909 - DNA, 15 bp, Homo sapiens
cttaaaattctcaac

SEQ ID NO: 350910 - DNA, 15 bp, Homo sapiens
ttaaaattctcaacc

SEQ ID NO: 350911 - DNA, 15 bp, Homo sapiens
taaaattctcaacct

SEQ ID NO: 350912 - DNA, 15 bp, Homo sapiens
aaaattctcaacctg

SEQ ID NO: 350913 - DNA, 15 bp, Homo sapiens
aaattctcaacctgt

SEQ ID NO: 350914 - DNA, 15 bp, Homo sapiens
aattctcaacctgtt

SEQ ID NO: 350915 - DNA, 15 bp, Homo sapiens
attctcaacctgttc

SEQ ID NO: 350916 - DNA, 15 bp, Homo sapiens
ttctcaacctgttca

SEQ ID NO: 350917 - DNA, 15 bp, Homo sapiens
tctcaacctgttcat

SEQ ID NO: 350918 - DNA, 15 bp, Homo sapiens
ctcaacctgttcata

SEQ ID NO: 350919 - DNA, 15 bp, Homo sapiens
tcaacctgttcataa

SEQ ID NO: 350920 - DNA, 15 bp, Homo sapiens
caacctgttcataaa

SEQ ID NO: 350921 - DNA, 15 bp, Homo sapiens
aacctgttcataaaa

SEQ ID NO: 350922 - DNA, 15 bp, Homo sapiens
acctgttcataaaat

SEQ ID NO: 350923 - DNA, 15 bp, Homo sapiens
cctgttcataaaatc

SEQ ID NO: 350924 - DNA, 15 bp, Homo sapiens
ctgttcataaaatct

SEQ ID NO: 350925 - DNA, 15 bp, Homo sapiens
tgttcataaaatctg

SEQ ID NO: 350926 - DNA, 15 bp, Homo sapiens
gttcataaaatctgc

SEQ ID NO: 350927 - DNA, 15 bp, Homo sapiens
ttcataaaatctgct

SEQ ID NO: 350928 - DNA, 15 bp, Homo sapiens
tcataaaatctgcta

SEQ ID NO: 350929 - DNA, 15 bp, Homo sapiens
cataaaatctgctaa

SEQ ID NO: 350930 - DNA, 15 bp, Homo sapiens
ataaaatctgctaaa

SEQ ID NO: 350931 - DNA, 15 bp, Homo sapiens
taaaatctgctaaaa

SEQ ID NO: 350932 - DNA, 15 bp, Homo sapiens
aaaatctgctaaaat

SEQ ID NO: 350933 - DNA, 15 bp, Homo sapiens
aaatctgctaaaata

SEQ ID NO: 350934 - DNA, 15 bp, Homo sapiens
aatctgctaaaatat

SEQ ID NO: 350935 - DNA, 15 bp, Homo sapiens
atctgctaaaatatc

SEQ ID NO: 350936 - DNA, 15 bp, Homo sapiens
tctgctaaaatatct

SEQ ID NO: 350937 - DNA, 15 bp, Homo sapiens
ctgctaaaatatctt

SEQ ID NO: 350938 - DNA, 15 bp, Homo sapiens
tgctaaaatatcttt

SEQ ID NO: 350939 - DNA, 15 bp, Homo sapiens
gctaaaatatcttta

SEQ ID NO: 350940 - DNA, 15 bp, Homo sapiens
ctaaaatatctttat

SEQ ID NO: 350941 - DNA, 15 bp, Homo sapiens
taaaatatctttatg

SEQ ID NO: 350942 - DNA, 15 bp, Homo sapiens
aaaatatctttatga

SEQ ID NO: 350943 - DNA, 15 bp, Homo sapiens
aaatatctttatgaa

SEQ ID NO: 350944 - DNA, 15 bp, Homo sapiens
aatatctttatgaaa

SEQ ID NO: 350945 - DNA, 15 bp, Homo sapiens
atatctttatgaaat

SEQ ID NO: 350946 - DNA, 15 bp, Homo sapiens
tatctttatgaaatg

SEQ ID NO: 350947 - DNA, 15 bp, Homo sapiens
atctttatgaaatga

SEQ ID NO: 350948 - DNA, 15 bp, Homo sapiens
tctttatgaaatgag

SEQ ID NO: 350949 - DNA, 15 bp, Homo sapiens
ctttatgaaatgagg

SEQ ID NO: 350950 - DNA, 15 bp, Homo sapiens
tttatgaaatgagga

SEQ ID NO: 350951 - DNA, 15 bp, Homo sapiens
ttatgaaatgaggac

SEQ ID NO: 350952 - DNA, 15 bp, Homo sapiens
tatgaaatgaggact

SEQ ID NO: 350953 - DNA, 15 bp, Homo sapiens
atgaaatgaggacta

SEQ ID NO: 350954 - DNA, 15 bp, Homo sapiens
tgaaatgaggactat

SEQ ID NO: 350955 - DNA, 15 bp, Homo sapiens
gaaatgaggactatc

SEQ ID NO: 350956 - DNA, 15 bp, Homo sapiens
aaatgaggactatca

SEQ ID NO: 350957 - DNA, 15 bp, Homo sapiens
aatgaggactatcag

SEQ ID NO: 350958 - DNA, 15 bp, Homo sapiens
atgaggactatcagt

SEQ ID NO: 350959 - DNA, 15 bp, Homo sapiens
tgaggactatcagtt

SEQ ID NO: 350960 - DNA, 15 bp, Homo sapiens
gaggactatcagttg

SEQ ID NO: 350961 - DNA, 15 bp, Homo sapiens
aggactatcagttga

SEQ ID NO: 350962 - DNA, 15 bp, Homo sapiens
ggactatcagttgac

SEQ ID NO: 350963 - DNA, 15 bp, Homo sapiens
gactatcagttgacg

SEQ ID NO: 350964 - DNA, 15 bp, Homo sapiens
actatcagttgacgt

SEQ ID NO: 350965 - DNA, 15 bp, Homo sapiens
ctatcagttgacgtg

SEQ ID NO: 350966 - DNA, 15 bp, Homo sapiens
tatcagttgacgtgt

SEQ ID NO: 350967 - DNA, 15 bp, Homo sapiens
atcagttgacgtgtt

SEQ ID NO: 350968 - DNA, 15 bp, Homo sapiens
tcagttgacgtgttg

SEQ ID NO: 350969 - DNA, 15 bp, Homo sapiens
cagttgacgtgttga

SEQ ID NO: 350970 - DNA, 15 bp, Homo sapiens
agttgacgtgttgat

SEQ ID NO: 350971 - DNA, 15 bp, Homo sapiens
gttgacgtgttgatg

SEQ ID NO: 350972 - DNA, 15 bp, Homo sapiens
ttgacgtgttgatgt

SEQ ID NO: 350973 - DNA, 15 bp, Homo sapiens
tgacgtgttgatgta

SEQ ID NO: 350974 - DNA, 15 bp, Homo sapiens
gacgtgttgatgtat

SEQ ID NO: 350975 - DNA, 15 bp, Homo sapiens
acgtgttgatgtata

SEQ ID NO: 350976 - DNA, 15 bp, Homo sapiens
cgtgttgatgtatac

SEQ ID NO: 350977 - DNA, 15 bp, Homo sapiens
gtgttgatgtatact

SEQ ID NO: 350978 - DNA, 15 bp, Homo sapiens
tgttgatgtatactt

SEQ ID NO: 350979 - DNA, 15 bp, Homo sapiens
gttgatgtatacttt

SEQ ID NO: 350980 - DNA, 15 bp, Homo sapiens
ttgatgtatactttt

SEQ ID NO: 350981 - DNA, 15 bp, Homo sapiens
tgatgtatacttttt

SEQ ID NO: 350982 - DNA, 15 bp, Homo sapiens
gatgtatactttttt

SEQ ID NO: 350983 - DNA, 15 bp, Homo sapiens
atgtatacttttttc

SEQ ID NO: 350984 - DNA, 15 bp, Homo sapiens
tgtatacttttttct

SEQ ID NO: 350985 - DNA, 15 bp, Homo sapiens
gtatacttttttctg

SEQ ID NO: 350986 - DNA, 15 bp, Homo sapiens
tatacttttttctgc

SEQ ID NO: 350987 - DNA, 15 bp, Homo sapiens
atacttttttctgca

SEQ ID NO: 350988 - DNA, 15 bp, Homo sapiens
tacttttttctgcat

SEQ ID NO: 350989 - DNA, 15 bp, Homo sapiens
acttttttctgcatc

SEQ ID NO: 350990 - DNA, 15 bp, Homo sapiens
cttttttctgcatcg

SEQ ID NO: 350991 - DNA, 15 bp, Homo sapiens
ttttttctgcatcga

SEQ ID NO: 350992 - DNA, 15 bp, Homo sapiens
tttttctgcatcgaa

SEQ ID NO: 350993 - DNA, 15 bp, Homo sapiens
ttttctgcatcgaat

SEQ ID NO: 350994 - DNA, 15 bp, Homo sapiens
tttctgcatcgaata

SEQ ID NO: 350995 - DNA, 15 bp, Homo sapiens
ttctgcatcgaatag

SEQ ID NO: 350996 - DNA, 15 bp, Homo sapiens
tctgcatcgaatagg

SEQ ID NO: 350997 - DNA, 15 bp, Homo sapiens
ctgcatcgaatagga

SEQ ID NO: 350998 - DNA, 15 bp, Homo sapiens
tgcatcgaataggaa

SEQ ID NO: 350999 - DNA, 15 bp, Homo sapiens
gcatcgaataggaat

SEQ ID NO: 351000 - DNA, 15 bp, Homo sapiens
catcgaataggaatg

SEQ ID NO: 351001 - DNA, 15 bp, Homo sapiens
atcgaataggaatgt

SEQ ID NO: 351002 - DNA, 15 bp, Homo sapiens
tcgaataggaatgtt

SEQ ID NO: 351003 - DNA, 15 bp, Homo sapiens
cgaataggaatgttt

SEQ ID NO: 351004 - DNA, 15 bp, Homo sapiens
gaataggaatgtttc

SEQ ID NO: 351005 - DNA, 15 bp, Homo sapiens
aataggaatgtttcc

SEQ ID NO: 351006 - DNA, 15 bp, Homo sapiens
ataggaatgtttccg

SEQ ID NO: 351007 - DNA, 15 bp, Homo sapiens
taggaatgtttccga

SEQ ID NO: 351008 - DNA, 15 bp, Homo sapiens
aggaatgtttccgag

SEQ ID NO: 351009 - DNA, 15 bp, Homo sapiens
ggaatgtttccgagg

SEQ ID NO: 351010 - DNA, 15 bp, Homo sapiens
gaatgtttccgaggt

SEQ ID NO: 351011 - DNA, 15 bp, Homo sapiens
aatgtttccgaggtc

SEQ ID NO: 351012 - DNA, 15 bp, Homo sapiens
atgtttccgaggtca

SEQ ID NO: 351013 - DNA, 15 bp, Homo sapiens
tgtttccgaggtcat

SEQ ID NO: 351014 - DNA, 15 bp, Homo sapiens
gtttccgaggtcatt

SEQ ID NO: 351015 - DNA, 15 bp, Homo sapiens
tttccgaggtcattt

SEQ ID NO: 351016 - DNA, 15 bp, Homo sapiens
ttccgaggtcattta

SEQ ID NO: 351017 - DNA, 15 bp, Homo sapiens
tccgaggtcatttag

SEQ ID NO: 351018 - DNA, 15 bp, Homo sapiens
ccgaggtcatttagt

SEQ ID NO: 351019 - DNA, 15 bp, Homo sapiens
cgaggtcatttagtt

SEQ ID NO: 351020 - DNA, 15 bp, Homo sapiens
gaggtcatttagttg

SEQ ID NO: 351021 - DNA, 15 bp, Homo sapiens
aggtcatttagttga

SEQ ID NO: 351022 - DNA, 15 bp, Homo sapiens
ggtcatttagttgag

SEQ ID NO: 351023 - DNA, 15 bp, Homo sapiens
gtcatttagttgagt

SEQ ID NO: 351024 - DNA, 15 bp, Homo sapiens
tcatttagttgagta

SEQ ID NO: 351025 - DNA, 15 bp, Homo sapiens
catttagttgagtag

SEQ ID NO: 351026 - DNA, 15 bp, Homo sapiens
atttagttgagtagc

SEQ ID NO: 351027 - DNA, 15 bp, Homo sapiens
tttagttgagtagcc

SEQ ID NO: 351028 - DNA, 15 bp, Homo sapiens
ttagttgagtagcct

SEQ ID NO: 351029 - DNA, 15 bp, Homo sapiens
tagttgagtagcctt

SEQ ID NO: 351030 - DNA, 15 bp, Homo sapiens
agttgagtagcctta

SEQ ID NO: 351031 - DNA, 15 bp, Homo sapiens
gttgagtagccttat

SEQ ID NO: 351032 - DNA, 15 bp, Homo sapiens
ttgagtagccttatg

SEQ ID NO: 351033 - DNA, 15 bp, Homo sapiens
tgagtagccttatgg

SEQ ID NO: 351034 - DNA, 15 bp, Homo sapiens
gagtagccttatggc

SEQ ID NO: 351035 - DNA, 15 bp, Homo sapiens
agtagccttatggct

SEQ ID NO: 351036 - DNA, 15 bp, Homo sapiens
gtagccttatggctc

SEQ ID NO: 351037 - DNA, 15 bp, Homo sapiens
tagccttatggctct

SEQ ID NO: 351038 - DNA, 15 bp, Homo sapiens
agccttatggctctg

SEQ ID NO: 351039 - DNA, 15 bp, Homo sapiens
gccttatggctctgt

SEQ ID NO: 351040 - DNA, 15 bp, Homo sapiens
ccttatggctctgtg

SEQ ID NO: 351041 - DNA, 15 bp, Homo sapiens
cttatggctctgtgc

SEQ ID NO: 351042 - DNA, 15 bp, Homo sapiens
ttatggctctgtgct

SEQ ID NO: 351043 - DNA, 15 bp, Homo sapiens
tatggctctgtgcta

SEQ ID NO: 351044 - DNA, 15 bp, Homo sapiens
atggctctgtgctat

SEQ ID NO: 351045 - DNA, 15 bp, Homo sapiens
tggctctgtgctatt

SEQ ID NO: 351046 - DNA, 15 bp, Homo sapiens
ggctctgtgctatta

SEQ ID NO: 351047 - DNA, 15 bp, Homo sapiens
gctctgtgctattag

SEQ ID NO: 351048 - DNA, 15 bp, Homo sapiens
ctctgtgctattaga

SEQ ID NO: 351049 - DNA, 15 bp, Homo sapiens
tctgtgctattagat

SEQ ID NO: 351050 - DNA, 15 bp, Homo sapiens
ctgtgctattagatg

SEQ ID NO: 351051 - DNA, 15 bp, Homo sapiens
tgtgctattagatga

SEQ ID NO: 351052 - DNA, 15 bp, Homo sapiens
gtgctattagatgaa

SEQ ID NO: 351053 - DNA, 15 bp, Homo sapiens
tgctattagatgaaa

SEQ ID NO: 351054 - DNA, 15 bp, Homo sapiens
gctattagatgaaaa

SEQ ID NO: 351055 - DNA, 15 bp, Homo sapiens
ctattagatgaaaag

SEQ ID NO: 351056 - DNA, 15 bp, Homo sapiens
tattagatgaaaagg

SEQ ID NO: 351057 - DNA, 15 bp, Homo sapiens
attagatgaaaagga

SEQ ID NO: 351058 - DNA, 15 bp, Homo sapiens
ttagatgaaaaggag

SEQ ID NO: 351059 - DNA, 15 bp, Homo sapiens
tagatgaaaaggaga

SEQ ID NO: 351060 - DNA, 15 bp, Homo sapiens
agatgaaaaggagag

SEQ ID NO: 351061 - DNA, 15 bp, Homo sapiens
gatgaaaaggagagc

SEQ ID NO: 351062 - DNA, 15 bp, Homo sapiens
atgaaaaggagagca

SEQ ID NO: 351063 - DNA, 15 bp, Homo sapiens
tgaaaaggagagcag

SEQ ID NO: 351064 - DNA, 15 bp, Homo sapiens
gaaaaggagagcagc

SEQ ID NO: 351065 - DNA, 15 bp, Homo sapiens
aaaaggagagcagcc

SEQ ID NO: 351066 - DNA, 15 bp, Homo sapiens
aaaggagagcagcca

SEQ ID NO: 351067 - DNA, 15 bp, Homo sapiens
aaggagagcagccat

SEQ ID NO: 351068 - DNA, 15 bp, Homo sapiens
aggagagcagccatt

SEQ ID NO: 351069 - DNA, 15 bp, Homo sapiens
ggagagcagccattg

SEQ ID NO: 351070 - DNA, 15 bp, Homo sapiens
gagagcagccattga

SEQ ID NO: 351071 - DNA, 15 bp, Homo sapiens
agagcagccattgag

SEQ ID NO: 351072 - DNA, 15 bp, Homo sapiens
gagcagccattgagc

SEQ ID NO: 351073 - DNA, 15 bp, Homo sapiens
agcagccattgagca

SEQ ID NO: 351074 - DNA, 15 bp, Homo sapiens
gcagccattgagcac

SEQ ID NO: 351075 - DNA, 15 bp, Homo sapiens
cagccattgagcact

SEQ ID NO: 351076 - DNA, 15 bp, Homo sapiens
agccattgagcactg

SEQ ID NO: 351077 - DNA, 15 bp, Homo sapiens
gccattgagcactgc

SEQ ID NO: 351078 - DNA, 15 bp, Homo sapiens
ccattgagcactgca

SEQ ID NO: 351079 - DNA, 15 bp, Homo sapiens
cattgagcactgcac

SEQ ID NO: 351080 - DNA, 15 bp, Homo sapiens
attgagcactgcaca

SEQ ID NO: 351081 - DNA, 15 bp, Homo sapiens
ttgagcactgcacac

SEQ ID NO: 351082 - DNA, 15 bp, Homo sapiens
tgagcactgcacact

SEQ ID NO: 351083 - DNA, 15 bp, Homo sapiens
gagcactgcacactt

SEQ ID NO: 351084 - DNA, 15 bp, Homo sapiens
agcactgcacacttg

SEQ ID NO: 351085 - DNA, 15 bp, Homo sapiens
gcactgcacacttgg

SEQ ID NO: 351086 - DNA, 15 bp, Homo sapiens
cactgcacacttggc

SEQ ID NO: 351087 - DNA, 15 bp, Homo sapiens
actgcacacttggcc

SEQ ID NO: 351088 - DNA, 15 bp, Homo sapiens
ctgcacacttggccc

SEQ ID NO: 351089 - DNA, 15 bp, Homo sapiens
tgcacacttggccca

SEQ ID NO: 351090 - DNA, 15 bp, Homo sapiens
gcacacttggcccac

SEQ ID NO: 351091 - DNA, 15 bp, Homo sapiens
cacacttggcccaca

SEQ ID NO: 351092 - DNA, 15 bp, Homo sapiens
acacttggcccacac

SEQ ID NO: 351093 - DNA, 15 bp, Homo sapiens
cacttggcccacact

SEQ ID NO: 351094 - DNA, 15 bp, Homo sapiens
acttggcccacactg

SEQ ID NO: 351095 - DNA, 15 bp, Homo sapiens
cttggcccacactgg

SEQ ID NO: 351096 - DNA, 15 bp, Homo sapiens
ttggcccacactggg

SEQ ID NO: 351097 - DNA, 15 bp, Homo sapiens
tggcccacactgggt

SEQ ID NO: 351098 - DNA, 15 bp, Homo sapiens
ggcccacactgggtt

SEQ ID NO: 351099 - DNA, 15 bp, Homo sapiens
gcccacactgggttt

SEQ ID NO: 351100 - DNA, 15 bp, Homo sapiens
cccacactgggtttg

SEQ ID NO: 351101 - DNA, 15 bp, Homo sapiens
ccacactgggtttgc

SEQ ID NO: 351102 - DNA, 15 bp, Homo sapiens
cacactgggtttgct

SEQ ID NO: 351103 - DNA, 15 bp, Homo sapiens
acactgggtttgctg

SEQ ID NO: 351104 - DNA, 15 bp, Homo sapiens
cactgggtttgctgt

SEQ ID NO: 351105 - DNA, 15 bp, Homo sapiens
actgggtttgctgtt

SEQ ID NO: 351106 - DNA, 15 bp, Homo sapiens
ctgggtttgctgttc

SEQ ID NO: 351107 - DNA, 15 bp, Homo sapiens
tgggtttgctgttcc

SEQ ID NO: 351108 - DNA, 15 bp, Homo sapiens
gggtttgctgttccc

SEQ ID NO: 351109 - DNA, 15 bp, Homo sapiens
ggtttgctgttccct

SEQ ID NO: 351110 - DNA, 15 bp, Homo sapiens
gtttgctgttccctt

SEQ ID NO: 351111 - DNA, 15 bp, Homo sapiens
tttgctgttcccttg

SEQ ID NO: 351112 - DNA, 15 bp, Homo sapiens
ttgctgttcccttgg

SEQ ID NO: 351113 - DNA, 15 bp, Homo sapiens
tgctgttcccttggt

SEQ ID NO: 351114 - DNA, 15 bp, Homo sapiens
gctgttcccttggtt

SEQ ID NO: 351115 - DNA, 15 bp, Homo sapiens
ctgttcccttggttt

SEQ ID NO: 351116 - DNA, 15 bp, Homo sapiens
tgttcccttggtttt

SEQ ID NO: 351117 - DNA, 15 bp, Homo sapiens
gttcccttggttttt

SEQ ID NO: 351118 - DNA, 15 bp, Homo sapiens
ttcccttggttttta

SEQ ID NO: 351119 - DNA, 15 bp, Homo sapiens
tcccttggtttttag

SEQ ID NO: 351120 - DNA, 15 bp, Homo sapiens
cccttggtttttagg

SEQ ID NO: 351121 - DNA, 15 bp, Homo sapiens
ccttggtttttaggg

SEQ ID NO: 351122 - DNA, 15 bp, Homo sapiens
cttggtttttagggt

SEQ ID NO: 351123 - DNA, 15 bp, Homo sapiens
ttggtttttagggtt

SEQ ID NO: 351124 - DNA, 15 bp, Homo sapiens
tggtttttagggttg

SEQ ID NO: 351125 - DNA, 15 bp, Homo sapiens
ggtttttagggttga

SEQ ID NO: 351126 - DNA, 15 bp, Homo sapiens
gtttttagggttgag

SEQ ID NO: 351127 - DNA, 15 bp, Homo sapiens
tttttagggttgaga

SEQ ID NO: 351128 - DNA, 15 bp, Homo sapiens
ttttagggttgagaa

SEQ ID NO: 351129 - DNA, 15 bp, Homo sapiens
tttagggttgagaat

SEQ ID NO: 351130 - DNA, 15 bp, Homo sapiens
ttagggttgagaata

SEQ ID NO: 351131 - DNA, 15 bp, Homo sapiens
tagggttgagaatac

SEQ ID NO: 351132 - DNA, 15 bp, Homo sapiens
agggttgagaataca

SEQ ID NO: 351133 - DNA, 15 bp, Homo sapiens
gggttgagaatacac

SEQ ID NO: 351134 - DNA, 15 bp, Homo sapiens
ggttgagaatacact

SEQ ID NO: 351135 - DNA, 15 bp, Homo sapiens
gttgagaatacactg

SEQ ID NO: 351136 - DNA, 15 bp, Homo sapiens
ttgagaatacactgt

SEQ ID NO: 351137 - DNA, 15 bp, Homo sapiens
tgagaatacactgta

SEQ ID NO: 351138 - DNA, 15 bp, Homo sapiens
gagaatacactgtat

SEQ ID NO: 351139 - DNA, 15 bp, Homo sapiens
agaatacactgtatt

SEQ ID NO: 351140 - DNA, 15 bp, Homo sapiens
gaatacactgtattg

SEQ ID NO: 351141 - DNA, 15 bp, Homo sapiens
aatacactgtattgc

SEQ ID NO: 351142 - DNA, 15 bp, Homo sapiens
atacactgtattgcc

SEQ ID NO: 351143 - DNA, 15 bp, Homo sapiens
tacactgtattgccc

SEQ ID NO: 351144 - DNA, 15 bp, Homo sapiens
acactgtattgccca

SEQ ID NO: 351145 - DNA, 15 bp, Homo sapiens
cactgtattgcccac

SEQ ID NO: 351146 - DNA, 15 bp, Homo sapiens
actgtattgcccaca

SEQ ID NO: 351147 - DNA, 15 bp, Homo sapiens
ctgtattgcccacac

SEQ ID NO: 351148 - DNA, 15 bp, Homo sapiens
tgtattgcccacaca

SEQ ID NO: 351149 - DNA, 15 bp, Homo sapiens
gtattgcccacacac

SEQ ID NO: 351150 - DNA, 15 bp, Homo sapiens
tattgcccacacaca

SEQ ID NO: 351151 - DNA, 15 bp, Homo sapiens
attgcccacacacaa

SEQ ID NO: 351152 - DNA, 15 bp, Homo sapiens
ttgcccacacacaac

SEQ ID NO: 351153 - DNA, 15 bp, Homo sapiens
tgcccacacacaact

SEQ ID NO: 351154 - DNA, 15 bp, Homo sapiens
gcccacacacaactc

SEQ ID NO: 351155 - DNA, 15 bp, Homo sapiens
cccacacacaactca

SEQ ID NO: 351156 - DNA, 15 bp, Homo sapiens
ccacacacaactcat

SEQ ID NO: 351157 - DNA, 15 bp, Homo sapiens
cacacacaactcatg

SEQ ID NO: 351158 - DNA, 15 bp, Homo sapiens
acacacaactcatga

SEQ ID NO: 351159 - DNA, 15 bp, Homo sapiens
cacacaactcatgaa

SEQ ID NO: 351160 - DNA, 15 bp, Homo sapiens
acacaactcatgaag

SEQ ID NO: 351161 - DNA, 15 bp, Homo sapiens
cacaactcatgaaga

SEQ ID NO: 351162 - DNA, 15 bp, Homo sapiens
acaactcatgaagaa

SEQ ID NO: 351163 - DNA, 15 bp, Homo sapiens
caactcatgaagaaa

SEQ ID NO: 351164 - DNA, 15 bp, Homo sapiens
aactcatgaagaaaa

SEQ ID NO: 351165 - DNA, 15 bp, Homo sapiens
actcatgaagaaaaa

SEQ ID NO: 351166 - DNA, 15 bp, Homo sapiens
ctcatgaagaaaaag

SEQ ID NO: 351167 - DNA, 15 bp, Homo sapiens
tcatgaagaaaaagc

SEQ ID NO: 351168 - DNA, 15 bp, Homo sapiens
catgaagaaaaagct

SEQ ID NO: 351169 - DNA, 15 bp, Homo sapiens
atgaagaaaaagctt

SEQ ID NO: 351170 - DNA, 15 bp, Homo sapiens
tgaagaaaaagcttt

SEQ ID NO: 351171 - DNA, 15 bp, Homo sapiens
gaagaaaaagcttta

SEQ ID NO: 351172 - DNA, 15 bp, Homo sapiens
aagaaaaagctttaa

SEQ ID NO: 351173 - DNA, 15 bp, Homo sapiens
agaaaaagctttaat

SEQ ID NO: 351174 - DNA, 15 bp, Homo sapiens
gaaaaagctttaatt

SEQ ID NO: 351175 - DNA, 15 bp, Homo sapiens
aaaaagctttaattt

SEQ ID NO: 351176 - DNA, 15 bp, Homo sapiens
aaaagctttaatttt

SEQ ID NO: 351177 - DNA, 15 bp, Homo sapiens
aaagctttaattttt

SEQ ID NO: 351178 - DNA, 15 bp, Homo sapiens
aagctttaattttta

SEQ ID NO: 351179 - DNA, 15 bp, Homo sapiens
agctttaatttttat

SEQ ID NO: 351180 - DNA, 15 bp, Homo sapiens
gctttaatttttatg

SEQ ID NO: 351181 - DNA, 15 bp, Homo sapiens
ctttaatttttatga

SEQ ID NO: 351182 - DNA, 15 bp, Homo sapiens
tttaatttttatgat

SEQ ID NO: 351183 - DNA, 15 bp, Homo sapiens
ttaatttttatgatt

SEQ ID NO: 351184 - DNA, 15 bp, Homo sapiens
taatttttatgatta

SEQ ID NO: 351185 - DNA, 15 bp, Homo sapiens
aatttttatgattat

SEQ ID NO: 351186 - DNA, 15 bp, Homo sapiens
atttttatgattatg

SEQ ID NO: 351187 - DNA, 15 bp, Homo sapiens
tttttatgattatgc

SEQ ID NO: 351188 - DNA, 15 bp, Homo sapiens
ttttatgattatgcc

SEQ ID NO: 351189 - DNA, 15 bp, Homo sapiens
tttatgattatgcct

SEQ ID NO: 351190 - DNA, 15 bp, Homo sapiens
ttatgattatgccta

SEQ ID NO: 351191 - DNA, 15 bp, Homo sapiens
tatgattatgcctat

SEQ ID NO: 351192 - DNA, 15 bp, Homo sapiens
atgattatgcctatt

SEQ ID NO: 351193 - DNA, 15 bp, Homo sapiens
tgattatgcctattt

SEQ ID NO: 351194 - DNA, 15 bp, Homo sapiens
gattatgcctatttt

SEQ ID NO: 351195 - DNA, 15 bp, Homo sapiens
attatgcctattttt

SEQ ID NO: 351196 - DNA, 15 bp, Homo sapiens
ttatgcctatttttt

SEQ ID NO: 351197 - DNA, 15 bp, Homo sapiens
tatgcctattttttt

SEQ ID NO: 351198 - DNA, 15 bp, Homo sapiens
atgcctatttttttc

SEQ ID NO: 351199 - DNA, 15 bp, Homo sapiens
tgcctatttttttca

SEQ ID NO: 351200 - DNA, 15 bp, Homo sapiens
gcctatttttttcat

SEQ ID NO: 351201 - DNA, 15 bp, Homo sapiens
cctatttttttcatg

SEQ ID NO: 351202 - DNA, 15 bp, Homo sapiens
ctatttttttcatga

SEQ ID NO: 351203 - DNA, 15 bp, Homo sapiens
tatttttttcatgag

SEQ ID NO: 351204 - DNA, 15 bp, Homo sapiens
atttttttcatgagt

SEQ ID NO: 351205 - DNA, 15 bp, Homo sapiens
tttttttcatgagtt

SEQ ID NO: 351206 - DNA, 15 bp, Homo sapiens
ttttttcatgagttt

SEQ ID NO: 351207 - DNA, 15 bp, Homo sapiens
tttttcatgagtttt

SEQ ID NO: 351208 - DNA, 15 bp, Homo sapiens
ttttcatgagttttt

SEQ ID NO: 351209 - DNA, 15 bp, Homo sapiens
tttcatgagtttttc

SEQ ID NO: 351210 - DNA, 15 bp, Homo sapiens
ttcatgagtttttca

SEQ ID NO: 351211 - DNA, 15 bp, Homo sapiens
tcatgagtttttcat

SEQ ID NO: 351212 - DNA, 15 bp, Homo sapiens
catgagtttttcatg

SEQ ID NO: 351213 - DNA, 15 bp, Homo sapiens
atgagtttttcatgt

SEQ ID NO: 351214 - DNA, 15 bp, Homo sapiens
tgagtttttcatgtt

SEQ ID NO: 351215 - DNA, 15 bp, Homo sapiens
gagtttttcatgttt

SEQ ID NO: 351216 - DNA, 15 bp, Homo sapiens
agtttttcatgtttt

SEQ ID NO: 351217 - DNA, 15 bp, Homo sapiens
gtttttcatgttttg

SEQ ID NO: 351218 - DNA, 15 bp, Homo sapiens
tttttcatgttttgt

SEQ ID NO: 351219 - DNA, 15 bp, Homo sapiens
ttttcatgttttgtt

SEQ ID NO: 351220 - DNA, 15 bp, Homo sapiens
tttcatgttttgttt

SEQ ID NO: 351221 - DNA, 15 bp, Homo sapiens
ttcatgttttgtttt

SEQ ID NO: 351222 - DNA, 15 bp, Homo sapiens
tcatgttttgttttg

SEQ ID NO: 351223 - DNA, 15 bp, Homo sapiens
catgttttgttttgt

SEQ ID NO: 351224 - DNA, 15 bp, Homo sapiens
atgttttgttttgtt

SEQ ID NO: 351225 - DNA, 15 bp, Homo sapiens
tgttttgttttgttt

SEQ ID NO: 351226 - DNA, 15 bp, Homo sapiens
gttttgttttgtttt

SEQ ID NO: 351227 - DNA, 15 bp, Homo sapiens
ttttgttttgttttg

SEQ ID NO: 351228 - DNA, 15 bp, Homo sapiens
tttgttttgttttgt

SEQ ID NO: 351229 - DNA, 15 bp, Homo sapiens
ttgttttgttttgtt

SEQ ID NO: 351230 - DNA, 15 bp, Homo sapiens
ttttgttttgttttt

SEQ ID NO: 351231 - DNA, 15 bp, Homo sapiens
gttttgttttttgat

SEQ ID NO: 351232 - DNA, 15 bp, Homo sapiens
ttttgttttttgatt

SEQ ID NO: 351233 - DNA, 15 bp, Homo sapiens
tttgttttttgattt

SEQ ID NO: 351234 - DNA, 15 bp, Homo sapiens
ttgttttttgatttc

SEQ ID NO: 351235 - DNA, 15 bp, Homo sapiens
tgttttttgatttcc

SEQ ID NO: 351236 - DNA, 15 bp, Homo sapiens
gttttttgatttcca

SEQ ID NO: 351237 - DNA, 15 bp, Homo sapiens
ttttttgatttccaa

SEQ ID NO: 351238 - DNA, 15 bp, Homo sapiens
tttttgatttccaac

SEQ ID NO: 351239 - DNA, 15 bp, Homo sapiens
ttttgatttccaact

SEQ ID NO: 351240 - DNA, 15 bp, Homo sapiens
tttgatttccaactt

SEQ ID NO: 351241 - DNA, 15 bp, Homo sapiens
ttgatttccaacttt

SEQ ID NO: 351242 - DNA, 15 bp, Homo sapiens
tgatttccaactttt

SEQ ID NO: 351243 - DNA, 15 bp, Homo sapiens
gatttccaactttta

SEQ ID NO: 351244 - DNA, 15 bp, Homo sapiens
atttccaacttttat

SEQ ID NO: 351245 - DNA, 15 bp, Homo sapiens
tttccaacttttatt

SEQ ID NO: 351246 - DNA, 15 bp, Homo sapiens
ttccaacttttattt

SEQ ID NO: 351247 - DNA, 15 bp, Homo sapiens
tccaacttttatttt

SEQ ID NO: 351248 - DNA, 15 bp, Homo sapiens
ccaacttttatttta

SEQ ID NO: 351249 - DNA, 15 bp, Homo sapiens
caacttttattttaa

SEQ ID NO: 351250 - DNA, 15 bp, Homo sapiens
ttttattttaagttc

SEQ ID NO: 351251 - DNA, 15 bp, Homo sapiens
tttattttaagttca

SEQ ID NO: 351252 - DNA, 15 bp, Homo sapiens
ttattttaagttcag

SEQ ID NO: 351253 - DNA, 15 bp, Homo sapiens
tattttaagttcagg

SEQ ID NO: 351254 - DNA, 15 bp, Homo sapiens
attttaagttcaggg

SEQ ID NO: 351255 - DNA, 15 bp, Homo sapiens
ttttaagttcagggg

SEQ ID NO: 351256 - DNA, 15 bp, Homo sapiens
tttaagttcaggggt

SEQ ID NO: 351257 - DNA, 15 bp, Homo sapiens
ttaagttcaggggta

SEQ ID NO: 351258 - DNA, 15 bp, Homo sapiens
taagttcaggggtac

SEQ ID NO: 351259 - DNA, 15 bp, Homo sapiens
aagttcaggggtact

SEQ ID NO: 351260 - DNA, 15 bp, Homo sapiens
agttcaggggtactt

SEQ ID NO: 351261 - DNA, 15 bp, Homo sapiens
gttcaggggtacttg

SEQ ID NO: 351262 - DNA, 15 bp, Homo sapiens
ttcaggggtacttgt

SEQ ID NO: 351263 - DNA, 15 bp, Homo sapiens
tcaggggtacttgtg

SEQ ID NO: 351264 - DNA, 15 bp, Homo sapiens
caggggtacttgtgc

SEQ ID NO: 351265 - DNA, 15 bp, Homo sapiens
aggggtacttgtgca

SEQ ID NO: 351266 - DNA, 15 bp, Homo sapiens
ggggtacttgtgcag

SEQ ID NO: 351267 - DNA, 15 bp, Homo sapiens
gggtacttgtgcagg

SEQ ID NO: 351268 - DNA, 15 bp, Homo sapiens
ggtacttgtgcagga

SEQ ID NO: 351269 - DNA, 15 bp, Homo sapiens
gtacttgtgcaggat

SEQ ID NO: 351270 - DNA, 15 bp, Homo sapiens
tacttgtgcaggatg

SEQ ID NO: 351271 - DNA, 15 bp, Homo sapiens
acttgtgcaggatgt

SEQ ID NO: 351272 - DNA, 15 bp, Homo sapiens
cttgtgcaggatgtg

SEQ ID NO: 351273 - DNA, 15 bp, Homo sapiens
ttgtgcaggatgtgc

SEQ ID NO: 351274 - DNA, 15 bp, Homo sapiens
tgtgcaggatgtgca

SEQ ID NO: 351275 - DNA, 15 bp, Homo sapiens
gtgcaggatgtgcag

SEQ ID NO: 351276 - DNA, 15 bp, Homo sapiens
tgcaggatgtgcagg

SEQ ID NO: 351277 - DNA, 15 bp, Homo sapiens
gcaggatgtgcaggt

SEQ ID NO: 351278 - DNA, 15 bp, Homo sapiens
caggatgtgcaggtt

SEQ ID NO: 351279 - DNA, 15 bp, Homo sapiens
aggatgtgcaggttt

SEQ ID NO: 351280 - DNA, 15 bp, Homo sapiens
ggatgtgcaggtttg

SEQ ID NO: 351281 - DNA, 15 bp, Homo sapiens
gatgtgcaggtttgt

SEQ ID NO: 351282 - DNA, 15 bp, Homo sapiens
atgtgcaggtttgtt

SEQ ID NO: 351283 - DNA, 15 bp, Homo sapiens
gtgcaggtttgttaa

SEQ ID NO: 351284 - DNA, 15 bp, Homo sapiens
tgcaggtttgttaaa

SEQ ID NO: 351285 - DNA, 15 bp, Homo sapiens
gcaggtttgttaaat

SEQ ID NO: 351286 - DNA, 15 bp, Homo sapiens
caggtttgttaaatg

SEQ ID NO: 351287 - DNA, 15 bp, Homo sapiens
aggtttgttaaatgg

SEQ ID NO: 351288 - DNA, 15 bp, Homo sapiens
ggtttgttaaatggg

SEQ ID NO: 351289 - DNA, 15 bp, Homo sapiens
gtttgttaaatgggt

SEQ ID NO: 351290 - DNA, 15 bp, Homo sapiens
tttgttaaatgggta

SEQ ID NO: 351291 - DNA, 15 bp, Homo sapiens
ttgttaaatgggtaa

SEQ ID NO: 351292 - DNA, 15 bp, Homo sapiens
tgttaaatgggtaaa

SEQ ID NO: 351293 - DNA, 15 bp, Homo sapiens
gttaaatgggtaaac

SEQ ID NO: 351294 - DNA, 15 bp, Homo sapiens
ttaaatgggtaaacg

SEQ ID NO: 351295 - DNA, 15 bp, Homo sapiens
taaatgggtaaacgt

SEQ ID NO: 351296 - DNA, 15 bp, Homo sapiens
aaatgggtaaacgtg

SEQ ID NO: 351297 - DNA, 15 bp, Homo sapiens
aatgggtaaacgtgt

SEQ ID NO: 351298 - DNA, 15 bp, Homo sapiens
atgggtaaacgtgtg

SEQ ID NO: 351299 - DNA, 15 bp, Homo sapiens
tgggtaaacgtgtgt

SEQ ID NO: 351300 - DNA, 15 bp, Homo sapiens
gggtaaacgtgtgtc

SEQ ID NO: 351301 - DNA, 15 bp, Homo sapiens
ggtaaacgtgtgtca

SEQ ID NO: 351302 - DNA, 15 bp, Homo sapiens
gtaaacgtgtgtcat

SEQ ID NO: 351303 - DNA, 15 bp, Homo sapiens
taaacgtgtgtcatg

SEQ ID NO: 351304 - DNA, 15 bp, Homo sapiens
aaacgtgtgtcatgg

SEQ ID NO: 351305 - DNA, 15 bp, Homo sapiens
aacgtgtgtcatggt

SEQ ID NO: 351306 - DNA, 15 bp, Homo sapiens
acgtgtgtcatggta

SEQ ID NO: 351307 - DNA, 15 bp, Homo sapiens
cgtgtgtcatggtag

SEQ ID NO: 351308 - DNA, 15 bp, Homo sapiens
gtgtgtcatggtagt

SEQ ID NO: 351309 - DNA, 15 bp, Homo sapiens
tgtgtcatggtagtt

SEQ ID NO: 351310 - DNA, 15 bp, Homo sapiens
gtgtcatggtagttt

SEQ ID NO: 351311 - DNA, 15 bp, Homo sapiens
tgtcatggtagtttg

SEQ ID NO: 351312 - DNA, 15 bp, Homo sapiens
gtcatggtagtttgc

SEQ ID NO: 351313 - DNA, 15 bp, Homo sapiens
tcatggtagtttgct

SEQ ID NO: 351314 - DNA, 15 bp, Homo sapiens
catggtagtttgctg

SEQ ID NO: 351315 - DNA, 15 bp, Homo sapiens
atggtagtttgctgc

SEQ ID NO: 351316 - DNA, 15 bp, Homo sapiens
tggtagtttgctgca

SEQ ID NO: 351317 - DNA, 15 bp, Homo sapiens
ggtagtttgctgcac

SEQ ID NO: 351318 - DNA, 15 bp, Homo sapiens
gtagtttgctgcact

SEQ ID NO: 351319 - DNA, 15 bp, Homo sapiens
tagtttgctgcacta

SEQ ID NO: 351320 - DNA, 15 bp, Homo sapiens
agtttgctgcactac

SEQ ID NO: 351321 - DNA, 15 bp, Homo sapiens
gtttgctgcactacg

SEQ ID NO: 351322 - DNA, 15 bp, Homo sapiens
tttgctgcactacgt

SEQ ID NO: 351323 - DNA, 15 bp, Homo sapiens
ttgctgcactacgta

SEQ ID NO: 351324 - DNA, 15 bp, Homo sapiens
tgctgcactacgtat

SEQ ID NO: 351325 - DNA, 15 bp, Homo sapiens
gctgcactacgtatt

SEQ ID NO: 351326 - DNA, 15 bp, Homo sapiens
ctgcactacgtatta

SEQ ID NO: 351327 - DNA, 15 bp, Homo sapiens
tgcactacgtattaa

SEQ ID NO: 351328 - DNA, 15 bp, Homo sapiens
gcactacgtattaag

SEQ ID NO: 351329 - DNA, 15 bp, Homo sapiens
cactacgtattaagc

SEQ ID NO: 351330 - DNA, 15 bp, Homo sapiens
actacgtattaagcc

SEQ ID NO: 351331 - DNA, 15 bp, Homo sapiens
ctacgtattaagccc

SEQ ID NO: 351332 - DNA, 15 bp, Homo sapiens
tacgtattaagccca

SEQ ID NO: 351333 - DNA, 15 bp, Homo sapiens
acgtattaagcccag

SEQ ID NO: 351334 - DNA, 15 bp, Homo sapiens
cgtattaagcccagc

SEQ ID NO: 351335 - DNA, 15 bp, Homo sapiens
gtattaagcccagca

SEQ ID NO: 351336 - DNA, 15 bp, Homo sapiens
tattaagcccagcat

SEQ ID NO: 351337 - DNA, 15 bp, Homo sapiens
attaagcccagcatc

SEQ ID NO: 351338 - DNA, 15 bp, Homo sapiens
ttaagcccagcatcc

SEQ ID NO: 351339 - DNA, 15 bp, Homo sapiens
taagcccagcatcca

SEQ ID NO: 351340 - DNA, 15 bp, Homo sapiens
aagcccagcatccat

SEQ ID NO: 351341 - DNA, 15 bp, Homo sapiens
agcccagcatccatt

SEQ ID NO: 351342 - DNA, 15 bp, Homo sapiens
gcccagcatccatta

SEQ ID NO: 351343 - DNA, 15 bp, Homo sapiens
cccagcatccattag

SEQ ID NO: 351344 - DNA, 15 bp, Homo sapiens
ccagcatccattagc

SEQ ID NO: 351345 - DNA, 15 bp, Homo sapiens
cagcatccattagct

SEQ ID NO: 351346 - DNA, 15 bp, Homo sapiens
agcatccattagctc

SEQ ID NO: 351347 - DNA, 15 bp, Homo sapiens
gcatccattagctct

SEQ ID NO: 351348 - DNA, 15 bp, Homo sapiens
catccattagctctt

SEQ ID NO: 351349 - DNA, 15 bp, Homo sapiens
atccattagctcttc

SEQ ID NO: 351350 - DNA, 15 bp, Homo sapiens
tccattagctcttct

SEQ ID NO: 351351 - DNA, 15 bp, Homo sapiens
ccattagctcttctt

SEQ ID NO: 351352 - DNA, 15 bp, Homo sapiens
cattagctcttcttc

SEQ ID NO: 351353 - DNA, 15 bp, Homo sapiens
attagctcttcttcc

SEQ ID NO: 351354 - DNA, 15 bp, Homo sapiens
ttagctcttcttcct

SEQ ID NO: 351355 - DNA, 15 bp, Homo sapiens
tagctcttcttcctg

SEQ ID NO: 351356 - DNA, 15 bp, Homo sapiens
agctcttcttcctga

SEQ ID NO: 351357 - DNA, 15 bp, Homo sapiens
gctcttcttcctgat

SEQ ID NO: 351358 - DNA, 15 bp, Homo sapiens
ctcttcttcctgatg

SEQ ID NO: 351359 - DNA, 15 bp, Homo sapiens
tcttcttcctgatgc

SEQ ID NO: 351360 - DNA, 15 bp, Homo sapiens
cttcttcctgatgct

SEQ ID NO: 351361 - DNA, 15 bp, Homo sapiens
ttcttcctgatgctt

SEQ ID NO: 351362 - DNA, 15 bp, Homo sapiens
tcttcctgatgcttt

SEQ ID NO: 351363 - DNA, 15 bp, Homo sapiens
cttcctgatgctttc

SEQ ID NO: 351364 - DNA, 15 bp, Homo sapiens
ttcctgatgctttcc

SEQ ID NO: 351365 - DNA, 15 bp, Homo sapiens
tcctgatgctttccc

SEQ ID NO: 351366 - DNA, 15 bp, Homo sapiens
cctgatgctttccct

SEQ ID NO: 351367 - DNA, 15 bp, Homo sapiens
ctgatgctttccctc

SEQ ID NO: 351368 - DNA, 15 bp, Homo sapiens
tgatgctttccctcc

SEQ ID NO: 351369 - DNA, 15 bp, Homo sapiens
gatgctttccctccc

SEQ ID NO: 351370 - DNA, 15 bp, Homo sapiens
atgctttccctccca

SEQ ID NO: 351371 - DNA, 15 bp, Homo sapiens
tgctttccctcccac

SEQ ID NO: 351372 - DNA, 15 bp, Homo sapiens
gctttccctcccacc

SEQ ID NO: 351373 - DNA, 15 bp, Homo sapiens
ctttccctcccacca

SEQ ID NO: 351374 - DNA, 15 bp, Homo sapiens
tttccctcccaccat

SEQ ID NO: 351375 - DNA, 15 bp, Homo sapiens
ttccctcccaccatg

SEQ ID NO: 351376 - DNA, 15 bp, Homo sapiens
tccctcccaccatgc

SEQ ID NO: 351377 - DNA, 15 bp, Homo sapiens
ccctcccaccatgcc

SEQ ID NO: 351378 - DNA, 15 bp, Homo sapiens
cctcccaccatgccc

SEQ ID NO: 351379 - DNA, 15 bp, Homo sapiens
ctcccaccatgcccc

SEQ ID NO: 351380 - DNA, 15 bp, Homo sapiens
tcccaccatgcccca

SEQ ID NO: 351381 - DNA, 15 bp, Homo sapiens
cccaccatgccccac

SEQ ID NO: 351382 - DNA, 15 bp, Homo sapiens
ccaccatgccccacc

SEQ ID NO: 351383 - DNA, 15 bp, Homo sapiens
caccatgccccaccc

SEQ ID NO: 351384 - DNA, 15 bp, Homo sapiens
accatgccccaccct

SEQ ID NO: 351385 - DNA, 15 bp, Homo sapiens
ccatgccccaccctc

SEQ ID NO: 351386 - DNA, 15 bp, Homo sapiens
catgccccaccctcc

SEQ ID NO: 351387 - DNA, 15 bp, Homo sapiens
atgccccaccctcca

SEQ ID NO: 351388 - DNA, 15 bp, Homo sapiens
tgccccaccctccaa

SEQ ID NO: 351389 - DNA, 15 bp, Homo sapiens
gccccaccctccaac

SEQ ID NO: 351390 - DNA, 15 bp, Homo sapiens
ccccaccctccaaca

SEQ ID NO: 351391 - DNA, 15 bp, Homo sapiens
cccaccctccaacag

SEQ ID NO: 351392 - DNA, 15 bp, Homo sapiens
ccaccctccaacaga

SEQ ID NO: 351393 - DNA, 15 bp, Homo sapiens
caccctccaacagac

SEQ ID NO: 351394 - DNA, 15 bp, Homo sapiens
accctccaacagacc

SEQ ID NO: 351395 - DNA, 15 bp, Homo sapiens
ccctccaacagaccc

SEQ ID NO: 351396 - DNA, 15 bp, Homo sapiens
cctccaacagacccc

SEQ ID NO: 351397 - DNA, 15 bp, Homo sapiens
ctccaacagacccca

SEQ ID NO: 351398 - DNA, 15 bp, Homo sapiens
tccaacagaccccag

SEQ ID NO: 351399 - DNA, 15 bp, Homo sapiens
ccaacagaccccagt

SEQ ID NO: 351400 - DNA, 15 bp, Homo sapiens
caacagaccccagtg

SEQ ID NO: 351401 - DNA, 15 bp, Homo sapiens
aacagaccccagtgt

SEQ ID NO: 351402 - DNA, 15 bp, Homo sapiens
acagaccccagtgtg

SEQ ID NO: 351403 - DNA, 15 bp, Homo sapiens
cagaccccagtgtgt

SEQ ID NO: 351404 - DNA, 15 bp, Homo sapiens
agaccccagtgtgtg

SEQ ID NO: 351405 - DNA, 15 bp, Homo sapiens
gaccccagtgtgtgt

SEQ ID NO: 351406 - DNA, 15 bp, Homo sapiens
accccagtgtgtgtt

SEQ ID NO: 351407 - DNA, 15 bp, Homo sapiens
ccccagtgtgtgttt

SEQ ID NO: 351408 - DNA, 15 bp, Homo sapiens
cccagtgtgtgtttt

SEQ ID NO: 351409 - DNA, 15 bp, Homo sapiens
ccagtgtgtgttttt

SEQ ID NO: 351410 - DNA, 15 bp, Homo sapiens
cagtgtgtgtttttc

SEQ ID NO: 351411 - DNA, 15 bp, Homo sapiens
agtgtgtgtttttcc

SEQ ID NO: 351412 - DNA, 15 bp, Homo sapiens
gtgtgtgtttttccc

SEQ ID NO: 351413 - DNA, 15 bp, Homo sapiens
tgtgtgtttttcccc

SEQ ID NO: 351414 - DNA, 15 bp, Homo sapiens
gtgtgtttttcccca

SEQ ID NO: 351415 - DNA, 15 bp, Homo sapiens
tgtgtttttccccac

SEQ ID NO: 351416 - DNA, 15 bp, Homo sapiens
gtgtttttccccacc

SEQ ID NO: 351417 - DNA, 15 bp, Homo sapiens
tgtttttccccacca

SEQ ID NO: 351418 - DNA, 15 bp, Homo sapiens
gtttttccccaccat

SEQ ID NO: 351419 - DNA, 15 bp, Homo sapiens
tttttccccaccatg

SEQ ID NO: 351420 - DNA, 15 bp, Homo sapiens
ttttccccaccatgt

SEQ ID NO: 351421 - DNA, 15 bp, Homo sapiens
tttccccaccatgtg

SEQ ID NO: 351422 - DNA, 15 bp, Homo sapiens
ttccccaccatgtgt

SEQ ID NO: 351423 - DNA, 15 bp, Homo sapiens
tccccaccatgtgtc

SEQ ID NO: 351424 - DNA, 15 bp, Homo sapiens
ccccaccatgtgtcc

SEQ ID NO: 351425 - DNA, 15 bp, Homo sapiens
cccaccatgtgtccg

SEQ ID NO: 351426 - DNA, 15 bp, Homo sapiens
ccaccatgtgtccgt

SEQ ID NO: 351427 - DNA, 15 bp, Homo sapiens
caccatgtgtccgta

SEQ ID NO: 351428 - DNA, 15 bp, Homo sapiens
accatgtgtccgtat

SEQ ID NO: 351429 - DNA, 15 bp, Homo sapiens
ccatgtgtccgtatg

SEQ ID NO: 351430 - DNA, 15 bp, Homo sapiens
catgtgtccgtatgt

SEQ ID NO: 351431 - DNA, 15 bp, Homo sapiens
atgtgtccgtatgtt

SEQ ID NO: 351432 - DNA, 15 bp, Homo sapiens
tgtgtccgtatgttc

SEQ ID NO: 351433 - DNA, 15 bp, Homo sapiens
gtgtccgtatgttct

SEQ ID NO: 351434 - DNA, 15 bp, Homo sapiens
tgtccgtatgttctc

SEQ ID NO: 351435 - DNA, 15 bp, Homo sapiens
gtccgtatgttctca

SEQ ID NO: 351436 - DNA, 15 bp, Homo sapiens
tccgtatgttctcat

SEQ ID NO: 351437 - DNA, 15 bp, Homo sapiens
ccgtatgttctcatt

SEQ ID NO: 351438 - DNA, 15 bp, Homo sapiens
cgtatgttctcatta

SEQ ID NO: 351439 - DNA, 15 bp, Homo sapiens
gtatgttctcattat

SEQ ID NO: 351440 - DNA, 15 bp, Homo sapiens
tatgttctcattatt

SEQ ID NO: 351441 - DNA, 15 bp, Homo sapiens
atgttctcattattc

SEQ ID NO: 351442 - DNA, 15 bp, Homo sapiens
tgttctcattattca

SEQ ID NO: 351443 - DNA, 15 bp, Homo sapiens
gttctcattattcag

SEQ ID NO: 351444 - DNA, 15 bp, Homo sapiens
ttctcattattcagc

SEQ ID NO: 351445 - DNA, 15 bp, Homo sapiens
tctcattattcagct

SEQ ID NO: 351446 - DNA, 15 bp, Homo sapiens
ctcattattcagctc

SEQ ID NO: 351447 - DNA, 15 bp, Homo sapiens
tcattattcagctcc

SEQ ID NO: 351448 - DNA, 15 bp, Homo sapiens
cattattcagctccc

SEQ ID NO: 351449 - DNA, 15 bp, Homo sapiens
attattcagctccca

SEQ ID NO: 351450 - DNA, 15 bp, Homo sapiens
ttattcagctcccac

SEQ ID NO: 351451 - DNA, 15 bp, Homo sapiens
tattcagctcccact

SEQ ID NO: 351452 - DNA, 15 bp, Homo sapiens
attcagctcccactt

SEQ ID NO: 351453 - DNA, 15 bp, Homo sapiens
ttcagctcccactta

SEQ ID NO: 351454 - DNA, 15 bp, Homo sapiens
tcagctcccacttat

SEQ ID NO: 351455 - DNA, 15 bp, Homo sapiens
cagctcccacttata

SEQ ID NO: 351456 - DNA, 15 bp, Homo sapiens
agctcccacttataa

SEQ ID NO: 351457 - DNA, 15 bp, Homo sapiens
gctcccacttataag

SEQ ID NO: 351458 - DNA, 15 bp, Homo sapiens
ctcccacttataagt

SEQ ID NO: 351459 - DNA, 15 bp, Homo sapiens
tcccacttataagtg

SEQ ID NO: 351460 - DNA, 15 bp, Homo sapiens
cccacttataagtga

SEQ ID NO: 351461 - DNA, 15 bp, Homo sapiens
ccacttataagtgag

SEQ ID NO: 351462 - DNA, 15 bp, Homo sapiens
cacttataagtgaga

SEQ ID NO: 351463 - DNA, 15 bp, Homo sapiens
acttataagtgagaa

SEQ ID NO: 351464 - DNA, 15 bp, Homo sapiens
cttataagtgagaat

SEQ ID NO: 351465 - DNA, 15 bp, Homo sapiens
ttataagtgagaata

SEQ ID NO: 351466 - DNA, 15 bp, Homo sapiens
tataagtgagaatat

SEQ ID NO: 351467 - DNA, 15 bp, Homo sapiens
ataagtgagaatatg

SEQ ID NO: 351468 - DNA, 15 bp, Homo sapiens
taagtgagaatatgc

SEQ ID NO: 351469 - DNA, 15 bp, Homo sapiens
aagtgagaatatgcg

SEQ ID NO: 351470 - DNA, 15 bp, Homo sapiens
agtgagaatatgcgg

SEQ ID NO: 351471 - DNA, 15 bp, Homo sapiens
gtgagaatatgcggt

SEQ ID NO: 351472 - DNA, 15 bp, Homo sapiens
tgagaatatgcggta

SEQ ID NO: 351473 - DNA, 15 bp, Homo sapiens
gagaatatgcggtat

SEQ ID NO: 351474 - DNA, 15 bp, Homo sapiens
agaatatgcggtatt

SEQ ID NO: 351475 - DNA, 15 bp, Homo sapiens
gaatatgcggtattt

SEQ ID NO: 351476 - DNA, 15 bp, Homo sapiens
aatatgcggtatttt

SEQ ID NO: 351477 - DNA, 15 bp, Homo sapiens
atatgcggtattttt

SEQ ID NO: 351478 - DNA, 15 bp, Homo sapiens
tatgcggtatttttt

SEQ ID NO: 351479 - DNA, 15 bp, Homo sapiens
atgcggtattttttt

SEQ ID NO: 351480 - DNA, 15 bp, Homo sapiens
tgcggtatttttttt

SEQ ID NO: 351481 - DNA, 15 bp, Homo sapiens
gcggtattttttttt

SEQ ID NO: 351482 - DNA, 15 bp, Homo sapiens
cggtatttttttttg

SEQ ID NO: 351483 - DNA, 15 bp, Homo sapiens
ggtatttttttttgt

SEQ ID NO: 351484 - DNA, 15 bp, Homo sapiens
gtatttttttttgtt

SEQ ID NO: 351485 - DNA, 15 bp, Homo sapiens
tatttttttttgttg

SEQ ID NO: 351486 - DNA, 15 bp, Homo sapiens
atttttttttgttgt

SEQ ID NO: 351487 - DNA, 15 bp, Homo sapiens
tttttttttgttgtt

SEQ ID NO: 351488 - DNA, 15 bp, Homo sapiens
ttttttttgttgttt

SEQ ID NO: 351489 - DNA, 15 bp, Homo sapiens
tttttttgttgtttc

SEQ ID NO: 351490 - DNA, 15 bp, Homo sapiens
ttttttgttgtttct

SEQ ID NO: 351491 - DNA, 15 bp, Homo sapiens
tttttgttgtttctg

SEQ ID NO: 351492 - DNA, 15 bp, Homo sapiens
ttttgttgtttctga

SEQ ID NO: 351493 - DNA, 15 bp, Homo sapiens
tttgttgtttctgaa

SEQ ID NO: 351494 - DNA, 15 bp, Homo sapiens
ttgttgtttctgaat

SEQ ID NO: 351495 - DNA, 15 bp, Homo sapiens
tgttgtttctgaatt

SEQ ID NO: 351496 - DNA, 15 bp, Homo sapiens
gttgtttctgaatta

SEQ ID NO: 351497 - DNA, 15 bp, Homo sapiens
ttgtttctgaattag

SEQ ID NO: 351498 - DNA, 15 bp, Homo sapiens
tgtttctgaattagt

SEQ ID NO: 351499 - DNA, 15 bp, Homo sapiens
gtttctgaattagtt

SEQ ID NO: 351500 - DNA, 15 bp, Homo sapiens
tttctgaattagttt

SEQ ID NO: 351501 - DNA, 15 bp, Homo sapiens
ttctgaattagtttg

SEQ ID NO: 351502 - DNA, 15 bp, Homo sapiens
tctgaattagtttgc

SEQ ID NO: 351503 - DNA, 15 bp, Homo sapiens
ctgaattagtttgcc

SEQ ID NO: 351504 - DNA, 15 bp, Homo sapiens
tgaattagtttgccg

SEQ ID NO: 351505 - DNA, 15 bp, Homo sapiens
gaattagtttgccga

SEQ ID NO: 351506 - DNA, 15 bp, Homo sapiens
aattagtttgccgag

SEQ ID NO: 351507 - DNA, 15 bp, Homo sapiens
attagtttgccgagg

SEQ ID NO: 351508 - DNA, 15 bp, Homo sapiens
ttagtttgccgagga

SEQ ID NO: 351509 - DNA, 15 bp, Homo sapiens
tagtttgccgaggat

SEQ ID NO: 351510 - DNA, 15 bp, Homo sapiens
agtttgccgaggata

SEQ ID NO: 351511 - DNA, 15 bp, Homo sapiens
gtttgccgaggataa

SEQ ID NO: 351512 - DNA, 15 bp, Homo sapiens
tttgccgaggataat

SEQ ID NO: 351513 - DNA, 15 bp, Homo sapiens
ttgccgaggataatg

SEQ ID NO: 351514 - DNA, 15 bp, Homo sapiens
tgccgaggataatgg

SEQ ID NO: 351515 - DNA, 15 bp, Homo sapiens
gccgaggataatggc

SEQ ID NO: 351516 - DNA, 15 bp, Homo sapiens
ccgaggataatggct

SEQ ID NO: 351517 - DNA, 15 bp, Homo sapiens
cgaggataatggctt

SEQ ID NO: 351518 - DNA, 15 bp, Homo sapiens
gaggataatggcttc

SEQ ID NO: 351519 - DNA, 15 bp, Homo sapiens
aggataatggcttcc

SEQ ID NO: 351520 - DNA, 15 bp, Homo sapiens
ggataatggcttcca

SEQ ID NO: 351521 - DNA, 15 bp, Homo sapiens
gataatggcttccag

SEQ ID NO: 351522 - DNA, 15 bp, Homo sapiens
ataatggcttccagc

SEQ ID NO: 351523 - DNA, 15 bp, Homo sapiens
taatggcttccagct

SEQ ID NO: 351524 - DNA, 15 bp, Homo sapiens
aatggcttccagctc

SEQ ID NO: 351525 - DNA, 15 bp, Homo sapiens
atggcttccagctcc

SEQ ID NO: 351526 - DNA, 15 bp, Homo sapiens
tggcttccagctcca

SEQ ID NO: 351527 - DNA, 15 bp, Homo sapiens
ggcttccagctccat

SEQ ID NO: 351528 - DNA, 15 bp, Homo sapiens
gcttccagctccatc

SEQ ID NO: 351529 - DNA, 15 bp, Homo sapiens
cttccagctccatcc

SEQ ID NO: 351530 - DNA, 15 bp, Homo sapiens
ttccagctccatcca

SEQ ID NO: 351531 - DNA, 15 bp, Homo sapiens
ccagctccatccata

SEQ ID NO: 351532 - DNA, 15 bp, Homo sapiens
cagctccatccatat

SEQ ID NO: 351533 - DNA, 15 bp, Homo sapiens
agctccatccatata

SEQ ID NO: 351534 - DNA, 15 bp, Homo sapiens
gctccatccatatac

SEQ ID NO: 351535 - DNA, 15 bp, Homo sapiens
ctccatccatatacc

SEQ ID NO: 351536 - DNA, 15 bp, Homo sapiens
tccatccatatacct

SEQ ID NO: 351537 - DNA, 15 bp, Homo sapiens
ccatccatatacctg

SEQ ID NO: 351538 - DNA, 15 bp, Homo sapiens
catccatatacctgc

SEQ ID NO: 351539 - DNA, 15 bp, Homo sapiens
atccatatacctgca

SEQ ID NO: 351540 - DNA, 15 bp, Homo sapiens
tccatatacctgcaa

SEQ ID NO: 351541 - DNA, 15 bp, Homo sapiens
ccatatacctgcaaa

SEQ ID NO: 351542 - DNA, 15 bp, Homo sapiens
catatacctgcaaag

SEQ ID NO: 351543 - DNA, 15 bp, Homo sapiens
atatacctgcaaagg

SEQ ID NO: 351544 - DNA, 15 bp, Homo sapiens
tatacctgcaaagga

SEQ ID NO: 351545 - DNA, 15 bp, Homo sapiens
atacctgcaaaggac

SEQ ID NO: 351546 - DNA, 15 bp, Homo sapiens
tacctgcaaaggaca

SEQ ID NO: 351547 - DNA, 15 bp, Homo sapiens
acctgcaaaggacat

SEQ ID NO: 351548 - DNA, 15 bp, Homo sapiens
cctgcaaaggacatg

SEQ ID NO: 351549 - DNA, 15 bp, Homo sapiens
ctgcaaaggacatga

SEQ ID NO: 351550 - DNA, 15 bp, Homo sapiens
tgcaaaggacatgat

SEQ ID NO: 351551 - DNA, 15 bp, Homo sapiens
gcaaaggacatgatc

SEQ ID NO: 351552 - DNA, 15 bp, Homo sapiens
caaaggacatgatct

SEQ ID NO: 351553 - DNA, 15 bp, Homo sapiens
aaaggacatgatctt

SEQ ID NO: 351554 - DNA, 15 bp, Homo sapiens
aaggacatgatcttg

SEQ ID NO: 351555 - DNA, 15 bp, Homo sapiens
aggacatgatcttgt

SEQ ID NO: 351556 - DNA, 15 bp, Homo sapiens
ggacatgatcttgtt

SEQ ID NO: 351557 - DNA, 15 bp, Homo sapiens
gacatgatcttgttc

SEQ ID NO: 351558 - DNA, 15 bp, Homo sapiens
acatgatcttgttcc

SEQ ID NO: 351559 - DNA, 15 bp, Homo sapiens
catgatcttgttcct

SEQ ID NO: 351560 - DNA, 15 bp, Homo sapiens
atgatcttgttcctt

SEQ ID NO: 351561 - DNA, 15 bp, Homo sapiens
tgatcttgttccttt

SEQ ID NO: 351562 - DNA, 15 bp, Homo sapiens
gatcttgttcctttt

SEQ ID NO: 351563 - DNA, 15 bp, Homo sapiens
atcttgttccttttt

SEQ ID NO: 351564 - DNA, 15 bp, Homo sapiens
tcttgttccttttta

SEQ ID NO: 351565 - DNA, 15 bp, Homo sapiens
cttgttcctttttat

SEQ ID NO: 351566 - DNA, 15 bp, Homo sapiens
ttgttcctttttatg

SEQ ID NO: 351567 - DNA, 15 bp, Homo sapiens
tgttcctttttatgg

SEQ ID NO: 351568 - DNA, 15 bp, Homo sapiens
gttcctttttatggc

SEQ ID NO: 351569 - DNA, 15 bp, Homo sapiens
ttcctttttatggct

SEQ ID NO: 351570 - DNA, 15 bp, Homo sapiens
tcctttttatggctg

SEQ ID NO: 351571 - DNA, 15 bp, Homo sapiens
cctttttatggctgc

SEQ ID NO: 351572 - DNA, 15 bp, Homo sapiens
ctttttatggctgca

SEQ ID NO: 351573 - DNA, 15 bp, Homo sapiens
tttttatggctgcat

SEQ ID NO: 351574 - DNA, 15 bp, Homo sapiens
gcatagtattccatg

SEQ ID NO: 351575 - DNA, 15 bp, Homo sapiens
catagtattccatgg

SEQ ID NO: 351576 - DNA, 15 bp, Homo sapiens
tagtattccatggtt

SEQ ID NO: 351577 - DNA, 15 bp, Homo sapiens
agtattccatggttg

SEQ ID NO: 351578 - DNA, 15 bp, Homo sapiens
gtattccatggttga

SEQ ID NO: 351579 - DNA, 15 bp, Homo sapiens
tattccatggttgat

SEQ ID NO: 351580 - DNA, 15 bp, Homo sapiens
attccatggttgata

SEQ ID NO: 351581 - DNA, 15 bp, Homo sapiens
ttccatggttgatat

SEQ ID NO: 351582 - DNA, 15 bp, Homo sapiens
tccatggttgatatg

SEQ ID NO: 351583 - DNA, 15 bp, Homo sapiens
ccatggttgatatgt

SEQ ID NO: 351584 - DNA, 15 bp, Homo sapiens
catggttgatatgta

SEQ ID NO: 351585 - DNA, 15 bp, Homo sapiens
atggttgatatgtac

SEQ ID NO: 351586 - DNA, 15 bp, Homo sapiens
tggttgatatgtacc

SEQ ID NO: 351587 - DNA, 15 bp, Homo sapiens
ggttgatatgtacca

SEQ ID NO: 351588 - DNA, 15 bp, Homo sapiens
gttgatatgtaccac

SEQ ID NO: 351589 - DNA, 15 bp, Homo sapiens
ttgatatgtaccaca

SEQ ID NO: 351590 - DNA, 15 bp, Homo sapiens
tgatatgtaccacat

SEQ ID NO: 351591 - DNA, 15 bp, Homo sapiens
gatatgtaccacatt

SEQ ID NO: 351592 - DNA, 15 bp, Homo sapiens
atatgtaccacattt

SEQ ID NO: 351593 - DNA, 15 bp, Homo sapiens
tatgtaccacatttt

SEQ ID NO: 351594 - DNA, 15 bp, Homo sapiens
atgtaccacattttc

SEQ ID NO: 351595 - DNA, 15 bp, Homo sapiens
tgtaccacattttct

SEQ ID NO: 351596 - DNA, 15 bp, Homo sapiens
gtaccacattttctt

SEQ ID NO: 351597 - DNA, 15 bp, Homo sapiens
ccacattttctttaa

SEQ ID NO: 351598 - DNA, 15 bp, Homo sapiens
cacattttctttaag

SEQ ID NO: 351599 - DNA, 15 bp, Homo sapiens
acattttctttaagt

SEQ ID NO: 351600 - DNA, 15 bp, Homo sapiens
cattttctttaagta

SEQ ID NO: 351601 - DNA, 15 bp, Homo sapiens
attttctttaagtag

SEQ ID NO: 351602 - DNA, 15 bp, Homo sapiens
ttttctttaagtagt

SEQ ID NO: 351603 - DNA, 15 bp, Homo sapiens
tttctttaagtagtc

SEQ ID NO: 351604 - DNA, 15 bp, Homo sapiens
ttctttaagtagtct

SEQ ID NO: 351605 - DNA, 15 bp, Homo sapiens
tctttaagtagtcta

SEQ ID NO: 351606 - DNA, 15 bp, Homo sapiens
ctttaagtagtctat

SEQ ID NO: 351607 - DNA, 15 bp, Homo sapiens
tttaagtagtctatc

SEQ ID NO: 351608 - DNA, 15 bp, Homo sapiens
ttaagtagtctatca

SEQ ID NO: 351609 - DNA, 15 bp, Homo sapiens
taagtagtctatcat

SEQ ID NO: 351610 - DNA, 15 bp, Homo sapiens
aagtagtctatcatt

SEQ ID NO: 351611 - DNA, 15 bp, Homo sapiens
agtagtctatcattg

SEQ ID NO: 351612 - DNA, 15 bp, Homo sapiens
gtagtctatcattga

SEQ ID NO: 351613 - DNA, 15 bp, Homo sapiens
tagtctatcattgat

SEQ ID NO: 351614 - DNA, 15 bp, Homo sapiens
agtctatcattgatg

SEQ ID NO: 351615 - DNA, 15 bp, Homo sapiens
gtctatcattgatgg

SEQ ID NO: 351616 - DNA, 15 bp, Homo sapiens
tctatcattgatggg

SEQ ID NO: 351617 - DNA, 15 bp, Homo sapiens
ctatcattgatgggc

SEQ ID NO: 351618 - DNA, 15 bp, Homo sapiens
tatcattgatgggca

SEQ ID NO: 351619 - DNA, 15 bp, Homo sapiens
atcattgatgggcat

SEQ ID NO: 351620 - DNA, 15 bp, Homo sapiens
tcattgatgggcatt

SEQ ID NO: 351621 - DNA, 15 bp, Homo sapiens
attgatgggcatttg

SEQ ID NO: 351622 - DNA, 15 bp, Homo sapiens
ttgatgggcatttgg

SEQ ID NO: 351623 - DNA, 15 bp, Homo sapiens
gatgggcatttgggt

SEQ ID NO: 351624 - DNA, 15 bp, Homo sapiens
atgggcatttgggtt

SEQ ID NO: 351625 - DNA, 15 bp, Homo sapiens
tgggcatttgggttg

SEQ ID NO: 351626 - DNA, 15 bp, Homo sapiens
gggcatttgggttga

SEQ ID NO: 351627 - DNA, 15 bp, Homo sapiens
ggcatttgggttgat

SEQ ID NO: 351628 - DNA, 15 bp, Homo sapiens
gcatttgggttgatt

SEQ ID NO: 351629 - DNA, 15 bp, Homo sapiens
catttgggttgattc

SEQ ID NO: 351630 - DNA, 15 bp, Homo sapiens
atttgggttgattcc

SEQ ID NO: 351631 - DNA, 15 bp, Homo sapiens
tttgggttgattcct

SEQ ID NO: 351632 - DNA, 15 bp, Homo sapiens
ttgggttgattcctt

SEQ ID NO: 351633 - DNA, 15 bp, Homo sapiens
tgggttgattccttg

SEQ ID NO: 351634 - DNA, 15 bp, Homo sapiens
gggttgattccttgt

SEQ ID NO: 351635 - DNA, 15 bp, Homo sapiens
ggttgattccttgtc

SEQ ID NO: 351636 - DNA, 15 bp, Homo sapiens
gttgattccttgtcc

SEQ ID NO: 351637 - DNA, 15 bp, Homo sapiens
ttgattccttgtcct

SEQ ID NO: 351638 - DNA, 15 bp, Homo sapiens
tgattccttgtcctt

SEQ ID NO: 351639 - DNA, 15 bp, Homo sapiens
gattccttgtccttg

SEQ ID NO: 351640 - DNA, 15 bp, Homo sapiens
attccttgtccttgc

SEQ ID NO: 351641 - DNA, 15 bp, Homo sapiens
ttccttgtccttgct

SEQ ID NO: 351642 - DNA, 15 bp, Homo sapiens
tccttgtccttgcta

SEQ ID NO: 351643 - DNA, 15 bp, Homo sapiens
ccttgtccttgctat

SEQ ID NO: 351644 - DNA, 15 bp, Homo sapiens
cttgtccttgctatt

SEQ ID NO: 351645 - DNA, 15 bp, Homo sapiens
ttgtccttgctattg

SEQ ID NO: 351646 - DNA, 15 bp, Homo sapiens
tgtccttgctattgt

SEQ ID NO: 351647 - DNA, 15 bp, Homo sapiens
gtccttgctattgtg

SEQ ID NO: 351648 - DNA, 15 bp, Homo sapiens
tccttgctattgtga

SEQ ID NO: 351649 - DNA, 15 bp, Homo sapiens
ccttgctattgtgaa

SEQ ID NO: 351650 - DNA, 15 bp, Homo sapiens
cttgctattgtgaat

SEQ ID NO: 351651 - DNA, 15 bp, Homo sapiens
ttgctattgtgaatt

SEQ ID NO: 351652 - DNA, 15 bp, Homo sapiens
tgctattgtgaattg

SEQ ID NO: 351653 - DNA, 15 bp, Homo sapiens
gctattgtgaattgt

SEQ ID NO: 351654 - DNA, 15 bp, Homo sapiens
ctattgtgaattgtg

SEQ ID NO: 351655 - DNA, 15 bp, Homo sapiens
tattgtgaattgtgc

SEQ ID NO: 351656 - DNA, 15 bp, Homo sapiens
gtgaattgtgctgca

SEQ ID NO: 351657 - DNA, 15 bp, Homo sapiens
tgaattgtgctgcaa

SEQ ID NO: 351658 - DNA, 15 bp, Homo sapiens
gaattgtgctgcaat

SEQ ID NO: 351659 - DNA, 15 bp, Homo sapiens
aattgtgctgcaatg

SEQ ID NO: 351660 - DNA, 15 bp, Homo sapiens
attgtgctgcaatga

SEQ ID NO: 351661 - DNA, 15 bp, Homo sapiens
ttgtgctgcaatgaa

SEQ ID NO: 351662 - DNA, 15 bp, Homo sapiens
tgtgctgcaatgaac

SEQ ID NO: 351663 - DNA, 15 bp, Homo sapiens
gtgctgcaatgaaca

SEQ ID NO: 351664 - DNA, 15 bp, Homo sapiens
tgctgcaatgaacat

SEQ ID NO: 351665 - DNA, 15 bp, Homo sapiens
gctgcaatgaacata

SEQ ID NO: 351666 - DNA, 15 bp, Homo sapiens
ctgcaatgaacatag

SEQ ID NO: 351667 - DNA, 15 bp, Homo sapiens
tgcaatgaacatagt

SEQ ID NO: 351668 - DNA, 15 bp, Homo sapiens
gcaatgaacatagtg

SEQ ID NO: 351669 - DNA, 15 bp, Homo sapiens
caatgaacatagtgt

SEQ ID NO: 351670 - DNA, 15 bp, Homo sapiens
aatgaacatagtgtg

SEQ ID NO: 351671 - DNA, 15 bp, Homo sapiens
atgaacatagtgtgc

SEQ ID NO: 351672 - DNA, 15 bp, Homo sapiens
tgaacatagtgtgca

SEQ ID NO: 351673 - DNA, 15 bp, Homo sapiens
gaacatagtgtgcat

SEQ ID NO: 351674 - DNA, 15 bp, Homo sapiens
aacatagtgtgcata

SEQ ID NO: 351675 - DNA, 15 bp, Homo sapiens
acatagtgtgcatat

SEQ ID NO: 351676 - DNA, 15 bp, Homo sapiens
catagtgtgcatata

SEQ ID NO: 351677 - DNA, 15 bp, Homo sapiens
atagtgtgcatatat

SEQ ID NO: 351678 - DNA, 15 bp, Homo sapiens
tagtgtgcatatatc

SEQ ID NO: 351679 - DNA, 15 bp, Homo sapiens
agtgtgcatatatct

SEQ ID NO: 351680 - DNA, 15 bp, Homo sapiens
gtgtgcatatatctt

SEQ ID NO: 351681 - DNA, 15 bp, Homo sapiens
tgtgcatatatcttt

SEQ ID NO: 351682 - DNA, 15 bp, Homo sapiens
gtgcatatatcttta

SEQ ID NO: 351683 - DNA, 15 bp, Homo sapiens
tgcatatatctttat

SEQ ID NO: 351684 - DNA, 15 bp, Homo sapiens
gcatatatctttata

SEQ ID NO: 351685 - DNA, 15 bp, Homo sapiens
catatatctttataa

SEQ ID NO: 351686 - DNA, 15 bp, Homo sapiens
atatatctttataac

SEQ ID NO: 351687 - DNA, 15 bp, Homo sapiens
tatatctttataaca

SEQ ID NO: 351688 - DNA, 15 bp, Homo sapiens
atatctttataacag

SEQ ID NO: 351689 - DNA, 15 bp, Homo sapiens
tatctttataacaga

SEQ ID NO: 351690 - DNA, 15 bp, Homo sapiens
atctttataacagaa

SEQ ID NO: 351691 - DNA, 15 bp, Homo sapiens
tctttataacagaat

SEQ ID NO: 351692 - DNA, 15 bp, Homo sapiens
ctttataacagaatg

SEQ ID NO: 351693 - DNA, 15 bp, Homo sapiens
tttataacagaatga

SEQ ID NO: 351694 - DNA, 15 bp, Homo sapiens
ttataacagaatgat

SEQ ID NO: 351695 - DNA, 15 bp, Homo sapiens
tataacagaatgatt

SEQ ID NO: 351696 - DNA, 15 bp, Homo sapiens
ataacagaatgattt

SEQ ID NO: 351697 - DNA, 15 bp, Homo sapiens
taacagaatgatttg

SEQ ID NO: 351698 - DNA, 15 bp, Homo sapiens
aacagaatgatttgt

SEQ ID NO: 351699 - DNA, 15 bp, Homo sapiens
acagaatgatttgta

SEQ ID NO: 351700 - DNA, 15 bp, Homo sapiens
cagaatgatttgtat

SEQ ID NO: 351701 - DNA, 15 bp, Homo sapiens
agaatgatttgtatt

SEQ ID NO: 351702 - DNA, 15 bp, Homo sapiens
gaatgatttgtattc

SEQ ID NO: 351703 - DNA, 15 bp, Homo sapiens
aatgatttgtattcc

SEQ ID NO: 351704 - DNA, 15 bp, Homo sapiens
atgatttgtattcct

SEQ ID NO: 351705 - DNA, 15 bp, Homo sapiens
tgatttgtattcctt

SEQ ID NO: 351706 - DNA, 15 bp, Homo sapiens
gatttgtattccttt

SEQ ID NO: 351707 - DNA, 15 bp, Homo sapiens
atttgtattcctttg

SEQ ID NO: 351708 - DNA, 15 bp, Homo sapiens
tttgtattcctttgg

SEQ ID NO: 351709 - DNA, 15 bp, Homo sapiens
ttgtattcctttggg

SEQ ID NO: 351710 - DNA, 15 bp, Homo sapiens
tgtattcctttgggt

SEQ ID NO: 351711 - DNA, 15 bp, Homo sapiens
gtattcctttgggta

SEQ ID NO: 351712 - DNA, 15 bp, Homo sapiens
tattcctttgggtat

SEQ ID NO: 351713 - DNA, 15 bp, Homo sapiens
attcctttgggtata

SEQ ID NO: 351714 - DNA, 15 bp, Homo sapiens
ttcctttgggtatat

SEQ ID NO: 351715 - DNA, 15 bp, Homo sapiens
tcctttgggtatata

SEQ ID NO: 351716 - DNA, 15 bp, Homo sapiens
cctttgggtatatac

SEQ ID NO: 351717 - DNA, 15 bp, Homo sapiens
ctttgggtatatacc

SEQ ID NO: 351718 - DNA, 15 bp, Homo sapiens
tttgggtatataccc

SEQ ID NO: 351719 - DNA, 15 bp, Homo sapiens
ttgggtatataccca

SEQ ID NO: 351720 - DNA, 15 bp, Homo sapiens
tgggtatatacccag

SEQ ID NO: 351721 - DNA, 15 bp, Homo sapiens
gggtatatacccagt

SEQ ID NO: 351722 - DNA, 15 bp, Homo sapiens
ggtatatacccagtg

SEQ ID NO: 351723 - DNA, 15 bp, Homo sapiens
gtatatacccagtga

SEQ ID NO: 351724 - DNA, 15 bp, Homo sapiens
tatatacccagtgag

SEQ ID NO: 351725 - DNA, 15 bp, Homo sapiens
atatacccagtgaga

SEQ ID NO: 351726 - DNA, 15 bp, Homo sapiens
tatacccagtgagat

SEQ ID NO: 351727 - DNA, 15 bp, Homo sapiens
atacccagtgagatt

SEQ ID NO: 351728 - DNA, 15 bp, Homo sapiens
tacccagtgagattg

SEQ ID NO: 351729 - DNA, 15 bp, Homo sapiens
acccagtgagattgc

SEQ ID NO: 351730 - DNA, 15 bp, Homo sapiens
cccagtgagattgct

SEQ ID NO: 351731 - DNA, 15 bp, Homo sapiens
ccagtgagattgctg

SEQ ID NO: 351732 - DNA, 15 bp, Homo sapiens
cagtgagattgctgg

SEQ ID NO: 351733 - DNA, 15 bp, Homo sapiens
agtgagattgctggg

SEQ ID NO: 351734 - DNA, 15 bp, Homo sapiens
gtgagattgctgggt

SEQ ID NO: 351735 - DNA, 15 bp, Homo sapiens
tgagattgctgggtc

SEQ ID NO: 351736 - DNA, 15 bp, Homo sapiens
gagattgctgggtca

SEQ ID NO: 351737 - DNA, 15 bp, Homo sapiens
agattgctgggtcaa

SEQ ID NO: 351738 - DNA, 15 bp, Homo sapiens
ttgctgggtcaaatg

SEQ ID NO: 351739 - DNA, 15 bp, Homo sapiens
tgctgggtcaaatgg

SEQ ID NO: 351740 - DNA, 15 bp, Homo sapiens
gctgggtcaaatggc

SEQ ID NO: 351741 - DNA, 15 bp, Homo sapiens
ctgggtcaaatggca

SEQ ID NO: 351742 - DNA, 15 bp, Homo sapiens
tgggtcaaatggcat

SEQ ID NO: 351743 - DNA, 15 bp, Homo sapiens
gggtcaaatggcatt

SEQ ID NO: 351744 - DNA, 15 bp, Homo sapiens
ggtcaaatggcattt

SEQ ID NO: 351745 - DNA, 15 bp, Homo sapiens
gtcaaatggcatttc

SEQ ID NO: 351746 - DNA, 15 bp, Homo sapiens
tcaaatggcatttct

SEQ ID NO: 351747 - DNA, 15 bp, Homo sapiens
caaatggcatttctg

SEQ ID NO: 351748 - DNA, 15 bp, Homo sapiens
aaatggcatttctgg

SEQ ID NO: 351749 - DNA, 15 bp, Homo sapiens
aatggcatttctggt

SEQ ID NO: 351750 - DNA, 15 bp, Homo sapiens
atggcatttctggtt

SEQ ID NO: 351751 - DNA, 15 bp, Homo sapiens
tggcatttctggttt

SEQ ID NO: 351752 - DNA, 15 bp, Homo sapiens
ggcatttctggtttt

SEQ ID NO: 351753 - DNA, 15 bp, Homo sapiens
gcatttctggtttta

SEQ ID NO: 351754 - DNA, 15 bp, Homo sapiens
catttctggttttag

SEQ ID NO: 351755 - DNA, 15 bp, Homo sapiens
atttctggttttagg

SEQ ID NO: 351756 - DNA, 15 bp, Homo sapiens
tttctggttttaggt

SEQ ID NO: 351757 - DNA, 15 bp, Homo sapiens
ttctggttttaggtc

SEQ ID NO: 351758 - DNA, 15 bp, Homo sapiens
tctggttttaggtct

SEQ ID NO: 351759 - DNA, 15 bp, Homo sapiens
ctggttttaggtctt

SEQ ID NO: 351760 - DNA, 15 bp, Homo sapiens
tggttttaggtcttt

SEQ ID NO: 351761 - DNA, 15 bp, Homo sapiens
ggttttaggtctttg

SEQ ID NO: 351762 - DNA, 15 bp, Homo sapiens
gttttaggtctttga

SEQ ID NO: 351763 - DNA, 15 bp, Homo sapiens
ttttaggtctttgag

SEQ ID NO: 351764 - DNA, 15 bp, Homo sapiens
ggtctttgaggaatc

SEQ ID NO: 351765 - DNA, 15 bp, Homo sapiens
gtctttgaggaatca

SEQ ID NO: 351766 - DNA, 15 bp, Homo sapiens
tctttgaggaatcac

SEQ ID NO: 351767 - DNA, 15 bp, Homo sapiens
ctttgaggaatcacc

SEQ ID NO: 351768 - DNA, 15 bp, Homo sapiens
tttgaggaatcacca

SEQ ID NO: 351769 - DNA, 15 bp, Homo sapiens
ttgaggaatcaccac

SEQ ID NO: 351770 - DNA, 15 bp, Homo sapiens
tgaggaatcaccaca

SEQ ID NO: 351771 - DNA, 15 bp, Homo sapiens
gaggaatcaccacac

SEQ ID NO: 351772 - DNA, 15 bp, Homo sapiens
aggaatcaccacact

SEQ ID NO: 351773 - DNA, 15 bp, Homo sapiens
ggaatcaccacactg

SEQ ID NO: 351774 - DNA, 15 bp, Homo sapiens
gaatcaccacactgt

SEQ ID NO: 351775 - DNA, 15 bp, Homo sapiens
aatcaccacactgtc

SEQ ID NO: 351776 - DNA, 15 bp, Homo sapiens
atcaccacactgtct

SEQ ID NO: 351777 - DNA, 15 bp, Homo sapiens
tcaccacactgtctt

SEQ ID NO: 351778 - DNA, 15 bp, Homo sapiens
caccacactgtcttc

SEQ ID NO: 351779 - DNA, 15 bp, Homo sapiens
accacactgtcttcc

SEQ ID NO: 351780 - DNA, 15 bp, Homo sapiens
ccacactgtcttcca

SEQ ID NO: 351781 - DNA, 15 bp, Homo sapiens
cacactgtcttccac

SEQ ID NO: 351782 - DNA, 15 bp, Homo sapiens
acactgtcttccaca

SEQ ID NO: 351783 - DNA, 15 bp, Homo sapiens
cactgtcttccacag

SEQ ID NO: 351784 - DNA, 15 bp, Homo sapiens
actgtcttccacagt

SEQ ID NO: 351785 - DNA, 15 bp, Homo sapiens
ctgtcttccacagtg

SEQ ID NO: 351786 - DNA, 15 bp, Homo sapiens
tgtcttccacagtgg

SEQ ID NO: 351787 - DNA, 15 bp, Homo sapiens
gtcttccacagtggt

SEQ ID NO: 351788 - DNA, 15 bp, Homo sapiens
tcttccacagtggtt

SEQ ID NO: 351789 - DNA, 15 bp, Homo sapiens
cttccacagtggttg

SEQ ID NO: 351790 - DNA, 15 bp, Homo sapiens
ttccacagtggttga

SEQ ID NO: 351791 - DNA, 15 bp, Homo sapiens
tccacagtggttgaa

SEQ ID NO: 351792 - DNA, 15 bp, Homo sapiens
ccacagtggttgaac

SEQ ID NO: 351793 - DNA, 15 bp, Homo sapiens
cacagtggttgaact

SEQ ID NO: 351794 - DNA, 15 bp, Homo sapiens
acagtggttgaacta

SEQ ID NO: 351795 - DNA, 15 bp, Homo sapiens
cagtggttgaactaa

SEQ ID NO: 351796 - DNA, 15 bp, Homo sapiens
agtggttgaactaat

SEQ ID NO: 351797 - DNA, 15 bp, Homo sapiens
gtggttgaactaatt

SEQ ID NO: 351798 - DNA, 15 bp, Homo sapiens
tggttgaactaattc

SEQ ID NO: 351799 - DNA, 15 bp, Homo sapiens
ggttgaactaattca

SEQ ID NO: 351800 - DNA, 15 bp, Homo sapiens
gttgaactaattcac

SEQ ID NO: 351801 - DNA, 15 bp, Homo sapiens
ttgaactaattcaca

SEQ ID NO: 351802 - DNA, 15 bp, Homo sapiens
tgaactaattcacac

SEQ ID NO: 351803 - DNA, 15 bp, Homo sapiens
gaactaattcacact

SEQ ID NO: 351804 - DNA, 15 bp, Homo sapiens
aactaattcacactc

SEQ ID NO: 351805 - DNA, 15 bp, Homo sapiens
actaattcacactcc

SEQ ID NO: 351806 - DNA, 15 bp, Homo sapiens
ctaattcacactccc

SEQ ID NO: 351807 - DNA, 15 bp, Homo sapiens
taattcacactccca

SEQ ID NO: 351808 - DNA, 15 bp, Homo sapiens
aattcacactcccac

SEQ ID NO: 351809 - DNA, 15 bp, Homo sapiens
attcacactcccacc

SEQ ID NO: 351810 - DNA, 15 bp, Homo sapiens
ttcacactcccaccc

SEQ ID NO: 351811 - DNA, 15 bp, Homo sapiens
tcacactcccaccca

SEQ ID NO: 351812 - DNA, 15 bp, Homo sapiens
cacactcccacccac

SEQ ID NO: 351813 - DNA, 15 bp, Homo sapiens
acactcccacccact

SEQ ID NO: 351814 - DNA, 15 bp, Homo sapiens
cactcccacccactg

SEQ ID NO: 351815 - DNA, 15 bp, Homo sapiens
actcccacccactgt

SEQ ID NO: 351816 - DNA, 15 bp, Homo sapiens
ctcccacccactgtt

SEQ ID NO: 351817 - DNA, 15 bp, Homo sapiens
tcccacccactgttc

SEQ ID NO: 351818 - DNA, 15 bp, Homo sapiens
cccacccactgttct

SEQ ID NO: 351819 - DNA, 15 bp, Homo sapiens
ccacccactgttctt

SEQ ID NO: 351820 - DNA, 15 bp, Homo sapiens
cacccactgttcttt

SEQ ID NO: 351821 - DNA, 15 bp, Homo sapiens
acccactgttctttt

SEQ ID NO: 351822 - DNA, 15 bp, Homo sapiens
cccactgttcttttt

SEQ ID NO: 351823 - DNA, 15 bp, Homo sapiens
ccactgttcttttta

SEQ ID NO: 351824 - DNA, 15 bp, Homo sapiens
cactgttctttttag

SEQ ID NO: 351825 - DNA, 15 bp, Homo sapiens
actgttctttttaga

SEQ ID NO: 351826 - DNA, 15 bp, Homo sapiens
ctgttctttttagat

SEQ ID NO: 351827 - DNA, 15 bp, Homo sapiens
tgttctttttagata

SEQ ID NO: 351828 - DNA, 15 bp, Homo sapiens
gttctttttagataa

SEQ ID NO: 351829 - DNA, 15 bp, Homo sapiens
ttctttttagataaa

SEQ ID NO: 351830 - DNA, 15 bp, Homo sapiens
tctttttagataaaa

SEQ ID NO: 351831 - DNA, 15 bp, Homo sapiens
ctttttagataaaaa

SEQ ID NO: 351832 - DNA, 15 bp, Homo sapiens
tttttagataaaaat

SEQ ID NO: 351833 - DNA, 15 bp, Homo sapiens
ttttagataaaaatg

SEQ ID NO: 351834 - DNA, 15 bp, Homo sapiens
tttagataaaaatgc

SEQ ID NO: 351835 - DNA, 15 bp, Homo sapiens
ttagataaaaatgct

SEQ ID NO: 351836 - DNA, 15 bp, Homo sapiens
tagataaaaatgctt

SEQ ID NO: 351837 - DNA, 15 bp, Homo sapiens
agataaaaatgcttt

SEQ ID NO: 351838 - DNA, 15 bp, Homo sapiens
gataaaaatgctttc

SEQ ID NO: 351839 - DNA, 15 bp, Homo sapiens
ataaaaatgctttct

SEQ ID NO: 351840 - DNA, 15 bp, Homo sapiens
taaaaatgctttcta

SEQ ID NO: 351841 - DNA, 15 bp, Homo sapiens
aaaaatgctttctaa

SEQ ID NO: 351842 - DNA, 15 bp, Homo sapiens
aaaatgctttctaat

SEQ ID NO: 351843 - DNA, 15 bp, Homo sapiens
aaatgctttctaatg

SEQ ID NO: 351844 - DNA, 15 bp, Homo sapiens
aatgctttctaatgc

SEQ ID NO: 351845 - DNA, 15 bp, Homo sapiens
atgctttctaatgca

SEQ ID NO: 351846 - DNA, 15 bp, Homo sapiens
tgctttctaatgcat

SEQ ID NO: 351847 - DNA, 15 bp, Homo sapiens
gctttctaatgcatt

SEQ ID NO: 351848 - DNA, 15 bp, Homo sapiens
ctttctaatgcattt

SEQ ID NO: 351849 - DNA, 15 bp, Homo sapiens
tttctaatgcatttt

SEQ ID NO: 351850 - DNA, 15 bp, Homo sapiens
ttctaatgcatttta

SEQ ID NO: 351851 - DNA, 15 bp, Homo sapiens
tctaatgcattttaa

SEQ ID NO: 351852 - DNA, 15 bp, Homo sapiens
ctaatgcattttaaa

SEQ ID NO: 351853 - DNA, 15 bp, Homo sapiens
taatgcattttaaag

SEQ ID NO: 351854 - DNA, 15 bp, Homo sapiens
aatgcattttaaagt

SEQ ID NO: 351855 - DNA, 15 bp, Homo sapiens
atgcattttaaagtg

SEQ ID NO: 351856 - DNA, 15 bp, Homo sapiens
tgcattttaaagtga

SEQ ID NO: 351857 - DNA, 15 bp, Homo sapiens
gcattttaaagtgac

SEQ ID NO: 351858 - DNA, 15 bp, Homo sapiens
cattttaaagtgact

SEQ ID NO: 351859 - DNA, 15 bp, Homo sapiens
attttaaagtgactt

SEQ ID NO: 351860 - DNA, 15 bp, Homo sapiens
ttttaaagtgacttt

SEQ ID NO: 351861 - DNA, 15 bp, Homo sapiens
tttaaagtgactttt

SEQ ID NO: 351862 - DNA, 15 bp, Homo sapiens
ttaaagtgacttttg

SEQ ID NO: 351863 - DNA, 15 bp, Homo sapiens
taaagtgacttttga

SEQ ID NO: 351864 - DNA, 15 bp, Homo sapiens
aaagtgacttttgac

SEQ ID NO: 351865 - DNA, 15 bp, Homo sapiens
aagtgacttttgact

SEQ ID NO: 351866 - DNA, 15 bp, Homo sapiens
agtgacttttgactt

SEQ ID NO: 351867 - DNA, 15 bp, Homo sapiens
gtgacttttgacttt

SEQ ID NO: 351868 - DNA, 15 bp, Homo sapiens
tgacttttgacttta

SEQ ID NO: 351869 - DNA, 15 bp, Homo sapiens
gacttttgactttat

SEQ ID NO: 351870 - DNA, 15 bp, Homo sapiens
acttttgactttata

SEQ ID NO: 351871 - DNA, 15 bp, Homo sapiens
cttttgactttatat

SEQ ID NO: 351872 - DNA, 15 bp, Homo sapiens
ttttgactttatata

SEQ ID NO: 351873 - DNA, 15 bp, Homo sapiens
tttgactttatatag

SEQ ID NO: 351874 - DNA, 15 bp, Homo sapiens
ttgactttatatagc

SEQ ID NO: 351875 - DNA, 15 bp, Homo sapiens
tgactttatatagcc

SEQ ID NO: 351876 - DNA, 15 bp, Homo sapiens
gactttatatagccc

SEQ ID NO: 351877 - DNA, 15 bp, Homo sapiens
actttatatagccca

SEQ ID NO: 351878 - DNA, 15 bp, Homo sapiens
ctttatatagcccat

SEQ ID NO: 351879 - DNA, 15 bp, Homo sapiens
tttatatagcccatt

SEQ ID NO: 351880 - DNA, 15 bp, Homo sapiens
ttatatagcccattt

SEQ ID NO: 351881 - DNA, 15 bp, Homo sapiens
tatatagcccatttt

SEQ ID NO: 351882 - DNA, 15 bp, Homo sapiens
atatagcccatttta

SEQ ID NO: 351883 - DNA, 15 bp, Homo sapiens
tatagcccattttac

SEQ ID NO: 351884 - DNA, 15 bp, Homo sapiens
atagcccattttact

SEQ ID NO: 351885 - DNA, 15 bp, Homo sapiens
tagcccattttacta

SEQ ID NO: 351886 - DNA, 15 bp, Homo sapiens
agcccattttactat

SEQ ID NO: 351887 - DNA, 15 bp, Homo sapiens
gcccattttactata

SEQ ID NO: 351888 - DNA, 15 bp, Homo sapiens
cccattttactatat

SEQ ID NO: 351889 - DNA, 15 bp, Homo sapiens
ccattttactatatc

SEQ ID NO: 351890 - DNA, 15 bp, Homo sapiens
cattttactatatct

SEQ ID NO: 351891 - DNA, 15 bp, Homo sapiens
attttactatatctg

SEQ ID NO: 351892 - DNA, 15 bp, Homo sapiens
ttttactatatctgt

SEQ ID NO: 351893 - DNA, 15 bp, Homo sapiens
tttactatatctgtg

SEQ ID NO: 351894 - DNA, 15 bp, Homo sapiens
ttactatatctgtgc

SEQ ID NO: 351895 - DNA, 15 bp, Homo sapiens
tactatatctgtgca

SEQ ID NO: 351896 - DNA, 15 bp, Homo sapiens
actatatctgtgcag

SEQ ID NO: 351897 - DNA, 15 bp, Homo sapiens
ctatatctgtgcaga

SEQ ID NO: 351898 - DNA, 15 bp, Homo sapiens
tatatctgtgcagac

SEQ ID NO: 351899 - DNA, 15 bp, Homo sapiens
atatctgtgcagaca

SEQ ID NO: 351900 - DNA, 15 bp, Homo sapiens
tatctgtgcagacac

SEQ ID NO: 351901 - DNA, 15 bp, Homo sapiens
atctgtgcagacaca

SEQ ID NO: 351902 - DNA, 15 bp, Homo sapiens
tctgtgcagacacat

SEQ ID NO: 351903 - DNA, 15 bp, Homo sapiens
ctgtgcagacacatt

SEQ ID NO: 351904 - DNA, 15 bp, Homo sapiens
tgtgcagacacattt

SEQ ID NO: 351905 - DNA, 15 bp, Homo sapiens
gtgcagacacatttt

SEQ ID NO: 351906 - DNA, 15 bp, Homo sapiens
tgcagacacattttt

SEQ ID NO: 351907 - DNA, 15 bp, Homo sapiens
gcagacacatttttg

SEQ ID NO: 351908 - DNA, 15 bp, Homo sapiens
cagacacatttttgt

SEQ ID NO: 351909 - DNA, 15 bp, Homo sapiens
agacacatttttgtg

SEQ ID NO: 351910 - DNA, 15 bp, Homo sapiens
gacacatttttgtgc

SEQ ID NO: 351911 - DNA, 15 bp, Homo sapiens
acacatttttgtgca

SEQ ID NO: 351912 - DNA, 15 bp, Homo sapiens
cacatttttgtgcat

SEQ ID NO: 351913 - DNA, 15 bp, Homo sapiens
acatttttgtgcata

SEQ ID NO: 351914 - DNA, 15 bp, Homo sapiens
catttttgtgcatat

SEQ ID NO: 351915 - DNA, 15 bp, Homo sapiens
atttttgtgcatatt

SEQ ID NO: 351916 - DNA, 15 bp, Homo sapiens
tttttgtgcatattt

SEQ ID NO: 351917 - DNA, 15 bp, Homo sapiens
ttttgtgcatatttt

SEQ ID NO: 351918 - DNA, 15 bp, Homo sapiens
tttgtgcatattttt

SEQ ID NO: 351919 - DNA, 15 bp, Homo sapiens
ttgtgcatattttta

SEQ ID NO: 351920 - DNA, 15 bp, Homo sapiens
tgtgcatatttttaa

SEQ ID NO: 351921 - DNA, 15 bp, Homo sapiens
gtgcatatttttaat

SEQ ID NO: 351922 - DNA, 15 bp, Homo sapiens
tgcatatttttaatc

SEQ ID NO: 351923 - DNA, 15 bp, Homo sapiens
gcatatttttaatct

SEQ ID NO: 351924 - DNA, 15 bp, Homo sapiens
catatttttaatctt

SEQ ID NO: 351925 - DNA, 15 bp, Homo sapiens
atatttttaatcttt

SEQ ID NO: 351926 - DNA, 15 bp, Homo sapiens
tatttttaatctttt

SEQ ID NO: 351927 - DNA, 15 bp, Homo sapiens
atttttaatctttta

SEQ ID NO: 351928 - DNA, 15 bp, Homo sapiens
tttttaatcttttaa

SEQ ID NO: 351929 - DNA, 15 bp, Homo sapiens
ttttaatcttttaaa

SEQ ID NO: 351930 - DNA, 15 bp, Homo sapiens
tttaatcttttaaaa

SEQ ID NO: 351931 - DNA, 15 bp, Homo sapiens
ttaatcttttaaaac

SEQ ID NO: 351932 - DNA, 15 bp, Homo sapiens
taatcttttaaaact

SEQ ID NO: 351933 - DNA, 15 bp, Homo sapiens
aatcttttaaaactt

SEQ ID NO: 351934 - DNA, 15 bp, Homo sapiens
atcttttaaaacttt

SEQ ID NO: 351935 - DNA, 15 bp, Homo sapiens
tcttttaaaactttt

SEQ ID NO: 351936 - DNA, 15 bp, Homo sapiens
cttttaaaacttttt

SEQ ID NO: 351937 - DNA, 15 bp, Homo sapiens
ttttaaaactttttc

SEQ ID NO: 351938 - DNA, 15 bp, Homo sapiens
tttaaaactttttcc

SEQ ID NO: 351939 - DNA, 15 bp, Homo sapiens
ttaaaactttttcca

SEQ ID NO: 351940 - DNA, 15 bp, Homo sapiens
taaaactttttccag

SEQ ID NO: 351941 - DNA, 15 bp, Homo sapiens
aaaactttttccaga

SEQ ID NO: 351942 - DNA, 15 bp, Homo sapiens
aaactttttccagac

SEQ ID NO: 351943 - DNA, 15 bp, Homo sapiens
aactttttccagacc

SEQ ID NO: 351944 - DNA, 15 bp, Homo sapiens
actttttccagaccc

SEQ ID NO: 351945 - DNA, 15 bp, Homo sapiens
ctttttccagaccct

SEQ ID NO: 351946 - DNA, 15 bp, Homo sapiens
tttttccagaccctt

SEQ ID NO: 351947 - DNA, 15 bp, Homo sapiens
ttttccagacccttg

SEQ ID NO: 351948 - DNA, 15 bp, Homo sapiens
tttccagacccttga

SEQ ID NO: 351949 - DNA, 15 bp, Homo sapiens
ttccagacccttgat

SEQ ID NO: 351950 - DNA, 15 bp, Homo sapiens
tccagacccttgatg

SEQ ID NO: 351951 - DNA, 15 bp, Homo sapiens
ccagacccttgatga

SEQ ID NO: 351952 - DNA, 15 bp, Homo sapiens
cagacccttgatgaa

SEQ ID NO: 351953 - DNA, 15 bp, Homo sapiens
agacccttgatgaaa

SEQ ID NO: 351954 - DNA, 15 bp, Homo sapiens
gacccttgatgaaat

SEQ ID NO: 351955 - DNA, 15 bp, Homo sapiens
acccttgatgaaatc

SEQ ID NO: 351956 - DNA, 15 bp, Homo sapiens
cccttgatgaaatcc

SEQ ID NO: 351957 - DNA, 15 bp, Homo sapiens
ccttgatgaaatcct

SEQ ID NO: 351958 - DNA, 15 bp, Homo sapiens
cttgatgaaatcctt

SEQ ID NO: 351959 - DNA, 15 bp, Homo sapiens
ttgatgaaatccttg

SEQ ID NO: 351960 - DNA, 15 bp, Homo sapiens
tgatgaaatccttga

SEQ ID NO: 351961 - DNA, 15 bp, Homo sapiens
gatgaaatccttgag

SEQ ID NO: 351962 - DNA, 15 bp, Homo sapiens
atgaaatccttgaga

SEQ ID NO: 351963 - DNA, 15 bp, Homo sapiens
tgaaatccttgagaa

SEQ ID NO: 351964 - DNA, 15 bp, Homo sapiens
gaaatccttgagaat

SEQ ID NO: 351965 - DNA, 15 bp, Homo sapiens
aaatccttgagaatc

SEQ ID NO: 351966 - DNA, 15 bp, Homo sapiens
aatccttgagaatca

SEQ ID NO: 351967 - DNA, 15 bp, Homo sapiens
atccttgagaatcag

SEQ ID NO: 351968 - DNA, 15 bp, Homo sapiens
tccttgagaatcaga

SEQ ID NO: 351969 - DNA, 15 bp, Homo sapiens
ccttgagaatcagaa

SEQ ID NO: 351970 - DNA, 15 bp, Homo sapiens
cttgagaatcagaaa

SEQ ID NO: 351971 - DNA, 15 bp, Homo sapiens
ttgagaatcagaaac

SEQ ID NO: 351972 - DNA, 15 bp, Homo sapiens
tgagaatcagaaacc

SEQ ID NO: 351973 - DNA, 15 bp, Homo sapiens
gagaatcagaaacct

SEQ ID NO: 351974 - DNA, 15 bp, Homo sapiens
agaatcagaaacctg

SEQ ID NO: 351975 - DNA, 15 bp, Homo sapiens
gaatcagaaacctgc

SEQ ID NO: 351976 - DNA, 15 bp, Homo sapiens
aatcagaaacctgca

SEQ ID NO: 351977 - DNA, 15 bp, Homo sapiens
atcagaaacctgcat

SEQ ID NO: 351978 - DNA, 15 bp, Homo sapiens
tcagaaacctgcatt

SEQ ID NO: 351979 - DNA, 15 bp, Homo sapiens
cagaaacctgcatta

SEQ ID NO: 351980 - DNA, 15 bp, Homo sapiens
agaaacctgcattac

SEQ ID NO: 351981 - DNA, 15 bp, Homo sapiens
gaaacctgcattaca

SEQ ID NO: 351982 - DNA, 15 bp, Homo sapiens
aaacctgcattacat

SEQ ID NO: 351983 - DNA, 15 bp, Homo sapiens
aacctgcattacata

SEQ ID NO: 351984 - DNA, 15 bp, Homo sapiens
acctgcattacataa

SEQ ID NO: 351985 - DNA, 15 bp, Homo sapiens
cctgcattacataaa

SEQ ID NO: 351986 - DNA, 15 bp, Homo sapiens
ctgcattacataaac

SEQ ID NO: 351987 - DNA, 15 bp, Homo sapiens
tgcattacataaact

SEQ ID NO: 351988 - DNA, 15 bp, Homo sapiens
gcattacataaactt

SEQ ID NO: 351989 - DNA, 15 bp, Homo sapiens
cattacataaacttg

SEQ ID NO: 351990 - DNA, 15 bp, Homo sapiens
attacataaacttgc

SEQ ID NO: 351991 - DNA, 15 bp, Homo sapiens
ttacataaacttgca

SEQ ID NO: 351992 - DNA, 15 bp, Homo sapiens
tacataaacttgcag

SEQ ID NO: 351993 - DNA, 15 bp, Homo sapiens
acataaacttgcaga

SEQ ID NO: 351994 - DNA, 15 bp, Homo sapiens
cataaacttgcagaa

SEQ ID NO: 351995 - DNA, 15 bp, Homo sapiens
ataaacttgcagaag

SEQ ID NO: 351996 - DNA, 15 bp, Homo sapiens
taaacttgcagaaga

SEQ ID NO: 351997 - DNA, 15 bp, Homo sapiens
aaacttgcagaagaa

SEQ ID NO: 351998 - DNA, 15 bp, Homo sapiens
aacttgcagaagaaa

SEQ ID NO: 351999 - DNA, 15 bp, Homo sapiens
acttgcagaagaaac

SEQ ID NO: 352000 - DNA, 15 bp, Homo sapiens
cttgcagaagaaaca

SEQ ID NO: 352001 - DNA, 15 bp, Homo sapiens
ttgcagaagaaacaa

SEQ ID NO: 352002 - DNA, 15 bp, Homo sapiens
tgcagaagaaacaaa

SEQ ID NO: 352003 - DNA, 15 bp, Homo sapiens
gcagaagaaacaaag

SEQ ID NO: 352004 - DNA, 15 bp, Homo sapiens
cagaagaaacaaagg

SEQ ID NO: 352005 - DNA, 15 bp, Homo sapiens
agaagaaacaaaggc

SEQ ID NO: 352006 - DNA, 15 bp, Homo sapiens
gaagaaacaaaggct

SEQ ID NO: 352007 - DNA, 15 bp, Homo sapiens
aagaaacaaaggctc

SEQ ID NO: 352008 - DNA, 15 bp, Homo sapiens
agaaacaaaggctct

SEQ ID NO: 352009 - DNA, 15 bp, Homo sapiens
gaaacaaaggctctg

SEQ ID NO: 352010 - DNA, 15 bp, Homo sapiens
aaacaaaggctctgg

SEQ ID NO: 352011 - DNA, 15 bp, Homo sapiens
aacaaaggctctgga

SEQ ID NO: 352012 - DNA, 15 bp, Homo sapiens
acaaaggctctggag

SEQ ID NO: 352013 - DNA, 15 bp, Homo sapiens
caaaggctctggaga

SEQ ID NO: 352014 - DNA, 15 bp, Homo sapiens
aaaggctctggagaa

SEQ ID NO: 352015 - DNA, 15 bp, Homo sapiens
aaggctctggagaaa

SEQ ID NO: 352016 - DNA, 15 bp, Homo sapiens
aggctctggagaaaa

SEQ ID NO: 352017 - DNA, 15 bp, Homo sapiens
ggctctggagaaaaa

SEQ ID NO: 352018 - DNA, 15 bp, Homo sapiens
gctctggagaaaaat

SEQ ID NO: 352019 - DNA, 15 bp, Homo sapiens
ctctggagaaaaatg

SEQ ID NO: 352020 - DNA, 15 bp, Homo sapiens
tctggagaaaaatgt

SEQ ID NO: 352021 - DNA, 15 bp, Homo sapiens
ctggagaaaaatgtt

SEQ ID NO: 352022 - DNA, 15 bp, Homo sapiens
tggagaaaaatgttc

SEQ ID NO: 352023 - DNA, 15 bp, Homo sapiens
ggagaaaaatgttca

SEQ ID NO: 352024 - DNA, 15 bp, Homo sapiens
gagaaaaatgttcat

SEQ ID NO: 352025 - DNA, 15 bp, Homo sapiens
agaaaaatgttcatc

SEQ ID NO: 352026 - DNA, 15 bp, Homo sapiens
gaaaaatgttcatcc

SEQ ID NO: 352027 - DNA, 15 bp, Homo sapiens
aaaaatgttcatcct

SEQ ID NO: 352028 - DNA, 15 bp, Homo sapiens
aaaatgttcatcctg

SEQ ID NO: 352029 - DNA, 15 bp, Homo sapiens
aaatgttcatcctga

SEQ ID NO: 352030 - DNA, 15 bp, Homo sapiens
aatgttcatcctgat

SEQ ID NO: 352031 - DNA, 15 bp, Homo sapiens
atgttcatcctgatg

SEQ ID NO: 352032 - DNA, 15 bp, Homo sapiens
tgttcatcctgatgt

SEQ ID NO: 352033 - DNA, 15 bp, Homo sapiens
gttcatcctgatgta

SEQ ID NO: 352034 - DNA, 15 bp, Homo sapiens
ttcatcctgatgtag

SEQ ID NO: 352035 - DNA, 15 bp, Homo sapiens
tcatcctgatgtaga

SEQ ID NO: 352036 - DNA, 15 bp, Homo sapiens
catcctgatgtagaa

SEQ ID NO: 352037 - DNA, 15 bp, Homo sapiens
atcctgatgtagaaa

SEQ ID NO: 352038 - DNA, 15 bp, Homo sapiens
tcctgatgtagaaaa

SEQ ID NO: 352039 - DNA, 15 bp, Homo sapiens
cctgatgtagaaaaa

SEQ ID NO: 352040 - DNA, 15 bp, Homo sapiens
ctgatgtagaaaaat

SEQ ID NO: 352041 - DNA, 15 bp, Homo sapiens
tgatgtagaaaaatt

SEQ ID NO: 352042 - DNA, 15 bp, Homo sapiens
gatgtagaaaaatta

SEQ ID NO: 352043 - DNA, 15 bp, Homo sapiens
atgtagaaaaattat

SEQ ID NO: 352044 - DNA, 15 bp, Homo sapiens
tgtagaaaaattata

SEQ ID NO: 352045 - DNA, 15 bp, Homo sapiens
gtagaaaaattatat

SEQ ID NO: 352046 - DNA, 15 bp, Homo sapiens
tagaaaaattatata

SEQ ID NO: 352047 - DNA, 15 bp, Homo sapiens
agaaaaattatataa

SEQ ID NO: 352048 - DNA, 15 bp, Homo sapiens
gaaaaattatataag

SEQ ID NO: 352049 - DNA, 15 bp, Homo sapiens
aaaaattatataagc

SEQ ID NO: 352050 - DNA, 15 bp, Homo sapiens
aaaattatataagca

SEQ ID NO: 352051 - DNA, 15 bp, Homo sapiens
aaattatataagcaa

SEQ ID NO: 352052 - DNA, 15 bp, Homo sapiens
aattatataagcaag

SEQ ID NO: 352053 - DNA, 15 bp, Homo sapiens
attatataagcaaga

SEQ ID NO: 352054 - DNA, 15 bp, Homo sapiens
ttatataagcaagaa

SEQ ID NO: 352055 - DNA, 15 bp, Homo sapiens
tatataagcaagaat

SEQ ID NO: 352056 - DNA, 15 bp, Homo sapiens
atataagcaagaatt

SEQ ID NO: 352057 - DNA, 15 bp, Homo sapiens
tataagcaagaattt

SEQ ID NO: 352058 - DNA, 15 bp, Homo sapiens
ataagcaagaatttg

SEQ ID NO: 352059 - DNA, 15 bp, Homo sapiens
taagcaagaatttga

SEQ ID NO: 352060 - DNA, 15 bp, Homo sapiens
aagcaagaatttgat

SEQ ID NO: 352061 - DNA, 15 bp, Homo sapiens
agcaagaatttgatg

SEQ ID NO: 352062 - DNA, 15 bp, Homo sapiens
gcaagaatttgatga

SEQ ID NO: 352063 - DNA, 15 bp, Homo sapiens
caagaatttgatgat

SEQ ID NO: 352064 - DNA, 15 bp, Homo sapiens
aagaatttgatgatg

SEQ ID NO: 352065 - DNA, 15 bp, Homo sapiens
agaatttgatgatgt

SEQ ID NO: 352066 - DNA, 15 bp, Homo sapiens
gaatttgatgatgtg

SEQ ID NO: 352067 - DNA, 15 bp, Homo sapiens
aatttgatgatgtgc

SEQ ID NO: 352068 - DNA, 15 bp, Homo sapiens
atttgatgatgtgca

SEQ ID NO: 352069 - DNA, 15 bp, Homo sapiens
tttgatgatgtgcaa

SEQ ID NO: 352070 - DNA, 15 bp, Homo sapiens
ttgatgatgtgcaag

SEQ ID NO: 352071 - DNA, 15 bp, Homo sapiens
tgatgatgtgcaagg

SEQ ID NO: 352072 - DNA, 15 bp, Homo sapiens
gatgatgtgcaagga

SEQ ID NO: 352073 - DNA, 15 bp, Homo sapiens
atgatgtgcaaggaa

SEQ ID NO: 352074 - DNA, 15 bp, Homo sapiens
tgatgtgcaaggaaa

SEQ ID NO: 352075 - DNA, 15 bp, Homo sapiens
gatgtgcaaggaaag

SEQ ID NO: 352076 - DNA, 15 bp, Homo sapiens
atgtgcaaggaaagt

SEQ ID NO: 352077 - DNA, 15 bp, Homo sapiens
tgtgcaaggaaagtg

SEQ ID NO: 352078 - DNA, 15 bp, Homo sapiens
gtgcaaggaaagtgg

SEQ ID NO: 352079 - DNA, 15 bp, Homo sapiens
tgcaaggaaagtgga

SEQ ID NO: 352080 - DNA, 15 bp, Homo sapiens
gcaaggaaagtggaa

SEQ ID NO: 352081 - DNA, 15 bp, Homo sapiens
caaggaaagtggaac

SEQ ID NO: 352082 - DNA, 15 bp, Homo sapiens
aaggaaagtggaaca

SEQ ID NO: 352083 - DNA, 15 bp, Homo sapiens
aggaaagtggaacaa

SEQ ID NO: 352084 - DNA, 15 bp, Homo sapiens
ggaaagtggaacaag

SEQ ID NO: 352085 - DNA, 15 bp, Homo sapiens
gaaagtggaacaagc

SEQ ID NO: 352086 - DNA, 15 bp, Homo sapiens
aaagtggaacaagct

SEQ ID NO: 352087 - DNA, 15 bp, Homo sapiens
aagtggaacaagcta

SEQ ID NO: 352088 - DNA, 15 bp, Homo sapiens
agtggaacaagctaa

SEQ ID NO: 352089 - DNA, 15 bp, Homo sapiens
gtggaacaagctaaa

SEQ ID NO: 352090 - DNA, 15 bp, Homo sapiens
tggaacaagctaaag

SEQ ID NO: 352091 - DNA, 15 bp, Homo sapiens
ggaacaagctaaagg

SEQ ID NO: 352092 - DNA, 15 bp, Homo sapiens
gaacaagctaaaggt

SEQ ID NO: 352093 - DNA, 15 bp, Homo sapiens
aacaagctaaaggtc

SEQ ID NO: 352094 - DNA, 15 bp, Homo sapiens
acaagctaaaggtct

SEQ ID NO: 352095 - DNA, 15 bp, Homo sapiens
caagctaaaggtctt

SEQ ID NO: 352096 - DNA, 15 bp, Homo sapiens
aagctaaaggtcttg

SEQ ID NO: 352097 - DNA, 15 bp, Homo sapiens
agctaaaggtcttgg

SEQ ID NO: 352098 - DNA, 15 bp, Homo sapiens
gctaaaggtcttggt

SEQ ID NO: 352099 - DNA, 15 bp, Homo sapiens
ctaaaggtcttggtt

SEQ ID NO: 352100 - DNA, 15 bp, Homo sapiens
taaaggtcttggttt

SEQ ID NO: 352101 - DNA, 15 bp, Homo sapiens
aaaggtcttggtttc

SEQ ID NO: 352102 - DNA, 15 bp, Homo sapiens
aaggtcttggtttcc

SEQ ID NO: 352103 - DNA, 15 bp, Homo sapiens
aggtcttggtttcca

SEQ ID NO: 352104 - DNA, 15 bp, Homo sapiens
ggtcttggtttccaa

SEQ ID NO: 352105 - DNA, 15 bp, Homo sapiens
gtcttggtttccaaa

SEQ ID NO: 352106 - DNA, 15 bp, Homo sapiens
tcttggtttccaaag

SEQ ID NO: 352107 - DNA, 15 bp, Homo sapiens
cttggtttccaaaga

SEQ ID NO: 352108 - DNA, 15 bp, Homo sapiens
ttggtttccaaagat

SEQ ID NO: 352109 - DNA, 15 bp, Homo sapiens
tggtttccaaagatc

SEQ ID NO: 352110 - DNA, 15 bp, Homo sapiens
ggtttccaaagatct

SEQ ID NO: 352111 - DNA, 15 bp, Homo sapiens
gtttccaaagatcta

SEQ ID NO: 352112 - DNA, 15 bp, Homo sapiens
tttccaaagatctac

SEQ ID NO: 352113 - DNA, 15 bp, Homo sapiens
ttccaaagatctaca

SEQ ID NO: 352114 - DNA, 15 bp, Homo sapiens
tccaaagatctacat

SEQ ID NO: 352115 - DNA, 15 bp, Homo sapiens
ccaaagatctacatt

SEQ ID NO: 352116 - DNA, 15 bp, Homo sapiens
caaagatctacattt

SEQ ID NO: 352117 - DNA, 15 bp, Homo sapiens
aaagatctacatttg

SEQ ID NO: 352118 - DNA, 15 bp, Homo sapiens
aagatctacatttgc

SEQ ID NO: 352119 - DNA, 15 bp, Homo sapiens
agatctacatttgct

SEQ ID NO: 352120 - DNA, 15 bp, Homo sapiens
gatctacatttgctt

SEQ ID NO: 352121 - DNA, 15 bp, Homo sapiens
atctacatttgcttg

SEQ ID NO: 352122 - DNA, 15 bp, Homo sapiens
tctacatttgcttga

SEQ ID NO: 352123 - DNA, 15 bp, Homo sapiens
ctacatttgcttgag

SEQ ID NO: 352124 - DNA, 15 bp, Homo sapiens
tacatttgcttgagg

SEQ ID NO: 352125 - DNA, 15 bp, Homo sapiens
acatttgcttgagga

SEQ ID NO: 352126 - DNA, 15 bp, Homo sapiens
catttgcttgaggaa

SEQ ID NO: 352127 - DNA, 15 bp, Homo sapiens
atttgcttgaggaaa

SEQ ID NO: 352128 - DNA, 15 bp, Homo sapiens
tttgcttgaggaaat

SEQ ID NO: 352129 - DNA, 15 bp, Homo sapiens
ttgcttgaggaaatt

SEQ ID NO: 352130 - DNA, 15 bp, Homo sapiens
tgcttgaggaaattg

SEQ ID NO: 352131 - DNA, 15 bp, Homo sapiens
gcttgaggaaattgc

SEQ ID NO: 352132 - DNA, 15 bp, Homo sapiens
cttgaggaaattgct

SEQ ID NO: 352133 - DNA, 15 bp, Homo sapiens
ttgaggaaattgctc

SEQ ID NO: 352134 - DNA, 15 bp, Homo sapiens
tgaggaaattgctct

SEQ ID NO: 352135 - DNA, 15 bp, Homo sapiens
gaggaaattgctctc

SEQ ID NO: 352136 - DNA, 15 bp, Homo sapiens
aggaaattgctctca

SEQ ID NO: 352137 - DNA, 15 bp, Homo sapiens
ggaaattgctctcac

SEQ ID NO: 352138 - DNA, 15 bp, Homo sapiens
gaaattgctctcaca

SEQ ID NO: 352139 - DNA, 15 bp, Homo sapiens
aaattgctctcacac

SEQ ID NO: 352140 - DNA, 15 bp, Homo sapiens
aattgctctcacact

SEQ ID NO: 352141 - DNA, 15 bp, Homo sapiens
attgctctcacactc

SEQ ID NO: 352142 - DNA, 15 bp, Homo sapiens
ttgctctcacactca

SEQ ID NO: 352143 - DNA, 15 bp, Homo sapiens
tgctctcacactcag

SEQ ID NO: 352144 - DNA, 15 bp, Homo sapiens
gctctcacactcaga

SEQ ID NO: 352145 - DNA, 15 bp, Homo sapiens
ctctcacactcagag

SEQ ID NO: 352146 - DNA, 15 bp, Homo sapiens
tctcacactcagagc

SEQ ID NO: 352147 - DNA, 15 bp, Homo sapiens
ctcacactcagagct

SEQ ID NO: 352148 - DNA, 15 bp, Homo sapiens
tcacactcagagctt

SEQ ID NO: 352149 - DNA, 15 bp, Homo sapiens
cacactcagagcttt

SEQ ID NO: 352150 - DNA, 15 bp, Homo sapiens
acactcagagctttt

SEQ ID NO: 352151 - DNA, 15 bp, Homo sapiens
cactcagagcttttg

SEQ ID NO: 352152 - DNA, 15 bp, Homo sapiens
actcagagcttttga

SEQ ID NO: 352153 - DNA, 15 bp, Homo sapiens
ctcagagcttttgag

SEQ ID NO: 352154 - DNA, 15 bp, Homo sapiens
tcagagcttttgagg

SEQ ID NO: 352155 - DNA, 15 bp, Homo sapiens
cagagcttttgaggt

SEQ ID NO: 352156 - DNA, 15 bp, Homo sapiens
agagcttttgaggta

SEQ ID NO: 352157 - DNA, 15 bp, Homo sapiens
gagcttttgaggtaa

SEQ ID NO: 352158 - DNA, 15 bp, Homo sapiens
agcttttgaggtaaa

SEQ ID NO: 352159 - DNA, 15 bp, Homo sapiens
gcttttgaggtaaat

SEQ ID NO: 352160 - DNA, 15 bp, Homo sapiens
cttttgaggtaaatc

SEQ ID NO: 352161 - DNA, 15 bp, Homo sapiens
ttttgaggtaaatcc

SEQ ID NO: 352162 - DNA, 15 bp, Homo sapiens
tttgaggtaaatcca

SEQ ID NO: 352163 - DNA, 15 bp, Homo sapiens
ttgaggtaaatccag

SEQ ID NO: 352164 - DNA, 15 bp, Homo sapiens
tgaggtaaatccaga

SEQ ID NO: 352165 - DNA, 15 bp, Homo sapiens
gaggtaaatccagag

SEQ ID NO: 352166 - DNA, 15 bp, Homo sapiens
aggtaaatccagagg

SEQ ID NO: 352167 - DNA, 15 bp, Homo sapiens
ggtaaatccagaggc

SEQ ID NO: 352168 - DNA, 15 bp, Homo sapiens
gtaaatccagaggcc

SEQ ID NO: 352169 - DNA, 15 bp, Homo sapiens
taaatccagaggcca

SEQ ID NO: 352170 - DNA, 15 bp, Homo sapiens
aaatccagaggccac

SEQ ID NO: 352171 - DNA, 15 bp, Homo sapiens
aatccagaggccact

SEQ ID NO: 352172 - DNA, 15 bp, Homo sapiens
atccagaggccactg

SEQ ID NO: 352173 - DNA, 15 bp, Homo sapiens
tccagaggccactgg

SEQ ID NO: 352174 - DNA, 15 bp, Homo sapiens
ccagaggccactggg

SEQ ID NO: 352175 - DNA, 15 bp, Homo sapiens
cagaggccactggga

SEQ ID NO: 352176 - DNA, 15 bp, Homo sapiens
agaggccactgggag

SEQ ID NO: 352177 - DNA, 15 bp, Homo sapiens
gaggccactgggagt

SEQ ID NO: 352178 - DNA, 15 bp, Homo sapiens
aggccactgggagtt

SEQ ID NO: 352179 - DNA, 15 bp, Homo sapiens
ggccactgggagttt

SEQ ID NO: 352180 - DNA, 15 bp, Homo sapiens
gccactgggagttta

SEQ ID NO: 352181 - DNA, 15 bp, Homo sapiens
ccactgggagtttaa

SEQ ID NO: 352182 - DNA, 15 bp, Homo sapiens
cactgggagtttaag

SEQ ID NO: 352183 - DNA, 15 bp, Homo sapiens
actgggagtttaagt

SEQ ID NO: 352184 - DNA, 15 bp, Homo sapiens
ctgggagtttaagtt

SEQ ID NO: 352185 - DNA, 15 bp, Homo sapiens
tgggagtttaagttt

SEQ ID NO: 352186 - DNA, 15 bp, Homo sapiens
gggagtttaagttta

SEQ ID NO: 352187 - DNA, 15 bp, Homo sapiens
ggagtttaagtttat

SEQ ID NO: 352188 - DNA, 15 bp, Homo sapiens
gagtttaagtttatt

SEQ ID NO: 352189 - DNA, 15 bp, Homo sapiens
agtttaagtttatta

SEQ ID NO: 352190 - DNA, 15 bp, Homo sapiens
gtttaagtttattac

SEQ ID NO: 352191 - DNA, 15 bp, Homo sapiens
tttaagtttattacg

SEQ ID NO: 352192 - DNA, 15 bp, Homo sapiens
ttaagtttattacgg

SEQ ID NO: 352193 - DNA, 15 bp, Homo sapiens
taagtttattacggg

SEQ ID NO: 352194 - DNA, 15 bp, Homo sapiens
aagtttattacgggg

SEQ ID NO: 352195 - DNA, 15 bp, Homo sapiens
agtttattacggggt

SEQ ID NO: 352196 - DNA, 15 bp, Homo sapiens
gtttattacggggta

SEQ ID NO: 352197 - DNA, 15 bp, Homo sapiens
tttattacggggtaa

SEQ ID NO: 352198 - DNA, 15 bp, Homo sapiens
ttattacggggtaaa

SEQ ID NO: 352199 - DNA, 15 bp, Homo sapiens
tattacggggtaaat

SEQ ID NO: 352200 - DNA, 15 bp, Homo sapiens
attacggggtaaata

SEQ ID NO: 352201 - DNA, 15 bp, Homo sapiens
ttacggggtaaatag

SEQ ID NO: 352202 - DNA, 15 bp, Homo sapiens
tacggggtaaatagt

SEQ ID NO: 352203 - DNA, 15 bp, Homo sapiens
acggggtaaatagta

SEQ ID NO: 352204 - DNA, 15 bp, Homo sapiens
cggggtaaatagtaa

SEQ ID NO: 352205 - DNA, 15 bp, Homo sapiens
ggggtaaatagtaat

SEQ ID NO: 352206 - DNA, 15 bp, Homo sapiens
gggtaaatagtaatt

SEQ ID NO: 352207 - DNA, 15 bp, Homo sapiens
ggtaaatagtaatta

SEQ ID NO: 352208 - DNA, 15 bp, Homo sapiens
gtaaatagtaattat

SEQ ID NO: 352209 - DNA, 15 bp, Homo sapiens
taaatagtaattatc

SEQ ID NO: 352210 - DNA, 15 bp, Homo sapiens
aaatagtaattatct

SEQ ID NO: 352211 - DNA, 15 bp, Homo sapiens
aatagtaattatctt

SEQ ID NO: 352212 - DNA, 15 bp, Homo sapiens
atagtaattatctta

SEQ ID NO: 352213 - DNA, 15 bp, Homo sapiens
tagtaattatcttat

SEQ ID NO: 352214 - DNA, 15 bp, Homo sapiens
agtaattatcttata

SEQ ID NO: 352215 - DNA, 15 bp, Homo sapiens
gtaattatcttataa

SEQ ID NO: 352216 - DNA, 15 bp, Homo sapiens
taattatcttataag

SEQ ID NO: 352217 - DNA, 15 bp, Homo sapiens
aattatcttataaga

SEQ ID NO: 352218 - DNA, 15 bp, Homo sapiens
attatcttataagat

SEQ ID NO: 352219 - DNA, 15 bp, Homo sapiens
ttatcttataagatt

SEQ ID NO: 352220 - DNA, 15 bp, Homo sapiens
tatcttataagattc

SEQ ID NO: 352221 - DNA, 15 bp, Homo sapiens
atcttataagattca

SEQ ID NO: 352222 - DNA, 15 bp, Homo sapiens
tcttataagattcac

SEQ ID NO: 352223 - DNA, 15 bp, Homo sapiens
cttataagattcacg

SEQ ID NO: 352224 - DNA, 15 bp, Homo sapiens
ttataagattcacgt

SEQ ID NO: 352225 - DNA, 15 bp, Homo sapiens
tataagattcacgta

SEQ ID NO: 352226 - DNA, 15 bp, Homo sapiens
ataagattcacgtat

SEQ ID NO: 352227 - DNA, 15 bp, Homo sapiens
taagattcacgtatt

SEQ ID NO: 352228 - DNA, 15 bp, Homo sapiens
aagattcacgtattt

SEQ ID NO: 352229 - DNA, 15 bp, Homo sapiens
agattcacgtattta

SEQ ID NO: 352230 - DNA, 15 bp, Homo sapiens
gattcacgtatttat

SEQ ID NO: 352231 - DNA, 15 bp, Homo sapiens
attcacgtatttatt

SEQ ID NO: 352232 - DNA, 15 bp, Homo sapiens
ttcacgtatttatta

SEQ ID NO: 352233 - DNA, 15 bp, Homo sapiens
tcacgtatttattat

SEQ ID NO: 352234 - DNA, 15 bp, Homo sapiens
cacgtatttattatt

SEQ ID NO: 352235 - DNA, 15 bp, Homo sapiens
acgtatttattattt

SEQ ID NO: 352236 - DNA, 15 bp, Homo sapiens
cgtatttattattta

SEQ ID NO: 352237 - DNA, 15 bp, Homo sapiens
gtatttattatttaa

SEQ ID NO: 352238 - DNA, 15 bp, Homo sapiens
tatttattatttaaa

SEQ ID NO: 352239 - DNA, 15 bp, Homo sapiens
atttattatttaaat

SEQ ID NO: 352240 - DNA, 15 bp, Homo sapiens
tttattatttaaata

SEQ ID NO: 352241 - DNA, 15 bp, Homo sapiens
ttattatttaaatat

SEQ ID NO: 352242 - DNA, 15 bp, Homo sapiens
tattatttaaatatt

SEQ ID NO: 352243 - DNA, 15 bp, Homo sapiens
attatttaaatattt

SEQ ID NO: 352244 - DNA, 15 bp, Homo sapiens
ttatttaaatatttt

SEQ ID NO: 352245 - DNA, 15 bp, Homo sapiens
atttaaatattttac

SEQ ID NO: 352246 - DNA, 15 bp, Homo sapiens
tttaaatattttaca

SEQ ID NO: 352247 - DNA, 15 bp, Homo sapiens
ttaaatattttacat

SEQ ID NO: 352248 - DNA, 15 bp, Homo sapiens
aaatattttacattc

SEQ ID NO: 352249 - DNA, 15 bp, Homo sapiens
aatattttacattct

SEQ ID NO: 352250 - DNA, 15 bp, Homo sapiens
atattttacattctt

SEQ ID NO: 352251 - DNA, 15 bp, Homo sapiens
tattttacattcttt

SEQ ID NO: 352252 - DNA, 15 bp, Homo sapiens
attttacattctttc

SEQ ID NO: 352253 - DNA, 15 bp, Homo sapiens
ttttacattctttct

SEQ ID NO: 352254 - DNA, 15 bp, Homo sapiens
tttacattctttcta

SEQ ID NO: 352255 - DNA, 15 bp, Homo sapiens
ttacattctttctag

SEQ ID NO: 352256 - DNA, 15 bp, Homo sapiens
tacattctttctaga

SEQ ID NO: 352257 - DNA, 15 bp, Homo sapiens
acattctttctagat

SEQ ID NO: 352258 - DNA, 15 bp, Homo sapiens
cattctttctagatc

SEQ ID NO: 352259 - DNA, 15 bp, Homo sapiens
attctttctagatcc

SEQ ID NO: 352260 - DNA, 15 bp, Homo sapiens
ttctttctagatccc

SEQ ID NO: 352261 - DNA, 15 bp, Homo sapiens
tctttctagatcccc

SEQ ID NO: 352262 - DNA, 15 bp, Homo sapiens
ctttctagatcccca

SEQ ID NO: 352263 - DNA, 15 bp, Homo sapiens
tttctagatccccat

SEQ ID NO: 352264 - DNA, 15 bp, Homo sapiens
ttctagatccccatt

SEQ ID NO: 352265 - DNA, 15 bp, Homo sapiens
tctagatccccattt

SEQ ID NO: 352266 - DNA, 15 bp, Homo sapiens
ctagatccccattta

SEQ ID NO: 352267 - DNA, 15 bp, Homo sapiens
tagatccccatttat

SEQ ID NO: 352268 - DNA, 15 bp, Homo sapiens
agatccccatttatt

SEQ ID NO: 352269 - DNA, 15 bp, Homo sapiens
gatccccatttatta

SEQ ID NO: 352270 - DNA, 15 bp, Homo sapiens
atccccatttattat

SEQ ID NO: 352271 - DNA, 15 bp, Homo sapiens
tccccatttattatg

SEQ ID NO: 352272 - DNA, 15 bp, Homo sapiens
ccccatttattatgt

SEQ ID NO: 352273 - DNA, 15 bp, Homo sapiens
cccatttattatgta

SEQ ID NO: 352274 - DNA, 15 bp, Homo sapiens
ccatttattatgtat

SEQ ID NO: 352275 - DNA, 15 bp, Homo sapiens
catttattatgtatt

SEQ ID NO: 352276 - DNA, 15 bp, Homo sapiens
atttattatgtattt

SEQ ID NO: 352277 - DNA, 15 bp, Homo sapiens
tttattatgtattta

SEQ ID NO: 352278 - DNA, 15 bp, Homo sapiens
ttattatgtatttaa

SEQ ID NO: 352279 - DNA, 15 bp, Homo sapiens
tattatgtatttaag

SEQ ID NO: 352280 - DNA, 15 bp, Homo sapiens
attatgtatttaagt

SEQ ID NO: 352281 - DNA, 15 bp, Homo sapiens
ttatgtatttaagtt

SEQ ID NO: 352282 - DNA, 15 bp, Homo sapiens
tatgtatttaagttg

SEQ ID NO: 352283 - DNA, 15 bp, Homo sapiens
atgtatttaagttgg

SEQ ID NO: 352284 - DNA, 15 bp, Homo sapiens
tgtatttaagttggg

SEQ ID NO: 352285 - DNA, 15 bp, Homo sapiens
gtatttaagttggga

SEQ ID NO: 352286 - DNA, 15 bp, Homo sapiens
tatttaagttgggac

SEQ ID NO: 352287 - DNA, 15 bp, Homo sapiens
atttaagttgggact

SEQ ID NO: 352288 - DNA, 15 bp, Homo sapiens
tttaagttgggactt

SEQ ID NO: 352289 - DNA, 15 bp, Homo sapiens
ttaagttgggactta

SEQ ID NO: 352290 - DNA, 15 bp, Homo sapiens
taagttgggacttat

SEQ ID NO: 352291 - DNA, 15 bp, Homo sapiens
aagttgggacttatc

SEQ ID NO: 352292 - DNA, 15 bp, Homo sapiens
agttgggacttatca

SEQ ID NO: 352293 - DNA, 15 bp, Homo sapiens
gttgggacttatcaa

SEQ ID NO: 352294 - DNA, 15 bp, Homo sapiens
ttgggacttatcaaa

SEQ ID NO: 352295 - DNA, 15 bp, Homo sapiens
tgggacttatcaaag

SEQ ID NO: 352296 - DNA, 15 bp, Homo sapiens
gggacttatcaaaga

SEQ ID NO: 352297 - DNA, 15 bp, Homo sapiens
ggacttatcaaagat

SEQ ID NO: 352298 - DNA, 15 bp, Homo sapiens
gacttatcaaagatg

SEQ ID NO: 352299 - DNA, 15 bp, Homo sapiens
acttatcaaagatgt

SEQ ID NO: 352300 - DNA, 15 bp, Homo sapiens
cttatcaaagatgta

SEQ ID NO: 352301 - DNA, 15 bp, Homo sapiens
ttatcaaagatgtac

SEQ ID NO: 352302 - DNA, 15 bp, Homo sapiens
tatcaaagatgtact

SEQ ID NO: 352303 - DNA, 15 bp, Homo sapiens
atcaaagatgtactt

SEQ ID NO: 352304 - DNA, 15 bp, Homo sapiens
tcaaagatgtacttt

SEQ ID NO: 352305 - DNA, 15 bp, Homo sapiens
caaagatgtactttt

SEQ ID NO: 352306 - DNA, 15 bp, Homo sapiens
aaagatgtactttta

SEQ ID NO: 352307 - DNA, 15 bp, Homo sapiens
aagatgtacttttaa

SEQ ID NO: 352308 - DNA, 15 bp, Homo sapiens
agatgtacttttaat

SEQ ID NO: 352309 - DNA, 15 bp, Homo sapiens
gatgtacttttaatg

SEQ ID NO: 352310 - DNA, 15 bp, Homo sapiens
atgtacttttaatgt

SEQ ID NO: 352311 - DNA, 15 bp, Homo sapiens
tgtacttttaatgtg

SEQ ID NO: 352312 - DNA, 15 bp, Homo sapiens
gtacttttaatgtgc

SEQ ID NO: 352313 - DNA, 15 bp, Homo sapiens
tacttttaatgtgct

SEQ ID NO: 352314 - DNA, 15 bp, Homo sapiens
acttttaatgtgcta

SEQ ID NO: 352315 - DNA, 15 bp, Homo sapiens
cttttaatgtgctag

SEQ ID NO: 352316 - DNA, 15 bp, Homo sapiens
ttttaatgtgctaga

SEQ ID NO: 352317 - DNA, 15 bp, Homo sapiens
tttaatgtgctagag

SEQ ID NO: 352318 - DNA, 15 bp, Homo sapiens
ttaatgtgctagaga

SEQ ID NO: 352319 - DNA, 15 bp, Homo sapiens
taatgtgctagagag

SEQ ID NO: 352320 - DNA, 15 bp, Homo sapiens
aatgtgctagagagc

SEQ ID NO: 352321 - DNA, 15 bp, Homo sapiens
atgtgctagagagca

SEQ ID NO: 352322 - DNA, 15 bp, Homo sapiens
tgtgctagagagcac

SEQ ID NO: 352323 - DNA, 15 bp, Homo sapiens
gtgctagagagcaca

SEQ ID NO: 352324 - DNA, 15 bp, Homo sapiens
tgctagagagcacat

SEQ ID NO: 352325 - DNA, 15 bp, Homo sapiens
gctagagagcacatt

SEQ ID NO: 352326 - DNA, 15 bp, Homo sapiens
ctagagagcacattt

SEQ ID NO: 352327 - DNA, 15 bp, Homo sapiens
tagagagcacattta

SEQ ID NO: 352328 - DNA, 15 bp, Homo sapiens
agagagcacatttat

SEQ ID NO: 352329 - DNA, 15 bp, Homo sapiens
gagagcacatttatt

SEQ ID NO: 352330 - DNA, 15 bp, Homo sapiens
agagcacatttattt

SEQ ID NO: 352331 - DNA, 15 bp, Homo sapiens
gagcacatttatttc

SEQ ID NO: 352332 - DNA, 15 bp, Homo sapiens
agcacatttatttcc

SEQ ID NO: 352333 - DNA, 15 bp, Homo sapiens
gcacatttatttcct

SEQ ID NO: 352334 - DNA, 15 bp, Homo sapiens
cacatttatttcctt

SEQ ID NO: 352335 - DNA, 15 bp, Homo sapiens
acatttatttccttt

SEQ ID NO: 352336 - DNA, 15 bp, Homo sapiens
catttatttcctttt

SEQ ID NO: 352337 - DNA, 15 bp, Homo sapiens
atttatttccttttg

SEQ ID NO: 352338 - DNA, 15 bp, Homo sapiens
tttatttccttttgc

SEQ ID NO: 352339 - DNA, 15 bp, Homo sapiens
ttatttccttttgcc

SEQ ID NO: 352340 - DNA, 15 bp, Homo sapiens
tatttccttttgcct

SEQ ID NO: 352341 - DNA, 15 bp, Homo sapiens
atttccttttgcctg

SEQ ID NO: 352342 - DNA, 15 bp, Homo sapiens
tttccttttgcctgg

SEQ ID NO: 352343 - DNA, 15 bp, Homo sapiens
ttccttttgcctgga

SEQ ID NO: 352344 - DNA, 15 bp, Homo sapiens
tccttttgcctggaa

SEQ ID NO: 352345 - DNA, 15 bp, Homo sapiens
ccttttgcctggaag

SEQ ID NO: 352346 - DNA, 15 bp, Homo sapiens
cttttgcctggaagc

SEQ ID NO: 352347 - DNA, 15 bp, Homo sapiens
ttttgcctggaagca

SEQ ID NO: 352348 - DNA, 15 bp, Homo sapiens
tttgcctggaagcaa

SEQ ID NO: 352349 - DNA, 15 bp, Homo sapiens
ttgcctggaagcaaa

SEQ ID NO: 352350 - DNA, 15 bp, Homo sapiens
tgcctggaagcaaag

SEQ ID NO: 352351 - DNA, 15 bp, Homo sapiens
gcctggaagcaaagt

SEQ ID NO: 352352 - DNA, 15 bp, Homo sapiens
cctggaagcaaagtc

SEQ ID NO: 352353 - DNA, 15 bp, Homo sapiens
ctggaagcaaagtca

SEQ ID NO: 352354 - DNA, 15 bp, Homo sapiens
tggaagcaaagtcaa

SEQ ID NO: 352355 - DNA, 15 bp, Homo sapiens
ggaagcaaagtcaaa

SEQ ID NO: 352356 - DNA, 15 bp, Homo sapiens
gaagcaaagtcaaaa

SEQ ID NO: 352357 - DNA, 15 bp, Homo sapiens
aagcaaagtcaaaag

SEQ ID NO: 352358 - DNA, 15 bp, Homo sapiens
agcaaagtcaaaagt

SEQ ID NO: 352359 - DNA, 15 bp, Homo sapiens
gcaaagtcaaaagta

SEQ ID NO: 352360 - DNA, 15 bp, Homo sapiens
caaagtcaaaagtag

SEQ ID NO: 352361 - DNA, 15 bp, Homo sapiens
aaagtcaaaagtaga

SEQ ID NO: 352362 - DNA, 15 bp, Homo sapiens
aagtcaaaagtagag

SEQ ID NO: 352363 - DNA, 15 bp, Homo sapiens
agtcaaaagtagagt

SEQ ID NO: 352364 - DNA, 15 bp, Homo sapiens
gtcaaaagtagagta

SEQ ID NO: 352365 - DNA, 15 bp, Homo sapiens
tcaaaagtagagtaa

SEQ ID NO: 352366 - DNA, 15 bp, Homo sapiens
caaaagtagagtaaa

SEQ ID NO: 352367 - DNA, 15 bp, Homo sapiens
aaaagtagagtaaac

SEQ ID NO: 352368 - DNA, 15 bp, Homo sapiens
aaagtagagtaaact

SEQ ID NO: 352369 - DNA, 15 bp, Homo sapiens
aagtagagtaaactg

SEQ ID NO: 352370 - DNA, 15 bp, Homo sapiens
agtagagtaaactgg

SEQ ID NO: 352371 - DNA, 15 bp, Homo sapiens
gtagagtaaactgga

SEQ ID NO: 352372 - DNA, 15 bp, Homo sapiens
tagagtaaactggac

SEQ ID NO: 352373 - DNA, 15 bp, Homo sapiens
agagtaaactggacc

SEQ ID NO: 352374 - DNA, 15 bp, Homo sapiens
gagtaaactggacct

SEQ ID NO: 352375 - DNA, 15 bp, Homo sapiens
agtaaactggacctt

SEQ ID NO: 352376 - DNA, 15 bp, Homo sapiens
gtaaactggaccttg

SEQ ID NO: 352377 - DNA, 15 bp, Homo sapiens
taaactggaccttga

SEQ ID NO: 352378 - DNA, 15 bp, Homo sapiens
aaactggaccttgaa

SEQ ID NO: 352379 - DNA, 15 bp, Homo sapiens
aactggaccttgaag

SEQ ID NO: 352380 - DNA, 15 bp, Homo sapiens
actggaccttgaaga

SEQ ID NO: 352381 - DNA, 15 bp, Homo sapiens
ctggaccttgaagat

SEQ ID NO: 352382 - DNA, 15 bp, Homo sapiens
tggaccttgaagata

SEQ ID NO: 352383 - DNA, 15 bp, Homo sapiens
ggaccttgaagataa

SEQ ID NO: 352384 - DNA, 15 bp, Homo sapiens
gaccttgaagataag

SEQ ID NO: 352385 - DNA, 15 bp, Homo sapiens
accttgaagataaga

SEQ ID NO: 352386 - DNA, 15 bp, Homo sapiens
ccttgaagataagag

SEQ ID NO: 352387 - DNA, 15 bp, Homo sapiens
cttgaagataagaga

SEQ ID NO: 352388 - DNA, 15 bp, Homo sapiens
ttgaagataagagaa

SEQ ID NO: 352389 - DNA, 15 bp, Homo sapiens
tgaagataagagaaa

SEQ ID NO: 352390 - DNA, 15 bp, Homo sapiens
gaagataagagaaaa

SEQ ID NO: 352391 - DNA, 15 bp, Homo sapiens
aagataagagaaaat

SEQ ID NO: 352392 - DNA, 15 bp, Homo sapiens
agataagagaaaatt

SEQ ID NO: 352393 - DNA, 15 bp, Homo sapiens
gataagagaaaattg

SEQ ID NO: 352394 - DNA, 15 bp, Homo sapiens
ataagagaaaattgc

SEQ ID NO: 352395 - DNA, 15 bp, Homo sapiens
taagagaaaattgct

SEQ ID NO: 352396 - DNA, 15 bp, Homo sapiens
aagagaaaattgctt

SEQ ID NO: 352397 - DNA, 15 bp, Homo sapiens
agagaaaattgctta

SEQ ID NO: 352398 - DNA, 15 bp, Homo sapiens
gagaaaattgcttaa

SEQ ID NO: 352399 - DNA, 15 bp, Homo sapiens
agaaaattgcttaaa

SEQ ID NO: 352400 - DNA, 15 bp, Homo sapiens
gaaaattgcttaaaa

SEQ ID NO: 352401 - DNA, 15 bp, Homo sapiens
aaaattgcttaaaaa

SEQ ID NO: 352402 - DNA, 15 bp, Homo sapiens
aaattgcttaaaaat

SEQ ID NO: 352403 - DNA, 15 bp, Homo sapiens
aattgcttaaaaatg

SEQ ID NO: 352404 - DNA, 15 bp, Homo sapiens
attgcttaaaaatgg

SEQ ID NO: 352405 - DNA, 15 bp, Homo sapiens
ttgcttaaaaatggt

SEQ ID NO: 352406 - DNA, 15 bp, Homo sapiens
tgcttaaaaatggtc

SEQ ID NO: 352407 - DNA, 15 bp, Homo sapiens
gcttaaaaatggtca

SEQ ID NO: 352408 - DNA, 15 bp, Homo sapiens
cttaaaaatggtcaa

SEQ ID NO: 352409 - DNA, 15 bp, Homo sapiens
ttaaaaatggtcaaa

SEQ ID NO: 352410 - DNA, 15 bp, Homo sapiens
taaaaatggtcaaaa

SEQ ID NO: 352411 - DNA, 15 bp, Homo sapiens
aaaaatggtcaaaat

SEQ ID NO: 352412 - DNA, 15 bp, Homo sapiens
aaaatggtcaaaata

SEQ ID NO: 352413 - DNA, 15 bp, Homo sapiens
aaatggtcaaaataa

SEQ ID NO: 352414 - DNA, 15 bp, Homo sapiens
aatggtcaaaataat

SEQ ID NO: 352415 - DNA, 15 bp, Homo sapiens
atggtcaaaataatg

SEQ ID NO: 352416 - DNA, 15 bp, Homo sapiens
tggtcaaaataatgt

SEQ ID NO: 352417 - DNA, 15 bp, Homo sapiens
ggtcaaaataatgtt

SEQ ID NO: 352418 - DNA, 15 bp, Homo sapiens
gtcaaaataatgttt

SEQ ID NO: 352419 - DNA, 15 bp, Homo sapiens
tcaaaataatgtttc

SEQ ID NO: 352420 - DNA, 15 bp, Homo sapiens
caaaataatgtttca

SEQ ID NO: 352421 - DNA, 15 bp, Homo sapiens
aaaataatgtttcag

SEQ ID NO: 352422 - DNA, 15 bp, Homo sapiens
aaataatgtttcagg

SEQ ID NO: 352423 - DNA, 15 bp, Homo sapiens
aataatgtttcaggc

SEQ ID NO: 352424 - DNA, 15 bp, Homo sapiens
ataatgtttcaggca

SEQ ID NO: 352425 - DNA, 15 bp, Homo sapiens
taatgtttcaggcat

SEQ ID NO: 352426 - DNA, 15 bp, Homo sapiens
aatgtttcaggcatg

SEQ ID NO: 352427 - DNA, 15 bp, Homo sapiens
atgtttcaggcatgg

SEQ ID NO: 352428 - DNA, 15 bp, Homo sapiens
tgtttcaggcatgga

SEQ ID NO: 352429 - DNA, 15 bp, Homo sapiens
gtttcaggcatggag

SEQ ID NO: 352430 - DNA, 15 bp, Homo sapiens
tttcaggcatggagg

SEQ ID NO: 352431 - DNA, 15 bp, Homo sapiens
ttcaggcatggaggg

SEQ ID NO: 352432 - DNA, 15 bp, Homo sapiens
tcaggcatggagggc

SEQ ID NO: 352433 - DNA, 15 bp, Homo sapiens
caggcatggagggcc

SEQ ID NO: 352434 - DNA, 15 bp, Homo sapiens
aggcatggagggcct

SEQ ID NO: 352435 - DNA, 15 bp, Homo sapiens
ggcatggagggcctg

SEQ ID NO: 352436 - DNA, 15 bp, Homo sapiens
gcatggagggcctgt

SEQ ID NO: 352437 - DNA, 15 bp, Homo sapiens
catggagggcctgtg

SEQ ID NO: 352438 - DNA, 15 bp, Homo sapiens
atggagggcctgtgt

SEQ ID NO: 352439 - DNA, 15 bp, Homo sapiens
tggagggcctgtgtg

SEQ ID NO: 352440 - DNA, 15 bp, Homo sapiens
ggagggcctgtgtga

SEQ ID NO: 352441 - DNA, 15 bp, Homo sapiens
gagggcctgtgtgaa

SEQ ID NO: 352442 - DNA, 15 bp, Homo sapiens
agggcctgtgtgaaa

SEQ ID NO: 352443 - DNA, 15 bp, Homo sapiens
gggcctgtgtgaaat

SEQ ID NO: 352444 - DNA, 15 bp, Homo sapiens
ggcctgtgtgaaata

SEQ ID NO: 352445 - DNA, 15 bp, Homo sapiens
gcctgtgtgaaatac

SEQ ID NO: 352446 - DNA, 15 bp, Homo sapiens
cctgtgtgaaataca

SEQ ID NO: 352447 - DNA, 15 bp, Homo sapiens
ctgtgtgaaatacag

SEQ ID NO: 352448 - DNA, 15 bp, Homo sapiens
tgtgtgaaatacaga

SEQ ID NO: 352449 - DNA, 15 bp, Homo sapiens
gtgtgaaatacagac

SEQ ID NO: 352450 - DNA, 15 bp, Homo sapiens
tgtgaaatacagact

SEQ ID NO: 352451 - DNA, 15 bp, Homo sapiens
gtgaaatacagactg

SEQ ID NO: 352452 - DNA, 15 bp, Homo sapiens
tgaaatacagactgt

SEQ ID NO: 352453 - DNA, 15 bp, Homo sapiens
gaaatacagactgtt

SEQ ID NO: 352454 - DNA, 15 bp, Homo sapiens
aaatacagactgttg

SEQ ID NO: 352455 - DNA, 15 bp, Homo sapiens
aatacagactgttga

SEQ ID NO: 352456 - DNA, 15 bp, Homo sapiens
atacagactgttgat

SEQ ID NO: 352457 - DNA, 15 bp, Homo sapiens
tacagactgttgatt

SEQ ID NO: 352458 - DNA, 15 bp, Homo sapiens
acagactgttgatta

SEQ ID NO: 352459 - DNA, 15 bp, Homo sapiens
cagactgttgattag

SEQ ID NO: 352460 - DNA, 15 bp, Homo sapiens
agactgttgattaga

SEQ ID NO: 352461 - DNA, 15 bp, Homo sapiens
gactgttgattagat

SEQ ID NO: 352462 - DNA, 15 bp, Homo sapiens
actgttgattagatt

SEQ ID NO: 352463 - DNA, 15 bp, Homo sapiens
ctgttgattagatta

SEQ ID NO: 352464 - DNA, 15 bp, Homo sapiens
tgttgattagattat

SEQ ID NO: 352465 - DNA, 15 bp, Homo sapiens
gttgattagattata

SEQ ID NO: 352466 - DNA, 15 bp, Homo sapiens
ttgattagattatag

SEQ ID NO: 352467 - DNA, 15 bp, Homo sapiens
tgattagattatagt

SEQ ID NO: 352468 - DNA, 15 bp, Homo sapiens
gattagattatagta

SEQ ID NO: 352469 - DNA, 15 bp, Homo sapiens
attagattatagtag

SEQ ID NO: 352470 - DNA, 15 bp, Homo sapiens
ttagattatagtagt

SEQ ID NO: 352471 - DNA, 15 bp, Homo sapiens
tagattatagtagta

SEQ ID NO: 352472 - DNA, 15 bp, Homo sapiens
agattatagtagtaa

SEQ ID NO: 352473 - DNA, 15 bp, Homo sapiens
gattatagtagtaac

SEQ ID NO: 352474 - DNA, 15 bp, Homo sapiens
attatagtagtaact

SEQ ID NO: 352475 - DNA, 15 bp, Homo sapiens
ttatagtagtaactt

SEQ ID NO: 352476 - DNA, 15 bp, Homo sapiens
tatagtagtaacttg

SEQ ID NO: 352477 - DNA, 15 bp, Homo sapiens
atagtagtaacttgg

SEQ ID NO: 352478 - DNA, 15 bp, Homo sapiens
tagtagtaacttggt

SEQ ID NO: 352479 - DNA, 15 bp, Homo sapiens
agtagtaacttggtt

SEQ ID NO: 352480 - DNA, 15 bp, Homo sapiens
gtagtaacttggttg

SEQ ID NO: 352481 - DNA, 15 bp, Homo sapiens
tagtaacttggttgg

SEQ ID NO: 352482 - DNA, 15 bp, Homo sapiens
agtaacttggttggg

SEQ ID NO: 352483 - DNA, 15 bp, Homo sapiens
gtaacttggttgggg

SEQ ID NO: 352484 - DNA, 15 bp, Homo sapiens
taacttggttggggt

SEQ ID NO: 352485 - DNA, 15 bp, Homo sapiens
aacttggttggggtg

SEQ ID NO: 352486 - DNA, 15 bp, Homo sapiens
acttggttggggtgg

SEQ ID NO: 352487 - DNA, 15 bp, Homo sapiens
cttggttggggtggt

SEQ ID NO: 352488 - DNA, 15 bp, Homo sapiens
ttggttggggtggta

SEQ ID NO: 352489 - DNA, 15 bp, Homo sapiens
tggttggggtggtag

SEQ ID NO: 352490 - DNA, 15 bp, Homo sapiens
ggttggggtggtaga

SEQ ID NO: 352491 - DNA, 15 bp, Homo sapiens
gttggggtggtagaa

SEQ ID NO: 352492 - DNA, 15 bp, Homo sapiens
ttggggtggtagaaa

SEQ ID NO: 352493 - DNA, 15 bp, Homo sapiens
tggggtggtagaaat

SEQ ID NO: 352494 - DNA, 15 bp, Homo sapiens
ggggtggtagaaata

SEQ ID NO: 352495 - DNA, 15 bp, Homo sapiens
gggtggtagaaatag

SEQ ID NO: 352496 - DNA, 15 bp, Homo sapiens
ggtggtagaaatagc

SEQ ID NO: 352497 - DNA, 15 bp, Homo sapiens
gtggtagaaatagcc

SEQ ID NO: 352498 - DNA, 15 bp, Homo sapiens
tggtagaaatagccc

SEQ ID NO: 352499 - DNA, 15 bp, Homo sapiens
ggtagaaatagccca

SEQ ID NO: 352500 - DNA, 15 bp, Homo sapiens
gtagaaatagcccag

SEQ ID NO: 352501 - DNA, 15 bp, Homo sapiens
tagaaatagcccagg

SEQ ID NO: 352502 - DNA, 15 bp, Homo sapiens
agaaatagcccaggt

SEQ ID NO: 352503 - DNA, 15 bp, Homo sapiens
gaaatagcccaggta

SEQ ID NO: 352504 - DNA, 15 bp, Homo sapiens
aaatagcccaggtag

SEQ ID NO: 352505 - DNA, 15 bp, Homo sapiens
aatagcccaggtagt

SEQ ID NO: 352506 - DNA, 15 bp, Homo sapiens
atagcccaggtagta

SEQ ID NO: 352507 - DNA, 15 bp, Homo sapiens
tagcccaggtagtag

SEQ ID NO: 352508 - DNA, 15 bp, Homo sapiens
agcccaggtagtagt

SEQ ID NO: 352509 - DNA, 15 bp, Homo sapiens
gcccaggtagtagta

SEQ ID NO: 352510 - DNA, 15 bp, Homo sapiens
cccaggtagtagtaa

SEQ ID NO: 352511 - DNA, 15 bp, Homo sapiens
ccaggtagtagtaaa

SEQ ID NO: 352512 - DNA, 15 bp, Homo sapiens
caggtagtagtaaat

SEQ ID NO: 352513 - DNA, 15 bp, Homo sapiens
aggtagtagtaaatt

SEQ ID NO: 352514 - DNA, 15 bp, Homo sapiens
ggtagtagtaaattg

SEQ ID NO: 352515 - DNA, 15 bp, Homo sapiens
gtagtagtaaattgc

SEQ ID NO: 352516 - DNA, 15 bp, Homo sapiens
tagtagtaaattgct

SEQ ID NO: 352517 - DNA, 15 bp, Homo sapiens
agtagtaaattgctg

SEQ ID NO: 352518 - DNA, 15 bp, Homo sapiens
gtagtaaattgctga

SEQ ID NO: 352519 - DNA, 15 bp, Homo sapiens
tagtaaattgctgaa

SEQ ID NO: 352520 - DNA, 15 bp, Homo sapiens
agtaaattgctgaat

SEQ ID NO: 352521 - DNA, 15 bp, Homo sapiens
gtaaattgctgaata

SEQ ID NO: 352522 - DNA, 15 bp, Homo sapiens
taaattgctgaatac

SEQ ID NO: 352523 - DNA, 15 bp, Homo sapiens
aaattgctgaataca

SEQ ID NO: 352524 - DNA, 15 bp, Homo sapiens
aattgctgaatacat

SEQ ID NO: 352525 - DNA, 15 bp, Homo sapiens
attgctgaatacatg

SEQ ID NO: 352526 - DNA, 15 bp, Homo sapiens
ttgctgaatacatga

SEQ ID NO: 352527 - DNA, 15 bp, Homo sapiens
tgctgaatacatgaa

SEQ ID NO: 352528 - DNA, 15 bp, Homo sapiens
gctgaatacatgaaa

SEQ ID NO: 352529 - DNA, 15 bp, Homo sapiens
ctgaatacatgaaac

SEQ ID NO: 352530 - DNA, 15 bp, Homo sapiens
tgaatacatgaaact

SEQ ID NO: 352531 - DNA, 15 bp, Homo sapiens
gaatacatgaaacta

SEQ ID NO: 352532 - DNA, 15 bp, Homo sapiens
aatacatgaaactac

SEQ ID NO: 352533 - DNA, 15 bp, Homo sapiens
atacatgaaactact

SEQ ID NO: 352534 - DNA, 15 bp, Homo sapiens
tacatgaaactactt

SEQ ID NO: 352535 - DNA, 15 bp, Homo sapiens
acatgaaactacttt

SEQ ID NO: 352536 - DNA, 15 bp, Homo sapiens
catgaaactactttt

SEQ ID NO: 352537 - DNA, 15 bp, Homo sapiens
atgaaactacttttt

SEQ ID NO: 352538 - DNA, 15 bp, Homo sapiens
tgaaactactttttg

SEQ ID NO: 352539 - DNA, 15 bp, Homo sapiens
gaaactactttttgc

SEQ ID NO: 352540 - DNA, 15 bp, Homo sapiens
aaactactttttgca

SEQ ID NO: 352541 - DNA, 15 bp, Homo sapiens
aactactttttgcag

SEQ ID NO: 352542 - DNA, 15 bp, Homo sapiens
actactttttgcagg

SEQ ID NO: 352543 - DNA, 15 bp, Homo sapiens
ctactttttgcaggt

SEQ ID NO: 352544 - DNA, 15 bp, Homo sapiens
tactttttgcaggtt

SEQ ID NO: 352545 - DNA, 15 bp, Homo sapiens
actttttgcaggttt

SEQ ID NO: 352546 - DNA, 15 bp, Homo sapiens
ctttttgcaggtttt

SEQ ID NO: 352547 - DNA, 15 bp, Homo sapiens
tttttgcaggttttt

SEQ ID NO: 352548 - DNA, 15 bp, Homo sapiens
ttttgcaggtttttg

SEQ ID NO: 352549 - DNA, 15 bp, Homo sapiens
tttgcaggtttttga

SEQ ID NO: 352550 - DNA, 15 bp, Homo sapiens
ttgcaggtttttgac

SEQ ID NO: 352551 - DNA, 15 bp, Homo sapiens
tgcaggtttttgaca

SEQ ID NO: 352552 - DNA, 15 bp, Homo sapiens
gcaggtttttgacat

SEQ ID NO: 352553 - DNA, 15 bp, Homo sapiens
caggtttttgacatt

SEQ ID NO: 352554 - DNA, 15 bp, Homo sapiens
aggtttttgacattt

SEQ ID NO: 352555 - DNA, 15 bp, Homo sapiens
ggtttttgacatttg

SEQ ID NO: 352556 - DNA, 15 bp, Homo sapiens
gtttttgacatttga

SEQ ID NO: 352557 - DNA, 15 bp, Homo sapiens
tttttgacatttgaa

SEQ ID NO: 352558 - DNA, 15 bp, Homo sapiens
ttttgacatttgaag

SEQ ID NO: 352559 - DNA, 15 bp, Homo sapiens
tttgacatttgaagt

SEQ ID NO: 352560 - DNA, 15 bp, Homo sapiens
ttgacatttgaagtc

SEQ ID NO: 352561 - DNA, 15 bp, Homo sapiens
tgacatttgaagtca

SEQ ID NO: 352562 - DNA, 15 bp, Homo sapiens
gacatttgaagtcaa

SEQ ID NO: 352563 - DNA, 15 bp, Homo sapiens
acatttgaagtcaaa

SEQ ID NO: 352564 - DNA, 15 bp, Homo sapiens
catttgaagtcaaaa

SEQ ID NO: 352565 - DNA, 15 bp, Homo sapiens
atttgaagtcaaaag

SEQ ID NO: 352566 - DNA, 15 bp, Homo sapiens
tttgaagtcaaaagt

SEQ ID NO: 352567 - DNA, 15 bp, Homo sapiens
ttgaagtcaaaagtc

SEQ ID NO: 352568 - DNA, 15 bp, Homo sapiens
tgaagtcaaaagtca

SEQ ID NO: 352569 - DNA, 15 bp, Homo sapiens
gaagtcaaaagtcag

SEQ ID NO: 352570 - DNA, 15 bp, Homo sapiens
aagtcaaaagtcaga

SEQ ID NO: 352571 - DNA, 15 bp, Homo sapiens
agtcaaaagtcagag

SEQ ID NO: 352572 - DNA, 15 bp, Homo sapiens
gtcaaaagtcagaga

SEQ ID NO: 352573 - DNA, 15 bp, Homo sapiens
tcaaaagtcagagat

SEQ ID NO: 352574 - DNA, 15 bp, Homo sapiens
caaaagtcagagata

SEQ ID NO: 352575 - DNA, 15 bp, Homo sapiens
aaaagtcagagatag

SEQ ID NO: 352576 - DNA, 15 bp, Homo sapiens
aaagtcagagatagg

SEQ ID NO: 352577 - DNA, 15 bp, Homo sapiens
aagtcagagataggc

SEQ ID NO: 352578 - DNA, 15 bp, Homo sapiens
agtcagagataggcc

SEQ ID NO: 352579 - DNA, 15 bp, Homo sapiens
gtcagagataggcca

SEQ ID NO: 352580 - DNA, 15 bp, Homo sapiens
tcagagataggccat

SEQ ID NO: 352581 - DNA, 15 bp, Homo sapiens
cagagataggccatt

SEQ ID NO: 352582 - DNA, 15 bp, Homo sapiens
agagataggccattg

SEQ ID NO: 352583 - DNA, 15 bp, Homo sapiens
gagataggccattga

SEQ ID NO: 352584 - DNA, 15 bp, Homo sapiens
agataggccattgac

SEQ ID NO: 352585 - DNA, 15 bp, Homo sapiens
gataggccattgaca

SEQ ID NO: 352586 - DNA, 15 bp, Homo sapiens
ataggccattgacag

SEQ ID NO: 352587 - DNA, 15 bp, Homo sapiens
taggccattgacagt

SEQ ID NO: 352588 - DNA, 15 bp, Homo sapiens
aggccattgacagtg

SEQ ID NO: 352589 - DNA, 15 bp, Homo sapiens
ggccattgacagtgt

SEQ ID NO: 352590 - DNA, 15 bp, Homo sapiens
gccattgacagtgtc

SEQ ID NO: 352591 - DNA, 15 bp, Homo sapiens
ccattgacagtgtca

SEQ ID NO: 352592 - DNA, 15 bp, Homo sapiens
cattgacagtgtcag

SEQ ID NO: 352593 - DNA, 15 bp, Homo sapiens
attgacagtgtcaga

SEQ ID NO: 352594 - DNA, 15 bp, Homo sapiens
ttgacagtgtcagag

SEQ ID NO: 352595 - DNA, 15 bp, Homo sapiens
tgacagtgtcagagt

SEQ ID NO: 352596 - DNA, 15 bp, Homo sapiens
gacagtgtcagagtg

SEQ ID NO: 352597 - DNA, 15 bp, Homo sapiens
acagtgtcagagtgg

SEQ ID NO: 352598 - DNA, 15 bp, Homo sapiens
cagtgtcagagtggg

SEQ ID NO: 352599 - DNA, 15 bp, Homo sapiens
agtgtcagagtggga

SEQ ID NO: 352600 - DNA, 15 bp, Homo sapiens
gtgtcagagtgggaa

SEQ ID NO: 352601 - DNA, 15 bp, Homo sapiens
tgtcagagtgggaag

SEQ ID NO: 352602 - DNA, 15 bp, Homo sapiens
gtcagagtgggaagg

SEQ ID NO: 352603 - DNA, 15 bp, Homo sapiens
tcagagtgggaaggc

SEQ ID NO: 352604 - DNA, 15 bp, Homo sapiens
cagagtgggaaggca

SEQ ID NO: 352605 - DNA, 15 bp, Homo sapiens
agagtgggaaggcaa

SEQ ID NO: 352606 - DNA, 15 bp, Homo sapiens
gagtgggaaggcaaa

SEQ ID NO: 352607 - DNA, 15 bp, Homo sapiens
agtgggaaggcaaat

SEQ ID NO: 352608 - DNA, 15 bp, Homo sapiens
gtgggaaggcaaatc

SEQ ID NO: 352609 - DNA, 15 bp, Homo sapiens
tgggaaggcaaatcg

SEQ ID NO: 352610 - DNA, 15 bp, Homo sapiens
gggaaggcaaatcgt

SEQ ID NO: 352611 - DNA, 15 bp, Homo sapiens
ggaaggcaaatcgtt

SEQ ID NO: 352612 - DNA, 15 bp, Homo sapiens
gaaggcaaatcgttc

SEQ ID NO: 352613 - DNA, 15 bp, Homo sapiens
aaggcaaatcgttcc

SEQ ID NO: 352614 - DNA, 15 bp, Homo sapiens
aggcaaatcgttcca

SEQ ID NO: 352615 - DNA, 15 bp, Homo sapiens
ggcaaatcgttccag

SEQ ID NO: 352616 - DNA, 15 bp, Homo sapiens
gcaaatcgttccagg

SEQ ID NO: 352617 - DNA, 15 bp, Homo sapiens
caaatcgttccaggg

SEQ ID NO: 352618 - DNA, 15 bp, Homo sapiens
aaatcgttccaggga

SEQ ID NO: 352619 - DNA, 15 bp, Homo sapiens
aatcgttccagggac

SEQ ID NO: 352620 - DNA, 15 bp, Homo sapiens
atcgttccagggaca

SEQ ID NO: 352621 - DNA, 15 bp, Homo sapiens
tcgttccagggacat

SEQ ID NO: 352622 - DNA, 15 bp, Homo sapiens
cgttccagggacatg

SEQ ID NO: 352623 - DNA, 15 bp, Homo sapiens
gttccagggacatga

SEQ ID NO: 352624 - DNA, 15 bp, Homo sapiens
ttccagggacatgaa

SEQ ID NO: 352625 - DNA, 15 bp, Homo sapiens
tccagggacatgaaa

SEQ ID NO: 352626 - DNA, 15 bp, Homo sapiens
ccagggacatgaaaa

SEQ ID NO: 352627 - DNA, 15 bp, Homo sapiens
cagggacatgaaaat

SEQ ID NO: 352628 - DNA, 15 bp, Homo sapiens
agggacatgaaaatt

SEQ ID NO: 352629 - DNA, 15 bp, Homo sapiens
gggacatgaaaattc

SEQ ID NO: 352630 - DNA, 15 bp, Homo sapiens
ggacatgaaaattca

SEQ ID NO: 352631 - DNA, 15 bp, Homo sapiens
gacatgaaaattcag

SEQ ID NO: 352632 - DNA, 15 bp, Homo sapiens
acatgaaaattcaga

SEQ ID NO: 352633 - DNA, 15 bp, Homo sapiens
catgaaaattcagaa

SEQ ID NO: 352634 - DNA, 15 bp, Homo sapiens
atgaaaattcagaaa

SEQ ID NO: 352635 - DNA, 15 bp, Homo sapiens
tgaaaattcagaaac

SEQ ID NO: 352636 - DNA, 15 bp, Homo sapiens
gaaaattcagaaaca

SEQ ID NO: 352637 - DNA, 15 bp, Homo sapiens
aaaattcagaaacag

SEQ ID NO: 352638 - DNA, 15 bp, Homo sapiens
aaattcagaaacagg

SEQ ID NO: 352639 - DNA, 15 bp, Homo sapiens
aattcagaaacagga

SEQ ID NO: 352640 - DNA, 15 bp, Homo sapiens
attcagaaacaggat

SEQ ID NO: 352641 - DNA, 15 bp, Homo sapiens
ttcagaaacaggatc

SEQ ID NO: 352642 - DNA, 15 bp, Homo sapiens
tcagaaacaggatcc

SEQ ID NO: 352643 - DNA, 15 bp, Homo sapiens
cagaaacaggatcct

SEQ ID NO: 352644 - DNA, 15 bp, Homo sapiens
agaaacaggatcctt

SEQ ID NO: 352645 - DNA, 15 bp, Homo sapiens
gaaacaggatccttc

SEQ ID NO: 352646 - DNA, 15 bp, Homo sapiens
aaacaggatccttca

SEQ ID NO: 352647 - DNA, 15 bp, Homo sapiens
aacaggatccttcac

SEQ ID NO: 352648 - DNA, 15 bp, Homo sapiens
acaggatccttcact

SEQ ID NO: 352649 - DNA, 15 bp, Homo sapiens
caggatccttcacta

SEQ ID NO: 352650 - DNA, 15 bp, Homo sapiens
aggatccttcactac

SEQ ID NO: 352651 - DNA, 15 bp, Homo sapiens
ggatccttcactaca

SEQ ID NO: 352652 - DNA, 15 bp, Homo sapiens
gatccttcactacac

SEQ ID NO: 352653 - DNA, 15 bp, Homo sapiens
atccttcactacacc

SEQ ID NO: 352654 - DNA, 15 bp, Homo sapiens
tccttcactacacct

SEQ ID NO: 352655 - DNA, 15 bp, Homo sapiens
ccttcactacacctg

SEQ ID NO: 352656 - DNA, 15 bp, Homo sapiens
cttcactacacctga

SEQ ID NO: 352657 - DNA, 15 bp, Homo sapiens
ttcactacacctgaa

SEQ ID NO: 352658 - DNA, 15 bp, Homo sapiens
tcactacacctgaaa

SEQ ID NO: 352659 - DNA, 15 bp, Homo sapiens
cactacacctgaaaa

SEQ ID NO: 352660 - DNA, 15 bp, Homo sapiens
actacacctgaaaat

SEQ ID NO: 352661 - DNA, 15 bp, Homo sapiens
ctacacctgaaaatg

SEQ ID NO: 352662 - DNA, 15 bp, Homo sapiens
tacacctgaaaatgt

SEQ ID NO: 352663 - DNA, 15 bp, Homo sapiens
acacctgaaaatgtt

SEQ ID NO: 352664 - DNA, 15 bp, Homo sapiens
cacctgaaaatgttg

SEQ ID NO: 352665 - DNA, 15 bp, Homo sapiens
acctgaaaatgttga

SEQ ID NO: 352666 - DNA, 15 bp, Homo sapiens
cctgaaaatgttgac

SEQ ID NO: 352667 - DNA, 15 bp, Homo sapiens
ctgaaaatgttgaca

SEQ ID NO: 352668 - DNA, 15 bp, Homo sapiens
tgaaaatgttgacag

SEQ ID NO: 352669 - DNA, 15 bp, Homo sapiens
gaaaatgttgacaga

SEQ ID NO: 352670 - DNA, 15 bp, Homo sapiens
aaaatgttgacagat

SEQ ID NO: 352671 - DNA, 15 bp, Homo sapiens
aaatgttgacagatg

SEQ ID NO: 352672 - DNA, 15 bp, Homo sapiens
aatgttgacagatgc

SEQ ID NO: 352673 - DNA, 15 bp, Homo sapiens
atgttgacagatgca

SEQ ID NO: 352674 - DNA, 15 bp, Homo sapiens
tgttgacagatgcag

SEQ ID NO: 352675 - DNA, 15 bp, Homo sapiens
gttgacagatgcagc

SEQ ID NO: 352676 - DNA, 15 bp, Homo sapiens
ttgacagatgcagca

SEQ ID NO: 352677 - DNA, 15 bp, Homo sapiens
tgacagatgcagcag

SEQ ID NO: 352678 - DNA, 15 bp, Homo sapiens
gacagatgcagcagt

SEQ ID NO: 352679 - DNA, 15 bp, Homo sapiens
acagatgcagcagtg

SEQ ID NO: 352680 - DNA, 15 bp, Homo sapiens
cagatgcagcagtga

SEQ ID NO: 352681 - DNA, 15 bp, Homo sapiens
agatgcagcagtgat

SEQ ID NO: 352682 - DNA, 15 bp, Homo sapiens
gatgcagcagtgata

SEQ ID NO: 352683 - DNA, 15 bp, Homo sapiens
atgcagcagtgataa

SEQ ID NO: 352684 - DNA, 15 bp, Homo sapiens
tgcagcagtgataaa

SEQ ID NO: 352685 - DNA, 15 bp, Homo sapiens
gcagcagtgataaag

SEQ ID NO: 352686 - DNA, 15 bp, Homo sapiens
cagcagtgataaagt

SEQ ID NO: 352687 - DNA, 15 bp, Homo sapiens
agcagtgataaagtt

SEQ ID NO: 352688 - DNA, 15 bp, Homo sapiens
gcagtgataaagttt

SEQ ID NO: 352689 - DNA, 15 bp, Homo sapiens
cagtgataaagttta

SEQ ID NO: 352690 - DNA, 15 bp, Homo sapiens
agtgataaagtttaa

SEQ ID NO: 352691 - DNA, 15 bp, Homo sapiens
gtgataaagtttaag

SEQ ID NO: 352692 - DNA, 15 bp, Homo sapiens
tgataaagtttaaga

SEQ ID NO: 352693 - DNA, 15 bp, Homo sapiens
gataaagtttaagag

SEQ ID NO: 352694 - DNA, 15 bp, Homo sapiens
ataaagtttaagagg

SEQ ID NO: 352695 - DNA, 15 bp, Homo sapiens
taaagtttaagagga

SEQ ID NO: 352696 - DNA, 15 bp, Homo sapiens
aaagtttaagaggaa

SEQ ID NO: 352697 - DNA, 15 bp, Homo sapiens
aagtttaagaggaaa

SEQ ID NO: 352698 - DNA, 15 bp, Homo sapiens
agtttaagaggaaag

SEQ ID NO: 352699 - DNA, 15 bp, Homo sapiens
gtttaagaggaaagg

SEQ ID NO: 352700 - DNA, 15 bp, Homo sapiens
tttaagaggaaagga

SEQ ID NO: 352701 - DNA, 15 bp, Homo sapiens
ttaagaggaaaggat

SEQ ID NO: 352702 - DNA, 15 bp, Homo sapiens
taagaggaaaggata

SEQ ID NO: 352703 - DNA, 15 bp, Homo sapiens
aagaggaaaggataa

SEQ ID NO: 352704 - DNA, 15 bp, Homo sapiens
agaggaaaggataaa

SEQ ID NO: 352705 - DNA, 15 bp, Homo sapiens
gaggaaaggataaat

SEQ ID NO: 352706 - DNA, 15 bp, Homo sapiens
aggaaaggataaatg

SEQ ID NO: 352707 - DNA, 15 bp, Homo sapiens
ggaaaggataaatgt

SEQ ID NO: 352708 - DNA, 15 bp, Homo sapiens
gaaaggataaatgtg

SEQ ID NO: 352709 - DNA, 15 bp, Homo sapiens
aaaggataaatgtga

SEQ ID NO: 352710 - DNA, 15 bp, Homo sapiens
aaggataaatgtgag

SEQ ID NO: 352711 - DNA, 15 bp, Homo sapiens
aggataaatgtgagg

SEQ ID NO: 352712 - DNA, 15 bp, Homo sapiens
ggataaatgtgagga

SEQ ID NO: 352713 - DNA, 15 bp, Homo sapiens
gataaatgtgaggat

SEQ ID NO: 352714 - DNA, 15 bp, Homo sapiens
ataaatgtgaggatg

SEQ ID NO: 352715 - DNA, 15 bp, Homo sapiens
taaatgtgaggatgt

SEQ ID NO: 352716 - DNA, 15 bp, Homo sapiens
aaatgtgaggatgta

SEQ ID NO: 352717 - DNA, 15 bp, Homo sapiens
aatgtgaggatgtat

SEQ ID NO: 352718 - DNA, 15 bp, Homo sapiens
atgtgaggatgtata

SEQ ID NO: 352719 - DNA, 15 bp, Homo sapiens
tgtgaggatgtataa

SEQ ID NO: 352720 - DNA, 15 bp, Homo sapiens
gtgaggatgtataag

SEQ ID NO: 352721 - DNA, 15 bp, Homo sapiens
tgaggatgtataagg

SEQ ID NO: 352722 - DNA, 15 bp, Homo sapiens
gaggatgtataagga

SEQ ID NO: 352723 - DNA, 15 bp, Homo sapiens
aggatgtataaggag

SEQ ID NO: 352724 - DNA, 15 bp, Homo sapiens
ggatgtataaggaga

SEQ ID NO: 352725 - DNA, 15 bp, Homo sapiens
gatgtataaggagag

SEQ ID NO: 352726 - DNA, 15 bp, Homo sapiens
atgtataaggagaga

SEQ ID NO: 352727 - DNA, 15 bp, Homo sapiens
tgtataaggagagag

SEQ ID NO: 352728 - DNA, 15 bp, Homo sapiens
gtataaggagagagt

SEQ ID NO: 352729 - DNA, 15 bp, Homo sapiens
tataaggagagagtc

SEQ ID NO: 352730 - DNA, 15 bp, Homo sapiens
ataaggagagagtca

SEQ ID NO: 352731 - DNA, 15 bp, Homo sapiens
taaggagagagtcaa

SEQ ID NO: 352732 - DNA, 15 bp, Homo sapiens
aaggagagagtcaat

SEQ ID NO: 352733 - DNA, 15 bp, Homo sapiens
aggagagagtcaatg

SEQ ID NO: 352734 - DNA, 15 bp, Homo sapiens
ggagagagtcaatgt

SEQ ID NO: 352735 - DNA, 15 bp, Homo sapiens
gagagagtcaatgtc

SEQ ID NO: 352736 - DNA, 15 bp, Homo sapiens
agagagtcaatgtca

SEQ ID NO: 352737 - DNA, 15 bp, Homo sapiens
gagagtcaatgtcaa

SEQ ID NO: 352738 - DNA, 15 bp, Homo sapiens
agagtcaatgtcaat

SEQ ID NO: 352739 - DNA, 15 bp, Homo sapiens
gagtcaatgtcaata

SEQ ID NO: 352740 - DNA, 15 bp, Homo sapiens
agtcaatgtcaatag

SEQ ID NO: 352741 - DNA, 15 bp, Homo sapiens
gtcaatgtcaataga

SEQ ID NO: 352742 - DNA, 15 bp, Homo sapiens
tcaatgtcaatagaa

SEQ ID NO: 352743 - DNA, 15 bp, Homo sapiens
caatgtcaatagaag

SEQ ID NO: 352744 - DNA, 15 bp, Homo sapiens
aatgtcaatagaagt

SEQ ID NO: 352745 - DNA, 15 bp, Homo sapiens
atgtcaatagaagtc

SEQ ID NO: 352746 - DNA, 15 bp, Homo sapiens
tgtcaatagaagtca

SEQ ID NO: 352747 - DNA, 15 bp, Homo sapiens
gtcaatagaagtcag

SEQ ID NO: 352748 - DNA, 15 bp, Homo sapiens
tcaatagaagtcagt

SEQ ID NO: 352749 - DNA, 15 bp, Homo sapiens
caatagaagtcagtg

SEQ ID NO: 352750 - DNA, 15 bp, Homo sapiens
aatagaagtcagtgt

SEQ ID NO: 352751 - DNA, 15 bp, Homo sapiens
atagaagtcagtgtc

SEQ ID NO: 352752 - DNA, 15 bp, Homo sapiens
tagaagtcagtgtca

SEQ ID NO: 352753 - DNA, 15 bp, Homo sapiens
agaagtcagtgtcag

SEQ ID NO: 352754 - DNA, 15 bp, Homo sapiens
gaagtcagtgtcaga

SEQ ID NO: 352755 - DNA, 15 bp, Homo sapiens
aagtcagtgtcagat

SEQ ID NO: 352756 - DNA, 15 bp, Homo sapiens
agtcagtgtcagatt

SEQ ID NO: 352757 - DNA, 15 bp, Homo sapiens
gtcagtgtcagattt

SEQ ID NO: 352758 - DNA, 15 bp, Homo sapiens
tcagtgtcagatttt

SEQ ID NO: 352759 - DNA, 15 bp, Homo sapiens
cagtgtcagatttta

SEQ ID NO: 352760 - DNA, 15 bp, Homo sapiens
agtgtcagattttaa

SEQ ID NO: 352761 - DNA, 15 bp, Homo sapiens
gtgtcagattttaac

SEQ ID NO: 352762 - DNA, 15 bp, Homo sapiens
tgtcagattttaaca

SEQ ID NO: 352763 - DNA, 15 bp, Homo sapiens
gtcagattttaacat

SEQ ID NO: 352764 - DNA, 15 bp, Homo sapiens
tcagattttaacatt

SEQ ID NO: 352765 - DNA, 15 bp, Homo sapiens
cagattttaacattc

SEQ ID NO: 352766 - DNA, 15 bp, Homo sapiens
agattttaacattct

SEQ ID NO: 352767 - DNA, 15 bp, Homo sapiens
gattttaacattctg

SEQ ID NO: 352768 - DNA, 15 bp, Homo sapiens
attttaacattctgc

SEQ ID NO: 352769 - DNA, 15 bp, Homo sapiens
ttttaacattctgcc

SEQ ID NO: 352770 - DNA, 15 bp, Homo sapiens
tttaacattctgcct

SEQ ID NO: 352771 - DNA, 15 bp, Homo sapiens
ttaacattctgcctg

SEQ ID NO: 352772 - DNA, 15 bp, Homo sapiens
taacattctgcctgt

SEQ ID NO: 352773 - DNA, 15 bp, Homo sapiens
aacattctgcctgtg

SEQ ID NO: 352774 - DNA, 15 bp, Homo sapiens
acattctgcctgtga

SEQ ID NO: 352775 - DNA, 15 bp, Homo sapiens
cattctgcctgtgag

SEQ ID NO: 352776 - DNA, 15 bp, Homo sapiens
attctgcctgtgaga

SEQ ID NO: 352777 - DNA, 15 bp, Homo sapiens
ttctgcctgtgagaa

SEQ ID NO: 352778 - DNA, 15 bp, Homo sapiens
tctgcctgtgagaaa

SEQ ID NO: 352779 - DNA, 15 bp, Homo sapiens
ctgcctgtgagaaag

SEQ ID NO: 352780 - DNA, 15 bp, Homo sapiens
tgcctgtgagaaaga

SEQ ID NO: 352781 - DNA, 15 bp, Homo sapiens
gcctgtgagaaagat

SEQ ID NO: 352782 - DNA, 15 bp, Homo sapiens
cctgtgagaaagatg

SEQ ID NO: 352783 - DNA, 15 bp, Homo sapiens
ctgtgagaaagatgg

SEQ ID NO: 352784 - DNA, 15 bp, Homo sapiens
tgtgagaaagatgga

SEQ ID NO: 352785 - DNA, 15 bp, Homo sapiens
gtgagaaagatggag

SEQ ID NO: 352786 - DNA, 15 bp, Homo sapiens
tgagaaagatggaga

SEQ ID NO: 352787 - DNA, 15 bp, Homo sapiens
gagaaagatggagaa

SEQ ID NO: 352788 - DNA, 15 bp, Homo sapiens
agaaagatggagaag

SEQ ID NO: 352789 - DNA, 15 bp, Homo sapiens
gaaagatggagaagc

SEQ ID NO: 352790 - DNA, 15 bp, Homo sapiens
aaagatggagaagca

SEQ ID NO: 352791 - DNA, 15 bp, Homo sapiens
aagatggagaagcag

SEQ ID NO: 352792 - DNA, 15 bp, Homo sapiens
agatggagaagcaga

SEQ ID NO: 352793 - DNA, 15 bp, Homo sapiens
gatggagaagcagag

SEQ ID NO: 352794 - DNA, 15 bp, Homo sapiens
atggagaagcagagt

SEQ ID NO: 352795 - DNA, 15 bp, Homo sapiens
tggagaagcagagtt

SEQ ID NO: 352796 - DNA, 15 bp, Homo sapiens
ggagaagcagagttt

SEQ ID NO: 352797 - DNA, 15 bp, Homo sapiens
gagaagcagagtttc

SEQ ID NO: 352798 - DNA, 15 bp, Homo sapiens
agaagcagagtttcc

SEQ ID NO: 352799 - DNA, 15 bp, Homo sapiens
gaagcagagtttcca

SEQ ID NO: 352800 - DNA, 15 bp, Homo sapiens
aagcagagtttccag

SEQ ID NO: 352801 - DNA, 15 bp, Homo sapiens
agcagagtttccagg

SEQ ID NO: 352802 - DNA, 15 bp, Homo sapiens
gcagagtttccaggt

SEQ ID NO: 352803 - DNA, 15 bp, Homo sapiens
cagagtttccaggtc

SEQ ID NO: 352804 - DNA, 15 bp, Homo sapiens
agagtttccaggtca

SEQ ID NO: 352805 - DNA, 15 bp, Homo sapiens
gagtttccaggtcac

SEQ ID NO: 352806 - DNA, 15 bp, Homo sapiens
agtttccaggtcacc

SEQ ID NO: 352807 - DNA, 15 bp, Homo sapiens
gtttccaggtcacct

SEQ ID NO: 352808 - DNA, 15 bp, Homo sapiens
tttccaggtcacctg

SEQ ID NO: 352809 - DNA, 15 bp, Homo sapiens
ttccaggtcacctgg

SEQ ID NO: 352810 - DNA, 15 bp, Homo sapiens
tccaggtcacctggt

SEQ ID NO: 352811 - DNA, 15 bp, Homo sapiens
ccaggtcacctggta

SEQ ID NO: 352812 - DNA, 15 bp, Homo sapiens
caggtcacctggtat

SEQ ID NO: 352813 - DNA, 15 bp, Homo sapiens
aggtcacctggtatt

SEQ ID NO: 352814 - DNA, 15 bp, Homo sapiens
ggtcacctggtattt

SEQ ID NO: 352815 - DNA, 15 bp, Homo sapiens
gtcacctggtatttt

SEQ ID NO: 352816 - DNA, 15 bp, Homo sapiens
tcacctggtatttta

SEQ ID NO: 352817 - DNA, 15 bp, Homo sapiens
cacctggtattttaa

SEQ ID NO: 352818 - DNA, 15 bp, Homo sapiens
acctggtattttaat

SEQ ID NO: 352819 - DNA, 15 bp, Homo sapiens
cctggtattttaata

SEQ ID NO: 352820 - DNA, 15 bp, Homo sapiens
ctggtattttaatag

SEQ ID NO: 352821 - DNA, 15 bp, Homo sapiens
tggtattttaatagg

SEQ ID NO: 352822 - DNA, 15 bp, Homo sapiens
ggtattttaatagga

SEQ ID NO: 352823 - DNA, 15 bp, Homo sapiens
gtattttaataggaa

SEQ ID NO: 352824 - DNA, 15 bp, Homo sapiens
tattttaataggaaa

SEQ ID NO: 352825 - DNA, 15 bp, Homo sapiens
attttaataggaaag

SEQ ID NO: 352826 - DNA, 15 bp, Homo sapiens
ttttaataggaaagt

SEQ ID NO: 352827 - DNA, 15 bp, Homo sapiens
tttaataggaaagtt

SEQ ID NO: 352828 - DNA, 15 bp, Homo sapiens
ttaataggaaagttc

SEQ ID NO: 352829 - DNA, 15 bp, Homo sapiens
taataggaaagttct

SEQ ID NO: 352830 - DNA, 15 bp, Homo sapiens
aataggaaagttctg

SEQ ID NO: 352831 - DNA, 15 bp, Homo sapiens
ataggaaagttctgg

SEQ ID NO: 352832 - DNA, 15 bp, Homo sapiens
taggaaagttctggg

SEQ ID NO: 352833 - DNA, 15 bp, Homo sapiens
aggaaagttctgggt

SEQ ID NO: 352834 - DNA, 15 bp, Homo sapiens
ggaaagttctgggtg

SEQ ID NO: 352835 - DNA, 15 bp, Homo sapiens
gaaagttctgggtgg

SEQ ID NO: 352836 - DNA, 15 bp, Homo sapiens
aaagttctgggtgga

SEQ ID NO: 352837 - DNA, 15 bp, Homo sapiens
aagttctgggtggag

SEQ ID NO: 352838 - DNA, 15 bp, Homo sapiens
agttctgggtggaga

SEQ ID NO: 352839 - DNA, 15 bp, Homo sapiens
gttctgggtggagaa

SEQ ID NO: 352840 - DNA, 15 bp, Homo sapiens
ttctgggtggagaat

SEQ ID NO: 352841 - DNA, 15 bp, Homo sapiens
tctgggtggagaatg

SEQ ID NO: 352842 - DNA, 15 bp, Homo sapiens
ctgggtggagaatga

SEQ ID NO: 352843 - DNA, 15 bp, Homo sapiens
tgggtggagaatgaa

SEQ ID NO: 352844 - DNA, 15 bp, Homo sapiens
gggtggagaatgaac

SEQ ID NO: 352845 - DNA, 15 bp, Homo sapiens
ggtggagaatgaacc

SEQ ID NO: 352846 - DNA, 15 bp, Homo sapiens
gtggagaatgaacca

SEQ ID NO: 352847 - DNA, 15 bp, Homo sapiens
tggagaatgaaccaa

SEQ ID NO: 352848 - DNA, 15 bp, Homo sapiens
ggagaatgaaccaat

SEQ ID NO: 352849 - DNA, 15 bp, Homo sapiens
gagaatgaaccaatc

SEQ ID NO: 352850 - DNA, 15 bp, Homo sapiens
agaatgaaccaatca

SEQ ID NO: 352851 - DNA, 15 bp, Homo sapiens
gaatgaaccaatcac

SEQ ID NO: 352852 - DNA, 15 bp, Homo sapiens
aatgaaccaatcaca

SEQ ID NO: 352853 - DNA, 15 bp, Homo sapiens
atgaaccaatcacac

SEQ ID NO: 352854 - DNA, 15 bp, Homo sapiens
tgaaccaatcacact

SEQ ID NO: 352855 - DNA, 15 bp, Homo sapiens
gaaccaatcacactc

SEQ ID NO: 352856 - DNA, 15 bp, Homo sapiens
aaccaatcacactct

SEQ ID NO: 352857 - DNA, 15 bp, Homo sapiens
accaatcacactctc

SEQ ID NO: 352858 - DNA, 15 bp, Homo sapiens
ccaatcacactctct

SEQ ID NO: 352859 - DNA, 15 bp, Homo sapiens
caatcacactctctc

SEQ ID NO: 352860 - DNA, 15 bp, Homo sapiens
aatcacactctctcc

SEQ ID NO: 352861 - DNA, 15 bp, Homo sapiens
atcacactctctccc

SEQ ID NO: 352862 - DNA, 15 bp, Homo sapiens
tcacactctctccct

SEQ ID NO: 352863 - DNA, 15 bp, Homo sapiens
cacactctctccctg

SEQ ID NO: 352864 - DNA, 15 bp, Homo sapiens
acactctctccctgc

SEQ ID NO: 352865 - DNA, 15 bp, Homo sapiens
cactctctccctgca

SEQ ID NO: 352866 - DNA, 15 bp, Homo sapiens
actctctccctgcaa

SEQ ID NO: 352867 - DNA, 15 bp, Homo sapiens
ctctctccctgcaag

SEQ ID NO: 352868 - DNA, 15 bp, Homo sapiens
tctctccctgcaagg

SEQ ID NO: 352869 - DNA, 15 bp, Homo sapiens
ctctccctgcaaggc

SEQ ID NO: 352870 - DNA, 15 bp, Homo sapiens
tctccctgcaaggct

SEQ ID NO: 352871 - DNA, 15 bp, Homo sapiens
ctccctgcaaggctt

SEQ ID NO: 352872 - DNA, 15 bp, Homo sapiens
tccctgcaaggcttc

SEQ ID NO: 352873 - DNA, 15 bp, Homo sapiens
ccctgcaaggcttcc

SEQ ID NO: 352874 - DNA, 15 bp, Homo sapiens
cctgcaaggcttcct

SEQ ID NO: 352875 - DNA, 15 bp, Homo sapiens
ctgcaaggcttccta

SEQ ID NO: 352876 - DNA, 15 bp, Homo sapiens
tgcaaggcttcctat

SEQ ID NO: 352877 - DNA, 15 bp, Homo sapiens
gcaaggcttcctatc

SEQ ID NO: 352878 - DNA, 15 bp, Homo sapiens
caaggcttcctatcc

SEQ ID NO: 352879 - DNA, 15 bp, Homo sapiens
aaggcttcctatcct

SEQ ID NO: 352880 - DNA, 15 bp, Homo sapiens
aggcttcctatcctc

SEQ ID NO: 352881 - DNA, 15 bp, Homo sapiens
ggcttcctatcctcc

SEQ ID NO: 352882 - DNA, 15 bp, Homo sapiens
gcttcctatcctcca

SEQ ID NO: 352883 - DNA, 15 bp, Homo sapiens
cttcctatcctccag

SEQ ID NO: 352884 - DNA, 15 bp, Homo sapiens
ttcctatcctccagt

SEQ ID NO: 352885 - DNA, 15 bp, Homo sapiens
tcctatcctccagtg

SEQ ID NO: 352886 - DNA, 15 bp, Homo sapiens
cctatcctccagtga

SEQ ID NO: 352887 - DNA, 15 bp, Homo sapiens
ctatcctccagtgac

SEQ ID NO: 352888 - DNA, 15 bp, Homo sapiens
tatcctccagtgact

SEQ ID NO: 352889 - DNA, 15 bp, Homo sapiens
atcctccagtgactc

SEQ ID NO: 352890 - DNA, 15 bp, Homo sapiens
tcctccagtgactcc

SEQ ID NO: 352891 - DNA, 15 bp, Homo sapiens
cctccagtgactcct

SEQ ID NO: 352892 - DNA, 15 bp, Homo sapiens
ctccagtgactcctt

SEQ ID NO: 352893 - DNA, 15 bp, Homo sapiens
tccagtgactcctta

SEQ ID NO: 352894 - DNA, 15 bp, Homo sapiens
ccagtgactccttac

SEQ ID NO: 352895 - DNA, 15 bp, Homo sapiens
cagtgactccttacc

SEQ ID NO: 352896 - DNA, 15 bp, Homo sapiens
agtgactccttacct

SEQ ID NO: 352897 - DNA, 15 bp, Homo sapiens
gtgactccttacctt

SEQ ID NO: 352898 - DNA, 15 bp, Homo sapiens
tgactccttaccttg

SEQ ID NO: 352899 - DNA, 15 bp, Homo sapiens
gactccttaccttgg

SEQ ID NO: 352900 - DNA, 15 bp, Homo sapiens
actccttaccttggt

SEQ ID NO: 352901 - DNA, 15 bp, Homo sapiens
ctccttaccttggtc

SEQ ID NO: 352902 - DNA, 15 bp, Homo sapiens
tccttaccttggtct

SEQ ID NO: 352903 - DNA, 15 bp, Homo sapiens
ccttaccttggtctt

SEQ ID NO: 352904 - DNA, 15 bp, Homo sapiens
cttaccttggtcttt

SEQ ID NO: 352905 - DNA, 15 bp, Homo sapiens
ttaccttggtctttt

SEQ ID NO: 352906 - DNA, 15 bp, Homo sapiens
taccttggtcttttt

SEQ ID NO: 352907 - DNA, 15 bp, Homo sapiens
accttggtctttttt

SEQ ID NO: 352908 - DNA, 15 bp, Homo sapiens
ccttggtcttttttt

SEQ ID NO: 352909 - DNA, 15 bp, Homo sapiens
cttggtctttttttt

SEQ ID NO: 352910 - DNA, 15 bp, Homo sapiens
ttggtcttttttttt

SEQ ID NO: 352911 - DNA, 15 bp, Homo sapiens
tggtctttttttttt

SEQ ID NO: 352912 - DNA, 15 bp, Homo sapiens
ggtcttttttttttt

SEQ ID NO: 352913 - DNA, 15 bp, Homo sapiens
tttttttttttttcc

SEQ ID NO: 352914 - DNA, 15 bp, Homo sapiens
ttttttttttttccc

SEQ ID NO: 352915 - DNA, 15 bp, Homo sapiens
tttttttttttcccc

SEQ ID NO: 352916 - DNA, 15 bp, Homo sapiens
ttttttttttcccca

SEQ ID NO: 352917 - DNA, 15 bp, Homo sapiens
tttttttttccccat

SEQ ID NO: 352918 - DNA, 15 bp, Homo sapiens
ttttttttccccatc

SEQ ID NO: 352919 - DNA, 15 bp, Homo sapiens
tttttttccccatca

SEQ ID NO: 352920 - DNA, 15 bp, Homo sapiens
ttttttccccatcag

SEQ ID NO: 352921 - DNA, 15 bp, Homo sapiens
tttttccccatcagt

SEQ ID NO: 352922 - DNA, 15 bp, Homo sapiens
ttttccccatcagtc

SEQ ID NO: 352923 - DNA, 15 bp, Homo sapiens
tttccccatcagtca

SEQ ID NO: 352924 - DNA, 15 bp, Homo sapiens
ttccccatcagtcag

SEQ ID NO: 352925 - DNA, 15 bp, Homo sapiens
tccccatcagtcagg

SEQ ID NO: 352926 - DNA, 15 bp, Homo sapiens
ccccatcagtcaggg

SEQ ID NO: 352927 - DNA, 15 bp, Homo sapiens
cccatcagtcaggga

SEQ ID NO: 352928 - DNA, 15 bp, Homo sapiens
ccatcagtcagggat

SEQ ID NO: 352929 - DNA, 15 bp, Homo sapiens
catcagtcagggatc

SEQ ID NO: 352930 - DNA, 15 bp, Homo sapiens
atcagtcagggatct

SEQ ID NO: 352931 - DNA, 15 bp, Homo sapiens
tcagtcagggatctt

SEQ ID NO: 352932 - DNA, 15 bp, Homo sapiens
cagtcagggatcttt

SEQ ID NO: 352933 - DNA, 15 bp, Homo sapiens
agtcagggatctttg

SEQ ID NO: 352934 - DNA, 15 bp, Homo sapiens
gtcagggatctttgt

SEQ ID NO: 352935 - DNA, 15 bp, Homo sapiens
tcagggatctttgtc

SEQ ID NO: 352936 - DNA, 15 bp, Homo sapiens
cagggatctttgtct

SEQ ID NO: 352937 - DNA, 15 bp, Homo sapiens
agggatctttgtctt

SEQ ID NO: 352938 - DNA, 15 bp, Homo sapiens
gggatctttgtcttt

SEQ ID NO: 352939 - DNA, 15 bp, Homo sapiens
ggatctttgtctttt

SEQ ID NO: 352940 - DNA, 15 bp, Homo sapiens
gatctttgtcttttt

SEQ ID NO: 352941 - DNA, 15 bp, Homo sapiens
atctttgtctttttt

SEQ ID NO: 352942 - DNA, 15 bp, Homo sapiens
tctttgtctttttta

SEQ ID NO: 352943 - DNA, 15 bp, Homo sapiens
ctttgtcttttttaa

SEQ ID NO: 352944 - DNA, 15 bp, Homo sapiens
tttgtcttttttaaa

SEQ ID NO: 352945 - DNA, 15 bp, Homo sapiens
ttgtcttttttaaat

SEQ ID NO: 352946 - DNA, 15 bp, Homo sapiens
tgtcttttttaaatt

SEQ ID NO: 352947 - DNA, 15 bp, Homo sapiens
gtcttttttaaattt

SEQ ID NO: 352948 - DNA, 15 bp, Homo sapiens
tcttttttaaatttc

SEQ ID NO: 352949 - DNA, 15 bp, Homo sapiens
cttttttaaatttct

SEQ ID NO: 352950 - DNA, 15 bp, Homo sapiens
ttttttaaatttctt

SEQ ID NO: 352951 - DNA, 15 bp, Homo sapiens
tttttaaatttctta

SEQ ID NO: 352952 - DNA, 15 bp, Homo sapiens
ttttaaatttcttat

SEQ ID NO: 352953 - DNA, 15 bp, Homo sapiens
tttaaatttcttatt

SEQ ID NO: 352954 - DNA, 15 bp, Homo sapiens
ttaaatttcttattc

SEQ ID NO: 352955 - DNA, 15 bp, Homo sapiens
taaatttcttattca

SEQ ID NO: 352956 - DNA, 15 bp, Homo sapiens
aaatttcttattcac

SEQ ID NO: 352957 - DNA, 15 bp, Homo sapiens
aatttcttattcacc

SEQ ID NO: 352958 - DNA, 15 bp, Homo sapiens
atttcttattcaccg

SEQ ID NO: 352959 - DNA, 15 bp, Homo sapiens
tttcttattcaccga

SEQ ID NO: 352960 - DNA, 15 bp, Homo sapiens
ttcttattcaccgat

SEQ ID NO: 352961 - DNA, 15 bp, Homo sapiens
tcttattcaccgatg

SEQ ID NO: 352962 - DNA, 15 bp, Homo sapiens
cttattcaccgatgt

SEQ ID NO: 352963 - DNA, 15 bp, Homo sapiens
ttattcaccgatgta

SEQ ID NO: 352964 - DNA, 15 bp, Homo sapiens
tattcaccgatgtat

SEQ ID NO: 352965 - DNA, 15 bp, Homo sapiens
attcaccgatgtatg

SEQ ID NO: 352966 - DNA, 15 bp, Homo sapiens
ttcaccgatgtatgc

SEQ ID NO: 352967 - DNA, 15 bp, Homo sapiens
tcaccgatgtatgcc

SEQ ID NO: 352968 - DNA, 15 bp, Homo sapiens
caccgatgtatgcca

SEQ ID NO: 352969 - DNA, 15 bp, Homo sapiens
accgatgtatgccaa

SEQ ID NO: 352970 - DNA, 15 bp, Homo sapiens
ccgatgtatgccaag

SEQ ID NO: 352971 - DNA, 15 bp, Homo sapiens
cgatgtatgccaaga

SEQ ID NO: 352972 - DNA, 15 bp, Homo sapiens
gatgtatgccaagat

SEQ ID NO: 352973 - DNA, 15 bp, Homo sapiens
atgtatgccaagatg

SEQ ID NO: 352974 - DNA, 15 bp, Homo sapiens
tgtatgccaagatgt

SEQ ID NO: 352975 - DNA, 15 bp, Homo sapiens
gtatgccaagatgta

SEQ ID NO: 352976 - DNA, 15 bp, Homo sapiens
tatgccaagatgtac

SEQ ID NO: 352977 - DNA, 15 bp, Homo sapiens
atgccaagatgtact

SEQ ID NO: 352978 - DNA, 15 bp, Homo sapiens
tgccaagatgtactc

SEQ ID NO: 352979 - DNA, 15 bp, Homo sapiens
gccaagatgtactca

SEQ ID NO: 352980 - DNA, 15 bp, Homo sapiens
ccaagatgtactcat

SEQ ID NO: 352981 - DNA, 15 bp, Homo sapiens
caagatgtactcata

SEQ ID NO: 352982 - DNA, 15 bp, Homo sapiens
aagatgtactcataa

SEQ ID NO: 352983 - DNA, 15 bp, Homo sapiens
agatgtactcataac

SEQ ID NO: 352984 - DNA, 15 bp, Homo sapiens
gatgtactcataact

SEQ ID NO: 352985 - DNA, 15 bp, Homo sapiens
atgtactcataacta

SEQ ID NO: 352986 - DNA, 15 bp, Homo sapiens
tgtactcataactag

SEQ ID NO: 352987 - DNA, 15 bp, Homo sapiens
gtactcataactaga

SEQ ID NO: 352988 - DNA, 15 bp, Homo sapiens
tactcataactagag

SEQ ID NO: 352989 - DNA, 15 bp, Homo sapiens
actcataactagagc

SEQ ID NO: 352990 - DNA, 15 bp, Homo sapiens
ctcataactagagca

SEQ ID NO: 352991 - DNA, 15 bp, Homo sapiens
tcataactagagcaa

SEQ ID NO: 352992 - DNA, 15 bp, Homo sapiens
cataactagagcaat

SEQ ID NO: 352993 - DNA, 15 bp, Homo sapiens
ataactagagcaatg

SEQ ID NO: 352994 - DNA, 15 bp, Homo sapiens
taactagagcaatgc

SEQ ID NO: 352995 - DNA, 15 bp, Homo sapiens
aactagagcaatgcc

SEQ ID NO: 352996 - DNA, 15 bp, Homo sapiens
actagagcaatgcct

SEQ ID NO: 352997 - DNA, 15 bp, Homo sapiens
ctagagcaatgcctg

SEQ ID NO: 352998 - DNA, 15 bp, Homo sapiens
tagagcaatgcctgg

SEQ ID NO: 352999 - DNA, 15 bp, Homo sapiens
agagcaatgcctggc

SEQ ID NO: 353000 - DNA, 15 bp, Homo sapiens
gagcaatgcctggca

SEQ ID NO: 353001 - DNA, 15 bp, Homo sapiens
agcaatgcctggcac

SEQ ID NO: 353002 - DNA, 15 bp, Homo sapiens
gcaatgcctggcaca

SEQ ID NO: 353003 - DNA, 15 bp, Homo sapiens
caatgcctggcacag

SEQ ID NO: 353004 - DNA, 15 bp, Homo sapiens
aatgcctggcacaga

SEQ ID NO: 353005 - DNA, 15 bp, Homo sapiens
atgcctggcacagag

SEQ ID NO: 353006 - DNA, 15 bp, Homo sapiens
tgcctggcacagaga

SEQ ID NO: 353007 - DNA, 15 bp, Homo sapiens
gcctggcacagagaa

SEQ ID NO: 353008 - DNA, 15 bp, Homo sapiens
cctggcacagagaag

SEQ ID NO: 353009 - DNA, 15 bp, Homo sapiens
ctggcacagagaagg

SEQ ID NO: 353010 - DNA, 15 bp, Homo sapiens
tggcacagagaaggc

SEQ ID NO: 353011 - DNA, 15 bp, Homo sapiens
ggcacagagaaggca

SEQ ID NO: 353012 - DNA, 15 bp, Homo sapiens
gcacagagaaggcat

SEQ ID NO: 353013 - DNA, 15 bp, Homo sapiens
cacagagaaggcatc

SEQ ID NO: 353014 - DNA, 15 bp, Homo sapiens
acagagaaggcatcc

SEQ ID NO: 353015 - DNA, 15 bp, Homo sapiens
cagagaaggcatcca

SEQ ID NO: 353016 - DNA, 15 bp, Homo sapiens
agagaaggcatccaa

SEQ ID NO: 353017 - DNA, 15 bp, Homo sapiens
gagaaggcatccaat

SEQ ID NO: 353018 - DNA, 15 bp, Homo sapiens
agaaggcatccaatc

SEQ ID NO: 353019 - DNA, 15 bp, Homo sapiens
gaaggcatccaatca

SEQ ID NO: 353020 - DNA, 15 bp, Homo sapiens
aaggcatccaatcaa

SEQ ID NO: 353021 - DNA, 15 bp, Homo sapiens
aggcatccaatcaat

SEQ ID NO: 353022 - DNA, 15 bp, Homo sapiens
ggcatccaatcaata

SEQ ID NO: 353023 - DNA, 15 bp, Homo sapiens
gcatccaatcaatat

SEQ ID NO: 353024 - DNA, 15 bp, Homo sapiens
catccaatcaatatt

SEQ ID NO: 353025 - DNA, 15 bp, Homo sapiens
atccaatcaatattt

SEQ ID NO: 353026 - DNA, 15 bp, Homo sapiens
tccaatcaatatttt

SEQ ID NO: 353027 - DNA, 15 bp, Homo sapiens
ccaatcaatattttt

SEQ ID NO: 353028 - DNA, 15 bp, Homo sapiens
caatcaatatttttc

SEQ ID NO: 353029 - DNA, 15 bp, Homo sapiens
aatcaatatttttca

SEQ ID NO: 353030 - DNA, 15 bp, Homo sapiens
atcaatatttttcaa

SEQ ID NO: 353031 - DNA, 15 bp, Homo sapiens
tcaatatttttcaac

SEQ ID NO: 353032 - DNA, 15 bp, Homo sapiens
caatatttttcaacg

SEQ ID NO: 353033 - DNA, 15 bp, Homo sapiens
aatatttttcaacga

SEQ ID NO: 353034 - DNA, 15 bp, Homo sapiens
atatttttcaacgaa

SEQ ID NO: 353035 - DNA, 15 bp, Homo sapiens
tatttttcaacgaat

SEQ ID NO: 353036 - DNA, 15 bp, Homo sapiens
atttttcaacgaatg

SEQ ID NO: 353037 - DNA, 15 bp, Homo sapiens
tttttcaacgaatga

SEQ ID NO: 353038 - DNA, 15 bp, Homo sapiens
ttttcaacgaatgaa

SEQ ID NO: 353039 - DNA, 15 bp, Homo sapiens
tttcaacgaatgaaa

SEQ ID NO: 353040 - DNA, 15 bp, Homo sapiens
ttcaacgaatgaaat

SEQ ID NO: 353041 - DNA, 15 bp, Homo sapiens
tcaacgaatgaaatg

SEQ ID NO: 353042 - DNA, 15 bp, Homo sapiens
caacgaatgaaatga

SEQ ID NO: 353043 - DNA, 15 bp, Homo sapiens
aacgaatgaaatgaa

SEQ ID NO: 353044 - DNA, 15 bp, Homo sapiens
acgaatgaaatgaaa

SEQ ID NO: 353045 - DNA, 15 bp, Homo sapiens
cgaatgaaatgaaat

SEQ ID NO: 353046 - DNA, 15 bp, Homo sapiens
gaatgaaatgaaatt

SEQ ID NO: 353047 - DNA, 15 bp, Homo sapiens
aatgaaatgaaatta

SEQ ID NO: 353048 - DNA, 15 bp, Homo sapiens
atgaaatgaaattag

SEQ ID NO: 353049 - DNA, 15 bp, Homo sapiens
tgaaatgaaattagc

SEQ ID NO: 353050 - DNA, 15 bp, Homo sapiens
gaaatgaaattagca

SEQ ID NO: 353051 - DNA, 15 bp, Homo sapiens
aaatgaaattagcaa

SEQ ID NO: 353052 - DNA, 15 bp, Homo sapiens
aatgaaattagcaat

SEQ ID NO: 353053 - DNA, 15 bp, Homo sapiens
atgaaattagcaata

SEQ ID NO: 353054 - DNA, 15 bp, Homo sapiens
tgaaattagcaatag

SEQ ID NO: 353055 - DNA, 15 bp, Homo sapiens
gaaattagcaatagg

SEQ ID NO: 353056 - DNA, 15 bp, Homo sapiens
aaattagcaatagga

SEQ ID NO: 353057 - DNA, 15 bp, Homo sapiens
aattagcaataggag

SEQ ID NO: 353058 - DNA, 15 bp, Homo sapiens
attagcaataggaga

SEQ ID NO: 353059 - DNA, 15 bp, Homo sapiens
ttagcaataggagat

SEQ ID NO: 353060 - DNA, 15 bp, Homo sapiens
tagcaataggagatt

SEQ ID NO: 353061 - DNA, 15 bp, Homo sapiens
agcaataggagattt

SEQ ID NO: 353062 - DNA, 15 bp, Homo sapiens
gcaataggagattta

SEQ ID NO: 353063 - DNA, 15 bp, Homo sapiens
caataggagatttag

SEQ ID NO: 353064 - DNA, 15 bp, Homo sapiens
aataggagatttaga

SEQ ID NO: 353065 - DNA, 15 bp, Homo sapiens
ataggagatttagat

SEQ ID NO: 353066 - DNA, 15 bp, Homo sapiens
taggagatttagatt

SEQ ID NO: 353067 - DNA, 15 bp, Homo sapiens
aggagatttagattt

SEQ ID NO: 353068 - DNA, 15 bp, Homo sapiens
ggagatttagatttg

SEQ ID NO: 353069 - DNA, 15 bp, Homo sapiens
gagatttagatttgg

SEQ ID NO: 353070 - DNA, 15 bp, Homo sapiens
agatttagatttgga

SEQ ID NO: 353071 - DNA, 15 bp, Homo sapiens
gatttagatttggat

SEQ ID NO: 353072 - DNA, 15 bp, Homo sapiens
atttagatttggata

SEQ ID NO: 353073 - DNA, 15 bp, Homo sapiens
tttagatttggatat

SEQ ID NO: 353074 - DNA, 15 bp, Homo sapiens
ttagatttggatata

SEQ ID NO: 353075 - DNA, 15 bp, Homo sapiens
tagatttggatatat

SEQ ID NO: 353076 - DNA, 15 bp, Homo sapiens
agatttggatatatc

SEQ ID NO: 353077 - DNA, 15 bp, Homo sapiens
gatttggatatatct

SEQ ID NO: 353078 - DNA, 15 bp, Homo sapiens
atttggatatatctc

SEQ ID NO: 353079 - DNA, 15 bp, Homo sapiens
tttggatatatctct

SEQ ID NO: 353080 - DNA, 15 bp, Homo sapiens
ttggatatatctctg

SEQ ID NO: 353081 - DNA, 15 bp, Homo sapiens
tggatatatctctgt

SEQ ID NO: 353082 - DNA, 15 bp, Homo sapiens
ggatatatctctgta

SEQ ID NO: 353083 - DNA, 15 bp, Homo sapiens
gatatatctctgtat

SEQ ID NO: 353084 - DNA, 15 bp, Homo sapiens
atatatctctgtata

SEQ ID NO: 353085 - DNA, 15 bp, Homo sapiens
tatatctctgtatat

SEQ ID NO: 353086 - DNA, 15 bp, Homo sapiens
atatctctgtatatc

SEQ ID NO: 353087 - DNA, 15 bp, Homo sapiens
tatctctgtatatct

SEQ ID NO: 353088 - DNA, 15 bp, Homo sapiens
atctctgtatatcta

SEQ ID NO: 353089 - DNA, 15 bp, Homo sapiens
tctctgtatatctat

SEQ ID NO: 353090 - DNA, 15 bp, Homo sapiens
ctctgtatatctatc

SEQ ID NO: 353091 - DNA, 15 bp, Homo sapiens
tctgtatatctatct

SEQ ID NO: 353092 - DNA, 15 bp, Homo sapiens
ctgtatatctatcta

SEQ ID NO: 353093 - DNA, 15 bp, Homo sapiens
tgtatatctatctat

SEQ ID NO: 353094 - DNA, 15 bp, Homo sapiens
taaatatcatgtcct

SEQ ID NO: 353095 - DNA, 15 bp, Homo sapiens
aaatatcatgtccta

SEQ ID NO: 353096 - DNA, 15 bp, Homo sapiens
aatatcatgtcctac

SEQ ID NO: 353097 - DNA, 15 bp, Homo sapiens
atatcatgtcctaca

SEQ ID NO: 353098 - DNA, 15 bp, Homo sapiens
tatcatgtcctacag

SEQ ID NO: 353099 - DNA, 15 bp, Homo sapiens
atcatgtcctacaga

SEQ ID NO: 353100 - DNA, 15 bp, Homo sapiens
tcatgtcctacagac

SEQ ID NO: 353101 - DNA, 15 bp, Homo sapiens
catgtcctacagaca

SEQ ID NO: 353102 - DNA, 15 bp, Homo sapiens
atgtcctacagacat

SEQ ID NO: 353103 - DNA, 15 bp, Homo sapiens
tgtcctacagacatc

SEQ ID NO: 353104 - DNA, 15 bp, Homo sapiens
gtcctacagacatca

SEQ ID NO: 353105 - DNA, 15 bp, Homo sapiens
tcctacagacatcat

SEQ ID NO: 353106 - DNA, 15 bp, Homo sapiens
cctacagacatcatg

SEQ ID NO: 353107 - DNA, 15 bp, Homo sapiens
ctacagacatcatgg

SEQ ID NO: 353108 - DNA, 15 bp, Homo sapiens
tacagacatcatgga

SEQ ID NO: 353109 - DNA, 15 bp, Homo sapiens
acagacatcatggaa

SEQ ID NO: 353110 - DNA, 15 bp, Homo sapiens
cagacatcatggaag

SEQ ID NO: 353111 - DNA, 15 bp, Homo sapiens
agacatcatggaagg

SEQ ID NO: 353112 - DNA, 15 bp, Homo sapiens
gacatcatggaagga

SEQ ID NO: 353113 - DNA, 15 bp, Homo sapiens
acatcatggaaggaa

SEQ ID NO: 353114 - DNA, 15 bp, Homo sapiens
catcatggaaggaat

SEQ ID NO: 353115 - DNA, 15 bp, Homo sapiens
atcatggaaggaatt

SEQ ID NO: 353116 - DNA, 15 bp, Homo sapiens
tcatggaaggaattg

SEQ ID NO: 353117 - DNA, 15 bp, Homo sapiens
catggaaggaattgg

SEQ ID NO: 353118 - DNA, 15 bp, Homo sapiens
atggaaggaattggg

SEQ ID NO: 353119 - DNA, 15 bp, Homo sapiens
tggaaggaattggga

SEQ ID NO: 353120 - DNA, 15 bp, Homo sapiens
ggaaggaattgggaa

SEQ ID NO: 353121 - DNA, 15 bp, Homo sapiens
gaaggaattgggaac

SEQ ID NO: 353122 - DNA, 15 bp, Homo sapiens
aaggaattgggaaca

SEQ ID NO: 353123 - DNA, 15 bp, Homo sapiens
aggaattgggaacat

SEQ ID NO: 353124 - DNA, 15 bp, Homo sapiens
ggaattgggaacatg

SEQ ID NO: 353125 - DNA, 15 bp, Homo sapiens
gaattgggaacatgt

SEQ ID NO: 353126 - DNA, 15 bp, Homo sapiens
aattgggaacatgta

SEQ ID NO: 353127 - DNA, 15 bp, Homo sapiens
attgggaacatgtaa

SEQ ID NO: 353128 - DNA, 15 bp, Homo sapiens
ttgggaacatgtaat

SEQ ID NO: 353129 - DNA, 15 bp, Homo sapiens
tgggaacatgtaatc

SEQ ID NO: 353130 - DNA, 15 bp, Homo sapiens
gggaacatgtaatca

SEQ ID NO: 353131 - DNA, 15 bp, Homo sapiens
ggaacatgtaatcag

SEQ ID NO: 353132 - DNA, 15 bp, Homo sapiens
gaacatgtaatcagt

SEQ ID NO: 353133 - DNA, 15 bp, Homo sapiens
aacatgtaatcagta

SEQ ID NO: 353134 - DNA, 15 bp, Homo sapiens
acatgtaatcagtag

SEQ ID NO: 353135 - DNA, 15 bp, Homo sapiens
catgtaatcagtaga

SEQ ID NO: 353136 - DNA, 15 bp, Homo sapiens
atgtaatcagtagaa

SEQ ID NO: 353137 - DNA, 15 bp, Homo sapiens
tgtaatcagtagaag

SEQ ID NO: 353138 - DNA, 15 bp, Homo sapiens
gtaatcagtagaaga

SEQ ID NO: 353139 - DNA, 15 bp, Homo sapiens
taatcagtagaagac

SEQ ID NO: 353140 - DNA, 15 bp, Homo sapiens
aatcagtagaagacc

SEQ ID NO: 353141 - DNA, 15 bp, Homo sapiens
atcagtagaagacca

SEQ ID NO: 353142 - DNA, 15 bp, Homo sapiens
tcagtagaagaccag

SEQ ID NO: 353143 - DNA, 15 bp, Homo sapiens
cagtagaagaccaga

SEQ ID NO: 353144 - DNA, 15 bp, Homo sapiens
agtagaagaccagag

SEQ ID NO: 353145 - DNA, 15 bp, Homo sapiens
gtagaagaccagaga

SEQ ID NO: 353146 - DNA, 15 bp, Homo sapiens
tagaagaccagagaa

SEQ ID NO: 353147 - DNA, 15 bp, Homo sapiens
agaagaccagagaaa

SEQ ID NO: 353148 - DNA, 15 bp, Homo sapiens
gaagaccagagaaaa

SEQ ID NO: 353149 - DNA, 15 bp, Homo sapiens
aagaccagagaaaaa

SEQ ID NO: 353150 - DNA, 15 bp, Homo sapiens
agaccagagaaaaac

SEQ ID NO: 353151 - DNA, 15 bp, Homo sapiens
gaccagagaaaaaca

SEQ ID NO: 353152 - DNA, 15 bp, Homo sapiens
accagagaaaaacat

SEQ ID NO: 353153 - DNA, 15 bp, Homo sapiens
ccagagaaaaacatg

SEQ ID NO: 353154 - DNA, 15 bp, Homo sapiens
cagagaaaaacatgg

SEQ ID NO: 353155 - DNA, 15 bp, Homo sapiens
agagaaaaacatggc

SEQ ID NO: 353156 - DNA, 15 bp, Homo sapiens
gagaaaaacatggca

SEQ ID NO: 353157 - DNA, 15 bp, Homo sapiens
agaaaaacatggcag

SEQ ID NO: 353158 - DNA, 15 bp, Homo sapiens
gaaaaacatggcagt

SEQ ID NO: 353159 - DNA, 15 bp, Homo sapiens
aaaaacatggcagtt

SEQ ID NO: 353160 - DNA, 15 bp, Homo sapiens
aaaacatggcagttg

SEQ ID NO: 353161 - DNA, 15 bp, Homo sapiens
aaacatggcagttgc

SEQ ID NO: 353162 - DNA, 15 bp, Homo sapiens
aacatggcagttgcc

SEQ ID NO: 353163 - DNA, 15 bp, Homo sapiens
acatggcagttgccc

SEQ ID NO: 353164 - DNA, 15 bp, Homo sapiens
catggcagttgccca

SEQ ID NO: 353165 - DNA, 15 bp, Homo sapiens
atggcagttgcccac

SEQ ID NO: 353166 - DNA, 15 bp, Homo sapiens
tggcagttgcccacc

SEQ ID NO: 353167 - DNA, 15 bp, Homo sapiens
ggcagttgcccacct

SEQ ID NO: 353168 - DNA, 15 bp, Homo sapiens
gcagttgcccaccta

SEQ ID NO: 353169 - DNA, 15 bp, Homo sapiens
cagttgcccacctat

SEQ ID NO: 353170 - DNA, 15 bp, Homo sapiens
agttgcccacctatg

SEQ ID NO: 353171 - DNA, 15 bp, Homo sapiens
gttgcccacctatgg

SEQ ID NO: 353172 - DNA, 15 bp, Homo sapiens
ttgcccacctatgga

SEQ ID NO: 353173 - DNA, 15 bp, Homo sapiens
tgcccacctatggaa

SEQ ID NO: 353174 - DNA, 15 bp, Homo sapiens
gcccacctatggaaa

SEQ ID NO: 353175 - DNA, 15 bp, Homo sapiens
cccacctatggaaag

SEQ ID NO: 353176 - DNA, 15 bp, Homo sapiens
ccacctatggaaaga

SEQ ID NO: 353177 - DNA, 15 bp, Homo sapiens
cacctatggaaagaa

SEQ ID NO: 353178 - DNA, 15 bp, Homo sapiens
acctatggaaagaaa

SEQ ID NO: 353179 - DNA, 15 bp, Homo sapiens
cctatggaaagaaat

SEQ ID NO: 353180 - DNA, 15 bp, Homo sapiens
ctatggaaagaaatg

SEQ ID NO: 353181 - DNA, 15 bp, Homo sapiens
tatggaaagaaatga

SEQ ID NO: 353182 - DNA, 15 bp, Homo sapiens
atggaaagaaatgac

SEQ ID NO: 353183 - DNA, 15 bp, Homo sapiens
tggaaagaaatgaca

SEQ ID NO: 353184 - DNA, 15 bp, Homo sapiens
ggaaagaaatgacaa

SEQ ID NO: 353185 - DNA, 15 bp, Homo sapiens
gaaagaaatgacaat

SEQ ID NO: 353186 - DNA, 15 bp, Homo sapiens
aaagaaatgacaatg

SEQ ID NO: 353187 - DNA, 15 bp, Homo sapiens
aagaaatgacaatga

SEQ ID NO: 353188 - DNA, 15 bp, Homo sapiens
agaaatgacaatgat

SEQ ID NO: 353189 - DNA, 15 bp, Homo sapiens
gaaatgacaatgatt

SEQ ID NO: 353190 - DNA, 15 bp, Homo sapiens
aaatgacaatgattt

SEQ ID NO: 353191 - DNA, 15 bp, Homo sapiens
aatgacaatgatttt

SEQ ID NO: 353192 - DNA, 15 bp, Homo sapiens
atgacaatgattttg

SEQ ID NO: 353193 - DNA, 15 bp, Homo sapiens
tgacaatgattttgg

SEQ ID NO: 353194 - DNA, 15 bp, Homo sapiens
gacaatgattttggt

SEQ ID NO: 353195 - DNA, 15 bp, Homo sapiens
acaatgattttggta

SEQ ID NO: 353196 - DNA, 15 bp, Homo sapiens
caatgattttggtat

SEQ ID NO: 353197 - DNA, 15 bp, Homo sapiens
aatgattttggtatt

SEQ ID NO: 353198 - DNA, 15 bp, Homo sapiens
atgattttggtattg

SEQ ID NO: 353199 - DNA, 15 bp, Homo sapiens
tgattttggtattgg

SEQ ID NO: 353200 - DNA, 15 bp, Homo sapiens
gattttggtattgga

SEQ ID NO: 353201 - DNA, 15 bp, Homo sapiens
attttggtattggag

SEQ ID NO: 353202 - DNA, 15 bp, Homo sapiens
ttttggtattggagc

SEQ ID NO: 353203 - DNA, 15 bp, Homo sapiens
tttggtattggagct

SEQ ID NO: 353204 - DNA, 15 bp, Homo sapiens
ttggtattggagctc

SEQ ID NO: 353205 - DNA, 15 bp, Homo sapiens
tggtattggagctca

SEQ ID NO: 353206 - DNA, 15 bp, Homo sapiens
ggtattggagctcaa

SEQ ID NO: 353207 - DNA, 15 bp, Homo sapiens
gtattggagctcaaa

SEQ ID NO: 353208 - DNA, 15 bp, Homo sapiens
tattggagctcaaaa

SEQ ID NO: 353209 - DNA, 15 bp, Homo sapiens
attggagctcaaaag

SEQ ID NO: 353210 - DNA, 15 bp, Homo sapiens
ttggagctcaaaagc

SEQ ID NO: 353211 - DNA, 15 bp, Homo sapiens
tggagctcaaaagct

SEQ ID NO: 353212 - DNA, 15 bp, Homo sapiens
ggagctcaaaagcta

SEQ ID NO: 353213 - DNA, 15 bp, Homo sapiens
gagctcaaaagctaa

SEQ ID NO: 353214 - DNA, 15 bp, Homo sapiens
agctcaaaagctaaa

SEQ ID NO: 353215 - DNA, 15 bp, Homo sapiens
gctcaaaagctaaaa

SEQ ID NO: 353216 - DNA, 15 bp, Homo sapiens
ctcaaaagctaaaat

SEQ ID NO: 353217 - DNA, 15 bp, Homo sapiens
tcaaaagctaaaatt

SEQ ID NO: 353218 - DNA, 15 bp, Homo sapiens
caaaagctaaaattg

SEQ ID NO: 353219 - DNA, 15 bp, Homo sapiens
aaaagctaaaattgc

SEQ ID NO: 353220 - DNA, 15 bp, Homo sapiens
aaagctaaaattgca

SEQ ID NO: 353221 - DNA, 15 bp, Homo sapiens
aagctaaaattgcat

SEQ ID NO: 353222 - DNA, 15 bp, Homo sapiens
agctaaaattgcatc

SEQ ID NO: 353223 - DNA, 15 bp, Homo sapiens
gctaaaattgcatct

SEQ ID NO: 353224 - DNA, 15 bp, Homo sapiens
ctaaaattgcatcta

SEQ ID NO: 353225 - DNA, 15 bp, Homo sapiens
taaaattgcatctac

SEQ ID NO: 353226 - DNA, 15 bp, Homo sapiens
aaaattgcatctact

SEQ ID NO: 353227 - DNA, 15 bp, Homo sapiens
aaattgcatctactt

SEQ ID NO: 353228 - DNA, 15 bp, Homo sapiens
aattgcatctactta

SEQ ID NO: 353229 - DNA, 15 bp, Homo sapiens
attgcatctacttac

SEQ ID NO: 353230 - DNA, 15 bp, Homo sapiens
ttgcatctacttact

SEQ ID NO: 353231 - DNA, 15 bp, Homo sapiens
tgcatctacttactt

SEQ ID NO: 353232 - DNA, 15 bp, Homo sapiens
gcatctacttacttg

SEQ ID NO: 353233 - DNA, 15 bp, Homo sapiens
catctacttacttgc

SEQ ID NO: 353234 - DNA, 15 bp, Homo sapiens
atctacttacttgca

SEQ ID NO: 353235 - DNA, 15 bp, Homo sapiens
tctacttacttgcat

SEQ ID NO: 353236 - DNA, 15 bp, Homo sapiens
ctacttacttgcatt

SEQ ID NO: 353237 - DNA, 15 bp, Homo sapiens
tacttacttgcattt

SEQ ID NO: 353238 - DNA, 15 bp, Homo sapiens
acttacttgcatttt

SEQ ID NO: 353239 - DNA, 15 bp, Homo sapiens
cttacttgcattttt

SEQ ID NO: 353240 - DNA, 15 bp, Homo sapiens
ttacttgcatttttt

SEQ ID NO: 353241 - DNA, 15 bp, Homo sapiens
gcatttttttttttt

SEQ ID NO: 353242 - DNA, 15 bp, Homo sapiens
agtcttgctctgtcg

SEQ ID NO: 353243 - DNA, 15 bp, Homo sapiens
gtcttgctctgtcgc

SEQ ID NO: 353244 - DNA, 15 bp, Homo sapiens
tcttgctctgtcgcc

SEQ ID NO: 353245 - DNA, 15 bp, Homo sapiens
cttgctctgtcgcca

SEQ ID NO: 353246 - DNA, 15 bp, Homo sapiens
ttgctctgtcgccag

SEQ ID NO: 353247 - DNA, 15 bp, Homo sapiens
tgctctgtcgccagg

SEQ ID NO: 353248 - DNA, 15 bp, Homo sapiens
gctctgtcgccaggc

SEQ ID NO: 353249 - DNA, 15 bp, Homo sapiens
ctctgtcgccaggct

SEQ ID NO: 353250 - DNA, 15 bp, Homo sapiens
tctgtcgccaggctg

SEQ ID NO: 353251 - DNA, 15 bp, Homo sapiens
ctgtcgccaggctgg

SEQ ID NO: 353252 - DNA, 15 bp, Homo sapiens
tgtcgccaggctgga

SEQ ID NO: 353253 - DNA, 15 bp, Homo sapiens
gtcgccaggctggag

SEQ ID NO: 353254 - DNA, 15 bp, Homo sapiens
tcgccaggctggagt

SEQ ID NO: 353255 - DNA, 15 bp, Homo sapiens
cgccaggctggagtg

SEQ ID NO: 353256 - DNA, 15 bp, Homo sapiens
gccaggctggagtgt

SEQ ID NO: 353257 - DNA, 15 bp, Homo sapiens
tggagtgtagtggtg

SEQ ID NO: 353258 - DNA, 15 bp, Homo sapiens
ggagtgtagtggtgc

SEQ ID NO: 353259 - DNA, 15 bp, Homo sapiens
gagtgtagtggtgcc

SEQ ID NO: 353260 - DNA, 15 bp, Homo sapiens
agtgtagtggtgcca

SEQ ID NO: 353261 - DNA, 15 bp, Homo sapiens
gtgtagtggtgccat

SEQ ID NO: 353262 - DNA, 15 bp, Homo sapiens
tgtagtggtgccatc

SEQ ID NO: 353263 - DNA, 15 bp, Homo sapiens
gtagtggtgccatct

SEQ ID NO: 353264 - DNA, 15 bp, Homo sapiens
tagtggtgccatctt

SEQ ID NO: 353265 - DNA, 15 bp, Homo sapiens
agtggtgccatcttg

SEQ ID NO: 353266 - DNA, 15 bp, Homo sapiens
gtggtgccatcttgg

SEQ ID NO: 353267 - DNA, 15 bp, Homo sapiens
tggtgccatcttggc

SEQ ID NO: 353268 - DNA, 15 bp, Homo sapiens
ggtgccatcttggct

SEQ ID NO: 353269 - DNA, 15 bp, Homo sapiens
gtgccatcttggctc

SEQ ID NO: 353270 - DNA, 15 bp, Homo sapiens
tgccatcttggctca

SEQ ID NO: 353271 - DNA, 15 bp, Homo sapiens
caacctctgcttccc

SEQ ID NO: 353272 - DNA, 15 bp, Homo sapiens
aacctctgcttccca

SEQ ID NO: 353273 - DNA, 15 bp, Homo sapiens
acctctgcttcccag

SEQ ID NO: 353274 - DNA, 15 bp, Homo sapiens
cctctgcttcccagt

SEQ ID NO: 353275 - DNA, 15 bp, Homo sapiens
ctctgcttcccagtt

SEQ ID NO: 353276 - DNA, 15 bp, Homo sapiens
tctgcttcccagttt

SEQ ID NO: 353277 - DNA, 15 bp, Homo sapiens
ctgcttcccagtttc

SEQ ID NO: 353278 - DNA, 15 bp, Homo sapiens
tgcttcccagtttca

SEQ ID NO: 353279 - DNA, 15 bp, Homo sapiens
gcttcccagtttcaa

SEQ ID NO: 353280 - DNA, 15 bp, Homo sapiens
cttcccagtttcaag

SEQ ID NO: 353281 - DNA, 15 bp, Homo sapiens
ttcccagtttcaagc

SEQ ID NO: 353282 - DNA, 15 bp, Homo sapiens
tcccagtttcaagct

SEQ ID NO: 353283 - DNA, 15 bp, Homo sapiens
cccagtttcaagcta

SEQ ID NO: 353284 - DNA, 15 bp, Homo sapiens
ccagtttcaagctat

SEQ ID NO: 353285 - DNA, 15 bp, Homo sapiens
cagtttcaagctatt

SEQ ID NO: 353286 - DNA, 15 bp, Homo sapiens
agtttcaagctattc

SEQ ID NO: 353287 - DNA, 15 bp, Homo sapiens
gtttcaagctattct

SEQ ID NO: 353288 - DNA, 15 bp, Homo sapiens
tttcaagctattctc

SEQ ID NO: 353289 - DNA, 15 bp, Homo sapiens
ttcaagctattctcc

SEQ ID NO: 353290 - DNA, 15 bp, Homo sapiens
tcaagctattctcct

SEQ ID NO: 353291 - DNA, 15 bp, Homo sapiens
caagctattctcctg

SEQ ID NO: 353292 - DNA, 15 bp, Homo sapiens
aagctattctcctgc

SEQ ID NO: 353293 - DNA, 15 bp, Homo sapiens
agctattctcctgcc

SEQ ID NO: 353294 - DNA, 15 bp, Homo sapiens
gctattctcctgcct

SEQ ID NO: 353295 - DNA, 15 bp, Homo sapiens
ctattctcctgccta

SEQ ID NO: 353296 - DNA, 15 bp, Homo sapiens
tattctcctgcctaa

SEQ ID NO: 353297 - DNA, 15 bp, Homo sapiens
attctcctgcctaag

SEQ ID NO: 353298 - DNA, 15 bp, Homo sapiens
ttctcctgcctaagc

SEQ ID NO: 353299 - DNA, 15 bp, Homo sapiens
tctcctgcctaagcc

SEQ ID NO: 353300 - DNA, 15 bp, Homo sapiens
ctcctgcctaagcca

SEQ ID NO: 353301 - DNA, 15 bp, Homo sapiens
tcctgcctaagccac

SEQ ID NO: 353302 - DNA, 15 bp, Homo sapiens
cctgcctaagccacc

SEQ ID NO: 353303 - DNA, 15 bp, Homo sapiens
ctgcctaagccaccc

SEQ ID NO: 353304 - DNA, 15 bp, Homo sapiens
tgcctaagccacccc

SEQ ID NO: 353305 - DNA, 15 bp, Homo sapiens
gcctaagccaccccg

SEQ ID NO: 353306 - DNA, 15 bp, Homo sapiens
cctaagccaccccga

SEQ ID NO: 353307 - DNA, 15 bp, Homo sapiens
ctaagccaccccgag

SEQ ID NO: 353308 - DNA, 15 bp, Homo sapiens
taagccaccccgagt

SEQ ID NO: 353309 - DNA, 15 bp, Homo sapiens
aagccaccccgagta

SEQ ID NO: 353310 - DNA, 15 bp, Homo sapiens
agccaccccgagtag

SEQ ID NO: 353311 - DNA, 15 bp, Homo sapiens
gccaccccgagtagc

SEQ ID NO: 353312 - DNA, 15 bp, Homo sapiens
ccaccccgagtagct

SEQ ID NO: 353313 - DNA, 15 bp, Homo sapiens
caccccgagtagctg

SEQ ID NO: 353314 - DNA, 15 bp, Homo sapiens
accccgagtagctgg

SEQ ID NO: 353315 - DNA, 15 bp, Homo sapiens
ccccgagtagctggg

SEQ ID NO: 353316 - DNA, 15 bp, Homo sapiens
gggactacaggtgcc

SEQ ID NO: 353317 - DNA, 15 bp, Homo sapiens
ggactacaggtgccc

SEQ ID NO: 353318 - DNA, 15 bp, Homo sapiens
gactacaggtgcccc

SEQ ID NO: 353319 - DNA, 15 bp, Homo sapiens
actacaggtgcccca

SEQ ID NO: 353320 - DNA, 15 bp, Homo sapiens
ctacaggtgccccac

SEQ ID NO: 353321 - DNA, 15 bp, Homo sapiens
tacaggtgccccacc

SEQ ID NO: 353322 - DNA, 15 bp, Homo sapiens
acaggtgccccacca

SEQ ID NO: 353323 - DNA, 15 bp, Homo sapiens
caggtgccccaccac

SEQ ID NO: 353324 - DNA, 15 bp, Homo sapiens
aggtgccccaccacg

SEQ ID NO: 353325 - DNA, 15 bp, Homo sapiens
ggtgccccaccacgc

SEQ ID NO: 353326 - DNA, 15 bp, Homo sapiens
gtgccccaccacgcc

SEQ ID NO: 353327 - DNA, 15 bp, Homo sapiens
tgccccaccacgccc

SEQ ID NO: 353328 - DNA, 15 bp, Homo sapiens
gccccaccacgcccc

SEQ ID NO: 353329 - DNA, 15 bp, Homo sapiens
ccccaccacgccccc

SEQ ID NO: 353330 - DNA, 15 bp, Homo sapiens
cccaccacgccccca

SEQ ID NO: 353331 - DNA, 15 bp, Homo sapiens
ccaccacgcccccag

SEQ ID NO: 353332 - DNA, 15 bp, Homo sapiens
caccacgcccccagc

SEQ ID NO: 353333 - DNA, 15 bp, Homo sapiens
accacgcccccagct

SEQ ID NO: 353334 - DNA, 15 bp, Homo sapiens
ccacgcccccagcta

SEQ ID NO: 353335 - DNA, 15 bp, Homo sapiens
cacgcccccagctaa

SEQ ID NO: 353336 - DNA, 15 bp, Homo sapiens
acgcccccagctaat

SEQ ID NO: 353337 - DNA, 15 bp, Homo sapiens
cgcccccagctaatt

SEQ ID NO: 353338 - DNA, 15 bp, Homo sapiens
gcccccagctaattt

SEQ ID NO: 353339 - DNA, 15 bp, Homo sapiens
cccccagctaatttt

SEQ ID NO: 353340 - DNA, 15 bp, Homo sapiens
ccccagctaattttt

SEQ ID NO: 353341 - DNA, 15 bp, Homo sapiens
tttttgtatttttaa

SEQ ID NO: 353342 - DNA, 15 bp, Homo sapiens
ttttgtatttttaat

SEQ ID NO: 353343 - DNA, 15 bp, Homo sapiens
tttgtatttttaata

SEQ ID NO: 353344 - DNA, 15 bp, Homo sapiens
ttgtatttttaatag

SEQ ID NO: 353345 - DNA, 15 bp, Homo sapiens
atttttaatagagac

SEQ ID NO: 353346 - DNA, 15 bp, Homo sapiens
tttttaatagagacg

SEQ ID NO: 353347 - DNA, 15 bp, Homo sapiens
ttttaatagagacgg

SEQ ID NO: 353348 - DNA, 15 bp, Homo sapiens
tttaatagagacggg

SEQ ID NO: 353349 - DNA, 15 bp, Homo sapiens
ttaatagagacgggg

SEQ ID NO: 353350 - DNA, 15 bp, Homo sapiens
taatagagacggggt

SEQ ID NO: 353351 - DNA, 15 bp, Homo sapiens
aatagagacggggtt

SEQ ID NO: 353352 - DNA, 15 bp, Homo sapiens
atagagacggggttt

SEQ ID NO: 353353 - DNA, 15 bp, Homo sapiens
gtttcaccttgttgg

SEQ ID NO: 353354 - DNA, 15 bp, Homo sapiens
tttcaccttgttggc

SEQ ID NO: 353355 - DNA, 15 bp, Homo sapiens
ttcaccttgttggcc

SEQ ID NO: 353356 - DNA, 15 bp, Homo sapiens
tcaccttgttggcca

SEQ ID NO: 353357 - DNA, 15 bp, Homo sapiens
caccttgttggccag

SEQ ID NO: 353358 - DNA, 15 bp, Homo sapiens
accttgttggccagg

SEQ ID NO: 353359 - DNA, 15 bp, Homo sapiens
ccttgttggccagga

SEQ ID NO: 353360 - DNA, 15 bp, Homo sapiens
cttgttggccaggat

SEQ ID NO: 353361 - DNA, 15 bp, Homo sapiens
ttgttggccaggatg

SEQ ID NO: 353362 - DNA, 15 bp, Homo sapiens
caggatggtcttgat

SEQ ID NO: 353363 - DNA, 15 bp, Homo sapiens
aggatggtcttgatc

SEQ ID NO: 353364 - DNA, 15 bp, Homo sapiens
ggatggtcttgatct

SEQ ID NO: 353365 - DNA, 15 bp, Homo sapiens
gatggtcttgatctc

SEQ ID NO: 353366 - DNA, 15 bp, Homo sapiens
atggtcttgatctct

SEQ ID NO: 353367 - DNA, 15 bp, Homo sapiens
tggtcttgatctctt

SEQ ID NO: 353368 - DNA, 15 bp, Homo sapiens
ggtcttgatctcttg

SEQ ID NO: 353369 - DNA, 15 bp, Homo sapiens
tgatctcttgacctc

SEQ ID NO: 353370 - DNA, 15 bp, Homo sapiens
gatctcttgacctcg

SEQ ID NO: 353371 - DNA, 15 bp, Homo sapiens
atctcttgacctcgt

SEQ ID NO: 353372 - DNA, 15 bp, Homo sapiens
tctcttgacctcgtg

SEQ ID NO: 353373 - DNA, 15 bp, Homo sapiens
ctcttgacctcgtga

SEQ ID NO: 353374 - DNA, 15 bp, Homo sapiens
tcttgacctcgtgat

SEQ ID NO: 353375 - DNA, 15 bp, Homo sapiens
cttgacctcgtgatc

SEQ ID NO: 353376 - DNA, 15 bp, Homo sapiens
ttgacctcgtgatcc

SEQ ID NO: 353377 - DNA, 15 bp, Homo sapiens
gacctcgtgatccgt

SEQ ID NO: 353378 - DNA, 15 bp, Homo sapiens
acctcgtgatccgta

SEQ ID NO: 353379 - DNA, 15 bp, Homo sapiens
cctcgtgatccgtag

SEQ ID NO: 353380 - DNA, 15 bp, Homo sapiens
ctcgtgatccgtagc

SEQ ID NO: 353381 - DNA, 15 bp, Homo sapiens
tcgtgatccgtagcc

SEQ ID NO: 353382 - DNA, 15 bp, Homo sapiens
cgtgatccgtagcct

SEQ ID NO: 353383 - DNA, 15 bp, Homo sapiens
gtgatccgtagcctg

SEQ ID NO: 353384 - DNA, 15 bp, Homo sapiens
tgatccgtagcctgg

SEQ ID NO: 353385 - DNA, 15 bp, Homo sapiens
gatccgtagcctggg

SEQ ID NO: 353386 - DNA, 15 bp, Homo sapiens
atccgtagcctgggc

SEQ ID NO: 353387 - DNA, 15 bp, Homo sapiens
tccgtagcctgggcc

SEQ ID NO: 353388 - DNA, 15 bp, Homo sapiens
ccgtagcctgggcct

SEQ ID NO: 353389 - DNA, 15 bp, Homo sapiens
cgtagcctgggcctc

SEQ ID NO: 353390 - DNA, 15 bp, Homo sapiens
gtagcctgggcctcc

SEQ ID NO: 353391 - DNA, 15 bp, Homo sapiens
tagcctgggcctcct

SEQ ID NO: 353392 - DNA, 15 bp, Homo sapiens
agcctgggcctccta

SEQ ID NO: 353393 - DNA, 15 bp, Homo sapiens
gcctgggcctcctaa

SEQ ID NO: 353394 - DNA, 15 bp, Homo sapiens
cctgggcctcctaaa

SEQ ID NO: 353395 - DNA, 15 bp, Homo sapiens
ctgggcctcctaaag

SEQ ID NO: 353396 - DNA, 15 bp, Homo sapiens
tgggcctcctaaagt

SEQ ID NO: 353397 - DNA, 15 bp, Homo sapiens
gggcctcctaaagtg

SEQ ID NO: 353398 - DNA, 15 bp, Homo sapiens
gtgctgggattacaa

SEQ ID NO: 353399 - DNA, 15 bp, Homo sapiens
tgctgggattacaag

SEQ ID NO: 353400 - DNA, 15 bp, Homo sapiens
gattacaagcgtgag

SEQ ID NO: 353401 - DNA, 15 bp, Homo sapiens
attacaagcgtgagc

SEQ ID NO: 353402 - DNA, 15 bp, Homo sapiens
ttacaagcgtgagcc

SEQ ID NO: 353403 - DNA, 15 bp, Homo sapiens
tacaagcgtgagcca

SEQ ID NO: 353404 - DNA, 15 bp, Homo sapiens
acaagcgtgagccac

SEQ ID NO: 353405 - DNA, 15 bp, Homo sapiens
caagcgtgagccacc

SEQ ID NO: 353406 - DNA, 15 bp, Homo sapiens
aagcgtgagccaccg

SEQ ID NO: 353407 - DNA, 15 bp, Homo sapiens
agcgtgagccaccgt

SEQ ID NO: 353408 - DNA, 15 bp, Homo sapiens
gcgtgagccaccgta

SEQ ID NO: 353409 - DNA, 15 bp, Homo sapiens
cgtgagccaccgtac

SEQ ID NO: 353410 - DNA, 15 bp, Homo sapiens
gtgagccaccgtacc

SEQ ID NO: 353411 - DNA, 15 bp, Homo sapiens
tgagccaccgtacct

SEQ ID NO: 353412 - DNA, 15 bp, Homo sapiens
gagccaccgtacctg

SEQ ID NO: 353413 - DNA, 15 bp, Homo sapiens
agccaccgtacctgg

SEQ ID NO: 353414 - DNA, 15 bp, Homo sapiens
gccaccgtacctggc

SEQ ID NO: 353415 - DNA, 15 bp, Homo sapiens
ccaccgtacctggcc

SEQ ID NO: 353416 - DNA, 15 bp, Homo sapiens
caccgtacctggccc

SEQ ID NO: 353417 - DNA, 15 bp, Homo sapiens
accgtacctggccct

SEQ ID NO: 353418 - DNA, 15 bp, Homo sapiens
ccgtacctggccctt

SEQ ID NO: 353419 - DNA, 15 bp, Homo sapiens
cgtacctggccctta

SEQ ID NO: 353420 - DNA, 15 bp, Homo sapiens
gtacctggcccttat

SEQ ID NO: 353421 - DNA, 15 bp, Homo sapiens
tacctggcccttatt

SEQ ID NO: 353422 - DNA, 15 bp, Homo sapiens
acctggcccttattt

SEQ ID NO: 353423 - DNA, 15 bp, Homo sapiens
cctggcccttatttg

SEQ ID NO: 353424 - DNA, 15 bp, Homo sapiens
ctggcccttatttgc

SEQ ID NO: 353425 - DNA, 15 bp, Homo sapiens
tggcccttatttgca

SEQ ID NO: 353426 - DNA, 15 bp, Homo sapiens
ggcccttatttgcat

SEQ ID NO: 353427 - DNA, 15 bp, Homo sapiens
gcccttatttgcatt

SEQ ID NO: 353428 - DNA, 15 bp, Homo sapiens
cccttatttgcattc

SEQ ID NO: 353429 - DNA, 15 bp, Homo sapiens
ccttatttgcattct

SEQ ID NO: 353430 - DNA, 15 bp, Homo sapiens
cttatttgcattctt

SEQ ID NO: 353431 - DNA, 15 bp, Homo sapiens
ttatttgcattcttt

SEQ ID NO: 353432 - DNA, 15 bp, Homo sapiens
tatttgcattcttta

SEQ ID NO: 353433 - DNA, 15 bp, Homo sapiens
atttgcattctttaa

SEQ ID NO: 353434 - DNA, 15 bp, Homo sapiens
tttgcattctttaag

SEQ ID NO: 353435 - DNA, 15 bp, Homo sapiens
ttgcattctttaagg

SEQ ID NO: 353436 - DNA, 15 bp, Homo sapiens
tgcattctttaaggc

SEQ ID NO: 353437 - DNA, 15 bp, Homo sapiens
gcattctttaaggcc

SEQ ID NO: 353438 - DNA, 15 bp, Homo sapiens
cattctttaaggcct

SEQ ID NO: 353439 - DNA, 15 bp, Homo sapiens
attctttaaggcctg

SEQ ID NO: 353440 - DNA, 15 bp, Homo sapiens
ttctttaaggcctgg

SEQ ID NO: 353441 - DNA, 15 bp, Homo sapiens
tctttaaggcctggt

SEQ ID NO: 353442 - DNA, 15 bp, Homo sapiens
ctttaaggcctggtt

SEQ ID NO: 353443 - DNA, 15 bp, Homo sapiens
tttaaggcctggttc

SEQ ID NO: 353444 - DNA, 15 bp, Homo sapiens
ttaaggcctggttcc

SEQ ID NO: 353445 - DNA, 15 bp, Homo sapiens
taaggcctggttcca

SEQ ID NO: 353446 - DNA, 15 bp, Homo sapiens
aaggcctggttccaa

SEQ ID NO: 353447 - DNA, 15 bp, Homo sapiens
aggcctggttccaat

SEQ ID NO: 353448 - DNA, 15 bp, Homo sapiens
ggcctggttccaatg

SEQ ID NO: 353449 - DNA, 15 bp, Homo sapiens
gcctggttccaatgt

SEQ ID NO: 353450 - DNA, 15 bp, Homo sapiens
cctggttccaatgtt

SEQ ID NO: 353451 - DNA, 15 bp, Homo sapiens
ctggttccaatgtta

SEQ ID NO: 353452 - DNA, 15 bp, Homo sapiens
tggttccaatgttac

SEQ ID NO: 353453 - DNA, 15 bp, Homo sapiens
ggttccaatgttacc

SEQ ID NO: 353454 - DNA, 15 bp, Homo sapiens
gttccaatgttacct

SEQ ID NO: 353455 - DNA, 15 bp, Homo sapiens
ttccaatgttacctt

SEQ ID NO: 353456 - DNA, 15 bp, Homo sapiens
tccaatgttaccttc

SEQ ID NO: 353457 - DNA, 15 bp, Homo sapiens
ccaatgttaccttct

SEQ ID NO: 353458 - DNA, 15 bp, Homo sapiens
caatgttaccttctc

SEQ ID NO: 353459 - DNA, 15 bp, Homo sapiens
aatgttaccttctct

SEQ ID NO: 353460 - DNA, 15 bp, Homo sapiens
atgttaccttctctc

SEQ ID NO: 353461 - DNA, 15 bp, Homo sapiens
tgttaccttctctct

SEQ ID NO: 353462 - DNA, 15 bp, Homo sapiens
gttaccttctctcta

SEQ ID NO: 353463 - DNA, 15 bp, Homo sapiens
ttaccttctctctaa

SEQ ID NO: 353464 - DNA, 15 bp, Homo sapiens
taccttctctctaaa

SEQ ID NO: 353465 - DNA, 15 bp, Homo sapiens
accttctctctaaag

SEQ ID NO: 353466 - DNA, 15 bp, Homo sapiens
ccttctctctaaagt

SEQ ID NO: 353467 - DNA, 15 bp, Homo sapiens
cttctctctaaagtc

SEQ ID NO: 353468 - DNA, 15 bp, Homo sapiens
ttctctctaaagtct

SEQ ID NO: 353469 - DNA, 15 bp, Homo sapiens
tctctctaaagtctc

SEQ ID NO: 353470 - DNA, 15 bp, Homo sapiens
ctctctaaagtctct

SEQ ID NO: 353471 - DNA, 15 bp, Homo sapiens
tctctaaagtctctt

SEQ ID NO: 353472 - DNA, 15 bp, Homo sapiens
ctctaaagtctcttt

SEQ ID NO: 353473 - DNA, 15 bp, Homo sapiens
tctaaagtctctttc

SEQ ID NO: 353474 - DNA, 15 bp, Homo sapiens
ctaaagtctctttct

SEQ ID NO: 353475 - DNA, 15 bp, Homo sapiens
taaagtctctttctc

SEQ ID NO: 353476 - DNA, 15 bp, Homo sapiens
aaagtctctttctct

SEQ ID NO: 353477 - DNA, 15 bp, Homo sapiens
aagtctctttctctt

SEQ ID NO: 353478 - DNA, 15 bp, Homo sapiens
agtctctttctcttt

SEQ ID NO: 353479 - DNA, 15 bp, Homo sapiens
gtctctttctctttg

SEQ ID NO: 353480 - DNA, 15 bp, Homo sapiens
tctctttctctttgc

SEQ ID NO: 353481 - DNA, 15 bp, Homo sapiens
ctctttctctttgca

SEQ ID NO: 353482 - DNA, 15 bp, Homo sapiens
tctttctctttgcaa

SEQ ID NO: 353483 - DNA, 15 bp, Homo sapiens
ctttctctttgcaaa

SEQ ID NO: 353484 - DNA, 15 bp, Homo sapiens
tttctctttgcaaaa

SEQ ID NO: 353485 - DNA, 15 bp, Homo sapiens
ttctctttgcaaaat

SEQ ID NO: 353486 - DNA, 15 bp, Homo sapiens
tctctttgcaaaatg

SEQ ID NO: 353487 - DNA, 15 bp, Homo sapiens
ctctttgcaaaatgt

SEQ ID NO: 353488 - DNA, 15 bp, Homo sapiens
tctttgcaaaatgtt

SEQ ID NO: 353489 - DNA, 15 bp, Homo sapiens
ctttgcaaaatgttt

SEQ ID NO: 353490 - DNA, 15 bp, Homo sapiens
tttgcaaaatgtttg

SEQ ID NO: 353491 - DNA, 15 bp, Homo sapiens
ttgcaaaatgtttgc

SEQ ID NO: 353492 - DNA, 15 bp, Homo sapiens
tgcaaaatgtttgct

SEQ ID NO: 353493 - DNA, 15 bp, Homo sapiens
gcaaaatgtttgctt

SEQ ID NO: 353494 - DNA, 15 bp, Homo sapiens
caaaatgtttgcttt

SEQ ID NO: 353495 - DNA, 15 bp, Homo sapiens
aaaatgtttgctttc

SEQ ID NO: 353496 - DNA, 15 bp, Homo sapiens
aaatgtttgctttca

SEQ ID NO: 353497 - DNA, 15 bp, Homo sapiens
aatgtttgctttcac

SEQ ID NO: 353498 - DNA, 15 bp, Homo sapiens
atgtttgctttcaca

SEQ ID NO: 353499 - DNA, 15 bp, Homo sapiens
tgtttgctttcacat

SEQ ID NO: 353500 - DNA, 15 bp, Homo sapiens
gtttgctttcacatt

SEQ ID NO: 353501 - DNA, 15 bp, Homo sapiens
tttgctttcacattt

SEQ ID NO: 353502 - DNA, 15 bp, Homo sapiens
ttgctttcacatttg

SEQ ID NO: 353503 - DNA, 15 bp, Homo sapiens
tgctttcacatttgt

SEQ ID NO: 353504 - DNA, 15 bp, Homo sapiens
gctttcacatttgtc

SEQ ID NO: 353505 - DNA, 15 bp, Homo sapiens
ctttcacatttgtct

SEQ ID NO: 353506 - DNA, 15 bp, Homo sapiens
tttcacatttgtctt

SEQ ID NO: 353507 - DNA, 15 bp, Homo sapiens
ttcacatttgtcttt

SEQ ID NO: 353508 - DNA, 15 bp, Homo sapiens
tcacatttgtctttg

SEQ ID NO: 353509 - DNA, 15 bp, Homo sapiens
cacatttgtctttga

SEQ ID NO: 353510 - DNA, 15 bp, Homo sapiens
acatttgtctttgaa

SEQ ID NO: 353511 - DNA, 15 bp, Homo sapiens
catttgtctttgaac

SEQ ID NO: 353512 - DNA, 15 bp, Homo sapiens
atttgtctttgaacc

SEQ ID NO: 353513 - DNA, 15 bp, Homo sapiens
tttgtctttgaaccc

SEQ ID NO: 353514 - DNA, 15 bp, Homo sapiens
ttgtctttgaacccc

SEQ ID NO: 353515 - DNA, 15 bp, Homo sapiens
tgtctttgaacccct

SEQ ID NO: 353516 - DNA, 15 bp, Homo sapiens
gtctttgaaccccta

SEQ ID NO: 353517 - DNA, 15 bp, Homo sapiens
tctttgaacccctat

SEQ ID NO: 353518 - DNA, 15 bp, Homo sapiens
ctttgaacccctatc

SEQ ID NO: 353519 - DNA, 15 bp, Homo sapiens
tttgaacccctatcg

SEQ ID NO: 353520 - DNA, 15 bp, Homo sapiens
ttgaacccctatcgc

SEQ ID NO: 353521 - DNA, 15 bp, Homo sapiens
tgaacccctatcgcc

SEQ ID NO: 353522 - DNA, 15 bp, Homo sapiens
gaacccctatcgcca

SEQ ID NO: 353523 - DNA, 15 bp, Homo sapiens
aacccctatcgccat

SEQ ID NO: 353524 - DNA, 15 bp, Homo sapiens
acccctatcgccata

SEQ ID NO: 353525 - DNA, 15 bp, Homo sapiens
cccctatcgccatac

SEQ ID NO: 353526 - DNA, 15 bp, Homo sapiens
ccctatcgccataca

SEQ ID NO: 353527 - DNA, 15 bp, Homo sapiens
cctatcgccatacac

SEQ ID NO: 353528 - DNA, 15 bp, Homo sapiens
ctatcgccatacaca

SEQ ID NO: 353529 - DNA, 15 bp, Homo sapiens
tatcgccatacacag

SEQ ID NO: 353530 - DNA, 15 bp, Homo sapiens
atcgccatacacagt

SEQ ID NO: 353531 - DNA, 15 bp, Homo sapiens
tcgccatacacagta

SEQ ID NO: 353532 - DNA, 15 bp, Homo sapiens
cgccatacacagtag

SEQ ID NO: 353533 - DNA, 15 bp, Homo sapiens
gccatacacagtagc

SEQ ID NO: 353534 - DNA, 15 bp, Homo sapiens
ccatacacagtagct

SEQ ID NO: 353535 - DNA, 15 bp, Homo sapiens
catacacagtagctg

SEQ ID NO: 353536 - DNA, 15 bp, Homo sapiens
atacacagtagctgg

SEQ ID NO: 353537 - DNA, 15 bp, Homo sapiens
tacacagtagctgga

SEQ ID NO: 353538 - DNA, 15 bp, Homo sapiens
acacagtagctggat

SEQ ID NO: 353539 - DNA, 15 bp, Homo sapiens
cacagtagctggatt

SEQ ID NO: 353540 - DNA, 15 bp, Homo sapiens
acagtagctggattt

SEQ ID NO: 353541 - DNA, 15 bp, Homo sapiens
cagtagctggatttt

SEQ ID NO: 353542 - DNA, 15 bp, Homo sapiens
agtagctggatttta

SEQ ID NO: 353543 - DNA, 15 bp, Homo sapiens
gtagctggattttat

SEQ ID NO: 353544 - DNA, 15 bp, Homo sapiens
tagctggattttata

SEQ ID NO: 353545 - DNA, 15 bp, Homo sapiens
agctggattttatat

SEQ ID NO: 353546 - DNA, 15 bp, Homo sapiens
gctggattttatata

SEQ ID NO: 353547 - DNA, 15 bp, Homo sapiens
ctggattttatatat

SEQ ID NO: 353548 - DNA, 15 bp, Homo sapiens
tggattttatatata

SEQ ID NO: 353549 - DNA, 15 bp, Homo sapiens
ggattttatatatat

SEQ ID NO: 353550 - DNA, 15 bp, Homo sapiens
gattttatatatata

SEQ ID NO: 353551 - DNA, 15 bp, Homo sapiens
attttatatatatag

SEQ ID NO: 353552 - DNA, 15 bp, Homo sapiens
ttttatatatatagt

SEQ ID NO: 353553 - DNA, 15 bp, Homo sapiens
tttatatatatagta

SEQ ID NO: 353554 - DNA, 15 bp, Homo sapiens
ttatatatatagtag

SEQ ID NO: 353555 - DNA, 15 bp, Homo sapiens
tatatatatagtagg

SEQ ID NO: 353556 - DNA, 15 bp, Homo sapiens
atatatatagtaggt

SEQ ID NO: 353557 - DNA, 15 bp, Homo sapiens
tatatatagtaggtg

SEQ ID NO: 353558 - DNA, 15 bp, Homo sapiens
atatatagtaggtgc

SEQ ID NO: 353559 - DNA, 15 bp, Homo sapiens
tatatagtaggtgct

SEQ ID NO: 353560 - DNA, 15 bp, Homo sapiens
atatagtaggtgctt

SEQ ID NO: 353561 - DNA, 15 bp, Homo sapiens
tatagtaggtgctta

SEQ ID NO: 353562 - DNA, 15 bp, Homo sapiens
atagtaggtgcttaa

SEQ ID NO: 353563 - DNA, 15 bp, Homo sapiens
tagtaggtgcttaat

SEQ ID NO: 353564 - DNA, 15 bp, Homo sapiens
agtaggtgcttaata

SEQ ID NO: 353565 - DNA, 15 bp, Homo sapiens
gtaggtgcttaataa

SEQ ID NO: 353566 - DNA, 15 bp, Homo sapiens
taggtgcttaataaa

SEQ ID NO: 353567 - DNA, 15 bp, Homo sapiens
aggtgcttaataaat

SEQ ID NO: 353568 - DNA, 15 bp, Homo sapiens
ggtgcttaataaatg

SEQ ID NO: 353569 - DNA, 15 bp, Homo sapiens
gtgcttaataaatgt

SEQ ID NO: 353570 - DNA, 15 bp, Homo sapiens
tgcttaataaatgtt

SEQ ID NO: 353571 - DNA, 15 bp, Homo sapiens
gcttaataaatgttg

SEQ ID NO: 353572 - DNA, 15 bp, Homo sapiens
cttaataaatgttgg

SEQ ID NO: 353573 - DNA, 15 bp, Homo sapiens
ttaataaatgttgga

SEQ ID NO: 353574 - DNA, 15 bp, Homo sapiens
taataaatgttggat

SEQ ID NO: 353575 - DNA, 15 bp, Homo sapiens
aataaatgttggatg

SEQ ID NO: 353576 - DNA, 15 bp, Homo sapiens
ataaatgttggatga

SEQ ID NO: 353577 - DNA, 15 bp, Homo sapiens
taaatgttggatgaa

SEQ ID NO: 353578 - DNA, 15 bp, Homo sapiens
aaatgttggatgaaa

SEQ ID NO: 353579 - DNA, 15 bp, Homo sapiens
aatgttggatgaaat

SEQ ID NO: 353580 - DNA, 15 bp, Homo sapiens
atgttggatgaaata

SEQ ID NO: 353581 - DNA, 15 bp, Homo sapiens
tgttggatgaaatat

SEQ ID NO: 353582 - DNA, 15 bp, Homo sapiens
gttggatgaaatatt

SEQ ID NO: 353583 - DNA, 15 bp, Homo sapiens
ttggatgaaatattg

SEQ ID NO: 353584 - DNA, 15 bp, Homo sapiens
tggatgaaatattgg

SEQ ID NO: 353585 - DNA, 15 bp, Homo sapiens
ggatgaaatattgga

SEQ ID NO: 353586 - DNA, 15 bp, Homo sapiens
gatgaaatattggag

SEQ ID NO: 353587 - DNA, 15 bp, Homo sapiens
atgaaatattggagc

SEQ ID NO: 353588 - DNA, 15 bp, Homo sapiens
tgaaatattggagct

SEQ ID NO: 353589 - DNA, 15 bp, Homo sapiens
gaaatattggagctg

SEQ ID NO: 353590 - DNA, 15 bp, Homo sapiens
aaatattggagctga

SEQ ID NO: 353591 - DNA, 15 bp, Homo sapiens
aatattggagctgaa

SEQ ID NO: 353592 - DNA, 15 bp, Homo sapiens
atattggagctgaac

SEQ ID NO: 353593 - DNA, 15 bp, Homo sapiens
tattggagctgaacg

SEQ ID NO: 353594 - DNA, 15 bp, Homo sapiens
attggagctgaacgg

SEQ ID NO: 353595 - DNA, 15 bp, Homo sapiens
ttggagctgaacggg

SEQ ID NO: 353596 - DNA, 15 bp, Homo sapiens
tggagctgaacgggg

SEQ ID NO: 353597 - DNA, 15 bp, Homo sapiens
ggagctgaacgggga

SEQ ID NO: 353598 - DNA, 15 bp, Homo sapiens
gagctgaacggggac

SEQ ID NO: 353599 - DNA, 15 bp, Homo sapiens
agctgaacggggact

SEQ ID NO: 353600 - DNA, 15 bp, Homo sapiens
gctgaacggggactg

SEQ ID NO: 353601 - DNA, 15 bp, Homo sapiens
ctgaacggggactgt

SEQ ID NO: 353602 - DNA, 15 bp, Homo sapiens
tgaacggggactgtc

SEQ ID NO: 353603 - DNA, 15 bp, Homo sapiens
gaacggggactgtct

SEQ ID NO: 353604 - DNA, 15 bp, Homo sapiens
aacggggactgtctt

SEQ ID NO: 353605 - DNA, 15 bp, Homo sapiens
acggggactgtcttg

SEQ ID NO: 353606 - DNA, 15 bp, Homo sapiens
cggggactgtcttga

SEQ ID NO: 353607 - DNA, 15 bp, Homo sapiens
ggggactgtcttgag

SEQ ID NO: 353608 - DNA, 15 bp, Homo sapiens
gggactgtcttgagt

SEQ ID NO: 353609 - DNA, 15 bp, Homo sapiens
ggactgtcttgagtt

SEQ ID NO: 353610 - DNA, 15 bp, Homo sapiens
gactgtcttgagttc

SEQ ID NO: 353611 - DNA, 15 bp, Homo sapiens
actgtcttgagttct

SEQ ID NO: 353612 - DNA, 15 bp, Homo sapiens
ctgtcttgagttctc

SEQ ID NO: 353613 - DNA, 15 bp, Homo sapiens
tgtcttgagttctca

SEQ ID NO: 353614 - DNA, 15 bp, Homo sapiens
gtcttgagttctcag

SEQ ID NO: 353615 - DNA, 15 bp, Homo sapiens
tcttgagttctcaga

SEQ ID NO: 353616 - DNA, 15 bp, Homo sapiens
cttgagttctcagat

SEQ ID NO: 353617 - DNA, 15 bp, Homo sapiens
ttgagttctcagata

SEQ ID NO: 353618 - DNA, 15 bp, Homo sapiens
tgagttctcagataa

SEQ ID NO: 353619 - DNA, 15 bp, Homo sapiens
gagttctcagataaa

SEQ ID NO: 353620 - DNA, 15 bp, Homo sapiens
agttctcagataaaa

SEQ ID NO: 353621 - DNA, 15 bp, Homo sapiens
gttctcagataaaaa

SEQ ID NO: 353622 - DNA, 15 bp, Homo sapiens
ttctcagataaaaag

SEQ ID NO: 353623 - DNA, 15 bp, Homo sapiens
tctcagataaaaagg

SEQ ID NO: 353624 - DNA, 15 bp, Homo sapiens
ctcagataaaaaggc

SEQ ID NO: 353625 - DNA, 15 bp, Homo sapiens
tcagataaaaaggca

SEQ ID NO: 353626 - DNA, 15 bp, Homo sapiens
cagataaaaaggcat

SEQ ID NO: 353627 - DNA, 15 bp, Homo sapiens
agataaaaaggcatc

SEQ ID NO: 353628 - DNA, 15 bp, Homo sapiens
gataaaaaggcatcc

SEQ ID NO: 353629 - DNA, 15 bp, Homo sapiens
ataaaaaggcatcca

SEQ ID NO: 353630 - DNA, 15 bp, Homo sapiens
taaaaaggcatccaa

SEQ ID NO: 353631 - DNA, 15 bp, Homo sapiens
aaaaaggcatccaaa

SEQ ID NO: 353632 - DNA, 15 bp, Homo sapiens
aaaaggcatccaaaa

SEQ ID NO: 353633 - DNA, 15 bp, Homo sapiens
aaaggcatccaaaag

SEQ ID NO: 353634 - DNA, 15 bp, Homo sapiens
aaggcatccaaaagc

SEQ ID NO: 353635 - DNA, 15 bp, Homo sapiens
aggcatccaaaagca

SEQ ID NO: 353636 - DNA, 15 bp, Homo sapiens
ggcatccaaaagcag

SEQ ID NO: 353637 - DNA, 15 bp, Homo sapiens
gcatccaaaagcaga

SEQ ID NO: 353638 - DNA, 15 bp, Homo sapiens
catccaaaagcagaa

SEQ ID NO: 353639 - DNA, 15 bp, Homo sapiens
atccaaaagcagaaa

SEQ ID NO: 353640 - DNA, 15 bp, Homo sapiens
tccaaaagcagaaat

SEQ ID NO: 353641 - DNA, 15 bp, Homo sapiens
ccaaaagcagaaatg

SEQ ID NO: 353642 - DNA, 15 bp, Homo sapiens
caaaagcagaaatga

SEQ ID NO: 353643 - DNA, 15 bp, Homo sapiens
aaaagcagaaatgag

SEQ ID NO: 353644 - DNA, 15 bp, Homo sapiens
aaagcagaaatgaga

SEQ ID NO: 353645 - DNA, 15 bp, Homo sapiens
aagcagaaatgagaa

SEQ ID NO: 353646 - DNA, 15 bp, Homo sapiens
agcagaaatgagaac

SEQ ID NO: 353647 - DNA, 15 bp, Homo sapiens
gcagaaatgagaacc

SEQ ID NO: 353648 - DNA, 15 bp, Homo sapiens
cagaaatgagaacca

SEQ ID NO: 353649 - DNA, 15 bp, Homo sapiens
agaaatgagaaccat

SEQ ID NO: 353650 - DNA, 15 bp, Homo sapiens
gaaatgagaaccatc

SEQ ID NO: 353651 - DNA, 15 bp, Homo sapiens
aaatgagaaccatct

SEQ ID NO: 353652 - DNA, 15 bp, Homo sapiens
aatgagaaccatcta

SEQ ID NO: 353653 - DNA, 15 bp, Homo sapiens
atgagaaccatctat

SEQ ID NO: 353654 - DNA, 15 bp, Homo sapiens
tgagaaccatctatt

SEQ ID NO: 353655 - DNA, 15 bp, Homo sapiens
gagaaccatctattg

SEQ ID NO: 353656 - DNA, 15 bp, Homo sapiens
agaaccatctattgt

SEQ ID NO: 353657 - DNA, 15 bp, Homo sapiens
gaaccatctattgta

SEQ ID NO: 353658 - DNA, 15 bp, Homo sapiens
aaccatctattgtat

SEQ ID NO: 353659 - DNA, 15 bp, Homo sapiens
accatctattgtatt

SEQ ID NO: 353660 - DNA, 15 bp, Homo sapiens
ccatctattgtattc

SEQ ID NO: 353661 - DNA, 15 bp, Homo sapiens
catctattgtattcc

SEQ ID NO: 353662 - DNA, 15 bp, Homo sapiens
atctattgtattccc

SEQ ID NO: 353663 - DNA, 15 bp, Homo sapiens
tctattgtattccct

SEQ ID NO: 353664 - DNA, 15 bp, Homo sapiens
ctattgtattccctc

SEQ ID NO: 353665 - DNA, 15 bp, Homo sapiens
tattgtattccctct

SEQ ID NO: 353666 - DNA, 15 bp, Homo sapiens
attgtattccctcta

SEQ ID NO: 353667 - DNA, 15 bp, Homo sapiens
ttgtattccctctac

SEQ ID NO: 353668 - DNA, 15 bp, Homo sapiens
tgtattccctctacc

SEQ ID NO: 353669 - DNA, 15 bp, Homo sapiens
gtattccctctaccg

SEQ ID NO: 353670 - DNA, 15 bp, Homo sapiens
tattccctctaccgt

SEQ ID NO: 353671 - DNA, 15 bp, Homo sapiens
attccctctaccgtg

SEQ ID NO: 353672 - DNA, 15 bp, Homo sapiens
ttccctctaccgtgc

SEQ ID NO: 353673 - DNA, 15 bp, Homo sapiens
tccctctaccgtgct

SEQ ID NO: 353674 - DNA, 15 bp, Homo sapiens
ccctctaccgtgcta

SEQ ID NO: 353675 - DNA, 15 bp, Homo sapiens
cctctaccgtgctat

SEQ ID NO: 353676 - DNA, 15 bp, Homo sapiens
ctctaccgtgctatt

SEQ ID NO: 353677 - DNA, 15 bp, Homo sapiens
tctaccgtgctattt

SEQ ID NO: 353678 - DNA, 15 bp, Homo sapiens
ctaccgtgctatttg

SEQ ID NO: 353679 - DNA, 15 bp, Homo sapiens
taccgtgctatttgt

SEQ ID NO: 353680 - DNA, 15 bp, Homo sapiens
accgtgctatttgtt

SEQ ID NO: 353681 - DNA, 15 bp, Homo sapiens
ccgtgctatttgttt

SEQ ID NO: 353682 - DNA, 15 bp, Homo sapiens
cgtgctatttgttta

SEQ ID NO: 353683 - DNA, 15 bp, Homo sapiens
gtgctatttgtttat

SEQ ID NO: 353684 - DNA, 15 bp, Homo sapiens
tgctatttgtttatt

SEQ ID NO: 353685 - DNA, 15 bp, Homo sapiens
gctatttgtttattc

SEQ ID NO: 353686 - DNA, 15 bp, Homo sapiens
ctatttgtttattcc

SEQ ID NO: 353687 - DNA, 15 bp, Homo sapiens
tatttgtttattcct

SEQ ID NO: 353688 - DNA, 15 bp, Homo sapiens
atttgtttattcctg

SEQ ID NO: 353689 - DNA, 15 bp, Homo sapiens
tttgtttattcctgc

SEQ ID NO: 353690 - DNA, 15 bp, Homo sapiens
ttgtttattcctgct

SEQ ID NO: 353691 - DNA, 15 bp, Homo sapiens
tgtttattcctgctc

SEQ ID NO: 353692 - DNA, 15 bp, Homo sapiens
gtttattcctgctct

SEQ ID NO: 353693 - DNA, 15 bp, Homo sapiens
tttattcctgctctg

SEQ ID NO: 353694 - DNA, 15 bp, Homo sapiens
ttattcctgctctga

SEQ ID NO: 353695 - DNA, 15 bp, Homo sapiens
tattcctgctctgag

SEQ ID NO: 353696 - DNA, 15 bp, Homo sapiens
attcctgctctgagt

SEQ ID NO: 353697 - DNA, 15 bp, Homo sapiens
ttcctgctctgagtt

SEQ ID NO: 353698 - DNA, 15 bp, Homo sapiens
tcctgctctgagtta

SEQ ID NO: 353699 - DNA, 15 bp, Homo sapiens
cctgctctgagttac

SEQ ID NO: 353700 - DNA, 15 bp, Homo sapiens
ctgctctgagttact

SEQ ID NO: 353701 - DNA, 15 bp, Homo sapiens
tgctctgagttacta

SEQ ID NO: 353702 - DNA, 15 bp, Homo sapiens
gctctgagttactaa

SEQ ID NO: 353703 - DNA, 15 bp, Homo sapiens
ctctgagttactaac

SEQ ID NO: 353704 - DNA, 15 bp, Homo sapiens
tctgagttactaact

SEQ ID NO: 353705 - DNA, 15 bp, Homo sapiens
ctgagttactaactt

SEQ ID NO: 353706 - DNA, 15 bp, Homo sapiens
tgagttactaacttt

SEQ ID NO: 353707 - DNA, 15 bp, Homo sapiens
gagttactaacttta

SEQ ID NO: 353708 - DNA, 15 bp, Homo sapiens
agttactaactttag

SEQ ID NO: 353709 - DNA, 15 bp, Homo sapiens
gttactaactttaga

SEQ ID NO: 353710 - DNA, 15 bp, Homo sapiens
ttactaactttagag

SEQ ID NO: 353711 - DNA, 15 bp, Homo sapiens
tactaactttagaga

SEQ ID NO: 353712 - DNA, 15 bp, Homo sapiens
actaactttagagaa

SEQ ID NO: 353713 - DNA, 15 bp, Homo sapiens
ctaactttagagaaa

SEQ ID NO: 353714 - DNA, 15 bp, Homo sapiens
taactttagagaaaa

SEQ ID NO: 353715 - DNA, 15 bp, Homo sapiens
aactttagagaaaaa

SEQ ID NO: 353716 - DNA, 15 bp, Homo sapiens
actttagagaaaaat

SEQ ID NO: 353717 - DNA, 15 bp, Homo sapiens
ctttagagaaaaatt

SEQ ID NO: 353718 - DNA, 15 bp, Homo sapiens
tttagagaaaaattg

SEQ ID NO: 353719 - DNA, 15 bp, Homo sapiens
ttagagaaaaattgt

SEQ ID NO: 353720 - DNA, 15 bp, Homo sapiens
tagagaaaaattgtt

SEQ ID NO: 353721 - DNA, 15 bp, Homo sapiens
agagaaaaattgttc

SEQ ID NO: 353722 - DNA, 15 bp, Homo sapiens
gagaaaaattgttct

SEQ ID NO: 353723 - DNA, 15 bp, Homo sapiens
agaaaaattgttcta

SEQ ID NO: 353724 - DNA, 15 bp, Homo sapiens
gaaaaattgttctaa

SEQ ID NO: 353725 - DNA, 15 bp, Homo sapiens
aaaaattgttctaaa

SEQ ID NO: 353726 - DNA, 15 bp, Homo sapiens
aaaattgttctaaat

SEQ ID NO: 353727 - DNA, 15 bp, Homo sapiens
aaattgttctaaatt

SEQ ID NO: 353728 - DNA, 15 bp, Homo sapiens
aattgttctaaatta

SEQ ID NO: 353729 - DNA, 15 bp, Homo sapiens
attgttctaaattat

SEQ ID NO: 353730 - DNA, 15 bp, Homo sapiens
ttgttctaaattata

SEQ ID NO: 353731 - DNA, 15 bp, Homo sapiens
tgttctaaattatat

SEQ ID NO: 353732 - DNA, 15 bp, Homo sapiens
gttctaaattatatc

SEQ ID NO: 353733 - DNA, 15 bp, Homo sapiens
ttctaaattatatca

SEQ ID NO: 353734 - DNA, 15 bp, Homo sapiens
tctaaattatatcag

SEQ ID NO: 353735 - DNA, 15 bp, Homo sapiens
ctaaattatatcaga

SEQ ID NO: 353736 - DNA, 15 bp, Homo sapiens
taaattatatcagag

SEQ ID NO: 353737 - DNA, 15 bp, Homo sapiens
aaattatatcagagc

SEQ ID NO: 353738 - DNA, 15 bp, Homo sapiens
aattatatcagagca

SEQ ID NO: 353739 - DNA, 15 bp, Homo sapiens
attatatcagagcaa

SEQ ID NO: 353740 - DNA, 15 bp, Homo sapiens
ttatatcagagcaaa

SEQ ID NO: 353741 - DNA, 15 bp, Homo sapiens
tatatcagagcaaaa

SEQ ID NO: 353742 - DNA, 15 bp, Homo sapiens
atatcagagcaaaat

SEQ ID NO: 353743 - DNA, 15 bp, Homo sapiens
tatcagagcaaaata

SEQ ID NO: 353744 - DNA, 15 bp, Homo sapiens
atcagagcaaaatat

SEQ ID NO: 353745 - DNA, 15 bp, Homo sapiens
tcagagcaaaatatt

SEQ ID NO: 353746 - DNA, 15 bp, Homo sapiens
cagagcaaaatattt

SEQ ID NO: 353747 - DNA, 15 bp, Homo sapiens
agagcaaaatatttt

SEQ ID NO: 353748 - DNA, 15 bp, Homo sapiens
gagcaaaatatttta

SEQ ID NO: 353749 - DNA, 15 bp, Homo sapiens
agcaaaatattttat

SEQ ID NO: 353750 - DNA, 15 bp, Homo sapiens
gcaaaatattttata

SEQ ID NO: 353751 - DNA, 15 bp, Homo sapiens
caaaatattttatag

SEQ ID NO: 353752 - DNA, 15 bp, Homo sapiens
aaaatattttatagc

SEQ ID NO: 353753 - DNA, 15 bp, Homo sapiens
aaatattttatagct

SEQ ID NO: 353754 - DNA, 15 bp, Homo sapiens
aatattttatagctg

SEQ ID NO: 353755 - DNA, 15 bp, Homo sapiens
atattttatagctga

SEQ ID NO: 353756 - DNA, 15 bp, Homo sapiens
tattttatagctgat

SEQ ID NO: 353757 - DNA, 15 bp, Homo sapiens
attttatagctgata

SEQ ID NO: 353758 - DNA, 15 bp, Homo sapiens
ttttatagctgataa

SEQ ID NO: 353759 - DNA, 15 bp, Homo sapiens
tttatagctgataaa

SEQ ID NO: 353760 - DNA, 15 bp, Homo sapiens
ttatagctgataaaa

SEQ ID NO: 353761 - DNA, 15 bp, Homo sapiens
tatagctgataaaac

SEQ ID NO: 353762 - DNA, 15 bp, Homo sapiens
atagctgataaaacc

SEQ ID NO: 353763 - DNA, 15 bp, Homo sapiens
tagctgataaaacct

SEQ ID NO: 353764 - DNA, 15 bp, Homo sapiens
agctgataaaaccta

SEQ ID NO: 353765 - DNA, 15 bp, Homo sapiens
gctgataaaacctag

SEQ ID NO: 353766 - DNA, 15 bp, Homo sapiens
ctgataaaacctaga

SEQ ID NO: 353767 - DNA, 15 bp, Homo sapiens
tgataaaacctagaa

SEQ ID NO: 353768 - DNA, 15 bp, Homo sapiens
gataaaacctagaaa

SEQ ID NO: 353769 - DNA, 15 bp, Homo sapiens
ataaaacctagaaat

SEQ ID NO: 353770 - DNA, 15 bp, Homo sapiens
taaaacctagaaatg

SEQ ID NO: 353771 - DNA, 15 bp, Homo sapiens
aaaacctagaaatgc

SEQ ID NO: 353772 - DNA, 15 bp, Homo sapiens
aaacctagaaatgca

SEQ ID NO: 353773 - DNA, 15 bp, Homo sapiens
aacctagaaatgcat

SEQ ID NO: 353774 - DNA, 15 bp, Homo sapiens
acctagaaatgcatt

SEQ ID NO: 353775 - DNA, 15 bp, Homo sapiens
cctagaaatgcattt

SEQ ID NO: 353776 - DNA, 15 bp, Homo sapiens
ctagaaatgcatttt

SEQ ID NO: 353777 - DNA, 15 bp, Homo sapiens
tagaaatgcattttt

SEQ ID NO: 353778 - DNA, 15 bp, Homo sapiens
agaaatgcatttttt

SEQ ID NO: 353779 - DNA, 15 bp, Homo sapiens
gaaatgcattttttc

SEQ ID NO: 353780 - DNA, 15 bp, Homo sapiens
aaatgcattttttcc

SEQ ID NO: 353781 - DNA, 15 bp, Homo sapiens
aatgcattttttccc

SEQ ID NO: 353782 - DNA, 15 bp, Homo sapiens
atgcattttttccct

SEQ ID NO: 353783 - DNA, 15 bp, Homo sapiens
tgcattttttccctg

SEQ ID NO: 353784 - DNA, 15 bp, Homo sapiens
gcattttttccctgt

SEQ ID NO: 353785 - DNA, 15 bp, Homo sapiens
cattttttccctgta

SEQ ID NO: 353786 - DNA, 15 bp, Homo sapiens
attttttccctgtaa

SEQ ID NO: 353787 - DNA, 15 bp, Homo sapiens
ttttttccctgtaat

SEQ ID NO: 353788 - DNA, 15 bp, Homo sapiens
tttttccctgtaatt

SEQ ID NO: 353789 - DNA, 15 bp, Homo sapiens
ttttccctgtaattt

SEQ ID NO: 353790 - DNA, 15 bp, Homo sapiens
tttccctgtaatttg

SEQ ID NO: 353791 - DNA, 15 bp, Homo sapiens
ttccctgtaatttgc

SEQ ID NO: 353792 - DNA, 15 bp, Homo sapiens
tccctgtaatttgca

SEQ ID NO: 353793 - DNA, 15 bp, Homo sapiens
ccctgtaatttgcat

SEQ ID NO: 353794 - DNA, 15 bp, Homo sapiens
cctgtaatttgcatt

SEQ ID NO: 353795 - DNA, 15 bp, Homo sapiens
ctgtaatttgcattt

SEQ ID NO: 353796 - DNA, 15 bp, Homo sapiens
tgtaatttgcatttt

SEQ ID NO: 353797 - DNA, 15 bp, Homo sapiens
gtaatttgcatttta

SEQ ID NO: 353798 - DNA, 15 bp, Homo sapiens
taatttgcattttaa

SEQ ID NO: 353799 - DNA, 15 bp, Homo sapiens
aatttgcattttaaa

SEQ ID NO: 353800 - DNA, 15 bp, Homo sapiens
atttgcattttaaat

SEQ ID NO: 353801 - DNA, 15 bp, Homo sapiens
tttgcattttaaatc

SEQ ID NO: 353802 - DNA, 15 bp, Homo sapiens
ttgcattttaaatca

SEQ ID NO: 353803 - DNA, 15 bp, Homo sapiens
tgcattttaaatcat

SEQ ID NO: 353804 - DNA, 15 bp, Homo sapiens
gcattttaaatcata

SEQ ID NO: 353805 - DNA, 15 bp, Homo sapiens
cattttaaatcataa

SEQ ID NO: 353806 - DNA, 15 bp, Homo sapiens
attttaaatcataac

SEQ ID NO: 353807 - DNA, 15 bp, Homo sapiens
ttttaaatcataact

SEQ ID NO: 353808 - DNA, 15 bp, Homo sapiens
tttaaatcataacta

SEQ ID NO: 353809 - DNA, 15 bp, Homo sapiens
ttaaatcataactat

SEQ ID NO: 353810 - DNA, 15 bp, Homo sapiens
taaatcataactatt

SEQ ID NO: 353811 - DNA, 15 bp, Homo sapiens
aaatcataactattg

SEQ ID NO: 353812 - DNA, 15 bp, Homo sapiens
aatcataactattgc

SEQ ID NO: 353813 - DNA, 15 bp, Homo sapiens
atcataactattgct

SEQ ID NO: 353814 - DNA, 15 bp, Homo sapiens
tcataactattgctt

SEQ ID NO: 353815 - DNA, 15 bp, Homo sapiens
cataactattgcttg

SEQ ID NO: 353816 - DNA, 15 bp, Homo sapiens
ataactattgcttgc

SEQ ID NO: 353817 - DNA, 15 bp, Homo sapiens
taactattgcttgca

SEQ ID NO: 353818 - DNA, 15 bp, Homo sapiens
aactattgcttgcat

SEQ ID NO: 353819 - DNA, 15 bp, Homo sapiens
actattgcttgcatt

SEQ ID NO: 353820 - DNA, 15 bp, Homo sapiens
ctattgcttgcattt

SEQ ID NO: 353821 - DNA, 15 bp, Homo sapiens
tattgcttgcattta

SEQ ID NO: 353822 - DNA, 15 bp, Homo sapiens
attgcttgcatttaa

SEQ ID NO: 353823 - DNA, 15 bp, Homo sapiens
ttgcttgcatttaag

SEQ ID NO: 353824 - DNA, 15 bp, Homo sapiens
tgcttgcatttaagc

SEQ ID NO: 353825 - DNA, 15 bp, Homo sapiens
gcttgcatttaagca

SEQ ID NO: 353826 - DNA, 15 bp, Homo sapiens
cttgcatttaagcaa

SEQ ID NO: 353827 - DNA, 15 bp, Homo sapiens
ttgcatttaagcaaa

SEQ ID NO: 353828 - DNA, 15 bp, Homo sapiens
tgcatttaagcaaaa

SEQ ID NO: 353829 - DNA, 15 bp, Homo sapiens
gcatttaagcaaaaa

SEQ ID NO: 353830 - DNA, 15 bp, Homo sapiens
catttaagcaaaaag

SEQ ID NO: 353831 - DNA, 15 bp, Homo sapiens
atttaagcaaaaaga

SEQ ID NO: 353832 - DNA, 15 bp, Homo sapiens
tttaagcaaaaagag

SEQ ID NO: 353833 - DNA, 15 bp, Homo sapiens
ttaagcaaaaagagc

SEQ ID NO: 353834 - DNA, 15 bp, Homo sapiens
taagcaaaaagagct

SEQ ID NO: 353835 - DNA, 15 bp, Homo sapiens
aagcaaaaagagcta

SEQ ID NO: 353836 - DNA, 15 bp, Homo sapiens
agcaaaaagagctag

SEQ ID NO: 353837 - DNA, 15 bp, Homo sapiens
gcaaaaagagctagc

SEQ ID NO: 353838 - DNA, 15 bp, Homo sapiens
caaaaagagctagcg

SEQ ID NO: 353839 - DNA, 15 bp, Homo sapiens
aaaaagagctagcgt

SEQ ID NO: 353840 - DNA, 15 bp, Homo sapiens
aaaagagctagcgtt

SEQ ID NO: 353841 - DNA, 15 bp, Homo sapiens
aaagagctagcgttt

SEQ ID NO: 353842 - DNA, 15 bp, Homo sapiens
aagagctagcgtttg

SEQ ID NO: 353843 - DNA, 15 bp, Homo sapiens
agagctagcgtttgg

SEQ ID NO: 353844 - DNA, 15 bp, Homo sapiens
gagctagcgtttgga

SEQ ID NO: 353845 - DNA, 15 bp, Homo sapiens
agctagcgtttggaa

SEQ ID NO: 353846 - DNA, 15 bp, Homo sapiens
gctagcgtttggaaa

SEQ ID NO: 353847 - DNA, 15 bp, Homo sapiens
ctagcgtttggaaat

SEQ ID NO: 353848 - DNA, 15 bp, Homo sapiens
tagcgtttggaaatt

SEQ ID NO: 353849 - DNA, 15 bp, Homo sapiens
agcgtttggaaattt

SEQ ID NO: 353850 - DNA, 15 bp, Homo sapiens
gcgtttggaaatttt

SEQ ID NO: 353851 - DNA, 15 bp, Homo sapiens
cgtttggaaattttt

SEQ ID NO: 353852 - DNA, 15 bp, Homo sapiens
gtttggaaattttta

SEQ ID NO: 353853 - DNA, 15 bp, Homo sapiens
tttggaaatttttag

SEQ ID NO: 353854 - DNA, 15 bp, Homo sapiens
ttggaaatttttaga

SEQ ID NO: 353855 - DNA, 15 bp, Homo sapiens
tggaaatttttagag

SEQ ID NO: 353856 - DNA, 15 bp, Homo sapiens
ggaaatttttagagt

SEQ ID NO: 353857 - DNA, 15 bp, Homo sapiens
gaaatttttagagtg

SEQ ID NO: 353858 - DNA, 15 bp, Homo sapiens
aaatttttagagtgg

SEQ ID NO: 353859 - DNA, 15 bp, Homo sapiens
aatttttagagtggt

SEQ ID NO: 353860 - DNA, 15 bp, Homo sapiens
atttttagagtggtt

SEQ ID NO: 353861 - DNA, 15 bp, Homo sapiens
tttttagagtggtta

SEQ ID NO: 353862 - DNA, 15 bp, Homo sapiens
ttttagagtggttac

SEQ ID NO: 353863 - DNA, 15 bp, Homo sapiens
tttagagtggttact

SEQ ID NO: 353864 - DNA, 15 bp, Homo sapiens
ttagagtggttacta

SEQ ID NO: 353865 - DNA, 15 bp, Homo sapiens
tagagtggttactaa

SEQ ID NO: 353866 - DNA, 15 bp, Homo sapiens
agagtggttactaac

SEQ ID NO: 353867 - DNA, 15 bp, Homo sapiens
gagtggttactaacc

SEQ ID NO: 353868 - DNA, 15 bp, Homo sapiens
agtggttactaacct

SEQ ID NO: 353869 - DNA, 15 bp, Homo sapiens
gtggttactaacctg

SEQ ID NO: 353870 - DNA, 15 bp, Homo sapiens
tggttactaacctgt

SEQ ID NO: 353871 - DNA, 15 bp, Homo sapiens
ggttactaacctgtc

SEQ ID NO: 353872 - DNA, 15 bp, Homo sapiens
gttactaacctgtca

SEQ ID NO: 353873 - DNA, 15 bp, Homo sapiens
ttactaacctgtcat

SEQ ID NO: 353874 - DNA, 15 bp, Homo sapiens
tactaacctgtcatc

SEQ ID NO: 353875 - DNA, 15 bp, Homo sapiens
actaacctgtcatct

SEQ ID NO: 353876 - DNA, 15 bp, Homo sapiens
ctaacctgtcatctc

SEQ ID NO: 353877 - DNA, 15 bp, Homo sapiens
taacctgtcatctct

SEQ ID NO: 353878 - DNA, 15 bp, Homo sapiens
aacctgtcatctctt

SEQ ID NO: 353879 - DNA, 15 bp, Homo sapiens
acctgtcatctcttg

SEQ ID NO: 353880 - DNA, 15 bp, Homo sapiens
cctgtcatctcttga

SEQ ID NO: 353881 - DNA, 15 bp, Homo sapiens
ctgtcatctcttgag

SEQ ID NO: 353882 - DNA, 15 bp, Homo sapiens
tgtcatctcttgagg

SEQ ID NO: 353883 - DNA, 15 bp, Homo sapiens
gtcatctcttgagga

SEQ ID NO: 353884 - DNA, 15 bp, Homo sapiens
tcatctcttgaggat

SEQ ID NO: 353885 - DNA, 15 bp, Homo sapiens
catctcttgaggatt

SEQ ID NO: 353886 - DNA, 15 bp, Homo sapiens
atctcttgaggattt

SEQ ID NO: 353887 - DNA, 15 bp, Homo sapiens
tctcttgaggatttt

SEQ ID NO: 353888 - DNA, 15 bp, Homo sapiens
ctcttgaggatttta

SEQ ID NO: 353889 - DNA, 15 bp, Homo sapiens
tcttgaggattttag

SEQ ID NO: 353890 - DNA, 15 bp, Homo sapiens
cttgaggattttagt

SEQ ID NO: 353891 - DNA, 15 bp, Homo sapiens
ttgaggattttagtc

SEQ ID NO: 353892 - DNA, 15 bp, Homo sapiens
tgaggattttagtca

SEQ ID NO: 353893 - DNA, 15 bp, Homo sapiens
gaggattttagtcaa

SEQ ID NO: 353894 - DNA, 15 bp, Homo sapiens
aggattttagtcaag

SEQ ID NO: 353895 - DNA, 15 bp, Homo sapiens
ggattttagtcaaga

SEQ ID NO: 353896 - DNA, 15 bp, Homo sapiens
gattttagtcaagaa

SEQ ID NO: 353897 - DNA, 15 bp, Homo sapiens
attttagtcaagaat

SEQ ID NO: 353898 - DNA, 15 bp, Homo sapiens
ttttagtcaagaatg

SEQ ID NO: 353899 - DNA, 15 bp, Homo sapiens
tttagtcaagaatga

SEQ ID NO: 353900 - DNA, 15 bp, Homo sapiens
ttagtcaagaatgaa

SEQ ID NO: 353901 - DNA, 15 bp, Homo sapiens
tagtcaagaatgaag

SEQ ID NO: 353902 - DNA, 15 bp, Homo sapiens
agtcaagaatgaaga

SEQ ID NO: 353903 - DNA, 15 bp, Homo sapiens
gtcaagaatgaagaa

SEQ ID NO: 353904 - DNA, 15 bp, Homo sapiens
tcaagaatgaagaaa

SEQ ID NO: 353905 - DNA, 15 bp, Homo sapiens
caagaatgaagaaaa

SEQ ID NO: 353906 - DNA, 15 bp, Homo sapiens
aagaatgaagaaaat

SEQ ID NO: 353907 - DNA, 15 bp, Homo sapiens
agaatgaagaaaata

SEQ ID NO: 353908 - DNA, 15 bp, Homo sapiens
gaatgaagaaaataa

SEQ ID NO: 353909 - DNA, 15 bp, Homo sapiens
aatgaagaaaataat

SEQ ID NO: 353910 - DNA, 15 bp, Homo sapiens
atgaagaaaataatc

SEQ ID NO: 353911 - DNA, 15 bp, Homo sapiens
tgaagaaaataatca

SEQ ID NO: 353912 - DNA, 15 bp, Homo sapiens
gaagaaaataatcat

SEQ ID NO: 353913 - DNA, 15 bp, Homo sapiens
aagaaaataatcatt

SEQ ID NO: 353914 - DNA, 15 bp, Homo sapiens
agaaaataatcattt

SEQ ID NO: 353915 - DNA, 15 bp, Homo sapiens
gaaaataatcatttt

SEQ ID NO: 353916 - DNA, 15 bp, Homo sapiens
aaaataatcattttc

SEQ ID NO: 353917 - DNA, 15 bp, Homo sapiens
aaataatcattttca

SEQ ID NO: 353918 - DNA, 15 bp, Homo sapiens
aataatcattttcaa

SEQ ID NO: 353919 - DNA, 15 bp, Homo sapiens
ataatcattttcaaa

SEQ ID NO: 353920 - DNA, 15 bp, Homo sapiens
taatcattttcaaat

SEQ ID NO: 353921 - DNA, 15 bp, Homo sapiens
aatcattttcaaatt

SEQ ID NO: 353922 - DNA, 15 bp, Homo sapiens
atcattttcaaattt

SEQ ID NO: 353923 - DNA, 15 bp, Homo sapiens
tcattttcaaatttg

SEQ ID NO: 353924 - DNA, 15 bp, Homo sapiens
cattttcaaatttgg

SEQ ID NO: 353925 - DNA, 15 bp, Homo sapiens
attttcaaatttgga

SEQ ID NO: 353926 - DNA, 15 bp, Homo sapiens
ttttcaaatttggaa

SEQ ID NO: 353927 - DNA, 15 bp, Homo sapiens
tttcaaatttggaag

SEQ ID NO: 353928 - DNA, 15 bp, Homo sapiens
ttcaaatttggaagg

SEQ ID NO: 353929 - DNA, 15 bp, Homo sapiens
tcaaatttggaaggt

SEQ ID NO: 353930 - DNA, 15 bp, Homo sapiens
caaatttggaaggtt

SEQ ID NO: 353931 - DNA, 15 bp, Homo sapiens
aaatttggaaggttt

SEQ ID NO: 353932 - DNA, 15 bp, Homo sapiens
aatttggaaggttta

SEQ ID NO: 353933 - DNA, 15 bp, Homo sapiens
atttggaaggtttag

SEQ ID NO: 353934 - DNA, 15 bp, Homo sapiens
tttggaaggtttaga

SEQ ID NO: 353935 - DNA, 15 bp, Homo sapiens
ttggaaggtttagaa

SEQ ID NO: 353936 - DNA, 15 bp, Homo sapiens
tggaaggtttagaaa

SEQ ID NO: 353937 - DNA, 15 bp, Homo sapiens
ggaaggtttagaaaa

SEQ ID NO: 353938 - DNA, 15 bp, Homo sapiens
gaaggtttagaaaaa

SEQ ID NO: 353939 - DNA, 15 bp, Homo sapiens
aaggtttagaaaaag

SEQ ID NO: 353940 - DNA, 15 bp, Homo sapiens
aggtttagaaaaaga

SEQ ID NO: 353941 - DNA, 15 bp, Homo sapiens
ggtttagaaaaagaa

SEQ ID NO: 353942 - DNA, 15 bp, Homo sapiens
gtttagaaaaagaaa

SEQ ID NO: 353943 - DNA, 15 bp, Homo sapiens
tttagaaaaagaaat

SEQ ID NO: 353944 - DNA, 15 bp, Homo sapiens
ttagaaaaagaaata

SEQ ID NO: 353945 - DNA, 15 bp, Homo sapiens
tagaaaaagaaataa

SEQ ID NO: 353946 - DNA, 15 bp, Homo sapiens
agaaaaagaaataac

SEQ ID NO: 353947 - DNA, 15 bp, Homo sapiens
gaaaaagaaataaca

SEQ ID NO: 353948 - DNA, 15 bp, Homo sapiens
aaaaagaaataacat

SEQ ID NO: 353949 - DNA, 15 bp, Homo sapiens
aaaagaaataacata

SEQ ID NO: 353950 - DNA, 15 bp, Homo sapiens
aaagaaataacataa

SEQ ID NO: 353951 - DNA, 15 bp, Homo sapiens
aagaaataacataaa

SEQ ID NO: 353952 - DNA, 15 bp, Homo sapiens
agaaataacataaat

SEQ ID NO: 353953 - DNA, 15 bp, Homo sapiens
gaaataacataaatg

SEQ ID NO: 353954 - DNA, 15 bp, Homo sapiens
aaataacataaatga

SEQ ID NO: 353955 - DNA, 15 bp, Homo sapiens
aataacataaatgaa

SEQ ID NO: 353956 - DNA, 15 bp, Homo sapiens
ataacataaatgaaa

SEQ ID NO: 353957 - DNA, 15 bp, Homo sapiens
taacataaatgaaag

SEQ ID NO: 353958 - DNA, 15 bp, Homo sapiens
aacataaatgaaagc

SEQ ID NO: 353959 - DNA, 15 bp, Homo sapiens
acataaatgaaagcg

SEQ ID NO: 353960 - DNA, 15 bp, Homo sapiens
cataaatgaaagcga

SEQ ID NO: 353961 - DNA, 15 bp, Homo sapiens
ataaatgaaagcgat

SEQ ID NO: 353962 - DNA, 15 bp, Homo sapiens
taaatgaaagcgatg

SEQ ID NO: 353963 - DNA, 15 bp, Homo sapiens
aaatgaaagcgatgc

SEQ ID NO: 353964 - DNA, 15 bp, Homo sapiens
aatgaaagcgatgct

SEQ ID NO: 353965 - DNA, 15 bp, Homo sapiens
atgaaagcgatgcta

SEQ ID NO: 353966 - DNA, 15 bp, Homo sapiens
tgaaagcgatgctat

SEQ ID NO: 353967 - DNA, 15 bp, Homo sapiens
gaaagcgatgctatc

SEQ ID NO: 353968 - DNA, 15 bp, Homo sapiens
aaagcgatgctatcg

SEQ ID NO: 353969 - DNA, 15 bp, Homo sapiens
aagcgatgctatcgg

SEQ ID NO: 353970 - DNA, 15 bp, Homo sapiens
agcgatgctatcgga

SEQ ID NO: 353971 - DNA, 15 bp, Homo sapiens
gcgatgctatcggag

SEQ ID NO: 353972 - DNA, 15 bp, Homo sapiens
cgatgctatcggagc

SEQ ID NO: 353973 - DNA, 15 bp, Homo sapiens
gatgctatcggagct

SEQ ID NO: 353974 - DNA, 15 bp, Homo sapiens
atgctatcggagctt

SEQ ID NO: 353975 - DNA, 15 bp, Homo sapiens
tgctatcggagcttt

SEQ ID NO: 353976 - DNA, 15 bp, Homo sapiens
gctatcggagcttta

SEQ ID NO: 353977 - DNA, 15 bp, Homo sapiens
ctatcggagctttaa

SEQ ID NO: 353978 - DNA, 15 bp, Homo sapiens
tatcggagctttaaa

SEQ ID NO: 353979 - DNA, 15 bp, Homo sapiens
atcggagctttaaaa

SEQ ID NO: 353980 - DNA, 15 bp, Homo sapiens
tcggagctttaaaaa

SEQ ID NO: 353981 - DNA, 15 bp, Homo sapiens
cggagctttaaaaag

SEQ ID NO: 353982 - DNA, 15 bp, Homo sapiens
ggagctttaaaaagt

SEQ ID NO: 353983 - DNA, 15 bp, Homo sapiens
gagctttaaaaagtt

SEQ ID NO: 353984 - DNA, 15 bp, Homo sapiens
agctttaaaaagttc

SEQ ID NO: 353985 - DNA, 15 bp, Homo sapiens
gctttaaaaagttcc

SEQ ID NO: 353986 - DNA, 15 bp, Homo sapiens
ctttaaaaagttcct

SEQ ID NO: 353987 - DNA, 15 bp, Homo sapiens
tttaaaaagttcctt

SEQ ID NO: 353988 - DNA, 15 bp, Homo sapiens
ttaaaaagttccttt

SEQ ID NO: 353989 - DNA, 15 bp, Homo sapiens
taaaaagttcctttg

SEQ ID NO: 353990 - DNA, 15 bp, Homo sapiens
aaaaagttcctttgt

SEQ ID NO: 353991 - DNA, 15 bp, Homo sapiens
aaaagttcctttgtt

SEQ ID NO: 353992 - DNA, 15 bp, Homo sapiens
aaagttcctttgttc

SEQ ID NO: 353993 - DNA, 15 bp, Homo sapiens
aagttcctttgttcc

SEQ ID NO: 353994 - DNA, 15 bp, Homo sapiens
agttcctttgttcca

SEQ ID NO: 353995 - DNA, 15 bp, Homo sapiens
gttcctttgttccag

SEQ ID NO: 353996 - DNA, 15 bp, Homo sapiens
ttcctttgttccagt

SEQ ID NO: 353997 - DNA, 15 bp, Homo sapiens
tcctttgttccagtg

SEQ ID NO: 353998 - DNA, 15 bp, Homo sapiens
cctttgttccagtgg

SEQ ID NO: 353999 - DNA, 15 bp, Homo sapiens
ctttgttccagtggc

SEQ ID NO: 354000 - DNA, 15 bp, Homo sapiens
tttgttccagtggcg

SEQ ID NO: 354001 - DNA, 15 bp, Homo sapiens
ttgttccagtggcgg

SEQ ID NO: 354002 - DNA, 15 bp, Homo sapiens
tgttccagtggcggt

SEQ ID NO: 354003 - DNA, 15 bp, Homo sapiens
gttccagtggcggta

SEQ ID NO: 354004 - DNA, 15 bp, Homo sapiens
ttccagtggcggtag

SEQ ID NO: 354005 - DNA, 15 bp, Homo sapiens
tccagtggcggtaga

SEQ ID NO: 354006 - DNA, 15 bp, Homo sapiens
ccagtggcggtagat

SEQ ID NO: 354007 - DNA, 15 bp, Homo sapiens
cagtggcggtagatc

SEQ ID NO: 354008 - DNA, 15 bp, Homo sapiens
agtggcggtagatct

SEQ ID NO: 354009 - DNA, 15 bp, Homo sapiens
gtggcggtagatctt

SEQ ID NO: 354010 - DNA, 15 bp, Homo sapiens
tggcggtagatcttg

SEQ ID NO: 354011 - DNA, 15 bp, Homo sapiens
ggcggtagatcttga

SEQ ID NO: 354012 - DNA, 15 bp, Homo sapiens
gcggtagatcttgag

SEQ ID NO: 354013 - DNA, 15 bp, Homo sapiens
cggtagatcttgaga

SEQ ID NO: 354014 - DNA, 15 bp, Homo sapiens
ggtagatcttgagat

SEQ ID NO: 354015 - DNA, 15 bp, Homo sapiens
gtagatcttgagatg

SEQ ID NO: 354016 - DNA, 15 bp, Homo sapiens
tagatcttgagatgt

SEQ ID NO: 354017 - DNA, 15 bp, Homo sapiens
agatcttgagatgta

SEQ ID NO: 354018 - DNA, 15 bp, Homo sapiens
gatcttgagatgtag

SEQ ID NO: 354019 - DNA, 15 bp, Homo sapiens
atcttgagatgtagt

SEQ ID NO: 354020 - DNA, 15 bp, Homo sapiens
tcttgagatgtagta

SEQ ID NO: 354021 - DNA, 15 bp, Homo sapiens
cttgagatgtagtag

SEQ ID NO: 354022 - DNA, 15 bp, Homo sapiens
ttgagatgtagtagg

SEQ ID NO: 354023 - DNA, 15 bp, Homo sapiens
tgagatgtagtaggc

SEQ ID NO: 354024 - DNA, 15 bp, Homo sapiens
gagatgtagtaggct

SEQ ID NO: 354025 - DNA, 15 bp, Homo sapiens
agatgtagtaggctg

SEQ ID NO: 354026 - DNA, 15 bp, Homo sapiens
gatgtagtaggctga

SEQ ID NO: 354027 - DNA, 15 bp, Homo sapiens
atgtagtaggctgaa

SEQ ID NO: 354028 - DNA, 15 bp, Homo sapiens
tgtagtaggctgaac

SEQ ID NO: 354029 - DNA, 15 bp, Homo sapiens
gtagtaggctgaacg

SEQ ID NO: 354030 - DNA, 15 bp, Homo sapiens
tagtaggctgaacgt

SEQ ID NO: 354031 - DNA, 15 bp, Homo sapiens
agtaggctgaacgtc

SEQ ID NO: 354032 - DNA, 15 bp, Homo sapiens
gtaggctgaacgtca

SEQ ID NO: 354033 - DNA, 15 bp, Homo sapiens
taggctgaacgtcac

SEQ ID NO: 354034 - DNA, 15 bp, Homo sapiens
aggctgaacgtcacg

SEQ ID NO: 354035 - DNA, 15 bp, Homo sapiens
ggctgaacgtcacga

SEQ ID NO: 354036 - DNA, 15 bp, Homo sapiens
gctgaacgtcacgaa

SEQ ID NO: 354037 - DNA, 15 bp, Homo sapiens
ctgaacgtcacgaag

SEQ ID NO: 354038 - DNA, 15 bp, Homo sapiens
tgaacgtcacgaagt

SEQ ID NO: 354039 - DNA, 15 bp, Homo sapiens
gaacgtcacgaagta

SEQ ID NO: 354040 - DNA, 15 bp, Homo sapiens
aacgtcacgaagtaa

SEQ ID NO: 354041 - DNA, 15 bp, Homo sapiens
acgtcacgaagtaat

SEQ ID NO: 354042 - DNA, 15 bp, Homo sapiens
cgtcacgaagtaata

SEQ ID NO: 354043 - DNA, 15 bp, Homo sapiens
gtcacgaagtaatat

SEQ ID NO: 354044 - DNA, 15 bp, Homo sapiens
tcacgaagtaatatc

SEQ ID NO: 354045 - DNA, 15 bp, Homo sapiens
cacgaagtaatatcc

SEQ ID NO: 354046 - DNA, 15 bp, Homo sapiens
acgaagtaatatccc

SEQ ID NO: 354047 - DNA, 15 bp, Homo sapiens
cgaagtaatatcccc

SEQ ID NO: 354048 - DNA, 15 bp, Homo sapiens
gaagtaatatccccc

SEQ ID NO: 354049 - DNA, 15 bp, Homo sapiens
aagtaatatccccct

SEQ ID NO: 354050 - DNA, 15 bp, Homo sapiens
agtaatatccccctc

SEQ ID NO: 354051 - DNA, 15 bp, Homo sapiens
gtaatatccccctct

SEQ ID NO: 354052 - DNA, 15 bp, Homo sapiens
taatatccccctctg

SEQ ID NO: 354053 - DNA, 15 bp, Homo sapiens
aatatccccctctgt

SEQ ID NO: 354054 - DNA, 15 bp, Homo sapiens
atatccccctctgtt

SEQ ID NO: 354055 - DNA, 15 bp, Homo sapiens
tatccccctctgtta

SEQ ID NO: 354056 - DNA, 15 bp, Homo sapiens
atccccctctgttat

SEQ ID NO: 354057 - DNA, 15 bp, Homo sapiens
tccccctctgttatc

SEQ ID NO: 354058 - DNA, 15 bp, Homo sapiens
ccccctctgttatca

SEQ ID NO: 354059 - DNA, 15 bp, Homo sapiens
cccctctgttatcat

SEQ ID NO: 354060 - DNA, 15 bp, Homo sapiens
ccctctgttatcatg

SEQ ID NO: 354061 - DNA, 15 bp, Homo sapiens
cctctgttatcatgt

SEQ ID NO: 354062 - DNA, 15 bp, Homo sapiens
ctctgttatcatgtt

SEQ ID NO: 354063 - DNA, 15 bp, Homo sapiens
tctgttatcatgttc

SEQ ID NO: 354064 - DNA, 15 bp, Homo sapiens
ctgttatcatgttcg

SEQ ID NO: 354065 - DNA, 15 bp, Homo sapiens
tgttatcatgttcga

SEQ ID NO: 354066 - DNA, 15 bp, Homo sapiens
gttatcatgttcgat

SEQ ID NO: 354067 - DNA, 15 bp, Homo sapiens
ttatcatgttcgatt

SEQ ID NO: 354068 - DNA, 15 bp, Homo sapiens
tatcatgttcgatta

SEQ ID NO: 354069 - DNA, 15 bp, Homo sapiens
atcatgttcgattag

SEQ ID NO: 354070 - DNA, 15 bp, Homo sapiens
tcatgttcgattagg

SEQ ID NO: 354071 - DNA, 15 bp, Homo sapiens
catgttcgattaggc

SEQ ID NO: 354072 - DNA, 15 bp, Homo sapiens
atgttcgattaggcc

SEQ ID NO: 354073 - DNA, 15 bp, Homo sapiens
tgttcgattaggccg

SEQ ID NO: 354074 - DNA, 15 bp, Homo sapiens
gttcgattaggccga

SEQ ID NO: 354075 - DNA, 15 bp, Homo sapiens
ttcgattaggccgat

SEQ ID NO: 354076 - DNA, 15 bp, Homo sapiens
tcgattaggccgatt

SEQ ID NO: 354077 - DNA, 15 bp, Homo sapiens
cgattaggccgattc

SEQ ID NO: 354078 - DNA, 15 bp, Homo sapiens
gattaggccgattca

SEQ ID NO: 354079 - DNA, 15 bp, Homo sapiens
attaggccgattcaa

SEQ ID NO: 354080 - DNA, 15 bp, Homo sapiens
ttaggccgattcaac

SEQ ID NO: 354081 - DNA, 15 bp, Homo sapiens
taggccgattcaaca

SEQ ID NO: 354082 - DNA, 15 bp, Homo sapiens
aggccgattcaacag

SEQ ID NO: 354083 - DNA, 15 bp, Homo sapiens
ggccgattcaacagt

SEQ ID NO: 354084 - DNA, 15 bp, Homo sapiens
gccgattcaacagtc

SEQ ID NO: 354085 - DNA, 15 bp, Homo sapiens
ccgattcaacagtca

SEQ ID NO: 354086 - DNA, 15 bp, Homo sapiens
cgattcaacagtcat

SEQ ID NO: 354087 - DNA, 15 bp, Homo sapiens
gattcaacagtcatt

SEQ ID NO: 354088 - DNA, 15 bp, Homo sapiens
attcaacagtcattg

SEQ ID NO: 354089 - DNA, 15 bp, Homo sapiens
ttcaacagtcattga

SEQ ID NO: 354090 - DNA, 15 bp, Homo sapiens
tcaacagtcattgag

SEQ ID NO: 354091 - DNA, 15 bp, Homo sapiens
caacagtcattgaga

SEQ ID NO: 354092 - DNA, 15 bp, Homo sapiens
aacagtcattgagaa

SEQ ID NO: 354093 - DNA, 15 bp, Homo sapiens
acagtcattgagaag

SEQ ID NO: 354094 - DNA, 15 bp, Homo sapiens
cagtcattgagaagt

SEQ ID NO: 354095 - DNA, 15 bp, Homo sapiens
agtcattgagaagtg

SEQ ID NO: 354096 - DNA, 15 bp, Homo sapiens
gtcattgagaagtgg

SEQ ID NO: 354097 - DNA, 15 bp, Homo sapiens
tcattgagaagtgga

SEQ ID NO: 354098 - DNA, 15 bp, Homo sapiens
cattgagaagtggat

SEQ ID NO: 354099 - DNA, 15 bp, Homo sapiens
attgagaagtggatg

SEQ ID NO: 354100 - DNA, 15 bp, Homo sapiens
ttgagaagtggatgg

SEQ ID NO: 354101 - DNA, 15 bp, Homo sapiens
tgagaagtggatgga

SEQ ID NO: 354102 - DNA, 15 bp, Homo sapiens
gagaagtggatggat

SEQ ID NO: 354103 - DNA, 15 bp, Homo sapiens
agaagtggatggatg

SEQ ID NO: 354104 - DNA, 15 bp, Homo sapiens
gaagtggatggatgg

SEQ ID NO: 354105 - DNA, 15 bp, Homo sapiens
aagtggatggatggc

SEQ ID NO: 354106 - DNA, 15 bp, Homo sapiens
agtggatggatggcg

SEQ ID NO: 354107 - DNA, 15 bp, Homo sapiens
gtggatggatggcgt

SEQ ID NO: 354108 - DNA, 15 bp, Homo sapiens
tggatggatggcgtg

SEQ ID NO: 354109 - DNA, 15 bp, Homo sapiens
ggatggatggcgtga

SEQ ID NO: 354110 - DNA, 15 bp, Homo sapiens
gatggatggcgtgaa

SEQ ID NO: 354111 - DNA, 15 bp, Homo sapiens
atggatggcgtgaaa

SEQ ID NO: 354112 - DNA, 15 bp, Homo sapiens
tggatggcgtgaaag

SEQ ID NO: 354113 - DNA, 15 bp, Homo sapiens
ggatggcgtgaaaga

SEQ ID NO: 354114 - DNA, 15 bp, Homo sapiens
gatggcgtgaaagac

SEQ ID NO: 354115 - DNA, 15 bp, Homo sapiens
atggcgtgaaagact

SEQ ID NO: 354116 - DNA, 15 bp, Homo sapiens
tggcgtgaaagactt

SEQ ID NO: 354117 - DNA, 15 bp, Homo sapiens
ggcgtgaaagacttc

SEQ ID NO: 354118 - DNA, 15 bp, Homo sapiens
gcgtgaaagacttct

SEQ ID NO: 354119 - DNA, 15 bp, Homo sapiens
cgtgaaagacttctt

SEQ ID NO: 354120 - DNA, 15 bp, Homo sapiens
gtgaaagacttctta

SEQ ID NO: 354121 - DNA, 15 bp, Homo sapiens
tgaaagacttcttaa

SEQ ID NO: 354122 - DNA, 15 bp, Homo sapiens
gaaagacttcttaat

SEQ ID NO: 354123 - DNA, 15 bp, Homo sapiens
aaagacttcttaatg

SEQ ID NO: 354124 - DNA, 15 bp, Homo sapiens
aagacttcttaatga

SEQ ID NO: 354125 - DNA, 15 bp, Homo sapiens
agacttcttaatgaa

SEQ ID NO: 354126 - DNA, 15 bp, Homo sapiens
gacttcttaatgaaa

SEQ ID NO: 354127 - DNA, 15 bp, Homo sapiens
acttcttaatgaaac

SEQ ID NO: 354128 - DNA, 15 bp, Homo sapiens
cttcttaatgaaaca

SEQ ID NO: 354129 - DNA, 15 bp, Homo sapiens
ttcttaatgaaacag

SEQ ID NO: 354130 - DNA, 15 bp, Homo sapiens
tcttaatgaaacagc

SEQ ID NO: 354131 - DNA, 15 bp, Homo sapiens
cttaatgaaacagca

SEQ ID NO: 354132 - DNA, 15 bp, Homo sapiens
ttaatgaaacagcag

SEQ ID NO: 354133 - DNA, 15 bp, Homo sapiens
taatgaaacagcagg

SEQ ID NO: 354134 - DNA, 15 bp, Homo sapiens
aatgaaacagcaggc

SEQ ID NO: 354135 - DNA, 15 bp, Homo sapiens
atgaaacagcaggct

SEQ ID NO: 354136 - DNA, 15 bp, Homo sapiens
tgaaacagcaggctg

SEQ ID NO: 354137 - DNA, 15 bp, Homo sapiens
gaaacagcaggctgc

SEQ ID NO: 354138 - DNA, 15 bp, Homo sapiens
aaacagcaggctgcc

SEQ ID NO: 354139 - DNA, 15 bp, Homo sapiens
aacagcaggctgccc

SEQ ID NO: 354140 - DNA, 15 bp, Homo sapiens
acagcaggctgccca

SEQ ID NO: 354141 - DNA, 15 bp, Homo sapiens
cagcaggctgcccaa

SEQ ID NO: 354142 - DNA, 15 bp, Homo sapiens
agcaggctgcccaag

SEQ ID NO: 354143 - DNA, 15 bp, Homo sapiens
gcaggctgcccaagg

SEQ ID NO: 354144 - DNA, 15 bp, Homo sapiens
caggctgcccaagga

SEQ ID NO: 354145 - DNA, 15 bp, Homo sapiens
aggctgcccaaggag

SEQ ID NO: 354146 - DNA, 15 bp, Homo sapiens
ggctgcccaaggaga

SEQ ID NO: 354147 - DNA, 15 bp, Homo sapiens
gctgcccaaggagac

SEQ ID NO: 354148 - DNA, 15 bp, Homo sapiens
ctgcccaaggagacg

SEQ ID NO: 354149 - DNA, 15 bp, Homo sapiens
tgcccaaggagacga

SEQ ID NO: 354150 - DNA, 15 bp, Homo sapiens
gcccaaggagacgac

SEQ ID NO: 354151 - DNA, 15 bp, Homo sapiens
cccaaggagacgacg

SEQ ID NO: 354152 - DNA, 15 bp, Homo sapiens
ccaaggagacgacgc

SEQ ID NO: 354153 - DNA, 15 bp, Homo sapiens
caaggagacgacgca

SEQ ID NO: 354154 - DNA, 15 bp, Homo sapiens
aaggagacgacgcag

SEQ ID NO: 354155 - DNA, 15 bp, Homo sapiens
aggagacgacgcagg

SEQ ID NO: 354156 - DNA, 15 bp, Homo sapiens
ggagacgacgcaggt

SEQ ID NO: 354157 - DNA, 15 bp, Homo sapiens
gagacgacgcaggtc

SEQ ID NO: 354158 - DNA, 15 bp, Homo sapiens
agacgacgcaggtct

SEQ ID NO: 354159 - DNA, 15 bp, Homo sapiens
gacgacgcaggtcta

SEQ ID NO: 354160 - DNA, 15 bp, Homo sapiens
acgacgcaggtctac

SEQ ID NO: 354161 - DNA, 15 bp, Homo sapiens
cgacgcaggtctaca

SEQ ID NO: 354162 - DNA, 15 bp, Homo sapiens
gacgcaggtctacag

SEQ ID NO: 354163 - DNA, 15 bp, Homo sapiens
acgcaggtctacaga

SEQ ID NO: 354164 - DNA, 15 bp, Homo sapiens
cgcaggtctacagag

SEQ ID NO: 354165 - DNA, 15 bp, Homo sapiens
gcaggtctacagagg

SEQ ID NO: 354166 - DNA, 15 bp, Homo sapiens
caggtctacagaggc

SEQ ID NO: 354167 - DNA, 15 bp, Homo sapiens
aggtctacagaggca

SEQ ID NO: 354168 - DNA, 15 bp, Homo sapiens
ggtctacagaggcag

SEQ ID NO: 354169 - DNA, 15 bp, Homo sapiens
gtctacagaggcagt

SEQ ID NO: 354170 - DNA, 15 bp, Homo sapiens
tctacagaggcagtt

SEQ ID NO: 354171 - DNA, 15 bp, Homo sapiens
ctacagaggcagtta

SEQ ID NO: 354172 - DNA, 15 bp, Homo sapiens
tacagaggcagttag

SEQ ID NO: 354173 - DNA, 15 bp, Homo sapiens
acagaggcagttaga

SEQ ID NO: 354174 - DNA, 15 bp, Homo sapiens
cagaggcagttagac

SEQ ID NO: 354175 - DNA, 15 bp, Homo sapiens
agaggcagttagacc

SEQ ID NO: 354176 - DNA, 15 bp, Homo sapiens
gaggcagttagacca

SEQ ID NO: 354177 - DNA, 15 bp, Homo sapiens
aggcagttagaccag

SEQ ID NO: 354178 - DNA, 15 bp, Homo sapiens
ggcagttagaccagt

SEQ ID NO: 354179 - DNA, 15 bp, Homo sapiens
gcagttagaccagtg

SEQ ID NO: 354180 - DNA, 15 bp, Homo sapiens
cagttagaccagtgc

SEQ ID NO: 354181 - DNA, 15 bp, Homo sapiens
agttagaccagtgct

SEQ ID NO: 354182 - DNA, 15 bp, Homo sapiens
gttagaccagtgctc

SEQ ID NO: 354183 - DNA, 15 bp, Homo sapiens
ttagaccagtgctct

SEQ ID NO: 354184 - DNA, 15 bp, Homo sapiens
tagaccagtgctctg

SEQ ID NO: 354185 - DNA, 15 bp, Homo sapiens
agaccagtgctctgt

SEQ ID NO: 354186 - DNA, 15 bp, Homo sapiens
gaccagtgctctgtg

SEQ ID NO: 354187 - DNA, 15 bp, Homo sapiens
accagtgctctgtga

SEQ ID NO: 354188 - DNA, 15 bp, Homo sapiens
ccagtgctctgtgag

SEQ ID NO: 354189 - DNA, 15 bp, Homo sapiens
cagtgctctgtgagt

SEQ ID NO: 354190 - DNA, 15 bp, Homo sapiens
agtgctctgtgagtt

SEQ ID NO: 354191 - DNA, 15 bp, Homo sapiens
gtgctctgtgagttc

SEQ ID NO: 354192 - DNA, 15 bp, Homo sapiens
tgctctgtgagttct

SEQ ID NO: 354193 - DNA, 15 bp, Homo sapiens
gctctgtgagttctg

SEQ ID NO: 354194 - DNA, 15 bp, Homo sapiens
ctctgtgagttctgc

SEQ ID NO: 354195 - DNA, 15 bp, Homo sapiens
tctgtgagttctgct

SEQ ID NO: 354196 - DNA, 15 bp, Homo sapiens
ctgtgagttctgctg

SEQ ID NO: 354197 - DNA, 15 bp, Homo sapiens
tgtgagttctgctga

SEQ ID NO: 354198 - DNA, 15 bp, Homo sapiens
gtgagttctgctgat

SEQ ID NO: 354199 - DNA, 15 bp, Homo sapiens
tgagttctgctgatc

SEQ ID NO: 354200 - DNA, 15 bp, Homo sapiens
gagttctgctgatct

SEQ ID NO: 354201 - DNA, 15 bp, Homo sapiens
agttctgctgatctg

SEQ ID NO: 354202 - DNA, 15 bp, Homo sapiens
gttctgctgatctgg

SEQ ID NO: 354203 - DNA, 15 bp, Homo sapiens
ttctgctgatctggg

SEQ ID NO: 354204 - DNA, 15 bp, Homo sapiens
tctgctgatctgggg

SEQ ID NO: 354205 - DNA, 15 bp, Homo sapiens
ctgctgatctgggga

SEQ ID NO: 354206 - DNA, 15 bp, Homo sapiens
tgctgatctggggaa

SEQ ID NO: 354207 - DNA, 15 bp, Homo sapiens
gctgatctggggaac

SEQ ID NO: 354208 - DNA, 15 bp, Homo sapiens
ctgatctggggaact

SEQ ID NO: 354209 - DNA, 15 bp, Homo sapiens
tgatctggggaactt

SEQ ID NO: 354210 - DNA, 15 bp, Homo sapiens
gatctggggaacttg

SEQ ID NO: 354211 - DNA, 15 bp, Homo sapiens
atctggggaacttgt

SEQ ID NO: 354212 - DNA, 15 bp, Homo sapiens
tctggggaacttgtc

SEQ ID NO: 354213 - DNA, 15 bp, Homo sapiens
ctggggaacttgtca

SEQ ID NO: 354214 - DNA, 15 bp, Homo sapiens
tggggaacttgtcat

SEQ ID NO: 354215 - DNA, 15 bp, Homo sapiens
ggggaacttgtcata

SEQ ID NO: 354216 - DNA, 15 bp, Homo sapiens
gggaacttgtcataa

SEQ ID NO: 354217 - DNA, 15 bp, Homo sapiens
ggaacttgtcataaa

SEQ ID NO: 354218 - DNA, 15 bp, Homo sapiens
gaacttgtcataaat

SEQ ID NO: 354219 - DNA, 15 bp, Homo sapiens
aacttgtcataaata

SEQ ID NO: 354220 - DNA, 15 bp, Homo sapiens
acttgtcataaataa

SEQ ID NO: 354221 - DNA, 15 bp, Homo sapiens
cttgtcataaataac

SEQ ID NO: 354222 - DNA, 15 bp, Homo sapiens
ttgtcataaataaca

SEQ ID NO: 354223 - DNA, 15 bp, Homo sapiens
tgtcataaataacat

SEQ ID NO: 354224 - DNA, 15 bp, Homo sapiens
gtcataaataacatt

SEQ ID NO: 354225 - DNA, 15 bp, Homo sapiens
tcataaataacattt

SEQ ID NO: 354226 - DNA, 15 bp, Homo sapiens
cataaataacatttt

SEQ ID NO: 354227 - DNA, 15 bp, Homo sapiens
ataaataacattttg

SEQ ID NO: 354228 - DNA, 15 bp, Homo sapiens
taaataacattttgt

SEQ ID NO: 354229 - DNA, 15 bp, Homo sapiens
aaataacattttgtt

SEQ ID NO: 354230 - DNA, 15 bp, Homo sapiens
aataacattttgttc

SEQ ID NO: 354231 - DNA, 15 bp, Homo sapiens
ataacattttgttct

SEQ ID NO: 354232 - DNA, 15 bp, Homo sapiens
taacattttgttctt

SEQ ID NO: 354233 - DNA, 15 bp, Homo sapiens
aacattttgttcttt

SEQ ID NO: 354234 - DNA, 15 bp, Homo sapiens
acattttgttctttt

SEQ ID NO: 354235 - DNA, 15 bp, Homo sapiens
cattttgttcttttt

SEQ ID NO: 354236 - DNA, 15 bp, Homo sapiens
attttgttctttttc

SEQ ID NO: 354237 - DNA, 15 bp, Homo sapiens
ttttgttctttttct

SEQ ID NO: 354238 - DNA, 15 bp, Homo sapiens
tttgttctttttcta

SEQ ID NO: 354239 - DNA, 15 bp, Homo sapiens
ttgttctttttctat

SEQ ID NO: 354240 - DNA, 15 bp, Homo sapiens
tgttctttttctatg

SEQ ID NO: 354241 - DNA, 15 bp, Homo sapiens
gttctttttctatgt

SEQ ID NO: 354242 - DNA, 15 bp, Homo sapiens
ttctttttctatgtt

SEQ ID NO: 354243 - DNA, 15 bp, Homo sapiens
tctttttctatgtta

SEQ ID NO: 354244 - DNA, 15 bp, Homo sapiens
ctttttctatgttat

SEQ ID NO: 354245 - DNA, 15 bp, Homo sapiens
tttttctatgttatt

SEQ ID NO: 354246 - DNA, 15 bp, Homo sapiens
ttttctatgttattt

SEQ ID NO: 354247 - DNA, 15 bp, Homo sapiens
tttctatgttatttg

SEQ ID NO: 354248 - DNA, 15 bp, Homo sapiens
ttctatgttatttgc

SEQ ID NO: 354249 - DNA, 15 bp, Homo sapiens
tctatgttatttgct

SEQ ID NO: 354250 - DNA, 15 bp, Homo sapiens
ctatgttatttgctg

SEQ ID NO: 354251 - DNA, 15 bp, Homo sapiens
tatgttatttgctgc

SEQ ID NO: 354252 - DNA, 15 bp, Homo sapiens
atgttatttgctgct

SEQ ID NO: 354253 - DNA, 15 bp, Homo sapiens
tgttatttgctgcta

SEQ ID NO: 354254 - DNA, 15 bp, Homo sapiens
gttatttgctgctat

SEQ ID NO: 354255 - DNA, 15 bp, Homo sapiens
ttatttgctgctatt

SEQ ID NO: 354256 - DNA, 15 bp, Homo sapiens
tatttgctgctatta

SEQ ID NO: 354257 - DNA, 15 bp, Homo sapiens
atttgctgctattat

SEQ ID NO: 354258 - DNA, 15 bp, Homo sapiens
tttgctgctattatt

SEQ ID NO: 354259 - DNA, 15 bp, Homo sapiens
ttgctgctattatta

SEQ ID NO: 354260 - DNA, 15 bp, Homo sapiens
tgctgctattattaa

SEQ ID NO: 354261 - DNA, 15 bp, Homo sapiens
gctgctattattaaa

SEQ ID NO: 354262 - DNA, 15 bp, Homo sapiens
ctgctattattaaaa

SEQ ID NO: 354263 - DNA, 15 bp, Homo sapiens
tgctattattaaaat

SEQ ID NO: 354264 - DNA, 15 bp, Homo sapiens
gctattattaaaatt

SEQ ID NO: 354265 - DNA, 15 bp, Homo sapiens
ctattattaaaattg

SEQ ID NO: 354266 - DNA, 15 bp, Homo sapiens
tattattaaaattgt

SEQ ID NO: 354267 - DNA, 15 bp, Homo sapiens
attattaaaattgtg

SEQ ID NO: 354268 - DNA, 15 bp, Homo sapiens
ttattaaaattgtga

SEQ ID NO: 354269 - DNA, 15 bp, Homo sapiens
tattaaaattgtgag

SEQ ID NO: 354270 - DNA, 15 bp, Homo sapiens
attaaaattgtgaga

SEQ ID NO: 354271 - DNA, 15 bp, Homo sapiens
ttaaaattgtgagaa

SEQ ID NO: 354272 - DNA, 15 bp, Homo sapiens
taaaattgtgagaat

SEQ ID NO: 354273 - DNA, 15 bp, Homo sapiens
aaaattgtgagaata

SEQ ID NO: 354274 - DNA, 15 bp, Homo sapiens
aaattgtgagaatat

SEQ ID NO: 354275 - DNA, 15 bp, Homo sapiens
aattgtgagaatata

SEQ ID NO: 354276 - DNA, 15 bp, Homo sapiens
attgtgagaatatag

SEQ ID NO: 354277 - DNA, 15 bp, Homo sapiens
ttgtgagaatatagc

SEQ ID NO: 354278 - DNA, 15 bp, Homo sapiens
tgtgagaatatagca

SEQ ID NO: 354279 - DNA, 15 bp, Homo sapiens
gtgagaatatagcat

SEQ ID NO: 354280 - DNA, 15 bp, Homo sapiens
tgagaatatagcata

SEQ ID NO: 354281 - DNA, 15 bp, Homo sapiens
gagaatatagcatag

SEQ ID NO: 354282 - DNA, 15 bp, Homo sapiens
agaatatagcatagc

SEQ ID NO: 354283 - DNA, 15 bp, Homo sapiens
gaatatagcatagca

SEQ ID NO: 354284 - DNA, 15 bp, Homo sapiens
aatatagcatagcat

SEQ ID NO: 354285 - DNA, 15 bp, Homo sapiens
atatagcatagcatt

SEQ ID NO: 354286 - DNA, 15 bp, Homo sapiens
tatagcatagcatta

SEQ ID NO: 354287 - DNA, 15 bp, Homo sapiens
atagcatagcattac

SEQ ID NO: 354288 - DNA, 15 bp, Homo sapiens
tagcatagcattaca

SEQ ID NO: 354289 - DNA, 15 bp, Homo sapiens
agcatagcattacat

SEQ ID NO: 354290 - DNA, 15 bp, Homo sapiens
gcatagcattacatc

SEQ ID NO: 354291 - DNA, 15 bp, Homo sapiens
catagcattacatct

SEQ ID NO: 354292 - DNA, 15 bp, Homo sapiens
atagcattacatcta

SEQ ID NO: 354293 - DNA, 15 bp, Homo sapiens
tagcattacatctag

SEQ ID NO: 354294 - DNA, 15 bp, Homo sapiens
agcattacatctaga

SEQ ID NO: 354295 - DNA, 15 bp, Homo sapiens
gcattacatctagat

SEQ ID NO: 354296 - DNA, 15 bp, Homo sapiens
cattacatctagata

SEQ ID NO: 354297 - DNA, 15 bp, Homo sapiens
attacatctagataa

SEQ ID NO: 354298 - DNA, 15 bp, Homo sapiens
ttacatctagataaa

SEQ ID NO: 354299 - DNA, 15 bp, Homo sapiens
tacatctagataaaa

SEQ ID NO: 354300 - DNA, 15 bp, Homo sapiens
acatctagataaaat

SEQ ID NO: 354301 - DNA, 15 bp, Homo sapiens
catctagataaaata

SEQ ID NO: 354302 - DNA, 15 bp, Homo sapiens
atctagataaaatat

SEQ ID NO: 354303 - DNA, 15 bp, Homo sapiens
tctagataaaatatc

SEQ ID NO: 354304 - DNA, 15 bp, Homo sapiens
ctagataaaatatct

SEQ ID NO: 354305 - DNA, 15 bp, Homo sapiens
tagataaaatatctt

SEQ ID NO: 354306 - DNA, 15 bp, Homo sapiens
agataaaatatcttt

SEQ ID NO: 354307 - DNA, 15 bp, Homo sapiens
gataaaatatctttc

SEQ ID NO: 354308 - DNA, 15 bp, Homo sapiens
ataaaatatctttca

SEQ ID NO: 354309 - DNA, 15 bp, Homo sapiens
taaaatatctttcat

SEQ ID NO: 354310 - DNA, 15 bp, Homo sapiens
aaaatatctttcatc

SEQ ID NO: 354311 - DNA, 15 bp, Homo sapiens
aaatatctttcatca

SEQ ID NO: 354312 - DNA, 15 bp, Homo sapiens
aatatctttcatcat

SEQ ID NO: 354313 - DNA, 15 bp, Homo sapiens
atatctttcatcata

SEQ ID NO: 354314 - DNA, 15 bp, Homo sapiens
tatctttcatcataa

SEQ ID NO: 354315 - DNA, 15 bp, Homo sapiens
atctttcatcataaa

SEQ ID NO: 354316 - DNA, 15 bp, Homo sapiens
tctttcatcataaag

SEQ ID NO: 354317 - DNA, 15 bp, Homo sapiens
ctttcatcataaagc

SEQ ID NO: 354318 - DNA, 15 bp, Homo sapiens
tttcatcataaagct

SEQ ID NO: 354319 - DNA, 15 bp, Homo sapiens
ttcatcataaagctt

SEQ ID NO: 354320 - DNA, 15 bp, Homo sapiens
tcatcataaagcttt

SEQ ID NO: 354321 - DNA, 15 bp, Homo sapiens
catcataaagctttt

SEQ ID NO: 354322 - DNA, 15 bp, Homo sapiens
atcataaagctttta

SEQ ID NO: 354323 - DNA, 15 bp, Homo sapiens
tcataaagcttttat

SEQ ID NO: 354324 - DNA, 15 bp, Homo sapiens
cataaagcttttatg

SEQ ID NO: 354325 - DNA, 15 bp, Homo sapiens
ataaagcttttatga

SEQ ID NO: 354326 - DNA, 15 bp, Homo sapiens
taaagcttttatgac

SEQ ID NO: 354327 - DNA, 15 bp, Homo sapiens
aaagcttttatgact

SEQ ID NO: 354328 - DNA, 15 bp, Homo sapiens
aagcttttatgactt

SEQ ID NO: 354329 - DNA, 15 bp, Homo sapiens
agcttttatgacttt

SEQ ID NO: 354330 - DNA, 15 bp, Homo sapiens
gcttttatgacttta

SEQ ID NO: 354331 - DNA, 15 bp, Homo sapiens
cttttatgactttat

SEQ ID NO: 354332 - DNA, 15 bp, Homo sapiens
ttttatgactttata

SEQ ID NO: 354333 - DNA, 15 bp, Homo sapiens
tttatgactttatag

SEQ ID NO: 354334 - DNA, 15 bp, Homo sapiens
ttatgactttatagc

SEQ ID NO: 354335 - DNA, 15 bp, Homo sapiens
tatgactttatagct

SEQ ID NO: 354336 - DNA, 15 bp, Homo sapiens
atgactttatagcta

SEQ ID NO: 354337 - DNA, 15 bp, Homo sapiens
tgactttatagctaa

SEQ ID NO: 354338 - DNA, 15 bp, Homo sapiens
gactttatagctaat

SEQ ID NO: 354339 - DNA, 15 bp, Homo sapiens
actttatagctaata

SEQ ID NO: 354340 - DNA, 15 bp, Homo sapiens
ctttatagctaataa

SEQ ID NO: 354341 - DNA, 15 bp, Homo sapiens
tttatagctaataaa

SEQ ID NO: 354342 - DNA, 15 bp, Homo sapiens
ttatagctaataaaa

SEQ ID NO: 354343 - DNA, 15 bp, Homo sapiens
tatagctaataaaag

SEQ ID NO: 354344 - DNA, 15 bp, Homo sapiens
atagctaataaaaga

SEQ ID NO: 354345 - DNA, 15 bp, Homo sapiens
tagctaataaaagaa

SEQ ID NO: 354346 - DNA, 15 bp, Homo sapiens
agctaataaaagaat

SEQ ID NO: 354347 - DNA, 15 bp, Homo sapiens
gctaataaaagaatg

SEQ ID NO: 354348 - DNA, 15 bp, Homo sapiens
ctaataaaagaatga

SEQ ID NO: 354349 - DNA, 15 bp, Homo sapiens
taataaaagaatgac

SEQ ID NO: 354350 - DNA, 15 bp, Homo sapiens
aataaaagaatgaca

SEQ ID NO: 354351 - DNA, 15 bp, Homo sapiens
ataaaagaatgacag

SEQ ID NO: 354352 - DNA, 15 bp, Homo sapiens
taaaagaatgacaga

SEQ ID NO: 354353 - DNA, 15 bp, Homo sapiens
aaaagaatgacagat

SEQ ID NO: 354354 - DNA, 15 bp, Homo sapiens
aaagaatgacagatt

SEQ ID NO: 354355 - DNA, 15 bp, Homo sapiens
aagaatgacagattc

SEQ ID NO: 354356 - DNA, 15 bp, Homo sapiens
agaatgacagattct

SEQ ID NO: 354357 - DNA, 15 bp, Homo sapiens
gaatgacagattctt

SEQ ID NO: 354358 - DNA, 15 bp, Homo sapiens
aatgacagattcttc

SEQ ID NO: 354359 - DNA, 15 bp, Homo sapiens
atgacagattcttca

SEQ ID NO: 354360 - DNA, 15 bp, Homo sapiens
tgacagattcttcaa

SEQ ID NO: 354361 - DNA, 15 bp, Homo sapiens
gacagattcttcaag

SEQ ID NO: 354362 - DNA, 15 bp, Homo sapiens
acagattcttcaagt

SEQ ID NO: 354363 - DNA, 15 bp, Homo sapiens
cagattcttcaagtt

SEQ ID NO: 354364 - DNA, 15 bp, Homo sapiens
agattcttcaagttt

SEQ ID NO: 354365 - DNA, 15 bp, Homo sapiens
gattcttcaagtttt

SEQ ID NO: 354366 - DNA, 15 bp, Homo sapiens
attcttcaagttttt

SEQ ID NO: 354367 - DNA, 15 bp, Homo sapiens
ttcttcaagttttta

SEQ ID NO: 354368 - DNA, 15 bp, Homo sapiens
tcttcaagtttttat

SEQ ID NO: 354369 - DNA, 15 bp, Homo sapiens
cttcaagtttttatt

SEQ ID NO: 354370 - DNA, 15 bp, Homo sapiens
ttcaagtttttattt

SEQ ID NO: 354371 - DNA, 15 bp, Homo sapiens
tcaagtttttatttc

SEQ ID NO: 354372 - DNA, 15 bp, Homo sapiens
caagtttttatttct

SEQ ID NO: 354373 - DNA, 15 bp, Homo sapiens
aagtttttatttctg

SEQ ID NO: 354374 - DNA, 15 bp, Homo sapiens
agtttttatttctgg

SEQ ID NO: 354375 - DNA, 15 bp, Homo sapiens
gtttttatttctgga

SEQ ID NO: 354376 - DNA, 15 bp, Homo sapiens
tttttatttctggac

SEQ ID NO: 354377 - DNA, 15 bp, Homo sapiens
ttttatttctggacg

SEQ ID NO: 354378 - DNA, 15 bp, Homo sapiens
tttatttctggacgt

SEQ ID NO: 354379 - DNA, 15 bp, Homo sapiens
ttatttctggacgtg

SEQ ID NO: 354380 - DNA, 15 bp, Homo sapiens
tatttctggacgtgg

SEQ ID NO: 354381 - DNA, 15 bp, Homo sapiens
atttctggacgtggt

SEQ ID NO: 354382 - DNA, 15 bp, Homo sapiens
tttctggacgtggtt

SEQ ID NO: 354383 - DNA, 15 bp, Homo sapiens
ttctggacgtggtta

SEQ ID NO: 354384 - DNA, 15 bp, Homo sapiens
tctggacgtggttat

SEQ ID NO: 354385 - DNA, 15 bp, Homo sapiens
ctggacgtggttata

SEQ ID NO: 354386 - DNA, 15 bp, Homo sapiens
tggacgtggttatag

SEQ ID NO: 354387 - DNA, 15 bp, Homo sapiens
ggacgtggttataga

SEQ ID NO: 354388 - DNA, 15 bp, Homo sapiens
gacgtggttatagaa

SEQ ID NO: 354389 - DNA, 15 bp, Homo sapiens
acgtggttatagaat

SEQ ID NO: 354390 - DNA, 15 bp, Homo sapiens
cgtggttatagaatt

SEQ ID NO: 354391 - DNA, 15 bp, Homo sapiens
gtggttatagaattt

SEQ ID NO: 354392 - DNA, 15 bp, Homo sapiens
tggttatagaatttt

SEQ ID NO: 354393 - DNA, 15 bp, Homo sapiens
ggttatagaattttg

SEQ ID NO: 354394 - DNA, 15 bp, Homo sapiens
gttatagaattttga

SEQ ID NO: 354395 - DNA, 15 bp, Homo sapiens
ttatagaattttgag

SEQ ID NO: 354396 - DNA, 15 bp, Homo sapiens
tatagaattttgaga

SEQ ID NO: 354397 - DNA, 15 bp, Homo sapiens
atagaattttgagag

SEQ ID NO: 354398 - DNA, 15 bp, Homo sapiens
tagaattttgagagg

SEQ ID NO: 354399 - DNA, 15 bp, Homo sapiens
agaattttgagaggt

SEQ ID NO: 354400 - DNA, 15 bp, Homo sapiens
gaattttgagaggtt

SEQ ID NO: 354401 - DNA, 15 bp, Homo sapiens
aattttgagaggtta

SEQ ID NO: 354402 - DNA, 15 bp, Homo sapiens
attttgagaggttat

SEQ ID NO: 354403 - DNA, 15 bp, Homo sapiens
ttttgagaggttata

SEQ ID NO: 354404 - DNA, 15 bp, Homo sapiens
tttgagaggttatag

SEQ ID NO: 354405 - DNA, 15 bp, Homo sapiens
ttgagaggttataga

SEQ ID NO: 354406 - DNA, 15 bp, Homo sapiens
tgagaggttatagaa

SEQ ID NO: 354407 - DNA, 15 bp, Homo sapiens
gagaggttatagaat

SEQ ID NO: 354408 - DNA, 15 bp, Homo sapiens
agaggttatagaata

SEQ ID NO: 354409 - DNA, 15 bp, Homo sapiens
gaggttatagaatag

SEQ ID NO: 354410 - DNA, 15 bp, Homo sapiens
aggttatagaataga

SEQ ID NO: 354411 - DNA, 15 bp, Homo sapiens
ggttatagaatagag

SEQ ID NO: 354412 - DNA, 15 bp, Homo sapiens
gttatagaatagaga

SEQ ID NO: 354413 - DNA, 15 bp, Homo sapiens
ttatagaatagagaa

SEQ ID NO: 354414 - DNA, 15 bp, Homo sapiens
tatagaatagagaac

SEQ ID NO: 354415 - DNA, 15 bp, Homo sapiens
atagaatagagaaca

SEQ ID NO: 354416 - DNA, 15 bp, Homo sapiens
tagaatagagaacaa

SEQ ID NO: 354417 - DNA, 15 bp, Homo sapiens
agaatagagaacaag

SEQ ID NO: 354418 - DNA, 15 bp, Homo sapiens
gaatagagaacaaga

SEQ ID NO: 354419 - DNA, 15 bp, Homo sapiens
aatagagaacaagaa

SEQ ID NO: 354420 - DNA, 15 bp, Homo sapiens
atagagaacaagaac

SEQ ID NO: 354421 - DNA, 15 bp, Homo sapiens
tagagaacaagaaca

SEQ ID NO: 354422 - DNA, 15 bp, Homo sapiens
agagaacaagaacaa

SEQ ID NO: 354423 - DNA, 15 bp, Homo sapiens
gagaacaagaacaat

SEQ ID NO: 354424 - DNA, 15 bp, Homo sapiens
agaacaagaacaatt

SEQ ID NO: 354425 - DNA, 15 bp, Homo sapiens
gaacaagaacaattt

SEQ ID NO: 354426 - DNA, 15 bp, Homo sapiens
aacaagaacaatttt

SEQ ID NO: 354427 - DNA, 15 bp, Homo sapiens
acaagaacaattttg

SEQ ID NO: 354428 - DNA, 15 bp, Homo sapiens
caagaacaattttgg

SEQ ID NO: 354429 - DNA, 15 bp, Homo sapiens
aagaacaattttggt

SEQ ID NO: 354430 - DNA, 15 bp, Homo sapiens
agaacaattttggtt

SEQ ID NO: 354431 - DNA, 15 bp, Homo sapiens
gaacaattttggttc

SEQ ID NO: 354432 - DNA, 15 bp, Homo sapiens
aacaattttggttca

SEQ ID NO: 354433 - DNA, 15 bp, Homo sapiens
acaattttggttcat

SEQ ID NO: 354434 - DNA, 15 bp, Homo sapiens
caattttggttcatt

SEQ ID NO: 354435 - DNA, 15 bp, Homo sapiens
aattttggttcatta

SEQ ID NO: 354436 - DNA, 15 bp, Homo sapiens
attttggttcattag

SEQ ID NO: 354437 - DNA, 15 bp, Homo sapiens
ttttggttcattagg

SEQ ID NO: 354438 - DNA, 15 bp, Homo sapiens
tttggttcattagga

SEQ ID NO: 354439 - DNA, 15 bp, Homo sapiens
ttggttcattaggag

SEQ ID NO: 354440 - DNA, 15 bp, Homo sapiens
tggttcattaggagt

SEQ ID NO: 354441 - DNA, 15 bp, Homo sapiens
ggttcattaggagtc

SEQ ID NO: 354442 - DNA, 15 bp, Homo sapiens
gttcattaggagtca

SEQ ID NO: 354443 - DNA, 15 bp, Homo sapiens
ttcattaggagtcat

SEQ ID NO: 354444 - DNA, 15 bp, Homo sapiens
tcattaggagtcatt

SEQ ID NO: 354445 - DNA, 15 bp, Homo sapiens
cattaggagtcattg

SEQ ID NO: 354446 - DNA, 15 bp, Homo sapiens
attaggagtcattgt

SEQ ID NO: 354447 - DNA, 15 bp, Homo sapiens
ttaggagtcattgta

SEQ ID NO: 354448 - DNA, 15 bp, Homo sapiens
taggagtcattgtat

SEQ ID NO: 354449 - DNA, 15 bp, Homo sapiens
aggagtcattgtata

SEQ ID NO: 354450 - DNA, 15 bp, Homo sapiens
ggagtcattgtatat

SEQ ID NO: 354451 - DNA, 15 bp, Homo sapiens
gagtcattgtatatt

SEQ ID NO: 354452 - DNA, 15 bp, Homo sapiens
agtcattgtatattg

SEQ ID NO: 354453 - DNA, 15 bp, Homo sapiens
gtcattgtatattgc

SEQ ID NO: 354454 - DNA, 15 bp, Homo sapiens
tcattgtatattgca

SEQ ID NO: 354455 - DNA, 15 bp, Homo sapiens
cattgtatattgcat

SEQ ID NO: 354456 - DNA, 15 bp, Homo sapiens
attgtatattgcatt

SEQ ID NO: 354457 - DNA, 15 bp, Homo sapiens
ttgtatattgcattt

SEQ ID NO: 354458 - DNA, 15 bp, Homo sapiens
tgtatattgcatttc

SEQ ID NO: 354459 - DNA, 15 bp, Homo sapiens
gtatattgcatttct

SEQ ID NO: 354460 - DNA, 15 bp, Homo sapiens
tatattgcatttctt

SEQ ID NO: 354461 - DNA, 15 bp, Homo sapiens
atattgcatttcttg

SEQ ID NO: 354462 - DNA, 15 bp, Homo sapiens
tattgcatttcttgt

SEQ ID NO: 354463 - DNA, 15 bp, Homo sapiens
attgcatttcttgtg

SEQ ID NO: 354464 - DNA, 15 bp, Homo sapiens
ttgcatttcttgtgc

SEQ ID NO: 354465 - DNA, 15 bp, Homo sapiens
tgcatttcttgtgcc

SEQ ID NO: 354466 - DNA, 15 bp, Homo sapiens
gcatttcttgtgcca

SEQ ID NO: 354467 - DNA, 15 bp, Homo sapiens
catttcttgtgccac

SEQ ID NO: 354468 - DNA, 15 bp, Homo sapiens
atttcttgtgccaca

SEQ ID NO: 354469 - DNA, 15 bp, Homo sapiens
tttcttgtgccacat

SEQ ID NO: 354470 - DNA, 15 bp, Homo sapiens
ttcttgtgccacatg

SEQ ID NO: 354471 - DNA, 15 bp, Homo sapiens
tcttgtgccacatgg

SEQ ID NO: 354472 - DNA, 15 bp, Homo sapiens
cttgtgccacatggt

SEQ ID NO: 354473 - DNA, 15 bp, Homo sapiens
ttgtgccacatggtg

SEQ ID NO: 354474 - DNA, 15 bp, Homo sapiens
tgtgccacatggtga

SEQ ID NO: 354475 - DNA, 15 bp, Homo sapiens
gtgccacatggtgag

SEQ ID NO: 354476 - DNA, 15 bp, Homo sapiens
tgccacatggtgagg

SEQ ID NO: 354477 - DNA, 15 bp, Homo sapiens
gccacatggtgagga

SEQ ID NO: 354478 - DNA, 15 bp, Homo sapiens
ccacatggtgaggat

SEQ ID NO: 354479 - DNA, 15 bp, Homo sapiens
cacatggtgaggatt

SEQ ID NO: 354480 - DNA, 15 bp, Homo sapiens
acatggtgaggattt

SEQ ID NO: 354481 - DNA, 15 bp, Homo sapiens
catggtgaggattta

SEQ ID NO: 354482 - DNA, 15 bp, Homo sapiens
atggtgaggatttaa

SEQ ID NO: 354483 - DNA, 15 bp, Homo sapiens
tggtgaggatttaag

SEQ ID NO: 354484 - DNA, 15 bp, Homo sapiens
ggtgaggatttaaga

SEQ ID NO: 354485 - DNA, 15 bp, Homo sapiens
gtgaggatttaagaa

SEQ ID NO: 354486 - DNA, 15 bp, Homo sapiens
tgaggatttaagaaa

SEQ ID NO: 354487 - DNA, 15 bp, Homo sapiens
gaggatttaagaaaa

SEQ ID NO: 354488 - DNA, 15 bp, Homo sapiens
aggatttaagaaaaa

SEQ ID NO: 354489 - DNA, 15 bp, Homo sapiens
ggatttaagaaaaac

SEQ ID NO: 354490 - DNA, 15 bp, Homo sapiens
gatttaagaaaaaca

SEQ ID NO: 354491 - DNA, 15 bp, Homo sapiens
atttaagaaaaacat

SEQ ID NO: 354492 - DNA, 15 bp, Homo sapiens
tttaagaaaaacata

SEQ ID NO: 354493 - DNA, 15 bp, Homo sapiens
ttaagaaaaacatat

SEQ ID NO: 354494 - DNA, 15 bp, Homo sapiens
taagaaaaacatatt

SEQ ID NO: 354495 - DNA, 15 bp, Homo sapiens
aagaaaaacatattt

SEQ ID NO: 354496 - DNA, 15 bp, Homo sapiens
agaaaaacatattta

SEQ ID NO: 354497 - DNA, 15 bp, Homo sapiens
gaaaaacatatttaa

SEQ ID NO: 354498 - DNA, 15 bp, Homo sapiens
aaaaacatatttaac

SEQ ID NO: 354499 - DNA, 15 bp, Homo sapiens
aaaacatatttaaca

SEQ ID NO: 354500 - DNA, 15 bp, Homo sapiens
aaacatatttaacaa

SEQ ID NO: 354501 - DNA, 15 bp, Homo sapiens
aacatatttaacaaa

SEQ ID NO: 354502 - DNA, 15 bp, Homo sapiens
acatatttaacaaat

SEQ ID NO: 354503 - DNA, 15 bp, Homo sapiens
catatttaacaaatg

SEQ ID NO: 354504 - DNA, 15 bp, Homo sapiens
atatttaacaaatga

SEQ ID NO: 354505 - DNA, 15 bp, Homo sapiens
tatttaacaaatgaa

SEQ ID NO: 354506 - DNA, 15 bp, Homo sapiens
atttaacaaatgaat

SEQ ID NO: 354507 - DNA, 15 bp, Homo sapiens
tttaacaaatgaatt

SEQ ID NO: 354508 - DNA, 15 bp, Homo sapiens
ttaacaaatgaattt

SEQ ID NO: 354509 - DNA, 15 bp, Homo sapiens
taacaaatgaatttg

SEQ ID NO: 354510 - DNA, 15 bp, Homo sapiens
aacaaatgaatttga

SEQ ID NO: 354511 - DNA, 15 bp, Homo sapiens
acaaatgaatttgag

SEQ ID NO: 354512 - DNA, 15 bp, Homo sapiens
caaatgaatttgaga

SEQ ID NO: 354513 - DNA, 15 bp, Homo sapiens
aaatgaatttgagaa

SEQ ID NO: 354514 - DNA, 15 bp, Homo sapiens
aatgaatttgagaag

SEQ ID NO: 354515 - DNA, 15 bp, Homo sapiens
atgaatttgagaagt

SEQ ID NO: 354516 - DNA, 15 bp, Homo sapiens
tgaatttgagaagtg

SEQ ID NO: 354517 - DNA, 15 bp, Homo sapiens
gaatttgagaagtgt

SEQ ID NO: 354518 - DNA, 15 bp, Homo sapiens
aatttgagaagtgtc

SEQ ID NO: 354519 - DNA, 15 bp, Homo sapiens
atttgagaagtgtct

SEQ ID NO: 354520 - DNA, 15 bp, Homo sapiens
tttgagaagtgtctg

SEQ ID NO: 354521 - DNA, 15 bp, Homo sapiens
ttgagaagtgtctgt

SEQ ID NO: 354522 - DNA, 15 bp, Homo sapiens
tgagaagtgtctgtt

SEQ ID NO: 354523 - DNA, 15 bp, Homo sapiens
gagaagtgtctgttc

SEQ ID NO: 354524 - DNA, 15 bp, Homo sapiens
agaagtgtctgttca

SEQ ID NO: 354525 - DNA, 15 bp, Homo sapiens
gaagtgtctgttcat

SEQ ID NO: 354526 - DNA, 15 bp, Homo sapiens
aagtgtctgttcatc

SEQ ID NO: 354527 - DNA, 15 bp, Homo sapiens
agtgtctgttcatca

SEQ ID NO: 354528 - DNA, 15 bp, Homo sapiens
gtgtctgttcatcaa

SEQ ID NO: 354529 - DNA, 15 bp, Homo sapiens
tgtctgttcatcaaa

SEQ ID NO: 354530 - DNA, 15 bp, Homo sapiens
gtctgttcatcaaat

SEQ ID NO: 354531 - DNA, 15 bp, Homo sapiens
tctgttcatcaaatt

SEQ ID NO: 354532 - DNA, 15 bp, Homo sapiens
ctgttcatcaaattc

SEQ ID NO: 354533 - DNA, 15 bp, Homo sapiens
tgttcatcaaattca

SEQ ID NO: 354534 - DNA, 15 bp, Homo sapiens
gttcatcaaattcat

SEQ ID NO: 354535 - DNA, 15 bp, Homo sapiens
ttcatcaaattcatt

SEQ ID NO: 354536 - DNA, 15 bp, Homo sapiens
tcatcaaattcattt

SEQ ID NO: 354537 - DNA, 15 bp, Homo sapiens
catcaaattcattta

SEQ ID NO: 354538 - DNA, 15 bp, Homo sapiens
atcaaattcatttaa

SEQ ID NO: 354539 - DNA, 15 bp, Homo sapiens
tcaaattcatttaag

SEQ ID NO: 354540 - DNA, 15 bp, Homo sapiens
caaattcatttaagt

SEQ ID NO: 354541 - DNA, 15 bp, Homo sapiens
aaattcatttaagta

SEQ ID NO: 354542 - DNA, 15 bp, Homo sapiens
aattcatttaagtat

SEQ ID NO: 354543 - DNA, 15 bp, Homo sapiens
attcatttaagtatg

SEQ ID NO: 354544 - DNA, 15 bp, Homo sapiens
ttcatttaagtatgt

SEQ ID NO: 354545 - DNA, 15 bp, Homo sapiens
tcatttaagtatgtt

SEQ ID NO: 354546 - DNA, 15 bp, Homo sapiens
catttaagtatgttt

SEQ ID NO: 354547 - DNA, 15 bp, Homo sapiens
atttaagtatgtttt

SEQ ID NO: 354548 - DNA, 15 bp, Homo sapiens
tttaagtatgttttt

SEQ ID NO: 354549 - DNA, 15 bp, Homo sapiens
ttaagtatgtttttc

SEQ ID NO: 354550 - DNA, 15 bp, Homo sapiens
taagtatgtttttct

SEQ ID NO: 354551 - DNA, 15 bp, Homo sapiens
aagtatgtttttctt

SEQ ID NO: 354552 - DNA, 15 bp, Homo sapiens
agtatgtttttctta

SEQ ID NO: 354553 - DNA, 15 bp, Homo sapiens
gtatgtttttcttaa

SEQ ID NO: 354554 - DNA, 15 bp, Homo sapiens
tatgtttttcttaaa

SEQ ID NO: 354555 - DNA, 15 bp, Homo sapiens
atgtttttcttaaat

SEQ ID NO: 354556 - DNA, 15 bp, Homo sapiens
tgtttttcttaaatc

SEQ ID NO: 354557 - DNA, 15 bp, Homo sapiens
gtttttcttaaatcc

SEQ ID NO: 354558 - DNA, 15 bp, Homo sapiens
tttttcttaaatcct

SEQ ID NO: 354559 - DNA, 15 bp, Homo sapiens
ttttcttaaatcctc

SEQ ID NO: 354560 - DNA, 15 bp, Homo sapiens
tttcttaaatcctca

SEQ ID NO: 354561 - DNA, 15 bp, Homo sapiens
ttcttaaatcctcac

SEQ ID NO: 354562 - DNA, 15 bp, Homo sapiens
tcttaaatcctcacc

SEQ ID NO: 354563 - DNA, 15 bp, Homo sapiens
cttaaatcctcacca

SEQ ID NO: 354564 - DNA, 15 bp, Homo sapiens
ttaaatcctcaccat

SEQ ID NO: 354565 - DNA, 15 bp, Homo sapiens
taaatcctcaccatg

SEQ ID NO: 354566 - DNA, 15 bp, Homo sapiens
aaatcctcaccatgt

SEQ ID NO: 354567 - DNA, 15 bp, Homo sapiens
aatcctcaccatgtg

SEQ ID NO: 354568 - DNA, 15 bp, Homo sapiens
atcctcaccatgtgg

SEQ ID NO: 354569 - DNA, 15 bp, Homo sapiens
tcctcaccatgtggc

SEQ ID NO: 354570 - DNA, 15 bp, Homo sapiens
cctcaccatgtggca

SEQ ID NO: 354571 - DNA, 15 bp, Homo sapiens
ctcaccatgtggcac

SEQ ID NO: 354572 - DNA, 15 bp, Homo sapiens
tcaccatgtggcaca

SEQ ID NO: 354573 - DNA, 15 bp, Homo sapiens
caccatgtggcacaa

SEQ ID NO: 354574 - DNA, 15 bp, Homo sapiens
accatgtggcacaag

SEQ ID NO: 354575 - DNA, 15 bp, Homo sapiens
ccatgtggcacaaga

SEQ ID NO: 354576 - DNA, 15 bp, Homo sapiens
catgtggcacaagaa

SEQ ID NO: 354577 - DNA, 15 bp, Homo sapiens
atgtggcacaagaaa

SEQ ID NO: 354578 - DNA, 15 bp, Homo sapiens
tgtggcacaagaaaa

SEQ ID NO: 354579 - DNA, 15 bp, Homo sapiens
gtggcacaagaaaag

SEQ ID NO: 354580 - DNA, 15 bp, Homo sapiens
tggcacaagaaaagc

SEQ ID NO: 354581 - DNA, 15 bp, Homo sapiens
ggcacaagaaaagca

SEQ ID NO: 354582 - DNA, 15 bp, Homo sapiens
gcacaagaaaagcaa

SEQ ID NO: 354583 - DNA, 15 bp, Homo sapiens
cacaagaaaagcaat

SEQ ID NO: 354584 - DNA, 15 bp, Homo sapiens
acaagaaaagcaata

SEQ ID NO: 354585 - DNA, 15 bp, Homo sapiens
caagaaaagcaatat

SEQ ID NO: 354586 - DNA, 15 bp, Homo sapiens
aagaaaagcaatata

SEQ ID NO: 354587 - DNA, 15 bp, Homo sapiens
agaaaagcaatatac

SEQ ID NO: 354588 - DNA, 15 bp, Homo sapiens
gaaaagcaatataca

SEQ ID NO: 354589 - DNA, 15 bp, Homo sapiens
aaaagcaatatacaa

SEQ ID NO: 354590 - DNA, 15 bp, Homo sapiens
aaagcaatatacaat

SEQ ID NO: 354591 - DNA, 15 bp, Homo sapiens
aagcaatatacaatg

SEQ ID NO: 354592 - DNA, 15 bp, Homo sapiens
agcaatatacaatga

SEQ ID NO: 354593 - DNA, 15 bp, Homo sapiens
gcaatatacaatgac

SEQ ID NO: 354594 - DNA, 15 bp, Homo sapiens
caatatacaatgact

SEQ ID NO: 354595 - DNA, 15 bp, Homo sapiens
aatatacaatgactc

SEQ ID NO: 354596 - DNA, 15 bp, Homo sapiens
atatacaatgactcc

SEQ ID NO: 354597 - DNA, 15 bp, Homo sapiens
tatacaatgactcca

SEQ ID NO: 354598 - DNA, 15 bp, Homo sapiens
atacaatgactccat

SEQ ID NO: 354599 - DNA, 15 bp, Homo sapiens
tacaatgactccatg

SEQ ID NO: 354600 - DNA, 15 bp, Homo sapiens
acaatgactccatgt

SEQ ID NO: 354601 - DNA, 15 bp, Homo sapiens
caatgactccatgtt

SEQ ID NO: 354602 - DNA, 15 bp, Homo sapiens
aatgactccatgttg

SEQ ID NO: 354603 - DNA, 15 bp, Homo sapiens
atgactccatgttgt

SEQ ID NO: 354604 - DNA, 15 bp, Homo sapiens
tgactccatgttgtg

SEQ ID NO: 354605 - DNA, 15 bp, Homo sapiens
gactccatgttgtgc

SEQ ID NO: 354606 - DNA, 15 bp, Homo sapiens
actccatgttgtgca

SEQ ID NO: 354607 - DNA, 15 bp, Homo sapiens
ctccatgttgtgcac

SEQ ID NO: 354608 - DNA, 15 bp, Homo sapiens
tccatgttgtgcacg

SEQ ID NO: 354609 - DNA, 15 bp, Homo sapiens
ccatgttgtgcacgt

SEQ ID NO: 354610 - DNA, 15 bp, Homo sapiens
catgttgtgcacgtg

SEQ ID NO: 354611 - DNA, 15 bp, Homo sapiens
atgttgtgcacgtgt

SEQ ID NO: 354612 - DNA, 15 bp, Homo sapiens
tgttgtgcacgtgta

SEQ ID NO: 354613 - DNA, 15 bp, Homo sapiens
gttgtgcacgtgtac

SEQ ID NO: 354614 - DNA, 15 bp, Homo sapiens
ttgtgcacgtgtacc

SEQ ID NO: 354615 - DNA, 15 bp, Homo sapiens
tgtgcacgtgtaccc

SEQ ID NO: 354616 - DNA, 15 bp, Homo sapiens
gtgcacgtgtaccct

SEQ ID NO: 354617 - DNA, 15 bp, Homo sapiens
tgcacgtgtacccta

SEQ ID NO: 354618 - DNA, 15 bp, Homo sapiens
gcacgtgtaccctag

SEQ ID NO: 354619 - DNA, 15 bp, Homo sapiens
cacgtgtaccctaga

SEQ ID NO: 354620 - DNA, 15 bp, Homo sapiens
acgtgtaccctagaa

SEQ ID NO: 354621 - DNA, 15 bp, Homo sapiens
cgtgtaccctagaac

SEQ ID NO: 354622 - DNA, 15 bp, Homo sapiens
gtgtaccctagaact

SEQ ID NO: 354623 - DNA, 15 bp, Homo sapiens
tgtaccctagaactt

SEQ ID NO: 354624 - DNA, 15 bp, Homo sapiens
gtaccctagaactta

SEQ ID NO: 354625 - DNA, 15 bp, Homo sapiens
taccctagaacttaa

SEQ ID NO: 354626 - DNA, 15 bp, Homo sapiens
accctagaacttaaa

SEQ ID NO: 354627 - DNA, 15 bp, Homo sapiens
ccctagaacttaaag

SEQ ID NO: 354628 - DNA, 15 bp, Homo sapiens
cctagaacttaaagt

SEQ ID NO: 354629 - DNA, 15 bp, Homo sapiens
ctagaacttaaagtg

SEQ ID NO: 354630 - DNA, 15 bp, Homo sapiens
tagaacttaaagtgt

SEQ ID NO: 354631 - DNA, 15 bp, Homo sapiens
agaacttaaagtgtt

SEQ ID NO: 354632 - DNA, 15 bp, Homo sapiens
gaacttaaagtgtta

SEQ ID NO: 354633 - DNA, 15 bp, Homo sapiens
aacttaaagtgttaa

SEQ ID NO: 354634 - DNA, 15 bp, Homo sapiens
acttaaagtgttaaa

SEQ ID NO: 354635 - DNA, 15 bp, Homo sapiens
cttaaagtgttaaaa

SEQ ID NO: 354636 - DNA, 15 bp, Homo sapiens
ttaaagtgttaaaaa

SEQ ID NO: 354637 - DNA, 15 bp, Homo sapiens
taaagtgttaaaaaa

SEQ ID NO: 354638 - DNA, 15 bp, Homo sapiens
aaagtgttaaaaaaa

SEQ ID NO: 354639 - DNA, 15 bp, Homo sapiens
aagtgttaaaaaaac

SEQ ID NO: 354640 - DNA, 15 bp, Homo sapiens
agtgttaaaaaaaca

SEQ ID NO: 354641 - DNA, 15 bp, Homo sapiens
gtgttaaaaaaacaa

SEQ ID NO: 354642 - DNA, 15 bp, Homo sapiens
tgttaaaaaaacaaa

SEQ ID NO: 354643 - DNA, 15 bp, Homo sapiens
gttaaaaaaacaaaa

SEQ ID NO: 354644 - DNA, 15 bp, Homo sapiens
aaaacaaaaaacaag

SEQ ID NO: 354645 - DNA, 15 bp, Homo sapiens
aaacaaaaaacaaga

SEQ ID NO: 354646 - DNA, 15 bp, Homo sapiens
aacaaaaaacaagaa

SEQ ID NO: 354647 - DNA, 15 bp, Homo sapiens
acaaaaaacaagaaa

SEQ ID NO: 354648 - DNA, 15 bp, Homo sapiens
caaaaaacaagaaat

SEQ ID NO: 354649 - DNA, 15 bp, Homo sapiens
aaaaaacaagaaatg

SEQ ID NO: 354650 - DNA, 15 bp, Homo sapiens
aaaaacaagaaatga

SEQ ID NO: 354651 - DNA, 15 bp, Homo sapiens
aaaacaagaaatgaa

SEQ ID NO: 354652 - DNA, 15 bp, Homo sapiens
aaacaagaaatgaat

SEQ ID NO: 354653 - DNA, 15 bp, Homo sapiens
aacaagaaatgaatt

SEQ ID NO: 354654 - DNA, 15 bp, Homo sapiens
acaagaaatgaattt

SEQ ID NO: 354655 - DNA, 15 bp, Homo sapiens
caagaaatgaatttg

SEQ ID NO: 354656 - DNA, 15 bp, Homo sapiens
aagaaatgaatttgc

SEQ ID NO: 354657 - DNA, 15 bp, Homo sapiens
agaaatgaatttgct

SEQ ID NO: 354658 - DNA, 15 bp, Homo sapiens
gaaatgaatttgcta

SEQ ID NO: 354659 - DNA, 15 bp, Homo sapiens
aaatgaatttgctag

SEQ ID NO: 354660 - DNA, 15 bp, Homo sapiens
aatgaatttgctagt

SEQ ID NO: 354661 - DNA, 15 bp, Homo sapiens
atgaatttgctagta

SEQ ID NO: 354662 - DNA, 15 bp, Homo sapiens
tgaatttgctagtaa

SEQ ID NO: 354663 - DNA, 15 bp, Homo sapiens
gaatttgctagtaat

SEQ ID NO: 354664 - DNA, 15 bp, Homo sapiens
aatttgctagtaata

SEQ ID NO: 354665 - DNA, 15 bp, Homo sapiens
atttgctagtaatag

SEQ ID NO: 354666 - DNA, 15 bp, Homo sapiens
tttgctagtaatagt

SEQ ID NO: 354667 - DNA, 15 bp, Homo sapiens
ttgctagtaatagtg

SEQ ID NO: 354668 - DNA, 15 bp, Homo sapiens
tgctagtaatagtgc

SEQ ID NO: 354669 - DNA, 15 bp, Homo sapiens
gctagtaatagtgca

SEQ ID NO: 354670 - DNA, 15 bp, Homo sapiens
ctagtaatagtgcat

SEQ ID NO: 354671 - DNA, 15 bp, Homo sapiens
tagtaatagtgcatg

SEQ ID NO: 354672 - DNA, 15 bp, Homo sapiens
agtaatagtgcatgc

SEQ ID NO: 354673 - DNA, 15 bp, Homo sapiens
gtaatagtgcatgca

SEQ ID NO: 354674 - DNA, 15 bp, Homo sapiens
taatagtgcatgcag

SEQ ID NO: 354675 - DNA, 15 bp, Homo sapiens
aatagtgcatgcagt

SEQ ID NO: 354676 - DNA, 15 bp, Homo sapiens
atagtgcatgcagtt

SEQ ID NO: 354677 - DNA, 15 bp, Homo sapiens
tagtgcatgcagttt

SEQ ID NO: 354678 - DNA, 15 bp, Homo sapiens
agtgcatgcagttta

SEQ ID NO: 354679 - DNA, 15 bp, Homo sapiens
gtgcatgcagtttat

SEQ ID NO: 354680 - DNA, 15 bp, Homo sapiens
tgcatgcagtttata

SEQ ID NO: 354681 - DNA, 15 bp, Homo sapiens
gcatgcagtttatat

SEQ ID NO: 354682 - DNA, 15 bp, Homo sapiens
catgcagtttatatt

SEQ ID NO: 354683 - DNA, 15 bp, Homo sapiens
atgcagtttatattt

SEQ ID NO: 354684 - DNA, 15 bp, Homo sapiens
tgcagtttatatttg

SEQ ID NO: 354685 - DNA, 15 bp, Homo sapiens
gcagtttatatttgg

SEQ ID NO: 354686 - DNA, 15 bp, Homo sapiens
cagtttatatttggt

SEQ ID NO: 354687 - DNA, 15 bp, Homo sapiens
agtttatatttggtg

SEQ ID NO: 354688 - DNA, 15 bp, Homo sapiens
gtttatatttggtga

SEQ ID NO: 354689 - DNA, 15 bp, Homo sapiens
tttatatttggtgaa

SEQ ID NO: 354690 - DNA, 15 bp, Homo sapiens
ttatatttggtgaaa

SEQ ID NO: 354691 - DNA, 15 bp, Homo sapiens
tatatttggtgaaat

SEQ ID NO: 354692 - DNA, 15 bp, Homo sapiens
atatttggtgaaatc

SEQ ID NO: 354693 - DNA, 15 bp, Homo sapiens
tatttggtgaaatca

SEQ ID NO: 354694 - DNA, 15 bp, Homo sapiens
atttggtgaaatcat

SEQ ID NO: 354695 - DNA, 15 bp, Homo sapiens
tttggtgaaatcatc

SEQ ID NO: 354696 - DNA, 15 bp, Homo sapiens
ttggtgaaatcatca

SEQ ID NO: 354697 - DNA, 15 bp, Homo sapiens
tggtgaaatcatcag

SEQ ID NO: 354698 - DNA, 15 bp, Homo sapiens
ggtgaaatcatcagg

SEQ ID NO: 354699 - DNA, 15 bp, Homo sapiens
gtgaaatcatcaggc

SEQ ID NO: 354700 - DNA, 15 bp, Homo sapiens
tgaaatcatcaggct

SEQ ID NO: 354701 - DNA, 15 bp, Homo sapiens
gaaatcatcaggctt

SEQ ID NO: 354702 - DNA, 15 bp, Homo sapiens
aaatcatcaggcttc

SEQ ID NO: 354703 - DNA, 15 bp, Homo sapiens
aatcatcaggcttct

SEQ ID NO: 354704 - DNA, 15 bp, Homo sapiens
atcatcaggcttctc

SEQ ID NO: 354705 - DNA, 15 bp, Homo sapiens
tcatcaggcttctct

SEQ ID NO: 354706 - DNA, 15 bp, Homo sapiens
catcaggcttctcta

SEQ ID NO: 354707 - DNA, 15 bp, Homo sapiens
atcaggcttctctac

SEQ ID NO: 354708 - DNA, 15 bp, Homo sapiens
tcaggcttctctaca

SEQ ID NO: 354709 - DNA, 15 bp, Homo sapiens
caggcttctctacat

SEQ ID NO: 354710 - DNA, 15 bp, Homo sapiens
aggcttctctacatt

SEQ ID NO: 354711 - DNA, 15 bp, Homo sapiens
ggcttctctacatta

SEQ ID NO: 354712 - DNA, 15 bp, Homo sapiens
gcttctctacattaa

SEQ ID NO: 354713 - DNA, 15 bp, Homo sapiens
cttctctacattaat

SEQ ID NO: 354714 - DNA, 15 bp, Homo sapiens
ttctctacattaatt

SEQ ID NO: 354715 - DNA, 15 bp, Homo sapiens
tctctacattaatta

SEQ ID NO: 354716 - DNA, 15 bp, Homo sapiens
ctctacattaattaa

SEQ ID NO: 354717 - DNA, 15 bp, Homo sapiens
tctacattaattaaa

SEQ ID NO: 354718 - DNA, 15 bp, Homo sapiens
ctacattaattaaaa

SEQ ID NO: 354719 - DNA, 15 bp, Homo sapiens
tacattaattaaaag

SEQ ID NO: 354720 - DNA, 15 bp, Homo sapiens
acattaattaaaagg

SEQ ID NO: 354721 - DNA, 15 bp, Homo sapiens
cattaattaaaaggc

SEQ ID NO: 354722 - DNA, 15 bp, Homo sapiens
attaattaaaaggct

SEQ ID NO: 354723 - DNA, 15 bp, Homo sapiens
ttaattaaaaggcta

SEQ ID NO: 354724 - DNA, 15 bp, Homo sapiens
taattaaaaggctat

SEQ ID NO: 354725 - DNA, 15 bp, Homo sapiens
aattaaaaggctatt

SEQ ID NO: 354726 - DNA, 15 bp, Homo sapiens
attaaaaggctattc

SEQ ID NO: 354727 - DNA, 15 bp, Homo sapiens
ttaaaaggctattcc

SEQ ID NO: 354728 - DNA, 15 bp, Homo sapiens
taaaaggctattccc

SEQ ID NO: 354729 - DNA, 15 bp, Homo sapiens
aaaaggctattccct

SEQ ID NO: 354730 - DNA, 15 bp, Homo sapiens
aaaggctattccctt

SEQ ID NO: 354731 - DNA, 15 bp, Homo sapiens
aaggctattcccttc

SEQ ID NO: 354732 - DNA, 15 bp, Homo sapiens
aggctattcccttct

SEQ ID NO: 354733 - DNA, 15 bp, Homo sapiens
ggctattcccttctg

SEQ ID NO: 354734 - DNA, 15 bp, Homo sapiens
gctattcccttctga

SEQ ID NO: 354735 - DNA, 15 bp, Homo sapiens
ctattcccttctgag

SEQ ID NO: 354736 - DNA, 15 bp, Homo sapiens
tattcccttctgaga

SEQ ID NO: 354737 - DNA, 15 bp, Homo sapiens
attcccttctgagag

SEQ ID NO: 354738 - DNA, 15 bp, Homo sapiens
ttcccttctgagagt

SEQ ID NO: 354739 - DNA, 15 bp, Homo sapiens
tcccttctgagagtc

SEQ ID NO: 354740 - DNA, 15 bp, Homo sapiens
cccttctgagagtca

SEQ ID NO: 354741 - DNA, 15 bp, Homo sapiens
ccttctgagagtcaa

SEQ ID NO: 354742 - DNA, 15 bp, Homo sapiens
cttctgagagtcaag

SEQ ID NO: 354743 - DNA, 15 bp, Homo sapiens
ttctgagagtcaagt

SEQ ID NO: 354744 - DNA, 15 bp, Homo sapiens
tctgagagtcaagta

SEQ ID NO: 354745 - DNA, 15 bp, Homo sapiens
ctgagagtcaagtat

SEQ ID NO: 354746 - DNA, 15 bp, Homo sapiens
tgagagtcaagtatt

SEQ ID NO: 354747 - DNA, 15 bp, Homo sapiens
gagagtcaagtattt

SEQ ID NO: 354748 - DNA, 15 bp, Homo sapiens
agagtcaagtatttc

SEQ ID NO: 354749 - DNA, 15 bp, Homo sapiens
gagtcaagtatttcc

SEQ ID NO: 354750 - DNA, 15 bp, Homo sapiens
agtcaagtatttcca

SEQ ID NO: 354751 - DNA, 15 bp, Homo sapiens
gtcaagtatttccag

SEQ ID NO: 354752 - DNA, 15 bp, Homo sapiens
tcaagtatttccagt

SEQ ID NO: 354753 - DNA, 15 bp, Homo sapiens
caagtatttccagtc

SEQ ID NO: 354754 - DNA, 15 bp, Homo sapiens
aagtatttccagtct

SEQ ID NO: 354755 - DNA, 15 bp, Homo sapiens
agtatttccagtcta

SEQ ID NO: 354756 - DNA, 15 bp, Homo sapiens
gtatttccagtctaa

SEQ ID NO: 354757 - DNA, 15 bp, Homo sapiens
tatttccagtctaat

SEQ ID NO: 354758 - DNA, 15 bp, Homo sapiens
atttccagtctaatt

SEQ ID NO: 354759 - DNA, 15 bp, Homo sapiens
tttccagtctaattt

SEQ ID NO: 354760 - DNA, 15 bp, Homo sapiens
ttccagtctaatttg

SEQ ID NO: 354761 - DNA, 15 bp, Homo sapiens
tccagtctaatttgg

SEQ ID NO: 354762 - DNA, 15 bp, Homo sapiens
ccagtctaatttggc

SEQ ID NO: 354763 - DNA, 15 bp, Homo sapiens
cagtctaatttggca

SEQ ID NO: 354764 - DNA, 15 bp, Homo sapiens
agtctaatttggcag

SEQ ID NO: 354765 - DNA, 15 bp, Homo sapiens
gtctaatttggcaga

SEQ ID NO: 354766 - DNA, 15 bp, Homo sapiens
tctaatttggcagat

SEQ ID NO: 354767 - DNA, 15 bp, Homo sapiens
ctaatttggcagatg

SEQ ID NO: 354768 - DNA, 15 bp, Homo sapiens
taatttggcagatgg

SEQ ID NO: 354769 - DNA, 15 bp, Homo sapiens
aatttggcagatggc

SEQ ID NO: 354770 - DNA, 15 bp, Homo sapiens
atttggcagatggct

SEQ ID NO: 354771 - DNA, 15 bp, Homo sapiens
tttggcagatggcta

SEQ ID NO: 354772 - DNA, 15 bp, Homo sapiens
ttggcagatggctat

SEQ ID NO: 354773 - DNA, 15 bp, Homo sapiens
tggcagatggctata

SEQ ID NO: 354774 - DNA, 15 bp, Homo sapiens
ggcagatggctatat

SEQ ID NO: 354775 - DNA, 15 bp, Homo sapiens
gcagatggctatatc

SEQ ID NO: 354776 - DNA, 15 bp, Homo sapiens
cagatggctatatca

SEQ ID NO: 354777 - DNA, 15 bp, Homo sapiens
agatggctatatcaa

SEQ ID NO: 354778 - DNA, 15 bp, Homo sapiens
gatggctatatcaag

SEQ ID NO: 354779 - DNA, 15 bp, Homo sapiens
atggctatatcaagc

SEQ ID NO: 354780 - DNA, 15 bp, Homo sapiens
tggctatatcaagca

SEQ ID NO: 354781 - DNA, 15 bp, Homo sapiens
ggctatatcaagcac

SEQ ID NO: 354782 - DNA, 15 bp, Homo sapiens
gctatatcaagcacc

SEQ ID NO: 354783 - DNA, 15 bp, Homo sapiens
ctatatcaagcaccc

SEQ ID NO: 354784 - DNA, 15 bp, Homo sapiens
tatatcaagcaccca

SEQ ID NO: 354785 - DNA, 15 bp, Homo sapiens
atatcaagcacccag

SEQ ID NO: 354786 - DNA, 15 bp, Homo sapiens
tatcaagcacccagg

SEQ ID NO: 354787 - DNA, 15 bp, Homo sapiens
atcaagcacccaggt

SEQ ID NO: 354788 - DNA, 15 bp, Homo sapiens
tcaagcacccaggtg

SEQ ID NO: 354789 - DNA, 15 bp, Homo sapiens
caagcacccaggtga

SEQ ID NO: 354790 - DNA, 15 bp, Homo sapiens
aagcacccaggtgaa

SEQ ID NO: 354791 - DNA, 15 bp, Homo sapiens
agcacccaggtgaaa

SEQ ID NO: 354792 - DNA, 15 bp, Homo sapiens
gcacccaggtgaaat

SEQ ID NO: 354793 - DNA, 15 bp, Homo sapiens
cacccaggtgaaatg

SEQ ID NO: 354794 - DNA, 15 bp, Homo sapiens
acccaggtgaaatga

SEQ ID NO: 354795 - DNA, 15 bp, Homo sapiens
cccaggtgaaatgag

SEQ ID NO: 354796 - DNA, 15 bp, Homo sapiens
ccaggtgaaatgagt

SEQ ID NO: 354797 - DNA, 15 bp, Homo sapiens
caggtgaaatgagtt

SEQ ID NO: 354798 - DNA, 15 bp, Homo sapiens
aggtgaaatgagttt

SEQ ID NO: 354799 - DNA, 15 bp, Homo sapiens
ggtgaaatgagtttc

SEQ ID NO: 354800 - DNA, 15 bp, Homo sapiens
gtgaaatgagtttct

SEQ ID NO: 354801 - DNA, 15 bp, Homo sapiens
tgaaatgagtttctt

SEQ ID NO: 354802 - DNA, 15 bp, Homo sapiens
gaaatgagtttctta

SEQ ID NO: 354803 - DNA, 15 bp, Homo sapiens
aaatgagtttcttaa

SEQ ID NO: 354804 - DNA, 15 bp, Homo sapiens
aatgagtttcttaag

SEQ ID NO: 354805 - DNA, 15 bp, Homo sapiens
atgagtttcttaagg

SEQ ID NO: 354806 - DNA, 15 bp, Homo sapiens
tgagtttcttaaggc

SEQ ID NO: 354807 - DNA, 15 bp, Homo sapiens
gagtttcttaaggca

SEQ ID NO: 354808 - DNA, 15 bp, Homo sapiens
agtttcttaaggcac

SEQ ID NO: 354809 - DNA, 15 bp, Homo sapiens
gtttcttaaggcaca

SEQ ID NO: 354810 - DNA, 15 bp, Homo sapiens
tttcttaaggcacaa

SEQ ID NO: 354811 - DNA, 15 bp, Homo sapiens
ttcttaaggcacaat

SEQ ID NO: 354812 - DNA, 15 bp, Homo sapiens
tcttaaggcacaata

SEQ ID NO: 354813 - DNA, 15 bp, Homo sapiens
cttaaggcacaatat

SEQ ID NO: 354814 - DNA, 15 bp, Homo sapiens
ttaaggcacaatatt

SEQ ID NO: 354815 - DNA, 15 bp, Homo sapiens
taaggcacaatattt

SEQ ID NO: 354816 - DNA, 15 bp, Homo sapiens
aaggcacaatatttc

SEQ ID NO: 354817 - DNA, 15 bp, Homo sapiens
aggcacaatatttct

SEQ ID NO: 354818 - DNA, 15 bp, Homo sapiens
ggcacaatatttctt

SEQ ID NO: 354819 - DNA, 15 bp, Homo sapiens
gcacaatatttctta

SEQ ID NO: 354820 - DNA, 15 bp, Homo sapiens
cacaatatttcttaa

SEQ ID NO: 354821 - DNA, 15 bp, Homo sapiens
acaatatttcttaag

SEQ ID NO: 354822 - DNA, 15 bp, Homo sapiens
caatatttcttaagt

SEQ ID NO: 354823 - DNA, 15 bp, Homo sapiens
aatatttcttaagta

SEQ ID NO: 354824 - DNA, 15 bp, Homo sapiens
atatttcttaagtag

SEQ ID NO: 354825 - DNA, 15 bp, Homo sapiens
tatttcttaagtagt

SEQ ID NO: 354826 - DNA, 15 bp, Homo sapiens
atttcttaagtagtt

SEQ ID NO: 354827 - DNA, 15 bp, Homo sapiens
tttcttaagtagtta

SEQ ID NO: 354828 - DNA, 15 bp, Homo sapiens
ttcttaagtagttag

SEQ ID NO: 354829 - DNA, 15 bp, Homo sapiens
tcttaagtagttaga

SEQ ID NO: 354830 - DNA, 15 bp, Homo sapiens
cttaagtagttagaa

SEQ ID NO: 354831 - DNA, 15 bp, Homo sapiens
ttaagtagttagaag

SEQ ID NO: 354832 - DNA, 15 bp, Homo sapiens
taagtagttagaagt

SEQ ID NO: 354833 - DNA, 15 bp, Homo sapiens
aagtagttagaagta

SEQ ID NO: 354834 - DNA, 15 bp, Homo sapiens
agtagttagaagtac

SEQ ID NO: 354835 - DNA, 15 bp, Homo sapiens
gtagttagaagtact

SEQ ID NO: 354836 - DNA, 15 bp, Homo sapiens
tagttagaagtactg

SEQ ID NO: 354837 - DNA, 15 bp, Homo sapiens
agttagaagtactga

SEQ ID NO: 354838 - DNA, 15 bp, Homo sapiens
gttagaagtactgac

SEQ ID NO: 354839 - DNA, 15 bp, Homo sapiens
ttagaagtactgact

SEQ ID NO: 354840 - DNA, 15 bp, Homo sapiens
tagaagtactgactc

SEQ ID NO: 354841 - DNA, 15 bp, Homo sapiens
agaagtactgactct

SEQ ID NO: 354842 - DNA, 15 bp, Homo sapiens
gaagtactgactctt

SEQ ID NO: 354843 - DNA, 15 bp, Homo sapiens
aagtactgactctta

SEQ ID NO: 354844 - DNA, 15 bp, Homo sapiens
agtactgactcttaa

SEQ ID NO: 354845 - DNA, 15 bp, Homo sapiens
gtactgactcttaag

SEQ ID NO: 354846 - DNA, 15 bp, Homo sapiens
tactgactcttaagc

SEQ ID NO: 354847 - DNA, 15 bp, Homo sapiens
actgactcttaagca

SEQ ID NO: 354848 - DNA, 15 bp, Homo sapiens
ctgactcttaagcag

SEQ ID NO: 354849 - DNA, 15 bp, Homo sapiens
tgactcttaagcagt

SEQ ID NO: 354850 - DNA, 15 bp, Homo sapiens
gactcttaagcagtc

SEQ ID NO: 354851 - DNA, 15 bp, Homo sapiens
actcttaagcagtct

SEQ ID NO: 354852 - DNA, 15 bp, Homo sapiens
ctcttaagcagtctg

SEQ ID NO: 354853 - DNA, 15 bp, Homo sapiens
tcttaagcagtctgc

SEQ ID NO: 354854 - DNA, 15 bp, Homo sapiens
cttaagcagtctgct

SEQ ID NO: 354855 - DNA, 15 bp, Homo sapiens
ttaagcagtctgctt

SEQ ID NO: 354856 - DNA, 15 bp, Homo sapiens
taagcagtctgcttg

SEQ ID NO: 354857 - DNA, 15 bp, Homo sapiens
aagcagtctgcttgt

SEQ ID NO: 354858 - DNA, 15 bp, Homo sapiens
agcagtctgcttgtg

SEQ ID NO: 354859 - DNA, 15 bp, Homo sapiens
gcagtctgcttgtgt

SEQ ID NO: 354860 - DNA, 15 bp, Homo sapiens
cagtctgcttgtgta

SEQ ID NO: 354861 - DNA, 15 bp, Homo sapiens
agtctgcttgtgtaa

SEQ ID NO: 354862 - DNA, 15 bp, Homo sapiens
gtctgcttgtgtaat

SEQ ID NO: 354863 - DNA, 15 bp, Homo sapiens
tctgcttgtgtaata

SEQ ID NO: 354864 - DNA, 15 bp, Homo sapiens
ctgcttgtgtaatat

SEQ ID NO: 354865 - DNA, 15 bp, Homo sapiens
tgcttgtgtaatatt

SEQ ID NO: 354866 - DNA, 15 bp, Homo sapiens
gcttgtgtaatattt

SEQ ID NO: 354867 - DNA, 15 bp, Homo sapiens
cttgtgtaatatttg

SEQ ID NO: 354868 - DNA, 15 bp, Homo sapiens
ttgtgtaatatttgc

SEQ ID NO: 354869 - DNA, 15 bp, Homo sapiens
tgtgtaatatttgca

SEQ ID NO: 354870 - DNA, 15 bp, Homo sapiens
gtgtaatatttgcag

SEQ ID NO: 354871 - DNA, 15 bp, Homo sapiens
tgtaatatttgcagg

SEQ ID NO: 354872 - DNA, 15 bp, Homo sapiens
gtaatatttgcaggg

SEQ ID NO: 354873 - DNA, 15 bp, Homo sapiens
taatatttgcaggga

SEQ ID NO: 354874 - DNA, 15 bp, Homo sapiens
aatatttgcagggag

SEQ ID NO: 354875 - DNA, 15 bp, Homo sapiens
atatttgcagggaga

SEQ ID NO: 354876 - DNA, 15 bp, Homo sapiens
tatttgcagggagat

SEQ ID NO: 354877 - DNA, 15 bp, Homo sapiens
atttgcagggagata

SEQ ID NO: 354878 - DNA, 15 bp, Homo sapiens
tttgcagggagataa

SEQ ID NO: 354879 - DNA, 15 bp, Homo sapiens
ttgcagggagataag

SEQ ID NO: 354880 - DNA, 15 bp, Homo sapiens
tgcagggagataagc

SEQ ID NO: 354881 - DNA, 15 bp, Homo sapiens
gcagggagataagca

SEQ ID NO: 354882 - DNA, 15 bp, Homo sapiens
cagggagataagcag

SEQ ID NO: 354883 - DNA, 15 bp, Homo sapiens
agggagataagcaga

SEQ ID NO: 354884 - DNA, 15 bp, Homo sapiens
gggagataagcagac

SEQ ID NO: 354885 - DNA, 15 bp, Homo sapiens
ggagataagcagaca

SEQ ID NO: 354886 - DNA, 15 bp, Homo sapiens
gagataagcagacaa

SEQ ID NO: 354887 - DNA, 15 bp, Homo sapiens
agataagcagacaaa

SEQ ID NO: 354888 - DNA, 15 bp, Homo sapiens
gataagcagacaaac

SEQ ID NO: 354889 - DNA, 15 bp, Homo sapiens
ataagcagacaaact

SEQ ID NO: 354890 - DNA, 15 bp, Homo sapiens
taagcagacaaacta

SEQ ID NO: 354891 - DNA, 15 bp, Homo sapiens
aagcagacaaactat

SEQ ID NO: 354892 - DNA, 15 bp, Homo sapiens
agcagacaaactata

SEQ ID NO: 354893 - DNA, 15 bp, Homo sapiens
gcagacaaactataa

SEQ ID NO: 354894 - DNA, 15 bp, Homo sapiens
cagacaaactataat

SEQ ID NO: 354895 - DNA, 15 bp, Homo sapiens
agacaaactataatt

SEQ ID NO: 354896 - DNA, 15 bp, Homo sapiens
gacaaactataatta

SEQ ID NO: 354897 - DNA, 15 bp, Homo sapiens
acaaactataattat

SEQ ID NO: 354898 - DNA, 15 bp, Homo sapiens
caaactataattatg

SEQ ID NO: 354899 - DNA, 15 bp, Homo sapiens
aaactataattatgg

SEQ ID NO: 354900 - DNA, 15 bp, Homo sapiens
aactataattatggc

SEQ ID NO: 354901 - DNA, 15 bp, Homo sapiens
actataattatggca

SEQ ID NO: 354902 - DNA, 15 bp, Homo sapiens
ctataattatggcat

SEQ ID NO: 354903 - DNA, 15 bp, Homo sapiens
tataattatggcatc

SEQ ID NO: 354904 - DNA, 15 bp, Homo sapiens
ataattatggcatcc

SEQ ID NO: 354905 - DNA, 15 bp, Homo sapiens
taattatggcatcca

SEQ ID NO: 354906 - DNA, 15 bp, Homo sapiens
aattatggcatccac

SEQ ID NO: 354907 - DNA, 15 bp, Homo sapiens
attatggcatccact

SEQ ID NO: 354908 - DNA, 15 bp, Homo sapiens
ttatggcatccactt

SEQ ID NO: 354909 - DNA, 15 bp, Homo sapiens
tatggcatccactta

SEQ ID NO: 354910 - DNA, 15 bp, Homo sapiens
atggcatccacttat

SEQ ID NO: 354911 - DNA, 15 bp, Homo sapiens
tggcatccacttata

SEQ ID NO: 354912 - DNA, 15 bp, Homo sapiens
ggcatccacttatat

SEQ ID NO: 354913 - DNA, 15 bp, Homo sapiens
gcatccacttatata

SEQ ID NO: 354914 - DNA, 15 bp, Homo sapiens
catccacttatatag

SEQ ID NO: 354915 - DNA, 15 bp, Homo sapiens
atccacttatatagt

SEQ ID NO: 354916 - DNA, 15 bp, Homo sapiens
tccacttatatagta

SEQ ID NO: 354917 - DNA, 15 bp, Homo sapiens
ccacttatatagtaa

SEQ ID NO: 354918 - DNA, 15 bp, Homo sapiens
cacttatatagtaat

SEQ ID NO: 354919 - DNA, 15 bp, Homo sapiens
acttatatagtaatg

SEQ ID NO: 354920 - DNA, 15 bp, Homo sapiens
cttatatagtaatga

SEQ ID NO: 354921 - DNA, 15 bp, Homo sapiens
ttatatagtaatgaa

SEQ ID NO: 354922 - DNA, 15 bp, Homo sapiens
tatatagtaatgaac

SEQ ID NO: 354923 - DNA, 15 bp, Homo sapiens
atatagtaatgaact

SEQ ID NO: 354924 - DNA, 15 bp, Homo sapiens
tatagtaatgaactc

SEQ ID NO: 354925 - DNA, 15 bp, Homo sapiens
atagtaatgaactca

SEQ ID NO: 354926 - DNA, 15 bp, Homo sapiens
tagtaatgaactcaa

SEQ ID NO: 354927 - DNA, 15 bp, Homo sapiens
agtaatgaactcaac

SEQ ID NO: 354928 - DNA, 15 bp, Homo sapiens
gtaatgaactcaaca

SEQ ID NO: 354929 - DNA, 15 bp, Homo sapiens
taatgaactcaacat

SEQ ID NO: 354930 - DNA, 15 bp, Homo sapiens
aatgaactcaacatg

SEQ ID NO: 354931 - DNA, 15 bp, Homo sapiens
atgaactcaacatgc

SEQ ID NO: 354932 - DNA, 15 bp, Homo sapiens
tgaactcaacatgca

SEQ ID NO: 354933 - DNA, 15 bp, Homo sapiens
gaactcaacatgcat

SEQ ID NO: 354934 - DNA, 15 bp, Homo sapiens
aactcaacatgcatc

SEQ ID NO: 354935 - DNA, 15 bp, Homo sapiens
actcaacatgcatct

SEQ ID NO: 354936 - DNA, 15 bp, Homo sapiens
ctcaacatgcatctt

SEQ ID NO: 354937 - DNA, 15 bp, Homo sapiens
tcaacatgcatcttt

SEQ ID NO: 354938 - DNA, 15 bp, Homo sapiens
caacatgcatctttt

SEQ ID NO: 354939 - DNA, 15 bp, Homo sapiens
aacatgcatctttta

SEQ ID NO: 354940 - DNA, 15 bp, Homo sapiens
acatgcatcttttat

SEQ ID NO: 354941 - DNA, 15 bp, Homo sapiens
catgcatcttttatg

SEQ ID NO: 354942 - DNA, 15 bp, Homo sapiens
atgcatcttttatgt

SEQ ID NO: 354943 - DNA, 15 bp, Homo sapiens
tgcatcttttatgtg

SEQ ID NO: 354944 - DNA, 15 bp, Homo sapiens
gcatcttttatgtgt

SEQ ID NO: 354945 - DNA, 15 bp, Homo sapiens
catcttttatgtgtt

SEQ ID NO: 354946 - DNA, 15 bp, Homo sapiens
atcttttatgtgttt

SEQ ID NO: 354947 - DNA, 15 bp, Homo sapiens
tcttttatgtgttta

SEQ ID NO: 354948 - DNA, 15 bp, Homo sapiens
cttttatgtgtttag

SEQ ID NO: 354949 - DNA, 15 bp, Homo sapiens
ttttatgtgtttagg

SEQ ID NO: 354950 - DNA, 15 bp, Homo sapiens
tttatgtgtttaggc

SEQ ID NO: 354951 - DNA, 15 bp, Homo sapiens
ttatgtgtttaggca

SEQ ID NO: 354952 - DNA, 15 bp, Homo sapiens
tatgtgtttaggcat

SEQ ID NO: 354953 - DNA, 15 bp, Homo sapiens
atgtgtttaggcatt

SEQ ID NO: 354954 - DNA, 15 bp, Homo sapiens
tgtgtttaggcattt

SEQ ID NO: 354955 - DNA, 15 bp, Homo sapiens
gtgtttaggcatttg

SEQ ID NO: 354956 - DNA, 15 bp, Homo sapiens
tgtttaggcatttgt

SEQ ID NO: 354957 - DNA, 15 bp, Homo sapiens
gtttaggcatttgtt

SEQ ID NO: 354958 - DNA, 15 bp, Homo sapiens
tttaggcatttgtta

SEQ ID NO: 354959 - DNA, 15 bp, Homo sapiens
ttaggcatttgttaa

SEQ ID NO: 354960 - DNA, 15 bp, Homo sapiens
taggcatttgttaat

SEQ ID NO: 354961 - DNA, 15 bp, Homo sapiens
aggcatttgttaatg

SEQ ID NO: 354962 - DNA, 15 bp, Homo sapiens
ggcatttgttaatga

SEQ ID NO: 354963 - DNA, 15 bp, Homo sapiens
gcatttgttaatgaa

SEQ ID NO: 354964 - DNA, 15 bp, Homo sapiens
catttgttaatgaaa

SEQ ID NO: 354965 - DNA, 15 bp, Homo sapiens
atttgttaatgaaat

SEQ ID NO: 354966 - DNA, 15 bp, Homo sapiens
tttgttaatgaaata

SEQ ID NO: 354967 - DNA, 15 bp, Homo sapiens
ttgttaatgaaatag

SEQ ID NO: 354968 - DNA, 15 bp, Homo sapiens
tgttaatgaaataga

SEQ ID NO: 354969 - DNA, 15 bp, Homo sapiens
gttaatgaaatagaa

SEQ ID NO: 354970 - DNA, 15 bp, Homo sapiens
ttaatgaaatagaaa

SEQ ID NO: 354971 - DNA, 15 bp, Homo sapiens
taatgaaatagaaac

SEQ ID NO: 354972 - DNA, 15 bp, Homo sapiens
aatgaaatagaaaca

SEQ ID NO: 354973 - DNA, 15 bp, Homo sapiens
atgaaatagaaacaa

SEQ ID NO: 354974 - DNA, 15 bp, Homo sapiens
tgaaatagaaacaat

SEQ ID NO: 354975 - DNA, 15 bp, Homo sapiens
gaaatagaaacaatt

SEQ ID NO: 354976 - DNA, 15 bp, Homo sapiens
aaatagaaacaattg

SEQ ID NO: 354977 - DNA, 15 bp, Homo sapiens
aatagaaacaattga

SEQ ID NO: 354978 - DNA, 15 bp, Homo sapiens
atagaaacaattgaa

SEQ ID NO: 354979 - DNA, 15 bp, Homo sapiens
tagaaacaattgaat

SEQ ID NO: 354980 - DNA, 15 bp, Homo sapiens
agaaacaattgaatc

SEQ ID NO: 354981 - DNA, 15 bp, Homo sapiens
gaaacaattgaatca

SEQ ID NO: 354982 - DNA, 15 bp, Homo sapiens
aaacaattgaatcat

SEQ ID NO: 354983 - DNA, 15 bp, Homo sapiens
aacaattgaatcatc

SEQ ID NO: 354984 - DNA, 15 bp, Homo sapiens
acaattgaatcatct

SEQ ID NO: 354985 - DNA, 15 bp, Homo sapiens
caattgaatcatctc

SEQ ID NO: 354986 - DNA, 15 bp, Homo sapiens
aattgaatcatctct

SEQ ID NO: 354987 - DNA, 15 bp, Homo sapiens
attgaatcatctctg

SEQ ID NO: 354988 - DNA, 15 bp, Homo sapiens
ttgaatcatctctga

SEQ ID NO: 354989 - DNA, 15 bp, Homo sapiens
tgaatcatctctgaa

SEQ ID NO: 354990 - DNA, 15 bp, Homo sapiens
gaatcatctctgaaa

SEQ ID NO: 354991 - DNA, 15 bp, Homo sapiens
aatcatctctgaaaa

SEQ ID NO: 354992 - DNA, 15 bp, Homo sapiens
atcatctctgaaaaa

SEQ ID NO: 354993 - DNA, 15 bp, Homo sapiens
tcatctctgaaaaac

SEQ ID NO: 354994 - DNA, 15 bp, Homo sapiens
catctctgaaaaaca

SEQ ID NO: 354995 - DNA, 15 bp, Homo sapiens
atctctgaaaaacat

SEQ ID NO: 354996 - DNA, 15 bp, Homo sapiens
tctctgaaaaacatg

SEQ ID NO: 354997 - DNA, 15 bp, Homo sapiens
ctctgaaaaacatga

SEQ ID NO: 354998 - DNA, 15 bp, Homo sapiens
tctgaaaaacatgaa

SEQ ID NO: 354999 - DNA, 15 bp, Homo sapiens
ctgaaaaacatgaag

SEQ ID NO: 355000 - DNA, 15 bp, Homo sapiens
tgaaaaacatgaagg

SEQ ID NO: 355001 - DNA, 15 bp, Homo sapiens
gaaaaacatgaagga

SEQ ID NO: 355002 - DNA, 15 bp, Homo sapiens
aaaaacatgaaggaa

SEQ ID NO: 355003 - DNA, 15 bp, Homo sapiens
aaaacatgaaggaaa

SEQ ID NO: 355004 - DNA, 15 bp, Homo sapiens
aaacatgaaggaaat

SEQ ID NO: 355005 - DNA, 15 bp, Homo sapiens
aacatgaaggaaata

SEQ ID NO: 355006 - DNA, 15 bp, Homo sapiens
acatgaaggaaatag

SEQ ID NO: 355007 - DNA, 15 bp, Homo sapiens
catgaaggaaataga

SEQ ID NO: 355008 - DNA, 15 bp, Homo sapiens
atgaaggaaatagag

SEQ ID NO: 355009 - DNA, 15 bp, Homo sapiens
tgaaggaaatagaga

SEQ ID NO: 355010 - DNA, 15 bp, Homo sapiens
gaaggaaatagagac

SEQ ID NO: 355011 - DNA, 15 bp, Homo sapiens
aaggaaatagagact

SEQ ID NO: 355012 - DNA, 15 bp, Homo sapiens
aggaaatagagacta

SEQ ID NO: 355013 - DNA, 15 bp, Homo sapiens
ggaaatagagactaa

SEQ ID NO: 355014 - DNA, 15 bp, Homo sapiens
gaaatagagactaat

SEQ ID NO: 355015 - DNA, 15 bp, Homo sapiens
aaatagagactaatc

SEQ ID NO: 355016 - DNA, 15 bp, Homo sapiens
aatagagactaatct

SEQ ID NO: 355017 - DNA, 15 bp, Homo sapiens
atagagactaatctt

SEQ ID NO: 355018 - DNA, 15 bp, Homo sapiens
tagagactaatcttc

SEQ ID NO: 355019 - DNA, 15 bp, Homo sapiens
agagactaatcttcg

SEQ ID NO: 355020 - DNA, 15 bp, Homo sapiens
gagactaatcttcga

SEQ ID NO: 355021 - DNA, 15 bp, Homo sapiens
agactaatcttcgaa

SEQ ID NO: 355022 - DNA, 15 bp, Homo sapiens
gactaatcttcgaag

SEQ ID NO: 355023 - DNA, 15 bp, Homo sapiens
actaatcttcgaagt

SEQ ID NO: 355024 - DNA, 15 bp, Homo sapiens
ctaatcttcgaagtg

SEQ ID NO: 355025 - DNA, 15 bp, Homo sapiens
taatcttcgaagtgg

SEQ ID NO: 355026 - DNA, 15 bp, Homo sapiens
aatcttcgaagtggt

SEQ ID NO: 355027 - DNA, 15 bp, Homo sapiens
atcttcgaagtggtc

SEQ ID NO: 355028 - DNA, 15 bp, Homo sapiens
tcttcgaagtggtcc

SEQ ID NO: 355029 - DNA, 15 bp, Homo sapiens
cttcgaagtggtcca

SEQ ID NO: 355030 - DNA, 15 bp, Homo sapiens
ttcgaagtggtccag

SEQ ID NO: 355031 - DNA, 15 bp, Homo sapiens
tcgaagtggtccagt

SEQ ID NO: 355032 - DNA, 15 bp, Homo sapiens
cgaagtggtccagtt

SEQ ID NO: 355033 - DNA, 15 bp, Homo sapiens
gaagtggtccagttg

SEQ ID NO: 355034 - DNA, 15 bp, Homo sapiens
aagtggtccagttgc

SEQ ID NO: 355035 - DNA, 15 bp, Homo sapiens
agtggtccagttgct

SEQ ID NO: 355036 - DNA, 15 bp, Homo sapiens
gtggtccagttgctg

SEQ ID NO: 355037 - DNA, 15 bp, Homo sapiens
tggtccagttgctgg

SEQ ID NO: 355038 - DNA, 15 bp, Homo sapiens
ggtccagttgctgga

SEQ ID NO: 355039 - DNA, 15 bp, Homo sapiens
gtccagttgctggaa

SEQ ID NO: 355040 - DNA, 15 bp, Homo sapiens
tccagttgctggaat

SEQ ID NO: 355041 - DNA, 15 bp, Homo sapiens
ccagttgctggaata

SEQ ID NO: 355042 - DNA, 15 bp, Homo sapiens
cagttgctggaataa

SEQ ID NO: 355043 - DNA, 15 bp, Homo sapiens
agttgctggaataaa

SEQ ID NO: 355044 - DNA, 15 bp, Homo sapiens
gttgctggaataaaa

SEQ ID NO: 355045 - DNA, 15 bp, Homo sapiens
ttgctggaataaaaa

SEQ ID NO: 355046 - DNA, 15 bp, Homo sapiens
tgctggaataaaaac

SEQ ID NO: 355047 - DNA, 15 bp, Homo sapiens
gctggaataaaaact

SEQ ID NO: 355048 - DNA, 15 bp, Homo sapiens
ctggaataaaaactt

SEQ ID NO: 355049 - DNA, 15 bp, Homo sapiens
tggaataaaaacttg

SEQ ID NO: 355050 - DNA, 15 bp, Homo sapiens
ggaataaaaacttgg

SEQ ID NO: 355051 - DNA, 15 bp, Homo sapiens
gaataaaaacttggg

SEQ ID NO: 355052 - DNA, 15 bp, Homo sapiens
aataaaaacttgggt

SEQ ID NO: 355053 - DNA, 15 bp, Homo sapiens
ataaaaacttgggtg

SEQ ID NO: 355054 - DNA, 15 bp, Homo sapiens
taaaaacttgggtgc

SEQ ID NO: 355055 - DNA, 15 bp, Homo sapiens
aaaaacttgggtgca

SEQ ID NO: 355056 - DNA, 15 bp, Homo sapiens
aaaacttgggtgcag

SEQ ID NO: 355057 - DNA, 15 bp, Homo sapiens
aaacttgggtgcaga

SEQ ID NO: 355058 - DNA, 15 bp, Homo sapiens
aacttgggtgcagac

SEQ ID NO: 355059 - DNA, 15 bp, Homo sapiens
acttgggtgcagaca

SEQ ID NO: 355060 - DNA, 15 bp, Homo sapiens
cttgggtgcagacaa

SEQ ID NO: 355061 - DNA, 15 bp, Homo sapiens
ttgggtgcagacaag

SEQ ID NO: 355062 - DNA, 15 bp, Homo sapiens
tgggtgcagacaaga

SEQ ID NO: 355063 - DNA, 15 bp, Homo sapiens
gggtgcagacaagac

SEQ ID NO: 355064 - DNA, 15 bp, Homo sapiens
ggtgcagacaagact

SEQ ID NO: 355065 - DNA, 15 bp, Homo sapiens
gtgcagacaagacta

SEQ ID NO: 355066 - DNA, 15 bp, Homo sapiens
tgcagacaagactag

SEQ ID NO: 355067 - DNA, 15 bp, Homo sapiens
gcagacaagactagg

SEQ ID NO: 355068 - DNA, 15 bp, Homo sapiens
cagacaagactaggt

SEQ ID NO: 355069 - DNA, 15 bp, Homo sapiens
agacaagactaggtg

SEQ ID NO: 355070 - DNA, 15 bp, Homo sapiens
gacaagactaggtga

SEQ ID NO: 355071 - DNA, 15 bp, Homo sapiens
acaagactaggtgac

SEQ ID NO: 355072 - DNA, 15 bp, Homo sapiens
caagactaggtgact

SEQ ID NO: 355073 - DNA, 15 bp, Homo sapiens
aagactaggtgacta

SEQ ID NO: 355074 - DNA, 15 bp, Homo sapiens
agactaggtgactac

SEQ ID NO: 355075 - DNA, 15 bp, Homo sapiens
gactaggtgactacc

SEQ ID NO: 355076 - DNA, 15 bp, Homo sapiens
actaggtgactacca

SEQ ID NO: 355077 - DNA, 15 bp, Homo sapiens
ctaggtgactaccaa

SEQ ID NO: 355078 - DNA, 15 bp, Homo sapiens
taggtgactaccaaa

SEQ ID NO: 355079 - DNA, 15 bp, Homo sapiens
aggtgactaccaaac

SEQ ID NO: 355080 - DNA, 15 bp, Homo sapiens
ggtgactaccaaact

SEQ ID NO: 355081 - DNA, 15 bp, Homo sapiens
gtgactaccaaactc

SEQ ID NO: 355082 - DNA, 15 bp, Homo sapiens
tgactaccaaactca

SEQ ID NO: 355083 - DNA, 15 bp, Homo sapiens
gactaccaaactcaa

SEQ ID NO: 355084 - DNA, 15 bp, Homo sapiens
actaccaaactcaac

SEQ ID NO: 355085 - DNA, 15 bp, Homo sapiens
ctaccaaactcaact

SEQ ID NO: 355086 - DNA, 15 bp, Homo sapiens
taccaaactcaactg

SEQ ID NO: 355087 - DNA, 15 bp, Homo sapiens
accaaactcaactgg

SEQ ID NO: 355088 - DNA, 15 bp, Homo sapiens
ccaaactcaactgga

SEQ ID NO: 355089 - DNA, 15 bp, Homo sapiens
caaactcaactggag

SEQ ID NO: 355090 - DNA, 15 bp, Homo sapiens
aaactcaactggaga

SEQ ID NO: 355091 - DNA, 15 bp, Homo sapiens
aactcaactggagaa

SEQ ID NO: 355092 - DNA, 15 bp, Homo sapiens
actcaactggagaaa

SEQ ID NO: 355093 - DNA, 15 bp, Homo sapiens
ctcaactggagaaac

SEQ ID NO: 355094 - DNA, 15 bp, Homo sapiens
tcaactggagaaact

SEQ ID NO: 355095 - DNA, 15 bp, Homo sapiens
caactggagaaactt

SEQ ID NO: 355096 - DNA, 15 bp, Homo sapiens
aactggagaaactta

SEQ ID NO: 355097 - DNA, 15 bp, Homo sapiens
actggagaaacttag

SEQ ID NO: 355098 - DNA, 15 bp, Homo sapiens
ctggagaaacttagc

SEQ ID NO: 355099 - DNA, 15 bp, Homo sapiens
tggagaaacttagca

SEQ ID NO: 355100 - DNA, 15 bp, Homo sapiens
ggagaaacttagcaa

SEQ ID NO: 355101 - DNA, 15 bp, Homo sapiens
gagaaacttagcaag

SEQ ID NO: 355102 - DNA, 15 bp, Homo sapiens
agaaacttagcaagg

SEQ ID NO: 355103 - DNA, 15 bp, Homo sapiens
gaaacttagcaagga

SEQ ID NO: 355104 - DNA, 15 bp, Homo sapiens
aaacttagcaaggag

SEQ ID NO: 355105 - DNA, 15 bp, Homo sapiens
aacttagcaaggagg

SEQ ID NO: 355106 - DNA, 15 bp, Homo sapiens
acttagcaaggaggt

SEQ ID NO: 355107 - DNA, 15 bp, Homo sapiens
cttagcaaggaggtg

SEQ ID NO: 355108 - DNA, 15 bp, Homo sapiens
ttagcaaggaggtga

SEQ ID NO: 355109 - DNA, 15 bp, Homo sapiens
tagcaaggaggtgag

SEQ ID NO: 355110 - DNA, 15 bp, Homo sapiens
agcaaggaggtgagt

SEQ ID NO: 355111 - DNA, 15 bp, Homo sapiens
gcaaggaggtgagtt

SEQ ID NO: 355112 - DNA, 15 bp, Homo sapiens
caaggaggtgagttt

SEQ ID NO: 355113 - DNA, 15 bp, Homo sapiens
aaggaggtgagtttt

SEQ ID NO: 355114 - DNA, 15 bp, Homo sapiens
aggaggtgagttttt

SEQ ID NO: 355115 - DNA, 15 bp, Homo sapiens
ggaggtgagtttttc

SEQ ID NO: 355116 - DNA, 15 bp, Homo sapiens
gaggtgagtttttca

SEQ ID NO: 355117 - DNA, 15 bp, Homo sapiens
aggtgagtttttcaa

SEQ ID NO: 355118 - DNA, 15 bp, Homo sapiens
ggtgagtttttcaac

SEQ ID NO: 355119 - DNA, 15 bp, Homo sapiens
gtgagtttttcaact

SEQ ID NO: 355120 - DNA, 15 bp, Homo sapiens
tgagtttttcaactt

SEQ ID NO: 355121 - DNA, 15 bp, Homo sapiens
gagtttttcaacttt

SEQ ID NO: 355122 - DNA, 15 bp, Homo sapiens
agtttttcaacttta

SEQ ID NO: 355123 - DNA, 15 bp, Homo sapiens
gtttttcaactttac

SEQ ID NO: 355124 - DNA, 15 bp, Homo sapiens
tttttcaactttact

SEQ ID NO: 355125 - DNA, 15 bp, Homo sapiens
ttttcaactttacta

SEQ ID NO: 355126 - DNA, 15 bp, Homo sapiens
tttcaactttactac

SEQ ID NO: 355127 - DNA, 15 bp, Homo sapiens
ttcaactttactacc

SEQ ID NO: 355128 - DNA, 15 bp, Homo sapiens
tcaactttactacct

SEQ ID NO: 355129 - DNA, 15 bp, Homo sapiens
caactttactaccta

SEQ ID NO: 355130 - DNA, 15 bp, Homo sapiens
aactttactacctac

SEQ ID NO: 355131 - DNA, 15 bp, Homo sapiens
actttactacctacg

SEQ ID NO: 355132 - DNA, 15 bp, Homo sapiens
ctttactacctacgg

SEQ ID NO: 355133 - DNA, 15 bp, Homo sapiens
tttactacctacggt

SEQ ID NO: 355134 - DNA, 15 bp, Homo sapiens
ttactacctacggtt

SEQ ID NO: 355135 - DNA, 15 bp, Homo sapiens
tactacctacggttt

SEQ ID NO: 355136 - DNA, 15 bp, Homo sapiens
actacctacggtttt

SEQ ID NO: 355137 - DNA, 15 bp, Homo sapiens
ctacctacggttttc

SEQ ID NO: 355138 - DNA, 15 bp, Homo sapiens
tacctacggttttca

SEQ ID NO: 355139 - DNA, 15 bp, Homo sapiens
acctacggttttcag

SEQ ID NO: 355140 - DNA, 15 bp, Homo sapiens
cctacggttttcagg

SEQ ID NO: 355141 - DNA, 15 bp, Homo sapiens
ctacggttttcagga

SEQ ID NO: 355142 - DNA, 15 bp, Homo sapiens
tacggttttcaggag

SEQ ID NO: 355143 - DNA, 15 bp, Homo sapiens
acggttttcaggaga

SEQ ID NO: 355144 - DNA, 15 bp, Homo sapiens
cggttttcaggagat

SEQ ID NO: 355145 - DNA, 15 bp, Homo sapiens
ggttttcaggagatg

SEQ ID NO: 355146 - DNA, 15 bp, Homo sapiens
gttttcaggagatgt

SEQ ID NO: 355147 - DNA, 15 bp, Homo sapiens
ttttcaggagatgta

SEQ ID NO: 355148 - DNA, 15 bp, Homo sapiens
tttcaggagatgtag

SEQ ID NO: 355149 - DNA, 15 bp, Homo sapiens
ttcaggagatgtaga

SEQ ID NO: 355150 - DNA, 15 bp, Homo sapiens
tcaggagatgtagac

SEQ ID NO: 355151 - DNA, 15 bp, Homo sapiens
caggagatgtagact

SEQ ID NO: 355152 - DNA, 15 bp, Homo sapiens
aggagatgtagactg

SEQ ID NO: 355153 - DNA, 15 bp, Homo sapiens
ggagatgtagactgt

SEQ ID NO: 355154 - DNA, 15 bp, Homo sapiens
gagatgtagactgta

SEQ ID NO: 355155 - DNA, 15 bp, Homo sapiens
agatgtagactgtag

SEQ ID NO: 355156 - DNA, 15 bp, Homo sapiens
gatgtagactgtagc

SEQ ID NO: 355157 - DNA, 15 bp, Homo sapiens
atgtagactgtagct

SEQ ID NO: 355158 - DNA, 15 bp, Homo sapiens
tgtagactgtagctt

SEQ ID NO: 355159 - DNA, 15 bp, Homo sapiens
gtagactgtagcttc

SEQ ID NO: 355160 - DNA, 15 bp, Homo sapiens
tagactgtagcttct

SEQ ID NO: 355161 - DNA, 15 bp, Homo sapiens
agactgtagcttctc

SEQ ID NO: 355162 - DNA, 15 bp, Homo sapiens
gactgtagcttctct

SEQ ID NO: 355163 - DNA, 15 bp, Homo sapiens
actgtagcttctctc

SEQ ID NO: 355164 - DNA, 15 bp, Homo sapiens
ctgtagcttctctca

SEQ ID NO: 355165 - DNA, 15 bp, Homo sapiens
tgtagcttctctcag

SEQ ID NO: 355166 - DNA, 15 bp, Homo sapiens
gtagcttctctcagc

SEQ ID NO: 355167 - DNA, 15 bp, Homo sapiens
tagcttctctcagct

SEQ ID NO: 355168 - DNA, 15 bp, Homo sapiens
agcttctctcagctg

SEQ ID NO: 355169 - DNA, 15 bp, Homo sapiens
gcttctctcagctga

SEQ ID NO: 355170 - DNA, 15 bp, Homo sapiens
cttctctcagctgac

SEQ ID NO: 355171 - DNA, 15 bp, Homo sapiens
ttctctcagctgact

SEQ ID NO: 355172 - DNA, 15 bp, Homo sapiens
tctctcagctgacta

SEQ ID NO: 355173 - DNA, 15 bp, Homo sapiens
ctctcagctgactaa

SEQ ID NO: 355174 - DNA, 15 bp, Homo sapiens
tctcagctgactaaa

SEQ ID NO: 355175 - DNA, 15 bp, Homo sapiens
ctcagctgactaaat

SEQ ID NO: 355176 - DNA, 15 bp, Homo sapiens
tcagctgactaaatg

SEQ ID NO: 355177 - DNA, 15 bp, Homo sapiens
cagctgactaaatgt

SEQ ID NO: 355178 - DNA, 15 bp, Homo sapiens
agctgactaaatgta

SEQ ID NO: 355179 - DNA, 15 bp, Homo sapiens
gctgactaaatgtat

SEQ ID NO: 355180 - DNA, 15 bp, Homo sapiens
ctgactaaatgtatt

SEQ ID NO: 355181 - DNA, 15 bp, Homo sapiens
tgactaaatgtatta

SEQ ID NO: 355182 - DNA, 15 bp, Homo sapiens
gactaaatgtattat

SEQ ID NO: 355183 - DNA, 15 bp, Homo sapiens
actaaatgtattatg

SEQ ID NO: 355184 - DNA, 15 bp, Homo sapiens
ctaaatgtattatga

SEQ ID NO: 355185 - DNA, 15 bp, Homo sapiens
taaatgtattatgac

SEQ ID NO: 355186 - DNA, 15 bp, Homo sapiens
aaatgtattatgacc

SEQ ID NO: 355187 - DNA, 15 bp, Homo sapiens
aatgtattatgaccc

SEQ ID NO: 355188 - DNA, 15 bp, Homo sapiens
atgtattatgaccca

SEQ ID NO: 355189 - DNA, 15 bp, Homo sapiens
tgtattatgacccat

SEQ ID NO: 355190 - DNA, 15 bp, Homo sapiens
gtattatgacccatc

SEQ ID NO: 355191 - DNA, 15 bp, Homo sapiens
tattatgacccatcc

SEQ ID NO: 355192 - DNA, 15 bp, Homo sapiens
attatgacccatcca

SEQ ID NO: 355193 - DNA, 15 bp, Homo sapiens
ttatgacccatccag

SEQ ID NO: 355194 - DNA, 15 bp, Homo sapiens
tatgacccatccagt

SEQ ID NO: 355195 - DNA, 15 bp, Homo sapiens
atgacccatccagtt

SEQ ID NO: 355196 - DNA, 15 bp, Homo sapiens
tgacccatccagttt

SEQ ID NO: 355197 - DNA, 15 bp, Homo sapiens
gacccatccagtttg

SEQ ID NO: 355198 - DNA, 15 bp, Homo sapiens
acccatccagtttga

SEQ ID NO: 355199 - DNA, 15 bp, Homo sapiens
cccatccagtttgaa

SEQ ID NO: 355200 - DNA, 15 bp, Homo sapiens
ccatccagtttgaaa

SEQ ID NO: 355201 - DNA, 15 bp, Homo sapiens
catccagtttgaaaa

SEQ ID NO: 355202 - DNA, 15 bp, Homo sapiens
atccagtttgaaaaa

SEQ ID NO: 355203 - DNA, 15 bp, Homo sapiens
tccagtttgaaaaac

SEQ ID NO: 355204 - DNA, 15 bp, Homo sapiens
ccagtttgaaaaacg

SEQ ID NO: 355205 - DNA, 15 bp, Homo sapiens
cagtttgaaaaacga

SEQ ID NO: 355206 - DNA, 15 bp, Homo sapiens
agtttgaaaaacgat

SEQ ID NO: 355207 - DNA, 15 bp, Homo sapiens
gtttgaaaaacgatg

SEQ ID NO: 355208 - DNA, 15 bp, Homo sapiens
tttgaaaaacgatgg

SEQ ID NO: 355209 - DNA, 15 bp, Homo sapiens
ttgaaaaacgatggt

SEQ ID NO: 355210 - DNA, 15 bp, Homo sapiens
tgaaaaacgatggtc

SEQ ID NO: 355211 - DNA, 15 bp, Homo sapiens
gaaaaacgatggtct

SEQ ID NO: 355212 - DNA, 15 bp, Homo sapiens
aaaaacgatggtcta

SEQ ID NO: 355213 - DNA, 15 bp, Homo sapiens
aaaacgatggtctag

SEQ ID NO: 355214 - DNA, 15 bp, Homo sapiens
aaacgatggtctaga

SEQ ID NO: 355215 - DNA, 15 bp, Homo sapiens
aacgatggtctagaa

SEQ ID NO: 355216 - DNA, 15 bp, Homo sapiens
acgatggtctagaat

SEQ ID NO: 355217 - DNA, 15 bp, Homo sapiens
cgatggtctagaata

SEQ ID NO: 355218 - DNA, 15 bp, Homo sapiens
gatggtctagaataa

SEQ ID NO: 355219 - DNA, 15 bp, Homo sapiens
atggtctagaataac

SEQ ID NO: 355220 - DNA, 15 bp, Homo sapiens
tggtctagaataact

SEQ ID NO: 355221 - DNA, 15 bp, Homo sapiens
ggtctagaataactc

SEQ ID NO: 355222 - DNA, 15 bp, Homo sapiens
gtctagaataactcc

SEQ ID NO: 355223 - DNA, 15 bp, Homo sapiens
tctagaataactcca

SEQ ID NO: 355224 - DNA, 15 bp, Homo sapiens
ctagaataactccag

SEQ ID NO: 355225 - DNA, 15 bp, Homo sapiens
tagaataactccagc

SEQ ID NO: 355226 - DNA, 15 bp, Homo sapiens
agaataactccagca

SEQ ID NO: 355227 - DNA, 15 bp, Homo sapiens
gaataactccagcat

SEQ ID NO: 355228 - DNA, 15 bp, Homo sapiens
aataactccagcatg

SEQ ID NO: 355229 - DNA, 15 bp, Homo sapiens
ataactccagcatgg

SEQ ID NO: 355230 - DNA, 15 bp, Homo sapiens
taactccagcatggg

SEQ ID NO: 355231 - DNA, 15 bp, Homo sapiens
aactccagcatgggt

SEQ ID NO: 355232 - DNA, 15 bp, Homo sapiens
actccagcatgggta

SEQ ID NO: 355233 - DNA, 15 bp, Homo sapiens
ctccagcatgggtag

SEQ ID NO: 355234 - DNA, 15 bp, Homo sapiens
tccagcatgggtagt

SEQ ID NO: 355235 - DNA, 15 bp, Homo sapiens
ccagcatgggtagtg

SEQ ID NO: 355236 - DNA, 15 bp, Homo sapiens
cagcatgggtagtga

SEQ ID NO: 355237 - DNA, 15 bp, Homo sapiens
agcatgggtagtgag

SEQ ID NO: 355238 - DNA, 15 bp, Homo sapiens
gcatgggtagtgagc

SEQ ID NO: 355239 - DNA, 15 bp, Homo sapiens
catgggtagtgagct

SEQ ID NO: 355240 - DNA, 15 bp, Homo sapiens
atgggtagtgagctg

SEQ ID NO: 355241 - DNA, 15 bp, Homo sapiens
tgggtagtgagctgg

SEQ ID NO: 355242 - DNA, 15 bp, Homo sapiens
gggtagtgagctggg

SEQ ID NO: 355243 - DNA, 15 bp, Homo sapiens
ggtagtgagctgggg

SEQ ID NO: 355244 - DNA, 15 bp, Homo sapiens
gtagtgagctggggc

SEQ ID NO: 355245 - DNA, 15 bp, Homo sapiens
tagtgagctggggcc

SEQ ID NO: 355246 - DNA, 15 bp, Homo sapiens
agtgagctggggcca

SEQ ID NO: 355247 - DNA, 15 bp, Homo sapiens
gtgagctggggccaa

SEQ ID NO: 355248 - DNA, 15 bp, Homo sapiens
tgagctggggccaaa

SEQ ID NO: 355249 - DNA, 15 bp, Homo sapiens
gagctggggccaaaa

SEQ ID NO: 355250 - DNA, 15 bp, Homo sapiens
agctggggccaaaaa

SEQ ID NO: 355251 - DNA, 15 bp, Homo sapiens
gctggggccaaaaaa

SEQ ID NO: 355252 - DNA, 15 bp, Homo sapiens
ctggggccaaaaaaa

SEQ ID NO: 355253 - DNA, 15 bp, Homo sapiens
tggggccaaaaaaaa

SEQ ID NO: 355254 - DNA, 15 bp, Homo sapiens
ggggccaaaaaaaaa

SEQ ID NO: 355255 - DNA, 15 bp, Homo sapiens
gggccaaaaaaaaag

SEQ ID NO: 355256 - DNA, 15 bp, Homo sapiens
ggccaaaaaaaaagg

SEQ ID NO: 355257 - DNA, 15 bp, Homo sapiens
gccaaaaaaaaaggc

SEQ ID NO: 355258 - DNA, 15 bp, Homo sapiens
ccaaaaaaaaaggca

SEQ ID NO: 355259 - DNA, 15 bp, Homo sapiens
caaaaaaaaaggcat

SEQ ID NO: 355260 - DNA, 15 bp, Homo sapiens
aaaaaaaaaggcatc

SEQ ID NO: 355261 - DNA, 15 bp, Homo sapiens
aaaaaaaaggcatca

SEQ ID NO: 355262 - DNA, 15 bp, Homo sapiens
aaaaaaaggcatcat

SEQ ID NO: 355263 - DNA, 15 bp, Homo sapiens
aaaaaaggcatcatt

SEQ ID NO: 355264 - DNA, 15 bp, Homo sapiens
aaaaaggcatcattt

SEQ ID NO: 355265 - DNA, 15 bp, Homo sapiens
aaaaggcatcatttt

SEQ ID NO: 355266 - DNA, 15 bp, Homo sapiens
aaaggcatcattttt

SEQ ID NO: 355267 - DNA, 15 bp, Homo sapiens
aaggcatcatttttt

SEQ ID NO: 355268 - DNA, 15 bp, Homo sapiens
aggcatcatttttta

SEQ ID NO: 355269 - DNA, 15 bp, Homo sapiens
ggcatcattttttaa

SEQ ID NO: 355270 - DNA, 15 bp, Homo sapiens
gcatcattttttaaa

SEQ ID NO: 355271 - DNA, 15 bp, Homo sapiens
catcattttttaaat

SEQ ID NO: 355272 - DNA, 15 bp, Homo sapiens
atcattttttaaatt

SEQ ID NO: 355273 - DNA, 15 bp, Homo sapiens
tcattttttaaatta

SEQ ID NO: 355274 - DNA, 15 bp, Homo sapiens
cattttttaaattaa

SEQ ID NO: 355275 - DNA, 15 bp, Homo sapiens
attttttaaattaag

SEQ ID NO: 355276 - DNA, 15 bp, Homo sapiens
ttttttaaattaaga

SEQ ID NO: 355277 - DNA, 15 bp, Homo sapiens
tttttaaattaagag

SEQ ID NO: 355278 - DNA, 15 bp, Homo sapiens
ttttaaattaagaga

SEQ ID NO: 355279 - DNA, 15 bp, Homo sapiens
tttaaattaagagag

SEQ ID NO: 355280 - DNA, 15 bp, Homo sapiens
ttaaattaagagagg

SEQ ID NO: 355281 - DNA, 15 bp, Homo sapiens
taaattaagagaggg

SEQ ID NO: 355282 - DNA, 15 bp, Homo sapiens
aaattaagagagggt

SEQ ID NO: 355283 - DNA, 15 bp, Homo sapiens
aattaagagagggtg

SEQ ID NO: 355284 - DNA, 15 bp, Homo sapiens
attaagagagggtgc

SEQ ID NO: 355285 - DNA, 15 bp, Homo sapiens
ttaagagagggtgct

SEQ ID NO: 355286 - DNA, 15 bp, Homo sapiens
taagagagggtgctg

SEQ ID NO: 355287 - DNA, 15 bp, Homo sapiens
aagagagggtgctga

SEQ ID NO: 355288 - DNA, 15 bp, Homo sapiens
agagagggtgctgat

SEQ ID NO: 355289 - DNA, 15 bp, Homo sapiens
gagagggtgctgatt

SEQ ID NO: 355290 - DNA, 15 bp, Homo sapiens
agagggtgctgattg

SEQ ID NO: 355291 - DNA, 15 bp, Homo sapiens
gagggtgctgattgt

SEQ ID NO: 355292 - DNA, 15 bp, Homo sapiens
agggtgctgattgtc

SEQ ID NO: 355293 - DNA, 15 bp, Homo sapiens
gggtgctgattgtcc

SEQ ID NO: 355294 - DNA, 15 bp, Homo sapiens
ggtgctgattgtcca

SEQ ID NO: 355295 - DNA, 15 bp, Homo sapiens
gtgctgattgtccag

SEQ ID NO: 355296 - DNA, 15 bp, Homo sapiens
tgctgattgtccagt

SEQ ID NO: 355297 - DNA, 15 bp, Homo sapiens
gctgattgtccagtt

SEQ ID NO: 355298 - DNA, 15 bp, Homo sapiens
ctgattgtccagttt

SEQ ID NO: 355299 - DNA, 15 bp, Homo sapiens
tgattgtccagtttg

SEQ ID NO: 355300 - DNA, 15 bp, Homo sapiens
gattgtccagtttgg

SEQ ID NO: 355301 - DNA, 15 bp, Homo sapiens
attgtccagtttggc

SEQ ID NO: 355302 - DNA, 15 bp, Homo sapiens
ttgtccagtttggct

SEQ ID NO: 355303 - DNA, 15 bp, Homo sapiens
tgtccagtttggctc

SEQ ID NO: 355304 - DNA, 15 bp, Homo sapiens
gtccagtttggctca

SEQ ID NO: 355305 - DNA, 15 bp, Homo sapiens
tccagtttggctcag

SEQ ID NO: 355306 - DNA, 15 bp, Homo sapiens
ccagtttggctcagg

SEQ ID NO: 355307 - DNA, 15 bp, Homo sapiens
cagtttggctcaggg

SEQ ID NO: 355308 - DNA, 15 bp, Homo sapiens
agtttggctcagggc

SEQ ID NO: 355309 - DNA, 15 bp, Homo sapiens
gtttggctcagggct

SEQ ID NO: 355310 - DNA, 15 bp, Homo sapiens
tttggctcagggctt

SEQ ID NO: 355311 - DNA, 15 bp, Homo sapiens
ttggctcagggctta

SEQ ID NO: 355312 - DNA, 15 bp, Homo sapiens
tggctcagggcttat

SEQ ID NO: 355313 - DNA, 15 bp, Homo sapiens
ggctcagggcttatc

SEQ ID NO: 355314 - DNA, 15 bp, Homo sapiens
gctcagggcttatcc

SEQ ID NO: 355315 - DNA, 15 bp, Homo sapiens
ctcagggcttatcca

SEQ ID NO: 355316 - DNA, 15 bp, Homo sapiens
tcagggcttatccat

SEQ ID NO: 355317 - DNA, 15 bp, Homo sapiens
cagggcttatccatt

SEQ ID NO: 355318 - DNA, 15 bp, Homo sapiens
agggcttatccattc

SEQ ID NO: 355319 - DNA, 15 bp, Homo sapiens
gggcttatccattct

SEQ ID NO: 355320 - DNA, 15 bp, Homo sapiens
ggcttatccattctt

SEQ ID NO: 355321 - DNA, 15 bp, Homo sapiens
gcttatccattcttg

SEQ ID NO: 355322 - DNA, 15 bp, Homo sapiens
cttatccattcttgt

SEQ ID NO: 355323 - DNA, 15 bp, Homo sapiens
ttatccattcttgtc

SEQ ID NO: 355324 - DNA, 15 bp, Homo sapiens
tatccattcttgtct

SEQ ID NO: 355325 - DNA, 15 bp, Homo sapiens
atccattcttgtctt

SEQ ID NO: 355326 - DNA, 15 bp, Homo sapiens
tccattcttgtctta

SEQ ID NO: 355327 - DNA, 15 bp, Homo sapiens
ccattcttgtcttaa

SEQ ID NO: 355328 - DNA, 15 bp, Homo sapiens
cattcttgtcttaaa

SEQ ID NO: 355329 - DNA, 15 bp, Homo sapiens
attcttgtcttaaat

SEQ ID NO: 355330 - DNA, 15 bp, Homo sapiens
ttcttgtcttaaatc

SEQ ID NO: 355331 - DNA, 15 bp, Homo sapiens
tcttgtcttaaatct

SEQ ID NO: 355332 - DNA, 15 bp, Homo sapiens
cttgtcttaaatctg

SEQ ID NO: 355333 - DNA, 15 bp, Homo sapiens
ttgtcttaaatctgg

SEQ ID NO: 355334 - DNA, 15 bp, Homo sapiens
tgtcttaaatctggc

SEQ ID NO: 355335 - DNA, 15 bp, Homo sapiens
gtcttaaatctggct

SEQ ID NO: 355336 - DNA, 15 bp, Homo sapiens
tcttaaatctggctt

SEQ ID NO: 355337 - DNA, 15 bp, Homo sapiens
cttaaatctggcttg

SEQ ID NO: 355338 - DNA, 15 bp, Homo sapiens
ttaaatctggcttga

SEQ ID NO: 355339 - DNA, 15 bp, Homo sapiens
taaatctggcttgaa

SEQ ID NO: 355340 - DNA, 15 bp, Homo sapiens
aaatctggcttgaaa

SEQ ID NO: 355341 - DNA, 15 bp, Homo sapiens
aatctggcttgaaac

SEQ ID NO: 355342 - DNA, 15 bp, Homo sapiens
atctggcttgaaaca

SEQ ID NO: 355343 - DNA, 15 bp, Homo sapiens
tctggcttgaaacac

SEQ ID NO: 355344 - DNA, 15 bp, Homo sapiens
ctggcttgaaacaca

SEQ ID NO: 355345 - DNA, 15 bp, Homo sapiens
tggcttgaaacacat

SEQ ID NO: 355346 - DNA, 15 bp, Homo sapiens
ggcttgaaacacatt

SEQ ID NO: 355347 - DNA, 15 bp, Homo sapiens
gcttgaaacacattt

SEQ ID NO: 355348 - DNA, 15 bp, Homo sapiens
cttgaaacacattta

SEQ ID NO: 355349 - DNA, 15 bp, Homo sapiens
ttgaaacacatttat

SEQ ID NO: 355350 - DNA, 15 bp, Homo sapiens
tgaaacacatttatg

SEQ ID NO: 355351 - DNA, 15 bp, Homo sapiens
gaaacacatttatga

SEQ ID NO: 355352 - DNA, 15 bp, Homo sapiens
aaacacatttatgac

SEQ ID NO: 355353 - DNA, 15 bp, Homo sapiens
aacacatttatgaca

SEQ ID NO: 355354 - DNA, 15 bp, Homo sapiens
acacatttatgacac

SEQ ID NO: 355355 - DNA, 15 bp, Homo sapiens
cacatttatgacact

SEQ ID NO: 355356 - DNA, 15 bp, Homo sapiens
acatttatgacactt

SEQ ID NO: 355357 - DNA, 15 bp, Homo sapiens
catttatgacacttg

SEQ ID NO: 355358 - DNA, 15 bp, Homo sapiens
atttatgacacttgc

SEQ ID NO: 355359 - DNA, 15 bp, Homo sapiens
tttatgacacttgct

SEQ ID NO: 355360 - DNA, 15 bp, Homo sapiens
ttatgacacttgctt

SEQ ID NO: 355361 - DNA, 15 bp, Homo sapiens
tatgacacttgcttt

SEQ ID NO: 355362 - DNA, 15 bp, Homo sapiens
atgacacttgcttta

SEQ ID NO: 355363 - DNA, 15 bp, Homo sapiens
tgacacttgctttac

SEQ ID NO: 355364 - DNA, 15 bp, Homo sapiens
gacacttgctttacc

SEQ ID NO: 355365 - DNA, 15 bp, Homo sapiens
acacttgctttaccc

SEQ ID NO: 355366 - DNA, 15 bp, Homo sapiens
cacttgctttacccc

SEQ ID NO: 355367 - DNA, 15 bp, Homo sapiens
acttgctttacccct

SEQ ID NO: 355368 - DNA, 15 bp, Homo sapiens
cttgctttaccccta

SEQ ID NO: 355369 - DNA, 15 bp, Homo sapiens
ttgctttacccctaa

SEQ ID NO: 355370 - DNA, 15 bp, Homo sapiens
tgctttacccctaag

SEQ ID NO: 355371 - DNA, 15 bp, Homo sapiens
gctttacccctaaga

SEQ ID NO: 355372 - DNA, 15 bp, Homo sapiens
ctttacccctaagac

SEQ ID NO: 355373 - DNA, 15 bp, Homo sapiens
tttacccctaagaca

SEQ ID NO: 355374 - DNA, 15 bp, Homo sapiens
ttacccctaagacat

SEQ ID NO: 355375 - DNA, 15 bp, Homo sapiens
tacccctaagacatt

SEQ ID NO: 355376 - DNA, 15 bp, Homo sapiens
acccctaagacattt

SEQ ID NO: 355377 - DNA, 15 bp, Homo sapiens
cccctaagacatttg

SEQ ID NO: 355378 - DNA, 15 bp, Homo sapiens
ccctaagacatttga

SEQ ID NO: 355379 - DNA, 15 bp, Homo sapiens
cctaagacatttgag

SEQ ID NO: 355380 - DNA, 15 bp, Homo sapiens
ctaagacatttgagt

SEQ ID NO: 355381 - DNA, 15 bp, Homo sapiens
taagacatttgagtg

SEQ ID NO: 355382 - DNA, 15 bp, Homo sapiens
aagacatttgagtgg

SEQ ID NO: 355383 - DNA, 15 bp, Homo sapiens
agacatttgagtggg

SEQ ID NO: 355384 - DNA, 15 bp, Homo sapiens
gacatttgagtggga

SEQ ID NO: 355385 - DNA, 15 bp, Homo sapiens
acatttgagtgggac

SEQ ID NO: 355386 - DNA, 15 bp, Homo sapiens
catttgagtgggacc

SEQ ID NO: 355387 - DNA, 15 bp, Homo sapiens
atttgagtgggacca

SEQ ID NO: 355388 - DNA, 15 bp, Homo sapiens
tttgagtgggaccat

SEQ ID NO: 355389 - DNA, 15 bp, Homo sapiens
ttgagtgggaccatt

SEQ ID NO: 355390 - DNA, 15 bp, Homo sapiens
tgagtgggaccattt

SEQ ID NO: 355391 - DNA, 15 bp, Homo sapiens
gagtgggaccattta

SEQ ID NO: 355392 - DNA, 15 bp, Homo sapiens
agtgggaccatttat

SEQ ID NO: 355393 - DNA, 15 bp, Homo sapiens
gtgggaccatttatt

SEQ ID NO: 355394 - DNA, 15 bp, Homo sapiens
tgggaccatttattt

SEQ ID NO: 355395 - DNA, 15 bp, Homo sapiens
gggaccatttattta

SEQ ID NO: 355396 - DNA, 15 bp, Homo sapiens
ggaccatttatttac

SEQ ID NO: 355397 - DNA, 15 bp, Homo sapiens
gaccatttatttact

SEQ ID NO: 355398 - DNA, 15 bp, Homo sapiens
accatttatttactt

SEQ ID NO: 355399 - DNA, 15 bp, Homo sapiens
ccatttatttactta

SEQ ID NO: 355400 - DNA, 15 bp, Homo sapiens
catttatttacttag

SEQ ID NO: 355401 - DNA, 15 bp, Homo sapiens
atttatttacttagc

SEQ ID NO: 355402 - DNA, 15 bp, Homo sapiens
tttatttacttagca

SEQ ID NO: 355403 - DNA, 15 bp, Homo sapiens
ttatttacttagcaa

SEQ ID NO: 355404 - DNA, 15 bp, Homo sapiens
tatttacttagcaaa

SEQ ID NO: 355405 - DNA, 15 bp, Homo sapiens
atttacttagcaaat

SEQ ID NO: 355406 - DNA, 15 bp, Homo sapiens
tttacttagcaaata

SEQ ID NO: 355407 - DNA, 15 bp, Homo sapiens
ttacttagcaaatat

SEQ ID NO: 355408 - DNA, 15 bp, Homo sapiens
tacttagcaaatatt

SEQ ID NO: 355409 - DNA, 15 bp, Homo sapiens
acttagcaaatattt

SEQ ID NO: 355410 - DNA, 15 bp, Homo sapiens
cttagcaaatatttc

SEQ ID NO: 355411 - DNA, 15 bp, Homo sapiens
ttagcaaatatttct

SEQ ID NO: 355412 - DNA, 15 bp, Homo sapiens
tagcaaatatttctt

SEQ ID NO: 355413 - DNA, 15 bp, Homo sapiens
agcaaatatttctta

SEQ ID NO: 355414 - DNA, 15 bp, Homo sapiens
gcaaatatttcttaa

SEQ ID NO: 355415 - DNA, 15 bp, Homo sapiens
caaatatttcttaat

SEQ ID NO: 355416 - DNA, 15 bp, Homo sapiens
aaatatttcttaatc

SEQ ID NO: 355417 - DNA, 15 bp, Homo sapiens
aatatttcttaatca

SEQ ID NO: 355418 - DNA, 15 bp, Homo sapiens
atatttcttaatcag

SEQ ID NO: 355419 - DNA, 15 bp, Homo sapiens
tatttcttaatcagt

SEQ ID NO: 355420 - DNA, 15 bp, Homo sapiens
atttcttaatcagtt

SEQ ID NO: 355421 - DNA, 15 bp, Homo sapiens
tttcttaatcagttg

SEQ ID NO: 355422 - DNA, 15 bp, Homo sapiens
ttcttaatcagttgc

SEQ ID NO: 355423 - DNA, 15 bp, Homo sapiens
tcttaatcagttgcc

SEQ ID NO: 355424 - DNA, 15 bp, Homo sapiens
cttaatcagttgcca

SEQ ID NO: 355425 - DNA, 15 bp, Homo sapiens
ttaatcagttgccac

SEQ ID NO: 355426 - DNA, 15 bp, Homo sapiens
taatcagttgccacc

SEQ ID NO: 355427 - DNA, 15 bp, Homo sapiens
aatcagttgccacct

SEQ ID NO: 355428 - DNA, 15 bp, Homo sapiens
atcagttgccacctg

SEQ ID NO: 355429 - DNA, 15 bp, Homo sapiens
tcagttgccacctgt

SEQ ID NO: 355430 - DNA, 15 bp, Homo sapiens
cagttgccacctgtc

SEQ ID NO: 355431 - DNA, 15 bp, Homo sapiens
agttgccacctgtca

SEQ ID NO: 355432 - DNA, 15 bp, Homo sapiens
gttgccacctgtcaa

SEQ ID NO: 355433 - DNA, 15 bp, Homo sapiens
ttgccacctgtcaag

SEQ ID NO: 355434 - DNA, 15 bp, Homo sapiens
tgccacctgtcaagc

SEQ ID NO: 355435 - DNA, 15 bp, Homo sapiens
gccacctgtcaagca

SEQ ID NO: 355436 - DNA, 15 bp, Homo sapiens
ccacctgtcaagcat

SEQ ID NO: 355437 - DNA, 15 bp, Homo sapiens
cacctgtcaagcatc

SEQ ID NO: 355438 - DNA, 15 bp, Homo sapiens
acctgtcaagcatca

SEQ ID NO: 355439 - DNA, 15 bp, Homo sapiens
cctgtcaagcatcat

SEQ ID NO: 355440 - DNA, 15 bp, Homo sapiens
ctgtcaagcatcatt

SEQ ID NO: 355441 - DNA, 15 bp, Homo sapiens
tgtcaagcatcattc

SEQ ID NO: 355442 - DNA, 15 bp, Homo sapiens
gtcaagcatcattct

SEQ ID NO: 355443 - DNA, 15 bp, Homo sapiens
tcaagcatcattcta

SEQ ID NO: 355444 - DNA, 15 bp, Homo sapiens
caagcatcattctag

SEQ ID NO: 355445 - DNA, 15 bp, Homo sapiens
aagcatcattctagg

SEQ ID NO: 355446 - DNA, 15 bp, Homo sapiens
agcatcattctaggc

SEQ ID NO: 355447 - DNA, 15 bp, Homo sapiens
gcatcattctaggca

SEQ ID NO: 355448 - DNA, 15 bp, Homo sapiens
catcattctaggcac

SEQ ID NO: 355449 - DNA, 15 bp, Homo sapiens
atcattctaggcact

SEQ ID NO: 355450 - DNA, 15 bp, Homo sapiens
tcattctaggcactg

SEQ ID NO: 355451 - DNA, 15 bp, Homo sapiens
cattctaggcactgc

SEQ ID NO: 355452 - DNA, 15 bp, Homo sapiens
attctaggcactgca

SEQ ID NO: 355453 - DNA, 15 bp, Homo sapiens
ttctaggcactgcag

SEQ ID NO: 355454 - DNA, 15 bp, Homo sapiens
tctaggcactgcagg

SEQ ID NO: 355455 - DNA, 15 bp, Homo sapiens
ctaggcactgcaggt

SEQ ID NO: 355456 - DNA, 15 bp, Homo sapiens
taggcactgcaggta

SEQ ID NO: 355457 - DNA, 15 bp, Homo sapiens
aggcactgcaggtac

SEQ ID NO: 355458 - DNA, 15 bp, Homo sapiens
ggcactgcaggtaca

SEQ ID NO: 355459 - DNA, 15 bp, Homo sapiens
gcactgcaggtacag

SEQ ID NO: 355460 - DNA, 15 bp, Homo sapiens
cactgcaggtacagc

SEQ ID NO: 355461 - DNA, 15 bp, Homo sapiens
actgcaggtacagca

SEQ ID NO: 355462 - DNA, 15 bp, Homo sapiens
ctgcaggtacagcat

SEQ ID NO: 355463 - DNA, 15 bp, Homo sapiens
tgcaggtacagcatt

SEQ ID NO: 355464 - DNA, 15 bp, Homo sapiens
gcaggtacagcattg

SEQ ID NO: 355465 - DNA, 15 bp, Homo sapiens
caggtacagcattga

SEQ ID NO: 355466 - DNA, 15 bp, Homo sapiens
aggtacagcattgaa

SEQ ID NO: 355467 - DNA, 15 bp, Homo sapiens
ggtacagcattgaac

SEQ ID NO: 355468 - DNA, 15 bp, Homo sapiens
gtacagcattgaaca

SEQ ID NO: 355469 - DNA, 15 bp, Homo sapiens
tacagcattgaacaa

SEQ ID NO: 355470 - DNA, 15 bp, Homo sapiens
acagcattgaacaag

SEQ ID NO: 355471 - DNA, 15 bp, Homo sapiens
cagcattgaacaagg

SEQ ID NO: 355472 - DNA, 15 bp, Homo sapiens
agcattgaacaagga

SEQ ID NO: 355473 - DNA, 15 bp, Homo sapiens
gcattgaacaaggaa

SEQ ID NO: 355474 - DNA, 15 bp, Homo sapiens
cattgaacaaggaag

SEQ ID NO: 355475 - DNA, 15 bp, Homo sapiens
attgaacaaggaaga

SEQ ID NO: 355476 - DNA, 15 bp, Homo sapiens
ttgaacaaggaagaa

SEQ ID NO: 355477 - DNA, 15 bp, Homo sapiens
tgaacaaggaagaag

SEQ ID NO: 355478 - DNA, 15 bp, Homo sapiens
gaacaaggaagaaga

SEQ ID NO: 355479 - DNA, 15 bp, Homo sapiens
aacaaggaagaagaa

SEQ ID NO: 355480 - DNA, 15 bp, Homo sapiens
acaaggaagaagaaa

SEQ ID NO: 355481 - DNA, 15 bp, Homo sapiens
caaggaagaagaaac

SEQ ID NO: 355482 - DNA, 15 bp, Homo sapiens
aaggaagaagaaact

SEQ ID NO: 355483 - DNA, 15 bp, Homo sapiens
aggaagaagaaactc

SEQ ID NO: 355484 - DNA, 15 bp, Homo sapiens
ggaagaagaaactcc

SEQ ID NO: 355485 - DNA, 15 bp, Homo sapiens
gaagaagaaactcct

SEQ ID NO: 355486 - DNA, 15 bp, Homo sapiens
aagaagaaactcctc

SEQ ID NO: 355487 - DNA, 15 bp, Homo sapiens
agaagaaactcctct

SEQ ID NO: 355488 - DNA, 15 bp, Homo sapiens
gaagaaactcctctt

SEQ ID NO: 355489 - DNA, 15 bp, Homo sapiens
aagaaactcctctta

SEQ ID NO: 355490 - DNA, 15 bp, Homo sapiens
agaaactcctcttaa

SEQ ID NO: 355491 - DNA, 15 bp, Homo sapiens
gaaactcctcttaag

SEQ ID NO: 355492 - DNA, 15 bp, Homo sapiens
aaactcctcttaagg

SEQ ID NO: 355493 - DNA, 15 bp, Homo sapiens
aactcctcttaagga

SEQ ID NO: 355494 - DNA, 15 bp, Homo sapiens
actcctcttaaggag

SEQ ID NO: 355495 - DNA, 15 bp, Homo sapiens
ctcctcttaaggagc

SEQ ID NO: 355496 - DNA, 15 bp, Homo sapiens
tcctcttaaggagct

SEQ ID NO: 355497 - DNA, 15 bp, Homo sapiens
cctcttaaggagctt

SEQ ID NO: 355498 - DNA, 15 bp, Homo sapiens
ctcttaaggagctta

SEQ ID NO: 355499 - DNA, 15 bp, Homo sapiens
tcttaaggagcttac

SEQ ID NO: 355500 - DNA, 15 bp, Homo sapiens
cttaaggagcttaca

SEQ ID NO: 355501 - DNA, 15 bp, Homo sapiens
ttaaggagcttacat

SEQ ID NO: 355502 - DNA, 15 bp, Homo sapiens
taaggagcttacatt

SEQ ID NO: 355503 - DNA, 15 bp, Homo sapiens
aaggagcttacattc

SEQ ID NO: 355504 - DNA, 15 bp, Homo sapiens
aggagcttacattct

SEQ ID NO: 355505 - DNA, 15 bp, Homo sapiens
ggagcttacattcta

SEQ ID NO: 355506 - DNA, 15 bp, Homo sapiens
gagcttacattctag

SEQ ID NO: 355507 - DNA, 15 bp, Homo sapiens
agcttacattctagt

SEQ ID NO: 355508 - DNA, 15 bp, Homo sapiens
gcttacattctagtg

SEQ ID NO: 355509 - DNA, 15 bp, Homo sapiens
cttacattctagtga

SEQ ID NO: 355510 - DNA, 15 bp, Homo sapiens
ttacattctagtgag

SEQ ID NO: 355511 - DNA, 15 bp, Homo sapiens
tacattctagtgagg

SEQ ID NO: 355512 - DNA, 15 bp, Homo sapiens
acattctagtgaggc

SEQ ID NO: 355513 - DNA, 15 bp, Homo sapiens
cattctagtgaggca

SEQ ID NO: 355514 - DNA, 15 bp, Homo sapiens
attctagtgaggcag

SEQ ID NO: 355515 - DNA, 15 bp, Homo sapiens
ttctagtgaggcaga

SEQ ID NO: 355516 - DNA, 15 bp, Homo sapiens
tctagtgaggcagat

SEQ ID NO: 355517 - DNA, 15 bp, Homo sapiens
ctagtgaggcagatg

SEQ ID NO: 355518 - DNA, 15 bp, Homo sapiens
tagtgaggcagatgg

SEQ ID NO: 355519 - DNA, 15 bp, Homo sapiens
agtgaggcagatgga

SEQ ID NO: 355520 - DNA, 15 bp, Homo sapiens
gtgaggcagatggat

SEQ ID NO: 355521 - DNA, 15 bp, Homo sapiens
tgaggcagatggata

SEQ ID NO: 355522 - DNA, 15 bp, Homo sapiens
gaggcagatggataa

SEQ ID NO: 355523 - DNA, 15 bp, Homo sapiens
aggcagatggataat

SEQ ID NO: 355524 - DNA, 15 bp, Homo sapiens
ggcagatggataatg

SEQ ID NO: 355525 - DNA, 15 bp, Homo sapiens
gcagatggataatga

SEQ ID NO: 355526 - DNA, 15 bp, Homo sapiens
cagatggataatgaa

SEQ ID NO: 355527 - DNA, 15 bp, Homo sapiens
agatggataatgaat

SEQ ID NO: 355528 - DNA, 15 bp, Homo sapiens
gatggataatgaata

SEQ ID NO: 355529 - DNA, 15 bp, Homo sapiens
atggataatgaataa

SEQ ID NO: 355530 - DNA, 15 bp, Homo sapiens
tggataatgaataat

SEQ ID NO: 355531 - DNA, 15 bp, Homo sapiens
ggataatgaataata

SEQ ID NO: 355532 - DNA, 15 bp, Homo sapiens
gataatgaataatat

SEQ ID NO: 355533 - DNA, 15 bp, Homo sapiens
ataatgaataatatc

SEQ ID NO: 355534 - DNA, 15 bp, Homo sapiens
taatgaataatatca

SEQ ID NO: 355535 - DNA, 15 bp, Homo sapiens
aatgaataatatcat

SEQ ID NO: 355536 - DNA, 15 bp, Homo sapiens
atgaataatatcatg

SEQ ID NO: 355537 - DNA, 15 bp, Homo sapiens
tgaataatatcatgg

SEQ ID NO: 355538 - DNA, 15 bp, Homo sapiens
gaataatatcatgga

SEQ ID NO: 355539 - DNA, 15 bp, Homo sapiens
aataatatcatggag

SEQ ID NO: 355540 - DNA, 15 bp, Homo sapiens
ataatatcatggagg

SEQ ID NO: 355541 - DNA, 15 bp, Homo sapiens
taatatcatggagga

SEQ ID NO: 355542 - DNA, 15 bp, Homo sapiens
aatatcatggaggag

SEQ ID NO: 355543 - DNA, 15 bp, Homo sapiens
atatcatggaggagt

SEQ ID NO: 355544 - DNA, 15 bp, Homo sapiens
tatcatggaggagta

SEQ ID NO: 355545 - DNA, 15 bp, Homo sapiens
atcatggaggagtag

SEQ ID NO: 355546 - DNA, 15 bp, Homo sapiens
tcatggaggagtagc

SEQ ID NO: 355547 - DNA, 15 bp, Homo sapiens
catggaggagtagca

SEQ ID NO: 355548 - DNA, 15 bp, Homo sapiens
atggaggagtagcaa

SEQ ID NO: 355549 - DNA, 15 bp, Homo sapiens
tggaggagtagcaag

SEQ ID NO: 355550 - DNA, 15 bp, Homo sapiens
ggaggagtagcaagg

SEQ ID NO: 355551 - DNA, 15 bp, Homo sapiens
gaggagtagcaagga

SEQ ID NO: 355552 - DNA, 15 bp, Homo sapiens
aggagtagcaaggag

SEQ ID NO: 355553 - DNA, 15 bp, Homo sapiens
ggagtagcaaggagt

SEQ ID NO: 355554 - DNA, 15 bp, Homo sapiens
gagtagcaaggagtt

SEQ ID NO: 355555 - DNA, 15 bp, Homo sapiens
agtagcaaggagtta

SEQ ID NO: 355556 - DNA, 15 bp, Homo sapiens
gtagcaaggagttag

SEQ ID NO: 355557 - DNA, 15 bp, Homo sapiens
tagcaaggagttagg

SEQ ID NO: 355558 - DNA, 15 bp, Homo sapiens
agcaaggagttaggg

SEQ ID NO: 355559 - DNA, 15 bp, Homo sapiens
gcaaggagttagggc

SEQ ID NO: 355560 - DNA, 15 bp, Homo sapiens
caaggagttagggct

SEQ ID NO: 355561 - DNA, 15 bp, Homo sapiens
aaggagttagggcta

SEQ ID NO: 355562 - DNA, 15 bp, Homo sapiens
aggagttagggctag

SEQ ID NO: 355563 - DNA, 15 bp, Homo sapiens
ggagttagggctagg

SEQ ID NO: 355564 - DNA, 15 bp, Homo sapiens
gagttagggctaggt

SEQ ID NO: 355565 - DNA, 15 bp, Homo sapiens
agttagggctaggtg

SEQ ID NO: 355566 - DNA, 15 bp, Homo sapiens
gttagggctaggtgg

SEQ ID NO: 355567 - DNA, 15 bp, Homo sapiens
ttagggctaggtggg

SEQ ID NO: 355568 - DNA, 15 bp, Homo sapiens
tagggctaggtgggt

SEQ ID NO: 355569 - DNA, 15 bp, Homo sapiens
agggctaggtgggtt

SEQ ID NO: 355570 - DNA, 15 bp, Homo sapiens
gggctaggtgggtta

SEQ ID NO: 355571 - DNA, 15 bp, Homo sapiens
ggctaggtgggttat

SEQ ID NO: 355572 - DNA, 15 bp, Homo sapiens
gctaggtgggttatt

SEQ ID NO: 355573 - DNA, 15 bp, Homo sapiens
ctaggtgggttattt

SEQ ID NO: 355574 - DNA, 15 bp, Homo sapiens
taggtgggttatttc

SEQ ID NO: 355575 - DNA, 15 bp, Homo sapiens
aggtgggttatttca

SEQ ID NO: 355576 - DNA, 15 bp, Homo sapiens
ggtgggttatttcaa

SEQ ID NO: 355577 - DNA, 15 bp, Homo sapiens
gtgggttatttcaaa

SEQ ID NO: 355578 - DNA, 15 bp, Homo sapiens
tgggttatttcaaat

SEQ ID NO: 355579 - DNA, 15 bp, Homo sapiens
gggttatttcaaata

SEQ ID NO: 355580 - DNA, 15 bp, Homo sapiens
ggttatttcaaatag

SEQ ID NO: 355581 - DNA, 15 bp, Homo sapiens
gttatttcaaatagg

SEQ ID NO: 355582 - DNA, 15 bp, Homo sapiens
ttatttcaaatagga

SEQ ID NO: 355583 - DNA, 15 bp, Homo sapiens
tatttcaaataggat

SEQ ID NO: 355584 - DNA, 15 bp, Homo sapiens
atttcaaataggatg

SEQ ID NO: 355585 - DNA, 15 bp, Homo sapiens
tttcaaataggatgg

SEQ ID NO: 355586 - DNA, 15 bp, Homo sapiens
ttcaaataggatggt

SEQ ID NO: 355587 - DNA, 15 bp, Homo sapiens
tcaaataggatggtc

SEQ ID NO: 355588 - DNA, 15 bp, Homo sapiens
caaataggatggtca

SEQ ID NO: 355589 - DNA, 15 bp, Homo sapiens
aaataggatggtcag

SEQ ID NO: 355590 - DNA, 15 bp, Homo sapiens
aataggatggtcagg

SEQ ID NO: 355591 - DNA, 15 bp, Homo sapiens
ataggatggtcaggg

SEQ ID NO: 355592 - DNA, 15 bp, Homo sapiens
taggatggtcaggga

SEQ ID NO: 355593 - DNA, 15 bp, Homo sapiens
aggatggtcagggaa

SEQ ID NO: 355594 - DNA, 15 bp, Homo sapiens
ggatggtcagggaag

SEQ ID NO: 355595 - DNA, 15 bp, Homo sapiens
gatggtcagggaagg

SEQ ID NO: 355596 - DNA, 15 bp, Homo sapiens
atggtcagggaagga

SEQ ID NO: 355597 - DNA, 15 bp, Homo sapiens
tggtcagggaaggac

SEQ ID NO: 355598 - DNA, 15 bp, Homo sapiens
ggtcagggaaggact

SEQ ID NO: 355599 - DNA, 15 bp, Homo sapiens
gtcagggaaggactt

SEQ ID NO: 355600 - DNA, 15 bp, Homo sapiens
tcagggaaggacttt

SEQ ID NO: 355601 - DNA, 15 bp, Homo sapiens
cagggaaggactttc

SEQ ID NO: 355602 - DNA, 15 bp, Homo sapiens
agggaaggactttct

SEQ ID NO: 355603 - DNA, 15 bp, Homo sapiens
gggaaggactttctg

SEQ ID NO: 355604 - DNA, 15 bp, Homo sapiens
ggaaggactttctga

SEQ ID NO: 355605 - DNA, 15 bp, Homo sapiens
gaaggactttctgag

SEQ ID NO: 355606 - DNA, 15 bp, Homo sapiens
aaggactttctgaga

SEQ ID NO: 355607 - DNA, 15 bp, Homo sapiens
aggactttctgagat

SEQ ID NO: 355608 - DNA, 15 bp, Homo sapiens
ggactttctgagatg

SEQ ID NO: 355609 - DNA, 15 bp, Homo sapiens
gactttctgagatgg

SEQ ID NO: 355610 - DNA, 15 bp, Homo sapiens
actttctgagatggg

SEQ ID NO: 355611 - DNA, 15 bp, Homo sapiens
ctttctgagatgggg

SEQ ID NO: 355612 - DNA, 15 bp, Homo sapiens
tttctgagatgggga

SEQ ID NO: 355613 - DNA, 15 bp, Homo sapiens
ttctgagatggggat

SEQ ID NO: 355614 - DNA, 15 bp, Homo sapiens
tctgagatggggatg

SEQ ID NO: 355615 - DNA, 15 bp, Homo sapiens
ctgagatggggatgt

SEQ ID NO: 355616 - DNA, 15 bp, Homo sapiens
tgagatggggatgtt

SEQ ID NO: 355617 - DNA, 15 bp, Homo sapiens
gagatggggatgttt

SEQ ID NO: 355618 - DNA, 15 bp, Homo sapiens
agatggggatgtttg

SEQ ID NO: 355619 - DNA, 15 bp, Homo sapiens
gatggggatgtttga

SEQ ID NO: 355620 - DNA, 15 bp, Homo sapiens
atggggatgtttgaa

SEQ ID NO: 355621 - DNA, 15 bp, Homo sapiens
tggggatgtttgaat

SEQ ID NO: 355622 - DNA, 15 bp, Homo sapiens
ggggatgtttgaata

SEQ ID NO: 355623 - DNA, 15 bp, Homo sapiens
gggatgtttgaataa

SEQ ID NO: 355624 - DNA, 15 bp, Homo sapiens
ggatgtttgaataaa

SEQ ID NO: 355625 - DNA, 15 bp, Homo sapiens
gatgtttgaataaag

SEQ ID NO: 355626 - DNA, 15 bp, Homo sapiens
atgtttgaataaaga

SEQ ID NO: 355627 - DNA, 15 bp, Homo sapiens
tgtttgaataaagaa

SEQ ID NO: 355628 - DNA, 15 bp, Homo sapiens
gtttgaataaagaac

SEQ ID NO: 355629 - DNA, 15 bp, Homo sapiens
tttgaataaagaact

SEQ ID NO: 355630 - DNA, 15 bp, Homo sapiens
ttgaataaagaactg

SEQ ID NO: 355631 - DNA, 15 bp, Homo sapiens
tgaataaagaactga

SEQ ID NO: 355632 - DNA, 15 bp, Homo sapiens
gaataaagaactgag

SEQ ID NO: 355633 - DNA, 15 bp, Homo sapiens
aataaagaactgagt

SEQ ID NO: 355634 - DNA, 15 bp, Homo sapiens
ataaagaactgagta

SEQ ID NO: 355635 - DNA, 15 bp, Homo sapiens
taaagaactgagtaa

SEQ ID NO: 355636 - DNA, 15 bp, Homo sapiens
aaagaactgagtaaa

SEQ ID NO: 355637 - DNA, 15 bp, Homo sapiens
aagaactgagtaaag

SEQ ID NO: 355638 - DNA, 15 bp, Homo sapiens
agaactgagtaaagt

SEQ ID NO: 355639 - DNA, 15 bp, Homo sapiens
gaactgagtaaagta

SEQ ID NO: 355640 - DNA, 15 bp, Homo sapiens
aactgagtaaagtaa

SEQ ID NO: 355641 - DNA, 15 bp, Homo sapiens
actgagtaaagtaag

SEQ ID NO: 355642 - DNA, 15 bp, Homo sapiens
ctgagtaaagtaaga

SEQ ID NO: 355643 - DNA, 15 bp, Homo sapiens
tgagtaaagtaagag

SEQ ID NO: 355644 - DNA, 15 bp, Homo sapiens
gagtaaagtaagaga

SEQ ID NO: 355645 - DNA, 15 bp, Homo sapiens
agtaaagtaagagat

SEQ ID NO: 355646 - DNA, 15 bp, Homo sapiens
gtaaagtaagagatg

SEQ ID NO: 355647 - DNA, 15 bp, Homo sapiens
taaagtaagagatga

SEQ ID NO: 355648 - DNA, 15 bp, Homo sapiens
aaagtaagagatgag

SEQ ID NO: 355649 - DNA, 15 bp, Homo sapiens
aagtaagagatgagc

SEQ ID NO: 355650 - DNA, 15 bp, Homo sapiens
agtaagagatgagcc

SEQ ID NO: 355651 - DNA, 15 bp, Homo sapiens
gtaagagatgagcct

SEQ ID NO: 355652 - DNA, 15 bp, Homo sapiens
taagagatgagcctt

SEQ ID NO: 355653 - DNA, 15 bp, Homo sapiens
aagagatgagccttg

SEQ ID NO: 355654 - DNA, 15 bp, Homo sapiens
agagatgagccttgt

SEQ ID NO: 355655 - DNA, 15 bp, Homo sapiens
gagatgagccttgta

SEQ ID NO: 355656 - DNA, 15 bp, Homo sapiens
agatgagccttgtaa

SEQ ID NO: 355657 - DNA, 15 bp, Homo sapiens
gatgagccttgtaag

SEQ ID NO: 355658 - DNA, 15 bp, Homo sapiens
atgagccttgtaagg

SEQ ID NO: 355659 - DNA, 15 bp, Homo sapiens
tgagccttgtaaggt

SEQ ID NO: 355660 - DNA, 15 bp, Homo sapiens
gagccttgtaaggtt

SEQ ID NO: 355661 - DNA, 15 bp, Homo sapiens
agccttgtaaggttc

SEQ ID NO: 355662 - DNA, 15 bp, Homo sapiens
gccttgtaaggttca

SEQ ID NO: 355663 - DNA, 15 bp, Homo sapiens
ccttgtaaggttcag

SEQ ID NO: 355664 - DNA, 15 bp, Homo sapiens
cttgtaaggttcaga

SEQ ID NO: 355665 - DNA, 15 bp, Homo sapiens
ttgtaaggttcagat

SEQ ID NO: 355666 - DNA, 15 bp, Homo sapiens
tgtaaggttcagata

SEQ ID NO: 355667 - DNA, 15 bp, Homo sapiens
gtaaggttcagataa

SEQ ID NO: 355668 - DNA, 15 bp, Homo sapiens
taaggttcagataag

SEQ ID NO: 355669 - DNA, 15 bp, Homo sapiens
aaggttcagataaga

SEQ ID NO: 355670 - DNA, 15 bp, Homo sapiens
aggttcagataagaa

SEQ ID NO: 355671 - DNA, 15 bp, Homo sapiens
ggttcagataagaac

SEQ ID NO: 355672 - DNA, 15 bp, Homo sapiens
gttcagataagaaca

SEQ ID NO: 355673 - DNA, 15 bp, Homo sapiens
ttcagataagaacat

SEQ ID NO: 355674 - DNA, 15 bp, Homo sapiens
tcagataagaacatt

SEQ ID NO: 355675 - DNA, 15 bp, Homo sapiens
cagataagaacattc

SEQ ID NO: 355676 - DNA, 15 bp, Homo sapiens
agataagaacattca

SEQ ID NO: 355677 - DNA, 15 bp, Homo sapiens
gataagaacattcag

SEQ ID NO: 355678 - DNA, 15 bp, Homo sapiens
ataagaacattcagg

SEQ ID NO: 355679 - DNA, 15 bp, Homo sapiens
taagaacattcaggc

SEQ ID NO: 355680 - DNA, 15 bp, Homo sapiens
aagaacattcaggcg

SEQ ID NO: 355681 - DNA, 15 bp, Homo sapiens
agaacattcaggcgt

SEQ ID NO: 355682 - DNA, 15 bp, Homo sapiens
gaacattcaggcgtg

SEQ ID NO: 355683 - DNA, 15 bp, Homo sapiens
aacattcaggcgtgg

SEQ ID NO: 355684 - DNA, 15 bp, Homo sapiens
acattcaggcgtgga

SEQ ID NO: 355685 - DNA, 15 bp, Homo sapiens
cattcaggcgtggag

SEQ ID NO: 355686 - DNA, 15 bp, Homo sapiens
attcaggcgtggaga

SEQ ID NO: 355687 - DNA, 15 bp, Homo sapiens
ttcaggcgtggagaa

SEQ ID NO: 355688 - DNA, 15 bp, Homo sapiens
tcaggcgtggagaat

SEQ ID NO: 355689 - DNA, 15 bp, Homo sapiens
caggcgtggagaata

SEQ ID NO: 355690 - DNA, 15 bp, Homo sapiens
aggcgtggagaatag

SEQ ID NO: 355691 - DNA, 15 bp, Homo sapiens
ggcgtggagaatagc

SEQ ID NO: 355692 - DNA, 15 bp, Homo sapiens
gcgtggagaatagca

SEQ ID NO: 355693 - DNA, 15 bp, Homo sapiens
cgtggagaatagcag

SEQ ID NO: 355694 - DNA, 15 bp, Homo sapiens
gtggagaatagcagg

SEQ ID NO: 355695 - DNA, 15 bp, Homo sapiens
tggagaatagcaggc

SEQ ID NO: 355696 - DNA, 15 bp, Homo sapiens
ggagaatagcaggct

SEQ ID NO: 355697 - DNA, 15 bp, Homo sapiens
gagaatagcaggctt

SEQ ID NO: 355698 - DNA, 15 bp, Homo sapiens
agaatagcaggcttt

SEQ ID NO: 355699 - DNA, 15 bp, Homo sapiens
gaatagcaggcttta

SEQ ID NO: 355700 - DNA, 15 bp, Homo sapiens
aatagcaggctttaa

SEQ ID NO: 355701 - DNA, 15 bp, Homo sapiens
atagcaggctttaaa

SEQ ID NO: 355702 - DNA, 15 bp, Homo sapiens
tagcaggctttaaaa

SEQ ID NO: 355703 - DNA, 15 bp, Homo sapiens
agcaggctttaaaac

SEQ ID NO: 355704 - DNA, 15 bp, Homo sapiens
gcaggctttaaaact

SEQ ID NO: 355705 - DNA, 15 bp, Homo sapiens
caggctttaaaactc

SEQ ID NO: 355706 - DNA, 15 bp, Homo sapiens
aggctttaaaactct

SEQ ID NO: 355707 - DNA, 15 bp, Homo sapiens
ggctttaaaactctg

SEQ ID NO: 355708 - DNA, 15 bp, Homo sapiens
gctttaaaactctgt

SEQ ID NO: 355709 - DNA, 15 bp, Homo sapiens
ctttaaaactctgtg

SEQ ID NO: 355710 - DNA, 15 bp, Homo sapiens
tttaaaactctgtgg

SEQ ID NO: 355711 - DNA, 15 bp, Homo sapiens
ttaaaactctgtggt

SEQ ID NO: 355712 - DNA, 15 bp, Homo sapiens
taaaactctgtggtg

SEQ ID NO: 355713 - DNA, 15 bp, Homo sapiens
aaaactctgtggtgg

SEQ ID NO: 355714 - DNA, 15 bp, Homo sapiens
aaactctgtggtggg

SEQ ID NO: 355715 - DNA, 15 bp, Homo sapiens
aactctgtggtggga

SEQ ID NO: 355716 - DNA, 15 bp, Homo sapiens
actctgtggtgggaa

SEQ ID NO: 355717 - DNA, 15 bp, Homo sapiens
ctctgtggtgggaat

SEQ ID NO: 355718 - DNA, 15 bp, Homo sapiens
tctgtggtgggaatg

SEQ ID NO: 355719 - DNA, 15 bp, Homo sapiens
ctgtggtgggaatga

SEQ ID NO: 355720 - DNA, 15 bp, Homo sapiens
tgtggtgggaatgaa

SEQ ID NO: 355721 - DNA, 15 bp, Homo sapiens
gtggtgggaatgaac

SEQ ID NO: 355722 - DNA, 15 bp, Homo sapiens
tggtgggaatgaact

SEQ ID NO: 355723 - DNA, 15 bp, Homo sapiens
ggtgggaatgaactt

SEQ ID NO: 355724 - DNA, 15 bp, Homo sapiens
gtgggaatgaacttg

SEQ ID NO: 355725 - DNA, 15 bp, Homo sapiens
tgggaatgaacttgg

SEQ ID NO: 355726 - DNA, 15 bp, Homo sapiens
gggaatgaacttggt

SEQ ID NO: 355727 - DNA, 15 bp, Homo sapiens
ggaatgaacttggtc

SEQ ID NO: 355728 - DNA, 15 bp, Homo sapiens
gaatgaacttggtct

SEQ ID NO: 355729 - DNA, 15 bp, Homo sapiens
aatgaacttggtctg

SEQ ID NO: 355730 - DNA, 15 bp, Homo sapiens
atgaacttggtctgt

SEQ ID NO: 355731 - DNA, 15 bp, Homo sapiens
tgaacttggtctgtt

SEQ ID NO: 355732 - DNA, 15 bp, Homo sapiens
gaacttggtctgttt

SEQ ID NO: 355733 - DNA, 15 bp, Homo sapiens
aacttggtctgttta

SEQ ID NO: 355734 - DNA, 15 bp, Homo sapiens
acttggtctgtttaa

SEQ ID NO: 355735 - DNA, 15 bp, Homo sapiens
cttggtctgtttaat

SEQ ID NO: 355736 - DNA, 15 bp, Homo sapiens
ttggtctgtttaata

SEQ ID NO: 355737 - DNA, 15 bp, Homo sapiens
tggtctgtttaataa

SEQ ID NO: 355738 - DNA, 15 bp, Homo sapiens
ggtctgtttaataaa

SEQ ID NO: 355739 - DNA, 15 bp, Homo sapiens
gtctgtttaataaag

SEQ ID NO: 355740 - DNA, 15 bp, Homo sapiens
tctgtttaataaaga

SEQ ID NO: 355741 - DNA, 15 bp, Homo sapiens
ctgtttaataaagaa

SEQ ID NO: 355742 - DNA, 15 bp, Homo sapiens
tgtttaataaagaat

SEQ ID NO: 355743 - DNA, 15 bp, Homo sapiens
gtttaataaagaatg

SEQ ID NO: 355744 - DNA, 15 bp, Homo sapiens
tttaataaagaatga

SEQ ID NO: 355745 - DNA, 15 bp, Homo sapiens
ttaataaagaatgaa

SEQ ID NO: 355746 - DNA, 15 bp, Homo sapiens
taataaagaatgaag

SEQ ID NO: 355747 - DNA, 15 bp, Homo sapiens
aataaagaatgaagg

SEQ ID NO: 355748 - DNA, 15 bp, Homo sapiens
ataaagaatgaaggc

SEQ ID NO: 355749 - DNA, 15 bp, Homo sapiens
taaagaatgaaggca

SEQ ID NO: 355750 - DNA, 15 bp, Homo sapiens
aaagaatgaaggcag

SEQ ID NO: 355751 - DNA, 15 bp, Homo sapiens
aagaatgaaggcagt

SEQ ID NO: 355752 - DNA, 15 bp, Homo sapiens
agaatgaaggcagtg

SEQ ID NO: 355753 - DNA, 15 bp, Homo sapiens
gaatgaaggcagtgt

SEQ ID NO: 355754 - DNA, 15 bp, Homo sapiens
aatgaaggcagtgta

SEQ ID NO: 355755 - DNA, 15 bp, Homo sapiens
atgaaggcagtgtag

SEQ ID NO: 355756 - DNA, 15 bp, Homo sapiens
tgaaggcagtgtagc

SEQ ID NO: 355757 - DNA, 15 bp, Homo sapiens
gaaggcagtgtagct

SEQ ID NO: 355758 - DNA, 15 bp, Homo sapiens
aaggcagtgtagctg

SEQ ID NO: 355759 - DNA, 15 bp, Homo sapiens
aggcagtgtagctgg

SEQ ID NO: 355760 - DNA, 15 bp, Homo sapiens
ggcagtgtagctgga

SEQ ID NO: 355761 - DNA, 15 bp, Homo sapiens
gcagtgtagctggaa

SEQ ID NO: 355762 - DNA, 15 bp, Homo sapiens
cagtgtagctggaat

SEQ ID NO: 355763 - DNA, 15 bp, Homo sapiens
agtgtagctggaata

SEQ ID NO: 355764 - DNA, 15 bp, Homo sapiens
gtgtagctggaataa

SEQ ID NO: 355765 - DNA, 15 bp, Homo sapiens
tgtagctggaataaa

SEQ ID NO: 355766 - DNA, 15 bp, Homo sapiens
gtagctggaataaaa

SEQ ID NO: 355767 - DNA, 15 bp, Homo sapiens
tagctggaataaaac

SEQ ID NO: 355768 - DNA, 15 bp, Homo sapiens
agctggaataaaaca

SEQ ID NO: 355769 - DNA, 15 bp, Homo sapiens
gctggaataaaacag

SEQ ID NO: 355770 - DNA, 15 bp, Homo sapiens
ctggaataaaacaga

SEQ ID NO: 355771 - DNA, 15 bp, Homo sapiens
tggaataaaacagag

SEQ ID NO: 355772 - DNA, 15 bp, Homo sapiens
ggaataaaacagaga

SEQ ID NO: 355773 - DNA, 15 bp, Homo sapiens
gaataaaacagagag

SEQ ID NO: 355774 - DNA, 15 bp, Homo sapiens
aataaaacagagagg

SEQ ID NO: 355775 - DNA, 15 bp, Homo sapiens
ataaaacagagagga

SEQ ID NO: 355776 - DNA, 15 bp, Homo sapiens
taaaacagagaggag

SEQ ID NO: 355777 - DNA, 15 bp, Homo sapiens
aaaacagagaggagt

SEQ ID NO: 355778 - DNA, 15 bp, Homo sapiens
aaacagagaggagtt

SEQ ID NO: 355779 - DNA, 15 bp, Homo sapiens
aacagagaggagtta

SEQ ID NO: 355780 - DNA, 15 bp, Homo sapiens
acagagaggagttag

SEQ ID NO: 355781 - DNA, 15 bp, Homo sapiens
cagagaggagttagt

SEQ ID NO: 355782 - DNA, 15 bp, Homo sapiens
agagaggagttagtg

SEQ ID NO: 355783 - DNA, 15 bp, Homo sapiens
gagaggagttagtga

SEQ ID NO: 355784 - DNA, 15 bp, Homo sapiens
agaggagttagtgag

SEQ ID NO: 355785 - DNA, 15 bp, Homo sapiens
gaggagttagtgagt

SEQ ID NO: 355786 - DNA, 15 bp, Homo sapiens
aggagttagtgagtt

SEQ ID NO: 355787 - DNA, 15 bp, Homo sapiens
ggagttagtgagttg

SEQ ID NO: 355788 - DNA, 15 bp, Homo sapiens
gagttagtgagttgg

SEQ ID NO: 355789 - DNA, 15 bp, Homo sapiens
agttagtgagttgga

SEQ ID NO: 355790 - DNA, 15 bp, Homo sapiens
gttagtgagttggag

SEQ ID NO: 355791 - DNA, 15 bp, Homo sapiens
ttagtgagttggaga

SEQ ID NO: 355792 - DNA, 15 bp, Homo sapiens
tagtgagttggagaa

SEQ ID NO: 355793 - DNA, 15 bp, Homo sapiens
agtgagttggagaat

SEQ ID NO: 355794 - DNA, 15 bp, Homo sapiens
gtgagttggagaatg

SEQ ID NO: 355795 - DNA, 15 bp, Homo sapiens
tgagttggagaatgg

SEQ ID NO: 355796 - DNA, 15 bp, Homo sapiens
gagttggagaatggg

SEQ ID NO: 355797 - DNA, 15 bp, Homo sapiens
agttggagaatggga

SEQ ID NO: 355798 - DNA, 15 bp, Homo sapiens
gttggagaatgggaa

SEQ ID NO: 355799 - DNA, 15 bp, Homo sapiens
ttggagaatgggaat

SEQ ID NO: 355800 - DNA, 15 bp, Homo sapiens
tggagaatgggaata

SEQ ID NO: 355801 - DNA, 15 bp, Homo sapiens
ggagaatgggaatat

SEQ ID NO: 355802 - DNA, 15 bp, Homo sapiens
gagaatgggaatatt

SEQ ID NO: 355803 - DNA, 15 bp, Homo sapiens
agaatgggaatattt

SEQ ID NO: 355804 - DNA, 15 bp, Homo sapiens
gaatgggaatatttg

SEQ ID NO: 355805 - DNA, 15 bp, Homo sapiens
aatgggaatatttga

SEQ ID NO: 355806 - DNA, 15 bp, Homo sapiens
atgggaatatttgag

SEQ ID NO: 355807 - DNA, 15 bp, Homo sapiens
tgggaatatttgagg

SEQ ID NO: 355808 - DNA, 15 bp, Homo sapiens
gggaatatttgaggt

SEQ ID NO: 355809 - DNA, 15 bp, Homo sapiens
ggaatatttgaggtt

SEQ ID NO: 355810 - DNA, 15 bp, Homo sapiens
gaatatttgaggtta

SEQ ID NO: 355811 - DNA, 15 bp, Homo sapiens
aatatttgaggttag

SEQ ID NO: 355812 - DNA, 15 bp, Homo sapiens
atatttgaggttaga

SEQ ID NO: 355813 - DNA, 15 bp, Homo sapiens
tatttgaggttagag

SEQ ID NO: 355814 - DNA, 15 bp, Homo sapiens
atttgaggttagagg

SEQ ID NO: 355815 - DNA, 15 bp, Homo sapiens
tttgaggttagaggt

SEQ ID NO: 355816 - DNA, 15 bp, Homo sapiens
ttgaggttagaggta

SEQ ID NO: 355817 - DNA, 15 bp, Homo sapiens
tgaggttagaggtag

SEQ ID NO: 355818 - DNA, 15 bp, Homo sapiens
gaggttagaggtagg

SEQ ID NO: 355819 - DNA, 15 bp, Homo sapiens
aggttagaggtaggc

SEQ ID NO: 355820 - DNA, 15 bp, Homo sapiens
ggttagaggtaggca

SEQ ID NO: 355821 - DNA, 15 bp, Homo sapiens
gttagaggtaggcag

SEQ ID NO: 355822 - DNA, 15 bp, Homo sapiens
ttagaggtaggcaga

SEQ ID NO: 355823 - DNA, 15 bp, Homo sapiens
tagaggtaggcagag

SEQ ID NO: 355824 - DNA, 15 bp, Homo sapiens
agaggtaggcagagg

SEQ ID NO: 355825 - DNA, 15 bp, Homo sapiens
gaggtaggcagagga

SEQ ID NO: 355826 - DNA, 15 bp, Homo sapiens
aggtaggcagaggat

SEQ ID NO: 355827 - DNA, 15 bp, Homo sapiens
ggtaggcagaggatg

SEQ ID NO: 355828 - DNA, 15 bp, Homo sapiens
gtaggcagaggatgg

SEQ ID NO: 355829 - DNA, 15 bp, Homo sapiens
taggcagaggatgga

SEQ ID NO: 355830 - DNA, 15 bp, Homo sapiens
aggcagaggatggat

SEQ ID NO: 355831 - DNA, 15 bp, Homo sapiens
ggcagaggatggatt

SEQ ID NO: 355832 - DNA, 15 bp, Homo sapiens
gcagaggatggatta

SEQ ID NO: 355833 - DNA, 15 bp, Homo sapiens
cagaggatggattag

SEQ ID NO: 355834 - DNA, 15 bp, Homo sapiens
agaggatggattagc

SEQ ID NO: 355835 - DNA, 15 bp, Homo sapiens
gaggatggattagct

SEQ ID NO: 355836 - DNA, 15 bp, Homo sapiens
aggatggattagcta

SEQ ID NO: 355837 - DNA, 15 bp, Homo sapiens
ggatggattagctat

SEQ ID NO: 355838 - DNA, 15 bp, Homo sapiens
gatggattagctatg

SEQ ID NO: 355839 - DNA, 15 bp, Homo sapiens
atggattagctatgg

SEQ ID NO: 355840 - DNA, 15 bp, Homo sapiens
tggattagctatggc

SEQ ID NO: 355841 - DNA, 15 bp, Homo sapiens
ggattagctatggcc

SEQ ID NO: 355842 - DNA, 15 bp, Homo sapiens
gattagctatggcct

SEQ ID NO: 355843 - DNA, 15 bp, Homo sapiens
attagctatggcctt

SEQ ID NO: 355844 - DNA, 15 bp, Homo sapiens
ttagctatggccttg

SEQ ID NO: 355845 - DNA, 15 bp, Homo sapiens
tagctatggccttgg

SEQ ID NO: 355846 - DNA, 15 bp, Homo sapiens
agctatggccttgga

SEQ ID NO: 355847 - DNA, 15 bp, Homo sapiens
gctatggccttggag

SEQ ID NO: 355848 - DNA, 15 bp, Homo sapiens
ctatggccttggagg

SEQ ID NO: 355849 - DNA, 15 bp, Homo sapiens
tatggccttggagga

SEQ ID NO: 355850 - DNA, 15 bp, Homo sapiens
atggccttggaggaa

SEQ ID NO: 355851 - DNA, 15 bp, Homo sapiens
tggccttggaggaaa

SEQ ID NO: 355852 - DNA, 15 bp, Homo sapiens
ggccttggaggaaag

SEQ ID NO: 355853 - DNA, 15 bp, Homo sapiens
gccttggaggaaagg

SEQ ID NO: 355854 - DNA, 15 bp, Homo sapiens
ccttggaggaaagga

SEQ ID NO: 355855 - DNA, 15 bp, Homo sapiens
cttggaggaaaggac

SEQ ID NO: 355856 - DNA, 15 bp, Homo sapiens
ttggaggaaaggact

SEQ ID NO: 355857 - DNA, 15 bp, Homo sapiens
tggaggaaaggactt

SEQ ID NO: 355858 - DNA, 15 bp, Homo sapiens
ggaggaaaggacttg

SEQ ID NO: 355859 - DNA, 15 bp, Homo sapiens
gaggaaaggacttgg

SEQ ID NO: 355860 - DNA, 15 bp, Homo sapiens
aggaaaggacttggg

SEQ ID NO: 355861 - DNA, 15 bp, Homo sapiens
ggaaaggacttggga

SEQ ID NO: 355862 - DNA, 15 bp, Homo sapiens
gaaaggacttgggat

SEQ ID NO: 355863 - DNA, 15 bp, Homo sapiens
aaaggacttgggatt

SEQ ID NO: 355864 - DNA, 15 bp, Homo sapiens
aaggacttgggattt

SEQ ID NO: 355865 - DNA, 15 bp, Homo sapiens
aggacttgggattta

SEQ ID NO: 355866 - DNA, 15 bp, Homo sapiens
ggacttgggatttat

SEQ ID NO: 355867 - DNA, 15 bp, Homo sapiens
gacttgggatttatt

SEQ ID NO: 355868 - DNA, 15 bp, Homo sapiens
acttgggatttattt

SEQ ID NO: 355869 - DNA, 15 bp, Homo sapiens
cttgggatttatttc

SEQ ID NO: 355870 - DNA, 15 bp, Homo sapiens
ttgggatttatttca

SEQ ID NO: 355871 - DNA, 15 bp, Homo sapiens
tgggatttatttcaa

SEQ ID NO: 355872 - DNA, 15 bp, Homo sapiens
gggatttatttcaag

SEQ ID NO: 355873 - DNA, 15 bp, Homo sapiens
ggatttatttcaagt

SEQ ID NO: 355874 - DNA, 15 bp, Homo sapiens
gatttatttcaagta

SEQ ID NO: 355875 - DNA, 15 bp, Homo sapiens
atttatttcaagtat

SEQ ID NO: 355876 - DNA, 15 bp, Homo sapiens
tttatttcaagtatg

SEQ ID NO: 355877 - DNA, 15 bp, Homo sapiens
ttatttcaagtatga

SEQ ID NO: 355878 - DNA, 15 bp, Homo sapiens
tatttcaagtatgat

SEQ ID NO: 355879 - DNA, 15 bp, Homo sapiens
atttcaagtatgata

SEQ ID NO: 355880 - DNA, 15 bp, Homo sapiens
tttcaagtatgatat

SEQ ID NO: 355881 - DNA, 15 bp, Homo sapiens
ttcaagtatgatatt

SEQ ID NO: 355882 - DNA, 15 bp, Homo sapiens
tcaagtatgatatta

SEQ ID NO: 355883 - DNA, 15 bp, Homo sapiens
caagtatgatattac

SEQ ID NO: 355884 - DNA, 15 bp, Homo sapiens
aagtatgatattaca

SEQ ID NO: 355885 - DNA, 15 bp, Homo sapiens
agtatgatattacac

SEQ ID NO: 355886 - DNA, 15 bp, Homo sapiens
gtatgatattacaca

SEQ ID NO: 355887 - DNA, 15 bp, Homo sapiens
tatgatattacacag

SEQ ID NO: 355888 - DNA, 15 bp, Homo sapiens
atgatattacacaga

SEQ ID NO: 355889 - DNA, 15 bp, Homo sapiens
tgatattacacagaa

SEQ ID NO: 355890 - DNA, 15 bp, Homo sapiens
gatattacacagaaa

SEQ ID NO: 355891 - DNA, 15 bp, Homo sapiens
atattacacagaaag

SEQ ID NO: 355892 - DNA, 15 bp, Homo sapiens
tattacacagaaagc

SEQ ID NO: 355893 - DNA, 15 bp, Homo sapiens
attacacagaaagca

SEQ ID NO: 355894 - DNA, 15 bp, Homo sapiens
ttacacagaaagcaa

SEQ ID NO: 355895 - DNA, 15 bp, Homo sapiens
tacacagaaagcaat

SEQ ID NO: 355896 - DNA, 15 bp, Homo sapiens
acacagaaagcaatt

SEQ ID NO: 355897 - DNA, 15 bp, Homo sapiens
cacagaaagcaattg

SEQ ID NO: 355898 - DNA, 15 bp, Homo sapiens
acagaaagcaattgg

SEQ ID NO: 355899 - DNA, 15 bp, Homo sapiens
cagaaagcaattgga

SEQ ID NO: 355900 - DNA, 15 bp, Homo sapiens
agaaagcaattggaa

SEQ ID NO: 355901 - DNA, 15 bp, Homo sapiens
gaaagcaattggaag

SEQ ID NO: 355902 - DNA, 15 bp, Homo sapiens
aaagcaattggaagg

SEQ ID NO: 355903 - DNA, 15 bp, Homo sapiens
aagcaattggaaggt

SEQ ID NO: 355904 - DNA, 15 bp, Homo sapiens
agcaattggaaggtt

SEQ ID NO: 355905 - DNA, 15 bp, Homo sapiens
gcaattggaaggttt

SEQ ID NO: 355906 - DNA, 15 bp, Homo sapiens
caattggaaggtttt

SEQ ID NO: 355907 - DNA, 15 bp, Homo sapiens
aattggaaggttttg

SEQ ID NO: 355908 - DNA, 15 bp, Homo sapiens
attggaaggttttga

SEQ ID NO: 355909 - DNA, 15 bp, Homo sapiens
ttggaaggttttgaa

SEQ ID NO: 355910 - DNA, 15 bp, Homo sapiens
tggaaggttttgaac

SEQ ID NO: 355911 - DNA, 15 bp, Homo sapiens
ggaaggttttgaaca

SEQ ID NO: 355912 - DNA, 15 bp, Homo sapiens
gaaggttttgaacag

SEQ ID NO: 355913 - DNA, 15 bp, Homo sapiens
aaggttttgaacagg

SEQ ID NO: 355914 - DNA, 15 bp, Homo sapiens
aggttttgaacaggg

SEQ ID NO: 355915 - DNA, 15 bp, Homo sapiens
ggttttgaacaggga

SEQ ID NO: 355916 - DNA, 15 bp, Homo sapiens
gttttgaacagggaa

SEQ ID NO: 355917 - DNA, 15 bp, Homo sapiens
ttttgaacagggaag

SEQ ID NO: 355918 - DNA, 15 bp, Homo sapiens
tttgaacagggaagt

SEQ ID NO: 355919 - DNA, 15 bp, Homo sapiens
ttgaacagggaagtg

SEQ ID NO: 355920 - DNA, 15 bp, Homo sapiens
tgaacagggaagtga

SEQ ID NO: 355921 - DNA, 15 bp, Homo sapiens
gaacagggaagtgac

SEQ ID NO: 355922 - DNA, 15 bp, Homo sapiens
aacagggaagtgaca

SEQ ID NO: 355923 - DNA, 15 bp, Homo sapiens
acagggaagtgacat

SEQ ID NO: 355924 - DNA, 15 bp, Homo sapiens
cagggaagtgacatg

SEQ ID NO: 355925 - DNA, 15 bp, Homo sapiens
agggaagtgacatgt

SEQ ID NO: 355926 - DNA, 15 bp, Homo sapiens
gggaagtgacatgtg

SEQ ID NO: 355927 - DNA, 15 bp, Homo sapiens
ggaagtgacatgtga

SEQ ID NO: 355928 - DNA, 15 bp, Homo sapiens
gaagtgacatgtgat

SEQ ID NO: 355929 - DNA, 15 bp, Homo sapiens
aagtgacatgtgata

SEQ ID NO: 355930 - DNA, 15 bp, Homo sapiens
agtgacatgtgatat

SEQ ID NO: 355931 - DNA, 15 bp, Homo sapiens
gtgacatgtgatata

SEQ ID NO: 355932 - DNA, 15 bp, Homo sapiens
tgacatgtgatatag

SEQ ID NO: 355933 - DNA, 15 bp, Homo sapiens
gacatgtgatataga

SEQ ID NO: 355934 - DNA, 15 bp, Homo sapiens
acatgtgatatagat

SEQ ID NO: 355935 - DNA, 15 bp, Homo sapiens
catgtgatatagatc

SEQ ID NO: 355936 - DNA, 15 bp, Homo sapiens
atgtgatatagatct

SEQ ID NO: 355937 - DNA, 15 bp, Homo sapiens
tgtgatatagatctt

SEQ ID NO: 355938 - DNA, 15 bp, Homo sapiens
gtgatatagatcttt

SEQ ID NO: 355939 - DNA, 15 bp, Homo sapiens
tgatatagatctttt

SEQ ID NO: 355940 - DNA, 15 bp, Homo sapiens
gatatagatctttta

SEQ ID NO: 355941 - DNA, 15 bp, Homo sapiens
atatagatcttttaa

SEQ ID NO: 355942 - DNA, 15 bp, Homo sapiens
tatagatcttttaag

SEQ ID NO: 355943 - DNA, 15 bp, Homo sapiens
atagatcttttaagg

SEQ ID NO: 355944 - DNA, 15 bp, Homo sapiens
tagatcttttaaggt

SEQ ID NO: 355945 - DNA, 15 bp, Homo sapiens
agatcttttaaggtc

SEQ ID NO: 355946 - DNA, 15 bp, Homo sapiens
gatcttttaaggtca

SEQ ID NO: 355947 - DNA, 15 bp, Homo sapiens
atcttttaaggtcac

SEQ ID NO: 355948 - DNA, 15 bp, Homo sapiens
tcttttaaggtcact

SEQ ID NO: 355949 - DNA, 15 bp, Homo sapiens
cttttaaggtcactc

SEQ ID NO: 355950 - DNA, 15 bp, Homo sapiens
ttttaaggtcactct

SEQ ID NO: 355951 - DNA, 15 bp, Homo sapiens
tttaaggtcactctg

SEQ ID NO: 355952 - DNA, 15 bp, Homo sapiens
ttaaggtcactctgg

SEQ ID NO: 355953 - DNA, 15 bp, Homo sapiens
taaggtcactctggc

SEQ ID NO: 355954 - DNA, 15 bp, Homo sapiens
aaggtcactctggct

SEQ ID NO: 355955 - DNA, 15 bp, Homo sapiens
aggtcactctggctt

SEQ ID NO: 355956 - DNA, 15 bp, Homo sapiens
ggtcactctggcttt

SEQ ID NO: 355957 - DNA, 15 bp, Homo sapiens
gtcactctggctttt

SEQ ID NO: 355958 - DNA, 15 bp, Homo sapiens
tcactctggcttttt

SEQ ID NO: 355959 - DNA, 15 bp, Homo sapiens
cactctggctttttg

SEQ ID NO: 355960 - DNA, 15 bp, Homo sapiens
actctggctttttgt

SEQ ID NO: 355961 - DNA, 15 bp, Homo sapiens
ctctggctttttgtt

SEQ ID NO: 355962 - DNA, 15 bp, Homo sapiens
tctggctttttgttt

SEQ ID NO: 355963 - DNA, 15 bp, Homo sapiens
ctggctttttgtttt

SEQ ID NO: 355964 - DNA, 15 bp, Homo sapiens
tggctttttgttttg

SEQ ID NO: 355965 - DNA, 15 bp, Homo sapiens
ggctttttgttttgt

SEQ ID NO: 355966 - DNA, 15 bp, Homo sapiens
gctttttgttttgtt

SEQ ID NO: 355967 - DNA, 15 bp, Homo sapiens
ctttttgttttgttt

SEQ ID NO: 355968 - DNA, 15 bp, Homo sapiens
tttttgttttgtttc

SEQ ID NO: 355969 - DNA, 15 bp, Homo sapiens
ttttgttttgtttcc

SEQ ID NO: 355970 - DNA, 15 bp, Homo sapiens
tttgttttgtttcct

SEQ ID NO: 355971 - DNA, 15 bp, Homo sapiens
ttgttttgtttcctt

SEQ ID NO: 355972 - DNA, 15 bp, Homo sapiens
tgttttgtttccttt

SEQ ID NO: 355973 - DNA, 15 bp, Homo sapiens
gttttgtttcctttt

SEQ ID NO: 355974 - DNA, 15 bp, Homo sapiens
ttttgtttccttttt

SEQ ID NO: 355975 - DNA, 15 bp, Homo sapiens
tttgtttcctttttt

SEQ ID NO: 355976 - DNA, 15 bp, Homo sapiens
ttgtttccttttttt

SEQ ID NO: 355977 - DNA, 15 bp, Homo sapiens
tgtttcctttttttt

SEQ ID NO: 355978 - DNA, 15 bp, Homo sapiens
gtttcctttttttta

SEQ ID NO: 355979 - DNA, 15 bp, Homo sapiens
tttccttttttttag

SEQ ID NO: 355980 - DNA, 15 bp, Homo sapiens
ttccttttttttagc

SEQ ID NO: 355981 - DNA, 15 bp, Homo sapiens
tccttttttttagca

SEQ ID NO: 355982 - DNA, 15 bp, Homo sapiens
ccttttttttagcaa

SEQ ID NO: 355983 - DNA, 15 bp, Homo sapiens
cttttttttagcaac

SEQ ID NO: 355984 - DNA, 15 bp, Homo sapiens
ttttttttagcaaca

SEQ ID NO: 355985 - DNA, 15 bp, Homo sapiens
tttttttagcaacag

SEQ ID NO: 355986 - DNA, 15 bp, Homo sapiens
ttttttagcaacagt

SEQ ID NO: 355987 - DNA, 15 bp, Homo sapiens
tttttagcaacagta

SEQ ID NO: 355988 - DNA, 15 bp, Homo sapiens
ttttagcaacagtat

SEQ ID NO: 355989 - DNA, 15 bp, Homo sapiens
tttagcaacagtatc

SEQ ID NO: 355990 - DNA, 15 bp, Homo sapiens
ttagcaacagtatct

SEQ ID NO: 355991 - DNA, 15 bp, Homo sapiens
tagcaacagtatctt

SEQ ID NO: 355992 - DNA, 15 bp, Homo sapiens
agcaacagtatcttg

SEQ ID NO: 355993 - DNA, 15 bp, Homo sapiens
gcaacagtatcttgt

SEQ ID NO: 355994 - DNA, 15 bp, Homo sapiens
caacagtatcttgtt

SEQ ID NO: 355995 - DNA, 15 bp, Homo sapiens
aacagtatcttgttg

SEQ ID NO: 355996 - DNA, 15 bp, Homo sapiens
acagtatcttgttgt

SEQ ID NO: 355997 - DNA, 15 bp, Homo sapiens
cagtatcttgttgta

SEQ ID NO: 355998 - DNA, 15 bp, Homo sapiens
agtatcttgttgtat

SEQ ID NO: 355999 - DNA, 15 bp, Homo sapiens
gtatcttgttgtatc

SEQ ID NO: 356000 - DNA, 15 bp, Homo sapiens
tatcttgttgtatca

SEQ ID NO: 356001 - DNA, 15 bp, Homo sapiens
atcttgttgtatcac

SEQ ID NO: 356002 - DNA, 15 bp, Homo sapiens
tcttgttgtatcacc

SEQ ID NO: 356003 - DNA, 15 bp, Homo sapiens
cttgttgtatcaccc

SEQ ID NO: 356004 - DNA, 15 bp, Homo sapiens
ttgttgtatcaccca

SEQ ID NO: 356005 - DNA, 15 bp, Homo sapiens
tgttgtatcacccag

SEQ ID NO: 356006 - DNA, 15 bp, Homo sapiens
gttgtatcacccagg

SEQ ID NO: 356007 - DNA, 15 bp, Homo sapiens
ttgtatcacccaggc

SEQ ID NO: 356008 - DNA, 15 bp, Homo sapiens
tgtatcacccaggct

SEQ ID NO: 356009 - DNA, 15 bp, Homo sapiens
gtatcacccaggctg

SEQ ID NO: 356010 - DNA, 15 bp, Homo sapiens
tatcacccaggctgg

SEQ ID NO: 356011 - DNA, 15 bp, Homo sapiens
atcacccaggctgga

SEQ ID NO: 356012 - DNA, 15 bp, Homo sapiens
gcagtggcacaatcc

SEQ ID NO: 356013 - DNA, 15 bp, Homo sapiens
cagtggcacaatcct

SEQ ID NO: 356014 - DNA, 15 bp, Homo sapiens
agtggcacaatccta

SEQ ID NO: 356015 - DNA, 15 bp, Homo sapiens
gtggcacaatcctag

SEQ ID NO: 356016 - DNA, 15 bp, Homo sapiens
tggcacaatcctagc

SEQ ID NO: 356017 - DNA, 15 bp, Homo sapiens
ggcacaatcctagct

SEQ ID NO: 356018 - DNA, 15 bp, Homo sapiens
gcacaatcctagctt

SEQ ID NO: 356019 - DNA, 15 bp, Homo sapiens
cacaatcctagctta

SEQ ID NO: 356020 - DNA, 15 bp, Homo sapiens
acaatcctagcttac

SEQ ID NO: 356021 - DNA, 15 bp, Homo sapiens
caatcctagcttact

SEQ ID NO: 356022 - DNA, 15 bp, Homo sapiens
aatcctagcttactg

SEQ ID NO: 356023 - DNA, 15 bp, Homo sapiens
atcctagcttactgc

SEQ ID NO: 356024 - DNA, 15 bp, Homo sapiens
tcctagcttactgca

SEQ ID NO: 356025 - DNA, 15 bp, Homo sapiens
cctagcttactgcag

SEQ ID NO: 356026 - DNA, 15 bp, Homo sapiens
ctagcttactgcagc

SEQ ID NO: 356027 - DNA, 15 bp, Homo sapiens
tagcttactgcagcc

SEQ ID NO: 356028 - DNA, 15 bp, Homo sapiens
agcttactgcagcct

SEQ ID NO: 356029 - DNA, 15 bp, Homo sapiens
gcttactgcagcctt

SEQ ID NO: 356030 - DNA, 15 bp, Homo sapiens
cttactgcagccttg

SEQ ID NO: 356031 - DNA, 15 bp, Homo sapiens
ttactgcagccttga

SEQ ID NO: 356032 - DNA, 15 bp, Homo sapiens
tactgcagccttgaa

SEQ ID NO: 356033 - DNA, 15 bp, Homo sapiens
tgcagccttgaactc

SEQ ID NO: 356034 - DNA, 15 bp, Homo sapiens
gcagccttgaactcc

SEQ ID NO: 356035 - DNA, 15 bp, Homo sapiens
cagccttgaactcct

SEQ ID NO: 356036 - DNA, 15 bp, Homo sapiens
agccttgaactcctg

SEQ ID NO: 356037 - DNA, 15 bp, Homo sapiens
cctgggctcaagcag

SEQ ID NO: 356038 - DNA, 15 bp, Homo sapiens
ctgggctcaagcagt

SEQ ID NO: 356039 - DNA, 15 bp, Homo sapiens
tgggctcaagcagtc

SEQ ID NO: 356040 - DNA, 15 bp, Homo sapiens
ggctcaagcagtcct

SEQ ID NO: 356041 - DNA, 15 bp, Homo sapiens
gctcaagcagtcctc

SEQ ID NO: 356042 - DNA, 15 bp, Homo sapiens
ctcaagcagtcctcc

SEQ ID NO: 356043 - DNA, 15 bp, Homo sapiens
tcaagcagtcctcct

SEQ ID NO: 356044 - DNA, 15 bp, Homo sapiens
caagcagtcctcctg

SEQ ID NO: 356045 - DNA, 15 bp, Homo sapiens
aagcagtcctcctgc

SEQ ID NO: 356046 - DNA, 15 bp, Homo sapiens
agcagtcctcctgcc

SEQ ID NO: 356047 - DNA, 15 bp, Homo sapiens
gcagtcctcctgcct

SEQ ID NO: 356048 - DNA, 15 bp, Homo sapiens
cagtcctcctgcctc

SEQ ID NO: 356049 - DNA, 15 bp, Homo sapiens
agtcctcctgcctcc

SEQ ID NO: 356050 - DNA, 15 bp, Homo sapiens
gtcctcctgcctcct

SEQ ID NO: 356051 - DNA, 15 bp, Homo sapiens
tcctcctgcctcctg

SEQ ID NO: 356052 - DNA, 15 bp, Homo sapiens
cctcctgcctcctgg

SEQ ID NO: 356053 - DNA, 15 bp, Homo sapiens
ctcctgcctcctggg

SEQ ID NO: 356054 - DNA, 15 bp, Homo sapiens
tcctgcctcctgggt

SEQ ID NO: 356055 - DNA, 15 bp, Homo sapiens
cctgcctcctgggta

SEQ ID NO: 356056 - DNA, 15 bp, Homo sapiens
ctgcctcctgggtag

SEQ ID NO: 356057 - DNA, 15 bp, Homo sapiens
tgcctcctgggtagc

SEQ ID NO: 356058 - DNA, 15 bp, Homo sapiens
gcctcctgggtagct

SEQ ID NO: 356059 - DNA, 15 bp, Homo sapiens
cctcctgggtagctg

SEQ ID NO: 356060 - DNA, 15 bp, Homo sapiens
ctcctgggtagctgg

SEQ ID NO: 356061 - DNA, 15 bp, Homo sapiens
tcctgggtagctgga

SEQ ID NO: 356062 - DNA, 15 bp, Homo sapiens
cctgggtagctggaa

SEQ ID NO: 356063 - DNA, 15 bp, Homo sapiens
ctgggtagctggaac

SEQ ID NO: 356064 - DNA, 15 bp, Homo sapiens
tgggtagctggaact

SEQ ID NO: 356065 - DNA, 15 bp, Homo sapiens
gggtagctggaacta

SEQ ID NO: 356066 - DNA, 15 bp, Homo sapiens
ggtagctggaactat

SEQ ID NO: 356067 - DNA, 15 bp, Homo sapiens
gtagctggaactata

SEQ ID NO: 356068 - DNA, 15 bp, Homo sapiens
tagctggaactatag

SEQ ID NO: 356069 - DNA, 15 bp, Homo sapiens
agctggaactataga

SEQ ID NO: 356070 - DNA, 15 bp, Homo sapiens
gctggaactatagat

SEQ ID NO: 356071 - DNA, 15 bp, Homo sapiens
ctggaactatagatg

SEQ ID NO: 356072 - DNA, 15 bp, Homo sapiens
tggaactatagatgt

SEQ ID NO: 356073 - DNA, 15 bp, Homo sapiens
ggaactatagatgtt

SEQ ID NO: 356074 - DNA, 15 bp, Homo sapiens
gaactatagatgttc

SEQ ID NO: 356075 - DNA, 15 bp, Homo sapiens
aactatagatgttca

SEQ ID NO: 356076 - DNA, 15 bp, Homo sapiens
actatagatgttcac

SEQ ID NO: 356077 - DNA, 15 bp, Homo sapiens
ctatagatgttcacc

SEQ ID NO: 356078 - DNA, 15 bp, Homo sapiens
tatagatgttcacca

SEQ ID NO: 356079 - DNA, 15 bp, Homo sapiens
atagatgttcaccac

SEQ ID NO: 356080 - DNA, 15 bp, Homo sapiens
tagatgttcaccact

SEQ ID NO: 356081 - DNA, 15 bp, Homo sapiens
agatgttcaccacta

SEQ ID NO: 356082 - DNA, 15 bp, Homo sapiens
gatgttcaccactat

SEQ ID NO: 356083 - DNA, 15 bp, Homo sapiens
atgttcaccactatg

SEQ ID NO: 356084 - DNA, 15 bp, Homo sapiens
tgttcaccactatgc

SEQ ID NO: 356085 - DNA, 15 bp, Homo sapiens
gttcaccactatgcc

SEQ ID NO: 356086 - DNA, 15 bp, Homo sapiens
ttcaccactatgcct

SEQ ID NO: 356087 - DNA, 15 bp, Homo sapiens
tcaccactatgccta

SEQ ID NO: 356088 - DNA, 15 bp, Homo sapiens
caccactatgcctag

SEQ ID NO: 356089 - DNA, 15 bp, Homo sapiens
accactatgcctaga

SEQ ID NO: 356090 - DNA, 15 bp, Homo sapiens
ccactatgcctagat

SEQ ID NO: 356091 - DNA, 15 bp, Homo sapiens
cactatgcctagata

SEQ ID NO: 356092 - DNA, 15 bp, Homo sapiens
actatgcctagataa

SEQ ID NO: 356093 - DNA, 15 bp, Homo sapiens
ctatgcctagataat

SEQ ID NO: 356094 - DNA, 15 bp, Homo sapiens
tatgcctagataatt

SEQ ID NO: 356095 - DNA, 15 bp, Homo sapiens
atgcctagataattt

SEQ ID NO: 356096 - DNA, 15 bp, Homo sapiens
tgcctagataatttt

SEQ ID NO: 356097 - DNA, 15 bp, Homo sapiens
gcctagataatttta

SEQ ID NO: 356098 - DNA, 15 bp, Homo sapiens
cctagataattttag

SEQ ID NO: 356099 - DNA, 15 bp, Homo sapiens
ctagataattttaga

SEQ ID NO: 356100 - DNA, 15 bp, Homo sapiens
tagataattttagaa

SEQ ID NO: 356101 - DNA, 15 bp, Homo sapiens
agataattttagaaa

SEQ ID NO: 356102 - DNA, 15 bp, Homo sapiens
gataattttagaaat

SEQ ID NO: 356103 - DNA, 15 bp, Homo sapiens
ataattttagaaata

SEQ ID NO: 356104 - DNA, 15 bp, Homo sapiens
taattttagaaatat

SEQ ID NO: 356105 - DNA, 15 bp, Homo sapiens
aattttagaaatatt

SEQ ID NO: 356106 - DNA, 15 bp, Homo sapiens
attttagaaatattt

SEQ ID NO: 356107 - DNA, 15 bp, Homo sapiens
ttttagaaatatttt

SEQ ID NO: 356108 - DNA, 15 bp, Homo sapiens
tttagaaatattttt

SEQ ID NO: 356109 - DNA, 15 bp, Homo sapiens
ttagaaatatttttg

SEQ ID NO: 356110 - DNA, 15 bp, Homo sapiens
tagaaatatttttga

SEQ ID NO: 356111 - DNA, 15 bp, Homo sapiens
agaaatatttttgag

SEQ ID NO: 356112 - DNA, 15 bp, Homo sapiens
gaaatatttttgagc

SEQ ID NO: 356113 - DNA, 15 bp, Homo sapiens
aaatatttttgagcc

SEQ ID NO: 356114 - DNA, 15 bp, Homo sapiens
aatatttttgagcca

SEQ ID NO: 356115 - DNA, 15 bp, Homo sapiens
atatttttgagccag

SEQ ID NO: 356116 - DNA, 15 bp, Homo sapiens
tatttttgagccaga

SEQ ID NO: 356117 - DNA, 15 bp, Homo sapiens
atttttgagccagat

SEQ ID NO: 356118 - DNA, 15 bp, Homo sapiens
tttttgagccagatg

SEQ ID NO: 356119 - DNA, 15 bp, Homo sapiens
ttttgagccagatgc

SEQ ID NO: 356120 - DNA, 15 bp, Homo sapiens
tttgagccagatgca

SEQ ID NO: 356121 - DNA, 15 bp, Homo sapiens
ttgagccagatgcag

SEQ ID NO: 356122 - DNA, 15 bp, Homo sapiens
tgagccagatgcagt

SEQ ID NO: 356123 - DNA, 15 bp, Homo sapiens
gagccagatgcagtg

SEQ ID NO: 356124 - DNA, 15 bp, Homo sapiens
agccagatgcagtgg

SEQ ID NO: 356125 - DNA, 15 bp, Homo sapiens
gccagatgcagtggt

SEQ ID NO: 356126 - DNA, 15 bp, Homo sapiens
ccagatgcagtggtg

SEQ ID NO: 356127 - DNA, 15 bp, Homo sapiens
cagatgcagtggtgc

SEQ ID NO: 356128 - DNA, 15 bp, Homo sapiens
agatgcagtggtgca

SEQ ID NO: 356129 - DNA, 15 bp, Homo sapiens
gatgcagtggtgcat

SEQ ID NO: 356130 - DNA, 15 bp, Homo sapiens
atgcagtggtgcatg

SEQ ID NO: 356131 - DNA, 15 bp, Homo sapiens
tgcagtggtgcatgc

SEQ ID NO: 356132 - DNA, 15 bp, Homo sapiens
gcagtggtgcatgct

SEQ ID NO: 356133 - DNA, 15 bp, Homo sapiens
cagtggtgcatgctt

SEQ ID NO: 356134 - DNA, 15 bp, Homo sapiens
agtggtgcatgcttg

SEQ ID NO: 356135 - DNA, 15 bp, Homo sapiens
gtggtgcatgcttgt

SEQ ID NO: 356136 - DNA, 15 bp, Homo sapiens
tggtgcatgcttgta

SEQ ID NO: 356137 - DNA, 15 bp, Homo sapiens
ggtgcatgcttgtaa

SEQ ID NO: 356138 - DNA, 15 bp, Homo sapiens
gtgcatgcttgtaat

SEQ ID NO: 356139 - DNA, 15 bp, Homo sapiens
tgcatgcttgtaatc

SEQ ID NO: 356140 - DNA, 15 bp, Homo sapiens
gcatgcttgtaatcc

SEQ ID NO: 356141 - DNA, 15 bp, Homo sapiens
gcttgtaatcccagt

SEQ ID NO: 356142 - DNA, 15 bp, Homo sapiens
cttgtaatcccagta

SEQ ID NO: 356143 - DNA, 15 bp, Homo sapiens
ttgtaatcccagtac

SEQ ID NO: 356144 - DNA, 15 bp, Homo sapiens
gtactttgggaggct

SEQ ID NO: 356145 - DNA, 15 bp, Homo sapiens
tactttgggaggctg

SEQ ID NO: 356146 - DNA, 15 bp, Homo sapiens
tgaggtgggtggatt

SEQ ID NO: 356147 - DNA, 15 bp, Homo sapiens
gaggtgggtggattg

SEQ ID NO: 356148 - DNA, 15 bp, Homo sapiens
aggtgggtggattgc

SEQ ID NO: 356149 - DNA, 15 bp, Homo sapiens
ggtgggtggattgcc

SEQ ID NO: 356150 - DNA, 15 bp, Homo sapiens
gtgggtggattgcct

SEQ ID NO: 356151 - DNA, 15 bp, Homo sapiens
tgggtggattgcctg

SEQ ID NO: 356152 - DNA, 15 bp, Homo sapiens
gagctcaggagtttg

SEQ ID NO: 356153 - DNA, 15 bp, Homo sapiens
agctcaggagtttga

SEQ ID NO: 356154 - DNA, 15 bp, Homo sapiens
gctcaggagtttgag

SEQ ID NO: 356155 - DNA, 15 bp, Homo sapiens
ctcaggagtttgaga

SEQ ID NO: 356156 - DNA, 15 bp, Homo sapiens
cctgggcaacatggc

SEQ ID NO: 356157 - DNA, 15 bp, Homo sapiens
ctgggcaacatggca

SEQ ID NO: 356158 - DNA, 15 bp, Homo sapiens
tgggcaacatggcaa

SEQ ID NO: 356159 - DNA, 15 bp, Homo sapiens
gggcaacatggcaaa

SEQ ID NO: 356160 - DNA, 15 bp, Homo sapiens
ggcaacatggcaaaa

SEQ ID NO: 356161 - DNA, 15 bp, Homo sapiens
gcaacatggcaaaac

SEQ ID NO: 356162 - DNA, 15 bp, Homo sapiens
aacatggcaaaacct

SEQ ID NO: 356163 - DNA, 15 bp, Homo sapiens
acatggcaaaacctt

SEQ ID NO: 356164 - DNA, 15 bp, Homo sapiens
catggcaaaacctta

SEQ ID NO: 356165 - DNA, 15 bp, Homo sapiens
atggcaaaaccttat

SEQ ID NO: 356166 - DNA, 15 bp, Homo sapiens
tggcaaaaccttatc

SEQ ID NO: 356167 - DNA, 15 bp, Homo sapiens
ggcaaaaccttatct

SEQ ID NO: 356168 - DNA, 15 bp, Homo sapiens
gcaaaaccttatctc

SEQ ID NO: 356169 - DNA, 15 bp, Homo sapiens
caaaaccttatctct

SEQ ID NO: 356170 - DNA, 15 bp, Homo sapiens
aaaaccttatctcta

SEQ ID NO: 356171 - DNA, 15 bp, Homo sapiens
aaaccttatctctat

SEQ ID NO: 356172 - DNA, 15 bp, Homo sapiens
aaccttatctctata

SEQ ID NO: 356173 - DNA, 15 bp, Homo sapiens
accttatctctataa

SEQ ID NO: 356174 - DNA, 15 bp, Homo sapiens
ccttatctctataaa

SEQ ID NO: 356175 - DNA, 15 bp, Homo sapiens
cttatctctataaaa

SEQ ID NO: 356176 - DNA, 15 bp, Homo sapiens
ttatctctataaaaa

SEQ ID NO: 356177 - DNA, 15 bp, Homo sapiens
tatctctataaaaaa

SEQ ID NO: 356178 - DNA, 15 bp, Homo sapiens
atctctataaaaaat

SEQ ID NO: 356179 - DNA, 15 bp, Homo sapiens
tctctataaaaaata

SEQ ID NO: 356180 - DNA, 15 bp, Homo sapiens
ctctataaaaaatac

SEQ ID NO: 356181 - DNA, 15 bp, Homo sapiens
tctataaaaaataca

SEQ ID NO: 356182 - DNA, 15 bp, Homo sapiens
ctataaaaaatacaa

SEQ ID NO: 356183 - DNA, 15 bp, Homo sapiens
tataaaaaatacaaa

SEQ ID NO: 356184 - DNA, 15 bp, Homo sapiens
tacaaaaattagccg

SEQ ID NO: 356185 - DNA, 15 bp, Homo sapiens
acaaaaattagccgg

SEQ ID NO: 356186 - DNA, 15 bp, Homo sapiens
caaaaattagccggg

SEQ ID NO: 356187 - DNA, 15 bp, Homo sapiens
cgggcatggtggtgt

SEQ ID NO: 356188 - DNA, 15 bp, Homo sapiens
gggcatggtggtgtg

SEQ ID NO: 356189 - DNA, 15 bp, Homo sapiens
gcatggtggtgtgcg

SEQ ID NO: 356190 - DNA, 15 bp, Homo sapiens
catggtggtgtgcgc

SEQ ID NO: 356191 - DNA, 15 bp, Homo sapiens
atggtggtgtgcgcc

SEQ ID NO: 356192 - DNA, 15 bp, Homo sapiens
ggtggtgtgcgccta

SEQ ID NO: 356193 - DNA, 15 bp, Homo sapiens
gtggtgtgcgcctat

SEQ ID NO: 356194 - DNA, 15 bp, Homo sapiens
tggtgtgcgcctata

SEQ ID NO: 356195 - DNA, 15 bp, Homo sapiens
ggtgtgcgcctatag

SEQ ID NO: 356196 - DNA, 15 bp, Homo sapiens
gtgtgcgcctatagt

SEQ ID NO: 356197 - DNA, 15 bp, Homo sapiens
tgtgcgcctatagtc

SEQ ID NO: 356198 - DNA, 15 bp, Homo sapiens
gtgcgcctatagtcc

SEQ ID NO: 356199 - DNA, 15 bp, Homo sapiens
tgcgcctatagtccc

SEQ ID NO: 356200 - DNA, 15 bp, Homo sapiens
gcgcctatagtccca

SEQ ID NO: 356201 - DNA, 15 bp, Homo sapiens
cgcctatagtcccag

SEQ ID NO: 356202 - DNA, 15 bp, Homo sapiens
gcctatagtcccagc

SEQ ID NO: 356203 - DNA, 15 bp, Homo sapiens
cctatagtcccagct

SEQ ID NO: 356204 - DNA, 15 bp, Homo sapiens
ctatagtcccagcta

SEQ ID NO: 356205 - DNA, 15 bp, Homo sapiens
tatagtcccagctac

SEQ ID NO: 356206 - DNA, 15 bp, Homo sapiens
atagtcccagctact

SEQ ID NO: 356207 - DNA, 15 bp, Homo sapiens
tagtcccagctactt

SEQ ID NO: 356208 - DNA, 15 bp, Homo sapiens
agtcccagctactta

SEQ ID NO: 356209 - DNA, 15 bp, Homo sapiens
cagctacttaggagg

SEQ ID NO: 356210 - DNA, 15 bp, Homo sapiens
agctacttaggaggc

SEQ ID NO: 356211 - DNA, 15 bp, Homo sapiens
gctacttaggaggct

SEQ ID NO: 356212 - DNA, 15 bp, Homo sapiens
ctacttaggaggctg

SEQ ID NO: 356213 - DNA, 15 bp, Homo sapiens
tacttaggaggctga

SEQ ID NO: 356214 - DNA, 15 bp, Homo sapiens
acttaggaggctgag

SEQ ID NO: 356215 - DNA, 15 bp, Homo sapiens
cttaggaggctgagg

SEQ ID NO: 356216 - DNA, 15 bp, Homo sapiens
ttaggaggctgaggt

SEQ ID NO: 356217 - DNA, 15 bp, Homo sapiens
taggaggctgaggtg

SEQ ID NO: 356218 - DNA, 15 bp, Homo sapiens
tgaggtgggaggatg

SEQ ID NO: 356219 - DNA, 15 bp, Homo sapiens
gaggtgggaggatgg

SEQ ID NO: 356220 - DNA, 15 bp, Homo sapiens
aggtgggaggatggc

SEQ ID NO: 356221 - DNA, 15 bp, Homo sapiens
ggtgggaggatggct

SEQ ID NO: 356222 - DNA, 15 bp, Homo sapiens
gtgggaggatggctt

SEQ ID NO: 356223 - DNA, 15 bp, Homo sapiens
tgggaggatggcttg

SEQ ID NO: 356224 - DNA, 15 bp, Homo sapiens
gggaggatggcttga

SEQ ID NO: 356225 - DNA, 15 bp, Homo sapiens
atggcttgagcccag

SEQ ID NO: 356226 - DNA, 15 bp, Homo sapiens
tggcttgagcccagg

SEQ ID NO: 356227 - DNA, 15 bp, Homo sapiens
ggcttgagcccaggg

SEQ ID NO: 356228 - DNA, 15 bp, Homo sapiens
cttgagcccagggga

SEQ ID NO: 356229 - DNA, 15 bp, Homo sapiens
ttgagcccaggggat

SEQ ID NO: 356230 - DNA, 15 bp, Homo sapiens
tgagcccaggggatg

SEQ ID NO: 356231 - DNA, 15 bp, Homo sapiens
gagcccaggggatgg

SEQ ID NO: 356232 - DNA, 15 bp, Homo sapiens
agcccaggggatgga

SEQ ID NO: 356233 - DNA, 15 bp, Homo sapiens
gcccaggggatggag

SEQ ID NO: 356234 - DNA, 15 bp, Homo sapiens
cccaggggatggagg

SEQ ID NO: 356235 - DNA, 15 bp, Homo sapiens
ccaggggatggaggt

SEQ ID NO: 356236 - DNA, 15 bp, Homo sapiens
caggggatggaggtt

SEQ ID NO: 356237 - DNA, 15 bp, Homo sapiens
aggggatggaggttg

SEQ ID NO: 356238 - DNA, 15 bp, Homo sapiens
ggggatggaggttgc

SEQ ID NO: 356239 - DNA, 15 bp, Homo sapiens
gggatggaggttgca

SEQ ID NO: 356240 - DNA, 15 bp, Homo sapiens
ggatggaggttgcag

SEQ ID NO: 356241 - DNA, 15 bp, Homo sapiens
gatggaggttgcagt

SEQ ID NO: 356242 - DNA, 15 bp, Homo sapiens
atggaggttgcagtg

SEQ ID NO: 356243 - DNA, 15 bp, Homo sapiens
gcagtgagctgagac

SEQ ID NO: 356244 - DNA, 15 bp, Homo sapiens
cagtgagctgagact

SEQ ID NO: 356245 - DNA, 15 bp, Homo sapiens
agtgagctgagactg

SEQ ID NO: 356246 - DNA, 15 bp, Homo sapiens
gtgagctgagactgc

SEQ ID NO: 356247 - DNA, 15 bp, Homo sapiens
tgagctgagactgca

SEQ ID NO: 356248 - DNA, 15 bp, Homo sapiens
gagctgagactgcac

SEQ ID NO: 356249 - DNA, 15 bp, Homo sapiens
agctgagactgcacc

SEQ ID NO: 356250 - DNA, 15 bp, Homo sapiens
gctgagactgcacca

SEQ ID NO: 356251 - DNA, 15 bp, Homo sapiens
ctgagactgcaccac

SEQ ID NO: 356252 - DNA, 15 bp, Homo sapiens
tgagactgcaccact

SEQ ID NO: 356253 - DNA, 15 bp, Homo sapiens
gagactgcaccactg

SEQ ID NO: 356254 - DNA, 15 bp, Homo sapiens
agactgcaccactgc

SEQ ID NO: 356255 - DNA, 15 bp, Homo sapiens
gactgcaccactgca

SEQ ID NO: 356256 - DNA, 15 bp, Homo sapiens
actgcaccactgcac

SEQ ID NO: 356257 - DNA, 15 bp, Homo sapiens
ctgcaccactgcact

SEQ ID NO: 356258 - DNA, 15 bp, Homo sapiens
tgcaccactgcactc

SEQ ID NO: 356259 - DNA, 15 bp, Homo sapiens
tccagcctgggcgaa

SEQ ID NO: 356260 - DNA, 15 bp, Homo sapiens
ccagcctgggcgaaa

SEQ ID NO: 356261 - DNA, 15 bp, Homo sapiens
cagcctgggcgaaag

SEQ ID NO: 356262 - DNA, 15 bp, Homo sapiens
agcctgggcgaaaga

SEQ ID NO: 356263 - DNA, 15 bp, Homo sapiens
gcctgggcgaaagag

SEQ ID NO: 356264 - DNA, 15 bp, Homo sapiens
cctgggcgaaagagc

SEQ ID NO: 356265 - DNA, 15 bp, Homo sapiens
ctgggcgaaagagcc

SEQ ID NO: 356266 - DNA, 15 bp, Homo sapiens
tgggcgaaagagcca

SEQ ID NO: 356267 - DNA, 15 bp, Homo sapiens
gggcgaaagagccag

SEQ ID NO: 356268 - DNA, 15 bp, Homo sapiens
ggcgaaagagccaga

SEQ ID NO: 356269 - DNA, 15 bp, Homo sapiens
gcgaaagagccagat

SEQ ID NO: 356270 - DNA, 15 bp, Homo sapiens
cgaaagagccagatc

SEQ ID NO: 356271 - DNA, 15 bp, Homo sapiens
gaaagagccagatcc

SEQ ID NO: 356272 - DNA, 15 bp, Homo sapiens
aaagagccagatcct

SEQ ID NO: 356273 - DNA, 15 bp, Homo sapiens
aagagccagatcctg

SEQ ID NO: 356274 - DNA, 15 bp, Homo sapiens
agagccagatcctgt

SEQ ID NO: 356275 - DNA, 15 bp, Homo sapiens
gagccagatcctgtc

SEQ ID NO: 356276 - DNA, 15 bp, Homo sapiens
agccagatcctgtct

SEQ ID NO: 356277 - DNA, 15 bp, Homo sapiens
gccagatcctgtctt

SEQ ID NO: 356278 - DNA, 15 bp, Homo sapiens
ccagatcctgtctta

SEQ ID NO: 356279 - DNA, 15 bp, Homo sapiens
cagatcctgtcttaa

SEQ ID NO: 356280 - DNA, 15 bp, Homo sapiens
agatcctgtcttaaa

SEQ ID NO: 356281 - DNA, 15 bp, Homo sapiens
gatcctgtcttaaaa

SEQ ID NO: 356282 - DNA, 15 bp, Homo sapiens
atcctgtcttaaaaa

SEQ ID NO: 356283 - DNA, 15 bp, Homo sapiens
tcctgtcttaaaaaa

SEQ ID NO: 356284 - DNA, 15 bp, Homo sapiens
cctgtcttaaaaaaa

SEQ ID NO: 356285 - DNA, 15 bp, Homo sapiens
ctgtcttaaaaaaaa

SEQ ID NO: 356286 - DNA, 15 bp, Homo sapiens
tgtcttaaaaaaaaa

SEQ ID NO: 356287 - DNA, 15 bp, Homo sapiens
tcttaaaaaaaaaac

SEQ ID NO: 356288 - DNA, 15 bp, Homo sapiens
cttaaaaaaaaaaca

SEQ ID NO: 356289 - DNA, 15 bp, Homo sapiens
aaaaaaaaaacaaaa

SEQ ID NO: 356290 - DNA, 15 bp, Homo sapiens
aaaaaaaacaaaaat

SEQ ID NO: 356291 - DNA, 15 bp, Homo sapiens
aaaaaaacaaaaatt

SEQ ID NO: 356292 - DNA, 15 bp, Homo sapiens
aaaaaacaaaaattg

SEQ ID NO: 356293 - DNA, 15 bp, Homo sapiens
aaaaacaaaaattgt

SEQ ID NO: 356294 - DNA, 15 bp, Homo sapiens
aaaacaaaaattgta

SEQ ID NO: 356295 - DNA, 15 bp, Homo sapiens
aaacaaaaattgtag

SEQ ID NO: 356296 - DNA, 15 bp, Homo sapiens
aacaaaaattgtaga

SEQ ID NO: 356297 - DNA, 15 bp, Homo sapiens
acaaaaattgtagag

SEQ ID NO: 356298 - DNA, 15 bp, Homo sapiens
caaaaattgtagaga

SEQ ID NO: 356299 - DNA, 15 bp, Homo sapiens
aaaaattgtagagat

SEQ ID NO: 356300 - DNA, 15 bp, Homo sapiens
aaaattgtagagatg

SEQ ID NO: 356301 - DNA, 15 bp, Homo sapiens
aaattgtagagatgg

SEQ ID NO: 356302 - DNA, 15 bp, Homo sapiens
aattgtagagatggg

SEQ ID NO: 356303 - DNA, 15 bp, Homo sapiens
attgtagagatgggg

SEQ ID NO: 356304 - DNA, 15 bp, Homo sapiens
tgtagagatggggtt

SEQ ID NO: 356305 - DNA, 15 bp, Homo sapiens
gtagagatggggttc

SEQ ID NO: 356306 - DNA, 15 bp, Homo sapiens
tagagatggggttct

SEQ ID NO: 356307 - DNA, 15 bp, Homo sapiens
agagatggggttctt

SEQ ID NO: 356308 - DNA, 15 bp, Homo sapiens
gagatggggttctta

SEQ ID NO: 356309 - DNA, 15 bp, Homo sapiens
agatggggttcttag

SEQ ID NO: 356310 - DNA, 15 bp, Homo sapiens
gatggggttcttaga

SEQ ID NO: 356311 - DNA, 15 bp, Homo sapiens
atggggttcttagag

SEQ ID NO: 356312 - DNA, 15 bp, Homo sapiens
tggggttcttagagg

SEQ ID NO: 356313 - DNA, 15 bp, Homo sapiens
ggggttcttagaggc

SEQ ID NO: 356314 - DNA, 15 bp, Homo sapiens
gggttcttagaggct

SEQ ID NO: 356315 - DNA, 15 bp, Homo sapiens
ggttcttagaggctg

SEQ ID NO: 356316 - DNA, 15 bp, Homo sapiens
gttcttagaggctga

SEQ ID NO: 356317 - DNA, 15 bp, Homo sapiens
ttcttagaggctgag

SEQ ID NO: 356318 - DNA, 15 bp, Homo sapiens
tcttagaggctgagg

SEQ ID NO: 356319 - DNA, 15 bp, Homo sapiens
cttagaggctgaggc

SEQ ID NO: 356320 - DNA, 15 bp, Homo sapiens
ttagaggctgaggca

SEQ ID NO: 356321 - DNA, 15 bp, Homo sapiens
tagaggctgaggcaa

SEQ ID NO: 356322 - DNA, 15 bp, Homo sapiens
agaggctgaggcaaa

SEQ ID NO: 356323 - DNA, 15 bp, Homo sapiens
gaggctgaggcaaaa

SEQ ID NO: 356324 - DNA, 15 bp, Homo sapiens
aggctgaggcaaaag

SEQ ID NO: 356325 - DNA, 15 bp, Homo sapiens
ggctgaggcaaaagg

SEQ ID NO: 356326 - DNA, 15 bp, Homo sapiens
gctgaggcaaaagga

SEQ ID NO: 356327 - DNA, 15 bp, Homo sapiens
ctgaggcaaaaggat

SEQ ID NO: 356328 - DNA, 15 bp, Homo sapiens
tgaggcaaaaggatg

SEQ ID NO: 356329 - DNA, 15 bp, Homo sapiens
gaggcaaaaggatgg

SEQ ID NO: 356330 - DNA, 15 bp, Homo sapiens
aggcaaaaggatggc

SEQ ID NO: 356331 - DNA, 15 bp, Homo sapiens
ggcaaaaggatggct

SEQ ID NO: 356332 - DNA, 15 bp, Homo sapiens
gcaaaaggatggctt

SEQ ID NO: 356333 - DNA, 15 bp, Homo sapiens
caaaaggatggcttg

SEQ ID NO: 356334 - DNA, 15 bp, Homo sapiens
aaaaggatggcttga

SEQ ID NO: 356335 - DNA, 15 bp, Homo sapiens
aaaggatggcttgag

SEQ ID NO: 356336 - DNA, 15 bp, Homo sapiens
aaggatggcttgagg

SEQ ID NO: 356337 - DNA, 15 bp, Homo sapiens
aggatggcttgaggt

SEQ ID NO: 356338 - DNA, 15 bp, Homo sapiens
ggatggcttgaggtc

SEQ ID NO: 356339 - DNA, 15 bp, Homo sapiens
gatggcttgaggtca

SEQ ID NO: 356340 - DNA, 15 bp, Homo sapiens
atggcttgaggtcag

SEQ ID NO: 356341 - DNA, 15 bp, Homo sapiens
tggcttgaggtcagc

SEQ ID NO: 356342 - DNA, 15 bp, Homo sapiens
ggcttgaggtcagca

SEQ ID NO: 356343 - DNA, 15 bp, Homo sapiens
gcttgaggtcagcag

SEQ ID NO: 356344 - DNA, 15 bp, Homo sapiens
cttgaggtcagcagt

SEQ ID NO: 356345 - DNA, 15 bp, Homo sapiens
ttgaggtcagcagtt

SEQ ID NO: 356346 - DNA, 15 bp, Homo sapiens
tgaggtcagcagttt

SEQ ID NO: 356347 - DNA, 15 bp, Homo sapiens
gaggtcagcagtttg

SEQ ID NO: 356348 - DNA, 15 bp, Homo sapiens
aggtcagcagtttga

SEQ ID NO: 356349 - DNA, 15 bp, Homo sapiens
ggtcagcagtttgag

SEQ ID NO: 356350 - DNA, 15 bp, Homo sapiens
gtcagcagtttgaga

SEQ ID NO: 356351 - DNA, 15 bp, Homo sapiens
tcagcagtttgagac

SEQ ID NO: 356352 - DNA, 15 bp, Homo sapiens
cagcagtttgagacc

SEQ ID NO: 356353 - DNA, 15 bp, Homo sapiens
agcagtttgagacca

SEQ ID NO: 356354 - DNA, 15 bp, Homo sapiens
gcagtttgagaccag

SEQ ID NO: 356355 - DNA, 15 bp, Homo sapiens
cagtttgagaccaga

SEQ ID NO: 356356 - DNA, 15 bp, Homo sapiens
agtttgagaccagat

SEQ ID NO: 356357 - DNA, 15 bp, Homo sapiens
gtttgagaccagatg

SEQ ID NO: 356358 - DNA, 15 bp, Homo sapiens
tttgagaccagatgc

SEQ ID NO: 356359 - DNA, 15 bp, Homo sapiens
ttgagaccagatgcc

SEQ ID NO: 356360 - DNA, 15 bp, Homo sapiens
tgagaccagatgcca

SEQ ID NO: 356361 - DNA, 15 bp, Homo sapiens
gagaccagatgccag

SEQ ID NO: 356362 - DNA, 15 bp, Homo sapiens
agaccagatgccagt

SEQ ID NO: 356363 - DNA, 15 bp, Homo sapiens
gaccagatgccagtc

SEQ ID NO: 356364 - DNA, 15 bp, Homo sapiens
accagatgccagtct

SEQ ID NO: 356365 - DNA, 15 bp, Homo sapiens
ccagatgccagtctg

SEQ ID NO: 356366 - DNA, 15 bp, Homo sapiens
cagatgccagtctgg

SEQ ID NO: 356367 - DNA, 15 bp, Homo sapiens
agatgccagtctggt

SEQ ID NO: 356368 - DNA, 15 bp, Homo sapiens
gatgccagtctggtc

SEQ ID NO: 356369 - DNA, 15 bp, Homo sapiens
atgccagtctggtca

SEQ ID NO: 356370 - DNA, 15 bp, Homo sapiens
tgccagtctggtcag

SEQ ID NO: 356371 - DNA, 15 bp, Homo sapiens
gccagtctggtcaga

SEQ ID NO: 356372 - DNA, 15 bp, Homo sapiens
ccagtctggtcagat

SEQ ID NO: 356373 - DNA, 15 bp, Homo sapiens
cagtctggtcagatg

SEQ ID NO: 356374 - DNA, 15 bp, Homo sapiens
agtctggtcagatgc

SEQ ID NO: 356375 - DNA, 15 bp, Homo sapiens
gtctggtcagatgct

SEQ ID NO: 356376 - DNA, 15 bp, Homo sapiens
tctggtcagatgctg

SEQ ID NO: 356377 - DNA, 15 bp, Homo sapiens
ctggtcagatgctgc

SEQ ID NO: 356378 - DNA, 15 bp, Homo sapiens
tggtcagatgctgct

SEQ ID NO: 356379 - DNA, 15 bp, Homo sapiens
ggtcagatgctgctg

SEQ ID NO: 356380 - DNA, 15 bp, Homo sapiens
gtcagatgctgctga

SEQ ID NO: 356381 - DNA, 15 bp, Homo sapiens
tcagatgctgctgac

SEQ ID NO: 356382 - DNA, 15 bp, Homo sapiens
cagatgctgctgacc

SEQ ID NO: 356383 - DNA, 15 bp, Homo sapiens
agatgctgctgacct

SEQ ID NO: 356384 - DNA, 15 bp, Homo sapiens
gatgctgctgacctc

SEQ ID NO: 356385 - DNA, 15 bp, Homo sapiens
atgctgctgacctca

SEQ ID NO: 356386 - DNA, 15 bp, Homo sapiens
tgctgctgacctcaa

SEQ ID NO: 356387 - DNA, 15 bp, Homo sapiens
gctgctgacctcaag

SEQ ID NO: 356388 - DNA, 15 bp, Homo sapiens
ctgctgacctcaagc

SEQ ID NO: 356389 - DNA, 15 bp, Homo sapiens
tgctgacctcaagca

SEQ ID NO: 356390 - DNA, 15 bp, Homo sapiens
gctgacctcaagcaa

SEQ ID NO: 356391 - DNA, 15 bp, Homo sapiens
ctgacctcaagcaat

SEQ ID NO: 356392 - DNA, 15 bp, Homo sapiens
tgacctcaagcaatc

SEQ ID NO: 356393 - DNA, 15 bp, Homo sapiens
gacctcaagcaatcc

SEQ ID NO: 356394 - DNA, 15 bp, Homo sapiens
acctcaagcaatcct

SEQ ID NO: 356395 - DNA, 15 bp, Homo sapiens
cctcaagcaatcctc

SEQ ID NO: 356396 - DNA, 15 bp, Homo sapiens
ctcaagcaatcctcc

SEQ ID NO: 356397 - DNA, 15 bp, Homo sapiens
caatcctcctgcctc

SEQ ID NO: 356398 - DNA, 15 bp, Homo sapiens
aatcctcctgcctca

SEQ ID NO: 356399 - DNA, 15 bp, Homo sapiens
atcctcctgcctcag

SEQ ID NO: 356400 - DNA, 15 bp, Homo sapiens
tcctcctgcctcagc

SEQ ID NO: 356401 - DNA, 15 bp, Homo sapiens
cctcctgcctcagcc

SEQ ID NO: 356402 - DNA, 15 bp, Homo sapiens
tcagcctcccaaagc

SEQ ID NO: 356403 - DNA, 15 bp, Homo sapiens
cagcctcccaaagcg

SEQ ID NO: 356404 - DNA, 15 bp, Homo sapiens
agcctcccaaagcgt

SEQ ID NO: 356405 - DNA, 15 bp, Homo sapiens
gcctcccaaagcgtg

SEQ ID NO: 356406 - DNA, 15 bp, Homo sapiens
cctcccaaagcgtgg

SEQ ID NO: 356407 - DNA, 15 bp, Homo sapiens
ctcccaaagcgtgga

SEQ ID NO: 356408 - DNA, 15 bp, Homo sapiens
tcccaaagcgtggag

SEQ ID NO: 356409 - DNA, 15 bp, Homo sapiens
cccaaagcgtggaga

SEQ ID NO: 356410 - DNA, 15 bp, Homo sapiens
ccaaagcgtggagat

SEQ ID NO: 356411 - DNA, 15 bp, Homo sapiens
caaagcgtggagatc

SEQ ID NO: 356412 - DNA, 15 bp, Homo sapiens
aaagcgtggagatca

SEQ ID NO: 356413 - DNA, 15 bp, Homo sapiens
aagcgtggagatcac

SEQ ID NO: 356414 - DNA, 15 bp, Homo sapiens
agcgtggagatcaca

SEQ ID NO: 356415 - DNA, 15 bp, Homo sapiens
gcgtggagatcacag

SEQ ID NO: 356416 - DNA, 15 bp, Homo sapiens
cgtggagatcacagg

SEQ ID NO: 356417 - DNA, 15 bp, Homo sapiens
gtggagatcacaggc

SEQ ID NO: 356418 - DNA, 15 bp, Homo sapiens
tggagatcacaggca

SEQ ID NO: 356419 - DNA, 15 bp, Homo sapiens
ggagatcacaggcat

SEQ ID NO: 356420 - DNA, 15 bp, Homo sapiens
gagatcacaggcatg

SEQ ID NO: 356421 - DNA, 15 bp, Homo sapiens
agatcacaggcatgg

SEQ ID NO: 356422 - DNA, 15 bp, Homo sapiens
gatcacaggcatggg

SEQ ID NO: 356423 - DNA, 15 bp, Homo sapiens
atcacaggcatgggc

SEQ ID NO: 356424 - DNA, 15 bp, Homo sapiens
tcacaggcatgggcc

SEQ ID NO: 356425 - DNA, 15 bp, Homo sapiens
cacaggcatgggcca

SEQ ID NO: 356426 - DNA, 15 bp, Homo sapiens
acaggcatgggccat

SEQ ID NO: 356427 - DNA, 15 bp, Homo sapiens
caggcatgggccatt

SEQ ID NO: 356428 - DNA, 15 bp, Homo sapiens
aggcatgggccattg

SEQ ID NO: 356429 - DNA, 15 bp, Homo sapiens
ggcatgggccattgc

SEQ ID NO: 356430 - DNA, 15 bp, Homo sapiens
gcatgggccattgca

SEQ ID NO: 356431 - DNA, 15 bp, Homo sapiens
catgggccattgcac

SEQ ID NO: 356432 - DNA, 15 bp, Homo sapiens
atgggccattgcact

SEQ ID NO: 356433 - DNA, 15 bp, Homo sapiens
tgggccattgcactc

SEQ ID NO: 356434 - DNA, 15 bp, Homo sapiens
gggccattgcactcg

SEQ ID NO: 356435 - DNA, 15 bp, Homo sapiens
ggccattgcactcgg

SEQ ID NO: 356436 - DNA, 15 bp, Homo sapiens
gccattgcactcggc

SEQ ID NO: 356437 - DNA, 15 bp, Homo sapiens
ccattgcactcggcc

SEQ ID NO: 356438 - DNA, 15 bp, Homo sapiens
cattgcactcggcct

SEQ ID NO: 356439 - DNA, 15 bp, Homo sapiens
attgcactcggcctc

SEQ ID NO: 356440 - DNA, 15 bp, Homo sapiens
ttgcactcggcctct

SEQ ID NO: 356441 - DNA, 15 bp, Homo sapiens
tgcactcggcctctc

SEQ ID NO: 356442 - DNA, 15 bp, Homo sapiens
gcactcggcctctct

SEQ ID NO: 356443 - DNA, 15 bp, Homo sapiens
cactcggcctctctc

SEQ ID NO: 356444 - DNA, 15 bp, Homo sapiens
actcggcctctctct

SEQ ID NO: 356445 - DNA, 15 bp, Homo sapiens
ctcggcctctctctg

SEQ ID NO: 356446 - DNA, 15 bp, Homo sapiens
tcggcctctctctgg

SEQ ID NO: 356447 - DNA, 15 bp, Homo sapiens
cggcctctctctggt

SEQ ID NO: 356448 - DNA, 15 bp, Homo sapiens
ggcctctctctggtt

SEQ ID NO: 356449 - DNA, 15 bp, Homo sapiens
gcctctctctggttt

SEQ ID NO: 356450 - DNA, 15 bp, Homo sapiens
cctctctctggtttt

SEQ ID NO: 356451 - DNA, 15 bp, Homo sapiens
ctctctctggttttc

SEQ ID NO: 356452 - DNA, 15 bp, Homo sapiens
tctctctggttttca

SEQ ID NO: 356453 - DNA, 15 bp, Homo sapiens
ctctctggttttcat

SEQ ID NO: 356454 - DNA, 15 bp, Homo sapiens
tctctggttttcatg

SEQ ID NO: 356455 - DNA, 15 bp, Homo sapiens
ctctggttttcatgt

SEQ ID NO: 356456 - DNA, 15 bp, Homo sapiens
tctggttttcatgtg

SEQ ID NO: 356457 - DNA, 15 bp, Homo sapiens
ctggttttcatgtga

SEQ ID NO: 356458 - DNA, 15 bp, Homo sapiens
tggttttcatgtgaa

SEQ ID NO: 356459 - DNA, 15 bp, Homo sapiens
ggttttcatgtgaat

SEQ ID NO: 356460 - DNA, 15 bp, Homo sapiens
gttttcatgtgaata

SEQ ID NO: 356461 - DNA, 15 bp, Homo sapiens
ttttcatgtgaatag

SEQ ID NO: 356462 - DNA, 15 bp, Homo sapiens
tttcatgtgaatagt

SEQ ID NO: 356463 - DNA, 15 bp, Homo sapiens
ttcatgtgaatagtt

SEQ ID NO: 356464 - DNA, 15 bp, Homo sapiens
tcatgtgaatagttt

SEQ ID NO: 356465 - DNA, 15 bp, Homo sapiens
catgtgaatagtttg

SEQ ID NO: 356466 - DNA, 15 bp, Homo sapiens
atgtgaatagtttgc

SEQ ID NO: 356467 - DNA, 15 bp, Homo sapiens
tgtgaatagtttgct

SEQ ID NO: 356468 - DNA, 15 bp, Homo sapiens
gtgaatagtttgctc

SEQ ID NO: 356469 - DNA, 15 bp, Homo sapiens
tgaatagtttgctct

SEQ ID NO: 356470 - DNA, 15 bp, Homo sapiens
gaatagtttgctctg

SEQ ID NO: 356471 - DNA, 15 bp, Homo sapiens
aatagtttgctctgg

SEQ ID NO: 356472 - DNA, 15 bp, Homo sapiens
atagtttgctctggg

SEQ ID NO: 356473 - DNA, 15 bp, Homo sapiens
tagtttgctctggga

SEQ ID NO: 356474 - DNA, 15 bp, Homo sapiens
agtttgctctgggaa

SEQ ID NO: 356475 - DNA, 15 bp, Homo sapiens
gtttgctctgggaag

SEQ ID NO: 356476 - DNA, 15 bp, Homo sapiens
tttgctctgggaagg

SEQ ID NO: 356477 - DNA, 15 bp, Homo sapiens
ttgctctgggaaggc

SEQ ID NO: 356478 - DNA, 15 bp, Homo sapiens
tgctctgggaaggca

SEQ ID NO: 356479 - DNA, 15 bp, Homo sapiens
gctctgggaaggcag

SEQ ID NO: 356480 - DNA, 15 bp, Homo sapiens
ctctgggaaggcagg

SEQ ID NO: 356481 - DNA, 15 bp, Homo sapiens
tctgggaaggcagga

SEQ ID NO: 356482 - DNA, 15 bp, Homo sapiens
ctgggaaggcaggaa

SEQ ID NO: 356483 - DNA, 15 bp, Homo sapiens
tgggaaggcaggaat

SEQ ID NO: 356484 - DNA, 15 bp, Homo sapiens
gggaaggcaggaatg

SEQ ID NO: 356485 - DNA, 15 bp, Homo sapiens
ggaaggcaggaatga

SEQ ID NO: 356486 - DNA, 15 bp, Homo sapiens
gaaggcaggaatgaa

SEQ ID NO: 356487 - DNA, 15 bp, Homo sapiens
aaggcaggaatgaaa

SEQ ID NO: 356488 - DNA, 15 bp, Homo sapiens
aggcaggaatgaaaa

SEQ ID NO: 356489 - DNA, 15 bp, Homo sapiens
ggcaggaatgaaaac

SEQ ID NO: 356490 - DNA, 15 bp, Homo sapiens
gcaggaatgaaaaca

SEQ ID NO: 356491 - DNA, 15 bp, Homo sapiens
caggaatgaaaacag

SEQ ID NO: 356492 - DNA, 15 bp, Homo sapiens
aggaatgaaaacaga

SEQ ID NO: 356493 - DNA, 15 bp, Homo sapiens
ggaatgaaaacagaa

SEQ ID NO: 356494 - DNA, 15 bp, Homo sapiens
gaatgaaaacagaaa

SEQ ID NO: 356495 - DNA, 15 bp, Homo sapiens
aatgaaaacagaaag

SEQ ID NO: 356496 - DNA, 15 bp, Homo sapiens
atgaaaacagaaaga

SEQ ID NO: 356497 - DNA, 15 bp, Homo sapiens
tgaaaacagaaagaa

SEQ ID NO: 356498 - DNA, 15 bp, Homo sapiens
gaaaacagaaagaat

SEQ ID NO: 356499 - DNA, 15 bp, Homo sapiens
aaaacagaaagaatt

SEQ ID NO: 356500 - DNA, 15 bp, Homo sapiens
aaacagaaagaattc

SEQ ID NO: 356501 - DNA, 15 bp, Homo sapiens
aacagaaagaattct

SEQ ID NO: 356502 - DNA, 15 bp, Homo sapiens
acagaaagaattctt

SEQ ID NO: 356503 - DNA, 15 bp, Homo sapiens
cagaaagaattctta

SEQ ID NO: 356504 - DNA, 15 bp, Homo sapiens
agaaagaattcttat

SEQ ID NO: 356505 - DNA, 15 bp, Homo sapiens
gaaagaattcttata

SEQ ID NO: 356506 - DNA, 15 bp, Homo sapiens
aaagaattcttataa

SEQ ID NO: 356507 - DNA, 15 bp, Homo sapiens
aagaattcttataag

SEQ ID NO: 356508 - DNA, 15 bp, Homo sapiens
agaattcttataagg

SEQ ID NO: 356509 - DNA, 15 bp, Homo sapiens
gaattcttataaggt

SEQ ID NO: 356510 - DNA, 15 bp, Homo sapiens
aattcttataaggtt

SEQ ID NO: 356511 - DNA, 15 bp, Homo sapiens
attcttataaggtta

SEQ ID NO: 356512 - DNA, 15 bp, Homo sapiens
ttcttataaggttac

SEQ ID NO: 356513 - DNA, 15 bp, Homo sapiens
tcttataaggttact

SEQ ID NO: 356514 - DNA, 15 bp, Homo sapiens
cttataaggttactg

SEQ ID NO: 356515 - DNA, 15 bp, Homo sapiens
ttataaggttactgc

SEQ ID NO: 356516 - DNA, 15 bp, Homo sapiens
tataaggttactgca

SEQ ID NO: 356517 - DNA, 15 bp, Homo sapiens
ataaggttactgcag

SEQ ID NO: 356518 - DNA, 15 bp, Homo sapiens
taaggttactgcagg

SEQ ID NO: 356519 - DNA, 15 bp, Homo sapiens
aaggttactgcaggc

SEQ ID NO: 356520 - DNA, 15 bp, Homo sapiens
aggttactgcaggct

SEQ ID NO: 356521 - DNA, 15 bp, Homo sapiens
ggttactgcaggctt

SEQ ID NO: 356522 - DNA, 15 bp, Homo sapiens
gttactgcaggcttg

SEQ ID NO: 356523 - DNA, 15 bp, Homo sapiens
ttactgcaggcttgg

SEQ ID NO: 356524 - DNA, 15 bp, Homo sapiens
tactgcaggcttgga

SEQ ID NO: 356525 - DNA, 15 bp, Homo sapiens
actgcaggcttggag

SEQ ID NO: 356526 - DNA, 15 bp, Homo sapiens
ctgcaggcttggaga

SEQ ID NO: 356527 - DNA, 15 bp, Homo sapiens
tgcaggcttggagag

SEQ ID NO: 356528 - DNA, 15 bp, Homo sapiens
gcaggcttggagaga

SEQ ID NO: 356529 - DNA, 15 bp, Homo sapiens
caggcttggagagag

SEQ ID NO: 356530 - DNA, 15 bp, Homo sapiens
aggcttggagagaga

SEQ ID NO: 356531 - DNA, 15 bp, Homo sapiens
ggcttggagagagag

SEQ ID NO: 356532 - DNA, 15 bp, Homo sapiens
gcttggagagagagg

SEQ ID NO: 356533 - DNA, 15 bp, Homo sapiens
cttggagagagagga

SEQ ID NO: 356534 - DNA, 15 bp, Homo sapiens
ttggagagagaggat

SEQ ID NO: 356535 - DNA, 15 bp, Homo sapiens
tggagagagaggatg

SEQ ID NO: 356536 - DNA, 15 bp, Homo sapiens
ggagagagaggatgg

SEQ ID NO: 356537 - DNA, 15 bp, Homo sapiens
gagagagaggatgga

SEQ ID NO: 356538 - DNA, 15 bp, Homo sapiens
agagagaggatggac

SEQ ID NO: 356539 - DNA, 15 bp, Homo sapiens
gagagaggatggacc

SEQ ID NO: 356540 - DNA, 15 bp, Homo sapiens
agagaggatggaccc

SEQ ID NO: 356541 - DNA, 15 bp, Homo sapiens
gagaggatggaccca

SEQ ID NO: 356542 - DNA, 15 bp, Homo sapiens
agaggatggacccat

SEQ ID NO: 356543 - DNA, 15 bp, Homo sapiens
gaggatggacccata

SEQ ID NO: 356544 - DNA, 15 bp, Homo sapiens
aggatggacccatac

SEQ ID NO: 356545 - DNA, 15 bp, Homo sapiens
ggatggacccataca

SEQ ID NO: 356546 - DNA, 15 bp, Homo sapiens
gatggacccatacac

SEQ ID NO: 356547 - DNA, 15 bp, Homo sapiens
atggacccatacact

SEQ ID NO: 356548 - DNA, 15 bp, Homo sapiens
tggacccatacacta

SEQ ID NO: 356549 - DNA, 15 bp, Homo sapiens
ggacccatacactag

SEQ ID NO: 356550 - DNA, 15 bp, Homo sapiens
gacccatacactagg

SEQ ID NO: 356551 - DNA, 15 bp, Homo sapiens
acccatacactaggg

SEQ ID NO: 356552 - DNA, 15 bp, Homo sapiens
cccatacactaggga

SEQ ID NO: 356553 - DNA, 15 bp, Homo sapiens
ccatacactagggag

SEQ ID NO: 356554 - DNA, 15 bp, Homo sapiens
catacactagggagg

SEQ ID NO: 356555 - DNA, 15 bp, Homo sapiens
atacactagggaggc

SEQ ID NO: 356556 - DNA, 15 bp, Homo sapiens
tacactagggaggct

SEQ ID NO: 356557 - DNA, 15 bp, Homo sapiens
acactagggaggctt

SEQ ID NO: 356558 - DNA, 15 bp, Homo sapiens
cactagggaggctta

SEQ ID NO: 356559 - DNA, 15 bp, Homo sapiens
actagggaggcttaa

SEQ ID NO: 356560 - DNA, 15 bp, Homo sapiens
ctagggaggcttaac

SEQ ID NO: 356561 - DNA, 15 bp, Homo sapiens
tagggaggcttaacg

SEQ ID NO: 356562 - DNA, 15 bp, Homo sapiens
agggaggcttaacga

SEQ ID NO: 356563 - DNA, 15 bp, Homo sapiens
gggaggcttaacgaa

SEQ ID NO: 356564 - DNA, 15 bp, Homo sapiens
ggaggcttaacgaag

SEQ ID NO: 356565 - DNA, 15 bp, Homo sapiens
gaggcttaacgaagt

SEQ ID NO: 356566 - DNA, 15 bp, Homo sapiens
aggcttaacgaagta

SEQ ID NO: 356567 - DNA, 15 bp, Homo sapiens
ggcttaacgaagtag

SEQ ID NO: 356568 - DNA, 15 bp, Homo sapiens
gcttaacgaagtagt

SEQ ID NO: 356569 - DNA, 15 bp, Homo sapiens
cttaacgaagtagtg

SEQ ID NO: 356570 - DNA, 15 bp, Homo sapiens
ttaacgaagtagtga

SEQ ID NO: 356571 - DNA, 15 bp, Homo sapiens
taacgaagtagtgat

SEQ ID NO: 356572 - DNA, 15 bp, Homo sapiens
aacgaagtagtgatg

SEQ ID NO: 356573 - DNA, 15 bp, Homo sapiens
acgaagtagtgatgg

SEQ ID NO: 356574 - DNA, 15 bp, Homo sapiens
cgaagtagtgatgga

SEQ ID NO: 356575 - DNA, 15 bp, Homo sapiens
gaagtagtgatggag

SEQ ID NO: 356576 - DNA, 15 bp, Homo sapiens
aagtagtgatggagg

SEQ ID NO: 356577 - DNA, 15 bp, Homo sapiens
agtagtgatggaggg

SEQ ID NO: 356578 - DNA, 15 bp, Homo sapiens
gtagtgatggagggc

SEQ ID NO: 356579 - DNA, 15 bp, Homo sapiens
tagtgatggagggca

SEQ ID NO: 356580 - DNA, 15 bp, Homo sapiens
agtgatggagggcat

SEQ ID NO: 356581 - DNA, 15 bp, Homo sapiens
gtgatggagggcatg

SEQ ID NO: 356582 - DNA, 15 bp, Homo sapiens
tgatggagggcatga

SEQ ID NO: 356583 - DNA, 15 bp, Homo sapiens
gatggagggcatgag

SEQ ID NO: 356584 - DNA, 15 bp, Homo sapiens
atggagggcatgaga

SEQ ID NO: 356585 - DNA, 15 bp, Homo sapiens
tggagggcatgagaa

SEQ ID NO: 356586 - DNA, 15 bp, Homo sapiens
ggagggcatgagaaa

SEQ ID NO: 356587 - DNA, 15 bp, Homo sapiens
gagggcatgagaaat

SEQ ID NO: 356588 - DNA, 15 bp, Homo sapiens
agggcatgagaaata

SEQ ID NO: 356589 - DNA, 15 bp, Homo sapiens
gggcatgagaaatat

SEQ ID NO: 356590 - DNA, 15 bp, Homo sapiens
ggcatgagaaatatt

SEQ ID NO: 356591 - DNA, 15 bp, Homo sapiens
gcatgagaaatatta

SEQ ID NO: 356592 - DNA, 15 bp, Homo sapiens
catgagaaatattag

SEQ ID NO: 356593 - DNA, 15 bp, Homo sapiens
atgagaaatattagg

SEQ ID NO: 356594 - DNA, 15 bp, Homo sapiens
tgagaaatattaggt

SEQ ID NO: 356595 - DNA, 15 bp, Homo sapiens
gagaaatattaggtt

SEQ ID NO: 356596 - DNA, 15 bp, Homo sapiens
agaaatattaggttt

SEQ ID NO: 356597 - DNA, 15 bp, Homo sapiens
gaaatattaggtttg

SEQ ID NO: 356598 - DNA, 15 bp, Homo sapiens
aaatattaggtttga

SEQ ID NO: 356599 - DNA, 15 bp, Homo sapiens
aatattaggtttgaa

SEQ ID NO: 356600 - DNA, 15 bp, Homo sapiens
atattaggtttgaaa

SEQ ID NO: 356601 - DNA, 15 bp, Homo sapiens
tattaggtttgaaaa

SEQ ID NO: 356602 - DNA, 15 bp, Homo sapiens
attaggtttgaaaat

SEQ ID NO: 356603 - DNA, 15 bp, Homo sapiens
ttaggtttgaaaata

SEQ ID NO: 356604 - DNA, 15 bp, Homo sapiens
taggtttgaaaataa

SEQ ID NO: 356605 - DNA, 15 bp, Homo sapiens
aggtttgaaaataaa

SEQ ID NO: 356606 - DNA, 15 bp, Homo sapiens
ggtttgaaaataaag

SEQ ID NO: 356607 - DNA, 15 bp, Homo sapiens
gtttgaaaataaaga

SEQ ID NO: 356608 - DNA, 15 bp, Homo sapiens
tttgaaaataaagaa

SEQ ID NO: 356609 - DNA, 15 bp, Homo sapiens
ttgaaaataaagaag

SEQ ID NO: 356610 - DNA, 15 bp, Homo sapiens
tgaaaataaagaaga

SEQ ID NO: 356611 - DNA, 15 bp, Homo sapiens
gaaaataaagaagag

SEQ ID NO: 356612 - DNA, 15 bp, Homo sapiens
aaaataaagaagaga

SEQ ID NO: 356613 - DNA, 15 bp, Homo sapiens
aaataaagaagagac

SEQ ID NO: 356614 - DNA, 15 bp, Homo sapiens
aataaagaagagacc

SEQ ID NO: 356615 - DNA, 15 bp, Homo sapiens
ataaagaagagacct

SEQ ID NO: 356616 - DNA, 15 bp, Homo sapiens
taaagaagagaccta

SEQ ID NO: 356617 - DNA, 15 bp, Homo sapiens
aaagaagagacctaa

SEQ ID NO: 356618 - DNA, 15 bp, Homo sapiens
aagaagagacctaag

SEQ ID NO: 356619 - DNA, 15 bp, Homo sapiens
agaagagacctaagg

SEQ ID NO: 356620 - DNA, 15 bp, Homo sapiens
gaagagacctaagga

SEQ ID NO: 356621 - DNA, 15 bp, Homo sapiens
aagagacctaaggaa

SEQ ID NO: 356622 - DNA, 15 bp, Homo sapiens
agagacctaaggaaa

SEQ ID NO: 356623 - DNA, 15 bp, Homo sapiens
gagacctaaggaaag

SEQ ID NO: 356624 - DNA, 15 bp, Homo sapiens
agacctaaggaaaga

SEQ ID NO: 356625 - DNA, 15 bp, Homo sapiens
gacctaaggaaagaa

SEQ ID NO: 356626 - DNA, 15 bp, Homo sapiens
acctaaggaaagaat

SEQ ID NO: 356627 - DNA, 15 bp, Homo sapiens
cctaaggaaagaatt

SEQ ID NO: 356628 - DNA, 15 bp, Homo sapiens
ctaaggaaagaattg

SEQ ID NO: 356629 - DNA, 15 bp, Homo sapiens
taaggaaagaattgg

SEQ ID NO: 356630 - DNA, 15 bp, Homo sapiens
aaggaaagaattgga

SEQ ID NO: 356631 - DNA, 15 bp, Homo sapiens
aggaaagaattggat

SEQ ID NO: 356632 - DNA, 15 bp, Homo sapiens
ggaaagaattggatg

SEQ ID NO: 356633 - DNA, 15 bp, Homo sapiens
gaaagaattggatgt

SEQ ID NO: 356634 - DNA, 15 bp, Homo sapiens
aaagaattggatgtg

SEQ ID NO: 356635 - DNA, 15 bp, Homo sapiens
aagaattggatgtgt

SEQ ID NO: 356636 - DNA, 15 bp, Homo sapiens
agaattggatgtgtg

SEQ ID NO: 356637 - DNA, 15 bp, Homo sapiens
gaattggatgtgtga

SEQ ID NO: 356638 - DNA, 15 bp, Homo sapiens
aattggatgtgtgat

SEQ ID NO: 356639 - DNA, 15 bp, Homo sapiens
attggatgtgtgata

SEQ ID NO: 356640 - DNA, 15 bp, Homo sapiens
ttggatgtgtgatag

SEQ ID NO: 356641 - DNA, 15 bp, Homo sapiens
tggatgtgtgataga

SEQ ID NO: 356642 - DNA, 15 bp, Homo sapiens
ggatgtgtgatagaa

SEQ ID NO: 356643 - DNA, 15 bp, Homo sapiens
gatgtgtgatagaag

SEQ ID NO: 356644 - DNA, 15 bp, Homo sapiens
atgtgtgatagaaga

SEQ ID NO: 356645 - DNA, 15 bp, Homo sapiens
tgtgtgatagaagaa

SEQ ID NO: 356646 - DNA, 15 bp, Homo sapiens
gtgtgatagaagaaa

SEQ ID NO: 356647 - DNA, 15 bp, Homo sapiens
tgtgatagaagaaaa

SEQ ID NO: 356648 - DNA, 15 bp, Homo sapiens
gtgatagaagaaaaa

SEQ ID NO: 356649 - DNA, 15 bp, Homo sapiens
tgatagaagaaaaag

SEQ ID NO: 356650 - DNA, 15 bp, Homo sapiens
gatagaagaaaaagt

SEQ ID NO: 356651 - DNA, 15 bp, Homo sapiens
atagaagaaaaagtg

SEQ ID NO: 356652 - DNA, 15 bp, Homo sapiens
tagaagaaaaagtga

SEQ ID NO: 356653 - DNA, 15 bp, Homo sapiens
agaagaaaaagtgaa

SEQ ID NO: 356654 - DNA, 15 bp, Homo sapiens
gaagaaaaagtgaat

SEQ ID NO: 356655 - DNA, 15 bp, Homo sapiens
aagaaaaagtgaatg

SEQ ID NO: 356656 - DNA, 15 bp, Homo sapiens
agaaaaagtgaatgg

SEQ ID NO: 356657 - DNA, 15 bp, Homo sapiens
gaaaaagtgaatggt

SEQ ID NO: 356658 - DNA, 15 bp, Homo sapiens
aaaaagtgaatggtc

SEQ ID NO: 356659 - DNA, 15 bp, Homo sapiens
aaaagtgaatggtca

SEQ ID NO: 356660 - DNA, 15 bp, Homo sapiens
aaagtgaatggtcaa

SEQ ID NO: 356661 - DNA, 15 bp, Homo sapiens
aagtgaatggtcaag

SEQ ID NO: 356662 - DNA, 15 bp, Homo sapiens
agtgaatggtcaagg

SEQ ID NO: 356663 - DNA, 15 bp, Homo sapiens
gtgaatggtcaagga

SEQ ID NO: 356664 - DNA, 15 bp, Homo sapiens
tgaatggtcaaggat

SEQ ID NO: 356665 - DNA, 15 bp, Homo sapiens
gaatggtcaaggatg

SEQ ID NO: 356666 - DNA, 15 bp, Homo sapiens
aatggtcaaggatga

SEQ ID NO: 356667 - DNA, 15 bp, Homo sapiens
atggtcaaggatgac

SEQ ID NO: 356668 - DNA, 15 bp, Homo sapiens
tggtcaaggatgact

SEQ ID NO: 356669 - DNA, 15 bp, Homo sapiens
ggtcaaggatgactc

SEQ ID NO: 356670 - DNA, 15 bp, Homo sapiens
gtcaaggatgactca

SEQ ID NO: 356671 - DNA, 15 bp, Homo sapiens
tcaaggatgactcag

SEQ ID NO: 356672 - DNA, 15 bp, Homo sapiens
caaggatgactcagg

SEQ ID NO: 356673 - DNA, 15 bp, Homo sapiens
aaggatgactcagga

SEQ ID NO: 356674 - DNA, 15 bp, Homo sapiens
aggatgactcaggat

SEQ ID NO: 356675 - DNA, 15 bp, Homo sapiens
ggatgactcaggatt

SEQ ID NO: 356676 - DNA, 15 bp, Homo sapiens
gatgactcaggattt

SEQ ID NO: 356677 - DNA, 15 bp, Homo sapiens
atgactcaggatttt

SEQ ID NO: 356678 - DNA, 15 bp, Homo sapiens
tgactcaggattttt

SEQ ID NO: 356679 - DNA, 15 bp, Homo sapiens
gactcaggattttta

SEQ ID NO: 356680 - DNA, 15 bp, Homo sapiens
actcaggatttttac

SEQ ID NO: 356681 - DNA, 15 bp, Homo sapiens
ctcaggatttttaca

SEQ ID NO: 356682 - DNA, 15 bp, Homo sapiens
tcaggatttttacaa

SEQ ID NO: 356683 - DNA, 15 bp, Homo sapiens
caggatttttacaaa

SEQ ID NO: 356684 - DNA, 15 bp, Homo sapiens
aggatttttacaaag

SEQ ID NO: 356685 - DNA, 15 bp, Homo sapiens
ggatttttacaaagc

SEQ ID NO: 356686 - DNA, 15 bp, Homo sapiens
gatttttacaaagct

SEQ ID NO: 356687 - DNA, 15 bp, Homo sapiens
atttttacaaagctt

SEQ ID NO: 356688 - DNA, 15 bp, Homo sapiens
tttttacaaagcttc

SEQ ID NO: 356689 - DNA, 15 bp, Homo sapiens
ttttacaaagcttcc

SEQ ID NO: 356690 - DNA, 15 bp, Homo sapiens
tttacaaagcttcca

SEQ ID NO: 356691 - DNA, 15 bp, Homo sapiens
ttacaaagcttccac

SEQ ID NO: 356692 - DNA, 15 bp, Homo sapiens
tacaaagcttccact

SEQ ID NO: 356693 - DNA, 15 bp, Homo sapiens
acaaagcttccactt

SEQ ID NO: 356694 - DNA, 15 bp, Homo sapiens
caaagcttccacttt

SEQ ID NO: 356695 - DNA, 15 bp, Homo sapiens
aaagcttccactttg

SEQ ID NO: 356696 - DNA, 15 bp, Homo sapiens
aagcttccactttgt

SEQ ID NO: 356697 - DNA, 15 bp, Homo sapiens
agcttccactttgtg

SEQ ID NO: 356698 - DNA, 15 bp, Homo sapiens
gcttccactttgtgt

SEQ ID NO: 356699 - DNA, 15 bp, Homo sapiens
cttccactttgtgtg

SEQ ID NO: 356700 - DNA, 15 bp, Homo sapiens
ttccactttgtgtga

SEQ ID NO: 356701 - DNA, 15 bp, Homo sapiens
tccactttgtgtgaa

SEQ ID NO: 356702 - DNA, 15 bp, Homo sapiens
ccactttgtgtgaat

SEQ ID NO: 356703 - DNA, 15 bp, Homo sapiens
cactttgtgtgaatt

SEQ ID NO: 356704 - DNA, 15 bp, Homo sapiens
actttgtgtgaattg

SEQ ID NO: 356705 - DNA, 15 bp, Homo sapiens
ctttgtgtgaattgt

SEQ ID NO: 356706 - DNA, 15 bp, Homo sapiens
tttgtgtgaattgtg

SEQ ID NO: 356707 - DNA, 15 bp, Homo sapiens
ttgtgtgaattgtgg

SEQ ID NO: 356708 - DNA, 15 bp, Homo sapiens
tgtgtgaattgtggt

SEQ ID NO: 356709 - DNA, 15 bp, Homo sapiens
gtgtgaattgtggtg

SEQ ID NO: 356710 - DNA, 15 bp, Homo sapiens
tgtgaattgtggtgt

SEQ ID NO: 356711 - DNA, 15 bp, Homo sapiens
gtgaattgtggtgtc

SEQ ID NO: 356712 - DNA, 15 bp, Homo sapiens
tgaattgtggtgtca

SEQ ID NO: 356713 - DNA, 15 bp, Homo sapiens
gaattgtggtgtcat

SEQ ID NO: 356714 - DNA, 15 bp, Homo sapiens
aattgtggtgtcatt

SEQ ID NO: 356715 - DNA, 15 bp, Homo sapiens
attgtggtgtcattt

SEQ ID NO: 356716 - DNA, 15 bp, Homo sapiens
ttgtggtgtcattta

SEQ ID NO: 356717 - DNA, 15 bp, Homo sapiens
tgtggtgtcatttac

SEQ ID NO: 356718 - DNA, 15 bp, Homo sapiens
gtggtgtcatttact

SEQ ID NO: 356719 - DNA, 15 bp, Homo sapiens
tggtgtcatttactg

SEQ ID NO: 356720 - DNA, 15 bp, Homo sapiens
ggtgtcatttactgc

SEQ ID NO: 356721 - DNA, 15 bp, Homo sapiens
gtgtcatttactgca

SEQ ID NO: 356722 - DNA, 15 bp, Homo sapiens
tgtcatttactgcaa

SEQ ID NO: 356723 - DNA, 15 bp, Homo sapiens
gtcatttactgcaat

SEQ ID NO: 356724 - DNA, 15 bp, Homo sapiens
tcatttactgcaata

SEQ ID NO: 356725 - DNA, 15 bp, Homo sapiens
catttactgcaataa

SEQ ID NO: 356726 - DNA, 15 bp, Homo sapiens
atttactgcaataac

SEQ ID NO: 356727 - DNA, 15 bp, Homo sapiens
tttactgcaataacg

SEQ ID NO: 356728 - DNA, 15 bp, Homo sapiens
ttactgcaataacga

SEQ ID NO: 356729 - DNA, 15 bp, Homo sapiens
tactgcaataacgaa

SEQ ID NO: 356730 - DNA, 15 bp, Homo sapiens
actgcaataacgaag

SEQ ID NO: 356731 - DNA, 15 bp, Homo sapiens
ctgcaataacgaagg

SEQ ID NO: 356732 - DNA, 15 bp, Homo sapiens
tgcaataacgaagga

SEQ ID NO: 356733 - DNA, 15 bp, Homo sapiens
gcaataacgaaggag

SEQ ID NO: 356734 - DNA, 15 bp, Homo sapiens
caataacgaaggaga

SEQ ID NO: 356735 - DNA, 15 bp, Homo sapiens
aataacgaaggagaa

SEQ ID NO: 356736 - DNA, 15 bp, Homo sapiens
ataacgaaggagaag

SEQ ID NO: 356737 - DNA, 15 bp, Homo sapiens
taacgaaggagaagc

SEQ ID NO: 356738 - DNA, 15 bp, Homo sapiens
aacgaaggagaagct

SEQ ID NO: 356739 - DNA, 15 bp, Homo sapiens
acgaaggagaagctt

SEQ ID NO: 356740 - DNA, 15 bp, Homo sapiens
cgaaggagaagcttc

SEQ ID NO: 356741 - DNA, 15 bp, Homo sapiens
gaaggagaagcttct

SEQ ID NO: 356742 - DNA, 15 bp, Homo sapiens
aaggagaagcttctg

SEQ ID NO: 356743 - DNA, 15 bp, Homo sapiens
aggagaagcttctgt

SEQ ID NO: 356744 - DNA, 15 bp, Homo sapiens
ggagaagcttctgtg

SEQ ID NO: 356745 - DNA, 15 bp, Homo sapiens
gagaagcttctgtgg

SEQ ID NO: 356746 - DNA, 15 bp, Homo sapiens
agaagcttctgtggg

SEQ ID NO: 356747 - DNA, 15 bp, Homo sapiens
gaagcttctgtgggt

SEQ ID NO: 356748 - DNA, 15 bp, Homo sapiens
aagcttctgtgggtg

SEQ ID NO: 356749 - DNA, 15 bp, Homo sapiens
agcttctgtgggtgt

SEQ ID NO: 356750 - DNA, 15 bp, Homo sapiens
gcttctgtgggtgta

SEQ ID NO: 356751 - DNA, 15 bp, Homo sapiens
cttctgtgggtgtag

SEQ ID NO: 356752 - DNA, 15 bp, Homo sapiens
ttctgtgggtgtagg

SEQ ID NO: 356753 - DNA, 15 bp, Homo sapiens
tctgtgggtgtaggt

SEQ ID NO: 356754 - DNA, 15 bp, Homo sapiens
ctgtgggtgtaggtg

SEQ ID NO: 356755 - DNA, 15 bp, Homo sapiens
tgtgggtgtaggtga

SEQ ID NO: 356756 - DNA, 15 bp, Homo sapiens
gtgggtgtaggtgaa

SEQ ID NO: 356757 - DNA, 15 bp, Homo sapiens
tgggtgtaggtgaaa

SEQ ID NO: 356758 - DNA, 15 bp, Homo sapiens
gggtgtaggtgaaat

SEQ ID NO: 356759 - DNA, 15 bp, Homo sapiens
ggtgtaggtgaaatg

SEQ ID NO: 356760 - DNA, 15 bp, Homo sapiens
gtgtaggtgaaatga

SEQ ID NO: 356761 - DNA, 15 bp, Homo sapiens
tgtaggtgaaatgat

SEQ ID NO: 356762 - DNA, 15 bp, Homo sapiens
gtaggtgaaatgatg

SEQ ID NO: 356763 - DNA, 15 bp, Homo sapiens
taggtgaaatgatga

SEQ ID NO: 356764 - DNA, 15 bp, Homo sapiens
aggtgaaatgatgac

SEQ ID NO: 356765 - DNA, 15 bp, Homo sapiens
ggtgaaatgatgact

SEQ ID NO: 356766 - DNA, 15 bp, Homo sapiens
gtgaaatgatgacta

SEQ ID NO: 356767 - DNA, 15 bp, Homo sapiens
tgaaatgatgactac

SEQ ID NO: 356768 - DNA, 15 bp, Homo sapiens
gaaatgatgactacc

SEQ ID NO: 356769 - DNA, 15 bp, Homo sapiens
aaatgatgactacca

SEQ ID NO: 356770 - DNA, 15 bp, Homo sapiens
aatgatgactaccat

SEQ ID NO: 356771 - DNA, 15 bp, Homo sapiens
atgatgactaccatt

SEQ ID NO: 356772 - DNA, 15 bp, Homo sapiens
tgatgactaccattc

SEQ ID NO: 356773 - DNA, 15 bp, Homo sapiens
gatgactaccattct

SEQ ID NO: 356774 - DNA, 15 bp, Homo sapiens
atgactaccattctg

SEQ ID NO: 356775 - DNA, 15 bp, Homo sapiens
tgactaccattctgg

SEQ ID NO: 356776 - DNA, 15 bp, Homo sapiens
gactaccattctgga

SEQ ID NO: 356777 - DNA, 15 bp, Homo sapiens
actaccattctggaa

SEQ ID NO: 356778 - DNA, 15 bp, Homo sapiens
ctaccattctggaag

SEQ ID NO: 356779 - DNA, 15 bp, Homo sapiens
taccattctggaagg

SEQ ID NO: 356780 - DNA, 15 bp, Homo sapiens
accattctggaaggg

SEQ ID NO: 356781 - DNA, 15 bp, Homo sapiens
ccattctggaagggt

SEQ ID NO: 356782 - DNA, 15 bp, Homo sapiens
cattctggaagggtt

SEQ ID NO: 356783 - DNA, 15 bp, Homo sapiens
attctggaagggtta

SEQ ID NO: 356784 - DNA, 15 bp, Homo sapiens
ttctggaagggttaa

SEQ ID NO: 356785 - DNA, 15 bp, Homo sapiens
tctggaagggttaaa

SEQ ID NO: 356786 - DNA, 15 bp, Homo sapiens
ctggaagggttaaat

SEQ ID NO: 356787 - DNA, 15 bp, Homo sapiens
tggaagggttaaatt

SEQ ID NO: 356788 - DNA, 15 bp, Homo sapiens
ggaagggttaaattt

SEQ ID NO: 356789 - DNA, 15 bp, Homo sapiens
gaagggttaaatttg

SEQ ID NO: 356790 - DNA, 15 bp, Homo sapiens
aagggttaaatttga

SEQ ID NO: 356791 - DNA, 15 bp, Homo sapiens
agggttaaatttgat

SEQ ID NO: 356792 - DNA, 15 bp, Homo sapiens
gggttaaatttgatg

SEQ ID NO: 356793 - DNA, 15 bp, Homo sapiens
ggttaaatttgatgc

SEQ ID NO: 356794 - DNA, 15 bp, Homo sapiens
gttaaatttgatgct

SEQ ID NO: 356795 - DNA, 15 bp, Homo sapiens
ttaaatttgatgcta

SEQ ID NO: 356796 - DNA, 15 bp, Homo sapiens
taaatttgatgctag

SEQ ID NO: 356797 - DNA, 15 bp, Homo sapiens
aaatttgatgctaga

SEQ ID NO: 356798 - DNA, 15 bp, Homo sapiens
aatttgatgctagaa

SEQ ID NO: 356799 - DNA, 15 bp, Homo sapiens
atttgatgctagaag

SEQ ID NO: 356800 - DNA, 15 bp, Homo sapiens
tttgatgctagaagc

SEQ ID NO: 356801 - DNA, 15 bp, Homo sapiens
ttgatgctagaagct

SEQ ID NO: 356802 - DNA, 15 bp, Homo sapiens
tgatgctagaagcta

SEQ ID NO: 356803 - DNA, 15 bp, Homo sapiens
gatgctagaagctaa

SEQ ID NO: 356804 - DNA, 15 bp, Homo sapiens
atgctagaagctaag

SEQ ID NO: 356805 - DNA, 15 bp, Homo sapiens
tgctagaagctaagg

SEQ ID NO: 356806 - DNA, 15 bp, Homo sapiens
gctagaagctaagga

SEQ ID NO: 356807 - DNA, 15 bp, Homo sapiens
ctagaagctaaggag

SEQ ID NO: 356808 - DNA, 15 bp, Homo sapiens
tagaagctaaggagg

SEQ ID NO: 356809 - DNA, 15 bp, Homo sapiens
agaagctaaggagga

SEQ ID NO: 356810 - DNA, 15 bp, Homo sapiens
gaagctaaggaggaa

SEQ ID NO: 356811 - DNA, 15 bp, Homo sapiens
aagctaaggaggaaa

SEQ ID NO: 356812 - DNA, 15 bp, Homo sapiens
agctaaggaggaaaa

SEQ ID NO: 356813 - DNA, 15 bp, Homo sapiens
gctaaggaggaaaaa

SEQ ID NO: 356814 - DNA, 15 bp, Homo sapiens
ctaaggaggaaaaat

SEQ ID NO: 356815 - DNA, 15 bp, Homo sapiens
taaggaggaaaaatc

SEQ ID NO: 356816 - DNA, 15 bp, Homo sapiens
aaggaggaaaaatca

SEQ ID NO: 356817 - DNA, 15 bp, Homo sapiens
aggaggaaaaatcag

SEQ ID NO: 356818 - DNA, 15 bp, Homo sapiens
ggaggaaaaatcagt

SEQ ID NO: 356819 - DNA, 15 bp, Homo sapiens
gaggaaaaatcagta

SEQ ID NO: 356820 - DNA, 15 bp, Homo sapiens
aggaaaaatcagtaa

SEQ ID NO: 356821 - DNA, 15 bp, Homo sapiens
ggaaaaatcagtaac

SEQ ID NO: 356822 - DNA, 15 bp, Homo sapiens
gaaaaatcagtaacg

SEQ ID NO: 356823 - DNA, 15 bp, Homo sapiens
aaaaatcagtaacgg

SEQ ID NO: 356824 - DNA, 15 bp, Homo sapiens
aaaatcagtaacggg

SEQ ID NO: 356825 - DNA, 15 bp, Homo sapiens
aaatcagtaacgggg

SEQ ID NO: 356826 - DNA, 15 bp, Homo sapiens
aatcagtaacgggga

SEQ ID NO: 356827 - DNA, 15 bp, Homo sapiens
atcagtaacggggaa

SEQ ID NO: 356828 - DNA, 15 bp, Homo sapiens
tcagtaacggggaat

SEQ ID NO: 356829 - DNA, 15 bp, Homo sapiens
cagtaacggggaatg

SEQ ID NO: 356830 - DNA, 15 bp, Homo sapiens
agtaacggggaatgt

SEQ ID NO: 356831 - DNA, 15 bp, Homo sapiens
gtaacggggaatgtg

SEQ ID NO: 356832 - DNA, 15 bp, Homo sapiens
taacggggaatgtgg

SEQ ID NO: 356833 - DNA, 15 bp, Homo sapiens
aacggggaatgtggg

SEQ ID NO: 356834 - DNA, 15 bp, Homo sapiens
acggggaatgtgggg

SEQ ID NO: 356835 - DNA, 15 bp, Homo sapiens
cggggaatgtggggt

SEQ ID NO: 356836 - DNA, 15 bp, Homo sapiens
ggggaatgtggggtc

SEQ ID NO: 356837 - DNA, 15 bp, Homo sapiens
gggaatgtggggtcc

SEQ ID NO: 356838 - DNA, 15 bp, Homo sapiens
ggaatgtggggtccc

SEQ ID NO: 356839 - DNA, 15 bp, Homo sapiens
gaatgtggggtccca

SEQ ID NO: 356840 - DNA, 15 bp, Homo sapiens
aatgtggggtcccaa

SEQ ID NO: 356841 - DNA, 15 bp, Homo sapiens
atgtggggtcccaaa

SEQ ID NO: 356842 - DNA, 15 bp, Homo sapiens
tgtggggtcccaaat

SEQ ID NO: 356843 - DNA, 15 bp, Homo sapiens
gtggggtcccaaatg

SEQ ID NO: 356844 - DNA, 15 bp, Homo sapiens
tggggtcccaaatgc

SEQ ID NO: 356845 - DNA, 15 bp, Homo sapiens
ggggtcccaaatgct

SEQ ID NO: 356846 - DNA, 15 bp, Homo sapiens
gggtcccaaatgcta

SEQ ID NO: 356847 - DNA, 15 bp, Homo sapiens
ggtcccaaatgctag

SEQ ID NO: 356848 - DNA, 15 bp, Homo sapiens
gtcccaaatgctagg

SEQ ID NO: 356849 - DNA, 15 bp, Homo sapiens
tcccaaatgctaggt

SEQ ID NO: 356850 - DNA, 15 bp, Homo sapiens
cccaaatgctaggtg

SEQ ID NO: 356851 - DNA, 15 bp, Homo sapiens
ccaaatgctaggtgg

SEQ ID NO: 356852 - DNA, 15 bp, Homo sapiens
tattctaattcagtg

SEQ ID NO: 356853 - DNA, 15 bp, Homo sapiens
attctaattcagtgg

SEQ ID NO: 356854 - DNA, 15 bp, Homo sapiens
ttctaattcagtggc

SEQ ID NO: 356855 - DNA, 15 bp, Homo sapiens
tctaattcagtggct

SEQ ID NO: 356856 - DNA, 15 bp, Homo sapiens
ctaattcagtggctg

SEQ ID NO: 356857 - DNA, 15 bp, Homo sapiens
taattcagtggctgg

SEQ ID NO: 356858 - DNA, 15 bp, Homo sapiens
aattcagtggctgga

SEQ ID NO: 356859 - DNA, 15 bp, Homo sapiens
attcagtggctggaa

SEQ ID NO: 356860 - DNA, 15 bp, Homo sapiens
ttcagtggctggaaa

SEQ ID NO: 356861 - DNA, 15 bp, Homo sapiens
tcagtggctggaaaa

SEQ ID NO: 356862 - DNA, 15 bp, Homo sapiens
cagtggctggaaaat

SEQ ID NO: 356863 - DNA, 15 bp, Homo sapiens
agtggctggaaaatt

SEQ ID NO: 356864 - DNA, 15 bp, Homo sapiens
gtggctggaaaatta

SEQ ID NO: 356865 - DNA, 15 bp, Homo sapiens
tggctggaaaattat

SEQ ID NO: 356866 - DNA, 15 bp, Homo sapiens
ggctggaaaattatg

SEQ ID NO: 356867 - DNA, 15 bp, Homo sapiens
gctggaaaattatgg

SEQ ID NO: 356868 - DNA, 15 bp, Homo sapiens
ctggaaaattatggc

SEQ ID NO: 356869 - DNA, 15 bp, Homo sapiens
tggaaaattatggct

SEQ ID NO: 356870 - DNA, 15 bp, Homo sapiens
ggaaaattatggctg

SEQ ID NO: 356871 - DNA, 15 bp, Homo sapiens
gaaaattatggctga

SEQ ID NO: 356872 - DNA, 15 bp, Homo sapiens
aaaattatggctgag

SEQ ID NO: 356873 - DNA, 15 bp, Homo sapiens
aaattatggctgagg

SEQ ID NO: 356874 - DNA, 15 bp, Homo sapiens
aattatggctgagga

SEQ ID NO: 356875 - DNA, 15 bp, Homo sapiens
attatggctgaggat

SEQ ID NO: 356876 - DNA, 15 bp, Homo sapiens
ttatggctgaggatt

SEQ ID NO: 356877 - DNA, 15 bp, Homo sapiens
tatggctgaggattt

SEQ ID NO: 356878 - DNA, 15 bp, Homo sapiens
atggctgaggatttt

SEQ ID NO: 356879 - DNA, 15 bp, Homo sapiens
tggctgaggattttg

SEQ ID NO: 356880 - DNA, 15 bp, Homo sapiens
ggctgaggattttgt

SEQ ID NO: 356881 - DNA, 15 bp, Homo sapiens
gctgaggattttgtt

SEQ ID NO: 356882 - DNA, 15 bp, Homo sapiens
ctgaggattttgttt

SEQ ID NO: 356883 - DNA, 15 bp, Homo sapiens
tgaggattttgtttt

SEQ ID NO: 356884 - DNA, 15 bp, Homo sapiens
gaggattttgttttg

SEQ ID NO: 356885 - DNA, 15 bp, Homo sapiens
aggattttgttttgt

SEQ ID NO: 356886 - DNA, 15 bp, Homo sapiens
attttgttttgtttt

SEQ ID NO: 356887 - DNA, 15 bp, Homo sapiens
ttttgttttgtttga

SEQ ID NO: 356888 - DNA, 15 bp, Homo sapiens
tttgttttgtttgag

SEQ ID NO: 356889 - DNA, 15 bp, Homo sapiens
ttgttttgtttgaga

SEQ ID NO: 356890 - DNA, 15 bp, Homo sapiens
tgttttgtttgagac

SEQ ID NO: 356891 - DNA, 15 bp, Homo sapiens
gttttgtttgagaca

SEQ ID NO: 356892 - DNA, 15 bp, Homo sapiens
ttttgtttgagacag

SEQ ID NO: 356893 - DNA, 15 bp, Homo sapiens
tttgtttgagacagg

SEQ ID NO: 356894 - DNA, 15 bp, Homo sapiens
ttgtttgagacaggg

SEQ ID NO: 356895 - DNA, 15 bp, Homo sapiens
tgtttgagacagggt

SEQ ID NO: 356896 - DNA, 15 bp, Homo sapiens
gtttgagacagggtc

SEQ ID NO: 356897 - DNA, 15 bp, Homo sapiens
cttgctctgtcacct

SEQ ID NO: 356898 - DNA, 15 bp, Homo sapiens
ttgctctgtcaccta

SEQ ID NO: 356899 - DNA, 15 bp, Homo sapiens
tgctctgtcacctat

SEQ ID NO: 356900 - DNA, 15 bp, Homo sapiens
gctctgtcacctatg

SEQ ID NO: 356901 - DNA, 15 bp, Homo sapiens
ctctgtcacctatgc

SEQ ID NO: 356902 - DNA, 15 bp, Homo sapiens
tctgtcacctatgct

SEQ ID NO: 356903 - DNA, 15 bp, Homo sapiens
ctgtcacctatgctg

SEQ ID NO: 356904 - DNA, 15 bp, Homo sapiens
tgtcacctatgctgg

SEQ ID NO: 356905 - DNA, 15 bp, Homo sapiens
gtcacctatgctgga

SEQ ID NO: 356906 - DNA, 15 bp, Homo sapiens
tcacctatgctggag

SEQ ID NO: 356907 - DNA, 15 bp, Homo sapiens
cacctatgctggagt

SEQ ID NO: 356908 - DNA, 15 bp, Homo sapiens
acctatgctggagtg

SEQ ID NO: 356909 - DNA, 15 bp, Homo sapiens
cctatgctggagtgc

SEQ ID NO: 356910 - DNA, 15 bp, Homo sapiens
ctatgctggagtgca

SEQ ID NO: 356911 - DNA, 15 bp, Homo sapiens
tatgctggagtgcag

SEQ ID NO: 356912 - DNA, 15 bp, Homo sapiens
atgctggagtgcagt

SEQ ID NO: 356913 - DNA, 15 bp, Homo sapiens
tgctggagtgcagtg

SEQ ID NO: 356914 - DNA, 15 bp, Homo sapiens
tggagtgcagtggta

SEQ ID NO: 356915 - DNA, 15 bp, Homo sapiens
ggagtgcagtggtat

SEQ ID NO: 356916 - DNA, 15 bp, Homo sapiens
gagtgcagtggtatg

SEQ ID NO: 356917 - DNA, 15 bp, Homo sapiens
agtgcagtggtatga

SEQ ID NO: 356918 - DNA, 15 bp, Homo sapiens
gtgcagtggtatgat

SEQ ID NO: 356919 - DNA, 15 bp, Homo sapiens
tgcagtggtatgatc

SEQ ID NO: 356920 - DNA, 15 bp, Homo sapiens
gcagtggtatgatca

SEQ ID NO: 356921 - DNA, 15 bp, Homo sapiens
cagtggtatgatcac

SEQ ID NO: 356922 - DNA, 15 bp, Homo sapiens
agtggtatgatcaca

SEQ ID NO: 356923 - DNA, 15 bp, Homo sapiens
gtggtatgatcacag

SEQ ID NO: 356924 - DNA, 15 bp, Homo sapiens
tggtatgatcacagc

SEQ ID NO: 356925 - DNA, 15 bp, Homo sapiens
ggtatgatcacagct

SEQ ID NO: 356926 - DNA, 15 bp, Homo sapiens
gtatgatcacagctc

SEQ ID NO: 356927 - DNA, 15 bp, Homo sapiens
tatgatcacagctca

SEQ ID NO: 356928 - DNA, 15 bp, Homo sapiens
atgatcacagctcac

SEQ ID NO: 356929 - DNA, 15 bp, Homo sapiens
atcacagctcactgt

SEQ ID NO: 356930 - DNA, 15 bp, Homo sapiens
tcacagctcactgta

SEQ ID NO: 356931 - DNA, 15 bp, Homo sapiens
cacagctcactgtaa

SEQ ID NO: 356932 - DNA, 15 bp, Homo sapiens
acagctcactgtaac

SEQ ID NO: 356933 - DNA, 15 bp, Homo sapiens
cagctcactgtaacc

SEQ ID NO: 356934 - DNA, 15 bp, Homo sapiens
agctcactgtaacct

SEQ ID NO: 356935 - DNA, 15 bp, Homo sapiens
gctcactgtaacctc

SEQ ID NO: 356936 - DNA, 15 bp, Homo sapiens
ctcactgtaacctca

SEQ ID NO: 356937 - DNA, 15 bp, Homo sapiens
tcactgtaacctcaa

SEQ ID NO: 356938 - DNA, 15 bp, Homo sapiens
cactgtaacctcaaa

SEQ ID NO: 356939 - DNA, 15 bp, Homo sapiens
actgtaacctcaaac

SEQ ID NO: 356940 - DNA, 15 bp, Homo sapiens
ctgtaacctcaaact

SEQ ID NO: 356941 - DNA, 15 bp, Homo sapiens
tgtaacctcaaactc

SEQ ID NO: 356942 - DNA, 15 bp, Homo sapiens
gtaacctcaaactcc

SEQ ID NO: 356943 - DNA, 15 bp, Homo sapiens
taacctcaaactcct

SEQ ID NO: 356944 - DNA, 15 bp, Homo sapiens
aacctcaaactcctg

SEQ ID NO: 356945 - DNA, 15 bp, Homo sapiens
acctcaaactcctgg

SEQ ID NO: 356946 - DNA, 15 bp, Homo sapiens
ctgggctcaagtgac

SEQ ID NO: 356947 - DNA, 15 bp, Homo sapiens
tgggctcaagtgacc

SEQ ID NO: 356948 - DNA, 15 bp, Homo sapiens
gggctcaagtgacct

SEQ ID NO: 356949 - DNA, 15 bp, Homo sapiens
ggctcaagtgacctt

SEQ ID NO: 356950 - DNA, 15 bp, Homo sapiens
gctcaagtgaccttc

SEQ ID NO: 356951 - DNA, 15 bp, Homo sapiens
ctcaagtgaccttcc

SEQ ID NO: 356952 - DNA, 15 bp, Homo sapiens
tcaagtgaccttcct

SEQ ID NO: 356953 - DNA, 15 bp, Homo sapiens
caagtgaccttcctg

SEQ ID NO: 356954 - DNA, 15 bp, Homo sapiens
aagtgaccttcctgc

SEQ ID NO: 356955 - DNA, 15 bp, Homo sapiens
agtgaccttcctgcc

SEQ ID NO: 356956 - DNA, 15 bp, Homo sapiens
gtgaccttcctgccc

SEQ ID NO: 356957 - DNA, 15 bp, Homo sapiens
tgaccttcctgcccc

SEQ ID NO: 356958 - DNA, 15 bp, Homo sapiens
gaccttcctgccccc

SEQ ID NO: 356959 - DNA, 15 bp, Homo sapiens
accttcctgcccccg

SEQ ID NO: 356960 - DNA, 15 bp, Homo sapiens
ccttcctgcccccgc

SEQ ID NO: 356961 - DNA, 15 bp, Homo sapiens
cttcctgcccccgct

SEQ ID NO: 356962 - DNA, 15 bp, Homo sapiens
ttcctgcccccgctt

SEQ ID NO: 356963 - DNA, 15 bp, Homo sapiens
tcctgcccccgcttc

SEQ ID NO: 356964 - DNA, 15 bp, Homo sapiens
cctgcccccgcttcc

SEQ ID NO: 356965 - DNA, 15 bp, Homo sapiens
ctgcccccgcttcct

SEQ ID NO: 356966 - DNA, 15 bp, Homo sapiens
tgcccccgcttcctg

SEQ ID NO: 356967 - DNA, 15 bp, Homo sapiens
gcccccgcttcctga

SEQ ID NO: 356968 - DNA, 15 bp, Homo sapiens
cccccgcttcctgag

SEQ ID NO: 356969 - DNA, 15 bp, Homo sapiens
ccccgcttcctgagt

SEQ ID NO: 356970 - DNA, 15 bp, Homo sapiens
cccgcttcctgagta

SEQ ID NO: 356971 - DNA, 15 bp, Homo sapiens
ccgcttcctgagtag

SEQ ID NO: 356972 - DNA, 15 bp, Homo sapiens
cgcttcctgagtagc

SEQ ID NO: 356973 - DNA, 15 bp, Homo sapiens
cttcctgagtagcta

SEQ ID NO: 356974 - DNA, 15 bp, Homo sapiens
ttcctgagtagctat

SEQ ID NO: 356975 - DNA, 15 bp, Homo sapiens
tcctgagtagctatg

SEQ ID NO: 356976 - DNA, 15 bp, Homo sapiens
cctgagtagctatga

SEQ ID NO: 356977 - DNA, 15 bp, Homo sapiens
ctgagtagctatgac

SEQ ID NO: 356978 - DNA, 15 bp, Homo sapiens
tgagtagctatgact

SEQ ID NO: 356979 - DNA, 15 bp, Homo sapiens
gagtagctatgactc

SEQ ID NO: 356980 - DNA, 15 bp, Homo sapiens
agtagctatgactcc

SEQ ID NO: 356981 - DNA, 15 bp, Homo sapiens
gtagctatgactcca

SEQ ID NO: 356982 - DNA, 15 bp, Homo sapiens
tagctatgactccag

SEQ ID NO: 356983 - DNA, 15 bp, Homo sapiens
agctatgactccagc

SEQ ID NO: 356984 - DNA, 15 bp, Homo sapiens
gctatgactccagcc

SEQ ID NO: 356985 - DNA, 15 bp, Homo sapiens
ctatgactccagcct

SEQ ID NO: 356986 - DNA, 15 bp, Homo sapiens
tatgactccagcctt

SEQ ID NO: 356987 - DNA, 15 bp, Homo sapiens
atgactccagccttg

SEQ ID NO: 356988 - DNA, 15 bp, Homo sapiens
tgactccagccttgc

SEQ ID NO: 356989 - DNA, 15 bp, Homo sapiens
gactccagccttgca

SEQ ID NO: 356990 - DNA, 15 bp, Homo sapiens
actccagccttgcaa

SEQ ID NO: 356991 - DNA, 15 bp, Homo sapiens
ctccagccttgcaat

SEQ ID NO: 356992 - DNA, 15 bp, Homo sapiens
tccagccttgcaatg

SEQ ID NO: 356993 - DNA, 15 bp, Homo sapiens
ccagccttgcaatgc

SEQ ID NO: 356994 - DNA, 15 bp, Homo sapiens
cagccttgcaatgcc

SEQ ID NO: 356995 - DNA, 15 bp, Homo sapiens
agccttgcaatgcca

SEQ ID NO: 356996 - DNA, 15 bp, Homo sapiens
gccttgcaatgccac

SEQ ID NO: 356997 - DNA, 15 bp, Homo sapiens
ccttgcaatgccaca

SEQ ID NO: 356998 - DNA, 15 bp, Homo sapiens
cttgcaatgccacac

SEQ ID NO: 356999 - DNA, 15 bp, Homo sapiens
ttgcaatgccacacc

SEQ ID NO: 357000 - DNA, 15 bp, Homo sapiens
tgcaatgccacacct

SEQ ID NO: 357001 - DNA, 15 bp, Homo sapiens
gcaatgccacacctg

SEQ ID NO: 357002 - DNA, 15 bp, Homo sapiens
caatgccacacctgg

SEQ ID NO: 357003 - DNA, 15 bp, Homo sapiens
aatgccacacctggc

SEQ ID NO: 357004 - DNA, 15 bp, Homo sapiens
atgccacacctggct

SEQ ID NO: 357005 - DNA, 15 bp, Homo sapiens
tgccacacctggcta

SEQ ID NO: 357006 - DNA, 15 bp, Homo sapiens
gccacacctggctaa

SEQ ID NO: 357007 - DNA, 15 bp, Homo sapiens
acacctggctaatta

SEQ ID NO: 357008 - DNA, 15 bp, Homo sapiens
cacctggctaattat

SEQ ID NO: 357009 - DNA, 15 bp, Homo sapiens
acctggctaattatt

SEQ ID NO: 357010 - DNA, 15 bp, Homo sapiens
cctggctaattattt

SEQ ID NO: 357011 - DNA, 15 bp, Homo sapiens
ctggctaattatttt

SEQ ID NO: 357012 - DNA, 15 bp, Homo sapiens
tggctaattattttt

SEQ ID NO: 357013 - DNA, 15 bp, Homo sapiens
ggctaattattttta

SEQ ID NO: 357014 - DNA, 15 bp, Homo sapiens
gctaattatttttaa

SEQ ID NO: 357015 - DNA, 15 bp, Homo sapiens
ctaattatttttaaa

SEQ ID NO: 357016 - DNA, 15 bp, Homo sapiens
taattatttttaaat

SEQ ID NO: 357017 - DNA, 15 bp, Homo sapiens
aattatttttaaatt

SEQ ID NO: 357018 - DNA, 15 bp, Homo sapiens
ttatttttaaatttt

SEQ ID NO: 357019 - DNA, 15 bp, Homo sapiens
atttttaaatttttt

SEQ ID NO: 357020 - DNA, 15 bp, Homo sapiens
tttttaaattttttt

SEQ ID NO: 357021 - DNA, 15 bp, Homo sapiens
ttttaaatttttttt

SEQ ID NO: 357022 - DNA, 15 bp, Homo sapiens
tttaaattttttttg

SEQ ID NO: 357023 - DNA, 15 bp, Homo sapiens
ttaaattttttttgt

SEQ ID NO: 357024 - DNA, 15 bp, Homo sapiens
taaattttttttgta

SEQ ID NO: 357025 - DNA, 15 bp, Homo sapiens
aaattttttttgtag

SEQ ID NO: 357026 - DNA, 15 bp, Homo sapiens
aattttttttgtaga

SEQ ID NO: 357027 - DNA, 15 bp, Homo sapiens
attttttttgtagag

SEQ ID NO: 357028 - DNA, 15 bp, Homo sapiens
ttgtagagatggggg

SEQ ID NO: 357029 - DNA, 15 bp, Homo sapiens
tgtagagatgggggt

SEQ ID NO: 357030 - DNA, 15 bp, Homo sapiens
gtagagatgggggtc

SEQ ID NO: 357031 - DNA, 15 bp, Homo sapiens
tagagatgggggtct

SEQ ID NO: 357032 - DNA, 15 bp, Homo sapiens
agagatgggggtctt

SEQ ID NO: 357033 - DNA, 15 bp, Homo sapiens
gagatgggggtcttg

SEQ ID NO: 357034 - DNA, 15 bp, Homo sapiens
agatgggggtcttgc

SEQ ID NO: 357035 - DNA, 15 bp, Homo sapiens
gatgggggtcttgct

SEQ ID NO: 357036 - DNA, 15 bp, Homo sapiens
atgggggtcttgcta

SEQ ID NO: 357037 - DNA, 15 bp, Homo sapiens
tgggggtcttgctat

SEQ ID NO: 357038 - DNA, 15 bp, Homo sapiens
gggggtcttgctatg

SEQ ID NO: 357039 - DNA, 15 bp, Homo sapiens
ggggtcttgctatgt

SEQ ID NO: 357040 - DNA, 15 bp, Homo sapiens
gggtcttgctatgtt

SEQ ID NO: 357041 - DNA, 15 bp, Homo sapiens
ggtcttgctatgttg

SEQ ID NO: 357042 - DNA, 15 bp, Homo sapiens
gtcttgctatgttgc

SEQ ID NO: 357043 - DNA, 15 bp, Homo sapiens
tcttgctatgttgcc

SEQ ID NO: 357044 - DNA, 15 bp, Homo sapiens
cttgctatgttgccc

SEQ ID NO: 357045 - DNA, 15 bp, Homo sapiens
ttgctatgttgccca

SEQ ID NO: 357046 - DNA, 15 bp, Homo sapiens
tgctatgttgcccaa

SEQ ID NO: 357047 - DNA, 15 bp, Homo sapiens
gctatgttgcccaag

SEQ ID NO: 357048 - DNA, 15 bp, Homo sapiens
ctatgttgcccaagt

SEQ ID NO: 357049 - DNA, 15 bp, Homo sapiens
tatgttgcccaagtt

SEQ ID NO: 357050 - DNA, 15 bp, Homo sapiens
atgttgcccaagttg

SEQ ID NO: 357051 - DNA, 15 bp, Homo sapiens
tgttgcccaagttgg

SEQ ID NO: 357052 - DNA, 15 bp, Homo sapiens
gttgcccaagttggt

SEQ ID NO: 357053 - DNA, 15 bp, Homo sapiens
ttgcccaagttggtc

SEQ ID NO: 357054 - DNA, 15 bp, Homo sapiens
tgcccaagttggtct

SEQ ID NO: 357055 - DNA, 15 bp, Homo sapiens
gcccaagttggtctg

SEQ ID NO: 357056 - DNA, 15 bp, Homo sapiens
cccaagttggtctgg

SEQ ID NO: 357057 - DNA, 15 bp, Homo sapiens
ccaagttggtctgga

SEQ ID NO: 357058 - DNA, 15 bp, Homo sapiens
caagttggtctggaa

SEQ ID NO: 357059 - DNA, 15 bp, Homo sapiens
aagttggtctggaac

SEQ ID NO: 357060 - DNA, 15 bp, Homo sapiens
agttggtctggaact

SEQ ID NO: 357061 - DNA, 15 bp, Homo sapiens
gttggtctggaactc

SEQ ID NO: 357062 - DNA, 15 bp, Homo sapiens
ttggtctggaactct

SEQ ID NO: 357063 - DNA, 15 bp, Homo sapiens
tggtctggaactctt

SEQ ID NO: 357064 - DNA, 15 bp, Homo sapiens
ggtctggaactcttg

SEQ ID NO: 357065 - DNA, 15 bp, Homo sapiens
gtctggaactcttgg

SEQ ID NO: 357066 - DNA, 15 bp, Homo sapiens
tctggaactcttggg

SEQ ID NO: 357067 - DNA, 15 bp, Homo sapiens
ctggaactcttgggc

SEQ ID NO: 357068 - DNA, 15 bp, Homo sapiens
tggaactcttgggct

SEQ ID NO: 357069 - DNA, 15 bp, Homo sapiens
ggaactcttgggctc

SEQ ID NO: 357070 - DNA, 15 bp, Homo sapiens
gaactcttgggctca

SEQ ID NO: 357071 - DNA, 15 bp, Homo sapiens
aactcttgggctcaa

SEQ ID NO: 357072 - DNA, 15 bp, Homo sapiens
actcttgggctcaag

SEQ ID NO: 357073 - DNA, 15 bp, Homo sapiens
ctcttgggctcaagc

SEQ ID NO: 357074 - DNA, 15 bp, Homo sapiens
tcttgggctcaagcc

SEQ ID NO: 357075 - DNA, 15 bp, Homo sapiens
cttgggctcaagcca

SEQ ID NO: 357076 - DNA, 15 bp, Homo sapiens
ttgggctcaagccat

SEQ ID NO: 357077 - DNA, 15 bp, Homo sapiens
tgggctcaagccatc

SEQ ID NO: 357078 - DNA, 15 bp, Homo sapiens
gggctcaagccatcc

SEQ ID NO: 357079 - DNA, 15 bp, Homo sapiens
ggctcaagccatcct

SEQ ID NO: 357080 - DNA, 15 bp, Homo sapiens
gctcaagccatcctc

SEQ ID NO: 357081 - DNA, 15 bp, Homo sapiens
ctcaagccatcctcc

SEQ ID NO: 357082 - DNA, 15 bp, Homo sapiens
tcaagccatcctcct

SEQ ID NO: 357083 - DNA, 15 bp, Homo sapiens
caagccatcctcctg

SEQ ID NO: 357084 - DNA, 15 bp, Homo sapiens
aagccatcctcctgc

SEQ ID NO: 357085 - DNA, 15 bp, Homo sapiens
agccatcctcctgcc

SEQ ID NO: 357086 - DNA, 15 bp, Homo sapiens
gccatcctcctgcct

SEQ ID NO: 357087 - DNA, 15 bp, Homo sapiens
ccatcctcctgcctt

SEQ ID NO: 357088 - DNA, 15 bp, Homo sapiens
catcctcctgccttg

SEQ ID NO: 357089 - DNA, 15 bp, Homo sapiens
tcctgccttggccta

SEQ ID NO: 357090 - DNA, 15 bp, Homo sapiens
cctgccttggcctac

SEQ ID NO: 357091 - DNA, 15 bp, Homo sapiens
ctgccttggcctacc

SEQ ID NO: 357092 - DNA, 15 bp, Homo sapiens
tgccttggcctacca

SEQ ID NO: 357093 - DNA, 15 bp, Homo sapiens
gccttggcctaccaa

SEQ ID NO: 357094 - DNA, 15 bp, Homo sapiens
ccttggcctaccaaa

SEQ ID NO: 357095 - DNA, 15 bp, Homo sapiens
cttggcctaccaaag

SEQ ID NO: 357096 - DNA, 15 bp, Homo sapiens
ttggcctaccaaagt

SEQ ID NO: 357097 - DNA, 15 bp, Homo sapiens
tggcctaccaaagtc

SEQ ID NO: 357098 - DNA, 15 bp, Homo sapiens
ggcctaccaaagtcc

SEQ ID NO: 357099 - DNA, 15 bp, Homo sapiens
gcctaccaaagtcct

SEQ ID NO: 357100 - DNA, 15 bp, Homo sapiens
cctaccaaagtcctg

SEQ ID NO: 357101 - DNA, 15 bp, Homo sapiens
ctaccaaagtcctgg

SEQ ID NO: 357102 - DNA, 15 bp, Homo sapiens
taccaaagtcctggg

SEQ ID NO: 357103 - DNA, 15 bp, Homo sapiens
accaaagtcctggga

SEQ ID NO: 357104 - DNA, 15 bp, Homo sapiens
ccaaagtcctgggat

SEQ ID NO: 357105 - DNA, 15 bp, Homo sapiens
caaagtcctgggatt

SEQ ID NO: 357106 - DNA, 15 bp, Homo sapiens
aaagtcctgggatta

SEQ ID NO: 357107 - DNA, 15 bp, Homo sapiens
aagtcctgggattaa

SEQ ID NO: 357108 - DNA, 15 bp, Homo sapiens
agtcctgggattaaa

SEQ ID NO: 357109 - DNA, 15 bp, Homo sapiens
gtcctgggattaaag

SEQ ID NO: 357110 - DNA, 15 bp, Homo sapiens
tcctgggattaaagg

SEQ ID NO: 357111 - DNA, 15 bp, Homo sapiens
cctgggattaaaggc

SEQ ID NO: 357112 - DNA, 15 bp, Homo sapiens
ctgggattaaaggca

SEQ ID NO: 357113 - DNA, 15 bp, Homo sapiens
tgggattaaaggcat

SEQ ID NO: 357114 - DNA, 15 bp, Homo sapiens
gggattaaaggcatt

SEQ ID NO: 357115 - DNA, 15 bp, Homo sapiens
ggattaaaggcatta

SEQ ID NO: 357116 - DNA, 15 bp, Homo sapiens
gattaaaggcattag

SEQ ID NO: 357117 - DNA, 15 bp, Homo sapiens
attaaaggcattagc

SEQ ID NO: 357118 - DNA, 15 bp, Homo sapiens
ttaaaggcattagcc

SEQ ID NO: 357119 - DNA, 15 bp, Homo sapiens
taaaggcattagcca

SEQ ID NO: 357120 - DNA, 15 bp, Homo sapiens
aaaggcattagccac

SEQ ID NO: 357121 - DNA, 15 bp, Homo sapiens
aaggcattagccact

SEQ ID NO: 357122 - DNA, 15 bp, Homo sapiens
aggcattagccactg

SEQ ID NO: 357123 - DNA, 15 bp, Homo sapiens
ggcattagccactgc

SEQ ID NO: 357124 - DNA, 15 bp, Homo sapiens
gcattagccactgca

SEQ ID NO: 357125 - DNA, 15 bp, Homo sapiens
cattagccactgcac

SEQ ID NO: 357126 - DNA, 15 bp, Homo sapiens
attagccactgcacc

SEQ ID NO: 357127 - DNA, 15 bp, Homo sapiens
ttagccactgcaccc

SEQ ID NO: 357128 - DNA, 15 bp, Homo sapiens
tagccactgcacccg

SEQ ID NO: 357129 - DNA, 15 bp, Homo sapiens
agccactgcacccgg

SEQ ID NO: 357130 - DNA, 15 bp, Homo sapiens
gccactgcacccgga

SEQ ID NO: 357131 - DNA, 15 bp, Homo sapiens
ccactgcacccggac

SEQ ID NO: 357132 - DNA, 15 bp, Homo sapiens
cactgcacccggact

SEQ ID NO: 357133 - DNA, 15 bp, Homo sapiens
actgcacccggactg

SEQ ID NO: 357134 - DNA, 15 bp, Homo sapiens
ctgcacccggactgg

SEQ ID NO: 357135 - DNA, 15 bp, Homo sapiens
tgcacccggactggc

SEQ ID NO: 357136 - DNA, 15 bp, Homo sapiens
gcacccggactggct

SEQ ID NO: 357137 - DNA, 15 bp, Homo sapiens
cacccggactggctg

SEQ ID NO: 357138 - DNA, 15 bp, Homo sapiens
acccggactggctga

SEQ ID NO: 357139 - DNA, 15 bp, Homo sapiens
cccggactggctgag

SEQ ID NO: 357140 - DNA, 15 bp, Homo sapiens
ccggactggctgagg

SEQ ID NO: 357141 - DNA, 15 bp, Homo sapiens
cggactggctgaggg

SEQ ID NO: 357142 - DNA, 15 bp, Homo sapiens
ggactggctgagggt

SEQ ID NO: 357143 - DNA, 15 bp, Homo sapiens
gactggctgagggtt

SEQ ID NO: 357144 - DNA, 15 bp, Homo sapiens
actggctgagggttt

SEQ ID NO: 357145 - DNA, 15 bp, Homo sapiens
ctggctgagggttta

SEQ ID NO: 357146 - DNA, 15 bp, Homo sapiens
tggctgagggtttaa

SEQ ID NO: 357147 - DNA, 15 bp, Homo sapiens
ggctgagggtttaaa

SEQ ID NO: 357148 - DNA, 15 bp, Homo sapiens
gctgagggtttaaat

SEQ ID NO: 357149 - DNA, 15 bp, Homo sapiens
ctgagggtttaaatc

SEQ ID NO: 357150 - DNA, 15 bp, Homo sapiens
tgagggtttaaatct

SEQ ID NO: 357151 - DNA, 15 bp, Homo sapiens
gagggtttaaatcta

SEQ ID NO: 357152 - DNA, 15 bp, Homo sapiens
agggtttaaatctaa

SEQ ID NO: 357153 - DNA, 15 bp, Homo sapiens
gggtttaaatctaac

SEQ ID NO: 357154 - DNA, 15 bp, Homo sapiens
ggtttaaatctaact

SEQ ID NO: 357155 - DNA, 15 bp, Homo sapiens
gtttaaatctaactt

SEQ ID NO: 357156 - DNA, 15 bp, Homo sapiens
tttaaatctaacttg

SEQ ID NO: 357157 - DNA, 15 bp, Homo sapiens
ttaaatctaacttgt

SEQ ID NO: 357158 - DNA, 15 bp, Homo sapiens
taaatctaacttgta

SEQ ID NO: 357159 - DNA, 15 bp, Homo sapiens
aatctaacttgtagt

SEQ ID NO: 357160 - DNA, 15 bp, Homo sapiens
atctaacttgtagtt

SEQ ID NO: 357161 - DNA, 15 bp, Homo sapiens
tctaacttgtagttt

SEQ ID NO: 357162 - DNA, 15 bp, Homo sapiens
ctaacttgtagtttg

SEQ ID NO: 357163 - DNA, 15 bp, Homo sapiens
taacttgtagtttgg

SEQ ID NO: 357164 - DNA, 15 bp, Homo sapiens
aacttgtagtttggt

SEQ ID NO: 357165 - DNA, 15 bp, Homo sapiens
acttgtagtttggtt

SEQ ID NO: 357166 - DNA, 15 bp, Homo sapiens
cttgtagtttggttt

SEQ ID NO: 357167 - DNA, 15 bp, Homo sapiens
ttgtagtttggtttt

SEQ ID NO: 357168 - DNA, 15 bp, Homo sapiens
tgtagtttggttttg

SEQ ID NO: 357169 - DNA, 15 bp, Homo sapiens
gtagtttggttttgg

SEQ ID NO: 357170 - DNA, 15 bp, Homo sapiens
tagtttggttttgga

SEQ ID NO: 357171 - DNA, 15 bp, Homo sapiens
agtttggttttggat

SEQ ID NO: 357172 - DNA, 15 bp, Homo sapiens
gtttggttttggata

SEQ ID NO: 357173 - DNA, 15 bp, Homo sapiens
tttggttttggatac

SEQ ID NO: 357174 - DNA, 15 bp, Homo sapiens
ttggttttggatacc

SEQ ID NO: 357175 - DNA, 15 bp, Homo sapiens
tggttttggatacct

SEQ ID NO: 357176 - DNA, 15 bp, Homo sapiens
ggttttggatacctg

SEQ ID NO: 357177 - DNA, 15 bp, Homo sapiens
gttttggatacctgg

SEQ ID NO: 357178 - DNA, 15 bp, Homo sapiens
ttttggatacctggt

SEQ ID NO: 357179 - DNA, 15 bp, Homo sapiens
tttggatacctggtt

SEQ ID NO: 357180 - DNA, 15 bp, Homo sapiens
ttggatacctggtta

SEQ ID NO: 357181 - DNA, 15 bp, Homo sapiens
tggatacctggttaa

SEQ ID NO: 357182 - DNA, 15 bp, Homo sapiens
ggatacctggttaac

SEQ ID NO: 357183 - DNA, 15 bp, Homo sapiens
gatacctggttaact

SEQ ID NO: 357184 - DNA, 15 bp, Homo sapiens
atacctggttaactg

SEQ ID NO: 357185 - DNA, 15 bp, Homo sapiens
tacctggttaactga

SEQ ID NO: 357186 - DNA, 15 bp, Homo sapiens
acctggttaactgag

SEQ ID NO: 357187 - DNA, 15 bp, Homo sapiens
cctggttaactgaga

SEQ ID NO: 357188 - DNA, 15 bp, Homo sapiens
ctggttaactgagaa

SEQ ID NO: 357189 - DNA, 15 bp, Homo sapiens
tggttaactgagaat

SEQ ID NO: 357190 - DNA, 15 bp, Homo sapiens
ggttaactgagaata

SEQ ID NO: 357191 - DNA, 15 bp, Homo sapiens
gttaactgagaatag

SEQ ID NO: 357192 - DNA, 15 bp, Homo sapiens
ttaactgagaatagt

SEQ ID NO: 357193 - DNA, 15 bp, Homo sapiens
taactgagaatagtt

SEQ ID NO: 357194 - DNA, 15 bp, Homo sapiens
aactgagaatagttt

SEQ ID NO: 357195 - DNA, 15 bp, Homo sapiens
actgagaatagttta

SEQ ID NO: 357196 - DNA, 15 bp, Homo sapiens
ctgagaatagtttat

SEQ ID NO: 357197 - DNA, 15 bp, Homo sapiens
tgagaatagtttata

SEQ ID NO: 357198 - DNA, 15 bp, Homo sapiens
gagaatagtttatac

SEQ ID NO: 357199 - DNA, 15 bp, Homo sapiens
agaatagtttataca

SEQ ID NO: 357200 - DNA, 15 bp, Homo sapiens
gaatagtttatacat

SEQ ID NO: 357201 - DNA, 15 bp, Homo sapiens
aatagtttatacatt

SEQ ID NO: 357202 - DNA, 15 bp, Homo sapiens
atagtttatacattt

SEQ ID NO: 357203 - DNA, 15 bp, Homo sapiens
tagtttatacatttc

SEQ ID NO: 357204 - DNA, 15 bp, Homo sapiens
agtttatacatttct

SEQ ID NO: 357205 - DNA, 15 bp, Homo sapiens
gtttatacatttctc

SEQ ID NO: 357206 - DNA, 15 bp, Homo sapiens
tttatacatttctca

SEQ ID NO: 357207 - DNA, 15 bp, Homo sapiens
ttatacatttctcaa

SEQ ID NO: 357208 - DNA, 15 bp, Homo sapiens
tatacatttctcaag

SEQ ID NO: 357209 - DNA, 15 bp, Homo sapiens
atacatttctcaagg

SEQ ID NO: 357210 - DNA, 15 bp, Homo sapiens
tacatttctcaaggg

SEQ ID NO: 357211 - DNA, 15 bp, Homo sapiens
acatttctcaagggt

SEQ ID NO: 357212 - DNA, 15 bp, Homo sapiens
catttctcaagggtt

SEQ ID NO: 357213 - DNA, 15 bp, Homo sapiens
atttctcaagggttg

SEQ ID NO: 357214 - DNA, 15 bp, Homo sapiens
tttctcaagggttgt

SEQ ID NO: 357215 - DNA, 15 bp, Homo sapiens
ttctcaagggttgta

SEQ ID NO: 357216 - DNA, 15 bp, Homo sapiens
tctcaagggttgtac

SEQ ID NO: 357217 - DNA, 15 bp, Homo sapiens
ctcaagggttgtaca

SEQ ID NO: 357218 - DNA, 15 bp, Homo sapiens
tcaagggttgtacaa

SEQ ID NO: 357219 - DNA, 15 bp, Homo sapiens
caagggttgtacaac

SEQ ID NO: 357220 - DNA, 15 bp, Homo sapiens
aagggttgtacaaca

SEQ ID NO: 357221 - DNA, 15 bp, Homo sapiens
agggttgtacaacac

SEQ ID NO: 357222 - DNA, 15 bp, Homo sapiens
gggttgtacaacaca

SEQ ID NO: 357223 - DNA, 15 bp, Homo sapiens
ggttgtacaacacat

SEQ ID NO: 357224 - DNA, 15 bp, Homo sapiens
gttgtacaacacata

SEQ ID NO: 357225 - DNA, 15 bp, Homo sapiens
ttgtacaacacatac

SEQ ID NO: 357226 - DNA, 15 bp, Homo sapiens
tgtacaacacatacc

SEQ ID NO: 357227 - DNA, 15 bp, Homo sapiens
gtacaacacataccc

SEQ ID NO: 357228 - DNA, 15 bp, Homo sapiens
tacaacacatacccc

SEQ ID NO: 357229 - DNA, 15 bp, Homo sapiens
acaacacataccccc

SEQ ID NO: 357230 - DNA, 15 bp, Homo sapiens
caacacatacccccc

SEQ ID NO: 357231 - DNA, 15 bp, Homo sapiens
aacacatacccccct

SEQ ID NO: 357232 - DNA, 15 bp, Homo sapiens
acacatacccccctc

SEQ ID NO: 357233 - DNA, 15 bp, Homo sapiens
cacatacccccctcc

SEQ ID NO: 357234 - DNA, 15 bp, Homo sapiens
acatacccccctcca

SEQ ID NO: 357235 - DNA, 15 bp, Homo sapiens
catacccccctccaa

SEQ ID NO: 357236 - DNA, 15 bp, Homo sapiens
atacccccctccaag

SEQ ID NO: 357237 - DNA, 15 bp, Homo sapiens
tacccccctccaaga

SEQ ID NO: 357238 - DNA, 15 bp, Homo sapiens
acccccctccaagaa

SEQ ID NO: 357239 - DNA, 15 bp, Homo sapiens
cccccctccaagaag

SEQ ID NO: 357240 - DNA, 15 bp, Homo sapiens
ccccctccaagaaga

SEQ ID NO: 357241 - DNA, 15 bp, Homo sapiens
cccctccaagaagaa

SEQ ID NO: 357242 - DNA, 15 bp, Homo sapiens
ccctccaagaagaat

SEQ ID NO: 357243 - DNA, 15 bp, Homo sapiens
cctccaagaagaatc

SEQ ID NO: 357244 - DNA, 15 bp, Homo sapiens
ctccaagaagaatct

SEQ ID NO: 357245 - DNA, 15 bp, Homo sapiens
tccaagaagaatctg

SEQ ID NO: 357246 - DNA, 15 bp, Homo sapiens
ccaagaagaatctgt

SEQ ID NO: 357247 - DNA, 15 bp, Homo sapiens
caagaagaatctgtg

SEQ ID NO: 357248 - DNA, 15 bp, Homo sapiens
aagaagaatctgtga

SEQ ID NO: 357249 - DNA, 15 bp, Homo sapiens
agaagaatctgtgat

SEQ ID NO: 357250 - DNA, 15 bp, Homo sapiens
gaagaatctgtgata

SEQ ID NO: 357251 - DNA, 15 bp, Homo sapiens
aagaatctgtgatag

SEQ ID NO: 357252 - DNA, 15 bp, Homo sapiens
agaatctgtgatagg

SEQ ID NO: 357253 - DNA, 15 bp, Homo sapiens
gaatctgtgatagga

SEQ ID NO: 357254 - DNA, 15 bp, Homo sapiens
aatctgtgataggaa

SEQ ID NO: 357255 - DNA, 15 bp, Homo sapiens
atctgtgataggaag

SEQ ID NO: 357256 - DNA, 15 bp, Homo sapiens
tctgtgataggaagc

SEQ ID NO: 357257 - DNA, 15 bp, Homo sapiens
ctgtgataggaagca

SEQ ID NO: 357258 - DNA, 15 bp, Homo sapiens
tgtgataggaagcaa

SEQ ID NO: 357259 - DNA, 15 bp, Homo sapiens
gtgataggaagcaaa

SEQ ID NO: 357260 - DNA, 15 bp, Homo sapiens
tgataggaagcaaat

SEQ ID NO: 357261 - DNA, 15 bp, Homo sapiens
gataggaagcaaatg

SEQ ID NO: 357262 - DNA, 15 bp, Homo sapiens
ataggaagcaaatgt

SEQ ID NO: 357263 - DNA, 15 bp, Homo sapiens
taggaagcaaatgtg

SEQ ID NO: 357264 - DNA, 15 bp, Homo sapiens
aggaagcaaatgtgt

SEQ ID NO: 357265 - DNA, 15 bp, Homo sapiens
ggaagcaaatgtgtc

SEQ ID NO: 357266 - DNA, 15 bp, Homo sapiens
gaagcaaatgtgtcc

SEQ ID NO: 357267 - DNA, 15 bp, Homo sapiens
aagcaaatgtgtcct

SEQ ID NO: 357268 - DNA, 15 bp, Homo sapiens
agcaaatgtgtcctc

SEQ ID NO: 357269 - DNA, 15 bp, Homo sapiens
gcaaatgtgtcctcc

SEQ ID NO: 357270 - DNA, 15 bp, Homo sapiens
caaatgtgtcctccc

SEQ ID NO: 357271 - DNA, 15 bp, Homo sapiens
aaatgtgtcctccca

SEQ ID NO: 357272 - DNA, 15 bp, Homo sapiens
aatgtgtcctcccaa

SEQ ID NO: 357273 - DNA, 15 bp, Homo sapiens
atgtgtcctcccaaa

SEQ ID NO: 357274 - DNA, 15 bp, Homo sapiens
tgtgtcctcccaaaa

SEQ ID NO: 357275 - DNA, 15 bp, Homo sapiens
gtgtcctcccaaaac

SEQ ID NO: 357276 - DNA, 15 bp, Homo sapiens
tgtcctcccaaaacc

SEQ ID NO: 357277 - DNA, 15 bp, Homo sapiens
gtcctcccaaaacct

SEQ ID NO: 357278 - DNA, 15 bp, Homo sapiens
tcctcccaaaaccta

SEQ ID NO: 357279 - DNA, 15 bp, Homo sapiens
cctcccaaaacctaa

SEQ ID NO: 357280 - DNA, 15 bp, Homo sapiens
ctcccaaaacctaaa

SEQ ID NO: 357281 - DNA, 15 bp, Homo sapiens
tcccaaaacctaaaa

SEQ ID NO: 357282 - DNA, 15 bp, Homo sapiens
cccaaaacctaaaat

SEQ ID NO: 357283 - DNA, 15 bp, Homo sapiens
ccaaaacctaaaata

SEQ ID NO: 357284 - DNA, 15 bp, Homo sapiens
caaaacctaaaatat

SEQ ID NO: 357285 - DNA, 15 bp, Homo sapiens
aaaacctaaaatatt

SEQ ID NO: 357286 - DNA, 15 bp, Homo sapiens
aaacctaaaatattt

SEQ ID NO: 357287 - DNA, 15 bp, Homo sapiens
aacctaaaatattta

SEQ ID NO: 357288 - DNA, 15 bp, Homo sapiens
acctaaaatatttac

SEQ ID NO: 357289 - DNA, 15 bp, Homo sapiens
cctaaaatatttact

SEQ ID NO: 357290 - DNA, 15 bp, Homo sapiens
ctaaaatatttactg

SEQ ID NO: 357291 - DNA, 15 bp, Homo sapiens
taaaatatttactgg

SEQ ID NO: 357292 - DNA, 15 bp, Homo sapiens
aaaatatttactggc

SEQ ID NO: 357293 - DNA, 15 bp, Homo sapiens
aaatatttactggct

SEQ ID NO: 357294 - DNA, 15 bp, Homo sapiens
aatatttactggctg

SEQ ID NO: 357295 - DNA, 15 bp, Homo sapiens
atatttactggctgg

SEQ ID NO: 357296 - DNA, 15 bp, Homo sapiens
tatttactggctggc

SEQ ID NO: 357297 - DNA, 15 bp, Homo sapiens
atttactggctggcc

SEQ ID NO: 357298 - DNA, 15 bp, Homo sapiens
tttactggctggccc

SEQ ID NO: 357299 - DNA, 15 bp, Homo sapiens
ttactggctggccct

SEQ ID NO: 357300 - DNA, 15 bp, Homo sapiens
tactggctggccctt

SEQ ID NO: 357301 - DNA, 15 bp, Homo sapiens
actggctggcccttt

SEQ ID NO: 357302 - DNA, 15 bp, Homo sapiens
ctggctggccctttg

SEQ ID NO: 357303 - DNA, 15 bp, Homo sapiens
tggctggccctttgt

SEQ ID NO: 357304 - DNA, 15 bp, Homo sapiens
ggctggccctttgta

SEQ ID NO: 357305 - DNA, 15 bp, Homo sapiens
gctggccctttgtag

SEQ ID NO: 357306 - DNA, 15 bp, Homo sapiens
ctggccctttgtaga

SEQ ID NO: 357307 - DNA, 15 bp, Homo sapiens
tggccctttgtagaa

SEQ ID NO: 357308 - DNA, 15 bp, Homo sapiens
ggccctttgtagaaa

SEQ ID NO: 357309 - DNA, 15 bp, Homo sapiens
gccctttgtagaaaa

SEQ ID NO: 357310 - DNA, 15 bp, Homo sapiens
ccctttgtagaaaaa

SEQ ID NO: 357311 - DNA, 15 bp, Homo sapiens
cctttgtagaaaaat

SEQ ID NO: 357312 - DNA, 15 bp, Homo sapiens
ctttgtagaaaaatg

SEQ ID NO: 357313 - DNA, 15 bp, Homo sapiens
tttgtagaaaaatgt

SEQ ID NO: 357314 - DNA, 15 bp, Homo sapiens
ttgtagaaaaatgta

SEQ ID NO: 357315 - DNA, 15 bp, Homo sapiens
tgtagaaaaatgtac

SEQ ID NO: 357316 - DNA, 15 bp, Homo sapiens
gtagaaaaatgtact

SEQ ID NO: 357317 - DNA, 15 bp, Homo sapiens
tagaaaaatgtactg

SEQ ID NO: 357318 - DNA, 15 bp, Homo sapiens
agaaaaatgtactgc

SEQ ID NO: 357319 - DNA, 15 bp, Homo sapiens
gaaaaatgtactgct

SEQ ID NO: 357320 - DNA, 15 bp, Homo sapiens
aaaaatgtactgctc

SEQ ID NO: 357321 - DNA, 15 bp, Homo sapiens
aaaatgtactgctcc

SEQ ID NO: 357322 - DNA, 15 bp, Homo sapiens
aaatgtactgctcct

SEQ ID NO: 357323 - DNA, 15 bp, Homo sapiens
aatgtactgctcctt

SEQ ID NO: 357324 - DNA, 15 bp, Homo sapiens
atgtactgctccttg

SEQ ID NO: 357325 - DNA, 15 bp, Homo sapiens
tgtactgctccttga

SEQ ID NO: 357326 - DNA, 15 bp, Homo sapiens
gtactgctccttgat

SEQ ID NO: 357327 - DNA, 15 bp, Homo sapiens
tactgctccttgatc

SEQ ID NO: 357328 - DNA, 15 bp, Homo sapiens
actgctccttgatct

SEQ ID NO: 357329 - DNA, 15 bp, Homo sapiens
ctgctccttgatctg

SEQ ID NO: 357330 - DNA, 15 bp, Homo sapiens
tgctccttgatctgg

SEQ ID NO: 357331 - DNA, 15 bp, Homo sapiens
gctccttgatctggt

SEQ ID NO: 357332 - DNA, 15 bp, Homo sapiens
ctccttgatctggta

SEQ ID NO: 357333 - DNA, 15 bp, Homo sapiens
tccttgatctggtaa

SEQ ID NO: 357334 - DNA, 15 bp, Homo sapiens
ccttgatctggtaag

SEQ ID NO: 357335 - DNA, 15 bp, Homo sapiens
cttgatctggtaagc

SEQ ID NO: 357336 - DNA, 15 bp, Homo sapiens
ttgatctggtaagca

SEQ ID NO: 357337 - DNA, 15 bp, Homo sapiens
tgatctggtaagcat

SEQ ID NO: 357338 - DNA, 15 bp, Homo sapiens
gatctggtaagcata

SEQ ID NO: 357339 - DNA, 15 bp, Homo sapiens
atctggtaagcatac

SEQ ID NO: 357340 - DNA, 15 bp, Homo sapiens
tctggtaagcatact

SEQ ID NO: 357341 - DNA, 15 bp, Homo sapiens
ctggtaagcatactt

SEQ ID NO: 357342 - DNA, 15 bp, Homo sapiens
tggtaagcatacttc

SEQ ID NO: 357343 - DNA, 15 bp, Homo sapiens
ggtaagcatacttca

SEQ ID NO: 357344 - DNA, 15 bp, Homo sapiens
gtaagcatacttcat

SEQ ID NO: 357345 - DNA, 15 bp, Homo sapiens
taagcatacttcata

SEQ ID NO: 357346 - DNA, 15 bp, Homo sapiens
aagcatacttcatat

SEQ ID NO: 357347 - DNA, 15 bp, Homo sapiens
agcatacttcatatg

SEQ ID NO: 357348 - DNA, 15 bp, Homo sapiens
gcatacttcatatgg

SEQ ID NO: 357349 - DNA, 15 bp, Homo sapiens
catacttcatatgga

SEQ ID NO: 357350 - DNA, 15 bp, Homo sapiens
atacttcatatggag

SEQ ID NO: 357351 - DNA, 15 bp, Homo sapiens
tacttcatatggaga

SEQ ID NO: 357352 - DNA, 15 bp, Homo sapiens
acttcatatggagag

SEQ ID NO: 357353 - DNA, 15 bp, Homo sapiens
cttcatatggagagt

SEQ ID NO: 357354 - DNA, 15 bp, Homo sapiens
ttcatatggagagtg

SEQ ID NO: 357355 - DNA, 15 bp, Homo sapiens
tcatatggagagtgg

SEQ ID NO: 357356 - DNA, 15 bp, Homo sapiens
catatggagagtgga

SEQ ID NO: 357357 - DNA, 15 bp, Homo sapiens
atatggagagtggac

SEQ ID NO: 357358 - DNA, 15 bp, Homo sapiens
tatggagagtggacc

SEQ ID NO: 357359 - DNA, 15 bp, Homo sapiens
atggagagtggaccg

SEQ ID NO: 357360 - DNA, 15 bp, Homo sapiens
tggagagtggaccgg

SEQ ID NO: 357361 - DNA, 15 bp, Homo sapiens
ggagagtggaccggc

SEQ ID NO: 357362 - DNA, 15 bp, Homo sapiens
gagagtggaccggca

SEQ ID NO: 357363 - DNA, 15 bp, Homo sapiens
agagtggaccggcag

SEQ ID NO: 357364 - DNA, 15 bp, Homo sapiens
gagtggaccggcagg

SEQ ID NO: 357365 - DNA, 15 bp, Homo sapiens
agtggaccggcaggt

SEQ ID NO: 357366 - DNA, 15 bp, Homo sapiens
gtggaccggcaggtg

SEQ ID NO: 357367 - DNA, 15 bp, Homo sapiens
tggaccggcaggtgc

SEQ ID NO: 357368 - DNA, 15 bp, Homo sapiens
ggaccggcaggtgcc

SEQ ID NO: 357369 - DNA, 15 bp, Homo sapiens
gaccggcaggtgcct

SEQ ID NO: 357370 - DNA, 15 bp, Homo sapiens
accggcaggtgcctt

SEQ ID NO: 357371 - DNA, 15 bp, Homo sapiens
ccggcaggtgccttc

SEQ ID NO: 357372 - DNA, 15 bp, Homo sapiens
cggcaggtgccttca

SEQ ID NO: 357373 - DNA, 15 bp, Homo sapiens
ggcaggtgccttcac

SEQ ID NO: 357374 - DNA, 15 bp, Homo sapiens
gcaggtgccttcact

SEQ ID NO: 357375 - DNA, 15 bp, Homo sapiens
caggtgccttcactc

SEQ ID NO: 357376 - DNA, 15 bp, Homo sapiens
aggtgccttcactca

SEQ ID NO: 357377 - DNA, 15 bp, Homo sapiens
ggtgccttcactcat

SEQ ID NO: 357378 - DNA, 15 bp, Homo sapiens
gtgccttcactcatt

SEQ ID NO: 357379 - DNA, 15 bp, Homo sapiens
tgccttcactcattt

SEQ ID NO: 357380 - DNA, 15 bp, Homo sapiens
gccttcactcattta

SEQ ID NO: 357381 - DNA, 15 bp, Homo sapiens
ccttcactcatttat

SEQ ID NO: 357382 - DNA, 15 bp, Homo sapiens
cttcactcatttatg

SEQ ID NO: 357383 - DNA, 15 bp, Homo sapiens
ttcactcatttatgt

SEQ ID NO: 357384 - DNA, 15 bp, Homo sapiens
tcactcatttatgta

SEQ ID NO: 357385 - DNA, 15 bp, Homo sapiens
cactcatttatgtaa

SEQ ID NO: 357386 - DNA, 15 bp, Homo sapiens
actcatttatgtaaa

SEQ ID NO: 357387 - DNA, 15 bp, Homo sapiens
ctcatttatgtaaac

SEQ ID NO: 357388 - DNA, 15 bp, Homo sapiens
tcatttatgtaaacc

SEQ ID NO: 357389 - DNA, 15 bp, Homo sapiens
catttatgtaaacca

SEQ ID NO: 357390 - DNA, 15 bp, Homo sapiens
atttatgtaaaccag

SEQ ID NO: 357391 - DNA, 15 bp, Homo sapiens
tttatgtaaaccaga

SEQ ID NO: 357392 - DNA, 15 bp, Homo sapiens
ttatgtaaaccagaa

SEQ ID NO: 357393 - DNA, 15 bp, Homo sapiens
tatgtaaaccagaag

SEQ ID NO: 357394 - DNA, 15 bp, Homo sapiens
atgtaaaccagaaga

SEQ ID NO: 357395 - DNA, 15 bp, Homo sapiens
tgtaaaccagaagat

SEQ ID NO: 357396 - DNA, 15 bp, Homo sapiens
gtaaaccagaagatg

SEQ ID NO: 357397 - DNA, 15 bp, Homo sapiens
taaaccagaagatgc

SEQ ID NO: 357398 - DNA, 15 bp, Homo sapiens
aaaccagaagatgcc

SEQ ID NO: 357399 - DNA, 15 bp, Homo sapiens
aaccagaagatgcct

SEQ ID NO: 357400 - DNA, 15 bp, Homo sapiens
accagaagatgcctc

SEQ ID NO: 357401 - DNA, 15 bp, Homo sapiens
ccagaagatgcctcc

SEQ ID NO: 357402 - DNA, 15 bp, Homo sapiens
cagaagatgcctcca

SEQ ID NO: 357403 - DNA, 15 bp, Homo sapiens
agaagatgcctccac

SEQ ID NO: 357404 - DNA, 15 bp, Homo sapiens
gaagatgcctccact

SEQ ID NO: 357405 - DNA, 15 bp, Homo sapiens
aagatgcctccactc

SEQ ID NO: 357406 - DNA, 15 bp, Homo sapiens
agatgcctccactca

SEQ ID NO: 357407 - DNA, 15 bp, Homo sapiens
gatgcctccactcat

SEQ ID NO: 357408 - DNA, 15 bp, Homo sapiens
atgcctccactcatt

SEQ ID NO: 357409 - DNA, 15 bp, Homo sapiens
tgcctccactcattc

SEQ ID NO: 357410 - DNA, 15 bp, Homo sapiens
gcctccactcattca

SEQ ID NO: 357411 - DNA, 15 bp, Homo sapiens
cctccactcattcag

SEQ ID NO: 357412 - DNA, 15 bp, Homo sapiens
ctccactcattcagt

SEQ ID NO: 357413 - DNA, 15 bp, Homo sapiens
tccactcattcagta

SEQ ID NO: 357414 - DNA, 15 bp, Homo sapiens
ccactcattcagtac

SEQ ID NO: 357415 - DNA, 15 bp, Homo sapiens
cactcattcagtaca

SEQ ID NO: 357416 - DNA, 15 bp, Homo sapiens
actcattcagtacat

SEQ ID NO: 357417 - DNA, 15 bp, Homo sapiens
ctcattcagtacatt

SEQ ID NO: 357418 - DNA, 15 bp, Homo sapiens
tcattcagtacattc

SEQ ID NO: 357419 - DNA, 15 bp, Homo sapiens
cattcagtacattca

SEQ ID NO: 357420 - DNA, 15 bp, Homo sapiens
attcagtacattcaa

SEQ ID NO: 357421 - DNA, 15 bp, Homo sapiens
ttcagtacattcaag

SEQ ID NO: 357422 - DNA, 15 bp, Homo sapiens
tcagtacattcaaga

SEQ ID NO: 357423 - DNA, 15 bp, Homo sapiens
cagtacattcaagac

SEQ ID NO: 357424 - DNA, 15 bp, Homo sapiens
agtacattcaagacg

SEQ ID NO: 357425 - DNA, 15 bp, Homo sapiens
gtacattcaagacga

SEQ ID NO: 357426 - DNA, 15 bp, Homo sapiens
tacattcaagacgac

SEQ ID NO: 357427 - DNA, 15 bp, Homo sapiens
acattcaagacgaca

SEQ ID NO: 357428 - DNA, 15 bp, Homo sapiens
cattcaagacgacaa

SEQ ID NO: 357429 - DNA, 15 bp, Homo sapiens
attcaagacgacaag

SEQ ID NO: 357430 - DNA, 15 bp, Homo sapiens
ttcaagacgacaagc

SEQ ID NO: 357431 - DNA, 15 bp, Homo sapiens
tcaagacgacaagcc

SEQ ID NO: 357432 - DNA, 15 bp, Homo sapiens
caagacgacaagccc

SEQ ID NO: 357433 - DNA, 15 bp, Homo sapiens
aagacgacaagccca

SEQ ID NO: 357434 - DNA, 15 bp, Homo sapiens
agacgacaagcccag

SEQ ID NO: 357435 - DNA, 15 bp, Homo sapiens
gacgacaagcccagg

SEQ ID NO: 357436 - DNA, 15 bp, Homo sapiens
acgacaagcccagga

SEQ ID NO: 357437 - DNA, 15 bp, Homo sapiens
cgacaagcccaggag

SEQ ID NO: 357438 - DNA, 15 bp, Homo sapiens
gacaagcccaggagg

SEQ ID NO: 357439 - DNA, 15 bp, Homo sapiens
acaagcccaggaggc

SEQ ID NO: 357440 - DNA, 15 bp, Homo sapiens
caagcccaggaggca

SEQ ID NO: 357441 - DNA, 15 bp, Homo sapiens
aagcccaggaggcat

SEQ ID NO: 357442 - DNA, 15 bp, Homo sapiens
agcccaggaggcatc

SEQ ID NO: 357443 - DNA, 15 bp, Homo sapiens
gcccaggaggcatcc

SEQ ID NO: 357444 - DNA, 15 bp, Homo sapiens
cccaggaggcatcca

SEQ ID NO: 357445 - DNA, 15 bp, Homo sapiens
ccaggaggcatccag

SEQ ID NO: 357446 - DNA, 15 bp, Homo sapiens
caggaggcatccagc

SEQ ID NO: 357447 - DNA, 15 bp, Homo sapiens
aggaggcatccagct

SEQ ID NO: 357448 - DNA, 15 bp, Homo sapiens
ggaggcatccagctg

SEQ ID NO: 357449 - DNA, 15 bp, Homo sapiens
gaggcatccagctga

SEQ ID NO: 357450 - DNA, 15 bp, Homo sapiens
aggcatccagctgag

SEQ ID NO: 357451 - DNA, 15 bp, Homo sapiens
ggcatccagctgagt

SEQ ID NO: 357452 - DNA, 15 bp, Homo sapiens
gcatccagctgagtt

SEQ ID NO: 357453 - DNA, 15 bp, Homo sapiens
catccagctgagttc

SEQ ID NO: 357454 - DNA, 15 bp, Homo sapiens
atccagctgagttct

SEQ ID NO: 357455 - DNA, 15 bp, Homo sapiens
tccagctgagttctt

SEQ ID NO: 357456 - DNA, 15 bp, Homo sapiens
ccagctgagttcttt

SEQ ID NO: 357457 - DNA, 15 bp, Homo sapiens
cagctgagttctttc

SEQ ID NO: 357458 - DNA, 15 bp, Homo sapiens
agctgagttctttct

SEQ ID NO: 357459 - DNA, 15 bp, Homo sapiens
gctgagttctttctc

SEQ ID NO: 357460 - DNA, 15 bp, Homo sapiens
ctgagttctttctcc

SEQ ID NO: 357461 - DNA, 15 bp, Homo sapiens
tgagttctttctcct

SEQ ID NO: 357462 - DNA, 15 bp, Homo sapiens
gagttctttctccta

SEQ ID NO: 357463 - DNA, 15 bp, Homo sapiens
agttctttctcctaa

SEQ ID NO: 357464 - DNA, 15 bp, Homo sapiens
gttctttctcctaaa

SEQ ID NO: 357465 - DNA, 15 bp, Homo sapiens
ttctttctcctaaac

SEQ ID NO: 357466 - DNA, 15 bp, Homo sapiens
tctttctcctaaact

SEQ ID NO: 357467 - DNA, 15 bp, Homo sapiens
ctttctcctaaactt

SEQ ID NO: 357468 - DNA, 15 bp, Homo sapiens
tttctcctaaactta

SEQ ID NO: 357469 - DNA, 15 bp, Homo sapiens
ttctcctaaacttac

SEQ ID NO: 357470 - DNA, 15 bp, Homo sapiens
tctcctaaacttacc

SEQ ID NO: 357471 - DNA, 15 bp, Homo sapiens
ctcctaaacttacca

SEQ ID NO: 357472 - DNA, 15 bp, Homo sapiens
tcctaaacttaccac

SEQ ID NO: 357473 - DNA, 15 bp, Homo sapiens
cctaaacttaccact

SEQ ID NO: 357474 - DNA, 15 bp, Homo sapiens
ctaaacttaccactc

SEQ ID NO: 357475 - DNA, 15 bp, Homo sapiens
taaacttaccactca

SEQ ID NO: 357476 - DNA, 15 bp, Homo sapiens
aaacttaccactcaa

SEQ ID NO: 357477 - DNA, 15 bp, Homo sapiens
aacttaccactcaaa

SEQ ID NO: 357478 - DNA, 15 bp, Homo sapiens
acttaccactcaaat

SEQ ID NO: 357479 - DNA, 15 bp, Homo sapiens
cttaccactcaaata

SEQ ID NO: 357480 - DNA, 15 bp, Homo sapiens
ttaccactcaaataa

SEQ ID NO: 357481 - DNA, 15 bp, Homo sapiens
taccactcaaataag

SEQ ID NO: 357482 - DNA, 15 bp, Homo sapiens
accactcaaataagt

SEQ ID NO: 357483 - DNA, 15 bp, Homo sapiens
ccactcaaataagtt

SEQ ID NO: 357484 - DNA, 15 bp, Homo sapiens
cactcaaataagttc

SEQ ID NO: 357485 - DNA, 15 bp, Homo sapiens
actcaaataagttcc

SEQ ID NO: 357486 - DNA, 15 bp, Homo sapiens
ctcaaataagttcct

SEQ ID NO: 357487 - DNA, 15 bp, Homo sapiens
tcaaataagttcctc

SEQ ID NO: 357488 - DNA, 15 bp, Homo sapiens
caaataagttcctct

SEQ ID NO: 357489 - DNA, 15 bp, Homo sapiens
aaataagttcctctt

SEQ ID NO: 357490 - DNA, 15 bp, Homo sapiens
aataagttcctctta

SEQ ID NO: 357491 - DNA, 15 bp, Homo sapiens
ataagttcctcttat

SEQ ID NO: 357492 - DNA, 15 bp, Homo sapiens
taagttcctcttata

SEQ ID NO: 357493 - DNA, 15 bp, Homo sapiens
aagttcctcttataa

SEQ ID NO: 357494 - DNA, 15 bp, Homo sapiens
agttcctcttataat

SEQ ID NO: 357495 - DNA, 15 bp, Homo sapiens
gttcctcttataata

SEQ ID NO: 357496 - DNA, 15 bp, Homo sapiens
ttcctcttataataa

SEQ ID NO: 357497 - DNA, 15 bp, Homo sapiens
tcctcttataataag

SEQ ID NO: 357498 - DNA, 15 bp, Homo sapiens
cctcttataataagg

SEQ ID NO: 357499 - DNA, 15 bp, Homo sapiens
ctcttataataaggg

SEQ ID NO: 357500 - DNA, 15 bp, Homo sapiens
tcttataataaggga

SEQ ID NO: 357501 - DNA, 15 bp, Homo sapiens
cttataataagggat

SEQ ID NO: 357502 - DNA, 15 bp, Homo sapiens
ttataataagggatt

SEQ ID NO: 357503 - DNA, 15 bp, Homo sapiens
tataataagggatta

SEQ ID NO: 357504 - DNA, 15 bp, Homo sapiens
ataataagggattat

SEQ ID NO: 357505 - DNA, 15 bp, Homo sapiens
taataagggattata

SEQ ID NO: 357506 - DNA, 15 bp, Homo sapiens
aataagggattataa

SEQ ID NO: 357507 - DNA, 15 bp, Homo sapiens
ataagggattataaa

SEQ ID NO: 357508 - DNA, 15 bp, Homo sapiens
taagggattataaat

SEQ ID NO: 357509 - DNA, 15 bp, Homo sapiens
aagggattataaatt

SEQ ID NO: 357510 - DNA, 15 bp, Homo sapiens
agggattataaattt

SEQ ID NO: 357511 - DNA, 15 bp, Homo sapiens
gggattataaattta

SEQ ID NO: 357512 - DNA, 15 bp, Homo sapiens
ggattataaatttat

SEQ ID NO: 357513 - DNA, 15 bp, Homo sapiens
gattataaatttata

SEQ ID NO: 357514 - DNA, 15 bp, Homo sapiens
attataaatttataa

SEQ ID NO: 357515 - DNA, 15 bp, Homo sapiens
ttataaatttataaa

SEQ ID NO: 357516 - DNA, 15 bp, Homo sapiens
tataaatttataaat

SEQ ID NO: 357517 - DNA, 15 bp, Homo sapiens
ataaatttataaatg

SEQ ID NO: 357518 - DNA, 15 bp, Homo sapiens
taaatttataaatgt

SEQ ID NO: 357519 - DNA, 15 bp, Homo sapiens
aaatttataaatgtt

SEQ ID NO: 357520 - DNA, 15 bp, Homo sapiens
aatttataaatgttt

SEQ ID NO: 357521 - DNA, 15 bp, Homo sapiens
atttataaatgtttc

SEQ ID NO: 357522 - DNA, 15 bp, Homo sapiens
tttataaatgtttcc

SEQ ID NO: 357523 - DNA, 15 bp, Homo sapiens
ttataaatgtttcca

SEQ ID NO: 357524 - DNA, 15 bp, Homo sapiens
tataaatgtttccac

SEQ ID NO: 357525 - DNA, 15 bp, Homo sapiens
ataaatgtttccacc

SEQ ID NO: 357526 - DNA, 15 bp, Homo sapiens
taaatgtttccaccc

SEQ ID NO: 357527 - DNA, 15 bp, Homo sapiens
aaatgtttccaccca

SEQ ID NO: 357528 - DNA, 15 bp, Homo sapiens
aatgtttccacccac

SEQ ID NO: 357529 - DNA, 15 bp, Homo sapiens
atgtttccacccact

SEQ ID NO: 357530 - DNA, 15 bp, Homo sapiens
tgtttccacccacta

SEQ ID NO: 357531 - DNA, 15 bp, Homo sapiens
gtttccacccactac

SEQ ID NO: 357532 - DNA, 15 bp, Homo sapiens
tttccacccactaca

SEQ ID NO: 357533 - DNA, 15 bp, Homo sapiens
ttccacccactacac

SEQ ID NO: 357534 - DNA, 15 bp, Homo sapiens
tccacccactacaca

SEQ ID NO: 357535 - DNA, 15 bp, Homo sapiens
ccacccactacacaa

SEQ ID NO: 357536 - DNA, 15 bp, Homo sapiens
cacccactacacaac

SEQ ID NO: 357537 - DNA, 15 bp, Homo sapiens
acccactacacaacc

SEQ ID NO: 357538 - DNA, 15 bp, Homo sapiens
cccactacacaaccc

SEQ ID NO: 357539 - DNA, 15 bp, Homo sapiens
ccactacacaacccc

SEQ ID NO: 357540 - DNA, 15 bp, Homo sapiens
cactacacaacccct

SEQ ID NO: 357541 - DNA, 15 bp, Homo sapiens
actacacaacccctg

SEQ ID NO: 357542 - DNA, 15 bp, Homo sapiens
ctacacaacccctgg

SEQ ID NO: 357543 - DNA, 15 bp, Homo sapiens
tacacaacccctggg

SEQ ID NO: 357544 - DNA, 15 bp, Homo sapiens
acacaacccctgggt

SEQ ID NO: 357545 - DNA, 15 bp, Homo sapiens
cacaacccctgggtc

SEQ ID NO: 357546 - DNA, 15 bp, Homo sapiens
acaacccctgggtcc

SEQ ID NO: 357547 - DNA, 15 bp, Homo sapiens
caacccctgggtccc

SEQ ID NO: 357548 - DNA, 15 bp, Homo sapiens
aacccctgggtccct

SEQ ID NO: 357549 - DNA, 15 bp, Homo sapiens
acccctgggtccctg

SEQ ID NO: 357550 - DNA, 15 bp, Homo sapiens
cccctgggtccctgc

SEQ ID NO: 357551 - DNA, 15 bp, Homo sapiens
ccctgggtccctgct

SEQ ID NO: 357552 - DNA, 15 bp, Homo sapiens
cctgggtccctgctc

SEQ ID NO: 357553 - DNA, 15 bp, Homo sapiens
ctgggtccctgctct

SEQ ID NO: 357554 - DNA, 15 bp, Homo sapiens
tgggtccctgctctg

SEQ ID NO: 357555 - DNA, 15 bp, Homo sapiens
gggtccctgctctgg

SEQ ID NO: 357556 - DNA, 15 bp, Homo sapiens
ggtccctgctctgga

SEQ ID NO: 357557 - DNA, 15 bp, Homo sapiens
gtccctgctctggaa

SEQ ID NO: 357558 - DNA, 15 bp, Homo sapiens
tccctgctctggaaa

SEQ ID NO: 357559 - DNA, 15 bp, Homo sapiens
ccctgctctggaaac

SEQ ID NO: 357560 - DNA, 15 bp, Homo sapiens
cctgctctggaaacc

SEQ ID NO: 357561 - DNA, 15 bp, Homo sapiens
ctgctctggaaacct

SEQ ID NO: 357562 - DNA, 15 bp, Homo sapiens
tgctctggaaacctc

SEQ ID NO: 357563 - DNA, 15 bp, Homo sapiens
gctctggaaacctca

SEQ ID NO: 357564 - DNA, 15 bp, Homo sapiens
ctctggaaacctcag

SEQ ID NO: 357565 - DNA, 15 bp, Homo sapiens
tctggaaacctcaga

SEQ ID NO: 357566 - DNA, 15 bp, Homo sapiens
ctggaaacctcagag

SEQ ID NO: 357567 - DNA, 15 bp, Homo sapiens
tggaaacctcagagg

SEQ ID NO: 357568 - DNA, 15 bp, Homo sapiens
ggaaacctcagaggg

SEQ ID NO: 357569 - DNA, 15 bp, Homo sapiens
gaaacctcagagggg

SEQ ID NO: 357570 - DNA, 15 bp, Homo sapiens
aaacctcagagggga

SEQ ID NO: 357571 - DNA, 15 bp, Homo sapiens
aacctcagaggggaa

SEQ ID NO: 357572 - DNA, 15 bp, Homo sapiens
acctcagaggggaat

SEQ ID NO: 357573 - DNA, 15 bp, Homo sapiens
cctcagaggggaatg

SEQ ID NO: 357574 - DNA, 15 bp, Homo sapiens
ctcagaggggaatga

SEQ ID NO: 357575 - DNA, 15 bp, Homo sapiens
tcagaggggaatgag

SEQ ID NO: 357576 - DNA, 15 bp, Homo sapiens
cagaggggaatgagt

SEQ ID NO: 357577 - DNA, 15 bp, Homo sapiens
agaggggaatgagtg

SEQ ID NO: 357578 - DNA, 15 bp, Homo sapiens
gaggggaatgagtga

SEQ ID NO: 357579 - DNA, 15 bp, Homo sapiens
aggggaatgagtgat

SEQ ID NO: 357580 - DNA, 15 bp, Homo sapiens
ggggaatgagtgatc

SEQ ID NO: 357581 - DNA, 15 bp, Homo sapiens
gggaatgagtgatca

SEQ ID NO: 357582 - DNA, 15 bp, Homo sapiens
ggaatgagtgatcaa

SEQ ID NO: 357583 - DNA, 15 bp, Homo sapiens
gaatgagtgatcaaa

SEQ ID NO: 357584 - DNA, 15 bp, Homo sapiens
aatgagtgatcaaaa

SEQ ID NO: 357585 - DNA, 15 bp, Homo sapiens
atgagtgatcaaaac

SEQ ID NO: 357586 - DNA, 15 bp, Homo sapiens
tgagtgatcaaaacc

SEQ ID NO: 357587 - DNA, 15 bp, Homo sapiens
gagtgatcaaaacca

SEQ ID NO: 357588 - DNA, 15 bp, Homo sapiens
agtgatcaaaaccaa

SEQ ID NO: 357589 - DNA, 15 bp, Homo sapiens
gtgatcaaaaccaac

SEQ ID NO: 357590 - DNA, 15 bp, Homo sapiens
tgatcaaaaccaaca

SEQ ID NO: 357591 - DNA, 15 bp, Homo sapiens
gatcaaaaccaacac

SEQ ID NO: 357592 - DNA, 15 bp, Homo sapiens
atcaaaaccaacaca

SEQ ID NO: 357593 - DNA, 15 bp, Homo sapiens
tcaaaaccaacacag

SEQ ID NO: 357594 - DNA, 15 bp, Homo sapiens
caaaaccaacacagt

SEQ ID NO: 357595 - DNA, 15 bp, Homo sapiens
aaaaccaacacagta

SEQ ID NO: 357596 - DNA, 15 bp, Homo sapiens
aaaccaacacagtaa

SEQ ID NO: 357597 - DNA, 15 bp, Homo sapiens
aaccaacacagtaag

SEQ ID NO: 357598 - DNA, 15 bp, Homo sapiens
accaacacagtaaga

SEQ ID NO: 357599 - DNA, 15 bp, Homo sapiens
ccaacacagtaagaa

SEQ ID NO: 357600 - DNA, 15 bp, Homo sapiens
caacacagtaagaac

SEQ ID NO: 357601 - DNA, 15 bp, Homo sapiens
aacacagtaagaaca

SEQ ID NO: 357602 - DNA, 15 bp, Homo sapiens
acacagtaagaacag

SEQ ID NO: 357603 - DNA, 15 bp, Homo sapiens
cacagtaagaacagt

SEQ ID NO: 357604 - DNA, 15 bp, Homo sapiens
acagtaagaacagta

SEQ ID NO: 357605 - DNA, 15 bp, Homo sapiens
cagtaagaacagtat

SEQ ID NO: 357606 - DNA, 15 bp, Homo sapiens
agtaagaacagtata

SEQ ID NO: 357607 - DNA, 15 bp, Homo sapiens
gtaagaacagtataa

SEQ ID NO: 357608 - DNA, 15 bp, Homo sapiens
taagaacagtataac

SEQ ID NO: 357609 - DNA, 15 bp, Homo sapiens
aagaacagtataact

SEQ ID NO: 357610 - DNA, 15 bp, Homo sapiens
agaacagtataactc

SEQ ID NO: 357611 - DNA, 15 bp, Homo sapiens
gaacagtataactcc

SEQ ID NO: 357612 - DNA, 15 bp, Homo sapiens
aacagtataactcca

SEQ ID NO: 357613 - DNA, 15 bp, Homo sapiens
acagtataactccag

SEQ ID NO: 357614 - DNA, 15 bp, Homo sapiens
cagtataactccagt

SEQ ID NO: 357615 - DNA, 15 bp, Homo sapiens
agtataactccagtt

SEQ ID NO: 357616 - DNA, 15 bp, Homo sapiens
gtataactccagttt

SEQ ID NO: 357617 - DNA, 15 bp, Homo sapiens
tataactccagtttt

SEQ ID NO: 357618 - DNA, 15 bp, Homo sapiens
ataactccagttttg

SEQ ID NO: 357619 - DNA, 15 bp, Homo sapiens
taactccagttttgg

SEQ ID NO: 357620 - DNA, 15 bp, Homo sapiens
aactccagttttggt

SEQ ID NO: 357621 - DNA, 15 bp, Homo sapiens
actccagttttggta

SEQ ID NO: 357622 - DNA, 15 bp, Homo sapiens
ctccagttttggtaa

SEQ ID NO: 357623 - DNA, 15 bp, Homo sapiens
tccagttttggtaaa

SEQ ID NO: 357624 - DNA, 15 bp, Homo sapiens
ccagttttggtaaaa

SEQ ID NO: 357625 - DNA, 15 bp, Homo sapiens
cagttttggtaaaat

SEQ ID NO: 357626 - DNA, 15 bp, Homo sapiens
agttttggtaaaatg

SEQ ID NO: 357627 - DNA, 15 bp, Homo sapiens
gttttggtaaaatgt

SEQ ID NO: 357628 - DNA, 15 bp, Homo sapiens
ttttggtaaaatgtg

SEQ ID NO: 357629 - DNA, 15 bp, Homo sapiens
tttggtaaaatgtgg

SEQ ID NO: 357630 - DNA, 15 bp, Homo sapiens
ttggtaaaatgtggc

SEQ ID NO: 357631 - DNA, 15 bp, Homo sapiens
tggtaaaatgtggct

SEQ ID NO: 357632 - DNA, 15 bp, Homo sapiens
ggtaaaatgtggctc

SEQ ID NO: 357633 - DNA, 15 bp, Homo sapiens
gtaaaatgtggctct

SEQ ID NO: 357634 - DNA, 15 bp, Homo sapiens
taaaatgtggctctc

SEQ ID NO: 357635 - DNA, 15 bp, Homo sapiens
aaaatgtggctctct

SEQ ID NO: 357636 - DNA, 15 bp, Homo sapiens
aaatgtggctctctt

SEQ ID NO: 357637 - DNA, 15 bp, Homo sapiens
aatgtggctctctta

SEQ ID NO: 357638 - DNA, 15 bp, Homo sapiens
atgtggctctcttat

SEQ ID NO: 357639 - DNA, 15 bp, Homo sapiens
tgtggctctcttata

SEQ ID NO: 357640 - DNA, 15 bp, Homo sapiens
gtggctctcttatat

SEQ ID NO: 357641 - DNA, 15 bp, Homo sapiens
tggctctcttatatt

SEQ ID NO: 357642 - DNA, 15 bp, Homo sapiens
ggctctcttatattg

SEQ ID NO: 357643 - DNA, 15 bp, Homo sapiens
gctctcttatattga

SEQ ID NO: 357644 - DNA, 15 bp, Homo sapiens
ctctcttatattgac

SEQ ID NO: 357645 - DNA, 15 bp, Homo sapiens
tctcttatattgaca

SEQ ID NO: 357646 - DNA, 15 bp, Homo sapiens
ctcttatattgacat

SEQ ID NO: 357647 - DNA, 15 bp, Homo sapiens
tcttatattgacatg

SEQ ID NO: 357648 - DNA, 15 bp, Homo sapiens
cttatattgacatgt

SEQ ID NO: 357649 - DNA, 15 bp, Homo sapiens
ttatattgacatgtc

SEQ ID NO: 357650 - DNA, 15 bp, Homo sapiens
tatattgacatgtcc

SEQ ID NO: 357651 - DNA, 15 bp, Homo sapiens
atattgacatgtcct

SEQ ID NO: 357652 - DNA, 15 bp, Homo sapiens
tattgacatgtcctc

SEQ ID NO: 357653 - DNA, 15 bp, Homo sapiens
attgacatgtcctca

SEQ ID NO: 357654 - DNA, 15 bp, Homo sapiens
ttgacatgtcctcat

SEQ ID NO: 357655 - DNA, 15 bp, Homo sapiens
tgacatgtcctcatg

SEQ ID NO: 357656 - DNA, 15 bp, Homo sapiens
gacatgtcctcatga

SEQ ID NO: 357657 - DNA, 15 bp, Homo sapiens
acatgtcctcatgaa

SEQ ID NO: 357658 - DNA, 15 bp, Homo sapiens
catgtcctcatgaat

SEQ ID NO: 357659 - DNA, 15 bp, Homo sapiens
atgtcctcatgaatt

SEQ ID NO: 357660 - DNA, 15 bp, Homo sapiens
tgtcctcatgaattt

SEQ ID NO: 357661 - DNA, 15 bp, Homo sapiens
gtcctcatgaattta

SEQ ID NO: 357662 - DNA, 15 bp, Homo sapiens
tcctcatgaatttag

SEQ ID NO: 357663 - DNA, 15 bp, Homo sapiens
cctcatgaatttaga

SEQ ID NO: 357664 - DNA, 15 bp, Homo sapiens
ctcatgaatttagaa

SEQ ID NO: 357665 - DNA, 15 bp, Homo sapiens
tcatgaatttagaaa

SEQ ID NO: 357666 - DNA, 15 bp, Homo sapiens
catgaatttagaaaa

SEQ ID NO: 357667 - DNA, 15 bp, Homo sapiens
atgaatttagaaaaa

SEQ ID NO: 357668 - DNA, 15 bp, Homo sapiens
tgaatttagaaaaaa

SEQ ID NO: 357669 - DNA, 15 bp, Homo sapiens
gaatttagaaaaaag

SEQ ID NO: 357670 - DNA, 15 bp, Homo sapiens
aatttagaaaaaagt

SEQ ID NO: 357671 - DNA, 15 bp, Homo sapiens
atttagaaaaaagtt

SEQ ID NO: 357672 - DNA, 15 bp, Homo sapiens
tttagaaaaaagttg

SEQ ID NO: 357673 - DNA, 15 bp, Homo sapiens
ttagaaaaaagttgg

SEQ ID NO: 357674 - DNA, 15 bp, Homo sapiens
tagaaaaaagttggg

SEQ ID NO: 357675 - DNA, 15 bp, Homo sapiens
agaaaaaagttggga

SEQ ID NO: 357676 - DNA, 15 bp, Homo sapiens
gaaaaaagttgggaa

SEQ ID NO: 357677 - DNA, 15 bp, Homo sapiens
aaaaaagttgggaag

SEQ ID NO: 357678 - DNA, 15 bp, Homo sapiens
aaaaagttgggaagg

SEQ ID NO: 357679 - DNA, 15 bp, Homo sapiens
aaaagttgggaaggc

SEQ ID NO: 357680 - DNA, 15 bp, Homo sapiens
aaagttgggaaggct

SEQ ID NO: 357681 - DNA, 15 bp, Homo sapiens
aagttgggaaggcta

SEQ ID NO: 357682 - DNA, 15 bp, Homo sapiens
agttgggaaggctac

SEQ ID NO: 357683 - DNA, 15 bp, Homo sapiens
gttgggaaggctaca

SEQ ID NO: 357684 - DNA, 15 bp, Homo sapiens
ttgggaaggctacat

SEQ ID NO: 357685 - DNA, 15 bp, Homo sapiens
tgggaaggctacatt

SEQ ID NO: 357686 - DNA, 15 bp, Homo sapiens
gggaaggctacattg

SEQ ID NO: 357687 - DNA, 15 bp, Homo sapiens
ggaaggctacattgc

SEQ ID NO: 357688 - DNA, 15 bp, Homo sapiens
gaaggctacattgca

SEQ ID NO: 357689 - DNA, 15 bp, Homo sapiens
aaggctacattgcaa

SEQ ID NO: 357690 - DNA, 15 bp, Homo sapiens
aggctacattgcaaa

SEQ ID NO: 357691 - DNA, 15 bp, Homo sapiens
ggctacattgcaaac

SEQ ID NO: 357692 - DNA, 15 bp, Homo sapiens
gctacattgcaaact

SEQ ID NO: 357693 - DNA, 15 bp, Homo sapiens
ctacattgcaaactt

SEQ ID NO: 357694 - DNA, 15 bp, Homo sapiens
tacattgcaaacttt

SEQ ID NO: 357695 - DNA, 15 bp, Homo sapiens
acattgcaaactttt

SEQ ID NO: 357696 - DNA, 15 bp, Homo sapiens
cattgcaaactttta

SEQ ID NO: 357697 - DNA, 15 bp, Homo sapiens
attgcaaacttttac

SEQ ID NO: 357698 - DNA, 15 bp, Homo sapiens
ttgcaaacttttaca

SEQ ID NO: 357699 - DNA, 15 bp, Homo sapiens
tgcaaacttttacat

SEQ ID NO: 357700 - DNA, 15 bp, Homo sapiens
gcaaacttttacatc

SEQ ID NO: 357701 - DNA, 15 bp, Homo sapiens
caaacttttacatca

SEQ ID NO: 357702 - DNA, 15 bp, Homo sapiens
aaacttttacatcag

SEQ ID NO: 357703 - DNA, 15 bp, Homo sapiens
aacttttacatcagt

SEQ ID NO: 357704 - DNA, 15 bp, Homo sapiens
acttttacatcagtt

SEQ ID NO: 357705 - DNA, 15 bp, Homo sapiens
cttttacatcagtta

SEQ ID NO: 357706 - DNA, 15 bp, Homo sapiens
ttttacatcagttag

SEQ ID NO: 357707 - DNA, 15 bp, Homo sapiens
tttacatcagttagc

SEQ ID NO: 357708 - DNA, 15 bp, Homo sapiens
ttacatcagttagct

SEQ ID NO: 357709 - DNA, 15 bp, Homo sapiens
tacatcagttagctc

SEQ ID NO: 357710 - DNA, 15 bp, Homo sapiens
acatcagttagctcc

SEQ ID NO: 357711 - DNA, 15 bp, Homo sapiens
catcagttagctcca

SEQ ID NO: 357712 - DNA, 15 bp, Homo sapiens
atcagttagctccaa

SEQ ID NO: 357713 - DNA, 15 bp, Homo sapiens
tcagttagctccaag

SEQ ID NO: 357714 - DNA, 15 bp, Homo sapiens
cagttagctccaagt

SEQ ID NO: 357715 - DNA, 15 bp, Homo sapiens
agttagctccaagtt

SEQ ID NO: 357716 - DNA, 15 bp, Homo sapiens
gttagctccaagttg

SEQ ID NO: 357717 - DNA, 15 bp, Homo sapiens
ttagctccaagttgg

SEQ ID NO: 357718 - DNA, 15 bp, Homo sapiens
tagctccaagttgga

SEQ ID NO: 357719 - DNA, 15 bp, Homo sapiens
agctccaagttggaa

SEQ ID NO: 357720 - DNA, 15 bp, Homo sapiens
gctccaagttggaat

SEQ ID NO: 357721 - DNA, 15 bp, Homo sapiens
ctccaagttggaatt

SEQ ID NO: 357722 - DNA, 15 bp, Homo sapiens
tccaagttggaattg

SEQ ID NO: 357723 - DNA, 15 bp, Homo sapiens
ccaagttggaattgg

SEQ ID NO: 357724 - DNA, 15 bp, Homo sapiens
caagttggaattggg

SEQ ID NO: 357725 - DNA, 15 bp, Homo sapiens
aagttggaattgggt

SEQ ID NO: 357726 - DNA, 15 bp, Homo sapiens
agttggaattgggtg

SEQ ID NO: 357727 - DNA, 15 bp, Homo sapiens
gttggaattgggtgg

SEQ ID NO: 357728 - DNA, 15 bp, Homo sapiens
ttggaattgggtggg

SEQ ID NO: 357729 - DNA, 15 bp, Homo sapiens
tggaattgggtgggg

SEQ ID NO: 357730 - DNA, 15 bp, Homo sapiens
ggaattgggtggggc

SEQ ID NO: 357731 - DNA, 15 bp, Homo sapiens
gaattgggtggggcc

SEQ ID NO: 357732 - DNA, 15 bp, Homo sapiens
aattgggtggggccc

SEQ ID NO: 357733 - DNA, 15 bp, Homo sapiens
attgggtggggccca

SEQ ID NO: 357734 - DNA, 15 bp, Homo sapiens
ttgggtggggcccag

SEQ ID NO: 357735 - DNA, 15 bp, Homo sapiens
tgggtggggcccagg

SEQ ID NO: 357736 - DNA, 15 bp, Homo sapiens
gggtggggcccagga

SEQ ID NO: 357737 - DNA, 15 bp, Homo sapiens
ggtggggcccaggag

SEQ ID NO: 357738 - DNA, 15 bp, Homo sapiens
gtggggcccaggaga

SEQ ID NO: 357739 - DNA, 15 bp, Homo sapiens
tggggcccaggagat

SEQ ID NO: 357740 - DNA, 15 bp, Homo sapiens
ggggcccaggagatt

SEQ ID NO: 357741 - DNA, 15 bp, Homo sapiens
gggcccaggagattt

SEQ ID NO: 357742 - DNA, 15 bp, Homo sapiens
ggcccaggagatttc

SEQ ID NO: 357743 - DNA, 15 bp, Homo sapiens
gcccaggagatttca

SEQ ID NO: 357744 - DNA, 15 bp, Homo sapiens
cccaggagatttcaa

SEQ ID NO: 357745 - DNA, 15 bp, Homo sapiens
ccaggagatttcaat

SEQ ID NO: 357746 - DNA, 15 bp, Homo sapiens
caggagatttcaatt

SEQ ID NO: 357747 - DNA, 15 bp, Homo sapiens
aggagatttcaattt

SEQ ID NO: 357748 - DNA, 15 bp, Homo sapiens
ggagatttcaatttt

SEQ ID NO: 357749 - DNA, 15 bp, Homo sapiens
gagatttcaattttc

SEQ ID NO: 357750 - DNA, 15 bp, Homo sapiens
agatttcaattttct

SEQ ID NO: 357751 - DNA, 15 bp, Homo sapiens
gatttcaattttcta

SEQ ID NO: 357752 - DNA, 15 bp, Homo sapiens
atttcaattttctat

SEQ ID NO: 357753 - DNA, 15 bp, Homo sapiens
tttcaattttctatg

SEQ ID NO: 357754 - DNA, 15 bp, Homo sapiens
ttcaattttctatga

SEQ ID NO: 357755 - DNA, 15 bp, Homo sapiens
tcaattttctatgaa

SEQ ID NO: 357756 - DNA, 15 bp, Homo sapiens
caattttctatgaaa

SEQ ID NO: 357757 - DNA, 15 bp, Homo sapiens
aattttctatgaaat

SEQ ID NO: 357758 - DNA, 15 bp, Homo sapiens
attttctatgaaatt

SEQ ID NO: 357759 - DNA, 15 bp, Homo sapiens
ttttctatgaaatta

SEQ ID NO: 357760 - DNA, 15 bp, Homo sapiens
tttctatgaaattat

SEQ ID NO: 357761 - DNA, 15 bp, Homo sapiens
ttctatgaaattatt

SEQ ID NO: 357762 - DNA, 15 bp, Homo sapiens
tctatgaaattattt

SEQ ID NO: 357763 - DNA, 15 bp, Homo sapiens
ctatgaaattatttt

SEQ ID NO: 357764 - DNA, 15 bp, Homo sapiens
tatgaaattattttt

SEQ ID NO: 357765 - DNA, 15 bp, Homo sapiens
atgaaattatttttt

SEQ ID NO: 357766 - DNA, 15 bp, Homo sapiens
tgaaattatttttta

SEQ ID NO: 357767 - DNA, 15 bp, Homo sapiens
gaaattattttttaa

SEQ ID NO: 357768 - DNA, 15 bp, Homo sapiens
aaattattttttaaa

SEQ ID NO: 357769 - DNA, 15 bp, Homo sapiens
aattattttttaaaa

SEQ ID NO: 357770 - DNA, 15 bp, Homo sapiens
attattttttaaaaa

SEQ ID NO: 357771 - DNA, 15 bp, Homo sapiens
ttattttttaaaaat

SEQ ID NO: 357772 - DNA, 15 bp, Homo sapiens
tattttttaaaaatt

SEQ ID NO: 357773 - DNA, 15 bp, Homo sapiens
attttttaaaaattt

SEQ ID NO: 357774 - DNA, 15 bp, Homo sapiens
tttttaaaaatttac

SEQ ID NO: 357775 - DNA, 15 bp, Homo sapiens
ttttaaaaatttaca

SEQ ID NO: 357776 - DNA, 15 bp, Homo sapiens
tttaaaaatttacaa

SEQ ID NO: 357777 - DNA, 15 bp, Homo sapiens
ttaaaaatttacaat

SEQ ID NO: 357778 - DNA, 15 bp, Homo sapiens
taaaaatttacaatt

SEQ ID NO: 357779 - DNA, 15 bp, Homo sapiens
aaaaatttacaattg

SEQ ID NO: 357780 - DNA, 15 bp, Homo sapiens
aaaatttacaattgg

SEQ ID NO: 357781 - DNA, 15 bp, Homo sapiens
aaatttacaattggg

SEQ ID NO: 357782 - DNA, 15 bp, Homo sapiens
aatttacaattggga

SEQ ID NO: 357783 - DNA, 15 bp, Homo sapiens
atttacaattgggag

SEQ ID NO: 357784 - DNA, 15 bp, Homo sapiens
tttacaattgggagc

SEQ ID NO: 357785 - DNA, 15 bp, Homo sapiens
ttacaattgggagca

SEQ ID NO: 357786 - DNA, 15 bp, Homo sapiens
tacaattgggagcaa

SEQ ID NO: 357787 - DNA, 15 bp, Homo sapiens
acaattgggagcaat

SEQ ID NO: 357788 - DNA, 15 bp, Homo sapiens
caattgggagcaatt

SEQ ID NO: 357789 - DNA, 15 bp, Homo sapiens
aattgggagcaattt

SEQ ID NO: 357790 - DNA, 15 bp, Homo sapiens
attgggagcaatttt

SEQ ID NO: 357791 - DNA, 15 bp, Homo sapiens
ttgggagcaattttt

SEQ ID NO: 357792 - DNA, 15 bp, Homo sapiens
tgggagcaatttttt

SEQ ID NO: 357793 - DNA, 15 bp, Homo sapiens
gggagcaattttttc

SEQ ID NO: 357794 - DNA, 15 bp, Homo sapiens
ggagcaattttttca

SEQ ID NO: 357795 - DNA, 15 bp, Homo sapiens
gagcaattttttcat

SEQ ID NO: 357796 - DNA, 15 bp, Homo sapiens
agcaattttttcatt

SEQ ID NO: 357797 - DNA, 15 bp, Homo sapiens
gcaattttttcattt

SEQ ID NO: 357798 - DNA, 15 bp, Homo sapiens
caattttttcatttt

SEQ ID NO: 357799 - DNA, 15 bp, Homo sapiens
aattttttcattttg

SEQ ID NO: 357800 - DNA, 15 bp, Homo sapiens
attttttcattttgt

SEQ ID NO: 357801 - DNA, 15 bp, Homo sapiens
ttttttcattttgtt

SEQ ID NO: 357802 - DNA, 15 bp, Homo sapiens
tttttcattttgttc

SEQ ID NO: 357803 - DNA, 15 bp, Homo sapiens
ttttcattttgttca

SEQ ID NO: 357804 - DNA, 15 bp, Homo sapiens
tttcattttgttcaa

SEQ ID NO: 357805 - DNA, 15 bp, Homo sapiens
ttcattttgttcaaa

SEQ ID NO: 357806 - DNA, 15 bp, Homo sapiens
tcattttgttcaaaa

SEQ ID NO: 357807 - DNA, 15 bp, Homo sapiens
cattttgttcaaaaa

SEQ ID NO: 357808 - DNA, 15 bp, Homo sapiens
attttgttcaaaaac

SEQ ID NO: 357809 - DNA, 15 bp, Homo sapiens
ttttgttcaaaaacc

SEQ ID NO: 357810 - DNA, 15 bp, Homo sapiens
tttgttcaaaaacca

SEQ ID NO: 357811 - DNA, 15 bp, Homo sapiens
ttgttcaaaaaccaa

SEQ ID NO: 357812 - DNA, 15 bp, Homo sapiens
tgttcaaaaaccaaa

SEQ ID NO: 357813 - DNA, 15 bp, Homo sapiens
gttcaaaaaccaaac

SEQ ID NO: 357814 - DNA, 15 bp, Homo sapiens
ttcaaaaaccaaact

SEQ ID NO: 357815 - DNA, 15 bp, Homo sapiens
tcaaaaaccaaactt

SEQ ID NO: 357816 - DNA, 15 bp, Homo sapiens
caaaaaccaaacttt

SEQ ID NO: 357817 - DNA, 15 bp, Homo sapiens
aaaaaccaaactttt

SEQ ID NO: 357818 - DNA, 15 bp, Homo sapiens
aaaaccaaacttttt

SEQ ID NO: 357819 - DNA, 15 bp, Homo sapiens
aaaccaaactttttt

SEQ ID NO: 357820 - DNA, 15 bp, Homo sapiens
aaccaaacttttttt

SEQ ID NO: 357821 - DNA, 15 bp, Homo sapiens
accaaactttttttt

SEQ ID NO: 357822 - DNA, 15 bp, Homo sapiens
ccaaacttttttttt

SEQ ID NO: 357823 - DNA, 15 bp, Homo sapiens
caaactttttttttt

SEQ ID NO: 357824 - DNA, 15 bp, Homo sapiens
aaacttttttttttt

SEQ ID NO: 357825 - DNA, 15 bp, Homo sapiens
aactttttttttttt

SEQ ID NO: 357826 - DNA, 15 bp, Homo sapiens
gtttcactcttgtta

SEQ ID NO: 357827 - DNA, 15 bp, Homo sapiens
tttcactcttgttac

SEQ ID NO: 357828 - DNA, 15 bp, Homo sapiens
ttcactcttgttacc

SEQ ID NO: 357829 - DNA, 15 bp, Homo sapiens
tcactcttgttaccc

SEQ ID NO: 357830 - DNA, 15 bp, Homo sapiens
cactcttgttaccca

SEQ ID NO: 357831 - DNA, 15 bp, Homo sapiens
actcttgttacccag

SEQ ID NO: 357832 - DNA, 15 bp, Homo sapiens
ctcttgttacccagg

SEQ ID NO: 357833 - DNA, 15 bp, Homo sapiens
tcttgttacccaggc

SEQ ID NO: 357834 - DNA, 15 bp, Homo sapiens
cttgttacccaggct

SEQ ID NO: 357835 - DNA, 15 bp, Homo sapiens
ttgttacccaggctg

SEQ ID NO: 357836 - DNA, 15 bp, Homo sapiens
tacccaggctggagg

SEQ ID NO: 357837 - DNA, 15 bp, Homo sapiens
caggctggagggcag

SEQ ID NO: 357838 - DNA, 15 bp, Homo sapiens
aggctggagggcagt

SEQ ID NO: 357839 - DNA, 15 bp, Homo sapiens
ctggagggcagtggc

SEQ ID NO: 357840 - DNA, 15 bp, Homo sapiens
tggagggcagtggcg

SEQ ID NO: 357841 - DNA, 15 bp, Homo sapiens
ggagggcagtggcgt

SEQ ID NO: 357842 - DNA, 15 bp, Homo sapiens
gagggcagtggcgtg

SEQ ID NO: 357843 - DNA, 15 bp, Homo sapiens
agggcagtggcgtgg

SEQ ID NO: 357844 - DNA, 15 bp, Homo sapiens
gggcagtggcgtggc

SEQ ID NO: 357845 - DNA, 15 bp, Homo sapiens
ggcagtggcgtggcc

SEQ ID NO: 357846 - DNA, 15 bp, Homo sapiens
gcagtggcgtggcct

SEQ ID NO: 357847 - DNA, 15 bp, Homo sapiens
cagtggcgtggcctg

SEQ ID NO: 357848 - DNA, 15 bp, Homo sapiens
agtggcgtggcctgg

SEQ ID NO: 357849 - DNA, 15 bp, Homo sapiens
gtggcgtggcctggg

SEQ ID NO: 357850 - DNA, 15 bp, Homo sapiens
tggcgtggcctgggc

SEQ ID NO: 357851 - DNA, 15 bp, Homo sapiens
ggcgtggcctgggct

SEQ ID NO: 357852 - DNA, 15 bp, Homo sapiens
gcgtggcctgggctt

SEQ ID NO: 357853 - DNA, 15 bp, Homo sapiens
cgtggcctgggctta

SEQ ID NO: 357854 - DNA, 15 bp, Homo sapiens
gtggcctgggcttac

SEQ ID NO: 357855 - DNA, 15 bp, Homo sapiens
tggcctgggcttact

SEQ ID NO: 357856 - DNA, 15 bp, Homo sapiens
ggcctgggcttactg

SEQ ID NO: 357857 - DNA, 15 bp, Homo sapiens
gcctgggcttactgt

SEQ ID NO: 357858 - DNA, 15 bp, Homo sapiens
cctgggcttactgta

SEQ ID NO: 357859 - DNA, 15 bp, Homo sapiens
ctgggcttactgtaa

SEQ ID NO: 357860 - DNA, 15 bp, Homo sapiens
tgggcttactgtaac

SEQ ID NO: 357861 - DNA, 15 bp, Homo sapiens
gggcttactgtaacc

SEQ ID NO: 357862 - DNA, 15 bp, Homo sapiens
ggcttactgtaacct

SEQ ID NO: 357863 - DNA, 15 bp, Homo sapiens
gcttactgtaacctc

SEQ ID NO: 357864 - DNA, 15 bp, Homo sapiens
cttactgtaacctct

SEQ ID NO: 357865 - DNA, 15 bp, Homo sapiens
ttactgtaacctctg

SEQ ID NO: 357866 - DNA, 15 bp, Homo sapiens
tactgtaacctctgc

SEQ ID NO: 357867 - DNA, 15 bp, Homo sapiens
actgtaacctctgcc

SEQ ID NO: 357868 - DNA, 15 bp, Homo sapiens
ctgtaacctctgcct

SEQ ID NO: 357869 - DNA, 15 bp, Homo sapiens
tgtaacctctgcctc

SEQ ID NO: 357870 - DNA, 15 bp, Homo sapiens
gtaacctctgcctcc

SEQ ID NO: 357871 - DNA, 15 bp, Homo sapiens
taacctctgcctccc

SEQ ID NO: 357872 - DNA, 15 bp, Homo sapiens
cctgccaccatgccc

SEQ ID NO: 357873 - DNA, 15 bp, Homo sapiens
ctgccaccatgccca

SEQ ID NO: 357874 - DNA, 15 bp, Homo sapiens
ccaccatgcccagct

SEQ ID NO: 357875 - DNA, 15 bp, Homo sapiens
accatgcccagctag

SEQ ID NO: 357876 - DNA, 15 bp, Homo sapiens
ccatgcccagctagt

SEQ ID NO: 357877 - DNA, 15 bp, Homo sapiens
catgcccagctagtt

SEQ ID NO: 357878 - DNA, 15 bp, Homo sapiens
atgcccagctagttt

SEQ ID NO: 357879 - DNA, 15 bp, Homo sapiens
tgcccagctagtttt

SEQ ID NO: 357880 - DNA, 15 bp, Homo sapiens
gcccagctagttttt

SEQ ID NO: 357881 - DNA, 15 bp, Homo sapiens
cccagctagtttttg

SEQ ID NO: 357882 - DNA, 15 bp, Homo sapiens
ccagctagtttttgt

SEQ ID NO: 357883 - DNA, 15 bp, Homo sapiens
cagctagtttttgta

SEQ ID NO: 357884 - DNA, 15 bp, Homo sapiens
agctagtttttgtat

SEQ ID NO: 357885 - DNA, 15 bp, Homo sapiens
ctcctgacctcatgt

SEQ ID NO: 357886 - DNA, 15 bp, Homo sapiens
tcctgacctcatgtg

SEQ ID NO: 357887 - DNA, 15 bp, Homo sapiens
cctgacctcatgtga

SEQ ID NO: 357888 - DNA, 15 bp, Homo sapiens
ctgacctcatgtgat

SEQ ID NO: 357889 - DNA, 15 bp, Homo sapiens
tgacctcatgtgatc

SEQ ID NO: 357890 - DNA, 15 bp, Homo sapiens
gacctcatgtgatcc

SEQ ID NO: 357891 - DNA, 15 bp, Homo sapiens
acctcatgtgatcca

SEQ ID NO: 357892 - DNA, 15 bp, Homo sapiens
cctcatgtgatccac

SEQ ID NO: 357893 - DNA, 15 bp, Homo sapiens
ctcatgtgatccacc

SEQ ID NO: 357894 - DNA, 15 bp, Homo sapiens
tcatgtgatccacct

SEQ ID NO: 357895 - DNA, 15 bp, Homo sapiens
catgtgatccacctg

SEQ ID NO: 357896 - DNA, 15 bp, Homo sapiens
atgtgatccacctgc

SEQ ID NO: 357897 - DNA, 15 bp, Homo sapiens
tgtgatccacctgcc

SEQ ID NO: 357898 - DNA, 15 bp, Homo sapiens
ctcccaaaatgctga

SEQ ID NO: 357899 - DNA, 15 bp, Homo sapiens
tcccaaaatgctgag

SEQ ID NO: 357900 - DNA, 15 bp, Homo sapiens
cccaaaatgctgaga

SEQ ID NO: 357901 - DNA, 15 bp, Homo sapiens
ccaaaatgctgagat

SEQ ID NO: 357902 - DNA, 15 bp, Homo sapiens
caaaatgctgagatt

SEQ ID NO: 357903 - DNA, 15 bp, Homo sapiens
aaaatgctgagatta

SEQ ID NO: 357904 - DNA, 15 bp, Homo sapiens
aaatgctgagattac

SEQ ID NO: 357905 - DNA, 15 bp, Homo sapiens
aatgctgagattaca

SEQ ID NO: 357906 - DNA, 15 bp, Homo sapiens
atgctgagattacag

SEQ ID NO: 357907 - DNA, 15 bp, Homo sapiens
agattacaggtgtga

SEQ ID NO: 357908 - DNA, 15 bp, Homo sapiens
gattacaggtgtgaa

SEQ ID NO: 357909 - DNA, 15 bp, Homo sapiens
attacaggtgtgaac

SEQ ID NO: 357910 - DNA, 15 bp, Homo sapiens
ttacaggtgtgaacc

SEQ ID NO: 357911 - DNA, 15 bp, Homo sapiens
tacaggtgtgaacca

SEQ ID NO: 357912 - DNA, 15 bp, Homo sapiens
acaggtgtgaaccac

SEQ ID NO: 357913 - DNA, 15 bp, Homo sapiens
caggtgtgaaccacc

SEQ ID NO: 357914 - DNA, 15 bp, Homo sapiens
aggtgtgaaccaccg

SEQ ID NO: 357915 - DNA, 15 bp, Homo sapiens
ggtgtgaaccaccgc

SEQ ID NO: 357916 - DNA, 15 bp, Homo sapiens
gtgtgaaccaccgca

SEQ ID NO: 357917 - DNA, 15 bp, Homo sapiens
tgtgaaccaccgcac

SEQ ID NO: 357918 - DNA, 15 bp, Homo sapiens
gtgaaccaccgcact

SEQ ID NO: 357919 - DNA, 15 bp, Homo sapiens
tgaaccaccgcactt

SEQ ID NO: 357920 - DNA, 15 bp, Homo sapiens
gaaccaccgcacttg

SEQ ID NO: 357921 - DNA, 15 bp, Homo sapiens
aaccaccgcacttgg

SEQ ID NO: 357922 - DNA, 15 bp, Homo sapiens
accaccgcacttggt

SEQ ID NO: 357923 - DNA, 15 bp, Homo sapiens
ccaccgcacttggtc

SEQ ID NO: 357924 - DNA, 15 bp, Homo sapiens
caccgcacttggtct

SEQ ID NO: 357925 - DNA, 15 bp, Homo sapiens
accgcacttggtctt

SEQ ID NO: 357926 - DNA, 15 bp, Homo sapiens
ccgcacttggtcttt

SEQ ID NO: 357927 - DNA, 15 bp, Homo sapiens
cgcacttggtcttta

SEQ ID NO: 357928 - DNA, 15 bp, Homo sapiens
gcacttggtctttaa

SEQ ID NO: 357929 - DNA, 15 bp, Homo sapiens
cacttggtctttaaa

SEQ ID NO: 357930 - DNA, 15 bp, Homo sapiens
acttggtctttaaaa

SEQ ID NO: 357931 - DNA, 15 bp, Homo sapiens
cttggtctttaaaaa

SEQ ID NO: 357932 - DNA, 15 bp, Homo sapiens
ttggtctttaaaaaa

SEQ ID NO: 357933 - DNA, 15 bp, Homo sapiens
tggtctttaaaaaac

SEQ ID NO: 357934 - DNA, 15 bp, Homo sapiens
ggtctttaaaaaaca

SEQ ID NO: 357935 - DNA, 15 bp, Homo sapiens
gtctttaaaaaacaa

SEQ ID NO: 357936 - DNA, 15 bp, Homo sapiens
tctttaaaaaacaaa

SEQ ID NO: 357937 - DNA, 15 bp, Homo sapiens
ctttaaaaaacaaac

SEQ ID NO: 357938 - DNA, 15 bp, Homo sapiens
tttaaaaaacaaact

SEQ ID NO: 357939 - DNA, 15 bp, Homo sapiens
ttaaaaaacaaacta

SEQ ID NO: 357940 - DNA, 15 bp, Homo sapiens
taaaaaacaaactaa

SEQ ID NO: 357941 - DNA, 15 bp, Homo sapiens
aaaaaacaaactaaa

SEQ ID NO: 357942 - DNA, 15 bp, Homo sapiens
aaaaacaaactaaat

SEQ ID NO: 357943 - DNA, 15 bp, Homo sapiens
aaaacaaactaaata

SEQ ID NO: 357944 - DNA, 15 bp, Homo sapiens
aaacaaactaaataa

SEQ ID NO: 357945 - DNA, 15 bp, Homo sapiens
aacaaactaaataat

SEQ ID NO: 357946 - DNA, 15 bp, Homo sapiens
acaaactaaataatg

SEQ ID NO: 357947 - DNA, 15 bp, Homo sapiens
caaactaaataatgt

SEQ ID NO: 357948 - DNA, 15 bp, Homo sapiens
aaactaaataatgtt

SEQ ID NO: 357949 - DNA, 15 bp, Homo sapiens
aactaaataatgttt

SEQ ID NO: 357950 - DNA, 15 bp, Homo sapiens
actaaataatgtttc

SEQ ID NO: 357951 - DNA, 15 bp, Homo sapiens
ctaaataatgtttct

SEQ ID NO: 357952 - DNA, 15 bp, Homo sapiens
taaataatgtttctc

SEQ ID NO: 357953 - DNA, 15 bp, Homo sapiens
aaataatgtttctct

SEQ ID NO: 357954 - DNA, 15 bp, Homo sapiens
aataatgtttctctc

SEQ ID NO: 357955 - DNA, 15 bp, Homo sapiens
ataatgtttctctcc

SEQ ID NO: 357956 - DNA, 15 bp, Homo sapiens
taatgtttctctcct

SEQ ID NO: 357957 - DNA, 15 bp, Homo sapiens
aatgtttctctcctg

SEQ ID NO: 357958 - DNA, 15 bp, Homo sapiens
atgtttctctcctgt

SEQ ID NO: 357959 - DNA, 15 bp, Homo sapiens
tgtttctctcctgtt

SEQ ID NO: 357960 - DNA, 15 bp, Homo sapiens
gtttctctcctgttt

SEQ ID NO: 357961 - DNA, 15 bp, Homo sapiens
tttctctcctgtttt

SEQ ID NO: 357962 - DNA, 15 bp, Homo sapiens
ttctctcctgttttt

SEQ ID NO: 357963 - DNA, 15 bp, Homo sapiens
tctctcctgtttttc

SEQ ID NO: 357964 - DNA, 15 bp, Homo sapiens
ctctcctgtttttct

SEQ ID NO: 357965 - DNA, 15 bp, Homo sapiens
tctcctgtttttctt

SEQ ID NO: 357966 - DNA, 15 bp, Homo sapiens
ctcctgtttttctta

SEQ ID NO: 357967 - DNA, 15 bp, Homo sapiens
tcctgtttttcttac

SEQ ID NO: 357968 - DNA, 15 bp, Homo sapiens
cctgtttttcttact

SEQ ID NO: 357969 - DNA, 15 bp, Homo sapiens
ctgtttttcttacta

SEQ ID NO: 357970 - DNA, 15 bp, Homo sapiens
tgtttttcttactaa

SEQ ID NO: 357971 - DNA, 15 bp, Homo sapiens
gtttttcttactaat

SEQ ID NO: 357972 - DNA, 15 bp, Homo sapiens
tttttcttactaatt

SEQ ID NO: 357973 - DNA, 15 bp, Homo sapiens
ttttcttactaatta

SEQ ID NO: 357974 - DNA, 15 bp, Homo sapiens
tttcttactaattat

SEQ ID NO: 357975 - DNA, 15 bp, Homo sapiens
ttcttactaattata

SEQ ID NO: 357976 - DNA, 15 bp, Homo sapiens
tcttactaattatat

SEQ ID NO: 357977 - DNA, 15 bp, Homo sapiens
cttactaattatata

SEQ ID NO: 357978 - DNA, 15 bp, Homo sapiens
ttactaattatatag

SEQ ID NO: 357979 - DNA, 15 bp, Homo sapiens
tactaattatatagt

SEQ ID NO: 357980 - DNA, 15 bp, Homo sapiens
actaattatatagtt

SEQ ID NO: 357981 - DNA, 15 bp, Homo sapiens
ctaattatatagttc

SEQ ID NO: 357982 - DNA, 15 bp, Homo sapiens
taattatatagttct

SEQ ID NO: 357983 - DNA, 15 bp, Homo sapiens
aattatatagttcta

SEQ ID NO: 357984 - DNA, 15 bp, Homo sapiens
attatatagttctat

SEQ ID NO: 357985 - DNA, 15 bp, Homo sapiens
ttatatagttctatt

SEQ ID NO: 357986 - DNA, 15 bp, Homo sapiens
tatatagttctattt

SEQ ID NO: 357987 - DNA, 15 bp, Homo sapiens
atatagttctatttt

SEQ ID NO: 357988 - DNA, 15 bp, Homo sapiens
tatagttctattttt

SEQ ID NO: 357989 - DNA, 15 bp, Homo sapiens
atagttctatttttg

SEQ ID NO: 357990 - DNA, 15 bp, Homo sapiens
tagttctatttttga

SEQ ID NO: 357991 - DNA, 15 bp, Homo sapiens
agttctatttttgac

SEQ ID NO: 357992 - DNA, 15 bp, Homo sapiens
gttctatttttgaca

SEQ ID NO: 357993 - DNA, 15 bp, Homo sapiens
ttctatttttgacat

SEQ ID NO: 357994 - DNA, 15 bp, Homo sapiens
tctatttttgacatt

SEQ ID NO: 357995 - DNA, 15 bp, Homo sapiens
ctatttttgacattt

SEQ ID NO: 357996 - DNA, 15 bp, Homo sapiens
tatttttgacattta

SEQ ID NO: 357997 - DNA, 15 bp, Homo sapiens
atttttgacatttaa

SEQ ID NO: 357998 - DNA, 15 bp, Homo sapiens
tttttgacatttaaa

SEQ ID NO: 357999 - DNA, 15 bp, Homo sapiens
ttttgacatttaaat

SEQ ID NO: 358000 - DNA, 15 bp, Homo sapiens
tttgacatttaaatc

SEQ ID NO: 358001 - DNA, 15 bp, Homo sapiens
ttgacatttaaatca

SEQ ID NO: 358002 - DNA, 15 bp, Homo sapiens
tgacatttaaatcag

SEQ ID NO: 358003 - DNA, 15 bp, Homo sapiens
gacatttaaatcaga

SEQ ID NO: 358004 - DNA, 15 bp, Homo sapiens
acatttaaatcagat

SEQ ID NO: 358005 - DNA, 15 bp, Homo sapiens
catttaaatcagatc

SEQ ID NO: 358006 - DNA, 15 bp, Homo sapiens
atttaaatcagatca

SEQ ID NO: 358007 - DNA, 15 bp, Homo sapiens
tttaaatcagatcat

SEQ ID NO: 358008 - DNA, 15 bp, Homo sapiens
ttaaatcagatcatg

SEQ ID NO: 358009 - DNA, 15 bp, Homo sapiens
taaatcagatcatgg

SEQ ID NO: 358010 - DNA, 15 bp, Homo sapiens
aaatcagatcatgga

SEQ ID NO: 358011 - DNA, 15 bp, Homo sapiens
aatcagatcatggaa

SEQ ID NO: 358012 - DNA, 15 bp, Homo sapiens
atcagatcatggaat

SEQ ID NO: 358013 - DNA, 15 bp, Homo sapiens
tcagatcatggaatt

SEQ ID NO: 358014 - DNA, 15 bp, Homo sapiens
cagatcatggaattt

SEQ ID NO: 358015 - DNA, 15 bp, Homo sapiens
agatcatggaattta

SEQ ID NO: 358016 - DNA, 15 bp, Homo sapiens
gatcatggaatttat

SEQ ID NO: 358017 - DNA, 15 bp, Homo sapiens
atcatggaatttatt

SEQ ID NO: 358018 - DNA, 15 bp, Homo sapiens
tcatggaatttattt

SEQ ID NO: 358019 - DNA, 15 bp, Homo sapiens
catggaatttatttt

SEQ ID NO: 358020 - DNA, 15 bp, Homo sapiens
atggaatttatttta

SEQ ID NO: 358021 - DNA, 15 bp, Homo sapiens
tggaatttattttaa

SEQ ID NO: 358022 - DNA, 15 bp, Homo sapiens
ggaatttattttaaa

SEQ ID NO: 358023 - DNA, 15 bp, Homo sapiens
gaatttattttaaag

SEQ ID NO: 358024 - DNA, 15 bp, Homo sapiens
aatttattttaaaga

SEQ ID NO: 358025 - DNA, 15 bp, Homo sapiens
atttattttaaagag

SEQ ID NO: 358026 - DNA, 15 bp, Homo sapiens
tttattttaaagagt

SEQ ID NO: 358027 - DNA, 15 bp, Homo sapiens
ttattttaaagagtg

SEQ ID NO: 358028 - DNA, 15 bp, Homo sapiens
tattttaaagagtga

SEQ ID NO: 358029 - DNA, 15 bp, Homo sapiens
attttaaagagtgag

SEQ ID NO: 358030 - DNA, 15 bp, Homo sapiens
ttttaaagagtgagg

SEQ ID NO: 358031 - DNA, 15 bp, Homo sapiens
tttaaagagtgaggc

SEQ ID NO: 358032 - DNA, 15 bp, Homo sapiens
ttaaagagtgaggca

SEQ ID NO: 358033 - DNA, 15 bp, Homo sapiens
taaagagtgaggcag

SEQ ID NO: 358034 - DNA, 15 bp, Homo sapiens
aaagagtgaggcagc

SEQ ID NO: 358035 - DNA, 15 bp, Homo sapiens
aagagtgaggcagcc

SEQ ID NO: 358036 - DNA, 15 bp, Homo sapiens
agagtgaggcagcct

SEQ ID NO: 358037 - DNA, 15 bp, Homo sapiens
gagtgaggcagcctc

SEQ ID NO: 358038 - DNA, 15 bp, Homo sapiens
agtgaggcagcctct

SEQ ID NO: 358039 - DNA, 15 bp, Homo sapiens
gtgaggcagcctctt

SEQ ID NO: 358040 - DNA, 15 bp, Homo sapiens
tgaggcagcctcttg

SEQ ID NO: 358041 - DNA, 15 bp, Homo sapiens
gaggcagcctcttgc

SEQ ID NO: 358042 - DNA, 15 bp, Homo sapiens
aggcagcctcttgcc

SEQ ID NO: 358043 - DNA, 15 bp, Homo sapiens
ggcagcctcttgccc

SEQ ID NO: 358044 - DNA, 15 bp, Homo sapiens
gcagcctcttgccca

SEQ ID NO: 358045 - DNA, 15 bp, Homo sapiens
cagcctcttgcccac

SEQ ID NO: 358046 - DNA, 15 bp, Homo sapiens
agcctcttgcccact

SEQ ID NO: 358047 - DNA, 15 bp, Homo sapiens
gcctcttgcccactc

SEQ ID NO: 358048 - DNA, 15 bp, Homo sapiens
cctcttgcccactct

SEQ ID NO: 358049 - DNA, 15 bp, Homo sapiens
ctcttgcccactctt

SEQ ID NO: 358050 - DNA, 15 bp, Homo sapiens
tcttgcccactcttt

SEQ ID NO: 358051 - DNA, 15 bp, Homo sapiens
cttgcccactctttg

SEQ ID NO: 358052 - DNA, 15 bp, Homo sapiens
ttgcccactctttgc

SEQ ID NO: 358053 - DNA, 15 bp, Homo sapiens
tgcccactctttgct

SEQ ID NO: 358054 - DNA, 15 bp, Homo sapiens
gcccactctttgctc

SEQ ID NO: 358055 - DNA, 15 bp, Homo sapiens
cccactctttgctcc

SEQ ID NO: 358056 - DNA, 15 bp, Homo sapiens
ccactctttgctccc

SEQ ID NO: 358057 - DNA, 15 bp, Homo sapiens
cactctttgctcccc

SEQ ID NO: 358058 - DNA, 15 bp, Homo sapiens
actctttgctcccca

SEQ ID NO: 358059 - DNA, 15 bp, Homo sapiens
ctctttgctccccac

SEQ ID NO: 358060 - DNA, 15 bp, Homo sapiens
tctttgctccccacc

SEQ ID NO: 358061 - DNA, 15 bp, Homo sapiens
ctttgctccccaccc

SEQ ID NO: 358062 - DNA, 15 bp, Homo sapiens
tttgctccccaccct

SEQ ID NO: 358063 - DNA, 15 bp, Homo sapiens
ttgctccccaccctt

SEQ ID NO: 358064 - DNA, 15 bp, Homo sapiens
tgctccccacccttc

SEQ ID NO: 358065 - DNA, 15 bp, Homo sapiens
gctccccacccttca

SEQ ID NO: 358066 - DNA, 15 bp, Homo sapiens
ctccccacccttcac

SEQ ID NO: 358067 - DNA, 15 bp, Homo sapiens
tccccacccttcacc

SEQ ID NO: 358068 - DNA, 15 bp, Homo sapiens
ccccacccttcacca

SEQ ID NO: 358069 - DNA, 15 bp, Homo sapiens
cccacccttcaccaa

SEQ ID NO: 358070 - DNA, 15 bp, Homo sapiens
ccacccttcaccaac

SEQ ID NO: 358071 - DNA, 15 bp, Homo sapiens
cacccttcaccaact

SEQ ID NO: 358072 - DNA, 15 bp, Homo sapiens
acccttcaccaactg

SEQ ID NO: 358073 - DNA, 15 bp, Homo sapiens
cccttcaccaactgg

SEQ ID NO: 358074 - DNA, 15 bp, Homo sapiens
ccttcaccaactggt

SEQ ID NO: 358075 - DNA, 15 bp, Homo sapiens
cttcaccaactggtc

SEQ ID NO: 358076 - DNA, 15 bp, Homo sapiens
ttcaccaactggtct

SEQ ID NO: 358077 - DNA, 15 bp, Homo sapiens
tcaccaactggtctc

SEQ ID NO: 358078 - DNA, 15 bp, Homo sapiens
caccaactggtctca

SEQ ID NO: 358079 - DNA, 15 bp, Homo sapiens
accaactggtctcat

SEQ ID NO: 358080 - DNA, 15 bp, Homo sapiens
ccaactggtctcata

SEQ ID NO: 358081 - DNA, 15 bp, Homo sapiens
caactggtctcatat

SEQ ID NO: 358082 - DNA, 15 bp, Homo sapiens
aactggtctcatatg

SEQ ID NO: 358083 - DNA, 15 bp, Homo sapiens
actggtctcatatga

SEQ ID NO: 358084 - DNA, 15 bp, Homo sapiens
ctggtctcatatgat

SEQ ID NO: 358085 - DNA, 15 bp, Homo sapiens
tggtctcatatgatt

SEQ ID NO: 358086 - DNA, 15 bp, Homo sapiens
ggtctcatatgattt

SEQ ID NO: 358087 - DNA, 15 bp, Homo sapiens
gtctcatatgatttt

SEQ ID NO: 358088 - DNA, 15 bp, Homo sapiens
tctcatatgattttg

SEQ ID NO: 358089 - DNA, 15 bp, Homo sapiens
ctcatatgattttgt

SEQ ID NO: 358090 - DNA, 15 bp, Homo sapiens
tcatatgattttgtt

SEQ ID NO: 358091 - DNA, 15 bp, Homo sapiens
catatgattttgttg

SEQ ID NO: 358092 - DNA, 15 bp, Homo sapiens
atatgattttgttga

SEQ ID NO: 358093 - DNA, 15 bp, Homo sapiens
tatgattttgttgat

SEQ ID NO: 358094 - DNA, 15 bp, Homo sapiens
atgattttgttgatt

SEQ ID NO: 358095 - DNA, 15 bp, Homo sapiens
tgattttgttgatta

SEQ ID NO: 358096 - DNA, 15 bp, Homo sapiens
gattttgttgattat

SEQ ID NO: 358097 - DNA, 15 bp, Homo sapiens
attttgttgattatt

SEQ ID NO: 358098 - DNA, 15 bp, Homo sapiens
ttttgttgattattt

SEQ ID NO: 358099 - DNA, 15 bp, Homo sapiens
tttgttgattatttt

SEQ ID NO: 358100 - DNA, 15 bp, Homo sapiens
ttgttgattatttta

SEQ ID NO: 358101 - DNA, 15 bp, Homo sapiens
tgttgattattttat

SEQ ID NO: 358102 - DNA, 15 bp, Homo sapiens
gttgattattttatt

SEQ ID NO: 358103 - DNA, 15 bp, Homo sapiens
ttgattattttattt

SEQ ID NO: 358104 - DNA, 15 bp, Homo sapiens
tgattattttatttt

SEQ ID NO: 358105 - DNA, 15 bp, Homo sapiens
gattattttatttta

SEQ ID NO: 358106 - DNA, 15 bp, Homo sapiens
attttattttatttg

SEQ ID NO: 358107 - DNA, 15 bp, Homo sapiens
ttttattttatttga

SEQ ID NO: 358108 - DNA, 15 bp, Homo sapiens
tttattttatttgag

SEQ ID NO: 358109 - DNA, 15 bp, Homo sapiens
ttattttatttgaga

SEQ ID NO: 358110 - DNA, 15 bp, Homo sapiens
tattttatttgagat

SEQ ID NO: 358111 - DNA, 15 bp, Homo sapiens
attttatttgagatg

SEQ ID NO: 358112 - DNA, 15 bp, Homo sapiens
ttttatttgagatgg

SEQ ID NO: 358113 - DNA, 15 bp, Homo sapiens
aatgcagtggtgcaa

SEQ ID NO: 358114 - DNA, 15 bp, Homo sapiens
atgcagtggtgcaat

SEQ ID NO: 358115 - DNA, 15 bp, Homo sapiens
agtggtgcaatctca

SEQ ID NO: 358116 - DNA, 15 bp, Homo sapiens
gtggtgcaatctcag

SEQ ID NO: 358117 - DNA, 15 bp, Homo sapiens
tggtgcaatctcagc

SEQ ID NO: 358118 - DNA, 15 bp, Homo sapiens
ggtgcaatctcagct

SEQ ID NO: 358119 - DNA, 15 bp, Homo sapiens
gtgcaatctcagctc

SEQ ID NO: 358120 - DNA, 15 bp, Homo sapiens
tgcaatctcagctca

SEQ ID NO: 358121 - DNA, 15 bp, Homo sapiens
gcaatctcagctcac

SEQ ID NO: 358122 - DNA, 15 bp, Homo sapiens
caatctcagctcacc

SEQ ID NO: 358123 - DNA, 15 bp, Homo sapiens
aatctcagctcaccg

SEQ ID NO: 358124 - DNA, 15 bp, Homo sapiens
atctcagctcaccgc

SEQ ID NO: 358125 - DNA, 15 bp, Homo sapiens
tctcagctcaccgca

SEQ ID NO: 358126 - DNA, 15 bp, Homo sapiens
ctcagctcaccgcaa

SEQ ID NO: 358127 - DNA, 15 bp, Homo sapiens
tcagctcaccgcaac

SEQ ID NO: 358128 - DNA, 15 bp, Homo sapiens
cagctcaccgcaacc

SEQ ID NO: 358129 - DNA, 15 bp, Homo sapiens
agctcaccgcaacct

SEQ ID NO: 358130 - DNA, 15 bp, Homo sapiens
ctccgcctcccgggt

SEQ ID NO: 358131 - DNA, 15 bp, Homo sapiens
tccgcctcccgggtt

SEQ ID NO: 358132 - DNA, 15 bp, Homo sapiens
ccgcctcccgggttc

SEQ ID NO: 358133 - DNA, 15 bp, Homo sapiens
cgcctcccgggttca

SEQ ID NO: 358134 - DNA, 15 bp, Homo sapiens
gcctcccgggttcac

SEQ ID NO: 358135 - DNA, 15 bp, Homo sapiens
cattctcctgcctcc

SEQ ID NO: 358136 - DNA, 15 bp, Homo sapiens
attctcctgcctcct

SEQ ID NO: 358137 - DNA, 15 bp, Homo sapiens
ttctcctgcctcctc

SEQ ID NO: 358138 - DNA, 15 bp, Homo sapiens
tctcctgcctcctcc

SEQ ID NO: 358139 - DNA, 15 bp, Homo sapiens
ctcctgcctcctcca

SEQ ID NO: 358140 - DNA, 15 bp, Homo sapiens
tcctgcctcctccag

SEQ ID NO: 358141 - DNA, 15 bp, Homo sapiens
cctgcctcctccaga

SEQ ID NO: 358142 - DNA, 15 bp, Homo sapiens
ctgcctcctccagag

SEQ ID NO: 358143 - DNA, 15 bp, Homo sapiens
tgcctcctccagagt

SEQ ID NO: 358144 - DNA, 15 bp, Homo sapiens
gcctcctccagagta

SEQ ID NO: 358145 - DNA, 15 bp, Homo sapiens
cctcctccagagtag

SEQ ID NO: 358146 - DNA, 15 bp, Homo sapiens
ctcctccagagtagc

SEQ ID NO: 358147 - DNA, 15 bp, Homo sapiens
tcctccagagtagct

SEQ ID NO: 358148 - DNA, 15 bp, Homo sapiens
gggactacaggcatc

SEQ ID NO: 358149 - DNA, 15 bp, Homo sapiens
ggactacaggcatcc

SEQ ID NO: 358150 - DNA, 15 bp, Homo sapiens
gactacaggcatccg

SEQ ID NO: 358151 - DNA, 15 bp, Homo sapiens
actacaggcatccgc

SEQ ID NO: 358152 - DNA, 15 bp, Homo sapiens
ctacaggcatccgcc

SEQ ID NO: 358153 - DNA, 15 bp, Homo sapiens
tacaggcatccgcca

SEQ ID NO: 358154 - DNA, 15 bp, Homo sapiens
acaggcatccgccac

SEQ ID NO: 358155 - DNA, 15 bp, Homo sapiens
caggcatccgccacc

SEQ ID NO: 358156 - DNA, 15 bp, Homo sapiens
aggcatccgccacca

SEQ ID NO: 358157 - DNA, 15 bp, Homo sapiens
ggcatccgccaccac

SEQ ID NO: 358158 - DNA, 15 bp, Homo sapiens
gcatccgccaccaca

SEQ ID NO: 358159 - DNA, 15 bp, Homo sapiens
catccgccaccacac

SEQ ID NO: 358160 - DNA, 15 bp, Homo sapiens
atccgccaccacacc

SEQ ID NO: 358161 - DNA, 15 bp, Homo sapiens
tccgccaccacaccc

SEQ ID NO: 358162 - DNA, 15 bp, Homo sapiens
ccgccaccacacccg

SEQ ID NO: 358163 - DNA, 15 bp, Homo sapiens
cgccaccacacccgg

SEQ ID NO: 358164 - DNA, 15 bp, Homo sapiens
accacacccggctaa

SEQ ID NO: 358165 - DNA, 15 bp, Homo sapiens
ccacacccggctaat

SEQ ID NO: 358166 - DNA, 15 bp, Homo sapiens
cacacccggctaata

SEQ ID NO: 358167 - DNA, 15 bp, Homo sapiens
acacccggctaatat

SEQ ID NO: 358168 - DNA, 15 bp, Homo sapiens
cacccggctaatatt

SEQ ID NO: 358169 - DNA, 15 bp, Homo sapiens
acccggctaatattt

SEQ ID NO: 358170 - DNA, 15 bp, Homo sapiens
cccggctaatatttt

SEQ ID NO: 358171 - DNA, 15 bp, Homo sapiens
ccggctaatattttt

SEQ ID NO: 358172 - DNA, 15 bp, Homo sapiens
cggctaatattttta

SEQ ID NO: 358173 - DNA, 15 bp, Homo sapiens
ggctaatatttttat

SEQ ID NO: 358174 - DNA, 15 bp, Homo sapiens
gctaatatttttata

SEQ ID NO: 358175 - DNA, 15 bp, Homo sapiens
ctaatatttttatat

SEQ ID NO: 358176 - DNA, 15 bp, Homo sapiens
taatatttttatata

SEQ ID NO: 358177 - DNA, 15 bp, Homo sapiens
tatttttatatatat

SEQ ID NO: 358178 - DNA, 15 bp, Homo sapiens
atttttatatatata

SEQ ID NO: 358179 - DNA, 15 bp, Homo sapiens
ttatatatatatata

SEQ ID NO: 358180 - DNA, 15 bp, Homo sapiens
tatatatatattttt

SEQ ID NO: 358181 - DNA, 15 bp, Homo sapiens
atatatatattttta

SEQ ID NO: 358182 - DNA, 15 bp, Homo sapiens
tatatatatttttag

SEQ ID NO: 358183 - DNA, 15 bp, Homo sapiens
atatatatttttagt

SEQ ID NO: 358184 - DNA, 15 bp, Homo sapiens
tatatatttttagta

SEQ ID NO: 358185 - DNA, 15 bp, Homo sapiens
atatatttttagtag

SEQ ID NO: 358186 - DNA, 15 bp, Homo sapiens
agacagggtttcacc

SEQ ID NO: 358187 - DNA, 15 bp, Homo sapiens
gacagggtttcaccg

SEQ ID NO: 358188 - DNA, 15 bp, Homo sapiens
acagggtttcaccgt

SEQ ID NO: 358189 - DNA, 15 bp, Homo sapiens
cagggtttcaccgtg

SEQ ID NO: 358190 - DNA, 15 bp, Homo sapiens
agggtttcaccgtgt

SEQ ID NO: 358191 - DNA, 15 bp, Homo sapiens
agccaggatggtctt

SEQ ID NO: 358192 - DNA, 15 bp, Homo sapiens
gccaggatggtctta

SEQ ID NO: 358193 - DNA, 15 bp, Homo sapiens
ccaggatggtcttaa

SEQ ID NO: 358194 - DNA, 15 bp, Homo sapiens
caggatggtcttaat

SEQ ID NO: 358195 - DNA, 15 bp, Homo sapiens
aggatggtcttaatc

SEQ ID NO: 358196 - DNA, 15 bp, Homo sapiens
ggatggtcttaatct

SEQ ID NO: 358197 - DNA, 15 bp, Homo sapiens
gatggtcttaatctc

SEQ ID NO: 358198 - DNA, 15 bp, Homo sapiens
atggtcttaatctcc

SEQ ID NO: 358199 - DNA, 15 bp, Homo sapiens
atctcctgacctcat

SEQ ID NO: 358200 - DNA, 15 bp, Homo sapiens
tctcctgacctcatg

SEQ ID NO: 358201 - DNA, 15 bp, Homo sapiens
catgatctgcctgct

SEQ ID NO: 358202 - DNA, 15 bp, Homo sapiens
atgatctgcctgctt

SEQ ID NO: 358203 - DNA, 15 bp, Homo sapiens
tgatctgcctgcttc

SEQ ID NO: 358204 - DNA, 15 bp, Homo sapiens
gatctgcctgcttca

SEQ ID NO: 358205 - DNA, 15 bp, Homo sapiens
atctgcctgcttcag

SEQ ID NO: 358206 - DNA, 15 bp, Homo sapiens
tctgcctgcttcagc

SEQ ID NO: 358207 - DNA, 15 bp, Homo sapiens
ctgcctgcttcagcc

SEQ ID NO: 358208 - DNA, 15 bp, Homo sapiens
tgcctgcttcagcct

SEQ ID NO: 358209 - DNA, 15 bp, Homo sapiens
tgcttcagcctccca

SEQ ID NO: 358210 - DNA, 15 bp, Homo sapiens
gcttcagcctcccaa

SEQ ID NO: 358211 - DNA, 15 bp, Homo sapiens
cttcagcctcccaaa

SEQ ID NO: 358212 - DNA, 15 bp, Homo sapiens
ttcagcctcccaaag

SEQ ID NO: 358213 - DNA, 15 bp, Homo sapiens
tgagccaccacgcct

SEQ ID NO: 358214 - DNA, 15 bp, Homo sapiens
gagccaccacgcctg

SEQ ID NO: 358215 - DNA, 15 bp, Homo sapiens
agccaccacgcctgg

SEQ ID NO: 358216 - DNA, 15 bp, Homo sapiens
ccaccacgcctggcc

SEQ ID NO: 358217 - DNA, 15 bp, Homo sapiens
caccacgcctggccg

SEQ ID NO: 358218 - DNA, 15 bp, Homo sapiens
accacgcctggccga

SEQ ID NO: 358219 - DNA, 15 bp, Homo sapiens
ccacgcctggccgat

SEQ ID NO: 358220 - DNA, 15 bp, Homo sapiens
cacgcctggccgatt

SEQ ID NO: 358221 - DNA, 15 bp, Homo sapiens
acgcctggccgattt

SEQ ID NO: 358222 - DNA, 15 bp, Homo sapiens
cgcctggccgatttt

SEQ ID NO: 358223 - DNA, 15 bp, Homo sapiens
gcctggccgatttta

SEQ ID NO: 358224 - DNA, 15 bp, Homo sapiens
cctggccgattttat

SEQ ID NO: 358225 - DNA, 15 bp, Homo sapiens
ctggccgattttatt

SEQ ID NO: 358226 - DNA, 15 bp, Homo sapiens
tggccgattttattt

SEQ ID NO: 358227 - DNA, 15 bp, Homo sapiens
ggccgattttatttt

SEQ ID NO: 358228 - DNA, 15 bp, Homo sapiens
gccgattttatttta

SEQ ID NO: 358229 - DNA, 15 bp, Homo sapiens
ccgattttattttat

SEQ ID NO: 358230 - DNA, 15 bp, Homo sapiens
cgattttattttatt

SEQ ID NO: 358231 - DNA, 15 bp, Homo sapiens
gattttattttattt

SEQ ID NO: 358232 - DNA, 15 bp, Homo sapiens
tattttatttttttg

SEQ ID NO: 358233 - DNA, 15 bp, Homo sapiens
attttatttttttga

SEQ ID NO: 358234 - DNA, 15 bp, Homo sapiens
ttttatttttttgaa

SEQ ID NO: 358235 - DNA, 15 bp, Homo sapiens
tttatttttttgaag

SEQ ID NO: 358236 - DNA, 15 bp, Homo sapiens
ttatttttttgaagt

SEQ ID NO: 358237 - DNA, 15 bp, Homo sapiens
tatttttttgaagtt

SEQ ID NO: 358238 - DNA, 15 bp, Homo sapiens
atttttttgaagttt

SEQ ID NO: 358239 - DNA, 15 bp, Homo sapiens
tttttttgaagtttc

SEQ ID NO: 358240 - DNA, 15 bp, Homo sapiens
ttttttgaagtttca

SEQ ID NO: 358241 - DNA, 15 bp, Homo sapiens
tttttgaagtttcaa

SEQ ID NO: 358242 - DNA, 15 bp, Homo sapiens
ttttgaagtttcaac

SEQ ID NO: 358243 - DNA, 15 bp, Homo sapiens
tttgaagtttcaact

SEQ ID NO: 358244 - DNA, 15 bp, Homo sapiens
ttgaagtttcaactc

SEQ ID NO: 358245 - DNA, 15 bp, Homo sapiens
tgaagtttcaactcc

SEQ ID NO: 358246 - DNA, 15 bp, Homo sapiens
gaagtttcaactcca

SEQ ID NO: 358247 - DNA, 15 bp, Homo sapiens
aagtttcaactccat

SEQ ID NO: 358248 - DNA, 15 bp, Homo sapiens
agtttcaactccatc

SEQ ID NO: 358249 - DNA, 15 bp, Homo sapiens
gtttcaactccatca

SEQ ID NO: 358250 - DNA, 15 bp, Homo sapiens
tttcaactccatcag

SEQ ID NO: 358251 - DNA, 15 bp, Homo sapiens
ttcaactccatcagt

SEQ ID NO: 358252 - DNA, 15 bp, Homo sapiens
tcaactccatcagtt

SEQ ID NO: 358253 - DNA, 15 bp, Homo sapiens
caactccatcagttc

SEQ ID NO: 358254 - DNA, 15 bp, Homo sapiens
aactccatcagttct

SEQ ID NO: 358255 - DNA, 15 bp, Homo sapiens
actccatcagttctg

SEQ ID NO: 358256 - DNA, 15 bp, Homo sapiens
ctccatcagttctga

SEQ ID NO: 358257 - DNA, 15 bp, Homo sapiens
tccatcagttctgaa

SEQ ID NO: 358258 - DNA, 15 bp, Homo sapiens
ccatcagttctgaat

SEQ ID NO: 358259 - DNA, 15 bp, Homo sapiens
catcagttctgaatt

SEQ ID NO: 358260 - DNA, 15 bp, Homo sapiens
atcagttctgaattc

SEQ ID NO: 358261 - DNA, 15 bp, Homo sapiens
tcagttctgaattcc

SEQ ID NO: 358262 - DNA, 15 bp, Homo sapiens
cagttctgaattcct

SEQ ID NO: 358263 - DNA, 15 bp, Homo sapiens
agttctgaattccta

SEQ ID NO: 358264 - DNA, 15 bp, Homo sapiens
gttctgaattcctag

SEQ ID NO: 358265 - DNA, 15 bp, Homo sapiens
ttctgaattcctagg

SEQ ID NO: 358266 - DNA, 15 bp, Homo sapiens
tctgaattcctaggt

SEQ ID NO: 358267 - DNA, 15 bp, Homo sapiens
ctgaattcctaggta

SEQ ID NO: 358268 - DNA, 15 bp, Homo sapiens
tgaattcctaggtat

SEQ ID NO: 358269 - DNA, 15 bp, Homo sapiens
gaattcctaggtata

SEQ ID NO: 358270 - DNA, 15 bp, Homo sapiens
aattcctaggtatac

SEQ ID NO: 358271 - DNA, 15 bp, Homo sapiens
attcctaggtatact

SEQ ID NO: 358272 - DNA, 15 bp, Homo sapiens
ttcctaggtatactc

SEQ ID NO: 358273 - DNA, 15 bp, Homo sapiens
tcctaggtatactca

SEQ ID NO: 358274 - DNA, 15 bp, Homo sapiens
cctaggtatactcac

SEQ ID NO: 358275 - DNA, 15 bp, Homo sapiens
ctaggtatactcaca

SEQ ID NO: 358276 - DNA, 15 bp, Homo sapiens
taggtatactcacat

SEQ ID NO: 358277 - DNA, 15 bp, Homo sapiens
aggtatactcacatc

SEQ ID NO: 358278 - DNA, 15 bp, Homo sapiens
ggtatactcacatcc

SEQ ID NO: 358279 - DNA, 15 bp, Homo sapiens
gtatactcacatcca

SEQ ID NO: 358280 - DNA, 15 bp, Homo sapiens
tatactcacatccaa

SEQ ID NO: 358281 - DNA, 15 bp, Homo sapiens
atactcacatccaaa

SEQ ID NO: 358282 - DNA, 15 bp, Homo sapiens
tactcacatccaaat

SEQ ID NO: 358283 - DNA, 15 bp, Homo sapiens
actcacatccaaatg

SEQ ID NO: 358284 - DNA, 15 bp, Homo sapiens
ctcacatccaaatga

SEQ ID NO: 358285 - DNA, 15 bp, Homo sapiens
tcacatccaaatgaa

SEQ ID NO: 358286 - DNA, 15 bp, Homo sapiens
cacatccaaatgaaa

SEQ ID NO: 358287 - DNA, 15 bp, Homo sapiens
acatccaaatgaaat

SEQ ID NO: 358288 - DNA, 15 bp, Homo sapiens
catccaaatgaaatt

SEQ ID NO: 358289 - DNA, 15 bp, Homo sapiens
atccaaatgaaatta

SEQ ID NO: 358290 - DNA, 15 bp, Homo sapiens
tccaaatgaaattat

SEQ ID NO: 358291 - DNA, 15 bp, Homo sapiens
ccaaatgaaattatt

SEQ ID NO: 358292 - DNA, 15 bp, Homo sapiens
caaatgaaattatta

SEQ ID NO: 358293 - DNA, 15 bp, Homo sapiens
aaatgaaattattag

SEQ ID NO: 358294 - DNA, 15 bp, Homo sapiens
aatgaaattattagc

SEQ ID NO: 358295 - DNA, 15 bp, Homo sapiens
atgaaattattagcg

SEQ ID NO: 358296 - DNA, 15 bp, Homo sapiens
tgaaattattagcga

SEQ ID NO: 358297 - DNA, 15 bp, Homo sapiens
gaaattattagcgat

SEQ ID NO: 358298 - DNA, 15 bp, Homo sapiens
aaattattagcgatt

SEQ ID NO: 358299 - DNA, 15 bp, Homo sapiens
aattattagcgatta

SEQ ID NO: 358300 - DNA, 15 bp, Homo sapiens
attattagcgattaa

SEQ ID NO: 358301 - DNA, 15 bp, Homo sapiens
ttattagcgattaaa

SEQ ID NO: 358302 - DNA, 15 bp, Homo sapiens
tattagcgattaaag

SEQ ID NO: 358303 - DNA, 15 bp, Homo sapiens
attagcgattaaaga

SEQ ID NO: 358304 - DNA, 15 bp, Homo sapiens
ttagcgattaaagag

SEQ ID NO: 358305 - DNA, 15 bp, Homo sapiens
tagcgattaaagaga

SEQ ID NO: 358306 - DNA, 15 bp, Homo sapiens
agcgattaaagagaa

SEQ ID NO: 358307 - DNA, 15 bp, Homo sapiens
gcgattaaagagaat

SEQ ID NO: 358308 - DNA, 15 bp, Homo sapiens
cgattaaagagaatg

SEQ ID NO: 358309 - DNA, 15 bp, Homo sapiens
gattaaagagaatgt

SEQ ID NO: 358310 - DNA, 15 bp, Homo sapiens
attaaagagaatgtg

SEQ ID NO: 358311 - DNA, 15 bp, Homo sapiens
ttaaagagaatgtgt

SEQ ID NO: 358312 - DNA, 15 bp, Homo sapiens
taaagagaatgtgta

SEQ ID NO: 358313 - DNA, 15 bp, Homo sapiens
aaagagaatgtgtag

SEQ ID NO: 358314 - DNA, 15 bp, Homo sapiens
aagagaatgtgtagt

SEQ ID NO: 358315 - DNA, 15 bp, Homo sapiens
agagaatgtgtagta

SEQ ID NO: 358316 - DNA, 15 bp, Homo sapiens
gagaatgtgtagtac

SEQ ID NO: 358317 - DNA, 15 bp, Homo sapiens
agaatgtgtagtact

SEQ ID NO: 358318 - DNA, 15 bp, Homo sapiens
gaatgtgtagtacta

SEQ ID NO: 358319 - DNA, 15 bp, Homo sapiens
aatgtgtagtactag

SEQ ID NO: 358320 - DNA, 15 bp, Homo sapiens
atgtgtagtactaga

SEQ ID NO: 358321 - DNA, 15 bp, Homo sapiens
tgtgtagtactagag

SEQ ID NO: 358322 - DNA, 15 bp, Homo sapiens
gtgtagtactagaga

SEQ ID NO: 358323 - DNA, 15 bp, Homo sapiens
tgtagtactagagat

SEQ ID NO: 358324 - DNA, 15 bp, Homo sapiens
gtagtactagagata

SEQ ID NO: 358325 - DNA, 15 bp, Homo sapiens
tagtactagagatac

SEQ ID NO: 358326 - DNA, 15 bp, Homo sapiens
agtactagagatacg

SEQ ID NO: 358327 - DNA, 15 bp, Homo sapiens
gtactagagatacga

SEQ ID NO: 358328 - DNA, 15 bp, Homo sapiens
tactagagatacgat

SEQ ID NO: 358329 - DNA, 15 bp, Homo sapiens
actagagatacgatg

SEQ ID NO: 358330 - DNA, 15 bp, Homo sapiens
ctagagatacgatgt

SEQ ID NO: 358331 - DNA, 15 bp, Homo sapiens
tagagatacgatgtg

SEQ ID NO: 358332 - DNA, 15 bp, Homo sapiens
agagatacgatgtgt

SEQ ID NO: 358333 - DNA, 15 bp, Homo sapiens
gagatacgatgtgtg

SEQ ID NO: 358334 - DNA, 15 bp, Homo sapiens
agatacgatgtgtga

SEQ ID NO: 358335 - DNA, 15 bp, Homo sapiens
gatacgatgtgtgaa

SEQ ID NO: 358336 - DNA, 15 bp, Homo sapiens
atacgatgtgtgaaa

SEQ ID NO: 358337 - DNA, 15 bp, Homo sapiens
tacgatgtgtgaaat

SEQ ID NO: 358338 - DNA, 15 bp, Homo sapiens
acgatgtgtgaaatg

SEQ ID NO: 358339 - DNA, 15 bp, Homo sapiens
cgatgtgtgaaatgg

SEQ ID NO: 358340 - DNA, 15 bp, Homo sapiens
gatgtgtgaaatggc

SEQ ID NO: 358341 - DNA, 15 bp, Homo sapiens
atgtgtgaaatggct

SEQ ID NO: 358342 - DNA, 15 bp, Homo sapiens
tgtgtgaaatggctt

SEQ ID NO: 358343 - DNA, 15 bp, Homo sapiens
gtgtgaaatggcttt

SEQ ID NO: 358344 - DNA, 15 bp, Homo sapiens
tgtgaaatggctttt

SEQ ID NO: 358345 - DNA, 15 bp, Homo sapiens
gtgaaatggcttttt

SEQ ID NO: 358346 - DNA, 15 bp, Homo sapiens
tgaaatggctttttg

SEQ ID NO: 358347 - DNA, 15 bp, Homo sapiens
gaaatggctttttgt

SEQ ID NO: 358348 - DNA, 15 bp, Homo sapiens
aaatggctttttgtc

SEQ ID NO: 358349 - DNA, 15 bp, Homo sapiens
aatggctttttgtct

SEQ ID NO: 358350 - DNA, 15 bp, Homo sapiens
atggctttttgtcta

SEQ ID NO: 358351 - DNA, 15 bp, Homo sapiens
tggctttttgtctaa

SEQ ID NO: 358352 - DNA, 15 bp, Homo sapiens
ggctttttgtctaat

SEQ ID NO: 358353 - DNA, 15 bp, Homo sapiens
gctttttgtctaatt

SEQ ID NO: 358354 - DNA, 15 bp, Homo sapiens
ctttttgtctaattt

SEQ ID NO: 358355 - DNA, 15 bp, Homo sapiens
tttttgtctaattta

SEQ ID NO: 358356 - DNA, 15 bp, Homo sapiens
ttttgtctaatttaa

SEQ ID NO: 358357 - DNA, 15 bp, Homo sapiens
tttgtctaatttaaa

SEQ ID NO: 358358 - DNA, 15 bp, Homo sapiens
ttgtctaatttaaaa

SEQ ID NO: 358359 - DNA, 15 bp, Homo sapiens
tgtctaatttaaaat

SEQ ID NO: 358360 - DNA, 15 bp, Homo sapiens
gtctaatttaaaatt

SEQ ID NO: 358361 - DNA, 15 bp, Homo sapiens
tctaatttaaaattt

SEQ ID NO: 358362 - DNA, 15 bp, Homo sapiens
ctaatttaaaatttt

SEQ ID NO: 358363 - DNA, 15 bp, Homo sapiens
taatttaaaattttt

SEQ ID NO: 358364 - DNA, 15 bp, Homo sapiens
aatttaaaatttttc

SEQ ID NO: 358365 - DNA, 15 bp, Homo sapiens
atttaaaatttttca

SEQ ID NO: 358366 - DNA, 15 bp, Homo sapiens
tttaaaatttttcat

SEQ ID NO: 358367 - DNA, 15 bp, Homo sapiens
ttaaaatttttcatg

SEQ ID NO: 358368 - DNA, 15 bp, Homo sapiens
taaaatttttcatgc

SEQ ID NO: 358369 - DNA, 15 bp, Homo sapiens
aaaatttttcatgct

SEQ ID NO: 358370 - DNA, 15 bp, Homo sapiens
aaatttttcatgctt

SEQ ID NO: 358371 - DNA, 15 bp, Homo sapiens
aatttttcatgcttt

SEQ ID NO: 358372 - DNA, 15 bp, Homo sapiens
atttttcatgcttta

SEQ ID NO: 358373 - DNA, 15 bp, Homo sapiens
tttttcatgctttag

SEQ ID NO: 358374 - DNA, 15 bp, Homo sapiens
ttttcatgctttagg

SEQ ID NO: 358375 - DNA, 15 bp, Homo sapiens
tttcatgctttagga

SEQ ID NO: 358376 - DNA, 15 bp, Homo sapiens
ttcatgctttaggag

SEQ ID NO: 358377 - DNA, 15 bp, Homo sapiens
tcatgctttaggagg

SEQ ID NO: 358378 - DNA, 15 bp, Homo sapiens
catgctttaggaggt

SEQ ID NO: 358379 - DNA, 15 bp, Homo sapiens
atgctttaggaggtc

SEQ ID NO: 358380 - DNA, 15 bp, Homo sapiens
tgctttaggaggtct

SEQ ID NO: 358381 - DNA, 15 bp, Homo sapiens
gctttaggaggtctg

SEQ ID NO: 358382 - DNA, 15 bp, Homo sapiens
ctttaggaggtctgg

SEQ ID NO: 358383 - DNA, 15 bp, Homo sapiens
tttaggaggtctggt

SEQ ID NO: 358384 - DNA, 15 bp, Homo sapiens
ttaggaggtctggtc

SEQ ID NO: 358385 - DNA, 15 bp, Homo sapiens
taggaggtctggtct

SEQ ID NO: 358386 - DNA, 15 bp, Homo sapiens
aggaggtctggtctt

SEQ ID NO: 358387 - DNA, 15 bp, Homo sapiens
ggaggtctggtcttg

SEQ ID NO: 358388 - DNA, 15 bp, Homo sapiens
gaggtctggtcttgt

SEQ ID NO: 358389 - DNA, 15 bp, Homo sapiens
aggtctggtcttgtt

SEQ ID NO: 358390 - DNA, 15 bp, Homo sapiens
ggtctggtcttgttg

SEQ ID NO: 358391 - DNA, 15 bp, Homo sapiens
gtctggtcttgttgg

SEQ ID NO: 358392 - DNA, 15 bp, Homo sapiens
tctggtcttgttgga

SEQ ID NO: 358393 - DNA, 15 bp, Homo sapiens
ctggtcttgttggat

SEQ ID NO: 358394 - DNA, 15 bp, Homo sapiens
tggtcttgttggatt

SEQ ID NO: 358395 - DNA, 15 bp, Homo sapiens
ggtcttgttggattg

SEQ ID NO: 358396 - DNA, 15 bp, Homo sapiens
gtcttgttggattga

SEQ ID NO: 358397 - DNA, 15 bp, Homo sapiens
tcttgttggattgaa

SEQ ID NO: 358398 - DNA, 15 bp, Homo sapiens
cttgttggattgaac

SEQ ID NO: 358399 - DNA, 15 bp, Homo sapiens
ttgttggattgaact

SEQ ID NO: 358400 - DNA, 15 bp, Homo sapiens
tgttggattgaactg

SEQ ID NO: 358401 - DNA, 15 bp, Homo sapiens
gttggattgaactgc

SEQ ID NO: 358402 - DNA, 15 bp, Homo sapiens
ttggattgaactgct

SEQ ID NO: 358403 - DNA, 15 bp, Homo sapiens
tggattgaactgctt

SEQ ID NO: 358404 - DNA, 15 bp, Homo sapiens
ggattgaactgcttc

SEQ ID NO: 358405 - DNA, 15 bp, Homo sapiens
gattgaactgcttca

SEQ ID NO: 358406 - DNA, 15 bp, Homo sapiens
attgaactgcttcac

SEQ ID NO: 358407 - DNA, 15 bp, Homo sapiens
ttgaactgcttcact

SEQ ID NO: 358408 - DNA, 15 bp, Homo sapiens
tgaactgcttcacta

SEQ ID NO: 358409 - DNA, 15 bp, Homo sapiens
gaactgcttcactat

SEQ ID NO: 358410 - DNA, 15 bp, Homo sapiens
aactgcttcactatt

SEQ ID NO: 358411 - DNA, 15 bp, Homo sapiens
actgcttcactattt

SEQ ID NO: 358412 - DNA, 15 bp, Homo sapiens
ctgcttcactatttg

SEQ ID NO: 358413 - DNA, 15 bp, Homo sapiens
tgcttcactatttgg

SEQ ID NO: 358414 - DNA, 15 bp, Homo sapiens
gcttcactatttgga

SEQ ID NO: 358415 - DNA, 15 bp, Homo sapiens
cttcactatttggat

SEQ ID NO: 358416 - DNA, 15 bp, Homo sapiens
ttcactatttggatc

SEQ ID NO: 358417 - DNA, 15 bp, Homo sapiens
tcactatttggatct

SEQ ID NO: 358418 - DNA, 15 bp, Homo sapiens
cactatttggatctt

SEQ ID NO: 358419 - DNA, 15 bp, Homo sapiens
actatttggatcttg

SEQ ID NO: 358420 - DNA, 15 bp, Homo sapiens
ctatttggatcttga

SEQ ID NO: 358421 - DNA, 15 bp, Homo sapiens
tatttggatcttgaa

SEQ ID NO: 358422 - DNA, 15 bp, Homo sapiens
atttggatcttgaaa

SEQ ID NO: 358423 - DNA, 15 bp, Homo sapiens
tttggatcttgaaac

SEQ ID NO: 358424 - DNA, 15 bp, Homo sapiens
ttggatcttgaaact

SEQ ID NO: 358425 - DNA, 15 bp, Homo sapiens
tggatcttgaaacta

SEQ ID NO: 358426 - DNA, 15 bp, Homo sapiens
ggatcttgaaactac

SEQ ID NO: 358427 - DNA, 15 bp, Homo sapiens
gatcttgaaactacc

SEQ ID NO: 358428 - DNA, 15 bp, Homo sapiens
atcttgaaactacct

SEQ ID NO: 358429 - DNA, 15 bp, Homo sapiens
tcttgaaactacctg

SEQ ID NO: 358430 - DNA, 15 bp, Homo sapiens
cttgaaactacctgg

SEQ ID NO: 358431 - DNA, 15 bp, Homo sapiens
ttgaaactacctggt

SEQ ID NO: 358432 - DNA, 15 bp, Homo sapiens
tgaaactacctggtt

SEQ ID NO: 358433 - DNA, 15 bp, Homo sapiens
gaaactacctggtta

SEQ ID NO: 358434 - DNA, 15 bp, Homo sapiens
aaactacctggttaa

SEQ ID NO: 358435 - DNA, 15 bp, Homo sapiens
aactacctggttaaa

SEQ ID NO: 358436 - DNA, 15 bp, Homo sapiens
actacctggttaaac

SEQ ID NO: 358437 - DNA, 15 bp, Homo sapiens
ctacctggttaaaca

SEQ ID NO: 358438 - DNA, 15 bp, Homo sapiens
tacctggttaaacac

SEQ ID NO: 358439 - DNA, 15 bp, Homo sapiens
acctggttaaacact

SEQ ID NO: 358440 - DNA, 15 bp, Homo sapiens
cctggttaaacactt

SEQ ID NO: 358441 - DNA, 15 bp, Homo sapiens
ctggttaaacacttt

SEQ ID NO: 358442 - DNA, 15 bp, Homo sapiens
tggttaaacactttg

SEQ ID NO: 358443 - DNA, 15 bp, Homo sapiens
ggttaaacactttgg

SEQ ID NO: 358444 - DNA, 15 bp, Homo sapiens
gttaaacactttgga

SEQ ID NO: 358445 - DNA, 15 bp, Homo sapiens
ttaaacactttggaa

SEQ ID NO: 358446 - DNA, 15 bp, Homo sapiens
taaacactttggaag

SEQ ID NO: 358447 - DNA, 15 bp, Homo sapiens
aaacactttggaaga

SEQ ID NO: 358448 - DNA, 15 bp, Homo sapiens
aacactttggaagag

SEQ ID NO: 358449 - DNA, 15 bp, Homo sapiens
acactttggaagagc

SEQ ID NO: 358450 - DNA, 15 bp, Homo sapiens
cactttggaagagcg

SEQ ID NO: 358451 - DNA, 15 bp, Homo sapiens
actttggaagagcgg

SEQ ID NO: 358452 - DNA, 15 bp, Homo sapiens
ctttggaagagcgga

SEQ ID NO: 358453 - DNA, 15 bp, Homo sapiens
tttggaagagcggat

SEQ ID NO: 358454 - DNA, 15 bp, Homo sapiens
ttggaagagcggatg

SEQ ID NO: 358455 - DNA, 15 bp, Homo sapiens
tggaagagcggatga

SEQ ID NO: 358456 - DNA, 15 bp, Homo sapiens
ggaagagcggatgaa

SEQ ID NO: 358457 - DNA, 15 bp, Homo sapiens
gaagagcggatgaag

SEQ ID NO: 358458 - DNA, 15 bp, Homo sapiens
aagagcggatgaaga

SEQ ID NO: 358459 - DNA, 15 bp, Homo sapiens
agagcggatgaagag

SEQ ID NO: 358460 - DNA, 15 bp, Homo sapiens
gagcggatgaagagc

SEQ ID NO: 358461 - DNA, 15 bp, Homo sapiens
agcggatgaagagca

SEQ ID NO: 358462 - DNA, 15 bp, Homo sapiens
gcggatgaagagcac

SEQ ID NO: 358463 - DNA, 15 bp, Homo sapiens
cggatgaagagcaca

SEQ ID NO: 358464 - DNA, 15 bp, Homo sapiens
ggatgaagagcacag

SEQ ID NO: 358465 - DNA, 15 bp, Homo sapiens
gatgaagagcacaga

SEQ ID NO: 358466 - DNA, 15 bp, Homo sapiens
atgaagagcacagag

SEQ ID NO: 358467 - DNA, 15 bp, Homo sapiens
tgaagagcacagagg

SEQ ID NO: 358468 - DNA, 15 bp, Homo sapiens
gaagagcacagaggt

SEQ ID NO: 358469 - DNA, 15 bp, Homo sapiens
aagagcacagaggtc

SEQ ID NO: 358470 - DNA, 15 bp, Homo sapiens
agagcacagaggtcc

SEQ ID NO: 358471 - DNA, 15 bp, Homo sapiens
gagcacagaggtcct

SEQ ID NO: 358472 - DNA, 15 bp, Homo sapiens
gcacagaggtcctgc

SEQ ID NO: 358473 - DNA, 15 bp, Homo sapiens
cacagaggtcctgcc

SEQ ID NO: 358474 - DNA, 15 bp, Homo sapiens
acagaggtcctgcct

SEQ ID NO: 358475 - DNA, 15 bp, Homo sapiens
cagaggtcctgcctg

SEQ ID NO: 358476 - DNA, 15 bp, Homo sapiens
agaggtcctgcctga

SEQ ID NO: 358477 - DNA, 15 bp, Homo sapiens
gaggtcctgcctgag

SEQ ID NO: 358478 - DNA, 15 bp, Homo sapiens
aggtcctgcctgaga

SEQ ID NO: 358479 - DNA, 15 bp, Homo sapiens
ggtcctgcctgagaa

SEQ ID NO: 358480 - DNA, 15 bp, Homo sapiens
gtcctgcctgagaag

SEQ ID NO: 358481 - DNA, 15 bp, Homo sapiens
tcctgcctgagaaga

SEQ ID NO: 358482 - DNA, 15 bp, Homo sapiens
cctgcctgagaagac

SEQ ID NO: 358483 - DNA, 15 bp, Homo sapiens
ctgcctgagaagacg

SEQ ID NO: 358484 - DNA, 15 bp, Homo sapiens
tgcctgagaagacgg

SEQ ID NO: 358485 - DNA, 15 bp, Homo sapiens
gcctgagaagacgga

SEQ ID NO: 358486 - DNA, 15 bp, Homo sapiens
cctgagaagacggat

SEQ ID NO: 358487 - DNA, 15 bp, Homo sapiens
ctgagaagacggatg

SEQ ID NO: 358488 - DNA, 15 bp, Homo sapiens
tgagaagacggatgc

SEQ ID NO: 358489 - DNA, 15 bp, Homo sapiens
gagaagacggatgct

SEQ ID NO: 358490 - DNA, 15 bp, Homo sapiens
agaagacggatgctg

SEQ ID NO: 358491 - DNA, 15 bp, Homo sapiens
gaagacggatgctgt

SEQ ID NO: 358492 - DNA, 15 bp, Homo sapiens
aagacggatgctgtc

SEQ ID NO: 358493 - DNA, 15 bp, Homo sapiens
agacggatgctgtca

SEQ ID NO: 358494 - DNA, 15 bp, Homo sapiens
gacggatgctgtcaa

SEQ ID NO: 358495 - DNA, 15 bp, Homo sapiens
acggatgctgtcaac

SEQ ID NO: 358496 - DNA, 15 bp, Homo sapiens
cggatgctgtcaacg

SEQ ID NO: 358497 - DNA, 15 bp, Homo sapiens
ggatgctgtcaacga

SEQ ID NO: 358498 - DNA, 15 bp, Homo sapiens
gatgctgtcaacgaa

SEQ ID NO: 358499 - DNA, 15 bp, Homo sapiens
atgctgtcaacgaag

SEQ ID NO: 358500 - DNA, 15 bp, Homo sapiens
tgctgtcaacgaagc

SEQ ID NO: 358501 - DNA, 15 bp, Homo sapiens
gctgtcaacgaagcc

SEQ ID NO: 358502 - DNA, 15 bp, Homo sapiens
ctgtcaacgaagccc

SEQ ID NO: 358503 - DNA, 15 bp, Homo sapiens
tgtcaacgaagccct

SEQ ID NO: 358504 - DNA, 15 bp, Homo sapiens
gtcaacgaagccctg

SEQ ID NO: 358505 - DNA, 15 bp, Homo sapiens
tcaacgaagccctgg

SEQ ID NO: 358506 - DNA, 15 bp, Homo sapiens
caacgaagccctgga

SEQ ID NO: 358507 - DNA, 15 bp, Homo sapiens
aacgaagccctggag

SEQ ID NO: 358508 - DNA, 15 bp, Homo sapiens
acgaagccctggagg

SEQ ID NO: 358509 - DNA, 15 bp, Homo sapiens
cgaagccctggaggt

SEQ ID NO: 358510 - DNA, 15 bp, Homo sapiens
gaagccctggaggtt

SEQ ID NO: 358511 - DNA, 15 bp, Homo sapiens
aagccctggaggttg

SEQ ID NO: 358512 - DNA, 15 bp, Homo sapiens
agccctggaggttgg

SEQ ID NO: 358513 - DNA, 15 bp, Homo sapiens
gccctggaggttgga

SEQ ID NO: 358514 - DNA, 15 bp, Homo sapiens
ccctggaggttggaa

SEQ ID NO: 358515 - DNA, 15 bp, Homo sapiens
cctggaggttggaac

SEQ ID NO: 358516 - DNA, 15 bp, Homo sapiens
ctggaggttggaacc

SEQ ID NO: 358517 - DNA, 15 bp, Homo sapiens
tggaggttggaaccc

SEQ ID NO: 358518 - DNA, 15 bp, Homo sapiens
ggaggttggaacccg

SEQ ID NO: 358519 - DNA, 15 bp, Homo sapiens
gaggttggaacccgt

SEQ ID NO: 358520 - DNA, 15 bp, Homo sapiens
aggttggaacccgtg

SEQ ID NO: 358521 - DNA, 15 bp, Homo sapiens
ggttggaacccgtga

SEQ ID NO: 358522 - DNA, 15 bp, Homo sapiens
gttggaacccgtgat

SEQ ID NO: 358523 - DNA, 15 bp, Homo sapiens
ttggaacccgtgatc

SEQ ID NO: 358524 - DNA, 15 bp, Homo sapiens
tggaacccgtgatct

SEQ ID NO: 358525 - DNA, 15 bp, Homo sapiens
ggaacccgtgatctc

SEQ ID NO: 358526 - DNA, 15 bp, Homo sapiens
gaacccgtgatctcc

SEQ ID NO: 358527 - DNA, 15 bp, Homo sapiens
aacccgtgatctcca

SEQ ID NO: 358528 - DNA, 15 bp, Homo sapiens
acccgtgatctccac

SEQ ID NO: 358529 - DNA, 15 bp, Homo sapiens
cccgtgatctccacg

SEQ ID NO: 358530 - DNA, 15 bp, Homo sapiens
ccgtgatctccacgg

SEQ ID NO: 358531 - DNA, 15 bp, Homo sapiens
cgtgatctccacggc

SEQ ID NO: 358532 - DNA, 15 bp, Homo sapiens
gtgatctccacggca

SEQ ID NO: 358533 - DNA, 15 bp, Homo sapiens
tgatctccacggcat

SEQ ID NO: 358534 - DNA, 15 bp, Homo sapiens
gatctccacggcatt

SEQ ID NO: 358535 - DNA, 15 bp, Homo sapiens
atctccacggcattt

SEQ ID NO: 358536 - DNA, 15 bp, Homo sapiens
tctccacggcatttc

SEQ ID NO: 358537 - DNA, 15 bp, Homo sapiens
ctccacggcatttct

SEQ ID NO: 358538 - DNA, 15 bp, Homo sapiens
tccacggcatttctc

SEQ ID NO: 358539 - DNA, 15 bp, Homo sapiens
ccacggcatttctct

SEQ ID NO: 358540 - DNA, 15 bp, Homo sapiens
cacggcatttctctt

SEQ ID NO: 358541 - DNA, 15 bp, Homo sapiens
acggcatttctcttt

SEQ ID NO: 358542 - DNA, 15 bp, Homo sapiens
cggcatttctctttg

SEQ ID NO: 358543 - DNA, 15 bp, Homo sapiens
ggcatttctctttgc

SEQ ID NO: 358544 - DNA, 15 bp, Homo sapiens
gcatttctctttgct

SEQ ID NO: 358545 - DNA, 15 bp, Homo sapiens
catttctctttgctg

SEQ ID NO: 358546 - DNA, 15 bp, Homo sapiens
atttctctttgctgt

SEQ ID NO: 358547 - DNA, 15 bp, Homo sapiens
tttctctttgctgtg

SEQ ID NO: 358548 - DNA, 15 bp, Homo sapiens
ttctctttgctgtga

SEQ ID NO: 358549 - DNA, 15 bp, Homo sapiens
tctctttgctgtgat

SEQ ID NO: 358550 - DNA, 15 bp, Homo sapiens
ctctttgctgtgatg

SEQ ID NO: 358551 - DNA, 15 bp, Homo sapiens
tctttgctgtgatga

SEQ ID NO: 358552 - DNA, 15 bp, Homo sapiens
ctttgctgtgatgag

SEQ ID NO: 358553 - DNA, 15 bp, Homo sapiens
tttgctgtgatgagg

SEQ ID NO: 358554 - DNA, 15 bp, Homo sapiens
ttgctgtgatgaggc

SEQ ID NO: 358555 - DNA, 15 bp, Homo sapiens
tgctgtgatgaggcc

SEQ ID NO: 358556 - DNA, 15 bp, Homo sapiens
gctgtgatgaggcca

SEQ ID NO: 358557 - DNA, 15 bp, Homo sapiens
ctgtgatgaggccac

SEQ ID NO: 358558 - DNA, 15 bp, Homo sapiens
tgtgatgaggccaca

SEQ ID NO: 358559 - DNA, 15 bp, Homo sapiens
gtgatgaggccacac

SEQ ID NO: 358560 - DNA, 15 bp, Homo sapiens
tgatgaggccacacg

SEQ ID NO: 358561 - DNA, 15 bp, Homo sapiens
gatgaggccacacgt

SEQ ID NO: 358562 - DNA, 15 bp, Homo sapiens
atgaggccacacgtg

SEQ ID NO: 358563 - DNA, 15 bp, Homo sapiens
tgaggccacacgtgt

SEQ ID NO: 358564 - DNA, 15 bp, Homo sapiens
gaggccacacgtgta

SEQ ID NO: 358565 - DNA, 15 bp, Homo sapiens
aggccacacgtgtat

SEQ ID NO: 358566 - DNA, 15 bp, Homo sapiens
ggccacacgtgtatt

SEQ ID NO: 358567 - DNA, 15 bp, Homo sapiens
gccacacgtgtatta

SEQ ID NO: 358568 - DNA, 15 bp, Homo sapiens
ccacacgtgtattac

SEQ ID NO: 358569 - DNA, 15 bp, Homo sapiens
cacacgtgtattaca

SEQ ID NO: 358570 - DNA, 15 bp, Homo sapiens
acacgtgtattacaa

SEQ ID NO: 358571 - DNA, 15 bp, Homo sapiens
cacgtgtattacaat

SEQ ID NO: 358572 - DNA, 15 bp, Homo sapiens
acgtgtattacaatg

SEQ ID NO: 358573 - DNA, 15 bp, Homo sapiens
cgtgtattacaatga

SEQ ID NO: 358574 - DNA, 15 bp, Homo sapiens
gtgtattacaatgag

SEQ ID NO: 358575 - DNA, 15 bp, Homo sapiens
tgtattacaatgagg

SEQ ID NO: 358576 - DNA, 15 bp, Homo sapiens
gtattacaatgagga

SEQ ID NO: 358577 - DNA, 15 bp, Homo sapiens
tattacaatgaggaa

SEQ ID NO: 358578 - DNA, 15 bp, Homo sapiens
attacaatgaggaat

SEQ ID NO: 358579 - DNA, 15 bp, Homo sapiens
ttacaatgaggaatg

SEQ ID NO: 358580 - DNA, 15 bp, Homo sapiens
tacaatgaggaatgt

SEQ ID NO: 358581 - DNA, 15 bp, Homo sapiens
acaatgaggaatgta

SEQ ID NO: 358582 - DNA, 15 bp, Homo sapiens
caatgaggaatgtaa

SEQ ID NO: 358583 - DNA, 15 bp, Homo sapiens
aatgaggaatgtaat

SEQ ID NO: 358584 - DNA, 15 bp, Homo sapiens
atgaggaatgtaatg

SEQ ID NO: 358585 - DNA, 15 bp, Homo sapiens
tgaggaatgtaatgc

SEQ ID NO: 358586 - DNA, 15 bp, Homo sapiens
gaggaatgtaatgct

SEQ ID NO: 358587 - DNA, 15 bp, Homo sapiens
aggaatgtaatgctt

SEQ ID NO: 358588 - DNA, 15 bp, Homo sapiens
ggaatgtaatgcttt

SEQ ID NO: 358589 - DNA, 15 bp, Homo sapiens
gaatgtaatgcttta

SEQ ID NO: 358590 - DNA, 15 bp, Homo sapiens
aatgtaatgctttac

SEQ ID NO: 358591 - DNA, 15 bp, Homo sapiens
atgtaatgctttacg

SEQ ID NO: 358592 - DNA, 15 bp, Homo sapiens
tgtaatgctttacgc

SEQ ID NO: 358593 - DNA, 15 bp, Homo sapiens
gtaatgctttacgca

SEQ ID NO: 358594 - DNA, 15 bp, Homo sapiens
taatgctttacgcag

SEQ ID NO: 358595 - DNA, 15 bp, Homo sapiens
aatgctttacgcagg

SEQ ID NO: 358596 - DNA, 15 bp, Homo sapiens
atgctttacgcaggc

SEQ ID NO: 358597 - DNA, 15 bp, Homo sapiens
tgctttacgcaggca

SEQ ID NO: 358598 - DNA, 15 bp, Homo sapiens
gctttacgcaggcaa

SEQ ID NO: 358599 - DNA, 15 bp, Homo sapiens
ctttacgcaggcaaa

SEQ ID NO: 358600 - DNA, 15 bp, Homo sapiens
tttacgcaggcaaat

SEQ ID NO: 358601 - DNA, 15 bp, Homo sapiens
ttacgcaggcaaatg

SEQ ID NO: 358602 - DNA, 15 bp, Homo sapiens
tacgcaggcaaatgc

SEQ ID NO: 358603 - DNA, 15 bp, Homo sapiens
acgcaggcaaatgca

SEQ ID NO: 358604 - DNA, 15 bp, Homo sapiens
cgcaggcaaatgcat

SEQ ID NO: 358605 - DNA, 15 bp, Homo sapiens
gcaggcaaatgcatt

SEQ ID NO: 358606 - DNA, 15 bp, Homo sapiens
caggcaaatgcattt

SEQ ID NO: 358607 - DNA, 15 bp, Homo sapiens
aggcaaatgcatttg

SEQ ID NO: 358608 - DNA, 15 bp, Homo sapiens
ggcaaatgcatttgc

SEQ ID NO: 358609 - DNA, 15 bp, Homo sapiens
gcaaatgcatttgct

SEQ ID NO: 358610 - DNA, 15 bp, Homo sapiens
caaatgcatttgctt

SEQ ID NO: 358611 - DNA, 15 bp, Homo sapiens
aaatgcatttgcttc

SEQ ID NO: 358612 - DNA, 15 bp, Homo sapiens
aatgcatttgcttcc

SEQ ID NO: 358613 - DNA, 15 bp, Homo sapiens
atgcatttgcttcct

SEQ ID NO: 358614 - DNA, 15 bp, Homo sapiens
tgcatttgcttcctc

SEQ ID NO: 358615 - DNA, 15 bp, Homo sapiens
gcatttgcttcctca

SEQ ID NO: 358616 - DNA, 15 bp, Homo sapiens
catttgcttcctcag

SEQ ID NO: 358617 - DNA, 15 bp, Homo sapiens
atttgcttcctcagt

SEQ ID NO: 358618 - DNA, 15 bp, Homo sapiens
tttgcttcctcagtg

SEQ ID NO: 358619 - DNA, 15 bp, Homo sapiens
ttgcttcctcagtgg

SEQ ID NO: 358620 - DNA, 15 bp, Homo sapiens
tgcttcctcagtggt

SEQ ID NO: 358621 - DNA, 15 bp, Homo sapiens
gcttcctcagtggtt

SEQ ID NO: 358622 - DNA, 15 bp, Homo sapiens
cttcctcagtggttt

SEQ ID NO: 358623 - DNA, 15 bp, Homo sapiens
ttcctcagtggtttt

SEQ ID NO: 358624 - DNA, 15 bp, Homo sapiens
tcctcagtggttttc

SEQ ID NO: 358625 - DNA, 15 bp, Homo sapiens
cctcagtggttttca

SEQ ID NO: 358626 - DNA, 15 bp, Homo sapiens
ctcagtggttttcaa

SEQ ID NO: 358627 - DNA, 15 bp, Homo sapiens
tcagtggttttcaat

SEQ ID NO: 358628 - DNA, 15 bp, Homo sapiens
cagtggttttcaatg

SEQ ID NO: 358629 - DNA, 15 bp, Homo sapiens
agtggttttcaatgt

SEQ ID NO: 358630 - DNA, 15 bp, Homo sapiens
gtggttttcaatgtc

SEQ ID NO: 358631 - DNA, 15 bp, Homo sapiens
tggttttcaatgtca

SEQ ID NO: 358632 - DNA, 15 bp, Homo sapiens
ggttttcaatgtcac

SEQ ID NO: 358633 - DNA, 15 bp, Homo sapiens
gttttcaatgtcact

SEQ ID NO: 358634 - DNA, 15 bp, Homo sapiens
ttttcaatgtcactt

SEQ ID NO: 358635 - DNA, 15 bp, Homo sapiens
tttcaatgtcacttg

SEQ ID NO: 358636 - DNA, 15 bp, Homo sapiens
ttcaatgtcacttgc

SEQ ID NO: 358637 - DNA, 15 bp, Homo sapiens
tcaatgtcacttgca

SEQ ID NO: 358638 - DNA, 15 bp, Homo sapiens
caatgtcacttgcat

SEQ ID NO: 358639 - DNA, 15 bp, Homo sapiens
aatgtcacttgcatt

SEQ ID NO: 358640 - DNA, 15 bp, Homo sapiens
atgtcacttgcattt

SEQ ID NO: 358641 - DNA, 15 bp, Homo sapiens
tgtcacttgcatttt

SEQ ID NO: 358642 - DNA, 15 bp, Homo sapiens
gtcacttgcattttc

SEQ ID NO: 358643 - DNA, 15 bp, Homo sapiens
acttgcattttcttc

SEQ ID NO: 358644 - DNA, 15 bp, Homo sapiens
cttgcattttcttcc

SEQ ID NO: 358645 - DNA, 15 bp, Homo sapiens
ttgcattttcttcca

SEQ ID NO: 358646 - DNA, 15 bp, Homo sapiens
tgcattttcttccat

SEQ ID NO: 358647 - DNA, 15 bp, Homo sapiens
gcattttcttccata

SEQ ID NO: 358648 - DNA, 15 bp, Homo sapiens
cattttcttccatag

SEQ ID NO: 358649 - DNA, 15 bp, Homo sapiens
attttcttccatagc

SEQ ID NO: 358650 - DNA, 15 bp, Homo sapiens
ttttcttccatagcc

SEQ ID NO: 358651 - DNA, 15 bp, Homo sapiens
tttcttccatagcct

SEQ ID NO: 358652 - DNA, 15 bp, Homo sapiens
ttcttccatagcctg

SEQ ID NO: 358653 - DNA, 15 bp, Homo sapiens
tcttccatagcctga

SEQ ID NO: 358654 - DNA, 15 bp, Homo sapiens
cttccatagcctgaa

SEQ ID NO: 358655 - DNA, 15 bp, Homo sapiens
ttccatagcctgaag

SEQ ID NO: 358656 - DNA, 15 bp, Homo sapiens
tccatagcctgaagt

SEQ ID NO: 358657 - DNA, 15 bp, Homo sapiens
ccatagcctgaagtg

SEQ ID NO: 358658 - DNA, 15 bp, Homo sapiens
catagcctgaagtgt

SEQ ID NO: 358659 - DNA, 15 bp, Homo sapiens
atagcctgaagtgtt

SEQ ID NO: 358660 - DNA, 15 bp, Homo sapiens
tagcctgaagtgttt

SEQ ID NO: 358661 - DNA, 15 bp, Homo sapiens
agcctgaagtgttta

SEQ ID NO: 358662 - DNA, 15 bp, Homo sapiens
gcctgaagtgtttat

SEQ ID NO: 358663 - DNA, 15 bp, Homo sapiens
cctgaagtgtttata

SEQ ID NO: 358664 - DNA, 15 bp, Homo sapiens
ctgaagtgtttatac

SEQ ID NO: 358665 - DNA, 15 bp, Homo sapiens
tgaagtgtttataca

SEQ ID NO: 358666 - DNA, 15 bp, Homo sapiens
gaagtgtttatacaa

SEQ ID NO: 358667 - DNA, 15 bp, Homo sapiens
aagtgtttatacaat

SEQ ID NO: 358668 - DNA, 15 bp, Homo sapiens
agtgtttatacaatc

SEQ ID NO: 358669 - DNA, 15 bp, Homo sapiens
gtgtttatacaatca

SEQ ID NO: 358670 - DNA, 15 bp, Homo sapiens
tgtttatacaatcat

SEQ ID NO: 358671 - DNA, 15 bp, Homo sapiens
gtttatacaatcatg

SEQ ID NO: 358672 - DNA, 15 bp, Homo sapiens
tttatacaatcatgt

SEQ ID NO: 358673 - DNA, 15 bp, Homo sapiens
ttatacaatcatgtg

SEQ ID NO: 358674 - DNA, 15 bp, Homo sapiens
tatacaatcatgtgt

SEQ ID NO: 358675 - DNA, 15 bp, Homo sapiens
atacaatcatgtgta

SEQ ID NO: 358676 - DNA, 15 bp, Homo sapiens
tacaatcatgtgtat

SEQ ID NO: 358677 - DNA, 15 bp, Homo sapiens
acaatcatgtgtatt

SEQ ID NO: 358678 - DNA, 15 bp, Homo sapiens
caatcatgtgtattt

SEQ ID NO: 358679 - DNA, 15 bp, Homo sapiens
aatcatgtgtattta

SEQ ID NO: 358680 - DNA, 15 bp, Homo sapiens
atcatgtgtatttag

SEQ ID NO: 358681 - DNA, 15 bp, Homo sapiens
tcatgtgtatttaga

SEQ ID NO: 358682 - DNA, 15 bp, Homo sapiens
catgtgtatttagat

SEQ ID NO: 358683 - DNA, 15 bp, Homo sapiens
atgtgtatttagatt

SEQ ID NO: 358684 - DNA, 15 bp, Homo sapiens
tgtgtatttagatta

SEQ ID NO: 358685 - DNA, 15 bp, Homo sapiens
gtgtatttagattat

SEQ ID NO: 358686 - DNA, 15 bp, Homo sapiens
tgtatttagattatt

SEQ ID NO: 358687 - DNA, 15 bp, Homo sapiens
gtatttagattattg

SEQ ID NO: 358688 - DNA, 15 bp, Homo sapiens
tatttagattattgg

SEQ ID NO: 358689 - DNA, 15 bp, Homo sapiens
atttagattattggt

SEQ ID NO: 358690 - DNA, 15 bp, Homo sapiens
tttagattattggtg

SEQ ID NO: 358691 - DNA, 15 bp, Homo sapiens
ttagattattggtga

SEQ ID NO: 358692 - DNA, 15 bp, Homo sapiens
tagattattggtgac

SEQ ID NO: 358693 - DNA, 15 bp, Homo sapiens
agattattggtgacc

SEQ ID NO: 358694 - DNA, 15 bp, Homo sapiens
gattattggtgaccc

SEQ ID NO: 358695 - DNA, 15 bp, Homo sapiens
attattggtgaccca

SEQ ID NO: 358696 - DNA, 15 bp, Homo sapiens
ttattggtgacccat

SEQ ID NO: 358697 - DNA, 15 bp, Homo sapiens
tattggtgacccatt

SEQ ID NO: 358698 - DNA, 15 bp, Homo sapiens
attggtgacccatta

SEQ ID NO: 358699 - DNA, 15 bp, Homo sapiens
ttggtgacccattat

SEQ ID NO: 358700 - DNA, 15 bp, Homo sapiens
tggtgacccattata

SEQ ID NO: 358701 - DNA, 15 bp, Homo sapiens
ggtgacccattatat

SEQ ID NO: 358702 - DNA, 15 bp, Homo sapiens
gtgacccattatatc

SEQ ID NO: 358703 - DNA, 15 bp, Homo sapiens
tgacccattatatca

SEQ ID NO: 358704 - DNA, 15 bp, Homo sapiens
gacccattatatcag

SEQ ID NO: 358705 - DNA, 15 bp, Homo sapiens
acccattatatcagc

SEQ ID NO: 358706 - DNA, 15 bp, Homo sapiens
cccattatatcagcc

SEQ ID NO: 358707 - DNA, 15 bp, Homo sapiens
ccattatatcagcct

SEQ ID NO: 358708 - DNA, 15 bp, Homo sapiens
cattatatcagcctc

SEQ ID NO: 358709 - DNA, 15 bp, Homo sapiens
attatatcagcctca

SEQ ID NO: 358710 - DNA, 15 bp, Homo sapiens
ttatatcagcctcaa

SEQ ID NO: 358711 - DNA, 15 bp, Homo sapiens
tatatcagcctcaag

SEQ ID NO: 358712 - DNA, 15 bp, Homo sapiens
atatcagcctcaaga

SEQ ID NO: 358713 - DNA, 15 bp, Homo sapiens
tatcagcctcaagac

SEQ ID NO: 358714 - DNA, 15 bp, Homo sapiens
atcagcctcaagacg

SEQ ID NO: 358715 - DNA, 15 bp, Homo sapiens
tcagcctcaagacgt

SEQ ID NO: 358716 - DNA, 15 bp, Homo sapiens
cagcctcaagacgtg

SEQ ID NO: 358717 - DNA, 15 bp, Homo sapiens
agcctcaagacgtgg

SEQ ID NO: 358718 - DNA, 15 bp, Homo sapiens
gcctcaagacgtggt

SEQ ID NO: 358719 - DNA, 15 bp, Homo sapiens
cctcaagacgtggtt

SEQ ID NO: 358720 - DNA, 15 bp, Homo sapiens
ctcaagacgtggtta

SEQ ID NO: 358721 - DNA, 15 bp, Homo sapiens
tcaagacgtggttag

SEQ ID NO: 358722 - DNA, 15 bp, Homo sapiens
caagacgtggttagc

SEQ ID NO: 358723 - DNA, 15 bp, Homo sapiens
aagacgtggttagct

SEQ ID NO: 358724 - DNA, 15 bp, Homo sapiens
agacgtggttagctg

SEQ ID NO: 358725 - DNA, 15 bp, Homo sapiens
gacgtggttagctgt

SEQ ID NO: 358726 - DNA, 15 bp, Homo sapiens
acgtggttagctgtt

SEQ ID NO: 358727 - DNA, 15 bp, Homo sapiens
cgtggttagctgttt

SEQ ID NO: 358728 - DNA, 15 bp, Homo sapiens
gtggttagctgtttg

SEQ ID NO: 358729 - DNA, 15 bp, Homo sapiens
tggttagctgtttga

SEQ ID NO: 358730 - DNA, 15 bp, Homo sapiens
ggttagctgtttgac

SEQ ID NO: 358731 - DNA, 15 bp, Homo sapiens
gttagctgtttgaca

SEQ ID NO: 358732 - DNA, 15 bp, Homo sapiens
ttagctgtttgacat

SEQ ID NO: 358733 - DNA, 15 bp, Homo sapiens
tagctgtttgacatc

SEQ ID NO: 358734 - DNA, 15 bp, Homo sapiens
agctgtttgacatct

SEQ ID NO: 358735 - DNA, 15 bp, Homo sapiens
gctgtttgacatctt

SEQ ID NO: 358736 - DNA, 15 bp, Homo sapiens
ctgtttgacatctta

SEQ ID NO: 358737 - DNA, 15 bp, Homo sapiens
tgtttgacatcttac

SEQ ID NO: 358738 - DNA, 15 bp, Homo sapiens
gtttgacatcttaca

SEQ ID NO: 358739 - DNA, 15 bp, Homo sapiens
tttgacatcttacat

SEQ ID NO: 358740 - DNA, 15 bp, Homo sapiens
ttgacatcttacatt

SEQ ID NO: 358741 - DNA, 15 bp, Homo sapiens
tgacatcttacattt

SEQ ID NO: 358742 - DNA, 15 bp, Homo sapiens
gacatcttacatttt

SEQ ID NO: 358743 - DNA, 15 bp, Homo sapiens
acatcttacatttta

SEQ ID NO: 358744 - DNA, 15 bp, Homo sapiens
catcttacattttag

SEQ ID NO: 358745 - DNA, 15 bp, Homo sapiens
atcttacattttaga

SEQ ID NO: 358746 - DNA, 15 bp, Homo sapiens
tcttacattttagac

SEQ ID NO: 358747 - DNA, 15 bp, Homo sapiens
cttacattttagaca

SEQ ID NO: 358748 - DNA, 15 bp, Homo sapiens
ttacattttagacat

SEQ ID NO: 358749 - DNA, 15 bp, Homo sapiens
tacattttagacatg

SEQ ID NO: 358750 - DNA, 15 bp, Homo sapiens
acattttagacatgt

SEQ ID NO: 358751 - DNA, 15 bp, Homo sapiens
cattttagacatgtt

SEQ ID NO: 358752 - DNA, 15 bp, Homo sapiens
attttagacatgttg

SEQ ID NO: 358753 - DNA, 15 bp, Homo sapiens
ttttagacatgttga

SEQ ID NO: 358754 - DNA, 15 bp, Homo sapiens
tttagacatgttgaa

SEQ ID NO: 358755 - DNA, 15 bp, Homo sapiens
ttagacatgttgaag

SEQ ID NO: 358756 - DNA, 15 bp, Homo sapiens
tagacatgttgaagc

SEQ ID NO: 358757 - DNA, 15 bp, Homo sapiens
agacatgttgaagca

SEQ ID NO: 358758 - DNA, 15 bp, Homo sapiens
gacatgttgaagcac

SEQ ID NO: 358759 - DNA, 15 bp, Homo sapiens
acatgttgaagcact

SEQ ID NO: 358760 - DNA, 15 bp, Homo sapiens
catgttgaagcactc

SEQ ID NO: 358761 - DNA, 15 bp, Homo sapiens
atgttgaagcactct

SEQ ID NO: 358762 - DNA, 15 bp, Homo sapiens
tgttgaagcactcta

SEQ ID NO: 358763 - DNA, 15 bp, Homo sapiens
gttgaagcactctag

SEQ ID NO: 358764 - DNA, 15 bp, Homo sapiens
ttgaagcactctagt

SEQ ID NO: 358765 - DNA, 15 bp, Homo sapiens
tgaagcactctagtg

SEQ ID NO: 358766 - DNA, 15 bp, Homo sapiens
gaagcactctagtgg

SEQ ID NO: 358767 - DNA, 15 bp, Homo sapiens
aagcactctagtggt

SEQ ID NO: 358768 - DNA, 15 bp, Homo sapiens
agcactctagtggtt

SEQ ID NO: 358769 - DNA, 15 bp, Homo sapiens
gcactctagtggttt

SEQ ID NO: 358770 - DNA, 15 bp, Homo sapiens
cactctagtggtttt

SEQ ID NO: 358771 - DNA, 15 bp, Homo sapiens
actctagtggttttc

SEQ ID NO: 358772 - DNA, 15 bp, Homo sapiens
ctctagtggttttcc

SEQ ID NO: 358773 - DNA, 15 bp, Homo sapiens
tctagtggttttcca

SEQ ID NO: 358774 - DNA, 15 bp, Homo sapiens
ctagtggttttccag

SEQ ID NO: 358775 - DNA, 15 bp, Homo sapiens
tagtggttttccagt

SEQ ID NO: 358776 - DNA, 15 bp, Homo sapiens
agtggttttccagtt

SEQ ID NO: 358777 - DNA, 15 bp, Homo sapiens
gtggttttccagttt

SEQ ID NO: 358778 - DNA, 15 bp, Homo sapiens
tggttttccagttta

SEQ ID NO: 358779 - DNA, 15 bp, Homo sapiens
ggttttccagtttat

SEQ ID NO: 358780 - DNA, 15 bp, Homo sapiens
gttttccagtttatt

SEQ ID NO: 358781 - DNA, 15 bp, Homo sapiens
ttttccagtttattt

SEQ ID NO: 358782 - DNA, 15 bp, Homo sapiens
tttccagtttatttt

SEQ ID NO: 358783 - DNA, 15 bp, Homo sapiens
ttccagtttatttta

SEQ ID NO: 358784 - DNA, 15 bp, Homo sapiens
tccagtttattttag

SEQ ID NO: 358785 - DNA, 15 bp, Homo sapiens
ccagtttattttagt

SEQ ID NO: 358786 - DNA, 15 bp, Homo sapiens
cagtttattttagta

SEQ ID NO: 358787 - DNA, 15 bp, Homo sapiens
agtttattttagtag

SEQ ID NO: 358788 - DNA, 15 bp, Homo sapiens
gtttattttagtagg

SEQ ID NO: 358789 - DNA, 15 bp, Homo sapiens
tttattttagtaggc

SEQ ID NO: 358790 - DNA, 15 bp, Homo sapiens
ttattttagtaggcc

SEQ ID NO: 358791 - DNA, 15 bp, Homo sapiens
tattttagtaggccc

SEQ ID NO: 358792 - DNA, 15 bp, Homo sapiens
attttagtaggccct

SEQ ID NO: 358793 - DNA, 15 bp, Homo sapiens
ttttagtaggccctg

SEQ ID NO: 358794 - DNA, 15 bp, Homo sapiens
tttagtaggccctgg

SEQ ID NO: 358795 - DNA, 15 bp, Homo sapiens
ttagtaggccctgga

SEQ ID NO: 358796 - DNA, 15 bp, Homo sapiens
tagtaggccctggac

SEQ ID NO: 358797 - DNA, 15 bp, Homo sapiens
agtaggccctggaca

SEQ ID NO: 358798 - DNA, 15 bp, Homo sapiens
gtaggccctggacaa

SEQ ID NO: 358799 - DNA, 15 bp, Homo sapiens
taggccctggacaaa

SEQ ID NO: 358800 - DNA, 15 bp, Homo sapiens
aggccctggacaaag

SEQ ID NO: 358801 - DNA, 15 bp, Homo sapiens
ggccctggacaaagc

SEQ ID NO: 358802 - DNA, 15 bp, Homo sapiens
gccctggacaaagct

SEQ ID NO: 358803 - DNA, 15 bp, Homo sapiens
ccctggacaaagctc

SEQ ID NO: 358804 - DNA, 15 bp, Homo sapiens
cctggacaaagctct

SEQ ID NO: 358805 - DNA, 15 bp, Homo sapiens
ctggacaaagctctg

SEQ ID NO: 358806 - DNA, 15 bp, Homo sapiens
tggacaaagctctgc

SEQ ID NO: 358807 - DNA, 15 bp, Homo sapiens
ggacaaagctctgcc

SEQ ID NO: 358808 - DNA, 15 bp, Homo sapiens
gacaaagctctgcca

SEQ ID NO: 358809 - DNA, 15 bp, Homo sapiens
acaaagctctgccat

SEQ ID NO: 358810 - DNA, 15 bp, Homo sapiens
caaagctctgccata

SEQ ID NO: 358811 - DNA, 15 bp, Homo sapiens
aaagctctgccatat

SEQ ID NO: 358812 - DNA, 15 bp, Homo sapiens
aagctctgccatatg

SEQ ID NO: 358813 - DNA, 15 bp, Homo sapiens
agctctgccatatgt

SEQ ID NO: 358814 - DNA, 15 bp, Homo sapiens
gctctgccatatgtt

SEQ ID NO: 358815 - DNA, 15 bp, Homo sapiens
ctctgccatatgtta

SEQ ID NO: 358816 - DNA, 15 bp, Homo sapiens
tctgccatatgttat

SEQ ID NO: 358817 - DNA, 15 bp, Homo sapiens
ctgccatatgttatt

SEQ ID NO: 358818 - DNA, 15 bp, Homo sapiens
tgccatatgttatta

SEQ ID NO: 358819 - DNA, 15 bp, Homo sapiens
gccatatgttattag

SEQ ID NO: 358820 - DNA, 15 bp, Homo sapiens
ccatatgttattagg

SEQ ID NO: 358821 - DNA, 15 bp, Homo sapiens
catatgttattagga

SEQ ID NO: 358822 - DNA, 15 bp, Homo sapiens
atatgttattaggac

SEQ ID NO: 358823 - DNA, 15 bp, Homo sapiens
tatgttattaggaca

SEQ ID NO: 358824 - DNA, 15 bp, Homo sapiens
atgttattaggacaa

SEQ ID NO: 358825 - DNA, 15 bp, Homo sapiens
tgttattaggacaac

SEQ ID NO: 358826 - DNA, 15 bp, Homo sapiens
gttattaggacaact

SEQ ID NO: 358827 - DNA, 15 bp, Homo sapiens
ttattaggacaactg

SEQ ID NO: 358828 - DNA, 15 bp, Homo sapiens
tattaggacaactgc

SEQ ID NO: 358829 - DNA, 15 bp, Homo sapiens
attaggacaactgct

SEQ ID NO: 358830 - DNA, 15 bp, Homo sapiens
ttaggacaactgctc

SEQ ID NO: 358831 - DNA, 15 bp, Homo sapiens
taggacaactgctct

SEQ ID NO: 358832 - DNA, 15 bp, Homo sapiens
aggacaactgctctc

SEQ ID NO: 358833 - DNA, 15 bp, Homo sapiens
ggacaactgctctct

SEQ ID NO: 358834 - DNA, 15 bp, Homo sapiens
gacaactgctctctt

SEQ ID NO: 358835 - DNA, 15 bp, Homo sapiens
acaactgctctcttg

SEQ ID NO: 358836 - DNA, 15 bp, Homo sapiens
caactgctctcttgt

SEQ ID NO: 358837 - DNA, 15 bp, Homo sapiens
aactgctctcttgtt

SEQ ID NO: 358838 - DNA, 15 bp, Homo sapiens
actgctctcttgttt

SEQ ID NO: 358839 - DNA, 15 bp, Homo sapiens
ctgctctcttgtttc

SEQ ID NO: 358840 - DNA, 15 bp, Homo sapiens
ctcttgtttcatcaa

SEQ ID NO: 358841 - DNA, 15 bp, Homo sapiens
tcttgtttcatcaac

SEQ ID NO: 358842 - DNA, 15 bp, Homo sapiens
cttgtttcatcaaca

SEQ ID NO: 358843 - DNA, 15 bp, Homo sapiens
ttgtttcatcaacaa

SEQ ID NO: 358844 - DNA, 15 bp, Homo sapiens
tgtttcatcaacaag

SEQ ID NO: 358845 - DNA, 15 bp, Homo sapiens
gtttcatcaacaagt

SEQ ID NO: 358846 - DNA, 15 bp, Homo sapiens
tttcatcaacaagtt

SEQ ID NO: 358847 - DNA, 15 bp, Homo sapiens
ttcatcaacaagtta

SEQ ID NO: 358848 - DNA, 15 bp, Homo sapiens
tcatcaacaagttat

SEQ ID NO: 358849 - DNA, 15 bp, Homo sapiens
catcaacaagttatt

SEQ ID NO: 358850 - DNA, 15 bp, Homo sapiens
atcaacaagttattt

SEQ ID NO: 358851 - DNA, 15 bp, Homo sapiens
tcaacaagttatttt

SEQ ID NO: 358852 - DNA, 15 bp, Homo sapiens
caacaagttattttt

SEQ ID NO: 358853 - DNA, 15 bp, Homo sapiens
aacaagttattttta

SEQ ID NO: 358854 - DNA, 15 bp, Homo sapiens
acaagttatttttac

SEQ ID NO: 358855 - DNA, 15 bp, Homo sapiens
caagttatttttact

SEQ ID NO: 358856 - DNA, 15 bp, Homo sapiens
aagttatttttactc

SEQ ID NO: 358857 - DNA, 15 bp, Homo sapiens
agttatttttactca

SEQ ID NO: 358858 - DNA, 15 bp, Homo sapiens
gttatttttactcac

SEQ ID NO: 358859 - DNA, 15 bp, Homo sapiens
ttatttttactcact

SEQ ID NO: 358860 - DNA, 15 bp, Homo sapiens
tatttttactcacta

SEQ ID NO: 358861 - DNA, 15 bp, Homo sapiens
atttttactcactaa

SEQ ID NO: 358862 - DNA, 15 bp, Homo sapiens
tttttactcactaaa

SEQ ID NO: 358863 - DNA, 15 bp, Homo sapiens
ttttactcactaaac

SEQ ID NO: 358864 - DNA, 15 bp, Homo sapiens
tttactcactaaaca

SEQ ID NO: 358865 - DNA, 15 bp, Homo sapiens
ttactcactaaacac

SEQ ID NO: 358866 - DNA, 15 bp, Homo sapiens
tactcactaaacaca

SEQ ID NO: 358867 - DNA, 15 bp, Homo sapiens
actcactaaacacag

SEQ ID NO: 358868 - DNA, 15 bp, Homo sapiens
ctcactaaacacagc

SEQ ID NO: 358869 - DNA, 15 bp, Homo sapiens
tcactaaacacagca

SEQ ID NO: 358870 - DNA, 15 bp, Homo sapiens
cactaaacacagcac

SEQ ID NO: 358871 - DNA, 15 bp, Homo sapiens
actaaacacagcact

SEQ ID NO: 358872 - DNA, 15 bp, Homo sapiens
ctaaacacagcactg

SEQ ID NO: 358873 - DNA, 15 bp, Homo sapiens
taaacacagcactga

SEQ ID NO: 358874 - DNA, 15 bp, Homo sapiens
aaacacagcactgac

SEQ ID NO: 358875 - DNA, 15 bp, Homo sapiens
aacacagcactgaca

SEQ ID NO: 358876 - DNA, 15 bp, Homo sapiens
acacagcactgacag

SEQ ID NO: 358877 - DNA, 15 bp, Homo sapiens
cacagcactgacagt

SEQ ID NO: 358878 - DNA, 15 bp, Homo sapiens
acagcactgacagtt

SEQ ID NO: 358879 - DNA, 15 bp, Homo sapiens
cagcactgacagttt

SEQ ID NO: 358880 - DNA, 15 bp, Homo sapiens
agcactgacagttta

SEQ ID NO: 358881 - DNA, 15 bp, Homo sapiens
gcactgacagtttat

SEQ ID NO: 358882 - DNA, 15 bp, Homo sapiens
cactgacagtttata

SEQ ID NO: 358883 - DNA, 15 bp, Homo sapiens
actgacagtttatag

SEQ ID NO: 358884 - DNA, 15 bp, Homo sapiens
ctgacagtttatagg

SEQ ID NO: 358885 - DNA, 15 bp, Homo sapiens
tgacagtttataggg

SEQ ID NO: 358886 - DNA, 15 bp, Homo sapiens
gacagtttatagggg

SEQ ID NO: 358887 - DNA, 15 bp, Homo sapiens
acagtttatagggga

SEQ ID NO: 358888 - DNA, 15 bp, Homo sapiens
cagtttataggggat

SEQ ID NO: 358889 - DNA, 15 bp, Homo sapiens
agtttataggggatt

SEQ ID NO: 358890 - DNA, 15 bp, Homo sapiens
gtttataggggattc

SEQ ID NO: 358891 - DNA, 15 bp, Homo sapiens
tttataggggattcc

SEQ ID NO: 358892 - DNA, 15 bp, Homo sapiens
ttataggggattcct

SEQ ID NO: 358893 - DNA, 15 bp, Homo sapiens
tataggggattcctg

SEQ ID NO: 358894 - DNA, 15 bp, Homo sapiens
ataggggattcctgt

SEQ ID NO: 358895 - DNA, 15 bp, Homo sapiens
taggggattcctgtc

SEQ ID NO: 358896 - DNA, 15 bp, Homo sapiens
aggggattcctgtct

SEQ ID NO: 358897 - DNA, 15 bp, Homo sapiens
ggggattcctgtctc

SEQ ID NO: 358898 - DNA, 15 bp, Homo sapiens
gggattcctgtctct

SEQ ID NO: 358899 - DNA, 15 bp, Homo sapiens
ggattcctgtctctt

SEQ ID NO: 358900 - DNA, 15 bp, Homo sapiens
gattcctgtctctta

SEQ ID NO: 358901 - DNA, 15 bp, Homo sapiens
attcctgtctcttac

SEQ ID NO: 358902 - DNA, 15 bp, Homo sapiens
ttcctgtctcttacc

SEQ ID NO: 358903 - DNA, 15 bp, Homo sapiens
tcctgtctcttacct

SEQ ID NO: 358904 - DNA, 15 bp, Homo sapiens
cctgtctcttacctt

SEQ ID NO: 358905 - DNA, 15 bp, Homo sapiens
ctgtctcttaccttc

SEQ ID NO: 358906 - DNA, 15 bp, Homo sapiens
tgtctcttaccttca

SEQ ID NO: 358907 - DNA, 15 bp, Homo sapiens
gtctcttaccttcag

SEQ ID NO: 358908 - DNA, 15 bp, Homo sapiens
tctcttaccttcaga

SEQ ID NO: 358909 - DNA, 15 bp, Homo sapiens
ctcttaccttcagat

SEQ ID NO: 358910 - DNA, 15 bp, Homo sapiens
tcttaccttcagatg

SEQ ID NO: 358911 - DNA, 15 bp, Homo sapiens
cttaccttcagatgc

SEQ ID NO: 358912 - DNA, 15 bp, Homo sapiens
ttaccttcagatgct

SEQ ID NO: 358913 - DNA, 15 bp, Homo sapiens
taccttcagatgcta

SEQ ID NO: 358914 - DNA, 15 bp, Homo sapiens
accttcagatgctag

SEQ ID NO: 358915 - DNA, 15 bp, Homo sapiens
ccttcagatgctaga

SEQ ID NO: 358916 - DNA, 15 bp, Homo sapiens
cttcagatgctagaa

SEQ ID NO: 358917 - DNA, 15 bp, Homo sapiens
ttcagatgctagaag

SEQ ID NO: 358918 - DNA, 15 bp, Homo sapiens
tcagatgctagaagt

SEQ ID NO: 358919 - DNA, 15 bp, Homo sapiens
cagatgctagaagtt

SEQ ID NO: 358920 - DNA, 15 bp, Homo sapiens
agatgctagaagtta

SEQ ID NO: 358921 - DNA, 15 bp, Homo sapiens
gatgctagaagttaa

SEQ ID NO: 358922 - DNA, 15 bp, Homo sapiens
atgctagaagttaag

SEQ ID NO: 358923 - DNA, 15 bp, Homo sapiens
tgctagaagttaaga

SEQ ID NO: 358924 - DNA, 15 bp, Homo sapiens
gctagaagttaagac

SEQ ID NO: 358925 - DNA, 15 bp, Homo sapiens
ctagaagttaagaca

SEQ ID NO: 358926 - DNA, 15 bp, Homo sapiens
tagaagttaagacag

SEQ ID NO: 358927 - DNA, 15 bp, Homo sapiens
agaagttaagacagt

SEQ ID NO: 358928 - DNA, 15 bp, Homo sapiens
gaagttaagacagtg

SEQ ID NO: 358929 - DNA, 15 bp, Homo sapiens
aagttaagacagtgg

SEQ ID NO: 358930 - DNA, 15 bp, Homo sapiens
agttaagacagtggt

SEQ ID NO: 358931 - DNA, 15 bp, Homo sapiens
gttaagacagtggtt

SEQ ID NO: 358932 - DNA, 15 bp, Homo sapiens
ttaagacagtggttg

SEQ ID NO: 358933 - DNA, 15 bp, Homo sapiens
taagacagtggttga

SEQ ID NO: 358934 - DNA, 15 bp, Homo sapiens
aagacagtggttgag

SEQ ID NO: 358935 - DNA, 15 bp, Homo sapiens
agacagtggttgagc

SEQ ID NO: 358936 - DNA, 15 bp, Homo sapiens
gacagtggttgagcc

SEQ ID NO: 358937 - DNA, 15 bp, Homo sapiens
acagtggttgagcca

SEQ ID NO: 358938 - DNA, 15 bp, Homo sapiens
cagtggttgagccat

SEQ ID NO: 358939 - DNA, 15 bp, Homo sapiens
agtggttgagccatg

SEQ ID NO: 358940 - DNA, 15 bp, Homo sapiens
gtggttgagccatgg

SEQ ID NO: 358941 - DNA, 15 bp, Homo sapiens
tggttgagccatggg

SEQ ID NO: 358942 - DNA, 15 bp, Homo sapiens
ggttgagccatggga

SEQ ID NO: 358943 - DNA, 15 bp, Homo sapiens
gttgagccatgggat

SEQ ID NO: 358944 - DNA, 15 bp, Homo sapiens
ttgagccatgggatc

SEQ ID NO: 358945 - DNA, 15 bp, Homo sapiens
tgagccatgggatct

SEQ ID NO: 358946 - DNA, 15 bp, Homo sapiens
gagccatgggatctt

SEQ ID NO: 358947 - DNA, 15 bp, Homo sapiens
agccatgggatcttg

SEQ ID NO: 358948 - DNA, 15 bp, Homo sapiens
gccatgggatcttgt

SEQ ID NO: 358949 - DNA, 15 bp, Homo sapiens
ccatgggatcttgtc

SEQ ID NO: 358950 - DNA, 15 bp, Homo sapiens
catgggatcttgtcg

SEQ ID NO: 358951 - DNA, 15 bp, Homo sapiens
atgggatcttgtcgt

SEQ ID NO: 358952 - DNA, 15 bp, Homo sapiens
tgggatcttgtcgta

SEQ ID NO: 358953 - DNA, 15 bp, Homo sapiens
gggatcttgtcgtag

SEQ ID NO: 358954 - DNA, 15 bp, Homo sapiens
ggatcttgtcgtagg

SEQ ID NO: 358955 - DNA, 15 bp, Homo sapiens
gatcttgtcgtagga

SEQ ID NO: 358956 - DNA, 15 bp, Homo sapiens
atcttgtcgtaggag

SEQ ID NO: 358957 - DNA, 15 bp, Homo sapiens
tcttgtcgtaggagc

SEQ ID NO: 358958 - DNA, 15 bp, Homo sapiens
cttgtcgtaggagct

SEQ ID NO: 358959 - DNA, 15 bp, Homo sapiens
ttgtcgtaggagctt

SEQ ID NO: 358960 - DNA, 15 bp, Homo sapiens
tgtcgtaggagcttg

SEQ ID NO: 358961 - DNA, 15 bp, Homo sapiens
gtcgtaggagcttgt

SEQ ID NO: 358962 - DNA, 15 bp, Homo sapiens
tcgtaggagcttgtc

SEQ ID NO: 358963 - DNA, 15 bp, Homo sapiens
cgtaggagcttgtct

SEQ ID NO: 358964 - DNA, 15 bp, Homo sapiens
gtaggagcttgtctt

SEQ ID NO: 358965 - DNA, 15 bp, Homo sapiens
taggagcttgtcttc

SEQ ID NO: 358966 - DNA, 15 bp, Homo sapiens
aggagcttgtcttca

SEQ ID NO: 358967 - DNA, 15 bp, Homo sapiens
ggagcttgtcttcaa

SEQ ID NO: 358968 - DNA, 15 bp, Homo sapiens
gagcttgtcttcaag

SEQ ID NO: 358969 - DNA, 15 bp, Homo sapiens
agcttgtcttcaagc

SEQ ID NO: 358970 - DNA, 15 bp, Homo sapiens
gcttgtcttcaagcc

SEQ ID NO: 358971 - DNA, 15 bp, Homo sapiens
cttgtcttcaagcct

SEQ ID NO: 358972 - DNA, 15 bp, Homo sapiens
ttgtcttcaagcctg

SEQ ID NO: 358973 - DNA, 15 bp, Homo sapiens
tgtcttcaagcctgg

SEQ ID NO: 358974 - DNA, 15 bp, Homo sapiens
gtcttcaagcctgga

SEQ ID NO: 358975 - DNA, 15 bp, Homo sapiens
tcttcaagcctggat

SEQ ID NO: 358976 - DNA, 15 bp, Homo sapiens
cttcaagcctggatt

SEQ ID NO: 358977 - DNA, 15 bp, Homo sapiens
ttcaagcctggattt

SEQ ID NO: 358978 - DNA, 15 bp, Homo sapiens
tcaagcctggatttg

SEQ ID NO: 358979 - DNA, 15 bp, Homo sapiens
caagcctggatttga

SEQ ID NO: 358980 - DNA, 15 bp, Homo sapiens
aagcctggatttgaa

SEQ ID NO: 358981 - DNA, 15 bp, Homo sapiens
agcctggatttgaac

SEQ ID NO: 358982 - DNA, 15 bp, Homo sapiens
gcctggatttgaact

SEQ ID NO: 358983 - DNA, 15 bp, Homo sapiens
cctggatttgaactc

SEQ ID NO: 358984 - DNA, 15 bp, Homo sapiens
ctggatttgaactcc

SEQ ID NO: 358985 - DNA, 15 bp, Homo sapiens
tggatttgaactcct

SEQ ID NO: 358986 - DNA, 15 bp, Homo sapiens
ggatttgaactcctt

SEQ ID NO: 358987 - DNA, 15 bp, Homo sapiens
gatttgaactccttg

SEQ ID NO: 358988 - DNA, 15 bp, Homo sapiens
atttgaactccttga

SEQ ID NO: 358989 - DNA, 15 bp, Homo sapiens
tttgaactccttgag

SEQ ID NO: 358990 - DNA, 15 bp, Homo sapiens
ttgaactccttgagg

SEQ ID NO: 358991 - DNA, 15 bp, Homo sapiens
tgaactccttgaggc

SEQ ID NO: 358992 - DNA, 15 bp, Homo sapiens
gaactccttgaggcc

SEQ ID NO: 358993 - DNA, 15 bp, Homo sapiens
aactccttgaggcca

SEQ ID NO: 358994 - DNA, 15 bp, Homo sapiens
actccttgaggccaa

SEQ ID NO: 358995 - DNA, 15 bp, Homo sapiens
ctccttgaggccaag

SEQ ID NO: 358996 - DNA, 15 bp, Homo sapiens
tccttgaggccaaga

SEQ ID NO: 358997 - DNA, 15 bp, Homo sapiens
ccttgaggccaagaa

SEQ ID NO: 358998 - DNA, 15 bp, Homo sapiens
cttgaggccaagaaa

SEQ ID NO: 358999 - DNA, 15 bp, Homo sapiens
ttgaggccaagaaat

SEQ ID NO: 359000 - DNA, 15 bp, Homo sapiens
tgaggccaagaaatg

SEQ ID NO: 359001 - DNA, 15 bp, Homo sapiens
gaggccaagaaatgt

SEQ ID NO: 359002 - DNA, 15 bp, Homo sapiens
aggccaagaaatgta

SEQ ID NO: 359003 - DNA, 15 bp, Homo sapiens
ggccaagaaatgtac

SEQ ID NO: 359004 - DNA, 15 bp, Homo sapiens
gccaagaaatgtacc

SEQ ID NO: 359005 - DNA, 15 bp, Homo sapiens
ccaagaaatgtaccc

SEQ ID NO: 359006 - DNA, 15 bp, Homo sapiens
caagaaatgtacccg

SEQ ID NO: 359007 - DNA, 15 bp, Homo sapiens
aagaaatgtacccga

SEQ ID NO: 359008 - DNA, 15 bp, Homo sapiens
agaaatgtacccgat

SEQ ID NO: 359009 - DNA, 15 bp, Homo sapiens
gaaatgtacccgatg

SEQ ID NO: 359010 - DNA, 15 bp, Homo sapiens
aaatgtacccgatgc

SEQ ID NO: 359011 - DNA, 15 bp, Homo sapiens
aatgtacccgatgct

SEQ ID NO: 359012 - DNA, 15 bp, Homo sapiens
atgtacccgatgctt

SEQ ID NO: 359013 - DNA, 15 bp, Homo sapiens
tgtacccgatgcttt

SEQ ID NO: 359014 - DNA, 15 bp, Homo sapiens
gtacccgatgctttg

SEQ ID NO: 359015 - DNA, 15 bp, Homo sapiens
tacccgatgctttgt

SEQ ID NO: 359016 - DNA, 15 bp, Homo sapiens
acccgatgctttgtt

SEQ ID NO: 359017 - DNA, 15 bp, Homo sapiens
cccgatgctttgtta

SEQ ID NO: 359018 - DNA, 15 bp, Homo sapiens
ccgatgctttgttat

SEQ ID NO: 359019 - DNA, 15 bp, Homo sapiens
cgatgctttgttatt

SEQ ID NO: 359020 - DNA, 15 bp, Homo sapiens
gatgctttgttattc

SEQ ID NO: 359021 - DNA, 15 bp, Homo sapiens
atgctttgttattcc

SEQ ID NO: 359022 - DNA, 15 bp, Homo sapiens
tgctttgttattcct

SEQ ID NO: 359023 - DNA, 15 bp, Homo sapiens
gctttgttattcctc

SEQ ID NO: 359024 - DNA, 15 bp, Homo sapiens
ctttgttattcctca

SEQ ID NO: 359025 - DNA, 15 bp, Homo sapiens
tttgttattcctcag

SEQ ID NO: 359026 - DNA, 15 bp, Homo sapiens
ttgttattcctcagt

SEQ ID NO: 359027 - DNA, 15 bp, Homo sapiens
tgttattcctcagtt

SEQ ID NO: 359028 - DNA, 15 bp, Homo sapiens
gttattcctcagttc

SEQ ID NO: 359029 - DNA, 15 bp, Homo sapiens
ttattcctcagttcc

SEQ ID NO: 359030 - DNA, 15 bp, Homo sapiens
tattcctcagttccc

SEQ ID NO: 359031 - DNA, 15 bp, Homo sapiens
attcctcagttccca

SEQ ID NO: 359032 - DNA, 15 bp, Homo sapiens
ttcctcagttcccag

SEQ ID NO: 359033 - DNA, 15 bp, Homo sapiens
tcctcagttcccagc

SEQ ID NO: 359034 - DNA, 15 bp, Homo sapiens
cctcagttcccagca

SEQ ID NO: 359035 - DNA, 15 bp, Homo sapiens
ctcagttcccagcac

SEQ ID NO: 359036 - DNA, 15 bp, Homo sapiens
tcagttcccagcaca

SEQ ID NO: 359037 - DNA, 15 bp, Homo sapiens
cagttcccagcacag

SEQ ID NO: 359038 - DNA, 15 bp, Homo sapiens
agttcccagcacagt

SEQ ID NO: 359039 - DNA, 15 bp, Homo sapiens
gttcccagcacagtg

SEQ ID NO: 359040 - DNA, 15 bp, Homo sapiens
ttcccagcacagtgt

SEQ ID NO: 359041 - DNA, 15 bp, Homo sapiens
tcccagcacagtgtg

SEQ ID NO: 359042 - DNA, 15 bp, Homo sapiens
cccagcacagtgtgt

SEQ ID NO: 359043 - DNA, 15 bp, Homo sapiens
ccagcacagtgtgta

SEQ ID NO: 359044 - DNA, 15 bp, Homo sapiens
cagcacagtgtgtag

SEQ ID NO: 359045 - DNA, 15 bp, Homo sapiens
agcacagtgtgtagc

SEQ ID NO: 359046 - DNA, 15 bp, Homo sapiens
gcacagtgtgtagca

SEQ ID NO: 359047 - DNA, 15 bp, Homo sapiens
cacagtgtgtagcac

SEQ ID NO: 359048 - DNA, 15 bp, Homo sapiens
acagtgtgtagcaca

SEQ ID NO: 359049 - DNA, 15 bp, Homo sapiens
cagtgtgtagcacat

SEQ ID NO: 359050 - DNA, 15 bp, Homo sapiens
agtgtgtagcacatg

SEQ ID NO: 359051 - DNA, 15 bp, Homo sapiens
gtgtgtagcacatgt

SEQ ID NO: 359052 - DNA, 15 bp, Homo sapiens
tgtgtagcacatgtt

SEQ ID NO: 359053 - DNA, 15 bp, Homo sapiens
gtgtagcacatgtta

SEQ ID NO: 359054 - DNA, 15 bp, Homo sapiens
tgtagcacatgttaa

SEQ ID NO: 359055 - DNA, 15 bp, Homo sapiens
gtagcacatgttaac

SEQ ID NO: 359056 - DNA, 15 bp, Homo sapiens
tagcacatgttaact

SEQ ID NO: 359057 - DNA, 15 bp, Homo sapiens
agcacatgttaactt

SEQ ID NO: 359058 - DNA, 15 bp, Homo sapiens
gcacatgttaactta

SEQ ID NO: 359059 - DNA, 15 bp, Homo sapiens
cacatgttaacttaa

SEQ ID NO: 359060 - DNA, 15 bp, Homo sapiens
acatgttaacttaat

SEQ ID NO: 359061 - DNA, 15 bp, Homo sapiens
catgttaacttaata

SEQ ID NO: 359062 - DNA, 15 bp, Homo sapiens
atgttaacttaataa

SEQ ID NO: 359063 - DNA, 15 bp, Homo sapiens
tgttaacttaataac

SEQ ID NO: 359064 - DNA, 15 bp, Homo sapiens
gttaacttaataacc

SEQ ID NO: 359065 - DNA, 15 bp, Homo sapiens
ttaacttaataaccg

SEQ ID NO: 359066 - DNA, 15 bp, Homo sapiens
taacttaataaccgt

SEQ ID NO: 359067 - DNA, 15 bp, Homo sapiens
aacttaataaccgtt

SEQ ID NO: 359068 - DNA, 15 bp, Homo sapiens
acttaataaccgttt

SEQ ID NO: 359069 - DNA, 15 bp, Homo sapiens
cttaataaccgtttc

SEQ ID NO: 359070 - DNA, 15 bp, Homo sapiens
ttaataaccgtttct

SEQ ID NO: 359071 - DNA, 15 bp, Homo sapiens
taataaccgtttctt

SEQ ID NO: 359072 - DNA, 15 bp, Homo sapiens
aataaccgtttctta

SEQ ID NO: 359073 - DNA, 15 bp, Homo sapiens
ataaccgtttcttaa

SEQ ID NO: 359074 - DNA, 15 bp, Homo sapiens
taaccgtttcttaaa

SEQ ID NO: 359075 - DNA, 15 bp, Homo sapiens
aaccgtttcttaaat

SEQ ID NO: 359076 - DNA, 15 bp, Homo sapiens
accgtttcttaaatg

SEQ ID NO: 359077 - DNA, 15 bp, Homo sapiens
ccgtttcttaaatga

SEQ ID NO: 359078 - DNA, 15 bp, Homo sapiens
cgtttcttaaatgaa

SEQ ID NO: 359079 - DNA, 15 bp, Homo sapiens
gtttcttaaatgaaa

SEQ ID NO: 359080 - DNA, 15 bp, Homo sapiens
tttcttaaatgaaat

SEQ ID NO: 359081 - DNA, 15 bp, Homo sapiens
ttcttaaatgaaata

SEQ ID NO: 359082 - DNA, 15 bp, Homo sapiens
tcttaaatgaaatac

SEQ ID NO: 359083 - DNA, 15 bp, Homo sapiens
cttaaatgaaataca

SEQ ID NO: 359084 - DNA, 15 bp, Homo sapiens
ttaaatgaaatacag

SEQ ID NO: 359085 - DNA, 15 bp, Homo sapiens
taaatgaaatacagt

SEQ ID NO: 359086 - DNA, 15 bp, Homo sapiens
aaatgaaatacagtg

SEQ ID NO: 359087 - DNA, 15 bp, Homo sapiens
aatgaaatacagtgc

SEQ ID NO: 359088 - DNA, 15 bp, Homo sapiens
atgaaatacagtgca

SEQ ID NO: 359089 - DNA, 15 bp, Homo sapiens
tgaaatacagtgcaa

SEQ ID NO: 359090 - DNA, 15 bp, Homo sapiens
gaaatacagtgcaaa

SEQ ID NO: 359091 - DNA, 15 bp, Homo sapiens
aaatacagtgcaaag

SEQ ID NO: 359092 - DNA, 15 bp, Homo sapiens
aatacagtgcaaaga

SEQ ID NO: 359093 - DNA, 15 bp, Homo sapiens
atacagtgcaaagag

SEQ ID NO: 359094 - DNA, 15 bp, Homo sapiens
tacagtgcaaagagg

SEQ ID NO: 359095 - DNA, 15 bp, Homo sapiens
acagtgcaaagaggg

SEQ ID NO: 359096 - DNA, 15 bp, Homo sapiens
cagtgcaaagagggt

SEQ ID NO: 359097 - DNA, 15 bp, Homo sapiens
agtgcaaagagggta

SEQ ID NO: 359098 - DNA, 15 bp, Homo sapiens
gtgcaaagagggtag

SEQ ID NO: 359099 - DNA, 15 bp, Homo sapiens
tgcaaagagggtagg

SEQ ID NO: 359100 - DNA, 15 bp, Homo sapiens
gcaaagagggtaggt

SEQ ID NO: 359101 - DNA, 15 bp, Homo sapiens
caaagagggtaggtt

SEQ ID NO: 359102 - DNA, 15 bp, Homo sapiens
aaagagggtaggttt

SEQ ID NO: 359103 - DNA, 15 bp, Homo sapiens
aagagggtaggtttg

SEQ ID NO: 359104 - DNA, 15 bp, Homo sapiens
agagggtaggtttgc

SEQ ID NO: 359105 - DNA, 15 bp, Homo sapiens
gagggtaggtttgct

SEQ ID NO: 359106 - DNA, 15 bp, Homo sapiens
agggtaggtttgctt

SEQ ID NO: 359107 - DNA, 15 bp, Homo sapiens
gggtaggtttgctta

SEQ ID NO: 359108 - DNA, 15 bp, Homo sapiens
ggtaggtttgcttaa

SEQ ID NO: 359109 - DNA, 15 bp, Homo sapiens
gtaggtttgcttaac

SEQ ID NO: 359110 - DNA, 15 bp, Homo sapiens
taggtttgcttaaca

SEQ ID NO: 359111 - DNA, 15 bp, Homo sapiens
aggtttgcttaacaa

SEQ ID NO: 359112 - DNA, 15 bp, Homo sapiens
ggtttgcttaacaaa

SEQ ID NO: 359113 - DNA, 15 bp, Homo sapiens
gtttgcttaacaaaa

SEQ ID NO: 359114 - DNA, 15 bp, Homo sapiens
tttgcttaacaaaaa

SEQ ID NO: 359115 - DNA, 15 bp, Homo sapiens
ttgcttaacaaaaaa

SEQ ID NO: 359116 - DNA, 15 bp, Homo sapiens
tgcttaacaaaaaag

SEQ ID NO: 359117 - DNA, 15 bp, Homo sapiens
gcttaacaaaaaaga

SEQ ID NO: 359118 - DNA, 15 bp, Homo sapiens
cttaacaaaaaagaa

SEQ ID NO: 359119 - DNA, 15 bp, Homo sapiens
ttaacaaaaaagaaa

SEQ ID NO: 359120 - DNA, 15 bp, Homo sapiens
aacaaaaaagaaaag

SEQ ID NO: 359121 - DNA, 15 bp, Homo sapiens
acaaaaaagaaaagg

SEQ ID NO: 359122 - DNA, 15 bp, Homo sapiens
caaaaaagaaaaggg

SEQ ID NO: 359123 - DNA, 15 bp, Homo sapiens
aaaaaagaaaaggga

SEQ ID NO: 359124 - DNA, 15 bp, Homo sapiens
aaaaagaaaagggaa

SEQ ID NO: 359125 - DNA, 15 bp, Homo sapiens
aaaagaaaagggaag

SEQ ID NO: 359126 - DNA, 15 bp, Homo sapiens
aaagaaaagggaagg

SEQ ID NO: 359127 - DNA, 15 bp, Homo sapiens
aagaaaagggaaggg

SEQ ID NO: 359128 - DNA, 15 bp, Homo sapiens
agaaaagggaagggg

SEQ ID NO: 359129 - DNA, 15 bp, Homo sapiens
gaaaagggaaggggg

SEQ ID NO: 359130 - DNA, 15 bp, Homo sapiens
aaaagggaagggggt

SEQ ID NO: 359131 - DNA, 15 bp, Homo sapiens
aaagggaagggggta

SEQ ID NO: 359132 - DNA, 15 bp, Homo sapiens
aagggaagggggtag

SEQ ID NO: 359133 - DNA, 15 bp, Homo sapiens
agggaagggggtaga

SEQ ID NO: 359134 - DNA, 15 bp, Homo sapiens
gggaagggggtagat

SEQ ID NO: 359135 - DNA, 15 bp, Homo sapiens
ggaagggggtagata

SEQ ID NO: 359136 - DNA, 15 bp, Homo sapiens
gaagggggtagatag

SEQ ID NO: 359137 - DNA, 15 bp, Homo sapiens
aagggggtagatagg

SEQ ID NO: 359138 - DNA, 15 bp, Homo sapiens
agggggtagataggc

SEQ ID NO: 359139 - DNA, 15 bp, Homo sapiens
gggggtagataggct

SEQ ID NO: 359140 - DNA, 15 bp, Homo sapiens
ggggtagataggctt

SEQ ID NO: 359141 - DNA, 15 bp, Homo sapiens
gggtagataggcttt

SEQ ID NO: 359142 - DNA, 15 bp, Homo sapiens
ggtagataggctttt

SEQ ID NO: 359143 - DNA, 15 bp, Homo sapiens
gtagataggctttta

SEQ ID NO: 359144 - DNA, 15 bp, Homo sapiens
tagataggcttttaa

SEQ ID NO: 359145 - DNA, 15 bp, Homo sapiens
agataggcttttaaa

SEQ ID NO: 359146 - DNA, 15 bp, Homo sapiens
gataggcttttaaaa

SEQ ID NO: 359147 - DNA, 15 bp, Homo sapiens
ataggcttttaaaaa

SEQ ID NO: 359148 - DNA, 15 bp, Homo sapiens
taggcttttaaaaat

SEQ ID NO: 359149 - DNA, 15 bp, Homo sapiens
aggcttttaaaaatg

SEQ ID NO: 359150 - DNA, 15 bp, Homo sapiens
ggcttttaaaaatgt

SEQ ID NO: 359151 - DNA, 15 bp, Homo sapiens
gcttttaaaaatgtc

SEQ ID NO: 359152 - DNA, 15 bp, Homo sapiens
cttttaaaaatgtca

SEQ ID NO: 359153 - DNA, 15 bp, Homo sapiens
ttttaaaaatgtcat

SEQ ID NO: 359154 - DNA, 15 bp, Homo sapiens
tttaaaaatgtcatg

SEQ ID NO: 359155 - DNA, 15 bp, Homo sapiens
ttaaaaatgtcatgg

SEQ ID NO: 359156 - DNA, 15 bp, Homo sapiens
taaaaatgtcatggt

SEQ ID NO: 359157 - DNA, 15 bp, Homo sapiens
aaaaatgtcatggta

SEQ ID NO: 359158 - DNA, 15 bp, Homo sapiens
aaaatgtcatggtac

SEQ ID NO: 359159 - DNA, 15 bp, Homo sapiens
aaatgtcatggtacc

SEQ ID NO: 359160 - DNA, 15 bp, Homo sapiens
aatgtcatggtacca

SEQ ID NO: 359161 - DNA, 15 bp, Homo sapiens
atgtcatggtaccat

SEQ ID NO: 359162 - DNA, 15 bp, Homo sapiens
tgtcatggtaccatg

SEQ ID NO: 359163 - DNA, 15 bp, Homo sapiens
gtcatggtaccatgt

SEQ ID NO: 359164 - DNA, 15 bp, Homo sapiens
tcatggtaccatgtg

SEQ ID NO: 359165 - DNA, 15 bp, Homo sapiens
catggtaccatgtgg

SEQ ID NO: 359166 - DNA, 15 bp, Homo sapiens
atggtaccatgtggg

SEQ ID NO: 359167 - DNA, 15 bp, Homo sapiens
tggtaccatgtggga

SEQ ID NO: 359168 - DNA, 15 bp, Homo sapiens
ggtaccatgtgggaa

SEQ ID NO: 359169 - DNA, 15 bp, Homo sapiens
gtaccatgtgggaac

SEQ ID NO: 359170 - DNA, 15 bp, Homo sapiens
taccatgtgggaact

SEQ ID NO: 359171 - DNA, 15 bp, Homo sapiens
accatgtgggaactg

SEQ ID NO: 359172 - DNA, 15 bp, Homo sapiens
ccatgtgggaactga

SEQ ID NO: 359173 - DNA, 15 bp, Homo sapiens
catgtgggaactgag

SEQ ID NO: 359174 - DNA, 15 bp, Homo sapiens
atgtgggaactgagt

SEQ ID NO: 359175 - DNA, 15 bp, Homo sapiens
tgtgggaactgagtg

SEQ ID NO: 359176 - DNA, 15 bp, Homo sapiens
gtgggaactgagtgg

SEQ ID NO: 359177 - DNA, 15 bp, Homo sapiens
tgggaactgagtgga

SEQ ID NO: 359178 - DNA, 15 bp, Homo sapiens
gggaactgagtggac

SEQ ID NO: 359179 - DNA, 15 bp, Homo sapiens
ggaactgagtggaca

SEQ ID NO: 359180 - DNA, 15 bp, Homo sapiens
gaactgagtggacaa

SEQ ID NO: 359181 - DNA, 15 bp, Homo sapiens
aactgagtggacaac

SEQ ID NO: 359182 - DNA, 15 bp, Homo sapiens
actgagtggacaact

SEQ ID NO: 359183 - DNA, 15 bp, Homo sapiens
ctgagtggacaactg

SEQ ID NO: 359184 - DNA, 15 bp, Homo sapiens
tgagtggacaactgg

SEQ ID NO: 359185 - DNA, 15 bp, Homo sapiens
gagtggacaactgga

SEQ ID NO: 359186 - DNA, 15 bp, Homo sapiens
agtggacaactggat

SEQ ID NO: 359187 - DNA, 15 bp, Homo sapiens
gtggacaactggatt

SEQ ID NO: 359188 - DNA, 15 bp, Homo sapiens
tggacaactggatta

SEQ ID NO: 359189 - DNA, 15 bp, Homo sapiens
ggacaactggattaa

SEQ ID NO: 359190 - DNA, 15 bp, Homo sapiens
gacaactggattaaa

SEQ ID NO: 359191 - DNA, 15 bp, Homo sapiens
acaactggattaaag

SEQ ID NO: 359192 - DNA, 15 bp, Homo sapiens
caactggattaaagg

SEQ ID NO: 359193 - DNA, 15 bp, Homo sapiens
aactggattaaaggt

SEQ ID NO: 359194 - DNA, 15 bp, Homo sapiens
actggattaaaggtc

SEQ ID NO: 359195 - DNA, 15 bp, Homo sapiens
ctggattaaaggtca

SEQ ID NO: 359196 - DNA, 15 bp, Homo sapiens
tggattaaaggtcag

SEQ ID NO: 359197 - DNA, 15 bp, Homo sapiens
ggattaaaggtcaga

SEQ ID NO: 359198 - DNA, 15 bp, Homo sapiens
gattaaaggtcagaa

SEQ ID NO: 359199 - DNA, 15 bp, Homo sapiens
attaaaggtcagaaa

SEQ ID NO: 359200 - DNA, 15 bp, Homo sapiens
ttaaaggtcagaaat

SEQ ID NO: 359201 - DNA, 15 bp, Homo sapiens
taaaggtcagaaatg

SEQ ID NO: 359202 - DNA, 15 bp, Homo sapiens
aaaggtcagaaatga

SEQ ID NO: 359203 - DNA, 15 bp, Homo sapiens
aaggtcagaaatgag

SEQ ID NO: 359204 - DNA, 15 bp, Homo sapiens
aggtcagaaatgagt

SEQ ID NO: 359205 - DNA, 15 bp, Homo sapiens
ggtcagaaatgagta

SEQ ID NO: 359206 - DNA, 15 bp, Homo sapiens
gtcagaaatgagtaa

SEQ ID NO: 359207 - DNA, 15 bp, Homo sapiens
tcagaaatgagtaaa

SEQ ID NO: 359208 - DNA, 15 bp, Homo sapiens
cagaaatgagtaaaa

SEQ ID NO: 359209 - DNA, 15 bp, Homo sapiens
agaaatgagtaaaat

SEQ ID NO: 359210 - DNA, 15 bp, Homo sapiens
gaaatgagtaaaatg

SEQ ID NO: 359211 - DNA, 15 bp, Homo sapiens
aaatgagtaaaatgt

SEQ ID NO: 359212 - DNA, 15 bp, Homo sapiens
aatgagtaaaatgtg

SEQ ID NO: 359213 - DNA, 15 bp, Homo sapiens
atgagtaaaatgtgg

SEQ ID NO: 359214 - DNA, 15 bp, Homo sapiens
tgagtaaaatgtggc

SEQ ID NO: 359215 - DNA, 15 bp, Homo sapiens
gagtaaaatgtggca

SEQ ID NO: 359216 - DNA, 15 bp, Homo sapiens
agtaaaatgtggcac

SEQ ID NO: 359217 - DNA, 15 bp, Homo sapiens
gtaaaatgtggcact

SEQ ID NO: 359218 - DNA, 15 bp, Homo sapiens
taaaatgtggcactt

SEQ ID NO: 359219 - DNA, 15 bp, Homo sapiens
aaaatgtggcactta

SEQ ID NO: 359220 - DNA, 15 bp, Homo sapiens
aaatgtggcacttac

SEQ ID NO: 359221 - DNA, 15 bp, Homo sapiens
aatgtggcacttaca

SEQ ID NO: 359222 - DNA, 15 bp, Homo sapiens
atgtggcacttacat

SEQ ID NO: 359223 - DNA, 15 bp, Homo sapiens
tgtggcacttacatt

SEQ ID NO: 359224 - DNA, 15 bp, Homo sapiens
gtggcacttacattc

SEQ ID NO: 359225 - DNA, 15 bp, Homo sapiens
tggcacttacattcc

SEQ ID NO: 359226 - DNA, 15 bp, Homo sapiens
ggcacttacattcca

SEQ ID NO: 359227 - DNA, 15 bp, Homo sapiens
gcacttacattccag

SEQ ID NO: 359228 - DNA, 15 bp, Homo sapiens
cacttacattccagg

SEQ ID NO: 359229 - DNA, 15 bp, Homo sapiens
acttacattccagga

SEQ ID NO: 359230 - DNA, 15 bp, Homo sapiens
cttacattccaggag

SEQ ID NO: 359231 - DNA, 15 bp, Homo sapiens
ttacattccaggaga

SEQ ID NO: 359232 - DNA, 15 bp, Homo sapiens
tacattccaggagac

SEQ ID NO: 359233 - DNA, 15 bp, Homo sapiens
acattccaggagacg

SEQ ID NO: 359234 - DNA, 15 bp, Homo sapiens
cattccaggagacgg

SEQ ID NO: 359235 - DNA, 15 bp, Homo sapiens
attccaggagacgga

SEQ ID NO: 359236 - DNA, 15 bp, Homo sapiens
ttccaggagacggat

SEQ ID NO: 359237 - DNA, 15 bp, Homo sapiens
tccaggagacggatg

SEQ ID NO: 359238 - DNA, 15 bp, Homo sapiens
ccaggagacggatgc

SEQ ID NO: 359239 - DNA, 15 bp, Homo sapiens
caggagacggatgct

SEQ ID NO: 359240 - DNA, 15 bp, Homo sapiens
aggagacggatgctc

SEQ ID NO: 359241 - DNA, 15 bp, Homo sapiens
ggagacggatgctct

SEQ ID NO: 359242 - DNA, 15 bp, Homo sapiens
gagacggatgctctg

SEQ ID NO: 359243 - DNA, 15 bp, Homo sapiens
agacggatgctctgc

SEQ ID NO: 359244 - DNA, 15 bp, Homo sapiens
gacggatgctctgct

SEQ ID NO: 359245 - DNA, 15 bp, Homo sapiens
acggatgctctgcta

SEQ ID NO: 359246 - DNA, 15 bp, Homo sapiens
cggatgctctgctag

SEQ ID NO: 359247 - DNA, 15 bp, Homo sapiens
ggatgctctgctaga

SEQ ID NO: 359248 - DNA, 15 bp, Homo sapiens
gatgctctgctagag

SEQ ID NO: 359249 - DNA, 15 bp, Homo sapiens
atgctctgctagaga

SEQ ID NO: 359250 - DNA, 15 bp, Homo sapiens
tgctctgctagagaa

SEQ ID NO: 359251 - DNA, 15 bp, Homo sapiens
gctctgctagagaaa

SEQ ID NO: 359252 - DNA, 15 bp, Homo sapiens
ctctgctagagaaaa

SEQ ID NO: 359253 - DNA, 15 bp, Homo sapiens
tctgctagagaaaag

SEQ ID NO: 359254 - DNA, 15 bp, Homo sapiens
ctgctagagaaaaga

SEQ ID NO: 359255 - DNA, 15 bp, Homo sapiens
tgctagagaaaagat

SEQ ID NO: 359256 - DNA, 15 bp, Homo sapiens
gctagagaaaagatg

SEQ ID NO: 359257 - DNA, 15 bp, Homo sapiens
ctagagaaaagatgt

SEQ ID NO: 359258 - DNA, 15 bp, Homo sapiens
tagagaaaagatgtc

SEQ ID NO: 359259 - DNA, 15 bp, Homo sapiens
agagaaaagatgtca

SEQ ID NO: 359260 - DNA, 15 bp, Homo sapiens
gagaaaagatgtcac

SEQ ID NO: 359261 - DNA, 15 bp, Homo sapiens
agaaaagatgtcact

SEQ ID NO: 359262 - DNA, 15 bp, Homo sapiens
gaaaagatgtcactt

SEQ ID NO: 359263 - DNA, 15 bp, Homo sapiens
aaaagatgtcacttc

SEQ ID NO: 359264 - DNA, 15 bp, Homo sapiens
aaagatgtcacttct

SEQ ID NO: 359265 - DNA, 15 bp, Homo sapiens
aagatgtcacttctc

SEQ ID NO: 359266 - DNA, 15 bp, Homo sapiens
agatgtcacttctca

SEQ ID NO: 359267 - DNA, 15 bp, Homo sapiens
gatgtcacttctcaa

SEQ ID NO: 359268 - DNA, 15 bp, Homo sapiens
atgtcacttctcaaa

SEQ ID NO: 359269 - DNA, 15 bp, Homo sapiens
tgtcacttctcaaat

SEQ ID NO: 359270 - DNA, 15 bp, Homo sapiens
gtcacttctcaaata

SEQ ID NO: 359271 - DNA, 15 bp, Homo sapiens
tcacttctcaaatat

SEQ ID NO: 359272 - DNA, 15 bp, Homo sapiens
cacttctcaaatata

SEQ ID NO: 359273 - DNA, 15 bp, Homo sapiens
acttctcaaatatag

SEQ ID NO: 359274 - DNA, 15 bp, Homo sapiens
cttctcaaatatagc

SEQ ID NO: 359275 - DNA, 15 bp, Homo sapiens
ttctcaaatatagca

SEQ ID NO: 359276 - DNA, 15 bp, Homo sapiens
tctcaaatatagcag

SEQ ID NO: 359277 - DNA, 15 bp, Homo sapiens
ctcaaatatagcaga

SEQ ID NO: 359278 - DNA, 15 bp, Homo sapiens
tcaaatatagcagag

SEQ ID NO: 359279 - DNA, 15 bp, Homo sapiens
caaatatagcagagt

SEQ ID NO: 359280 - DNA, 15 bp, Homo sapiens
aaatatagcagagtg

SEQ ID NO: 359281 - DNA, 15 bp, Homo sapiens
aatatagcagagtga

SEQ ID NO: 359282 - DNA, 15 bp, Homo sapiens
atatagcagagtgag

SEQ ID NO: 359283 - DNA, 15 bp, Homo sapiens
tatagcagagtgaga

SEQ ID NO: 359284 - DNA, 15 bp, Homo sapiens
atagcagagtgagag

SEQ ID NO: 359285 - DNA, 15 bp, Homo sapiens
tagcagagtgagaga

SEQ ID NO: 359286 - DNA, 15 bp, Homo sapiens
agcagagtgagagac

SEQ ID NO: 359287 - DNA, 15 bp, Homo sapiens
gcagagtgagagaca

SEQ ID NO: 359288 - DNA, 15 bp, Homo sapiens
cagagtgagagacag

SEQ ID NO: 359289 - DNA, 15 bp, Homo sapiens
agagtgagagacaga

SEQ ID NO: 359290 - DNA, 15 bp, Homo sapiens
gagtgagagacagag

SEQ ID NO: 359291 - DNA, 15 bp, Homo sapiens
agtgagagacagagt

SEQ ID NO: 359292 - DNA, 15 bp, Homo sapiens
gtgagagacagagtg

SEQ ID NO: 359293 - DNA, 15 bp, Homo sapiens
tgagagacagagtga

SEQ ID NO: 359294 - DNA, 15 bp, Homo sapiens
gagagacagagtgaa

SEQ ID NO: 359295 - DNA, 15 bp, Homo sapiens
agagacagagtgaat

SEQ ID NO: 359296 - DNA, 15 bp, Homo sapiens
gagacagagtgaatg

SEQ ID NO: 359297 - DNA, 15 bp, Homo sapiens
agacagagtgaatga

SEQ ID NO: 359298 - DNA, 15 bp, Homo sapiens
gacagagtgaatgaa

SEQ ID NO: 359299 - DNA, 15 bp, Homo sapiens
acagagtgaatgaaa

SEQ ID NO: 359300 - DNA, 15 bp, Homo sapiens
cagagtgaatgaaaa

SEQ ID NO: 359301 - DNA, 15 bp, Homo sapiens
agagtgaatgaaaaa

SEQ ID NO: 359302 - DNA, 15 bp, Homo sapiens
gagtgaatgaaaaat

SEQ ID NO: 359303 - DNA, 15 bp, Homo sapiens
agtgaatgaaaaata

SEQ ID NO: 359304 - DNA, 15 bp, Homo sapiens
gtgaatgaaaaatat

SEQ ID NO: 359305 - DNA, 15 bp, Homo sapiens
tgaatgaaaaatatg

SEQ ID NO: 359306 - DNA, 15 bp, Homo sapiens
gaatgaaaaatatga

SEQ ID NO: 359307 - DNA, 15 bp, Homo sapiens
aatgaaaaatatgaa

SEQ ID NO: 359308 - DNA, 15 bp, Homo sapiens
atgaaaaatatgaaa

SEQ ID NO: 359309 - DNA, 15 bp, Homo sapiens
tgaaaaatatgaaaa

SEQ ID NO: 359310 - DNA, 15 bp, Homo sapiens
gaaaaatatgaaaag

SEQ ID NO: 359311 - DNA, 15 bp, Homo sapiens
aaaaatatgaaaagc

SEQ ID NO: 359312 - DNA, 15 bp, Homo sapiens
aaaatatgaaaagct

SEQ ID NO: 359313 - DNA, 15 bp, Homo sapiens
aaatatgaaaagctt

SEQ ID NO: 359314 - DNA, 15 bp, Homo sapiens
aatatgaaaagctta

SEQ ID NO: 359315 - DNA, 15 bp, Homo sapiens
atatgaaaagcttaa

SEQ ID NO: 359316 - DNA, 15 bp, Homo sapiens
tatgaaaagcttaat

SEQ ID NO: 359317 - DNA, 15 bp, Homo sapiens
atgaaaagcttaatt

SEQ ID NO: 359318 - DNA, 15 bp, Homo sapiens
tgaaaagcttaattt

SEQ ID NO: 359319 - DNA, 15 bp, Homo sapiens
gaaaagcttaatttt

SEQ ID NO: 359320 - DNA, 15 bp, Homo sapiens
aaaagcttaattttt

SEQ ID NO: 359321 - DNA, 15 bp, Homo sapiens
aaagcttaatttttt

SEQ ID NO: 359322 - DNA, 15 bp, Homo sapiens
aagcttaattttttt

SEQ ID NO: 359323 - DNA, 15 bp, Homo sapiens
agcttaatttttttc

SEQ ID NO: 359324 - DNA, 15 bp, Homo sapiens
gcttaatttttttcc

SEQ ID NO: 359325 - DNA, 15 bp, Homo sapiens
cttaatttttttcct

SEQ ID NO: 359326 - DNA, 15 bp, Homo sapiens
ttaatttttttccta

SEQ ID NO: 359327 - DNA, 15 bp, Homo sapiens
taatttttttcctaa

SEQ ID NO: 359328 - DNA, 15 bp, Homo sapiens
aatttttttcctaat

SEQ ID NO: 359329 - DNA, 15 bp, Homo sapiens
atttttttcctaatg

SEQ ID NO: 359330 - DNA, 15 bp, Homo sapiens
tttttttcctaatgt

SEQ ID NO: 359331 - DNA, 15 bp, Homo sapiens
ttttttcctaatgta

SEQ ID NO: 359332 - DNA, 15 bp, Homo sapiens
tttttcctaatgtaa

SEQ ID NO: 359333 - DNA, 15 bp, Homo sapiens
ttttcctaatgtaag

SEQ ID NO: 359334 - DNA, 15 bp, Homo sapiens
tttcctaatgtaaga

SEQ ID NO: 359335 - DNA, 15 bp, Homo sapiens
ttcctaatgtaagag

SEQ ID NO: 359336 - DNA, 15 bp, Homo sapiens
tcctaatgtaagagt

SEQ ID NO: 359337 - DNA, 15 bp, Homo sapiens
cctaatgtaagagtg

SEQ ID NO: 359338 - DNA, 15 bp, Homo sapiens
ctaatgtaagagtga

SEQ ID NO: 359339 - DNA, 15 bp, Homo sapiens
taatgtaagagtgaa

SEQ ID NO: 359340 - DNA, 15 bp, Homo sapiens
aatgtaagagtgaat

SEQ ID NO: 359341 - DNA, 15 bp, Homo sapiens
atgtaagagtgaata

SEQ ID NO: 359342 - DNA, 15 bp, Homo sapiens
tgtaagagtgaatac

SEQ ID NO: 359343 - DNA, 15 bp, Homo sapiens
gtaagagtgaatacg

SEQ ID NO: 359344 - DNA, 15 bp, Homo sapiens
taagagtgaatacgt

SEQ ID NO: 359345 - DNA, 15 bp, Homo sapiens
aagagtgaatacgta

SEQ ID NO: 359346 - DNA, 15 bp, Homo sapiens
agagtgaatacgtat

SEQ ID NO: 359347 - DNA, 15 bp, Homo sapiens
gagtgaatacgtata

SEQ ID NO: 359348 - DNA, 15 bp, Homo sapiens
agtgaatacgtatat

SEQ ID NO: 359349 - DNA, 15 bp, Homo sapiens
gtgaatacgtatata

SEQ ID NO: 359350 - DNA, 15 bp, Homo sapiens
tgaatacgtatatat

SEQ ID NO: 359351 - DNA, 15 bp, Homo sapiens
gaatacgtatatatt

SEQ ID NO: 359352 - DNA, 15 bp, Homo sapiens
aatacgtatatattc

SEQ ID NO: 359353 - DNA, 15 bp, Homo sapiens
atacgtatatattct

SEQ ID NO: 359354 - DNA, 15 bp, Homo sapiens
tacgtatatattctt

SEQ ID NO: 359355 - DNA, 15 bp, Homo sapiens
acgtatatattcttg

SEQ ID NO: 359356 - DNA, 15 bp, Homo sapiens
cgtatatattcttga

SEQ ID NO: 359357 - DNA, 15 bp, Homo sapiens
gtatatattcttgaa

SEQ ID NO: 359358 - DNA, 15 bp, Homo sapiens
tatatattcttgaaa

SEQ ID NO: 359359 - DNA, 15 bp, Homo sapiens
atatattcttgaaat

SEQ ID NO: 359360 - DNA, 15 bp, Homo sapiens
tatattcttgaaata

SEQ ID NO: 359361 - DNA, 15 bp, Homo sapiens
atattcttgaaatat

SEQ ID NO: 359362 - DNA, 15 bp, Homo sapiens
tattcttgaaatatg

SEQ ID NO: 359363 - DNA, 15 bp, Homo sapiens
attcttgaaatatgg

SEQ ID NO: 359364 - DNA, 15 bp, Homo sapiens
ttcttgaaatatgga

SEQ ID NO: 359365 - DNA, 15 bp, Homo sapiens
tcttgaaatatggaa

SEQ ID NO: 359366 - DNA, 15 bp, Homo sapiens
cttgaaatatggaaa

SEQ ID NO: 359367 - DNA, 15 bp, Homo sapiens
ttgaaatatggaaaa

SEQ ID NO: 359368 - DNA, 15 bp, Homo sapiens
tgaaatatggaaaat

SEQ ID NO: 359369 - DNA, 15 bp, Homo sapiens
gaaatatggaaaata

SEQ ID NO: 359370 - DNA, 15 bp, Homo sapiens
aaatatggaaaataa

SEQ ID NO: 359371 - DNA, 15 bp, Homo sapiens
aatatggaaaataaa

SEQ ID NO: 359372 - DNA, 15 bp, Homo sapiens
atatggaaaataaag

SEQ ID NO: 359373 - DNA, 15 bp, Homo sapiens
tatggaaaataaaga

SEQ ID NO: 359374 - DNA, 15 bp, Homo sapiens
atggaaaataaagaa

SEQ ID NO: 359375 - DNA, 15 bp, Homo sapiens
tggaaaataaagaaa

SEQ ID NO: 359376 - DNA, 15 bp, Homo sapiens
ggaaaataaagaaaa

SEQ ID NO: 359377 - DNA, 15 bp, Homo sapiens
gaaaataaagaaaag

SEQ ID NO: 359378 - DNA, 15 bp, Homo sapiens
aaaataaagaaaagt

SEQ ID NO: 359379 - DNA, 15 bp, Homo sapiens
aaataaagaaaagta

SEQ ID NO: 359380 - DNA, 15 bp, Homo sapiens
aataaagaaaagtat

SEQ ID NO: 359381 - DNA, 15 bp, Homo sapiens
ataaagaaaagtata

SEQ ID NO: 359382 - DNA, 15 bp, Homo sapiens
taaagaaaagtataa

SEQ ID NO: 359383 - DNA, 15 bp, Homo sapiens
aaagaaaagtataaa

SEQ ID NO: 359384 - DNA, 15 bp, Homo sapiens
aagaaaagtataaag

SEQ ID NO: 359385 - DNA, 15 bp, Homo sapiens
agaaaagtataaagc

SEQ ID NO: 359386 - DNA, 15 bp, Homo sapiens
gaaaagtataaagca

SEQ ID NO: 359387 - DNA, 15 bp, Homo sapiens
aaaagtataaagcaa

SEQ ID NO: 359388 - DNA, 15 bp, Homo sapiens
aaagtataaagcaaa

SEQ ID NO: 359389 - DNA, 15 bp, Homo sapiens
aagtataaagcaaac

SEQ ID NO: 359390 - DNA, 15 bp, Homo sapiens
agtataaagcaaact

SEQ ID NO: 359391 - DNA, 15 bp, Homo sapiens
gtataaagcaaactc

SEQ ID NO: 359392 - DNA, 15 bp, Homo sapiens
tataaagcaaactct

SEQ ID NO: 359393 - DNA, 15 bp, Homo sapiens
ataaagcaaactcta

SEQ ID NO: 359394 - DNA, 15 bp, Homo sapiens
taaagcaaactctaa

SEQ ID NO: 359395 - DNA, 15 bp, Homo sapiens
aaagcaaactctaag

SEQ ID NO: 359396 - DNA, 15 bp, Homo sapiens
aagcaaactctaaga

SEQ ID NO: 359397 - DNA, 15 bp, Homo sapiens
agcaaactctaagat

SEQ ID NO: 359398 - DNA, 15 bp, Homo sapiens
gcaaactctaagata

SEQ ID NO: 359399 - DNA, 15 bp, Homo sapiens
caaactctaagataa

SEQ ID NO: 359400 - DNA, 15 bp, Homo sapiens
aaactctaagataaa

SEQ ID NO: 359401 - DNA, 15 bp, Homo sapiens
aactctaagataaac

SEQ ID NO: 359402 - DNA, 15 bp, Homo sapiens
actctaagataaaca

SEQ ID NO: 359403 - DNA, 15 bp, Homo sapiens
ctctaagataaacat

SEQ ID NO: 359404 - DNA, 15 bp, Homo sapiens
tctaagataaacatt

SEQ ID NO: 359405 - DNA, 15 bp, Homo sapiens
ctaagataaacattt

SEQ ID NO: 359406 - DNA, 15 bp, Homo sapiens
taagataaacatttt

SEQ ID NO: 359407 - DNA, 15 bp, Homo sapiens
aagataaacatttta

SEQ ID NO: 359408 - DNA, 15 bp, Homo sapiens
agataaacattttaa

SEQ ID NO: 359409 - DNA, 15 bp, Homo sapiens
gataaacattttaaa

SEQ ID NO: 359410 - DNA, 15 bp, Homo sapiens
ataaacattttaaaa

SEQ ID NO: 359411 - DNA, 15 bp, Homo sapiens
taaacattttaaaac

SEQ ID NO: 359412 - DNA, 15 bp, Homo sapiens
aaacattttaaaaca

SEQ ID NO: 359413 - DNA, 15 bp, Homo sapiens
aacattttaaaacag

SEQ ID NO: 359414 - DNA, 15 bp, Homo sapiens
acattttaaaacagt

SEQ ID NO: 359415 - DNA, 15 bp, Homo sapiens
cattttaaaacagtt

SEQ ID NO: 359416 - DNA, 15 bp, Homo sapiens
attttaaaacagttt

SEQ ID NO: 359417 - DNA, 15 bp, Homo sapiens
ttttaaaacagtttg

SEQ ID NO: 359418 - DNA, 15 bp, Homo sapiens
tttaaaacagtttgt

SEQ ID NO: 359419 - DNA, 15 bp, Homo sapiens
ttaaaacagtttgta

SEQ ID NO: 359420 - DNA, 15 bp, Homo sapiens
taaaacagtttgtag

SEQ ID NO: 359421 - DNA, 15 bp, Homo sapiens
aaaacagtttgtaga

SEQ ID NO: 359422 - DNA, 15 bp, Homo sapiens
aaacagtttgtagat

SEQ ID NO: 359423 - DNA, 15 bp, Homo sapiens
aacagtttgtagatt

SEQ ID NO: 359424 - DNA, 15 bp, Homo sapiens
acagtttgtagattt

SEQ ID NO: 359425 - DNA, 15 bp, Homo sapiens
cagtttgtagatttc

SEQ ID NO: 359426 - DNA, 15 bp, Homo sapiens
agtttgtagatttct

SEQ ID NO: 359427 - DNA, 15 bp, Homo sapiens
gtttgtagatttctt

SEQ ID NO: 359428 - DNA, 15 bp, Homo sapiens
tttgtagatttcttc

SEQ ID NO: 359429 - DNA, 15 bp, Homo sapiens
ttgtagatttcttcc

SEQ ID NO: 359430 - DNA, 15 bp, Homo sapiens
tgtagatttcttcct

SEQ ID NO: 359431 - DNA, 15 bp, Homo sapiens
gtagatttcttccta

SEQ ID NO: 359432 - DNA, 15 bp, Homo sapiens
tagatttcttcctaa

SEQ ID NO: 359433 - DNA, 15 bp, Homo sapiens
agatttcttcctaat

SEQ ID NO: 359434 - DNA, 15 bp, Homo sapiens
gatttcttcctaatt

SEQ ID NO: 359435 - DNA, 15 bp, Homo sapiens
atttcttcctaatta

SEQ ID NO: 359436 - DNA, 15 bp, Homo sapiens
tttcttcctaattat

SEQ ID NO: 359437 - DNA, 15 bp, Homo sapiens
ttcttcctaattatt

SEQ ID NO: 359438 - DNA, 15 bp, Homo sapiens
tcttcctaattatta

SEQ ID NO: 359439 - DNA, 15 bp, Homo sapiens
cttcctaattattat

SEQ ID NO: 359440 - DNA, 15 bp, Homo sapiens
ttcctaattattatc

SEQ ID NO: 359441 - DNA, 15 bp, Homo sapiens
tcctaattattatct

SEQ ID NO: 359442 - DNA, 15 bp, Homo sapiens
cctaattattatctt

SEQ ID NO: 359443 - DNA, 15 bp, Homo sapiens
ctaattattatcttt

SEQ ID NO: 359444 - DNA, 15 bp, Homo sapiens
taattattatctttt

SEQ ID NO: 359445 - DNA, 15 bp, Homo sapiens
ttattatcttttatg

SEQ ID NO: 359446 - DNA, 15 bp, Homo sapiens
tattatcttttatgt

SEQ ID NO: 359447 - DNA, 15 bp, Homo sapiens
attatcttttatgta

SEQ ID NO: 359448 - DNA, 15 bp, Homo sapiens
ttatcttttatgtat

SEQ ID NO: 359449 - DNA, 15 bp, Homo sapiens
tatcttttatgtatg

SEQ ID NO: 359450 - DNA, 15 bp, Homo sapiens
atcttttatgtatgc

SEQ ID NO: 359451 - DNA, 15 bp, Homo sapiens
tcttttatgtatgca

SEQ ID NO: 359452 - DNA, 15 bp, Homo sapiens
cttttatgtatgcat

SEQ ID NO: 359453 - DNA, 15 bp, Homo sapiens
ttttatgtatgcata

SEQ ID NO: 359454 - DNA, 15 bp, Homo sapiens
tttatgtatgcatac

SEQ ID NO: 359455 - DNA, 15 bp, Homo sapiens
ttatgtatgcatact

SEQ ID NO: 359456 - DNA, 15 bp, Homo sapiens
tatgtatgcatacta

SEQ ID NO: 359457 - DNA, 15 bp, Homo sapiens
atgtatgcatactag

SEQ ID NO: 359458 - DNA, 15 bp, Homo sapiens
tgtatgcatactaga

SEQ ID NO: 359459 - DNA, 15 bp, Homo sapiens
gtatgcatactagaa

SEQ ID NO: 359460 - DNA, 15 bp, Homo sapiens
tatgcatactagaag

SEQ ID NO: 359461 - DNA, 15 bp, Homo sapiens
atgcatactagaagg

SEQ ID NO: 359462 - DNA, 15 bp, Homo sapiens
tgcatactagaaggt

SEQ ID NO: 359463 - DNA, 15 bp, Homo sapiens
gcatactagaaggta

SEQ ID NO: 359464 - DNA, 15 bp, Homo sapiens
catactagaaggtag

SEQ ID NO: 359465 - DNA, 15 bp, Homo sapiens
atactagaaggtagt

SEQ ID NO: 359466 - DNA, 15 bp, Homo sapiens
tactagaaggtagta

SEQ ID NO: 359467 - DNA, 15 bp, Homo sapiens
actagaaggtagtat

SEQ ID NO: 359468 - DNA, 15 bp, Homo sapiens
ctagaaggtagtata

SEQ ID NO: 359469 - DNA, 15 bp, Homo sapiens
tagaaggtagtatat

SEQ ID NO: 359470 - DNA, 15 bp, Homo sapiens
agaaggtagtatatt

SEQ ID NO: 359471 - DNA, 15 bp, Homo sapiens
gaaggtagtatattg

SEQ ID NO: 359472 - DNA, 15 bp, Homo sapiens
aaggtagtatattgg

SEQ ID NO: 359473 - DNA, 15 bp, Homo sapiens
aggtagtatattgga

SEQ ID NO: 359474 - DNA, 15 bp, Homo sapiens
ggtagtatattggat

SEQ ID NO: 359475 - DNA, 15 bp, Homo sapiens
gtagtatattggatc

SEQ ID NO: 359476 - DNA, 15 bp, Homo sapiens
tagtatattggatca

SEQ ID NO: 359477 - DNA, 15 bp, Homo sapiens
agtatattggatcaa

SEQ ID NO: 359478 - DNA, 15 bp, Homo sapiens
gtatattggatcaaa

SEQ ID NO: 359479 - DNA, 15 bp, Homo sapiens
tatattggatcaaag

SEQ ID NO: 359480 - DNA, 15 bp, Homo sapiens
atattggatcaaagg

SEQ ID NO: 359481 - DNA, 15 bp, Homo sapiens
tattggatcaaaggc

SEQ ID NO: 359482 - DNA, 15 bp, Homo sapiens
attggatcaaaggct

SEQ ID NO: 359483 - DNA, 15 bp, Homo sapiens
ttggatcaaaggctt

SEQ ID NO: 359484 - DNA, 15 bp, Homo sapiens
tggatcaaaggcttt

SEQ ID NO: 359485 - DNA, 15 bp, Homo sapiens
ggatcaaaggctttg

SEQ ID NO: 359486 - DNA, 15 bp, Homo sapiens
gatcaaaggctttgg

SEQ ID NO: 359487 - DNA, 15 bp, Homo sapiens
atcaaaggctttgga

SEQ ID NO: 359488 - DNA, 15 bp, Homo sapiens
tcaaaggctttggag

SEQ ID NO: 359489 - DNA, 15 bp, Homo sapiens
caaaggctttggagt

SEQ ID NO: 359490 - DNA, 15 bp, Homo sapiens
aaaggctttggagtc

SEQ ID NO: 359491 - DNA, 15 bp, Homo sapiens
aaggctttggagtct

SEQ ID NO: 359492 - DNA, 15 bp, Homo sapiens
aggctttggagtctt

SEQ ID NO: 359493 - DNA, 15 bp, Homo sapiens
ggctttggagtcttt

SEQ ID NO: 359494 - DNA, 15 bp, Homo sapiens
gctttggagtctttt

SEQ ID NO: 359495 - DNA, 15 bp, Homo sapiens
ctttggagtctttta

SEQ ID NO: 359496 - DNA, 15 bp, Homo sapiens
tttggagtcttttat

SEQ ID NO: 359497 - DNA, 15 bp, Homo sapiens
ttggagtcttttatt

SEQ ID NO: 359498 - DNA, 15 bp, Homo sapiens
tggagtcttttattt

SEQ ID NO: 359499 - DNA, 15 bp, Homo sapiens
ggagtcttttattta

SEQ ID NO: 359500 - DNA, 15 bp, Homo sapiens
gagtcttttatttac

SEQ ID NO: 359501 - DNA, 15 bp, Homo sapiens
agtcttttatttact

SEQ ID NO: 359502 - DNA, 15 bp, Homo sapiens
gtcttttatttactt

SEQ ID NO: 359503 - DNA, 15 bp, Homo sapiens
tcttttatttactta

SEQ ID NO: 359504 - DNA, 15 bp, Homo sapiens
cttttatttacttat

SEQ ID NO: 359505 - DNA, 15 bp, Homo sapiens
ttttatttacttatt

SEQ ID NO: 359506 - DNA, 15 bp, Homo sapiens
tttatttacttattt

SEQ ID NO: 359507 - DNA, 15 bp, Homo sapiens
ttatttacttattta

SEQ ID NO: 359508 - DNA, 15 bp, Homo sapiens
tatttacttatttat

SEQ ID NO: 359509 - DNA, 15 bp, Homo sapiens
atttacttatttatc

SEQ ID NO: 359510 - DNA, 15 bp, Homo sapiens
tttacttatttatct

SEQ ID NO: 359511 - DNA, 15 bp, Homo sapiens
ttacttatttatctt

SEQ ID NO: 359512 - DNA, 15 bp, Homo sapiens
tacttatttatcttt

SEQ ID NO: 359513 - DNA, 15 bp, Homo sapiens
acttatttatctttt

SEQ ID NO: 359514 - DNA, 15 bp, Homo sapiens
cttatttatcttttt

SEQ ID NO: 359515 - DNA, 15 bp, Homo sapiens
ttatttatcttttta

SEQ ID NO: 359516 - DNA, 15 bp, Homo sapiens
tatttatctttttat

SEQ ID NO: 359517 - DNA, 15 bp, Homo sapiens
atttatctttttatt

SEQ ID NO: 359518 - DNA, 15 bp, Homo sapiens
tttatctttttattt

SEQ ID NO: 359519 - DNA, 15 bp, Homo sapiens
ttatctttttatttg

SEQ ID NO: 359520 - DNA, 15 bp, Homo sapiens
tatctttttatttga

SEQ ID NO: 359521 - DNA, 15 bp, Homo sapiens
atctttttatttgag

SEQ ID NO: 359522 - DNA, 15 bp, Homo sapiens
tctttttatttgaga

SEQ ID NO: 359523 - DNA, 15 bp, Homo sapiens
ctttttatttgagat

SEQ ID NO: 359524 - DNA, 15 bp, Homo sapiens
tttttatttgagatg

SEQ ID NO: 359525 - DNA, 15 bp, Homo sapiens
ttatttgagatggaa

SEQ ID NO: 359526 - DNA, 15 bp, Homo sapiens
tatttgagatggaat

SEQ ID NO: 359527 - DNA, 15 bp, Homo sapiens
atttgagatggaatc

SEQ ID NO: 359528 - DNA, 15 bp, Homo sapiens
tttgagatggaatct

SEQ ID NO: 359529 - DNA, 15 bp, Homo sapiens
ttgagatggaatctt

SEQ ID NO: 359530 - DNA, 15 bp, Homo sapiens
tgagatggaatcttg

SEQ ID NO: 359531 - DNA, 15 bp, Homo sapiens
gagatggaatcttgc

SEQ ID NO: 359532 - DNA, 15 bp, Homo sapiens
agatggaatcttgct

SEQ ID NO: 359533 - DNA, 15 bp, Homo sapiens
gatggaatcttgcta

SEQ ID NO: 359534 - DNA, 15 bp, Homo sapiens
atggaatcttgctat

SEQ ID NO: 359535 - DNA, 15 bp, Homo sapiens
tggaatcttgctatg

SEQ ID NO: 359536 - DNA, 15 bp, Homo sapiens
ggaatcttgctatgt

SEQ ID NO: 359537 - DNA, 15 bp, Homo sapiens
gaatcttgctatgtt

SEQ ID NO: 359538 - DNA, 15 bp, Homo sapiens
aatcttgctatgttg

SEQ ID NO: 359539 - DNA, 15 bp, Homo sapiens
atcttgctatgttgc

SEQ ID NO: 359540 - DNA, 15 bp, Homo sapiens
tgctatgttgcccag

SEQ ID NO: 359541 - DNA, 15 bp, Homo sapiens
ggctggagtgcaatt

SEQ ID NO: 359542 - DNA, 15 bp, Homo sapiens
gctggagtgcaattg

SEQ ID NO: 359543 - DNA, 15 bp, Homo sapiens
ctggagtgcaattgc

SEQ ID NO: 359544 - DNA, 15 bp, Homo sapiens
tggagtgcaattgca

SEQ ID NO: 359545 - DNA, 15 bp, Homo sapiens
ggagtgcaattgcat

SEQ ID NO: 359546 - DNA, 15 bp, Homo sapiens
gagtgcaattgcatg

SEQ ID NO: 359547 - DNA, 15 bp, Homo sapiens
agtgcaattgcatga

SEQ ID NO: 359548 - DNA, 15 bp, Homo sapiens
gtgcaattgcatgat

SEQ ID NO: 359549 - DNA, 15 bp, Homo sapiens
tgcaattgcatgatt

SEQ ID NO: 359550 - DNA, 15 bp, Homo sapiens
gcaattgcatgattt

SEQ ID NO: 359551 - DNA, 15 bp, Homo sapiens
caattgcatgatttt

SEQ ID NO: 359552 - DNA, 15 bp, Homo sapiens
aattgcatgattttg

SEQ ID NO: 359553 - DNA, 15 bp, Homo sapiens
attgcatgattttgg

SEQ ID NO: 359554 - DNA, 15 bp, Homo sapiens
ttgcatgattttggc

SEQ ID NO: 359555 - DNA, 15 bp, Homo sapiens
tgcatgattttggct

SEQ ID NO: 359556 - DNA, 15 bp, Homo sapiens
gcatgattttggctc

SEQ ID NO: 359557 - DNA, 15 bp, Homo sapiens
catgattttggctca

SEQ ID NO: 359558 - DNA, 15 bp, Homo sapiens
atgattttggctcac

SEQ ID NO: 359559 - DNA, 15 bp, Homo sapiens
tgattttggctcact

SEQ ID NO: 359560 - DNA, 15 bp, Homo sapiens
gattttggctcactg

SEQ ID NO: 359561 - DNA, 15 bp, Homo sapiens
attttggctcactgc

SEQ ID NO: 359562 - DNA, 15 bp, Homo sapiens
ttttggctcactgca

SEQ ID NO: 359563 - DNA, 15 bp, Homo sapiens
tttggctcactgcaa

SEQ ID NO: 359564 - DNA, 15 bp, Homo sapiens
actgcaacctccacc

SEQ ID NO: 359565 - DNA, 15 bp, Homo sapiens
ctgcaacctccacct

SEQ ID NO: 359566 - DNA, 15 bp, Homo sapiens
tgcaacctccacctc

SEQ ID NO: 359567 - DNA, 15 bp, Homo sapiens
gcaacctccacctcc

SEQ ID NO: 359568 - DNA, 15 bp, Homo sapiens
caacctccacctcct

SEQ ID NO: 359569 - DNA, 15 bp, Homo sapiens
aacctccacctcctg

SEQ ID NO: 359570 - DNA, 15 bp, Homo sapiens
acctccacctcctga

SEQ ID NO: 359571 - DNA, 15 bp, Homo sapiens
cctccacctcctgag

SEQ ID NO: 359572 - DNA, 15 bp, Homo sapiens
ctccacctcctgagt

SEQ ID NO: 359573 - DNA, 15 bp, Homo sapiens
tccacctcctgagtt

SEQ ID NO: 359574 - DNA, 15 bp, Homo sapiens
ccacctcctgagttc

SEQ ID NO: 359575 - DNA, 15 bp, Homo sapiens
cacctcctgagttca

SEQ ID NO: 359576 - DNA, 15 bp, Homo sapiens
cctcctgagttcaag

SEQ ID NO: 359577 - DNA, 15 bp, Homo sapiens
tcctgagttcaagca

SEQ ID NO: 359578 - DNA, 15 bp, Homo sapiens
cctgagttcaagcaa

SEQ ID NO: 359579 - DNA, 15 bp, Homo sapiens
ctgagttcaagcaat

SEQ ID NO: 359580 - DNA, 15 bp, Homo sapiens
tgagttcaagcaatt

SEQ ID NO: 359581 - DNA, 15 bp, Homo sapiens
gagttcaagcaattc

SEQ ID NO: 359582 - DNA, 15 bp, Homo sapiens
agttcaagcaattct

SEQ ID NO: 359583 - DNA, 15 bp, Homo sapiens
caattctcatgcctc

SEQ ID NO: 359584 - DNA, 15 bp, Homo sapiens
aattctcatgcctca

SEQ ID NO: 359585 - DNA, 15 bp, Homo sapiens
agctgggatcacagg

SEQ ID NO: 359586 - DNA, 15 bp, Homo sapiens
gctgggatcacaggc

SEQ ID NO: 359587 - DNA, 15 bp, Homo sapiens
ctgggatcacaggcg

SEQ ID NO: 359588 - DNA, 15 bp, Homo sapiens
tgggatcacaggcgt

SEQ ID NO: 359589 - DNA, 15 bp, Homo sapiens
gggatcacaggcgtg

SEQ ID NO: 359590 - DNA, 15 bp, Homo sapiens
ggatcacaggcgtgt

SEQ ID NO: 359591 - DNA, 15 bp, Homo sapiens
gatcacaggcgtgtg

SEQ ID NO: 359592 - DNA, 15 bp, Homo sapiens
atcacaggcgtgtgc

SEQ ID NO: 359593 - DNA, 15 bp, Homo sapiens
tcacaggcgtgtgcc

SEQ ID NO: 359594 - DNA, 15 bp, Homo sapiens
cacaggcgtgtgcca

SEQ ID NO: 359595 - DNA, 15 bp, Homo sapiens
caggcgtgtgccact

SEQ ID NO: 359596 - DNA, 15 bp, Homo sapiens
aggcgtgtgccacta

SEQ ID NO: 359597 - DNA, 15 bp, Homo sapiens
ggcgtgtgccactac

SEQ ID NO: 359598 - DNA, 15 bp, Homo sapiens
gcgtgtgccactacc

SEQ ID NO: 359599 - DNA, 15 bp, Homo sapiens
cgtgtgccactaccc

SEQ ID NO: 359600 - DNA, 15 bp, Homo sapiens
gtgtgccactacccc

SEQ ID NO: 359601 - DNA, 15 bp, Homo sapiens
tgtgccactacccca

SEQ ID NO: 359602 - DNA, 15 bp, Homo sapiens
gtgccactaccccag

SEQ ID NO: 359603 - DNA, 15 bp, Homo sapiens
tgccactaccccagc

SEQ ID NO: 359604 - DNA, 15 bp, Homo sapiens
gccactaccccagct

SEQ ID NO: 359605 - DNA, 15 bp, Homo sapiens
ccactaccccagcta

SEQ ID NO: 359606 - DNA, 15 bp, Homo sapiens
cactaccccagctaa

SEQ ID NO: 359607 - DNA, 15 bp, Homo sapiens
actaccccagctaat

SEQ ID NO: 359608 - DNA, 15 bp, Homo sapiens
ctaccccagctaatt

SEQ ID NO: 359609 - DNA, 15 bp, Homo sapiens
taccccagctaattt

SEQ ID NO: 359610 - DNA, 15 bp, Homo sapiens
accccagctaatttt

SEQ ID NO: 359611 - DNA, 15 bp, Homo sapiens
ccccagctaattttg

SEQ ID NO: 359612 - DNA, 15 bp, Homo sapiens
cccagctaattttgt

SEQ ID NO: 359613 - DNA, 15 bp, Homo sapiens
ccagctaattttgta

SEQ ID NO: 359614 - DNA, 15 bp, Homo sapiens
cagctaattttgtat

SEQ ID NO: 359615 - DNA, 15 bp, Homo sapiens
agctaattttgtatt

SEQ ID NO: 359616 - DNA, 15 bp, Homo sapiens
gggttttaccatgtc

SEQ ID NO: 359617 - DNA, 15 bp, Homo sapiens
ggttttaccatgtcg

SEQ ID NO: 359618 - DNA, 15 bp, Homo sapiens
gttttaccatgtcgg

SEQ ID NO: 359619 - DNA, 15 bp, Homo sapiens
ttttaccatgtcggc

SEQ ID NO: 359620 - DNA, 15 bp, Homo sapiens
tttaccatgtcggcc

SEQ ID NO: 359621 - DNA, 15 bp, Homo sapiens
ttaccatgtcggcca

SEQ ID NO: 359622 - DNA, 15 bp, Homo sapiens
taccatgtcggccag

SEQ ID NO: 359623 - DNA, 15 bp, Homo sapiens
accatgtcggccagg

SEQ ID NO: 359624 - DNA, 15 bp, Homo sapiens
ccatgtcggccaggc

SEQ ID NO: 359625 - DNA, 15 bp, Homo sapiens
catgtcggccaggct

SEQ ID NO: 359626 - DNA, 15 bp, Homo sapiens
atgtcggccaggctg

SEQ ID NO: 359627 - DNA, 15 bp, Homo sapiens
tgtcggccaggctgg

SEQ ID NO: 359628 - DNA, 15 bp, Homo sapiens
gtcggccaggctggg

SEQ ID NO: 359629 - DNA, 15 bp, Homo sapiens
tcggccaggctgggc

SEQ ID NO: 359630 - DNA, 15 bp, Homo sapiens
cggccaggctgggct

SEQ ID NO: 359631 - DNA, 15 bp, Homo sapiens
ggccaggctgggctc

SEQ ID NO: 359632 - DNA, 15 bp, Homo sapiens
gccaggctgggctcg

SEQ ID NO: 359633 - DNA, 15 bp, Homo sapiens
ccaggctgggctcga

SEQ ID NO: 359634 - DNA, 15 bp, Homo sapiens
caggctgggctcgaa

SEQ ID NO: 359635 - DNA, 15 bp, Homo sapiens
aggctgggctcgaac

SEQ ID NO: 359636 - DNA, 15 bp, Homo sapiens
ggctgggctcgaact

SEQ ID NO: 359637 - DNA, 15 bp, Homo sapiens
gctgggctcgaactc

SEQ ID NO: 359638 - DNA, 15 bp, Homo sapiens
ctgggctcgaactcc

SEQ ID NO: 359639 - DNA, 15 bp, Homo sapiens
tgggctcgaactcct

SEQ ID NO: 359640 - DNA, 15 bp, Homo sapiens
gggctcgaactcctg

SEQ ID NO: 359641 - DNA, 15 bp, Homo sapiens
ggctcgaactcctga

SEQ ID NO: 359642 - DNA, 15 bp, Homo sapiens
gctcgaactcctgac

SEQ ID NO: 359643 - DNA, 15 bp, Homo sapiens
ctcgaactcctgaca

SEQ ID NO: 359644 - DNA, 15 bp, Homo sapiens
tcgaactcctgacat

SEQ ID NO: 359645 - DNA, 15 bp, Homo sapiens
cgaactcctgacatc

SEQ ID NO: 359646 - DNA, 15 bp, Homo sapiens
gaactcctgacatca

SEQ ID NO: 359647 - DNA, 15 bp, Homo sapiens
aactcctgacatcag

SEQ ID NO: 359648 - DNA, 15 bp, Homo sapiens
actcctgacatcagg

SEQ ID NO: 359649 - DNA, 15 bp, Homo sapiens
ctcctgacatcaggt

SEQ ID NO: 359650 - DNA, 15 bp, Homo sapiens
tcctgacatcaggtg

SEQ ID NO: 359651 - DNA, 15 bp, Homo sapiens
cctgacatcaggtga

SEQ ID NO: 359652 - DNA, 15 bp, Homo sapiens
ctgacatcaggtgat

SEQ ID NO: 359653 - DNA, 15 bp, Homo sapiens
tgacatcaggtgatc

SEQ ID NO: 359654 - DNA, 15 bp, Homo sapiens
gacatcaggtgatcc

SEQ ID NO: 359655 - DNA, 15 bp, Homo sapiens
acatcaggtgatcca

SEQ ID NO: 359656 - DNA, 15 bp, Homo sapiens
catcaggtgatccac

SEQ ID NO: 359657 - DNA, 15 bp, Homo sapiens
atcaggtgatccacc

SEQ ID NO: 359658 - DNA, 15 bp, Homo sapiens
ggtgatccacccgct

SEQ ID NO: 359659 - DNA, 15 bp, Homo sapiens
gtgatccacccgctt

SEQ ID NO: 359660 - DNA, 15 bp, Homo sapiens
tgatccacccgcttc

SEQ ID NO: 359661 - DNA, 15 bp, Homo sapiens
gatccacccgcttcg

SEQ ID NO: 359662 - DNA, 15 bp, Homo sapiens
atccacccgcttcgg

SEQ ID NO: 359663 - DNA, 15 bp, Homo sapiens
tccacccgcttcggc

SEQ ID NO: 359664 - DNA, 15 bp, Homo sapiens
ccacccgcttcggcc

SEQ ID NO: 359665 - DNA, 15 bp, Homo sapiens
cacccgcttcggcct

SEQ ID NO: 359666 - DNA, 15 bp, Homo sapiens
acccgcttcggcctc

SEQ ID NO: 359667 - DNA, 15 bp, Homo sapiens
cccgcttcggcctcc

SEQ ID NO: 359668 - DNA, 15 bp, Homo sapiens
ccgcttcggcctccc

SEQ ID NO: 359669 - DNA, 15 bp, Homo sapiens
cgcttcggcctccca

SEQ ID NO: 359670 - DNA, 15 bp, Homo sapiens
gcttcggcctcccaa

SEQ ID NO: 359671 - DNA, 15 bp, Homo sapiens
cttcggcctcccaat

SEQ ID NO: 359672 - DNA, 15 bp, Homo sapiens
ttcggcctcccaatg

SEQ ID NO: 359673 - DNA, 15 bp, Homo sapiens
tcggcctcccaatgt

SEQ ID NO: 359674 - DNA, 15 bp, Homo sapiens
cggcctcccaatgtg

SEQ ID NO: 359675 - DNA, 15 bp, Homo sapiens
ggcctcccaatgtgc

SEQ ID NO: 359676 - DNA, 15 bp, Homo sapiens
gcctcccaatgtgct

SEQ ID NO: 359677 - DNA, 15 bp, Homo sapiens
cctcccaatgtgcta

SEQ ID NO: 359678 - DNA, 15 bp, Homo sapiens
ctcccaatgtgctag

SEQ ID NO: 359679 - DNA, 15 bp, Homo sapiens
tcccaatgtgctagg

SEQ ID NO: 359680 - DNA, 15 bp, Homo sapiens
cccaatgtgctagga

SEQ ID NO: 359681 - DNA, 15 bp, Homo sapiens
ccaatgtgctaggat

SEQ ID NO: 359682 - DNA, 15 bp, Homo sapiens
caatgtgctaggatt

SEQ ID NO: 359683 - DNA, 15 bp, Homo sapiens
aatgtgctaggatta

SEQ ID NO: 359684 - DNA, 15 bp, Homo sapiens
atgtgctaggattag

SEQ ID NO: 359685 - DNA, 15 bp, Homo sapiens
tgtgctaggattaga

SEQ ID NO: 359686 - DNA, 15 bp, Homo sapiens
gtgctaggattagag

SEQ ID NO: 359687 - DNA, 15 bp, Homo sapiens
tgctaggattagagg

SEQ ID NO: 359688 - DNA, 15 bp, Homo sapiens
gctaggattagaggt

SEQ ID NO: 359689 - DNA, 15 bp, Homo sapiens
ctaggattagaggtg

SEQ ID NO: 359690 - DNA, 15 bp, Homo sapiens
taggattagaggtgt

SEQ ID NO: 359691 - DNA, 15 bp, Homo sapiens
aggattagaggtgtg

SEQ ID NO: 359692 - DNA, 15 bp, Homo sapiens
ggattagaggtgtga

SEQ ID NO: 359693 - DNA, 15 bp, Homo sapiens
gattagaggtgtgag

SEQ ID NO: 359694 - DNA, 15 bp, Homo sapiens
attagaggtgtgagc

SEQ ID NO: 359695 - DNA, 15 bp, Homo sapiens
ttagaggtgtgagcc

SEQ ID NO: 359696 - DNA, 15 bp, Homo sapiens
tagaggtgtgagcca

SEQ ID NO: 359697 - DNA, 15 bp, Homo sapiens
agaggtgtgagccat

SEQ ID NO: 359698 - DNA, 15 bp, Homo sapiens
gaggtgtgagccatc

SEQ ID NO: 359699 - DNA, 15 bp, Homo sapiens
aggtgtgagccatcg

SEQ ID NO: 359700 - DNA, 15 bp, Homo sapiens
ggtgtgagccatcgc

SEQ ID NO: 359701 - DNA, 15 bp, Homo sapiens
gtgtgagccatcgca

SEQ ID NO: 359702 - DNA, 15 bp, Homo sapiens
tgtgagccatcgcac

SEQ ID NO: 359703 - DNA, 15 bp, Homo sapiens
gtgagccatcgcact

SEQ ID NO: 359704 - DNA, 15 bp, Homo sapiens
tgagccatcgcactt

SEQ ID NO: 359705 - DNA, 15 bp, Homo sapiens
gagccatcgcacttg

SEQ ID NO: 359706 - DNA, 15 bp, Homo sapiens
agccatcgcacttgg

SEQ ID NO: 359707 - DNA, 15 bp, Homo sapiens
gccatcgcacttggc

SEQ ID NO: 359708 - DNA, 15 bp, Homo sapiens
ccatcgcacttggcc

SEQ ID NO: 359709 - DNA, 15 bp, Homo sapiens
catcgcacttggcca

SEQ ID NO: 359710 - DNA, 15 bp, Homo sapiens
atcgcacttggccag

SEQ ID NO: 359711 - DNA, 15 bp, Homo sapiens
tcgcacttggccagg

SEQ ID NO: 359712 - DNA, 15 bp, Homo sapiens
cgcacttggccaggc

SEQ ID NO: 359713 - DNA, 15 bp, Homo sapiens
gcacttggccaggct

SEQ ID NO: 359714 - DNA, 15 bp, Homo sapiens
cacttggccaggctt

SEQ ID NO: 359715 - DNA, 15 bp, Homo sapiens
acttggccaggcttt

SEQ ID NO: 359716 - DNA, 15 bp, Homo sapiens
cttggccaggctttg

SEQ ID NO: 359717 - DNA, 15 bp, Homo sapiens
ttggccaggctttgg

SEQ ID NO: 359718 - DNA, 15 bp, Homo sapiens
tggccaggctttgga

SEQ ID NO: 359719 - DNA, 15 bp, Homo sapiens
ggccaggctttggag

SEQ ID NO: 359720 - DNA, 15 bp, Homo sapiens
gccaggctttggagt

SEQ ID NO: 359721 - DNA, 15 bp, Homo sapiens
ccaggctttggagtc

SEQ ID NO: 359722 - DNA, 15 bp, Homo sapiens
caggctttggagtct

SEQ ID NO: 359723 - DNA, 15 bp, Homo sapiens
ggctttggagtctta

SEQ ID NO: 359724 - DNA, 15 bp, Homo sapiens
gctttggagtcttaa

SEQ ID NO: 359725 - DNA, 15 bp, Homo sapiens
ctttggagtcttaaa

SEQ ID NO: 359726 - DNA, 15 bp, Homo sapiens
tttggagtcttaaag

SEQ ID NO: 359727 - DNA, 15 bp, Homo sapiens
ttggagtcttaaagc

SEQ ID NO: 359728 - DNA, 15 bp, Homo sapiens
tggagtcttaaagct

SEQ ID NO: 359729 - DNA, 15 bp, Homo sapiens
ggagtcttaaagctt

SEQ ID NO: 359730 - DNA, 15 bp, Homo sapiens
gagtcttaaagcttt

SEQ ID NO: 359731 - DNA, 15 bp, Homo sapiens
agtcttaaagcttta

SEQ ID NO: 359732 - DNA, 15 bp, Homo sapiens
gtcttaaagctttag

SEQ ID NO: 359733 - DNA, 15 bp, Homo sapiens
tcttaaagctttaga

SEQ ID NO: 359734 - DNA, 15 bp, Homo sapiens
cttaaagctttagag

SEQ ID NO: 359735 - DNA, 15 bp, Homo sapiens
ttaaagctttagagc

SEQ ID NO: 359736 - DNA, 15 bp, Homo sapiens
taaagctttagagcc

SEQ ID NO: 359737 - DNA, 15 bp, Homo sapiens
aaagctttagagcca

SEQ ID NO: 359738 - DNA, 15 bp, Homo sapiens
aagctttagagccat

SEQ ID NO: 359739 - DNA, 15 bp, Homo sapiens
agctttagagccatg

SEQ ID NO: 359740 - DNA, 15 bp, Homo sapiens
gctttagagccatgt

SEQ ID NO: 359741 - DNA, 15 bp, Homo sapiens
ctttagagccatgtt

SEQ ID NO: 359742 - DNA, 15 bp, Homo sapiens
tttagagccatgttg

SEQ ID NO: 359743 - DNA, 15 bp, Homo sapiens
ttagagccatgttgg

SEQ ID NO: 359744 - DNA, 15 bp, Homo sapiens
tagagccatgttgga

SEQ ID NO: 359745 - DNA, 15 bp, Homo sapiens
agagccatgttggaa

SEQ ID NO: 359746 - DNA, 15 bp, Homo sapiens
gagccatgttggaat

SEQ ID NO: 359747 - DNA, 15 bp, Homo sapiens
agccatgttggaatc

SEQ ID NO: 359748 - DNA, 15 bp, Homo sapiens
gccatgttggaatct

SEQ ID NO: 359749 - DNA, 15 bp, Homo sapiens
ccatgttggaatctt

SEQ ID NO: 359750 - DNA, 15 bp, Homo sapiens
catgttggaatctta

SEQ ID NO: 359751 - DNA, 15 bp, Homo sapiens
atgttggaatcttag

SEQ ID NO: 359752 - DNA, 15 bp, Homo sapiens
tgttggaatcttagc

SEQ ID NO: 359753 - DNA, 15 bp, Homo sapiens
gttggaatcttagct

SEQ ID NO: 359754 - DNA, 15 bp, Homo sapiens
ttggaatcttagctc

SEQ ID NO: 359755 - DNA, 15 bp, Homo sapiens
tggaatcttagctct

SEQ ID NO: 359756 - DNA, 15 bp, Homo sapiens
ggaatcttagctctt

SEQ ID NO: 359757 - DNA, 15 bp, Homo sapiens
gaatcttagctcttc

SEQ ID NO: 359758 - DNA, 15 bp, Homo sapiens
aatcttagctcttct

SEQ ID NO: 359759 - DNA, 15 bp, Homo sapiens
atcttagctcttctt

SEQ ID NO: 359760 - DNA, 15 bp, Homo sapiens
tcttagctcttcttt

SEQ ID NO: 359761 - DNA, 15 bp, Homo sapiens
cttagctcttctttt

SEQ ID NO: 359762 - DNA, 15 bp, Homo sapiens
ttagctcttcttttg

SEQ ID NO: 359763 - DNA, 15 bp, Homo sapiens
tagctcttcttttga

SEQ ID NO: 359764 - DNA, 15 bp, Homo sapiens
agctcttcttttgac

SEQ ID NO: 359765 - DNA, 15 bp, Homo sapiens
gctcttcttttgact

SEQ ID NO: 359766 - DNA, 15 bp, Homo sapiens
ctcttcttttgactg

SEQ ID NO: 359767 - DNA, 15 bp, Homo sapiens
tcttcttttgactgt

SEQ ID NO: 359768 - DNA, 15 bp, Homo sapiens
cttcttttgactgtg

SEQ ID NO: 359769 - DNA, 15 bp, Homo sapiens
ttcttttgactgtgt

SEQ ID NO: 359770 - DNA, 15 bp, Homo sapiens
tcttttgactgtgtg

SEQ ID NO: 359771 - DNA, 15 bp, Homo sapiens
cttttgactgtgtgt

SEQ ID NO: 359772 - DNA, 15 bp, Homo sapiens
ttttgactgtgtgta

SEQ ID NO: 359773 - DNA, 15 bp, Homo sapiens
tttgactgtgtgtat

SEQ ID NO: 359774 - DNA, 15 bp, Homo sapiens
ttgactgtgtgtatg

SEQ ID NO: 359775 - DNA, 15 bp, Homo sapiens
tgactgtgtgtatgt

SEQ ID NO: 359776 - DNA, 15 bp, Homo sapiens
gactgtgtgtatgta

SEQ ID NO: 359777 - DNA, 15 bp, Homo sapiens
actgtgtgtatgtag

SEQ ID NO: 359778 - DNA, 15 bp, Homo sapiens
ctgtgtgtatgtagg

SEQ ID NO: 359779 - DNA, 15 bp, Homo sapiens
tgtgtgtatgtaggc

SEQ ID NO: 359780 - DNA, 15 bp, Homo sapiens
gtgtgtatgtaggca

SEQ ID NO: 359781 - DNA, 15 bp, Homo sapiens
tgtgtatgtaggcaa

SEQ ID NO: 359782 - DNA, 15 bp, Homo sapiens
gtgtatgtaggcaag

SEQ ID NO: 359783 - DNA, 15 bp, Homo sapiens
tgtatgtaggcaagt

SEQ ID NO: 359784 - DNA, 15 bp, Homo sapiens
gtatgtaggcaagta

SEQ ID NO: 359785 - DNA, 15 bp, Homo sapiens
tatgtaggcaagtaa

SEQ ID NO: 359786 - DNA, 15 bp, Homo sapiens
atgtaggcaagtaat

SEQ ID NO: 359787 - DNA, 15 bp, Homo sapiens
tgtaggcaagtaatt

SEQ ID NO: 359788 - DNA, 15 bp, Homo sapiens
gtaggcaagtaattt

SEQ ID NO: 359789 - DNA, 15 bp, Homo sapiens
taggcaagtaattta

SEQ ID NO: 359790 - DNA, 15 bp, Homo sapiens
aggcaagtaatttaa

SEQ ID NO: 359791 - DNA, 15 bp, Homo sapiens
ggcaagtaatttaac

SEQ ID NO: 359792 - DNA, 15 bp, Homo sapiens
gcaagtaatttaacc

SEQ ID NO: 359793 - DNA, 15 bp, Homo sapiens
caagtaatttaacct

SEQ ID NO: 359794 - DNA, 15 bp, Homo sapiens
aagtaatttaacctt

SEQ ID NO: 359795 - DNA, 15 bp, Homo sapiens
agtaatttaaccttt

SEQ ID NO: 359796 - DNA, 15 bp, Homo sapiens
gtaatttaacctttc

SEQ ID NO: 359797 - DNA, 15 bp, Homo sapiens
taatttaacctttct

SEQ ID NO: 359798 - DNA, 15 bp, Homo sapiens
aatttaacctttctg

SEQ ID NO: 359799 - DNA, 15 bp, Homo sapiens
atttaacctttctga

SEQ ID NO: 359800 - DNA, 15 bp, Homo sapiens
tttaacctttctgag

SEQ ID NO: 359801 - DNA, 15 bp, Homo sapiens
ttaacctttctgagc

SEQ ID NO: 359802 - DNA, 15 bp, Homo sapiens
taacctttctgagct

SEQ ID NO: 359803 - DNA, 15 bp, Homo sapiens
aacctttctgagctt

SEQ ID NO: 359804 - DNA, 15 bp, Homo sapiens
acctttctgagcttc

SEQ ID NO: 359805 - DNA, 15 bp, Homo sapiens
cctttctgagcttca

SEQ ID NO: 359806 - DNA, 15 bp, Homo sapiens
ctttctgagcttcaa

SEQ ID NO: 359807 - DNA, 15 bp, Homo sapiens
tttctgagcttcaat

SEQ ID NO: 359808 - DNA, 15 bp, Homo sapiens
ttctgagcttcaatt

SEQ ID NO: 359809 - DNA, 15 bp, Homo sapiens
tctgagcttcaattt

SEQ ID NO: 359810 - DNA, 15 bp, Homo sapiens
ctgagcttcaatttt

SEQ ID NO: 359811 - DNA, 15 bp, Homo sapiens
tgagcttcaattttc

SEQ ID NO: 359812 - DNA, 15 bp, Homo sapiens
gagcttcaattttcc

SEQ ID NO: 359813 - DNA, 15 bp, Homo sapiens
agcttcaattttcca

SEQ ID NO: 359814 - DNA, 15 bp, Homo sapiens
gcttcaattttccaa

SEQ ID NO: 359815 - DNA, 15 bp, Homo sapiens
cttcaattttccaat

SEQ ID NO: 359816 - DNA, 15 bp, Homo sapiens
ttcaattttccaatc

SEQ ID NO: 359817 - DNA, 15 bp, Homo sapiens
tcaattttccaatct

SEQ ID NO: 359818 - DNA, 15 bp, Homo sapiens
caattttccaatctg

SEQ ID NO: 359819 - DNA, 15 bp, Homo sapiens
aattttccaatctgt

SEQ ID NO: 359820 - DNA, 15 bp, Homo sapiens
attttccaatctgta

SEQ ID NO: 359821 - DNA, 15 bp, Homo sapiens
ttttccaatctgtaa

SEQ ID NO: 359822 - DNA, 15 bp, Homo sapiens
tttccaatctgtaaa

SEQ ID NO: 359823 - DNA, 15 bp, Homo sapiens
ttccaatctgtaaac

SEQ ID NO: 359824 - DNA, 15 bp, Homo sapiens
tccaatctgtaaact

SEQ ID NO: 359825 - DNA, 15 bp, Homo sapiens
ccaatctgtaaactg

SEQ ID NO: 359826 - DNA, 15 bp, Homo sapiens
caatctgtaaactgg

SEQ ID NO: 359827 - DNA, 15 bp, Homo sapiens
aatctgtaaactggg

SEQ ID NO: 359828 - DNA, 15 bp, Homo sapiens
atctgtaaactggga

SEQ ID NO: 359829 - DNA, 15 bp, Homo sapiens
tctgtaaactgggaa

SEQ ID NO: 359830 - DNA, 15 bp, Homo sapiens
ctgtaaactgggaat

SEQ ID NO: 359831 - DNA, 15 bp, Homo sapiens
tgtaaactgggaatg

SEQ ID NO: 359832 - DNA, 15 bp, Homo sapiens
gtaaactgggaatgc

SEQ ID NO: 359833 - DNA, 15 bp, Homo sapiens
taaactgggaatgct

SEQ ID NO: 359834 - DNA, 15 bp, Homo sapiens
aaactgggaatgcta

SEQ ID NO: 359835 - DNA, 15 bp, Homo sapiens
aactgggaatgctat

SEQ ID NO: 359836 - DNA, 15 bp, Homo sapiens
actgggaatgctatt

SEQ ID NO: 359837 - DNA, 15 bp, Homo sapiens
ctgggaatgctattt

SEQ ID NO: 359838 - DNA, 15 bp, Homo sapiens
tgggaatgctattta

SEQ ID NO: 359839 - DNA, 15 bp, Homo sapiens
gggaatgctatttag

SEQ ID NO: 359840 - DNA, 15 bp, Homo sapiens
ggaatgctatttagc

SEQ ID NO: 359841 - DNA, 15 bp, Homo sapiens
gaatgctatttagcc

SEQ ID NO: 359842 - DNA, 15 bp, Homo sapiens
aatgctatttagccc

SEQ ID NO: 359843 - DNA, 15 bp, Homo sapiens
atgctatttagccca

SEQ ID NO: 359844 - DNA, 15 bp, Homo sapiens
tgctatttagcccat

SEQ ID NO: 359845 - DNA, 15 bp, Homo sapiens
gctatttagcccata

SEQ ID NO: 359846 - DNA, 15 bp, Homo sapiens
ctatttagcccatat

SEQ ID NO: 359847 - DNA, 15 bp, Homo sapiens
tatttagcccatatg

SEQ ID NO: 359848 - DNA, 15 bp, Homo sapiens
atttagcccatatgg

SEQ ID NO: 359849 - DNA, 15 bp, Homo sapiens
tttagcccatatggt

SEQ ID NO: 359850 - DNA, 15 bp, Homo sapiens
ttagcccatatggtt

SEQ ID NO: 359851 - DNA, 15 bp, Homo sapiens
tagcccatatggtta

SEQ ID NO: 359852 - DNA, 15 bp, Homo sapiens
agcccatatggttaa

SEQ ID NO: 359853 - DNA, 15 bp, Homo sapiens
gcccatatggttaat

SEQ ID NO: 359854 - DNA, 15 bp, Homo sapiens
cccatatggttaatt

SEQ ID NO: 359855 - DNA, 15 bp, Homo sapiens
ccatatggttaatta

SEQ ID NO: 359856 - DNA, 15 bp, Homo sapiens
catatggttaattag

SEQ ID NO: 359857 - DNA, 15 bp, Homo sapiens
atatggttaattaga

SEQ ID NO: 359858 - DNA, 15 bp, Homo sapiens
tatggttaattagat

SEQ ID NO: 359859 - DNA, 15 bp, Homo sapiens
atggttaattagatt

SEQ ID NO: 359860 - DNA, 15 bp, Homo sapiens
tggttaattagattt

SEQ ID NO: 359861 - DNA, 15 bp, Homo sapiens
ggttaattagattta

SEQ ID NO: 359862 - DNA, 15 bp, Homo sapiens
gttaattagatttat

SEQ ID NO: 359863 - DNA, 15 bp, Homo sapiens
ttaattagatttatg

SEQ ID NO: 359864 - DNA, 15 bp, Homo sapiens
taattagatttatgt

SEQ ID NO: 359865 - DNA, 15 bp, Homo sapiens
aattagatttatgta

SEQ ID NO: 359866 - DNA, 15 bp, Homo sapiens
attagatttatgtat

SEQ ID NO: 359867 - DNA, 15 bp, Homo sapiens
ttagatttatgtata

SEQ ID NO: 359868 - DNA, 15 bp, Homo sapiens
tagatttatgtatat

SEQ ID NO: 359869 - DNA, 15 bp, Homo sapiens
agatttatgtatata

SEQ ID NO: 359870 - DNA, 15 bp, Homo sapiens
gatttatgtatataa

SEQ ID NO: 359871 - DNA, 15 bp, Homo sapiens
atttatgtatataaa

SEQ ID NO: 359872 - DNA, 15 bp, Homo sapiens
tttatgtatataaaa

SEQ ID NO: 359873 - DNA, 15 bp, Homo sapiens
ttatgtatataaaaa

SEQ ID NO: 359874 - DNA, 15 bp, Homo sapiens
tatgtatataaaaag

SEQ ID NO: 359875 - DNA, 15 bp, Homo sapiens
atgtatataaaaagt

SEQ ID NO: 359876 - DNA, 15 bp, Homo sapiens
tgtatataaaaagtg

SEQ ID NO: 359877 - DNA, 15 bp, Homo sapiens
gtatataaaaagtgt

SEQ ID NO: 359878 - DNA, 15 bp, Homo sapiens
tatataaaaagtgtg

SEQ ID NO: 359879 - DNA, 15 bp, Homo sapiens
atataaaaagtgtgt

SEQ ID NO: 359880 - DNA, 15 bp, Homo sapiens
tataaaaagtgtgta

SEQ ID NO: 359881 - DNA, 15 bp, Homo sapiens
ataaaaagtgtgtat

SEQ ID NO: 359882 - DNA, 15 bp, Homo sapiens
taaaaagtgtgtata

SEQ ID NO: 359883 - DNA, 15 bp, Homo sapiens
aaaaagtgtgtatat

SEQ ID NO: 359884 - DNA, 15 bp, Homo sapiens
aaaagtgtgtatata

SEQ ID NO: 359885 - DNA, 15 bp, Homo sapiens
aaagtgtgtatataa

SEQ ID NO: 359886 - DNA, 15 bp, Homo sapiens
aagtgtgtatataaa

SEQ ID NO: 359887 - DNA, 15 bp, Homo sapiens
agtgtgtatataaaa

SEQ ID NO: 359888 - DNA, 15 bp, Homo sapiens
gtgtgtatataaaac

SEQ ID NO: 359889 - DNA, 15 bp, Homo sapiens
tgtgtatataaaaca

SEQ ID NO: 359890 - DNA, 15 bp, Homo sapiens
gtgtatataaaacaa

SEQ ID NO: 359891 - DNA, 15 bp, Homo sapiens
tgtatataaaacaat

SEQ ID NO: 359892 - DNA, 15 bp, Homo sapiens
gtatataaaacaatg

SEQ ID NO: 359893 - DNA, 15 bp, Homo sapiens
tatataaaacaatgc

SEQ ID NO: 359894 - DNA, 15 bp, Homo sapiens
atataaaacaatgcc

SEQ ID NO: 359895 - DNA, 15 bp, Homo sapiens
tataaaacaatgcct

SEQ ID NO: 359896 - DNA, 15 bp, Homo sapiens
ataaaacaatgcctc

SEQ ID NO: 359897 - DNA, 15 bp, Homo sapiens
taaaacaatgcctct

SEQ ID NO: 359898 - DNA, 15 bp, Homo sapiens
aaaacaatgcctctt

SEQ ID NO: 359899 - DNA, 15 bp, Homo sapiens
aaacaatgcctctta

SEQ ID NO: 359900 - DNA, 15 bp, Homo sapiens
aacaatgcctcttat

SEQ ID NO: 359901 - DNA, 15 bp, Homo sapiens
acaatgcctcttatt

SEQ ID NO: 359902 - DNA, 15 bp, Homo sapiens
caatgcctcttattc

SEQ ID NO: 359903 - DNA, 15 bp, Homo sapiens
aatgcctcttattct

SEQ ID NO: 359904 - DNA, 15 bp, Homo sapiens
atgcctcttattctg

SEQ ID NO: 359905 - DNA, 15 bp, Homo sapiens
tgcctcttattctgc

SEQ ID NO: 359906 - DNA, 15 bp, Homo sapiens
gcctcttattctgca

SEQ ID NO: 359907 - DNA, 15 bp, Homo sapiens
cctcttattctgcat

SEQ ID NO: 359908 - DNA, 15 bp, Homo sapiens
ctcttattctgcata

SEQ ID NO: 359909 - DNA, 15 bp, Homo sapiens
tcttattctgcatat

SEQ ID NO: 359910 - DNA, 15 bp, Homo sapiens
cttattctgcatata

SEQ ID NO: 359911 - DNA, 15 bp, Homo sapiens
ttattctgcatatat

SEQ ID NO: 359912 - DNA, 15 bp, Homo sapiens
tattctgcatatatt

SEQ ID NO: 359913 - DNA, 15 bp, Homo sapiens
attctgcatatattg

SEQ ID NO: 359914 - DNA, 15 bp, Homo sapiens
ttctgcatatattgt

SEQ ID NO: 359915 - DNA, 15 bp, Homo sapiens
tctgcatatattgta

SEQ ID NO: 359916 - DNA, 15 bp, Homo sapiens
ctgcatatattgtag

SEQ ID NO: 359917 - DNA, 15 bp, Homo sapiens
tgcatatattgtagg

SEQ ID NO: 359918 - DNA, 15 bp, Homo sapiens
gcatatattgtagga

SEQ ID NO: 359919 - DNA, 15 bp, Homo sapiens
catatattgtaggaa

SEQ ID NO: 359920 - DNA, 15 bp, Homo sapiens
atatattgtaggaaa

SEQ ID NO: 359921 - DNA, 15 bp, Homo sapiens
tatattgtaggaaaa

SEQ ID NO: 359922 - DNA, 15 bp, Homo sapiens
atattgtaggaaaat

SEQ ID NO: 359923 - DNA, 15 bp, Homo sapiens
tattgtaggaaaatg

SEQ ID NO: 359924 - DNA, 15 bp, Homo sapiens
attgtaggaaaatga

SEQ ID NO: 359925 - DNA, 15 bp, Homo sapiens
ttgtaggaaaatgac

SEQ ID NO: 359926 - DNA, 15 bp, Homo sapiens
tgtaggaaaatgact

SEQ ID NO: 359927 - DNA, 15 bp, Homo sapiens
gtaggaaaatgacta

SEQ ID NO: 359928 - DNA, 15 bp, Homo sapiens
taggaaaatgactac

SEQ ID NO: 359929 - DNA, 15 bp, Homo sapiens
aggaaaatgactact

SEQ ID NO: 359930 - DNA, 15 bp, Homo sapiens
ggaaaatgactactt

SEQ ID NO: 359931 - DNA, 15 bp, Homo sapiens
gaaaatgactactta

SEQ ID NO: 359932 - DNA, 15 bp, Homo sapiens
aaaatgactacttat

SEQ ID NO: 359933 - DNA, 15 bp, Homo sapiens
aaatgactacttatt

SEQ ID NO: 359934 - DNA, 15 bp, Homo sapiens
aatgactacttattt

SEQ ID NO: 359935 - DNA, 15 bp, Homo sapiens
atgactacttatttt

SEQ ID NO: 359936 - DNA, 15 bp, Homo sapiens
tgactacttattttt

SEQ ID NO: 359937 - DNA, 15 bp, Homo sapiens
gactacttattttta

SEQ ID NO: 359938 - DNA, 15 bp, Homo sapiens
actacttatttttag

SEQ ID NO: 359939 - DNA, 15 bp, Homo sapiens
ctacttatttttagt

SEQ ID NO: 359940 - DNA, 15 bp, Homo sapiens
tacttatttttagta

SEQ ID NO: 359941 - DNA, 15 bp, Homo sapiens
acttatttttagtaa

SEQ ID NO: 359942 - DNA, 15 bp, Homo sapiens
cttatttttagtaat

SEQ ID NO: 359943 - DNA, 15 bp, Homo sapiens
ttatttttagtaata

SEQ ID NO: 359944 - DNA, 15 bp, Homo sapiens
tatttttagtaatat

SEQ ID NO: 359945 - DNA, 15 bp, Homo sapiens
tttttagtaatataa

SEQ ID NO: 359946 - DNA, 15 bp, Homo sapiens
ttttagtaatataat

SEQ ID NO: 359947 - DNA, 15 bp, Homo sapiens
tttagtaatataatt

SEQ ID NO: 359948 - DNA, 15 bp, Homo sapiens
ttagtaatataatta

SEQ ID NO: 359949 - DNA, 15 bp, Homo sapiens
tagtaatataattaa

SEQ ID NO: 359950 - DNA, 15 bp, Homo sapiens
agtaatataattaat

SEQ ID NO: 359951 - DNA, 15 bp, Homo sapiens
gtaatataattaata

SEQ ID NO: 359952 - DNA, 15 bp, Homo sapiens
taatataattaataa

SEQ ID NO: 359953 - DNA, 15 bp, Homo sapiens
aatataattaataaa

SEQ ID NO: 359954 - DNA, 15 bp, Homo sapiens
atataattaataaaa

SEQ ID NO: 359955 - DNA, 15 bp, Homo sapiens
tataattaataaaag

SEQ ID NO: 359956 - DNA, 15 bp, Homo sapiens
ataattaataaaagt

SEQ ID NO: 359957 - DNA, 15 bp, Homo sapiens
taattaataaaagtt

SEQ ID NO: 359958 - DNA, 15 bp, Homo sapiens
aattaataaaagttg

SEQ ID NO: 359959 - DNA, 15 bp, Homo sapiens
attaataaaagttga

SEQ ID NO: 359960 - DNA, 15 bp, Homo sapiens
ttaataaaagttgag

SEQ ID NO: 359961 - DNA, 15 bp, Homo sapiens
taataaaagttgaga

SEQ ID NO: 359962 - DNA, 15 bp, Homo sapiens
aataaaagttgagat

SEQ ID NO: 359963 - DNA, 15 bp, Homo sapiens
ataaaagttgagatc

SEQ ID NO: 359964 - DNA, 15 bp, Homo sapiens
taaaagttgagatca

SEQ ID NO: 359965 - DNA, 15 bp, Homo sapiens
aaaagttgagatcat

SEQ ID NO: 359966 - DNA, 15 bp, Homo sapiens
aaagttgagatcatt

SEQ ID NO: 359967 - DNA, 15 bp, Homo sapiens
aagttgagatcattt

SEQ ID NO: 359968 - DNA, 15 bp, Homo sapiens
agttgagatcatttt

SEQ ID NO: 359969 - DNA, 15 bp, Homo sapiens
gttgagatcattttg

SEQ ID NO: 359970 - DNA, 15 bp, Homo sapiens
ttgagatcattttgc

SEQ ID NO: 359971 - DNA, 15 bp, Homo sapiens
tgagatcattttgct

SEQ ID NO: 359972 - DNA, 15 bp, Homo sapiens
gagatcattttgctt

SEQ ID NO: 359973 - DNA, 15 bp, Homo sapiens
agatcattttgcttg

SEQ ID NO: 359974 - DNA, 15 bp, Homo sapiens
gatcattttgcttgt

SEQ ID NO: 359975 - DNA, 15 bp, Homo sapiens
atcattttgcttgta

SEQ ID NO: 359976 - DNA, 15 bp, Homo sapiens
tcattttgcttgtat

SEQ ID NO: 359977 - DNA, 15 bp, Homo sapiens
cattttgcttgtata

SEQ ID NO: 359978 - DNA, 15 bp, Homo sapiens
attttgcttgtatag

SEQ ID NO: 359979 - DNA, 15 bp, Homo sapiens
ttttgcttgtatagt

SEQ ID NO: 359980 - DNA, 15 bp, Homo sapiens
tttgcttgtatagta

SEQ ID NO: 359981 - DNA, 15 bp, Homo sapiens
ttgcttgtatagtac

SEQ ID NO: 359982 - DNA, 15 bp, Homo sapiens
tgcttgtatagtact

SEQ ID NO: 359983 - DNA, 15 bp, Homo sapiens
gcttgtatagtactg

SEQ ID NO: 359984 - DNA, 15 bp, Homo sapiens
cttgtatagtactgt

SEQ ID NO: 359985 - DNA, 15 bp, Homo sapiens
ttgtatagtactgtt

SEQ ID NO: 359986 - DNA, 15 bp, Homo sapiens
tgtatagtactgttc

SEQ ID NO: 359987 - DNA, 15 bp, Homo sapiens
gtatagtactgttct

SEQ ID NO: 359988 - DNA, 15 bp, Homo sapiens
tatagtactgttctc

SEQ ID NO: 359989 - DNA, 15 bp, Homo sapiens
atagtactgttctct

SEQ ID NO: 359990 - DNA, 15 bp, Homo sapiens
tagtactgttctctg

SEQ ID NO: 359991 - DNA, 15 bp, Homo sapiens
agtactgttctctgc

SEQ ID NO: 359992 - DNA, 15 bp, Homo sapiens
gtactgttctctgcc

SEQ ID NO: 359993 - DNA, 15 bp, Homo sapiens
tactgttctctgcct

SEQ ID NO: 359994 - DNA, 15 bp, Homo sapiens
actgttctctgcctt

SEQ ID NO: 359995 - DNA, 15 bp, Homo sapiens
ctgttctctgccttt

SEQ ID NO: 359996 - DNA, 15 bp, Homo sapiens
tgttctctgcctttg

SEQ ID NO: 359997 - DNA, 15 bp, Homo sapiens
gttctctgcctttga

SEQ ID NO: 359998 - DNA, 15 bp, Homo sapiens
ttctctgcctttgaa

SEQ ID NO: 359999 - DNA, 15 bp, Homo sapiens
tctctgcctttgaac

SEQ ID NO: 360000 - DNA, 15 bp, Homo sapiens
ctctgcctttgaact

SEQ ID NO: 360001 - DNA, 15 bp, Homo sapiens
tctgcctttgaactt

SEQ ID NO: 360002 - DNA, 15 bp, Homo sapiens
ctgcctttgaacttt

SEQ ID NO: 360003 - DNA, 15 bp, Homo sapiens
tgcctttgaactttg

SEQ ID NO: 360004 - DNA, 15 bp, Homo sapiens
gcctttgaactttgt

SEQ ID NO: 360005 - DNA, 15 bp, Homo sapiens
cctttgaactttgtg

SEQ ID NO: 360006 - DNA, 15 bp, Homo sapiens
ctttgaactttgtgt

SEQ ID NO: 360007 - DNA, 15 bp, Homo sapiens
tttgaactttgtgtc

SEQ ID NO: 360008 - DNA, 15 bp, Homo sapiens
ttgaactttgtgtca

SEQ ID NO: 360009 - DNA, 15 bp, Homo sapiens
tgaactttgtgtcat

SEQ ID NO: 360010 - DNA, 15 bp, Homo sapiens
gaactttgtgtcatg

SEQ ID NO: 360011 - DNA, 15 bp, Homo sapiens
aactttgtgtcatga

SEQ ID NO: 360012 - DNA, 15 bp, Homo sapiens
actttgtgtcatgag

SEQ ID NO: 360013 - DNA, 15 bp, Homo sapiens
ctttgtgtcatgagc

SEQ ID NO: 360014 - DNA, 15 bp, Homo sapiens
tttgtgtcatgagca

SEQ ID NO: 360015 - DNA, 15 bp, Homo sapiens
ttgtgtcatgagcat

SEQ ID NO: 360016 - DNA, 15 bp, Homo sapiens
tgtgtcatgagcatt

SEQ ID NO: 360017 - DNA, 15 bp, Homo sapiens
gtgtcatgagcattt

SEQ ID NO: 360018 - DNA, 15 bp, Homo sapiens
tgtcatgagcatttc

SEQ ID NO: 360019 - DNA, 15 bp, Homo sapiens
gtcatgagcatttcc

SEQ ID NO: 360020 - DNA, 15 bp, Homo sapiens
tcatgagcatttccc

SEQ ID NO: 360021 - DNA, 15 bp, Homo sapiens
catgagcatttcccc

SEQ ID NO: 360022 - DNA, 15 bp, Homo sapiens
atgagcatttcccca

SEQ ID NO: 360023 - DNA, 15 bp, Homo sapiens
tgagcatttccccat

SEQ ID NO: 360024 - DNA, 15 bp, Homo sapiens
gagcatttccccata

SEQ ID NO: 360025 - DNA, 15 bp, Homo sapiens
agcatttccccatat

SEQ ID NO: 360026 - DNA, 15 bp, Homo sapiens
gcatttccccatata

SEQ ID NO: 360027 - DNA, 15 bp, Homo sapiens
catttccccatataa

SEQ ID NO: 360028 - DNA, 15 bp, Homo sapiens
atttccccatataat

SEQ ID NO: 360029 - DNA, 15 bp, Homo sapiens
tttccccatataatt

SEQ ID NO: 360030 - DNA, 15 bp, Homo sapiens
ttccccatataatta

SEQ ID NO: 360031 - DNA, 15 bp, Homo sapiens
tccccatataattaa

SEQ ID NO: 360032 - DNA, 15 bp, Homo sapiens
ccccatataattaat

SEQ ID NO: 360033 - DNA, 15 bp, Homo sapiens
cccatataattaata

SEQ ID NO: 360034 - DNA, 15 bp, Homo sapiens
ccatataattaataa

SEQ ID NO: 360035 - DNA, 15 bp, Homo sapiens
catataattaataat

SEQ ID NO: 360036 - DNA, 15 bp, Homo sapiens
atataattaataatt

SEQ ID NO: 360037 - DNA, 15 bp, Homo sapiens
tataattaataatta

SEQ ID NO: 360038 - DNA, 15 bp, Homo sapiens
ataattaataattat

SEQ ID NO: 360039 - DNA, 15 bp, Homo sapiens
taattaataattatt

SEQ ID NO: 360040 - DNA, 15 bp, Homo sapiens
aattaataattattt

SEQ ID NO: 360041 - DNA, 15 bp, Homo sapiens
attaataattatttt

SEQ ID NO: 360042 - DNA, 15 bp, Homo sapiens
ttaataattattttt

SEQ ID NO: 360043 - DNA, 15 bp, Homo sapiens
taataattattttta

SEQ ID NO: 360044 - DNA, 15 bp, Homo sapiens
aataattatttttaa

SEQ ID NO: 360045 - DNA, 15 bp, Homo sapiens
ataattatttttaac

SEQ ID NO: 360046 - DNA, 15 bp, Homo sapiens
taattatttttaact

SEQ ID NO: 360047 - DNA, 15 bp, Homo sapiens
aattatttttaactt

SEQ ID NO: 360048 - DNA, 15 bp, Homo sapiens
attatttttaacttt

SEQ ID NO: 360049 - DNA, 15 bp, Homo sapiens
ttatttttaactttt

SEQ ID NO: 360050 - DNA, 15 bp, Homo sapiens
tatttttaacttttt

SEQ ID NO: 360051 - DNA, 15 bp, Homo sapiens
atttttaacttttta

SEQ ID NO: 360052 - DNA, 15 bp, Homo sapiens
tttttaactttttat

SEQ ID NO: 360053 - DNA, 15 bp, Homo sapiens
ttttaactttttatt

SEQ ID NO: 360054 - DNA, 15 bp, Homo sapiens
tttaactttttatta

SEQ ID NO: 360055 - DNA, 15 bp, Homo sapiens
ttaactttttattat

SEQ ID NO: 360056 - DNA, 15 bp, Homo sapiens
taactttttattatt

SEQ ID NO: 360057 - DNA, 15 bp, Homo sapiens
aactttttattattc

SEQ ID NO: 360058 - DNA, 15 bp, Homo sapiens
actttttattattca

SEQ ID NO: 360059 - DNA, 15 bp, Homo sapiens
ctttttattattcat

SEQ ID NO: 360060 - DNA, 15 bp, Homo sapiens
tttttattattcatt

SEQ ID NO: 360061 - DNA, 15 bp, Homo sapiens
ttttattattcattt

SEQ ID NO: 360062 - DNA, 15 bp, Homo sapiens
tttattattcattta

SEQ ID NO: 360063 - DNA, 15 bp, Homo sapiens
ttattattcatttat

SEQ ID NO: 360064 - DNA, 15 bp, Homo sapiens
tattattcatttatt

SEQ ID NO: 360065 - DNA, 15 bp, Homo sapiens
attattcatttattt

SEQ ID NO: 360066 - DNA, 15 bp, Homo sapiens
ttattcatttattta

SEQ ID NO: 360067 - DNA, 15 bp, Homo sapiens
tattcatttatttat

SEQ ID NO: 360068 - DNA, 15 bp, Homo sapiens
ttcatttatttattg

SEQ ID NO: 360069 - DNA, 15 bp, Homo sapiens
tcatttatttattgt

SEQ ID NO: 360070 - DNA, 15 bp, Homo sapiens
catttatttattgtt

SEQ ID NO: 360071 - DNA, 15 bp, Homo sapiens
atttatttattgttt

SEQ ID NO: 360072 - DNA, 15 bp, Homo sapiens
tttatttattgttta

SEQ ID NO: 360073 - DNA, 15 bp, Homo sapiens
ttatttattgtttag

SEQ ID NO: 360074 - DNA, 15 bp, Homo sapiens
tatttattgtttaga

SEQ ID NO: 360075 - DNA, 15 bp, Homo sapiens
atttattgtttagag

SEQ ID NO: 360076 - DNA, 15 bp, Homo sapiens
tttattgtttagaga

SEQ ID NO: 360077 - DNA, 15 bp, Homo sapiens
ttattgtttagagac

SEQ ID NO: 360078 - DNA, 15 bp, Homo sapiens
tattgtttagagaca

SEQ ID NO: 360079 - DNA, 15 bp, Homo sapiens
attgtttagagacat

SEQ ID NO: 360080 - DNA, 15 bp, Homo sapiens
ttgtttagagacata

SEQ ID NO: 360081 - DNA, 15 bp, Homo sapiens
tgtttagagacatag

SEQ ID NO: 360082 - DNA, 15 bp, Homo sapiens
gtttagagacatagt

SEQ ID NO: 360083 - DNA, 15 bp, Homo sapiens
tttagagacatagtc

SEQ ID NO: 360084 - DNA, 15 bp, Homo sapiens
ttagagacatagtct

SEQ ID NO: 360085 - DNA, 15 bp, Homo sapiens
tagagacatagtctc

SEQ ID NO: 360086 - DNA, 15 bp, Homo sapiens
agagacatagtctcg

SEQ ID NO: 360087 - DNA, 15 bp, Homo sapiens
gagacatagtctcgc

SEQ ID NO: 360088 - DNA, 15 bp, Homo sapiens
agacatagtctcgct

SEQ ID NO: 360089 - DNA, 15 bp, Homo sapiens
gacatagtctcgctc

SEQ ID NO: 360090 - DNA, 15 bp, Homo sapiens
acatagtctcgctct

SEQ ID NO: 360091 - DNA, 15 bp, Homo sapiens
catagtctcgctctg

SEQ ID NO: 360092 - DNA, 15 bp, Homo sapiens
atagtctcgctctgt

SEQ ID NO: 360093 - DNA, 15 bp, Homo sapiens
tagtctcgctctgtt

SEQ ID NO: 360094 - DNA, 15 bp, Homo sapiens
gcccaggctggagtc

SEQ ID NO: 360095 - DNA, 15 bp, Homo sapiens
cccaggctggagtcc

SEQ ID NO: 360096 - DNA, 15 bp, Homo sapiens
ccaggctggagtcca

SEQ ID NO: 360097 - DNA, 15 bp, Homo sapiens
caggctggagtccag

SEQ ID NO: 360098 - DNA, 15 bp, Homo sapiens
aggctggagtccagt

SEQ ID NO: 360099 - DNA, 15 bp, Homo sapiens
ggctggagtccagtg

SEQ ID NO: 360100 - DNA, 15 bp, Homo sapiens
gctggagtccagtgg

SEQ ID NO: 360101 - DNA, 15 bp, Homo sapiens
ctggagtccagtggt

SEQ ID NO: 360102 - DNA, 15 bp, Homo sapiens
tggagtccagtggta

SEQ ID NO: 360103 - DNA, 15 bp, Homo sapiens
ggagtccagtggtat

SEQ ID NO: 360104 - DNA, 15 bp, Homo sapiens
gagtccagtggtatg

SEQ ID NO: 360105 - DNA, 15 bp, Homo sapiens
agtccagtggtatga

SEQ ID NO: 360106 - DNA, 15 bp, Homo sapiens
gtccagtggtatgac

SEQ ID NO: 360107 - DNA, 15 bp, Homo sapiens
tccagtggtatgaca

SEQ ID NO: 360108 - DNA, 15 bp, Homo sapiens
ccagtggtatgacag

SEQ ID NO: 360109 - DNA, 15 bp, Homo sapiens
cagtggtatgacagc

SEQ ID NO: 360110 - DNA, 15 bp, Homo sapiens
agtggtatgacagct

SEQ ID NO: 360111 - DNA, 15 bp, Homo sapiens
gtggtatgacagctc

SEQ ID NO: 360112 - DNA, 15 bp, Homo sapiens
tggtatgacagctca

SEQ ID NO: 360113 - DNA, 15 bp, Homo sapiens
ggtatgacagctcac

SEQ ID NO: 360114 - DNA, 15 bp, Homo sapiens
gtatgacagctcact

SEQ ID NO: 360115 - DNA, 15 bp, Homo sapiens
tatgacagctcactg

SEQ ID NO: 360116 - DNA, 15 bp, Homo sapiens
atgacagctcactgc

SEQ ID NO: 360117 - DNA, 15 bp, Homo sapiens
tgacagctcactgca

SEQ ID NO: 360118 - DNA, 15 bp, Homo sapiens
gacagctcactgcag

SEQ ID NO: 360119 - DNA, 15 bp, Homo sapiens
acagctcactgcagc

SEQ ID NO: 360120 - DNA, 15 bp, Homo sapiens
cagctcactgcagcc

SEQ ID NO: 360121 - DNA, 15 bp, Homo sapiens
agctcactgcagcct

SEQ ID NO: 360122 - DNA, 15 bp, Homo sapiens
gcagccttgaactct

SEQ ID NO: 360123 - DNA, 15 bp, Homo sapiens
cagccttgaactctt

SEQ ID NO: 360124 - DNA, 15 bp, Homo sapiens
agccttgaactcttg

SEQ ID NO: 360125 - DNA, 15 bp, Homo sapiens
gccttgaactcttgg

SEQ ID NO: 360126 - DNA, 15 bp, Homo sapiens
ccttgaactcttggg

SEQ ID NO: 360127 - DNA, 15 bp, Homo sapiens
cttgaactcttgggc

SEQ ID NO: 360128 - DNA, 15 bp, Homo sapiens
ttgaactcttgggct

SEQ ID NO: 360129 - DNA, 15 bp, Homo sapiens
tgaactcttgggctc

SEQ ID NO: 360130 - DNA, 15 bp, Homo sapiens
ctcttgggctcaagt

SEQ ID NO: 360131 - DNA, 15 bp, Homo sapiens
tcttgggctcaagtg

SEQ ID NO: 360132 - DNA, 15 bp, Homo sapiens
cttgggctcaagtga

SEQ ID NO: 360133 - DNA, 15 bp, Homo sapiens
ttgggctcaagtgat

SEQ ID NO: 360134 - DNA, 15 bp, Homo sapiens
tcaagtgatcctcct

SEQ ID NO: 360135 - DNA, 15 bp, Homo sapiens
caagtgatcctcctg

SEQ ID NO: 360136 - DNA, 15 bp, Homo sapiens
tgatcctcctgcctc

SEQ ID NO: 360137 - DNA, 15 bp, Homo sapiens
gatcctcctgcctca

SEQ ID NO: 360138 - DNA, 15 bp, Homo sapiens
atcctcctgcctcac

SEQ ID NO: 360139 - DNA, 15 bp, Homo sapiens
tcctcctgcctcacc

SEQ ID NO: 360140 - DNA, 15 bp, Homo sapiens
cctcctgcctcaccc

SEQ ID NO: 360141 - DNA, 15 bp, Homo sapiens
ctcctgcctcaccct

SEQ ID NO: 360142 - DNA, 15 bp, Homo sapiens
tcctgcctcaccctc

SEQ ID NO: 360143 - DNA, 15 bp, Homo sapiens
gcctcaccctcccat

SEQ ID NO: 360144 - DNA, 15 bp, Homo sapiens
cctcaccctcccata

SEQ ID NO: 360145 - DNA, 15 bp, Homo sapiens
ctcaccctcccataa

SEQ ID NO: 360146 - DNA, 15 bp, Homo sapiens
tcaccctcccataat

SEQ ID NO: 360147 - DNA, 15 bp, Homo sapiens
caccctcccataatt

SEQ ID NO: 360148 - DNA, 15 bp, Homo sapiens
accctcccataatta

SEQ ID NO: 360149 - DNA, 15 bp, Homo sapiens
ccctcccataattaa

SEQ ID NO: 360150 - DNA, 15 bp, Homo sapiens
cctcccataattaat

SEQ ID NO: 360151 - DNA, 15 bp, Homo sapiens
ctcccataattaata

SEQ ID NO: 360152 - DNA, 15 bp, Homo sapiens
tcccataattaataa

SEQ ID NO: 360153 - DNA, 15 bp, Homo sapiens
cccataattaataat

SEQ ID NO: 360154 - DNA, 15 bp, Homo sapiens
ccataattaataata

SEQ ID NO: 360155 - DNA, 15 bp, Homo sapiens
cataattaataatag

SEQ ID NO: 360156 - DNA, 15 bp, Homo sapiens
ataattaataatagt

SEQ ID NO: 360157 - DNA, 15 bp, Homo sapiens
taattaataatagtt

SEQ ID NO: 360158 - DNA, 15 bp, Homo sapiens
aattaataatagttg

SEQ ID NO: 360159 - DNA, 15 bp, Homo sapiens
attaataatagttga

SEQ ID NO: 360160 - DNA, 15 bp, Homo sapiens
ttaataatagttgaa

SEQ ID NO: 360161 - DNA, 15 bp, Homo sapiens
taataatagttgaaa

SEQ ID NO: 360162 - DNA, 15 bp, Homo sapiens
aataatagttgaaat

SEQ ID NO: 360163 - DNA, 15 bp, Homo sapiens
ataatagttgaaatt

SEQ ID NO: 360164 - DNA, 15 bp, Homo sapiens
taatagttgaaatta

SEQ ID NO: 360165 - DNA, 15 bp, Homo sapiens
aatagttgaaattat

SEQ ID NO: 360166 - DNA, 15 bp, Homo sapiens
atagttgaaattatt

SEQ ID NO: 360167 - DNA, 15 bp, Homo sapiens
tagttgaaattattt

SEQ ID NO: 360168 - DNA, 15 bp, Homo sapiens
agttgaaattatttt

SEQ ID NO: 360169 - DNA, 15 bp, Homo sapiens
gttgaaattattttt

SEQ ID NO: 360170 - DNA, 15 bp, Homo sapiens
ttgaaattatttttg

SEQ ID NO: 360171 - DNA, 15 bp, Homo sapiens
tgaaattatttttgt

SEQ ID NO: 360172 - DNA, 15 bp, Homo sapiens
gaaattatttttgtg

SEQ ID NO: 360173 - DNA, 15 bp, Homo sapiens
aaattatttttgtga

SEQ ID NO: 360174 - DNA, 15 bp, Homo sapiens
aattatttttgtgaa

SEQ ID NO: 360175 - DNA, 15 bp, Homo sapiens
attatttttgtgaaa

SEQ ID NO: 360176 - DNA, 15 bp, Homo sapiens
ttatttttgtgaaat

SEQ ID NO: 360177 - DNA, 15 bp, Homo sapiens
tatttttgtgaaatt

SEQ ID NO: 360178 - DNA, 15 bp, Homo sapiens
atttttgtgaaatta

SEQ ID NO: 360179 - DNA, 15 bp, Homo sapiens
tttttgtgaaattat

SEQ ID NO: 360180 - DNA, 15 bp, Homo sapiens
ttttgtgaaattata

SEQ ID NO: 360181 - DNA, 15 bp, Homo sapiens
tttgtgaaattatat

SEQ ID NO: 360182 - DNA, 15 bp, Homo sapiens
ttgtgaaattatatc

SEQ ID NO: 360183 - DNA, 15 bp, Homo sapiens
tgtgaaattatatca

SEQ ID NO: 360184 - DNA, 15 bp, Homo sapiens
gtgaaattatatcat

SEQ ID NO: 360185 - DNA, 15 bp, Homo sapiens
tgaaattatatcata

SEQ ID NO: 360186 - DNA, 15 bp, Homo sapiens
gaaattatatcatat

SEQ ID NO: 360187 - DNA, 15 bp, Homo sapiens
aaattatatcatata

SEQ ID NO: 360188 - DNA, 15 bp, Homo sapiens
aattatatcatatat

SEQ ID NO: 360189 - DNA, 15 bp, Homo sapiens
attatatcatatatc

SEQ ID NO: 360190 - DNA, 15 bp, Homo sapiens
ttatatcatatatca

SEQ ID NO: 360191 - DNA, 15 bp, Homo sapiens
tatatcatatatcac

SEQ ID NO: 360192 - DNA, 15 bp, Homo sapiens
atatcatatatcact

SEQ ID NO: 360193 - DNA, 15 bp, Homo sapiens
tatcatatatcactt

SEQ ID NO: 360194 - DNA, 15 bp, Homo sapiens
atcatatatcacttg

SEQ ID NO: 360195 - DNA, 15 bp, Homo sapiens
tcatatatcacttgt

SEQ ID NO: 360196 - DNA, 15 bp, Homo sapiens
catatatcacttgtg

SEQ ID NO: 360197 - DNA, 15 bp, Homo sapiens
atatatcacttgtgc

SEQ ID NO: 360198 - DNA, 15 bp, Homo sapiens
tatatcacttgtgct

SEQ ID NO: 360199 - DNA, 15 bp, Homo sapiens
atatcacttgtgcta

SEQ ID NO: 360200 - DNA, 15 bp, Homo sapiens
tatcacttgtgctaa

SEQ ID NO: 360201 - DNA, 15 bp, Homo sapiens
atcacttgtgctaat

SEQ ID NO: 360202 - DNA, 15 bp, Homo sapiens
tcacttgtgctaatt

SEQ ID NO: 360203 - DNA, 15 bp, Homo sapiens
cacttgtgctaattt

SEQ ID NO: 360204 - DNA, 15 bp, Homo sapiens
acttgtgctaatttc

SEQ ID NO: 360205 - DNA, 15 bp, Homo sapiens
cttgtgctaatttct

SEQ ID NO: 360206 - DNA, 15 bp, Homo sapiens
ttgtgctaatttctc

SEQ ID NO: 360207 - DNA, 15 bp, Homo sapiens
tgtgctaatttctca

SEQ ID NO: 360208 - DNA, 15 bp, Homo sapiens
gtgctaatttctcaa

SEQ ID NO: 360209 - DNA, 15 bp, Homo sapiens
tgctaatttctcaat

SEQ ID NO: 360210 - DNA, 15 bp, Homo sapiens
gctaatttctcaatt

SEQ ID NO: 360211 - DNA, 15 bp, Homo sapiens
ctaatttctcaattt

SEQ ID NO: 360212 - DNA, 15 bp, Homo sapiens
taatttctcaatttt

SEQ ID NO: 360213 - DNA, 15 bp, Homo sapiens
aatttctcaatttta

SEQ ID NO: 360214 - DNA, 15 bp, Homo sapiens
atttctcaattttat

SEQ ID NO: 360215 - DNA, 15 bp, Homo sapiens
tttctcaattttatg

SEQ ID NO: 360216 - DNA, 15 bp, Homo sapiens
ttctcaattttatgc

SEQ ID NO: 360217 - DNA, 15 bp, Homo sapiens
tctcaattttatgca

SEQ ID NO: 360218 - DNA, 15 bp, Homo sapiens
ctcaattttatgcat

SEQ ID NO: 360219 - DNA, 15 bp, Homo sapiens
tcaattttatgcatt

SEQ ID NO: 360220 - DNA, 15 bp, Homo sapiens
caattttatgcattt

SEQ ID NO: 360221 - DNA, 15 bp, Homo sapiens
aattttatgcatttt

SEQ ID NO: 360222 - DNA, 15 bp, Homo sapiens
attttatgcattttt

SEQ ID NO: 360223 - DNA, 15 bp, Homo sapiens
ttttatgcatttttt

SEQ ID NO: 360224 - DNA, 15 bp, Homo sapiens
tttatgcatttttta

SEQ ID NO: 360225 - DNA, 15 bp, Homo sapiens
ttatgcattttttaa

SEQ ID NO: 360226 - DNA, 15 bp, Homo sapiens
tatgcattttttaat

SEQ ID NO: 360227 - DNA, 15 bp, Homo sapiens
atgcattttttaatc

SEQ ID NO: 360228 - DNA, 15 bp, Homo sapiens
tgcattttttaatcc

SEQ ID NO: 360229 - DNA, 15 bp, Homo sapiens
gcattttttaatccc

SEQ ID NO: 360230 - DNA, 15 bp, Homo sapiens
cattttttaatccca

SEQ ID NO: 360231 - DNA, 15 bp, Homo sapiens
attttttaatcccat

SEQ ID NO: 360232 - DNA, 15 bp, Homo sapiens
ttttttaatcccatg

SEQ ID NO: 360233 - DNA, 15 bp, Homo sapiens
tttttaatcccatga

SEQ ID NO: 360234 - DNA, 15 bp, Homo sapiens
ttttaatcccatgat

SEQ ID NO: 360235 - DNA, 15 bp, Homo sapiens
tttaatcccatgatg

SEQ ID NO: 360236 - DNA, 15 bp, Homo sapiens
ttaatcccatgatgg

SEQ ID NO: 360237 - DNA, 15 bp, Homo sapiens
taatcccatgatgga

SEQ ID NO: 360238 - DNA, 15 bp, Homo sapiens
aatcccatgatggat

SEQ ID NO: 360239 - DNA, 15 bp, Homo sapiens
atcccatgatggata

SEQ ID NO: 360240 - DNA, 15 bp, Homo sapiens
tcccatgatggatat

SEQ ID NO: 360241 - DNA, 15 bp, Homo sapiens
cccatgatggatatt

SEQ ID NO: 360242 - DNA, 15 bp, Homo sapiens
ccatgatggatattt

SEQ ID NO: 360243 - DNA, 15 bp, Homo sapiens
catgatggatatttt

SEQ ID NO: 360244 - DNA, 15 bp, Homo sapiens
atgatggatattttt

SEQ ID NO: 360245 - DNA, 15 bp, Homo sapiens
tgatggatatttttg

SEQ ID NO: 360246 - DNA, 15 bp, Homo sapiens
gatggatatttttgt

SEQ ID NO: 360247 - DNA, 15 bp, Homo sapiens
atggatatttttgtg

SEQ ID NO: 360248 - DNA, 15 bp, Homo sapiens
tggatatttttgtga

SEQ ID NO: 360249 - DNA, 15 bp, Homo sapiens
ggatatttttgtgaa

SEQ ID NO: 360250 - DNA, 15 bp, Homo sapiens
gatatttttgtgaat

SEQ ID NO: 360251 - DNA, 15 bp, Homo sapiens
atatttttgtgaatt

SEQ ID NO: 360252 - DNA, 15 bp, Homo sapiens
tatttttgtgaatta

SEQ ID NO: 360253 - DNA, 15 bp, Homo sapiens
atttttgtgaattag

SEQ ID NO: 360254 - DNA, 15 bp, Homo sapiens
tttttgtgaattagt

SEQ ID NO: 360255 - DNA, 15 bp, Homo sapiens
ttttgtgaattagta

SEQ ID NO: 360256 - DNA, 15 bp, Homo sapiens
tttgtgaattagtaa

SEQ ID NO: 360257 - DNA, 15 bp, Homo sapiens
ttgtgaattagtaat

SEQ ID NO: 360258 - DNA, 15 bp, Homo sapiens
tgtgaattagtaatt

SEQ ID NO: 360259 - DNA, 15 bp, Homo sapiens
gtgaattagtaattt

SEQ ID NO: 360260 - DNA, 15 bp, Homo sapiens
tgaattagtaattta

SEQ ID NO: 360261 - DNA, 15 bp, Homo sapiens
gaattagtaatttac

SEQ ID NO: 360262 - DNA, 15 bp, Homo sapiens
aattagtaatttact

SEQ ID NO: 360263 - DNA, 15 bp, Homo sapiens
attagtaatttactt

SEQ ID NO: 360264 - DNA, 15 bp, Homo sapiens
ttagtaatttactta

SEQ ID NO: 360265 - DNA, 15 bp, Homo sapiens
tagtaatttacttaa

SEQ ID NO: 360266 - DNA, 15 bp, Homo sapiens
agtaatttacttaac

SEQ ID NO: 360267 - DNA, 15 bp, Homo sapiens
gtaatttacttaact

SEQ ID NO: 360268 - DNA, 15 bp, Homo sapiens
taatttacttaactt

SEQ ID NO: 360269 - DNA, 15 bp, Homo sapiens
aatttacttaacttt

SEQ ID NO: 360270 - DNA, 15 bp, Homo sapiens
atttacttaactttt

SEQ ID NO: 360271 - DNA, 15 bp, Homo sapiens
tttacttaacttttg

SEQ ID NO: 360272 - DNA, 15 bp, Homo sapiens
ttacttaacttttgg

SEQ ID NO: 360273 - DNA, 15 bp, Homo sapiens
tacttaacttttggt

SEQ ID NO: 360274 - DNA, 15 bp, Homo sapiens
acttaacttttggtc

SEQ ID NO: 360275 - DNA, 15 bp, Homo sapiens
cttaacttttggtcc

SEQ ID NO: 360276 - DNA, 15 bp, Homo sapiens
ttaacttttggtcct

SEQ ID NO: 360277 - DNA, 15 bp, Homo sapiens
taacttttggtcctg

SEQ ID NO: 360278 - DNA, 15 bp, Homo sapiens
aacttttggtcctgt

SEQ ID NO: 360279 - DNA, 15 bp, Homo sapiens
acttttggtcctgtt

SEQ ID NO: 360280 - DNA, 15 bp, Homo sapiens
cttttggtcctgtta

SEQ ID NO: 360281 - DNA, 15 bp, Homo sapiens
ttttggtcctgttac

SEQ ID NO: 360282 - DNA, 15 bp, Homo sapiens
tttggtcctgttact

SEQ ID NO: 360283 - DNA, 15 bp, Homo sapiens
ttggtcctgttactt

SEQ ID NO: 360284 - DNA, 15 bp, Homo sapiens
tggtcctgttactta

SEQ ID NO: 360285 - DNA, 15 bp, Homo sapiens
ggtcctgttacttag

SEQ ID NO: 360286 - DNA, 15 bp, Homo sapiens
gtcctgttacttagg

SEQ ID NO: 360287 - DNA, 15 bp, Homo sapiens
tcctgttacttaggt

SEQ ID NO: 360288 - DNA, 15 bp, Homo sapiens
cctgttacttaggta

SEQ ID NO: 360289 - DNA, 15 bp, Homo sapiens
ctgttacttaggtag

SEQ ID NO: 360290 - DNA, 15 bp, Homo sapiens
tgttacttaggtaga

SEQ ID NO: 360291 - DNA, 15 bp, Homo sapiens
gttacttaggtagat

SEQ ID NO: 360292 - DNA, 15 bp, Homo sapiens
ttacttaggtagatt

SEQ ID NO: 360293 - DNA, 15 bp, Homo sapiens
tacttaggtagattt

SEQ ID NO: 360294 - DNA, 15 bp, Homo sapiens
acttaggtagatttt

SEQ ID NO: 360295 - DNA, 15 bp, Homo sapiens
cttaggtagattttt

SEQ ID NO: 360296 - DNA, 15 bp, Homo sapiens
ttaggtagattttta

SEQ ID NO: 360297 - DNA, 15 bp, Homo sapiens
taggtagatttttag

SEQ ID NO: 360298 - DNA, 15 bp, Homo sapiens
aggtagatttttaga

SEQ ID NO: 360299 - DNA, 15 bp, Homo sapiens
ggtagatttttagaa

SEQ ID NO: 360300 - DNA, 15 bp, Homo sapiens
gtagatttttagaaa

SEQ ID NO: 360301 - DNA, 15 bp, Homo sapiens
tagatttttagaaaa

SEQ ID NO: 360302 - DNA, 15 bp, Homo sapiens
agatttttagaaaat

SEQ ID NO: 360303 - DNA, 15 bp, Homo sapiens
gatttttagaaaata

SEQ ID NO: 360304 - DNA, 15 bp, Homo sapiens
atttttagaaaatat

SEQ ID NO: 360305 - DNA, 15 bp, Homo sapiens
tttttagaaaatata

SEQ ID NO: 360306 - DNA, 15 bp, Homo sapiens
ttttagaaaatataa

SEQ ID NO: 360307 - DNA, 15 bp, Homo sapiens
tttagaaaatataat

SEQ ID NO: 360308 - DNA, 15 bp, Homo sapiens
ttagaaaatataatt

SEQ ID NO: 360309 - DNA, 15 bp, Homo sapiens
tagaaaatataatta

SEQ ID NO: 360310 - DNA, 15 bp, Homo sapiens
agaaaatataattac

SEQ ID NO: 360311 - DNA, 15 bp, Homo sapiens
gaaaatataattact

SEQ ID NO: 360312 - DNA, 15 bp, Homo sapiens
aaaatataattactt

SEQ ID NO: 360313 - DNA, 15 bp, Homo sapiens
aaatataattacttg

SEQ ID NO: 360314 - DNA, 15 bp, Homo sapiens
aatataattacttgt

SEQ ID NO: 360315 - DNA, 15 bp, Homo sapiens
atataattacttgtt

SEQ ID NO: 360316 - DNA, 15 bp, Homo sapiens
tataattacttgttt

SEQ ID NO: 360317 - DNA, 15 bp, Homo sapiens
ataattacttgttta

SEQ ID NO: 360318 - DNA, 15 bp, Homo sapiens
taattacttgtttaa

SEQ ID NO: 360319 - DNA, 15 bp, Homo sapiens
aattacttgtttaac

SEQ ID NO: 360320 - DNA, 15 bp, Homo sapiens
attacttgtttaaca

SEQ ID NO: 360321 - DNA, 15 bp, Homo sapiens
ttacttgtttaacaa

SEQ ID NO: 360322 - DNA, 15 bp, Homo sapiens
tacttgtttaacaaa

SEQ ID NO: 360323 - DNA, 15 bp, Homo sapiens
acttgtttaacaaat

SEQ ID NO: 360324 - DNA, 15 bp, Homo sapiens
cttgtttaacaaata

SEQ ID NO: 360325 - DNA, 15 bp, Homo sapiens
ttgtttaacaaatag

SEQ ID NO: 360326 - DNA, 15 bp, Homo sapiens
tgtttaacaaataga

SEQ ID NO: 360327 - DNA, 15 bp, Homo sapiens
gtttaacaaatagac

SEQ ID NO: 360328 - DNA, 15 bp, Homo sapiens
tttaacaaatagaca

SEQ ID NO: 360329 - DNA, 15 bp, Homo sapiens
ttaacaaatagacat

SEQ ID NO: 360330 - DNA, 15 bp, Homo sapiens
taacaaatagacatt

SEQ ID NO: 360331 - DNA, 15 bp, Homo sapiens
tgttagaggaggggg

SEQ ID NO: 360332 - DNA, 15 bp, Homo sapiens
gttagaggaggggga

SEQ ID NO: 360333 - DNA, 15 bp, Homo sapiens
ttagaggagggggac

SEQ ID NO: 360334 - DNA, 15 bp, Homo sapiens
tagaggagggggact

SEQ ID NO: 360335 - DNA, 15 bp, Homo sapiens
agaggagggggactg

SEQ ID NO: 360336 - DNA, 15 bp, Homo sapiens
gaggagggggactgc

SEQ ID NO: 360337 - DNA, 15 bp, Homo sapiens
aggagggggactgca

SEQ ID NO: 360338 - DNA, 15 bp, Homo sapiens
ggagggggactgcac

SEQ ID NO: 360339 - DNA, 15 bp, Homo sapiens
gagggggactgcaca

SEQ ID NO: 360340 - DNA, 15 bp, Homo sapiens
agggggactgcacat

SEQ ID NO: 360341 - DNA, 15 bp, Homo sapiens
gggggactgcacata

SEQ ID NO: 360342 - DNA, 15 bp, Homo sapiens
ggggactgcacatat

SEQ ID NO: 360343 - DNA, 15 bp, Homo sapiens
gggactgcacatatg

SEQ ID NO: 360344 - DNA, 15 bp, Homo sapiens
ggactgcacatatgg

SEQ ID NO: 360345 - DNA, 15 bp, Homo sapiens
gactgcacatatggt

SEQ ID NO: 360346 - DNA, 15 bp, Homo sapiens
actgcacatatggtt

SEQ ID NO: 360347 - DNA, 15 bp, Homo sapiens
ctgcacatatggtta

SEQ ID NO: 360348 - DNA, 15 bp, Homo sapiens
tgcacatatggttag

SEQ ID NO: 360349 - DNA, 15 bp, Homo sapiens
gcacatatggttagt

SEQ ID NO: 360350 - DNA, 15 bp, Homo sapiens
cacatatggttagtg

SEQ ID NO: 360351 - DNA, 15 bp, Homo sapiens
acatatggttagtgt

SEQ ID NO: 360352 - DNA, 15 bp, Homo sapiens
catatggttagtgta

SEQ ID NO: 360353 - DNA, 15 bp, Homo sapiens
atatggttagtgtat

SEQ ID NO: 360354 - DNA, 15 bp, Homo sapiens
tatggttagtgtatg

SEQ ID NO: 360355 - DNA, 15 bp, Homo sapiens
atggttagtgtatgc

SEQ ID NO: 360356 - DNA, 15 bp, Homo sapiens
tggttagtgtatgcc

SEQ ID NO: 360357 - DNA, 15 bp, Homo sapiens
ggttagtgtatgcct

SEQ ID NO: 360358 - DNA, 15 bp, Homo sapiens
gttagtgtatgcctg

SEQ ID NO: 360359 - DNA, 15 bp, Homo sapiens
ttagtgtatgcctgt

SEQ ID NO: 360360 - DNA, 15 bp, Homo sapiens
tagtgtatgcctgtt

SEQ ID NO: 360361 - DNA, 15 bp, Homo sapiens
agtgtatgcctgtta

SEQ ID NO: 360362 - DNA, 15 bp, Homo sapiens
gtgtatgcctgttaa

SEQ ID NO: 360363 - DNA, 15 bp, Homo sapiens
tgtatgcctgttaag

SEQ ID NO: 360364 - DNA, 15 bp, Homo sapiens
gtatgcctgttaaga

SEQ ID NO: 360365 - DNA, 15 bp, Homo sapiens
tatgcctgttaagac

SEQ ID NO: 360366 - DNA, 15 bp, Homo sapiens
atgcctgttaagaca

SEQ ID NO: 360367 - DNA, 15 bp, Homo sapiens
tgcctgttaagacag

SEQ ID NO: 360368 - DNA, 15 bp, Homo sapiens
gcctgttaagacaga

SEQ ID NO: 360369 - DNA, 15 bp, Homo sapiens
cctgttaagacagat

SEQ ID NO: 360370 - DNA, 15 bp, Homo sapiens
ctgttaagacagatt

SEQ ID NO: 360371 - DNA, 15 bp, Homo sapiens
tgttaagacagattt

SEQ ID NO: 360372 - DNA, 15 bp, Homo sapiens
gttaagacagatttc

SEQ ID NO: 360373 - DNA, 15 bp, Homo sapiens
ttaagacagatttca

SEQ ID NO: 360374 - DNA, 15 bp, Homo sapiens
taagacagatttcag

SEQ ID NO: 360375 - DNA, 15 bp, Homo sapiens
aagacagatttcaga

SEQ ID NO: 360376 - DNA, 15 bp, Homo sapiens
agacagatttcagaa

SEQ ID NO: 360377 - DNA, 15 bp, Homo sapiens
gacagatttcagaag

SEQ ID NO: 360378 - DNA, 15 bp, Homo sapiens
acagatttcagaagt

SEQ ID NO: 360379 - DNA, 15 bp, Homo sapiens
cagatttcagaagta

SEQ ID NO: 360380 - DNA, 15 bp, Homo sapiens
agatttcagaagtag

SEQ ID NO: 360381 - DNA, 15 bp, Homo sapiens
gatttcagaagtagg

SEQ ID NO: 360382 - DNA, 15 bp, Homo sapiens
atttcagaagtaggg

SEQ ID NO: 360383 - DNA, 15 bp, Homo sapiens
tttcagaagtaggga

SEQ ID NO: 360384 - DNA, 15 bp, Homo sapiens
ttcagaagtagggac

SEQ ID NO: 360385 - DNA, 15 bp, Homo sapiens
tcagaagtagggaca

SEQ ID NO: 360386 - DNA, 15 bp, Homo sapiens
cagaagtagggacaa

SEQ ID NO: 360387 - DNA, 15 bp, Homo sapiens
agaagtagggacaaa

SEQ ID NO: 360388 - DNA, 15 bp, Homo sapiens
gaagtagggacaaaa

SEQ ID NO: 360389 - DNA, 15 bp, Homo sapiens
aagtagggacaaaat

SEQ ID NO: 360390 - DNA, 15 bp, Homo sapiens
agtagggacaaaata

SEQ ID NO: 360391 - DNA, 15 bp, Homo sapiens
gtagggacaaaatat

SEQ ID NO: 360392 - DNA, 15 bp, Homo sapiens
tagggacaaaatata

SEQ ID NO: 360393 - DNA, 15 bp, Homo sapiens
agggacaaaatatat

SEQ ID NO: 360394 - DNA, 15 bp, Homo sapiens
gggacaaaatatatt

SEQ ID NO: 360395 - DNA, 15 bp, Homo sapiens
ggacaaaatatatta

SEQ ID NO: 360396 - DNA, 15 bp, Homo sapiens
gacaaaatatattaa

SEQ ID NO: 360397 - DNA, 15 bp, Homo sapiens
acaaaatatattaat

SEQ ID NO: 360398 - DNA, 15 bp, Homo sapiens
caaaatatattaatt

SEQ ID NO: 360399 - DNA, 15 bp, Homo sapiens
aaaatatattaattt

SEQ ID NO: 360400 - DNA, 15 bp, Homo sapiens
aaatatattaatttt

SEQ ID NO: 360401 - DNA, 15 bp, Homo sapiens
aatatattaattttt

SEQ ID NO: 360402 - DNA, 15 bp, Homo sapiens
atatattaatttttc

SEQ ID NO: 360403 - DNA, 15 bp, Homo sapiens
tatattaatttttca

SEQ ID NO: 360404 - DNA, 15 bp, Homo sapiens
atattaatttttcag

SEQ ID NO: 360405 - DNA, 15 bp, Homo sapiens
tattaatttttcaga

SEQ ID NO: 360406 - DNA, 15 bp, Homo sapiens
attaatttttcagaa

SEQ ID NO: 360407 - DNA, 15 bp, Homo sapiens
ttaatttttcagaag

SEQ ID NO: 360408 - DNA, 15 bp, Homo sapiens
taatttttcagaagt

SEQ ID NO: 360409 - DNA, 15 bp, Homo sapiens
aatttttcagaagtc

SEQ ID NO: 360410 - DNA, 15 bp, Homo sapiens
atttttcagaagtca

SEQ ID NO: 360411 - DNA, 15 bp, Homo sapiens
tttttcagaagtcaa

SEQ ID NO: 360412 - DNA, 15 bp, Homo sapiens
ttttcagaagtcaat

SEQ ID NO: 360413 - DNA, 15 bp, Homo sapiens
tttcagaagtcaatg

SEQ ID NO: 360414 - DNA, 15 bp, Homo sapiens
ttcagaagtcaatgg

SEQ ID NO: 360415 - DNA, 15 bp, Homo sapiens
tcagaagtcaatgga

SEQ ID NO: 360416 - DNA, 15 bp, Homo sapiens
cagaagtcaatggac

SEQ ID NO: 360417 - DNA, 15 bp, Homo sapiens
agaagtcaatggaca

SEQ ID NO: 360418 - DNA, 15 bp, Homo sapiens
gaagtcaatggacaa

SEQ ID NO: 360419 - DNA, 15 bp, Homo sapiens
aagtcaatggacaat

SEQ ID NO: 360420 - DNA, 15 bp, Homo sapiens
agtcaatggacaatt

SEQ ID NO: 360421 - DNA, 15 bp, Homo sapiens
gtcaatggacaattt

SEQ ID NO: 360422 - DNA, 15 bp, Homo sapiens
tcaatggacaatttg

SEQ ID NO: 360423 - DNA, 15 bp, Homo sapiens
caatggacaatttgt

SEQ ID NO: 360424 - DNA, 15 bp, Homo sapiens
aatggacaatttgta

SEQ ID NO: 360425 - DNA, 15 bp, Homo sapiens
atggacaatttgtaa

SEQ ID NO: 360426 - DNA, 15 bp, Homo sapiens
tggacaatttgtaat

SEQ ID NO: 360427 - DNA, 15 bp, Homo sapiens
ggacaatttgtaatt

SEQ ID NO: 360428 - DNA, 15 bp, Homo sapiens
gacaatttgtaattt

SEQ ID NO: 360429 - DNA, 15 bp, Homo sapiens
acaatttgtaatttt

SEQ ID NO: 360430 - DNA, 15 bp, Homo sapiens
caatttgtaattttt

SEQ ID NO: 360431 - DNA, 15 bp, Homo sapiens
aatttgtaatttttg

SEQ ID NO: 360432 - DNA, 15 bp, Homo sapiens
atttgtaatttttgt

SEQ ID NO: 360433 - DNA, 15 bp, Homo sapiens
tttgtaatttttgtt

SEQ ID NO: 360434 - DNA, 15 bp, Homo sapiens
ttgtaatttttgttc

SEQ ID NO: 360435 - DNA, 15 bp, Homo sapiens
tgtaatttttgttcc

SEQ ID NO: 360436 - DNA, 15 bp, Homo sapiens
gtaatttttgttcca

SEQ ID NO: 360437 - DNA, 15 bp, Homo sapiens
taatttttgttccaa

SEQ ID NO: 360438 - DNA, 15 bp, Homo sapiens
aatttttgttccaat

SEQ ID NO: 360439 - DNA, 15 bp, Homo sapiens
atttttgttccaatt

SEQ ID NO: 360440 - DNA, 15 bp, Homo sapiens
tttttgttccaattc

SEQ ID NO: 360441 - DNA, 15 bp, Homo sapiens
ttttgttccaattct

SEQ ID NO: 360442 - DNA, 15 bp, Homo sapiens
tttgttccaattctt

SEQ ID NO: 360443 - DNA, 15 bp, Homo sapiens
ttgttccaattcttg

SEQ ID NO: 360444 - DNA, 15 bp, Homo sapiens
tgttccaattcttgt

SEQ ID NO: 360445 - DNA, 15 bp, Homo sapiens
gttccaattcttgtt

SEQ ID NO: 360446 - DNA, 15 bp, Homo sapiens
ttccaattcttgtta

SEQ ID NO: 360447 - DNA, 15 bp, Homo sapiens
tccaattcttgttac

SEQ ID NO: 360448 - DNA, 15 bp, Homo sapiens
ccaattcttgttacc

SEQ ID NO: 360449 - DNA, 15 bp, Homo sapiens
caattcttgttacca

SEQ ID NO: 360450 - DNA, 15 bp, Homo sapiens
aattcttgttaccag

SEQ ID NO: 360451 - DNA, 15 bp, Homo sapiens
attcttgttaccagt

SEQ ID NO: 360452 - DNA, 15 bp, Homo sapiens
ttcttgttaccagtt

SEQ ID NO: 360453 - DNA, 15 bp, Homo sapiens
tcttgttaccagtta

SEQ ID NO: 360454 - DNA, 15 bp, Homo sapiens
cttgttaccagttat

SEQ ID NO: 360455 - DNA, 15 bp, Homo sapiens
ttgttaccagttata

SEQ ID NO: 360456 - DNA, 15 bp, Homo sapiens
tgttaccagttataa

SEQ ID NO: 360457 - DNA, 15 bp, Homo sapiens
gttaccagttataaa

SEQ ID NO: 360458 - DNA, 15 bp, Homo sapiens
ttaccagttataaaa

SEQ ID NO: 360459 - DNA, 15 bp, Homo sapiens
taccagttataaaag

SEQ ID NO: 360460 - DNA, 15 bp, Homo sapiens
accagttataaaagt

SEQ ID NO: 360461 - DNA, 15 bp, Homo sapiens
ccagttataaaagtt

SEQ ID NO: 360462 - DNA, 15 bp, Homo sapiens
cagttataaaagttt

SEQ ID NO: 360463 - DNA, 15 bp, Homo sapiens
agttataaaagttta

SEQ ID NO: 360464 - DNA, 15 bp, Homo sapiens
gttataaaagtttaa

SEQ ID NO: 360465 - DNA, 15 bp, Homo sapiens
ttataaaagtttaag

SEQ ID NO: 360466 - DNA, 15 bp, Homo sapiens
tataaaagtttaaga

SEQ ID NO: 360467 - DNA, 15 bp, Homo sapiens
ataaaagtttaagaa

SEQ ID NO: 360468 - DNA, 15 bp, Homo sapiens
taaaagtttaagaaa

SEQ ID NO: 360469 - DNA, 15 bp, Homo sapiens
aaaagtttaagaaat

SEQ ID NO: 360470 - DNA, 15 bp, Homo sapiens
aaagtttaagaaatt

SEQ ID NO: 360471 - DNA, 15 bp, Homo sapiens
aagtttaagaaattg

SEQ ID NO: 360472 - DNA, 15 bp, Homo sapiens
agtttaagaaattgg

SEQ ID NO: 360473 - DNA, 15 bp, Homo sapiens
gtttaagaaattggt

SEQ ID NO: 360474 - DNA, 15 bp, Homo sapiens
taagaaattggtcaa

SEQ ID NO: 360475 - DNA, 15 bp, Homo sapiens
aagaaattggtcaat

SEQ ID NO: 360476 - DNA, 15 bp, Homo sapiens
agaaattggtcaatc

SEQ ID NO: 360477 - DNA, 15 bp, Homo sapiens
gaaattggtcaatca

SEQ ID NO: 360478 - DNA, 15 bp, Homo sapiens
aaattggtcaatcac

SEQ ID NO: 360479 - DNA, 15 bp, Homo sapiens
aattggtcaatcaca

SEQ ID NO: 360480 - DNA, 15 bp, Homo sapiens
attggtcaatcacaa

SEQ ID NO: 360481 - DNA, 15 bp, Homo sapiens
ttggtcaatcacaat

SEQ ID NO: 360482 - DNA, 15 bp, Homo sapiens
tggtcaatcacaatt

SEQ ID NO: 360483 - DNA, 15 bp, Homo sapiens
ggtcaatcacaattt

SEQ ID NO: 360484 - DNA, 15 bp, Homo sapiens
gtcaatcacaatttt

SEQ ID NO: 360485 - DNA, 15 bp, Homo sapiens
tcaatcacaattttc

SEQ ID NO: 360486 - DNA, 15 bp, Homo sapiens
caatcacaattttca

SEQ ID NO: 360487 - DNA, 15 bp, Homo sapiens
aatcacaattttcaa

SEQ ID NO: 360488 - DNA, 15 bp, Homo sapiens
atcacaattttcaat

SEQ ID NO: 360489 - DNA, 15 bp, Homo sapiens
tcacaattttcaatc

SEQ ID NO: 360490 - DNA, 15 bp, Homo sapiens
cacaattttcaatca

SEQ ID NO: 360491 - DNA, 15 bp, Homo sapiens
acaattttcaatcag

SEQ ID NO: 360492 - DNA, 15 bp, Homo sapiens
caattttcaatcagg

SEQ ID NO: 360493 - DNA, 15 bp, Homo sapiens
aattttcaatcagga

SEQ ID NO: 360494 - DNA, 15 bp, Homo sapiens
attttcaatcaggat

SEQ ID NO: 360495 - DNA, 15 bp, Homo sapiens
ttttcaatcaggatt

SEQ ID NO: 360496 - DNA, 15 bp, Homo sapiens
tttcaatcaggattt

SEQ ID NO: 360497 - DNA, 15 bp, Homo sapiens
ttcaatcaggatttc

SEQ ID NO: 360498 - DNA, 15 bp, Homo sapiens
tcaatcaggatttca

SEQ ID NO: 360499 - DNA, 15 bp, Homo sapiens
caatcaggatttcaa

SEQ ID NO: 360500 - DNA, 15 bp, Homo sapiens
aatcaggatttcaaa

SEQ ID NO: 360501 - DNA, 15 bp, Homo sapiens
atcaggatttcaaag

SEQ ID NO: 360502 - DNA, 15 bp, Homo sapiens
tcaggatttcaaaga

SEQ ID NO: 360503 - DNA, 15 bp, Homo sapiens
caggatttcaaagaa

SEQ ID NO: 360504 - DNA, 15 bp, Homo sapiens
aggatttcaaagaaa

SEQ ID NO: 360505 - DNA, 15 bp, Homo sapiens
ggatttcaaagaaat

SEQ ID NO: 360506 - DNA, 15 bp, Homo sapiens
gatttcaaagaaatt

SEQ ID NO: 360507 - DNA, 15 bp, Homo sapiens
atttcaaagaaattt

SEQ ID NO: 360508 - DNA, 15 bp, Homo sapiens
tttcaaagaaattta

SEQ ID NO: 360509 - DNA, 15 bp, Homo sapiens
ttcaaagaaatttaa

SEQ ID NO: 360510 - DNA, 15 bp, Homo sapiens
tcaaagaaatttaaa

SEQ ID NO: 360511 - DNA, 15 bp, Homo sapiens
caaagaaatttaaat

SEQ ID NO: 360512 - DNA, 15 bp, Homo sapiens
aaagaaatttaaata

SEQ ID NO: 360513 - DNA, 15 bp, Homo sapiens
aagaaatttaaataa

SEQ ID NO: 360514 - DNA, 15 bp, Homo sapiens
agaaatttaaataaa

SEQ ID NO: 360515 - DNA, 15 bp, Homo sapiens
gaaatttaaataaaa

SEQ ID NO: 360516 - DNA, 15 bp, Homo sapiens
aaatttaaataaaaa

SEQ ID NO: 360517 - DNA, 15 bp, Homo sapiens
aatttaaataaaaat

SEQ ID NO: 360518 - DNA, 15 bp, Homo sapiens
atttaaataaaaata

SEQ ID NO: 360519 - DNA, 15 bp, Homo sapiens
tttaaataaaaatac

SEQ ID NO: 360520 - DNA, 15 bp, Homo sapiens
ttaaataaaaatact

SEQ ID NO: 360521 - DNA, 15 bp, Homo sapiens
taaataaaaatactc

SEQ ID NO: 360522 - DNA, 15 bp, Homo sapiens
aaataaaaatactcc

SEQ ID NO: 360523 - DNA, 15 bp, Homo sapiens
aataaaaatactcct

SEQ ID NO: 360524 - DNA, 15 bp, Homo sapiens
ataaaaatactcctt

SEQ ID NO: 360525 - DNA, 15 bp, Homo sapiens
taaaaatactccttg

SEQ ID NO: 360526 - DNA, 15 bp, Homo sapiens
aaaaatactccttgg

SEQ ID NO: 360527 - DNA, 15 bp, Homo sapiens
aaaatactccttggt

SEQ ID NO: 360528 - DNA, 15 bp, Homo sapiens
aaatactccttggtg

SEQ ID NO: 360529 - DNA, 15 bp, Homo sapiens
aatactccttggtgg

SEQ ID NO: 360530 - DNA, 15 bp, Homo sapiens
atactccttggtggc

SEQ ID NO: 360531 - DNA, 15 bp, Homo sapiens
tactccttggtggct

SEQ ID NO: 360532 - DNA, 15 bp, Homo sapiens
actccttggtggcta

SEQ ID NO: 360533 - DNA, 15 bp, Homo sapiens
ctccttggtggctaa

SEQ ID NO: 360534 - DNA, 15 bp, Homo sapiens
tccttggtggctaat

SEQ ID NO: 360535 - DNA, 15 bp, Homo sapiens
ccttggtggctaatg

SEQ ID NO: 360536 - DNA, 15 bp, Homo sapiens
cttggtggctaatgt

SEQ ID NO: 360537 - DNA, 15 bp, Homo sapiens
ttggtggctaatgtg

SEQ ID NO: 360538 - DNA, 15 bp, Homo sapiens
tggtggctaatgtga

SEQ ID NO: 360539 - DNA, 15 bp, Homo sapiens
ggtggctaatgtgaa

SEQ ID NO: 360540 - DNA, 15 bp, Homo sapiens
gtggctaatgtgaaa

SEQ ID NO: 360541 - DNA, 15 bp, Homo sapiens
tggctaatgtgaaaa

SEQ ID NO: 360542 - DNA, 15 bp, Homo sapiens
ggctaatgtgaaaaa

SEQ ID NO: 360543 - DNA, 15 bp, Homo sapiens
gctaatgtgaaaaac

SEQ ID NO: 360544 - DNA, 15 bp, Homo sapiens
ctaatgtgaaaaaca

SEQ ID NO: 360545 - DNA, 15 bp, Homo sapiens
taatgtgaaaaacaa

SEQ ID NO: 360546 - DNA, 15 bp, Homo sapiens
aatgtgaaaaacaat

SEQ ID NO: 360547 - DNA, 15 bp, Homo sapiens
atgtgaaaaacaatt

SEQ ID NO: 360548 - DNA, 15 bp, Homo sapiens
tgtgaaaaacaattt

SEQ ID NO: 360549 - DNA, 15 bp, Homo sapiens
gtgaaaaacaatttt

SEQ ID NO: 360550 - DNA, 15 bp, Homo sapiens
tgaaaaacaatttta

SEQ ID NO: 360551 - DNA, 15 bp, Homo sapiens
gaaaaacaattttat

SEQ ID NO: 360552 - DNA, 15 bp, Homo sapiens
aaaaacaattttatt

SEQ ID NO: 360553 - DNA, 15 bp, Homo sapiens
aaaacaattttattt

SEQ ID NO: 360554 - DNA, 15 bp, Homo sapiens
aaacaattttattta

SEQ ID NO: 360555 - DNA, 15 bp, Homo sapiens
aacaattttatttaa

SEQ ID NO: 360556 - DNA, 15 bp, Homo sapiens
acaattttatttaaa

SEQ ID NO: 360557 - DNA, 15 bp, Homo sapiens
caattttatttaaac

SEQ ID NO: 360558 - DNA, 15 bp, Homo sapiens
aattttatttaaaca

SEQ ID NO: 360559 - DNA, 15 bp, Homo sapiens
attttatttaaacaa

SEQ ID NO: 360560 - DNA, 15 bp, Homo sapiens
ttttatttaaacaat

SEQ ID NO: 360561 - DNA, 15 bp, Homo sapiens
tttatttaaacaatt

SEQ ID NO: 360562 - DNA, 15 bp, Homo sapiens
ttatttaaacaattt

SEQ ID NO: 360563 - DNA, 15 bp, Homo sapiens
tatttaaacaatttt

SEQ ID NO: 360564 - DNA, 15 bp, Homo sapiens
atttaaacaatttta

SEQ ID NO: 360565 - DNA, 15 bp, Homo sapiens
tttaaacaattttat

SEQ ID NO: 360566 - DNA, 15 bp, Homo sapiens
ttaaacaattttata

SEQ ID NO: 360567 - DNA, 15 bp, Homo sapiens
taaacaattttatat

SEQ ID NO: 360568 - DNA, 15 bp, Homo sapiens
aaacaattttatatt

SEQ ID NO: 360569 - DNA, 15 bp, Homo sapiens
aacaattttatattt

SEQ ID NO: 360570 - DNA, 15 bp, Homo sapiens
acaattttatattta

SEQ ID NO: 360571 - DNA, 15 bp, Homo sapiens
caattttatatttag

SEQ ID NO: 360572 - DNA, 15 bp, Homo sapiens
aattttatatttaga

SEQ ID NO: 360573 - DNA, 15 bp, Homo sapiens
attttatatttagaa

SEQ ID NO: 360574 - DNA, 15 bp, Homo sapiens
ttttatatttagaat

SEQ ID NO: 360575 - DNA, 15 bp, Homo sapiens
tttatatttagaata

SEQ ID NO: 360576 - DNA, 15 bp, Homo sapiens
ttatatttagaataa

SEQ ID NO: 360577 - DNA, 15 bp, Homo sapiens
tatatttagaataaa

SEQ ID NO: 360578 - DNA, 15 bp, Homo sapiens
atatttagaataaaa

SEQ ID NO: 360579 - DNA, 15 bp, Homo sapiens
tatttagaataaaat

SEQ ID NO: 360580 - DNA, 15 bp, Homo sapiens
atttagaataaaatt

SEQ ID NO: 360581 - DNA, 15 bp, Homo sapiens
tttagaataaaattt

SEQ ID NO: 360582 - DNA, 15 bp, Homo sapiens
ttagaataaaatttg

SEQ ID NO: 360583 - DNA, 15 bp, Homo sapiens
tagaataaaatttgt

SEQ ID NO: 360584 - DNA, 15 bp, Homo sapiens
agaataaaatttgta

SEQ ID NO: 360585 - DNA, 15 bp, Homo sapiens
gaataaaatttgtaa

SEQ ID NO: 360586 - DNA, 15 bp, Homo sapiens
aataaaatttgtaaa

SEQ ID NO: 360587 - DNA, 15 bp, Homo sapiens
ataaaatttgtaaac

SEQ ID NO: 360588 - DNA, 15 bp, Homo sapiens
taaaatttgtaaact

SEQ ID NO: 360589 - DNA, 15 bp, Homo sapiens
aaaatttgtaaactg

SEQ ID NO: 360590 - DNA, 15 bp, Homo sapiens
aaatttgtaaactgt

SEQ ID NO: 360591 - DNA, 15 bp, Homo sapiens
aatttgtaaactgtt

SEQ ID NO: 360592 - DNA, 15 bp, Homo sapiens
atttgtaaactgtta

SEQ ID NO: 360593 - DNA, 15 bp, Homo sapiens
tttgtaaactgttat

SEQ ID NO: 360594 - DNA, 15 bp, Homo sapiens
ttgtaaactgttatg

SEQ ID NO: 360595 - DNA, 15 bp, Homo sapiens
tgtaaactgttatgc

SEQ ID NO: 360596 - DNA, 15 bp, Homo sapiens
gtaaactgttatgcc

SEQ ID NO: 360597 - DNA, 15 bp, Homo sapiens
taaactgttatgcct

SEQ ID NO: 360598 - DNA, 15 bp, Homo sapiens
aaactgttatgccta

SEQ ID NO: 360599 - DNA, 15 bp, Homo sapiens
aactgttatgcctaa

SEQ ID NO: 360600 - DNA, 15 bp, Homo sapiens
actgttatgcctaag

SEQ ID NO: 360601 - DNA, 15 bp, Homo sapiens
ctgttatgcctaaga

SEQ ID NO: 360602 - DNA, 15 bp, Homo sapiens
tgttatgcctaagac

SEQ ID NO: 360603 - DNA, 15 bp, Homo sapiens
gttatgcctaagact

SEQ ID NO: 360604 - DNA, 15 bp, Homo sapiens
ttatgcctaagacta

SEQ ID NO: 360605 - DNA, 15 bp, Homo sapiens
tatgcctaagactat

SEQ ID NO: 360606 - DNA, 15 bp, Homo sapiens
atgcctaagactata

SEQ ID NO: 360607 - DNA, 15 bp, Homo sapiens
tgcctaagactatac

SEQ ID NO: 360608 - DNA, 15 bp, Homo sapiens
gcctaagactatacc

SEQ ID NO: 360609 - DNA, 15 bp, Homo sapiens
cctaagactatacca

SEQ ID NO: 360610 - DNA, 15 bp, Homo sapiens
ctaagactataccaa

SEQ ID NO: 360611 - DNA, 15 bp, Homo sapiens
taagactataccaag

SEQ ID NO: 360612 - DNA, 15 bp, Homo sapiens
aagactataccaaga

SEQ ID NO: 360613 - DNA, 15 bp, Homo sapiens
agactataccaagaa

SEQ ID NO: 360614 - DNA, 15 bp, Homo sapiens
gactataccaagaac

SEQ ID NO: 360615 - DNA, 15 bp, Homo sapiens
actataccaagaaca

SEQ ID NO: 360616 - DNA, 15 bp, Homo sapiens
ctataccaagaacag

SEQ ID NO: 360617 - DNA, 15 bp, Homo sapiens
tataccaagaacaga

SEQ ID NO: 360618 - DNA, 15 bp, Homo sapiens
ataccaagaacagaa

SEQ ID NO: 360619 - DNA, 15 bp, Homo sapiens
taccaagaacagaaa

SEQ ID NO: 360620 - DNA, 15 bp, Homo sapiens
accaagaacagaaaa

SEQ ID NO: 360621 - DNA, 15 bp, Homo sapiens
ccaagaacagaaaaa

SEQ ID NO: 360622 - DNA, 15 bp, Homo sapiens
caagaacagaaaaaa

SEQ ID NO: 360623 - DNA, 15 bp, Homo sapiens
aagaacagaaaaaat

SEQ ID NO: 360624 - DNA, 15 bp, Homo sapiens
agaacagaaaaaata

SEQ ID NO: 360625 - DNA, 15 bp, Homo sapiens
gaacagaaaaaatat

SEQ ID NO: 360626 - DNA, 15 bp, Homo sapiens
aacagaaaaaatatt

SEQ ID NO: 360627 - DNA, 15 bp, Homo sapiens
acagaaaaaatattt

SEQ ID NO: 360628 - DNA, 15 bp, Homo sapiens
cagaaaaaatatttg

SEQ ID NO: 360629 - DNA, 15 bp, Homo sapiens
agaaaaaatatttgc

SEQ ID NO: 360630 - DNA, 15 bp, Homo sapiens
gaaaaaatatttgca

SEQ ID NO: 360631 - DNA, 15 bp, Homo sapiens
aaaaaatatttgcat

SEQ ID NO: 360632 - DNA, 15 bp, Homo sapiens
aaaaatatttgcatg

SEQ ID NO: 360633 - DNA, 15 bp, Homo sapiens
aaaatatttgcatgc

SEQ ID NO: 360634 - DNA, 15 bp, Homo sapiens
aaatatttgcatgcc

SEQ ID NO: 360635 - DNA, 15 bp, Homo sapiens
aatatttgcatgcct

SEQ ID NO: 360636 - DNA, 15 bp, Homo sapiens
atatttgcatgcctc

SEQ ID NO: 360637 - DNA, 15 bp, Homo sapiens
tatttgcatgcctca

SEQ ID NO: 360638 - DNA, 15 bp, Homo sapiens
atttgcatgcctcac

SEQ ID NO: 360639 - DNA, 15 bp, Homo sapiens
tttgcatgcctcacc

SEQ ID NO: 360640 - DNA, 15 bp, Homo sapiens
ttgcatgcctcacct

SEQ ID NO: 360641 - DNA, 15 bp, Homo sapiens
tgcatgcctcacctc

SEQ ID NO: 360642 - DNA, 15 bp, Homo sapiens
gcatgcctcacctct

SEQ ID NO: 360643 - DNA, 15 bp, Homo sapiens
catgcctcacctctg

SEQ ID NO: 360644 - DNA, 15 bp, Homo sapiens
atgcctcacctctgt

SEQ ID NO: 360645 - DNA, 15 bp, Homo sapiens
tgcctcacctctgtt

SEQ ID NO: 360646 - DNA, 15 bp, Homo sapiens
gcctcacctctgttt

SEQ ID NO: 360647 - DNA, 15 bp, Homo sapiens
cctcacctctgtttt

SEQ ID NO: 360648 - DNA, 15 bp, Homo sapiens
ctcacctctgttttt

SEQ ID NO: 360649 - DNA, 15 bp, Homo sapiens
tcacctctgtttttt

SEQ ID NO: 360650 - DNA, 15 bp, Homo sapiens
cacctctgttttttg

SEQ ID NO: 360651 - DNA, 15 bp, Homo sapiens
acctctgttttttgt

SEQ ID NO: 360652 - DNA, 15 bp, Homo sapiens
cctctgttttttgta

SEQ ID NO: 360653 - DNA, 15 bp, Homo sapiens
ctctgttttttgtac

SEQ ID NO: 360654 - DNA, 15 bp, Homo sapiens
tctgttttttgtact

SEQ ID NO: 360655 - DNA, 15 bp, Homo sapiens
ctgttttttgtactt

SEQ ID NO: 360656 - DNA, 15 bp, Homo sapiens
tgttttttgtactta

SEQ ID NO: 360657 - DNA, 15 bp, Homo sapiens
gttttttgtacttaa

SEQ ID NO: 360658 - DNA, 15 bp, Homo sapiens
ttttttgtacttaaa

SEQ ID NO: 360659 - DNA, 15 bp, Homo sapiens
tttttgtacttaaac

SEQ ID NO: 360660 - DNA, 15 bp, Homo sapiens
ttttgtacttaaaca

SEQ ID NO: 360661 - DNA, 15 bp, Homo sapiens
tttgtacttaaacac

SEQ ID NO: 360662 - DNA, 15 bp, Homo sapiens
ttgtacttaaacact

SEQ ID NO: 360663 - DNA, 15 bp, Homo sapiens
tgtacttaaacactt

SEQ ID NO: 360664 - DNA, 15 bp, Homo sapiens
gtacttaaacactta

SEQ ID NO: 360665 - DNA, 15 bp, Homo sapiens
tacttaaacacttag

SEQ ID NO: 360666 - DNA, 15 bp, Homo sapiens
aaacacttaggcatc

SEQ ID NO: 360667 - DNA, 15 bp, Homo sapiens
aacacttaggcatct

SEQ ID NO: 360668 - DNA, 15 bp, Homo sapiens
acacttaggcatctc

SEQ ID NO: 360669 - DNA, 15 bp, Homo sapiens
cacttaggcatctca

SEQ ID NO: 360670 - DNA, 15 bp, Homo sapiens
acttaggcatctcat

SEQ ID NO: 360671 - DNA, 15 bp, Homo sapiens
cttaggcatctcatt

SEQ ID NO: 360672 - DNA, 15 bp, Homo sapiens
ttaggcatctcattt

SEQ ID NO: 360673 - DNA, 15 bp, Homo sapiens
taggcatctcatttt

SEQ ID NO: 360674 - DNA, 15 bp, Homo sapiens
aggcatctcattttt

SEQ ID NO: 360675 - DNA, 15 bp, Homo sapiens
ggcatctcatttttc

SEQ ID NO: 360676 - DNA, 15 bp, Homo sapiens
gcatctcatttttct

SEQ ID NO: 360677 - DNA, 15 bp, Homo sapiens
catctcatttttctt

SEQ ID NO: 360678 - DNA, 15 bp, Homo sapiens
atctcatttttcttt

SEQ ID NO: 360679 - DNA, 15 bp, Homo sapiens
tctcatttttctttg

SEQ ID NO: 360680 - DNA, 15 bp, Homo sapiens
ctcatttttctttgt

SEQ ID NO: 360681 - DNA, 15 bp, Homo sapiens
tcatttttctttgta

SEQ ID NO: 360682 - DNA, 15 bp, Homo sapiens
catttttctttgtat

SEQ ID NO: 360683 - DNA, 15 bp, Homo sapiens
atttttctttgtatc

SEQ ID NO: 360684 - DNA, 15 bp, Homo sapiens
tttttctttgtatca

SEQ ID NO: 360685 - DNA, 15 bp, Homo sapiens
ttttctttgtatcat

SEQ ID NO: 360686 - DNA, 15 bp, Homo sapiens
tttctttgtatcatt

SEQ ID NO: 360687 - DNA, 15 bp, Homo sapiens
ttctttgtatcattg

SEQ ID NO: 360688 - DNA, 15 bp, Homo sapiens
tctttgtatcattga

SEQ ID NO: 360689 - DNA, 15 bp, Homo sapiens
ctttgtatcattgat

SEQ ID NO: 360690 - DNA, 15 bp, Homo sapiens
tttgtatcattgata

SEQ ID NO: 360691 - DNA, 15 bp, Homo sapiens
ttgtatcattgataa

SEQ ID NO: 360692 - DNA, 15 bp, Homo sapiens
tgtatcattgataat

SEQ ID NO: 360693 - DNA, 15 bp, Homo sapiens
gtatcattgataatt

SEQ ID NO: 360694 - DNA, 15 bp, Homo sapiens
tatcattgataatta

SEQ ID NO: 360695 - DNA, 15 bp, Homo sapiens
atcattgataattat

SEQ ID NO: 360696 - DNA, 15 bp, Homo sapiens
tcattgataattatc

SEQ ID NO: 360697 - DNA, 15 bp, Homo sapiens
cattgataattatca

SEQ ID NO: 360698 - DNA, 15 bp, Homo sapiens
attgataattatcat

SEQ ID NO: 360699 - DNA, 15 bp, Homo sapiens
ttgataattatcata

SEQ ID NO: 360700 - DNA, 15 bp, Homo sapiens
tgataattatcataa

SEQ ID NO: 360701 - DNA, 15 bp, Homo sapiens
gataattatcataaa

SEQ ID NO: 360702 - DNA, 15 bp, Homo sapiens
ataattatcataaag

SEQ ID NO: 360703 - DNA, 15 bp, Homo sapiens
taattatcataaagt

SEQ ID NO: 360704 - DNA, 15 bp, Homo sapiens
aattatcataaagta

SEQ ID NO: 360705 - DNA, 15 bp, Homo sapiens
attatcataaagtaa

SEQ ID NO: 360706 - DNA, 15 bp, Homo sapiens
ttatcataaagtaaa

SEQ ID NO: 360707 - DNA, 15 bp, Homo sapiens
tatcataaagtaaat

SEQ ID NO: 360708 - DNA, 15 bp, Homo sapiens
atcataaagtaaatt

SEQ ID NO: 360709 - DNA, 15 bp, Homo sapiens
tcataaagtaaatta

SEQ ID NO: 360710 - DNA, 15 bp, Homo sapiens
cataaagtaaattat

SEQ ID NO: 360711 - DNA, 15 bp, Homo sapiens
ataaagtaaattatt

SEQ ID NO: 360712 - DNA, 15 bp, Homo sapiens
taaagtaaattattc

SEQ ID NO: 360713 - DNA, 15 bp, Homo sapiens
aaagtaaattattct

SEQ ID NO: 360714 - DNA, 15 bp, Homo sapiens
aagtaaattattctg

SEQ ID NO: 360715 - DNA, 15 bp, Homo sapiens
agtaaattattctgg

SEQ ID NO: 360716 - DNA, 15 bp, Homo sapiens
gtaaattattctgga

SEQ ID NO: 360717 - DNA, 15 bp, Homo sapiens
taaattattctggag

SEQ ID NO: 360718 - DNA, 15 bp, Homo sapiens
aaattattctggagc

SEQ ID NO: 360719 - DNA, 15 bp, Homo sapiens
aattattctggagcg

SEQ ID NO: 360720 - DNA, 15 bp, Homo sapiens
attattctggagcga

SEQ ID NO: 360721 - DNA, 15 bp, Homo sapiens
ttattctggagcgac

SEQ ID NO: 360722 - DNA, 15 bp, Homo sapiens
tattctggagcgaca

SEQ ID NO: 360723 - DNA, 15 bp, Homo sapiens
attctggagcgacag

SEQ ID NO: 360724 - DNA, 15 bp, Homo sapiens
ttctggagcgacagc

SEQ ID NO: 360725 - DNA, 15 bp, Homo sapiens
tctggagcgacagca

SEQ ID NO: 360726 - DNA, 15 bp, Homo sapiens
ctggagcgacagcag

SEQ ID NO: 360727 - DNA, 15 bp, Homo sapiens
tggagcgacagcagg

SEQ ID NO: 360728 - DNA, 15 bp, Homo sapiens
ggagcgacagcaggg

SEQ ID NO: 360729 - DNA, 15 bp, Homo sapiens
gagcgacagcagggc

SEQ ID NO: 360730 - DNA, 15 bp, Homo sapiens
agcgacagcagggca

SEQ ID NO: 360731 - DNA, 15 bp, Homo sapiens
gcgacagcagggcag

SEQ ID NO: 360732 - DNA, 15 bp, Homo sapiens
cgacagcagggcagc

SEQ ID NO: 360733 - DNA, 15 bp, Homo sapiens
gacagcagggcagct

SEQ ID NO: 360734 - DNA, 15 bp, Homo sapiens
acagcagggcagctg

SEQ ID NO: 360735 - DNA, 15 bp, Homo sapiens
cagcagggcagctgc

SEQ ID NO: 360736 - DNA, 15 bp, Homo sapiens
agcagggcagctgct

SEQ ID NO: 360737 - DNA, 15 bp, Homo sapiens
gcagggcagctgctc

SEQ ID NO: 360738 - DNA, 15 bp, Homo sapiens
cagggcagctgctca

SEQ ID NO: 360739 - DNA, 15 bp, Homo sapiens
agggcagctgctcat

SEQ ID NO: 360740 - DNA, 15 bp, Homo sapiens
gggcagctgctcatg

SEQ ID NO: 360741 - DNA, 15 bp, Homo sapiens
ggcagctgctcatgt

SEQ ID NO: 360742 - DNA, 15 bp, Homo sapiens
gcagctgctcatgta

SEQ ID NO: 360743 - DNA, 15 bp, Homo sapiens
cagctgctcatgtaa

SEQ ID NO: 360744 - DNA, 15 bp, Homo sapiens
agctgctcatgtaag

SEQ ID NO: 360745 - DNA, 15 bp, Homo sapiens
gctgctcatgtaagt

SEQ ID NO: 360746 - DNA, 15 bp, Homo sapiens
ctgctcatgtaagtc

SEQ ID NO: 360747 - DNA, 15 bp, Homo sapiens
tgctcatgtaagtct

SEQ ID NO: 360748 - DNA, 15 bp, Homo sapiens
gctcatgtaagtcta

SEQ ID NO: 360749 - DNA, 15 bp, Homo sapiens
ctcatgtaagtctaa

SEQ ID NO: 360750 - DNA, 15 bp, Homo sapiens
tcatgtaagtctaat

SEQ ID NO: 360751 - DNA, 15 bp, Homo sapiens
catgtaagtctaatt

SEQ ID NO: 360752 - DNA, 15 bp, Homo sapiens
atgtaagtctaattc

SEQ ID NO: 360753 - DNA, 15 bp, Homo sapiens
tgtaagtctaattca

SEQ ID NO: 360754 - DNA, 15 bp, Homo sapiens
gtaagtctaattcag

SEQ ID NO: 360755 - DNA, 15 bp, Homo sapiens
taagtctaattcagt

SEQ ID NO: 360756 - DNA, 15 bp, Homo sapiens
aagtctaattcagtc

SEQ ID NO: 360757 - DNA, 15 bp, Homo sapiens
agtctaattcagtct

SEQ ID NO: 360758 - DNA, 15 bp, Homo sapiens
gtctaattcagtctt

SEQ ID NO: 360759 - DNA, 15 bp, Homo sapiens
tctaattcagtcttg

SEQ ID NO: 360760 - DNA, 15 bp, Homo sapiens
ctaattcagtcttgg

SEQ ID NO: 360761 - DNA, 15 bp, Homo sapiens
taattcagtcttggg

SEQ ID NO: 360762 - DNA, 15 bp, Homo sapiens
aattcagtcttggga

SEQ ID NO: 360763 - DNA, 15 bp, Homo sapiens
attcagtcttgggaa

SEQ ID NO: 360764 - DNA, 15 bp, Homo sapiens
ttcagtcttgggaaa

SEQ ID NO: 360765 - DNA, 15 bp, Homo sapiens
tcagtcttgggaaaa

SEQ ID NO: 360766 - DNA, 15 bp, Homo sapiens
cagtcttgggaaaat

SEQ ID NO: 360767 - DNA, 15 bp, Homo sapiens
agtcttgggaaaata

SEQ ID NO: 360768 - DNA, 15 bp, Homo sapiens
gtcttgggaaaatat

SEQ ID NO: 360769 - DNA, 15 bp, Homo sapiens
tcttgggaaaatata

SEQ ID NO: 360770 - DNA, 15 bp, Homo sapiens
cttgggaaaatataa

SEQ ID NO: 360771 - DNA, 15 bp, Homo sapiens
ttgggaaaatataac

SEQ ID NO: 360772 - DNA, 15 bp, Homo sapiens
tgggaaaatataaca

SEQ ID NO: 360773 - DNA, 15 bp, Homo sapiens
gggaaaatataacac

SEQ ID NO: 360774 - DNA, 15 bp, Homo sapiens
ggaaaatataacaca

SEQ ID NO: 360775 - DNA, 15 bp, Homo sapiens
gaaaatataacacaa

SEQ ID NO: 360776 - DNA, 15 bp, Homo sapiens
aaaatataacacaaa

SEQ ID NO: 360777 - DNA, 15 bp, Homo sapiens
aaatataacacaaag

SEQ ID NO: 360778 - DNA, 15 bp, Homo sapiens
aatataacacaaagt

SEQ ID NO: 360779 - DNA, 15 bp, Homo sapiens
atataacacaaagtt

SEQ ID NO: 360780 - DNA, 15 bp, Homo sapiens
tataacacaaagtta

SEQ ID NO: 360781 - DNA, 15 bp, Homo sapiens
ataacacaaagttag

SEQ ID NO: 360782 - DNA, 15 bp, Homo sapiens
taacacaaagttagt

SEQ ID NO: 360783 - DNA, 15 bp, Homo sapiens
aacacaaagttagtt

SEQ ID NO: 360784 - DNA, 15 bp, Homo sapiens
acacaaagttagttc

SEQ ID NO: 360785 - DNA, 15 bp, Homo sapiens
cacaaagttagttct

SEQ ID NO: 360786 - DNA, 15 bp, Homo sapiens
acaaagttagttctg

SEQ ID NO: 360787 - DNA, 15 bp, Homo sapiens
caaagttagttctga

SEQ ID NO: 360788 - DNA, 15 bp, Homo sapiens
aaagttagttctgat

SEQ ID NO: 360789 - DNA, 15 bp, Homo sapiens
aagttagttctgata

SEQ ID NO: 360790 - DNA, 15 bp, Homo sapiens
agttagttctgataa

SEQ ID NO: 360791 - DNA, 15 bp, Homo sapiens
gttagttctgataac

SEQ ID NO: 360792 - DNA, 15 bp, Homo sapiens
ttagttctgataaca

SEQ ID NO: 360793 - DNA, 15 bp, Homo sapiens
tagttctgataacaa

SEQ ID NO: 360794 - DNA, 15 bp, Homo sapiens
agttctgataacaat

SEQ ID NO: 360795 - DNA, 15 bp, Homo sapiens
gttctgataacaata

SEQ ID NO: 360796 - DNA, 15 bp, Homo sapiens
ttctgataacaatag

SEQ ID NO: 360797 - DNA, 15 bp, Homo sapiens
tctgataacaatagg

SEQ ID NO: 360798 - DNA, 15 bp, Homo sapiens
ctgataacaataggt

SEQ ID NO: 360799 - DNA, 15 bp, Homo sapiens
tgataacaataggtc

SEQ ID NO: 360800 - DNA, 15 bp, Homo sapiens
gataacaataggtct

SEQ ID NO: 360801 - DNA, 15 bp, Homo sapiens
ataacaataggtctt

SEQ ID NO: 360802 - DNA, 15 bp, Homo sapiens
taacaataggtcttt

SEQ ID NO: 360803 - DNA, 15 bp, Homo sapiens
aacaataggtcttta

SEQ ID NO: 360804 - DNA, 15 bp, Homo sapiens
acaataggtctttaa

SEQ ID NO: 360805 - DNA, 15 bp, Homo sapiens
caataggtctttaaa

SEQ ID NO: 360806 - DNA, 15 bp, Homo sapiens
aataggtctttaaaa

SEQ ID NO: 360807 - DNA, 15 bp, Homo sapiens
ataggtctttaaaaa

SEQ ID NO: 360808 - DNA, 15 bp, Homo sapiens
taggtctttaaaaat

SEQ ID NO: 360809 - DNA, 15 bp, Homo sapiens
aggtctttaaaaata

SEQ ID NO: 360810 - DNA, 15 bp, Homo sapiens
ggtctttaaaaataa

SEQ ID NO: 360811 - DNA, 15 bp, Homo sapiens
gtctttaaaaataat

SEQ ID NO: 360812 - DNA, 15 bp, Homo sapiens
ctttaaaaataatgg

SEQ ID NO: 360813 - DNA, 15 bp, Homo sapiens
tttaaaaataatggt

SEQ ID NO: 360814 - DNA, 15 bp, Homo sapiens
ttaaaaataatggta

SEQ ID NO: 360815 - DNA, 15 bp, Homo sapiens
taaaaataatggtag

SEQ ID NO: 360816 - DNA, 15 bp, Homo sapiens
aaaaataatggtaga

SEQ ID NO: 360817 - DNA, 15 bp, Homo sapiens
aaaataatggtagaa

SEQ ID NO: 360818 - DNA, 15 bp, Homo sapiens
aaataatggtagaaa

SEQ ID NO: 360819 - DNA, 15 bp, Homo sapiens
aataatggtagaaag

SEQ ID NO: 360820 - DNA, 15 bp, Homo sapiens
ataatggtagaaagc

SEQ ID NO: 360821 - DNA, 15 bp, Homo sapiens
taatggtagaaagca

SEQ ID NO: 360822 - DNA, 15 bp, Homo sapiens
aatggtagaaagcac

SEQ ID NO: 360823 - DNA, 15 bp, Homo sapiens
atggtagaaagcaca

SEQ ID NO: 360824 - DNA, 15 bp, Homo sapiens
tggtagaaagcacac

SEQ ID NO: 360825 - DNA, 15 bp, Homo sapiens
ggtagaaagcacacg

SEQ ID NO: 360826 - DNA, 15 bp, Homo sapiens
gtagaaagcacacgc

SEQ ID NO: 360827 - DNA, 15 bp, Homo sapiens
tagaaagcacacgca

SEQ ID NO: 360828 - DNA, 15 bp, Homo sapiens
agaaagcacacgcaa

SEQ ID NO: 360829 - DNA, 15 bp, Homo sapiens
gaaagcacacgcaat

SEQ ID NO: 360830 - DNA, 15 bp, Homo sapiens
aaagcacacgcaatt

SEQ ID NO: 360831 - DNA, 15 bp, Homo sapiens
aagcacacgcaattt

SEQ ID NO: 360832 - DNA, 15 bp, Homo sapiens
agcacacgcaatttc

SEQ ID NO: 360833 - DNA, 15 bp, Homo sapiens
gcacacgcaatttca

SEQ ID NO: 360834 - DNA, 15 bp, Homo sapiens
cacacgcaatttcaa

SEQ ID NO: 360835 - DNA, 15 bp, Homo sapiens
acacgcaatttcaat

SEQ ID NO: 360836 - DNA, 15 bp, Homo sapiens
cacgcaatttcaatt

SEQ ID NO: 360837 - DNA, 15 bp, Homo sapiens
acgcaatttcaattc

SEQ ID NO: 360838 - DNA, 15 bp, Homo sapiens
cgcaatttcaattct

SEQ ID NO: 360839 - DNA, 15 bp, Homo sapiens
gcaatttcaattcta

SEQ ID NO: 360840 - DNA, 15 bp, Homo sapiens
caatttcaattctac

SEQ ID NO: 360841 - DNA, 15 bp, Homo sapiens
aatttcaattctacc

SEQ ID NO: 360842 - DNA, 15 bp, Homo sapiens
atttcaattctacca

SEQ ID NO: 360843 - DNA, 15 bp, Homo sapiens
tttcaattctaccat

SEQ ID NO: 360844 - DNA, 15 bp, Homo sapiens
ttcaattctaccatt

SEQ ID NO: 360845 - DNA, 15 bp, Homo sapiens
tcaattctaccattg

SEQ ID NO: 360846 - DNA, 15 bp, Homo sapiens
caattctaccattga

SEQ ID NO: 360847 - DNA, 15 bp, Homo sapiens
aattctaccattgat

SEQ ID NO: 360848 - DNA, 15 bp, Homo sapiens
attctaccattgata

SEQ ID NO: 360849 - DNA, 15 bp, Homo sapiens
ttctaccattgataa

SEQ ID NO: 360850 - DNA, 15 bp, Homo sapiens
tctaccattgataaa

SEQ ID NO: 360851 - DNA, 15 bp, Homo sapiens
ctaccattgataaaa

SEQ ID NO: 360852 - DNA, 15 bp, Homo sapiens
taccattgataaaaa

SEQ ID NO: 360853 - DNA, 15 bp, Homo sapiens
accattgataaaaat

SEQ ID NO: 360854 - DNA, 15 bp, Homo sapiens
ccattgataaaaata

SEQ ID NO: 360855 - DNA, 15 bp, Homo sapiens
cattgataaaaatat

SEQ ID NO: 360856 - DNA, 15 bp, Homo sapiens
attgataaaaatatt

SEQ ID NO: 360857 - DNA, 15 bp, Homo sapiens
ttgataaaaatattt

SEQ ID NO: 360858 - DNA, 15 bp, Homo sapiens
tgataaaaatatttt

SEQ ID NO: 360859 - DNA, 15 bp, Homo sapiens
gataaaaatattttc

SEQ ID NO: 360860 - DNA, 15 bp, Homo sapiens
ataaaaatattttct

SEQ ID NO: 360861 - DNA, 15 bp, Homo sapiens
taaaaatattttctc

SEQ ID NO: 360862 - DNA, 15 bp, Homo sapiens
aaaaatattttctct

SEQ ID NO: 360863 - DNA, 15 bp, Homo sapiens
aaaatattttctctt

SEQ ID NO: 360864 - DNA, 15 bp, Homo sapiens
aaatattttctcttt

SEQ ID NO: 360865 - DNA, 15 bp, Homo sapiens
aatattttctctttt

SEQ ID NO: 360866 - DNA, 15 bp, Homo sapiens
atattttctctttta

SEQ ID NO: 360867 - DNA, 15 bp, Homo sapiens
tattttctcttttat

SEQ ID NO: 360868 - DNA, 15 bp, Homo sapiens
attttctcttttatt

SEQ ID NO: 360869 - DNA, 15 bp, Homo sapiens
ttttctcttttatta

SEQ ID NO: 360870 - DNA, 15 bp, Homo sapiens
tttctcttttattaa

SEQ ID NO: 360871 - DNA, 15 bp, Homo sapiens
ttctcttttattaag

SEQ ID NO: 360872 - DNA, 15 bp, Homo sapiens
tctcttttattaagt

SEQ ID NO: 360873 - DNA, 15 bp, Homo sapiens
ctcttttattaagtt

SEQ ID NO: 360874 - DNA, 15 bp, Homo sapiens
tcttttattaagttt

SEQ ID NO: 360875 - DNA, 15 bp, Homo sapiens
cttttattaagtttt

SEQ ID NO: 360876 - DNA, 15 bp, Homo sapiens
ttttattaagttttt

SEQ ID NO: 360877 - DNA, 15 bp, Homo sapiens
tttattaagtttttt

SEQ ID NO: 360878 - DNA, 15 bp, Homo sapiens
ttattaagtttttta

SEQ ID NO: 360879 - DNA, 15 bp, Homo sapiens
tattaagttttttaa

SEQ ID NO: 360880 - DNA, 15 bp, Homo sapiens
attaagttttttaaa

SEQ ID NO: 360881 - DNA, 15 bp, Homo sapiens
ttaagttttttaaat

SEQ ID NO: 360882 - DNA, 15 bp, Homo sapiens
taagttttttaaatg

SEQ ID NO: 360883 - DNA, 15 bp, Homo sapiens
aagttttttaaatgt

SEQ ID NO: 360884 - DNA, 15 bp, Homo sapiens
agttttttaaatgta

SEQ ID NO: 360885 - DNA, 15 bp, Homo sapiens
gttttttaaatgtat

SEQ ID NO: 360886 - DNA, 15 bp, Homo sapiens
ttttttaaatgtatt

SEQ ID NO: 360887 - DNA, 15 bp, Homo sapiens
tttttaaatgtattt

SEQ ID NO: 360888 - DNA, 15 bp, Homo sapiens
ttttaaatgtatttt

SEQ ID NO: 360889 - DNA, 15 bp, Homo sapiens
tttaaatgtatttta

SEQ ID NO: 360890 - DNA, 15 bp, Homo sapiens
ttaaatgtattttat

SEQ ID NO: 360891 - DNA, 15 bp, Homo sapiens
taaatgtattttatt

SEQ ID NO: 360892 - DNA, 15 bp, Homo sapiens
aaatgtattttattt

SEQ ID NO: 360893 - DNA, 15 bp, Homo sapiens
aatgtattttattta

SEQ ID NO: 360894 - DNA, 15 bp, Homo sapiens
atgtattttatttag

SEQ ID NO: 360895 - DNA, 15 bp, Homo sapiens
tgtattttatttaga

SEQ ID NO: 360896 - DNA, 15 bp, Homo sapiens
gtattttatttagaa

SEQ ID NO: 360897 - DNA, 15 bp, Homo sapiens
tattttatttagaag

SEQ ID NO: 360898 - DNA, 15 bp, Homo sapiens
attttatttagaagg

SEQ ID NO: 360899 - DNA, 15 bp, Homo sapiens
ttttatttagaagga

SEQ ID NO: 360900 - DNA, 15 bp, Homo sapiens
tttatttagaaggac

SEQ ID NO: 360901 - DNA, 15 bp, Homo sapiens
ttatttagaaggaca

SEQ ID NO: 360902 - DNA, 15 bp, Homo sapiens
tatttagaaggacat

SEQ ID NO: 360903 - DNA, 15 bp, Homo sapiens
atttagaaggacatg

SEQ ID NO: 360904 - DNA, 15 bp, Homo sapiens
tttagaaggacatga

SEQ ID NO: 360905 - DNA, 15 bp, Homo sapiens
ttagaaggacatgac

SEQ ID NO: 360906 - DNA, 15 bp, Homo sapiens
tagaaggacatgaca

SEQ ID NO: 360907 - DNA, 15 bp, Homo sapiens
agaaggacatgacaa

SEQ ID NO: 360908 - DNA, 15 bp, Homo sapiens
gaaggacatgacaat

SEQ ID NO: 360909 - DNA, 15 bp, Homo sapiens
aaggacatgacaatt

SEQ ID NO: 360910 - DNA, 15 bp, Homo sapiens
aggacatgacaattt

SEQ ID NO: 360911 - DNA, 15 bp, Homo sapiens
ggacatgacaattta

SEQ ID NO: 360912 - DNA, 15 bp, Homo sapiens
gacatgacaatttaa

SEQ ID NO: 360913 - DNA, 15 bp, Homo sapiens
acatgacaatttaaa

SEQ ID NO: 360914 - DNA, 15 bp, Homo sapiens
catgacaatttaaag

SEQ ID NO: 360915 - DNA, 15 bp, Homo sapiens
atgacaatttaaaga

SEQ ID NO: 360916 - DNA, 15 bp, Homo sapiens
tgacaatttaaagat

SEQ ID NO: 360917 - DNA, 15 bp, Homo sapiens
gacaatttaaagata

SEQ ID NO: 360918 - DNA, 15 bp, Homo sapiens
acaatttaaagataa

SEQ ID NO: 360919 - DNA, 15 bp, Homo sapiens
caatttaaagataat

SEQ ID NO: 360920 - DNA, 15 bp, Homo sapiens
aatttaaagataatt

SEQ ID NO: 360921 - DNA, 15 bp, Homo sapiens
atttaaagataattc

SEQ ID NO: 360922 - DNA, 15 bp, Homo sapiens
tttaaagataattca

SEQ ID NO: 360923 - DNA, 15 bp, Homo sapiens
ttaaagataattcat

SEQ ID NO: 360924 - DNA, 15 bp, Homo sapiens
taaagataattcatt

SEQ ID NO: 360925 - DNA, 15 bp, Homo sapiens
aaagataattcattt

SEQ ID NO: 360926 - DNA, 15 bp, Homo sapiens
aagataattcatttg

SEQ ID NO: 360927 - DNA, 15 bp, Homo sapiens
agataattcatttgt

SEQ ID NO: 360928 - DNA, 15 bp, Homo sapiens
gataattcatttgtt

SEQ ID NO: 360929 - DNA, 15 bp, Homo sapiens
ataattcatttgttt

SEQ ID NO: 360930 - DNA, 15 bp, Homo sapiens
taattcatttgtttt

SEQ ID NO: 360931 - DNA, 15 bp, Homo sapiens
aattcatttgttttt

SEQ ID NO: 360932 - DNA, 15 bp, Homo sapiens
attcatttgtttttc

SEQ ID NO: 360933 - DNA, 15 bp, Homo sapiens
ttcatttgtttttct

SEQ ID NO: 360934 - DNA, 15 bp, Homo sapiens
tcatttgtttttctt

SEQ ID NO: 360935 - DNA, 15 bp, Homo sapiens
catttgtttttctta

SEQ ID NO: 360936 - DNA, 15 bp, Homo sapiens
atttgtttttcttat

SEQ ID NO: 360937 - DNA, 15 bp, Homo sapiens
tttgtttttcttata

SEQ ID NO: 360938 - DNA, 15 bp, Homo sapiens
ttgtttttcttataa

SEQ ID NO: 360939 - DNA, 15 bp, Homo sapiens
tgtttttcttataaa

SEQ ID NO: 360940 - DNA, 15 bp, Homo sapiens
gtttttcttataaat

SEQ ID NO: 360941 - DNA, 15 bp, Homo sapiens
tttttcttataaatg

SEQ ID NO: 360942 - DNA, 15 bp, Homo sapiens
ttttcttataaatgt

SEQ ID NO: 360943 - DNA, 15 bp, Homo sapiens
tttcttataaatgtg

SEQ ID NO: 360944 - DNA, 15 bp, Homo sapiens
ttcttataaatgtgt

SEQ ID NO: 360945 - DNA, 15 bp, Homo sapiens
tcttataaatgtgtt

SEQ ID NO: 360946 - DNA, 15 bp, Homo sapiens
cttataaatgtgtta

SEQ ID NO: 360947 - DNA, 15 bp, Homo sapiens
ttataaatgtgttaa

SEQ ID NO: 360948 - DNA, 15 bp, Homo sapiens
tataaatgtgttaat

SEQ ID NO: 360949 - DNA, 15 bp, Homo sapiens
ataaatgtgttaatg

SEQ ID NO: 360950 - DNA, 15 bp, Homo sapiens
taaatgtgttaatgt

SEQ ID NO: 360951 - DNA, 15 bp, Homo sapiens
aaatgtgttaatgtg

SEQ ID NO: 360952 - DNA, 15 bp, Homo sapiens
aatgtgttaatgtgg

SEQ ID NO: 360953 - DNA, 15 bp, Homo sapiens
atgtgttaatgtggc

SEQ ID NO: 360954 - DNA, 15 bp, Homo sapiens
tgtgttaatgtggcc

SEQ ID NO: 360955 - DNA, 15 bp, Homo sapiens
gtgttaatgtggccg

SEQ ID NO: 360956 - DNA, 15 bp, Homo sapiens
tgttaatgtggccgg

SEQ ID NO: 360957 - DNA, 15 bp, Homo sapiens
gttaatgtggccggg

SEQ ID NO: 360958 - DNA, 15 bp, Homo sapiens
ttaatgtggccgggc

SEQ ID NO: 360959 - DNA, 15 bp, Homo sapiens
taatgtggccgggcg

SEQ ID NO: 360960 - DNA, 15 bp, Homo sapiens
aatgtggccgggcgc

SEQ ID NO: 360961 - DNA, 15 bp, Homo sapiens
atgtggccgggcgcg

SEQ ID NO: 360962 - DNA, 15 bp, Homo sapiens
tgtggccgggcgcgg

SEQ ID NO: 360963 - DNA, 15 bp, Homo sapiens
gtggccgggcgcggt

SEQ ID NO: 360964 - DNA, 15 bp, Homo sapiens
tggccgggcgcggtg

SEQ ID NO: 360965 - DNA, 15 bp, Homo sapiens
ggccgggcgcggtgc

SEQ ID NO: 360966 - DNA, 15 bp, Homo sapiens
gccgggcgcggtgcc

SEQ ID NO: 360967 - DNA, 15 bp, Homo sapiens
ccgggcgcggtgcct

SEQ ID NO: 360968 - DNA, 15 bp, Homo sapiens
cgggcgcggtgcctc

SEQ ID NO: 360969 - DNA, 15 bp, Homo sapiens
gggcgcggtgcctca

SEQ ID NO: 360970 - DNA, 15 bp, Homo sapiens
ggcgcggtgcctcac

SEQ ID NO: 360971 - DNA, 15 bp, Homo sapiens
gcgcggtgcctcaca

SEQ ID NO: 360972 - DNA, 15 bp, Homo sapiens
cgcggtgcctcacac

SEQ ID NO: 360973 - DNA, 15 bp, Homo sapiens
gcggtgcctcacact

SEQ ID NO: 360974 - DNA, 15 bp, Homo sapiens
cggtgcctcacactt

SEQ ID NO: 360975 - DNA, 15 bp, Homo sapiens
ggtgcctcacacttg

SEQ ID NO: 360976 - DNA, 15 bp, Homo sapiens
gtgcctcacacttgt

SEQ ID NO: 360977 - DNA, 15 bp, Homo sapiens
tgcctcacacttgta

SEQ ID NO: 360978 - DNA, 15 bp, Homo sapiens
gcctcacacttgtaa

SEQ ID NO: 360979 - DNA, 15 bp, Homo sapiens
cctcacacttgtaat

SEQ ID NO: 360980 - DNA, 15 bp, Homo sapiens
ctcacacttgtaatc

SEQ ID NO: 360981 - DNA, 15 bp, Homo sapiens
tcacacttgtaatcc

SEQ ID NO: 360982 - DNA, 15 bp, Homo sapiens
cacacttgtaatccc

SEQ ID NO: 360983 - DNA, 15 bp, Homo sapiens
acacttgtaatccca

SEQ ID NO: 360984 - DNA, 15 bp, Homo sapiens
cacttgtaatcccag

SEQ ID NO: 360985 - DNA, 15 bp, Homo sapiens
acttgtaatcccagc

SEQ ID NO: 360986 - DNA, 15 bp, Homo sapiens
ttgtaatcccagcat

SEQ ID NO: 360987 - DNA, 15 bp, Homo sapiens
tgtaatcccagcatt

SEQ ID NO: 360988 - DNA, 15 bp, Homo sapiens
gtaatcccagcattt

SEQ ID NO: 360989 - DNA, 15 bp, Homo sapiens
taatcccagcatttt

SEQ ID NO: 360990 - DNA, 15 bp, Homo sapiens
aatcccagcattttg

SEQ ID NO: 360991 - DNA, 15 bp, Homo sapiens
atcccagcattttgg

SEQ ID NO: 360992 - DNA, 15 bp, Homo sapiens
tcccagcattttggg

SEQ ID NO: 360993 - DNA, 15 bp, Homo sapiens
cccagcattttggga

SEQ ID NO: 360994 - DNA, 15 bp, Homo sapiens
ccagcattttgggag

SEQ ID NO: 360995 - DNA, 15 bp, Homo sapiens
cagcattttgggagg

SEQ ID NO: 360996 - DNA, 15 bp, Homo sapiens
agcattttgggaggc

SEQ ID NO: 360997 - DNA, 15 bp, Homo sapiens
gaggctgaggtgggc

SEQ ID NO: 360998 - DNA, 15 bp, Homo sapiens
aggctgaggtgggcg

SEQ ID NO: 360999 - DNA, 15 bp, Homo sapiens
ggctgaggtgggcgg

SEQ ID NO: 361000 - DNA, 15 bp, Homo sapiens
gctgaggtgggcgga

SEQ ID NO: 361001 - DNA, 15 bp, Homo sapiens
ctgaggtgggcggat

SEQ ID NO: 361002 - DNA, 15 bp, Homo sapiens
tgaggtgggcggatt

SEQ ID NO: 361003 - DNA, 15 bp, Homo sapiens
gaggtgggcggatta

SEQ ID NO: 361004 - DNA, 15 bp, Homo sapiens
aggtgggcggattat

SEQ ID NO: 361005 - DNA, 15 bp, Homo sapiens
ggtgggcggattatg

SEQ ID NO: 361006 - DNA, 15 bp, Homo sapiens
gtgggcggattatga

SEQ ID NO: 361007 - DNA, 15 bp, Homo sapiens
tgggcggattatgag

SEQ ID NO: 361008 - DNA, 15 bp, Homo sapiens
gggcggattatgagg

SEQ ID NO: 361009 - DNA, 15 bp, Homo sapiens
ggcggattatgaggt

SEQ ID NO: 361010 - DNA, 15 bp, Homo sapiens
gcggattatgaggtc

SEQ ID NO: 361011 - DNA, 15 bp, Homo sapiens
cggattatgaggtca

SEQ ID NO: 361012 - DNA, 15 bp, Homo sapiens
ggattatgaggtcag

SEQ ID NO: 361013 - DNA, 15 bp, Homo sapiens
gattatgaggtcagg

SEQ ID NO: 361014 - DNA, 15 bp, Homo sapiens
attatgaggtcagga

SEQ ID NO: 361015 - DNA, 15 bp, Homo sapiens
ttatgaggtcaggag

SEQ ID NO: 361016 - DNA, 15 bp, Homo sapiens
tatgaggtcaggaga

SEQ ID NO: 361017 - DNA, 15 bp, Homo sapiens
ctaacatggtgaaaa

SEQ ID NO: 361018 - DNA, 15 bp, Homo sapiens
taacatggtgaaaac

SEQ ID NO: 361019 - DNA, 15 bp, Homo sapiens
aacatggtgaaaacc

SEQ ID NO: 361020 - DNA, 15 bp, Homo sapiens
acatggtgaaaaccc

SEQ ID NO: 361021 - DNA, 15 bp, Homo sapiens
catggtgaaaaccca

SEQ ID NO: 361022 - DNA, 15 bp, Homo sapiens
atggtgaaaacccat

SEQ ID NO: 361023 - DNA, 15 bp, Homo sapiens
tggtgaaaacccatc

SEQ ID NO: 361024 - DNA, 15 bp, Homo sapiens
ggtgaaaacccatct

SEQ ID NO: 361025 - DNA, 15 bp, Homo sapiens
gtgaaaacccatctc

SEQ ID NO: 361026 - DNA, 15 bp, Homo sapiens
tgaaaacccatctct

SEQ ID NO: 361027 - DNA, 15 bp, Homo sapiens
gaaaacccatctcta

SEQ ID NO: 361028 - DNA, 15 bp, Homo sapiens
aaaacccatctctac

SEQ ID NO: 361029 - DNA, 15 bp, Homo sapiens
aaacccatctctact

SEQ ID NO: 361030 - DNA, 15 bp, Homo sapiens
aacccatctctacta

SEQ ID NO: 361031 - DNA, 15 bp, Homo sapiens
acccatctctactaa

SEQ ID NO: 361032 - DNA, 15 bp, Homo sapiens
gccgggcatggtgga

SEQ ID NO: 361033 - DNA, 15 bp, Homo sapiens
ccgggcatggtggaa

SEQ ID NO: 361034 - DNA, 15 bp, Homo sapiens
cgggcatggtggaac

SEQ ID NO: 361035 - DNA, 15 bp, Homo sapiens
gggcatggtggaacg

SEQ ID NO: 361036 - DNA, 15 bp, Homo sapiens
ggcatggtggaacgc

SEQ ID NO: 361037 - DNA, 15 bp, Homo sapiens
gcatggtggaacgca

SEQ ID NO: 361038 - DNA, 15 bp, Homo sapiens
catggtggaacgcac

SEQ ID NO: 361039 - DNA, 15 bp, Homo sapiens
atggtggaacgcacc

SEQ ID NO: 361040 - DNA, 15 bp, Homo sapiens
tggtggaacgcacct

SEQ ID NO: 361041 - DNA, 15 bp, Homo sapiens
ggtggaacgcacctg

SEQ ID NO: 361042 - DNA, 15 bp, Homo sapiens
gtggaacgcacctgc

SEQ ID NO: 361043 - DNA, 15 bp, Homo sapiens
tggaacgcacctgca

SEQ ID NO: 361044 - DNA, 15 bp, Homo sapiens
ggaacgcacctgcag

SEQ ID NO: 361045 - DNA, 15 bp, Homo sapiens
gaacgcacctgcagt

SEQ ID NO: 361046 - DNA, 15 bp, Homo sapiens
aacgcacctgcagtc

SEQ ID NO: 361047 - DNA, 15 bp, Homo sapiens
acgcacctgcagtcc

SEQ ID NO: 361048 - DNA, 15 bp, Homo sapiens
cgcacctgcagtccc

SEQ ID NO: 361049 - DNA, 15 bp, Homo sapiens
gcacctgcagtccca

SEQ ID NO: 361050 - DNA, 15 bp, Homo sapiens
cacctgcagtcccag

SEQ ID NO: 361051 - DNA, 15 bp, Homo sapiens
acctgcagtcccagc

SEQ ID NO: 361052 - DNA, 15 bp, Homo sapiens
agtgagccaagatcg

SEQ ID NO: 361053 - DNA, 15 bp, Homo sapiens
gtgagccaagatcgt

SEQ ID NO: 361054 - DNA, 15 bp, Homo sapiens
tgagccaagatcgtg

SEQ ID NO: 361055 - DNA, 15 bp, Homo sapiens
gagccaagatcgtgc

SEQ ID NO: 361056 - DNA, 15 bp, Homo sapiens
agccaagatcgtgcc

SEQ ID NO: 361057 - DNA, 15 bp, Homo sapiens
gccaagatcgtgcca

SEQ ID NO: 361058 - DNA, 15 bp, Homo sapiens
ccaagatcgtgccac

SEQ ID NO: 361059 - DNA, 15 bp, Homo sapiens
caagatcgtgccact

SEQ ID NO: 361060 - DNA, 15 bp, Homo sapiens
aagatcgtgccactg

SEQ ID NO: 361061 - DNA, 15 bp, Homo sapiens
gggtgacagagcaat

SEQ ID NO: 361062 - DNA, 15 bp, Homo sapiens
ggtgacagagcaata

SEQ ID NO: 361063 - DNA, 15 bp, Homo sapiens
gtgacagagcaatac

SEQ ID NO: 361064 - DNA, 15 bp, Homo sapiens
tgacagagcaatact

SEQ ID NO: 361065 - DNA, 15 bp, Homo sapiens
gacagagcaatactg

SEQ ID NO: 361066 - DNA, 15 bp, Homo sapiens
acagagcaatactgt

SEQ ID NO: 361067 - DNA, 15 bp, Homo sapiens
cagagcaatactgtg

SEQ ID NO: 361068 - DNA, 15 bp, Homo sapiens
agagcaatactgtgt

SEQ ID NO: 361069 - DNA, 15 bp, Homo sapiens
gagcaatactgtgtc

SEQ ID NO: 361070 - DNA, 15 bp, Homo sapiens
agcaatactgtgtca

SEQ ID NO: 361071 - DNA, 15 bp, Homo sapiens
gcaatactgtgtcaa

SEQ ID NO: 361072 - DNA, 15 bp, Homo sapiens
caatactgtgtcaat

SEQ ID NO: 361073 - DNA, 15 bp, Homo sapiens
aatactgtgtcaata

SEQ ID NO: 361074 - DNA, 15 bp, Homo sapiens
atactgtgtcaataa

SEQ ID NO: 361075 - DNA, 15 bp, Homo sapiens
tactgtgtcaataaa

SEQ ID NO: 361076 - DNA, 15 bp, Homo sapiens
actgtgtcaataaat

SEQ ID NO: 361077 - DNA, 15 bp, Homo sapiens
ctgtgtcaataaata

SEQ ID NO: 361078 - DNA, 15 bp, Homo sapiens
tgtgtcaataaataa

SEQ ID NO: 361079 - DNA, 15 bp, Homo sapiens
gtgtcaataaataaa

SEQ ID NO: 361080 - DNA, 15 bp, Homo sapiens
tgtcaataaataaat

SEQ ID NO: 361081 - DNA, 15 bp, Homo sapiens
gtcaataaataaata

SEQ ID NO: 361082 - DNA, 15 bp, Homo sapiens
tcaataaataaataa

SEQ ID NO: 361083 - DNA, 15 bp, Homo sapiens
ataaataaataaatg

SEQ ID NO: 361084 - DNA, 15 bp, Homo sapiens
taaataaataaatgt

SEQ ID NO: 361085 - DNA, 15 bp, Homo sapiens
aaataaataaatgtg

SEQ ID NO: 361086 - DNA, 15 bp, Homo sapiens
aataaataaatgtgt

SEQ ID NO: 361087 - DNA, 15 bp, Homo sapiens
ataaataaatgtgtt

SEQ ID NO: 361088 - DNA, 15 bp, Homo sapiens
taaataaatgtgtta

SEQ ID NO: 361089 - DNA, 15 bp, Homo sapiens
aaataaatgtgttaa

SEQ ID NO: 361090 - DNA, 15 bp, Homo sapiens
aataaatgtgttaat

SEQ ID NO: 361091 - DNA, 15 bp, Homo sapiens
taaatgtgttaatgc

SEQ ID NO: 361092 - DNA, 15 bp, Homo sapiens
aaatgtgttaatgca

SEQ ID NO: 361093 - DNA, 15 bp, Homo sapiens
aatgtgttaatgcat

SEQ ID NO: 361094 - DNA, 15 bp, Homo sapiens
atgtgttaatgcatt

SEQ ID NO: 361095 - DNA, 15 bp, Homo sapiens
tgtgttaatgcattt

SEQ ID NO: 361096 - DNA, 15 bp, Homo sapiens
gtgttaatgcatttt

SEQ ID NO: 361097 - DNA, 15 bp, Homo sapiens
tgttaatgcattttt

SEQ ID NO: 361098 - DNA, 15 bp, Homo sapiens
gttaatgcatttttc

SEQ ID NO: 361099 - DNA, 15 bp, Homo sapiens
ttaatgcatttttct

SEQ ID NO: 361100 - DNA, 15 bp, Homo sapiens
taatgcatttttctt

SEQ ID NO: 361101 - DNA, 15 bp, Homo sapiens
aatgcatttttctta

SEQ ID NO: 361102 - DNA, 15 bp, Homo sapiens
atgcatttttcttat

SEQ ID NO: 361103 - DNA, 15 bp, Homo sapiens
tgcatttttcttatt

SEQ ID NO: 361104 - DNA, 15 bp, Homo sapiens
gcatttttcttattt

SEQ ID NO: 361105 - DNA, 15 bp, Homo sapiens
tttttcttatttttg

SEQ ID NO: 361106 - DNA, 15 bp, Homo sapiens
ttttcttatttttgg

SEQ ID NO: 361107 - DNA, 15 bp, Homo sapiens
tttcttatttttgga

SEQ ID NO: 361108 - DNA, 15 bp, Homo sapiens
ttcttatttttggag

SEQ ID NO: 361109 - DNA, 15 bp, Homo sapiens
tcttatttttggagt

SEQ ID NO: 361110 - DNA, 15 bp, Homo sapiens
cttatttttggagtt

SEQ ID NO: 361111 - DNA, 15 bp, Homo sapiens
ttatttttggagtta

SEQ ID NO: 361112 - DNA, 15 bp, Homo sapiens
tatttttggagttac

SEQ ID NO: 361113 - DNA, 15 bp, Homo sapiens
atttttggagttaca

SEQ ID NO: 361114 - DNA, 15 bp, Homo sapiens
tttttggagttacag

SEQ ID NO: 361115 - DNA, 15 bp, Homo sapiens
ttttggagttacaga

SEQ ID NO: 361116 - DNA, 15 bp, Homo sapiens
tttggagttacagat

SEQ ID NO: 361117 - DNA, 15 bp, Homo sapiens
ttggagttacagata

SEQ ID NO: 361118 - DNA, 15 bp, Homo sapiens
tggagttacagataa

SEQ ID NO: 361119 - DNA, 15 bp, Homo sapiens
ggagttacagataag

SEQ ID NO: 361120 - DNA, 15 bp, Homo sapiens
gagttacagataagt

SEQ ID NO: 361121 - DNA, 15 bp, Homo sapiens
agttacagataagtg

SEQ ID NO: 361122 - DNA, 15 bp, Homo sapiens
gttacagataagtgt

SEQ ID NO: 361123 - DNA, 15 bp, Homo sapiens
ttacagataagtgtt

SEQ ID NO: 361124 - DNA, 15 bp, Homo sapiens
tacagataagtgttt

SEQ ID NO: 361125 - DNA, 15 bp, Homo sapiens
acagataagtgttta

SEQ ID NO: 361126 - DNA, 15 bp, Homo sapiens
cagataagtgtttaa

SEQ ID NO: 361127 - DNA, 15 bp, Homo sapiens
agataagtgtttaaa

SEQ ID NO: 361128 - DNA, 15 bp, Homo sapiens
gataagtgtttaaat

SEQ ID NO: 361129 - DNA, 15 bp, Homo sapiens
ataagtgtttaaatt

SEQ ID NO: 361130 - DNA, 15 bp, Homo sapiens
taagtgtttaaattt

SEQ ID NO: 361131 - DNA, 15 bp, Homo sapiens
aagtgtttaaatttg

SEQ ID NO: 361132 - DNA, 15 bp, Homo sapiens
agtgtttaaatttga

SEQ ID NO: 361133 - DNA, 15 bp, Homo sapiens
gtgtttaaatttgac

SEQ ID NO: 361134 - DNA, 15 bp, Homo sapiens
tgtttaaatttgact

SEQ ID NO: 361135 - DNA, 15 bp, Homo sapiens
gtttaaatttgactt

SEQ ID NO: 361136 - DNA, 15 bp, Homo sapiens
tttaaatttgacttg

SEQ ID NO: 361137 - DNA, 15 bp, Homo sapiens
ttaaatttgacttga

SEQ ID NO: 361138 - DNA, 15 bp, Homo sapiens
taaatttgacttgaa

SEQ ID NO: 361139 - DNA, 15 bp, Homo sapiens
aaatttgacttgaaa

SEQ ID NO: 361140 - DNA, 15 bp, Homo sapiens
aatttgacttgaaaa

SEQ ID NO: 361141 - DNA, 15 bp, Homo sapiens
atttgacttgaaaat

SEQ ID NO: 361142 - DNA, 15 bp, Homo sapiens
tttgacttgaaaata

SEQ ID NO: 361143 - DNA, 15 bp, Homo sapiens
ttgacttgaaaatat

SEQ ID NO: 361144 - DNA, 15 bp, Homo sapiens
tgacttgaaaatatt

SEQ ID NO: 361145 - DNA, 15 bp, Homo sapiens
gacttgaaaatattc

SEQ ID NO: 361146 - DNA, 15 bp, Homo sapiens
acttgaaaatattca

SEQ ID NO: 361147 - DNA, 15 bp, Homo sapiens
cttgaaaatattcat

SEQ ID NO: 361148 - DNA, 15 bp, Homo sapiens
ttgaaaatattcatt

SEQ ID NO: 361149 - DNA, 15 bp, Homo sapiens
tgaaaatattcattc

SEQ ID NO: 361150 - DNA, 15 bp, Homo sapiens
gaaaatattcattca

SEQ ID NO: 361151 - DNA, 15 bp, Homo sapiens
aaaatattcattcaa

SEQ ID NO: 361152 - DNA, 15 bp, Homo sapiens
aaatattcattcaat

SEQ ID NO: 361153 - DNA, 15 bp, Homo sapiens
aatattcattcaatc

SEQ ID NO: 361154 - DNA, 15 bp, Homo sapiens
atattcattcaatct

SEQ ID NO: 361155 - DNA, 15 bp, Homo sapiens
tattcattcaatctg

SEQ ID NO: 361156 - DNA, 15 bp, Homo sapiens
attcattcaatctgt

SEQ ID NO: 361157 - DNA, 15 bp, Homo sapiens
ttcattcaatctgtt

SEQ ID NO: 361158 - DNA, 15 bp, Homo sapiens
tcattcaatctgtta

SEQ ID NO: 361159 - DNA, 15 bp, Homo sapiens
cattcaatctgttac

SEQ ID NO: 361160 - DNA, 15 bp, Homo sapiens
attcaatctgttact

SEQ ID NO: 361161 - DNA, 15 bp, Homo sapiens
ttcaatctgttactt

SEQ ID NO: 361162 - DNA, 15 bp, Homo sapiens
tcaatctgttactta

SEQ ID NO: 361163 - DNA, 15 bp, Homo sapiens
caatctgttacttaa

SEQ ID NO: 361164 - DNA, 15 bp, Homo sapiens
aatctgttacttaaa

SEQ ID NO: 361165 - DNA, 15 bp, Homo sapiens
atctgttacttaaac

SEQ ID NO: 361166 - DNA, 15 bp, Homo sapiens
tctgttacttaaaca

SEQ ID NO: 361167 - DNA, 15 bp, Homo sapiens
ctgttacttaaacat

SEQ ID NO: 361168 - DNA, 15 bp, Homo sapiens
tgttacttaaacatt

SEQ ID NO: 361169 - DNA, 15 bp, Homo sapiens
gttacttaaacattt

SEQ ID NO: 361170 - DNA, 15 bp, Homo sapiens
ttacttaaacatttg

SEQ ID NO: 361171 - DNA, 15 bp, Homo sapiens
tacttaaacatttgt

SEQ ID NO: 361172 - DNA, 15 bp, Homo sapiens
acttaaacatttgta

SEQ ID NO: 361173 - DNA, 15 bp, Homo sapiens
cttaaacatttgtag

SEQ ID NO: 361174 - DNA, 15 bp, Homo sapiens
ttaaacatttgtaga

SEQ ID NO: 361175 - DNA, 15 bp, Homo sapiens
taaacatttgtagac

SEQ ID NO: 361176 - DNA, 15 bp, Homo sapiens
aaacatttgtagacc

SEQ ID NO: 361177 - DNA, 15 bp, Homo sapiens
aacatttgtagacca

SEQ ID NO: 361178 - DNA, 15 bp, Homo sapiens
acatttgtagaccag

SEQ ID NO: 361179 - DNA, 15 bp, Homo sapiens
catttgtagaccagt

SEQ ID NO: 361180 - DNA, 15 bp, Homo sapiens
atttgtagaccagtg

SEQ ID NO: 361181 - DNA, 15 bp, Homo sapiens
tttgtagaccagtgt

SEQ ID NO: 361182 - DNA, 15 bp, Homo sapiens
ttgtagaccagtgta

SEQ ID NO: 361183 - DNA, 15 bp, Homo sapiens
tgtagaccagtgtat

SEQ ID NO: 361184 - DNA, 15 bp, Homo sapiens
gtagaccagtgtatt

SEQ ID NO: 361185 - DNA, 15 bp, Homo sapiens
tagaccagtgtatta

SEQ ID NO: 361186 - DNA, 15 bp, Homo sapiens
agaccagtgtattag

SEQ ID NO: 361187 - DNA, 15 bp, Homo sapiens
gaccagtgtattagt

SEQ ID NO: 361188 - DNA, 15 bp, Homo sapiens
accagtgtattagtc

SEQ ID NO: 361189 - DNA, 15 bp, Homo sapiens
ccagtgtattagtct

SEQ ID NO: 361190 - DNA, 15 bp, Homo sapiens
cagtgtattagtctg

SEQ ID NO: 361191 - DNA, 15 bp, Homo sapiens
tattagtctgttctc

SEQ ID NO: 361192 - DNA, 15 bp, Homo sapiens
attagtctgttctca

SEQ ID NO: 361193 - DNA, 15 bp, Homo sapiens
ttagtctgttctcat

SEQ ID NO: 361194 - DNA, 15 bp, Homo sapiens
tagtctgttctcatg

SEQ ID NO: 361195 - DNA, 15 bp, Homo sapiens
agtctgttctcatgc

SEQ ID NO: 361196 - DNA, 15 bp, Homo sapiens
gtctgttctcatgct

SEQ ID NO: 361197 - DNA, 15 bp, Homo sapiens
tctgttctcatgctg

SEQ ID NO: 361198 - DNA, 15 bp, Homo sapiens
ctgttctcatgctgc

SEQ ID NO: 361199 - DNA, 15 bp, Homo sapiens
tgttctcatgctgct

SEQ ID NO: 361200 - DNA, 15 bp, Homo sapiens
gttctcatgctgcta

SEQ ID NO: 361201 - DNA, 15 bp, Homo sapiens
ttctcatgctgctaa

SEQ ID NO: 361202 - DNA, 15 bp, Homo sapiens
tctcatgctgctaat

SEQ ID NO: 361203 - DNA, 15 bp, Homo sapiens
ctcatgctgctaata

SEQ ID NO: 361204 - DNA, 15 bp, Homo sapiens
tcatgctgctaataa

SEQ ID NO: 361205 - DNA, 15 bp, Homo sapiens
catgctgctaataaa

SEQ ID NO: 361206 - DNA, 15 bp, Homo sapiens
gctgctaataaagac

SEQ ID NO: 361207 - DNA, 15 bp, Homo sapiens
ctgctaataaagaca

SEQ ID NO: 361208 - DNA, 15 bp, Homo sapiens
tgctaataaagacat

SEQ ID NO: 361209 - DNA, 15 bp, Homo sapiens
gctaataaagacata

SEQ ID NO: 361210 - DNA, 15 bp, Homo sapiens
ctaataaagacatac

SEQ ID NO: 361211 - DNA, 15 bp, Homo sapiens
taataaagacatacc

SEQ ID NO: 361212 - DNA, 15 bp, Homo sapiens
aataaagacatacct

SEQ ID NO: 361213 - DNA, 15 bp, Homo sapiens
gaggtttaattgact

SEQ ID NO: 361214 - DNA, 15 bp, Homo sapiens
aggtttaattgactc

SEQ ID NO: 361215 - DNA, 15 bp, Homo sapiens
ggtttaattgactca

SEQ ID NO: 361216 - DNA, 15 bp, Homo sapiens
gtttaattgactcat

SEQ ID NO: 361217 - DNA, 15 bp, Homo sapiens
tttaattgactcata

SEQ ID NO: 361218 - DNA, 15 bp, Homo sapiens
ttaattgactcatag

SEQ ID NO: 361219 - DNA, 15 bp, Homo sapiens
taattgactcatagt

SEQ ID NO: 361220 - DNA, 15 bp, Homo sapiens
aattgactcatagtt

SEQ ID NO: 361221 - DNA, 15 bp, Homo sapiens
attgactcatagttc

SEQ ID NO: 361222 - DNA, 15 bp, Homo sapiens
ttgactcatagttca

SEQ ID NO: 361223 - DNA, 15 bp, Homo sapiens
tgactcatagttcag

SEQ ID NO: 361224 - DNA, 15 bp, Homo sapiens
gactcatagttcagc

SEQ ID NO: 361225 - DNA, 15 bp, Homo sapiens
actcatagttcagca

SEQ ID NO: 361226 - DNA, 15 bp, Homo sapiens
ctcatagttcagcat

SEQ ID NO: 361227 - DNA, 15 bp, Homo sapiens
tcatagttcagcatg

SEQ ID NO: 361228 - DNA, 15 bp, Homo sapiens
catagttcagcatgg

SEQ ID NO: 361229 - DNA, 15 bp, Homo sapiens
atagttcagcatggc

SEQ ID NO: 361230 - DNA, 15 bp, Homo sapiens
tagttcagcatggct

SEQ ID NO: 361231 - DNA, 15 bp, Homo sapiens
agttcagcatggctg

SEQ ID NO: 361232 - DNA, 15 bp, Homo sapiens
gttcagcatggctga

SEQ ID NO: 361233 - DNA, 15 bp, Homo sapiens
ttcagcatggctgag

SEQ ID NO: 361234 - DNA, 15 bp, Homo sapiens
tcagcatggctgagg

SEQ ID NO: 361235 - DNA, 15 bp, Homo sapiens
cagcatggctgagga

SEQ ID NO: 361236 - DNA, 15 bp, Homo sapiens
agcatggctgaggag

SEQ ID NO: 361237 - DNA, 15 bp, Homo sapiens
gcatggctgaggagg

SEQ ID NO: 361238 - DNA, 15 bp, Homo sapiens
catggctgaggaggc

SEQ ID NO: 361239 - DNA, 15 bp, Homo sapiens
atggctgaggaggcc

SEQ ID NO: 361240 - DNA, 15 bp, Homo sapiens
tggctgaggaggcca

SEQ ID NO: 361241 - DNA, 15 bp, Homo sapiens
ggctgaggaggccac

SEQ ID NO: 361242 - DNA, 15 bp, Homo sapiens
gctgaggaggccaca

SEQ ID NO: 361243 - DNA, 15 bp, Homo sapiens
ctgaggaggccacag

SEQ ID NO: 361244 - DNA, 15 bp, Homo sapiens
tgaggaggccacagg

SEQ ID NO: 361245 - DNA, 15 bp, Homo sapiens
gaggaggccacagga

SEQ ID NO: 361246 - DNA, 15 bp, Homo sapiens
aggaggccacaggaa

SEQ ID NO: 361247 - DNA, 15 bp, Homo sapiens
ggaggccacaggaaa

SEQ ID NO: 361248 - DNA, 15 bp, Homo sapiens
gaggccacaggaaac

SEQ ID NO: 361249 - DNA, 15 bp, Homo sapiens
aggccacaggaaacg

SEQ ID NO: 361250 - DNA, 15 bp, Homo sapiens
ggccacaggaaacgt

SEQ ID NO: 361251 - DNA, 15 bp, Homo sapiens
gccacaggaaacgtc

SEQ ID NO: 361252 - DNA, 15 bp, Homo sapiens
ccacaggaaacgtcc

SEQ ID NO: 361253 - DNA, 15 bp, Homo sapiens
cacaggaaacgtcca

SEQ ID NO: 361254 - DNA, 15 bp, Homo sapiens
acaggaaacgtccag

SEQ ID NO: 361255 - DNA, 15 bp, Homo sapiens
caggaaacgtccagt

SEQ ID NO: 361256 - DNA, 15 bp, Homo sapiens
aggaaacgtccagtc

SEQ ID NO: 361257 - DNA, 15 bp, Homo sapiens
ggaaacgtccagtca

SEQ ID NO: 361258 - DNA, 15 bp, Homo sapiens
gaaacgtccagtcat

SEQ ID NO: 361259 - DNA, 15 bp, Homo sapiens
aaacgtccagtcatg

SEQ ID NO: 361260 - DNA, 15 bp, Homo sapiens
aacgtccagtcatgg

SEQ ID NO: 361261 - DNA, 15 bp, Homo sapiens
acgtccagtcatggt

SEQ ID NO: 361262 - DNA, 15 bp, Homo sapiens
cgtccagtcatggtg

SEQ ID NO: 361263 - DNA, 15 bp, Homo sapiens
gtccagtcatggtgg

SEQ ID NO: 361264 - DNA, 15 bp, Homo sapiens
tccagtcatggtgga

SEQ ID NO: 361265 - DNA, 15 bp, Homo sapiens
ccagtcatggtggaa

SEQ ID NO: 361266 - DNA, 15 bp, Homo sapiens
cagtcatggtggaag

SEQ ID NO: 361267 - DNA, 15 bp, Homo sapiens
agtcatggtggaagg

SEQ ID NO: 361268 - DNA, 15 bp, Homo sapiens
gtcatggtggaaggg

SEQ ID NO: 361269 - DNA, 15 bp, Homo sapiens
tcatggtggaagggg

SEQ ID NO: 361270 - DNA, 15 bp, Homo sapiens
catggtggaagggga

SEQ ID NO: 361271 - DNA, 15 bp, Homo sapiens
atggtggaaggggaa

SEQ ID NO: 361272 - DNA, 15 bp, Homo sapiens
tggtggaaggggaaa

SEQ ID NO: 361273 - DNA, 15 bp, Homo sapiens
ggtggaaggggaaag

SEQ ID NO: 361274 - DNA, 15 bp, Homo sapiens
gtggaaggggaaaga

SEQ ID NO: 361275 - DNA, 15 bp, Homo sapiens
tggaaggggaaagaa

SEQ ID NO: 361276 - DNA, 15 bp, Homo sapiens
ggaaggggaaagaaa

SEQ ID NO: 361277 - DNA, 15 bp, Homo sapiens
gaaggggaaagaaac

SEQ ID NO: 361278 - DNA, 15 bp, Homo sapiens
aaggggaaagaaaca

SEQ ID NO: 361279 - DNA, 15 bp, Homo sapiens
aggggaaagaaacat

SEQ ID NO: 361280 - DNA, 15 bp, Homo sapiens
ggggaaagaaacatg

SEQ ID NO: 361281 - DNA, 15 bp, Homo sapiens
gggaaagaaacatgt

SEQ ID NO: 361282 - DNA, 15 bp, Homo sapiens
ggaaagaaacatgtc

SEQ ID NO: 361283 - DNA, 15 bp, Homo sapiens
gaaagaaacatgtcc

SEQ ID NO: 361284 - DNA, 15 bp, Homo sapiens
aaagaaacatgtcct

SEQ ID NO: 361285 - DNA, 15 bp, Homo sapiens
aagaaacatgtcctt

SEQ ID NO: 361286 - DNA, 15 bp, Homo sapiens
agaaacatgtccttc

SEQ ID NO: 361287 - DNA, 15 bp, Homo sapiens
gaaacatgtccttct

SEQ ID NO: 361288 - DNA, 15 bp, Homo sapiens
aaacatgtccttctt

SEQ ID NO: 361289 - DNA, 15 bp, Homo sapiens
aacatgtccttcttc

SEQ ID NO: 361290 - DNA, 15 bp, Homo sapiens
acatgtccttcttca

SEQ ID NO: 361291 - DNA, 15 bp, Homo sapiens
catgtccttcttcat

SEQ ID NO: 361292 - DNA, 15 bp, Homo sapiens
atgtccttcttcata

SEQ ID NO: 361293 - DNA, 15 bp, Homo sapiens
tgtccttcttcatat

SEQ ID NO: 361294 - DNA, 15 bp, Homo sapiens
gtccttcttcatatg

SEQ ID NO: 361295 - DNA, 15 bp, Homo sapiens
tccttcttcatatgg

SEQ ID NO: 361296 - DNA, 15 bp, Homo sapiens
ccttcttcatatggc

SEQ ID NO: 361297 - DNA, 15 bp, Homo sapiens
cttcttcatatggcg

SEQ ID NO: 361298 - DNA, 15 bp, Homo sapiens
ttcttcatatggcgg

SEQ ID NO: 361299 - DNA, 15 bp, Homo sapiens
tcttcatatggcggc

SEQ ID NO: 361300 - DNA, 15 bp, Homo sapiens
cttcatatggcggca

SEQ ID NO: 361301 - DNA, 15 bp, Homo sapiens
ttcatatggcggcag

SEQ ID NO: 361302 - DNA, 15 bp, Homo sapiens
tcatatggcggcagg

SEQ ID NO: 361303 - DNA, 15 bp, Homo sapiens
catatggcggcagga

SEQ ID NO: 361304 - DNA, 15 bp, Homo sapiens
atatggcggcaggag

SEQ ID NO: 361305 - DNA, 15 bp, Homo sapiens
tatggcggcaggaga

SEQ ID NO: 361306 - DNA, 15 bp, Homo sapiens
atggcggcaggagag

SEQ ID NO: 361307 - DNA, 15 bp, Homo sapiens
tggcggcaggagaga

SEQ ID NO: 361308 - DNA, 15 bp, Homo sapiens
ggcggcaggagagag

SEQ ID NO: 361309 - DNA, 15 bp, Homo sapiens
gcggcaggagagaga

SEQ ID NO: 361310 - DNA, 15 bp, Homo sapiens
cggcaggagagagaa

SEQ ID NO: 361311 - DNA, 15 bp, Homo sapiens
ggcaggagagagaag

SEQ ID NO: 361312 - DNA, 15 bp, Homo sapiens
gcaggagagagaagt

SEQ ID NO: 361313 - DNA, 15 bp, Homo sapiens
caggagagagaagtg

SEQ ID NO: 361314 - DNA, 15 bp, Homo sapiens
aggagagagaagtgc

SEQ ID NO: 361315 - DNA, 15 bp, Homo sapiens
ggagagagaagtgct

SEQ ID NO: 361316 - DNA, 15 bp, Homo sapiens
gagagagaagtgctg

SEQ ID NO: 361317 - DNA, 15 bp, Homo sapiens
agagagaagtgctga

SEQ ID NO: 361318 - DNA, 15 bp, Homo sapiens
gagagaagtgctgag

SEQ ID NO: 361319 - DNA, 15 bp, Homo sapiens
agagaagtgctgagc

SEQ ID NO: 361320 - DNA, 15 bp, Homo sapiens
gagaagtgctgagca

SEQ ID NO: 361321 - DNA, 15 bp, Homo sapiens
agaagtgctgagcaa

SEQ ID NO: 361322 - DNA, 15 bp, Homo sapiens
gaagtgctgagcaaa

SEQ ID NO: 361323 - DNA, 15 bp, Homo sapiens
aagtgctgagcaaag

SEQ ID NO: 361324 - DNA, 15 bp, Homo sapiens
agtgctgagcaaagt

SEQ ID NO: 361325 - DNA, 15 bp, Homo sapiens
gtgctgagcaaagtg

SEQ ID NO: 361326 - DNA, 15 bp, Homo sapiens
tgctgagcaaagtgg

SEQ ID NO: 361327 - DNA, 15 bp, Homo sapiens
gctgagcaaagtggg

SEQ ID NO: 361328 - DNA, 15 bp, Homo sapiens
ctgagcaaagtgggg

SEQ ID NO: 361329 - DNA, 15 bp, Homo sapiens
tgagcaaagtggggg

SEQ ID NO: 361330 - DNA, 15 bp, Homo sapiens
gagcaaagtggggga

SEQ ID NO: 361331 - DNA, 15 bp, Homo sapiens
agcaaagtgggggaa

SEQ ID NO: 361332 - DNA, 15 bp, Homo sapiens
gcaaagtgggggaaa

SEQ ID NO: 361333 - DNA, 15 bp, Homo sapiens
caaagtgggggaaaa

SEQ ID NO: 361334 - DNA, 15 bp, Homo sapiens
aaagtgggggaaaag

SEQ ID NO: 361335 - DNA, 15 bp, Homo sapiens
aagtgggggaaaagt

SEQ ID NO: 361336 - DNA, 15 bp, Homo sapiens
agtgggggaaaagtc

SEQ ID NO: 361337 - DNA, 15 bp, Homo sapiens
gtgggggaaaagtcc

SEQ ID NO: 361338 - DNA, 15 bp, Homo sapiens
tgggggaaaagtccc

SEQ ID NO: 361339 - DNA, 15 bp, Homo sapiens
gggggaaaagtccct

SEQ ID NO: 361340 - DNA, 15 bp, Homo sapiens
ggggaaaagtccctt

SEQ ID NO: 361341 - DNA, 15 bp, Homo sapiens
gggaaaagtccctta

SEQ ID NO: 361342 - DNA, 15 bp, Homo sapiens
ggaaaagtcccttat

SEQ ID NO: 361343 - DNA, 15 bp, Homo sapiens
gaaaagtcccttata

SEQ ID NO: 361344 - DNA, 15 bp, Homo sapiens
aaaagtcccttataa

SEQ ID NO: 361345 - DNA, 15 bp, Homo sapiens
aaagtcccttataaa

SEQ ID NO: 361346 - DNA, 15 bp, Homo sapiens
aagtcccttataaaa

SEQ ID NO: 361347 - DNA, 15 bp, Homo sapiens
agtcccttataaaac

SEQ ID NO: 361348 - DNA, 15 bp, Homo sapiens
gtcccttataaaacc

SEQ ID NO: 361349 - DNA, 15 bp, Homo sapiens
tcccttataaaacca

SEQ ID NO: 361350 - DNA, 15 bp, Homo sapiens
aaaaccatcagatca

SEQ ID NO: 361351 - DNA, 15 bp, Homo sapiens
aaaccatcagatcac

SEQ ID NO: 361352 - DNA, 15 bp, Homo sapiens
aaccatcagatcact

SEQ ID NO: 361353 - DNA, 15 bp, Homo sapiens
accatcagatcactc

SEQ ID NO: 361354 - DNA, 15 bp, Homo sapiens
ccatcagatcactct

SEQ ID NO: 361355 - DNA, 15 bp, Homo sapiens
catcagatcactctc

SEQ ID NO: 361356 - DNA, 15 bp, Homo sapiens
atcagatcactctca

SEQ ID NO: 361357 - DNA, 15 bp, Homo sapiens
tcagatcactctcac

SEQ ID NO: 361358 - DNA, 15 bp, Homo sapiens
cagatcactctcact

SEQ ID NO: 361359 - DNA, 15 bp, Homo sapiens
agatcactctcacta

SEQ ID NO: 361360 - DNA, 15 bp, Homo sapiens
gatcactctcactag

SEQ ID NO: 361361 - DNA, 15 bp, Homo sapiens
atcactctcactaga

SEQ ID NO: 361362 - DNA, 15 bp, Homo sapiens
tcactctcactagaa

SEQ ID NO: 361363 - DNA, 15 bp, Homo sapiens
cactctcactagaac

SEQ ID NO: 361364 - DNA, 15 bp, Homo sapiens
actctcactagaaca

SEQ ID NO: 361365 - DNA, 15 bp, Homo sapiens
ctctcactagaacaa

SEQ ID NO: 361366 - DNA, 15 bp, Homo sapiens
tctcactagaacaac

SEQ ID NO: 361367 - DNA, 15 bp, Homo sapiens
ctcactagaacaaca

SEQ ID NO: 361368 - DNA, 15 bp, Homo sapiens
tcactagaacaacac

SEQ ID NO: 361369 - DNA, 15 bp, Homo sapiens
cactagaacaacacg

SEQ ID NO: 361370 - DNA, 15 bp, Homo sapiens
actagaacaacacga

SEQ ID NO: 361371 - DNA, 15 bp, Homo sapiens
ctagaacaacacgag

SEQ ID NO: 361372 - DNA, 15 bp, Homo sapiens
tagaacaacacgagg

SEQ ID NO: 361373 - DNA, 15 bp, Homo sapiens
agaacaacacgaggg

SEQ ID NO: 361374 - DNA, 15 bp, Homo sapiens
gaacaacacgagggt

SEQ ID NO: 361375 - DNA, 15 bp, Homo sapiens
aacaacacgagggta

SEQ ID NO: 361376 - DNA, 15 bp, Homo sapiens
acaacacgagggtaa

SEQ ID NO: 361377 - DNA, 15 bp, Homo sapiens
caacacgagggtaac

SEQ ID NO: 361378 - DNA, 15 bp, Homo sapiens
aacacgagggtaacc

SEQ ID NO: 361379 - DNA, 15 bp, Homo sapiens
acacgagggtaacca

SEQ ID NO: 361380 - DNA, 15 bp, Homo sapiens
cacgagggtaaccac

SEQ ID NO: 361381 - DNA, 15 bp, Homo sapiens
acgagggtaaccacc

SEQ ID NO: 361382 - DNA, 15 bp, Homo sapiens
cgagggtaaccaccc

SEQ ID NO: 361383 - DNA, 15 bp, Homo sapiens
gagggtaaccacccc

SEQ ID NO: 361384 - DNA, 15 bp, Homo sapiens
agggtaaccacccct

SEQ ID NO: 361385 - DNA, 15 bp, Homo sapiens
gggtaaccacccctg

SEQ ID NO: 361386 - DNA, 15 bp, Homo sapiens
ggtaaccacccctgt

SEQ ID NO: 361387 - DNA, 15 bp, Homo sapiens
gtaaccacccctgtg

SEQ ID NO: 361388 - DNA, 15 bp, Homo sapiens
taaccacccctgtga

SEQ ID NO: 361389 - DNA, 15 bp, Homo sapiens
aaccacccctgtgat

SEQ ID NO: 361390 - DNA, 15 bp, Homo sapiens
accacccctgtgatt

SEQ ID NO: 361391 - DNA, 15 bp, Homo sapiens
ccacccctgtgattc

SEQ ID NO: 361392 - DNA, 15 bp, Homo sapiens
cacccctgtgattca

SEQ ID NO: 361393 - DNA, 15 bp, Homo sapiens
acccctgtgattcag

SEQ ID NO: 361394 - DNA, 15 bp, Homo sapiens
cccctgtgattcagt

SEQ ID NO: 361395 - DNA, 15 bp, Homo sapiens
ccctgtgattcagtt

SEQ ID NO: 361396 - DNA, 15 bp, Homo sapiens
cctgtgattcagtta

SEQ ID NO: 361397 - DNA, 15 bp, Homo sapiens
ctgtgattcagttac

SEQ ID NO: 361398 - DNA, 15 bp, Homo sapiens
tgtgattcagttacc

SEQ ID NO: 361399 - DNA, 15 bp, Homo sapiens
gtgattcagttacct

SEQ ID NO: 361400 - DNA, 15 bp, Homo sapiens
tgattcagttacctc

SEQ ID NO: 361401 - DNA, 15 bp, Homo sapiens
gattcagttacctcc

SEQ ID NO: 361402 - DNA, 15 bp, Homo sapiens
attcagttacctccc

SEQ ID NO: 361403 - DNA, 15 bp, Homo sapiens
ttcagttacctccca

SEQ ID NO: 361404 - DNA, 15 bp, Homo sapiens
tcagttacctcccac

SEQ ID NO: 361405 - DNA, 15 bp, Homo sapiens
cagttacctcccact

SEQ ID NO: 361406 - DNA, 15 bp, Homo sapiens
agttacctcccactg

SEQ ID NO: 361407 - DNA, 15 bp, Homo sapiens
gttacctcccactgg

SEQ ID NO: 361408 - DNA, 15 bp, Homo sapiens
actgggtccctccct

SEQ ID NO: 361409 - DNA, 15 bp, Homo sapiens
ctgggtccctccctt

SEQ ID NO: 361410 - DNA, 15 bp, Homo sapiens
tgggtccctcccttg

SEQ ID NO: 361411 - DNA, 15 bp, Homo sapiens
gggtccctcccttgg

SEQ ID NO: 361412 - DNA, 15 bp, Homo sapiens
ggtccctcccttggc

SEQ ID NO: 361413 - DNA, 15 bp, Homo sapiens
gtccctcccttggca

SEQ ID NO: 361414 - DNA, 15 bp, Homo sapiens
tccctcccttggcat

SEQ ID NO: 361415 - DNA, 15 bp, Homo sapiens
ccctcccttggcatg

SEQ ID NO: 361416 - DNA, 15 bp, Homo sapiens
cctcccttggcatgt

SEQ ID NO: 361417 - DNA, 15 bp, Homo sapiens
ctcccttggcatgtg

SEQ ID NO: 361418 - DNA, 15 bp, Homo sapiens
tcccttggcatgtgg

SEQ ID NO: 361419 - DNA, 15 bp, Homo sapiens
cccttggcatgtggg

SEQ ID NO: 361420 - DNA, 15 bp, Homo sapiens
ccttggcatgtgggg

SEQ ID NO: 361421 - DNA, 15 bp, Homo sapiens
cttggcatgtgggga

SEQ ID NO: 361422 - DNA, 15 bp, Homo sapiens
ttggcatgtggggat

SEQ ID NO: 361423 - DNA, 15 bp, Homo sapiens
tggcatgtggggatt

SEQ ID NO: 361424 - DNA, 15 bp, Homo sapiens
ggcatgtggggatta

SEQ ID NO: 361425 - DNA, 15 bp, Homo sapiens
gcatgtggggattat

SEQ ID NO: 361426 - DNA, 15 bp, Homo sapiens
catgtggggattatg

SEQ ID NO: 361427 - DNA, 15 bp, Homo sapiens
atgtggggattatgg

SEQ ID NO: 361428 - DNA, 15 bp, Homo sapiens
tgtggggattatggg

SEQ ID NO: 361429 - DNA, 15 bp, Homo sapiens
gtggggattatggga

SEQ ID NO: 361430 - DNA, 15 bp, Homo sapiens
tggggattatgggag

SEQ ID NO: 361431 - DNA, 15 bp, Homo sapiens
ggggattatgggagg

SEQ ID NO: 361432 - DNA, 15 bp, Homo sapiens
gggattatgggaggt

SEQ ID NO: 361433 - DNA, 15 bp, Homo sapiens
ggattatgggaggta

SEQ ID NO: 361434 - DNA, 15 bp, Homo sapiens
gattatgggaggtac

SEQ ID NO: 361435 - DNA, 15 bp, Homo sapiens
attatgggaggtaca

SEQ ID NO: 361436 - DNA, 15 bp, Homo sapiens
ttatgggaggtacaa

SEQ ID NO: 361437 - DNA, 15 bp, Homo sapiens
tatgggaggtacaat

SEQ ID NO: 361438 - DNA, 15 bp, Homo sapiens
atgggaggtacaatt

SEQ ID NO: 361439 - DNA, 15 bp, Homo sapiens
tgggaggtacaattc

SEQ ID NO: 361440 - DNA, 15 bp, Homo sapiens
gggaggtacaattca

SEQ ID NO: 361441 - DNA, 15 bp, Homo sapiens
ggaggtacaattcaa

SEQ ID NO: 361442 - DNA, 15 bp, Homo sapiens
gaggtacaattcaag

SEQ ID NO: 361443 - DNA, 15 bp, Homo sapiens
aggtacaattcaaga

SEQ ID NO: 361444 - DNA, 15 bp, Homo sapiens
ggtacaattcaagat

SEQ ID NO: 361445 - DNA, 15 bp, Homo sapiens
gtacaattcaagatg

SEQ ID NO: 361446 - DNA, 15 bp, Homo sapiens
aattcaagatgagat

SEQ ID NO: 361447 - DNA, 15 bp, Homo sapiens
attcaagatgagatt

SEQ ID NO: 361448 - DNA, 15 bp, Homo sapiens
ttcaagatgagattt

SEQ ID NO: 361449 - DNA, 15 bp, Homo sapiens
tcaagatgagatttg

SEQ ID NO: 361450 - DNA, 15 bp, Homo sapiens
tgggtggggacacaa

SEQ ID NO: 361451 - DNA, 15 bp, Homo sapiens
gggtggggacacaac

SEQ ID NO: 361452 - DNA, 15 bp, Homo sapiens
ggtggggacacaacc

SEQ ID NO: 361453 - DNA, 15 bp, Homo sapiens
gtggggacacaacca

SEQ ID NO: 361454 - DNA, 15 bp, Homo sapiens
tggggacacaaccaa

SEQ ID NO: 361455 - DNA, 15 bp, Homo sapiens
ggggacacaaccaaa

SEQ ID NO: 361456 - DNA, 15 bp, Homo sapiens
gggacacaaccaaac

SEQ ID NO: 361457 - DNA, 15 bp, Homo sapiens
ggacacaaccaaacc

SEQ ID NO: 361458 - DNA, 15 bp, Homo sapiens
gacacaaccaaacca

SEQ ID NO: 361459 - DNA, 15 bp, Homo sapiens
acacaaccaaaccat

SEQ ID NO: 361460 - DNA, 15 bp, Homo sapiens
cacaaccaaaccata

SEQ ID NO: 361461 - DNA, 15 bp, Homo sapiens
acaaccaaaccatat

SEQ ID NO: 361462 - DNA, 15 bp, Homo sapiens
caaccaaaccatatc

SEQ ID NO: 361463 - DNA, 15 bp, Homo sapiens
aaccaaaccatatca

SEQ ID NO: 361464 - DNA, 15 bp, Homo sapiens
accaaaccatatcaa

SEQ ID NO: 361465 - DNA, 15 bp, Homo sapiens
ccaaaccatatcaac

SEQ ID NO: 361466 - DNA, 15 bp, Homo sapiens
caaaccatatcaacc

SEQ ID NO: 361467 - DNA, 15 bp, Homo sapiens
aaaccatatcaacca

SEQ ID NO: 361468 - DNA, 15 bp, Homo sapiens
aaccatatcaaccag

SEQ ID NO: 361469 - DNA, 15 bp, Homo sapiens
accatatcaaccagt

SEQ ID NO: 361470 - DNA, 15 bp, Homo sapiens
ccatatcaaccagtg

SEQ ID NO: 361471 - DNA, 15 bp, Homo sapiens
catatcaaccagtga

SEQ ID NO: 361472 - DNA, 15 bp, Homo sapiens
atatcaaccagtgaa

SEQ ID NO: 361473 - DNA, 15 bp, Homo sapiens
tatcaaccagtgaag

SEQ ID NO: 361474 - DNA, 15 bp, Homo sapiens
atcaaccagtgaagc

SEQ ID NO: 361475 - DNA, 15 bp, Homo sapiens
tcaaccagtgaagca

SEQ ID NO: 361476 - DNA, 15 bp, Homo sapiens
caaccagtgaagcaa

SEQ ID NO: 361477 - DNA, 15 bp, Homo sapiens
aaccagtgaagcaat

SEQ ID NO: 361478 - DNA, 15 bp, Homo sapiens
accagtgaagcaata

SEQ ID NO: 361479 - DNA, 15 bp, Homo sapiens
ccagtgaagcaatat

SEQ ID NO: 361480 - DNA, 15 bp, Homo sapiens
cagtgaagcaatatc

SEQ ID NO: 361481 - DNA, 15 bp, Homo sapiens
agtgaagcaatatct

SEQ ID NO: 361482 - DNA, 15 bp, Homo sapiens
gtgaagcaatatctt

SEQ ID NO: 361483 - DNA, 15 bp, Homo sapiens
tgaagcaatatctta

SEQ ID NO: 361484 - DNA, 15 bp, Homo sapiens
gaagcaatatcttag

SEQ ID NO: 361485 - DNA, 15 bp, Homo sapiens
aagcaatatcttagt

SEQ ID NO: 361486 - DNA, 15 bp, Homo sapiens
agcaatatcttagta

SEQ ID NO: 361487 - DNA, 15 bp, Homo sapiens
gcaatatcttagtaa

SEQ ID NO: 361488 - DNA, 15 bp, Homo sapiens
caatatcttagtaaa

SEQ ID NO: 361489 - DNA, 15 bp, Homo sapiens
aatatcttagtaaaa

SEQ ID NO: 361490 - DNA, 15 bp, Homo sapiens
atatcttagtaaaat

SEQ ID NO: 361491 - DNA, 15 bp, Homo sapiens
tatcttagtaaaatg

SEQ ID NO: 361492 - DNA, 15 bp, Homo sapiens
atcttagtaaaatgt

SEQ ID NO: 361493 - DNA, 15 bp, Homo sapiens
tcttagtaaaatgtg

SEQ ID NO: 361494 - DNA, 15 bp, Homo sapiens
cttagtaaaatgtgc

SEQ ID NO: 361495 - DNA, 15 bp, Homo sapiens
ttagtaaaatgtgca

SEQ ID NO: 361496 - DNA, 15 bp, Homo sapiens
tagtaaaatgtgcat

SEQ ID NO: 361497 - DNA, 15 bp, Homo sapiens
agtaaaatgtgcatt

SEQ ID NO: 361498 - DNA, 15 bp, Homo sapiens
gtaaaatgtgcattt

SEQ ID NO: 361499 - DNA, 15 bp, Homo sapiens
taaaatgtgcattta

SEQ ID NO: 361500 - DNA, 15 bp, Homo sapiens
aaaatgtgcatttag

SEQ ID NO: 361501 - DNA, 15 bp, Homo sapiens
aaatgtgcatttagg

SEQ ID NO: 361502 - DNA, 15 bp, Homo sapiens
aatgtgcatttaggt

SEQ ID NO: 361503 - DNA, 15 bp, Homo sapiens
atgtgcatttaggtt

SEQ ID NO: 361504 - DNA, 15 bp, Homo sapiens
tgtgcatttaggttt

SEQ ID NO: 361505 - DNA, 15 bp, Homo sapiens
gtgcatttaggttta

SEQ ID NO: 361506 - DNA, 15 bp, Homo sapiens
tgcatttaggtttac

SEQ ID NO: 361507 - DNA, 15 bp, Homo sapiens
gcatttaggtttact

SEQ ID NO: 361508 - DNA, 15 bp, Homo sapiens
catttaggtttactt

SEQ ID NO: 361509 - DNA, 15 bp, Homo sapiens
atttaggtttacttg

SEQ ID NO: 361510 - DNA, 15 bp, Homo sapiens
tttaggtttacttgt

SEQ ID NO: 361511 - DNA, 15 bp, Homo sapiens
ttaggtttacttgta

SEQ ID NO: 361512 - DNA, 15 bp, Homo sapiens
taggtttacttgtat

SEQ ID NO: 361513 - DNA, 15 bp, Homo sapiens
aggtttacttgtatg

SEQ ID NO: 361514 - DNA, 15 bp, Homo sapiens
ggtttacttgtatgt

SEQ ID NO: 361515 - DNA, 15 bp, Homo sapiens
gtttacttgtatgtg

SEQ ID NO: 361516 - DNA, 15 bp, Homo sapiens
tttacttgtatgtgg

SEQ ID NO: 361517 - DNA, 15 bp, Homo sapiens
ttacttgtatgtggt

SEQ ID NO: 361518 - DNA, 15 bp, Homo sapiens
tacttgtatgtggta

SEQ ID NO: 361519 - DNA, 15 bp, Homo sapiens
acttgtatgtggtag

SEQ ID NO: 361520 - DNA, 15 bp, Homo sapiens
cttgtatgtggtagg

SEQ ID NO: 361521 - DNA, 15 bp, Homo sapiens
ttgtatgtggtagga

SEQ ID NO: 361522 - DNA, 15 bp, Homo sapiens
tgtatgtggtaggac

SEQ ID NO: 361523 - DNA, 15 bp, Homo sapiens
gtatgtggtaggaca

SEQ ID NO: 361524 - DNA, 15 bp, Homo sapiens
tatgtggtaggacac

SEQ ID NO: 361525 - DNA, 15 bp, Homo sapiens
atgtggtaggacaca

SEQ ID NO: 361526 - DNA, 15 bp, Homo sapiens
tgtggtaggacacaa

SEQ ID NO: 361527 - DNA, 15 bp, Homo sapiens
gtggtaggacacaag

SEQ ID NO: 361528 - DNA, 15 bp, Homo sapiens
tggtaggacacaagg

SEQ ID NO: 361529 - DNA, 15 bp, Homo sapiens
ggtaggacacaagga

SEQ ID NO: 361530 - DNA, 15 bp, Homo sapiens
gtaggacacaaggat

SEQ ID NO: 361531 - DNA, 15 bp, Homo sapiens
taggacacaaggata

SEQ ID NO: 361532 - DNA, 15 bp, Homo sapiens
aggacacaaggatat

SEQ ID NO: 361533 - DNA, 15 bp, Homo sapiens
ggacacaaggatata

SEQ ID NO: 361534 - DNA, 15 bp, Homo sapiens
gacacaaggatataa

SEQ ID NO: 361535 - DNA, 15 bp, Homo sapiens
acacaaggatataag

SEQ ID NO: 361536 - DNA, 15 bp, Homo sapiens
cacaaggatataagg

SEQ ID NO: 361537 - DNA, 15 bp, Homo sapiens
acaaggatataagga

SEQ ID NO: 361538 - DNA, 15 bp, Homo sapiens
caaggatataaggat

SEQ ID NO: 361539 - DNA, 15 bp, Homo sapiens
aaggatataaggatt

SEQ ID NO: 361540 - DNA, 15 bp, Homo sapiens
aggatataaggattt

SEQ ID NO: 361541 - DNA, 15 bp, Homo sapiens
ggatataaggattta

SEQ ID NO: 361542 - DNA, 15 bp, Homo sapiens
gatataaggatttat

SEQ ID NO: 361543 - DNA, 15 bp, Homo sapiens
atataaggatttatt

SEQ ID NO: 361544 - DNA, 15 bp, Homo sapiens
tataaggatttattg

SEQ ID NO: 361545 - DNA, 15 bp, Homo sapiens
ataaggatttattgg

SEQ ID NO: 361546 - DNA, 15 bp, Homo sapiens
taaggatttattggg

SEQ ID NO: 361547 - DNA, 15 bp, Homo sapiens
aaggatttattgggg

SEQ ID NO: 361548 - DNA, 15 bp, Homo sapiens
aggatttattggggt

SEQ ID NO: 361549 - DNA, 15 bp, Homo sapiens
ggatttattggggta

SEQ ID NO: 361550 - DNA, 15 bp, Homo sapiens
gatttattggggtat

SEQ ID NO: 361551 - DNA, 15 bp, Homo sapiens
atttattggggtata

SEQ ID NO: 361552 - DNA, 15 bp, Homo sapiens
tttattggggtatat

SEQ ID NO: 361553 - DNA, 15 bp, Homo sapiens
ttattggggtatata

SEQ ID NO: 361554 - DNA, 15 bp, Homo sapiens
tattggggtatataa

SEQ ID NO: 361555 - DNA, 15 bp, Homo sapiens
attggggtatataat

SEQ ID NO: 361556 - DNA, 15 bp, Homo sapiens
ttggggtatataatt

SEQ ID NO: 361557 - DNA, 15 bp, Homo sapiens
tggggtatataattt

SEQ ID NO: 361558 - DNA, 15 bp, Homo sapiens
ggggtatataatttt

SEQ ID NO: 361559 - DNA, 15 bp, Homo sapiens
gggtatataattttt

SEQ ID NO: 361560 - DNA, 15 bp, Homo sapiens
ggtatataatttttt

SEQ ID NO: 361561 - DNA, 15 bp, Homo sapiens
gtatataatttttta

SEQ ID NO: 361562 - DNA, 15 bp, Homo sapiens
tatataattttttaa

SEQ ID NO: 361563 - DNA, 15 bp, Homo sapiens
atataattttttaaa

SEQ ID NO: 361564 - DNA, 15 bp, Homo sapiens
tataattttttaaag

SEQ ID NO: 361565 - DNA, 15 bp, Homo sapiens
ataattttttaaagc

SEQ ID NO: 361566 - DNA, 15 bp, Homo sapiens
taattttttaaagca

SEQ ID NO: 361567 - DNA, 15 bp, Homo sapiens
aattttttaaagcaa

SEQ ID NO: 361568 - DNA, 15 bp, Homo sapiens
tttttaaagcaatgc

SEQ ID NO: 361569 - DNA, 15 bp, Homo sapiens
ttttaaagcaatgcc

SEQ ID NO: 361570 - DNA, 15 bp, Homo sapiens
tttaaagcaatgcct

SEQ ID NO: 361571 - DNA, 15 bp, Homo sapiens
ttaaagcaatgcctt

SEQ ID NO: 361572 - DNA, 15 bp, Homo sapiens
taaagcaatgccttc

SEQ ID NO: 361573 - DNA, 15 bp, Homo sapiens
aaagcaatgccttca

SEQ ID NO: 361574 - DNA, 15 bp, Homo sapiens
aagcaatgccttcaa

SEQ ID NO: 361575 - DNA, 15 bp, Homo sapiens
agcaatgccttcaag

SEQ ID NO: 361576 - DNA, 15 bp, Homo sapiens
gcaatgccttcaagc

SEQ ID NO: 361577 - DNA, 15 bp, Homo sapiens
caatgccttcaagca

SEQ ID NO: 361578 - DNA, 15 bp, Homo sapiens
aatgccttcaagcac

SEQ ID NO: 361579 - DNA, 15 bp, Homo sapiens
atgccttcaagcact

SEQ ID NO: 361580 - DNA, 15 bp, Homo sapiens
tgccttcaagcactt

SEQ ID NO: 361581 - DNA, 15 bp, Homo sapiens
gccttcaagcacttg

SEQ ID NO: 361582 - DNA, 15 bp, Homo sapiens
ccttcaagcacttgc

SEQ ID NO: 361583 - DNA, 15 bp, Homo sapiens
cttcaagcacttgct

SEQ ID NO: 361584 - DNA, 15 bp, Homo sapiens
ttcaagcacttgctt

SEQ ID NO: 361585 - DNA, 15 bp, Homo sapiens
tcaagcacttgcttg

SEQ ID NO: 361586 - DNA, 15 bp, Homo sapiens
caagcacttgcttga

SEQ ID NO: 361587 - DNA, 15 bp, Homo sapiens
aagcacttgcttgaa

SEQ ID NO: 361588 - DNA, 15 bp, Homo sapiens
agcacttgcttgaaa

SEQ ID NO: 361589 - DNA, 15 bp, Homo sapiens
gcacttgcttgaaag

SEQ ID NO: 361590 - DNA, 15 bp, Homo sapiens
cacttgcttgaaaga

SEQ ID NO: 361591 - DNA, 15 bp, Homo sapiens
acttgcttgaaagaa

SEQ ID NO: 361592 - DNA, 15 bp, Homo sapiens
cttgcttgaaagaag

SEQ ID NO: 361593 - DNA, 15 bp, Homo sapiens
ttgcttgaaagaaga

SEQ ID NO: 361594 - DNA, 15 bp, Homo sapiens
tgcttgaaagaagat

SEQ ID NO: 361595 - DNA, 15 bp, Homo sapiens
gcttgaaagaagatg

SEQ ID NO: 361596 - DNA, 15 bp, Homo sapiens
cttgaaagaagatga

SEQ ID NO: 361597 - DNA, 15 bp, Homo sapiens
ttgaaagaagatgag

SEQ ID NO: 361598 - DNA, 15 bp, Homo sapiens
tgaaagaagatgagc

SEQ ID NO: 361599 - DNA, 15 bp, Homo sapiens
gaaagaagatgagca

SEQ ID NO: 361600 - DNA, 15 bp, Homo sapiens
aaagaagatgagcaa

SEQ ID NO: 361601 - DNA, 15 bp, Homo sapiens
aagaagatgagcaat

SEQ ID NO: 361602 - DNA, 15 bp, Homo sapiens
agaagatgagcaatt

SEQ ID NO: 361603 - DNA, 15 bp, Homo sapiens
gaagatgagcaattc

SEQ ID NO: 361604 - DNA, 15 bp, Homo sapiens
aagatgagcaattca

SEQ ID NO: 361605 - DNA, 15 bp, Homo sapiens
agatgagcaattcat

SEQ ID NO: 361606 - DNA, 15 bp, Homo sapiens
gatgagcaattcatt

SEQ ID NO: 361607 - DNA, 15 bp, Homo sapiens
atgagcaattcattt

SEQ ID NO: 361608 - DNA, 15 bp, Homo sapiens
tgagcaattcatttt

SEQ ID NO: 361609 - DNA, 15 bp, Homo sapiens
gagcaattcattttc

SEQ ID NO: 361610 - DNA, 15 bp, Homo sapiens
agcaattcattttca

SEQ ID NO: 361611 - DNA, 15 bp, Homo sapiens
gcaattcattttcat

SEQ ID NO: 361612 - DNA, 15 bp, Homo sapiens
caattcattttcatc

SEQ ID NO: 361613 - DNA, 15 bp, Homo sapiens
aattcattttcatca

SEQ ID NO: 361614 - DNA, 15 bp, Homo sapiens
attcattttcatcaa

SEQ ID NO: 361615 - DNA, 15 bp, Homo sapiens
ttcattttcatcaaa

SEQ ID NO: 361616 - DNA, 15 bp, Homo sapiens
tcattttcatcaaac

SEQ ID NO: 361617 - DNA, 15 bp, Homo sapiens
cattttcatcaaaca

SEQ ID NO: 361618 - DNA, 15 bp, Homo sapiens
attttcatcaaacat

SEQ ID NO: 361619 - DNA, 15 bp, Homo sapiens
ttttcatcaaacatg

SEQ ID NO: 361620 - DNA, 15 bp, Homo sapiens
tttcatcaaacatga

SEQ ID NO: 361621 - DNA, 15 bp, Homo sapiens
ttcatcaaacatgat

SEQ ID NO: 361622 - DNA, 15 bp, Homo sapiens
tcatcaaacatgatt

SEQ ID NO: 361623 - DNA, 15 bp, Homo sapiens
catcaaacatgattg

SEQ ID NO: 361624 - DNA, 15 bp, Homo sapiens
atcaaacatgattga

SEQ ID NO: 361625 - DNA, 15 bp, Homo sapiens
tcaaacatgattgat

SEQ ID NO: 361626 - DNA, 15 bp, Homo sapiens
caaacatgattgatg

SEQ ID NO: 361627 - DNA, 15 bp, Homo sapiens
aaacatgattgatgc

SEQ ID NO: 361628 - DNA, 15 bp, Homo sapiens
aacatgattgatgct

SEQ ID NO: 361629 - DNA, 15 bp, Homo sapiens
acatgattgatgctt

SEQ ID NO: 361630 - DNA, 15 bp, Homo sapiens
catgattgatgctta

SEQ ID NO: 361631 - DNA, 15 bp, Homo sapiens
atgattgatgcttat

SEQ ID NO: 361632 - DNA, 15 bp, Homo sapiens
tgattgatgcttatg

SEQ ID NO: 361633 - DNA, 15 bp, Homo sapiens
gattgatgcttatgc

SEQ ID NO: 361634 - DNA, 15 bp, Homo sapiens
attgatgcttatgct

SEQ ID NO: 361635 - DNA, 15 bp, Homo sapiens
ttgatgcttatgctt

SEQ ID NO: 361636 - DNA, 15 bp, Homo sapiens
tgatgcttatgcttt

SEQ ID NO: 361637 - DNA, 15 bp, Homo sapiens
gatgcttatgcttta

SEQ ID NO: 361638 - DNA, 15 bp, Homo sapiens
atgcttatgctttaa

SEQ ID NO: 361639 - DNA, 15 bp, Homo sapiens
tgcttatgctttaat

SEQ ID NO: 361640 - DNA, 15 bp, Homo sapiens
gcttatgctttaatg

SEQ ID NO: 361641 - DNA, 15 bp, Homo sapiens
cttatgctttaatgt

SEQ ID NO: 361642 - DNA, 15 bp, Homo sapiens
ttatgctttaatgta

SEQ ID NO: 361643 - DNA, 15 bp, Homo sapiens
tatgctttaatgtaa

SEQ ID NO: 361644 - DNA, 15 bp, Homo sapiens
atgctttaatgtaaa

SEQ ID NO: 361645 - DNA, 15 bp, Homo sapiens
tgctttaatgtaaac

SEQ ID NO: 361646 - DNA, 15 bp, Homo sapiens
gctttaatgtaaaca

SEQ ID NO: 361647 - DNA, 15 bp, Homo sapiens
ctttaatgtaaacag

SEQ ID NO: 361648 - DNA, 15 bp, Homo sapiens
tttaatgtaaacagc

SEQ ID NO: 361649 - DNA, 15 bp, Homo sapiens
ttaatgtaaacagct

SEQ ID NO: 361650 - DNA, 15 bp, Homo sapiens
taatgtaaacagctg

SEQ ID NO: 361651 - DNA, 15 bp, Homo sapiens
aatgtaaacagctgt

SEQ ID NO: 361652 - DNA, 15 bp, Homo sapiens
atgtaaacagctgtt

SEQ ID NO: 361653 - DNA, 15 bp, Homo sapiens
tgtaaacagctgtta

SEQ ID NO: 361654 - DNA, 15 bp, Homo sapiens
gtaaacagctgttat

SEQ ID NO: 361655 - DNA, 15 bp, Homo sapiens
taaacagctgttatt

SEQ ID NO: 361656 - DNA, 15 bp, Homo sapiens
aaacagctgttattc

SEQ ID NO: 361657 - DNA, 15 bp, Homo sapiens
aacagctgttattca

SEQ ID NO: 361658 - DNA, 15 bp, Homo sapiens
acagctgttattcat

SEQ ID NO: 361659 - DNA, 15 bp, Homo sapiens
cagctgttattcatt

SEQ ID NO: 361660 - DNA, 15 bp, Homo sapiens
agctgttattcattt

SEQ ID NO: 361661 - DNA, 15 bp, Homo sapiens
gctgttattcatttt

SEQ ID NO: 361662 - DNA, 15 bp, Homo sapiens
ctgttattcatttta

SEQ ID NO: 361663 - DNA, 15 bp, Homo sapiens
tgttattcattttag

SEQ ID NO: 361664 - DNA, 15 bp, Homo sapiens
gttattcattttagt

SEQ ID NO: 361665 - DNA, 15 bp, Homo sapiens
ttattcattttagtt

SEQ ID NO: 361666 - DNA, 15 bp, Homo sapiens
tattcattttagtta

SEQ ID NO: 361667 - DNA, 15 bp, Homo sapiens
attcattttagttat

SEQ ID NO: 361668 - DNA, 15 bp, Homo sapiens
ttcattttagttatt

SEQ ID NO: 361669 - DNA, 15 bp, Homo sapiens
tcattttagttatta

SEQ ID NO: 361670 - DNA, 15 bp, Homo sapiens
cattttagttattaa

SEQ ID NO: 361671 - DNA, 15 bp, Homo sapiens
attttagttattaag

SEQ ID NO: 361672 - DNA, 15 bp, Homo sapiens
ttttagttattaagc

SEQ ID NO: 361673 - DNA, 15 bp, Homo sapiens
tttagttattaagct

SEQ ID NO: 361674 - DNA, 15 bp, Homo sapiens
ttagttattaagctg

SEQ ID NO: 361675 - DNA, 15 bp, Homo sapiens
tagttattaagctgc

SEQ ID NO: 361676 - DNA, 15 bp, Homo sapiens
agttattaagctgcc

SEQ ID NO: 361677 - DNA, 15 bp, Homo sapiens
gttattaagctgccc

SEQ ID NO: 361678 - DNA, 15 bp, Homo sapiens
ttattaagctgccct

SEQ ID NO: 361679 - DNA, 15 bp, Homo sapiens
tattaagctgcccta

SEQ ID NO: 361680 - DNA, 15 bp, Homo sapiens
attaagctgccctat

SEQ ID NO: 361681 - DNA, 15 bp, Homo sapiens
ttaagctgccctatt

SEQ ID NO: 361682 - DNA, 15 bp, Homo sapiens
taagctgccctattt

SEQ ID NO: 361683 - DNA, 15 bp, Homo sapiens
aagctgccctatttc

SEQ ID NO: 361684 - DNA, 15 bp, Homo sapiens
agctgccctatttcc

SEQ ID NO: 361685 - DNA, 15 bp, Homo sapiens
gctgccctatttcct

SEQ ID NO: 361686 - DNA, 15 bp, Homo sapiens
ctgccctatttcctt

SEQ ID NO: 361687 - DNA, 15 bp, Homo sapiens
tgccctatttccttg

SEQ ID NO: 361688 - DNA, 15 bp, Homo sapiens
gccctatttccttgt

SEQ ID NO: 361689 - DNA, 15 bp, Homo sapiens
ccctatttccttgta

SEQ ID NO: 361690 - DNA, 15 bp, Homo sapiens
cctatttccttgtat

SEQ ID NO: 361691 - DNA, 15 bp, Homo sapiens
ctatttccttgtatt

SEQ ID NO: 361692 - DNA, 15 bp, Homo sapiens
tatttccttgtattt

SEQ ID NO: 361693 - DNA, 15 bp, Homo sapiens
atttccttgtatttt

SEQ ID NO: 361694 - DNA, 15 bp, Homo sapiens
tttccttgtattttg

SEQ ID NO: 361695 - DNA, 15 bp, Homo sapiens
ttccttgtattttgc

SEQ ID NO: 361696 - DNA, 15 bp, Homo sapiens
tccttgtattttgcc

SEQ ID NO: 361697 - DNA, 15 bp, Homo sapiens
ccttgtattttgcct

SEQ ID NO: 361698 - DNA, 15 bp, Homo sapiens
cttgtattttgcctg

SEQ ID NO: 361699 - DNA, 15 bp, Homo sapiens
ttgtattttgcctga

SEQ ID NO: 361700 - DNA, 15 bp, Homo sapiens
tgtattttgcctgat

SEQ ID NO: 361701 - DNA, 15 bp, Homo sapiens
gtattttgcctgatg

SEQ ID NO: 361702 - DNA, 15 bp, Homo sapiens
tattttgcctgatga

SEQ ID NO: 361703 - DNA, 15 bp, Homo sapiens
attttgcctgatgac

SEQ ID NO: 361704 - DNA, 15 bp, Homo sapiens
ttttgcctgatgaca

SEQ ID NO: 361705 - DNA, 15 bp, Homo sapiens
tttgcctgatgacat

SEQ ID NO: 361706 - DNA, 15 bp, Homo sapiens
ttgcctgatgacatt

SEQ ID NO: 361707 - DNA, 15 bp, Homo sapiens
tgcctgatgacattc

SEQ ID NO: 361708 - DNA, 15 bp, Homo sapiens
gcctgatgacattca

SEQ ID NO: 361709 - DNA, 15 bp, Homo sapiens
cctgatgacattcat

SEQ ID NO: 361710 - DNA, 15 bp, Homo sapiens
ctgatgacattcatg

SEQ ID NO: 361711 - DNA, 15 bp, Homo sapiens
tgatgacattcatga

SEQ ID NO: 361712 - DNA, 15 bp, Homo sapiens
gatgacattcatgaa

SEQ ID NO: 361713 - DNA, 15 bp, Homo sapiens
atgacattcatgaag

SEQ ID NO: 361714 - DNA, 15 bp, Homo sapiens
tgacattcatgaagg

SEQ ID NO: 361715 - DNA, 15 bp, Homo sapiens
gacattcatgaaggt

SEQ ID NO: 361716 - DNA, 15 bp, Homo sapiens
acattcatgaaggtg

SEQ ID NO: 361717 - DNA, 15 bp, Homo sapiens
cattcatgaaggtgg

SEQ ID NO: 361718 - DNA, 15 bp, Homo sapiens
attcatgaaggtggg

SEQ ID NO: 361719 - DNA, 15 bp, Homo sapiens
ttcatgaaggtgggt

SEQ ID NO: 361720 - DNA, 15 bp, Homo sapiens
tcatgaaggtgggtt

SEQ ID NO: 361721 - DNA, 15 bp, Homo sapiens
catgaaggtgggtta

SEQ ID NO: 361722 - DNA, 15 bp, Homo sapiens
atgaaggtgggttag

SEQ ID NO: 361723 - DNA, 15 bp, Homo sapiens
tgaaggtgggttaga

SEQ ID NO: 361724 - DNA, 15 bp, Homo sapiens
gaaggtgggttagat

SEQ ID NO: 361725 - DNA, 15 bp, Homo sapiens
aaggtgggttagatt

SEQ ID NO: 361726 - DNA, 15 bp, Homo sapiens
aggtgggttagattt

SEQ ID NO: 361727 - DNA, 15 bp, Homo sapiens
ggtgggttagatttc

SEQ ID NO: 361728 - DNA, 15 bp, Homo sapiens
gtgggttagatttca

SEQ ID NO: 361729 - DNA, 15 bp, Homo sapiens
tgggttagatttcaa

SEQ ID NO: 361730 - DNA, 15 bp, Homo sapiens
gggttagatttcaaa

SEQ ID NO: 361731 - DNA, 15 bp, Homo sapiens
ggttagatttcaaaa

SEQ ID NO: 361732 - DNA, 15 bp, Homo sapiens
gttagatttcaaaat

SEQ ID NO: 361733 - DNA, 15 bp, Homo sapiens
ttagatttcaaaata

SEQ ID NO: 361734 - DNA, 15 bp, Homo sapiens
tagatttcaaaataa

SEQ ID NO: 361735 - DNA, 15 bp, Homo sapiens
agatttcaaaataaa

SEQ ID NO: 361736 - DNA, 15 bp, Homo sapiens
gatttcaaaataaat

SEQ ID NO: 361737 - DNA, 15 bp, Homo sapiens
atttcaaaataaatt

SEQ ID NO: 361738 - DNA, 15 bp, Homo sapiens
tttcaaaataaattt

SEQ ID NO: 361739 - DNA, 15 bp, Homo sapiens
ttcaaaataaatttc

SEQ ID NO: 361740 - DNA, 15 bp, Homo sapiens
tcaaaataaatttca

SEQ ID NO: 361741 - DNA, 15 bp, Homo sapiens
caaaataaatttcat

SEQ ID NO: 361742 - DNA, 15 bp, Homo sapiens
aaaataaatttcatt

SEQ ID NO: 361743 - DNA, 15 bp, Homo sapiens
aaataaatttcattt

SEQ ID NO: 361744 - DNA, 15 bp, Homo sapiens
aataaatttcattta

SEQ ID NO: 361745 - DNA, 15 bp, Homo sapiens
ataaatttcatttag

SEQ ID NO: 361746 - DNA, 15 bp, Homo sapiens
taaatttcatttagc

SEQ ID NO: 361747 - DNA, 15 bp, Homo sapiens
aaatttcatttagca

SEQ ID NO: 361748 - DNA, 15 bp, Homo sapiens
aatttcatttagcat

SEQ ID NO: 361749 - DNA, 15 bp, Homo sapiens
atttcatttagcatg

SEQ ID NO: 361750 - DNA, 15 bp, Homo sapiens
tttcatttagcatgt

SEQ ID NO: 361751 - DNA, 15 bp, Homo sapiens
ttcatttagcatgtt

SEQ ID NO: 361752 - DNA, 15 bp, Homo sapiens
tcatttagcatgttc

SEQ ID NO: 361753 - DNA, 15 bp, Homo sapiens
catttagcatgttca

SEQ ID NO: 361754 - DNA, 15 bp, Homo sapiens
atttagcatgttcat

SEQ ID NO: 361755 - DNA, 15 bp, Homo sapiens
tttagcatgttcatt

SEQ ID NO: 361756 - DNA, 15 bp, Homo sapiens
ttagcatgttcattg

SEQ ID NO: 361757 - DNA, 15 bp, Homo sapiens
tagcatgttcattga

SEQ ID NO: 361758 - DNA, 15 bp, Homo sapiens
agcatgttcattgaa

SEQ ID NO: 361759 - DNA, 15 bp, Homo sapiens
gcatgttcattgaaa

SEQ ID NO: 361760 - DNA, 15 bp, Homo sapiens
catgttcattgaaat

SEQ ID NO: 361761 - DNA, 15 bp, Homo sapiens
atgttcattgaaatg

SEQ ID NO: 361762 - DNA, 15 bp, Homo sapiens
tgttcattgaaatgt

SEQ ID NO: 361763 - DNA, 15 bp, Homo sapiens
gttcattgaaatgta

SEQ ID NO: 361764 - DNA, 15 bp, Homo sapiens
ttcattgaaatgtaa

SEQ ID NO: 361765 - DNA, 15 bp, Homo sapiens
tcattgaaatgtaat

SEQ ID NO: 361766 - DNA, 15 bp, Homo sapiens
cattgaaatgtaatt

SEQ ID NO: 361767 - DNA, 15 bp, Homo sapiens
attgaaatgtaatta

SEQ ID NO: 361768 - DNA, 15 bp, Homo sapiens
ttgaaatgtaattaa

SEQ ID NO: 361769 - DNA, 15 bp, Homo sapiens
tgaaatgtaattaaa

SEQ ID NO: 361770 - DNA, 15 bp, Homo sapiens
gaaatgtaattaaat

SEQ ID NO: 361771 - DNA, 15 bp, Homo sapiens
aaatgtaattaaatt

SEQ ID NO: 361772 - DNA, 15 bp, Homo sapiens
aatgtaattaaattg

SEQ ID NO: 361773 - DNA, 15 bp, Homo sapiens
atgtaattaaattgt

SEQ ID NO: 361774 - DNA, 15 bp, Homo sapiens
tgtaattaaattgtt

SEQ ID NO: 361775 - DNA, 15 bp, Homo sapiens
gtaattaaattgttt

SEQ ID NO: 361776 - DNA, 15 bp, Homo sapiens
taattaaattgtttt

SEQ ID NO: 361777 - DNA, 15 bp, Homo sapiens
aattaaattgtttta

SEQ ID NO: 361778 - DNA, 15 bp, Homo sapiens
attaaattgttttaa

SEQ ID NO: 361779 - DNA, 15 bp, Homo sapiens
ttaaattgttttaaa

SEQ ID NO: 361780 - DNA, 15 bp, Homo sapiens
taaattgttttaaaa

SEQ ID NO: 361781 - DNA, 15 bp, Homo sapiens
aaattgttttaaaat

SEQ ID NO: 361782 - DNA, 15 bp, Homo sapiens
aattgttttaaaatg

SEQ ID NO: 361783 - DNA, 15 bp, Homo sapiens
attgttttaaaatgc

SEQ ID NO: 361784 - DNA, 15 bp, Homo sapiens
ttgttttaaaatgcc

SEQ ID NO: 361785 - DNA, 15 bp, Homo sapiens
tgttttaaaatgcct

SEQ ID NO: 361786 - DNA, 15 bp, Homo sapiens
gttttaaaatgcctt

SEQ ID NO: 361787 - DNA, 15 bp, Homo sapiens
ttttaaaatgccttt

SEQ ID NO: 361788 - DNA, 15 bp, Homo sapiens
tttaaaatgcctttt

SEQ ID NO: 361789 - DNA, 15 bp, Homo sapiens
ttaaaatgccttttt

SEQ ID NO: 361790 - DNA, 15 bp, Homo sapiens
taaaatgcctttttt

SEQ ID NO: 361791 - DNA, 15 bp, Homo sapiens
aaaatgccttttttt

SEQ ID NO: 361792 - DNA, 15 bp, Homo sapiens
aaatgcctttttttt

SEQ ID NO: 361793 - DNA, 15 bp, Homo sapiens
aatgccttttttttc

SEQ ID NO: 361794 - DNA, 15 bp, Homo sapiens
atgccttttttttct

SEQ ID NO: 361795 - DNA, 15 bp, Homo sapiens
tgccttttttttcta

SEQ ID NO: 361796 - DNA, 15 bp, Homo sapiens
gccttttttttctaa

SEQ ID NO: 361797 - DNA, 15 bp, Homo sapiens
ccttttttttctaac

SEQ ID NO: 361798 - DNA, 15 bp, Homo sapiens
cttttttttctaaca

SEQ ID NO: 361799 - DNA, 15 bp, Homo sapiens
ttttttttctaacat

SEQ ID NO: 361800 - DNA, 15 bp, Homo sapiens
tttttttctaacata

SEQ ID NO: 361801 - DNA, 15 bp, Homo sapiens
ttttttctaacataa

SEQ ID NO: 361802 - DNA, 15 bp, Homo sapiens
tttttctaacataaa

SEQ ID NO: 361803 - DNA, 15 bp, Homo sapiens
ttttctaacataaaa

SEQ ID NO: 361804 - DNA, 15 bp, Homo sapiens
tttctaacataaaat

SEQ ID NO: 361805 - DNA, 15 bp, Homo sapiens
ttctaacataaaata

SEQ ID NO: 361806 - DNA, 15 bp, Homo sapiens
tctaacataaaatat

SEQ ID NO: 361807 - DNA, 15 bp, Homo sapiens
ctaacataaaatatc

SEQ ID NO: 361808 - DNA, 15 bp, Homo sapiens
taacataaaatatct

SEQ ID NO: 361809 - DNA, 15 bp, Homo sapiens
aacataaaatatctt

SEQ ID NO: 361810 - DNA, 15 bp, Homo sapiens
acataaaatatcttt

SEQ ID NO: 361811 - DNA, 15 bp, Homo sapiens
cataaaatatctttc

SEQ ID NO: 361812 - DNA, 15 bp, Homo sapiens
ataaaatatctttcc

SEQ ID NO: 361813 - DNA, 15 bp, Homo sapiens
taaaatatctttcca

SEQ ID NO: 361814 - DNA, 15 bp, Homo sapiens
aaaatatctttccag

SEQ ID NO: 361815 - DNA, 15 bp, Homo sapiens
aaatatctttccagg

SEQ ID NO: 361816 - DNA, 15 bp, Homo sapiens
aatatctttccagga

SEQ ID NO: 361817 - DNA, 15 bp, Homo sapiens
atatctttccaggag

SEQ ID NO: 361818 - DNA, 15 bp, Homo sapiens
tatctttccaggagt

SEQ ID NO: 361819 - DNA, 15 bp, Homo sapiens
atctttccaggagtt

SEQ ID NO: 361820 - DNA, 15 bp, Homo sapiens
tctttccaggagttt

SEQ ID NO: 361821 - DNA, 15 bp, Homo sapiens
ctttccaggagtttg

SEQ ID NO: 361822 - DNA, 15 bp, Homo sapiens
tttccaggagtttgt

SEQ ID NO: 361823 - DNA, 15 bp, Homo sapiens
ttccaggagtttgtt

SEQ ID NO: 361824 - DNA, 15 bp, Homo sapiens
tccaggagtttgttt

SEQ ID NO: 361825 - DNA, 15 bp, Homo sapiens
ccaggagtttgtttc

SEQ ID NO: 361826 - DNA, 15 bp, Homo sapiens
caggagtttgtttct

SEQ ID NO: 361827 - DNA, 15 bp, Homo sapiens
aggagtttgtttctt

SEQ ID NO: 361828 - DNA, 15 bp, Homo sapiens
ggagtttgtttcttt

SEQ ID NO: 361829 - DNA, 15 bp, Homo sapiens
gagtttgtttctttc

SEQ ID NO: 361830 - DNA, 15 bp, Homo sapiens
agtttgtttctttca

SEQ ID NO: 361831 - DNA, 15 bp, Homo sapiens
gtttgtttctttcac

SEQ ID NO: 361832 - DNA, 15 bp, Homo sapiens
tttgtttctttcaca

SEQ ID NO: 361833 - DNA, 15 bp, Homo sapiens
ttgtttctttcacac

SEQ ID NO: 361834 - DNA, 15 bp, Homo sapiens
tgtttctttcacact

SEQ ID NO: 361835 - DNA, 15 bp, Homo sapiens
gtttctttcacactt

SEQ ID NO: 361836 - DNA, 15 bp, Homo sapiens
tttctttcacactta

SEQ ID NO: 361837 - DNA, 15 bp, Homo sapiens
ttctttcacacttaa

SEQ ID NO: 361838 - DNA, 15 bp, Homo sapiens
tctttcacacttaaa

SEQ ID NO: 361839 - DNA, 15 bp, Homo sapiens
ctttcacacttaaat

SEQ ID NO: 361840 - DNA, 15 bp, Homo sapiens
tttcacacttaaatt

SEQ ID NO: 361841 - DNA, 15 bp, Homo sapiens
ttcacacttaaattg

SEQ ID NO: 361842 - DNA, 15 bp, Homo sapiens
tcacacttaaattga

SEQ ID NO: 361843 - DNA, 15 bp, Homo sapiens
cacacttaaattgat

SEQ ID NO: 361844 - DNA, 15 bp, Homo sapiens
acacttaaattgata

SEQ ID NO: 361845 - DNA, 15 bp, Homo sapiens
cacttaaattgatac

SEQ ID NO: 361846 - DNA, 15 bp, Homo sapiens
acttaaattgatacc

SEQ ID NO: 361847 - DNA, 15 bp, Homo sapiens
cttaaattgatacca

SEQ ID NO: 361848 - DNA, 15 bp, Homo sapiens
ttaaattgataccac

SEQ ID NO: 361849 - DNA, 15 bp, Homo sapiens
taaattgataccaca

SEQ ID NO: 361850 - DNA, 15 bp, Homo sapiens
aaattgataccacaa

SEQ ID NO: 361851 - DNA, 15 bp, Homo sapiens
aattgataccacaat

SEQ ID NO: 361852 - DNA, 15 bp, Homo sapiens
attgataccacaata

SEQ ID NO: 361853 - DNA, 15 bp, Homo sapiens
ttgataccacaatac

SEQ ID NO: 361854 - DNA, 15 bp, Homo sapiens
tgataccacaatact

SEQ ID NO: 361855 - DNA, 15 bp, Homo sapiens
gataccacaatactt

SEQ ID NO: 361856 - DNA, 15 bp, Homo sapiens
ataccacaatacttg

SEQ ID NO: 361857 - DNA, 15 bp, Homo sapiens
taccacaatacttgg

SEQ ID NO: 361858 - DNA, 15 bp, Homo sapiens
accacaatacttggg

SEQ ID NO: 361859 - DNA, 15 bp, Homo sapiens
ccacaatacttgggt

SEQ ID NO: 361860 - DNA, 15 bp, Homo sapiens
cacaatacttgggtg

SEQ ID NO: 361861 - DNA, 15 bp, Homo sapiens
acaatacttgggtgg

SEQ ID NO: 361862 - DNA, 15 bp, Homo sapiens
caatacttgggtgga

SEQ ID NO: 361863 - DNA, 15 bp, Homo sapiens
aatacttgggtggat

SEQ ID NO: 361864 - DNA, 15 bp, Homo sapiens
atacttgggtggatt

SEQ ID NO: 361865 - DNA, 15 bp, Homo sapiens
tacttgggtggattc

SEQ ID NO: 361866 - DNA, 15 bp, Homo sapiens
acttgggtggattca

SEQ ID NO: 361867 - DNA, 15 bp, Homo sapiens
cttgggtggattcat

SEQ ID NO: 361868 - DNA, 15 bp, Homo sapiens
ttgggtggattcatt

SEQ ID NO: 361869 - DNA, 15 bp, Homo sapiens
tgggtggattcattg

SEQ ID NO: 361870 - DNA, 15 bp, Homo sapiens
gggtggattcattgc

SEQ ID NO: 361871 - DNA, 15 bp, Homo sapiens
ggtggattcattgca

SEQ ID NO: 361872 - DNA, 15 bp, Homo sapiens
gtggattcattgcat

SEQ ID NO: 361873 - DNA, 15 bp, Homo sapiens
tggattcattgcatc

SEQ ID NO: 361874 - DNA, 15 bp, Homo sapiens
ggattcattgcatca

SEQ ID NO: 361875 - DNA, 15 bp, Homo sapiens
gattcattgcatcag

SEQ ID NO: 361876 - DNA, 15 bp, Homo sapiens
attcattgcatcaga

SEQ ID NO: 361877 - DNA, 15 bp, Homo sapiens
ttcattgcatcagaa

SEQ ID NO: 361878 - DNA, 15 bp, Homo sapiens
tcattgcatcagaat

SEQ ID NO: 361879 - DNA, 15 bp, Homo sapiens
cattgcatcagaatc

SEQ ID NO: 361880 - DNA, 15 bp, Homo sapiens
attgcatcagaatca

SEQ ID NO: 361881 - DNA, 15 bp, Homo sapiens
ttgcatcagaatcat

SEQ ID NO: 361882 - DNA, 15 bp, Homo sapiens
tgcatcagaatcatt

SEQ ID NO: 361883 - DNA, 15 bp, Homo sapiens
gcatcagaatcattt

SEQ ID NO: 361884 - DNA, 15 bp, Homo sapiens
catcagaatcattta

SEQ ID NO: 361885 - DNA, 15 bp, Homo sapiens
atcagaatcatttac

SEQ ID NO: 361886 - DNA, 15 bp, Homo sapiens
tcagaatcatttact

SEQ ID NO: 361887 - DNA, 15 bp, Homo sapiens
cagaatcatttactt

SEQ ID NO: 361888 - DNA, 15 bp, Homo sapiens
agaatcatttactta

SEQ ID NO: 361889 - DNA, 15 bp, Homo sapiens
gaatcatttacttat

SEQ ID NO: 361890 - DNA, 15 bp, Homo sapiens
aatcatttacttatt

SEQ ID NO: 361891 - DNA, 15 bp, Homo sapiens
atcatttacttatta

SEQ ID NO: 361892 - DNA, 15 bp, Homo sapiens
tcatttacttattag

SEQ ID NO: 361893 - DNA, 15 bp, Homo sapiens
catttacttattagt

SEQ ID NO: 361894 - DNA, 15 bp, Homo sapiens
atttacttattagtg

SEQ ID NO: 361895 - DNA, 15 bp, Homo sapiens
tttacttattagtga

SEQ ID NO: 361896 - DNA, 15 bp, Homo sapiens
ttacttattagtgaa

SEQ ID NO: 361897 - DNA, 15 bp, Homo sapiens
tacttattagtgaaa

SEQ ID NO: 361898 - DNA, 15 bp, Homo sapiens
acttattagtgaaac

SEQ ID NO: 361899 - DNA, 15 bp, Homo sapiens
cttattagtgaaact

SEQ ID NO: 361900 - DNA, 15 bp, Homo sapiens
ttattagtgaaacta

SEQ ID NO: 361901 - DNA, 15 bp, Homo sapiens
tattagtgaaactaa

SEQ ID NO: 361902 - DNA, 15 bp, Homo sapiens
attagtgaaactaat

SEQ ID NO: 361903 - DNA, 15 bp, Homo sapiens
ttagtgaaactaatc

SEQ ID NO: 361904 - DNA, 15 bp, Homo sapiens
tagtgaaactaatct

SEQ ID NO: 361905 - DNA, 15 bp, Homo sapiens
agtgaaactaatctt

SEQ ID NO: 361906 - DNA, 15 bp, Homo sapiens
gtgaaactaatcttg

SEQ ID NO: 361907 - DNA, 15 bp, Homo sapiens
tgaaactaatcttga

SEQ ID NO: 361908 - DNA, 15 bp, Homo sapiens
gaaactaatcttgag

SEQ ID NO: 361909 - DNA, 15 bp, Homo sapiens
aaactaatcttgagt

SEQ ID NO: 361910 - DNA, 15 bp, Homo sapiens
aactaatcttgagtt

SEQ ID NO: 361911 - DNA, 15 bp, Homo sapiens
actaatcttgagttg

SEQ ID NO: 361912 - DNA, 15 bp, Homo sapiens
ctaatcttgagttgt

SEQ ID NO: 361913 - DNA, 15 bp, Homo sapiens
taatcttgagttgtg

SEQ ID NO: 361914 - DNA, 15 bp, Homo sapiens
aatcttgagttgtgc

SEQ ID NO: 361915 - DNA, 15 bp, Homo sapiens
atcttgagttgtgct

SEQ ID NO: 361916 - DNA, 15 bp, Homo sapiens
tcttgagttgtgctc

SEQ ID NO: 361917 - DNA, 15 bp, Homo sapiens
cttgagttgtgctct

SEQ ID NO: 361918 - DNA, 15 bp, Homo sapiens
ttgagttgtgctctg

SEQ ID NO: 361919 - DNA, 15 bp, Homo sapiens
tgagttgtgctctgt

SEQ ID NO: 361920 - DNA, 15 bp, Homo sapiens
gagttgtgctctgtt

SEQ ID NO: 361921 - DNA, 15 bp, Homo sapiens
agttgtgctctgtta

SEQ ID NO: 361922 - DNA, 15 bp, Homo sapiens
gttgtgctctgttac

SEQ ID NO: 361923 - DNA, 15 bp, Homo sapiens
ttgtgctctgttaca

SEQ ID NO: 361924 - DNA, 15 bp, Homo sapiens
tgtgctctgttacag

SEQ ID NO: 361925 - DNA, 15 bp, Homo sapiens
gtgctctgttacagg

SEQ ID NO: 361926 - DNA, 15 bp, Homo sapiens
tgctctgttacagga

SEQ ID NO: 361927 - DNA, 15 bp, Homo sapiens
gctctgttacaggaa

SEQ ID NO: 361928 - DNA, 15 bp, Homo sapiens
ctctgttacaggaac

SEQ ID NO: 361929 - DNA, 15 bp, Homo sapiens
tctgttacaggaact

SEQ ID NO: 361930 - DNA, 15 bp, Homo sapiens
ctgttacaggaactt

SEQ ID NO: 361931 - DNA, 15 bp, Homo sapiens
tgttacaggaacttg

SEQ ID NO: 361932 - DNA, 15 bp, Homo sapiens
gttacaggaacttga

SEQ ID NO: 361933 - DNA, 15 bp, Homo sapiens
ttacaggaacttgag

SEQ ID NO: 361934 - DNA, 15 bp, Homo sapiens
tacaggaacttgagg

SEQ ID NO: 361935 - DNA, 15 bp, Homo sapiens
acaggaacttgaggt

SEQ ID NO: 361936 - DNA, 15 bp, Homo sapiens
caggaacttgaggtg

SEQ ID NO: 361937 - DNA, 15 bp, Homo sapiens
aggaacttgaggtgg

SEQ ID NO: 361938 - DNA, 15 bp, Homo sapiens
ggaacttgaggtggg

SEQ ID NO: 361939 - DNA, 15 bp, Homo sapiens
gaacttgaggtgggc

SEQ ID NO: 361940 - DNA, 15 bp, Homo sapiens
aacttgaggtgggca

SEQ ID NO: 361941 - DNA, 15 bp, Homo sapiens
acttgaggtgggcat

SEQ ID NO: 361942 - DNA, 15 bp, Homo sapiens
cttgaggtgggcatc

SEQ ID NO: 361943 - DNA, 15 bp, Homo sapiens
ttgaggtgggcatca

SEQ ID NO: 361944 - DNA, 15 bp, Homo sapiens
tgaggtgggcatcag

SEQ ID NO: 361945 - DNA, 15 bp, Homo sapiens
gaggtgggcatcagc

SEQ ID NO: 361946 - DNA, 15 bp, Homo sapiens
aggtgggcatcagca

SEQ ID NO: 361947 - DNA, 15 bp, Homo sapiens
ggtgggcatcagcag

SEQ ID NO: 361948 - DNA, 15 bp, Homo sapiens
gtgggcatcagcagc

SEQ ID NO: 361949 - DNA, 15 bp, Homo sapiens
tgggcatcagcagcc

SEQ ID NO: 361950 - DNA, 15 bp, Homo sapiens
gggcatcagcagcca

SEQ ID NO: 361951 - DNA, 15 bp, Homo sapiens
ggcatcagcagccac

SEQ ID NO: 361952 - DNA, 15 bp, Homo sapiens
gcatcagcagccacc

SEQ ID NO: 361953 - DNA, 15 bp, Homo sapiens
catcagcagccacca

SEQ ID NO: 361954 - DNA, 15 bp, Homo sapiens
atcagcagccaccag

SEQ ID NO: 361955 - DNA, 15 bp, Homo sapiens
tcagcagccaccagc

SEQ ID NO: 361956 - DNA, 15 bp, Homo sapiens
cagcagccaccagcc

SEQ ID NO: 361957 - DNA, 15 bp, Homo sapiens
agcagccaccagccc

SEQ ID NO: 361958 - DNA, 15 bp, Homo sapiens
gcagccaccagccca

SEQ ID NO: 361959 - DNA, 15 bp, Homo sapiens
cagccaccagcccag

SEQ ID NO: 361960 - DNA, 15 bp, Homo sapiens
agccaccagcccagt

SEQ ID NO: 361961 - DNA, 15 bp, Homo sapiens
gccaccagcccagtt

SEQ ID NO: 361962 - DNA, 15 bp, Homo sapiens
ccaccagcccagttt

SEQ ID NO: 361963 - DNA, 15 bp, Homo sapiens
caccagcccagtttt

SEQ ID NO: 361964 - DNA, 15 bp, Homo sapiens
accagcccagttttg

SEQ ID NO: 361965 - DNA, 15 bp, Homo sapiens
ccagcccagttttgc

SEQ ID NO: 361966 - DNA, 15 bp, Homo sapiens
cagcccagttttgca

SEQ ID NO: 361967 - DNA, 15 bp, Homo sapiens
agcccagttttgcag

SEQ ID NO: 361968 - DNA, 15 bp, Homo sapiens
gcccagttttgcagc

SEQ ID NO: 361969 - DNA, 15 bp, Homo sapiens
cccagttttgcagca

SEQ ID NO: 361970 - DNA, 15 bp, Homo sapiens
ccagttttgcagcac

SEQ ID NO: 361971 - DNA, 15 bp, Homo sapiens
cagttttgcagcact

SEQ ID NO: 361972 - DNA, 15 bp, Homo sapiens
agttttgcagcacta

SEQ ID NO: 361973 - DNA, 15 bp, Homo sapiens
gttttgcagcactaa

SEQ ID NO: 361974 - DNA, 15 bp, Homo sapiens
ttttgcagcactaaa

SEQ ID NO: 361975 - DNA, 15 bp, Homo sapiens
tttgcagcactaaac

SEQ ID NO: 361976 - DNA, 15 bp, Homo sapiens
ttgcagcactaaacc

SEQ ID NO: 361977 - DNA, 15 bp, Homo sapiens
tgcagcactaaaccg

SEQ ID NO: 361978 - DNA, 15 bp, Homo sapiens
gcagcactaaaccga

SEQ ID NO: 361979 - DNA, 15 bp, Homo sapiens
cagcactaaaccgaa

SEQ ID NO: 361980 - DNA, 15 bp, Homo sapiens
agcactaaaccgaac

SEQ ID NO: 361981 - DNA, 15 bp, Homo sapiens
gcactaaaccgaact

SEQ ID NO: 361982 - DNA, 15 bp, Homo sapiens
cactaaaccgaactg

SEQ ID NO: 361983 - DNA, 15 bp, Homo sapiens
actaaaccgaactgg

SEQ ID NO: 361984 - DNA, 15 bp, Homo sapiens
ctaaaccgaactggg

SEQ ID NO: 361985 - DNA, 15 bp, Homo sapiens
taaaccgaactgggg

SEQ ID NO: 361986 - DNA, 15 bp, Homo sapiens
aaaccgaactgggga

SEQ ID NO: 361987 - DNA, 15 bp, Homo sapiens
aaccgaactggggat

SEQ ID NO: 361988 - DNA, 15 bp, Homo sapiens
accgaactggggatg

SEQ ID NO: 361989 - DNA, 15 bp, Homo sapiens
ccgaactggggatgg

SEQ ID NO: 361990 - DNA, 15 bp, Homo sapiens
cgaactggggatggg

SEQ ID NO: 361991 - DNA, 15 bp, Homo sapiens
gaactggggatggga

SEQ ID NO: 361992 - DNA, 15 bp, Homo sapiens
aactggggatgggat

SEQ ID NO: 361993 - DNA, 15 bp, Homo sapiens
actggggatgggatt

SEQ ID NO: 361994 - DNA, 15 bp, Homo sapiens
ctggggatgggattg

SEQ ID NO: 361995 - DNA, 15 bp, Homo sapiens
tggggatgggattgt

SEQ ID NO: 361996 - DNA, 15 bp, Homo sapiens
ggggatgggattgtg

SEQ ID NO: 361997 - DNA, 15 bp, Homo sapiens
gggatgggattgtgc

SEQ ID NO: 361998 - DNA, 15 bp, Homo sapiens
ggatgggattgtgca

SEQ ID NO: 361999 - DNA, 15 bp, Homo sapiens
gatgggattgtgcag

SEQ ID NO: 362000 - DNA, 15 bp, Homo sapiens
atgggattgtgcaga

SEQ ID NO: 362001 - DNA, 15 bp, Homo sapiens
tgggattgtgcagaa

SEQ ID NO: 362002 - DNA, 15 bp, Homo sapiens
gggattgtgcagaaa

SEQ ID NO: 362003 - DNA, 15 bp, Homo sapiens
ggattgtgcagaaac

SEQ ID NO: 362004 - DNA, 15 bp, Homo sapiens
gattgtgcagaaact

SEQ ID NO: 362005 - DNA, 15 bp, Homo sapiens
attgtgcagaaactc

SEQ ID NO: 362006 - DNA, 15 bp, Homo sapiens
ttgtgcagaaactct

SEQ ID NO: 362007 - DNA, 15 bp, Homo sapiens
tgtgcagaaactctc

SEQ ID NO: 362008 - DNA, 15 bp, Homo sapiens
gtgcagaaactctcc

SEQ ID NO: 362009 - DNA, 15 bp, Homo sapiens
tgcagaaactctccc

SEQ ID NO: 362010 - DNA, 15 bp, Homo sapiens
gcagaaactctccca

SEQ ID NO: 362011 - DNA, 15 bp, Homo sapiens
cagaaactctcccag

SEQ ID NO: 362012 - DNA, 15 bp, Homo sapiens
agaaactctcccagg

SEQ ID NO: 362013 - DNA, 15 bp, Homo sapiens
gaaactctcccaggc

SEQ ID NO: 362014 - DNA, 15 bp, Homo sapiens
aaactctcccaggca

SEQ ID NO: 362015 - DNA, 15 bp, Homo sapiens
aactctcccaggcag

SEQ ID NO: 362016 - DNA, 15 bp, Homo sapiens
actctcccaggcaga

SEQ ID NO: 362017 - DNA, 15 bp, Homo sapiens
ctctcccaggcagat

SEQ ID NO: 362018 - DNA, 15 bp, Homo sapiens
tctcccaggcagatg

SEQ ID NO: 362019 - DNA, 15 bp, Homo sapiens
ctcccaggcagatgg

SEQ ID NO: 362020 - DNA, 15 bp, Homo sapiens
tcccaggcagatgga

SEQ ID NO: 362021 - DNA, 15 bp, Homo sapiens
cccaggcagatggaa

SEQ ID NO: 362022 - DNA, 15 bp, Homo sapiens
ccaggcagatggaag

SEQ ID NO: 362023 - DNA, 15 bp, Homo sapiens
caggcagatggaagc

SEQ ID NO: 362024 - DNA, 15 bp, Homo sapiens
aggcagatggaagct

SEQ ID NO: 362025 - DNA, 15 bp, Homo sapiens
ggcagatggaagctt

SEQ ID NO: 362026 - DNA, 15 bp, Homo sapiens
gcagatggaagcttc

SEQ ID NO: 362027 - DNA, 15 bp, Homo sapiens
cagatggaagcttct

SEQ ID NO: 362028 - DNA, 15 bp, Homo sapiens
agatggaagcttctt

SEQ ID NO: 362029 - DNA, 15 bp, Homo sapiens
gatggaagcttcttg

SEQ ID NO: 362030 - DNA, 15 bp, Homo sapiens
atggaagcttcttga

SEQ ID NO: 362031 - DNA, 15 bp, Homo sapiens
tggaagcttcttgaa

SEQ ID NO: 362032 - DNA, 15 bp, Homo sapiens
ggaagcttcttgaaa

SEQ ID NO: 362033 - DNA, 15 bp, Homo sapiens
gaagcttcttgaaag

SEQ ID NO: 362034 - DNA, 15 bp, Homo sapiens
aagcttcttgaaaga

SEQ ID NO: 362035 - DNA, 15 bp, Homo sapiens
agcttcttgaaagaa

SEQ ID NO: 362036 - DNA, 15 bp, Homo sapiens
gcttcttgaaagaaa

SEQ ID NO: 362037 - DNA, 15 bp, Homo sapiens
cttcttgaaagaaaa

SEQ ID NO: 362038 - DNA, 15 bp, Homo sapiens
ttcttgaaagaaaaa

SEQ ID NO: 362039 - DNA, 15 bp, Homo sapiens
tcttgaaagaaaaac

SEQ ID NO: 362040 - DNA, 15 bp, Homo sapiens
cttgaaagaaaaact

SEQ ID NO: 362041 - DNA, 15 bp, Homo sapiens
ttgaaagaaaaactg

SEQ ID NO: 362042 - DNA, 15 bp, Homo sapiens
tgaaagaaaaactgg

SEQ ID NO: 362043 - DNA, 15 bp, Homo sapiens
gaaagaaaaactggc

SEQ ID NO: 362044 - DNA, 15 bp, Homo sapiens
aaagaaaaactggca

SEQ ID NO: 362045 - DNA, 15 bp, Homo sapiens
aagaaaaactggcag

SEQ ID NO: 362046 - DNA, 15 bp, Homo sapiens
agaaaaactggcagg

SEQ ID NO: 362047 - DNA, 15 bp, Homo sapiens
gaaaaactggcaggt

SEQ ID NO: 362048 - DNA, 15 bp, Homo sapiens
aaaaactggcaggtt

SEQ ID NO: 362049 - DNA, 15 bp, Homo sapiens
aaaactggcaggttt

SEQ ID NO: 362050 - DNA, 15 bp, Homo sapiens
aaactggcaggttta

SEQ ID NO: 362051 - DNA, 15 bp, Homo sapiens
aactggcaggtttaa

SEQ ID NO: 362052 - DNA, 15 bp, Homo sapiens
actggcaggtttaaa

SEQ ID NO: 362053 - DNA, 15 bp, Homo sapiens
ctggcaggtttaaac

SEQ ID NO: 362054 - DNA, 15 bp, Homo sapiens
tggcaggtttaaacc

SEQ ID NO: 362055 - DNA, 15 bp, Homo sapiens
ggcaggtttaaacca

SEQ ID NO: 362056 - DNA, 15 bp, Homo sapiens
gcaggtttaaaccaa

SEQ ID NO: 362057 - DNA, 15 bp, Homo sapiens
caggtttaaaccaac

SEQ ID NO: 362058 - DNA, 15 bp, Homo sapiens
aggtttaaaccaacg

SEQ ID NO: 362059 - DNA, 15 bp, Homo sapiens
ggtttaaaccaacgc

SEQ ID NO: 362060 - DNA, 15 bp, Homo sapiens
gtttaaaccaacgct

SEQ ID NO: 362061 - DNA, 15 bp, Homo sapiens
tttaaaccaacgctg

SEQ ID NO: 362062 - DNA, 15 bp, Homo sapiens
ttaaaccaacgctgg

SEQ ID NO: 362063 - DNA, 15 bp, Homo sapiens
taaaccaacgctggg

SEQ ID NO: 362064 - DNA, 15 bp, Homo sapiens
aaaccaacgctggga

SEQ ID NO: 362065 - DNA, 15 bp, Homo sapiens
aaccaacgctgggat

SEQ ID NO: 362066 - DNA, 15 bp, Homo sapiens
accaacgctgggatg

SEQ ID NO: 362067 - DNA, 15 bp, Homo sapiens
ccaacgctgggatgc

SEQ ID NO: 362068 - DNA, 15 bp, Homo sapiens
caacgctgggatgca

SEQ ID NO: 362069 - DNA, 15 bp, Homo sapiens
aacgctgggatgcaa

SEQ ID NO: 362070 - DNA, 15 bp, Homo sapiens
acgctgggatgcaat

SEQ ID NO: 362071 - DNA, 15 bp, Homo sapiens
cgctgggatgcaatt

SEQ ID NO: 362072 - DNA, 15 bp, Homo sapiens
gctgggatgcaattg

SEQ ID NO: 362073 - DNA, 15 bp, Homo sapiens
ctgggatgcaattgt

SEQ ID NO: 362074 - DNA, 15 bp, Homo sapiens
tgggatgcaattgtt

SEQ ID NO: 362075 - DNA, 15 bp, Homo sapiens
gggatgcaattgttg

SEQ ID NO: 362076 - DNA, 15 bp, Homo sapiens
ggatgcaattgttgc

SEQ ID NO: 362077 - DNA, 15 bp, Homo sapiens
gatgcaattgttgca

SEQ ID NO: 362078 - DNA, 15 bp, Homo sapiens
atgcaattgttgcag

SEQ ID NO: 362079 - DNA, 15 bp, Homo sapiens
tgcaattgttgcaga

SEQ ID NO: 362080 - DNA, 15 bp, Homo sapiens
gcaattgttgcagaa

SEQ ID NO: 362081 - DNA, 15 bp, Homo sapiens
caattgttgcagaag

SEQ ID NO: 362082 - DNA, 15 bp, Homo sapiens
aattgttgcagaagt

SEQ ID NO: 362083 - DNA, 15 bp, Homo sapiens
attgttgcagaagtg

SEQ ID NO: 362084 - DNA, 15 bp, Homo sapiens
ttgttgcagaagtga

SEQ ID NO: 362085 - DNA, 15 bp, Homo sapiens
tgttgcagaagtgaa

SEQ ID NO: 362086 - DNA, 15 bp, Homo sapiens
gttgcagaagtgaag

SEQ ID NO: 362087 - DNA, 15 bp, Homo sapiens
ttgcagaagtgaagg

SEQ ID NO: 362088 - DNA, 15 bp, Homo sapiens
tgcagaagtgaagga

SEQ ID NO: 362089 - DNA, 15 bp, Homo sapiens
gcagaagtgaaggat

SEQ ID NO: 362090 - DNA, 15 bp, Homo sapiens
cagaagtgaaggata

SEQ ID NO: 362091 - DNA, 15 bp, Homo sapiens
agaagtgaaggatag

SEQ ID NO: 362092 - DNA, 15 bp, Homo sapiens
gaagtgaaggatagg

SEQ ID NO: 362093 - DNA, 15 bp, Homo sapiens
aagtgaaggataggc

SEQ ID NO: 362094 - DNA, 15 bp, Homo sapiens
agtgaaggataggca

SEQ ID NO: 362095 - DNA, 15 bp, Homo sapiens
gtgaaggataggcag

SEQ ID NO: 362096 - DNA, 15 bp, Homo sapiens
tgaaggataggcagc

SEQ ID NO: 362097 - DNA, 15 bp, Homo sapiens
gaaggataggcagcc

SEQ ID NO: 362098 - DNA, 15 bp, Homo sapiens
aaggataggcagcca

SEQ ID NO: 362099 - DNA, 15 bp, Homo sapiens
aggataggcagccaa

SEQ ID NO: 362100 - DNA, 15 bp, Homo sapiens
ggataggcagccaag

SEQ ID NO: 362101 - DNA, 15 bp, Homo sapiens
gataggcagccaagg

SEQ ID NO: 362102 - DNA, 15 bp, Homo sapiens
ataggcagccaaggt

SEQ ID NO: 362103 - DNA, 15 bp, Homo sapiens
taggcagccaaggtg

SEQ ID NO: 362104 - DNA, 15 bp, Homo sapiens
aggcagccaaggtga

SEQ ID NO: 362105 - DNA, 15 bp, Homo sapiens
ggcagccaaggtgat

SEQ ID NO: 362106 - DNA, 15 bp, Homo sapiens
gcagccaaggtgatt

SEQ ID NO: 362107 - DNA, 15 bp, Homo sapiens
cagccaaggtgattt

SEQ ID NO: 362108 - DNA, 15 bp, Homo sapiens
agccaaggtgattta

SEQ ID NO: 362109 - DNA, 15 bp, Homo sapiens
gccaaggtgatttag

SEQ ID NO: 362110 - DNA, 15 bp, Homo sapiens
ccaaggtgatttagc

SEQ ID NO: 362111 - DNA, 15 bp, Homo sapiens
caaggtgatttagct

SEQ ID NO: 362112 - DNA, 15 bp, Homo sapiens
aaggtgatttagcta

SEQ ID NO: 362113 - DNA, 15 bp, Homo sapiens
aggtgatttagctat

SEQ ID NO: 362114 - DNA, 15 bp, Homo sapiens
ggtgatttagctatg

SEQ ID NO: 362115 - DNA, 15 bp, Homo sapiens
gtgatttagctatga

SEQ ID NO: 362116 - DNA, 15 bp, Homo sapiens
tgatttagctatgat

SEQ ID NO: 362117 - DNA, 15 bp, Homo sapiens
gatttagctatgatt

SEQ ID NO: 362118 - DNA, 15 bp, Homo sapiens
atttagctatgattg

SEQ ID NO: 362119 - DNA, 15 bp, Homo sapiens
tttagctatgattgt

SEQ ID NO: 362120 - DNA, 15 bp, Homo sapiens
ttagctatgattgtt

SEQ ID NO: 362121 - DNA, 15 bp, Homo sapiens
tagctatgattgttt

SEQ ID NO: 362122 - DNA, 15 bp, Homo sapiens
agctatgattgtttg

SEQ ID NO: 362123 - DNA, 15 bp, Homo sapiens
gctatgattgtttgc

SEQ ID NO: 362124 - DNA, 15 bp, Homo sapiens
ctatgattgtttgca

SEQ ID NO: 362125 - DNA, 15 bp, Homo sapiens
tatgattgtttgcag

SEQ ID NO: 362126 - DNA, 15 bp, Homo sapiens
atgattgtttgcagg

SEQ ID NO: 362127 - DNA, 15 bp, Homo sapiens
tgattgtttgcaggc

SEQ ID NO: 362128 - DNA, 15 bp, Homo sapiens
gattgtttgcaggca

SEQ ID NO: 362129 - DNA, 15 bp, Homo sapiens
attgtttgcaggcac

SEQ ID NO: 362130 - DNA, 15 bp, Homo sapiens
ttgtttgcaggcaca

SEQ ID NO: 362131 - DNA, 15 bp, Homo sapiens
tgtttgcaggcacag

SEQ ID NO: 362132 - DNA, 15 bp, Homo sapiens
gtttgcaggcacagg

SEQ ID NO: 362133 - DNA, 15 bp, Homo sapiens
tttgcaggcacagga

SEQ ID NO: 362134 - DNA, 15 bp, Homo sapiens
ttgcaggcacaggag

SEQ ID NO: 362135 - DNA, 15 bp, Homo sapiens
tgcaggcacaggagt

SEQ ID NO: 362136 - DNA, 15 bp, Homo sapiens
gcaggcacaggagtg

SEQ ID NO: 362137 - DNA, 15 bp, Homo sapiens
caggcacaggagtga

SEQ ID NO: 362138 - DNA, 15 bp, Homo sapiens
aggcacaggagtgaa

SEQ ID NO: 362139 - DNA, 15 bp, Homo sapiens
ggcacaggagtgaac

SEQ ID NO: 362140 - DNA, 15 bp, Homo sapiens
gcacaggagtgaaca

SEQ ID NO: 362141 - DNA, 15 bp, Homo sapiens
cacaggagtgaacat

SEQ ID NO: 362142 - DNA, 15 bp, Homo sapiens
acaggagtgaacata

SEQ ID NO: 362143 - DNA, 15 bp, Homo sapiens
caggagtgaacatat

SEQ ID NO: 362144 - DNA, 15 bp, Homo sapiens
aggagtgaacatatt

SEQ ID NO: 362145 - DNA, 15 bp, Homo sapiens
ggagtgaacatattt

SEQ ID NO: 362146 - DNA, 15 bp, Homo sapiens
gagtgaacatatttt

SEQ ID NO: 362147 - DNA, 15 bp, Homo sapiens
agtgaacatattttg

SEQ ID NO: 362148 - DNA, 15 bp, Homo sapiens
gtgaacatattttgg

SEQ ID NO: 362149 - DNA, 15 bp, Homo sapiens
tgaacatattttgga

SEQ ID NO: 362150 - DNA, 15 bp, Homo sapiens
gaacatattttggat

SEQ ID NO: 362151 - DNA, 15 bp, Homo sapiens
aacatattttggata

SEQ ID NO: 362152 - DNA, 15 bp, Homo sapiens
acatattttggatag

SEQ ID NO: 362153 - DNA, 15 bp, Homo sapiens
catattttggataga

SEQ ID NO: 362154 - DNA, 15 bp, Homo sapiens
atattttggatagaa

SEQ ID NO: 362155 - DNA, 15 bp, Homo sapiens
tattttggatagaat

SEQ ID NO: 362156 - DNA, 15 bp, Homo sapiens
attttggatagaatc

SEQ ID NO: 362157 - DNA, 15 bp, Homo sapiens
ttttggatagaatct

SEQ ID NO: 362158 - DNA, 15 bp, Homo sapiens
tttggatagaatctt

SEQ ID NO: 362159 - DNA, 15 bp, Homo sapiens
ttggatagaatcttt

SEQ ID NO: 362160 - DNA, 15 bp, Homo sapiens
tggatagaatctttt

SEQ ID NO: 362161 - DNA, 15 bp, Homo sapiens
ggatagaatctttta

SEQ ID NO: 362162 - DNA, 15 bp, Homo sapiens
gatagaatcttttaa

SEQ ID NO: 362163 - DNA, 15 bp, Homo sapiens
atagaatcttttaag

SEQ ID NO: 362164 - DNA, 15 bp, Homo sapiens
tagaatcttttaaga

SEQ ID NO: 362165 - DNA, 15 bp, Homo sapiens
agaatcttttaagat

SEQ ID NO: 362166 - DNA, 15 bp, Homo sapiens
gaatcttttaagatg

SEQ ID NO: 362167 - DNA, 15 bp, Homo sapiens
aatcttttaagatgc

SEQ ID NO: 362168 - DNA, 15 bp, Homo sapiens
atcttttaagatgca

SEQ ID NO: 362169 - DNA, 15 bp, Homo sapiens
tcttttaagatgcaa

SEQ ID NO: 362170 - DNA, 15 bp, Homo sapiens
cttttaagatgcaat

SEQ ID NO: 362171 - DNA, 15 bp, Homo sapiens
ttttaagatgcaatc

SEQ ID NO: 362172 - DNA, 15 bp, Homo sapiens
tttaagatgcaatct

SEQ ID NO: 362173 - DNA, 15 bp, Homo sapiens
ttaagatgcaatcta

SEQ ID NO: 362174 - DNA, 15 bp, Homo sapiens
taagatgcaatctaa

SEQ ID NO: 362175 - DNA, 15 bp, Homo sapiens
aagatgcaatctaat

SEQ ID NO: 362176 - DNA, 15 bp, Homo sapiens
agatgcaatctaatg

SEQ ID NO: 362177 - DNA, 15 bp, Homo sapiens
gatgcaatctaatga

SEQ ID NO: 362178 - DNA, 15 bp, Homo sapiens
atgcaatctaatgag

SEQ ID NO: 362179 - DNA, 15 bp, Homo sapiens
tgcaatctaatgagt

SEQ ID NO: 362180 - DNA, 15 bp, Homo sapiens
gcaatctaatgagtt

SEQ ID NO: 362181 - DNA, 15 bp, Homo sapiens
caatctaatgagttc

SEQ ID NO: 362182 - DNA, 15 bp, Homo sapiens
aatctaatgagttct

SEQ ID NO: 362183 - DNA, 15 bp, Homo sapiens
atctaatgagttctt

SEQ ID NO: 362184 - DNA, 15 bp, Homo sapiens
tctaatgagttcttt

SEQ ID NO: 362185 - DNA, 15 bp, Homo sapiens
ctaatgagttctttt

SEQ ID NO: 362186 - DNA, 15 bp, Homo sapiens
taatgagttctttta

SEQ ID NO: 362187 - DNA, 15 bp, Homo sapiens
aatgagttcttttat

SEQ ID NO: 362188 - DNA, 15 bp, Homo sapiens
atgagttcttttatt

SEQ ID NO: 362189 - DNA, 15 bp, Homo sapiens
tgagttcttttattg

SEQ ID NO: 362190 - DNA, 15 bp, Homo sapiens
gagttcttttattgt

SEQ ID NO: 362191 - DNA, 15 bp, Homo sapiens
agttcttttattgtt

SEQ ID NO: 362192 - DNA, 15 bp, Homo sapiens
gttcttttattgttt

SEQ ID NO: 362193 - DNA, 15 bp, Homo sapiens
ttcttttattgtttg

SEQ ID NO: 362194 - DNA, 15 bp, Homo sapiens
tcttttattgtttga

SEQ ID NO: 362195 - DNA, 15 bp, Homo sapiens
cttttattgtttgac

SEQ ID NO: 362196 - DNA, 15 bp, Homo sapiens
ttttattgtttgaca

SEQ ID NO: 362197 - DNA, 15 bp, Homo sapiens
tttattgtttgacat

SEQ ID NO: 362198 - DNA, 15 bp, Homo sapiens
ttattgtttgacatt

SEQ ID NO: 362199 - DNA, 15 bp, Homo sapiens
tattgtttgacatta

SEQ ID NO: 362200 - DNA, 15 bp, Homo sapiens
attgtttgacattat

SEQ ID NO: 362201 - DNA, 15 bp, Homo sapiens
ttgtttgacattata

SEQ ID NO: 362202 - DNA, 15 bp, Homo sapiens
tgtttgacattataa

SEQ ID NO: 362203 - DNA, 15 bp, Homo sapiens
gtttgacattataat

SEQ ID NO: 362204 - DNA, 15 bp, Homo sapiens
tttgacattataata

SEQ ID NO: 362205 - DNA, 15 bp, Homo sapiens
ttgacattataatag

SEQ ID NO: 362206 - DNA, 15 bp, Homo sapiens
tgacattataatagg

SEQ ID NO: 362207 - DNA, 15 bp, Homo sapiens
gacattataatagga

SEQ ID NO: 362208 - DNA, 15 bp, Homo sapiens
acattataataggaa

SEQ ID NO: 362209 - DNA, 15 bp, Homo sapiens
cattataataggaat

SEQ ID NO: 362210 - DNA, 15 bp, Homo sapiens
attataataggaatt

SEQ ID NO: 362211 - DNA, 15 bp, Homo sapiens
ttataataggaattt

SEQ ID NO: 362212 - DNA, 15 bp, Homo sapiens
tataataggaatttt

SEQ ID NO: 362213 - DNA, 15 bp, Homo sapiens
ataataggaatttta

SEQ ID NO: 362214 - DNA, 15 bp, Homo sapiens
taataggaattttac

SEQ ID NO: 362215 - DNA, 15 bp, Homo sapiens
aataggaattttact

SEQ ID NO: 362216 - DNA, 15 bp, Homo sapiens
ataggaattttactg

SEQ ID NO: 362217 - DNA, 15 bp, Homo sapiens
taggaattttactga

SEQ ID NO: 362218 - DNA, 15 bp, Homo sapiens
aggaattttactgac

SEQ ID NO: 362219 - DNA, 15 bp, Homo sapiens
ggaattttactgaca

SEQ ID NO: 362220 - DNA, 15 bp, Homo sapiens
gaattttactgacat

SEQ ID NO: 362221 - DNA, 15 bp, Homo sapiens
aattttactgacatt

SEQ ID NO: 362222 - DNA, 15 bp, Homo sapiens
attttactgacattt

SEQ ID NO: 362223 - DNA, 15 bp, Homo sapiens
ttttactgacattta

SEQ ID NO: 362224 - DNA, 15 bp, Homo sapiens
tttactgacatttaa

SEQ ID NO: 362225 - DNA, 15 bp, Homo sapiens
ttactgacatttaag

SEQ ID NO: 362226 - DNA, 15 bp, Homo sapiens
tactgacatttaaga

SEQ ID NO: 362227 - DNA, 15 bp, Homo sapiens
actgacatttaagac

SEQ ID NO: 362228 - DNA, 15 bp, Homo sapiens
ctgacatttaagacc

SEQ ID NO: 362229 - DNA, 15 bp, Homo sapiens
tgacatttaagacct

SEQ ID NO: 362230 - DNA, 15 bp, Homo sapiens
gacatttaagacctc

SEQ ID NO: 362231 - DNA, 15 bp, Homo sapiens
acatttaagacctcc

SEQ ID NO: 362232 - DNA, 15 bp, Homo sapiens
catttaagacctcca

SEQ ID NO: 362233 - DNA, 15 bp, Homo sapiens
atttaagacctccac

SEQ ID NO: 362234 - DNA, 15 bp, Homo sapiens
tttaagacctccact

SEQ ID NO: 362235 - DNA, 15 bp, Homo sapiens
ttaagacctccactg

SEQ ID NO: 362236 - DNA, 15 bp, Homo sapiens
taagacctccactgc

SEQ ID NO: 362237 - DNA, 15 bp, Homo sapiens
aagacctccactgcc

SEQ ID NO: 362238 - DNA, 15 bp, Homo sapiens
agacctccactgccc

SEQ ID NO: 362239 - DNA, 15 bp, Homo sapiens
gacctccactgccca

SEQ ID NO: 362240 - DNA, 15 bp, Homo sapiens
acctccactgcccac

SEQ ID NO: 362241 - DNA, 15 bp, Homo sapiens
cctccactgcccacg

SEQ ID NO: 362242 - DNA, 15 bp, Homo sapiens
ctccactgcccacgt

SEQ ID NO: 362243 - DNA, 15 bp, Homo sapiens
tccactgcccacgtt

SEQ ID NO: 362244 - DNA, 15 bp, Homo sapiens
ccactgcccacgttc

SEQ ID NO: 362245 - DNA, 15 bp, Homo sapiens
cactgcccacgttct

SEQ ID NO: 362246 - DNA, 15 bp, Homo sapiens
actgcccacgttctc

SEQ ID NO: 362247 - DNA, 15 bp, Homo sapiens
ctgcccacgttctcc

SEQ ID NO: 362248 - DNA, 15 bp, Homo sapiens
tgcccacgttctccc

SEQ ID NO: 362249 - DNA, 15 bp, Homo sapiens
gcccacgttctccct

SEQ ID NO: 362250 - DNA, 15 bp, Homo sapiens
cccacgttctccctt

SEQ ID NO: 362251 - DNA, 15 bp, Homo sapiens
ccacgttctcccttc

SEQ ID NO: 362252 - DNA, 15 bp, Homo sapiens
cacgttctcccttcc

SEQ ID NO: 362253 - DNA, 15 bp, Homo sapiens
acgttctcccttcct

SEQ ID NO: 362254 - DNA, 15 bp, Homo sapiens
cgttctcccttcctg

SEQ ID NO: 362255 - DNA, 15 bp, Homo sapiens
gttctcccttcctgt

SEQ ID NO: 362256 - DNA, 15 bp, Homo sapiens
ttctcccttcctgta

SEQ ID NO: 362257 - DNA, 15 bp, Homo sapiens
tctcccttcctgtat

SEQ ID NO: 362258 - DNA, 15 bp, Homo sapiens
ctcccttcctgtatt

SEQ ID NO: 362259 - DNA, 15 bp, Homo sapiens
tcccttcctgtattt

SEQ ID NO: 362260 - DNA, 15 bp, Homo sapiens
cccttcctgtatttt

SEQ ID NO: 362261 - DNA, 15 bp, Homo sapiens
ccttcctgtattttt

SEQ ID NO: 362262 - DNA, 15 bp, Homo sapiens
cttcctgtattttta

SEQ ID NO: 362263 - DNA, 15 bp, Homo sapiens
ttcctgtatttttag

SEQ ID NO: 362264 - DNA, 15 bp, Homo sapiens
tcctgtatttttagg

SEQ ID NO: 362265 - DNA, 15 bp, Homo sapiens
cctgtatttttaggc

SEQ ID NO: 362266 - DNA, 15 bp, Homo sapiens
ctgtatttttaggct

SEQ ID NO: 362267 - DNA, 15 bp, Homo sapiens
tgtatttttaggctg

SEQ ID NO: 362268 - DNA, 15 bp, Homo sapiens
gtatttttaggctgt

SEQ ID NO: 362269 - DNA, 15 bp, Homo sapiens
tatttttaggctgtc

SEQ ID NO: 362270 - DNA, 15 bp, Homo sapiens
atttttaggctgtcc

SEQ ID NO: 362271 - DNA, 15 bp, Homo sapiens
tttttaggctgtcca

SEQ ID NO: 362272 - DNA, 15 bp, Homo sapiens
ttttaggctgtccat

SEQ ID NO: 362273 - DNA, 15 bp, Homo sapiens
tttaggctgtccata

SEQ ID NO: 362274 - DNA, 15 bp, Homo sapiens
ttaggctgtccataa

SEQ ID NO: 362275 - DNA, 15 bp, Homo sapiens
taggctgtccataaa

SEQ ID NO: 362276 - DNA, 15 bp, Homo sapiens
aggctgtccataaag

SEQ ID NO: 362277 - DNA, 15 bp, Homo sapiens
ggctgtccataaagt

SEQ ID NO: 362278 - DNA, 15 bp, Homo sapiens
gctgtccataaagtc

SEQ ID NO: 362279 - DNA, 15 bp, Homo sapiens
ctgtccataaagtct

SEQ ID NO: 362280 - DNA, 15 bp, Homo sapiens
tgtccataaagtctc

SEQ ID NO: 362281 - DNA, 15 bp, Homo sapiens
gtccataaagtctca

SEQ ID NO: 362282 - DNA, 15 bp, Homo sapiens
tccataaagtctcac

SEQ ID NO: 362283 - DNA, 15 bp, Homo sapiens
ccataaagtctcact

SEQ ID NO: 362284 - DNA, 15 bp, Homo sapiens
cataaagtctcactt

SEQ ID NO: 362285 - DNA, 15 bp, Homo sapiens
ataaagtctcacttt

SEQ ID NO: 362286 - DNA, 15 bp, Homo sapiens
taaagtctcactttt

SEQ ID NO: 362287 - DNA, 15 bp, Homo sapiens
aaagtctcacttttc

SEQ ID NO: 362288 - DNA, 15 bp, Homo sapiens
aagtctcacttttct

SEQ ID NO: 362289 - DNA, 15 bp, Homo sapiens
agtctcacttttcta

SEQ ID NO: 362290 - DNA, 15 bp, Homo sapiens
gtctcacttttctac

SEQ ID NO: 362291 - DNA, 15 bp, Homo sapiens
tctcacttttctact

SEQ ID NO: 362292 - DNA, 15 bp, Homo sapiens
ctcacttttctactc

SEQ ID NO: 362293 - DNA, 15 bp, Homo sapiens
tcacttttctactca

SEQ ID NO: 362294 - DNA, 15 bp, Homo sapiens
cacttttctactcaa

SEQ ID NO: 362295 - DNA, 15 bp, Homo sapiens
acttttctactcaaa

SEQ ID NO: 362296 - DNA, 15 bp, Homo sapiens
cttttctactcaaat

SEQ ID NO: 362297 - DNA, 15 bp, Homo sapiens
ttttctactcaaatg

SEQ ID NO: 362298 - DNA, 15 bp, Homo sapiens
tttctactcaaatgc

SEQ ID NO: 362299 - DNA, 15 bp, Homo sapiens
ttctactcaaatgct

SEQ ID NO: 362300 - DNA, 15 bp, Homo sapiens
tctactcaaatgcta

SEQ ID NO: 362301 - DNA, 15 bp, Homo sapiens
ctactcaaatgctac

SEQ ID NO: 362302 - DNA, 15 bp, Homo sapiens
tactcaaatgctaca

SEQ ID NO: 362303 - DNA, 15 bp, Homo sapiens
actcaaatgctacat

SEQ ID NO: 362304 - DNA, 15 bp, Homo sapiens
ctcaaatgctacata

SEQ ID NO: 362305 - DNA, 15 bp, Homo sapiens
tcaaatgctacatat

SEQ ID NO: 362306 - DNA, 15 bp, Homo sapiens
caaatgctacatatg

SEQ ID NO: 362307 - DNA, 15 bp, Homo sapiens
aaatgctacatatgt

SEQ ID NO: 362308 - DNA, 15 bp, Homo sapiens
aatgctacatatgta

SEQ ID NO: 362309 - DNA, 15 bp, Homo sapiens
atgctacatatgtaa

SEQ ID NO: 362310 - DNA, 15 bp, Homo sapiens
tgctacatatgtaaa

SEQ ID NO: 362311 - DNA, 15 bp, Homo sapiens
gctacatatgtaaaa

SEQ ID NO: 362312 - DNA, 15 bp, Homo sapiens
ctacatatgtaaaaa

SEQ ID NO: 362313 - DNA, 15 bp, Homo sapiens
tacatatgtaaaaac

SEQ ID NO: 362314 - DNA, 15 bp, Homo sapiens
acatatgtaaaaacc

SEQ ID NO: 362315 - DNA, 15 bp, Homo sapiens
catatgtaaaaacca

SEQ ID NO: 362316 - DNA, 15 bp, Homo sapiens
atatgtaaaaaccaa

SEQ ID NO: 362317 - DNA, 15 bp, Homo sapiens
tatgtaaaaaccaaa

SEQ ID NO: 362318 - DNA, 15 bp, Homo sapiens
atgtaaaaaccaaac

SEQ ID NO: 362319 - DNA, 15 bp, Homo sapiens
tgtaaaaaccaaaca

SEQ ID NO: 362320 - DNA, 15 bp, Homo sapiens
gtaaaaaccaaacac

SEQ ID NO: 362321 - DNA, 15 bp, Homo sapiens
taaaaaccaaacacc

SEQ ID NO: 362322 - DNA, 15 bp, Homo sapiens
aaaaaccaaacacct

SEQ ID NO: 362323 - DNA, 15 bp, Homo sapiens
aaaaccaaacacctt

SEQ ID NO: 362324 - DNA, 15 bp, Homo sapiens
aaaccaaacaccttt

SEQ ID NO: 362325 - DNA, 15 bp, Homo sapiens
aaccaaacaccttta

SEQ ID NO: 362326 - DNA, 15 bp, Homo sapiens
accaaacacctttat

SEQ ID NO: 362327 - DNA, 15 bp, Homo sapiens
ccaaacacctttatt

SEQ ID NO: 362328 - DNA, 15 bp, Homo sapiens
caaacacctttattc

SEQ ID NO: 362329 - DNA, 15 bp, Homo sapiens
aaacacctttattcc

SEQ ID NO: 362330 - DNA, 15 bp, Homo sapiens
aacacctttattcct

SEQ ID NO: 362331 - DNA, 15 bp, Homo sapiens
acacctttattcctt

SEQ ID NO: 362332 - DNA, 15 bp, Homo sapiens
cacctttattccttt

SEQ ID NO: 362333 - DNA, 15 bp, Homo sapiens
acctttattcctttt

SEQ ID NO: 362334 - DNA, 15 bp, Homo sapiens
cctttattcctttta

SEQ ID NO: 362335 - DNA, 15 bp, Homo sapiens
ctttattccttttat

SEQ ID NO: 362336 - DNA, 15 bp, Homo sapiens
tttattccttttatt

SEQ ID NO: 362337 - DNA, 15 bp, Homo sapiens
ttattccttttattt

SEQ ID NO: 362338 - DNA, 15 bp, Homo sapiens
tattccttttattta

SEQ ID NO: 362339 - DNA, 15 bp, Homo sapiens
attccttttatttac

SEQ ID NO: 362340 - DNA, 15 bp, Homo sapiens
ttccttttatttaca

SEQ ID NO: 362341 - DNA, 15 bp, Homo sapiens
tccttttatttacaa

SEQ ID NO: 362342 - DNA, 15 bp, Homo sapiens
ccttttatttacaac

SEQ ID NO: 362343 - DNA, 15 bp, Homo sapiens
cttttatttacaact

SEQ ID NO: 362344 - DNA, 15 bp, Homo sapiens
ttttatttacaactg

SEQ ID NO: 362345 - DNA, 15 bp, Homo sapiens
tttatttacaactgc

SEQ ID NO: 362346 - DNA, 15 bp, Homo sapiens
ttatttacaactgct

SEQ ID NO: 362347 - DNA, 15 bp, Homo sapiens
tatttacaactgctt

SEQ ID NO: 362348 - DNA, 15 bp, Homo sapiens
atttacaactgctta

SEQ ID NO: 362349 - DNA, 15 bp, Homo sapiens
tttacaactgcttat

SEQ ID NO: 362350 - DNA, 15 bp, Homo sapiens
ttacaactgcttatt

SEQ ID NO: 362351 - DNA, 15 bp, Homo sapiens
tacaactgcttatta

SEQ ID NO: 362352 - DNA, 15 bp, Homo sapiens
acaactgcttattat

SEQ ID NO: 362353 - DNA, 15 bp, Homo sapiens
caactgcttattatg

SEQ ID NO: 362354 - DNA, 15 bp, Homo sapiens
aactgcttattatga

SEQ ID NO: 362355 - DNA, 15 bp, Homo sapiens
actgcttattatgat

SEQ ID NO: 362356 - DNA, 15 bp, Homo sapiens
ctgcttattatgata

SEQ ID NO: 362357 - DNA, 15 bp, Homo sapiens
tgcttattatgatat

SEQ ID NO: 362358 - DNA, 15 bp, Homo sapiens
gcttattatgatatg

SEQ ID NO: 362359 - DNA, 15 bp, Homo sapiens
cttattatgatatgg

SEQ ID NO: 362360 - DNA, 15 bp, Homo sapiens
ttattatgatatggt

SEQ ID NO: 362361 - DNA, 15 bp, Homo sapiens
tattatgatatggtg

SEQ ID NO: 362362 - DNA, 15 bp, Homo sapiens
attatgatatggtga

SEQ ID NO: 362363 - DNA, 15 bp, Homo sapiens
ttatgatatggtgat

SEQ ID NO: 362364 - DNA, 15 bp, Homo sapiens
tatgatatggtgatt

SEQ ID NO: 362365 - DNA, 15 bp, Homo sapiens
atgatatggtgatta

SEQ ID NO: 362366 - DNA, 15 bp, Homo sapiens
tgatatggtgattat

SEQ ID NO: 362367 - DNA, 15 bp, Homo sapiens
gatatggtgattatg

SEQ ID NO: 362368 - DNA, 15 bp, Homo sapiens
atatggtgattatga

SEQ ID NO: 362369 - DNA, 15 bp, Homo sapiens
tatggtgattatgat

SEQ ID NO: 362370 - DNA, 15 bp, Homo sapiens
atggtgattatgatg

SEQ ID NO: 362371 - DNA, 15 bp, Homo sapiens
tggtgattatgatgg

SEQ ID NO: 362372 - DNA, 15 bp, Homo sapiens
ggtgattatgatggg

SEQ ID NO: 362373 - DNA, 15 bp, Homo sapiens
gtgattatgatggga

SEQ ID NO: 362374 - DNA, 15 bp, Homo sapiens
tgattatgatgggaa

SEQ ID NO: 362375 - DNA, 15 bp, Homo sapiens
gattatgatgggaat

SEQ ID NO: 362376 - DNA, 15 bp, Homo sapiens
attatgatgggaatt

SEQ ID NO: 362377 - DNA, 15 bp, Homo sapiens
ttatgatgggaattt

SEQ ID NO: 362378 - DNA, 15 bp, Homo sapiens
tatgatgggaattta

SEQ ID NO: 362379 - DNA, 15 bp, Homo sapiens
atgatgggaatttaa

SEQ ID NO: 362380 - DNA, 15 bp, Homo sapiens
tgatgggaatttaaa

SEQ ID NO: 362381 - DNA, 15 bp, Homo sapiens
gatgggaatttaaag

SEQ ID NO: 362382 - DNA, 15 bp, Homo sapiens
atgggaatttaaagt

SEQ ID NO: 362383 - DNA, 15 bp, Homo sapiens
tgggaatttaaagta

SEQ ID NO: 362384 - DNA, 15 bp, Homo sapiens
gggaatttaaagtag

SEQ ID NO: 362385 - DNA, 15 bp, Homo sapiens
ggaatttaaagtagt

SEQ ID NO: 362386 - DNA, 15 bp, Homo sapiens
gaatttaaagtagtt

SEQ ID NO: 362387 - DNA, 15 bp, Homo sapiens
aatttaaagtagttg

SEQ ID NO: 362388 - DNA, 15 bp, Homo sapiens
atttaaagtagttga

SEQ ID NO: 362389 - DNA, 15 bp, Homo sapiens
tttaaagtagttgaa

SEQ ID NO: 362390 - DNA, 15 bp, Homo sapiens
ttaaagtagttgaaa

SEQ ID NO: 362391 - DNA, 15 bp, Homo sapiens
taaagtagttgaaat

SEQ ID NO: 362392 - DNA, 15 bp, Homo sapiens
aaagtagttgaaata

SEQ ID NO: 362393 - DNA, 15 bp, Homo sapiens
aagtagttgaaataa

SEQ ID NO: 362394 - DNA, 15 bp, Homo sapiens
agtagttgaaataac

SEQ ID NO: 362395 - DNA, 15 bp, Homo sapiens
gtagttgaaataact

SEQ ID NO: 362396 - DNA, 15 bp, Homo sapiens
tagttgaaataactg

SEQ ID NO: 362397 - DNA, 15 bp, Homo sapiens
agttgaaataactga

SEQ ID NO: 362398 - DNA, 15 bp, Homo sapiens
gttgaaataactgaa

SEQ ID NO: 362399 - DNA, 15 bp, Homo sapiens
ttgaaataactgaaa

SEQ ID NO: 362400 - DNA, 15 bp, Homo sapiens
tgaaataactgaaac

SEQ ID NO: 362401 - DNA, 15 bp, Homo sapiens
gaaataactgaaact

SEQ ID NO: 362402 - DNA, 15 bp, Homo sapiens
aaataactgaaactc

SEQ ID NO: 362403 - DNA, 15 bp, Homo sapiens
aataactgaaactcc

SEQ ID NO: 362404 - DNA, 15 bp, Homo sapiens
ataactgaaactcca

SEQ ID NO: 362405 - DNA, 15 bp, Homo sapiens
taactgaaactccag

SEQ ID NO: 362406 - DNA, 15 bp, Homo sapiens
aactgaaactccagg

SEQ ID NO: 362407 - DNA, 15 bp, Homo sapiens
actgaaactccaggt

SEQ ID NO: 362408 - DNA, 15 bp, Homo sapiens
ctgaaactccaggtt

SEQ ID NO: 362409 - DNA, 15 bp, Homo sapiens
tgaaactccaggttt

SEQ ID NO: 362410 - DNA, 15 bp, Homo sapiens
gaaactccaggtttc

SEQ ID NO: 362411 - DNA, 15 bp, Homo sapiens
aaactccaggtttca

SEQ ID NO: 362412 - DNA, 15 bp, Homo sapiens
aactccaggtttcag

SEQ ID NO: 362413 - DNA, 15 bp, Homo sapiens
actccaggtttcagg

SEQ ID NO: 362414 - DNA, 15 bp, Homo sapiens
ctccaggtttcaggt

SEQ ID NO: 362415 - DNA, 15 bp, Homo sapiens
tccaggtttcaggtt

SEQ ID NO: 362416 - DNA, 15 bp, Homo sapiens
ccaggtttcaggttt

SEQ ID NO: 362417 - DNA, 15 bp, Homo sapiens
caggtttcaggtttg

SEQ ID NO: 362418 - DNA, 15 bp, Homo sapiens
aggtttcaggtttga

SEQ ID NO: 362419 - DNA, 15 bp, Homo sapiens
ggtttcaggtttgaa

SEQ ID NO: 362420 - DNA, 15 bp, Homo sapiens
gtttcaggtttgaag

SEQ ID NO: 362421 - DNA, 15 bp, Homo sapiens
tttcaggtttgaagg

SEQ ID NO: 362422 - DNA, 15 bp, Homo sapiens
ttcaggtttgaaggt

SEQ ID NO: 362423 - DNA, 15 bp, Homo sapiens
tcaggtttgaaggtc

SEQ ID NO: 362424 - DNA, 15 bp, Homo sapiens
caggtttgaaggtct

SEQ ID NO: 362425 - DNA, 15 bp, Homo sapiens
aggtttgaaggtctg

SEQ ID NO: 362426 - DNA, 15 bp, Homo sapiens
ggtttgaaggtctgg

SEQ ID NO: 362427 - DNA, 15 bp, Homo sapiens
gtttgaaggtctggg

SEQ ID NO: 362428 - DNA, 15 bp, Homo sapiens
tttgaaggtctgggt

SEQ ID NO: 362429 - DNA, 15 bp, Homo sapiens
ttgaaggtctgggtt

SEQ ID NO: 362430 - DNA, 15 bp, Homo sapiens
tgaaggtctgggttc

SEQ ID NO: 362431 - DNA, 15 bp, Homo sapiens
gaaggtctgggttca

SEQ ID NO: 362432 - DNA, 15 bp, Homo sapiens
aaggtctgggttcaa

SEQ ID NO: 362433 - DNA, 15 bp, Homo sapiens
aggtctgggttcaag

SEQ ID NO: 362434 - DNA, 15 bp, Homo sapiens
ggtctgggttcaaga

SEQ ID NO: 362435 - DNA, 15 bp, Homo sapiens
gtctgggttcaagat

SEQ ID NO: 362436 - DNA, 15 bp, Homo sapiens
tctgggttcaagatc

SEQ ID NO: 362437 - DNA, 15 bp, Homo sapiens
ctgggttcaagatca

SEQ ID NO: 362438 - DNA, 15 bp, Homo sapiens
tgggttcaagatcag

SEQ ID NO: 362439 - DNA, 15 bp, Homo sapiens
gggttcaagatcaga

SEQ ID NO: 362440 - DNA, 15 bp, Homo sapiens
ggttcaagatcagac

SEQ ID NO: 362441 - DNA, 15 bp, Homo sapiens
gttcaagatcagacc

SEQ ID NO: 362442 - DNA, 15 bp, Homo sapiens
ttcaagatcagacct

SEQ ID NO: 362443 - DNA, 15 bp, Homo sapiens
tcaagatcagacctt

SEQ ID NO: 362444 - DNA, 15 bp, Homo sapiens
caagatcagaccttc

SEQ ID NO: 362445 - DNA, 15 bp, Homo sapiens
aagatcagaccttcc

SEQ ID NO: 362446 - DNA, 15 bp, Homo sapiens
agatcagaccttccc

SEQ ID NO: 362447 - DNA, 15 bp, Homo sapiens
gatcagaccttccct

SEQ ID NO: 362448 - DNA, 15 bp, Homo sapiens
atcagaccttccctt

SEQ ID NO: 362449 - DNA, 15 bp, Homo sapiens
tcagaccttcccttt

SEQ ID NO: 362450 - DNA, 15 bp, Homo sapiens
cagaccttccctttg

SEQ ID NO: 362451 - DNA, 15 bp, Homo sapiens
agaccttccctttgc

SEQ ID NO: 362452 - DNA, 15 bp, Homo sapiens
gaccttccctttgct

SEQ ID NO: 362453 - DNA, 15 bp, Homo sapiens
accttccctttgctt

SEQ ID NO: 362454 - DNA, 15 bp, Homo sapiens
ccttccctttgctta

SEQ ID NO: 362455 - DNA, 15 bp, Homo sapiens
cttccctttgcttat

SEQ ID NO: 362456 - DNA, 15 bp, Homo sapiens
ttccctttgcttatt

SEQ ID NO: 362457 - DNA, 15 bp, Homo sapiens
tccctttgcttattt

SEQ ID NO: 362458 - DNA, 15 bp, Homo sapiens
ccctttgcttatttc

SEQ ID NO: 362459 - DNA, 15 bp, Homo sapiens
cctttgcttatttcc

SEQ ID NO: 362460 - DNA, 15 bp, Homo sapiens
ctttgcttatttcct

SEQ ID NO: 362461 - DNA, 15 bp, Homo sapiens
tttgcttatttcctg

SEQ ID NO: 362462 - DNA, 15 bp, Homo sapiens
ttgcttatttcctga

SEQ ID NO: 362463 - DNA, 15 bp, Homo sapiens
tgcttatttcctgat

SEQ ID NO: 362464 - DNA, 15 bp, Homo sapiens
gcttatttcctgatt

SEQ ID NO: 362465 - DNA, 15 bp, Homo sapiens
cttatttcctgattg

SEQ ID NO: 362466 - DNA, 15 bp, Homo sapiens
ttatttcctgattga

SEQ ID NO: 362467 - DNA, 15 bp, Homo sapiens
tatttcctgattgag

SEQ ID NO: 362468 - DNA, 15 bp, Homo sapiens
atttcctgattgagc

SEQ ID NO: 362469 - DNA, 15 bp, Homo sapiens
tttcctgattgagcc

SEQ ID NO: 362470 - DNA, 15 bp, Homo sapiens
ttcctgattgagcct

SEQ ID NO: 362471 - DNA, 15 bp, Homo sapiens
tcctgattgagccta

SEQ ID NO: 362472 - DNA, 15 bp, Homo sapiens
cctgattgagcctac

SEQ ID NO: 362473 - DNA, 15 bp, Homo sapiens
ctgattgagcctacc

SEQ ID NO: 362474 - DNA, 15 bp, Homo sapiens
tgattgagcctacct

SEQ ID NO: 362475 - DNA, 15 bp, Homo sapiens
gattgagcctacctt

SEQ ID NO: 362476 - DNA, 15 bp, Homo sapiens
attgagcctacctta

SEQ ID NO: 362477 - DNA, 15 bp, Homo sapiens
ttgagcctaccttag

SEQ ID NO: 362478 - DNA, 15 bp, Homo sapiens
tgagcctaccttagt

SEQ ID NO: 362479 - DNA, 15 bp, Homo sapiens
gagcctaccttagta

SEQ ID NO: 362480 - DNA, 15 bp, Homo sapiens
agcctaccttagtaa

SEQ ID NO: 362481 - DNA, 15 bp, Homo sapiens
gcctaccttagtaat

SEQ ID NO: 362482 - DNA, 15 bp, Homo sapiens
cctaccttagtaata

SEQ ID NO: 362483 - DNA, 15 bp, Homo sapiens
ctaccttagtaatac

SEQ ID NO: 362484 - DNA, 15 bp, Homo sapiens
taccttagtaatacg

SEQ ID NO: 362485 - DNA, 15 bp, Homo sapiens
accttagtaatacgt

SEQ ID NO: 362486 - DNA, 15 bp, Homo sapiens
ccttagtaatacgtc

SEQ ID NO: 362487 - DNA, 15 bp, Homo sapiens
cttagtaatacgtct

SEQ ID NO: 362488 - DNA, 15 bp, Homo sapiens
ttagtaatacgtctc

SEQ ID NO: 362489 - DNA, 15 bp, Homo sapiens
tagtaatacgtctca

SEQ ID NO: 362490 - DNA, 15 bp, Homo sapiens
agtaatacgtctcac

SEQ ID NO: 362491 - DNA, 15 bp, Homo sapiens
gtaatacgtctcact

SEQ ID NO: 362492 - DNA, 15 bp, Homo sapiens
taatacgtctcacta

SEQ ID NO: 362493 - DNA, 15 bp, Homo sapiens
aatacgtctcactaa

SEQ ID NO: 362494 - DNA, 15 bp, Homo sapiens
atacgtctcactaag

SEQ ID NO: 362495 - DNA, 15 bp, Homo sapiens
tacgtctcactaagt

SEQ ID NO: 362496 - DNA, 15 bp, Homo sapiens
acgtctcactaagtt

SEQ ID NO: 362497 - DNA, 15 bp, Homo sapiens
cgtctcactaagtta

SEQ ID NO: 362498 - DNA, 15 bp, Homo sapiens
gtctcactaagttat

SEQ ID NO: 362499 - DNA, 15 bp, Homo sapiens
tctcactaagttatt

SEQ ID NO: 362500 - DNA, 15 bp, Homo sapiens
ctcactaagttattt

SEQ ID NO: 362501 - DNA, 15 bp, Homo sapiens
tcactaagttatttt

SEQ ID NO: 362502 - DNA, 15 bp, Homo sapiens
cactaagttattttg

SEQ ID NO: 362503 - DNA, 15 bp, Homo sapiens
actaagttattttgg

SEQ ID NO: 362504 - DNA, 15 bp, Homo sapiens
ctaagttattttggt

SEQ ID NO: 362505 - DNA, 15 bp, Homo sapiens
taagttattttggtg

SEQ ID NO: 362506 - DNA, 15 bp, Homo sapiens
aagttattttggtgt

SEQ ID NO: 362507 - DNA, 15 bp, Homo sapiens
agttattttggtgtc

SEQ ID NO: 362508 - DNA, 15 bp, Homo sapiens
gttattttggtgtca

SEQ ID NO: 362509 - DNA, 15 bp, Homo sapiens
ttattttggtgtcaa

SEQ ID NO: 362510 - DNA, 15 bp, Homo sapiens
tattttggtgtcaaa

SEQ ID NO: 362511 - DNA, 15 bp, Homo sapiens
attttggtgtcaaat

SEQ ID NO: 362512 - DNA, 15 bp, Homo sapiens
ttttggtgtcaaatg

SEQ ID NO: 362513 - DNA, 15 bp, Homo sapiens
tttggtgtcaaatgt

SEQ ID NO: 362514 - DNA, 15 bp, Homo sapiens
ttggtgtcaaatgtt

SEQ ID NO: 362515 - DNA, 15 bp, Homo sapiens
tggtgtcaaatgttg

SEQ ID NO: 362516 - DNA, 15 bp, Homo sapiens
ggtgtcaaatgttgt

SEQ ID NO: 362517 - DNA, 15 bp, Homo sapiens
gtgtcaaatgttgtg

SEQ ID NO: 362518 - DNA, 15 bp, Homo sapiens
tgtcaaatgttgtgt

SEQ ID NO: 362519 - DNA, 15 bp, Homo sapiens
gtcaaatgttgtgtt

SEQ ID NO: 362520 - DNA, 15 bp, Homo sapiens
tcaaatgttgtgttc

SEQ ID NO: 362521 - DNA, 15 bp, Homo sapiens
caaatgttgtgttct

SEQ ID NO: 362522 - DNA, 15 bp, Homo sapiens
aaatgttgtgttcta

SEQ ID NO: 362523 - DNA, 15 bp, Homo sapiens
aatgttgtgttctat

SEQ ID NO: 362524 - DNA, 15 bp, Homo sapiens
atgttgtgttctatt

SEQ ID NO: 362525 - DNA, 15 bp, Homo sapiens
tgttgtgttctattc

SEQ ID NO: 362526 - DNA, 15 bp, Homo sapiens
gttgtgttctattca

SEQ ID NO: 362527 - DNA, 15 bp, Homo sapiens
ttgtgttctattcat

SEQ ID NO: 362528 - DNA, 15 bp, Homo sapiens
tgtgttctattcatg

SEQ ID NO: 362529 - DNA, 15 bp, Homo sapiens
gtgttctattcatgc

SEQ ID NO: 362530 - DNA, 15 bp, Homo sapiens
tgttctattcatgct

SEQ ID NO: 362531 - DNA, 15 bp, Homo sapiens
gttctattcatgctt

SEQ ID NO: 362532 - DNA, 15 bp, Homo sapiens
ttctattcatgcttt

SEQ ID NO: 362533 - DNA, 15 bp, Homo sapiens
tctattcatgctttg

SEQ ID NO: 362534 - DNA, 15 bp, Homo sapiens
ctattcatgctttgc

SEQ ID NO: 362535 - DNA, 15 bp, Homo sapiens
tattcatgctttgcc

SEQ ID NO: 362536 - DNA, 15 bp, Homo sapiens
attcatgctttgcca

SEQ ID NO: 362537 - DNA, 15 bp, Homo sapiens
ttcatgctttgccaa

SEQ ID NO: 362538 - DNA, 15 bp, Homo sapiens
tcatgctttgccaat

SEQ ID NO: 362539 - DNA, 15 bp, Homo sapiens
catgctttgccaata

SEQ ID NO: 362540 - DNA, 15 bp, Homo sapiens
atgctttgccaataa

SEQ ID NO: 362541 - DNA, 15 bp, Homo sapiens
tgctttgccaataat

SEQ ID NO: 362542 - DNA, 15 bp, Homo sapiens
gctttgccaataata

SEQ ID NO: 362543 - DNA, 15 bp, Homo sapiens
ctttgccaataataa

SEQ ID NO: 362544 - DNA, 15 bp, Homo sapiens
tttgccaataataaa

SEQ ID NO: 362545 - DNA, 15 bp, Homo sapiens
ttgccaataataaag

SEQ ID NO: 362546 - DNA, 15 bp, Homo sapiens
tgccaataataaagt

SEQ ID NO: 362547 - DNA, 15 bp, Homo sapiens
gccaataataaagtt

SEQ ID NO: 362548 - DNA, 15 bp, Homo sapiens
ccaataataaagttc

SEQ ID NO: 362549 - DNA, 15 bp, Homo sapiens
caataataaagttct

SEQ ID NO: 362550 - DNA, 15 bp, Homo sapiens
aataataaagttctt

SEQ ID NO: 362551 - DNA, 15 bp, Homo sapiens
ataataaagttcttc

SEQ ID NO: 362552 - DNA, 15 bp, Homo sapiens
taataaagttcttca

SEQ ID NO: 362553 - DNA, 15 bp, Homo sapiens
aataaagttcttcat

SEQ ID NO: 362554 - DNA, 15 bp, Homo sapiens
ataaagttcttcatc

SEQ ID NO: 362555 - DNA, 15 bp, Homo sapiens
taaagttcttcatct

SEQ ID NO: 362556 - DNA, 15 bp, Homo sapiens
aaagttcttcatcta

SEQ ID NO: 362557 - DNA, 15 bp, Homo sapiens
aagttcttcatctat

SEQ ID NO: 362558 - DNA, 15 bp, Homo sapiens
agttcttcatctatg

SEQ ID NO: 362559 - DNA, 15 bp, Homo sapiens
gttcttcatctatgt

SEQ ID NO: 362560 - DNA, 15 bp, Homo sapiens
ttcttcatctatgta

SEQ ID NO: 362561 - DNA, 15 bp, Homo sapiens
tcttcatctatgtaa

SEQ ID NO: 362562 - DNA, 15 bp, Homo sapiens
cttcatctatgtaat

SEQ ID NO: 362563 - DNA, 15 bp, Homo sapiens
ttcatctatgtaata

SEQ ID NO: 362564 - DNA, 15 bp, Homo sapiens
tcatctatgtaatat

SEQ ID NO: 362565 - DNA, 15 bp, Homo sapiens
catctatgtaatata

SEQ ID NO: 362566 - DNA, 15 bp, Homo sapiens
atctatgtaatataa

SEQ ID NO: 362567 - DNA, 15 bp, Homo sapiens
tctatgtaatataat

SEQ ID NO: 362568 - DNA, 15 bp, Homo sapiens
ctatgtaatataata

SEQ ID NO: 362569 - DNA, 15 bp, Homo sapiens
tatgtaatataatat

SEQ ID NO: 362570 - DNA, 15 bp, Homo sapiens
atgtaatataatata

SEQ ID NO: 362571 - DNA, 15 bp, Homo sapiens
tgtaatataatataa

SEQ ID NO: 362572 - DNA, 15 bp, Homo sapiens
gtaatataatataat

SEQ ID NO: 362573 - DNA, 15 bp, Homo sapiens
taatataatataata

SEQ ID NO: 362574 - DNA, 15 bp, Homo sapiens
aatataatataatat

SEQ ID NO: 362575 - DNA, 15 bp, Homo sapiens
atataatataatata

SEQ ID NO: 362576 - DNA, 15 bp, Homo sapiens
tataatataatataa

SEQ ID NO: 362577 - DNA, 15 bp, Homo sapiens
ataatataatataat

SEQ ID NO: 362578 - DNA, 15 bp, Homo sapiens
tataatataatatag

SEQ ID NO: 362579 - DNA, 15 bp, Homo sapiens
ataatataatatagt

SEQ ID NO: 362580 - DNA, 15 bp, Homo sapiens
taatataatatagta

SEQ ID NO: 362581 - DNA, 15 bp, Homo sapiens
aatataatatagtat

SEQ ID NO: 362582 - DNA, 15 bp, Homo sapiens
atataatatagtatt

SEQ ID NO: 362583 - DNA, 15 bp, Homo sapiens
tataatatagtatta

SEQ ID NO: 362584 - DNA, 15 bp, Homo sapiens
ataatatagtattat

SEQ ID NO: 362585 - DNA, 15 bp, Homo sapiens
taatatagtattatt

SEQ ID NO: 362586 - DNA, 15 bp, Homo sapiens
aatatagtattatta

SEQ ID NO: 362587 - DNA, 15 bp, Homo sapiens
atatagtattattaa

SEQ ID NO: 362588 - DNA, 15 bp, Homo sapiens
tatagtattattaat

SEQ ID NO: 362589 - DNA, 15 bp, Homo sapiens
atagtattattaatt

SEQ ID NO: 362590 - DNA, 15 bp, Homo sapiens
tagtattattaattt

SEQ ID NO: 362591 - DNA, 15 bp, Homo sapiens
agtattattaatttt

SEQ ID NO: 362592 - DNA, 15 bp, Homo sapiens
gtattattaattttt

SEQ ID NO: 362593 - DNA, 15 bp, Homo sapiens
tattattaattttta

SEQ ID NO: 362594 - DNA, 15 bp, Homo sapiens
attattaatttttat

SEQ ID NO: 362595 - DNA, 15 bp, Homo sapiens
ttattaatttttatg

SEQ ID NO: 362596 - DNA, 15 bp, Homo sapiens
tattaatttttatgt

SEQ ID NO: 362597 - DNA, 15 bp, Homo sapiens
attaatttttatgtc

SEQ ID NO: 362598 - DNA, 15 bp, Homo sapiens
ttaatttttatgtca

SEQ ID NO: 362599 - DNA, 15 bp, Homo sapiens
taatttttatgtcag

SEQ ID NO: 362600 - DNA, 15 bp, Homo sapiens
aatttttatgtcaga

SEQ ID NO: 362601 - DNA, 15 bp, Homo sapiens
atttttatgtcagat

SEQ ID NO: 362602 - DNA, 15 bp, Homo sapiens
tttttatgtcagatt

SEQ ID NO: 362603 - DNA, 15 bp, Homo sapiens
ttttatgtcagatta

SEQ ID NO: 362604 - DNA, 15 bp, Homo sapiens
tttatgtcagattat

SEQ ID NO: 362605 - DNA, 15 bp, Homo sapiens
ttatgtcagattatg

SEQ ID NO: 362606 - DNA, 15 bp, Homo sapiens
tatgtcagattatgt

SEQ ID NO: 362607 - DNA, 15 bp, Homo sapiens
atgtcagattatgtt

SEQ ID NO: 362608 - DNA, 15 bp, Homo sapiens
tgtcagattatgtta

SEQ ID NO: 362609 - DNA, 15 bp, Homo sapiens
gtcagattatgttac

SEQ ID NO: 362610 - DNA, 15 bp, Homo sapiens
tcagattatgttaca

SEQ ID NO: 362611 - DNA, 15 bp, Homo sapiens
cagattatgttacag

SEQ ID NO: 362612 - DNA, 15 bp, Homo sapiens
agattatgttacagt

SEQ ID NO: 362613 - DNA, 15 bp, Homo sapiens
gattatgttacagtg

SEQ ID NO: 362614 - DNA, 15 bp, Homo sapiens
attatgttacagtga

SEQ ID NO: 362615 - DNA, 15 bp, Homo sapiens
ttatgttacagtgac

SEQ ID NO: 362616 - DNA, 15 bp, Homo sapiens
tatgttacagtgact

SEQ ID NO: 362617 - DNA, 15 bp, Homo sapiens
atgttacagtgactc

SEQ ID NO: 362618 - DNA, 15 bp, Homo sapiens
tgttacagtgactca

SEQ ID NO: 362619 - DNA, 15 bp, Homo sapiens
gttacagtgactcag

SEQ ID NO: 362620 - DNA, 15 bp, Homo sapiens
ttacagtgactcaga

SEQ ID NO: 362621 - DNA, 15 bp, Homo sapiens
tacagtgactcagat

SEQ ID NO: 362622 - DNA, 15 bp, Homo sapiens
acagtgactcagatt

SEQ ID NO: 362623 - DNA, 15 bp, Homo sapiens
cagtgactcagattt

SEQ ID NO: 362624 - DNA, 15 bp, Homo sapiens
agtgactcagatttt

SEQ ID NO: 362625 - DNA, 15 bp, Homo sapiens
gtgactcagatttta

SEQ ID NO: 362626 - DNA, 15 bp, Homo sapiens
tgactcagattttat

SEQ ID NO: 362627 - DNA, 15 bp, Homo sapiens
gactcagattttatt

SEQ ID NO: 362628 - DNA, 15 bp, Homo sapiens
actcagattttattt

SEQ ID NO: 362629 - DNA, 15 bp, Homo sapiens
ctcagattttatttg

SEQ ID NO: 362630 - DNA, 15 bp, Homo sapiens
tcagattttatttgg

SEQ ID NO: 362631 - DNA, 15 bp, Homo sapiens
cagattttatttggg

SEQ ID NO: 362632 - DNA, 15 bp, Homo sapiens
agattttatttgggc

SEQ ID NO: 362633 - DNA, 15 bp, Homo sapiens
gattttatttgggca

SEQ ID NO: 362634 - DNA, 15 bp, Homo sapiens
attttatttgggcat

SEQ ID NO: 362635 - DNA, 15 bp, Homo sapiens
ttttatttgggcatc

SEQ ID NO: 362636 - DNA, 15 bp, Homo sapiens
tttatttgggcatct

SEQ ID NO: 362637 - DNA, 15 bp, Homo sapiens
ttatttgggcatctt

SEQ ID NO: 362638 - DNA, 15 bp, Homo sapiens
tatttgggcatcttc

SEQ ID NO: 362639 - DNA, 15 bp, Homo sapiens
atttgggcatcttcc

SEQ ID NO: 362640 - DNA, 15 bp, Homo sapiens
tttgggcatcttcca

SEQ ID NO: 362641 - DNA, 15 bp, Homo sapiens
ttgggcatcttccag

SEQ ID NO: 362642 - DNA, 15 bp, Homo sapiens
tgggcatcttccagt

SEQ ID NO: 362643 - DNA, 15 bp, Homo sapiens
gggcatcttccagtt

SEQ ID NO: 362644 - DNA, 15 bp, Homo sapiens
ggcatcttccagttg

SEQ ID NO: 362645 - DNA, 15 bp, Homo sapiens
gcatcttccagttgc

SEQ ID NO: 362646 - DNA, 15 bp, Homo sapiens
catcttccagttgca

SEQ ID NO: 362647 - DNA, 15 bp, Homo sapiens
atcttccagttgcaa

SEQ ID NO: 362648 - DNA, 15 bp, Homo sapiens
tcttccagttgcaaa

SEQ ID NO: 362649 - DNA, 15 bp, Homo sapiens
cttccagttgcaaat

SEQ ID NO: 362650 - DNA, 15 bp, Homo sapiens
ttccagttgcaaatt

SEQ ID NO: 362651 - DNA, 15 bp, Homo sapiens
tccagttgcaaattt

SEQ ID NO: 362652 - DNA, 15 bp, Homo sapiens
ccagttgcaaatttg

SEQ ID NO: 362653 - DNA, 15 bp, Homo sapiens
cagttgcaaatttgt

SEQ ID NO: 362654 - DNA, 15 bp, Homo sapiens
agttgcaaatttgtt

SEQ ID NO: 362655 - DNA, 15 bp, Homo sapiens
gttgcaaatttgttt

SEQ ID NO: 362656 - DNA, 15 bp, Homo sapiens
ttgcaaatttgtttt

SEQ ID NO: 362657 - DNA, 15 bp, Homo sapiens
tgcaaatttgttttg

SEQ ID NO: 362658 - DNA, 15 bp, Homo sapiens
gcaaatttgttttgc

SEQ ID NO: 362659 - DNA, 15 bp, Homo sapiens
caaatttgttttgca

SEQ ID NO: 362660 - DNA, 15 bp, Homo sapiens
aaatttgttttgcaa

SEQ ID NO: 362661 - DNA, 15 bp, Homo sapiens
aatttgttttgcaat

SEQ ID NO: 362662 - DNA, 15 bp, Homo sapiens
atttgttttgcaatt

SEQ ID NO: 362663 - DNA, 15 bp, Homo sapiens
tttgttttgcaattg

SEQ ID NO: 362664 - DNA, 15 bp, Homo sapiens
ttgttttgcaattgg

SEQ ID NO: 362665 - DNA, 15 bp, Homo sapiens
tgttttgcaattgga

SEQ ID NO: 362666 - DNA, 15 bp, Homo sapiens
gttttgcaattggaa

SEQ ID NO: 362667 - DNA, 15 bp, Homo sapiens
ttttgcaattggaat

SEQ ID NO: 362668 - DNA, 15 bp, Homo sapiens
tttgcaattggaata

SEQ ID NO: 362669 - DNA, 15 bp, Homo sapiens
ttgcaattggaatat

SEQ ID NO: 362670 - DNA, 15 bp, Homo sapiens
tgcaattggaatata

SEQ ID NO: 362671 - DNA, 15 bp, Homo sapiens
gcaattggaatataa

SEQ ID NO: 362672 - DNA, 15 bp, Homo sapiens
caattggaatataat

SEQ ID NO: 362673 - DNA, 15 bp, Homo sapiens
aattggaatataatg

SEQ ID NO: 362674 - DNA, 15 bp, Homo sapiens
attggaatataatgc

SEQ ID NO: 362675 - DNA, 15 bp, Homo sapiens
ttggaatataatgcc

SEQ ID NO: 362676 - DNA, 15 bp, Homo sapiens
tggaatataatgccc

SEQ ID NO: 362677 - DNA, 15 bp, Homo sapiens
ggaatataatgccca

SEQ ID NO: 362678 - DNA, 15 bp, Homo sapiens
gaatataatgcccaa

SEQ ID NO: 362679 - DNA, 15 bp, Homo sapiens
aatataatgcccaac

SEQ ID NO: 362680 - DNA, 15 bp, Homo sapiens
atataatgcccaaca

SEQ ID NO: 362681 - DNA, 15 bp, Homo sapiens
tataatgcccaacac

SEQ ID NO: 362682 - DNA, 15 bp, Homo sapiens
ataatgcccaacact

SEQ ID NO: 362683 - DNA, 15 bp, Homo sapiens
taatgcccaacacta

SEQ ID NO: 362684 - DNA, 15 bp, Homo sapiens
aatgcccaacactat

SEQ ID NO: 362685 - DNA, 15 bp, Homo sapiens
atgcccaacactata

SEQ ID NO: 362686 - DNA, 15 bp, Homo sapiens
tgcccaacactatag

SEQ ID NO: 362687 - DNA, 15 bp, Homo sapiens
gcccaacactataga

SEQ ID NO: 362688 - DNA, 15 bp, Homo sapiens
cccaacactatagac

SEQ ID NO: 362689 - DNA, 15 bp, Homo sapiens
ccaacactatagaca

SEQ ID NO: 362690 - DNA, 15 bp, Homo sapiens
caacactatagacac

SEQ ID NO: 362691 - DNA, 15 bp, Homo sapiens
aacactatagacact

SEQ ID NO: 362692 - DNA, 15 bp, Homo sapiens
acactatagacactt

SEQ ID NO: 362693 - DNA, 15 bp, Homo sapiens
cactatagacacttt

SEQ ID NO: 362694 - DNA, 15 bp, Homo sapiens
actatagacactttc

SEQ ID NO: 362695 - DNA, 15 bp, Homo sapiens
ctatagacactttcc

SEQ ID NO: 362696 - DNA, 15 bp, Homo sapiens
tatagacactttcca

SEQ ID NO: 362697 - DNA, 15 bp, Homo sapiens
atagacactttccat

SEQ ID NO: 362698 - DNA, 15 bp, Homo sapiens
tagacactttccata

SEQ ID NO: 362699 - DNA, 15 bp, Homo sapiens
agacactttccatat

SEQ ID NO: 362700 - DNA, 15 bp, Homo sapiens
gacactttccatatt

SEQ ID NO: 362701 - DNA, 15 bp, Homo sapiens
acactttccatattt

SEQ ID NO: 362702 - DNA, 15 bp, Homo sapiens
cactttccatattta

SEQ ID NO: 362703 - DNA, 15 bp, Homo sapiens
actttccatatttaa

SEQ ID NO: 362704 - DNA, 15 bp, Homo sapiens
ctttccatatttaaa

SEQ ID NO: 362705 - DNA, 15 bp, Homo sapiens
tttccatatttaaaa

SEQ ID NO: 362706 - DNA, 15 bp, Homo sapiens
ttccatatttaaaat

SEQ ID NO: 362707 - DNA, 15 bp, Homo sapiens
tccatatttaaaatt

SEQ ID NO: 362708 - DNA, 15 bp, Homo sapiens
ccatatttaaaatta

SEQ ID NO: 362709 - DNA, 15 bp, Homo sapiens
catatttaaaattat

SEQ ID NO: 362710 - DNA, 15 bp, Homo sapiens
atatttaaaattatt

SEQ ID NO: 362711 - DNA, 15 bp, Homo sapiens
tatttaaaattattt

SEQ ID NO: 362712 - DNA, 15 bp, Homo sapiens
atttaaaattatttg

SEQ ID NO: 362713 - DNA, 15 bp, Homo sapiens
tttaaaattatttga

SEQ ID NO: 362714 - DNA, 15 bp, Homo sapiens
ttaaaattatttgac

SEQ ID NO: 362715 - DNA, 15 bp, Homo sapiens
taaaattatttgaca

SEQ ID NO: 362716 - DNA, 15 bp, Homo sapiens
aaaattatttgacat

SEQ ID NO: 362717 - DNA, 15 bp, Homo sapiens
aaattatttgacatt

SEQ ID NO: 362718 - DNA, 15 bp, Homo sapiens
aattatttgacatta

SEQ ID NO: 362719 - DNA, 15 bp, Homo sapiens
attatttgacattat

SEQ ID NO: 362720 - DNA, 15 bp, Homo sapiens
ttatttgacattatt

SEQ ID NO: 362721 - DNA, 15 bp, Homo sapiens
tatttgacattattt

SEQ ID NO: 362722 - DNA, 15 bp, Homo sapiens
atttgacattatttt

SEQ ID NO: 362723 - DNA, 15 bp, Homo sapiens
tttgacattattttc

SEQ ID NO: 362724 - DNA, 15 bp, Homo sapiens
ttgacattattttct

SEQ ID NO: 362725 - DNA, 15 bp, Homo sapiens
tgacattattttctg

SEQ ID NO: 362726 - DNA, 15 bp, Homo sapiens
gacattattttctga

SEQ ID NO: 362727 - DNA, 15 bp, Homo sapiens
acattattttctgag

SEQ ID NO: 362728 - DNA, 15 bp, Homo sapiens
cattattttctgaga

SEQ ID NO: 362729 - DNA, 15 bp, Homo sapiens
attattttctgagac

SEQ ID NO: 362730 - DNA, 15 bp, Homo sapiens
ttattttctgagaca

SEQ ID NO: 362731 - DNA, 15 bp, Homo sapiens
tattttctgagacag

SEQ ID NO: 362732 - DNA, 15 bp, Homo sapiens
attttctgagacagt

SEQ ID NO: 362733 - DNA, 15 bp, Homo sapiens
ttttctgagacagtc

SEQ ID NO: 362734 - DNA, 15 bp, Homo sapiens
tttctgagacagtca

SEQ ID NO: 362735 - DNA, 15 bp, Homo sapiens
ttctgagacagtcaa

SEQ ID NO: 362736 - DNA, 15 bp, Homo sapiens
tctgagacagtcaag

SEQ ID NO: 362737 - DNA, 15 bp, Homo sapiens
ctgagacagtcaaga

SEQ ID NO: 362738 - DNA, 15 bp, Homo sapiens
tgagacagtcaagat

SEQ ID NO: 362739 - DNA, 15 bp, Homo sapiens
gagacagtcaagatt

SEQ ID NO: 362740 - DNA, 15 bp, Homo sapiens
agacagtcaagattt

SEQ ID NO: 362741 - DNA, 15 bp, Homo sapiens
gacagtcaagattta

SEQ ID NO: 362742 - DNA, 15 bp, Homo sapiens
acagtcaagatttat

SEQ ID NO: 362743 - DNA, 15 bp, Homo sapiens
cagtcaagatttatg

SEQ ID NO: 362744 - DNA, 15 bp, Homo sapiens
agtcaagatttatga

SEQ ID NO: 362745 - DNA, 15 bp, Homo sapiens
gtcaagatttatgaa

SEQ ID NO: 362746 - DNA, 15 bp, Homo sapiens
tcaagatttatgaat

SEQ ID NO: 362747 - DNA, 15 bp, Homo sapiens
caagatttatgaatg

SEQ ID NO: 362748 - DNA, 15 bp, Homo sapiens
aagatttatgaatga

SEQ ID NO: 362749 - DNA, 15 bp, Homo sapiens
agatttatgaatgat

SEQ ID NO: 362750 - DNA, 15 bp, Homo sapiens
gatttatgaatgatt

SEQ ID NO: 362751 - DNA, 15 bp, Homo sapiens
atttatgaatgattt

SEQ ID NO: 362752 - DNA, 15 bp, Homo sapiens
tttatgaatgatttc

SEQ ID NO: 362753 - DNA, 15 bp, Homo sapiens
ttatgaatgatttct

SEQ ID NO: 362754 - DNA, 15 bp, Homo sapiens
tatgaatgatttcta

SEQ ID NO: 362755 - DNA, 15 bp, Homo sapiens
atgaatgatttctac

SEQ ID NO: 362756 - DNA, 15 bp, Homo sapiens
tgaatgatttctact

SEQ ID NO: 362757 - DNA, 15 bp, Homo sapiens
gaatgatttctactt

SEQ ID NO: 362758 - DNA, 15 bp, Homo sapiens
aatgatttctacttt

SEQ ID NO: 362759 - DNA, 15 bp, Homo sapiens
atgatttctactttg

SEQ ID NO: 362760 - DNA, 15 bp, Homo sapiens
tgatttctactttgt

SEQ ID NO: 362761 - DNA, 15 bp, Homo sapiens
gatttctactttgtt

SEQ ID NO: 362762 - DNA, 15 bp, Homo sapiens
atttctactttgttt

SEQ ID NO: 362763 - DNA, 15 bp, Homo sapiens
tttctactttgtttc

SEQ ID NO: 362764 - DNA, 15 bp, Homo sapiens
ttctactttgtttca

SEQ ID NO: 362765 - DNA, 15 bp, Homo sapiens
tctactttgtttcat

SEQ ID NO: 362766 - DNA, 15 bp, Homo sapiens
ctactttgtttcata

SEQ ID NO: 362767 - DNA, 15 bp, Homo sapiens
tactttgtttcatat

SEQ ID NO: 362768 - DNA, 15 bp, Homo sapiens
actttgtttcatata

SEQ ID NO: 362769 - DNA, 15 bp, Homo sapiens
ctttgtttcatatat

SEQ ID NO: 362770 - DNA, 15 bp, Homo sapiens
tttgtttcatatatt

SEQ ID NO: 362771 - DNA, 15 bp, Homo sapiens
ttgtttcatatattc

SEQ ID NO: 362772 - DNA, 15 bp, Homo sapiens
tgtttcatatattcc

SEQ ID NO: 362773 - DNA, 15 bp, Homo sapiens
gtttcatatattccg

SEQ ID NO: 362774 - DNA, 15 bp, Homo sapiens
tttcatatattccgt

SEQ ID NO: 362775 - DNA, 15 bp, Homo sapiens
ttcatatattccgtc

SEQ ID NO: 362776 - DNA, 15 bp, Homo sapiens
tcatatattccgtca

SEQ ID NO: 362777 - DNA, 15 bp, Homo sapiens
catatattccgtcat

SEQ ID NO: 362778 - DNA, 15 bp, Homo sapiens
atatattccgtcatt

SEQ ID NO: 362779 - DNA, 15 bp, Homo sapiens
tatattccgtcatta

SEQ ID NO: 362780 - DNA, 15 bp, Homo sapiens
atattccgtcattaa

SEQ ID NO: 362781 - DNA, 15 bp, Homo sapiens
tattccgtcattaat

SEQ ID NO: 362782 - DNA, 15 bp, Homo sapiens
attccgtcattaatg

SEQ ID NO: 362783 - DNA, 15 bp, Homo sapiens
ttccgtcattaatga

SEQ ID NO: 362784 - DNA, 15 bp, Homo sapiens
tccgtcattaatgat

SEQ ID NO: 362785 - DNA, 15 bp, Homo sapiens
ccgtcattaatgatc

SEQ ID NO: 362786 - DNA, 15 bp, Homo sapiens
cgtcattaatgatct

SEQ ID NO: 362787 - DNA, 15 bp, Homo sapiens
gtcattaatgatctt

SEQ ID NO: 362788 - DNA, 15 bp, Homo sapiens
tcattaatgatcttt

SEQ ID NO: 362789 - DNA, 15 bp, Homo sapiens
cattaatgatctttt

SEQ ID NO: 362790 - DNA, 15 bp, Homo sapiens
attaatgatcttttt

SEQ ID NO: 362791 - DNA, 15 bp, Homo sapiens
ttaatgatctttttt

SEQ ID NO: 362792 - DNA, 15 bp, Homo sapiens
taatgatcttttttg

SEQ ID NO: 362793 - DNA, 15 bp, Homo sapiens
aatgatcttttttgt

SEQ ID NO: 362794 - DNA, 15 bp, Homo sapiens
atgatcttttttgtt

SEQ ID NO: 362795 - DNA, 15 bp, Homo sapiens
tgatcttttttgttt

SEQ ID NO: 362796 - DNA, 15 bp, Homo sapiens
gatcttttttgtttg

SEQ ID NO: 362797 - DNA, 15 bp, Homo sapiens
atcttttttgtttgt

SEQ ID NO: 362798 - DNA, 15 bp, Homo sapiens
tcttttttgtttgtt

SEQ ID NO: 362799 - DNA, 15 bp, Homo sapiens
cttttttgtttgttt

SEQ ID NO: 362800 - DNA, 15 bp, Homo sapiens
ttgtttgtttgtttc

SEQ ID NO: 362801 - DNA, 15 bp, Homo sapiens
tgtttgtttgtttct

SEQ ID NO: 362802 - DNA, 15 bp, Homo sapiens
gtttgtttgtttctt

SEQ ID NO: 362803 - DNA, 15 bp, Homo sapiens
tttgtttgtttcttg

SEQ ID NO: 362804 - DNA, 15 bp, Homo sapiens
ttgtttgtttcttgt

SEQ ID NO: 362805 - DNA, 15 bp, Homo sapiens
tgtttgtttcttgtt

SEQ ID NO: 362806 - DNA, 15 bp, Homo sapiens
gtttgtttcttgttg

SEQ ID NO: 362807 - DNA, 15 bp, Homo sapiens
tttgtttcttgttgg

SEQ ID NO: 362808 - DNA, 15 bp, Homo sapiens
ttgtttcttgttggt

SEQ ID NO: 362809 - DNA, 15 bp, Homo sapiens
tgtttcttgttggta

SEQ ID NO: 362810 - DNA, 15 bp, Homo sapiens
gtttcttgttggtag

SEQ ID NO: 362811 - DNA, 15 bp, Homo sapiens
tttcttgttggtagt

SEQ ID NO: 362812 - DNA, 15 bp, Homo sapiens
ttcttgttggtagtt

SEQ ID NO: 362813 - DNA, 15 bp, Homo sapiens
tcttgttggtagttt

SEQ ID NO: 362814 - DNA, 15 bp, Homo sapiens
cttgttggtagttta

SEQ ID NO: 362815 - DNA, 15 bp, Homo sapiens
ttgttggtagtttag

SEQ ID NO: 362816 - DNA, 15 bp, Homo sapiens
tgttggtagtttagg

SEQ ID NO: 362817 - DNA, 15 bp, Homo sapiens
gttggtagtttaggg

SEQ ID NO: 362818 - DNA, 15 bp, Homo sapiens
ttggtagtttagggt

SEQ ID NO: 362819 - DNA, 15 bp, Homo sapiens
tggtagtttagggtt

SEQ ID NO: 362820 - DNA, 15 bp, Homo sapiens
ggtagtttagggtta

SEQ ID NO: 362821 - DNA, 15 bp, Homo sapiens
gtagtttagggttaa

SEQ ID NO: 362822 - DNA, 15 bp, Homo sapiens
tagtttagggttaaa

SEQ ID NO: 362823 - DNA, 15 bp, Homo sapiens
agtttagggttaaaa

SEQ ID NO: 362824 - DNA, 15 bp, Homo sapiens
gtttagggttaaaaa

SEQ ID NO: 362825 - DNA, 15 bp, Homo sapiens
tttagggttaaaaac

SEQ ID NO: 362826 - DNA, 15 bp, Homo sapiens
ttagggttaaaaact

SEQ ID NO: 362827 - DNA, 15 bp, Homo sapiens
tagggttaaaaactc

SEQ ID NO: 362828 - DNA, 15 bp, Homo sapiens
agggttaaaaactcc

SEQ ID NO: 362829 - DNA, 15 bp, Homo sapiens
gggttaaaaactcca

SEQ ID NO: 362830 - DNA, 15 bp, Homo sapiens
ggttaaaaactccac

SEQ ID NO: 362831 - DNA, 15 bp, Homo sapiens
gttaaaaactccacg

SEQ ID NO: 362832 - DNA, 15 bp, Homo sapiens
ttaaaaactccacga

SEQ ID NO: 362833 - DNA, 15 bp, Homo sapiens
taaaaactccacgat

SEQ ID NO: 362834 - DNA, 15 bp, Homo sapiens
aaaaactccacgatt

SEQ ID NO: 362835 - DNA, 15 bp, Homo sapiens
aaaactccacgattt

SEQ ID NO: 362836 - DNA, 15 bp, Homo sapiens
aaactccacgatttt

SEQ ID NO: 362837 - DNA, 15 bp, Homo sapiens
aactccacgattttt

SEQ ID NO: 362838 - DNA, 15 bp, Homo sapiens
actccacgatttttt

SEQ ID NO: 362839 - DNA, 15 bp, Homo sapiens
ctccacgattttttt

SEQ ID NO: 362840 - DNA, 15 bp, Homo sapiens
tccacgatttttttt

SEQ ID NO: 362841 - DNA, 15 bp, Homo sapiens
ccacgattttttttt

SEQ ID NO: 362842 - DNA, 15 bp, Homo sapiens
cacgatttttttttc

SEQ ID NO: 362843 - DNA, 15 bp, Homo sapiens
acgatttttttttct

SEQ ID NO: 362844 - DNA, 15 bp, Homo sapiens
cgatttttttttctg

SEQ ID NO: 362845 - DNA, 15 bp, Homo sapiens
gatttttttttctgt

SEQ ID NO: 362846 - DNA, 15 bp, Homo sapiens
atttttttttctgtt

SEQ ID NO: 362847 - DNA, 15 bp, Homo sapiens
tttttttttctgtta

SEQ ID NO: 362848 - DNA, 15 bp, Homo sapiens
ttttttttctgttaa

SEQ ID NO: 362849 - DNA, 15 bp, Homo sapiens
tttttttctgttaat

SEQ ID NO: 362850 - DNA, 15 bp, Homo sapiens
ttttttctgttaatt

SEQ ID NO: 362851 - DNA, 15 bp, Homo sapiens
tttttctgttaattt

SEQ ID NO: 362852 - DNA, 15 bp, Homo sapiens
tttctgttaatttta

SEQ ID NO: 362853 - DNA, 15 bp, Homo sapiens
ttctgttaattttaa

SEQ ID NO: 362854 - DNA, 15 bp, Homo sapiens
tctgttaattttaac

SEQ ID NO: 362855 - DNA, 15 bp, Homo sapiens
ctgttaattttaact

SEQ ID NO: 362856 - DNA, 15 bp, Homo sapiens
tgttaattttaactc

SEQ ID NO: 362857 - DNA, 15 bp, Homo sapiens
gttaattttaactct

SEQ ID NO: 362858 - DNA, 15 bp, Homo sapiens
ttaattttaactctg

SEQ ID NO: 362859 - DNA, 15 bp, Homo sapiens
taattttaactctgt

SEQ ID NO: 362860 - DNA, 15 bp, Homo sapiens
aattttaactctgtt

SEQ ID NO: 362861 - DNA, 15 bp, Homo sapiens
attttaactctgttg

SEQ ID NO: 362862 - DNA, 15 bp, Homo sapiens
ttttaactctgttga

SEQ ID NO: 362863 - DNA, 15 bp, Homo sapiens
tttaactctgttgat

SEQ ID NO: 362864 - DNA, 15 bp, Homo sapiens
ttaactctgttgatg

SEQ ID NO: 362865 - DNA, 15 bp, Homo sapiens
taactctgttgatga

SEQ ID NO: 362866 - DNA, 15 bp, Homo sapiens
aactctgttgatgaa

SEQ ID NO: 362867 - DNA, 15 bp, Homo sapiens
actctgttgatgaag

SEQ ID NO: 362868 - DNA, 15 bp, Homo sapiens
ctctgttgatgaagt

SEQ ID NO: 362869 - DNA, 15 bp, Homo sapiens
tctgttgatgaagta

SEQ ID NO: 362870 - DNA, 15 bp, Homo sapiens
ctgttgatgaagtat

SEQ ID NO: 362871 - DNA, 15 bp, Homo sapiens
tgttgatgaagtatt

SEQ ID NO: 362872 - DNA, 15 bp, Homo sapiens
gttgatgaagtatta

SEQ ID NO: 362873 - DNA, 15 bp, Homo sapiens
ttgatgaagtattat

SEQ ID NO: 362874 - DNA, 15 bp, Homo sapiens
tgatgaagtattatt

SEQ ID NO: 362875 - DNA, 15 bp, Homo sapiens
gatgaagtattattt

SEQ ID NO: 362876 - DNA, 15 bp, Homo sapiens
atgaagtattatttt

SEQ ID NO: 362877 - DNA, 15 bp, Homo sapiens
tgaagtattatttta

SEQ ID NO: 362878 - DNA, 15 bp, Homo sapiens
aagtattattttagt

SEQ ID NO: 362879 - DNA, 15 bp, Homo sapiens
agtattattttagtg

SEQ ID NO: 362880 - DNA, 15 bp, Homo sapiens
gtattattttagtga

SEQ ID NO: 362881 - DNA, 15 bp, Homo sapiens
tattattttagtgat

SEQ ID NO: 362882 - DNA, 15 bp, Homo sapiens
attattttagtgata

SEQ ID NO: 362883 - DNA, 15 bp, Homo sapiens
ttattttagtgataa

SEQ ID NO: 362884 - DNA, 15 bp, Homo sapiens
tattttagtgataag

SEQ ID NO: 362885 - DNA, 15 bp, Homo sapiens
attttagtgataagc

SEQ ID NO: 362886 - DNA, 15 bp, Homo sapiens
ttttagtgataagct

SEQ ID NO: 362887 - DNA, 15 bp, Homo sapiens
tttagtgataagcta

SEQ ID NO: 362888 - DNA, 15 bp, Homo sapiens
ttagtgataagctat

SEQ ID NO: 362889 - DNA, 15 bp, Homo sapiens
tagtgataagctatc

SEQ ID NO: 362890 - DNA, 15 bp, Homo sapiens
agtgataagctatca

SEQ ID NO: 362891 - DNA, 15 bp, Homo sapiens
gtgataagctatcat

SEQ ID NO: 362892 - DNA, 15 bp, Homo sapiens
tgataagctatcatt

SEQ ID NO: 362893 - DNA, 15 bp, Homo sapiens
gataagctatcattt

SEQ ID NO: 362894 - DNA, 15 bp, Homo sapiens
ataagctatcatttt

SEQ ID NO: 362895 - DNA, 15 bp, Homo sapiens
taagctatcattttg

SEQ ID NO: 362896 - DNA, 15 bp, Homo sapiens
aagctatcattttgt

SEQ ID NO: 362897 - DNA, 15 bp, Homo sapiens
agctatcattttgtg

SEQ ID NO: 362898 - DNA, 15 bp, Homo sapiens
gctatcattttgtga

SEQ ID NO: 362899 - DNA, 15 bp, Homo sapiens
ctatcattttgtgaa

SEQ ID NO: 362900 - DNA, 15 bp, Homo sapiens
tatcattttgtgaaa

SEQ ID NO: 362901 - DNA, 15 bp, Homo sapiens
atcattttgtgaaag

SEQ ID NO: 362902 - DNA, 15 bp, Homo sapiens
tcattttgtgaaagg

SEQ ID NO: 362903 - DNA, 15 bp, Homo sapiens
cattttgtgaaaggc

SEQ ID NO: 362904 - DNA, 15 bp, Homo sapiens
attttgtgaaaggcc

SEQ ID NO: 362905 - DNA, 15 bp, Homo sapiens
ttttgtgaaaggcca

SEQ ID NO: 362906 - DNA, 15 bp, Homo sapiens
tttgtgaaaggccaa

SEQ ID NO: 362907 - DNA, 15 bp, Homo sapiens
ttgtgaaaggccaat

SEQ ID NO: 362908 - DNA, 15 bp, Homo sapiens
tgtgaaaggccaatc

SEQ ID NO: 362909 - DNA, 15 bp, Homo sapiens
gtgaaaggccaatct

SEQ ID NO: 362910 - DNA, 15 bp, Homo sapiens
tgaaaggccaatcta

SEQ ID NO: 362911 - DNA, 15 bp, Homo sapiens
gaaaggccaatctaa

SEQ ID NO: 362912 - DNA, 15 bp, Homo sapiens
aaaggccaatctaat

SEQ ID NO: 362913 - DNA, 15 bp, Homo sapiens
aaggccaatctaata

SEQ ID NO: 362914 - DNA, 15 bp, Homo sapiens
aggccaatctaatac

SEQ ID NO: 362915 - DNA, 15 bp, Homo sapiens
ggccaatctaatact

SEQ ID NO: 362916 - DNA, 15 bp, Homo sapiens
gccaatctaatactt

SEQ ID NO: 362917 - DNA, 15 bp, Homo sapiens
ccaatctaatacttt

SEQ ID NO: 362918 - DNA, 15 bp, Homo sapiens
caatctaatacttta

SEQ ID NO: 362919 - DNA, 15 bp, Homo sapiens
aatctaatactttat

SEQ ID NO: 362920 - DNA, 15 bp, Homo sapiens
atctaatactttatc

SEQ ID NO: 362921 - DNA, 15 bp, Homo sapiens
tctaatactttatca

SEQ ID NO: 362922 - DNA, 15 bp, Homo sapiens
ctaatactttatcag

SEQ ID NO: 362923 - DNA, 15 bp, Homo sapiens
taatactttatcagg

SEQ ID NO: 362924 - DNA, 15 bp, Homo sapiens
aatactttatcaggt

SEQ ID NO: 362925 - DNA, 15 bp, Homo sapiens
atactttatcaggtc

SEQ ID NO: 362926 - DNA, 15 bp, Homo sapiens
tactttatcaggtcc

SEQ ID NO: 362927 - DNA, 15 bp, Homo sapiens
actttatcaggtcca

SEQ ID NO: 362928 - DNA, 15 bp, Homo sapiens
ctttatcaggtccag

SEQ ID NO: 362929 - DNA, 15 bp, Homo sapiens
tttatcaggtccagt

SEQ ID NO: 362930 - DNA, 15 bp, Homo sapiens
ttatcaggtccagta

SEQ ID NO: 362931 - DNA, 15 bp, Homo sapiens
tatcaggtccagtat

SEQ ID NO: 362932 - DNA, 15 bp, Homo sapiens
atcaggtccagtatt

SEQ ID NO: 362933 - DNA, 15 bp, Homo sapiens
tcaggtccagtatta

SEQ ID NO: 362934 - DNA, 15 bp, Homo sapiens
caggtccagtattat

SEQ ID NO: 362935 - DNA, 15 bp, Homo sapiens
aggtccagtattatt

SEQ ID NO: 362936 - DNA, 15 bp, Homo sapiens
ggtccagtattatta

SEQ ID NO: 362937 - DNA, 15 bp, Homo sapiens
gtccagtattattat

SEQ ID NO: 362938 - DNA, 15 bp, Homo sapiens
tccagtattattatg

SEQ ID NO: 362939 - DNA, 15 bp, Homo sapiens
ccagtattattatgc

SEQ ID NO: 362940 - DNA, 15 bp, Homo sapiens
cagtattattatgca

SEQ ID NO: 362941 - DNA, 15 bp, Homo sapiens
agtattattatgcaa

SEQ ID NO: 362942 - DNA, 15 bp, Homo sapiens
gtattattatgcaac

SEQ ID NO: 362943 - DNA, 15 bp, Homo sapiens
tattattatgcaacc

SEQ ID NO: 362944 - DNA, 15 bp, Homo sapiens
attattatgcaacct

SEQ ID NO: 362945 - DNA, 15 bp, Homo sapiens
ttattatgcaaccta

SEQ ID NO: 362946 - DNA, 15 bp, Homo sapiens
tattatgcaacctaa

SEQ ID NO: 362947 - DNA, 15 bp, Homo sapiens
attatgcaacctaaa

SEQ ID NO: 362948 - DNA, 15 bp, Homo sapiens
ttatgcaacctaaaa

SEQ ID NO: 362949 - DNA, 15 bp, Homo sapiens
tatgcaacctaaaat

SEQ ID NO: 362950 - DNA, 15 bp, Homo sapiens
atgcaacctaaaata

SEQ ID NO: 362951 - DNA, 15 bp, Homo sapiens
tgcaacctaaaatat

SEQ ID NO: 362952 - DNA, 15 bp, Homo sapiens
gcaacctaaaatatt

SEQ ID NO: 362953 - DNA, 15 bp, Homo sapiens
caacctaaaatattc

SEQ ID NO: 362954 - DNA, 15 bp, Homo sapiens
aacctaaaatattca

SEQ ID NO: 362955 - DNA, 15 bp, Homo sapiens
acctaaaatattcaa

SEQ ID NO: 362956 - DNA, 15 bp, Homo sapiens
cctaaaatattcaag

SEQ ID NO: 362957 - DNA, 15 bp, Homo sapiens
ctaaaatattcaagt

SEQ ID NO: 362958 - DNA, 15 bp, Homo sapiens
taaaatattcaagta

SEQ ID NO: 362959 - DNA, 15 bp, Homo sapiens
aaaatattcaagtat

SEQ ID NO: 362960 - DNA, 15 bp, Homo sapiens
aaatattcaagtatc

SEQ ID NO: 362961 - DNA, 15 bp, Homo sapiens
aatattcaagtatca

SEQ ID NO: 362962 - DNA, 15 bp, Homo sapiens
atattcaagtatcat

SEQ ID NO: 362963 - DNA, 15 bp, Homo sapiens
tattcaagtatcatg

SEQ ID NO: 362964 - DNA, 15 bp, Homo sapiens
attcaagtatcatgt

SEQ ID NO: 362965 - DNA, 15 bp, Homo sapiens
ttcaagtatcatgtg

SEQ ID NO: 362966 - DNA, 15 bp, Homo sapiens
tcaagtatcatgtga

SEQ ID NO: 362967 - DNA, 15 bp, Homo sapiens
caagtatcatgtgac

SEQ ID NO: 362968 - DNA, 15 bp, Homo sapiens
aagtatcatgtgacc

SEQ ID NO: 362969 - DNA, 15 bp, Homo sapiens
agtatcatgtgacct

SEQ ID NO: 362970 - DNA, 15 bp, Homo sapiens
gtatcatgtgaccta

SEQ ID NO: 362971 - DNA, 15 bp, Homo sapiens
tatcatgtgacctac

SEQ ID NO: 362972 - DNA, 15 bp, Homo sapiens
atcatgtgacctaca

SEQ ID NO: 362973 - DNA, 15 bp, Homo sapiens
tcatgtgacctacag

SEQ ID NO: 362974 - DNA, 15 bp, Homo sapiens
catgtgacctacagt

SEQ ID NO: 362975 - DNA, 15 bp, Homo sapiens
atgtgacctacagtt

SEQ ID NO: 362976 - DNA, 15 bp, Homo sapiens
tgtgacctacagttg

SEQ ID NO: 362977 - DNA, 15 bp, Homo sapiens
gtgacctacagttgc

SEQ ID NO: 362978 - DNA, 15 bp, Homo sapiens
tgacctacagttgct

SEQ ID NO: 362979 - DNA, 15 bp, Homo sapiens
gacctacagttgctt

SEQ ID NO: 362980 - DNA, 15 bp, Homo sapiens
acctacagttgcttt

SEQ ID NO: 362981 - DNA, 15 bp, Homo sapiens
cctacagttgctttt

SEQ ID NO: 362982 - DNA, 15 bp, Homo sapiens
tacagttgcttttca

SEQ ID NO: 362983 - DNA, 15 bp, Homo sapiens
acagttgcttttcat

SEQ ID NO: 362984 - DNA, 15 bp, Homo sapiens
cagttgcttttcatt

SEQ ID NO: 362985 - DNA, 15 bp, Homo sapiens
agttgcttttcattt

SEQ ID NO: 362986 - DNA, 15 bp, Homo sapiens
gttgcttttcattta

SEQ ID NO: 362987 - DNA, 15 bp, Homo sapiens
ttgcttttcatttaa

SEQ ID NO: 362988 - DNA, 15 bp, Homo sapiens
tgcttttcatttaaa

SEQ ID NO: 362989 - DNA, 15 bp, Homo sapiens
gcttttcatttaaaa

SEQ ID NO: 362990 - DNA, 15 bp, Homo sapiens
cttttcatttaaaaa

SEQ ID NO: 362991 - DNA, 15 bp, Homo sapiens
ttttcatttaaaaaa

SEQ ID NO: 362992 - DNA, 15 bp, Homo sapiens
tttcatttaaaaaat

SEQ ID NO: 362993 - DNA, 15 bp, Homo sapiens
ttcatttaaaaaatc

SEQ ID NO: 362994 - DNA, 15 bp, Homo sapiens
tcatttaaaaaatct

SEQ ID NO: 362995 - DNA, 15 bp, Homo sapiens
catttaaaaaatcta

SEQ ID NO: 362996 - DNA, 15 bp, Homo sapiens
atttaaaaaatctat

SEQ ID NO: 362997 - DNA, 15 bp, Homo sapiens
tttaaaaaatctatt

SEQ ID NO: 362998 - DNA, 15 bp, Homo sapiens
ttaaaaaatctatta

SEQ ID NO: 362999 - DNA, 15 bp, Homo sapiens
taaaaaatctattat

SEQ ID NO: 363000 - DNA, 15 bp, Homo sapiens
aaaaaatctattatt

SEQ ID NO: 363001 - DNA, 15 bp, Homo sapiens
aaaaatctattattt

SEQ ID NO: 363002 - DNA, 15 bp, Homo sapiens
aaaatctattatttt

SEQ ID NO: 363003 - DNA, 15 bp, Homo sapiens
aaatctattattttg

SEQ ID NO: 363004 - DNA, 15 bp, Homo sapiens
aatctattattttgt

SEQ ID NO: 363005 - DNA, 15 bp, Homo sapiens
atctattattttgtg

SEQ ID NO: 363006 - DNA, 15 bp, Homo sapiens
tctattattttgtgt

SEQ ID NO: 363007 - DNA, 15 bp, Homo sapiens
ctattattttgtgtg

SEQ ID NO: 363008 - DNA, 15 bp, Homo sapiens
tattattttgtgtgt

SEQ ID NO: 363009 - DNA, 15 bp, Homo sapiens
attattttgtgtgtt

SEQ ID NO: 363010 - DNA, 15 bp, Homo sapiens
ttattttgtgtgttt

SEQ ID NO: 363011 - DNA, 15 bp, Homo sapiens
tattttgtgtgtttt

SEQ ID NO: 363012 - DNA, 15 bp, Homo sapiens
attttgtgtgttttg

SEQ ID NO: 363013 - DNA, 15 bp, Homo sapiens
ttttgtgtgttttgg

SEQ ID NO: 363014 - DNA, 15 bp, Homo sapiens
tttgtgtgttttggt

SEQ ID NO: 363015 - DNA, 15 bp, Homo sapiens
ttgtgtgttttggta

SEQ ID NO: 363016 - DNA, 15 bp, Homo sapiens
tgtgtgttttggtaa

SEQ ID NO: 363017 - DNA, 15 bp, Homo sapiens
gtgtgttttggtaag

SEQ ID NO: 363018 - DNA, 15 bp, Homo sapiens
tgtgttttggtaaga

SEQ ID NO: 363019 - DNA, 15 bp, Homo sapiens
gtgttttggtaagag

SEQ ID NO: 363020 - DNA, 15 bp, Homo sapiens
tgttttggtaagaga

SEQ ID NO: 363021 - DNA, 15 bp, Homo sapiens
gttttggtaagagac

SEQ ID NO: 363022 - DNA, 15 bp, Homo sapiens
ttttggtaagagaca

SEQ ID NO: 363023 - DNA, 15 bp, Homo sapiens
tttggtaagagacaa

SEQ ID NO: 363024 - DNA, 15 bp, Homo sapiens
ttggtaagagacaaa

SEQ ID NO: 363025 - DNA, 15 bp, Homo sapiens
tggtaagagacaaat

SEQ ID NO: 363026 - DNA, 15 bp, Homo sapiens
ggtaagagacaaata

SEQ ID NO: 363027 - DNA, 15 bp, Homo sapiens
gtaagagacaaataa

SEQ ID NO: 363028 - DNA, 15 bp, Homo sapiens
taagagacaaataat

SEQ ID NO: 363029 - DNA, 15 bp, Homo sapiens
aagagacaaataata

SEQ ID NO: 363030 - DNA, 15 bp, Homo sapiens
agagacaaataataa

SEQ ID NO: 363031 - DNA, 15 bp, Homo sapiens
gagacaaataataat

SEQ ID NO: 363032 - DNA, 15 bp, Homo sapiens
agacaaataataatt

SEQ ID NO: 363033 - DNA, 15 bp, Homo sapiens
gacaaataataatta

SEQ ID NO: 363034 - DNA, 15 bp, Homo sapiens
acaaataataattag

SEQ ID NO: 363035 - DNA, 15 bp, Homo sapiens
caaataataattagt

SEQ ID NO: 363036 - DNA, 15 bp, Homo sapiens
aaataataattagta

SEQ ID NO: 363037 - DNA, 15 bp, Homo sapiens
aataataattagtac

SEQ ID NO: 363038 - DNA, 15 bp, Homo sapiens
ataataattagtacg

SEQ ID NO: 363039 - DNA, 15 bp, Homo sapiens
taataattagtacgt

SEQ ID NO: 363040 - DNA, 15 bp, Homo sapiens
aataattagtacgtt

SEQ ID NO: 363041 - DNA, 15 bp, Homo sapiens
ataattagtacgttt

SEQ ID NO: 363042 - DNA, 15 bp, Homo sapiens
taattagtacgtttt

SEQ ID NO: 363043 - DNA, 15 bp, Homo sapiens
aattagtacgttttg

SEQ ID NO: 363044 - DNA, 15 bp, Homo sapiens
attagtacgttttgg

SEQ ID NO: 363045 - DNA, 15 bp, Homo sapiens
ttagtacgttttggt

SEQ ID NO: 363046 - DNA, 15 bp, Homo sapiens
tagtacgttttggtt

SEQ ID NO: 363047 - DNA, 15 bp, Homo sapiens
agtacgttttggttg

SEQ ID NO: 363048 - DNA, 15 bp, Homo sapiens
gtacgttttggttga

SEQ ID NO: 363049 - DNA, 15 bp, Homo sapiens
tacgttttggttgag

SEQ ID NO: 363050 - DNA, 15 bp, Homo sapiens
acgttttggttgaga

SEQ ID NO: 363051 - DNA, 15 bp, Homo sapiens
cgttttggttgagag

SEQ ID NO: 363052 - DNA, 15 bp, Homo sapiens
gttttggttgagaga

SEQ ID NO: 363053 - DNA, 15 bp, Homo sapiens
ttttggttgagagat

SEQ ID NO: 363054 - DNA, 15 bp, Homo sapiens
tttggttgagagatt

SEQ ID NO: 363055 - DNA, 15 bp, Homo sapiens
ttggttgagagatta

SEQ ID NO: 363056 - DNA, 15 bp, Homo sapiens
tggttgagagattac

SEQ ID NO: 363057 - DNA, 15 bp, Homo sapiens
ggttgagagattacc

SEQ ID NO: 363058 - DNA, 15 bp, Homo sapiens
gttgagagattacca

SEQ ID NO: 363059 - DNA, 15 bp, Homo sapiens
ttgagagattaccac

SEQ ID NO: 363060 - DNA, 15 bp, Homo sapiens
tgagagattaccaca

SEQ ID NO: 363061 - DNA, 15 bp, Homo sapiens
gagagattaccacat

SEQ ID NO: 363062 - DNA, 15 bp, Homo sapiens
agagattaccacatg

SEQ ID NO: 363063 - DNA, 15 bp, Homo sapiens
gagattaccacatgg

SEQ ID NO: 363064 - DNA, 15 bp, Homo sapiens
agattaccacatggc

SEQ ID NO: 363065 - DNA, 15 bp, Homo sapiens
gattaccacatggca

SEQ ID NO: 363066 - DNA, 15 bp, Homo sapiens
attaccacatggcag

SEQ ID NO: 363067 - DNA, 15 bp, Homo sapiens
ttaccacatggcaga

SEQ ID NO: 363068 - DNA, 15 bp, Homo sapiens
taccacatggcagag

SEQ ID NO: 363069 - DNA, 15 bp, Homo sapiens
accacatggcagaga

SEQ ID NO: 363070 - DNA, 15 bp, Homo sapiens
ccacatggcagagag

SEQ ID NO: 363071 - DNA, 15 bp, Homo sapiens
cacatggcagagaga

SEQ ID NO: 363072 - DNA, 15 bp, Homo sapiens
acatggcagagagag

SEQ ID NO: 363073 - DNA, 15 bp, Homo sapiens
catggcagagagagt

SEQ ID NO: 363074 - DNA, 15 bp, Homo sapiens
atggcagagagagta

SEQ ID NO: 363075 - DNA, 15 bp, Homo sapiens
tggcagagagagtat

SEQ ID NO: 363076 - DNA, 15 bp, Homo sapiens
ggcagagagagtatc

SEQ ID NO: 363077 - DNA, 15 bp, Homo sapiens
gcagagagagtatct

SEQ ID NO: 363078 - DNA, 15 bp, Homo sapiens
cagagagagtatctg

SEQ ID NO: 363079 - DNA, 15 bp, Homo sapiens
agagagagtatctgg

SEQ ID NO: 363080 - DNA, 15 bp, Homo sapiens
gagagagtatctggc

SEQ ID NO: 363081 - DNA, 15 bp, Homo sapiens
agagagtatctggca

SEQ ID NO: 363082 - DNA, 15 bp, Homo sapiens
gagagtatctggcac

SEQ ID NO: 363083 - DNA, 15 bp, Homo sapiens
agagtatctggcacc

SEQ ID NO: 363084 - DNA, 15 bp, Homo sapiens
gagtatctggcacct

SEQ ID NO: 363085 - DNA, 15 bp, Homo sapiens
agtatctggcacctt

SEQ ID NO: 363086 - DNA, 15 bp, Homo sapiens
gtatctggcaccttg

SEQ ID NO: 363087 - DNA, 15 bp, Homo sapiens
tatctggcaccttgc

SEQ ID NO: 363088 - DNA, 15 bp, Homo sapiens
atctggcaccttgca

SEQ ID NO: 363089 - DNA, 15 bp, Homo sapiens
tctggcaccttgcac

SEQ ID NO: 363090 - DNA, 15 bp, Homo sapiens
ctggcaccttgcaca

SEQ ID NO: 363091 - DNA, 15 bp, Homo sapiens
tggcaccttgcacac

SEQ ID NO: 363092 - DNA, 15 bp, Homo sapiens
ggcaccttgcacaca

SEQ ID NO: 363093 - DNA, 15 bp, Homo sapiens
gcaccttgcacacat

SEQ ID NO: 363094 - DNA, 15 bp, Homo sapiens
caccttgcacacatt

SEQ ID NO: 363095 - DNA, 15 bp, Homo sapiens
accttgcacacattg

SEQ ID NO: 363096 - DNA, 15 bp, Homo sapiens
ccttgcacacattgc

SEQ ID NO: 363097 - DNA, 15 bp, Homo sapiens
cttgcacacattgcc

SEQ ID NO: 363098 - DNA, 15 bp, Homo sapiens
ttgcacacattgcct

SEQ ID NO: 363099 - DNA, 15 bp, Homo sapiens
tgcacacattgcctt

SEQ ID NO: 363100 - DNA, 15 bp, Homo sapiens
gcacacattgccttg

SEQ ID NO: 363101 - DNA, 15 bp, Homo sapiens
cacacattgccttgt

SEQ ID NO: 363102 - DNA, 15 bp, Homo sapiens
acacattgccttgtt

SEQ ID NO: 363103 - DNA, 15 bp, Homo sapiens
cacattgccttgttt

SEQ ID NO: 363104 - DNA, 15 bp, Homo sapiens
acattgccttgttta

SEQ ID NO: 363105 - DNA, 15 bp, Homo sapiens
cattgccttgtttag

SEQ ID NO: 363106 - DNA, 15 bp, Homo sapiens
attgccttgtttagg

SEQ ID NO: 363107 - DNA, 15 bp, Homo sapiens
ttgccttgtttagga

SEQ ID NO: 363108 - DNA, 15 bp, Homo sapiens
tgccttgtttaggag

SEQ ID NO: 363109 - DNA, 15 bp, Homo sapiens
gccttgtttaggagt

SEQ ID NO: 363110 - DNA, 15 bp, Homo sapiens
ccttgtttaggagtc

SEQ ID NO: 363111 - DNA, 15 bp, Homo sapiens
cttgtttaggagtca

SEQ ID NO: 363112 - DNA, 15 bp, Homo sapiens
ttgtttaggagtcat

SEQ ID NO: 363113 - DNA, 15 bp, Homo sapiens
tgtttaggagtcatg

SEQ ID NO: 363114 - DNA, 15 bp, Homo sapiens
gtttaggagtcatga

SEQ ID NO: 363115 - DNA, 15 bp, Homo sapiens
tttaggagtcatgac

SEQ ID NO: 363116 - DNA, 15 bp, Homo sapiens
ttaggagtcatgact

SEQ ID NO: 363117 - DNA, 15 bp, Homo sapiens
taggagtcatgactc

SEQ ID NO: 363118 - DNA, 15 bp, Homo sapiens
aggagtcatgactca

SEQ ID NO: 363119 - DNA, 15 bp, Homo sapiens
ggagtcatgactcac

SEQ ID NO: 363120 - DNA, 15 bp, Homo sapiens
gagtcatgactcacc

SEQ ID NO: 363121 - DNA, 15 bp, Homo sapiens
agtcatgactcacct

SEQ ID NO: 363122 - DNA, 15 bp, Homo sapiens
gtcatgactcacctc

SEQ ID NO: 363123 - DNA, 15 bp, Homo sapiens
tcatgactcacctct

SEQ ID NO: 363124 - DNA, 15 bp, Homo sapiens
catgactcacctctt

SEQ ID NO: 363125 - DNA, 15 bp, Homo sapiens
atgactcacctctta

SEQ ID NO: 363126 - DNA, 15 bp, Homo sapiens
tgactcacctcttag

SEQ ID NO: 363127 - DNA, 15 bp, Homo sapiens
gactcacctcttagg

SEQ ID NO: 363128 - DNA, 15 bp, Homo sapiens
actcacctcttaggg

SEQ ID NO: 363129 - DNA, 15 bp, Homo sapiens
ctcacctcttagggg

SEQ ID NO: 363130 - DNA, 15 bp, Homo sapiens
tcacctcttagggga

SEQ ID NO: 363131 - DNA, 15 bp, Homo sapiens
cacctcttaggggac

SEQ ID NO: 363132 - DNA, 15 bp, Homo sapiens
acctcttaggggact

SEQ ID NO: 363133 - DNA, 15 bp, Homo sapiens
cctcttaggggactg

SEQ ID NO: 363134 - DNA, 15 bp, Homo sapiens
ctcttaggggactgt

SEQ ID NO: 363135 - DNA, 15 bp, Homo sapiens
tcttaggggactgtt

SEQ ID NO: 363136 - DNA, 15 bp, Homo sapiens
cttaggggactgtta

SEQ ID NO: 363137 - DNA, 15 bp, Homo sapiens
ttaggggactgttaa

SEQ ID NO: 363138 - DNA, 15 bp, Homo sapiens
taggggactgttaag

SEQ ID NO: 363139 - DNA, 15 bp, Homo sapiens
aggggactgttaagc

SEQ ID NO: 363140 - DNA, 15 bp, Homo sapiens
ggggactgttaagcc

SEQ ID NO: 363141 - DNA, 15 bp, Homo sapiens
gggactgttaagcct

SEQ ID NO: 363142 - DNA, 15 bp, Homo sapiens
ggactgttaagcctt

SEQ ID NO: 363143 - DNA, 15 bp, Homo sapiens
gactgttaagccttg

SEQ ID NO: 363144 - DNA, 15 bp, Homo sapiens
actgttaagccttgt

SEQ ID NO: 363145 - DNA, 15 bp, Homo sapiens
ctgttaagccttgta

SEQ ID NO: 363146 - DNA, 15 bp, Homo sapiens
tgttaagccttgtac

SEQ ID NO: 363147 - DNA, 15 bp, Homo sapiens
gttaagccttgtaca

SEQ ID NO: 363148 - DNA, 15 bp, Homo sapiens
ttaagccttgtacag

SEQ ID NO: 363149 - DNA, 15 bp, Homo sapiens
taagccttgtacagc

SEQ ID NO: 363150 - DNA, 15 bp, Homo sapiens
aagccttgtacagct

SEQ ID NO: 363151 - DNA, 15 bp, Homo sapiens
agccttgtacagctt

SEQ ID NO: 363152 - DNA, 15 bp, Homo sapiens
gccttgtacagcttt

SEQ ID NO: 363153 - DNA, 15 bp, Homo sapiens
ccttgtacagcttta

SEQ ID NO: 363154 - DNA, 15 bp, Homo sapiens
cttgtacagctttag

SEQ ID NO: 363155 - DNA, 15 bp, Homo sapiens
ttgtacagctttaga

SEQ ID NO: 363156 - DNA, 15 bp, Homo sapiens
tgtacagctttagaa

SEQ ID NO: 363157 - DNA, 15 bp, Homo sapiens
gtacagctttagaaa

SEQ ID NO: 363158 - DNA, 15 bp, Homo sapiens
tacagctttagaaac

SEQ ID NO: 363159 - DNA, 15 bp, Homo sapiens
acagctttagaaact

SEQ ID NO: 363160 - DNA, 15 bp, Homo sapiens
cagctttagaaactg

SEQ ID NO: 363161 - DNA, 15 bp, Homo sapiens
agctttagaaactga

SEQ ID NO: 363162 - DNA, 15 bp, Homo sapiens
gctttagaaactgag

SEQ ID NO: 363163 - DNA, 15 bp, Homo sapiens
ctttagaaactgagg

SEQ ID NO: 363164 - DNA, 15 bp, Homo sapiens
tttagaaactgaggc

SEQ ID NO: 363165 - DNA, 15 bp, Homo sapiens
ttagaaactgaggct

SEQ ID NO: 363166 - DNA, 15 bp, Homo sapiens
tagaaactgaggcta

SEQ ID NO: 363167 - DNA, 15 bp, Homo sapiens
agaaactgaggctaa

SEQ ID NO: 363168 - DNA, 15 bp, Homo sapiens
gaaactgaggctaag

SEQ ID NO: 363169 - DNA, 15 bp, Homo sapiens
aaactgaggctaaga

SEQ ID NO: 363170 - DNA, 15 bp, Homo sapiens
aactgaggctaagag

SEQ ID NO: 363171 - DNA, 15 bp, Homo sapiens
actgaggctaagaga

SEQ ID NO: 363172 - DNA, 15 bp, Homo sapiens
ctgaggctaagagag

SEQ ID NO: 363173 - DNA, 15 bp, Homo sapiens
tgaggctaagagagg

SEQ ID NO: 363174 - DNA, 15 bp, Homo sapiens
gaggctaagagaggc

SEQ ID NO: 363175 - DNA, 15 bp, Homo sapiens
aggctaagagaggcg

SEQ ID NO: 363176 - DNA, 15 bp, Homo sapiens
ggctaagagaggcga

SEQ ID NO: 363177 - DNA, 15 bp, Homo sapiens
gctaagagaggcgag

SEQ ID NO: 363178 - DNA, 15 bp, Homo sapiens
ctaagagaggcgagg

SEQ ID NO: 363179 - DNA, 15 bp, Homo sapiens
taagagaggcgaggt

SEQ ID NO: 363180 - DNA, 15 bp, Homo sapiens
aagagaggcgaggtt

SEQ ID NO: 363181 - DNA, 15 bp, Homo sapiens
agagaggcgaggtta

SEQ ID NO: 363182 - DNA, 15 bp, Homo sapiens
gagaggcgaggttaa

SEQ ID NO: 363183 - DNA, 15 bp, Homo sapiens
agaggcgaggttaag

SEQ ID NO: 363184 - DNA, 15 bp, Homo sapiens
gaggcgaggttaagt

SEQ ID NO: 363185 - DNA, 15 bp, Homo sapiens
aggcgaggttaagta

SEQ ID NO: 363186 - DNA, 15 bp, Homo sapiens
ggcgaggttaagtaa

SEQ ID NO: 363187 - DNA, 15 bp, Homo sapiens
gcgaggttaagtaac

SEQ ID NO: 363188 - DNA, 15 bp, Homo sapiens
cgaggttaagtaact

SEQ ID NO: 363189 - DNA, 15 bp, Homo sapiens
gaggttaagtaactt

SEQ ID NO: 363190 - DNA, 15 bp, Homo sapiens
aggttaagtaacttg

SEQ ID NO: 363191 - DNA, 15 bp, Homo sapiens
ggttaagtaacttgt

SEQ ID NO: 363192 - DNA, 15 bp, Homo sapiens
gttaagtaacttgtc

SEQ ID NO: 363193 - DNA, 15 bp, Homo sapiens
ttaagtaacttgtcc

SEQ ID NO: 363194 - DNA, 15 bp, Homo sapiens
taagtaacttgtcca

SEQ ID NO: 363195 - DNA, 15 bp, Homo sapiens
aagtaacttgtccaa

SEQ ID NO: 363196 - DNA, 15 bp, Homo sapiens
agtaacttgtccaag

SEQ ID NO: 363197 - DNA, 15 bp, Homo sapiens
gtaacttgtccaaga

SEQ ID NO: 363198 - DNA, 15 bp, Homo sapiens
taacttgtccaagat

SEQ ID NO: 363199 - DNA, 15 bp, Homo sapiens
aacttgtccaagatc

SEQ ID NO: 363200 - DNA, 15 bp, Homo sapiens
acttgtccaagatct

SEQ ID NO: 363201 - DNA, 15 bp, Homo sapiens
cttgtccaagatctc

SEQ ID NO: 363202 - DNA, 15 bp, Homo sapiens
ttgtccaagatctca

SEQ ID NO: 363203 - DNA, 15 bp, Homo sapiens
tgtccaagatctcat

SEQ ID NO: 363204 - DNA, 15 bp, Homo sapiens
gtccaagatctcata

SEQ ID NO: 363205 - DNA, 15 bp, Homo sapiens
tccaagatctcatag

SEQ ID NO: 363206 - DNA, 15 bp, Homo sapiens
ccaagatctcataga

SEQ ID NO: 363207 - DNA, 15 bp, Homo sapiens
caagatctcatagaa

SEQ ID NO: 363208 - DNA, 15 bp, Homo sapiens
aagatctcatagaaa

SEQ ID NO: 363209 - DNA, 15 bp, Homo sapiens
agatctcatagaaag

SEQ ID NO: 363210 - DNA, 15 bp, Homo sapiens
gatctcatagaaagt

SEQ ID NO: 363211 - DNA, 15 bp, Homo sapiens
atctcatagaaagta

SEQ ID NO: 363212 - DNA, 15 bp, Homo sapiens
tctcatagaaagtaa

SEQ ID NO: 363213 - DNA, 15 bp, Homo sapiens
ctcatagaaagtaag

SEQ ID NO: 363214 - DNA, 15 bp, Homo sapiens
tcatagaaagtaagt

SEQ ID NO: 363215 - DNA, 15 bp, Homo sapiens
catagaaagtaagtg

SEQ ID NO: 363216 - DNA, 15 bp, Homo sapiens
atagaaagtaagtga

SEQ ID NO: 363217 - DNA, 15 bp, Homo sapiens
tagaaagtaagtgat

SEQ ID NO: 363218 - DNA, 15 bp, Homo sapiens
agaaagtaagtgatc

SEQ ID NO: 363219 - DNA, 15 bp, Homo sapiens
gaaagtaagtgatca

SEQ ID NO: 363220 - DNA, 15 bp, Homo sapiens
aaagtaagtgatcat

SEQ ID NO: 363221 - DNA, 15 bp, Homo sapiens
aagtaagtgatcata

SEQ ID NO: 363222 - DNA, 15 bp, Homo sapiens
agtaagtgatcatac

SEQ ID NO: 363223 - DNA, 15 bp, Homo sapiens
gtaagtgatcatact

SEQ ID NO: 363224 - DNA, 15 bp, Homo sapiens
taagtgatcatactg

SEQ ID NO: 363225 - DNA, 15 bp, Homo sapiens
aagtgatcatactgt

SEQ ID NO: 363226 - DNA, 15 bp, Homo sapiens
agtgatcatactgtc

SEQ ID NO: 363227 - DNA, 15 bp, Homo sapiens
gtgatcatactgtct

SEQ ID NO: 363228 - DNA, 15 bp, Homo sapiens
tgatcatactgtctt

SEQ ID NO: 363229 - DNA, 15 bp, Homo sapiens
gatcatactgtctta

SEQ ID NO: 363230 - DNA, 15 bp, Homo sapiens
atcatactgtcttat

SEQ ID NO: 363231 - DNA, 15 bp, Homo sapiens
tcatactgtcttatg

SEQ ID NO: 363232 - DNA, 15 bp, Homo sapiens
catactgtcttatgc

SEQ ID NO: 363233 - DNA, 15 bp, Homo sapiens
atactgtcttatgct

SEQ ID NO: 363234 - DNA, 15 bp, Homo sapiens
tactgtcttatgctc

SEQ ID NO: 363235 - DNA, 15 bp, Homo sapiens
actgtcttatgctct

SEQ ID NO: 363236 - DNA, 15 bp, Homo sapiens
ctgtcttatgctctc

SEQ ID NO: 363237 - DNA, 15 bp, Homo sapiens
tgtcttatgctctca

SEQ ID NO: 363238 - DNA, 15 bp, Homo sapiens
gtcttatgctctcaa

SEQ ID NO: 363239 - DNA, 15 bp, Homo sapiens
tcttatgctctcaat

SEQ ID NO: 363240 - DNA, 15 bp, Homo sapiens
cttatgctctcaata

SEQ ID NO: 363241 - DNA, 15 bp, Homo sapiens
ttatgctctcaatat

SEQ ID NO: 363242 - DNA, 15 bp, Homo sapiens
tatgctctcaatatt

SEQ ID NO: 363243 - DNA, 15 bp, Homo sapiens
atgctctcaatatta

SEQ ID NO: 363244 - DNA, 15 bp, Homo sapiens
tgctctcaatattat

SEQ ID NO: 363245 - DNA, 15 bp, Homo sapiens
gctctcaatattatg

SEQ ID NO: 363246 - DNA, 15 bp, Homo sapiens
ctctcaatattatgc

SEQ ID NO: 363247 - DNA, 15 bp, Homo sapiens
tctcaatattatgct

SEQ ID NO: 363248 - DNA, 15 bp, Homo sapiens
ctcaatattatgctg

SEQ ID NO: 363249 - DNA, 15 bp, Homo sapiens
tcaatattatgctgt

SEQ ID NO: 363250 - DNA, 15 bp, Homo sapiens
caatattatgctgta

SEQ ID NO: 363251 - DNA, 15 bp, Homo sapiens
aatattatgctgtac

SEQ ID NO: 363252 - DNA, 15 bp, Homo sapiens
atattatgctgtacg

SEQ ID NO: 363253 - DNA, 15 bp, Homo sapiens
tattatgctgtacga

SEQ ID NO: 363254 - DNA, 15 bp, Homo sapiens
attatgctgtacgaa

SEQ ID NO: 363255 - DNA, 15 bp, Homo sapiens
ttatgctgtacgaac

SEQ ID NO: 363256 - DNA, 15 bp, Homo sapiens
tatgctgtacgaact

SEQ ID NO: 363257 - DNA, 15 bp, Homo sapiens
atgctgtacgaactt

SEQ ID NO: 363258 - DNA, 15 bp, Homo sapiens
tgctgtacgaacttg

SEQ ID NO: 363259 - DNA, 15 bp, Homo sapiens
gctgtacgaacttgg

SEQ ID NO: 363260 - DNA, 15 bp, Homo sapiens
ctgtacgaacttgga

SEQ ID NO: 363261 - DNA, 15 bp, Homo sapiens
tgtacgaacttggaa

SEQ ID NO: 363262 - DNA, 15 bp, Homo sapiens
gtacgaacttggaaa

SEQ ID NO: 363263 - DNA, 15 bp, Homo sapiens
tacgaacttggaaag

SEQ ID NO: 363264 - DNA, 15 bp, Homo sapiens
acgaacttggaaaga

SEQ ID NO: 363265 - DNA, 15 bp, Homo sapiens
cgaacttggaaagag

SEQ ID NO: 363266 - DNA, 15 bp, Homo sapiens
gaacttggaaagagc

SEQ ID NO: 363267 - DNA, 15 bp, Homo sapiens
aacttggaaagagca

SEQ ID NO: 363268 - DNA, 15 bp, Homo sapiens
acttggaaagagcac

SEQ ID NO: 363269 - DNA, 15 bp, Homo sapiens
cttggaaagagcaca

SEQ ID NO: 363270 - DNA, 15 bp, Homo sapiens
ttggaaagagcacag

SEQ ID NO: 363271 - DNA, 15 bp, Homo sapiens
tggaaagagcacaga

SEQ ID NO: 363272 - DNA, 15 bp, Homo sapiens
ggaaagagcacagaa

SEQ ID NO: 363273 - DNA, 15 bp, Homo sapiens
gaaagagcacagaac

SEQ ID NO: 363274 - DNA, 15 bp, Homo sapiens
aaagagcacagaact

SEQ ID NO: 363275 - DNA, 15 bp, Homo sapiens
aagagcacagaactc

SEQ ID NO: 363276 - DNA, 15 bp, Homo sapiens
agagcacagaactct

SEQ ID NO: 363277 - DNA, 15 bp, Homo sapiens
gagcacagaactctc

SEQ ID NO: 363278 - DNA, 15 bp, Homo sapiens
agcacagaactctct

SEQ ID NO: 363279 - DNA, 15 bp, Homo sapiens
gcacagaactctctg

SEQ ID NO: 363280 - DNA, 15 bp, Homo sapiens
cacagaactctctgg

SEQ ID NO: 363281 - DNA, 15 bp, Homo sapiens
acagaactctctggc

SEQ ID NO: 363282 - DNA, 15 bp, Homo sapiens
cagaactctctggcc

SEQ ID NO: 363283 - DNA, 15 bp, Homo sapiens
agaactctctggcca

SEQ ID NO: 363284 - DNA, 15 bp, Homo sapiens
gaactctctggccaa

SEQ ID NO: 363285 - DNA, 15 bp, Homo sapiens
aactctctggccaaa

SEQ ID NO: 363286 - DNA, 15 bp, Homo sapiens
actctctggccaaag

SEQ ID NO: 363287 - DNA, 15 bp, Homo sapiens
ctctctggccaaagt

SEQ ID NO: 363288 - DNA, 15 bp, Homo sapiens
tctctggccaaagtg

SEQ ID NO: 363289 - DNA, 15 bp, Homo sapiens
ctctggccaaagtgt

SEQ ID NO: 363290 - DNA, 15 bp, Homo sapiens
tctggccaaagtgtc

SEQ ID NO: 363291 - DNA, 15 bp, Homo sapiens
ctggccaaagtgtct

SEQ ID NO: 363292 - DNA, 15 bp, Homo sapiens
tggccaaagtgtctt

SEQ ID NO: 363293 - DNA, 15 bp, Homo sapiens
ggccaaagtgtcttc

SEQ ID NO: 363294 - DNA, 15 bp, Homo sapiens
gccaaagtgtcttcc

SEQ ID NO: 363295 - DNA, 15 bp, Homo sapiens
ccaaagtgtcttcct

SEQ ID NO: 363296 - DNA, 15 bp, Homo sapiens
caaagtgtcttcctc

SEQ ID NO: 363297 - DNA, 15 bp, Homo sapiens
aaagtgtcttcctct

SEQ ID NO: 363298 - DNA, 15 bp, Homo sapiens
aagtgtcttcctctg

SEQ ID NO: 363299 - DNA, 15 bp, Homo sapiens
agtgtcttcctctgg

SEQ ID NO: 363300 - DNA, 15 bp, Homo sapiens
gtgtcttcctctgga

SEQ ID NO: 363301 - DNA, 15 bp, Homo sapiens
tgtcttcctctggaa

SEQ ID NO: 363302 - DNA, 15 bp, Homo sapiens
gtcttcctctggaaa

SEQ ID NO: 363303 - DNA, 15 bp, Homo sapiens
tcttcctctggaaat

SEQ ID NO: 363304 - DNA, 15 bp, Homo sapiens
cttcctctggaaatg

SEQ ID NO: 363305 - DNA, 15 bp, Homo sapiens
ttcctctggaaatga

SEQ ID NO: 363306 - DNA, 15 bp, Homo sapiens
tcctctggaaatgag

SEQ ID NO: 363307 - DNA, 15 bp, Homo sapiens
cctctggaaatgaga

SEQ ID NO: 363308 - DNA, 15 bp, Homo sapiens
ctctggaaatgagaa

SEQ ID NO: 363309 - DNA, 15 bp, Homo sapiens
tctggaaatgagaac

SEQ ID NO: 363310 - DNA, 15 bp, Homo sapiens
ctggaaatgagaact

SEQ ID NO: 363311 - DNA, 15 bp, Homo sapiens
tggaaatgagaacta

SEQ ID NO: 363312 - DNA, 15 bp, Homo sapiens
ggaaatgagaactat

SEQ ID NO: 363313 - DNA, 15 bp, Homo sapiens
gaaatgagaactatg

SEQ ID NO: 363314 - DNA, 15 bp, Homo sapiens
aaatgagaactatga

SEQ ID NO: 363315 - DNA, 15 bp, Homo sapiens
aatgagaactatgat

SEQ ID NO: 363316 - DNA, 15 bp, Homo sapiens
atgagaactatgata

SEQ ID NO: 363317 - DNA, 15 bp, Homo sapiens
tgagaactatgatat

SEQ ID NO: 363318 - DNA, 15 bp, Homo sapiens
gagaactatgatatc

SEQ ID NO: 363319 - DNA, 15 bp, Homo sapiens
agaactatgatatca

SEQ ID NO: 363320 - DNA, 15 bp, Homo sapiens
gaactatgatatcac

SEQ ID NO: 363321 - DNA, 15 bp, Homo sapiens
aactatgatatcacc

SEQ ID NO: 363322 - DNA, 15 bp, Homo sapiens
actatgatatcacca

SEQ ID NO: 363323 - DNA, 15 bp, Homo sapiens
ctatgatatcaccac

SEQ ID NO: 363324 - DNA, 15 bp, Homo sapiens
tatgatatcaccaca

SEQ ID NO: 363325 - DNA, 15 bp, Homo sapiens
atgatatcaccacag

SEQ ID NO: 363326 - DNA, 15 bp, Homo sapiens
tgatatcaccacaga

SEQ ID NO: 363327 - DNA, 15 bp, Homo sapiens
gatatcaccacagag

SEQ ID NO: 363328 - DNA, 15 bp, Homo sapiens
atatcaccacagagg

SEQ ID NO: 363329 - DNA, 15 bp, Homo sapiens
tatcaccacagagga

SEQ ID NO: 363330 - DNA, 15 bp, Homo sapiens
atcaccacagaggac

SEQ ID NO: 363331 - DNA, 15 bp, Homo sapiens
tcaccacagaggact

SEQ ID NO: 363332 - DNA, 15 bp, Homo sapiens
caccacagaggactg

SEQ ID NO: 363333 - DNA, 15 bp, Homo sapiens
accacagaggactgt

SEQ ID NO: 363334 - DNA, 15 bp, Homo sapiens
ccacagaggactgtc

SEQ ID NO: 363335 - DNA, 15 bp, Homo sapiens
cacagaggactgtca

SEQ ID NO: 363336 - DNA, 15 bp, Homo sapiens
acagaggactgtcat

SEQ ID NO: 363337 - DNA, 15 bp, Homo sapiens
cagaggactgtcatg

SEQ ID NO: 363338 - DNA, 15 bp, Homo sapiens
agaggactgtcatga

SEQ ID NO: 363339 - DNA, 15 bp, Homo sapiens
gaggactgtcatgag

SEQ ID NO: 363340 - DNA, 15 bp, Homo sapiens
aggactgtcatgagg

SEQ ID NO: 363341 - DNA, 15 bp, Homo sapiens
ggactgtcatgagga

SEQ ID NO: 363342 - DNA, 15 bp, Homo sapiens
gactgtcatgaggat

SEQ ID NO: 363343 - DNA, 15 bp, Homo sapiens
actgtcatgaggatt

SEQ ID NO: 363344 - DNA, 15 bp, Homo sapiens
ctgtcatgaggatta

SEQ ID NO: 363345 - DNA, 15 bp, Homo sapiens
tgtcatgaggattaa

SEQ ID NO: 363346 - DNA, 15 bp, Homo sapiens
gtcatgaggattaaa

SEQ ID NO: 363347 - DNA, 15 bp, Homo sapiens
tcatgaggattaaat

SEQ ID NO: 363348 - DNA, 15 bp, Homo sapiens
catgaggattaaatg

SEQ ID NO: 363349 - DNA, 15 bp, Homo sapiens
atgaggattaaatgc

SEQ ID NO: 363350 - DNA, 15 bp, Homo sapiens
tgaggattaaatgca

SEQ ID NO: 363351 - DNA, 15 bp, Homo sapiens
gaggattaaatgcaa

SEQ ID NO: 363352 - DNA, 15 bp, Homo sapiens
aggattaaatgcaat

SEQ ID NO: 363353 - DNA, 15 bp, Homo sapiens
ggattaaatgcaata

SEQ ID NO: 363354 - DNA, 15 bp, Homo sapiens
gattaaatgcaatag

SEQ ID NO: 363355 - DNA, 15 bp, Homo sapiens
attaaatgcaatagt

SEQ ID NO: 363356 - DNA, 15 bp, Homo sapiens
ttaaatgcaatagtg

SEQ ID NO: 363357 - DNA, 15 bp, Homo sapiens
taaatgcaatagtgt

SEQ ID NO: 363358 - DNA, 15 bp, Homo sapiens
aaatgcaatagtgtt

SEQ ID NO: 363359 - DNA, 15 bp, Homo sapiens
aatgcaatagtgttt

SEQ ID NO: 363360 - DNA, 15 bp, Homo sapiens
atgcaatagtgtttg

SEQ ID NO: 363361 - DNA, 15 bp, Homo sapiens
tgcaatagtgtttgg

SEQ ID NO: 363362 - DNA, 15 bp, Homo sapiens
gcaatagtgtttgga

SEQ ID NO: 363363 - DNA, 15 bp, Homo sapiens
caatagtgtttggaa

SEQ ID NO: 363364 - DNA, 15 bp, Homo sapiens
aatagtgtttggaaa

SEQ ID NO: 363365 - DNA, 15 bp, Homo sapiens
atagtgtttggaaaa

SEQ ID NO: 363366 - DNA, 15 bp, Homo sapiens
tagtgtttggaaaat

SEQ ID NO: 363367 - DNA, 15 bp, Homo sapiens
agtgtttggaaaatg

SEQ ID NO: 363368 - DNA, 15 bp, Homo sapiens
gtgtttggaaaatgt

SEQ ID NO: 363369 - DNA, 15 bp, Homo sapiens
tgtttggaaaatgtg

SEQ ID NO: 363370 - DNA, 15 bp, Homo sapiens
gtttggaaaatgtgc

SEQ ID NO: 363371 - DNA, 15 bp, Homo sapiens
tttggaaaatgtgca

SEQ ID NO: 363372 - DNA, 15 bp, Homo sapiens
ttggaaaatgtgcat

SEQ ID NO: 363373 - DNA, 15 bp, Homo sapiens
tggaaaatgtgcatg

SEQ ID NO: 363374 - DNA, 15 bp, Homo sapiens
ggaaaatgtgcatgc

SEQ ID NO: 363375 - DNA, 15 bp, Homo sapiens
gaaaatgtgcatgcc

SEQ ID NO: 363376 - DNA, 15 bp, Homo sapiens
aaaatgtgcatgcct

SEQ ID NO: 363377 - DNA, 15 bp, Homo sapiens
aaatgtgcatgcctt

SEQ ID NO: 363378 - DNA, 15 bp, Homo sapiens
aatgtgcatgccttg

SEQ ID NO: 363379 - DNA, 15 bp, Homo sapiens
atgtgcatgccttga

SEQ ID NO: 363380 - DNA, 15 bp, Homo sapiens
tgtgcatgccttgac

SEQ ID NO: 363381 - DNA, 15 bp, Homo sapiens
gtgcatgccttgact

SEQ ID NO: 363382 - DNA, 15 bp, Homo sapiens
tgcatgccttgacta

SEQ ID NO: 363383 - DNA, 15 bp, Homo sapiens
gcatgccttgactat

SEQ ID NO: 363384 - DNA, 15 bp, Homo sapiens
atgccttgactattc

SEQ ID NO: 363385 - DNA, 15 bp, Homo sapiens
tgccttgactattca

SEQ ID NO: 363386 - DNA, 15 bp, Homo sapiens
gccttgactattcat

SEQ ID NO: 363387 - DNA, 15 bp, Homo sapiens
ccttgactattcata

SEQ ID NO: 363388 - DNA, 15 bp, Homo sapiens
cttgactattcatag

SEQ ID NO: 363389 - DNA, 15 bp, Homo sapiens
ttgactattcatagt

SEQ ID NO: 363390 - DNA, 15 bp, Homo sapiens
tgactattcatagta

SEQ ID NO: 363391 - DNA, 15 bp, Homo sapiens
gactattcatagtaa

SEQ ID NO: 363392 - DNA, 15 bp, Homo sapiens
actattcatagtaaa

SEQ ID NO: 363393 - DNA, 15 bp, Homo sapiens
ctattcatagtaaac

SEQ ID NO: 363394 - DNA, 15 bp, Homo sapiens
tattcatagtaaaca

SEQ ID NO: 363395 - DNA, 15 bp, Homo sapiens
attcatagtaaacac

SEQ ID NO: 363396 - DNA, 15 bp, Homo sapiens
ttcatagtaaacact

SEQ ID NO: 363397 - DNA, 15 bp, Homo sapiens
tcatagtaaacactt

SEQ ID NO: 363398 - DNA, 15 bp, Homo sapiens
catagtaaacactta

SEQ ID NO: 363399 - DNA, 15 bp, Homo sapiens
atagtaaacacttaa

SEQ ID NO: 363400 - DNA, 15 bp, Homo sapiens
tagtaaacacttaaa

SEQ ID NO: 363401 - DNA, 15 bp, Homo sapiens
agtaaacacttaaag

SEQ ID NO: 363402 - DNA, 15 bp, Homo sapiens
gtaaacacttaaagt

SEQ ID NO: 363403 - DNA, 15 bp, Homo sapiens
taaacacttaaagta

SEQ ID NO: 363404 - DNA, 15 bp, Homo sapiens
aaacacttaaagtat

SEQ ID NO: 363405 - DNA, 15 bp, Homo sapiens
aacacttaaagtatc

SEQ ID NO: 363406 - DNA, 15 bp, Homo sapiens
acacttaaagtatct

SEQ ID NO: 363407 - DNA, 15 bp, Homo sapiens
cacttaaagtatcta

SEQ ID NO: 363408 - DNA, 15 bp, Homo sapiens
acttaaagtatctat

SEQ ID NO: 363409 - DNA, 15 bp, Homo sapiens
cttaaagtatctatt

SEQ ID NO: 363410 - DNA, 15 bp, Homo sapiens
ttaaagtatctattt

SEQ ID NO: 363411 - DNA, 15 bp, Homo sapiens
taaagtatctatttc

SEQ ID NO: 363412 - DNA, 15 bp, Homo sapiens
aaagtatctatttct

SEQ ID NO: 363413 - DNA, 15 bp, Homo sapiens
aagtatctatttctt

SEQ ID NO: 363414 - DNA, 15 bp, Homo sapiens
agtatctatttctta

SEQ ID NO: 363415 - DNA, 15 bp, Homo sapiens
gtatctatttcttat

SEQ ID NO: 363416 - DNA, 15 bp, Homo sapiens
tatctatttcttatg

SEQ ID NO: 363417 - DNA, 15 bp, Homo sapiens
atctatttcttatga

SEQ ID NO: 363418 - DNA, 15 bp, Homo sapiens
tctatttcttatgaa

SEQ ID NO: 363419 - DNA, 15 bp, Homo sapiens
ctatttcttatgaaa

SEQ ID NO: 363420 - DNA, 15 bp, Homo sapiens
tatttcttatgaaag

SEQ ID NO: 363421 - DNA, 15 bp, Homo sapiens
atttcttatgaaagc

SEQ ID NO: 363422 - DNA, 15 bp, Homo sapiens
tttcttatgaaagca

SEQ ID NO: 363423 - DNA, 15 bp, Homo sapiens
ttcttatgaaagcaa

SEQ ID NO: 363424 - DNA, 15 bp, Homo sapiens
tcttatgaaagcaag

SEQ ID NO: 363425 - DNA, 15 bp, Homo sapiens
cttatgaaagcaagt

SEQ ID NO: 363426 - DNA, 15 bp, Homo sapiens
ttatgaaagcaagtt

SEQ ID NO: 363427 - DNA, 15 bp, Homo sapiens
tatgaaagcaagtta

SEQ ID NO: 363428 - DNA, 15 bp, Homo sapiens
atgaaagcaagttat

SEQ ID NO: 363429 - DNA, 15 bp, Homo sapiens
tgaaagcaagttatc

SEQ ID NO: 363430 - DNA, 15 bp, Homo sapiens
gaaagcaagttatct

SEQ ID NO: 363431 - DNA, 15 bp, Homo sapiens
aaagcaagttatctt

SEQ ID NO: 363432 - DNA, 15 bp, Homo sapiens
aagcaagttatctta

SEQ ID NO: 363433 - DNA, 15 bp, Homo sapiens
agcaagttatcttag

SEQ ID NO: 363434 - DNA, 15 bp, Homo sapiens
gcaagttatcttaga

SEQ ID NO: 363435 - DNA, 15 bp, Homo sapiens
caagttatcttagaa

SEQ ID NO: 363436 - DNA, 15 bp, Homo sapiens
aagttatcttagaac

SEQ ID NO: 363437 - DNA, 15 bp, Homo sapiens
agttatcttagaact

SEQ ID NO: 363438 - DNA, 15 bp, Homo sapiens
gttatcttagaactt

SEQ ID NO: 363439 - DNA, 15 bp, Homo sapiens
ttatcttagaactta

SEQ ID NO: 363440 - DNA, 15 bp, Homo sapiens
tatcttagaacttat

SEQ ID NO: 363441 - DNA, 15 bp, Homo sapiens
atcttagaacttatt

SEQ ID NO: 363442 - DNA, 15 bp, Homo sapiens
tcttagaacttattc

SEQ ID NO: 363443 - DNA, 15 bp, Homo sapiens
cttagaacttattct

SEQ ID NO: 363444 - DNA, 15 bp, Homo sapiens
ttagaacttattctc

SEQ ID NO: 363445 - DNA, 15 bp, Homo sapiens
tagaacttattctct

SEQ ID NO: 363446 - DNA, 15 bp, Homo sapiens
agaacttattctcta

SEQ ID NO: 363447 - DNA, 15 bp, Homo sapiens
gaacttattctctaa

SEQ ID NO: 363448 - DNA, 15 bp, Homo sapiens
aacttattctctaag

SEQ ID NO: 363449 - DNA, 15 bp, Homo sapiens
acttattctctaagc

SEQ ID NO: 363450 - DNA, 15 bp, Homo sapiens
cttattctctaagca

SEQ ID NO: 363451 - DNA, 15 bp, Homo sapiens
ttattctctaagcat

SEQ ID NO: 363452 - DNA, 15 bp, Homo sapiens
tattctctaagcata

SEQ ID NO: 363453 - DNA, 15 bp, Homo sapiens
attctctaagcatat

SEQ ID NO: 363454 - DNA, 15 bp, Homo sapiens
ttctctaagcatatt

SEQ ID NO: 363455 - DNA, 15 bp, Homo sapiens
tctctaagcatattg

SEQ ID NO: 363456 - DNA, 15 bp, Homo sapiens
ctctaagcatattgc

SEQ ID NO: 363457 - DNA, 15 bp, Homo sapiens
tctaagcatattgct

SEQ ID NO: 363458 - DNA, 15 bp, Homo sapiens
ctaagcatattgctg

SEQ ID NO: 363459 - DNA, 15 bp, Homo sapiens
taagcatattgctga

SEQ ID NO: 363460 - DNA, 15 bp, Homo sapiens
aagcatattgctgaa

SEQ ID NO: 363461 - DNA, 15 bp, Homo sapiens
agcatattgctgaat

SEQ ID NO: 363462 - DNA, 15 bp, Homo sapiens
gcatattgctgaatt

SEQ ID NO: 363463 - DNA, 15 bp, Homo sapiens
catattgctgaattt

SEQ ID NO: 363464 - DNA, 15 bp, Homo sapiens
atattgctgaatttt

SEQ ID NO: 363465 - DNA, 15 bp, Homo sapiens
tattgctgaattttg

SEQ ID NO: 363466 - DNA, 15 bp, Homo sapiens
attgctgaattttgc

SEQ ID NO: 363467 - DNA, 15 bp, Homo sapiens
ttgctgaattttgcc

SEQ ID NO: 363468 - DNA, 15 bp, Homo sapiens
tgctgaattttgcca

SEQ ID NO: 363469 - DNA, 15 bp, Homo sapiens
gctgaattttgccaa

SEQ ID NO: 363470 - DNA, 15 bp, Homo sapiens
ctgaattttgccaat

SEQ ID NO: 363471 - DNA, 15 bp, Homo sapiens
tgaattttgccaatg

SEQ ID NO: 363472 - DNA, 15 bp, Homo sapiens
gaattttgccaatga

SEQ ID NO: 363473 - DNA, 15 bp, Homo sapiens
aattttgccaatgat

SEQ ID NO: 363474 - DNA, 15 bp, Homo sapiens
attttgccaatgatt

SEQ ID NO: 363475 - DNA, 15 bp, Homo sapiens
ttttgccaatgattg

SEQ ID NO: 363476 - DNA, 15 bp, Homo sapiens
tttgccaatgattga

SEQ ID NO: 363477 - DNA, 15 bp, Homo sapiens
ttgccaatgattgat

SEQ ID NO: 363478 - DNA, 15 bp, Homo sapiens
tgccaatgattgatt

SEQ ID NO: 363479 - DNA, 15 bp, Homo sapiens
gccaatgattgatta

SEQ ID NO: 363480 - DNA, 15 bp, Homo sapiens
ccaatgattgattaa

SEQ ID NO: 363481 - DNA, 15 bp, Homo sapiens
caatgattgattaat

SEQ ID NO: 363482 - DNA, 15 bp, Homo sapiens
aatgattgattaatg

SEQ ID NO: 363483 - DNA, 15 bp, Homo sapiens
atgattgattaatga

SEQ ID NO: 363484 - DNA, 15 bp, Homo sapiens
tgattgattaatgac

SEQ ID NO: 363485 - DNA, 15 bp, Homo sapiens
gattgattaatgact

SEQ ID NO: 363486 - DNA, 15 bp, Homo sapiens
attgattaatgactt

SEQ ID NO: 363487 - DNA, 15 bp, Homo sapiens
ttgattaatgacttg

SEQ ID NO: 363488 - DNA, 15 bp, Homo sapiens
tgattaatgacttga

SEQ ID NO: 363489 - DNA, 15 bp, Homo sapiens
gattaatgacttgat

SEQ ID NO: 363490 - DNA, 15 bp, Homo sapiens
attaatgacttgatc

SEQ ID NO: 363491 - DNA, 15 bp, Homo sapiens
ttaatgacttgatcg

SEQ ID NO: 363492 - DNA, 15 bp, Homo sapiens
taatgacttgatcga

SEQ ID NO: 363493 - DNA, 15 bp, Homo sapiens
aatgacttgatcgat

SEQ ID NO: 363494 - DNA, 15 bp, Homo sapiens
atgacttgatcgata

SEQ ID NO: 363495 - DNA, 15 bp, Homo sapiens
tgacttgatcgatat

SEQ ID NO: 363496 - DNA, 15 bp, Homo sapiens
gacttgatcgatatt

SEQ ID NO: 363497 - DNA, 15 bp, Homo sapiens
acttgatcgatattt

SEQ ID NO: 363498 - DNA, 15 bp, Homo sapiens
cttgatcgatattta

SEQ ID NO: 363499 - DNA, 15 bp, Homo sapiens
ttgatcgatatttat

SEQ ID NO: 363500 - DNA, 15 bp, Homo sapiens
tgatcgatatttatt

SEQ ID NO: 363501 - DNA, 15 bp, Homo sapiens
gatcgatatttattg

SEQ ID NO: 363502 - DNA, 15 bp, Homo sapiens
atcgatatttattga

SEQ ID NO: 363503 - DNA, 15 bp, Homo sapiens
tcgatatttattgag

SEQ ID NO: 363504 - DNA, 15 bp, Homo sapiens
cgatatttattgagc

SEQ ID NO: 363505 - DNA, 15 bp, Homo sapiens
gatatttattgagct

SEQ ID NO: 363506 - DNA, 15 bp, Homo sapiens
atatttattgagctc

SEQ ID NO: 363507 - DNA, 15 bp, Homo sapiens
tatttattgagctct

SEQ ID NO: 363508 - DNA, 15 bp, Homo sapiens
atttattgagctcta

SEQ ID NO: 363509 - DNA, 15 bp, Homo sapiens
tttattgagctctat

SEQ ID NO: 363510 - DNA, 15 bp, Homo sapiens
ttattgagctctatg

SEQ ID NO: 363511 - DNA, 15 bp, Homo sapiens
tattgagctctatgt

SEQ ID NO: 363512 - DNA, 15 bp, Homo sapiens
attgagctctatgtt

SEQ ID NO: 363513 - DNA, 15 bp, Homo sapiens
ttgagctctatgttt

SEQ ID NO: 363514 - DNA, 15 bp, Homo sapiens
tgagctctatgttta

SEQ ID NO: 363515 - DNA, 15 bp, Homo sapiens
gagctctatgtttag

SEQ ID NO: 363516 - DNA, 15 bp, Homo sapiens
agctctatgtttagc

SEQ ID NO: 363517 - DNA, 15 bp, Homo sapiens
gctctatgtttagca

SEQ ID NO: 363518 - DNA, 15 bp, Homo sapiens
ctctatgtttagcac

SEQ ID NO: 363519 - DNA, 15 bp, Homo sapiens
tctatgtttagcact

SEQ ID NO: 363520 - DNA, 15 bp, Homo sapiens
ctatgtttagcactg

SEQ ID NO: 363521 - DNA, 15 bp, Homo sapiens
tatgtttagcactga

SEQ ID NO: 363522 - DNA, 15 bp, Homo sapiens
atgtttagcactgaa

SEQ ID NO: 363523 - DNA, 15 bp, Homo sapiens
tgtttagcactgaag

SEQ ID NO: 363524 - DNA, 15 bp, Homo sapiens
gtttagcactgaaga

SEQ ID NO: 363525 - DNA, 15 bp, Homo sapiens
tttagcactgaagat

SEQ ID NO: 363526 - DNA, 15 bp, Homo sapiens
ttagcactgaagata

SEQ ID NO: 363527 - DNA, 15 bp, Homo sapiens
tagcactgaagatac

SEQ ID NO: 363528 - DNA, 15 bp, Homo sapiens
agcactgaagataca

SEQ ID NO: 363529 - DNA, 15 bp, Homo sapiens
gcactgaagatacaa

SEQ ID NO: 363530 - DNA, 15 bp, Homo sapiens
cactgaagatacaag

SEQ ID NO: 363531 - DNA, 15 bp, Homo sapiens
actgaagatacaagt

SEQ ID NO: 363532 - DNA, 15 bp, Homo sapiens
ctgaagatacaagta

SEQ ID NO: 363533 - DNA, 15 bp, Homo sapiens
tgaagatacaagtat

SEQ ID NO: 363534 - DNA, 15 bp, Homo sapiens
gaagatacaagtatg

SEQ ID NO: 363535 - DNA, 15 bp, Homo sapiens
aagatacaagtatga

SEQ ID NO: 363536 - DNA, 15 bp, Homo sapiens
agatacaagtatgat

SEQ ID NO: 363537 - DNA, 15 bp, Homo sapiens
gatacaagtatgatt

SEQ ID NO: 363538 - DNA, 15 bp, Homo sapiens
atacaagtatgatta

SEQ ID NO: 363539 - DNA, 15 bp, Homo sapiens
tacaagtatgattag

SEQ ID NO: 363540 - DNA, 15 bp, Homo sapiens
acaagtatgattagg

SEQ ID NO: 363541 - DNA, 15 bp, Homo sapiens
caagtatgattagga

SEQ ID NO: 363542 - DNA, 15 bp, Homo sapiens
aagtatgattaggaa

SEQ ID NO: 363543 - DNA, 15 bp, Homo sapiens
agtatgattaggaac

SEQ ID NO: 363544 - DNA, 15 bp, Homo sapiens
gtatgattaggaact

SEQ ID NO: 363545 - DNA, 15 bp, Homo sapiens
tatgattaggaactc

SEQ ID NO: 363546 - DNA, 15 bp, Homo sapiens
atgattaggaactca

SEQ ID NO: 363547 - DNA, 15 bp, Homo sapiens
gattaggaactcaaa

SEQ ID NO: 363548 - DNA, 15 bp, Homo sapiens
attaggaactcaaag

SEQ ID NO: 363549 - DNA, 15 bp, Homo sapiens
ttaggaactcaaaga

SEQ ID NO: 363550 - DNA, 15 bp, Homo sapiens
taggaactcaaagac

SEQ ID NO: 363551 - DNA, 15 bp, Homo sapiens
aggaactcaaagact

SEQ ID NO: 363552 - DNA, 15 bp, Homo sapiens
ggaactcaaagacta

SEQ ID NO: 363553 - DNA, 15 bp, Homo sapiens
gaactcaaagactaa

SEQ ID NO: 363554 - DNA, 15 bp, Homo sapiens
aactcaaagactaag

SEQ ID NO: 363555 - DNA, 15 bp, Homo sapiens
actcaaagactaaga

SEQ ID NO: 363556 - DNA, 15 bp, Homo sapiens
ctcaaagactaagaa

SEQ ID NO: 363557 - DNA, 15 bp, Homo sapiens
tcaaagactaagaag

SEQ ID NO: 363558 - DNA, 15 bp, Homo sapiens
caaagactaagaaga

SEQ ID NO: 363559 - DNA, 15 bp, Homo sapiens
aaagactaagaagaa

SEQ ID NO: 363560 - DNA, 15 bp, Homo sapiens
aagactaagaagaag

SEQ ID NO: 363561 - DNA, 15 bp, Homo sapiens
agactaagaagaaga

SEQ ID NO: 363562 - DNA, 15 bp, Homo sapiens
gactaagaagaagaa

SEQ ID NO: 363563 - DNA, 15 bp, Homo sapiens
actaagaagaagaaa

SEQ ID NO: 363564 - DNA, 15 bp, Homo sapiens
ctaagaagaagaaaa

SEQ ID NO: 363565 - DNA, 15 bp, Homo sapiens
taagaagaagaaaat

SEQ ID NO: 363566 - DNA, 15 bp, Homo sapiens
aagaagaagaaaatg

SEQ ID NO: 363567 - DNA, 15 bp, Homo sapiens
agaagaagaaaatga

SEQ ID NO: 363568 - DNA, 15 bp, Homo sapiens
gaagaagaaaatgat

SEQ ID NO: 363569 - DNA, 15 bp, Homo sapiens
aagaagaaaatgatg

SEQ ID NO: 363570 - DNA, 15 bp, Homo sapiens
agaagaaaatgatga

SEQ ID NO: 363571 - DNA, 15 bp, Homo sapiens
gaagaaaatgatgaa

SEQ ID NO: 363572 - DNA, 15 bp, Homo sapiens
aagaaaatgatgaaa

SEQ ID NO: 363573 - DNA, 15 bp, Homo sapiens
agaaaatgatgaaag

SEQ ID NO: 363574 - DNA, 15 bp, Homo sapiens
gaaaatgatgaaaga

SEQ ID NO: 363575 - DNA, 15 bp, Homo sapiens
aaaatgatgaaagaa

SEQ ID NO: 363576 - DNA, 15 bp, Homo sapiens
aaatgatgaaagaaa

SEQ ID NO: 363577 - DNA, 15 bp, Homo sapiens
aatgatgaaagaaaa

SEQ ID NO: 363578 - DNA, 15 bp, Homo sapiens
atgatgaaagaaaac

SEQ ID NO: 363579 - DNA, 15 bp, Homo sapiens
tgatgaaagaaaaca

SEQ ID NO: 363580 - DNA, 15 bp, Homo sapiens
gatgaaagaaaacat

SEQ ID NO: 363581 - DNA, 15 bp, Homo sapiens
atgaaagaaaacatc

SEQ ID NO: 363582 - DNA, 15 bp, Homo sapiens
tgaaagaaaacatca

SEQ ID NO: 363583 - DNA, 15 bp, Homo sapiens
gaaagaaaacatcat

SEQ ID NO: 363584 - DNA, 15 bp, Homo sapiens
aaagaaaacatcatt

SEQ ID NO: 363585 - DNA, 15 bp, Homo sapiens
aagaaaacatcatta

SEQ ID NO: 363586 - DNA, 15 bp, Homo sapiens
agaaaacatcattaa

SEQ ID NO: 363587 - DNA, 15 bp, Homo sapiens
gaaaacatcattaaa

SEQ ID NO: 363588 - DNA, 15 bp, Homo sapiens
aaaacatcattaaaa

SEQ ID NO: 363589 - DNA, 15 bp, Homo sapiens
aaacatcattaaaaa

SEQ ID NO: 363590 - DNA, 15 bp, Homo sapiens
aacatcattaaaaag

SEQ ID NO: 363591 - DNA, 15 bp, Homo sapiens
acatcattaaaaaga

SEQ ID NO: 363592 - DNA, 15 bp, Homo sapiens
catcattaaaaagat

SEQ ID NO: 363593 - DNA, 15 bp, Homo sapiens
atcattaaaaagata

SEQ ID NO: 363594 - DNA, 15 bp, Homo sapiens
tcattaaaaagataa

SEQ ID NO: 363595 - DNA, 15 bp, Homo sapiens
cattaaaaagataaa

SEQ ID NO: 363596 - DNA, 15 bp, Homo sapiens
attaaaaagataaag

SEQ ID NO: 363597 - DNA, 15 bp, Homo sapiens
ttaaaaagataaagt

SEQ ID NO: 363598 - DNA, 15 bp, Homo sapiens
taaaaagataaagtg

SEQ ID NO: 363599 - DNA, 15 bp, Homo sapiens
aaaaagataaagtgt

SEQ ID NO: 363600 - DNA, 15 bp, Homo sapiens
aaaagataaagtgtc

SEQ ID NO: 363601 - DNA, 15 bp, Homo sapiens
aaagataaagtgtca

SEQ ID NO: 363602 - DNA, 15 bp, Homo sapiens
aagataaagtgtcac

SEQ ID NO: 363603 - DNA, 15 bp, Homo sapiens
agataaagtgtcaca

SEQ ID NO: 363604 - DNA, 15 bp, Homo sapiens
gataaagtgtcacag

SEQ ID NO: 363605 - DNA, 15 bp, Homo sapiens
ataaagtgtcacaga

SEQ ID NO: 363606 - DNA, 15 bp, Homo sapiens
taaagtgtcacagag

SEQ ID NO: 363607 - DNA, 15 bp, Homo sapiens
aaagtgtcacagagg

SEQ ID NO: 363608 - DNA, 15 bp, Homo sapiens
aagtgtcacagaggc

SEQ ID NO: 363609 - DNA, 15 bp, Homo sapiens
agtgtcacagaggca

SEQ ID NO: 363610 - DNA, 15 bp, Homo sapiens
gtgtcacagaggcag

SEQ ID NO: 363611 - DNA, 15 bp, Homo sapiens
tgtcacagaggcaga

SEQ ID NO: 363612 - DNA, 15 bp, Homo sapiens
gtcacagaggcagat

SEQ ID NO: 363613 - DNA, 15 bp, Homo sapiens
tcacagaggcagata

SEQ ID NO: 363614 - DNA, 15 bp, Homo sapiens
cacagaggcagatat

SEQ ID NO: 363615 - DNA, 15 bp, Homo sapiens
acagaggcagatatg

SEQ ID NO: 363616 - DNA, 15 bp, Homo sapiens
cagaggcagatatga

SEQ ID NO: 363617 - DNA, 15 bp, Homo sapiens
agaggcagatatgat

SEQ ID NO: 363618 - DNA, 15 bp, Homo sapiens
gaggcagatatgatg

SEQ ID NO: 363619 - DNA, 15 bp, Homo sapiens
aggcagatatgatgc

SEQ ID NO: 363620 - DNA, 15 bp, Homo sapiens
ggcagatatgatgcg

SEQ ID NO: 363621 - DNA, 15 bp, Homo sapiens
gcagatatgatgcgc

SEQ ID NO: 363622 - DNA, 15 bp, Homo sapiens
cagatatgatgcgct

SEQ ID NO: 363623 - DNA, 15 bp, Homo sapiens
agatatgatgcgctg

SEQ ID NO: 363624 - DNA, 15 bp, Homo sapiens
gatatgatgcgctgt

SEQ ID NO: 363625 - DNA, 15 bp, Homo sapiens
atatgatgcgctgtg

SEQ ID NO: 363626 - DNA, 15 bp, Homo sapiens
tatgatgcgctgtgg

SEQ ID NO: 363627 - DNA, 15 bp, Homo sapiens
atgatgcgctgtgga

SEQ ID NO: 363628 - DNA, 15 bp, Homo sapiens
tgatgcgctgtggaa

SEQ ID NO: 363629 - DNA, 15 bp, Homo sapiens
gatgcgctgtggaat

SEQ ID NO: 363630 - DNA, 15 bp, Homo sapiens
atgcgctgtggaatt

SEQ ID NO: 363631 - DNA, 15 bp, Homo sapiens
tgcgctgtggaattt

SEQ ID NO: 363632 - DNA, 15 bp, Homo sapiens
gcgctgtggaattta

SEQ ID NO: 363633 - DNA, 15 bp, Homo sapiens
cgctgtggaatttaa

SEQ ID NO: 363634 - DNA, 15 bp, Homo sapiens
gctgtggaatttaag

SEQ ID NO: 363635 - DNA, 15 bp, Homo sapiens
ctgtggaatttaagt

SEQ ID NO: 363636 - DNA, 15 bp, Homo sapiens
tgtggaatttaagtg

SEQ ID NO: 363637 - DNA, 15 bp, Homo sapiens
gtggaatttaagtgt

SEQ ID NO: 363638 - DNA, 15 bp, Homo sapiens
tggaatttaagtgtc

SEQ ID NO: 363639 - DNA, 15 bp, Homo sapiens
ggaatttaagtgtca

SEQ ID NO: 363640 - DNA, 15 bp, Homo sapiens
gaatttaagtgtcac

SEQ ID NO: 363641 - DNA, 15 bp, Homo sapiens
aatttaagtgtcaca

SEQ ID NO: 363642 - DNA, 15 bp, Homo sapiens
atttaagtgtcacag

SEQ ID NO: 363643 - DNA, 15 bp, Homo sapiens
tttaagtgtcacaga

SEQ ID NO: 363644 - DNA, 15 bp, Homo sapiens
ttaagtgtcacagag

SEQ ID NO: 363645 - DNA, 15 bp, Homo sapiens
taagtgtcacagagg

SEQ ID NO: 363646 - DNA, 15 bp, Homo sapiens
aagtgtcacagagga

SEQ ID NO: 363647 - DNA, 15 bp, Homo sapiens
agtgtcacagaggaa

SEQ ID NO: 363648 - DNA, 15 bp, Homo sapiens
gtgtcacagaggaag

SEQ ID NO: 363649 - DNA, 15 bp, Homo sapiens
tgtcacagaggaagc

SEQ ID NO: 363650 - DNA, 15 bp, Homo sapiens
gtcacagaggaagca

SEQ ID NO: 363651 - DNA, 15 bp, Homo sapiens
tcacagaggaagcat

SEQ ID NO: 363652 - DNA, 15 bp, Homo sapiens
cacagaggaagcatg

SEQ ID NO: 363653 - DNA, 15 bp, Homo sapiens
acagaggaagcatgc

SEQ ID NO: 363654 - DNA, 15 bp, Homo sapiens
cagaggaagcatgcc

SEQ ID NO: 363655 - DNA, 15 bp, Homo sapiens
agaggaagcatgccg

SEQ ID NO: 363656 - DNA, 15 bp, Homo sapiens
gaggaagcatgccga

SEQ ID NO: 363657 - DNA, 15 bp, Homo sapiens
aggaagcatgccgaa

SEQ ID NO: 363658 - DNA, 15 bp, Homo sapiens
ggaagcatgccgaag

SEQ ID NO: 363659 - DNA, 15 bp, Homo sapiens
gaagcatgccgaagc

SEQ ID NO: 363660 - DNA, 15 bp, Homo sapiens
aagcatgccgaagct

SEQ ID NO: 363661 - DNA, 15 bp, Homo sapiens
agcatgccgaagctg

SEQ ID NO: 363662 - DNA, 15 bp, Homo sapiens
gcatgccgaagctga

SEQ ID NO: 363663 - DNA, 15 bp, Homo sapiens
catgccgaagctgag

SEQ ID NO: 363664 - DNA, 15 bp, Homo sapiens
atgccgaagctgagt

SEQ ID NO: 363665 - DNA, 15 bp, Homo sapiens
tgccgaagctgagtt

SEQ ID NO: 363666 - DNA, 15 bp, Homo sapiens
gccgaagctgagttt

SEQ ID NO: 363667 - DNA, 15 bp, Homo sapiens
ccgaagctgagtttt

SEQ ID NO: 363668 - DNA, 15 bp, Homo sapiens
cgaagctgagtttta

SEQ ID NO: 363669 - DNA, 15 bp, Homo sapiens
gaagctgagttttaa

SEQ ID NO: 363670 - DNA, 15 bp, Homo sapiens
aagctgagttttaaa

SEQ ID NO: 363671 - DNA, 15 bp, Homo sapiens
agctgagttttaaag

SEQ ID NO: 363672 - DNA, 15 bp, Homo sapiens
gctgagttttaaagc

SEQ ID NO: 363673 - DNA, 15 bp, Homo sapiens
ctgagttttaaagca

SEQ ID NO: 363674 - DNA, 15 bp, Homo sapiens
tgagttttaaagcat

SEQ ID NO: 363675 - DNA, 15 bp, Homo sapiens
gagttttaaagcatt

SEQ ID NO: 363676 - DNA, 15 bp, Homo sapiens
agttttaaagcattt

SEQ ID NO: 363677 - DNA, 15 bp, Homo sapiens
gttttaaagcattta

SEQ ID NO: 363678 - DNA, 15 bp, Homo sapiens
ttttaaagcatttat

SEQ ID NO: 363679 - DNA, 15 bp, Homo sapiens
tttaaagcatttata

SEQ ID NO: 363680 - DNA, 15 bp, Homo sapiens
ttaaagcatttatag

SEQ ID NO: 363681 - DNA, 15 bp, Homo sapiens
taaagcatttatagc

SEQ ID NO: 363682 - DNA, 15 bp, Homo sapiens
aaagcatttatagca

SEQ ID NO: 363683 - DNA, 15 bp, Homo sapiens
aagcatttatagcaa

SEQ ID NO: 363684 - DNA, 15 bp, Homo sapiens
agcatttatagcaat

SEQ ID NO: 363685 - DNA, 15 bp, Homo sapiens
gcatttatagcaatt

SEQ ID NO: 363686 - DNA, 15 bp, Homo sapiens
catttatagcaattt

SEQ ID NO: 363687 - DNA, 15 bp, Homo sapiens
atttatagcaatttt

SEQ ID NO: 363688 - DNA, 15 bp, Homo sapiens
tttatagcaattttc

SEQ ID NO: 363689 - DNA, 15 bp, Homo sapiens
ttatagcaattttct

SEQ ID NO: 363690 - DNA, 15 bp, Homo sapiens
tatagcaattttcta

SEQ ID NO: 363691 - DNA, 15 bp, Homo sapiens
atagcaattttctat

SEQ ID NO: 363692 - DNA, 15 bp, Homo sapiens
tagcaattttctata

SEQ ID NO: 363693 - DNA, 15 bp, Homo sapiens
agcaattttctataa

SEQ ID NO: 363694 - DNA, 15 bp, Homo sapiens
gcaattttctataaa

SEQ ID NO: 363695 - DNA, 15 bp, Homo sapiens
caattttctataaat

SEQ ID NO: 363696 - DNA, 15 bp, Homo sapiens
aattttctataaatt

SEQ ID NO: 363697 - DNA, 15 bp, Homo sapiens
attttctataaattt

SEQ ID NO: 363698 - DNA, 15 bp, Homo sapiens
ttttctataaatttc

SEQ ID NO: 363699 - DNA, 15 bp, Homo sapiens
tttctataaatttct

SEQ ID NO: 363700 - DNA, 15 bp, Homo sapiens
ttctataaatttctt

SEQ ID NO: 363701 - DNA, 15 bp, Homo sapiens
tctataaatttcttc

SEQ ID NO: 363702 - DNA, 15 bp, Homo sapiens
ctataaatttcttct

SEQ ID NO: 363703 - DNA, 15 bp, Homo sapiens
tataaatttcttcta

SEQ ID NO: 363704 - DNA, 15 bp, Homo sapiens
ataaatttcttctag

SEQ ID NO: 363705 - DNA, 15 bp, Homo sapiens
taaatttcttctagg

SEQ ID NO: 363706 - DNA, 15 bp, Homo sapiens
aaatttcttctaggg

SEQ ID NO: 363707 - DNA, 15 bp, Homo sapiens
aatttcttctaggga

SEQ ID NO: 363708 - DNA, 15 bp, Homo sapiens
atttcttctagggag

SEQ ID NO: 363709 - DNA, 15 bp, Homo sapiens
tttcttctagggagg

SEQ ID NO: 363710 - DNA, 15 bp, Homo sapiens
ttcttctagggaggg

SEQ ID NO: 363711 - DNA, 15 bp, Homo sapiens
tcttctagggagggc

SEQ ID NO: 363712 - DNA, 15 bp, Homo sapiens
cttctagggagggcc

SEQ ID NO: 363713 - DNA, 15 bp, Homo sapiens
ttctagggagggcct

SEQ ID NO: 363714 - DNA, 15 bp, Homo sapiens
tctagggagggcctt

SEQ ID NO: 363715 - DNA, 15 bp, Homo sapiens
ctagggagggccttc

SEQ ID NO: 363716 - DNA, 15 bp, Homo sapiens
tagggagggccttct

SEQ ID NO: 363717 - DNA, 15 bp, Homo sapiens
agggagggccttcta

SEQ ID NO: 363718 - DNA, 15 bp, Homo sapiens
gggagggccttctag

SEQ ID NO: 363719 - DNA, 15 bp, Homo sapiens
ggagggccttctagg

SEQ ID NO: 363720 - DNA, 15 bp, Homo sapiens
gagggccttctaggc

SEQ ID NO: 363721 - DNA, 15 bp, Homo sapiens
agggccttctaggca

SEQ ID NO: 363722 - DNA, 15 bp, Homo sapiens
gggccttctaggcag

SEQ ID NO: 363723 - DNA, 15 bp, Homo sapiens
ggccttctaggcaga

SEQ ID NO: 363724 - DNA, 15 bp, Homo sapiens
gccttctaggcagaa

SEQ ID NO: 363725 - DNA, 15 bp, Homo sapiens
ccttctaggcagaag

SEQ ID NO: 363726 - DNA, 15 bp, Homo sapiens
cttctaggcagaaga

SEQ ID NO: 363727 - DNA, 15 bp, Homo sapiens
ttctaggcagaagaa

SEQ ID NO: 363728 - DNA, 15 bp, Homo sapiens
tctaggcagaagaag

SEQ ID NO: 363729 - DNA, 15 bp, Homo sapiens
ctaggcagaagaagt

SEQ ID NO: 363730 - DNA, 15 bp, Homo sapiens
taggcagaagaagta

SEQ ID NO: 363731 - DNA, 15 bp, Homo sapiens
aggcagaagaagtaa

SEQ ID NO: 363732 - DNA, 15 bp, Homo sapiens
ggcagaagaagtaaa

SEQ ID NO: 363733 - DNA, 15 bp, Homo sapiens
gcagaagaagtaaaa

SEQ ID NO: 363734 - DNA, 15 bp, Homo sapiens
cagaagaagtaaaac

SEQ ID NO: 363735 - DNA, 15 bp, Homo sapiens
agaagaagtaaaaca

SEQ ID NO: 363736 - DNA, 15 bp, Homo sapiens
gaagaagtaaaacag

SEQ ID NO: 363737 - DNA, 15 bp, Homo sapiens
aagaagtaaaacagc

SEQ ID NO: 363738 - DNA, 15 bp, Homo sapiens
agaagtaaaacagca

SEQ ID NO: 363739 - DNA, 15 bp, Homo sapiens
gaagtaaaacagcag

SEQ ID NO: 363740 - DNA, 15 bp, Homo sapiens
aagtaaaacagcaga

SEQ ID NO: 363741 - DNA, 15 bp, Homo sapiens
agtaaaacagcagag

SEQ ID NO: 363742 - DNA, 15 bp, Homo sapiens
gtaaaacagcagagg

SEQ ID NO: 363743 - DNA, 15 bp, Homo sapiens
taaaacagcagaggt

SEQ ID NO: 363744 - DNA, 15 bp, Homo sapiens
aaaacagcagaggtg

SEQ ID NO: 363745 - DNA, 15 bp, Homo sapiens
aaacagcagaggtgg

SEQ ID NO: 363746 - DNA, 15 bp, Homo sapiens
aacagcagaggtggg

SEQ ID NO: 363747 - DNA, 15 bp, Homo sapiens
acagcagaggtggga

SEQ ID NO: 363748 - DNA, 15 bp, Homo sapiens
cagcagaggtgggag

SEQ ID NO: 363749 - DNA, 15 bp, Homo sapiens
agcagaggtgggagg

SEQ ID NO: 363750 - DNA, 15 bp, Homo sapiens
gcagaggtgggaggc

SEQ ID NO: 363751 - DNA, 15 bp, Homo sapiens
cagaggtgggaggca

SEQ ID NO: 363752 - DNA, 15 bp, Homo sapiens
agaggtgggaggcat

SEQ ID NO: 363753 - DNA, 15 bp, Homo sapiens
gaggtgggaggcata

SEQ ID NO: 363754 - DNA, 15 bp, Homo sapiens
aggtgggaggcataa

SEQ ID NO: 363755 - DNA, 15 bp, Homo sapiens
ggtgggaggcataaa

SEQ ID NO: 363756 - DNA, 15 bp, Homo sapiens
gtgggaggcataaat

SEQ ID NO: 363757 - DNA, 15 bp, Homo sapiens
tgggaggcataaata

SEQ ID NO: 363758 - DNA, 15 bp, Homo sapiens
gggaggcataaatag

SEQ ID NO: 363759 - DNA, 15 bp, Homo sapiens
ggaggcataaatagc

SEQ ID NO: 363760 - DNA, 15 bp, Homo sapiens
gaggcataaatagca

SEQ ID NO: 363761 - DNA, 15 bp, Homo sapiens
aggcataaatagcat

SEQ ID NO: 363762 - DNA, 15 bp, Homo sapiens
ggcataaatagcatc

SEQ ID NO: 363763 - DNA, 15 bp, Homo sapiens
gcataaatagcatcg

SEQ ID NO: 363764 - DNA, 15 bp, Homo sapiens
cataaatagcatcgt

SEQ ID NO: 363765 - DNA, 15 bp, Homo sapiens
ataaatagcatcgtc

SEQ ID NO: 363766 - DNA, 15 bp, Homo sapiens
taaatagcatcgtcg

SEQ ID NO: 363767 - DNA, 15 bp, Homo sapiens
aaatagcatcgtcgt

SEQ ID NO: 363768 - DNA, 15 bp, Homo sapiens
aatagcatcgtcgtg

SEQ ID NO: 363769 - DNA, 15 bp, Homo sapiens
atagcatcgtcgtgt

SEQ ID NO: 363770 - DNA, 15 bp, Homo sapiens
tagcatcgtcgtgtg

SEQ ID NO: 363771 - DNA, 15 bp, Homo sapiens
agcatcgtcgtgtga

SEQ ID NO: 363772 - DNA, 15 bp, Homo sapiens
gcatcgtcgtgtgag

SEQ ID NO: 363773 - DNA, 15 bp, Homo sapiens
catcgtcgtgtgaga

SEQ ID NO: 363774 - DNA, 15 bp, Homo sapiens
atcgtcgtgtgagag

SEQ ID NO: 363775 - DNA, 15 bp, Homo sapiens
tcgtcgtgtgagaga

SEQ ID NO: 363776 - DNA, 15 bp, Homo sapiens
cgtcgtgtgagagat

SEQ ID NO: 363777 - DNA, 15 bp, Homo sapiens
gtcgtgtgagagatc

SEQ ID NO: 363778 - DNA, 15 bp, Homo sapiens
tcgtgtgagagatct

SEQ ID NO: 363779 - DNA, 15 bp, Homo sapiens
cgtgtgagagatctg

SEQ ID NO: 363780 - DNA, 15 bp, Homo sapiens
gtgtgagagatctgc

SEQ ID NO: 363781 - DNA, 15 bp, Homo sapiens
tgtgagagatctgca

SEQ ID NO: 363782 - DNA, 15 bp, Homo sapiens
gtgagagatctgcaa

SEQ ID NO: 363783 - DNA, 15 bp, Homo sapiens
tgagagatctgcaaa

SEQ ID NO: 363784 - DNA, 15 bp, Homo sapiens
gagagatctgcaaag

SEQ ID NO: 363785 - DNA, 15 bp, Homo sapiens
agagatctgcaaagg

SEQ ID NO: 363786 - DNA, 15 bp, Homo sapiens
gagatctgcaaagga

SEQ ID NO: 363787 - DNA, 15 bp, Homo sapiens
agatctgcaaaggat

SEQ ID NO: 363788 - DNA, 15 bp, Homo sapiens
gatctgcaaaggatt

SEQ ID NO: 363789 - DNA, 15 bp, Homo sapiens
atctgcaaaggattg

SEQ ID NO: 363790 - DNA, 15 bp, Homo sapiens
tctgcaaaggattga

SEQ ID NO: 363791 - DNA, 15 bp, Homo sapiens
ctgcaaaggattgaa

SEQ ID NO: 363792 - DNA, 15 bp, Homo sapiens
tgcaaaggattgaaa

SEQ ID NO: 363793 - DNA, 15 bp, Homo sapiens
gcaaaggattgaaag

SEQ ID NO: 363794 - DNA, 15 bp, Homo sapiens
caaaggattgaaagg

SEQ ID NO: 363795 - DNA, 15 bp, Homo sapiens
aaaggattgaaagga

SEQ ID NO: 363796 - DNA, 15 bp, Homo sapiens
aaggattgaaaggag

SEQ ID NO: 363797 - DNA, 15 bp, Homo sapiens
aggattgaaaggaga

SEQ ID NO: 363798 - DNA, 15 bp, Homo sapiens
ggattgaaaggagag

SEQ ID NO: 363799 - DNA, 15 bp, Homo sapiens
gattgaaaggagagg

SEQ ID NO: 363800 - DNA, 15 bp, Homo sapiens
attgaaaggagagga

SEQ ID NO: 363801 - DNA, 15 bp, Homo sapiens
ttgaaaggagaggag

SEQ ID NO: 363802 - DNA, 15 bp, Homo sapiens
tgaaaggagaggagg

SEQ ID NO: 363803 - DNA, 15 bp, Homo sapiens
gaaaggagaggaggg

SEQ ID NO: 363804 - DNA, 15 bp, Homo sapiens
aaaggagaggagggt

SEQ ID NO: 363805 - DNA, 15 bp, Homo sapiens
aaggagaggagggtt

SEQ ID NO: 363806 - DNA, 15 bp, Homo sapiens
aggagaggagggttc

SEQ ID NO: 363807 - DNA, 15 bp, Homo sapiens
ggagaggagggttca

SEQ ID NO: 363808 - DNA, 15 bp, Homo sapiens
gagaggagggttcaa

SEQ ID NO: 363809 - DNA, 15 bp, Homo sapiens
agaggagggttcaat

SEQ ID NO: 363810 - DNA, 15 bp, Homo sapiens
gaggagggttcaatg

SEQ ID NO: 363811 - DNA, 15 bp, Homo sapiens
aggagggttcaatga

SEQ ID NO: 363812 - DNA, 15 bp, Homo sapiens
ggagggttcaatgac

SEQ ID NO: 363813 - DNA, 15 bp, Homo sapiens
gagggttcaatgacc

SEQ ID NO: 363814 - DNA, 15 bp, Homo sapiens
agggttcaatgacca

SEQ ID NO: 363815 - DNA, 15 bp, Homo sapiens
gggttcaatgaccag

SEQ ID NO: 363816 - DNA, 15 bp, Homo sapiens
ggttcaatgaccagg

SEQ ID NO: 363817 - DNA, 15 bp, Homo sapiens
gttcaatgaccaggg

SEQ ID NO: 363818 - DNA, 15 bp, Homo sapiens
ttcaatgaccagggg

SEQ ID NO: 363819 - DNA, 15 bp, Homo sapiens
tcaatgaccagggga

SEQ ID NO: 363820 - DNA, 15 bp, Homo sapiens
caatgaccaggggaa

SEQ ID NO: 363821 - DNA, 15 bp, Homo sapiens
aatgaccaggggaag

SEQ ID NO: 363822 - DNA, 15 bp, Homo sapiens
atgaccaggggaagg

SEQ ID NO: 363823 - DNA, 15 bp, Homo sapiens
tgaccaggggaagga

SEQ ID NO: 363824 - DNA, 15 bp, Homo sapiens
gaccaggggaaggat

SEQ ID NO: 363825 - DNA, 15 bp, Homo sapiens
accaggggaaggatt

SEQ ID NO: 363826 - DNA, 15 bp, Homo sapiens
ccaggggaaggattg

SEQ ID NO: 363827 - DNA, 15 bp, Homo sapiens
caggggaaggattgg

SEQ ID NO: 363828 - DNA, 15 bp, Homo sapiens
aggggaaggattgga

SEQ ID NO: 363829 - DNA, 15 bp, Homo sapiens
ggggaaggattggaa

SEQ ID NO: 363830 - DNA, 15 bp, Homo sapiens
gggaaggattggaaa

SEQ ID NO: 363831 - DNA, 15 bp, Homo sapiens
ggaaggattggaaaa

SEQ ID NO: 363832 - DNA, 15 bp, Homo sapiens
gaaggattggaaaat

SEQ ID NO: 363833 - DNA, 15 bp, Homo sapiens
aaggattggaaaatg

SEQ ID NO: 363834 - DNA, 15 bp, Homo sapiens
aggattggaaaatga

SEQ ID NO: 363835 - DNA, 15 bp, Homo sapiens
ggattggaaaatgag

SEQ ID NO: 363836 - DNA, 15 bp, Homo sapiens
gattggaaaatgagg

SEQ ID NO: 363837 - DNA, 15 bp, Homo sapiens
attggaaaatgaggt

SEQ ID NO: 363838 - DNA, 15 bp, Homo sapiens
ttggaaaatgaggtc

SEQ ID NO: 363839 - DNA, 15 bp, Homo sapiens
tggaaaatgaggtcc

SEQ ID NO: 363840 - DNA, 15 bp, Homo sapiens
ggaaaatgaggtccc

SEQ ID NO: 363841 - DNA, 15 bp, Homo sapiens
gaaaatgaggtccca

SEQ ID NO: 363842 - DNA, 15 bp, Homo sapiens
aaaatgaggtcccat

SEQ ID NO: 363843 - DNA, 15 bp, Homo sapiens
aaatgaggtcccata

SEQ ID NO: 363844 - DNA, 15 bp, Homo sapiens
aatgaggtcccataa

SEQ ID NO: 363845 - DNA, 15 bp, Homo sapiens
atgaggtcccataag

SEQ ID NO: 363846 - DNA, 15 bp, Homo sapiens
tgaggtcccataaga

SEQ ID NO: 363847 - DNA, 15 bp, Homo sapiens
gaggtcccataagat

SEQ ID NO: 363848 - DNA, 15 bp, Homo sapiens
aggtcccataagatc

SEQ ID NO: 363849 - DNA, 15 bp, Homo sapiens
ggtcccataagatct

SEQ ID NO: 363850 - DNA, 15 bp, Homo sapiens
gtcccataagatctt

SEQ ID NO: 363851 - DNA, 15 bp, Homo sapiens
tcccataagatctta

SEQ ID NO: 363852 - DNA, 15 bp, Homo sapiens
cccataagatcttat

SEQ ID NO: 363853 - DNA, 15 bp, Homo sapiens
ccataagatcttata

SEQ ID NO: 363854 - DNA, 15 bp, Homo sapiens
cataagatcttatat

SEQ ID NO: 363855 - DNA, 15 bp, Homo sapiens
ataagatcttatatg

SEQ ID NO: 363856 - DNA, 15 bp, Homo sapiens
taagatcttatatgt

SEQ ID NO: 363857 - DNA, 15 bp, Homo sapiens
aagatcttatatgtc

SEQ ID NO: 363858 - DNA, 15 bp, Homo sapiens
agatcttatatgtca

SEQ ID NO: 363859 - DNA, 15 bp, Homo sapiens
gatcttatatgtcat

SEQ ID NO: 363860 - DNA, 15 bp, Homo sapiens
atcttatatgtcatg

SEQ ID NO: 363861 - DNA, 15 bp, Homo sapiens
tcttatatgtcatgc

SEQ ID NO: 363862 - DNA, 15 bp, Homo sapiens
cttatatgtcatgct

SEQ ID NO: 363863 - DNA, 15 bp, Homo sapiens
ttatatgtcatgcta

SEQ ID NO: 363864 - DNA, 15 bp, Homo sapiens
tatatgtcatgctat

SEQ ID NO: 363865 - DNA, 15 bp, Homo sapiens
atatgtcatgctatt

SEQ ID NO: 363866 - DNA, 15 bp, Homo sapiens
tatgtcatgctattc

SEQ ID NO: 363867 - DNA, 15 bp, Homo sapiens
atgtcatgctattca

SEQ ID NO: 363868 - DNA, 15 bp, Homo sapiens
tgtcatgctattcag

SEQ ID NO: 363869 - DNA, 15 bp, Homo sapiens
gtcatgctattcagt

SEQ ID NO: 363870 - DNA, 15 bp, Homo sapiens
tcatgctattcagtt

SEQ ID NO: 363871 - DNA, 15 bp, Homo sapiens
catgctattcagttt

SEQ ID NO: 363872 - DNA, 15 bp, Homo sapiens
atgctattcagtttg

SEQ ID NO: 363873 - DNA, 15 bp, Homo sapiens
tgctattcagtttgc

SEQ ID NO: 363874 - DNA, 15 bp, Homo sapiens
gctattcagtttgca

SEQ ID NO: 363875 - DNA, 15 bp, Homo sapiens
ctattcagtttgcat

SEQ ID NO: 363876 - DNA, 15 bp, Homo sapiens
tattcagtttgcatg

SEQ ID NO: 363877 - DNA, 15 bp, Homo sapiens
attcagtttgcatgg

SEQ ID NO: 363878 - DNA, 15 bp, Homo sapiens
ttcagtttgcatgga

SEQ ID NO: 363879 - DNA, 15 bp, Homo sapiens
tcagtttgcatggag

SEQ ID NO: 363880 - DNA, 15 bp, Homo sapiens
cagtttgcatggagg

SEQ ID NO: 363881 - DNA, 15 bp, Homo sapiens
agtttgcatggaggg

SEQ ID NO: 363882 - DNA, 15 bp, Homo sapiens
gtttgcatggagggt

SEQ ID NO: 363883 - DNA, 15 bp, Homo sapiens
tttgcatggagggtc

SEQ ID NO: 363884 - DNA, 15 bp, Homo sapiens
ttgcatggagggtct

SEQ ID NO: 363885 - DNA, 15 bp, Homo sapiens
tgcatggagggtctt

SEQ ID NO: 363886 - DNA, 15 bp, Homo sapiens
gcatggagggtctta

SEQ ID NO: 363887 - DNA, 15 bp, Homo sapiens
catggagggtcttag

SEQ ID NO: 363888 - DNA, 15 bp, Homo sapiens
atggagggtcttagc

SEQ ID NO: 363889 - DNA, 15 bp, Homo sapiens
tggagggtcttagct

SEQ ID NO: 363890 - DNA, 15 bp, Homo sapiens
ggagggtcttagctt

SEQ ID NO: 363891 - DNA, 15 bp, Homo sapiens
gagggtcttagcttg

SEQ ID NO: 363892 - DNA, 15 bp, Homo sapiens
agggtcttagcttga

SEQ ID NO: 363893 - DNA, 15 bp, Homo sapiens
gggtcttagcttgaa

SEQ ID NO: 363894 - DNA, 15 bp, Homo sapiens
ggtcttagcttgaaa

SEQ ID NO: 363895 - DNA, 15 bp, Homo sapiens
gtcttagcttgaaat

SEQ ID NO: 363896 - DNA, 15 bp, Homo sapiens
tcttagcttgaaatg

SEQ ID NO: 363897 - DNA, 15 bp, Homo sapiens
cttagcttgaaatga

SEQ ID NO: 363898 - DNA, 15 bp, Homo sapiens
ttagcttgaaatgat

SEQ ID NO: 363899 - DNA, 15 bp, Homo sapiens
tagcttgaaatgatt

SEQ ID NO: 363900 - DNA, 15 bp, Homo sapiens
agcttgaaatgattt

SEQ ID NO: 363901 - DNA, 15 bp, Homo sapiens
gcttgaaatgattta

SEQ ID NO: 363902 - DNA, 15 bp, Homo sapiens
cttgaaatgatttat

SEQ ID NO: 363903 - DNA, 15 bp, Homo sapiens
ttgaaatgatttatc

SEQ ID NO: 363904 - DNA, 15 bp, Homo sapiens
tgaaatgatttatct

SEQ ID NO: 363905 - DNA, 15 bp, Homo sapiens
gaaatgatttatctc

SEQ ID NO: 363906 - DNA, 15 bp, Homo sapiens
aaatgatttatctcc

SEQ ID NO: 363907 - DNA, 15 bp, Homo sapiens
aatgatttatctcct

SEQ ID NO: 363908 - DNA, 15 bp, Homo sapiens
atgatttatctccta

SEQ ID NO: 363909 - DNA, 15 bp, Homo sapiens
tgatttatctcctag

SEQ ID NO: 363910 - DNA, 15 bp, Homo sapiens
gatttatctcctaga

SEQ ID NO: 363911 - DNA, 15 bp, Homo sapiens
atttatctcctagac

SEQ ID NO: 363912 - DNA, 15 bp, Homo sapiens
tttatctcctagacc

SEQ ID NO: 363913 - DNA, 15 bp, Homo sapiens
ttatctcctagacct

SEQ ID NO: 363914 - DNA, 15 bp, Homo sapiens
tatctcctagacctt

SEQ ID NO: 363915 - DNA, 15 bp, Homo sapiens
atctcctagaccttt

SEQ ID NO: 363916 - DNA, 15 bp, Homo sapiens
tctcctagaccttta

SEQ ID NO: 363917 - DNA, 15 bp, Homo sapiens
ctcctagacctttat

SEQ ID NO: 363918 - DNA, 15 bp, Homo sapiens
tcctagacctttatt

SEQ ID NO: 363919 - DNA, 15 bp, Homo sapiens
cctagacctttattg

SEQ ID NO: 363920 - DNA, 15 bp, Homo sapiens
ctagacctttattgg

SEQ ID NO: 363921 - DNA, 15 bp, Homo sapiens
tagacctttattggt

SEQ ID NO: 363922 - DNA, 15 bp, Homo sapiens
agacctttattggtt

SEQ ID NO: 363923 - DNA, 15 bp, Homo sapiens
gacctttattggttt

SEQ ID NO: 363924 - DNA, 15 bp, Homo sapiens
acctttattggtttt

SEQ ID NO: 363925 - DNA, 15 bp, Homo sapiens
cctttattggttttt

SEQ ID NO: 363926 - DNA, 15 bp, Homo sapiens
ctttattggtttttt

SEQ ID NO: 363927 - DNA, 15 bp, Homo sapiens
tttattggttttttg

SEQ ID NO: 363928 - DNA, 15 bp, Homo sapiens
ttattggttttttga

SEQ ID NO: 363929 - DNA, 15 bp, Homo sapiens
tattggttttttgag

SEQ ID NO: 363930 - DNA, 15 bp, Homo sapiens
attggttttttgaga

SEQ ID NO: 363931 - DNA, 15 bp, Homo sapiens
ttggttttttgagac

SEQ ID NO: 363932 - DNA, 15 bp, Homo sapiens
tggttttttgagaca

SEQ ID NO: 363933 - DNA, 15 bp, Homo sapiens
ggttttttgagacag

SEQ ID NO: 363934 - DNA, 15 bp, Homo sapiens
ctgtcacccaggcta

SEQ ID NO: 363935 - DNA, 15 bp, Homo sapiens
tgtcacccaggctag

SEQ ID NO: 363936 - DNA, 15 bp, Homo sapiens
gtcacccaggctaga

SEQ ID NO: 363937 - DNA, 15 bp, Homo sapiens
tcacccaggctagag

SEQ ID NO: 363938 - DNA, 15 bp, Homo sapiens
cacccaggctagagt

SEQ ID NO: 363939 - DNA, 15 bp, Homo sapiens
acccaggctagagtg

SEQ ID NO: 363940 - DNA, 15 bp, Homo sapiens
agagtgcagtggcgt

SEQ ID NO: 363941 - DNA, 15 bp, Homo sapiens
aacctctgcctcccc

SEQ ID NO: 363942 - DNA, 15 bp, Homo sapiens
acctctgcctccccg

SEQ ID NO: 363943 - DNA, 15 bp, Homo sapiens
cctctgcctccccgg

SEQ ID NO: 363944 - DNA, 15 bp, Homo sapiens
ctctgcctccccggc

SEQ ID NO: 363945 - DNA, 15 bp, Homo sapiens
tctgcctccccggct

SEQ ID NO: 363946 - DNA, 15 bp, Homo sapiens
ctgcctccccggctc

SEQ ID NO: 363947 - DNA, 15 bp, Homo sapiens
tgcctccccggctca

SEQ ID NO: 363948 - DNA, 15 bp, Homo sapiens
gcctccccggctcaa

SEQ ID NO: 363949 - DNA, 15 bp, Homo sapiens
cctccccggctcaag

SEQ ID NO: 363950 - DNA, 15 bp, Homo sapiens
ctccccggctcaagc

SEQ ID NO: 363951 - DNA, 15 bp, Homo sapiens
tccccggctcaagca

SEQ ID NO: 363952 - DNA, 15 bp, Homo sapiens
ccccggctcaagcaa

SEQ ID NO: 363953 - DNA, 15 bp, Homo sapiens
cccggctcaagcaat

SEQ ID NO: 363954 - DNA, 15 bp, Homo sapiens
ccggctcaagcaatt

SEQ ID NO: 363955 - DNA, 15 bp, Homo sapiens
cggctcaagcaattc

SEQ ID NO: 363956 - DNA, 15 bp, Homo sapiens
ggctcaagcaattct

SEQ ID NO: 363957 - DNA, 15 bp, Homo sapiens
gctcaagcaattctc

SEQ ID NO: 363958 - DNA, 15 bp, Homo sapiens
ctcaagcaattctcg

SEQ ID NO: 363959 - DNA, 15 bp, Homo sapiens
tcaagcaattctcgt

SEQ ID NO: 363960 - DNA, 15 bp, Homo sapiens
caagcaattctcgtg

SEQ ID NO: 363961 - DNA, 15 bp, Homo sapiens
aagcaattctcgtgc

SEQ ID NO: 363962 - DNA, 15 bp, Homo sapiens
agcaattctcgtgcc

SEQ ID NO: 363963 - DNA, 15 bp, Homo sapiens
gcaattctcgtgcct

SEQ ID NO: 363964 - DNA, 15 bp, Homo sapiens
caattctcgtgcctc

SEQ ID NO: 363965 - DNA, 15 bp, Homo sapiens
aattctcgtgcctca

SEQ ID NO: 363966 - DNA, 15 bp, Homo sapiens
tgcctcagcctcctc

SEQ ID NO: 363967 - DNA, 15 bp, Homo sapiens
gcctcagcctcctca

SEQ ID NO: 363968 - DNA, 15 bp, Homo sapiens
cctcagcctcctcag

SEQ ID NO: 363969 - DNA, 15 bp, Homo sapiens
ctcagcctcctcagt

SEQ ID NO: 363970 - DNA, 15 bp, Homo sapiens
tcagcctcctcagta

SEQ ID NO: 363971 - DNA, 15 bp, Homo sapiens
cagcctcctcagtag

SEQ ID NO: 363972 - DNA, 15 bp, Homo sapiens
agcctcctcagtagc

SEQ ID NO: 363973 - DNA, 15 bp, Homo sapiens
gcctcctcagtagct

SEQ ID NO: 363974 - DNA, 15 bp, Homo sapiens
cctcctcagtagctg

SEQ ID NO: 363975 - DNA, 15 bp, Homo sapiens
ctcctcagtagctga

SEQ ID NO: 363976 - DNA, 15 bp, Homo sapiens
tcctcagtagctgag

SEQ ID NO: 363977 - DNA, 15 bp, Homo sapiens
cctcagtagctgaga

SEQ ID NO: 363978 - DNA, 15 bp, Homo sapiens
ctcagtagctgagat

SEQ ID NO: 363979 - DNA, 15 bp, Homo sapiens
tcagtagctgagatg

SEQ ID NO: 363980 - DNA, 15 bp, Homo sapiens
cagtagctgagatga

SEQ ID NO: 363981 - DNA, 15 bp, Homo sapiens
agtagctgagatgac

SEQ ID NO: 363982 - DNA, 15 bp, Homo sapiens
gtagctgagatgaca

SEQ ID NO: 363983 - DNA, 15 bp, Homo sapiens
tagctgagatgacag

SEQ ID NO: 363984 - DNA, 15 bp, Homo sapiens
agctgagatgacagg

SEQ ID NO: 363985 - DNA, 15 bp, Homo sapiens
gctgagatgacaggt

SEQ ID NO: 363986 - DNA, 15 bp, Homo sapiens
ctgagatgacaggtg

SEQ ID NO: 363987 - DNA, 15 bp, Homo sapiens
tgagatgacaggtgc

SEQ ID NO: 363988 - DNA, 15 bp, Homo sapiens
gagatgacaggtgcc

SEQ ID NO: 363989 - DNA, 15 bp, Homo sapiens
agatgacaggtgcct

SEQ ID NO: 363990 - DNA, 15 bp, Homo sapiens
gatgacaggtgcctg

SEQ ID NO: 363991 - DNA, 15 bp, Homo sapiens
atgacaggtgcctgt

SEQ ID NO: 363992 - DNA, 15 bp, Homo sapiens
tgacaggtgcctgtc

SEQ ID NO: 363993 - DNA, 15 bp, Homo sapiens
gacaggtgcctgtca

SEQ ID NO: 363994 - DNA, 15 bp, Homo sapiens
acaggtgcctgtcac

SEQ ID NO: 363995 - DNA, 15 bp, Homo sapiens
caggtgcctgtcacc

SEQ ID NO: 363996 - DNA, 15 bp, Homo sapiens
aggtgcctgtcacca

SEQ ID NO: 363997 - DNA, 15 bp, Homo sapiens
ggtgcctgtcaccat

SEQ ID NO: 363998 - DNA, 15 bp, Homo sapiens
gtgcctgtcaccatg

SEQ ID NO: 363999 - DNA, 15 bp, Homo sapiens
tgcctgtcaccatgc

SEQ ID NO: 364000 - DNA, 15 bp, Homo sapiens
gcctgtcaccatgcc

SEQ ID NO: 364001 - DNA, 15 bp, Homo sapiens
cctgtcaccatgcct

SEQ ID NO: 364002 - DNA, 15 bp, Homo sapiens
ctgtcaccatgcctg

SEQ ID NO: 364003 - DNA, 15 bp, Homo sapiens
tgtcaccatgcctgg

SEQ ID NO: 364004 - DNA, 15 bp, Homo sapiens
gtcaccatgcctggc

SEQ ID NO: 364005 - DNA, 15 bp, Homo sapiens
tcaccatgcctggct

SEQ ID NO: 364006 - DNA, 15 bp, Homo sapiens
gcctggctaattttc

SEQ ID NO: 364007 - DNA, 15 bp, Homo sapiens
cctggctaattttca

SEQ ID NO: 364008 - DNA, 15 bp, Homo sapiens
ctggctaattttcat

SEQ ID NO: 364009 - DNA, 15 bp, Homo sapiens
tggctaattttcata

SEQ ID NO: 364010 - DNA, 15 bp, Homo sapiens
ggctaattttcatat

SEQ ID NO: 364011 - DNA, 15 bp, Homo sapiens
gctaattttcatatt

SEQ ID NO: 364012 - DNA, 15 bp, Homo sapiens
attttcatattttta

SEQ ID NO: 364013 - DNA, 15 bp, Homo sapiens
ttttcatatttttag

SEQ ID NO: 364014 - DNA, 15 bp, Homo sapiens
tttcatatttttagt

SEQ ID NO: 364015 - DNA, 15 bp, Homo sapiens
ttcatatttttagta

SEQ ID NO: 364016 - DNA, 15 bp, Homo sapiens
tcatatttttagtag

SEQ ID NO: 364017 - DNA, 15 bp, Homo sapiens
catatttttagtaga

SEQ ID NO: 364018 - DNA, 15 bp, Homo sapiens
aacttcaccttaggt

SEQ ID NO: 364019 - DNA, 15 bp, Homo sapiens
acttcaccttaggtt

SEQ ID NO: 364020 - DNA, 15 bp, Homo sapiens
cttcaccttaggttg

SEQ ID NO: 364021 - DNA, 15 bp, Homo sapiens
ttcaccttaggttgg

SEQ ID NO: 364022 - DNA, 15 bp, Homo sapiens
tcaccttaggttggt

SEQ ID NO: 364023 - DNA, 15 bp, Homo sapiens
caccttaggttggta

SEQ ID NO: 364024 - DNA, 15 bp, Homo sapiens
accttaggttggtag

SEQ ID NO: 364025 - DNA, 15 bp, Homo sapiens
ccttaggttggtagt

SEQ ID NO: 364026 - DNA, 15 bp, Homo sapiens
cttaggttggtagtc

SEQ ID NO: 364027 - DNA, 15 bp, Homo sapiens
ttaggttggtagtct

SEQ ID NO: 364028 - DNA, 15 bp, Homo sapiens
taggttggtagtcta

SEQ ID NO: 364029 - DNA, 15 bp, Homo sapiens
aggttggtagtctat

SEQ ID NO: 364030 - DNA, 15 bp, Homo sapiens
ggttggtagtctata

SEQ ID NO: 364031 - DNA, 15 bp, Homo sapiens
gttggtagtctatat

SEQ ID NO: 364032 - DNA, 15 bp, Homo sapiens
ttggtagtctatatt

SEQ ID NO: 364033 - DNA, 15 bp, Homo sapiens
tggtagtctatatta

SEQ ID NO: 364034 - DNA, 15 bp, Homo sapiens
ggtagtctatattaa

SEQ ID NO: 364035 - DNA, 15 bp, Homo sapiens
gtagtctatattaaa

SEQ ID NO: 364036 - DNA, 15 bp, Homo sapiens
tagtctatattaaat

SEQ ID NO: 364037 - DNA, 15 bp, Homo sapiens
agtctatattaaatt

SEQ ID NO: 364038 - DNA, 15 bp, Homo sapiens
gtctatattaaattg

SEQ ID NO: 364039 - DNA, 15 bp, Homo sapiens
tctatattaaattgg

SEQ ID NO: 364040 - DNA, 15 bp, Homo sapiens
ctatattaaattggg

SEQ ID NO: 364041 - DNA, 15 bp, Homo sapiens
tatattaaattggga

SEQ ID NO: 364042 - DNA, 15 bp, Homo sapiens
atattaaattgggac

SEQ ID NO: 364043 - DNA, 15 bp, Homo sapiens
tattaaattgggacc

SEQ ID NO: 364044 - DNA, 15 bp, Homo sapiens
attaaattgggacca

SEQ ID NO: 364045 - DNA, 15 bp, Homo sapiens
ttaaattgggaccat

SEQ ID NO: 364046 - DNA, 15 bp, Homo sapiens
taaattgggaccatt

SEQ ID NO: 364047 - DNA, 15 bp, Homo sapiens
aaattgggaccattt

SEQ ID NO: 364048 - DNA, 15 bp, Homo sapiens
aattgggaccatttt

SEQ ID NO: 364049 - DNA, 15 bp, Homo sapiens
attgggaccattttg

SEQ ID NO: 364050 - DNA, 15 bp, Homo sapiens
ttgggaccattttgg

SEQ ID NO: 364051 - DNA, 15 bp, Homo sapiens
tgggaccattttggg

SEQ ID NO: 364052 - DNA, 15 bp, Homo sapiens
gggaccattttgggt

SEQ ID NO: 364053 - DNA, 15 bp, Homo sapiens
ggaccattttgggta

SEQ ID NO: 364054 - DNA, 15 bp, Homo sapiens
gaccattttgggtag

SEQ ID NO: 364055 - DNA, 15 bp, Homo sapiens
accattttgggtaga

SEQ ID NO: 364056 - DNA, 15 bp, Homo sapiens
ccattttgggtagat

SEQ ID NO: 364057 - DNA, 15 bp, Homo sapiens
cattttgggtagatt

SEQ ID NO: 364058 - DNA, 15 bp, Homo sapiens
attttgggtagattg

SEQ ID NO: 364059 - DNA, 15 bp, Homo sapiens
ttttgggtagattgt

SEQ ID NO: 364060 - DNA, 15 bp, Homo sapiens
tttgggtagattgta

SEQ ID NO: 364061 - DNA, 15 bp, Homo sapiens
ttgggtagattgtat

SEQ ID NO: 364062 - DNA, 15 bp, Homo sapiens
tgggtagattgtata

SEQ ID NO: 364063 - DNA, 15 bp, Homo sapiens
gggtagattgtatat

SEQ ID NO: 364064 - DNA, 15 bp, Homo sapiens
ggtagattgtatata

SEQ ID NO: 364065 - DNA, 15 bp, Homo sapiens
gtagattgtatatat

SEQ ID NO: 364066 - DNA, 15 bp, Homo sapiens
tagattgtatatatg

SEQ ID NO: 364067 - DNA, 15 bp, Homo sapiens
agattgtatatatgt

SEQ ID NO: 364068 - DNA, 15 bp, Homo sapiens
gattgtatatatgtt

SEQ ID NO: 364069 - DNA, 15 bp, Homo sapiens
attgtatatatgttg

SEQ ID NO: 364070 - DNA, 15 bp, Homo sapiens
ttgtatatatgttgt

SEQ ID NO: 364071 - DNA, 15 bp, Homo sapiens
tgtatatatgttgtt

SEQ ID NO: 364072 - DNA, 15 bp, Homo sapiens
gtatatatgttgtta

SEQ ID NO: 364073 - DNA, 15 bp, Homo sapiens
tatatatgttgttaa

SEQ ID NO: 364074 - DNA, 15 bp, Homo sapiens
atatatgttgttaac

SEQ ID NO: 364075 - DNA, 15 bp, Homo sapiens
tatatgttgttaaca

SEQ ID NO: 364076 - DNA, 15 bp, Homo sapiens
atatgttgttaacaa

SEQ ID NO: 364077 - DNA, 15 bp, Homo sapiens
tatgttgttaacaaa

SEQ ID NO: 364078 - DNA, 15 bp, Homo sapiens
atgttgttaacaaag

SEQ ID NO: 364079 - DNA, 15 bp, Homo sapiens
tgttgttaacaaagt

SEQ ID NO: 364080 - DNA, 15 bp, Homo sapiens
gttgttaacaaagta

SEQ ID NO: 364081 - DNA, 15 bp, Homo sapiens
ttgttaacaaagtaa

SEQ ID NO: 364082 - DNA, 15 bp, Homo sapiens
tgttaacaaagtaat

SEQ ID NO: 364083 - DNA, 15 bp, Homo sapiens
gttaacaaagtaatt

SEQ ID NO: 364084 - DNA, 15 bp, Homo sapiens
ttaacaaagtaattg

SEQ ID NO: 364085 - DNA, 15 bp, Homo sapiens
taacaaagtaattga

SEQ ID NO: 364086 - DNA, 15 bp, Homo sapiens
aacaaagtaattgag

SEQ ID NO: 364087 - DNA, 15 bp, Homo sapiens
acaaagtaattgaga

SEQ ID NO: 364088 - DNA, 15 bp, Homo sapiens
caaagtaattgagaa

SEQ ID NO: 364089 - DNA, 15 bp, Homo sapiens
aaagtaattgagaat

SEQ ID NO: 364090 - DNA, 15 bp, Homo sapiens
aagtaattgagaatt

SEQ ID NO: 364091 - DNA, 15 bp, Homo sapiens
agtaattgagaatta

SEQ ID NO: 364092 - DNA, 15 bp, Homo sapiens
gtaattgagaattat

SEQ ID NO: 364093 - DNA, 15 bp, Homo sapiens
taattgagaattatc

SEQ ID NO: 364094 - DNA, 15 bp, Homo sapiens
aattgagaattatca

SEQ ID NO: 364095 - DNA, 15 bp, Homo sapiens
attgagaattatcac

SEQ ID NO: 364096 - DNA, 15 bp, Homo sapiens
ttgagaattatcaca

SEQ ID NO: 364097 - DNA, 15 bp, Homo sapiens
tgagaattatcacac

SEQ ID NO: 364098 - DNA, 15 bp, Homo sapiens
gagaattatcacaca

SEQ ID NO: 364099 - DNA, 15 bp, Homo sapiens
agaattatcacacag

SEQ ID NO: 364100 - DNA, 15 bp, Homo sapiens
gaattatcacacagt

SEQ ID NO: 364101 - DNA, 15 bp, Homo sapiens
aattatcacacagtt

SEQ ID NO: 364102 - DNA, 15 bp, Homo sapiens
attatcacacagttc

SEQ ID NO: 364103 - DNA, 15 bp, Homo sapiens
ttatcacacagttca

SEQ ID NO: 364104 - DNA, 15 bp, Homo sapiens
tatcacacagttcaa

SEQ ID NO: 364105 - DNA, 15 bp, Homo sapiens
atcacacagttcaat

SEQ ID NO: 364106 - DNA, 15 bp, Homo sapiens
tcacacagttcaatt

SEQ ID NO: 364107 - DNA, 15 bp, Homo sapiens
cacacagttcaattt

SEQ ID NO: 364108 - DNA, 15 bp, Homo sapiens
acacagttcaatttg

SEQ ID NO: 364109 - DNA, 15 bp, Homo sapiens
cacagttcaatttgt

SEQ ID NO: 364110 - DNA, 15 bp, Homo sapiens
acagttcaatttgtt

SEQ ID NO: 364111 - DNA, 15 bp, Homo sapiens
cagttcaatttgttt

SEQ ID NO: 364112 - DNA, 15 bp, Homo sapiens
agttcaatttgtttt

SEQ ID NO: 364113 - DNA, 15 bp, Homo sapiens
gttcaatttgttttt

SEQ ID NO: 364114 - DNA, 15 bp, Homo sapiens
ttcaatttgtttttg

SEQ ID NO: 364115 - DNA, 15 bp, Homo sapiens
tcaatttgtttttgt

SEQ ID NO: 364116 - DNA, 15 bp, Homo sapiens
caatttgtttttgta

SEQ ID NO: 364117 - DNA, 15 bp, Homo sapiens
aatttgtttttgtat

SEQ ID NO: 364118 - DNA, 15 bp, Homo sapiens
atttgtttttgtatt

SEQ ID NO: 364119 - DNA, 15 bp, Homo sapiens
tttgtttttgtattg

SEQ ID NO: 364120 - DNA, 15 bp, Homo sapiens
ttgtttttgtattga

SEQ ID NO: 364121 - DNA, 15 bp, Homo sapiens
tgtttttgtattgag

SEQ ID NO: 364122 - DNA, 15 bp, Homo sapiens
gtttttgtattgagt

SEQ ID NO: 364123 - DNA, 15 bp, Homo sapiens
tttttgtattgagtg

SEQ ID NO: 364124 - DNA, 15 bp, Homo sapiens
ttttgtattgagtgc

SEQ ID NO: 364125 - DNA, 15 bp, Homo sapiens
tttgtattgagtgcc

SEQ ID NO: 364126 - DNA, 15 bp, Homo sapiens
ttgtattgagtgcct

SEQ ID NO: 364127 - DNA, 15 bp, Homo sapiens
tgtattgagtgcctg

SEQ ID NO: 364128 - DNA, 15 bp, Homo sapiens
gtattgagtgcctgt

SEQ ID NO: 364129 - DNA, 15 bp, Homo sapiens
tattgagtgcctgta

SEQ ID NO: 364130 - DNA, 15 bp, Homo sapiens
attgagtgcctgtag

SEQ ID NO: 364131 - DNA, 15 bp, Homo sapiens
ttgagtgcctgtagt

SEQ ID NO: 364132 - DNA, 15 bp, Homo sapiens
tgagtgcctgtagtt

SEQ ID NO: 364133 - DNA, 15 bp, Homo sapiens
gagtgcctgtagtta

SEQ ID NO: 364134 - DNA, 15 bp, Homo sapiens
agtgcctgtagttaa

SEQ ID NO: 364135 - DNA, 15 bp, Homo sapiens
gtgcctgtagttaag

SEQ ID NO: 364136 - DNA, 15 bp, Homo sapiens
tgcctgtagttaagt

SEQ ID NO: 364137 - DNA, 15 bp, Homo sapiens
gcctgtagttaagta

SEQ ID NO: 364138 - DNA, 15 bp, Homo sapiens
cctgtagttaagtat

SEQ ID NO: 364139 - DNA, 15 bp, Homo sapiens
ctgtagttaagtatt

SEQ ID NO: 364140 - DNA, 15 bp, Homo sapiens
tgtagttaagtattt

SEQ ID NO: 364141 - DNA, 15 bp, Homo sapiens
gtagttaagtatttg

SEQ ID NO: 364142 - DNA, 15 bp, Homo sapiens
tagttaagtatttgc

SEQ ID NO: 364143 - DNA, 15 bp, Homo sapiens
agttaagtatttgca

SEQ ID NO: 364144 - DNA, 15 bp, Homo sapiens
gttaagtatttgcat

SEQ ID NO: 364145 - DNA, 15 bp, Homo sapiens
ttaagtatttgcata

SEQ ID NO: 364146 - DNA, 15 bp, Homo sapiens
taagtatttgcatag

SEQ ID NO: 364147 - DNA, 15 bp, Homo sapiens
aagtatttgcatagt

SEQ ID NO: 364148 - DNA, 15 bp, Homo sapiens
agtatttgcatagtt

SEQ ID NO: 364149 - DNA, 15 bp, Homo sapiens
gtatttgcatagttc

SEQ ID NO: 364150 - DNA, 15 bp, Homo sapiens
tatttgcatagttca

SEQ ID NO: 364151 - DNA, 15 bp, Homo sapiens
atttgcatagttcag

SEQ ID NO: 364152 - DNA, 15 bp, Homo sapiens
tttgcatagttcagc

SEQ ID NO: 364153 - DNA, 15 bp, Homo sapiens
ttgcatagttcagca

SEQ ID NO: 364154 - DNA, 15 bp, Homo sapiens
tgcatagttcagcaa

SEQ ID NO: 364155 - DNA, 15 bp, Homo sapiens
gcatagttcagcaac

SEQ ID NO: 364156 - DNA, 15 bp, Homo sapiens
catagttcagcaacc

SEQ ID NO: 364157 - DNA, 15 bp, Homo sapiens
atagttcagcaacct

SEQ ID NO: 364158 - DNA, 15 bp, Homo sapiens
tagttcagcaacctg

SEQ ID NO: 364159 - DNA, 15 bp, Homo sapiens
agttcagcaacctgc

SEQ ID NO: 364160 - DNA, 15 bp, Homo sapiens
gttcagcaacctgca

SEQ ID NO: 364161 - DNA, 15 bp, Homo sapiens
ttcagcaacctgcag

SEQ ID NO: 364162 - DNA, 15 bp, Homo sapiens
tcagcaacctgcaga

SEQ ID NO: 364163 - DNA, 15 bp, Homo sapiens
cagcaacctgcagag

SEQ ID NO: 364164 - DNA, 15 bp, Homo sapiens
agcaacctgcagagt

SEQ ID NO: 364165 - DNA, 15 bp, Homo sapiens
gcaacctgcagagtt

SEQ ID NO: 364166 - DNA, 15 bp, Homo sapiens
caacctgcagagtta

SEQ ID NO: 364167 - DNA, 15 bp, Homo sapiens
aacctgcagagttat

SEQ ID NO: 364168 - DNA, 15 bp, Homo sapiens
acctgcagagttatt

SEQ ID NO: 364169 - DNA, 15 bp, Homo sapiens
cctgcagagttattt

SEQ ID NO: 364170 - DNA, 15 bp, Homo sapiens
ctgcagagttatttc

SEQ ID NO: 364171 - DNA, 15 bp, Homo sapiens
tgcagagttatttct

SEQ ID NO: 364172 - DNA, 15 bp, Homo sapiens
gcagagttatttctt

SEQ ID NO: 364173 - DNA, 15 bp, Homo sapiens
cagagttatttcttc

SEQ ID NO: 364174 - DNA, 15 bp, Homo sapiens
agagttatttcttcc

SEQ ID NO: 364175 - DNA, 15 bp, Homo sapiens
gagttatttcttccc

SEQ ID NO: 364176 - DNA, 15 bp, Homo sapiens
agttatttcttccct

SEQ ID NO: 364177 - DNA, 15 bp, Homo sapiens
gttatttcttccctt

SEQ ID NO: 364178 - DNA, 15 bp, Homo sapiens
ttatttcttcccttt

SEQ ID NO: 364179 - DNA, 15 bp, Homo sapiens
tatttcttccctttt

SEQ ID NO: 364180 - DNA, 15 bp, Homo sapiens
atttcttcccttttt

SEQ ID NO: 364181 - DNA, 15 bp, Homo sapiens
tttcttccctttttt

SEQ ID NO: 364182 - DNA, 15 bp, Homo sapiens
ttcttcccttttttg

SEQ ID NO: 364183 - DNA, 15 bp, Homo sapiens
tcttcccttttttgg

SEQ ID NO: 364184 - DNA, 15 bp, Homo sapiens
cttcccttttttgga

SEQ ID NO: 364185 - DNA, 15 bp, Homo sapiens
ttcccttttttggag

SEQ ID NO: 364186 - DNA, 15 bp, Homo sapiens
tcccttttttggaga

SEQ ID NO: 364187 - DNA, 15 bp, Homo sapiens
cccttttttggagac

SEQ ID NO: 364188 - DNA, 15 bp, Homo sapiens
ccttttttggagaca

SEQ ID NO: 364189 - DNA, 15 bp, Homo sapiens
cttttttggagacaa

SEQ ID NO: 364190 - DNA, 15 bp, Homo sapiens
ttttttggagacaag

SEQ ID NO: 364191 - DNA, 15 bp, Homo sapiens
tttttggagacaagg

SEQ ID NO: 364192 - DNA, 15 bp, Homo sapiens
ttttggagacaaggt

SEQ ID NO: 364193 - DNA, 15 bp, Homo sapiens
tttggagacaaggtc

SEQ ID NO: 364194 - DNA, 15 bp, Homo sapiens
ttggagacaaggtct

SEQ ID NO: 364195 - DNA, 15 bp, Homo sapiens
tggagacaaggtctt

SEQ ID NO: 364196 - DNA, 15 bp, Homo sapiens
ggagacaaggtcttg

SEQ ID NO: 364197 - DNA, 15 bp, Homo sapiens
gagacaaggtcttgt

SEQ ID NO: 364198 - DNA, 15 bp, Homo sapiens
agacaaggtcttgtt

SEQ ID NO: 364199 - DNA, 15 bp, Homo sapiens
gacaaggtcttgttc

SEQ ID NO: 364200 - DNA, 15 bp, Homo sapiens
acaaggtcttgttct

SEQ ID NO: 364201 - DNA, 15 bp, Homo sapiens
caaggtcttgttctg

SEQ ID NO: 364202 - DNA, 15 bp, Homo sapiens
aaggtcttgttctga

SEQ ID NO: 364203 - DNA, 15 bp, Homo sapiens
aggtcttgttctgat

SEQ ID NO: 364204 - DNA, 15 bp, Homo sapiens
ggtcttgttctgata

SEQ ID NO: 364205 - DNA, 15 bp, Homo sapiens
gtcttgttctgatac

SEQ ID NO: 364206 - DNA, 15 bp, Homo sapiens
tcttgttctgatacc

SEQ ID NO: 364207 - DNA, 15 bp, Homo sapiens
cttgttctgataccc

SEQ ID NO: 364208 - DNA, 15 bp, Homo sapiens
ttgttctgataccca

SEQ ID NO: 364209 - DNA, 15 bp, Homo sapiens
tgttctgatacccag

SEQ ID NO: 364210 - DNA, 15 bp, Homo sapiens
gttctgatacccagg

SEQ ID NO: 364211 - DNA, 15 bp, Homo sapiens
ttctgatacccaggc

SEQ ID NO: 364212 - DNA, 15 bp, Homo sapiens
tctgatacccaggct

SEQ ID NO: 364213 - DNA, 15 bp, Homo sapiens
ctgatacccaggctg

SEQ ID NO: 364214 - DNA, 15 bp, Homo sapiens
tgatacccaggctgg

SEQ ID NO: 364215 - DNA, 15 bp, Homo sapiens
gatacccaggctgga

SEQ ID NO: 364216 - DNA, 15 bp, Homo sapiens
atacccaggctggag

SEQ ID NO: 364217 - DNA, 15 bp, Homo sapiens
ggagtgcaatggtgc

SEQ ID NO: 364218 - DNA, 15 bp, Homo sapiens
gagtgcaatggtgca

SEQ ID NO: 364219 - DNA, 15 bp, Homo sapiens
agtgcaatggtgcaa

SEQ ID NO: 364220 - DNA, 15 bp, Homo sapiens
gtgcaatggtgcaat

SEQ ID NO: 364221 - DNA, 15 bp, Homo sapiens
tgcaatggtgcaatc

SEQ ID NO: 364222 - DNA, 15 bp, Homo sapiens
gcaatggtgcaatcg

SEQ ID NO: 364223 - DNA, 15 bp, Homo sapiens
caatggtgcaatcgt

SEQ ID NO: 364224 - DNA, 15 bp, Homo sapiens
aatggtgcaatcgta

SEQ ID NO: 364225 - DNA, 15 bp, Homo sapiens
atggtgcaatcgtag

SEQ ID NO: 364226 - DNA, 15 bp, Homo sapiens
tggtgcaatcgtagc

SEQ ID NO: 364227 - DNA, 15 bp, Homo sapiens
ggtgcaatcgtagct

SEQ ID NO: 364228 - DNA, 15 bp, Homo sapiens
gtgcaatcgtagctc

SEQ ID NO: 364229 - DNA, 15 bp, Homo sapiens
tgcaatcgtagctca

SEQ ID NO: 364230 - DNA, 15 bp, Homo sapiens
gcaatcgtagctcac

SEQ ID NO: 364231 - DNA, 15 bp, Homo sapiens
caatcgtagctcact

SEQ ID NO: 364232 - DNA, 15 bp, Homo sapiens
aatcgtagctcactg

SEQ ID NO: 364233 - DNA, 15 bp, Homo sapiens
atcgtagctcactgc

SEQ ID NO: 364234 - DNA, 15 bp, Homo sapiens
tcgtagctcactgca

SEQ ID NO: 364235 - DNA, 15 bp, Homo sapiens
cgtagctcactgcat

SEQ ID NO: 364236 - DNA, 15 bp, Homo sapiens
gtagctcactgcatc

SEQ ID NO: 364237 - DNA, 15 bp, Homo sapiens
tagctcactgcatcc

SEQ ID NO: 364238 - DNA, 15 bp, Homo sapiens
agctcactgcatcct

SEQ ID NO: 364239 - DNA, 15 bp, Homo sapiens
gctcactgcatcctt

SEQ ID NO: 364240 - DNA, 15 bp, Homo sapiens
ctcactgcatccttg

SEQ ID NO: 364241 - DNA, 15 bp, Homo sapiens
tcactgcatccttga

SEQ ID NO: 364242 - DNA, 15 bp, Homo sapiens
cactgcatccttgag

SEQ ID NO: 364243 - DNA, 15 bp, Homo sapiens
actgcatccttgagc

SEQ ID NO: 364244 - DNA, 15 bp, Homo sapiens
ctgcatccttgagcc

SEQ ID NO: 364245 - DNA, 15 bp, Homo sapiens
tgcatccttgagccc

SEQ ID NO: 364246 - DNA, 15 bp, Homo sapiens
gcatccttgagcccc

SEQ ID NO: 364247 - DNA, 15 bp, Homo sapiens
catccttgagcccct

SEQ ID NO: 364248 - DNA, 15 bp, Homo sapiens
atccttgagcccctg

SEQ ID NO: 364249 - DNA, 15 bp, Homo sapiens
tccttgagcccctgg

SEQ ID NO: 364250 - DNA, 15 bp, Homo sapiens
ccttgagcccctggg

SEQ ID NO: 364251 - DNA, 15 bp, Homo sapiens
cttgagcccctgggc

SEQ ID NO: 364252 - DNA, 15 bp, Homo sapiens
ttgagcccctgggct

SEQ ID NO: 364253 - DNA, 15 bp, Homo sapiens
tgagcccctgggctc

SEQ ID NO: 364254 - DNA, 15 bp, Homo sapiens
gagcccctgggctca

SEQ ID NO: 364255 - DNA, 15 bp, Homo sapiens
agcccctgggctcaa

SEQ ID NO: 364256 - DNA, 15 bp, Homo sapiens
gcccctgggctcaag

SEQ ID NO: 364257 - DNA, 15 bp, Homo sapiens
cccctgggctcaagc

SEQ ID NO: 364258 - DNA, 15 bp, Homo sapiens
ccctgggctcaagca

SEQ ID NO: 364259 - DNA, 15 bp, Homo sapiens
ctcaagcaatcctct

SEQ ID NO: 364260 - DNA, 15 bp, Homo sapiens
tcaagcaatcctctc

SEQ ID NO: 364261 - DNA, 15 bp, Homo sapiens
caagcaatcctctca

SEQ ID NO: 364262 - DNA, 15 bp, Homo sapiens
aagcaatcctctcac

SEQ ID NO: 364263 - DNA, 15 bp, Homo sapiens
agcaatcctctcacc

SEQ ID NO: 364264 - DNA, 15 bp, Homo sapiens
gcaatcctctcaccc

SEQ ID NO: 364265 - DNA, 15 bp, Homo sapiens
caatcctctcaccct

SEQ ID NO: 364266 - DNA, 15 bp, Homo sapiens
aatcctctcacccta

SEQ ID NO: 364267 - DNA, 15 bp, Homo sapiens
atcctctcaccctag

SEQ ID NO: 364268 - DNA, 15 bp, Homo sapiens
tcctctcaccctagt

SEQ ID NO: 364269 - DNA, 15 bp, Homo sapiens
cctctcaccctagtc

SEQ ID NO: 364270 - DNA, 15 bp, Homo sapiens
ctctcaccctagtct

SEQ ID NO: 364271 - DNA, 15 bp, Homo sapiens
tctcaccctagtctt

SEQ ID NO: 364272 - DNA, 15 bp, Homo sapiens
ctcaccctagtcttc

SEQ ID NO: 364273 - DNA, 15 bp, Homo sapiens
tcaccctagtcttct

SEQ ID NO: 364274 - DNA, 15 bp, Homo sapiens
caccctagtcttctg

SEQ ID NO: 364275 - DNA, 15 bp, Homo sapiens
accctagtcttctga

SEQ ID NO: 364276 - DNA, 15 bp, Homo sapiens
ccctagtcttctgag

SEQ ID NO: 364277 - DNA, 15 bp, Homo sapiens
cctagtcttctgagt

SEQ ID NO: 364278 - DNA, 15 bp, Homo sapiens
ctagtcttctgagta

SEQ ID NO: 364279 - DNA, 15 bp, Homo sapiens
tagtcttctgagtag

SEQ ID NO: 364280 - DNA, 15 bp, Homo sapiens
agtcttctgagtagt

SEQ ID NO: 364281 - DNA, 15 bp, Homo sapiens
gtcttctgagtagtt

SEQ ID NO: 364282 - DNA, 15 bp, Homo sapiens
tcttctgagtagttg

SEQ ID NO: 364283 - DNA, 15 bp, Homo sapiens
cttctgagtagttgg

SEQ ID NO: 364284 - DNA, 15 bp, Homo sapiens
ttctgagtagttggg

SEQ ID NO: 364285 - DNA, 15 bp, Homo sapiens
tctgagtagttgggg

SEQ ID NO: 364286 - DNA, 15 bp, Homo sapiens
ctgagtagttggggc

SEQ ID NO: 364287 - DNA, 15 bp, Homo sapiens
tgagtagttggggct

SEQ ID NO: 364288 - DNA, 15 bp, Homo sapiens
gagtagttggggctg

SEQ ID NO: 364289 - DNA, 15 bp, Homo sapiens
agtagttggggctgc

SEQ ID NO: 364290 - DNA, 15 bp, Homo sapiens
gtagttggggctgca

SEQ ID NO: 364291 - DNA, 15 bp, Homo sapiens
tagttggggctgcaa

SEQ ID NO: 364292 - DNA, 15 bp, Homo sapiens
agttggggctgcaag

SEQ ID NO: 364293 - DNA, 15 bp, Homo sapiens
gttggggctgcaagt

SEQ ID NO: 364294 - DNA, 15 bp, Homo sapiens
ttggggctgcaagtg

SEQ ID NO: 364295 - DNA, 15 bp, Homo sapiens
tggggctgcaagtgt

SEQ ID NO: 364296 - DNA, 15 bp, Homo sapiens
ggggctgcaagtgtg

SEQ ID NO: 364297 - DNA, 15 bp, Homo sapiens
gggctgcaagtgtgt

SEQ ID NO: 364298 - DNA, 15 bp, Homo sapiens
ggctgcaagtgtgtg

SEQ ID NO: 364299 - DNA, 15 bp, Homo sapiens
gctgcaagtgtgtgc

SEQ ID NO: 364300 - DNA, 15 bp, Homo sapiens
ctgcaagtgtgtgct

SEQ ID NO: 364301 - DNA, 15 bp, Homo sapiens
tgcaagtgtgtgcta

SEQ ID NO: 364302 - DNA, 15 bp, Homo sapiens
gcaagtgtgtgctac

SEQ ID NO: 364303 - DNA, 15 bp, Homo sapiens
caagtgtgtgctacc

SEQ ID NO: 364304 - DNA, 15 bp, Homo sapiens
aagtgtgtgctacca

SEQ ID NO: 364305 - DNA, 15 bp, Homo sapiens
agtgtgtgctaccac

SEQ ID NO: 364306 - DNA, 15 bp, Homo sapiens
gtgtgtgctaccaca

SEQ ID NO: 364307 - DNA, 15 bp, Homo sapiens
tgtgtgctaccacac

SEQ ID NO: 364308 - DNA, 15 bp, Homo sapiens
gtgtgctaccacacc

SEQ ID NO: 364309 - DNA, 15 bp, Homo sapiens
tgtgctaccacaccc

SEQ ID NO: 364310 - DNA, 15 bp, Homo sapiens
gtgctaccacaccca

SEQ ID NO: 364311 - DNA, 15 bp, Homo sapiens
tgctaccacacccag

SEQ ID NO: 364312 - DNA, 15 bp, Homo sapiens
gctaccacacccagc

SEQ ID NO: 364313 - DNA, 15 bp, Homo sapiens
ctaccacacccagct

SEQ ID NO: 364314 - DNA, 15 bp, Homo sapiens
taccacacccagctg

SEQ ID NO: 364315 - DNA, 15 bp, Homo sapiens
cccagctgattttta

SEQ ID NO: 364316 - DNA, 15 bp, Homo sapiens
ccagctgatttttaa

SEQ ID NO: 364317 - DNA, 15 bp, Homo sapiens
cagctgatttttaaa

SEQ ID NO: 364318 - DNA, 15 bp, Homo sapiens
agctgatttttaaat

SEQ ID NO: 364319 - DNA, 15 bp, Homo sapiens
gctgatttttaaatt

SEQ ID NO: 364320 - DNA, 15 bp, Homo sapiens
ctgatttttaaattg

SEQ ID NO: 364321 - DNA, 15 bp, Homo sapiens
tgatttttaaattgt

SEQ ID NO: 364322 - DNA, 15 bp, Homo sapiens
gatttttaaattgtt

SEQ ID NO: 364323 - DNA, 15 bp, Homo sapiens
atttttaaattgttt

SEQ ID NO: 364324 - DNA, 15 bp, Homo sapiens
tttttaaattgtttg

SEQ ID NO: 364325 - DNA, 15 bp, Homo sapiens
ttttaaattgtttgt

SEQ ID NO: 364326 - DNA, 15 bp, Homo sapiens
tttaaattgtttgta

SEQ ID NO: 364327 - DNA, 15 bp, Homo sapiens
ttaaattgtttgtaa

SEQ ID NO: 364328 - DNA, 15 bp, Homo sapiens
taaattgtttgtaaa

SEQ ID NO: 364329 - DNA, 15 bp, Homo sapiens
aattgtttgtaaaaa

SEQ ID NO: 364330 - DNA, 15 bp, Homo sapiens
attgtttgtaaaaat

SEQ ID NO: 364331 - DNA, 15 bp, Homo sapiens
ttgtttgtaaaaata

SEQ ID NO: 364332 - DNA, 15 bp, Homo sapiens
tgtttgtaaaaataa

SEQ ID NO: 364333 - DNA, 15 bp, Homo sapiens
gtttgtaaaaataag

SEQ ID NO: 364334 - DNA, 15 bp, Homo sapiens
tttgtaaaaataagg

SEQ ID NO: 364335 - DNA, 15 bp, Homo sapiens
ttgtaaaaataaggt

SEQ ID NO: 364336 - DNA, 15 bp, Homo sapiens
tgtaaaaataaggtc

SEQ ID NO: 364337 - DNA, 15 bp, Homo sapiens
gtaaaaataaggtct

SEQ ID NO: 364338 - DNA, 15 bp, Homo sapiens
taaaaataaggtctt

SEQ ID NO: 364339 - DNA, 15 bp, Homo sapiens
aaaaataaggtcttg

SEQ ID NO: 364340 - DNA, 15 bp, Homo sapiens
aaaataaggtcttgc

SEQ ID NO: 364341 - DNA, 15 bp, Homo sapiens
aaataaggtcttgcc

SEQ ID NO: 364342 - DNA, 15 bp, Homo sapiens
aataaggtcttgcca

SEQ ID NO: 364343 - DNA, 15 bp, Homo sapiens
ataaggtcttgccat

SEQ ID NO: 364344 - DNA, 15 bp, Homo sapiens
taaggtcttgccatg

SEQ ID NO: 364345 - DNA, 15 bp, Homo sapiens
aaggtcttgccatgt

SEQ ID NO: 364346 - DNA, 15 bp, Homo sapiens
aggtcttgccatgtt

SEQ ID NO: 364347 - DNA, 15 bp, Homo sapiens
ggtcttgccatgttg

SEQ ID NO: 364348 - DNA, 15 bp, Homo sapiens
gtcttgccatgttgt

SEQ ID NO: 364349 - DNA, 15 bp, Homo sapiens
tcttgccatgttgtc

SEQ ID NO: 364350 - DNA, 15 bp, Homo sapiens
cttgccatgttgtcc

SEQ ID NO: 364351 - DNA, 15 bp, Homo sapiens
ttgccatgttgtcca

SEQ ID NO: 364352 - DNA, 15 bp, Homo sapiens
tgccatgttgtccag

SEQ ID NO: 364353 - DNA, 15 bp, Homo sapiens
gccatgttgtccagg

SEQ ID NO: 364354 - DNA, 15 bp, Homo sapiens
gtccaggctggtctc

SEQ ID NO: 364355 - DNA, 15 bp, Homo sapiens
tccaggctggtctcg

SEQ ID NO: 364356 - DNA, 15 bp, Homo sapiens
ggtctcgaactccta

SEQ ID NO: 364357 - DNA, 15 bp, Homo sapiens
gtctcgaactcctag

SEQ ID NO: 364358 - DNA, 15 bp, Homo sapiens
tctcgaactcctagg

SEQ ID NO: 364359 - DNA, 15 bp, Homo sapiens
ctcgaactcctaggc

SEQ ID NO: 364360 - DNA, 15 bp, Homo sapiens
tcgaactcctaggct

SEQ ID NO: 364361 - DNA, 15 bp, Homo sapiens
cgaactcctaggctc

SEQ ID NO: 364362 - DNA, 15 bp, Homo sapiens
tcctcctgcctcagt

SEQ ID NO: 364363 - DNA, 15 bp, Homo sapiens
cctcctgcctcagtc

SEQ ID NO: 364364 - DNA, 15 bp, Homo sapiens
cctgcctcagtctct

SEQ ID NO: 364365 - DNA, 15 bp, Homo sapiens
ctgcctcagtctctc

SEQ ID NO: 364366 - DNA, 15 bp, Homo sapiens
tgcctcagtctctca

SEQ ID NO: 364367 - DNA, 15 bp, Homo sapiens
gcctcagtctctcaa

SEQ ID NO: 364368 - DNA, 15 bp, Homo sapiens
cctcagtctctcaaa

SEQ ID NO: 364369 - DNA, 15 bp, Homo sapiens
ctcagtctctcaaag

SEQ ID NO: 364370 - DNA, 15 bp, Homo sapiens
tcagtctctcaaagt

SEQ ID NO: 364371 - DNA, 15 bp, Homo sapiens
cagtctctcaaagtg

SEQ ID NO: 364372 - DNA, 15 bp, Homo sapiens
agtctctcaaagtgc

SEQ ID NO: 364373 - DNA, 15 bp, Homo sapiens
gtctctcaaagtgct

SEQ ID NO: 364374 - DNA, 15 bp, Homo sapiens
tctctcaaagtgctg

SEQ ID NO: 364375 - DNA, 15 bp, Homo sapiens
tctcaaagtgctggg

SEQ ID NO: 364376 - DNA, 15 bp, Homo sapiens
ctcaaagtgctggga

SEQ ID NO: 364377 - DNA, 15 bp, Homo sapiens
cagccgtgagccacc

SEQ ID NO: 364378 - DNA, 15 bp, Homo sapiens
agccgtgagccacca

SEQ ID NO: 364379 - DNA, 15 bp, Homo sapiens
gccgtgagccaccat

SEQ ID NO: 364380 - DNA, 15 bp, Homo sapiens
ccgtgagccaccatg

SEQ ID NO: 364381 - DNA, 15 bp, Homo sapiens
cgtgagccaccatgc

SEQ ID NO: 364382 - DNA, 15 bp, Homo sapiens
ccaccatgcccagtg

SEQ ID NO: 364383 - DNA, 15 bp, Homo sapiens
caccatgcccagtgg

SEQ ID NO: 364384 - DNA, 15 bp, Homo sapiens
accatgcccagtggg

SEQ ID NO: 364385 - DNA, 15 bp, Homo sapiens
ccatgcccagtgggt

SEQ ID NO: 364386 - DNA, 15 bp, Homo sapiens
catgcccagtgggtt

SEQ ID NO: 364387 - DNA, 15 bp, Homo sapiens
atgcccagtgggtta

SEQ ID NO: 364388 - DNA, 15 bp, Homo sapiens
tgcccagtgggttat

SEQ ID NO: 364389 - DNA, 15 bp, Homo sapiens
gcccagtgggttatt

SEQ ID NO: 364390 - DNA, 15 bp, Homo sapiens
cccagtgggttattc

SEQ ID NO: 364391 - DNA, 15 bp, Homo sapiens
ccagtgggttattcc

SEQ ID NO: 364392 - DNA, 15 bp, Homo sapiens
cagtgggttattcct

SEQ ID NO: 364393 - DNA, 15 bp, Homo sapiens
agtgggttattcctt

SEQ ID NO: 364394 - DNA, 15 bp, Homo sapiens
gtgggttattcctta

SEQ ID NO: 364395 - DNA, 15 bp, Homo sapiens
tgggttattccttag

SEQ ID NO: 364396 - DNA, 15 bp, Homo sapiens
gggttattccttagt

SEQ ID NO: 364397 - DNA, 15 bp, Homo sapiens
ggttattccttagtg

SEQ ID NO: 364398 - DNA, 15 bp, Homo sapiens
gttattccttagtga

SEQ ID NO: 364399 - DNA, 15 bp, Homo sapiens
ttattccttagtgag

SEQ ID NO: 364400 - DNA, 15 bp, Homo sapiens
tattccttagtgagc

SEQ ID NO: 364401 - DNA, 15 bp, Homo sapiens
attccttagtgagca

SEQ ID NO: 364402 - DNA, 15 bp, Homo sapiens
ttccttagtgagcaa

SEQ ID NO: 364403 - DNA, 15 bp, Homo sapiens
tccttagtgagcaat

SEQ ID NO: 364404 - DNA, 15 bp, Homo sapiens
ccttagtgagcaatt

SEQ ID NO: 364405 - DNA, 15 bp, Homo sapiens
cttagtgagcaattg

SEQ ID NO: 364406 - DNA, 15 bp, Homo sapiens
ttagtgagcaattgt

SEQ ID NO: 364407 - DNA, 15 bp, Homo sapiens
tagtgagcaattgtt

SEQ ID NO: 364408 - DNA, 15 bp, Homo sapiens
agtgagcaattgttt

SEQ ID NO: 364409 - DNA, 15 bp, Homo sapiens
gtgagcaattgtttc

SEQ ID NO: 364410 - DNA, 15 bp, Homo sapiens
tgagcaattgtttct

SEQ ID NO: 364411 - DNA, 15 bp, Homo sapiens
gagcaattgtttctt

SEQ ID NO: 364412 - DNA, 15 bp, Homo sapiens
agcaattgtttcttc

SEQ ID NO: 364413 - DNA, 15 bp, Homo sapiens
gcaattgtttcttct

SEQ ID NO: 364414 - DNA, 15 bp, Homo sapiens
caattgtttcttctg

SEQ ID NO: 364415 - DNA, 15 bp, Homo sapiens
aattgtttcttctgt

SEQ ID NO: 364416 - DNA, 15 bp, Homo sapiens
attgtttcttctgtt

SEQ ID NO: 364417 - DNA, 15 bp, Homo sapiens
ttgtttcttctgtta

SEQ ID NO: 364418 - DNA, 15 bp, Homo sapiens
tgtttcttctgttag

SEQ ID NO: 364419 - DNA, 15 bp, Homo sapiens
gtttcttctgttaga

SEQ ID NO: 364420 - DNA, 15 bp, Homo sapiens
tttcttctgttagaa

SEQ ID NO: 364421 - DNA, 15 bp, Homo sapiens
ttcttctgttagaac

SEQ ID NO: 364422 - DNA, 15 bp, Homo sapiens
tcttctgttagaaca

SEQ ID NO: 364423 - DNA, 15 bp, Homo sapiens
cttctgttagaacat

SEQ ID NO: 364424 - DNA, 15 bp, Homo sapiens
ttctgttagaacatg

SEQ ID NO: 364425 - DNA, 15 bp, Homo sapiens
tctgttagaacatga

SEQ ID NO: 364426 - DNA, 15 bp, Homo sapiens
ctgttagaacatgaa

SEQ ID NO: 364427 - DNA, 15 bp, Homo sapiens
tgttagaacatgaat

SEQ ID NO: 364428 - DNA, 15 bp, Homo sapiens
gttagaacatgaatt

SEQ ID NO: 364429 - DNA, 15 bp, Homo sapiens
ttagaacatgaattt

SEQ ID NO: 364430 - DNA, 15 bp, Homo sapiens
tagaacatgaattta

SEQ ID NO: 364431 - DNA, 15 bp, Homo sapiens
agaacatgaatttat

SEQ ID NO: 364432 - DNA, 15 bp, Homo sapiens
gaacatgaatttata

SEQ ID NO: 364433 - DNA, 15 bp, Homo sapiens
aacatgaatttataa

SEQ ID NO: 364434 - DNA, 15 bp, Homo sapiens
acatgaatttataat

SEQ ID NO: 364435 - DNA, 15 bp, Homo sapiens
catgaatttataatt

SEQ ID NO: 364436 - DNA, 15 bp, Homo sapiens
atgaatttataattt

SEQ ID NO: 364437 - DNA, 15 bp, Homo sapiens
tgaatttataatttg

SEQ ID NO: 364438 - DNA, 15 bp, Homo sapiens
gaatttataatttgt

SEQ ID NO: 364439 - DNA, 15 bp, Homo sapiens
aatttataatttgtt

SEQ ID NO: 364440 - DNA, 15 bp, Homo sapiens
atttataatttgttt

SEQ ID NO: 364441 - DNA, 15 bp, Homo sapiens
tttataatttgtttt

SEQ ID NO: 364442 - DNA, 15 bp, Homo sapiens
ttataatttgttttt

SEQ ID NO: 364443 - DNA, 15 bp, Homo sapiens
tataatttgttttta

SEQ ID NO: 364444 - DNA, 15 bp, Homo sapiens
ataatttgtttttac

SEQ ID NO: 364445 - DNA, 15 bp, Homo sapiens
taatttgtttttact

SEQ ID NO: 364446 - DNA, 15 bp, Homo sapiens
aatttgtttttactc

SEQ ID NO: 364447 - DNA, 15 bp, Homo sapiens
atttgtttttactct

SEQ ID NO: 364448 - DNA, 15 bp, Homo sapiens
tttgtttttactctt

SEQ ID NO: 364449 - DNA, 15 bp, Homo sapiens
ttgtttttactcttg

SEQ ID NO: 364450 - DNA, 15 bp, Homo sapiens
tgtttttactcttgg

SEQ ID NO: 364451 - DNA, 15 bp, Homo sapiens
gtttttactcttggg

SEQ ID NO: 364452 - DNA, 15 bp, Homo sapiens
tttttactcttgggg

SEQ ID NO: 364453 - DNA, 15 bp, Homo sapiens
ttttactcttgggga

SEQ ID NO: 364454 - DNA, 15 bp, Homo sapiens
tttactcttggggat

SEQ ID NO: 364455 - DNA, 15 bp, Homo sapiens
ttactcttggggata

SEQ ID NO: 364456 - DNA, 15 bp, Homo sapiens
tactcttggggataa

SEQ ID NO: 364457 - DNA, 15 bp, Homo sapiens
actcttggggataat

SEQ ID NO: 364458 - DNA, 15 bp, Homo sapiens
ctcttggggataata

SEQ ID NO: 364459 - DNA, 15 bp, Homo sapiens
tcttggggataatat

SEQ ID NO: 364460 - DNA, 15 bp, Homo sapiens
cttggggataatatt

SEQ ID NO: 364461 - DNA, 15 bp, Homo sapiens
ttggggataatattt

SEQ ID NO: 364462 - DNA, 15 bp, Homo sapiens
tggggataatattta

SEQ ID NO: 364463 - DNA, 15 bp, Homo sapiens
ggggataatatttaa

SEQ ID NO: 364464 - DNA, 15 bp, Homo sapiens
gggataatatttaaa

SEQ ID NO: 364465 - DNA, 15 bp, Homo sapiens
ggataatatttaaaa

SEQ ID NO: 364466 - DNA, 15 bp, Homo sapiens
gataatatttaaaat

SEQ ID NO: 364467 - DNA, 15 bp, Homo sapiens
ataatatttaaaatg

SEQ ID NO: 364468 - DNA, 15 bp, Homo sapiens
taatatttaaaatgt

SEQ ID NO: 364469 - DNA, 15 bp, Homo sapiens
aatatttaaaatgta

SEQ ID NO: 364470 - DNA, 15 bp, Homo sapiens
atatttaaaatgtag

SEQ ID NO: 364471 - DNA, 15 bp, Homo sapiens
tatttaaaatgtaga

SEQ ID NO: 364472 - DNA, 15 bp, Homo sapiens
atttaaaatgtagat

SEQ ID NO: 364473 - DNA, 15 bp, Homo sapiens
tttaaaatgtagatt

SEQ ID NO: 364474 - DNA, 15 bp, Homo sapiens
ttaaaatgtagatta

SEQ ID NO: 364475 - DNA, 15 bp, Homo sapiens
taaaatgtagattat

SEQ ID NO: 364476 - DNA, 15 bp, Homo sapiens
aaaatgtagattata

SEQ ID NO: 364477 - DNA, 15 bp, Homo sapiens
aaatgtagattatat

SEQ ID NO: 364478 - DNA, 15 bp, Homo sapiens
aatgtagattatatt

SEQ ID NO: 364479 - DNA, 15 bp, Homo sapiens
atgtagattatattt

SEQ ID NO: 364480 - DNA, 15 bp, Homo sapiens
tgtagattatattta

SEQ ID NO: 364481 - DNA, 15 bp, Homo sapiens
gtagattatatttag

SEQ ID NO: 364482 - DNA, 15 bp, Homo sapiens
tagattatatttagc

SEQ ID NO: 364483 - DNA, 15 bp, Homo sapiens
agattatatttagct

SEQ ID NO: 364484 - DNA, 15 bp, Homo sapiens
gattatatttagcta

SEQ ID NO: 364485 - DNA, 15 bp, Homo sapiens
attatatttagctaa

SEQ ID NO: 364486 - DNA, 15 bp, Homo sapiens
ttatatttagctaat

SEQ ID NO: 364487 - DNA, 15 bp, Homo sapiens
tatatttagctaatt

SEQ ID NO: 364488 - DNA, 15 bp, Homo sapiens
atatttagctaattt

SEQ ID NO: 364489 - DNA, 15 bp, Homo sapiens
tatttagctaatttg

SEQ ID NO: 364490 - DNA, 15 bp, Homo sapiens
atttagctaatttgc

SEQ ID NO: 364491 - DNA, 15 bp, Homo sapiens
tttagctaatttgca

SEQ ID NO: 364492 - DNA, 15 bp, Homo sapiens
ttagctaatttgcag

SEQ ID NO: 364493 - DNA, 15 bp, Homo sapiens
tagctaatttgcaga

SEQ ID NO: 364494 - DNA, 15 bp, Homo sapiens
agctaatttgcagat

SEQ ID NO: 364495 - DNA, 15 bp, Homo sapiens
gctaatttgcagatg

SEQ ID NO: 364496 - DNA, 15 bp, Homo sapiens
ctaatttgcagatga

SEQ ID NO: 364497 - DNA, 15 bp, Homo sapiens
taatttgcagatgaa

SEQ ID NO: 364498 - DNA, 15 bp, Homo sapiens
aatttgcagatgaaa

SEQ ID NO: 364499 - DNA, 15 bp, Homo sapiens
atttgcagatgaaaa

SEQ ID NO: 364500 - DNA, 15 bp, Homo sapiens
tttgcagatgaaaat

SEQ ID NO: 364501 - DNA, 15 bp, Homo sapiens
ttgcagatgaaaata

SEQ ID NO: 364502 - DNA, 15 bp, Homo sapiens
tgcagatgaaaatat

SEQ ID NO: 364503 - DNA, 15 bp, Homo sapiens
gcagatgaaaatatt

SEQ ID NO: 364504 - DNA, 15 bp, Homo sapiens
cagatgaaaatattg

SEQ ID NO: 364505 - DNA, 15 bp, Homo sapiens
agatgaaaatattgg

SEQ ID NO: 364506 - DNA, 15 bp, Homo sapiens
gatgaaaatattggg

SEQ ID NO: 364507 - DNA, 15 bp, Homo sapiens
atgaaaatattgggt

SEQ ID NO: 364508 - DNA, 15 bp, Homo sapiens
tgaaaatattgggtg

SEQ ID NO: 364509 - DNA, 15 bp, Homo sapiens
gaaaatattgggtga

SEQ ID NO: 364510 - DNA, 15 bp, Homo sapiens
aaaatattgggtgac

SEQ ID NO: 364511 - DNA, 15 bp, Homo sapiens
aaatattgggtgact

SEQ ID NO: 364512 - DNA, 15 bp, Homo sapiens
aatattgggtgactc

SEQ ID NO: 364513 - DNA, 15 bp, Homo sapiens
atattgggtgactca

SEQ ID NO: 364514 - DNA, 15 bp, Homo sapiens
tattgggtgactcaa

SEQ ID NO: 364515 - DNA, 15 bp, Homo sapiens
attgggtgactcaaa

SEQ ID NO: 364516 - DNA, 15 bp, Homo sapiens
ttgggtgactcaaat

SEQ ID NO: 364517 - DNA, 15 bp, Homo sapiens
tgggtgactcaaata

SEQ ID NO: 364518 - DNA, 15 bp, Homo sapiens
gggtgactcaaatat

SEQ ID NO: 364519 - DNA, 15 bp, Homo sapiens
ggtgactcaaatata

SEQ ID NO: 364520 - DNA, 15 bp, Homo sapiens
gtgactcaaatatat

SEQ ID NO: 364521 - DNA, 15 bp, Homo sapiens
tgactcaaatatatc

SEQ ID NO: 364522 - DNA, 15 bp, Homo sapiens
gactcaaatatatct

SEQ ID NO: 364523 - DNA, 15 bp, Homo sapiens
actcaaatatatctt

SEQ ID NO: 364524 - DNA, 15 bp, Homo sapiens
ctcaaatatatctta

SEQ ID NO: 364525 - DNA, 15 bp, Homo sapiens
tcaaatatatcttat

SEQ ID NO: 364526 - DNA, 15 bp, Homo sapiens
caaatatatcttatt

SEQ ID NO: 364527 - DNA, 15 bp, Homo sapiens
aaatatatcttattg

SEQ ID NO: 364528 - DNA, 15 bp, Homo sapiens
aatatatcttattga

SEQ ID NO: 364529 - DNA, 15 bp, Homo sapiens
atatatcttattgaa

SEQ ID NO: 364530 - DNA, 15 bp, Homo sapiens
tatatcttattgaaa

SEQ ID NO: 364531 - DNA, 15 bp, Homo sapiens
atatcttattgaaat

SEQ ID NO: 364532 - DNA, 15 bp, Homo sapiens
tatcttattgaaatc

SEQ ID NO: 364533 - DNA, 15 bp, Homo sapiens
atcttattgaaatca

SEQ ID NO: 364534 - DNA, 15 bp, Homo sapiens
tcttattgaaatcac

SEQ ID NO: 364535 - DNA, 15 bp, Homo sapiens
cttattgaaatcact

SEQ ID NO: 364536 - DNA, 15 bp, Homo sapiens
ttattgaaatcactt

SEQ ID NO: 364537 - DNA, 15 bp, Homo sapiens
tattgaaatcacttt

SEQ ID NO: 364538 - DNA, 15 bp, Homo sapiens
attgaaatcacttta

SEQ ID NO: 364539 - DNA, 15 bp, Homo sapiens
ttgaaatcactttat

SEQ ID NO: 364540 - DNA, 15 bp, Homo sapiens
tgaaatcactttata

SEQ ID NO: 364541 - DNA, 15 bp, Homo sapiens
gaaatcactttataa

SEQ ID NO: 364542 - DNA, 15 bp, Homo sapiens
aaatcactttataat

SEQ ID NO: 364543 - DNA, 15 bp, Homo sapiens
aatcactttataatg

SEQ ID NO: 364544 - DNA, 15 bp, Homo sapiens
atcactttataatgc

SEQ ID NO: 364545 - DNA, 15 bp, Homo sapiens
tcactttataatgct

SEQ ID NO: 364546 - DNA, 15 bp, Homo sapiens
cactttataatgcta

SEQ ID NO: 364547 - DNA, 15 bp, Homo sapiens
actttataatgctag

SEQ ID NO: 364548 - DNA, 15 bp, Homo sapiens
ctttataatgctagt

SEQ ID NO: 364549 - DNA, 15 bp, Homo sapiens
tttataatgctagtt

SEQ ID NO: 364550 - DNA, 15 bp, Homo sapiens
ttataatgctagttt

SEQ ID NO: 364551 - DNA, 15 bp, Homo sapiens
tataatgctagtttt

SEQ ID NO: 364552 - DNA, 15 bp, Homo sapiens
ataatgctagttttc

SEQ ID NO: 364553 - DNA, 15 bp, Homo sapiens
taatgctagttttct

SEQ ID NO: 364554 - DNA, 15 bp, Homo sapiens
aatgctagttttctt

SEQ ID NO: 364555 - DNA, 15 bp, Homo sapiens
atgctagttttcttc

SEQ ID NO: 364556 - DNA, 15 bp, Homo sapiens
tgctagttttcttca

SEQ ID NO: 364557 - DNA, 15 bp, Homo sapiens
gctagttttcttcat

SEQ ID NO: 364558 - DNA, 15 bp, Homo sapiens
ctagttttcttcata

SEQ ID NO: 364559 - DNA, 15 bp, Homo sapiens
tagttttcttcatag

SEQ ID NO: 364560 - DNA, 15 bp, Homo sapiens
agttttcttcatagt

SEQ ID NO: 364561 - DNA, 15 bp, Homo sapiens
gttttcttcatagtt

SEQ ID NO: 364562 - DNA, 15 bp, Homo sapiens
ttttcttcatagttc

SEQ ID NO: 364563 - DNA, 15 bp, Homo sapiens
tttcttcatagttct

SEQ ID NO: 364564 - DNA, 15 bp, Homo sapiens
ttcttcatagttctg

SEQ ID NO: 364565 - DNA, 15 bp, Homo sapiens
tcttcatagttctgt

SEQ ID NO: 364566 - DNA, 15 bp, Homo sapiens
cttcatagttctgtt

SEQ ID NO: 364567 - DNA, 15 bp, Homo sapiens
ttcatagttctgttt

SEQ ID NO: 364568 - DNA, 15 bp, Homo sapiens
tcatagttctgtttt

SEQ ID NO: 364569 - DNA, 15 bp, Homo sapiens
catagttctgttttg

SEQ ID NO: 364570 - DNA, 15 bp, Homo sapiens
atagttctgttttga

SEQ ID NO: 364571 - DNA, 15 bp, Homo sapiens
tagttctgttttgaa

SEQ ID NO: 364572 - DNA, 15 bp, Homo sapiens
agttctgttttgaaa

SEQ ID NO: 364573 - DNA, 15 bp, Homo sapiens
gttctgttttgaaag

SEQ ID NO: 364574 - DNA, 15 bp, Homo sapiens
ttctgttttgaaagt

SEQ ID NO: 364575 - DNA, 15 bp, Homo sapiens
tctgttttgaaagta

SEQ ID NO: 364576 - DNA, 15 bp, Homo sapiens
ctgttttgaaagtac

SEQ ID NO: 364577 - DNA, 15 bp, Homo sapiens
tgttttgaaagtact

SEQ ID NO: 364578 - DNA, 15 bp, Homo sapiens
gttttgaaagtacta

SEQ ID NO: 364579 - DNA, 15 bp, Homo sapiens
ttttgaaagtactaa

SEQ ID NO: 364580 - DNA, 15 bp, Homo sapiens
tttgaaagtactaaa

SEQ ID NO: 364581 - DNA, 15 bp, Homo sapiens
ttgaaagtactaaat

SEQ ID NO: 364582 - DNA, 15 bp, Homo sapiens
tgaaagtactaaatt

SEQ ID NO: 364583 - DNA, 15 bp, Homo sapiens
gaaagtactaaatta

SEQ ID NO: 364584 - DNA, 15 bp, Homo sapiens
aaagtactaaattag

SEQ ID NO: 364585 - DNA, 15 bp, Homo sapiens
aagtactaaattagt

SEQ ID NO: 364586 - DNA, 15 bp, Homo sapiens
agtactaaattagtc

SEQ ID NO: 364587 - DNA, 15 bp, Homo sapiens
gtactaaattagtca

SEQ ID NO: 364588 - DNA, 15 bp, Homo sapiens
tactaaattagtcat

SEQ ID NO: 364589 - DNA, 15 bp, Homo sapiens
actaaattagtcatg

SEQ ID NO: 364590 - DNA, 15 bp, Homo sapiens
ctaaattagtcatga

SEQ ID NO: 364591 - DNA, 15 bp, Homo sapiens
taaattagtcatgat

SEQ ID NO: 364592 - DNA, 15 bp, Homo sapiens
aaattagtcatgatc

SEQ ID NO: 364593 - DNA, 15 bp, Homo sapiens
aattagtcatgatct

SEQ ID NO: 364594 - DNA, 15 bp, Homo sapiens
attagtcatgatctt

SEQ ID NO: 364595 - DNA, 15 bp, Homo sapiens
ttagtcatgatcttg

SEQ ID NO: 364596 - DNA, 15 bp, Homo sapiens
tagtcatgatcttga

SEQ ID NO: 364597 - DNA, 15 bp, Homo sapiens
agtcatgatcttgaa

SEQ ID NO: 364598 - DNA, 15 bp, Homo sapiens
gtcatgatcttgaaa

SEQ ID NO: 364599 - DNA, 15 bp, Homo sapiens
tcatgatcttgaaac

SEQ ID NO: 364600 - DNA, 15 bp, Homo sapiens
catgatcttgaaaca

SEQ ID NO: 364601 - DNA, 15 bp, Homo sapiens
atgatcttgaaacat

SEQ ID NO: 364602 - DNA, 15 bp, Homo sapiens
tgatcttgaaacatt

SEQ ID NO: 364603 - DNA, 15 bp, Homo sapiens
gatcttgaaacattg

SEQ ID NO: 364604 - DNA, 15 bp, Homo sapiens
atcttgaaacattgg

SEQ ID NO: 364605 - DNA, 15 bp, Homo sapiens
tcttgaaacattgga

SEQ ID NO: 364606 - DNA, 15 bp, Homo sapiens
cttgaaacattggac

SEQ ID NO: 364607 - DNA, 15 bp, Homo sapiens
ttgaaacattggacg

SEQ ID NO: 364608 - DNA, 15 bp, Homo sapiens
tgaaacattggacgt

SEQ ID NO: 364609 - DNA, 15 bp, Homo sapiens
gaaacattggacgtg

SEQ ID NO: 364610 - DNA, 15 bp, Homo sapiens
aaacattggacgtga

SEQ ID NO: 364611 - DNA, 15 bp, Homo sapiens
aacattggacgtgaa

SEQ ID NO: 364612 - DNA, 15 bp, Homo sapiens
acattggacgtgaaa

SEQ ID NO: 364613 - DNA, 15 bp, Homo sapiens
cattggacgtgaaat

SEQ ID NO: 364614 - DNA, 15 bp, Homo sapiens
attggacgtgaaatt

SEQ ID NO: 364615 - DNA, 15 bp, Homo sapiens
ttggacgtgaaattt

SEQ ID NO: 364616 - DNA, 15 bp, Homo sapiens
tggacgtgaaatttc

SEQ ID NO: 364617 - DNA, 15 bp, Homo sapiens
ggacgtgaaatttca

SEQ ID NO: 364618 - DNA, 15 bp, Homo sapiens
gacgtgaaatttcaa

SEQ ID NO: 364619 - DNA, 15 bp, Homo sapiens
acgtgaaatttcaac

SEQ ID NO: 364620 - DNA, 15 bp, Homo sapiens
cgtgaaatttcaact

SEQ ID NO: 364621 - DNA, 15 bp, Homo sapiens
gtgaaatttcaactc

SEQ ID NO: 364622 - DNA, 15 bp, Homo sapiens
tgaaatttcaactct

SEQ ID NO: 364623 - DNA, 15 bp, Homo sapiens
gaaatttcaactctt

SEQ ID NO: 364624 - DNA, 15 bp, Homo sapiens
aaatttcaactcttt

SEQ ID NO: 364625 - DNA, 15 bp, Homo sapiens
aatttcaactctttt

SEQ ID NO: 364626 - DNA, 15 bp, Homo sapiens
atttcaactcttttt

SEQ ID NO: 364627 - DNA, 15 bp, Homo sapiens
tttcaactctttttt

SEQ ID NO: 364628 - DNA, 15 bp, Homo sapiens
ttcaactctttttta

SEQ ID NO: 364629 - DNA, 15 bp, Homo sapiens
tcaactcttttttag

SEQ ID NO: 364630 - DNA, 15 bp, Homo sapiens
caactcttttttaga

SEQ ID NO: 364631 - DNA, 15 bp, Homo sapiens
aactcttttttagaa

SEQ ID NO: 364632 - DNA, 15 bp, Homo sapiens
actcttttttagaaa

SEQ ID NO: 364633 - DNA, 15 bp, Homo sapiens
ctcttttttagaaac

SEQ ID NO: 364634 - DNA, 15 bp, Homo sapiens
tcttttttagaaaca

SEQ ID NO: 364635 - DNA, 15 bp, Homo sapiens
cttttttagaaacaa

SEQ ID NO: 364636 - DNA, 15 bp, Homo sapiens
ttttagaaacaaagg

SEQ ID NO: 364637 - DNA, 15 bp, Homo sapiens
tttagaaacaaaggc

SEQ ID NO: 364638 - DNA, 15 bp, Homo sapiens
ttagaaacaaaggcc

SEQ ID NO: 364639 - DNA, 15 bp, Homo sapiens
tagaaacaaaggcct

SEQ ID NO: 364640 - DNA, 15 bp, Homo sapiens
agaaacaaaggccta

SEQ ID NO: 364641 - DNA, 15 bp, Homo sapiens
gaaacaaaggcctat

SEQ ID NO: 364642 - DNA, 15 bp, Homo sapiens
aaacaaaggcctata

SEQ ID NO: 364643 - DNA, 15 bp, Homo sapiens
aacaaaggcctataa

SEQ ID NO: 364644 - DNA, 15 bp, Homo sapiens
acaaaggcctataat

SEQ ID NO: 364645 - DNA, 15 bp, Homo sapiens
caaaggcctataata

SEQ ID NO: 364646 - DNA, 15 bp, Homo sapiens
aaaggcctataatag

SEQ ID NO: 364647 - DNA, 15 bp, Homo sapiens
aaggcctataatagt

SEQ ID NO: 364648 - DNA, 15 bp, Homo sapiens
aggcctataatagta

SEQ ID NO: 364649 - DNA, 15 bp, Homo sapiens
ggcctataatagtat

SEQ ID NO: 364650 - DNA, 15 bp, Homo sapiens
gcctataatagtatt

SEQ ID NO: 364651 - DNA, 15 bp, Homo sapiens
cctataatagtattt

SEQ ID NO: 364652 - DNA, 15 bp, Homo sapiens
ctataatagtatttt

SEQ ID NO: 364653 - DNA, 15 bp, Homo sapiens
tataatagtattttg

SEQ ID NO: 364654 - DNA, 15 bp, Homo sapiens
ataatagtattttgg

SEQ ID NO: 364655 - DNA, 15 bp, Homo sapiens
taatagtattttggg

SEQ ID NO: 364656 - DNA, 15 bp, Homo sapiens
aatagtattttgggt

SEQ ID NO: 364657 - DNA, 15 bp, Homo sapiens
atagtattttgggtg

SEQ ID NO: 364658 - DNA, 15 bp, Homo sapiens
tagtattttgggtgt

SEQ ID NO: 364659 - DNA, 15 bp, Homo sapiens
agtattttgggtgtt

SEQ ID NO: 364660 - DNA, 15 bp, Homo sapiens
gtattttgggtgttt

SEQ ID NO: 364661 - DNA, 15 bp, Homo sapiens
tattttgggtgtttc

SEQ ID NO: 364662 - DNA, 15 bp, Homo sapiens
attttgggtgtttcc

SEQ ID NO: 364663 - DNA, 15 bp, Homo sapiens
ttttgggtgtttcca

SEQ ID NO: 364664 - DNA, 15 bp, Homo sapiens
tttgggtgtttccaa

SEQ ID NO: 364665 - DNA, 15 bp, Homo sapiens
ttgggtgtttccaaa

SEQ ID NO: 364666 - DNA, 15 bp, Homo sapiens
tgggtgtttccaaag

SEQ ID NO: 364667 - DNA, 15 bp, Homo sapiens
gggtgtttccaaagt

SEQ ID NO: 364668 - DNA, 15 bp, Homo sapiens
ggtgtttccaaagtt

SEQ ID NO: 364669 - DNA, 15 bp, Homo sapiens
gtgtttccaaagttg

SEQ ID NO: 364670 - DNA, 15 bp, Homo sapiens
tgtttccaaagttgt

SEQ ID NO: 364671 - DNA, 15 bp, Homo sapiens
gtttccaaagttgtc

SEQ ID NO: 364672 - DNA, 15 bp, Homo sapiens
tttccaaagttgtca

SEQ ID NO: 364673 - DNA, 15 bp, Homo sapiens
ttccaaagttgtcat

SEQ ID NO: 364674 - DNA, 15 bp, Homo sapiens
tccaaagttgtcatt

SEQ ID NO: 364675 - DNA, 15 bp, Homo sapiens
ccaaagttgtcattt

SEQ ID NO: 364676 - DNA, 15 bp, Homo sapiens
caaagttgtcattta

SEQ ID NO: 364677 - DNA, 15 bp, Homo sapiens
aaagttgtcatttaa

SEQ ID NO: 364678 - DNA, 15 bp, Homo sapiens
aagttgtcatttaag

SEQ ID NO: 364679 - DNA, 15 bp, Homo sapiens
agttgtcatttaagt

SEQ ID NO: 364680 - DNA, 15 bp, Homo sapiens
gttgtcatttaagtt

SEQ ID NO: 364681 - DNA, 15 bp, Homo sapiens
ttgtcatttaagtta

SEQ ID NO: 364682 - DNA, 15 bp, Homo sapiens
tgtcatttaagttaa

SEQ ID NO: 364683 - DNA, 15 bp, Homo sapiens
gtcatttaagttaaa

SEQ ID NO: 364684 - DNA, 15 bp, Homo sapiens
tcatttaagttaaat

SEQ ID NO: 364685 - DNA, 15 bp, Homo sapiens
catttaagttaaata

SEQ ID NO: 364686 - DNA, 15 bp, Homo sapiens
atttaagttaaatac

SEQ ID NO: 364687 - DNA, 15 bp, Homo sapiens
tttaagttaaatact

SEQ ID NO: 364688 - DNA, 15 bp, Homo sapiens
ttaagttaaatactt

SEQ ID NO: 364689 - DNA, 15 bp, Homo sapiens
taagttaaatacttt

SEQ ID NO: 364690 - DNA, 15 bp, Homo sapiens
aagttaaatactttt

SEQ ID NO: 364691 - DNA, 15 bp, Homo sapiens
agttaaatacttttc

SEQ ID NO: 364692 - DNA, 15 bp, Homo sapiens
gttaaatacttttca

SEQ ID NO: 364693 - DNA, 15 bp, Homo sapiens
ttaaatacttttcac

SEQ ID NO: 364694 - DNA, 15 bp, Homo sapiens
taaatacttttcact

SEQ ID NO: 364695 - DNA, 15 bp, Homo sapiens
aaatacttttcacta

SEQ ID NO: 364696 - DNA, 15 bp, Homo sapiens
aatacttttcactat

SEQ ID NO: 364697 - DNA, 15 bp, Homo sapiens
atacttttcactatg

SEQ ID NO: 364698 - DNA, 15 bp, Homo sapiens
tacttttcactatgg

SEQ ID NO: 364699 - DNA, 15 bp, Homo sapiens
acttttcactatgga

SEQ ID NO: 364700 - DNA, 15 bp, Homo sapiens
cttttcactatggag

SEQ ID NO: 364701 - DNA, 15 bp, Homo sapiens
ttttcactatggagg

SEQ ID NO: 364702 - DNA, 15 bp, Homo sapiens
tttcactatggaggg

SEQ ID NO: 364703 - DNA, 15 bp, Homo sapiens
ttcactatggagggt

SEQ ID NO: 364704 - DNA, 15 bp, Homo sapiens
tcactatggagggta

SEQ ID NO: 364705 - DNA, 15 bp, Homo sapiens
cactatggagggtag

SEQ ID NO: 364706 - DNA, 15 bp, Homo sapiens
actatggagggtaga

SEQ ID NO: 364707 - DNA, 15 bp, Homo sapiens
ctatggagggtagat

SEQ ID NO: 364708 - DNA, 15 bp, Homo sapiens
tatggagggtagatt

SEQ ID NO: 364709 - DNA, 15 bp, Homo sapiens
atggagggtagatta

SEQ ID NO: 364710 - DNA, 15 bp, Homo sapiens
tggagggtagattac

SEQ ID NO: 364711 - DNA, 15 bp, Homo sapiens
ggagggtagattact

SEQ ID NO: 364712 - DNA, 15 bp, Homo sapiens
gagggtagattactt

SEQ ID NO: 364713 - DNA, 15 bp, Homo sapiens
agggtagattacttg

SEQ ID NO: 364714 - DNA, 15 bp, Homo sapiens
gggtagattacttgt

SEQ ID NO: 364715 - DNA, 15 bp, Homo sapiens
ggtagattacttgtt

SEQ ID NO: 364716 - DNA, 15 bp, Homo sapiens
gtagattacttgttt

SEQ ID NO: 364717 - DNA, 15 bp, Homo sapiens
tagattacttgtttt

SEQ ID NO: 364718 - DNA, 15 bp, Homo sapiens
agattacttgtttta

SEQ ID NO: 364719 - DNA, 15 bp, Homo sapiens
gattacttgttttag

SEQ ID NO: 364720 - DNA, 15 bp, Homo sapiens
attacttgttttagt

SEQ ID NO: 364721 - DNA, 15 bp, Homo sapiens
ttacttgttttagtc

SEQ ID NO: 364722 - DNA, 15 bp, Homo sapiens
tacttgttttagtct

SEQ ID NO: 364723 - DNA, 15 bp, Homo sapiens
acttgttttagtctt

SEQ ID NO: 364724 - DNA, 15 bp, Homo sapiens
cttgttttagtctta

SEQ ID NO: 364725 - DNA, 15 bp, Homo sapiens
ttgttttagtcttag

SEQ ID NO: 364726 - DNA, 15 bp, Homo sapiens
tgttttagtcttagt

SEQ ID NO: 364727 - DNA, 15 bp, Homo sapiens
gttttagtcttagta

SEQ ID NO: 364728 - DNA, 15 bp, Homo sapiens
ttttagtcttagtaa

SEQ ID NO: 364729 - DNA, 15 bp, Homo sapiens
tttagtcttagtaat

SEQ ID NO: 364730 - DNA, 15 bp, Homo sapiens
ttagtcttagtaatt

SEQ ID NO: 364731 - DNA, 15 bp, Homo sapiens
tagtcttagtaatta

SEQ ID NO: 364732 - DNA, 15 bp, Homo sapiens
agtcttagtaattag

SEQ ID NO: 364733 - DNA, 15 bp, Homo sapiens
gtcttagtaattagt

SEQ ID NO: 364734 - DNA, 15 bp, Homo sapiens
tcttagtaattagtg

SEQ ID NO: 364735 - DNA, 15 bp, Homo sapiens
cttagtaattagtgc

SEQ ID NO: 364736 - DNA, 15 bp, Homo sapiens
ttagtaattagtgct

SEQ ID NO: 364737 - DNA, 15 bp, Homo sapiens
tagtaattagtgctg

SEQ ID NO: 364738 - DNA, 15 bp, Homo sapiens
agtaattagtgctgt

SEQ ID NO: 364739 - DNA, 15 bp, Homo sapiens
gtaattagtgctgtt

SEQ ID NO: 364740 - DNA, 15 bp, Homo sapiens
taattagtgctgttg

SEQ ID NO: 364741 - DNA, 15 bp, Homo sapiens
aattagtgctgttgc

SEQ ID NO: 364742 - DNA, 15 bp, Homo sapiens
attagtgctgttgct

SEQ ID NO: 364743 - DNA, 15 bp, Homo sapiens
ttagtgctgttgctg

SEQ ID NO: 364744 - DNA, 15 bp, Homo sapiens
tagtgctgttgctgt

SEQ ID NO: 364745 - DNA, 15 bp, Homo sapiens
agtgctgttgctgta

SEQ ID NO: 364746 - DNA, 15 bp, Homo sapiens
gtgctgttgctgtat

SEQ ID NO: 364747 - DNA, 15 bp, Homo sapiens
tgctgttgctgtatt

SEQ ID NO: 364748 - DNA, 15 bp, Homo sapiens
gctgttgctgtattt

SEQ ID NO: 364749 - DNA, 15 bp, Homo sapiens
ctgttgctgtattta

SEQ ID NO: 364750 - DNA, 15 bp, Homo sapiens
tgttgctgtatttat

SEQ ID NO: 364751 - DNA, 15 bp, Homo sapiens
gttgctgtatttatt

SEQ ID NO: 364752 - DNA, 15 bp, Homo sapiens
ttgctgtatttattt

SEQ ID NO: 364753 - DNA, 15 bp, Homo sapiens
tgctgtatttattta

SEQ ID NO: 364754 - DNA, 15 bp, Homo sapiens
gctgtatttatttat

SEQ ID NO: 364755 - DNA, 15 bp, Homo sapiens
ctgtatttatttatt

SEQ ID NO: 364756 - DNA, 15 bp, Homo sapiens
tgtatttatttattt

SEQ ID NO: 364757 - DNA, 15 bp, Homo sapiens
gtatttatttatttt

SEQ ID NO: 364758 - DNA, 15 bp, Homo sapiens
atttatttattttta

SEQ ID NO: 364759 - DNA, 15 bp, Homo sapiens
tttatttatttttaa

SEQ ID NO: 364760 - DNA, 15 bp, Homo sapiens
ttatttatttttaat

SEQ ID NO: 364761 - DNA, 15 bp, Homo sapiens
tatttatttttaatc

SEQ ID NO: 364762 - DNA, 15 bp, Homo sapiens
atttatttttaatct

SEQ ID NO: 364763 - DNA, 15 bp, Homo sapiens
tttatttttaatctt

SEQ ID NO: 364764 - DNA, 15 bp, Homo sapiens
ttatttttaatctta

SEQ ID NO: 364765 - DNA, 15 bp, Homo sapiens
tatttttaatcttaa

SEQ ID NO: 364766 - DNA, 15 bp, Homo sapiens
atttttaatcttaaa

SEQ ID NO: 364767 - DNA, 15 bp, Homo sapiens
tttttaatcttaaag

SEQ ID NO: 364768 - DNA, 15 bp, Homo sapiens
ttttaatcttaaagg

SEQ ID NO: 364769 - DNA, 15 bp, Homo sapiens
tttaatcttaaagga

SEQ ID NO: 364770 - DNA, 15 bp, Homo sapiens
ttaatcttaaaggag

SEQ ID NO: 364771 - DNA, 15 bp, Homo sapiens
taatcttaaaggagc

SEQ ID NO: 364772 - DNA, 15 bp, Homo sapiens
aatcttaaaggagca

SEQ ID NO: 364773 - DNA, 15 bp, Homo sapiens
atcttaaaggagcat

SEQ ID NO: 364774 - DNA, 15 bp, Homo sapiens
tcttaaaggagcatt

SEQ ID NO: 364775 - DNA, 15 bp, Homo sapiens
cttaaaggagcattc

SEQ ID NO: 364776 - DNA, 15 bp, Homo sapiens
ttaaaggagcattct

SEQ ID NO: 364777 - DNA, 15 bp, Homo sapiens
taaaggagcattctt

SEQ ID NO: 364778 - DNA, 15 bp, Homo sapiens
aaaggagcattcttt

SEQ ID NO: 364779 - DNA, 15 bp, Homo sapiens
aaggagcattctttc

SEQ ID NO: 364780 - DNA, 15 bp, Homo sapiens
aggagcattctttct

SEQ ID NO: 364781 - DNA, 15 bp, Homo sapiens
ggagcattctttctt

SEQ ID NO: 364782 - DNA, 15 bp, Homo sapiens
gagcattctttcttg

SEQ ID NO: 364783 - DNA, 15 bp, Homo sapiens
agcattctttcttga

SEQ ID NO: 364784 - DNA, 15 bp, Homo sapiens
gcattctttcttgat

SEQ ID NO: 364785 - DNA, 15 bp, Homo sapiens
cattctttcttgatg

SEQ ID NO: 364786 - DNA, 15 bp, Homo sapiens
attctttcttgatgg

SEQ ID NO: 364787 - DNA, 15 bp, Homo sapiens
ttctttcttgatgga

SEQ ID NO: 364788 - DNA, 15 bp, Homo sapiens
tctttcttgatggat

SEQ ID NO: 364789 - DNA, 15 bp, Homo sapiens
ctttcttgatggata

SEQ ID NO: 364790 - DNA, 15 bp, Homo sapiens
tttcttgatggatac

SEQ ID NO: 364791 - DNA, 15 bp, Homo sapiens
ttcttgatggatact

SEQ ID NO: 364792 - DNA, 15 bp, Homo sapiens
tcttgatggatactt

SEQ ID NO: 364793 - DNA, 15 bp, Homo sapiens
cttgatggatactta

SEQ ID NO: 364794 - DNA, 15 bp, Homo sapiens
ttgatggatacttaa

SEQ ID NO: 364795 - DNA, 15 bp, Homo sapiens
tgatggatacttaaa

SEQ ID NO: 364796 - DNA, 15 bp, Homo sapiens
gatggatacttaaaa

SEQ ID NO: 364797 - DNA, 15 bp, Homo sapiens
atggatacttaaaaa

SEQ ID NO: 364798 - DNA, 15 bp, Homo sapiens
tggatacttaaaaat

SEQ ID NO: 364799 - DNA, 15 bp, Homo sapiens
ggatacttaaaaatt

SEQ ID NO: 364800 - DNA, 15 bp, Homo sapiens
gatacttaaaaatta

SEQ ID NO: 364801 - DNA, 15 bp, Homo sapiens
atacttaaaaattat

SEQ ID NO: 364802 - DNA, 15 bp, Homo sapiens
tacttaaaaattatg

SEQ ID NO: 364803 - DNA, 15 bp, Homo sapiens
acttaaaaattatga

SEQ ID NO: 364804 - DNA, 15 bp, Homo sapiens
cttaaaaattatgat

SEQ ID NO: 364805 - DNA, 15 bp, Homo sapiens
ttaaaaattatgatt

SEQ ID NO: 364806 - DNA, 15 bp, Homo sapiens
taaaaattatgattt

SEQ ID NO: 364807 - DNA, 15 bp, Homo sapiens
aaaaattatgatttt

SEQ ID NO: 364808 - DNA, 15 bp, Homo sapiens
aaaattatgattttg

SEQ ID NO: 364809 - DNA, 15 bp, Homo sapiens
aaattatgattttgt

SEQ ID NO: 364810 - DNA, 15 bp, Homo sapiens
aattatgattttgta

SEQ ID NO: 364811 - DNA, 15 bp, Homo sapiens
attatgattttgtag

SEQ ID NO: 364812 - DNA, 15 bp, Homo sapiens
ttatgattttgtagt

SEQ ID NO: 364813 - DNA, 15 bp, Homo sapiens
tatgattttgtagtg

SEQ ID NO: 364814 - DNA, 15 bp, Homo sapiens
atgattttgtagtga

SEQ ID NO: 364815 - DNA, 15 bp, Homo sapiens
tgattttgtagtgat

SEQ ID NO: 364816 - DNA, 15 bp, Homo sapiens
gattttgtagtgatt

SEQ ID NO: 364817 - DNA, 15 bp, Homo sapiens
attttgtagtgattt

SEQ ID NO: 364818 - DNA, 15 bp, Homo sapiens
ttttgtagtgatttt

SEQ ID NO: 364819 - DNA, 15 bp, Homo sapiens
tttgtagtgattttc

SEQ ID NO: 364820 - DNA, 15 bp, Homo sapiens
ttgtagtgattttca

SEQ ID NO: 364821 - DNA, 15 bp, Homo sapiens
tgtagtgattttcat

SEQ ID NO: 364822 - DNA, 15 bp, Homo sapiens
gtagtgattttcatt

SEQ ID NO: 364823 - DNA, 15 bp, Homo sapiens
tagtgattttcattt

SEQ ID NO: 364824 - DNA, 15 bp, Homo sapiens
agtgattttcatttt

SEQ ID NO: 364825 - DNA, 15 bp, Homo sapiens
gtgattttcattttt

SEQ ID NO: 364826 - DNA, 15 bp, Homo sapiens
tgattttcatttttt

SEQ ID NO: 364827 - DNA, 15 bp, Homo sapiens
gattttcattttttt

SEQ ID NO: 364828 - DNA, 15 bp, Homo sapiens
attttcattttttta

SEQ ID NO: 364829 - DNA, 15 bp, Homo sapiens
ttttcatttttttaa

SEQ ID NO: 364830 - DNA, 15 bp, Homo sapiens
tttcatttttttaaa

SEQ ID NO: 364831 - DNA, 15 bp, Homo sapiens
ttcatttttttaaac

SEQ ID NO: 364832 - DNA, 15 bp, Homo sapiens
tcatttttttaaaca

SEQ ID NO: 364833 - DNA, 15 bp, Homo sapiens
catttttttaaacat

SEQ ID NO: 364834 - DNA, 15 bp, Homo sapiens
atttttttaaacatt

SEQ ID NO: 364835 - DNA, 15 bp, Homo sapiens
tttttttaaacatta

SEQ ID NO: 364836 - DNA, 15 bp, Homo sapiens
ttttttaaacattat

SEQ ID NO: 364837 - DNA, 15 bp, Homo sapiens
tttttaaacattata

SEQ ID NO: 364838 - DNA, 15 bp, Homo sapiens
ttttaaacattatac

SEQ ID NO: 364839 - DNA, 15 bp, Homo sapiens
tttaaacattataca

SEQ ID NO: 364840 - DNA, 15 bp, Homo sapiens
ttaaacattatacat

SEQ ID NO: 364841 - DNA, 15 bp, Homo sapiens
taaacattatacatc

SEQ ID NO: 364842 - DNA, 15 bp, Homo sapiens
aaacattatacatca

SEQ ID NO: 364843 - DNA, 15 bp, Homo sapiens
aacattatacatcaa

SEQ ID NO: 364844 - DNA, 15 bp, Homo sapiens
acattatacatcaaa

SEQ ID NO: 364845 - DNA, 15 bp, Homo sapiens
cattatacatcaaat

SEQ ID NO: 364846 - DNA, 15 bp, Homo sapiens
attatacatcaaata

SEQ ID NO: 364847 - DNA, 15 bp, Homo sapiens
ttatacatcaaatat

SEQ ID NO: 364848 - DNA, 15 bp, Homo sapiens
tatacatcaaatatt

SEQ ID NO: 364849 - DNA, 15 bp, Homo sapiens
atacatcaaatattg

SEQ ID NO: 364850 - DNA, 15 bp, Homo sapiens
tacatcaaatattga

SEQ ID NO: 364851 - DNA, 15 bp, Homo sapiens
acatcaaatattgac

SEQ ID NO: 364852 - DNA, 15 bp, Homo sapiens
catcaaatattgact

SEQ ID NO: 364853 - DNA, 15 bp, Homo sapiens
atcaaatattgactg

SEQ ID NO: 364854 - DNA, 15 bp, Homo sapiens
tcaaatattgactgt

SEQ ID NO: 364855 - DNA, 15 bp, Homo sapiens
caaatattgactgtt

SEQ ID NO: 364856 - DNA, 15 bp, Homo sapiens
aaatattgactgttt

SEQ ID NO: 364857 - DNA, 15 bp, Homo sapiens
aatattgactgttta

SEQ ID NO: 364858 - DNA, 15 bp, Homo sapiens
atattgactgtttat

SEQ ID NO: 364859 - DNA, 15 bp, Homo sapiens
tattgactgtttatt

SEQ ID NO: 364860 - DNA, 15 bp, Homo sapiens
attgactgtttatta

SEQ ID NO: 364861 - DNA, 15 bp, Homo sapiens
ttgactgtttattaa

SEQ ID NO: 364862 - DNA, 15 bp, Homo sapiens
tgactgtttattaaa

SEQ ID NO: 364863 - DNA, 15 bp, Homo sapiens
gactgtttattaaat

SEQ ID NO: 364864 - DNA, 15 bp, Homo sapiens
actgtttattaaata

SEQ ID NO: 364865 - DNA, 15 bp, Homo sapiens
ctgtttattaaatat

SEQ ID NO: 364866 - DNA, 15 bp, Homo sapiens
tgtttattaaatata

SEQ ID NO: 364867 - DNA, 15 bp, Homo sapiens
gtttattaaatatag

SEQ ID NO: 364868 - DNA, 15 bp, Homo sapiens
tttattaaatataga

SEQ ID NO: 364869 - DNA, 15 bp, Homo sapiens
ttattaaatatagaa

SEQ ID NO: 364870 - DNA, 15 bp, Homo sapiens
tattaaatatagaag

SEQ ID NO: 364871 - DNA, 15 bp, Homo sapiens
attaaatatagaagt

SEQ ID NO: 364872 - DNA, 15 bp, Homo sapiens
ttaaatatagaagta

SEQ ID NO: 364873 - DNA, 15 bp, Homo sapiens
taaatatagaagtat

SEQ ID NO: 364874 - DNA, 15 bp, Homo sapiens
aaatatagaagtatt

SEQ ID NO: 364875 - DNA, 15 bp, Homo sapiens
aatatagaagtatta

SEQ ID NO: 364876 - DNA, 15 bp, Homo sapiens
atatagaagtattat

SEQ ID NO: 364877 - DNA, 15 bp, Homo sapiens
tatagaagtattatc

SEQ ID NO: 364878 - DNA, 15 bp, Homo sapiens
atagaagtattatct

SEQ ID NO: 364879 - DNA, 15 bp, Homo sapiens
tagaagtattatcta

SEQ ID NO: 364880 - DNA, 15 bp, Homo sapiens
agaagtattatctaa

SEQ ID NO: 364881 - DNA, 15 bp, Homo sapiens
gaagtattatctaat

SEQ ID NO: 364882 - DNA, 15 bp, Homo sapiens
aagtattatctaata

SEQ ID NO: 364883 - DNA, 15 bp, Homo sapiens
agtattatctaatat

SEQ ID NO: 364884 - DNA, 15 bp, Homo sapiens
gtattatctaatatt

SEQ ID NO: 364885 - DNA, 15 bp, Homo sapiens
tattatctaatattt

SEQ ID NO: 364886 - DNA, 15 bp, Homo sapiens
attatctaatatttt

SEQ ID NO: 364887 - DNA, 15 bp, Homo sapiens
ttatctaatatttta

SEQ ID NO: 364888 - DNA, 15 bp, Homo sapiens
tatctaatattttat

SEQ ID NO: 364889 - DNA, 15 bp, Homo sapiens
atctaatattttatt

SEQ ID NO: 364890 - DNA, 15 bp, Homo sapiens
tctaatattttatta

SEQ ID NO: 364891 - DNA, 15 bp, Homo sapiens
ctaatattttattac

SEQ ID NO: 364892 - DNA, 15 bp, Homo sapiens
taatattttattaca

SEQ ID NO: 364893 - DNA, 15 bp, Homo sapiens
aatattttattacat

SEQ ID NO: 364894 - DNA, 15 bp, Homo sapiens
atattttattacatg

SEQ ID NO: 364895 - DNA, 15 bp, Homo sapiens
tattttattacatgt

SEQ ID NO: 364896 - DNA, 15 bp, Homo sapiens
attttattacatgta

SEQ ID NO: 364897 - DNA, 15 bp, Homo sapiens
ttttattacatgtat

SEQ ID NO: 364898 - DNA, 15 bp, Homo sapiens
tttattacatgtatt

SEQ ID NO: 364899 - DNA, 15 bp, Homo sapiens
ttattacatgtattg

SEQ ID NO: 364900 - DNA, 15 bp, Homo sapiens
tattacatgtattgc

SEQ ID NO: 364901 - DNA, 15 bp, Homo sapiens
attacatgtattgca

SEQ ID NO: 364902 - DNA, 15 bp, Homo sapiens
ttacatgtattgcac

SEQ ID NO: 364903 - DNA, 15 bp, Homo sapiens
tacatgtattgcacg

SEQ ID NO: 364904 - DNA, 15 bp, Homo sapiens
acatgtattgcacga

SEQ ID NO: 364905 - DNA, 15 bp, Homo sapiens
catgtattgcacgat

SEQ ID NO: 364906 - DNA, 15 bp, Homo sapiens
atgtattgcacgatt

SEQ ID NO: 364907 - DNA, 15 bp, Homo sapiens
tgtattgcacgatta

SEQ ID NO: 364908 - DNA, 15 bp, Homo sapiens
gtattgcacgattat

SEQ ID NO: 364909 - DNA, 15 bp, Homo sapiens
tattgcacgattatg

SEQ ID NO: 364910 - DNA, 15 bp, Homo sapiens
attgcacgattatgt

SEQ ID NO: 364911 - DNA, 15 bp, Homo sapiens
ttgcacgattatgtg

SEQ ID NO: 364912 - DNA, 15 bp, Homo sapiens
tgcacgattatgtga

SEQ ID NO: 364913 - DNA, 15 bp, Homo sapiens
gcacgattatgtgag

SEQ ID NO: 364914 - DNA, 15 bp, Homo sapiens
cacgattatgtgaga

SEQ ID NO: 364915 - DNA, 15 bp, Homo sapiens
acgattatgtgagaa

SEQ ID NO: 364916 - DNA, 15 bp, Homo sapiens
cgattatgtgagaac

SEQ ID NO: 364917 - DNA, 15 bp, Homo sapiens
gattatgtgagaact

SEQ ID NO: 364918 - DNA, 15 bp, Homo sapiens
attatgtgagaactt

SEQ ID NO: 364919 - DNA, 15 bp, Homo sapiens
ttatgtgagaacttt

SEQ ID NO: 364920 - DNA, 15 bp, Homo sapiens
tatgtgagaactttt

SEQ ID NO: 364921 - DNA, 15 bp, Homo sapiens
atgtgagaacttttg

SEQ ID NO: 364922 - DNA, 15 bp, Homo sapiens
tgtgagaacttttgt

SEQ ID NO: 364923 - DNA, 15 bp, Homo sapiens
gtgagaacttttgtg

SEQ ID NO: 364924 - DNA, 15 bp, Homo sapiens
tgagaacttttgtga

SEQ ID NO: 364925 - DNA, 15 bp, Homo sapiens
gagaacttttgtgat

SEQ ID NO: 364926 - DNA, 15 bp, Homo sapiens
agaacttttgtgatt

SEQ ID NO: 364927 - DNA, 15 bp, Homo sapiens
gaacttttgtgatta

SEQ ID NO: 364928 - DNA, 15 bp, Homo sapiens
aacttttgtgattaa

SEQ ID NO: 364929 - DNA, 15 bp, Homo sapiens
acttttgtgattaaa

SEQ ID NO: 364930 - DNA, 15 bp, Homo sapiens
cttttgtgattaaaa

SEQ ID NO: 364931 - DNA, 15 bp, Homo sapiens
ttttgtgattaaaaa

SEQ ID NO: 364932 - DNA, 15 bp, Homo sapiens
tttgtgattaaaaat

SEQ ID NO: 364933 - DNA, 15 bp, Homo sapiens
ttgtgattaaaaatg

SEQ ID NO: 364934 - DNA, 15 bp, Homo sapiens
tgtgattaaaaatga

SEQ ID NO: 364935 - DNA, 15 bp, Homo sapiens
gtgattaaaaatgaa

SEQ ID NO: 364936 - DNA, 15 bp, Homo sapiens
tgattaaaaatgaaa

SEQ ID NO: 364937 - DNA, 15 bp, Homo sapiens
gattaaaaatgaaaa

SEQ ID NO: 364938 - DNA, 15 bp, Homo sapiens
attaaaaatgaaaac

SEQ ID NO: 364939 - DNA, 15 bp, Homo sapiens
ttaaaaatgaaaact

SEQ ID NO: 364940 - DNA, 15 bp, Homo sapiens
taaaaatgaaaactc

SEQ ID NO: 364941 - DNA, 15 bp, Homo sapiens
aaaaatgaaaactcc

SEQ ID NO: 364942 - DNA, 15 bp, Homo sapiens
aaaatgaaaactcct

SEQ ID NO: 364943 - DNA, 15 bp, Homo sapiens
aaatgaaaactccta

SEQ ID NO: 364944 - DNA, 15 bp, Homo sapiens
aatgaaaactcctag

SEQ ID NO: 364945 - DNA, 15 bp, Homo sapiens
atgaaaactcctagc

SEQ ID NO: 364946 - DNA, 15 bp, Homo sapiens
tgaaaactcctagct

SEQ ID NO: 364947 - DNA, 15 bp, Homo sapiens
gaaaactcctagctg

SEQ ID NO: 364948 - DNA, 15 bp, Homo sapiens
aaaactcctagctgc

SEQ ID NO: 364949 - DNA, 15 bp, Homo sapiens
aaactcctagctgca

SEQ ID NO: 364950 - DNA, 15 bp, Homo sapiens
aactcctagctgcaa

SEQ ID NO: 364951 - DNA, 15 bp, Homo sapiens
actcctagctgcaaa

SEQ ID NO: 364952 - DNA, 15 bp, Homo sapiens
ctcctagctgcaaaa

SEQ ID NO: 364953 - DNA, 15 bp, Homo sapiens
tcctagctgcaaaaa

SEQ ID NO: 364954 - DNA, 15 bp, Homo sapiens
cctagctgcaaaaac

SEQ ID NO: 364955 - DNA, 15 bp, Homo sapiens
ctagctgcaaaaaca

SEQ ID NO: 364956 - DNA, 15 bp, Homo sapiens
tagctgcaaaaacat

SEQ ID NO: 364957 - DNA, 15 bp, Homo sapiens
agctgcaaaaacata

SEQ ID NO: 364958 - DNA, 15 bp, Homo sapiens
gctgcaaaaacataa

SEQ ID NO: 364959 - DNA, 15 bp, Homo sapiens
ctgcaaaaacataaa

SEQ ID NO: 364960 - DNA, 15 bp, Homo sapiens
tgcaaaaacataaat

SEQ ID NO: 364961 - DNA, 15 bp, Homo sapiens
gcaaaaacataaatt

SEQ ID NO: 364962 - DNA, 15 bp, Homo sapiens
caaaaacataaattc

SEQ ID NO: 364963 - DNA, 15 bp, Homo sapiens
aaaaacataaattct

SEQ ID NO: 364964 - DNA, 15 bp, Homo sapiens
aaaacataaattctt

SEQ ID NO: 364965 - DNA, 15 bp, Homo sapiens
aaacataaattctta

SEQ ID NO: 364966 - DNA, 15 bp, Homo sapiens
aacataaattcttat

SEQ ID NO: 364967 - DNA, 15 bp, Homo sapiens
acataaattcttatt

SEQ ID NO: 364968 - DNA, 15 bp, Homo sapiens
cataaattcttatta

SEQ ID NO: 364969 - DNA, 15 bp, Homo sapiens
ataaattcttattag

SEQ ID NO: 364970 - DNA, 15 bp, Homo sapiens
taaattcttattagg

SEQ ID NO: 364971 - DNA, 15 bp, Homo sapiens
aaattcttattagga

SEQ ID NO: 364972 - DNA, 15 bp, Homo sapiens
aattcttattaggaa

SEQ ID NO: 364973 - DNA, 15 bp, Homo sapiens
attcttattaggaat

SEQ ID NO: 364974 - DNA, 15 bp, Homo sapiens
ttcttattaggaatg

SEQ ID NO: 364975 - DNA, 15 bp, Homo sapiens
tcttattaggaatga

SEQ ID NO: 364976 - DNA, 15 bp, Homo sapiens
cttattaggaatgat

SEQ ID NO: 364977 - DNA, 15 bp, Homo sapiens
ttattaggaatgata

SEQ ID NO: 364978 - DNA, 15 bp, Homo sapiens
tattaggaatgatac

SEQ ID NO: 364979 - DNA, 15 bp, Homo sapiens
attaggaatgataca

SEQ ID NO: 364980 - DNA, 15 bp, Homo sapiens
ttaggaatgatacaa

SEQ ID NO: 364981 - DNA, 15 bp, Homo sapiens
taggaatgatacaat

SEQ ID NO: 364982 - DNA, 15 bp, Homo sapiens
aggaatgatacaata

SEQ ID NO: 364983 - DNA, 15 bp, Homo sapiens
ggaatgatacaatac

SEQ ID NO: 364984 - DNA, 15 bp, Homo sapiens
gaatgatacaataca

SEQ ID NO: 364985 - DNA, 15 bp, Homo sapiens
aatgatacaatacaa

SEQ ID NO: 364986 - DNA, 15 bp, Homo sapiens
atgatacaatacaat

SEQ ID NO: 364987 - DNA, 15 bp, Homo sapiens
tgatacaatacaatt

SEQ ID NO: 364988 - DNA, 15 bp, Homo sapiens
gatacaatacaattt

SEQ ID NO: 364989 - DNA, 15 bp, Homo sapiens
atacaatacaattta

SEQ ID NO: 364990 - DNA, 15 bp, Homo sapiens
tacaatacaatttat

SEQ ID NO: 364991 - DNA, 15 bp, Homo sapiens
acaatacaatttatt

SEQ ID NO: 364992 - DNA, 15 bp, Homo sapiens
caatacaatttattt

SEQ ID NO: 364993 - DNA, 15 bp, Homo sapiens
aatacaatttattta

SEQ ID NO: 364994 - DNA, 15 bp, Homo sapiens
atacaatttatttaa

SEQ ID NO: 364995 - DNA, 15 bp, Homo sapiens
tacaatttatttaaa

SEQ ID NO: 364996 - DNA, 15 bp, Homo sapiens
acaatttatttaaaa

SEQ ID NO: 364997 - DNA, 15 bp, Homo sapiens
caatttatttaaaaa

SEQ ID NO: 364998 - DNA, 15 bp, Homo sapiens
aatttatttaaaaat

SEQ ID NO: 364999 - DNA, 15 bp, Homo sapiens
atttatttaaaaatt

SEQ ID NO: 365000 - DNA, 15 bp, Homo sapiens
tttatttaaaaattg

SEQ ID NO: 365001 - DNA, 15 bp, Homo sapiens
ttatttaaaaattgc

SEQ ID NO: 365002 - DNA, 15 bp, Homo sapiens
tatttaaaaattgca

SEQ ID NO: 365003 - DNA, 15 bp, Homo sapiens
atttaaaaattgcat

SEQ ID NO: 365004 - DNA, 15 bp, Homo sapiens
tttaaaaattgcatt

SEQ ID NO: 365005 - DNA, 15 bp, Homo sapiens
ttaaaaattgcattc

SEQ ID NO: 365006 - DNA, 15 bp, Homo sapiens
taaaaattgcattca

SEQ ID NO: 365007 - DNA, 15 bp, Homo sapiens
aaaaattgcattcag

SEQ ID NO: 365008 - DNA, 15 bp, Homo sapiens
aaaattgcattcagt

SEQ ID NO: 365009 - DNA, 15 bp, Homo sapiens
aaattgcattcagtt

SEQ ID NO: 365010 - DNA, 15 bp, Homo sapiens
aattgcattcagttt

SEQ ID NO: 365011 - DNA, 15 bp, Homo sapiens
attgcattcagtttt

SEQ ID NO: 365012 - DNA, 15 bp, Homo sapiens
ttgcattcagttttt

SEQ ID NO: 365013 - DNA, 15 bp, Homo sapiens
tgcattcagttttta

SEQ ID NO: 365014 - DNA, 15 bp, Homo sapiens
gcattcagtttttaa

SEQ ID NO: 365015 - DNA, 15 bp, Homo sapiens
cattcagtttttaaa

SEQ ID NO: 365016 - DNA, 15 bp, Homo sapiens
attcagtttttaaac

SEQ ID NO: 365017 - DNA, 15 bp, Homo sapiens
ttcagtttttaaacc

SEQ ID NO: 365018 - DNA, 15 bp, Homo sapiens
tcagtttttaaacca

SEQ ID NO: 365019 - DNA, 15 bp, Homo sapiens
cagtttttaaaccag

SEQ ID NO: 365020 - DNA, 15 bp, Homo sapiens
agtttttaaaccagc

SEQ ID NO: 365021 - DNA, 15 bp, Homo sapiens
gtttttaaaccagca

SEQ ID NO: 365022 - DNA, 15 bp, Homo sapiens
tttttaaaccagcag

SEQ ID NO: 365023 - DNA, 15 bp, Homo sapiens
ttttaaaccagcagt

SEQ ID NO: 365024 - DNA, 15 bp, Homo sapiens
tttaaaccagcagtt

SEQ ID NO: 365025 - DNA, 15 bp, Homo sapiens
ttaaaccagcagtta

SEQ ID NO: 365026 - DNA, 15 bp, Homo sapiens
taaaccagcagttaa

SEQ ID NO: 365027 - DNA, 15 bp, Homo sapiens
aaaccagcagttaat

SEQ ID NO: 365028 - DNA, 15 bp, Homo sapiens
aaccagcagttaatt

SEQ ID NO: 365029 - DNA, 15 bp, Homo sapiens
accagcagttaatta

SEQ ID NO: 365030 - DNA, 15 bp, Homo sapiens
ccagcagttaattat

SEQ ID NO: 365031 - DNA, 15 bp, Homo sapiens
cagcagttaattata

SEQ ID NO: 365032 - DNA, 15 bp, Homo sapiens
agcagttaattatag

SEQ ID NO: 365033 - DNA, 15 bp, Homo sapiens
gcagttaattatagc

SEQ ID NO: 365034 - DNA, 15 bp, Homo sapiens
cagttaattatagca

SEQ ID NO: 365035 - DNA, 15 bp, Homo sapiens
agttaattatagcag

SEQ ID NO: 365036 - DNA, 15 bp, Homo sapiens
gttaattatagcagc

SEQ ID NO: 365037 - DNA, 15 bp, Homo sapiens
ttaattatagcagct

SEQ ID NO: 365038 - DNA, 15 bp, Homo sapiens
taattatagcagcta

SEQ ID NO: 365039 - DNA, 15 bp, Homo sapiens
aattatagcagctat

SEQ ID NO: 365040 - DNA, 15 bp, Homo sapiens
attatagcagctata

SEQ ID NO: 365041 - DNA, 15 bp, Homo sapiens
ttatagcagctataa

SEQ ID NO: 365042 - DNA, 15 bp, Homo sapiens
tatagcagctataaa

SEQ ID NO: 365043 - DNA, 15 bp, Homo sapiens
atagcagctataaaa

SEQ ID NO: 365044 - DNA, 15 bp, Homo sapiens
tagcagctataaaaa

SEQ ID NO: 365045 - DNA, 15 bp, Homo sapiens
agcagctataaaaat

SEQ ID NO: 365046 - DNA, 15 bp, Homo sapiens
gcagctataaaaata

SEQ ID NO: 365047 - DNA, 15 bp, Homo sapiens
cagctataaaaataa

SEQ ID NO: 365048 - DNA, 15 bp, Homo sapiens
agctataaaaataaa

SEQ ID NO: 365049 - DNA, 15 bp, Homo sapiens
gctataaaaataaag

SEQ ID NO: 365050 - DNA, 15 bp, Homo sapiens
ctataaaaataaaga

SEQ ID NO: 365051 - DNA, 15 bp, Homo sapiens
tataaaaataaagat

SEQ ID NO: 365052 - DNA, 15 bp, Homo sapiens
ataaaaataaagata

SEQ ID NO: 365053 - DNA, 15 bp, Homo sapiens
taaaaataaagatac

SEQ ID NO: 365054 - DNA, 15 bp, Homo sapiens
aaaaataaagatacc

SEQ ID NO: 365055 - DNA, 15 bp, Homo sapiens
aaaataaagatacca

SEQ ID NO: 365056 - DNA, 15 bp, Homo sapiens
aaataaagataccac

SEQ ID NO: 365057 - DNA, 15 bp, Homo sapiens
aataaagataccacc

SEQ ID NO: 365058 - DNA, 15 bp, Homo sapiens
ataaagataccacca

SEQ ID NO: 365059 - DNA, 15 bp, Homo sapiens
taaagataccaccag

SEQ ID NO: 365060 - DNA, 15 bp, Homo sapiens
aaagataccaccagg

SEQ ID NO: 365061 - DNA, 15 bp, Homo sapiens
aagataccaccaggc

SEQ ID NO: 365062 - DNA, 15 bp, Homo sapiens
agataccaccaggct

SEQ ID NO: 365063 - DNA, 15 bp, Homo sapiens
gataccaccaggctt

SEQ ID NO: 365064 - DNA, 15 bp, Homo sapiens
ataccaccaggcttt

SEQ ID NO: 365065 - DNA, 15 bp, Homo sapiens
taccaccaggctttt

SEQ ID NO: 365066 - DNA, 15 bp, Homo sapiens
accaccaggctttta

SEQ ID NO: 365067 - DNA, 15 bp, Homo sapiens
ccaccaggcttttaa

SEQ ID NO: 365068 - DNA, 15 bp, Homo sapiens
caccaggcttttaat

SEQ ID NO: 365069 - DNA, 15 bp, Homo sapiens
accaggcttttaata

SEQ ID NO: 365070 - DNA, 15 bp, Homo sapiens
ccaggcttttaatag

SEQ ID NO: 365071 - DNA, 15 bp, Homo sapiens
caggcttttaatagc

SEQ ID NO: 365072 - DNA, 15 bp, Homo sapiens
aggcttttaatagct

SEQ ID NO: 365073 - DNA, 15 bp, Homo sapiens
ggcttttaatagctt

SEQ ID NO: 365074 - DNA, 15 bp, Homo sapiens
gcttttaatagcttt

SEQ ID NO: 365075 - DNA, 15 bp, Homo sapiens
cttttaatagctttc

SEQ ID NO: 365076 - DNA, 15 bp, Homo sapiens
ttttaatagctttca

SEQ ID NO: 365077 - DNA, 15 bp, Homo sapiens
tttaatagctttcaa

SEQ ID NO: 365078 - DNA, 15 bp, Homo sapiens
ttaatagctttcaaa

SEQ ID NO: 365079 - DNA, 15 bp, Homo sapiens
taatagctttcaaat

SEQ ID NO: 365080 - DNA, 15 bp, Homo sapiens
aatagctttcaaatc

SEQ ID NO: 365081 - DNA, 15 bp, Homo sapiens
atagctttcaaatcc

SEQ ID NO: 365082 - DNA, 15 bp, Homo sapiens
tagctttcaaatcct

SEQ ID NO: 365083 - DNA, 15 bp, Homo sapiens
agctttcaaatcctt

SEQ ID NO: 365084 - DNA, 15 bp, Homo sapiens
gctttcaaatccttt

SEQ ID NO: 365085 - DNA, 15 bp, Homo sapiens
ctttcaaatcctttt

SEQ ID NO: 365086 - DNA, 15 bp, Homo sapiens
tttcaaatcctttta

SEQ ID NO: 365087 - DNA, 15 bp, Homo sapiens
ttcaaatccttttaa

SEQ ID NO: 365088 - DNA, 15 bp, Homo sapiens
tcaaatccttttaaa

SEQ ID NO: 365089 - DNA, 15 bp, Homo sapiens
caaatccttttaaaa

SEQ ID NO: 365090 - DNA, 15 bp, Homo sapiens
aaatccttttaaaaa

SEQ ID NO: 365091 - DNA, 15 bp, Homo sapiens
aatccttttaaaaaa

SEQ ID NO: 365092 - DNA, 15 bp, Homo sapiens
atccttttaaaaaac

SEQ ID NO: 365093 - DNA, 15 bp, Homo sapiens
tccttttaaaaaaca

SEQ ID NO: 365094 - DNA, 15 bp, Homo sapiens
ccttttaaaaaacac

SEQ ID NO: 365095 - DNA, 15 bp, Homo sapiens
cttttaaaaaacaca

SEQ ID NO: 365096 - DNA, 15 bp, Homo sapiens
ttttaaaaaacacat

SEQ ID NO: 365097 - DNA, 15 bp, Homo sapiens
tttaaaaaacacata

SEQ ID NO: 365098 - DNA, 15 bp, Homo sapiens
ttaaaaaacacataa

SEQ ID NO: 365099 - DNA, 15 bp, Homo sapiens
taaaaaacacataat

SEQ ID NO: 365100 - DNA, 15 bp, Homo sapiens
aaaaaacacataatc

SEQ ID NO: 365101 - DNA, 15 bp, Homo sapiens
aaaaacacataatct

SEQ ID NO: 365102 - DNA, 15 bp, Homo sapiens
aaaacacataatctt

SEQ ID NO: 365103 - DNA, 15 bp, Homo sapiens
aaacacataatctta

SEQ ID NO: 365104 - DNA, 15 bp, Homo sapiens
aacacataatcttat

SEQ ID NO: 365105 - DNA, 15 bp, Homo sapiens
acacataatcttatt

SEQ ID NO: 365106 - DNA, 15 bp, Homo sapiens
cacataatcttattt

SEQ ID NO: 365107 - DNA, 15 bp, Homo sapiens
acataatcttatttg

SEQ ID NO: 365108 - DNA, 15 bp, Homo sapiens
cataatcttatttgt

SEQ ID NO: 365109 - DNA, 15 bp, Homo sapiens
ataatcttatttgtc

SEQ ID NO: 365110 - DNA, 15 bp, Homo sapiens
taatcttatttgtca

SEQ ID NO: 365111 - DNA, 15 bp, Homo sapiens
aatcttatttgtcat

SEQ ID NO: 365112 - DNA, 15 bp, Homo sapiens
atcttatttgtcata

SEQ ID NO: 365113 - DNA, 15 bp, Homo sapiens
tcttatttgtcatat

SEQ ID NO: 365114 - DNA, 15 bp, Homo sapiens
cttatttgtcatatg

SEQ ID NO: 365115 - DNA, 15 bp, Homo sapiens
ttatttgtcatatga

SEQ ID NO: 365116 - DNA, 15 bp, Homo sapiens
tatttgtcatatgag

SEQ ID NO: 365117 - DNA, 15 bp, Homo sapiens
atttgtcatatgagt

SEQ ID NO: 365118 - DNA, 15 bp, Homo sapiens
tttgtcatatgagtt

SEQ ID NO: 365119 - DNA, 15 bp, Homo sapiens
ttgtcatatgagttc

SEQ ID NO: 365120 - DNA, 15 bp, Homo sapiens
tgtcatatgagttct

SEQ ID NO: 365121 - DNA, 15 bp, Homo sapiens
gtcatatgagttcta

SEQ ID NO: 365122 - DNA, 15 bp, Homo sapiens
tcatatgagttctaa

SEQ ID NO: 365123 - DNA, 15 bp, Homo sapiens
catatgagttctaat

SEQ ID NO: 365124 - DNA, 15 bp, Homo sapiens
atatgagttctaatc

SEQ ID NO: 365125 - DNA, 15 bp, Homo sapiens
tatgagttctaatca

SEQ ID NO: 365126 - DNA, 15 bp, Homo sapiens
atgagttctaatcat

SEQ ID NO: 365127 - DNA, 15 bp, Homo sapiens
tgagttctaatcata

SEQ ID NO: 365128 - DNA, 15 bp, Homo sapiens
gagttctaatcatat

SEQ ID NO: 365129 - DNA, 15 bp, Homo sapiens
agttctaatcatatt

SEQ ID NO: 365130 - DNA, 15 bp, Homo sapiens
gttctaatcatattc

SEQ ID NO: 365131 - DNA, 15 bp, Homo sapiens
ttctaatcatattcc

SEQ ID NO: 365132 - DNA, 15 bp, Homo sapiens
tctaatcatattcct

SEQ ID NO: 365133 - DNA, 15 bp, Homo sapiens
ctaatcatattcctc

SEQ ID NO: 365134 - DNA, 15 bp, Homo sapiens
taatcatattcctct

SEQ ID NO: 365135 - DNA, 15 bp, Homo sapiens
aatcatattcctctc

SEQ ID NO: 365136 - DNA, 15 bp, Homo sapiens
atcatattcctctct

SEQ ID NO: 365137 - DNA, 15 bp, Homo sapiens
tcatattcctctctt

SEQ ID NO: 365138 - DNA, 15 bp, Homo sapiens
catattcctctcttc

SEQ ID NO: 365139 - DNA, 15 bp, Homo sapiens
atattcctctcttct

SEQ ID NO: 365140 - DNA, 15 bp, Homo sapiens
tattcctctcttctg

SEQ ID NO: 365141 - DNA, 15 bp, Homo sapiens
attcctctcttctga

SEQ ID NO: 365142 - DNA, 15 bp, Homo sapiens
ttcctctcttctgac

SEQ ID NO: 365143 - DNA, 15 bp, Homo sapiens
tcctctcttctgaca

SEQ ID NO: 365144 - DNA, 15 bp, Homo sapiens
cctctcttctgacag

SEQ ID NO: 365145 - DNA, 15 bp, Homo sapiens
ctctcttctgacaga

SEQ ID NO: 365146 - DNA, 15 bp, Homo sapiens
tctcttctgacagat

SEQ ID NO: 365147 - DNA, 15 bp, Homo sapiens
ctcttctgacagatg

SEQ ID NO: 365148 - DNA, 15 bp, Homo sapiens
tcttctgacagatgg

SEQ ID NO: 365149 - DNA, 15 bp, Homo sapiens
cttctgacagatggt

SEQ ID NO: 365150 - DNA, 15 bp, Homo sapiens
ttctgacagatggtt

SEQ ID NO: 365151 - DNA, 15 bp, Homo sapiens
tctgacagatggttt

SEQ ID NO: 365152 - DNA, 15 bp, Homo sapiens
ctgacagatggttta

SEQ ID NO: 365153 - DNA, 15 bp, Homo sapiens
tgacagatggtttat

SEQ ID NO: 365154 - DNA, 15 bp, Homo sapiens
gacagatggtttata

SEQ ID NO: 365155 - DNA, 15 bp, Homo sapiens
acagatggtttatat

SEQ ID NO: 365156 - DNA, 15 bp, Homo sapiens
cagatggtttatatt

SEQ ID NO: 365157 - DNA, 15 bp, Homo sapiens
agatggtttatattc

SEQ ID NO: 365158 - DNA, 15 bp, Homo sapiens
gatggtttatattct

SEQ ID NO: 365159 - DNA, 15 bp, Homo sapiens
atggtttatattctt

SEQ ID NO: 365160 - DNA, 15 bp, Homo sapiens
tggtttatattctta

SEQ ID NO: 365161 - DNA, 15 bp, Homo sapiens
ggtttatattcttat

SEQ ID NO: 365162 - DNA, 15 bp, Homo sapiens
gtttatattcttata

SEQ ID NO: 365163 - DNA, 15 bp, Homo sapiens
tttatattcttataa

SEQ ID NO: 365164 - DNA, 15 bp, Homo sapiens
ttatattcttataaa

SEQ ID NO: 365165 - DNA, 15 bp, Homo sapiens
tatattcttataaat

SEQ ID NO: 365166 - DNA, 15 bp, Homo sapiens
atattcttataaatg

SEQ ID NO: 365167 - DNA, 15 bp, Homo sapiens
tattcttataaatgt

SEQ ID NO: 365168 - DNA, 15 bp, Homo sapiens
attcttataaatgtt

SEQ ID NO: 365169 - DNA, 15 bp, Homo sapiens
ttcttataaatgtta

SEQ ID NO: 365170 - DNA, 15 bp, Homo sapiens
tcttataaatgttat

SEQ ID NO: 365171 - DNA, 15 bp, Homo sapiens
cttataaatgttatt

SEQ ID NO: 365172 - DNA, 15 bp, Homo sapiens
ttataaatgttattc

SEQ ID NO: 365173 - DNA, 15 bp, Homo sapiens
tataaatgttattct

SEQ ID NO: 365174 - DNA, 15 bp, Homo sapiens
ataaatgttattctt

SEQ ID NO: 365175 - DNA, 15 bp, Homo sapiens
taaatgttattctta

SEQ ID NO: 365176 - DNA, 15 bp, Homo sapiens
aaatgttattcttat

SEQ ID NO: 365177 - DNA, 15 bp, Homo sapiens
aatgttattcttata

SEQ ID NO: 365178 - DNA, 15 bp, Homo sapiens
atgttattcttataa

SEQ ID NO: 365179 - DNA, 15 bp, Homo sapiens
tgttattcttataac

SEQ ID NO: 365180 - DNA, 15 bp, Homo sapiens
gttattcttataaca

SEQ ID NO: 365181 - DNA, 15 bp, Homo sapiens
ttattcttataacac

SEQ ID NO: 365182 - DNA, 15 bp, Homo sapiens
tattcttataacact

SEQ ID NO: 365183 - DNA, 15 bp, Homo sapiens
attcttataacacta

SEQ ID NO: 365184 - DNA, 15 bp, Homo sapiens
ttcttataacactat

SEQ ID NO: 365185 - DNA, 15 bp, Homo sapiens
tcttataacactata

SEQ ID NO: 365186 - DNA, 15 bp, Homo sapiens
cttataacactataa

SEQ ID NO: 365187 - DNA, 15 bp, Homo sapiens
ttataacactataaa

SEQ ID NO: 365188 - DNA, 15 bp, Homo sapiens
tataacactataaag

SEQ ID NO: 365189 - DNA, 15 bp, Homo sapiens
ataacactataaaga

SEQ ID NO: 365190 - DNA, 15 bp, Homo sapiens
taacactataaagat

SEQ ID NO: 365191 - DNA, 15 bp, Homo sapiens
aacactataaagatc

SEQ ID NO: 365192 - DNA, 15 bp, Homo sapiens
acactataaagatct

SEQ ID NO: 365193 - DNA, 15 bp, Homo sapiens
cactataaagatcta

SEQ ID NO: 365194 - DNA, 15 bp, Homo sapiens
actataaagatctaa

SEQ ID NO: 365195 - DNA, 15 bp, Homo sapiens
ctataaagatctaat

SEQ ID NO: 365196 - DNA, 15 bp, Homo sapiens
tataaagatctaatt

SEQ ID NO: 365197 - DNA, 15 bp, Homo sapiens
ataaagatctaattg

SEQ ID NO: 365198 - DNA, 15 bp, Homo sapiens
taaagatctaattga

SEQ ID NO: 365199 - DNA, 15 bp, Homo sapiens
aaagatctaattgag

SEQ ID NO: 365200 - DNA, 15 bp, Homo sapiens
aagatctaattgagg

SEQ ID NO: 365201 - DNA, 15 bp, Homo sapiens
agatctaattgaggc

SEQ ID NO: 365202 - DNA, 15 bp, Homo sapiens
gatctaattgaggca

SEQ ID NO: 365203 - DNA, 15 bp, Homo sapiens
atctaattgaggcag

SEQ ID NO: 365204 - DNA, 15 bp, Homo sapiens
tctaattgaggcagt

SEQ ID NO: 365205 - DNA, 15 bp, Homo sapiens
ctaattgaggcagtt

SEQ ID NO: 365206 - DNA, 15 bp, Homo sapiens
taattgaggcagttc

SEQ ID NO: 365207 - DNA, 15 bp, Homo sapiens
aattgaggcagttcc

SEQ ID NO: 365208 - DNA, 15 bp, Homo sapiens
attgaggcagttcct

SEQ ID NO: 365209 - DNA, 15 bp, Homo sapiens
ttgaggcagttcctt

SEQ ID NO: 365210 - DNA, 15 bp, Homo sapiens
tgaggcagttccttt

SEQ ID NO: 365211 - DNA, 15 bp, Homo sapiens
gaggcagttcctttt

SEQ ID NO: 365212 - DNA, 15 bp, Homo sapiens
aggcagttccttttt

SEQ ID NO: 365213 - DNA, 15 bp, Homo sapiens
ggcagttcctttttt

SEQ ID NO: 365214 - DNA, 15 bp, Homo sapiens
gcagttcctttttta

SEQ ID NO: 365215 - DNA, 15 bp, Homo sapiens
cagttccttttttat

SEQ ID NO: 365216 - DNA, 15 bp, Homo sapiens
agttccttttttata

SEQ ID NO: 365217 - DNA, 15 bp, Homo sapiens
gttccttttttatat

SEQ ID NO: 365218 - DNA, 15 bp, Homo sapiens
ttccttttttatatt

SEQ ID NO: 365219 - DNA, 15 bp, Homo sapiens
tccttttttatattc

SEQ ID NO: 365220 - DNA, 15 bp, Homo sapiens
ccttttttatattca

SEQ ID NO: 365221 - DNA, 15 bp, Homo sapiens
cttttttatattcat

SEQ ID NO: 365222 - DNA, 15 bp, Homo sapiens
ttttttatattcatt

SEQ ID NO: 365223 - DNA, 15 bp, Homo sapiens
tttttatattcattt

SEQ ID NO: 365224 - DNA, 15 bp, Homo sapiens
ttatattcatttgac

SEQ ID NO: 365225 - DNA, 15 bp, Homo sapiens
tatattcatttgact

SEQ ID NO: 365226 - DNA, 15 bp, Homo sapiens
atattcatttgactg

SEQ ID NO: 365227 - DNA, 15 bp, Homo sapiens
tattcatttgactgt

SEQ ID NO: 365228 - DNA, 15 bp, Homo sapiens
attcatttgactgtt

SEQ ID NO: 365229 - DNA, 15 bp, Homo sapiens
ttcatttgactgttt

SEQ ID NO: 365230 - DNA, 15 bp, Homo sapiens
tcatttgactgtttt

SEQ ID NO: 365231 - DNA, 15 bp, Homo sapiens
catttgactgttttc

SEQ ID NO: 365232 - DNA, 15 bp, Homo sapiens
atttgactgttttcc

SEQ ID NO: 365233 - DNA, 15 bp, Homo sapiens
tttgactgttttcct

SEQ ID NO: 365234 - DNA, 15 bp, Homo sapiens
ttgactgttttcctt

SEQ ID NO: 365235 - DNA, 15 bp, Homo sapiens
tgactgttttccttg

SEQ ID NO: 365236 - DNA, 15 bp, Homo sapiens
gactgttttccttgc

SEQ ID NO: 365237 - DNA, 15 bp, Homo sapiens
actgttttccttgca

SEQ ID NO: 365238 - DNA, 15 bp, Homo sapiens
ctgttttccttgcat

SEQ ID NO: 365239 - DNA, 15 bp, Homo sapiens
tgttttccttgcatc

SEQ ID NO: 365240 - DNA, 15 bp, Homo sapiens
gttttccttgcatca

SEQ ID NO: 365241 - DNA, 15 bp, Homo sapiens
ttttccttgcatcat

SEQ ID NO: 365242 - DNA, 15 bp, Homo sapiens
tttccttgcatcatt

SEQ ID NO: 365243 - DNA, 15 bp, Homo sapiens
ttccttgcatcattt

SEQ ID NO: 365244 - DNA, 15 bp, Homo sapiens
tccttgcatcattta

SEQ ID NO: 365245 - DNA, 15 bp, Homo sapiens
ccttgcatcatttaa

SEQ ID NO: 365246 - DNA, 15 bp, Homo sapiens
cttgcatcatttaaa

SEQ ID NO: 365247 - DNA, 15 bp, Homo sapiens
ttgcatcatttaaaa

SEQ ID NO: 365248 - DNA, 15 bp, Homo sapiens
tgcatcatttaaaat

SEQ ID NO: 365249 - DNA, 15 bp, Homo sapiens
gcatcatttaaaatt

SEQ ID NO: 365250 - DNA, 15 bp, Homo sapiens
catcatttaaaattt

SEQ ID NO: 365251 - DNA, 15 bp, Homo sapiens
atcatttaaaatttt

SEQ ID NO: 365252 - DNA, 15 bp, Homo sapiens
tcatttaaaattttt

SEQ ID NO: 365253 - DNA, 15 bp, Homo sapiens
atttaaaatttttgc

SEQ ID NO: 365254 - DNA, 15 bp, Homo sapiens
tttaaaatttttgct

SEQ ID NO: 365255 - DNA, 15 bp, Homo sapiens
ttaaaatttttgctt

SEQ ID NO: 365256 - DNA, 15 bp, Homo sapiens
taaaatttttgcttt

SEQ ID NO: 365257 - DNA, 15 bp, Homo sapiens
aaaatttttgctttg

SEQ ID NO: 365258 - DNA, 15 bp, Homo sapiens
aaatttttgctttgt

SEQ ID NO: 365259 - DNA, 15 bp, Homo sapiens
aatttttgctttgtt

SEQ ID NO: 365260 - DNA, 15 bp, Homo sapiens
atttttgctttgttt

SEQ ID NO: 365261 - DNA, 15 bp, Homo sapiens
tttttgctttgtttt

SEQ ID NO: 365262 - DNA, 15 bp, Homo sapiens
ttttgctttgttttt

SEQ ID NO: 365263 - DNA, 15 bp, Homo sapiens
tttgctttgtttttt

SEQ ID NO: 365264 - DNA, 15 bp, Homo sapiens
ttgctttgttttttt

SEQ ID NO: 365265 - DNA, 15 bp, Homo sapiens
tgctttgtttttttc

SEQ ID NO: 365266 - DNA, 15 bp, Homo sapiens
gctttgtttttttct

SEQ ID NO: 365267 - DNA, 15 bp, Homo sapiens
ctttgtttttttcta

SEQ ID NO: 365268 - DNA, 15 bp, Homo sapiens
tttgtttttttctat

SEQ ID NO: 365269 - DNA, 15 bp, Homo sapiens
ttgtttttttctata

SEQ ID NO: 365270 - DNA, 15 bp, Homo sapiens
tgtttttttctatat

SEQ ID NO: 365271 - DNA, 15 bp, Homo sapiens
gtttttttctatatc

SEQ ID NO: 365272 - DNA, 15 bp, Homo sapiens
tttttttctatatct

SEQ ID NO: 365273 - DNA, 15 bp, Homo sapiens
ttttttctatatctc

SEQ ID NO: 365274 - DNA, 15 bp, Homo sapiens
tttttctatatctct

SEQ ID NO: 365275 - DNA, 15 bp, Homo sapiens
ttttctatatctctt

SEQ ID NO: 365276 - DNA, 15 bp, Homo sapiens
tttctatatctcttt

SEQ ID NO: 365277 - DNA, 15 bp, Homo sapiens
ttctatatctctttt

SEQ ID NO: 365278 - DNA, 15 bp, Homo sapiens
tctatatctcttttt

SEQ ID NO: 365279 - DNA, 15 bp, Homo sapiens
ctatatctctttttg

SEQ ID NO: 365280 - DNA, 15 bp, Homo sapiens
tatatctctttttgt

SEQ ID NO: 365281 - DNA, 15 bp, Homo sapiens
atatctctttttgta

SEQ ID NO: 365282 - DNA, 15 bp, Homo sapiens
tatctctttttgtaa

SEQ ID NO: 365283 - DNA, 15 bp, Homo sapiens
atctctttttgtaac

SEQ ID NO: 365284 - DNA, 15 bp, Homo sapiens
tctctttttgtaaca

SEQ ID NO: 365285 - DNA, 15 bp, Homo sapiens
ctctttttgtaacag

SEQ ID NO: 365286 - DNA, 15 bp, Homo sapiens
tctttttgtaacagt

SEQ ID NO: 365287 - DNA, 15 bp, Homo sapiens
ctttttgtaacagtg

SEQ ID NO: 365288 - DNA, 15 bp, Homo sapiens
tttttgtaacagtgc

SEQ ID NO: 365289 - DNA, 15 bp, Homo sapiens
ttttgtaacagtgct

SEQ ID NO: 365290 - DNA, 15 bp, Homo sapiens
tttgtaacagtgctc

SEQ ID NO: 365291 - DNA, 15 bp, Homo sapiens
ttgtaacagtgctct

SEQ ID NO: 365292 - DNA, 15 bp, Homo sapiens
tgtaacagtgctcta

SEQ ID NO: 365293 - DNA, 15 bp, Homo sapiens
gtaacagtgctctat

SEQ ID NO: 365294 - DNA, 15 bp, Homo sapiens
taacagtgctctatt

SEQ ID NO: 365295 - DNA, 15 bp, Homo sapiens
aacagtgctctattc

SEQ ID NO: 365296 - DNA, 15 bp, Homo sapiens
acagtgctctattca

SEQ ID NO: 365297 - DNA, 15 bp, Homo sapiens
cagtgctctattcaa

SEQ ID NO: 365298 - DNA, 15 bp, Homo sapiens
agtgctctattcaaa

SEQ ID NO: 365299 - DNA, 15 bp, Homo sapiens
gtgctctattcaaat

SEQ ID NO: 365300 - DNA, 15 bp, Homo sapiens
tgctctattcaaata

SEQ ID NO: 365301 - DNA, 15 bp, Homo sapiens
gctctattcaaatat

SEQ ID NO: 365302 - DNA, 15 bp, Homo sapiens
ctctattcaaatata

SEQ ID NO: 365303 - DNA, 15 bp, Homo sapiens
tctattcaaatataa

SEQ ID NO: 365304 - DNA, 15 bp, Homo sapiens
ctattcaaatataat

SEQ ID NO: 365305 - DNA, 15 bp, Homo sapiens
tattcaaatataata

SEQ ID NO: 365306 - DNA, 15 bp, Homo sapiens
attcaaatataatag

SEQ ID NO: 365307 - DNA, 15 bp, Homo sapiens
ttcaaatataatagt

SEQ ID NO: 365308 - DNA, 15 bp, Homo sapiens
tcaaatataatagtt

SEQ ID NO: 365309 - DNA, 15 bp, Homo sapiens
caaatataatagtta

SEQ ID NO: 365310 - DNA, 15 bp, Homo sapiens
aaatataatagttat

SEQ ID NO: 365311 - DNA, 15 bp, Homo sapiens
aatataatagttatt

SEQ ID NO: 365312 - DNA, 15 bp, Homo sapiens
atataatagttattt

SEQ ID NO: 365313 - DNA, 15 bp, Homo sapiens
tataatagttatttt

SEQ ID NO: 365314 - DNA, 15 bp, Homo sapiens
ataatagttatttta

SEQ ID NO: 365315 - DNA, 15 bp, Homo sapiens
taatagttattttaa

SEQ ID NO: 365316 - DNA, 15 bp, Homo sapiens
aatagttattttaat

SEQ ID NO: 365317 - DNA, 15 bp, Homo sapiens
atagttattttaata

SEQ ID NO: 365318 - DNA, 15 bp, Homo sapiens
tagttattttaataa

SEQ ID NO: 365319 - DNA, 15 bp, Homo sapiens
agttattttaataaa

SEQ ID NO: 365320 - DNA, 15 bp, Homo sapiens
gttattttaataaac

SEQ ID NO: 365321 - DNA, 15 bp, Homo sapiens
ttattttaataaaca

SEQ ID NO: 365322 - DNA, 15 bp, Homo sapiens
tattttaataaacaa

SEQ ID NO: 365323 - DNA, 15 bp, Homo sapiens
attttaataaacaag

SEQ ID NO: 365324 - DNA, 15 bp, Homo sapiens
ttttaataaacaagc

SEQ ID NO: 365325 - DNA, 15 bp, Homo sapiens
tttaataaacaagcc

SEQ ID NO: 365326 - DNA, 15 bp, Homo sapiens
ttaataaacaagcca

SEQ ID NO: 365327 - DNA, 15 bp, Homo sapiens
taataaacaagccaa

SEQ ID NO: 365328 - DNA, 15 bp, Homo sapiens
aataaacaagccaaa

SEQ ID NO: 365329 - DNA, 15 bp, Homo sapiens
ataaacaagccaaat

SEQ ID NO: 365330 - DNA, 15 bp, Homo sapiens
taaacaagccaaatt

SEQ ID NO: 365331 - DNA, 15 bp, Homo sapiens
aaacaagccaaattc

SEQ ID NO: 365332 - DNA, 15 bp, Homo sapiens
aacaagccaaattca

SEQ ID NO: 365333 - DNA, 15 bp, Homo sapiens
acaagccaaattcac

SEQ ID NO: 365334 - DNA, 15 bp, Homo sapiens
caagccaaattcaca

SEQ ID NO: 365335 - DNA, 15 bp, Homo sapiens
aagccaaattcacat

SEQ ID NO: 365336 - DNA, 15 bp, Homo sapiens
agccaaattcacatg

SEQ ID NO: 365337 - DNA, 15 bp, Homo sapiens
gccaaattcacatgt

SEQ ID NO: 365338 - DNA, 15 bp, Homo sapiens
ccaaattcacatgtt

SEQ ID NO: 365339 - DNA, 15 bp, Homo sapiens
caaattcacatgttt

SEQ ID NO: 365340 - DNA, 15 bp, Homo sapiens
aaattcacatgtttc

SEQ ID NO: 365341 - DNA, 15 bp, Homo sapiens
aattcacatgtttct

SEQ ID NO: 365342 - DNA, 15 bp, Homo sapiens
attcacatgtttctt

SEQ ID NO: 365343 - DNA, 15 bp, Homo sapiens
ttcacatgtttcttg

SEQ ID NO: 365344 - DNA, 15 bp, Homo sapiens
tcacatgtttcttgt

SEQ ID NO: 365345 - DNA, 15 bp, Homo sapiens
cacatgtttcttgtc

SEQ ID NO: 365346 - DNA, 15 bp, Homo sapiens
acatgtttcttgtct

SEQ ID NO: 365347 - DNA, 15 bp, Homo sapiens
catgtttcttgtctt

SEQ ID NO: 365348 - DNA, 15 bp, Homo sapiens
atgtttcttgtcttc

SEQ ID NO: 365349 - DNA, 15 bp, Homo sapiens
tgtttcttgtcttcc

SEQ ID NO: 365350 - DNA, 15 bp, Homo sapiens
gtttcttgtcttccc

SEQ ID NO: 365351 - DNA, 15 bp, Homo sapiens
tttcttgtcttccct

SEQ ID NO: 365352 - DNA, 15 bp, Homo sapiens
ttcttgtcttcccta

SEQ ID NO: 365353 - DNA, 15 bp, Homo sapiens
tcttgtcttccctaa

SEQ ID NO: 365354 - DNA, 15 bp, Homo sapiens
cttgtcttccctaat

SEQ ID NO: 365355 - DNA, 15 bp, Homo sapiens
ttgtcttccctaata

SEQ ID NO: 365356 - DNA, 15 bp, Homo sapiens
tgtcttccctaatac

SEQ ID NO: 365357 - DNA, 15 bp, Homo sapiens
gtcttccctaatact

SEQ ID NO: 365358 - DNA, 15 bp, Homo sapiens
tcttccctaatactt

SEQ ID NO: 365359 - DNA, 15 bp, Homo sapiens
cttccctaatacttg

SEQ ID NO: 365360 - DNA, 15 bp, Homo sapiens
ttccctaatacttgt

SEQ ID NO: 365361 - DNA, 15 bp, Homo sapiens
tccctaatacttgta

SEQ ID NO: 365362 - DNA, 15 bp, Homo sapiens
ccctaatacttgtaa

SEQ ID NO: 365363 - DNA, 15 bp, Homo sapiens
cctaatacttgtaag

SEQ ID NO: 365364 - DNA, 15 bp, Homo sapiens
ctaatacttgtaaga

SEQ ID NO: 365365 - DNA, 15 bp, Homo sapiens
taatacttgtaagat

SEQ ID NO: 365366 - DNA, 15 bp, Homo sapiens
aatacttgtaagatt

SEQ ID NO: 365367 - DNA, 15 bp, Homo sapiens
atacttgtaagattc

SEQ ID NO: 365368 - DNA, 15 bp, Homo sapiens
tacttgtaagattct

SEQ ID NO: 365369 - DNA, 15 bp, Homo sapiens
acttgtaagattctc

SEQ ID NO: 365370 - DNA, 15 bp, Homo sapiens
cttgtaagattctcc

SEQ ID NO: 365371 - DNA, 15 bp, Homo sapiens
ttgtaagattctccc

SEQ ID NO: 365372 - DNA, 15 bp, Homo sapiens
tgtaagattctccca

SEQ ID NO: 365373 - DNA, 15 bp, Homo sapiens
gtaagattctcccat

SEQ ID NO: 365374 - DNA, 15 bp, Homo sapiens
taagattctcccatt

SEQ ID NO: 365375 - DNA, 15 bp, Homo sapiens
aagattctcccattc

SEQ ID NO: 365376 - DNA, 15 bp, Homo sapiens
agattctcccattct

SEQ ID NO: 365377 - DNA, 15 bp, Homo sapiens
gattctcccattctt

SEQ ID NO: 365378 - DNA, 15 bp, Homo sapiens
attctcccattcttg

SEQ ID NO: 365379 - DNA, 15 bp, Homo sapiens
ttctcccattcttga

SEQ ID NO: 365380 - DNA, 15 bp, Homo sapiens
tctcccattcttgat

SEQ ID NO: 365381 - DNA, 15 bp, Homo sapiens
ctcccattcttgata

SEQ ID NO: 365382 - DNA, 15 bp, Homo sapiens
tcccattcttgatac

SEQ ID NO: 365383 - DNA, 15 bp, Homo sapiens
cccattcttgatacc

SEQ ID NO: 365384 - DNA, 15 bp, Homo sapiens
ccattcttgatacct

SEQ ID NO: 365385 - DNA, 15 bp, Homo sapiens
cattcttgatacctt

SEQ ID NO: 365386 - DNA, 15 bp, Homo sapiens
attcttgataccttg

SEQ ID NO: 365387 - DNA, 15 bp, Homo sapiens
ttcttgataccttgc

SEQ ID NO: 365388 - DNA, 15 bp, Homo sapiens
tcttgataccttgct

SEQ ID NO: 365389 - DNA, 15 bp, Homo sapiens
cttgataccttgctt

SEQ ID NO: 365390 - DNA, 15 bp, Homo sapiens
ttgataccttgcttt

SEQ ID NO: 365391 - DNA, 15 bp, Homo sapiens
tgataccttgctttg

SEQ ID NO: 365392 - DNA, 15 bp, Homo sapiens
gataccttgctttgt

SEQ ID NO: 365393 - DNA, 15 bp, Homo sapiens
ataccttgctttgtt

SEQ ID NO: 365394 - DNA, 15 bp, Homo sapiens
taccttgctttgttc

SEQ ID NO: 365395 - DNA, 15 bp, Homo sapiens
accttgctttgttct

SEQ ID NO: 365396 - DNA, 15 bp, Homo sapiens
ccttgctttgttctt

SEQ ID NO: 365397 - DNA, 15 bp, Homo sapiens
cttgctttgttctta

SEQ ID NO: 365398 - DNA, 15 bp, Homo sapiens
ttgctttgttcttat

SEQ ID NO: 365399 - DNA, 15 bp, Homo sapiens
tgctttgttcttatt

SEQ ID NO: 365400 - DNA, 15 bp, Homo sapiens
gctttgttcttattc

SEQ ID NO: 365401 - DNA, 15 bp, Homo sapiens
ctttgttcttattct

SEQ ID NO: 365402 - DNA, 15 bp, Homo sapiens
tttgttcttattctt

SEQ ID NO: 365403 - DNA, 15 bp, Homo sapiens
ttgttcttattcttt

SEQ ID NO: 365404 - DNA, 15 bp, Homo sapiens
tgttcttattctttc

SEQ ID NO: 365405 - DNA, 15 bp, Homo sapiens
gttcttattctttct

SEQ ID NO: 365406 - DNA, 15 bp, Homo sapiens
ttcttattctttctg

SEQ ID NO: 365407 - DNA, 15 bp, Homo sapiens
tcttattctttctgt

SEQ ID NO: 365408 - DNA, 15 bp, Homo sapiens
cttattctttctgtt

SEQ ID NO: 365409 - DNA, 15 bp, Homo sapiens
ttattctttctgttc

SEQ ID NO: 365410 - DNA, 15 bp, Homo sapiens
tattctttctgttct

SEQ ID NO: 365411 - DNA, 15 bp, Homo sapiens
attctttctgttcta

SEQ ID NO: 365412 - DNA, 15 bp, Homo sapiens
ttctttctgttctat

SEQ ID NO: 365413 - DNA, 15 bp, Homo sapiens
tctttctgttctatg

SEQ ID NO: 365414 - DNA, 15 bp, Homo sapiens
ctttctgttctatga

SEQ ID NO: 365415 - DNA, 15 bp, Homo sapiens
tttctgttctatgaa

SEQ ID NO: 365416 - DNA, 15 bp, Homo sapiens
ttctgttctatgaat

SEQ ID NO: 365417 - DNA, 15 bp, Homo sapiens
tctgttctatgaata

SEQ ID NO: 365418 - DNA, 15 bp, Homo sapiens
ctgttctatgaataa

SEQ ID NO: 365419 - DNA, 15 bp, Homo sapiens
tgttctatgaataaa

SEQ ID NO: 365420 - DNA, 15 bp, Homo sapiens
gttctatgaataaag

SEQ ID NO: 365421 - DNA, 15 bp, Homo sapiens
ttctatgaataaagc

SEQ ID NO: 365422 - DNA, 15 bp, Homo sapiens
tctatgaataaagca

SEQ ID NO: 365423 - DNA, 15 bp, Homo sapiens
ctatgaataaagcag

SEQ ID NO: 365424 - DNA, 15 bp, Homo sapiens
tatgaataaagcaga

SEQ ID NO: 365425 - DNA, 15 bp, Homo sapiens
atgaataaagcagag

SEQ ID NO: 365426 - DNA, 15 bp, Homo sapiens
tgaataaagcagagt

SEQ ID NO: 365427 - DNA, 15 bp, Homo sapiens
gaataaagcagagta

SEQ ID NO: 365428 - DNA, 15 bp, Homo sapiens
aataaagcagagtaa

SEQ ID NO: 365429 - DNA, 15 bp, Homo sapiens
ataaagcagagtaat

SEQ ID NO: 365430 - DNA, 15 bp, Homo sapiens
taaagcagagtaata

SEQ ID NO: 365431 - DNA, 15 bp, Homo sapiens
aaagcagagtaatag

SEQ ID NO: 365432 - DNA, 15 bp, Homo sapiens
aagcagagtaatagt

SEQ ID NO: 365433 - DNA, 15 bp, Homo sapiens
agcagagtaatagtt

SEQ ID NO: 365434 - DNA, 15 bp, Homo sapiens
gcagagtaatagtta

SEQ ID NO: 365435 - DNA, 15 bp, Homo sapiens
cagagtaatagttac

SEQ ID NO: 365436 - DNA, 15 bp, Homo sapiens
agagtaatagttacc

SEQ ID NO: 365437 - DNA, 15 bp, Homo sapiens
gagtaatagttacca

SEQ ID NO: 365438 - DNA, 15 bp, Homo sapiens
agtaatagttaccac

SEQ ID NO: 365439 - DNA, 15 bp, Homo sapiens
gtaatagttaccacc

SEQ ID NO: 365440 - DNA, 15 bp, Homo sapiens
taatagttaccacct

SEQ ID NO: 365441 - DNA, 15 bp, Homo sapiens
aatagttaccaccta

SEQ ID NO: 365442 - DNA, 15 bp, Homo sapiens
atagttaccacctaa

SEQ ID NO: 365443 - DNA, 15 bp, Homo sapiens
tagttaccacctaat

SEQ ID NO: 365444 - DNA, 15 bp, Homo sapiens
agttaccacctaatg

SEQ ID NO: 365445 - DNA, 15 bp, Homo sapiens
gttaccacctaatgt

SEQ ID NO: 365446 - DNA, 15 bp, Homo sapiens
ttaccacctaatgtg

SEQ ID NO: 365447 - DNA, 15 bp, Homo sapiens
taccacctaatgtga

SEQ ID NO: 365448 - DNA, 15 bp, Homo sapiens
accacctaatgtgat

SEQ ID NO: 365449 - DNA, 15 bp, Homo sapiens
ccacctaatgtgata

SEQ ID NO: 365450 - DNA, 15 bp, Homo sapiens
cacctaatgtgataa

SEQ ID NO: 365451 - DNA, 15 bp, Homo sapiens
acctaatgtgataac

SEQ ID NO: 365452 - DNA, 15 bp, Homo sapiens
cctaatgtgataaca

SEQ ID NO: 365453 - DNA, 15 bp, Homo sapiens
ctaatgtgataacat

SEQ ID NO: 365454 - DNA, 15 bp, Homo sapiens
taatgtgataacatg

SEQ ID NO: 365455 - DNA, 15 bp, Homo sapiens
aatgtgataacatgt

SEQ ID NO: 365456 - DNA, 15 bp, Homo sapiens
atgtgataacatgtc

SEQ ID NO: 365457 - DNA, 15 bp, Homo sapiens
tgtgataacatgtca

SEQ ID NO: 365458 - DNA, 15 bp, Homo sapiens
gtgataacatgtcat

SEQ ID NO: 365459 - DNA, 15 bp, Homo sapiens
tgataacatgtcata

SEQ ID NO: 365460 - DNA, 15 bp, Homo sapiens
gataacatgtcatat

SEQ ID NO: 365461 - DNA, 15 bp, Homo sapiens
ataacatgtcatata

SEQ ID NO: 365462 - DNA, 15 bp, Homo sapiens
taacatgtcatataa

SEQ ID NO: 365463 - DNA, 15 bp, Homo sapiens
aacatgtcatataat

SEQ ID NO: 365464 - DNA, 15 bp, Homo sapiens
acatgtcatataatg

SEQ ID NO: 365465 - DNA, 15 bp, Homo sapiens
catgtcatataatga

SEQ ID NO: 365466 - DNA, 15 bp, Homo sapiens
atgtcatataatgat

SEQ ID NO: 365467 - DNA, 15 bp, Homo sapiens
tgtcatataatgatt

SEQ ID NO: 365468 - DNA, 15 bp, Homo sapiens
gtcatataatgattc

SEQ ID NO: 365469 - DNA, 15 bp, Homo sapiens
tcatataatgattcc

SEQ ID NO: 365470 - DNA, 15 bp, Homo sapiens
catataatgattcct

SEQ ID NO: 365471 - DNA, 15 bp, Homo sapiens
atataatgattcctt

SEQ ID NO: 365472 - DNA, 15 bp, Homo sapiens
tataatgattccttt

SEQ ID NO: 365473 - DNA, 15 bp, Homo sapiens
ataatgattcctttc

SEQ ID NO: 365474 - DNA, 15 bp, Homo sapiens
taatgattcctttca

SEQ ID NO: 365475 - DNA, 15 bp, Homo sapiens
aatgattcctttcaa

SEQ ID NO: 365476 - DNA, 15 bp, Homo sapiens
atgattcctttcaat

SEQ ID NO: 365477 - DNA, 15 bp, Homo sapiens
tgattcctttcaata

SEQ ID NO: 365478 - DNA, 15 bp, Homo sapiens
gattcctttcaatat

SEQ ID NO: 365479 - DNA, 15 bp, Homo sapiens
attcctttcaatatt

SEQ ID NO: 365480 - DNA, 15 bp, Homo sapiens
ttcctttcaatattc

SEQ ID NO: 365481 - DNA, 15 bp, Homo sapiens
tcctttcaatattcg

SEQ ID NO: 365482 - DNA, 15 bp, Homo sapiens
cctttcaatattcgt

SEQ ID NO: 365483 - DNA, 15 bp, Homo sapiens
ctttcaatattcgtg

SEQ ID NO: 365484 - DNA, 15 bp, Homo sapiens
tttcaatattcgtga

SEQ ID NO: 365485 - DNA, 15 bp, Homo sapiens
ttcaatattcgtgaa

SEQ ID NO: 365486 - DNA, 15 bp, Homo sapiens
tcaatattcgtgaaa

SEQ ID NO: 365487 - DNA, 15 bp, Homo sapiens
caatattcgtgaaac

SEQ ID NO: 365488 - DNA, 15 bp, Homo sapiens
aatattcgtgaaaca

SEQ ID NO: 365489 - DNA, 15 bp, Homo sapiens
atattcgtgaaacac

SEQ ID NO: 365490 - DNA, 15 bp, Homo sapiens
tattcgtgaaacact

SEQ ID NO: 365491 - DNA, 15 bp, Homo sapiens
attcgtgaaacactc

SEQ ID NO: 365492 - DNA, 15 bp, Homo sapiens
ttcgtgaaacactca

SEQ ID NO: 365493 - DNA, 15 bp, Homo sapiens
tcgtgaaacactcaa

SEQ ID NO: 365494 - DNA, 15 bp, Homo sapiens
cgtgaaacactcaaa

SEQ ID NO: 365495 - DNA, 15 bp, Homo sapiens
gtgaaacactcaaag

SEQ ID NO: 365496 - DNA, 15 bp, Homo sapiens
tgaaacactcaaaga

SEQ ID NO: 365497 - DNA, 15 bp, Homo sapiens
gaaacactcaaagag

SEQ ID NO: 365498 - DNA, 15 bp, Homo sapiens
aaacactcaaagaga

SEQ ID NO: 365499 - DNA, 15 bp, Homo sapiens
aacactcaaagagaa

SEQ ID NO: 365500 - DNA, 15 bp, Homo sapiens
acactcaaagagaat

SEQ ID NO: 365501 - DNA, 15 bp, Homo sapiens
cactcaaagagaatt

SEQ ID NO: 365502 - DNA, 15 bp, Homo sapiens
actcaaagagaatta

SEQ ID NO: 365503 - DNA, 15 bp, Homo sapiens
ctcaaagagaattat

SEQ ID NO: 365504 - DNA, 15 bp, Homo sapiens
tcaaagagaattatg

SEQ ID NO: 365505 - DNA, 15 bp, Homo sapiens
caaagagaattatgc

SEQ ID NO: 365506 - DNA, 15 bp, Homo sapiens
aaagagaattatgct

SEQ ID NO: 365507 - DNA, 15 bp, Homo sapiens
aagagaattatgctt

SEQ ID NO: 365508 - DNA, 15 bp, Homo sapiens
agagaattatgcttt

SEQ ID NO: 365509 - DNA, 15 bp, Homo sapiens
gagaattatgctttt

SEQ ID NO: 365510 - DNA, 15 bp, Homo sapiens
agaattatgcttttt

SEQ ID NO: 365511 - DNA, 15 bp, Homo sapiens
gaattatgctttttc

SEQ ID NO: 365512 - DNA, 15 bp, Homo sapiens
aattatgctttttcc

SEQ ID NO: 365513 - DNA, 15 bp, Homo sapiens
attatgctttttccc

SEQ ID NO: 365514 - DNA, 15 bp, Homo sapiens
ttatgctttttccct

SEQ ID NO: 365515 - DNA, 15 bp, Homo sapiens
tatgctttttcccta

SEQ ID NO: 365516 - DNA, 15 bp, Homo sapiens
atgctttttccctat

SEQ ID NO: 365517 - DNA, 15 bp, Homo sapiens
tgctttttccctatt

SEQ ID NO: 365518 - DNA, 15 bp, Homo sapiens
gctttttccctatta

SEQ ID NO: 365519 - DNA, 15 bp, Homo sapiens
ctttttccctattat

SEQ ID NO: 365520 - DNA, 15 bp, Homo sapiens
tttttccctattatt

SEQ ID NO: 365521 - DNA, 15 bp, Homo sapiens
ttttccctattattt

SEQ ID NO: 365522 - DNA, 15 bp, Homo sapiens
tttccctattatttt

SEQ ID NO: 365523 - DNA, 15 bp, Homo sapiens
ttccctattatttta

SEQ ID NO: 365524 - DNA, 15 bp, Homo sapiens
tccctattattttag

SEQ ID NO: 365525 - DNA, 15 bp, Homo sapiens
ccctattattttaga

SEQ ID NO: 365526 - DNA, 15 bp, Homo sapiens
cctattattttagat

SEQ ID NO: 365527 - DNA, 15 bp, Homo sapiens
ctattattttagata

SEQ ID NO: 365528 - DNA, 15 bp, Homo sapiens
tattattttagataa

SEQ ID NO: 365529 - DNA, 15 bp, Homo sapiens
attattttagataaa

SEQ ID NO: 365530 - DNA, 15 bp, Homo sapiens
ttattttagataaag

SEQ ID NO: 365531 - DNA, 15 bp, Homo sapiens
tattttagataaaga

SEQ ID NO: 365532 - DNA, 15 bp, Homo sapiens
attttagataaagac

SEQ ID NO: 365533 - DNA, 15 bp, Homo sapiens
ttttagataaagaca

SEQ ID NO: 365534 - DNA, 15 bp, Homo sapiens
tttagataaagacat

SEQ ID NO: 365535 - DNA, 15 bp, Homo sapiens
ttagataaagacatt

SEQ ID NO: 365536 - DNA, 15 bp, Homo sapiens
tagataaagacattt

SEQ ID NO: 365537 - DNA, 15 bp, Homo sapiens
agataaagacatttt

SEQ ID NO: 365538 - DNA, 15 bp, Homo sapiens
gataaagacattttt

SEQ ID NO: 365539 - DNA, 15 bp, Homo sapiens
ataaagacatttttc

SEQ ID NO: 365540 - DNA, 15 bp, Homo sapiens
taaagacatttttca

SEQ ID NO: 365541 - DNA, 15 bp, Homo sapiens
aaagacatttttcat

SEQ ID NO: 365542 - DNA, 15 bp, Homo sapiens
aagacatttttcatg

SEQ ID NO: 365543 - DNA, 15 bp, Homo sapiens
agacatttttcatgt

SEQ ID NO: 365544 - DNA, 15 bp, Homo sapiens
gacatttttcatgtt

SEQ ID NO: 365545 - DNA, 15 bp, Homo sapiens
acatttttcatgttt

SEQ ID NO: 365546 - DNA, 15 bp, Homo sapiens
catttttcatgtttt

SEQ ID NO: 365547 - DNA, 15 bp, Homo sapiens
atttttcatgtttta

SEQ ID NO: 365548 - DNA, 15 bp, Homo sapiens
tttttcatgttttaa

SEQ ID NO: 365549 - DNA, 15 bp, Homo sapiens
ttttcatgttttaaa

SEQ ID NO: 365550 - DNA, 15 bp, Homo sapiens
tttcatgttttaaaa

SEQ ID NO: 365551 - DNA, 15 bp, Homo sapiens
ttcatgttttaaaaa

SEQ ID NO: 365552 - DNA, 15 bp, Homo sapiens
tcatgttttaaaaaa

SEQ ID NO: 365553 - DNA, 15 bp, Homo sapiens
catgttttaaaaaat

SEQ ID NO: 365554 - DNA, 15 bp, Homo sapiens
atgttttaaaaaatt

SEQ ID NO: 365555 - DNA, 15 bp, Homo sapiens
tgttttaaaaaattt

SEQ ID NO: 365556 - DNA, 15 bp, Homo sapiens
gttttaaaaaatttc

SEQ ID NO: 365557 - DNA, 15 bp, Homo sapiens
ttttaaaaaatttcc

SEQ ID NO: 365558 - DNA, 15 bp, Homo sapiens
tttaaaaaatttcca

SEQ ID NO: 365559 - DNA, 15 bp, Homo sapiens
ttaaaaaatttccat

SEQ ID NO: 365560 - DNA, 15 bp, Homo sapiens
taaaaaatttccatt

SEQ ID NO: 365561 - DNA, 15 bp, Homo sapiens
aaaaaatttccatta

SEQ ID NO: 365562 - DNA, 15 bp, Homo sapiens
aaaaatttccattat

SEQ ID NO: 365563 - DNA, 15 bp, Homo sapiens
aaaatttccattatg

SEQ ID NO: 365564 - DNA, 15 bp, Homo sapiens
aaatttccattatgt

SEQ ID NO: 365565 - DNA, 15 bp, Homo sapiens
aatttccattatgtt

SEQ ID NO: 365566 - DNA, 15 bp, Homo sapiens
atttccattatgttg

SEQ ID NO: 365567 - DNA, 15 bp, Homo sapiens
tttccattatgttgc

SEQ ID NO: 365568 - DNA, 15 bp, Homo sapiens
ttccattatgttgcg

SEQ ID NO: 365569 - DNA, 15 bp, Homo sapiens
tccattatgttgcgg

SEQ ID NO: 365570 - DNA, 15 bp, Homo sapiens
ccattatgttgcgga

SEQ ID NO: 365571 - DNA, 15 bp, Homo sapiens
cattatgttgcggag

SEQ ID NO: 365572 - DNA, 15 bp, Homo sapiens
attatgttgcggagt

SEQ ID NO: 365573 - DNA, 15 bp, Homo sapiens
ttatgttgcggagtg

SEQ ID NO: 365574 - DNA, 15 bp, Homo sapiens
tatgttgcggagtgg

SEQ ID NO: 365575 - DNA, 15 bp, Homo sapiens
atgttgcggagtggt

SEQ ID NO: 365576 - DNA, 15 bp, Homo sapiens
tgttgcggagtggta

SEQ ID NO: 365577 - DNA, 15 bp, Homo sapiens
gttgcggagtggtat

SEQ ID NO: 365578 - DNA, 15 bp, Homo sapiens
ttgcggagtggtatc

SEQ ID NO: 365579 - DNA, 15 bp, Homo sapiens
tgcggagtggtatct

SEQ ID NO: 365580 - DNA, 15 bp, Homo sapiens
gcggagtggtatcta

SEQ ID NO: 365581 - DNA, 15 bp, Homo sapiens
cggagtggtatctaa

SEQ ID NO: 365582 - DNA, 15 bp, Homo sapiens
ggagtggtatctaac

SEQ ID NO: 365583 - DNA, 15 bp, Homo sapiens
gagtggtatctaact

SEQ ID NO: 365584 - DNA, 15 bp, Homo sapiens
agtggtatctaactg

SEQ ID NO: 365585 - DNA, 15 bp, Homo sapiens
gtggtatctaactgt

SEQ ID NO: 365586 - DNA, 15 bp, Homo sapiens
tggtatctaactgta

SEQ ID NO: 365587 - DNA, 15 bp, Homo sapiens
ggtatctaactgtaa

SEQ ID NO: 365588 - DNA, 15 bp, Homo sapiens
gtatctaactgtaaa

SEQ ID NO: 365589 - DNA, 15 bp, Homo sapiens
tatctaactgtaaaa

SEQ ID NO: 365590 - DNA, 15 bp, Homo sapiens
atctaactgtaaaaa

SEQ ID NO: 365591 - DNA, 15 bp, Homo sapiens
tctaactgtaaaaaa

SEQ ID NO: 365592 - DNA, 15 bp, Homo sapiens
ctaactgtaaaaaag

SEQ ID NO: 365593 - DNA, 15 bp, Homo sapiens
taactgtaaaaaagg

SEQ ID NO: 365594 - DNA, 15 bp, Homo sapiens
aactgtaaaaaaggc

SEQ ID NO: 365595 - DNA, 15 bp, Homo sapiens
actgtaaaaaaggct

SEQ ID NO: 365596 - DNA, 15 bp, Homo sapiens
ctgtaaaaaaggctt

SEQ ID NO: 365597 - DNA, 15 bp, Homo sapiens
tgtaaaaaaggcttt

SEQ ID NO: 365598 - DNA, 15 bp, Homo sapiens
gtaaaaaaggctttt

SEQ ID NO: 365599 - DNA, 15 bp, Homo sapiens
taaaaaaggcttttg

SEQ ID NO: 365600 - DNA, 15 bp, Homo sapiens
aaaaaaggcttttgt

SEQ ID NO: 365601 - DNA, 15 bp, Homo sapiens
aaaaaggcttttgta

SEQ ID NO: 365602 - DNA, 15 bp, Homo sapiens
aaaaggcttttgtat

SEQ ID NO: 365603 - DNA, 15 bp, Homo sapiens
aaaggcttttgtatt

SEQ ID NO: 365604 - DNA, 15 bp, Homo sapiens
aaggcttttgtattc

SEQ ID NO: 365605 - DNA, 15 bp, Homo sapiens
aggcttttgtattca

SEQ ID NO: 365606 - DNA, 15 bp, Homo sapiens
ggcttttgtattcaa

SEQ ID NO: 365607 - DNA, 15 bp, Homo sapiens
gcttttgtattcaat

SEQ ID NO: 365608 - DNA, 15 bp, Homo sapiens
cttttgtattcaatt

SEQ ID NO: 365609 - DNA, 15 bp, Homo sapiens
ttttgtattcaattt

SEQ ID NO: 365610 - DNA, 15 bp, Homo sapiens
tttgtattcaatttc

SEQ ID NO: 365611 - DNA, 15 bp, Homo sapiens
ttgtattcaatttct

SEQ ID NO: 365612 - DNA, 15 bp, Homo sapiens
tgtattcaatttcta

SEQ ID NO: 365613 - DNA, 15 bp, Homo sapiens
gtattcaatttctac

SEQ ID NO: 365614 - DNA, 15 bp, Homo sapiens
tattcaatttctaca

SEQ ID NO: 365615 - DNA, 15 bp, Homo sapiens
attcaatttctacat

SEQ ID NO: 365616 - DNA, 15 bp, Homo sapiens
ttcaatttctacata

SEQ ID NO: 365617 - DNA, 15 bp, Homo sapiens
tcaatttctacataa

SEQ ID NO: 365618 - DNA, 15 bp, Homo sapiens
caatttctacataac

SEQ ID NO: 365619 - DNA, 15 bp, Homo sapiens
aatttctacataact

SEQ ID NO: 365620 - DNA, 15 bp, Homo sapiens
atttctacataactt

SEQ ID NO: 365621 - DNA, 15 bp, Homo sapiens
tttctacataacttt

SEQ ID NO: 365622 - DNA, 15 bp, Homo sapiens
ttctacataactttt

SEQ ID NO: 365623 - DNA, 15 bp, Homo sapiens
tctacataacttttt

SEQ ID NO: 365624 - DNA, 15 bp, Homo sapiens
ctacataacttttta

SEQ ID NO: 365625 - DNA, 15 bp, Homo sapiens
tacataactttttat

SEQ ID NO: 365626 - DNA, 15 bp, Homo sapiens
acataactttttatg

SEQ ID NO: 365627 - DNA, 15 bp, Homo sapiens
cataactttttatga

SEQ ID NO: 365628 - DNA, 15 bp, Homo sapiens
ataactttttatgat

SEQ ID NO: 365629 - DNA, 15 bp, Homo sapiens
taactttttatgatg

SEQ ID NO: 365630 - DNA, 15 bp, Homo sapiens
aactttttatgatga

SEQ ID NO: 365631 - DNA, 15 bp, Homo sapiens
actttttatgatgag

SEQ ID NO: 365632 - DNA, 15 bp, Homo sapiens
ctttttatgatgagg

SEQ ID NO: 365633 - DNA, 15 bp, Homo sapiens
tttttatgatgaggg

SEQ ID NO: 365634 - DNA, 15 bp, Homo sapiens
ttttatgatgaggga

SEQ ID NO: 365635 - DNA, 15 bp, Homo sapiens
tttatgatgagggaa

SEQ ID NO: 365636 - DNA, 15 bp, Homo sapiens
ttatgatgagggaag

SEQ ID NO: 365637 - DNA, 15 bp, Homo sapiens
tatgatgagggaaga

SEQ ID NO: 365638 - DNA, 15 bp, Homo sapiens
atgatgagggaagat

SEQ ID NO: 365639 - DNA, 15 bp, Homo sapiens
tgatgagggaagata

SEQ ID NO: 365640 - DNA, 15 bp, Homo sapiens
gatgagggaagataa

SEQ ID NO: 365641 - DNA, 15 bp, Homo sapiens
atgagggaagataat

SEQ ID NO: 365642 - DNA, 15 bp, Homo sapiens
tgagggaagataata

SEQ ID NO: 365643 - DNA, 15 bp, Homo sapiens
gagggaagataatat

SEQ ID NO: 365644 - DNA, 15 bp, Homo sapiens
agggaagataatatt

SEQ ID NO: 365645 - DNA, 15 bp, Homo sapiens
gggaagataatattc

SEQ ID NO: 365646 - DNA, 15 bp, Homo sapiens
ggaagataatattct

SEQ ID NO: 365647 - DNA, 15 bp, Homo sapiens
gaagataatattctt

SEQ ID NO: 365648 - DNA, 15 bp, Homo sapiens
aagataatattcttt

SEQ ID NO: 365649 - DNA, 15 bp, Homo sapiens
agataatattcttta

SEQ ID NO: 365650 - DNA, 15 bp, Homo sapiens
gataatattctttag

SEQ ID NO: 365651 - DNA, 15 bp, Homo sapiens
ataatattctttagt

SEQ ID NO: 365652 - DNA, 15 bp, Homo sapiens
taatattctttagtt

SEQ ID NO: 365653 - DNA, 15 bp, Homo sapiens
aatattctttagttt

SEQ ID NO: 365654 - DNA, 15 bp, Homo sapiens
atattctttagtttc

SEQ ID NO: 365655 - DNA, 15 bp, Homo sapiens
tattctttagtttca

SEQ ID NO: 365656 - DNA, 15 bp, Homo sapiens
attctttagtttcaa

SEQ ID NO: 365657 - DNA, 15 bp, Homo sapiens
ttctttagtttcaat

SEQ ID NO: 365658 - DNA, 15 bp, Homo sapiens
tctttagtttcaatg

SEQ ID NO: 365659 - DNA, 15 bp, Homo sapiens
ctttagtttcaatgt

SEQ ID NO: 365660 - DNA, 15 bp, Homo sapiens
tttagtttcaatgtt

SEQ ID NO: 365661 - DNA, 15 bp, Homo sapiens
ttagtttcaatgttt

SEQ ID NO: 365662 - DNA, 15 bp, Homo sapiens
tagtttcaatgtttt

SEQ ID NO: 365663 - DNA, 15 bp, Homo sapiens
agtttcaatgttttt

SEQ ID NO: 365664 - DNA, 15 bp, Homo sapiens
gtttcaatgtttttg

SEQ ID NO: 365665 - DNA, 15 bp, Homo sapiens
tttcaatgtttttga

SEQ ID NO: 365666 - DNA, 15 bp, Homo sapiens
ttcaatgtttttgaa

SEQ ID NO: 365667 - DNA, 15 bp, Homo sapiens
tcaatgtttttgaat

SEQ ID NO: 365668 - DNA, 15 bp, Homo sapiens
caatgtttttgaatt

SEQ ID NO: 365669 - DNA, 15 bp, Homo sapiens
aatgtttttgaattt

SEQ ID NO: 365670 - DNA, 15 bp, Homo sapiens
atgtttttgaattta

SEQ ID NO: 365671 - DNA, 15 bp, Homo sapiens
tgtttttgaatttaa

SEQ ID NO: 365672 - DNA, 15 bp, Homo sapiens
gtttttgaatttaac

SEQ ID NO: 365673 - DNA, 15 bp, Homo sapiens
tttttgaatttaact

SEQ ID NO: 365674 - DNA, 15 bp, Homo sapiens
ttttgaatttaacta

SEQ ID NO: 365675 - DNA, 15 bp, Homo sapiens
tttgaatttaactaa

SEQ ID NO: 365676 - DNA, 15 bp, Homo sapiens
ttgaatttaactaag

SEQ ID NO: 365677 - DNA, 15 bp, Homo sapiens
tgaatttaactaagg

SEQ ID NO: 365678 - DNA, 15 bp, Homo sapiens
gaatttaactaagga

SEQ ID NO: 365679 - DNA, 15 bp, Homo sapiens
aatttaactaaggaa

SEQ ID NO: 365680 - DNA, 15 bp, Homo sapiens
atttaactaaggaaa

SEQ ID NO: 365681 - DNA, 15 bp, Homo sapiens
tttaactaaggaaaa

SEQ ID NO: 365682 - DNA, 15 bp, Homo sapiens
ttaactaaggaaaaa

SEQ ID NO: 365683 - DNA, 15 bp, Homo sapiens
taactaaggaaaaaa

SEQ ID NO: 365684 - DNA, 15 bp, Homo sapiens
aactaaggaaaaaag

SEQ ID NO: 365685 - DNA, 15 bp, Homo sapiens
actaaggaaaaaagc

SEQ ID NO: 365686 - DNA, 15 bp, Homo sapiens
ctaaggaaaaaagct

SEQ ID NO: 365687 - DNA, 15 bp, Homo sapiens
taaggaaaaaagctt

SEQ ID NO: 365688 - DNA, 15 bp, Homo sapiens
aaggaaaaaagcttc

SEQ ID NO: 365689 - DNA, 15 bp, Homo sapiens
aggaaaaaagcttct

SEQ ID NO: 365690 - DNA, 15 bp, Homo sapiens
ggaaaaaagcttctt

SEQ ID NO: 365691 - DNA, 15 bp, Homo sapiens
gaaaaaagcttcttg

SEQ ID NO: 365692 - DNA, 15 bp, Homo sapiens
aaaaaagcttcttgg

SEQ ID NO: 365693 - DNA, 15 bp, Homo sapiens
aaaaagcttcttggt

SEQ ID NO: 365694 - DNA, 15 bp, Homo sapiens
aaaagcttcttggtc

SEQ ID NO: 365695 - DNA, 15 bp, Homo sapiens
aaagcttcttggtct

SEQ ID NO: 365696 - DNA, 15 bp, Homo sapiens
aagcttcttggtcta

SEQ ID NO: 365697 - DNA, 15 bp, Homo sapiens
agcttcttggtctat

SEQ ID NO: 365698 - DNA, 15 bp, Homo sapiens
gcttcttggtctatt

SEQ ID NO: 365699 - DNA, 15 bp, Homo sapiens
cttcttggtctatta

SEQ ID NO: 365700 - DNA, 15 bp, Homo sapiens
ttcttggtctattat

SEQ ID NO: 365701 - DNA, 15 bp, Homo sapiens
tcttggtctattatt

SEQ ID NO: 365702 - DNA, 15 bp, Homo sapiens
cttggtctattatta

SEQ ID NO: 365703 - DNA, 15 bp, Homo sapiens
ttggtctattattaa

SEQ ID NO: 365704 - DNA, 15 bp, Homo sapiens
tggtctattattaag

SEQ ID NO: 365705 - DNA, 15 bp, Homo sapiens
ggtctattattaagc

SEQ ID NO: 365706 - DNA, 15 bp, Homo sapiens
gtctattattaagca

SEQ ID NO: 365707 - DNA, 15 bp, Homo sapiens
tctattattaagcaa

SEQ ID NO: 365708 - DNA, 15 bp, Homo sapiens
ctattattaagcaat

SEQ ID NO: 365709 - DNA, 15 bp, Homo sapiens
tattattaagcaatc

SEQ ID NO: 365710 - DNA, 15 bp, Homo sapiens
attattaagcaatct

SEQ ID NO: 365711 - DNA, 15 bp, Homo sapiens
ttattaagcaatctt

SEQ ID NO: 365712 - DNA, 15 bp, Homo sapiens
tattaagcaatcttt

SEQ ID NO: 365713 - DNA, 15 bp, Homo sapiens
attaagcaatcttta

SEQ ID NO: 365714 - DNA, 15 bp, Homo sapiens
ttaagcaatctttat

SEQ ID NO: 365715 - DNA, 15 bp, Homo sapiens
taagcaatctttata

SEQ ID NO: 365716 - DNA, 15 bp, Homo sapiens
aagcaatctttatat

SEQ ID NO: 365717 - DNA, 15 bp, Homo sapiens
agcaatctttatatt

SEQ ID NO: 365718 - DNA, 15 bp, Homo sapiens
gcaatctttatattg

SEQ ID NO: 365719 - DNA, 15 bp, Homo sapiens
caatctttatattgt

SEQ ID NO: 365720 - DNA, 15 bp, Homo sapiens
aatctttatattgta

SEQ ID NO: 365721 - DNA, 15 bp, Homo sapiens
atctttatattgtag

SEQ ID NO: 365722 - DNA, 15 bp, Homo sapiens
tctttatattgtaga

SEQ ID NO: 365723 - DNA, 15 bp, Homo sapiens
ctttatattgtagaa

SEQ ID NO: 365724 - DNA, 15 bp, Homo sapiens
tttatattgtagaat

SEQ ID NO: 365725 - DNA, 15 bp, Homo sapiens
ttatattgtagaata

SEQ ID NO: 365726 - DNA, 15 bp, Homo sapiens
tatattgtagaatat

SEQ ID NO: 365727 - DNA, 15 bp, Homo sapiens
atattgtagaatata

SEQ ID NO: 365728 - DNA, 15 bp, Homo sapiens
tattgtagaatatat

SEQ ID NO: 365729 - DNA, 15 bp, Homo sapiens
attgtagaatatata

SEQ ID NO: 365730 - DNA, 15 bp, Homo sapiens
ttgtagaatatatac

SEQ ID NO: 365731 - DNA, 15 bp, Homo sapiens
tgtagaatatataca

SEQ ID NO: 365732 - DNA, 15 bp, Homo sapiens
gtagaatatatacat

SEQ ID NO: 365733 - DNA, 15 bp, Homo sapiens
tagaatatatacatt

SEQ ID NO: 365734 - DNA, 15 bp, Homo sapiens
agaatatatacattg

SEQ ID NO: 365735 - DNA, 15 bp, Homo sapiens
gaatatatacattgt

SEQ ID NO: 365736 - DNA, 15 bp, Homo sapiens
aatatatacattgtt

SEQ ID NO: 365737 - DNA, 15 bp, Homo sapiens
atatatacattgttt

SEQ ID NO: 365738 - DNA, 15 bp, Homo sapiens
tatatacattgtttc

SEQ ID NO: 365739 - DNA, 15 bp, Homo sapiens
atatacattgtttca

SEQ ID NO: 365740 - DNA, 15 bp, Homo sapiens
tatacattgtttcac

SEQ ID NO: 365741 - DNA, 15 bp, Homo sapiens
atacattgtttcact

SEQ ID NO: 365742 - DNA, 15 bp, Homo sapiens
tacattgtttcactt

SEQ ID NO: 365743 - DNA, 15 bp, Homo sapiens
acattgtttcactta

SEQ ID NO: 365744 - DNA, 15 bp, Homo sapiens
cattgtttcacttaa

SEQ ID NO: 365745 - DNA, 15 bp, Homo sapiens
attgtttcacttaaa

SEQ ID NO: 365746 - DNA, 15 bp, Homo sapiens
ttgtttcacttaaaa

SEQ ID NO: 365747 - DNA, 15 bp, Homo sapiens
tgtttcacttaaaat

SEQ ID NO: 365748 - DNA, 15 bp, Homo sapiens
gtttcacttaaaata

SEQ ID NO: 365749 - DNA, 15 bp, Homo sapiens
tttcacttaaaatat

SEQ ID NO: 365750 - DNA, 15 bp, Homo sapiens
ttcacttaaaatata

SEQ ID NO: 365751 - DNA, 15 bp, Homo sapiens
tcacttaaaatatat

SEQ ID NO: 365752 - DNA, 15 bp, Homo sapiens
cacttaaaatatata

SEQ ID NO: 365753 - DNA, 15 bp, Homo sapiens
acttaaaatatatat

SEQ ID NO: 365754 - DNA, 15 bp, Homo sapiens
cttaaaatatatatt

SEQ ID NO: 365755 - DNA, 15 bp, Homo sapiens
ttaaaatatatatta

SEQ ID NO: 365756 - DNA, 15 bp, Homo sapiens
taaaatatatattaa

SEQ ID NO: 365757 - DNA, 15 bp, Homo sapiens
aaaatatatattaaa

SEQ ID NO: 365758 - DNA, 15 bp, Homo sapiens
aaatatatattaaaa

SEQ ID NO: 365759 - DNA, 15 bp, Homo sapiens
aatatatattaaaat

SEQ ID NO: 365760 - DNA, 15 bp, Homo sapiens
atatatattaaaata

SEQ ID NO: 365761 - DNA, 15 bp, Homo sapiens
tatatattaaaataa

SEQ ID NO: 365762 - DNA, 15 bp, Homo sapiens
atatattaaaataat

SEQ ID NO: 365763 - DNA, 15 bp, Homo sapiens
tatattaaaataatt

SEQ ID NO: 365764 - DNA, 15 bp, Homo sapiens
atattaaaataatta

SEQ ID NO: 365765 - DNA, 15 bp, Homo sapiens
tattaaaataattat

SEQ ID NO: 365766 - DNA, 15 bp, Homo sapiens
attaaaataattatt

SEQ ID NO: 365767 - DNA, 15 bp, Homo sapiens
taaaataattattag

SEQ ID NO: 365768 - DNA, 15 bp, Homo sapiens
aaaataattattaga

SEQ ID NO: 365769 - DNA, 15 bp, Homo sapiens
aaataattattagaa

SEQ ID NO: 365770 - DNA, 15 bp, Homo sapiens
aataattattagaaa

SEQ ID NO: 365771 - DNA, 15 bp, Homo sapiens
ataattattagaaat

SEQ ID NO: 365772 - DNA, 15 bp, Homo sapiens
taattattagaaatt

SEQ ID NO: 365773 - DNA, 15 bp, Homo sapiens
aattattagaaatta

SEQ ID NO: 365774 - DNA, 15 bp, Homo sapiens
attattagaaattat

SEQ ID NO: 365775 - DNA, 15 bp, Homo sapiens
ttattagaaattatt

SEQ ID NO: 365776 - DNA, 15 bp, Homo sapiens
tattagaaattattt

SEQ ID NO: 365777 - DNA, 15 bp, Homo sapiens
attagaaattattta

SEQ ID NO: 365778 - DNA, 15 bp, Homo sapiens
ttagaaattatttat

SEQ ID NO: 365779 - DNA, 15 bp, Homo sapiens
tagaaattatttatt

SEQ ID NO: 365780 - DNA, 15 bp, Homo sapiens
agaaattatttattt

SEQ ID NO: 365781 - DNA, 15 bp, Homo sapiens
gaaattatttatttt

SEQ ID NO: 365782 - DNA, 15 bp, Homo sapiens
aaattatttattttg

SEQ ID NO: 365783 - DNA, 15 bp, Homo sapiens
aattatttattttgg

SEQ ID NO: 365784 - DNA, 15 bp, Homo sapiens
attatttattttggg

SEQ ID NO: 365785 - DNA, 15 bp, Homo sapiens
ttatttattttggga

SEQ ID NO: 365786 - DNA, 15 bp, Homo sapiens
tatttattttgggaa

SEQ ID NO: 365787 - DNA, 15 bp, Homo sapiens
atttattttgggaaa

SEQ ID NO: 365788 - DNA, 15 bp, Homo sapiens
tttattttgggaaat

SEQ ID NO: 365789 - DNA, 15 bp, Homo sapiens
ttattttgggaaata

SEQ ID NO: 365790 - DNA, 15 bp, Homo sapiens
tattttgggaaatat

SEQ ID NO: 365791 - DNA, 15 bp, Homo sapiens
attttgggaaatatt

SEQ ID NO: 365792 - DNA, 15 bp, Homo sapiens
ttttgggaaatattt

SEQ ID NO: 365793 - DNA, 15 bp, Homo sapiens
tttgggaaatattta

SEQ ID NO: 365794 - DNA, 15 bp, Homo sapiens
ttgggaaatatttag

SEQ ID NO: 365795 - DNA, 15 bp, Homo sapiens
tgggaaatatttagt

SEQ ID NO: 365796 - DNA, 15 bp, Homo sapiens
gggaaatatttagtc

SEQ ID NO: 365797 - DNA, 15 bp, Homo sapiens
ggaaatatttagtca

SEQ ID NO: 365798 - DNA, 15 bp, Homo sapiens
gaaatatttagtcag

SEQ ID NO: 365799 - DNA, 15 bp, Homo sapiens
aaatatttagtcagg

SEQ ID NO: 365800 - DNA, 15 bp, Homo sapiens
aatatttagtcagga

SEQ ID NO: 365801 - DNA, 15 bp, Homo sapiens
atatttagtcaggat

SEQ ID NO: 365802 - DNA, 15 bp, Homo sapiens
tatttagtcaggata

SEQ ID NO: 365803 - DNA, 15 bp, Homo sapiens
atttagtcaggatat

SEQ ID NO: 365804 - DNA, 15 bp, Homo sapiens
tttagtcaggatatt

SEQ ID NO: 365805 - DNA, 15 bp, Homo sapiens
ttagtcaggatattc

SEQ ID NO: 365806 - DNA, 15 bp, Homo sapiens
tagtcaggatattca

SEQ ID NO: 365807 - DNA, 15 bp, Homo sapiens
agtcaggatattcaa

SEQ ID NO: 365808 - DNA, 15 bp, Homo sapiens
gtcaggatattcaaa

SEQ ID NO: 365809 - DNA, 15 bp, Homo sapiens
tcaggatattcaaag

SEQ ID NO: 365810 - DNA, 15 bp, Homo sapiens
caggatattcaaagc

SEQ ID NO: 365811 - DNA, 15 bp, Homo sapiens
aggatattcaaagca

SEQ ID NO: 365812 - DNA, 15 bp, Homo sapiens
ggatattcaaagcaa

SEQ ID NO: 365813 - DNA, 15 bp, Homo sapiens
gatattcaaagcaaa

SEQ ID NO: 365814 - DNA, 15 bp, Homo sapiens
atattcaaagcaaat

SEQ ID NO: 365815 - DNA, 15 bp, Homo sapiens
tattcaaagcaaata

SEQ ID NO: 365816 - DNA, 15 bp, Homo sapiens
attcaaagcaaatat

SEQ ID NO: 365817 - DNA, 15 bp, Homo sapiens
ttcaaagcaaatatg

SEQ ID NO: 365818 - DNA, 15 bp, Homo sapiens
tcaaagcaaatatgt

SEQ ID NO: 365819 - DNA, 15 bp, Homo sapiens
caaagcaaatatgta

SEQ ID NO: 365820 - DNA, 15 bp, Homo sapiens
aaagcaaatatgtaa

SEQ ID NO: 365821 - DNA, 15 bp, Homo sapiens
aagcaaatatgtaag

SEQ ID NO: 365822 - DNA, 15 bp, Homo sapiens
agcaaatatgtaagg

SEQ ID NO: 365823 - DNA, 15 bp, Homo sapiens
gcaaatatgtaaggt

SEQ ID NO: 365824 - DNA, 15 bp, Homo sapiens
caaatatgtaaggtt

SEQ ID NO: 365825 - DNA, 15 bp, Homo sapiens
aaatatgtaaggttc

SEQ ID NO: 365826 - DNA, 15 bp, Homo sapiens
aatatgtaaggttct

SEQ ID NO: 365827 - DNA, 15 bp, Homo sapiens
atatgtaaggttctg

SEQ ID NO: 365828 - DNA, 15 bp, Homo sapiens
tatgtaaggttctgc

SEQ ID NO: 365829 - DNA, 15 bp, Homo sapiens
atgtaaggttctgct

SEQ ID NO: 365830 - DNA, 15 bp, Homo sapiens
tgtaaggttctgctt

SEQ ID NO: 365831 - DNA, 15 bp, Homo sapiens
gtaaggttctgctta

SEQ ID NO: 365832 - DNA, 15 bp, Homo sapiens
taaggttctgcttaa

SEQ ID NO: 365833 - DNA, 15 bp, Homo sapiens
aaggttctgcttaat

SEQ ID NO: 365834 - DNA, 15 bp, Homo sapiens
aggttctgcttaatt

SEQ ID NO: 365835 - DNA, 15 bp, Homo sapiens
ggttctgcttaattg

SEQ ID NO: 365836 - DNA, 15 bp, Homo sapiens
gttctgcttaattgg

SEQ ID NO: 365837 - DNA, 15 bp, Homo sapiens
ttctgcttaattgga

SEQ ID NO: 365838 - DNA, 15 bp, Homo sapiens
tctgcttaattggac

SEQ ID NO: 365839 - DNA, 15 bp, Homo sapiens
ctgcttaattggaca

SEQ ID NO: 365840 - DNA, 15 bp, Homo sapiens
tgcttaattggacag

SEQ ID NO: 365841 - DNA, 15 bp, Homo sapiens
gcttaattggacagt

SEQ ID NO: 365842 - DNA, 15 bp, Homo sapiens
cttaattggacagtt

SEQ ID NO: 365843 - DNA, 15 bp, Homo sapiens
ttaattggacagttt

SEQ ID NO: 365844 - DNA, 15 bp, Homo sapiens
taattggacagtttt

SEQ ID NO: 365845 - DNA, 15 bp, Homo sapiens
aattggacagttttt

SEQ ID NO: 365846 - DNA, 15 bp, Homo sapiens
attggacagtttttc

SEQ ID NO: 365847 - DNA, 15 bp, Homo sapiens
ttggacagtttttcc

SEQ ID NO: 365848 - DNA, 15 bp, Homo sapiens
tggacagtttttcct

SEQ ID NO: 365849 - DNA, 15 bp, Homo sapiens
ggacagtttttcctc

SEQ ID NO: 365850 - DNA, 15 bp, Homo sapiens
gacagtttttcctca

SEQ ID NO: 365851 - DNA, 15 bp, Homo sapiens
acagtttttcctcaa

SEQ ID NO: 365852 - DNA, 15 bp, Homo sapiens
cagtttttcctcaat

SEQ ID NO: 365853 - DNA, 15 bp, Homo sapiens
agtttttcctcaata

SEQ ID NO: 365854 - DNA, 15 bp, Homo sapiens
gtttttcctcaatat

SEQ ID NO: 365855 - DNA, 15 bp, Homo sapiens
tttttcctcaatatt

SEQ ID NO: 365856 - DNA, 15 bp, Homo sapiens
ttttcctcaatattt

SEQ ID NO: 365857 - DNA, 15 bp, Homo sapiens
tttcctcaatatttt

SEQ ID NO: 365858 - DNA, 15 bp, Homo sapiens
ttcctcaatattttt

SEQ ID NO: 365859 - DNA, 15 bp, Homo sapiens
tcctcaatattttta

SEQ ID NO: 365860 - DNA, 15 bp, Homo sapiens
cctcaatatttttaa

SEQ ID NO: 365861 - DNA, 15 bp, Homo sapiens
ctcaatatttttaaa

SEQ ID NO: 365862 - DNA, 15 bp, Homo sapiens
tcaatatttttaaat

SEQ ID NO: 365863 - DNA, 15 bp, Homo sapiens
caatatttttaaata

SEQ ID NO: 365864 - DNA, 15 bp, Homo sapiens
atatttttaaataat

SEQ ID NO: 365865 - DNA, 15 bp, Homo sapiens
tatttttaaataata

SEQ ID NO: 365866 - DNA, 15 bp, Homo sapiens
atttttaaataatat

SEQ ID NO: 365867 - DNA, 15 bp, Homo sapiens
tttttaaataatata

SEQ ID NO: 365868 - DNA, 15 bp, Homo sapiens
ttttaaataatatat

SEQ ID NO: 365869 - DNA, 15 bp, Homo sapiens
tttaaataatatatt

SEQ ID NO: 365870 - DNA, 15 bp, Homo sapiens
ttaaataatatattc

SEQ ID NO: 365871 - DNA, 15 bp, Homo sapiens
taaataatatattct

SEQ ID NO: 365872 - DNA, 15 bp, Homo sapiens
aaataatatattctt

SEQ ID NO: 365873 - DNA, 15 bp, Homo sapiens
aataatatattcttt

SEQ ID NO: 365874 - DNA, 15 bp, Homo sapiens
ataatatattctttt

SEQ ID NO: 365875 - DNA, 15 bp, Homo sapiens
taatatattctttta

SEQ ID NO: 365876 - DNA, 15 bp, Homo sapiens
aatatattcttttag

SEQ ID NO: 365877 - DNA, 15 bp, Homo sapiens
atatattcttttagg

SEQ ID NO: 365878 - DNA, 15 bp, Homo sapiens
tatattcttttaggc

SEQ ID NO: 365879 - DNA, 15 bp, Homo sapiens
atattcttttaggct

SEQ ID NO: 365880 - DNA, 15 bp, Homo sapiens
tattcttttaggcta

SEQ ID NO: 365881 - DNA, 15 bp, Homo sapiens
attcttttaggctaa

SEQ ID NO: 365882 - DNA, 15 bp, Homo sapiens
ttcttttaggctaaa

SEQ ID NO: 365883 - DNA, 15 bp, Homo sapiens
tcttttaggctaaaa

SEQ ID NO: 365884 - DNA, 15 bp, Homo sapiens
cttttaggctaaaag

SEQ ID NO: 365885 - DNA, 15 bp, Homo sapiens
ttttaggctaaaagg

SEQ ID NO: 365886 - DNA, 15 bp, Homo sapiens
tttaggctaaaagga

SEQ ID NO: 365887 - DNA, 15 bp, Homo sapiens
ttaggctaaaaggag

SEQ ID NO: 365888 - DNA, 15 bp, Homo sapiens
taggctaaaaggaga

SEQ ID NO: 365889 - DNA, 15 bp, Homo sapiens
aggctaaaaggagaa

SEQ ID NO: 365890 - DNA, 15 bp, Homo sapiens
ggctaaaaggagaaa

SEQ ID NO: 365891 - DNA, 15 bp, Homo sapiens
gctaaaaggagaaag

SEQ ID NO: 365892 - DNA, 15 bp, Homo sapiens
ctaaaaggagaaagt

SEQ ID NO: 365893 - DNA, 15 bp, Homo sapiens
taaaaggagaaagta

SEQ ID NO: 365894 - DNA, 15 bp, Homo sapiens
aaaaggagaaagtaa

SEQ ID NO: 365895 - DNA, 15 bp, Homo sapiens
aaaggagaaagtaag

SEQ ID NO: 365896 - DNA, 15 bp, Homo sapiens
aaggagaaagtaagc

SEQ ID NO: 365897 - DNA, 15 bp, Homo sapiens
aggagaaagtaagca

SEQ ID NO: 365898 - DNA, 15 bp, Homo sapiens
ggagaaagtaagcag

SEQ ID NO: 365899 - DNA, 15 bp, Homo sapiens
gagaaagtaagcagg

SEQ ID NO: 365900 - DNA, 15 bp, Homo sapiens
agaaagtaagcaggt

SEQ ID NO: 365901 - DNA, 15 bp, Homo sapiens
gaaagtaagcaggtg

SEQ ID NO: 365902 - DNA, 15 bp, Homo sapiens
aaagtaagcaggtga

SEQ ID NO: 365903 - DNA, 15 bp, Homo sapiens
aagtaagcaggtgat

SEQ ID NO: 365904 - DNA, 15 bp, Homo sapiens
agtaagcaggtgatg

SEQ ID NO: 365905 - DNA, 15 bp, Homo sapiens
gtaagcaggtgatga

SEQ ID NO: 365906 - DNA, 15 bp, Homo sapiens
taagcaggtgatgaa

SEQ ID NO: 365907 - DNA, 15 bp, Homo sapiens
aagcaggtgatgaag

SEQ ID NO: 365908 - DNA, 15 bp, Homo sapiens
agcaggtgatgaagt

SEQ ID NO: 365909 - DNA, 15 bp, Homo sapiens
gcaggtgatgaagta

SEQ ID NO: 365910 - DNA, 15 bp, Homo sapiens
caggtgatgaagtac

SEQ ID NO: 365911 - DNA, 15 bp, Homo sapiens
aggtgatgaagtaca

SEQ ID NO: 365912 - DNA, 15 bp, Homo sapiens
ggtgatgaagtacag

SEQ ID NO: 365913 - DNA, 15 bp, Homo sapiens
gtgatgaagtacagg

SEQ ID NO: 365914 - DNA, 15 bp, Homo sapiens
tgatgaagtacaggc

SEQ ID NO: 365915 - DNA, 15 bp, Homo sapiens
gatgaagtacaggca

SEQ ID NO: 365916 - DNA, 15 bp, Homo sapiens
atgaagtacaggcat

SEQ ID NO: 365917 - DNA, 15 bp, Homo sapiens
tgaagtacaggcatc

SEQ ID NO: 365918 - DNA, 15 bp, Homo sapiens
gaagtacaggcatca

SEQ ID NO: 365919 - DNA, 15 bp, Homo sapiens
aagtacaggcatcag

SEQ ID NO: 365920 - DNA, 15 bp, Homo sapiens
agtacaggcatcagc

SEQ ID NO: 365921 - DNA, 15 bp, Homo sapiens
gtacaggcatcagct

SEQ ID NO: 365922 - DNA, 15 bp, Homo sapiens
tacaggcatcagcta

SEQ ID NO: 365923 - DNA, 15 bp, Homo sapiens
acaggcatcagctag

SEQ ID NO: 365924 - DNA, 15 bp, Homo sapiens
caggcatcagctaga

SEQ ID NO: 365925 - DNA, 15 bp, Homo sapiens
aggcatcagctagat

SEQ ID NO: 365926 - DNA, 15 bp, Homo sapiens
ggcatcagctagatg

SEQ ID NO: 365927 - DNA, 15 bp, Homo sapiens
gcatcagctagatga

SEQ ID NO: 365928 - DNA, 15 bp, Homo sapiens
catcagctagatgag

SEQ ID NO: 365929 - DNA, 15 bp, Homo sapiens
atcagctagatgaga

SEQ ID NO: 365930 - DNA, 15 bp, Homo sapiens
tcagctagatgagat

SEQ ID NO: 365931 - DNA, 15 bp, Homo sapiens
cagctagatgagatt

SEQ ID NO: 365932 - DNA, 15 bp, Homo sapiens
agctagatgagatta

SEQ ID NO: 365933 - DNA, 15 bp, Homo sapiens
gctagatgagattat

SEQ ID NO: 365934 - DNA, 15 bp, Homo sapiens
ctagatgagattatc

SEQ ID NO: 365935 - DNA, 15 bp, Homo sapiens
tagatgagattatct

SEQ ID NO: 365936 - DNA, 15 bp, Homo sapiens
agatgagattatctg

SEQ ID NO: 365937 - DNA, 15 bp, Homo sapiens
gatgagattatctgt

SEQ ID NO: 365938 - DNA, 15 bp, Homo sapiens
atgagattatctgtt

SEQ ID NO: 365939 - DNA, 15 bp, Homo sapiens
tgagattatctgttg

SEQ ID NO: 365940 - DNA, 15 bp, Homo sapiens
gagattatctgttgg

SEQ ID NO: 365941 - DNA, 15 bp, Homo sapiens
agattatctgttggt

SEQ ID NO: 365942 - DNA, 15 bp, Homo sapiens
gattatctgttggtt

SEQ ID NO: 365943 - DNA, 15 bp, Homo sapiens
attatctgttggtta

SEQ ID NO: 365944 - DNA, 15 bp, Homo sapiens
ttatctgttggttaa

SEQ ID NO: 365945 - DNA, 15 bp, Homo sapiens
tatctgttggttaac

SEQ ID NO: 365946 - DNA, 15 bp, Homo sapiens
atctgttggttaaca

SEQ ID NO: 365947 - DNA, 15 bp, Homo sapiens
tctgttggttaacaa

SEQ ID NO: 365948 - DNA, 15 bp, Homo sapiens
ctgttggttaacaaa

SEQ ID NO: 365949 - DNA, 15 bp, Homo sapiens
tgttggttaacaaag

SEQ ID NO: 365950 - DNA, 15 bp, Homo sapiens
gttggttaacaaagg

SEQ ID NO: 365951 - DNA, 15 bp, Homo sapiens
ttggttaacaaaggc

SEQ ID NO: 365952 - DNA, 15 bp, Homo sapiens
tggttaacaaaggct

SEQ ID NO: 365953 - DNA, 15 bp, Homo sapiens
ggttaacaaaggctg

SEQ ID NO: 365954 - DNA, 15 bp, Homo sapiens
gttaacaaaggctga

SEQ ID NO: 365955 - DNA, 15 bp, Homo sapiens
ttaacaaaggctgag

SEQ ID NO: 365956 - DNA, 15 bp, Homo sapiens
taacaaaggctgagc

SEQ ID NO: 365957 - DNA, 15 bp, Homo sapiens
aacaaaggctgagca

SEQ ID NO: 365958 - DNA, 15 bp, Homo sapiens
acaaaggctgagcat

SEQ ID NO: 365959 - DNA, 15 bp, Homo sapiens
caaaggctgagcatg

SEQ ID NO: 365960 - DNA, 15 bp, Homo sapiens
aaaggctgagcatgc

SEQ ID NO: 365961 - DNA, 15 bp, Homo sapiens
aaggctgagcatgct

SEQ ID NO: 365962 - DNA, 15 bp, Homo sapiens
aggctgagcatgcta

SEQ ID NO: 365963 - DNA, 15 bp, Homo sapiens
ggctgagcatgctat

SEQ ID NO: 365964 - DNA, 15 bp, Homo sapiens
gctgagcatgctatg

SEQ ID NO: 365965 - DNA, 15 bp, Homo sapiens
ctgagcatgctatgc

SEQ ID NO: 365966 - DNA, 15 bp, Homo sapiens
tgagcatgctatgca

SEQ ID NO: 365967 - DNA, 15 bp, Homo sapiens
gagcatgctatgcaa

SEQ ID NO: 365968 - DNA, 15 bp, Homo sapiens
agcatgctatgcaaa

SEQ ID NO: 365969 - DNA, 15 bp, Homo sapiens
gcatgctatgcaaaa

SEQ ID NO: 365970 - DNA, 15 bp, Homo sapiens
catgctatgcaaaag

SEQ ID NO: 365971 - DNA, 15 bp, Homo sapiens
atgctatgcaaaaga

SEQ ID NO: 365972 - DNA, 15 bp, Homo sapiens
tgctatgcaaaagag

SEQ ID NO: 365973 - DNA, 15 bp, Homo sapiens
gctatgcaaaagaga

SEQ ID NO: 365974 - DNA, 15 bp, Homo sapiens
ctatgcaaaagagat

SEQ ID NO: 365975 - DNA, 15 bp, Homo sapiens
tatgcaaaagagatc

SEQ ID NO: 365976 - DNA, 15 bp, Homo sapiens
atgcaaaagagatca

SEQ ID NO: 365977 - DNA, 15 bp, Homo sapiens
tgcaaaagagatcaa

SEQ ID NO: 365978 - DNA, 15 bp, Homo sapiens
gcaaaagagatcaac

SEQ ID NO: 365979 - DNA, 15 bp, Homo sapiens
caaaagagatcaacc

SEQ ID NO: 365980 - DNA, 15 bp, Homo sapiens
aaaagagatcaacca

SEQ ID NO: 365981 - DNA, 15 bp, Homo sapiens
aaagagatcaaccac

SEQ ID NO: 365982 - DNA, 15 bp, Homo sapiens
aagagatcaaccacc

SEQ ID NO: 365983 - DNA, 15 bp, Homo sapiens
agagatcaaccaccg

SEQ ID NO: 365984 - DNA, 15 bp, Homo sapiens
gagatcaaccaccga

SEQ ID NO: 365985 - DNA, 15 bp, Homo sapiens
agatcaaccaccgaa

SEQ ID NO: 365986 - DNA, 15 bp, Homo sapiens
gatcaaccaccgaat

SEQ ID NO: 365987 - DNA, 15 bp, Homo sapiens
atcaaccaccgaatt

SEQ ID NO: 365988 - DNA, 15 bp, Homo sapiens
tcaaccaccgaattg

SEQ ID NO: 365989 - DNA, 15 bp, Homo sapiens
caaccaccgaattgg

SEQ ID NO: 365990 - DNA, 15 bp, Homo sapiens
aaccaccgaattggg

SEQ ID NO: 365991 - DNA, 15 bp, Homo sapiens
accaccgaattggga

SEQ ID NO: 365992 - DNA, 15 bp, Homo sapiens
ccaccgaattgggag

SEQ ID NO: 365993 - DNA, 15 bp, Homo sapiens
caccgaattgggaga

SEQ ID NO: 365994 - DNA, 15 bp, Homo sapiens
accgaattgggagaa

SEQ ID NO: 365995 - DNA, 15 bp, Homo sapiens
ccgaattgggagaaa

SEQ ID NO: 365996 - DNA, 15 bp, Homo sapiens
cgaattgggagaaaa

SEQ ID NO: 365997 - DNA, 15 bp, Homo sapiens
gaattgggagaaaac

SEQ ID NO: 365998 - DNA, 15 bp, Homo sapiens
aattgggagaaaacc

SEQ ID NO: 365999 - DNA, 15 bp, Homo sapiens
attgggagaaaacct

SEQ ID NO: 366000 - DNA, 15 bp, Homo sapiens
ttgggagaaaacctg

SEQ ID NO: 366001 - DNA, 15 bp, Homo sapiens
tgggagaaaacctgc

SEQ ID NO: 366002 - DNA, 15 bp, Homo sapiens
gggagaaaacctgca

SEQ ID NO: 366003 - DNA, 15 bp, Homo sapiens
ggagaaaacctgcaa

SEQ ID NO: 366004 - DNA, 15 bp, Homo sapiens
gagaaaacctgcaag

SEQ ID NO: 366005 - DNA, 15 bp, Homo sapiens
agaaaacctgcaaga

SEQ ID NO: 366006 - DNA, 15 bp, Homo sapiens
gaaaacctgcaagaa

SEQ ID NO: 366007 - DNA, 15 bp, Homo sapiens
aaaacctgcaagaat

SEQ ID NO: 366008 - DNA, 15 bp, Homo sapiens
aaacctgcaagaatt

SEQ ID NO: 366009 - DNA, 15 bp, Homo sapiens
aacctgcaagaatta

SEQ ID NO: 366010 - DNA, 15 bp, Homo sapiens
acctgcaagaattaa

SEQ ID NO: 366011 - DNA, 15 bp, Homo sapiens
cctgcaagaattaag

SEQ ID NO: 366012 - DNA, 15 bp, Homo sapiens
ctgcaagaattaaga

SEQ ID NO: 366013 - DNA, 15 bp, Homo sapiens
tgcaagaattaagag

SEQ ID NO: 366014 - DNA, 15 bp, Homo sapiens
gcaagaattaagagt

SEQ ID NO: 366015 - DNA, 15 bp, Homo sapiens
caagaattaagagta

SEQ ID NO: 366016 - DNA, 15 bp, Homo sapiens
aagaattaagagtaa

SEQ ID NO: 366017 - DNA, 15 bp, Homo sapiens
agaattaagagtaag

SEQ ID NO: 366018 - DNA, 15 bp, Homo sapiens
gaattaagagtaagt

SEQ ID NO: 366019 - DNA, 15 bp, Homo sapiens
aattaagagtaagtt

SEQ ID NO: 366020 - DNA, 15 bp, Homo sapiens
attaagagtaagttg

SEQ ID NO: 366021 - DNA, 15 bp, Homo sapiens
ttaagagtaagttgt

SEQ ID NO: 366022 - DNA, 15 bp, Homo sapiens
taagagtaagttgtt

SEQ ID NO: 366023 - DNA, 15 bp, Homo sapiens
aagagtaagttgttt

SEQ ID NO: 366024 - DNA, 15 bp, Homo sapiens
agagtaagttgttta

SEQ ID NO: 366025 - DNA, 15 bp, Homo sapiens
gagtaagttgtttat

SEQ ID NO: 366026 - DNA, 15 bp, Homo sapiens
agtaagttgtttatt

SEQ ID NO: 366027 - DNA, 15 bp, Homo sapiens
gtaagttgtttattt

SEQ ID NO: 366028 - DNA, 15 bp, Homo sapiens
taagttgtttatttc

SEQ ID NO: 366029 - DNA, 15 bp, Homo sapiens
aagttgtttatttct

SEQ ID NO: 366030 - DNA, 15 bp, Homo sapiens
agttgtttatttctg

SEQ ID NO: 366031 - DNA, 15 bp, Homo sapiens
gttgtttatttctgt

SEQ ID NO: 366032 - DNA, 15 bp, Homo sapiens
ttgtttatttctgtc

SEQ ID NO: 366033 - DNA, 15 bp, Homo sapiens
tgtttatttctgtct

SEQ ID NO: 366034 - DNA, 15 bp, Homo sapiens
gtttatttctgtcta

SEQ ID NO: 366035 - DNA, 15 bp, Homo sapiens
tttatttctgtctat

SEQ ID NO: 366036 - DNA, 15 bp, Homo sapiens
ttatttctgtctata

SEQ ID NO: 366037 - DNA, 15 bp, Homo sapiens
tatttctgtctatat

SEQ ID NO: 366038 - DNA, 15 bp, Homo sapiens
atttctgtctatatg

SEQ ID NO: 366039 - DNA, 15 bp, Homo sapiens
tttctgtctatatgc

SEQ ID NO: 366040 - DNA, 15 bp, Homo sapiens
ttctgtctatatgcc

SEQ ID NO: 366041 - DNA, 15 bp, Homo sapiens
tctgtctatatgcct

SEQ ID NO: 366042 - DNA, 15 bp, Homo sapiens
ctgtctatatgcctt

SEQ ID NO: 366043 - DNA, 15 bp, Homo sapiens
tctatatgccttttg

SEQ ID NO: 366044 - DNA, 15 bp, Homo sapiens
ctatatgccttttgg

SEQ ID NO: 366045 - DNA, 15 bp, Homo sapiens
tatatgccttttggt

SEQ ID NO: 366046 - DNA, 15 bp, Homo sapiens
atatgccttttggtg

SEQ ID NO: 366047 - DNA, 15 bp, Homo sapiens
tatgccttttggtgc

SEQ ID NO: 366048 - DNA, 15 bp, Homo sapiens
atgccttttggtgcc

SEQ ID NO: 366049 - DNA, 15 bp, Homo sapiens
tgccttttggtgccc

SEQ ID NO: 366050 - DNA, 15 bp, Homo sapiens
gccttttggtgcccg

SEQ ID NO: 366051 - DNA, 15 bp, Homo sapiens
ccttttggtgcccga

SEQ ID NO: 366052 - DNA, 15 bp, Homo sapiens
cttttggtgcccgaa

SEQ ID NO: 366053 - DNA, 15 bp, Homo sapiens
ttttggtgcccgaac

SEQ ID NO: 366054 - DNA, 15 bp, Homo sapiens
tttggtgcccgaaca

SEQ ID NO: 366055 - DNA, 15 bp, Homo sapiens
ttggtgcccgaacat

SEQ ID NO: 366056 - DNA, 15 bp, Homo sapiens
tggtgcccgaacatt

SEQ ID NO: 366057 - DNA, 15 bp, Homo sapiens
ggtgcccgaacatta

SEQ ID NO: 366058 - DNA, 15 bp, Homo sapiens
gtgcccgaacattat

SEQ ID NO: 366059 - DNA, 15 bp, Homo sapiens
tgcccgaacattata

SEQ ID NO: 366060 - DNA, 15 bp, Homo sapiens
gcccgaacattatac

SEQ ID NO: 366061 - DNA, 15 bp, Homo sapiens
cccgaacattatact

SEQ ID NO: 366062 - DNA, 15 bp, Homo sapiens
ccgaacattatactt

SEQ ID NO: 366063 - DNA, 15 bp, Homo sapiens
cgaacattatacttc

SEQ ID NO: 366064 - DNA, 15 bp, Homo sapiens
gaacattatacttca

SEQ ID NO: 366065 - DNA, 15 bp, Homo sapiens
aacattatacttcag

SEQ ID NO: 366066 - DNA, 15 bp, Homo sapiens
acattatacttcaga

SEQ ID NO: 366067 - DNA, 15 bp, Homo sapiens
cattatacttcagag

SEQ ID NO: 366068 - DNA, 15 bp, Homo sapiens
attatacttcagagt

SEQ ID NO: 366069 - DNA, 15 bp, Homo sapiens
ttatacttcagagtc

SEQ ID NO: 366070 - DNA, 15 bp, Homo sapiens
tatacttcagagtca

SEQ ID NO: 366071 - DNA, 15 bp, Homo sapiens
atacttcagagtcac

SEQ ID NO: 366072 - DNA, 15 bp, Homo sapiens
tacttcagagtcaca

SEQ ID NO: 366073 - DNA, 15 bp, Homo sapiens
acttcagagtcacat

SEQ ID NO: 366074 - DNA, 15 bp, Homo sapiens
cttcagagtcacata

SEQ ID NO: 366075 - DNA, 15 bp, Homo sapiens
ttcagagtcacatac

SEQ ID NO: 366076 - DNA, 15 bp, Homo sapiens
tcagagtcacatact

SEQ ID NO: 366077 - DNA, 15 bp, Homo sapiens
cagagtcacatactg

SEQ ID NO: 366078 - DNA, 15 bp, Homo sapiens
agagtcacatactgc

SEQ ID NO: 366079 - DNA, 15 bp, Homo sapiens
gagtcacatactgcg

SEQ ID NO: 366080 - DNA, 15 bp, Homo sapiens
agtcacatactgcgt

SEQ ID NO: 366081 - DNA, 15 bp, Homo sapiens
gtcacatactgcgtg

SEQ ID NO: 366082 - DNA, 15 bp, Homo sapiens
tcacatactgcgtgt

SEQ ID NO: 366083 - DNA, 15 bp, Homo sapiens
cacatactgcgtgtc

SEQ ID NO: 366084 - DNA, 15 bp, Homo sapiens
acatactgcgtgtct

SEQ ID NO: 366085 - DNA, 15 bp, Homo sapiens
catactgcgtgtctc

SEQ ID NO: 366086 - DNA, 15 bp, Homo sapiens
atactgcgtgtctca

SEQ ID NO: 366087 - DNA, 15 bp, Homo sapiens
tactgcgtgtctcaa

SEQ ID NO: 366088 - DNA, 15 bp, Homo sapiens
actgcgtgtctcaag

SEQ ID NO: 366089 - DNA, 15 bp, Homo sapiens
ctgcgtgtctcaaga

SEQ ID NO: 366090 - DNA, 15 bp, Homo sapiens
tgcgtgtctcaagaa

SEQ ID NO: 366091 - DNA, 15 bp, Homo sapiens
gcgtgtctcaagaag

SEQ ID NO: 366092 - DNA, 15 bp, Homo sapiens
cgtgtctcaagaaga

SEQ ID NO: 366093 - DNA, 15 bp, Homo sapiens
gtgtctcaagaagaa

SEQ ID NO: 366094 - DNA, 15 bp, Homo sapiens
tgtctcaagaagaaa

SEQ ID NO: 366095 - DNA, 15 bp, Homo sapiens
gtctcaagaagaaaa

SEQ ID NO: 366096 - DNA, 15 bp, Homo sapiens
tctcaagaagaaaag

SEQ ID NO: 366097 - DNA, 15 bp, Homo sapiens
ctcaagaagaaaagg

SEQ ID NO: 366098 - DNA, 15 bp, Homo sapiens
tcaagaagaaaaggg

SEQ ID NO: 366099 - DNA, 15 bp, Homo sapiens
caagaagaaaaggga

SEQ ID NO: 366100 - DNA, 15 bp, Homo sapiens
aagaagaaaagggaa

SEQ ID NO: 366101 - DNA, 15 bp, Homo sapiens
agaagaaaagggaaa

SEQ ID NO: 366102 - DNA, 15 bp, Homo sapiens
gaagaaaagggaaaa

SEQ ID NO: 366103 - DNA, 15 bp, Homo sapiens
aagaaaagggaaaag

SEQ ID NO: 366104 - DNA, 15 bp, Homo sapiens
agaaaagggaaaaga

SEQ ID NO: 366105 - DNA, 15 bp, Homo sapiens
gaaaagggaaaagaa

SEQ ID NO: 366106 - DNA, 15 bp, Homo sapiens
aaaagggaaaagaaa

SEQ ID NO: 366107 - DNA, 15 bp, Homo sapiens
aaagggaaaagaaac

SEQ ID NO: 366108 - DNA, 15 bp, Homo sapiens
aagggaaaagaaact

SEQ ID NO: 366109 - DNA, 15 bp, Homo sapiens
agggaaaagaaactt

SEQ ID NO: 366110 - DNA, 15 bp, Homo sapiens
gggaaaagaaacttt

SEQ ID NO: 366111 - DNA, 15 bp, Homo sapiens
ggaaaagaaactttg

SEQ ID NO: 366112 - DNA, 15 bp, Homo sapiens
gaaaagaaactttgt

SEQ ID NO: 366113 - DNA, 15 bp, Homo sapiens
aaaagaaactttgta

SEQ ID NO: 366114 - DNA, 15 bp, Homo sapiens
aaagaaactttgtac

SEQ ID NO: 366115 - DNA, 15 bp, Homo sapiens
aagaaactttgtact

SEQ ID NO: 366116 - DNA, 15 bp, Homo sapiens
agaaactttgtactt

SEQ ID NO: 366117 - DNA, 15 bp, Homo sapiens
gaaactttgtacttt

SEQ ID NO: 366118 - DNA, 15 bp, Homo sapiens
aaactttgtactttt

SEQ ID NO: 366119 - DNA, 15 bp, Homo sapiens
aactttgtacttttt

SEQ ID NO: 366120 - DNA, 15 bp, Homo sapiens
actttgtactttttg

SEQ ID NO: 366121 - DNA, 15 bp, Homo sapiens
ctttgtactttttgg

SEQ ID NO: 366122 - DNA, 15 bp, Homo sapiens
tttgtactttttggt

SEQ ID NO: 366123 - DNA, 15 bp, Homo sapiens
ttgtactttttggta

SEQ ID NO: 366124 - DNA, 15 bp, Homo sapiens
tgtactttttggtaa

SEQ ID NO: 366125 - DNA, 15 bp, Homo sapiens
gtactttttggtaaa

SEQ ID NO: 366126 - DNA, 15 bp, Homo sapiens
tactttttggtaaat

SEQ ID NO: 366127 - DNA, 15 bp, Homo sapiens
actttttggtaaatg

SEQ ID NO: 366128 - DNA, 15 bp, Homo sapiens
ctttttggtaaatgt

SEQ ID NO: 366129 - DNA, 15 bp, Homo sapiens
tttttggtaaatgtg

SEQ ID NO: 366130 - DNA, 15 bp, Homo sapiens
ttttggtaaatgtgg

SEQ ID NO: 366131 - DNA, 15 bp, Homo sapiens
tttggtaaatgtggt

SEQ ID NO: 366132 - DNA, 15 bp, Homo sapiens
ttggtaaatgtggtg

SEQ ID NO: 366133 - DNA, 15 bp, Homo sapiens
tggtaaatgtggtga

SEQ ID NO: 366134 - DNA, 15 bp, Homo sapiens
ggtaaatgtggtgaa

SEQ ID NO: 366135 - DNA, 15 bp, Homo sapiens
gtaaatgtggtgaac

SEQ ID NO: 366136 - DNA, 15 bp, Homo sapiens
taaatgtggtgaacc

SEQ ID NO: 366137 - DNA, 15 bp, Homo sapiens
aaatgtggtgaacct

SEQ ID NO: 366138 - DNA, 15 bp, Homo sapiens
aatgtggtgaacctg

SEQ ID NO: 366139 - DNA, 15 bp, Homo sapiens
atgtggtgaacctga

SEQ ID NO: 366140 - DNA, 15 bp, Homo sapiens
tgtggtgaacctgaa

SEQ ID NO: 366141 - DNA, 15 bp, Homo sapiens
gtggtgaacctgaaa

SEQ ID NO: 366142 - DNA, 15 bp, Homo sapiens
tggtgaacctgaaag

SEQ ID NO: 366143 - DNA, 15 bp, Homo sapiens
ggtgaacctgaaaga

SEQ ID NO: 366144 - DNA, 15 bp, Homo sapiens
gtgaacctgaaagag

SEQ ID NO: 366145 - DNA, 15 bp, Homo sapiens
tgaacctgaaagagg

SEQ ID NO: 366146 - DNA, 15 bp, Homo sapiens
gaacctgaaagagga

SEQ ID NO: 366147 - DNA, 15 bp, Homo sapiens
aacctgaaagaggaa

SEQ ID NO: 366148 - DNA, 15 bp, Homo sapiens
acctgaaagaggaat

SEQ ID NO: 366149 - DNA, 15 bp, Homo sapiens
cctgaaagaggaata

SEQ ID NO: 366150 - DNA, 15 bp, Homo sapiens
ctgaaagaggaatat

SEQ ID NO: 366151 - DNA, 15 bp, Homo sapiens
tgaaagaggaatatc

SEQ ID NO: 366152 - DNA, 15 bp, Homo sapiens
gaaagaggaatatct

SEQ ID NO: 366153 - DNA, 15 bp, Homo sapiens
aaagaggaatatctt

SEQ ID NO: 366154 - DNA, 15 bp, Homo sapiens
aagaggaatatcttt

SEQ ID NO: 366155 - DNA, 15 bp, Homo sapiens
agaggaatatctttt

SEQ ID NO: 366156 - DNA, 15 bp, Homo sapiens
gaggaatatctttta

SEQ ID NO: 366157 - DNA, 15 bp, Homo sapiens
aggaatatcttttat

SEQ ID NO: 366158 - DNA, 15 bp, Homo sapiens
ggaatatcttttatt

SEQ ID NO: 366159 - DNA, 15 bp, Homo sapiens
gaatatcttttattt

SEQ ID NO: 366160 - DNA, 15 bp, Homo sapiens
aatatcttttatttt

SEQ ID NO: 366161 - DNA, 15 bp, Homo sapiens
atatcttttattttt

SEQ ID NO: 366162 - DNA, 15 bp, Homo sapiens
tatcttttatttttt

SEQ ID NO: 366163 - DNA, 15 bp, Homo sapiens
atcttttatttttta

SEQ ID NO: 366164 - DNA, 15 bp, Homo sapiens
tcttttattttttaa

SEQ ID NO: 366165 - DNA, 15 bp, Homo sapiens
cttttattttttaaa

SEQ ID NO: 366166 - DNA, 15 bp, Homo sapiens
tttattttttaaaga

SEQ ID NO: 366167 - DNA, 15 bp, Homo sapiens
ttattttttaaagag

SEQ ID NO: 366168 - DNA, 15 bp, Homo sapiens
tattttttaaagagc

SEQ ID NO: 366169 - DNA, 15 bp, Homo sapiens
attttttaaagagca

SEQ ID NO: 366170 - DNA, 15 bp, Homo sapiens
ttttttaaagagcag

SEQ ID NO: 366171 - DNA, 15 bp, Homo sapiens
tttttaaagagcagt

SEQ ID NO: 366172 - DNA, 15 bp, Homo sapiens
ttttaaagagcagtt

SEQ ID NO: 366173 - DNA, 15 bp, Homo sapiens
tttaaagagcagtta

SEQ ID NO: 366174 - DNA, 15 bp, Homo sapiens
ttaaagagcagttat

SEQ ID NO: 366175 - DNA, 15 bp, Homo sapiens
taaagagcagttata

SEQ ID NO: 366176 - DNA, 15 bp, Homo sapiens
aaagagcagttataa

SEQ ID NO: 366177 - DNA, 15 bp, Homo sapiens
aagagcagttataat

SEQ ID NO: 366178 - DNA, 15 bp, Homo sapiens
agagcagttataatt

SEQ ID NO: 366179 - DNA, 15 bp, Homo sapiens
gagcagttataattt

SEQ ID NO: 366180 - DNA, 15 bp, Homo sapiens
agcagttataatttt

SEQ ID NO: 366181 - DNA, 15 bp, Homo sapiens
gcagttataattttg

SEQ ID NO: 366182 - DNA, 15 bp, Homo sapiens
cagttataattttgg

SEQ ID NO: 366183 - DNA, 15 bp, Homo sapiens
agttataattttggt

SEQ ID NO: 366184 - DNA, 15 bp, Homo sapiens
gttataattttggtc

SEQ ID NO: 366185 - DNA, 15 bp, Homo sapiens
ttataattttggtct

SEQ ID NO: 366186 - DNA, 15 bp, Homo sapiens
tataattttggtctt

SEQ ID NO: 366187 - DNA, 15 bp, Homo sapiens
ataattttggtcttg

SEQ ID NO: 366188 - DNA, 15 bp, Homo sapiens
taattttggtcttgc

SEQ ID NO: 366189 - DNA, 15 bp, Homo sapiens
aattttggtcttgca

SEQ ID NO: 366190 - DNA, 15 bp, Homo sapiens
attttggtcttgcag

SEQ ID NO: 366191 - DNA, 15 bp, Homo sapiens
ttttggtcttgcaga

SEQ ID NO: 366192 - DNA, 15 bp, Homo sapiens
tttggtcttgcagag

SEQ ID NO: 366193 - DNA, 15 bp, Homo sapiens
ttggtcttgcagagc

SEQ ID NO: 366194 - DNA, 15 bp, Homo sapiens
tggtcttgcagagct

SEQ ID NO: 366195 - DNA, 15 bp, Homo sapiens
ggtcttgcagagctt

SEQ ID NO: 366196 - DNA, 15 bp, Homo sapiens
gtcttgcagagctta

SEQ ID NO: 366197 - DNA, 15 bp, Homo sapiens
tcttgcagagcttaa

SEQ ID NO: 366198 - DNA, 15 bp, Homo sapiens
cttgcagagcttaaa

SEQ ID NO: 366199 - DNA, 15 bp, Homo sapiens
ttgcagagcttaaac

SEQ ID NO: 366200 - DNA, 15 bp, Homo sapiens
tgcagagcttaaact

SEQ ID NO: 366201 - DNA, 15 bp, Homo sapiens
gcagagcttaaactt

SEQ ID NO: 366202 - DNA, 15 bp, Homo sapiens
cagagcttaaacttc

SEQ ID NO: 366203 - DNA, 15 bp, Homo sapiens
agagcttaaacttca

SEQ ID NO: 366204 - DNA, 15 bp, Homo sapiens
gagcttaaacttcac

SEQ ID NO: 366205 - DNA, 15 bp, Homo sapiens
agcttaaacttcact

SEQ ID NO: 366206 - DNA, 15 bp, Homo sapiens
gcttaaacttcactt

SEQ ID NO: 366207 - DNA, 15 bp, Homo sapiens
cttaaacttcactta

SEQ ID NO: 366208 - DNA, 15 bp, Homo sapiens
ttaaacttcacttat

SEQ ID NO: 366209 - DNA, 15 bp, Homo sapiens
taaacttcacttatg

SEQ ID NO: 366210 - DNA, 15 bp, Homo sapiens
aaacttcacttatgt

SEQ ID NO: 366211 - DNA, 15 bp, Homo sapiens
aacttcacttatgta

SEQ ID NO: 366212 - DNA, 15 bp, Homo sapiens
acttcacttatgtaa

SEQ ID NO: 366213 - DNA, 15 bp, Homo sapiens
cttcacttatgtaaa

SEQ ID NO: 366214 - DNA, 15 bp, Homo sapiens
ttcacttatgtaaaa

SEQ ID NO: 366215 - DNA, 15 bp, Homo sapiens
tcacttatgtaaaaa

SEQ ID NO: 366216 - DNA, 15 bp, Homo sapiens
cacttatgtaaaaag

SEQ ID NO: 366217 - DNA, 15 bp, Homo sapiens
acttatgtaaaaaga

SEQ ID NO: 366218 - DNA, 15 bp, Homo sapiens
cttatgtaaaaagaa

SEQ ID NO: 366219 - DNA, 15 bp, Homo sapiens
ttatgtaaaaagaac

SEQ ID NO: 366220 - DNA, 15 bp, Homo sapiens
tatgtaaaaagaaca

SEQ ID NO: 366221 - DNA, 15 bp, Homo sapiens
atgtaaaaagaacaa

SEQ ID NO: 366222 - DNA, 15 bp, Homo sapiens
tgtaaaaagaacaaa

SEQ ID NO: 366223 - DNA, 15 bp, Homo sapiens
gtaaaaagaacaaac

SEQ ID NO: 366224 - DNA, 15 bp, Homo sapiens
taaaaagaacaaact

SEQ ID NO: 366225 - DNA, 15 bp, Homo sapiens
aaaaagaacaaacta

SEQ ID NO: 366226 - DNA, 15 bp, Homo sapiens
aaaagaacaaactat

SEQ ID NO: 366227 - DNA, 15 bp, Homo sapiens
aaagaacaaactatt

SEQ ID NO: 366228 - DNA, 15 bp, Homo sapiens
aagaacaaactatta

SEQ ID NO: 366229 - DNA, 15 bp, Homo sapiens
agaacaaactattat

SEQ ID NO: 366230 - DNA, 15 bp, Homo sapiens
gaacaaactattatg

SEQ ID NO: 366231 - DNA, 15 bp, Homo sapiens
aacaaactattatgg

SEQ ID NO: 366232 - DNA, 15 bp, Homo sapiens
acaaactattatggt

SEQ ID NO: 366233 - DNA, 15 bp, Homo sapiens
caaactattatggtg

SEQ ID NO: 366234 - DNA, 15 bp, Homo sapiens
aaactattatggtgt

SEQ ID NO: 366235 - DNA, 15 bp, Homo sapiens
aactattatggtgtc

SEQ ID NO: 366236 - DNA, 15 bp, Homo sapiens
actattatggtgtca

SEQ ID NO: 366237 - DNA, 15 bp, Homo sapiens
ctattatggtgtcag

SEQ ID NO: 366238 - DNA, 15 bp, Homo sapiens
tattatggtgtcagt

SEQ ID NO: 366239 - DNA, 15 bp, Homo sapiens
attatggtgtcagta

SEQ ID NO: 366240 - DNA, 15 bp, Homo sapiens
ttatggtgtcagtat

SEQ ID NO: 366241 - DNA, 15 bp, Homo sapiens
tatggtgtcagtatt

SEQ ID NO: 366242 - DNA, 15 bp, Homo sapiens
atggtgtcagtatta

SEQ ID NO: 366243 - DNA, 15 bp, Homo sapiens
tggtgtcagtattag

SEQ ID NO: 366244 - DNA, 15 bp, Homo sapiens
ggtgtcagtattaga

SEQ ID NO: 366245 - DNA, 15 bp, Homo sapiens
gtgtcagtattagac

SEQ ID NO: 366246 - DNA, 15 bp, Homo sapiens
tgtcagtattagacc

SEQ ID NO: 366247 - DNA, 15 bp, Homo sapiens
gtcagtattagacca

SEQ ID NO: 366248 - DNA, 15 bp, Homo sapiens
tcagtattagaccaa

SEQ ID NO: 366249 - DNA, 15 bp, Homo sapiens
cagtattagaccaaa

SEQ ID NO: 366250 - DNA, 15 bp, Homo sapiens
agtattagaccaaag

SEQ ID NO: 366251 - DNA, 15 bp, Homo sapiens
gtattagaccaaagg

SEQ ID NO: 366252 - DNA, 15 bp, Homo sapiens
tattagaccaaaggt

SEQ ID NO: 366253 - DNA, 15 bp, Homo sapiens
attagaccaaaggtt

SEQ ID NO: 366254 - DNA, 15 bp, Homo sapiens
ttagaccaaaggttt

SEQ ID NO: 366255 - DNA, 15 bp, Homo sapiens
tagaccaaaggtttt

SEQ ID NO: 366256 - DNA, 15 bp, Homo sapiens
agaccaaaggttttt

SEQ ID NO: 366257 - DNA, 15 bp, Homo sapiens
gaccaaaggttttta

SEQ ID NO: 366258 - DNA, 15 bp, Homo sapiens
accaaaggtttttag

SEQ ID NO: 366259 - DNA, 15 bp, Homo sapiens
ccaaaggtttttagg

SEQ ID NO: 366260 - DNA, 15 bp, Homo sapiens
caaaggtttttagga

SEQ ID NO: 366261 - DNA, 15 bp, Homo sapiens
aaaggtttttaggat

SEQ ID NO: 366262 - DNA, 15 bp, Homo sapiens
aaggtttttaggata

SEQ ID NO: 366263 - DNA, 15 bp, Homo sapiens
aggtttttaggatat

SEQ ID NO: 366264 - DNA, 15 bp, Homo sapiens
ggtttttaggatatt

SEQ ID NO: 366265 - DNA, 15 bp, Homo sapiens
gtttttaggatattg

SEQ ID NO: 366266 - DNA, 15 bp, Homo sapiens
tttttaggatattgt

SEQ ID NO: 366267 - DNA, 15 bp, Homo sapiens
ttttaggatattgta

SEQ ID NO: 366268 - DNA, 15 bp, Homo sapiens
tttaggatattgtaa

SEQ ID NO: 366269 - DNA, 15 bp, Homo sapiens
ttaggatattgtaaa

SEQ ID NO: 366270 - DNA, 15 bp, Homo sapiens
taggatattgtaaac

SEQ ID NO: 366271 - DNA, 15 bp, Homo sapiens
aggatattgtaaact

SEQ ID NO: 366272 - DNA, 15 bp, Homo sapiens
ggatattgtaaactg

SEQ ID NO: 366273 - DNA, 15 bp, Homo sapiens
gatattgtaaactga

SEQ ID NO: 366274 - DNA, 15 bp, Homo sapiens
atattgtaaactgac

SEQ ID NO: 366275 - DNA, 15 bp, Homo sapiens
tattgtaaactgacc

SEQ ID NO: 366276 - DNA, 15 bp, Homo sapiens
attgtaaactgacct

SEQ ID NO: 366277 - DNA, 15 bp, Homo sapiens
ttgtaaactgacctt

SEQ ID NO: 366278 - DNA, 15 bp, Homo sapiens
tgtaaactgacctta

SEQ ID NO: 366279 - DNA, 15 bp, Homo sapiens
gtaaactgaccttat

SEQ ID NO: 366280 - DNA, 15 bp, Homo sapiens
taaactgaccttatc

SEQ ID NO: 366281 - DNA, 15 bp, Homo sapiens
aaactgaccttatca

SEQ ID NO: 366282 - DNA, 15 bp, Homo sapiens
aactgaccttatcat

SEQ ID NO: 366283 - DNA, 15 bp, Homo sapiens
actgaccttatcatt

SEQ ID NO: 366284 - DNA, 15 bp, Homo sapiens
ctgaccttatcattt

SEQ ID NO: 366285 - DNA, 15 bp, Homo sapiens
tgaccttatcatttt

SEQ ID NO: 366286 - DNA, 15 bp, Homo sapiens
gaccttatcatttta

SEQ ID NO: 366287 - DNA, 15 bp, Homo sapiens
accttatcattttaa

SEQ ID NO: 366288 - DNA, 15 bp, Homo sapiens
ccttatcattttaaa

SEQ ID NO: 366289 - DNA, 15 bp, Homo sapiens
cttatcattttaaaa

SEQ ID NO: 366290 - DNA, 15 bp, Homo sapiens
ttatcattttaaaat

SEQ ID NO: 366291 - DNA, 15 bp, Homo sapiens
tatcattttaaaata

SEQ ID NO: 366292 - DNA, 15 bp, Homo sapiens
atcattttaaaatac

SEQ ID NO: 366293 - DNA, 15 bp, Homo sapiens
tcattttaaaataca

SEQ ID NO: 366294 - DNA, 15 bp, Homo sapiens
cattttaaaatacaa

SEQ ID NO: 366295 - DNA, 15 bp, Homo sapiens
attttaaaatacaat

SEQ ID NO: 366296 - DNA, 15 bp, Homo sapiens
ttttaaaatacaata

SEQ ID NO: 366297 - DNA, 15 bp, Homo sapiens
tttaaaatacaatag

SEQ ID NO: 366298 - DNA, 15 bp, Homo sapiens
ttaaaatacaatagg

SEQ ID NO: 366299 - DNA, 15 bp, Homo sapiens
taaaatacaataggg

SEQ ID NO: 366300 - DNA, 15 bp, Homo sapiens
aaaatacaatagggc

SEQ ID NO: 366301 - DNA, 15 bp, Homo sapiens
aaatacaatagggct

SEQ ID NO: 366302 - DNA, 15 bp, Homo sapiens
aatacaatagggcta

SEQ ID NO: 366303 - DNA, 15 bp, Homo sapiens
atacaatagggctat

SEQ ID NO: 366304 - DNA, 15 bp, Homo sapiens
tacaatagggctatg

SEQ ID NO: 366305 - DNA, 15 bp, Homo sapiens
acaatagggctatga

SEQ ID NO: 366306 - DNA, 15 bp, Homo sapiens
caatagggctatgaa

SEQ ID NO: 366307 - DNA, 15 bp, Homo sapiens
aatagggctatgaaa

SEQ ID NO: 366308 - DNA, 15 bp, Homo sapiens
atagggctatgaaat

SEQ ID NO: 366309 - DNA, 15 bp, Homo sapiens
tagggctatgaaata

SEQ ID NO: 366310 - DNA, 15 bp, Homo sapiens
agggctatgaaatat

SEQ ID NO: 366311 - DNA, 15 bp, Homo sapiens
gggctatgaaatatc

SEQ ID NO: 366312 - DNA, 15 bp, Homo sapiens
ggctatgaaatatcg

SEQ ID NO: 366313 - DNA, 15 bp, Homo sapiens
gctatgaaatatcgt

SEQ ID NO: 366314 - DNA, 15 bp, Homo sapiens
ctatgaaatatcgtt

SEQ ID NO: 366315 - DNA, 15 bp, Homo sapiens
tatgaaatatcgttt

SEQ ID NO: 366316 - DNA, 15 bp, Homo sapiens
atgaaatatcgtttt

SEQ ID NO: 366317 - DNA, 15 bp, Homo sapiens
tgaaatatcgttttt

SEQ ID NO: 366318 - DNA, 15 bp, Homo sapiens
gaaatatcgtttttt

SEQ ID NO: 366319 - DNA, 15 bp, Homo sapiens
aaatatcgttttttg

SEQ ID NO: 366320 - DNA, 15 bp, Homo sapiens
aatatcgttttttgt

SEQ ID NO: 366321 - DNA, 15 bp, Homo sapiens
atatcgttttttgtt

SEQ ID NO: 366322 - DNA, 15 bp, Homo sapiens
tatcgttttttgttt

SEQ ID NO: 366323 - DNA, 15 bp, Homo sapiens
atcgttttttgtttt

SEQ ID NO: 366324 - DNA, 15 bp, Homo sapiens
tcgttttttgttttt

SEQ ID NO: 366325 - DNA, 15 bp, Homo sapiens
cgttttttgttttta

SEQ ID NO: 366326 - DNA, 15 bp, Homo sapiens
gttttttgtttttag

SEQ ID NO: 366327 - DNA, 15 bp, Homo sapiens
ttttttgtttttaga

SEQ ID NO: 366328 - DNA, 15 bp, Homo sapiens
tttttgtttttagat

SEQ ID NO: 366329 - DNA, 15 bp, Homo sapiens
ttttgtttttagatt

SEQ ID NO: 366330 - DNA, 15 bp, Homo sapiens
tttgtttttagattt

SEQ ID NO: 366331 - DNA, 15 bp, Homo sapiens
ttgtttttagatttg

SEQ ID NO: 366332 - DNA, 15 bp, Homo sapiens
tgtttttagatttgg

SEQ ID NO: 366333 - DNA, 15 bp, Homo sapiens
gtttttagatttgga

SEQ ID NO: 366334 - DNA, 15 bp, Homo sapiens
tttttagatttggaa

SEQ ID NO: 366335 - DNA, 15 bp, Homo sapiens
ttttagatttggaag

SEQ ID NO: 366336 - DNA, 15 bp, Homo sapiens
tttagatttggaaga

SEQ ID NO: 366337 - DNA, 15 bp, Homo sapiens
ttagatttggaagaa

SEQ ID NO: 366338 - DNA, 15 bp, Homo sapiens
tagatttggaagaaa

SEQ ID NO: 366339 - DNA, 15 bp, Homo sapiens
agatttggaagaaaa

SEQ ID NO: 366340 - DNA, 15 bp, Homo sapiens
gatttggaagaaaat

SEQ ID NO: 366341 - DNA, 15 bp, Homo sapiens
atttggaagaaaatt

SEQ ID NO: 366342 - DNA, 15 bp, Homo sapiens
tttggaagaaaatta

SEQ ID NO: 366343 - DNA, 15 bp, Homo sapiens
ttggaagaaaattac

SEQ ID NO: 366344 - DNA, 15 bp, Homo sapiens
tggaagaaaattact

SEQ ID NO: 366345 - DNA, 15 bp, Homo sapiens
ggaagaaaattactg

SEQ ID NO: 366346 - DNA, 15 bp, Homo sapiens
gaagaaaattactga

SEQ ID NO: 366347 - DNA, 15 bp, Homo sapiens
aagaaaattactgat

SEQ ID NO: 366348 - DNA, 15 bp, Homo sapiens
agaaaattactgatt

SEQ ID NO: 366349 - DNA, 15 bp, Homo sapiens
gaaaattactgatta

SEQ ID NO: 366350 - DNA, 15 bp, Homo sapiens
aaaattactgattat

SEQ ID NO: 366351 - DNA, 15 bp, Homo sapiens
aaattactgattatt

SEQ ID NO: 366352 - DNA, 15 bp, Homo sapiens
aattactgattattg

SEQ ID NO: 366353 - DNA, 15 bp, Homo sapiens
attactgattattgt

SEQ ID NO: 366354 - DNA, 15 bp, Homo sapiens
ttactgattattgtc

SEQ ID NO: 366355 - DNA, 15 bp, Homo sapiens
tactgattattgtct

SEQ ID NO: 366356 - DNA, 15 bp, Homo sapiens
actgattattgtcta

SEQ ID NO: 366357 - DNA, 15 bp, Homo sapiens
ctgattattgtctat

SEQ ID NO: 366358 - DNA, 15 bp, Homo sapiens
tgattattgtctata

SEQ ID NO: 366359 - DNA, 15 bp, Homo sapiens
gattattgtctataa

SEQ ID NO: 366360 - DNA, 15 bp, Homo sapiens
attattgtctataaa

SEQ ID NO: 366361 - DNA, 15 bp, Homo sapiens
ttattgtctataaag

SEQ ID NO: 366362 - DNA, 15 bp, Homo sapiens
tattgtctataaagc

SEQ ID NO: 366363 - DNA, 15 bp, Homo sapiens
attgtctataaagct

SEQ ID NO: 366364 - DNA, 15 bp, Homo sapiens
ttgtctataaagctg

SEQ ID NO: 366365 - DNA, 15 bp, Homo sapiens
tgtctataaagctgc

SEQ ID NO: 366366 - DNA, 15 bp, Homo sapiens
gtctataaagctgca

SEQ ID NO: 366367 - DNA, 15 bp, Homo sapiens
tctataaagctgcaa

SEQ ID NO: 366368 - DNA, 15 bp, Homo sapiens
ctataaagctgcaaa

SEQ ID NO: 366369 - DNA, 15 bp, Homo sapiens
tataaagctgcaaaa

SEQ ID NO: 366370 - DNA, 15 bp, Homo sapiens
ataaagctgcaaaac

SEQ ID NO: 366371 - DNA, 15 bp, Homo sapiens
taaagctgcaaaact

SEQ ID NO: 366372 - DNA, 15 bp, Homo sapiens
aaagctgcaaaactc

SEQ ID NO: 366373 - DNA, 15 bp, Homo sapiens
aagctgcaaaactca

SEQ ID NO: 366374 - DNA, 15 bp, Homo sapiens
agctgcaaaactcaa

SEQ ID NO: 366375 - DNA, 15 bp, Homo sapiens
gctgcaaaactcaac

SEQ ID NO: 366376 - DNA, 15 bp, Homo sapiens
ctgcaaaactcaact

SEQ ID NO: 366377 - DNA, 15 bp, Homo sapiens
tgcaaaactcaactt

SEQ ID NO: 366378 - DNA, 15 bp, Homo sapiens
gcaaaactcaacttt

SEQ ID NO: 366379 - DNA, 15 bp, Homo sapiens
caaaactcaacttta

SEQ ID NO: 366380 - DNA, 15 bp, Homo sapiens
aaaactcaactttat

SEQ ID NO: 366381 - DNA, 15 bp, Homo sapiens
aaactcaactttata

SEQ ID NO: 366382 - DNA, 15 bp, Homo sapiens
aactcaactttatag

SEQ ID NO: 366383 - DNA, 15 bp, Homo sapiens
actcaactttataga

SEQ ID NO: 366384 - DNA, 15 bp, Homo sapiens
ctcaactttatagat

SEQ ID NO: 366385 - DNA, 15 bp, Homo sapiens
tcaactttatagata

SEQ ID NO: 366386 - DNA, 15 bp, Homo sapiens
caactttatagataa

SEQ ID NO: 366387 - DNA, 15 bp, Homo sapiens
aactttatagataat

SEQ ID NO: 366388 - DNA, 15 bp, Homo sapiens
actttatagataatc

SEQ ID NO: 366389 - DNA, 15 bp, Homo sapiens
ctttatagataatca

SEQ ID NO: 366390 - DNA, 15 bp, Homo sapiens
tttatagataatcag

SEQ ID NO: 366391 - DNA, 15 bp, Homo sapiens
ttatagataatcagt

SEQ ID NO: 366392 - DNA, 15 bp, Homo sapiens
tatagataatcagta

SEQ ID NO: 366393 - DNA, 15 bp, Homo sapiens
atagataatcagtaa

SEQ ID NO: 366394 - DNA, 15 bp, Homo sapiens
tagataatcagtaat

SEQ ID NO: 366395 - DNA, 15 bp, Homo sapiens
agataatcagtaatt

SEQ ID NO: 366396 - DNA, 15 bp, Homo sapiens
gataatcagtaatta

SEQ ID NO: 366397 - DNA, 15 bp, Homo sapiens
ataatcagtaattat

SEQ ID NO: 366398 - DNA, 15 bp, Homo sapiens
taatcagtaattatc

SEQ ID NO: 366399 - DNA, 15 bp, Homo sapiens
aatcagtaattatca

SEQ ID NO: 366400 - DNA, 15 bp, Homo sapiens
atcagtaattatcag

SEQ ID NO: 366401 - DNA, 15 bp, Homo sapiens
tcagtaattatcaga

SEQ ID NO: 366402 - DNA, 15 bp, Homo sapiens
cagtaattatcagag

SEQ ID NO: 366403 - DNA, 15 bp, Homo sapiens
agtaattatcagagt

SEQ ID NO: 366404 - DNA, 15 bp, Homo sapiens
gtaattatcagagtg

SEQ ID NO: 366405 - DNA, 15 bp, Homo sapiens
taattatcagagtga

SEQ ID NO: 366406 - DNA, 15 bp, Homo sapiens
aattatcagagtgac

SEQ ID NO: 366407 - DNA, 15 bp, Homo sapiens
attatcagagtgact

SEQ ID NO: 366408 - DNA, 15 bp, Homo sapiens
ttatcagagtgactt

SEQ ID NO: 366409 - DNA, 15 bp, Homo sapiens
tatcagagtgacttg

SEQ ID NO: 366410 - DNA, 15 bp, Homo sapiens
atcagagtgacttgc

SEQ ID NO: 366411 - DNA, 15 bp, Homo sapiens
tcagagtgacttgct

SEQ ID NO: 366412 - DNA, 15 bp, Homo sapiens
cagagtgacttgctg

SEQ ID NO: 366413 - DNA, 15 bp, Homo sapiens
agagtgacttgctga

SEQ ID NO: 366414 - DNA, 15 bp, Homo sapiens
gagtgacttgctgag

SEQ ID NO: 366415 - DNA, 15 bp, Homo sapiens
agtgacttgctgagg

SEQ ID NO: 366416 - DNA, 15 bp, Homo sapiens
gtgacttgctgagga

SEQ ID NO: 366417 - DNA, 15 bp, Homo sapiens
tgacttgctgaggaa

SEQ ID NO: 366418 - DNA, 15 bp, Homo sapiens
gacttgctgaggaac

SEQ ID NO: 366419 - DNA, 15 bp, Homo sapiens
acttgctgaggaaca

SEQ ID NO: 366420 - DNA, 15 bp, Homo sapiens
cttgctgaggaacaa

SEQ ID NO: 366421 - DNA, 15 bp, Homo sapiens
ttgctgaggaacaaa

SEQ ID NO: 366422 - DNA, 15 bp, Homo sapiens
tgctgaggaacaaaa

SEQ ID NO: 366423 - DNA, 15 bp, Homo sapiens
gctgaggaacaaaat

SEQ ID NO: 366424 - DNA, 15 bp, Homo sapiens
ctgaggaacaaaatg

SEQ ID NO: 366425 - DNA, 15 bp, Homo sapiens
tgaggaacaaaatgc

SEQ ID NO: 366426 - DNA, 15 bp, Homo sapiens
gaggaacaaaatgca

SEQ ID NO: 366427 - DNA, 15 bp, Homo sapiens
aggaacaaaatgcag

SEQ ID NO: 366428 - DNA, 15 bp, Homo sapiens
ggaacaaaatgcagc

SEQ ID NO: 366429 - DNA, 15 bp, Homo sapiens
gaacaaaatgcagct

SEQ ID NO: 366430 - DNA, 15 bp, Homo sapiens
aacaaaatgcagctt

SEQ ID NO: 366431 - DNA, 15 bp, Homo sapiens
acaaaatgcagcttg

SEQ ID NO: 366432 - DNA, 15 bp, Homo sapiens
caaaatgcagcttgc

SEQ ID NO: 366433 - DNA, 15 bp, Homo sapiens
aaaatgcagcttgca

SEQ ID NO: 366434 - DNA, 15 bp, Homo sapiens
aaatgcagcttgcaa

SEQ ID NO: 366435 - DNA, 15 bp, Homo sapiens
aatgcagcttgcaat

SEQ ID NO: 366436 - DNA, 15 bp, Homo sapiens
atgcagcttgcaata

SEQ ID NO: 366437 - DNA, 15 bp, Homo sapiens
tgcagcttgcaatag

SEQ ID NO: 366438 - DNA, 15 bp, Homo sapiens
gcagcttgcaatagg

SEQ ID NO: 366439 - DNA, 15 bp, Homo sapiens
cagcttgcaataggt

SEQ ID NO: 366440 - DNA, 15 bp, Homo sapiens
agcttgcaataggtt

SEQ ID NO: 366441 - DNA, 15 bp, Homo sapiens
gcttgcaataggttt

SEQ ID NO: 366442 - DNA, 15 bp, Homo sapiens
cttgcaataggttta

SEQ ID NO: 366443 - DNA, 15 bp, Homo sapiens
ttgcaataggtttag

SEQ ID NO: 366444 - DNA, 15 bp, Homo sapiens
tgcaataggtttagt

SEQ ID NO: 366445 - DNA, 15 bp, Homo sapiens
gcaataggtttagtg

SEQ ID NO: 366446 - DNA, 15 bp, Homo sapiens
caataggtttagtgt

SEQ ID NO: 366447 - DNA, 15 bp, Homo sapiens
aataggtttagtgtc

SEQ ID NO: 366448 - DNA, 15 bp, Homo sapiens
ataggtttagtgtca

SEQ ID NO: 366449 - DNA, 15 bp, Homo sapiens
taggtttagtgtcat

SEQ ID NO: 366450 - DNA, 15 bp, Homo sapiens
aggtttagtgtcatg

SEQ ID NO: 366451 - DNA, 15 bp, Homo sapiens
ggtttagtgtcatgg

SEQ ID NO: 366452 - DNA, 15 bp, Homo sapiens
gtttagtgtcatggt

SEQ ID NO: 366453 - DNA, 15 bp, Homo sapiens
tttagtgtcatggtt

SEQ ID NO: 366454 - DNA, 15 bp, Homo sapiens
ttagtgtcatggttg

SEQ ID NO: 366455 - DNA, 15 bp, Homo sapiens
tagtgtcatggttgt

SEQ ID NO: 366456 - DNA, 15 bp, Homo sapiens
agtgtcatggttgta

SEQ ID NO: 366457 - DNA, 15 bp, Homo sapiens
gtgtcatggttgtat

SEQ ID NO: 366458 - DNA, 15 bp, Homo sapiens
tgtcatggttgtatt

SEQ ID NO: 366459 - DNA, 15 bp, Homo sapiens
gtcatggttgtatta

SEQ ID NO: 366460 - DNA, 15 bp, Homo sapiens
catggttgtattaat

SEQ ID NO: 366461 - DNA, 15 bp, Homo sapiens
atggttgtattaatc

SEQ ID NO: 366462 - DNA, 15 bp, Homo sapiens
tggttgtattaatca

SEQ ID NO: 366463 - DNA, 15 bp, Homo sapiens
ggttgtattaatcag

SEQ ID NO: 366464 - DNA, 15 bp, Homo sapiens
gttgtattaatcaga

SEQ ID NO: 366465 - DNA, 15 bp, Homo sapiens
ttgtattaatcagat

SEQ ID NO: 366466 - DNA, 15 bp, Homo sapiens
tgtattaatcagatt

SEQ ID NO: 366467 - DNA, 15 bp, Homo sapiens
gtattaatcagattt

SEQ ID NO: 366468 - DNA, 15 bp, Homo sapiens
tattaatcagatttt

SEQ ID NO: 366469 - DNA, 15 bp, Homo sapiens
attaatcagattttc

SEQ ID NO: 366470 - DNA, 15 bp, Homo sapiens
ttaatcagattttct

SEQ ID NO: 366471 - DNA, 15 bp, Homo sapiens
taatcagattttctt

SEQ ID NO: 366472 - DNA, 15 bp, Homo sapiens
aatcagattttcttt

SEQ ID NO: 366473 - DNA, 15 bp, Homo sapiens
atcagattttctttg

SEQ ID NO: 366474 - DNA, 15 bp, Homo sapiens
tcagattttctttgt

SEQ ID NO: 366475 - DNA, 15 bp, Homo sapiens
cagattttctttgtt

SEQ ID NO: 366476 - DNA, 15 bp, Homo sapiens
agattttctttgttg

SEQ ID NO: 366477 - DNA, 15 bp, Homo sapiens
gattttctttgttgg

SEQ ID NO: 366478 - DNA, 15 bp, Homo sapiens
attttctttgttggt

SEQ ID NO: 366479 - DNA, 15 bp, Homo sapiens
ttttctttgttggtt

SEQ ID NO: 366480 - DNA, 15 bp, Homo sapiens
tttctttgttggttt

SEQ ID NO: 366481 - DNA, 15 bp, Homo sapiens
ttctttgttggtttg

SEQ ID NO: 366482 - DNA, 15 bp, Homo sapiens
tctttgttggtttgc

SEQ ID NO: 366483 - DNA, 15 bp, Homo sapiens
ctttgttggtttgca

SEQ ID NO: 366484 - DNA, 15 bp, Homo sapiens
tttgttggtttgcaa

SEQ ID NO: 366485 - DNA, 15 bp, Homo sapiens
ttgttggtttgcaac

SEQ ID NO: 366486 - DNA, 15 bp, Homo sapiens
tgttggtttgcaact

SEQ ID NO: 366487 - DNA, 15 bp, Homo sapiens
gttggtttgcaacta

SEQ ID NO: 366488 - DNA, 15 bp, Homo sapiens
ttggtttgcaactaa

SEQ ID NO: 366489 - DNA, 15 bp, Homo sapiens
tggtttgcaactaac

SEQ ID NO: 366490 - DNA, 15 bp, Homo sapiens
ggtttgcaactaaca

SEQ ID NO: 366491 - DNA, 15 bp, Homo sapiens
gtttgcaactaacaa

SEQ ID NO: 366492 - DNA, 15 bp, Homo sapiens
tttgcaactaacaag

SEQ ID NO: 366493 - DNA, 15 bp, Homo sapiens
ttgcaactaacaagt

SEQ ID NO: 366494 - DNA, 15 bp, Homo sapiens
tgcaactaacaagta

SEQ ID NO: 366495 - DNA, 15 bp, Homo sapiens
gcaactaacaagtat

SEQ ID NO: 366496 - DNA, 15 bp, Homo sapiens
caactaacaagtatt

SEQ ID NO: 366497 - DNA, 15 bp, Homo sapiens
aactaacaagtattg

SEQ ID NO: 366498 - DNA, 15 bp, Homo sapiens
actaacaagtattgt

SEQ ID NO: 366499 - DNA, 15 bp, Homo sapiens
ctaacaagtattgtt

SEQ ID NO: 366500 - DNA, 15 bp, Homo sapiens
taacaagtattgttt

SEQ ID NO: 366501 - DNA, 15 bp, Homo sapiens
aacaagtattgttta

SEQ ID NO: 366502 - DNA, 15 bp, Homo sapiens
acaagtattgtttat

SEQ ID NO: 366503 - DNA, 15 bp, Homo sapiens
caagtattgtttata

SEQ ID NO: 366504 - DNA, 15 bp, Homo sapiens
aagtattgtttatag

SEQ ID NO: 366505 - DNA, 15 bp, Homo sapiens
agtattgtttatagt

SEQ ID NO: 366506 - DNA, 15 bp, Homo sapiens
gtattgtttatagtt

SEQ ID NO: 366507 - DNA, 15 bp, Homo sapiens
tattgtttatagttg

SEQ ID NO: 366508 - DNA, 15 bp, Homo sapiens
attgtttatagttgt

SEQ ID NO: 366509 - DNA, 15 bp, Homo sapiens
ttgtttatagttgta

SEQ ID NO: 366510 - DNA, 15 bp, Homo sapiens
tgtttatagttgtat

SEQ ID NO: 366511 - DNA, 15 bp, Homo sapiens
gtttatagttgtata

SEQ ID NO: 366512 - DNA, 15 bp, Homo sapiens
tttatagttgtatat

SEQ ID NO: 366513 - DNA, 15 bp, Homo sapiens
ttatagttgtatatg

SEQ ID NO: 366514 - DNA, 15 bp, Homo sapiens
tatagttgtatatgt

SEQ ID NO: 366515 - DNA, 15 bp, Homo sapiens
atagttgtatatgta

SEQ ID NO: 366516 - DNA, 15 bp, Homo sapiens
tagttgtatatgtat

SEQ ID NO: 366517 - DNA, 15 bp, Homo sapiens
agttgtatatgtata

SEQ ID NO: 366518 - DNA, 15 bp, Homo sapiens
gttgtatatgtatat

SEQ ID NO: 366519 - DNA, 15 bp, Homo sapiens
ttgtatatgtatata

SEQ ID NO: 366520 - DNA, 15 bp, Homo sapiens
tgtatatgtatataa

SEQ ID NO: 366521 - DNA, 15 bp, Homo sapiens
gtatatgtatataat

SEQ ID NO: 366522 - DNA, 15 bp, Homo sapiens
tatatgtatataatc

SEQ ID NO: 366523 - DNA, 15 bp, Homo sapiens
atatgtatataatct

SEQ ID NO: 366524 - DNA, 15 bp, Homo sapiens
tatgtatataatcta

SEQ ID NO: 366525 - DNA, 15 bp, Homo sapiens
atgtatataatctat

SEQ ID NO: 366526 - DNA, 15 bp, Homo sapiens
tgtatataatctata

SEQ ID NO: 366527 - DNA, 15 bp, Homo sapiens
gtatataatctataa

SEQ ID NO: 366528 - DNA, 15 bp, Homo sapiens
tatataatctataaa

SEQ ID NO: 366529 - DNA, 15 bp, Homo sapiens
atataatctataaaa

SEQ ID NO: 366530 - DNA, 15 bp, Homo sapiens
tataatctataaaaa

SEQ ID NO: 366531 - DNA, 15 bp, Homo sapiens
ataatctataaaaat

SEQ ID NO: 366532 - DNA, 15 bp, Homo sapiens
taatctataaaaatt

SEQ ID NO: 366533 - DNA, 15 bp, Homo sapiens
aatctataaaaattc

SEQ ID NO: 366534 - DNA, 15 bp, Homo sapiens
atctataaaaattca

SEQ ID NO: 366535 - DNA, 15 bp, Homo sapiens
tctataaaaattcat

SEQ ID NO: 366536 - DNA, 15 bp, Homo sapiens
ctataaaaattcata

SEQ ID NO: 366537 - DNA, 15 bp, Homo sapiens
tataaaaattcatac

SEQ ID NO: 366538 - DNA, 15 bp, Homo sapiens
ataaaaattcataca

SEQ ID NO: 366539 - DNA, 15 bp, Homo sapiens
taaaaattcatacat

SEQ ID NO: 366540 - DNA, 15 bp, Homo sapiens
aaaaattcatacata

SEQ ID NO: 366541 - DNA, 15 bp, Homo sapiens
aaaattcatacatat

SEQ ID NO: 366542 - DNA, 15 bp, Homo sapiens
aaattcatacatata

SEQ ID NO: 366543 - DNA, 15 bp, Homo sapiens
aattcatacatatat

SEQ ID NO: 366544 - DNA, 15 bp, Homo sapiens
attcatacatatata

SEQ ID NO: 366545 - DNA, 15 bp, Homo sapiens
ttcatacatatatag

SEQ ID NO: 366546 - DNA, 15 bp, Homo sapiens
tcatacatatataga

SEQ ID NO: 366547 - DNA, 15 bp, Homo sapiens
catacatatatagat

SEQ ID NO: 366548 - DNA, 15 bp, Homo sapiens
atacatatatagatg

SEQ ID NO: 366549 - DNA, 15 bp, Homo sapiens
tacatatatagatgt

SEQ ID NO: 366550 - DNA, 15 bp, Homo sapiens
acatatatagatgta

SEQ ID NO: 366551 - DNA, 15 bp, Homo sapiens
catatatagatgtat

SEQ ID NO: 366552 - DNA, 15 bp, Homo sapiens
atatatagatgtata

SEQ ID NO: 366553 - DNA, 15 bp, Homo sapiens
tatatagatgtataa

SEQ ID NO: 366554 - DNA, 15 bp, Homo sapiens
atatagatgtataaa

SEQ ID NO: 366555 - DNA, 15 bp, Homo sapiens
tatagatgtataaat

SEQ ID NO: 366556 - DNA, 15 bp, Homo sapiens
atagatgtataaata

SEQ ID NO: 366557 - DNA, 15 bp, Homo sapiens
tagatgtataaatat

SEQ ID NO: 366558 - DNA, 15 bp, Homo sapiens
agatgtataaatata

SEQ ID NO: 366559 - DNA, 15 bp, Homo sapiens
gatgtataaatatat

SEQ ID NO: 366560 - DNA, 15 bp, Homo sapiens
atgtataaatatatc

SEQ ID NO: 366561 - DNA, 15 bp, Homo sapiens
tgtataaatatatcc

SEQ ID NO: 366562 - DNA, 15 bp, Homo sapiens
gtataaatatatcca

SEQ ID NO: 366563 - DNA, 15 bp, Homo sapiens
tataaatatatccaa

SEQ ID NO: 366564 - DNA, 15 bp, Homo sapiens
ataaatatatccaaa

SEQ ID NO: 366565 - DNA, 15 bp, Homo sapiens
taaatatatccaaat

SEQ ID NO: 366566 - DNA, 15 bp, Homo sapiens
aaatatatccaaata

SEQ ID NO: 366567 - DNA, 15 bp, Homo sapiens
aatatatccaaatat

SEQ ID NO: 366568 - DNA, 15 bp, Homo sapiens
atatatccaaatatc

SEQ ID NO: 366569 - DNA, 15 bp, Homo sapiens
tatatccaaatatcc

SEQ ID NO: 366570 - DNA, 15 bp, Homo sapiens
atatccaaatatcca

SEQ ID NO: 366571 - DNA, 15 bp, Homo sapiens
tatccaaatatccat

SEQ ID NO: 366572 - DNA, 15 bp, Homo sapiens
atccaaatatccata

SEQ ID NO: 366573 - DNA, 15 bp, Homo sapiens
tccaaatatccataa

SEQ ID NO: 366574 - DNA, 15 bp, Homo sapiens
ccaaatatccataaa

SEQ ID NO: 366575 - DNA, 15 bp, Homo sapiens
caaatatccataaat

SEQ ID NO: 366576 - DNA, 15 bp, Homo sapiens
aaatatccataaatt

SEQ ID NO: 366577 - DNA, 15 bp, Homo sapiens
aatatccataaattt

SEQ ID NO: 366578 - DNA, 15 bp, Homo sapiens
atatccataaatttt

SEQ ID NO: 366579 - DNA, 15 bp, Homo sapiens
tatccataaattttg

SEQ ID NO: 366580 - DNA, 15 bp, Homo sapiens
atccataaattttgt

SEQ ID NO: 366581 - DNA, 15 bp, Homo sapiens
tccataaattttgta

SEQ ID NO: 366582 - DNA, 15 bp, Homo sapiens
ccataaattttgtat

SEQ ID NO: 366583 - DNA, 15 bp, Homo sapiens
cataaattttgtatt

SEQ ID NO: 366584 - DNA, 15 bp, Homo sapiens
ataaattttgtattc

SEQ ID NO: 366585 - DNA, 15 bp, Homo sapiens
taaattttgtattca

SEQ ID NO: 366586 - DNA, 15 bp, Homo sapiens
aaattttgtattcat

SEQ ID NO: 366587 - DNA, 15 bp, Homo sapiens
aattttgtattcata

SEQ ID NO: 366588 - DNA, 15 bp, Homo sapiens
attttgtattcataa

SEQ ID NO: 366589 - DNA, 15 bp, Homo sapiens
ttttgtattcataaa

SEQ ID NO: 366590 - DNA, 15 bp, Homo sapiens
tttgtattcataaat

SEQ ID NO: 366591 - DNA, 15 bp, Homo sapiens
ttgtattcataaata

SEQ ID NO: 366592 - DNA, 15 bp, Homo sapiens
tgtattcataaatat

SEQ ID NO: 366593 - DNA, 15 bp, Homo sapiens
gtattcataaatatt

SEQ ID NO: 366594 - DNA, 15 bp, Homo sapiens
tattcataaatattt

SEQ ID NO: 366595 - DNA, 15 bp, Homo sapiens
attcataaatattta

SEQ ID NO: 366596 - DNA, 15 bp, Homo sapiens
ttcataaatatttat

SEQ ID NO: 366597 - DNA, 15 bp, Homo sapiens
tcataaatatttatt

SEQ ID NO: 366598 - DNA, 15 bp, Homo sapiens
cataaatatttattt

SEQ ID NO: 366599 - DNA, 15 bp, Homo sapiens
ataaatatttatttt

SEQ ID NO: 366600 - DNA, 15 bp, Homo sapiens
taaatatttattttt

SEQ ID NO: 366601 - DNA, 15 bp, Homo sapiens
aaatatttatttttt

SEQ ID NO: 366602 - DNA, 15 bp, Homo sapiens
aatatttattttttg

SEQ ID NO: 366603 - DNA, 15 bp, Homo sapiens
atatttattttttgt

SEQ ID NO: 366604 - DNA, 15 bp, Homo sapiens
tatttattttttgtg

SEQ ID NO: 366605 - DNA, 15 bp, Homo sapiens
atttattttttgtgt

SEQ ID NO: 366606 - DNA, 15 bp, Homo sapiens
tttattttttgtgtt

SEQ ID NO: 366607 - DNA, 15 bp, Homo sapiens
ttattttttgtgtta

SEQ ID NO: 366608 - DNA, 15 bp, Homo sapiens
tattttttgtgttaa

SEQ ID NO: 366609 - DNA, 15 bp, Homo sapiens
attttttgtgttaag

SEQ ID NO: 366610 - DNA, 15 bp, Homo sapiens
ttttttgtgttaaga

SEQ ID NO: 366611 - DNA, 15 bp, Homo sapiens
tttttgtgttaagaa

SEQ ID NO: 366612 - DNA, 15 bp, Homo sapiens
ttttgtgttaagaat

SEQ ID NO: 366613 - DNA, 15 bp, Homo sapiens
tttgtgttaagaatt

SEQ ID NO: 366614 - DNA, 15 bp, Homo sapiens
ttgtgttaagaatta

SEQ ID NO: 366615 - DNA, 15 bp, Homo sapiens
tgtgttaagaattaa

SEQ ID NO: 366616 - DNA, 15 bp, Homo sapiens
gtgttaagaattaaa

SEQ ID NO: 366617 - DNA, 15 bp, Homo sapiens
tgttaagaattaaaa

SEQ ID NO: 366618 - DNA, 15 bp, Homo sapiens
gttaagaattaaaat

SEQ ID NO: 366619 - DNA, 15 bp, Homo sapiens
ttaagaattaaaata

SEQ ID NO: 366620 - DNA, 15 bp, Homo sapiens
taagaattaaaatac

SEQ ID NO: 366621 - DNA, 15 bp, Homo sapiens
aagaattaaaatact

SEQ ID NO: 366622 - DNA, 15 bp, Homo sapiens
agaattaaaatactt

SEQ ID NO: 366623 - DNA, 15 bp, Homo sapiens
gaattaaaatacttg

SEQ ID NO: 366624 - DNA, 15 bp, Homo sapiens
aattaaaatacttgt

SEQ ID NO: 366625 - DNA, 15 bp, Homo sapiens
attaaaatacttgtt

SEQ ID NO: 366626 - DNA, 15 bp, Homo sapiens
ttaaaatacttgttg

SEQ ID NO: 366627 - DNA, 15 bp, Homo sapiens
taaaatacttgttgc

SEQ ID NO: 366628 - DNA, 15 bp, Homo sapiens
aaaatacttgttgca

SEQ ID NO: 366629 - DNA, 15 bp, Homo sapiens
aaatacttgttgcag

SEQ ID NO: 366630 - DNA, 15 bp, Homo sapiens
aatacttgttgcaga

SEQ ID NO: 366631 - DNA, 15 bp, Homo sapiens
atacttgttgcagaa

SEQ ID NO: 366632 - DNA, 15 bp, Homo sapiens
tacttgttgcagaac

SEQ ID NO: 366633 - DNA, 15 bp, Homo sapiens
acttgttgcagaaca

SEQ ID NO: 366634 - DNA, 15 bp, Homo sapiens
cttgttgcagaacac

SEQ ID NO: 366635 - DNA, 15 bp, Homo sapiens
ttgttgcagaacact

SEQ ID NO: 366636 - DNA, 15 bp, Homo sapiens
tgttgcagaacactc

SEQ ID NO: 366637 - DNA, 15 bp, Homo sapiens
gttgcagaacactca

SEQ ID NO: 366638 - DNA, 15 bp, Homo sapiens
ttgcagaacactcag

SEQ ID NO: 366639 - DNA, 15 bp, Homo sapiens
tgcagaacactcagc

SEQ ID NO: 366640 - DNA, 15 bp, Homo sapiens
gcagaacactcagca

SEQ ID NO: 366641 - DNA, 15 bp, Homo sapiens
cagaacactcagcat

SEQ ID NO: 366642 - DNA, 15 bp, Homo sapiens
agaacactcagcata

SEQ ID NO: 366643 - DNA, 15 bp, Homo sapiens
gaacactcagcataa

SEQ ID NO: 366644 - DNA, 15 bp, Homo sapiens
aacactcagcataat

SEQ ID NO: 366645 - DNA, 15 bp, Homo sapiens
acactcagcataatg

SEQ ID NO: 366646 - DNA, 15 bp, Homo sapiens
cactcagcataatgt

SEQ ID NO: 366647 - DNA, 15 bp, Homo sapiens
actcagcataatgtg

SEQ ID NO: 366648 - DNA, 15 bp, Homo sapiens
ctcagcataatgtgc

SEQ ID NO: 366649 - DNA, 15 bp, Homo sapiens
tcagcataatgtgct

SEQ ID NO: 366650 - DNA, 15 bp, Homo sapiens
cagcataatgtgctc

SEQ ID NO: 366651 - DNA, 15 bp, Homo sapiens
agcataatgtgctca

SEQ ID NO: 366652 - DNA, 15 bp, Homo sapiens
gcataatgtgctcac

SEQ ID NO: 366653 - DNA, 15 bp, Homo sapiens
cataatgtgctcaca

SEQ ID NO: 366654 - DNA, 15 bp, Homo sapiens
ataatgtgctcacat

SEQ ID NO: 366655 - DNA, 15 bp, Homo sapiens
taatgtgctcacatt

SEQ ID NO: 366656 - DNA, 15 bp, Homo sapiens
aatgtgctcacattt

SEQ ID NO: 366657 - DNA, 15 bp, Homo sapiens
atgtgctcacatttt

SEQ ID NO: 366658 - DNA, 15 bp, Homo sapiens
tgtgctcacattttt

SEQ ID NO: 366659 - DNA, 15 bp, Homo sapiens
gtgctcacatttttt

SEQ ID NO: 366660 - DNA, 15 bp, Homo sapiens
tgctcacattttttt

SEQ ID NO: 366661 - DNA, 15 bp, Homo sapiens
gctcacatttttttt

SEQ ID NO: 366662 - DNA, 15 bp, Homo sapiens
ctcacattttttttt

SEQ ID NO: 366663 - DNA, 15 bp, Homo sapiens
tcacattttttttta

SEQ ID NO: 366664 - DNA, 15 bp, Homo sapiens
cacatttttttttaa

SEQ ID NO: 366665 - DNA, 15 bp, Homo sapiens
catttttttttaaaa

SEQ ID NO: 366666 - DNA, 15 bp, Homo sapiens
atttttttttaaaaa

SEQ ID NO: 366667 - DNA, 15 bp, Homo sapiens
tttttttttaaaaaa

SEQ ID NO: 366668 - DNA, 15 bp, Homo sapiens
ttttttttaaaaaaa

SEQ ID NO: 366669 - DNA, 15 bp, Homo sapiens
tttttttaaaaaaag

SEQ ID NO: 366670 - DNA, 15 bp, Homo sapiens
ttttttaaaaaaaga

SEQ ID NO: 366671 - DNA, 15 bp, Homo sapiens
ttttaaaaaaagaaa

SEQ ID NO: 366672 - DNA, 15 bp, Homo sapiens
tttaaaaaaagaaat

SEQ ID NO: 366673 - DNA, 15 bp, Homo sapiens
ttaaaaaaagaaatt

SEQ ID NO: 366674 - DNA, 15 bp, Homo sapiens
taaaaaaagaaattg

SEQ ID NO: 366675 - DNA, 15 bp, Homo sapiens
aaaaaaagaaattgt

SEQ ID NO: 366676 - DNA, 15 bp, Homo sapiens
aaaaaagaaattgtg

SEQ ID NO: 366677 - DNA, 15 bp, Homo sapiens
aaaaagaaattgtgg

SEQ ID NO: 366678 - DNA, 15 bp, Homo sapiens
aaaagaaattgtggg

SEQ ID NO: 366679 - DNA, 15 bp, Homo sapiens
aaagaaattgtgggc

SEQ ID NO: 366680 - DNA, 15 bp, Homo sapiens
aagaaattgtgggct

SEQ ID NO: 366681 - DNA, 15 bp, Homo sapiens
agaaattgtgggctg

SEQ ID NO: 366682 - DNA, 15 bp, Homo sapiens
gaaattgtgggctgg

SEQ ID NO: 366683 - DNA, 15 bp, Homo sapiens
aaattgtgggctggg

SEQ ID NO: 366684 - DNA, 15 bp, Homo sapiens
aattgtgggctgggt

SEQ ID NO: 366685 - DNA, 15 bp, Homo sapiens
attgtgggctgggtg

SEQ ID NO: 366686 - DNA, 15 bp, Homo sapiens
ttgtgggctgggtgt

SEQ ID NO: 366687 - DNA, 15 bp, Homo sapiens
tgtgggctgggtgtg

SEQ ID NO: 366688 - DNA, 15 bp, Homo sapiens
gtgggctgggtgtgg

SEQ ID NO: 366689 - DNA, 15 bp, Homo sapiens
tgggctgggtgtggt

SEQ ID NO: 366690 - DNA, 15 bp, Homo sapiens
gggctgggtgtggtg

SEQ ID NO: 366691 - DNA, 15 bp, Homo sapiens
ggctgggtgtggtgg

SEQ ID NO: 366692 - DNA, 15 bp, Homo sapiens
gaggccgaggcgggt

SEQ ID NO: 366693 - DNA, 15 bp, Homo sapiens
aggccgaggcgggtg

SEQ ID NO: 366694 - DNA, 15 bp, Homo sapiens
ggccgaggcgggtgg

SEQ ID NO: 366695 - DNA, 15 bp, Homo sapiens
gccgaggcgggtgga

SEQ ID NO: 366696 - DNA, 15 bp, Homo sapiens
ccgaggcgggtggat

SEQ ID NO: 366697 - DNA, 15 bp, Homo sapiens
cgaggcgggtggatc

SEQ ID NO: 366698 - DNA, 15 bp, Homo sapiens
ggcgggtggatcaca

SEQ ID NO: 366699 - DNA, 15 bp, Homo sapiens
gcgggtggatcacaa

SEQ ID NO: 366700 - DNA, 15 bp, Homo sapiens
cgggtggatcacaag

SEQ ID NO: 366701 - DNA, 15 bp, Homo sapiens
gggtggatcacaagg

SEQ ID NO: 366702 - DNA, 15 bp, Homo sapiens
ggatcacaaggtcat

SEQ ID NO: 366703 - DNA, 15 bp, Homo sapiens
gatcacaaggtcatg

SEQ ID NO: 366704 - DNA, 15 bp, Homo sapiens
atcacaaggtcatga

SEQ ID NO: 366705 - DNA, 15 bp, Homo sapiens
tcacaaggtcatgag

SEQ ID NO: 366706 - DNA, 15 bp, Homo sapiens
cacaaggtcatgaga

SEQ ID NO: 366707 - DNA, 15 bp, Homo sapiens
acaaggtcatgagat

SEQ ID NO: 366708 - DNA, 15 bp, Homo sapiens
caaggtcatgagatc

SEQ ID NO: 366709 - DNA, 15 bp, Homo sapiens
aaggtcatgagatcg

SEQ ID NO: 366710 - DNA, 15 bp, Homo sapiens
aggtcatgagatcga

SEQ ID NO: 366711 - DNA, 15 bp, Homo sapiens
ggtcatgagatcgag

SEQ ID NO: 366712 - DNA, 15 bp, Homo sapiens
gtcatgagatcgaga

SEQ ID NO: 366713 - DNA, 15 bp, Homo sapiens
tcatgagatcgagac

SEQ ID NO: 366714 - DNA, 15 bp, Homo sapiens
catgagatcgagacc

SEQ ID NO: 366715 - DNA, 15 bp, Homo sapiens
atgagatcgagacca

SEQ ID NO: 366716 - DNA, 15 bp, Homo sapiens
tgagatcgagaccat

SEQ ID NO: 366717 - DNA, 15 bp, Homo sapiens
agatcgagaccatct

SEQ ID NO: 366718 - DNA, 15 bp, Homo sapiens
gatcgagaccatctg

SEQ ID NO: 366719 - DNA, 15 bp, Homo sapiens
atcgagaccatctgg

SEQ ID NO: 366720 - DNA, 15 bp, Homo sapiens
tcgagaccatctggc

SEQ ID NO: 366721 - DNA, 15 bp, Homo sapiens
cgagaccatctggct

SEQ ID NO: 366722 - DNA, 15 bp, Homo sapiens
gagaccatctggcta

SEQ ID NO: 366723 - DNA, 15 bp, Homo sapiens
agaccatctggctaa

SEQ ID NO: 366724 - DNA, 15 bp, Homo sapiens
gaccatctggctaac

SEQ ID NO: 366725 - DNA, 15 bp, Homo sapiens
accatctggctaaca

SEQ ID NO: 366726 - DNA, 15 bp, Homo sapiens
ccatctggctaacat

SEQ ID NO: 366727 - DNA, 15 bp, Homo sapiens
catctggctaacatg

SEQ ID NO: 366728 - DNA, 15 bp, Homo sapiens
atctggctaacatgg

SEQ ID NO: 366729 - DNA, 15 bp, Homo sapiens
tctggctaacatggt

SEQ ID NO: 366730 - DNA, 15 bp, Homo sapiens
aaccccatctctata

SEQ ID NO: 366731 - DNA, 15 bp, Homo sapiens
accccatctctataa

SEQ ID NO: 366732 - DNA, 15 bp, Homo sapiens
ccccatctctataaa

SEQ ID NO: 366733 - DNA, 15 bp, Homo sapiens
cccatctctataaaa

SEQ ID NO: 366734 - DNA, 15 bp, Homo sapiens
ccatctctataaaaa

SEQ ID NO: 366735 - DNA, 15 bp, Homo sapiens
catctctataaaaat

SEQ ID NO: 366736 - DNA, 15 bp, Homo sapiens
atctctataaaaata

SEQ ID NO: 366737 - DNA, 15 bp, Homo sapiens
tctctataaaaatac

SEQ ID NO: 366738 - DNA, 15 bp, Homo sapiens
ctctataaaaataca

SEQ ID NO: 366739 - DNA, 15 bp, Homo sapiens
tctataaaaatacaa

SEQ ID NO: 366740 - DNA, 15 bp, Homo sapiens
ctataaaaatacaaa

SEQ ID NO: 366741 - DNA, 15 bp, Homo sapiens
tataaaaatacaaaa

SEQ ID NO: 366742 - DNA, 15 bp, Homo sapiens
aatacaaaaaaaaat

SEQ ID NO: 366743 - DNA, 15 bp, Homo sapiens
tacaaaaaaaaatta

SEQ ID NO: 366744 - DNA, 15 bp, Homo sapiens
acaaaaaaaaattag

SEQ ID NO: 366745 - DNA, 15 bp, Homo sapiens
aaaaaattagctggc

SEQ ID NO: 366746 - DNA, 15 bp, Homo sapiens
aaaaattagctggcc

SEQ ID NO: 366747 - DNA, 15 bp, Homo sapiens
aaaattagctggccg

SEQ ID NO: 366748 - DNA, 15 bp, Homo sapiens
aaattagctggccgt

SEQ ID NO: 366749 - DNA, 15 bp, Homo sapiens
aattagctggccgtg

SEQ ID NO: 366750 - DNA, 15 bp, Homo sapiens
attagctggccgtgg

SEQ ID NO: 366751 - DNA, 15 bp, Homo sapiens
ttagctggccgtggt

SEQ ID NO: 366752 - DNA, 15 bp, Homo sapiens
tagctggccgtggtg

SEQ ID NO: 366753 - DNA, 15 bp, Homo sapiens
agctggccgtggtgg

SEQ ID NO: 366754 - DNA, 15 bp, Homo sapiens
gctggccgtggtggc

SEQ ID NO: 366755 - DNA, 15 bp, Homo sapiens
ctggccgtggtggca

SEQ ID NO: 366756 - DNA, 15 bp, Homo sapiens
tggccgtggtggcag

SEQ ID NO: 366757 - DNA, 15 bp, Homo sapiens
ggccgtggtggcagg

SEQ ID NO: 366758 - DNA, 15 bp, Homo sapiens
gccgtggtggcaggc

SEQ ID NO: 366759 - DNA, 15 bp, Homo sapiens
ccgtggtggcaggcg

SEQ ID NO: 366760 - DNA, 15 bp, Homo sapiens
cgtggtggcaggcgc

SEQ ID NO: 366761 - DNA, 15 bp, Homo sapiens
gtggtggcaggcgca

SEQ ID NO: 366762 - DNA, 15 bp, Homo sapiens
tggtggcaggcgcat

SEQ ID NO: 366763 - DNA, 15 bp, Homo sapiens
ggtggcaggcgcatg

SEQ ID NO: 366764 - DNA, 15 bp, Homo sapiens
gtggcaggcgcatgt

SEQ ID NO: 366765 - DNA, 15 bp, Homo sapiens
tggcaggcgcatgta

SEQ ID NO: 366766 - DNA, 15 bp, Homo sapiens
ggcaggcgcatgtag

SEQ ID NO: 366767 - DNA, 15 bp, Homo sapiens
gcaggcgcatgtagt

SEQ ID NO: 366768 - DNA, 15 bp, Homo sapiens
caggcgcatgtagtc

SEQ ID NO: 366769 - DNA, 15 bp, Homo sapiens
aggcgcatgtagtct

SEQ ID NO: 366770 - DNA, 15 bp, Homo sapiens
ggcgcatgtagtctc

SEQ ID NO: 366771 - DNA, 15 bp, Homo sapiens
gcgcatgtagtctca

SEQ ID NO: 366772 - DNA, 15 bp, Homo sapiens
cgcatgtagtctcag

SEQ ID NO: 366773 - DNA, 15 bp, Homo sapiens
gcatgtagtctcagc

SEQ ID NO: 366774 - DNA, 15 bp, Homo sapiens
catgtagtctcagct

SEQ ID NO: 366775 - DNA, 15 bp, Homo sapiens
atgtagtctcagcta

SEQ ID NO: 366776 - DNA, 15 bp, Homo sapiens
tgtagtctcagctac

SEQ ID NO: 366777 - DNA, 15 bp, Homo sapiens
gtagtctcagctact

SEQ ID NO: 366778 - DNA, 15 bp, Homo sapiens
tagtctcagctactc

SEQ ID NO: 366779 - DNA, 15 bp, Homo sapiens
agtctcagctactcg

SEQ ID NO: 366780 - DNA, 15 bp, Homo sapiens
gtctcagctactcgg

SEQ ID NO: 366781 - DNA, 15 bp, Homo sapiens
tctcagctactcggg

SEQ ID NO: 366782 - DNA, 15 bp, Homo sapiens
ctcagctactcggga

SEQ ID NO: 366783 - DNA, 15 bp, Homo sapiens
tcagctactcgggag

SEQ ID NO: 366784 - DNA, 15 bp, Homo sapiens
actcgggaggctgaa

SEQ ID NO: 366785 - DNA, 15 bp, Homo sapiens
ctcgggaggctgaag

SEQ ID NO: 366786 - DNA, 15 bp, Homo sapiens
tcgggaggctgaagc

SEQ ID NO: 366787 - DNA, 15 bp, Homo sapiens
cgggaggctgaagca

SEQ ID NO: 366788 - DNA, 15 bp, Homo sapiens
gaggctgaagcagga

SEQ ID NO: 366789 - DNA, 15 bp, Homo sapiens
aggctgaagcaggag

SEQ ID NO: 366790 - DNA, 15 bp, Homo sapiens
ggctgaagcaggaga

SEQ ID NO: 366791 - DNA, 15 bp, Homo sapiens
gctgaagcaggagaa

SEQ ID NO: 366792 - DNA, 15 bp, Homo sapiens
ctgaagcaggagaat

SEQ ID NO: 366793 - DNA, 15 bp, Homo sapiens
tgaagcaggagaatg

SEQ ID NO: 366794 - DNA, 15 bp, Homo sapiens
gaagcaggagaatgg

SEQ ID NO: 366795 - DNA, 15 bp, Homo sapiens
aagcaggagaatggc

SEQ ID NO: 366796 - DNA, 15 bp, Homo sapiens
agcaggagaatggca

SEQ ID NO: 366797 - DNA, 15 bp, Homo sapiens
gcaggagaatggcat

SEQ ID NO: 366798 - DNA, 15 bp, Homo sapiens
caggagaatggcatg

SEQ ID NO: 366799 - DNA, 15 bp, Homo sapiens
aggagaatggcatga

SEQ ID NO: 366800 - DNA, 15 bp, Homo sapiens
ggagaatggcatgaa

SEQ ID NO: 366801 - DNA, 15 bp, Homo sapiens
gagaatggcatgaac

SEQ ID NO: 366802 - DNA, 15 bp, Homo sapiens
agaatggcatgaacc

SEQ ID NO: 366803 - DNA, 15 bp, Homo sapiens
gaatggcatgaaccc

SEQ ID NO: 366804 - DNA, 15 bp, Homo sapiens
aatggcatgaaccca

SEQ ID NO: 366805 - DNA, 15 bp, Homo sapiens
atggcatgaacccag

SEQ ID NO: 366806 - DNA, 15 bp, Homo sapiens
tggcatgaacccagg

SEQ ID NO: 366807 - DNA, 15 bp, Homo sapiens
ggcatgaacccagga

SEQ ID NO: 366808 - DNA, 15 bp, Homo sapiens
gcatgaacccaggag

SEQ ID NO: 366809 - DNA, 15 bp, Homo sapiens
catgaacccaggagg

SEQ ID NO: 366810 - DNA, 15 bp, Homo sapiens
atgaacccaggaggc

SEQ ID NO: 366811 - DNA, 15 bp, Homo sapiens
ccgagatcgtgccac

SEQ ID NO: 366812 - DNA, 15 bp, Homo sapiens
cgagatcgtgccact

SEQ ID NO: 366813 - DNA, 15 bp, Homo sapiens
cactccagcctggct

SEQ ID NO: 366814 - DNA, 15 bp, Homo sapiens
actccagcctggctg

SEQ ID NO: 366815 - DNA, 15 bp, Homo sapiens
ctccagcctggctga

SEQ ID NO: 366816 - DNA, 15 bp, Homo sapiens
tccagcctggctgac

SEQ ID NO: 366817 - DNA, 15 bp, Homo sapiens
cagcctggctgacag

SEQ ID NO: 366818 - DNA, 15 bp, Homo sapiens
agcctggctgacaga

SEQ ID NO: 366819 - DNA, 15 bp, Homo sapiens
gcctggctgacagag

SEQ ID NO: 366820 - DNA, 15 bp, Homo sapiens
cctggctgacagagc

SEQ ID NO: 366821 - DNA, 15 bp, Homo sapiens
ctggctgacagagcg

SEQ ID NO: 366822 - DNA, 15 bp, Homo sapiens
tggctgacagagcga

SEQ ID NO: 366823 - DNA, 15 bp, Homo sapiens
ggctgacagagcgag

SEQ ID NO: 366824 - DNA, 15 bp, Homo sapiens
gctgacagagcgaga

SEQ ID NO: 366825 - DNA, 15 bp, Homo sapiens
ctgacagagcgagac

SEQ ID NO: 366826 - DNA, 15 bp, Homo sapiens
tgacagagcgagact

SEQ ID NO: 366827 - DNA, 15 bp, Homo sapiens
acagagcgagactcc

SEQ ID NO: 366828 - DNA, 15 bp, Homo sapiens
cagagcgagactccg

SEQ ID NO: 366829 - DNA, 15 bp, Homo sapiens
agagcgagactccgt

SEQ ID NO: 366830 - DNA, 15 bp, Homo sapiens
gagcgagactccgtc

SEQ ID NO: 366831 - DNA, 15 bp, Homo sapiens
agcgagactccgtct

SEQ ID NO: 366832 - DNA, 15 bp, Homo sapiens
gcgagactccgtctc

SEQ ID NO: 366833 - DNA, 15 bp, Homo sapiens
cgagactccgtctca

SEQ ID NO: 366834 - DNA, 15 bp, Homo sapiens
aaaaaaaaaagaaat

SEQ ID NO: 366835 - DNA, 15 bp, Homo sapiens
aaaaaaaaagaaatt

SEQ ID NO: 366836 - DNA, 15 bp, Homo sapiens
aaaaaaaagaaatta

SEQ ID NO: 366837 - DNA, 15 bp, Homo sapiens
aaaaaaagaaattat

SEQ ID NO: 366838 - DNA, 15 bp, Homo sapiens
aaaaaagaaattatg

SEQ ID NO: 366839 - DNA, 15 bp, Homo sapiens
aaaaagaaattatga

SEQ ID NO: 366840 - DNA, 15 bp, Homo sapiens
aaaagaaattatgag

SEQ ID NO: 366841 - DNA, 15 bp, Homo sapiens
aaagaaattatgagt

SEQ ID NO: 366842 - DNA, 15 bp, Homo sapiens
aagaaattatgagtg

SEQ ID NO: 366843 - DNA, 15 bp, Homo sapiens
agaaattatgagtgt

SEQ ID NO: 366844 - DNA, 15 bp, Homo sapiens
gaaattatgagtgtg

SEQ ID NO: 366845 - DNA, 15 bp, Homo sapiens
aaattatgagtgtgt

SEQ ID NO: 366846 - DNA, 15 bp, Homo sapiens
aattatgagtgtgta

SEQ ID NO: 366847 - DNA, 15 bp, Homo sapiens
attatgagtgtgtat

SEQ ID NO: 366848 - DNA, 15 bp, Homo sapiens
ttatgagtgtgtatt

SEQ ID NO: 366849 - DNA, 15 bp, Homo sapiens
tatgagtgtgtattc

SEQ ID NO: 366850 - DNA, 15 bp, Homo sapiens
atgagtgtgtattca

SEQ ID NO: 366851 - DNA, 15 bp, Homo sapiens
tgagtgtgtattcat

SEQ ID NO: 366852 - DNA, 15 bp, Homo sapiens
gagtgtgtattcata

SEQ ID NO: 366853 - DNA, 15 bp, Homo sapiens
agtgtgtattcatac

SEQ ID NO: 366854 - DNA, 15 bp, Homo sapiens
gtgtgtattcataca

SEQ ID NO: 366855 - DNA, 15 bp, Homo sapiens
tgtgtattcatacat

SEQ ID NO: 366856 - DNA, 15 bp, Homo sapiens
gtgtattcatacatg

SEQ ID NO: 366857 - DNA, 15 bp, Homo sapiens
tgtattcatacatgt

SEQ ID NO: 366858 - DNA, 15 bp, Homo sapiens
gtattcatacatgta

SEQ ID NO: 366859 - DNA, 15 bp, Homo sapiens
tattcatacatgtac

SEQ ID NO: 366860 - DNA, 15 bp, Homo sapiens
attcatacatgtaca

SEQ ID NO: 366861 - DNA, 15 bp, Homo sapiens
ttcatacatgtacaa

SEQ ID NO: 366862 - DNA, 15 bp, Homo sapiens
tcatacatgtacaag

SEQ ID NO: 366863 - DNA, 15 bp, Homo sapiens
catacatgtacaagc

SEQ ID NO: 366864 - DNA, 15 bp, Homo sapiens
atacatgtacaagca

SEQ ID NO: 366865 - DNA, 15 bp, Homo sapiens
tacatgtacaagcat

SEQ ID NO: 366866 - DNA, 15 bp, Homo sapiens
acatgtacaagcata

SEQ ID NO: 366867 - DNA, 15 bp, Homo sapiens
catgtacaagcataa

SEQ ID NO: 366868 - DNA, 15 bp, Homo sapiens
atgtacaagcataag

SEQ ID NO: 366869 - DNA, 15 bp, Homo sapiens
tgtacaagcataagt

SEQ ID NO: 366870 - DNA, 15 bp, Homo sapiens
gtacaagcataagtg

SEQ ID NO: 366871 - DNA, 15 bp, Homo sapiens
tacaagcataagtgt

SEQ ID NO: 366872 - DNA, 15 bp, Homo sapiens
acaagcataagtgtg

SEQ ID NO: 366873 - DNA, 15 bp, Homo sapiens
caagcataagtgtgt

SEQ ID NO: 366874 - DNA, 15 bp, Homo sapiens
aagcataagtgtgtg

SEQ ID NO: 366875 - DNA, 15 bp, Homo sapiens
agcataagtgtgtgt

SEQ ID NO: 366876 - DNA, 15 bp, Homo sapiens
gcataagtgtgtgtg

SEQ ID NO: 366877 - DNA, 15 bp, Homo sapiens
cataagtgtgtgtga

SEQ ID NO: 366878 - DNA, 15 bp, Homo sapiens
ataagtgtgtgtgaa

SEQ ID NO: 366879 - DNA, 15 bp, Homo sapiens
taagtgtgtgtgaaa

SEQ ID NO: 366880 - DNA, 15 bp, Homo sapiens
aagtgtgtgtgaaag

SEQ ID NO: 366881 - DNA, 15 bp, Homo sapiens
agtgtgtgtgaaagg

SEQ ID NO: 366882 - DNA, 15 bp, Homo sapiens
gtgtgtgtgaaaggt

SEQ ID NO: 366883 - DNA, 15 bp, Homo sapiens
tgtgtgtgaaaggtt

SEQ ID NO: 366884 - DNA, 15 bp, Homo sapiens
gtgtgtgaaaggtta

SEQ ID NO: 366885 - DNA, 15 bp, Homo sapiens
tgtgtgaaaggttac

SEQ ID NO: 366886 - DNA, 15 bp, Homo sapiens
gtgtgaaaggttact

SEQ ID NO: 366887 - DNA, 15 bp, Homo sapiens
tgtgaaaggttactt

SEQ ID NO: 366888 - DNA, 15 bp, Homo sapiens
gtgaaaggttactta

SEQ ID NO: 366889 - DNA, 15 bp, Homo sapiens
tgaaaggttacttac

SEQ ID NO: 366890 - DNA, 15 bp, Homo sapiens
gaaaggttacttact

SEQ ID NO: 366891 - DNA, 15 bp, Homo sapiens
aaaggttacttacta

SEQ ID NO: 366892 - DNA, 15 bp, Homo sapiens
aaggttacttactaa

SEQ ID NO: 366893 - DNA, 15 bp, Homo sapiens
aggttacttactaat

SEQ ID NO: 366894 - DNA, 15 bp, Homo sapiens
ggttacttactaatt

SEQ ID NO: 366895 - DNA, 15 bp, Homo sapiens
gttacttactaattc

SEQ ID NO: 366896 - DNA, 15 bp, Homo sapiens
ttacttactaattca

SEQ ID NO: 366897 - DNA, 15 bp, Homo sapiens
tacttactaattcag

SEQ ID NO: 366898 - DNA, 15 bp, Homo sapiens
acttactaattcaga

SEQ ID NO: 366899 - DNA, 15 bp, Homo sapiens
cttactaattcagag

SEQ ID NO: 366900 - DNA, 15 bp, Homo sapiens
ttactaattcagaga

SEQ ID NO: 366901 - DNA, 15 bp, Homo sapiens
tactaattcagagat

SEQ ID NO: 366902 - DNA, 15 bp, Homo sapiens
actaattcagagatt

SEQ ID NO: 366903 - DNA, 15 bp, Homo sapiens
ctaattcagagattt

SEQ ID NO: 366904 - DNA, 15 bp, Homo sapiens
taattcagagatttt

SEQ ID NO: 366905 - DNA, 15 bp, Homo sapiens
tcagagattttgtct

SEQ ID NO: 366906 - DNA, 15 bp, Homo sapiens
cagagattttgtcta

SEQ ID NO: 366907 - DNA, 15 bp, Homo sapiens
agagattttgtctat

SEQ ID NO: 366908 - DNA, 15 bp, Homo sapiens
gagattttgtctata

SEQ ID NO: 366909 - DNA, 15 bp, Homo sapiens
agattttgtctataa

SEQ ID NO: 366910 - DNA, 15 bp, Homo sapiens
gattttgtctataaa

SEQ ID NO: 366911 - DNA, 15 bp, Homo sapiens
attttgtctataaag

SEQ ID NO: 366912 - DNA, 15 bp, Homo sapiens
ttttgtctataaagg

SEQ ID NO: 366913 - DNA, 15 bp, Homo sapiens
tttgtctataaagga

SEQ ID NO: 366914 - DNA, 15 bp, Homo sapiens
ttgtctataaaggag

SEQ ID NO: 366915 - DNA, 15 bp, Homo sapiens
tgtctataaaggagt

SEQ ID NO: 366916 - DNA, 15 bp, Homo sapiens
gtctataaaggagta

SEQ ID NO: 366917 - DNA, 15 bp, Homo sapiens
tctataaaggagtat

SEQ ID NO: 366918 - DNA, 15 bp, Homo sapiens
ctataaaggagtatg

SEQ ID NO: 366919 - DNA, 15 bp, Homo sapiens
tataaaggagtatga

SEQ ID NO: 366920 - DNA, 15 bp, Homo sapiens
ataaaggagtatgat

SEQ ID NO: 366921 - DNA, 15 bp, Homo sapiens
taaaggagtatgatt

SEQ ID NO: 366922 - DNA, 15 bp, Homo sapiens
aaaggagtatgattg

SEQ ID NO: 366923 - DNA, 15 bp, Homo sapiens
aaggagtatgattga

SEQ ID NO: 366924 - DNA, 15 bp, Homo sapiens
aggagtatgattgaa

SEQ ID NO: 366925 - DNA, 15 bp, Homo sapiens
ggagtatgattgaag

SEQ ID NO: 366926 - DNA, 15 bp, Homo sapiens
gagtatgattgaagc

SEQ ID NO: 366927 - DNA, 15 bp, Homo sapiens
agtatgattgaagca

SEQ ID NO: 366928 - DNA, 15 bp, Homo sapiens
gtatgattgaagcat

SEQ ID NO: 366929 - DNA, 15 bp, Homo sapiens
tatgattgaagcatt

SEQ ID NO: 366930 - DNA, 15 bp, Homo sapiens
atgattgaagcattt

SEQ ID NO: 366931 - DNA, 15 bp, Homo sapiens
tgattgaagcatttt

SEQ ID NO: 366932 - DNA, 15 bp, Homo sapiens
gattgaagcattttg

SEQ ID NO: 366933 - DNA, 15 bp, Homo sapiens
attgaagcattttga

SEQ ID NO: 366934 - DNA, 15 bp, Homo sapiens
ttgaagcattttgag

SEQ ID NO: 366935 - DNA, 15 bp, Homo sapiens
tgaagcattttgaga

SEQ ID NO: 366936 - DNA, 15 bp, Homo sapiens
gaagcattttgagaa

SEQ ID NO: 366937 - DNA, 15 bp, Homo sapiens
aagcattttgagaaa

SEQ ID NO: 366938 - DNA, 15 bp, Homo sapiens
agcattttgagaaag

SEQ ID NO: 366939 - DNA, 15 bp, Homo sapiens
gcattttgagaaaga

SEQ ID NO: 366940 - DNA, 15 bp, Homo sapiens
cattttgagaaagaa

SEQ ID NO: 366941 - DNA, 15 bp, Homo sapiens
attttgagaaagaaa

SEQ ID NO: 366942 - DNA, 15 bp, Homo sapiens
ttttgagaaagaaac

SEQ ID NO: 366943 - DNA, 15 bp, Homo sapiens
tttgagaaagaaaca

SEQ ID NO: 366944 - DNA, 15 bp, Homo sapiens
ttgagaaagaaacat

SEQ ID NO: 366945 - DNA, 15 bp, Homo sapiens
tgagaaagaaacatt

SEQ ID NO: 366946 - DNA, 15 bp, Homo sapiens
gagaaagaaacattg

SEQ ID NO: 366947 - DNA, 15 bp, Homo sapiens
agaaagaaacattga

SEQ ID NO: 366948 - DNA, 15 bp, Homo sapiens
gaaagaaacattgaa

SEQ ID NO: 366949 - DNA, 15 bp, Homo sapiens
aaagaaacattgaat

SEQ ID NO: 366950 - DNA, 15 bp, Homo sapiens
aagaaacattgaata

SEQ ID NO: 366951 - DNA, 15 bp, Homo sapiens
agaaacattgaataa

SEQ ID NO: 366952 - DNA, 15 bp, Homo sapiens
gaaacattgaataat

SEQ ID NO: 366953 - DNA, 15 bp, Homo sapiens
aaacattgaataatg

SEQ ID NO: 366954 - DNA, 15 bp, Homo sapiens
aacattgaataatga

SEQ ID NO: 366955 - DNA, 15 bp, Homo sapiens
acattgaataatgat

SEQ ID NO: 366956 - DNA, 15 bp, Homo sapiens
cattgaataatgatg

SEQ ID NO: 366957 - DNA, 15 bp, Homo sapiens
attgaataatgatga

SEQ ID NO: 366958 - DNA, 15 bp, Homo sapiens
ttgaataatgatgaa

SEQ ID NO: 366959 - DNA, 15 bp, Homo sapiens
tgaataatgatgaaa

SEQ ID NO: 366960 - DNA, 15 bp, Homo sapiens
gaataatgatgaaaa

SEQ ID NO: 366961 - DNA, 15 bp, Homo sapiens
aataatgatgaaaaa

SEQ ID NO: 366962 - DNA, 15 bp, Homo sapiens
ataatgatgaaaaat

SEQ ID NO: 366963 - DNA, 15 bp, Homo sapiens
taatgatgaaaaata

SEQ ID NO: 366964 - DNA, 15 bp, Homo sapiens
aatgatgaaaaatat

SEQ ID NO: 366965 - DNA, 15 bp, Homo sapiens
atgatgaaaaatatt

SEQ ID NO: 366966 - DNA, 15 bp, Homo sapiens
tgatgaaaaatattt

SEQ ID NO: 366967 - DNA, 15 bp, Homo sapiens
gatgaaaaatatttt

SEQ ID NO: 366968 - DNA, 15 bp, Homo sapiens
atgaaaaatattttg

SEQ ID NO: 366969 - DNA, 15 bp, Homo sapiens
tgaaaaatattttgt

SEQ ID NO: 366970 - DNA, 15 bp, Homo sapiens
gaaaaatattttgtg

SEQ ID NO: 366971 - DNA, 15 bp, Homo sapiens
aaaaatattttgtgg

SEQ ID NO: 366972 - DNA, 15 bp, Homo sapiens
aaaatattttgtgga

SEQ ID NO: 366973 - DNA, 15 bp, Homo sapiens
aaatattttgtggaa

SEQ ID NO: 366974 - DNA, 15 bp, Homo sapiens
aatattttgtggaac

SEQ ID NO: 366975 - DNA, 15 bp, Homo sapiens
atattttgtggaaca

SEQ ID NO: 366976 - DNA, 15 bp, Homo sapiens
tattttgtggaacat

SEQ ID NO: 366977 - DNA, 15 bp, Homo sapiens
attttgtggaacata

SEQ ID NO: 366978 - DNA, 15 bp, Homo sapiens
ttttgtggaacatat

SEQ ID NO: 366979 - DNA, 15 bp, Homo sapiens
tttgtggaacatata

SEQ ID NO: 366980 - DNA, 15 bp, Homo sapiens
ttgtggaacatatat

SEQ ID NO: 366981 - DNA, 15 bp, Homo sapiens
tgtggaacatatatt

SEQ ID NO: 366982 - DNA, 15 bp, Homo sapiens
gtggaacatatatta

SEQ ID NO: 366983 - DNA, 15 bp, Homo sapiens
tggaacatatattaa

SEQ ID NO: 366984 - DNA, 15 bp, Homo sapiens
ggaacatatattaag

SEQ ID NO: 366985 - DNA, 15 bp, Homo sapiens
gaacatatattaagt

SEQ ID NO: 366986 - DNA, 15 bp, Homo sapiens
aacatatattaagtt

SEQ ID NO: 366987 - DNA, 15 bp, Homo sapiens
acatatattaagttt

SEQ ID NO: 366988 - DNA, 15 bp, Homo sapiens
catatattaagtttt

SEQ ID NO: 366989 - DNA, 15 bp, Homo sapiens
atatattaagttttc

SEQ ID NO: 366990 - DNA, 15 bp, Homo sapiens
tatattaagttttct

SEQ ID NO: 366991 - DNA, 15 bp, Homo sapiens
atattaagttttctt

SEQ ID NO: 366992 - DNA, 15 bp, Homo sapiens
tattaagttttcttt

SEQ ID NO: 366993 - DNA, 15 bp, Homo sapiens
attaagttttctttt

SEQ ID NO: 366994 - DNA, 15 bp, Homo sapiens
ttaagttttcttttt

SEQ ID NO: 366995 - DNA, 15 bp, Homo sapiens
taagttttcttttta

SEQ ID NO: 366996 - DNA, 15 bp, Homo sapiens
aagttttctttttaa

SEQ ID NO: 366997 - DNA, 15 bp, Homo sapiens
agttttctttttaaa

SEQ ID NO: 366998 - DNA, 15 bp, Homo sapiens
gttttctttttaaaa

SEQ ID NO: 366999 - DNA, 15 bp, Homo sapiens
ttttctttttaaaat

SEQ ID NO: 367000 - DNA, 15 bp, Homo sapiens
tttctttttaaaatg

SEQ ID NO: 367001 - DNA, 15 bp, Homo sapiens
ttctttttaaaatgt

SEQ ID NO: 367002 - DNA, 15 bp, Homo sapiens
tctttttaaaatgtg

SEQ ID NO: 367003 - DNA, 15 bp, Homo sapiens
ctttttaaaatgtga

SEQ ID NO: 367004 - DNA, 15 bp, Homo sapiens
tttttaaaatgtgac

SEQ ID NO: 367005 - DNA, 15 bp, Homo sapiens
ttttaaaatgtgaca

SEQ ID NO: 367006 - DNA, 15 bp, Homo sapiens
tttaaaatgtgacaa

SEQ ID NO: 367007 - DNA, 15 bp, Homo sapiens
ttaaaatgtgacaat

SEQ ID NO: 367008 - DNA, 15 bp, Homo sapiens
taaaatgtgacaata

SEQ ID NO: 367009 - DNA, 15 bp, Homo sapiens
aaaatgtgacaatat

SEQ ID NO: 367010 - DNA, 15 bp, Homo sapiens
aaatgtgacaatatc

SEQ ID NO: 367011 - DNA, 15 bp, Homo sapiens
aatgtgacaatatct

SEQ ID NO: 367012 - DNA, 15 bp, Homo sapiens
atgtgacaatatcta

SEQ ID NO: 367013 - DNA, 15 bp, Homo sapiens
tgtgacaatatctaa

SEQ ID NO: 367014 - DNA, 15 bp, Homo sapiens
gtgacaatatctaac

SEQ ID NO: 367015 - DNA, 15 bp, Homo sapiens
tgacaatatctaaca

SEQ ID NO: 367016 - DNA, 15 bp, Homo sapiens
gacaatatctaacaa

SEQ ID NO: 367017 - DNA, 15 bp, Homo sapiens
acaatatctaacaag

SEQ ID NO: 367018 - DNA, 15 bp, Homo sapiens
caatatctaacaagc

SEQ ID NO: 367019 - DNA, 15 bp, Homo sapiens
aatatctaacaagct

SEQ ID NO: 367020 - DNA, 15 bp, Homo sapiens
atatctaacaagctt

SEQ ID NO: 367021 - DNA, 15 bp, Homo sapiens
tatctaacaagcttc

SEQ ID NO: 367022 - DNA, 15 bp, Homo sapiens
atctaacaagcttcc

SEQ ID NO: 367023 - DNA, 15 bp, Homo sapiens
tctaacaagcttcct

SEQ ID NO: 367024 - DNA, 15 bp, Homo sapiens
ctaacaagcttcctt

SEQ ID NO: 367025 - DNA, 15 bp, Homo sapiens
taacaagcttccttt

SEQ ID NO: 367026 - DNA, 15 bp, Homo sapiens
aacaagcttcctttt

SEQ ID NO: 367027 - DNA, 15 bp, Homo sapiens
acaagcttccttttt

SEQ ID NO: 367028 - DNA, 15 bp, Homo sapiens
caagcttcctttttt

SEQ ID NO: 367029 - DNA, 15 bp, Homo sapiens
aagcttcctttttta

SEQ ID NO: 367030 - DNA, 15 bp, Homo sapiens
agcttccttttttac

SEQ ID NO: 367031 - DNA, 15 bp, Homo sapiens
gcttccttttttacc

SEQ ID NO: 367032 - DNA, 15 bp, Homo sapiens
cttccttttttacct

SEQ ID NO: 367033 - DNA, 15 bp, Homo sapiens
ttccttttttaccta

SEQ ID NO: 367034 - DNA, 15 bp, Homo sapiens
tccttttttacctaa

SEQ ID NO: 367035 - DNA, 15 bp, Homo sapiens
ccttttttacctaaa

SEQ ID NO: 367036 - DNA, 15 bp, Homo sapiens
cttttttacctaaaa

SEQ ID NO: 367037 - DNA, 15 bp, Homo sapiens
ttttttacctaaaaa

SEQ ID NO: 367038 - DNA, 15 bp, Homo sapiens
tttttacctaaaaat

SEQ ID NO: 367039 - DNA, 15 bp, Homo sapiens
ttttacctaaaaatt

SEQ ID NO: 367040 - DNA, 15 bp, Homo sapiens
tttacctaaaaattt

SEQ ID NO: 367041 - DNA, 15 bp, Homo sapiens
ttacctaaaaatttc

SEQ ID NO: 367042 - DNA, 15 bp, Homo sapiens
tacctaaaaatttca

SEQ ID NO: 367043 - DNA, 15 bp, Homo sapiens
acctaaaaatttcag

SEQ ID NO: 367044 - DNA, 15 bp, Homo sapiens
cctaaaaatttcagt

SEQ ID NO: 367045 - DNA, 15 bp, Homo sapiens
ctaaaaatttcagtg

SEQ ID NO: 367046 - DNA, 15 bp, Homo sapiens
taaaaatttcagtgg

SEQ ID NO: 367047 - DNA, 15 bp, Homo sapiens
aaaaatttcagtggt

SEQ ID NO: 367048 - DNA, 15 bp, Homo sapiens
aaaatttcagtggtt

SEQ ID NO: 367049 - DNA, 15 bp, Homo sapiens
aaatttcagtggttt

SEQ ID NO: 367050 - DNA, 15 bp, Homo sapiens
aatttcagtggtttt

SEQ ID NO: 367051 - DNA, 15 bp, Homo sapiens
atttcagtggttttt

SEQ ID NO: 367052 - DNA, 15 bp, Homo sapiens
tttcagtggtttttt

SEQ ID NO: 367053 - DNA, 15 bp, Homo sapiens
ttcagtggttttttt

SEQ ID NO: 367054 - DNA, 15 bp, Homo sapiens
tcagtggtttttttg

SEQ ID NO: 367055 - DNA, 15 bp, Homo sapiens
cagtggtttttttgg

SEQ ID NO: 367056 - DNA, 15 bp, Homo sapiens
agtggtttttttggg

SEQ ID NO: 367057 - DNA, 15 bp, Homo sapiens
gtggtttttttggga

SEQ ID NO: 367058 - DNA, 15 bp, Homo sapiens
tggtttttttgggaa

SEQ ID NO: 367059 - DNA, 15 bp, Homo sapiens
ggtttttttgggaat

SEQ ID NO: 367060 - DNA, 15 bp, Homo sapiens
gtttttttgggaatg

SEQ ID NO: 367061 - DNA, 15 bp, Homo sapiens
tttttttgggaatgt

SEQ ID NO: 367062 - DNA, 15 bp, Homo sapiens
ttttttgggaatgtc

SEQ ID NO: 367063 - DNA, 15 bp, Homo sapiens
tttttgggaatgtct

SEQ ID NO: 367064 - DNA, 15 bp, Homo sapiens
ttttgggaatgtctc

SEQ ID NO: 367065 - DNA, 15 bp, Homo sapiens
tttgggaatgtctct

SEQ ID NO: 367066 - DNA, 15 bp, Homo sapiens
ttgggaatgtctctt

SEQ ID NO: 367067 - DNA, 15 bp, Homo sapiens
tgggaatgtctcttt

SEQ ID NO: 367068 - DNA, 15 bp, Homo sapiens
gggaatgtctctttt

SEQ ID NO: 367069 - DNA, 15 bp, Homo sapiens
ggaatgtctcttttg

SEQ ID NO: 367070 - DNA, 15 bp, Homo sapiens
gaatgtctcttttgt

SEQ ID NO: 367071 - DNA, 15 bp, Homo sapiens
aatgtctcttttgta

SEQ ID NO: 367072 - DNA, 15 bp, Homo sapiens
atgtctcttttgtaa

SEQ ID NO: 367073 - DNA, 15 bp, Homo sapiens
tgtctcttttgtaaa

SEQ ID NO: 367074 - DNA, 15 bp, Homo sapiens
gtctcttttgtaaac

SEQ ID NO: 367075 - DNA, 15 bp, Homo sapiens
tctcttttgtaaaca

SEQ ID NO: 367076 - DNA, 15 bp, Homo sapiens
ctcttttgtaaacaa

SEQ ID NO: 367077 - DNA, 15 bp, Homo sapiens
tcttttgtaaacaat

SEQ ID NO: 367078 - DNA, 15 bp, Homo sapiens
cttttgtaaacaatt

SEQ ID NO: 367079 - DNA, 15 bp, Homo sapiens
ttttgtaaacaattt

SEQ ID NO: 367080 - DNA, 15 bp, Homo sapiens
tttgtaaacaatttg

SEQ ID NO: 367081 - DNA, 15 bp, Homo sapiens
ttgtaaacaatttga

SEQ ID NO: 367082 - DNA, 15 bp, Homo sapiens
tgtaaacaatttgag

SEQ ID NO: 367083 - DNA, 15 bp, Homo sapiens
gtaaacaatttgagg

SEQ ID NO: 367084 - DNA, 15 bp, Homo sapiens
taaacaatttgagga

SEQ ID NO: 367085 - DNA, 15 bp, Homo sapiens
aaacaatttgaggag

SEQ ID NO: 367086 - DNA, 15 bp, Homo sapiens
aacaatttgaggaga

SEQ ID NO: 367087 - DNA, 15 bp, Homo sapiens
acaatttgaggagag

SEQ ID NO: 367088 - DNA, 15 bp, Homo sapiens
caatttgaggagagt

SEQ ID NO: 367089 - DNA, 15 bp, Homo sapiens
aatttgaggagagtt

SEQ ID NO: 367090 - DNA, 15 bp, Homo sapiens
atttgaggagagtta

SEQ ID NO: 367091 - DNA, 15 bp, Homo sapiens
tttgaggagagttag

SEQ ID NO: 367092 - DNA, 15 bp, Homo sapiens
ttgaggagagttaga

SEQ ID NO: 367093 - DNA, 15 bp, Homo sapiens
tgaggagagttagaa

SEQ ID NO: 367094 - DNA, 15 bp, Homo sapiens
gaggagagttagaaa

SEQ ID NO: 367095 - DNA, 15 bp, Homo sapiens
aggagagttagaaaa

SEQ ID NO: 367096 - DNA, 15 bp, Homo sapiens
ggagagttagaaaag

SEQ ID NO: 367097 - DNA, 15 bp, Homo sapiens
gagagttagaaaagg

SEQ ID NO: 367098 - DNA, 15 bp, Homo sapiens
agagttagaaaaggt

SEQ ID NO: 367099 - DNA, 15 bp, Homo sapiens
gagttagaaaaggtg

SEQ ID NO: 367100 - DNA, 15 bp, Homo sapiens
agttagaaaaggtgg

SEQ ID NO: 367101 - DNA, 15 bp, Homo sapiens
gttagaaaaggtgga

SEQ ID NO: 367102 - DNA, 15 bp, Homo sapiens
ttagaaaaggtggaa

SEQ ID NO: 367103 - DNA, 15 bp, Homo sapiens
tagaaaaggtggaac

SEQ ID NO: 367104 - DNA, 15 bp, Homo sapiens
agaaaaggtggaaca

SEQ ID NO: 367105 - DNA, 15 bp, Homo sapiens
gaaaaggtggaacag

SEQ ID NO: 367106 - DNA, 15 bp, Homo sapiens
aaaaggtggaacagt

SEQ ID NO: 367107 - DNA, 15 bp, Homo sapiens
aaaggtggaacagta

SEQ ID NO: 367108 - DNA, 15 bp, Homo sapiens
aaggtggaacagtat

SEQ ID NO: 367109 - DNA, 15 bp, Homo sapiens
aggtggaacagtata

SEQ ID NO: 367110 - DNA, 15 bp, Homo sapiens
ggtggaacagtatat

SEQ ID NO: 367111 - DNA, 15 bp, Homo sapiens
gtggaacagtatatt

SEQ ID NO: 367112 - DNA, 15 bp, Homo sapiens
tggaacagtatatta

SEQ ID NO: 367113 - DNA, 15 bp, Homo sapiens
ggaacagtatattag

SEQ ID NO: 367114 - DNA, 15 bp, Homo sapiens
gaacagtatattagg

SEQ ID NO: 367115 - DNA, 15 bp, Homo sapiens
aacagtatattagga

SEQ ID NO: 367116 - DNA, 15 bp, Homo sapiens
acagtatattaggat

SEQ ID NO: 367117 - DNA, 15 bp, Homo sapiens
cagtatattaggatg

SEQ ID NO: 367118 - DNA, 15 bp, Homo sapiens
agtatattaggatgg

SEQ ID NO: 367119 - DNA, 15 bp, Homo sapiens
gtatattaggatgga

SEQ ID NO: 367120 - DNA, 15 bp, Homo sapiens
tatattaggatggag

SEQ ID NO: 367121 - DNA, 15 bp, Homo sapiens
atattaggatggagt

SEQ ID NO: 367122 - DNA, 15 bp, Homo sapiens
tattaggatggagta

SEQ ID NO: 367123 - DNA, 15 bp, Homo sapiens
attaggatggagtag

SEQ ID NO: 367124 - DNA, 15 bp, Homo sapiens
ttaggatggagtagc

SEQ ID NO: 367125 - DNA, 15 bp, Homo sapiens
taggatggagtagca

SEQ ID NO: 367126 - DNA, 15 bp, Homo sapiens
aggatggagtagcaa

SEQ ID NO: 367127 - DNA, 15 bp, Homo sapiens
ggatggagtagcaag

SEQ ID NO: 367128 - DNA, 15 bp, Homo sapiens
gatggagtagcaagg

SEQ ID NO: 367129 - DNA, 15 bp, Homo sapiens
atggagtagcaagga

SEQ ID NO: 367130 - DNA, 15 bp, Homo sapiens
tggagtagcaaggag

SEQ ID NO: 367131 - DNA, 15 bp, Homo sapiens
ggagtagcaaggagg

SEQ ID NO: 367132 - DNA, 15 bp, Homo sapiens
gagtagcaaggagga

SEQ ID NO: 367133 - DNA, 15 bp, Homo sapiens
agtagcaaggaggag

SEQ ID NO: 367134 - DNA, 15 bp, Homo sapiens
gtagcaaggaggaga

SEQ ID NO: 367135 - DNA, 15 bp, Homo sapiens
tagcaaggaggagat

SEQ ID NO: 367136 - DNA, 15 bp, Homo sapiens
agcaaggaggagata

SEQ ID NO: 367137 - DNA, 15 bp, Homo sapiens
gcaaggaggagataa

SEQ ID NO: 367138 - DNA, 15 bp, Homo sapiens
caaggaggagataag

SEQ ID NO: 367139 - DNA, 15 bp, Homo sapiens
aaggaggagataaga

SEQ ID NO: 367140 - DNA, 15 bp, Homo sapiens
aggaggagataagaa

SEQ ID NO: 367141 - DNA, 15 bp, Homo sapiens
ggaggagataagaac

SEQ ID NO: 367142 - DNA, 15 bp, Homo sapiens
gaggagataagaaca

SEQ ID NO: 367143 - DNA, 15 bp, Homo sapiens
aggagataagaacag

SEQ ID NO: 367144 - DNA, 15 bp, Homo sapiens
ggagataagaacaga

SEQ ID NO: 367145 - DNA, 15 bp, Homo sapiens
gagataagaacagaa

SEQ ID NO: 367146 - DNA, 15 bp, Homo sapiens
agataagaacagaat

SEQ ID NO: 367147 - DNA, 15 bp, Homo sapiens
gataagaacagaatg

SEQ ID NO: 367148 - DNA, 15 bp, Homo sapiens
ataagaacagaatgt

SEQ ID NO: 367149 - DNA, 15 bp, Homo sapiens
taagaacagaatgtt

SEQ ID NO: 367150 - DNA, 15 bp, Homo sapiens
aagaacagaatgtta

SEQ ID NO: 367151 - DNA, 15 bp, Homo sapiens
agaacagaatgttaa

SEQ ID NO: 367152 - DNA, 15 bp, Homo sapiens
gaacagaatgttaaa

SEQ ID NO: 367153 - DNA, 15 bp, Homo sapiens
aacagaatgttaaat

SEQ ID NO: 367154 - DNA, 15 bp, Homo sapiens
acagaatgttaaatt

SEQ ID NO: 367155 - DNA, 15 bp, Homo sapiens
cagaatgttaaatta

SEQ ID NO: 367156 - DNA, 15 bp, Homo sapiens
agaatgttaaattag

SEQ ID NO: 367157 - DNA, 15 bp, Homo sapiens
gaatgttaaattagc

SEQ ID NO: 367158 - DNA, 15 bp, Homo sapiens
aatgttaaattagca

SEQ ID NO: 367159 - DNA, 15 bp, Homo sapiens
atgttaaattagcag

SEQ ID NO: 367160 - DNA, 15 bp, Homo sapiens
tgttaaattagcagt

SEQ ID NO: 367161 - DNA, 15 bp, Homo sapiens
gttaaattagcagtg

SEQ ID NO: 367162 - DNA, 15 bp, Homo sapiens
ttaaattagcagtgt

SEQ ID NO: 367163 - DNA, 15 bp, Homo sapiens
taaattagcagtgta

SEQ ID NO: 367164 - DNA, 15 bp, Homo sapiens
aaattagcagtgtaa

SEQ ID NO: 367165 - DNA, 15 bp, Homo sapiens
aattagcagtgtaaa

SEQ ID NO: 367166 - DNA, 15 bp, Homo sapiens
attagcagtgtaaaa

SEQ ID NO: 367167 - DNA, 15 bp, Homo sapiens
ttagcagtgtaaaaa

SEQ ID NO: 367168 - DNA, 15 bp, Homo sapiens
tagcagtgtaaaaat

SEQ ID NO: 367169 - DNA, 15 bp, Homo sapiens
agcagtgtaaaaata

SEQ ID NO: 367170 - DNA, 15 bp, Homo sapiens
gcagtgtaaaaataa

SEQ ID NO: 367171 - DNA, 15 bp, Homo sapiens
cagtgtaaaaataat

SEQ ID NO: 367172 - DNA, 15 bp, Homo sapiens
agtgtaaaaataata

SEQ ID NO: 367173 - DNA, 15 bp, Homo sapiens
gtgtaaaaataatat

SEQ ID NO: 367174 - DNA, 15 bp, Homo sapiens
tgtaaaaataatata

SEQ ID NO: 367175 - DNA, 15 bp, Homo sapiens
gtaaaaataatatat

SEQ ID NO: 367176 - DNA, 15 bp, Homo sapiens
taaaaataatatatg

SEQ ID NO: 367177 - DNA, 15 bp, Homo sapiens
aaaaataatatatga

SEQ ID NO: 367178 - DNA, 15 bp, Homo sapiens
aaaataatatatgac

SEQ ID NO: 367179 - DNA, 15 bp, Homo sapiens
aaataatatatgacc

SEQ ID NO: 367180 - DNA, 15 bp, Homo sapiens
aataatatatgaccc

SEQ ID NO: 367181 - DNA, 15 bp, Homo sapiens
ataatatatgacccg

SEQ ID NO: 367182 - DNA, 15 bp, Homo sapiens
taatatatgacccgg

SEQ ID NO: 367183 - DNA, 15 bp, Homo sapiens
aatatatgacccggt

SEQ ID NO: 367184 - DNA, 15 bp, Homo sapiens
atatatgacccggtt

SEQ ID NO: 367185 - DNA, 15 bp, Homo sapiens
tatatgacccggtta

SEQ ID NO: 367186 - DNA, 15 bp, Homo sapiens
atatgacccggttaa

SEQ ID NO: 367187 - DNA, 15 bp, Homo sapiens
tatgacccggttaag

SEQ ID NO: 367188 - DNA, 15 bp, Homo sapiens
atgacccggttaaga

SEQ ID NO: 367189 - DNA, 15 bp, Homo sapiens
tgacccggttaagag

SEQ ID NO: 367190 - DNA, 15 bp, Homo sapiens
gacccggttaagaga

SEQ ID NO: 367191 - DNA, 15 bp, Homo sapiens
acccggttaagagac

SEQ ID NO: 367192 - DNA, 15 bp, Homo sapiens
cccggttaagagaca

SEQ ID NO: 367193 - DNA, 15 bp, Homo sapiens
ccggttaagagacag

SEQ ID NO: 367194 - DNA, 15 bp, Homo sapiens
cggttaagagacagt

SEQ ID NO: 367195 - DNA, 15 bp, Homo sapiens
ggttaagagacagtg

SEQ ID NO: 367196 - DNA, 15 bp, Homo sapiens
gttaagagacagtga

SEQ ID NO: 367197 - DNA, 15 bp, Homo sapiens
ttaagagacagtgag

SEQ ID NO: 367198 - DNA, 15 bp, Homo sapiens
taagagacagtgagt

SEQ ID NO: 367199 - DNA, 15 bp, Homo sapiens
aagagacagtgagta

SEQ ID NO: 367200 - DNA, 15 bp, Homo sapiens
agagacagtgagtac

SEQ ID NO: 367201 - DNA, 15 bp, Homo sapiens
gagacagtgagtacc

SEQ ID NO: 367202 - DNA, 15 bp, Homo sapiens
agacagtgagtacca

SEQ ID NO: 367203 - DNA, 15 bp, Homo sapiens
gacagtgagtaccag

SEQ ID NO: 367204 - DNA, 15 bp, Homo sapiens
acagtgagtaccaga

SEQ ID NO: 367205 - DNA, 15 bp, Homo sapiens
cagtgagtaccagag

SEQ ID NO: 367206 - DNA, 15 bp, Homo sapiens
agtgagtaccagaga

SEQ ID NO: 367207 - DNA, 15 bp, Homo sapiens
gtgagtaccagagag

SEQ ID NO: 367208 - DNA, 15 bp, Homo sapiens
tgagtaccagagagc

SEQ ID NO: 367209 - DNA, 15 bp, Homo sapiens
gagtaccagagagcc

SEQ ID NO: 367210 - DNA, 15 bp, Homo sapiens
agtaccagagagccc

SEQ ID NO: 367211 - DNA, 15 bp, Homo sapiens
gtaccagagagcccg

SEQ ID NO: 367212 - DNA, 15 bp, Homo sapiens
taccagagagcccgt

SEQ ID NO: 367213 - DNA, 15 bp, Homo sapiens
accagagagcccgtt

SEQ ID NO: 367214 - DNA, 15 bp, Homo sapiens
ccagagagcccgttt

SEQ ID NO: 367215 - DNA, 15 bp, Homo sapiens
cagagagcccgtttg

SEQ ID NO: 367216 - DNA, 15 bp, Homo sapiens
agagagcccgtttgt

SEQ ID NO: 367217 - DNA, 15 bp, Homo sapiens
gagagcccgtttgtg

SEQ ID NO: 367218 - DNA, 15 bp, Homo sapiens
agagcccgtttgtgc

SEQ ID NO: 367219 - DNA, 15 bp, Homo sapiens
gagcccgtttgtgca

SEQ ID NO: 367220 - DNA, 15 bp, Homo sapiens
agcccgtttgtgcac

SEQ ID NO: 367221 - DNA, 15 bp, Homo sapiens
gcccgtttgtgcaca

SEQ ID NO: 367222 - DNA, 15 bp, Homo sapiens
cccgtttgtgcacag

SEQ ID NO: 367223 - DNA, 15 bp, Homo sapiens
ccgtttgtgcacagg

SEQ ID NO: 367224 - DNA, 15 bp, Homo sapiens
cgtttgtgcacagga

SEQ ID NO: 367225 - DNA, 15 bp, Homo sapiens
gtttgtgcacaggag

SEQ ID NO: 367226 - DNA, 15 bp, Homo sapiens
tttgtgcacaggagt

SEQ ID NO: 367227 - DNA, 15 bp, Homo sapiens
ttgtgcacaggagtg

SEQ ID NO: 367228 - DNA, 15 bp, Homo sapiens
tgtgcacaggagtgc

SEQ ID NO: 367229 - DNA, 15 bp, Homo sapiens
gtgcacaggagtgca

SEQ ID NO: 367230 - DNA, 15 bp, Homo sapiens
tgcacaggagtgcaa

SEQ ID NO: 367231 - DNA, 15 bp, Homo sapiens
gcacaggagtgcaaa

SEQ ID NO: 367232 - DNA, 15 bp, Homo sapiens
cacaggagtgcaaaa

SEQ ID NO: 367233 - DNA, 15 bp, Homo sapiens
acaggagtgcaaaaa

SEQ ID NO: 367234 - DNA, 15 bp, Homo sapiens
caggagtgcaaaaat

SEQ ID NO: 367235 - DNA, 15 bp, Homo sapiens
aggagtgcaaaaata

SEQ ID NO: 367236 - DNA, 15 bp, Homo sapiens
ggagtgcaaaaatac

SEQ ID NO: 367237 - DNA, 15 bp, Homo sapiens
gagtgcaaaaataca

SEQ ID NO: 367238 - DNA, 15 bp, Homo sapiens
agtgcaaaaatacac

SEQ ID NO: 367239 - DNA, 15 bp, Homo sapiens
gtgcaaaaatacaca

SEQ ID NO: 367240 - DNA, 15 bp, Homo sapiens
tgcaaaaatacacac

SEQ ID NO: 367241 - DNA, 15 bp, Homo sapiens
gcaaaaatacacaca

SEQ ID NO: 367242 - DNA, 15 bp, Homo sapiens
caaaaatacacacag

SEQ ID NO: 367243 - DNA, 15 bp, Homo sapiens
aaaaatacacacaga

SEQ ID NO: 367244 - DNA, 15 bp, Homo sapiens
aaaatacacacagaa

SEQ ID NO: 367245 - DNA, 15 bp, Homo sapiens
aaatacacacagaag

SEQ ID NO: 367246 - DNA, 15 bp, Homo sapiens
aatacacacagaagg

SEQ ID NO: 367247 - DNA, 15 bp, Homo sapiens
atacacacagaaggc

SEQ ID NO: 367248 - DNA, 15 bp, Homo sapiens
tacacacagaaggca

SEQ ID NO: 367249 - DNA, 15 bp, Homo sapiens
acacacagaaggcat

SEQ ID NO: 367250 - DNA, 15 bp, Homo sapiens
cacacagaaggcatg

SEQ ID NO: 367251 - DNA, 15 bp, Homo sapiens
acacagaaggcatgt

SEQ ID NO: 367252 - DNA, 15 bp, Homo sapiens
cacagaaggcatgtg

SEQ ID NO: 367253 - DNA, 15 bp, Homo sapiens
acagaaggcatgtgc

SEQ ID NO: 367254 - DNA, 15 bp, Homo sapiens
cagaaggcatgtgct

SEQ ID NO: 367255 - DNA, 15 bp, Homo sapiens
agaaggcatgtgctc

SEQ ID NO: 367256 - DNA, 15 bp, Homo sapiens
gaaggcatgtgctca

SEQ ID NO: 367257 - DNA, 15 bp, Homo sapiens
aaggcatgtgctcac

SEQ ID NO: 367258 - DNA, 15 bp, Homo sapiens
aggcatgtgctcact

SEQ ID NO: 367259 - DNA, 15 bp, Homo sapiens
ggcatgtgctcactc

SEQ ID NO: 367260 - DNA, 15 bp, Homo sapiens
gcatgtgctcactcc

SEQ ID NO: 367261 - DNA, 15 bp, Homo sapiens
catgtgctcactccc

SEQ ID NO: 367262 - DNA, 15 bp, Homo sapiens
atgtgctcactccct

SEQ ID NO: 367263 - DNA, 15 bp, Homo sapiens
tgtgctcactccctt

SEQ ID NO: 367264 - DNA, 15 bp, Homo sapiens
gtgctcactcccttc

SEQ ID NO: 367265 - DNA, 15 bp, Homo sapiens
tgctcactcccttcc

SEQ ID NO: 367266 - DNA, 15 bp, Homo sapiens
gctcactcccttcct

SEQ ID NO: 367267 - DNA, 15 bp, Homo sapiens
ctcactcccttccta

SEQ ID NO: 367268 - DNA, 15 bp, Homo sapiens
tcactcccttcctag

SEQ ID NO: 367269 - DNA, 15 bp, Homo sapiens
cactcccttcctagt

SEQ ID NO: 367270 - DNA, 15 bp, Homo sapiens
actcccttcctagtt

SEQ ID NO: 367271 - DNA, 15 bp, Homo sapiens
ctcccttcctagtta

SEQ ID NO: 367272 - DNA, 15 bp, Homo sapiens
tcccttcctagttat

SEQ ID NO: 367273 - DNA, 15 bp, Homo sapiens
cccttcctagttatc

SEQ ID NO: 367274 - DNA, 15 bp, Homo sapiens
ccttcctagttatca

SEQ ID NO: 367275 - DNA, 15 bp, Homo sapiens
cttcctagttatcat

SEQ ID NO: 367276 - DNA, 15 bp, Homo sapiens
ttcctagttatcatt

SEQ ID NO: 367277 - DNA, 15 bp, Homo sapiens
tcctagttatcattt

SEQ ID NO: 367278 - DNA, 15 bp, Homo sapiens
cctagttatcatttg

SEQ ID NO: 367279 - DNA, 15 bp, Homo sapiens
ctagttatcatttgt

SEQ ID NO: 367280 - DNA, 15 bp, Homo sapiens
tagttatcatttgtt

SEQ ID NO: 367281 - DNA, 15 bp, Homo sapiens
agttatcatttgtta

SEQ ID NO: 367282 - DNA, 15 bp, Homo sapiens
gttatcatttgttag

SEQ ID NO: 367283 - DNA, 15 bp, Homo sapiens
ttatcatttgttagc

SEQ ID NO: 367284 - DNA, 15 bp, Homo sapiens
tatcatttgttagca

SEQ ID NO: 367285 - DNA, 15 bp, Homo sapiens
atcatttgttagcat

SEQ ID NO: 367286 - DNA, 15 bp, Homo sapiens
tcatttgttagcatg

SEQ ID NO: 367287 - DNA, 15 bp, Homo sapiens
catttgttagcatga

SEQ ID NO: 367288 - DNA, 15 bp, Homo sapiens
atttgttagcatgag

SEQ ID NO: 367289 - DNA, 15 bp, Homo sapiens
tttgttagcatgagc

SEQ ID NO: 367290 - DNA, 15 bp, Homo sapiens
ttgttagcatgagct

SEQ ID NO: 367291 - DNA, 15 bp, Homo sapiens
tgttagcatgagctt

SEQ ID NO: 367292 - DNA, 15 bp, Homo sapiens
gttagcatgagctta

SEQ ID NO: 367293 - DNA, 15 bp, Homo sapiens
ttagcatgagcttaa

SEQ ID NO: 367294 - DNA, 15 bp, Homo sapiens
tagcatgagcttaag

SEQ ID NO: 367295 - DNA, 15 bp, Homo sapiens
agcatgagcttaagc

SEQ ID NO: 367296 - DNA, 15 bp, Homo sapiens
gcatgagcttaagct

SEQ ID NO: 367297 - DNA, 15 bp, Homo sapiens
catgagcttaagctt

SEQ ID NO: 367298 - DNA, 15 bp, Homo sapiens
atgagcttaagcttc

SEQ ID NO: 367299 - DNA, 15 bp, Homo sapiens
tgagcttaagcttct

SEQ ID NO: 367300 - DNA, 15 bp, Homo sapiens
gagcttaagcttctt

SEQ ID NO: 367301 - DNA, 15 bp, Homo sapiens
agcttaagcttctta

SEQ ID NO: 367302 - DNA, 15 bp, Homo sapiens
gcttaagcttcttat

SEQ ID NO: 367303 - DNA, 15 bp, Homo sapiens
cttaagcttcttata

SEQ ID NO: 367304 - DNA, 15 bp, Homo sapiens
ttaagcttcttataa

SEQ ID NO: 367305 - DNA, 15 bp, Homo sapiens
taagcttcttataag

SEQ ID NO: 367306 - DNA, 15 bp, Homo sapiens
aagcttcttataagt

SEQ ID NO: 367307 - DNA, 15 bp, Homo sapiens
agcttcttataagtt

SEQ ID NO: 367308 - DNA, 15 bp, Homo sapiens
gcttcttataagttt

SEQ ID NO: 367309 - DNA, 15 bp, Homo sapiens
cttcttataagttta

SEQ ID NO: 367310 - DNA, 15 bp, Homo sapiens
ttcttataagtttat

SEQ ID NO: 367311 - DNA, 15 bp, Homo sapiens
tcttataagtttatt

SEQ ID NO: 367312 - DNA, 15 bp, Homo sapiens
cttataagtttattt

SEQ ID NO: 367313 - DNA, 15 bp, Homo sapiens
ttataagtttatttt

SEQ ID NO: 367314 - DNA, 15 bp, Homo sapiens
tataagtttattttt

SEQ ID NO: 367315 - DNA, 15 bp, Homo sapiens
ataagtttatttttt

SEQ ID NO: 367316 - DNA, 15 bp, Homo sapiens
aagtttattttttca

SEQ ID NO: 367317 - DNA, 15 bp, Homo sapiens
agtttattttttcac

SEQ ID NO: 367318 - DNA, 15 bp, Homo sapiens
gtttattttttcact

SEQ ID NO: 367319 - DNA, 15 bp, Homo sapiens
tttattttttcactt

SEQ ID NO: 367320 - DNA, 15 bp, Homo sapiens
ttattttttcactta

SEQ ID NO: 367321 - DNA, 15 bp, Homo sapiens
tattttttcacttaa

SEQ ID NO: 367322 - DNA, 15 bp, Homo sapiens
attttttcacttaac

SEQ ID NO: 367323 - DNA, 15 bp, Homo sapiens
ttttttcacttaaca

SEQ ID NO: 367324 - DNA, 15 bp, Homo sapiens
tttttcacttaacaa

SEQ ID NO: 367325 - DNA, 15 bp, Homo sapiens
ttttcacttaacaaa

SEQ ID NO: 367326 - DNA, 15 bp, Homo sapiens
tttcacttaacaaat

SEQ ID NO: 367327 - DNA, 15 bp, Homo sapiens
ttcacttaacaaatt

SEQ ID NO: 367328 - DNA, 15 bp, Homo sapiens
tcacttaacaaatta

SEQ ID NO: 367329 - DNA, 15 bp, Homo sapiens
cacttaacaaattag

SEQ ID NO: 367330 - DNA, 15 bp, Homo sapiens
acttaacaaattaga

SEQ ID NO: 367331 - DNA, 15 bp, Homo sapiens
cttaacaaattagaa

SEQ ID NO: 367332 - DNA, 15 bp, Homo sapiens
ttaacaaattagaaa

SEQ ID NO: 367333 - DNA, 15 bp, Homo sapiens
taacaaattagaaag

SEQ ID NO: 367334 - DNA, 15 bp, Homo sapiens
aacaaattagaaagt

SEQ ID NO: 367335 - DNA, 15 bp, Homo sapiens
acaaattagaaagtt

SEQ ID NO: 367336 - DNA, 15 bp, Homo sapiens
caaattagaaagtta

SEQ ID NO: 367337 - DNA, 15 bp, Homo sapiens
aaattagaaagttac

SEQ ID NO: 367338 - DNA, 15 bp, Homo sapiens
aattagaaagttaca

SEQ ID NO: 367339 - DNA, 15 bp, Homo sapiens
attagaaagttacat

SEQ ID NO: 367340 - DNA, 15 bp, Homo sapiens
ttagaaagttacatt

SEQ ID NO: 367341 - DNA, 15 bp, Homo sapiens
tagaaagttacattt

SEQ ID NO: 367342 - DNA, 15 bp, Homo sapiens
agaaagttacatttg

SEQ ID NO: 367343 - DNA, 15 bp, Homo sapiens
gaaagttacatttgt

SEQ ID NO: 367344 - DNA, 15 bp, Homo sapiens
aaagttacatttgta

SEQ ID NO: 367345 - DNA, 15 bp, Homo sapiens
aagttacatttgtaa

SEQ ID NO: 367346 - DNA, 15 bp, Homo sapiens
agttacatttgtaat

SEQ ID NO: 367347 - DNA, 15 bp, Homo sapiens
gttacatttgtaata

SEQ ID NO: 367348 - DNA, 15 bp, Homo sapiens
ttacatttgtaataa

SEQ ID NO: 367349 - DNA, 15 bp, Homo sapiens
tacatttgtaataat

SEQ ID NO: 367350 - DNA, 15 bp, Homo sapiens
acatttgtaataata

SEQ ID NO: 367351 - DNA, 15 bp, Homo sapiens
catttgtaataatac

SEQ ID NO: 367352 - DNA, 15 bp, Homo sapiens
atttgtaataatacc

SEQ ID NO: 367353 - DNA, 15 bp, Homo sapiens
tttgtaataatacca

SEQ ID NO: 367354 - DNA, 15 bp, Homo sapiens
ttgtaataataccaa

SEQ ID NO: 367355 - DNA, 15 bp, Homo sapiens
tgtaataataccaaa

SEQ ID NO: 367356 - DNA, 15 bp, Homo sapiens
gtaataataccaaaa

SEQ ID NO: 367357 - DNA, 15 bp, Homo sapiens
taataataccaaaaa

SEQ ID NO: 367358 - DNA, 15 bp, Homo sapiens
aataataccaaaaag

SEQ ID NO: 367359 - DNA, 15 bp, Homo sapiens
ataataccaaaaagg

SEQ ID NO: 367360 - DNA, 15 bp, Homo sapiens
taataccaaaaaggt

SEQ ID NO: 367361 - DNA, 15 bp, Homo sapiens
aataccaaaaaggtt

SEQ ID NO: 367362 - DNA, 15 bp, Homo sapiens
ataccaaaaaggttt

SEQ ID NO: 367363 - DNA, 15 bp, Homo sapiens
taccaaaaaggtttc

SEQ ID NO: 367364 - DNA, 15 bp, Homo sapiens
accaaaaaggtttct

SEQ ID NO: 367365 - DNA, 15 bp, Homo sapiens
ccaaaaaggtttcta

SEQ ID NO: 367366 - DNA, 15 bp, Homo sapiens
caaaaaggtttctaa

SEQ ID NO: 367367 - DNA, 15 bp, Homo sapiens
aaaaaggtttctaat

SEQ ID NO: 367368 - DNA, 15 bp, Homo sapiens
aaaaggtttctaata

SEQ ID NO: 367369 - DNA, 15 bp, Homo sapiens
aaaggtttctaatac

SEQ ID NO: 367370 - DNA, 15 bp, Homo sapiens
aaggtttctaataca

SEQ ID NO: 367371 - DNA, 15 bp, Homo sapiens
aggtttctaatacag

SEQ ID NO: 367372 - DNA, 15 bp, Homo sapiens
gtttctaatacagtt

SEQ ID NO: 367373 - DNA, 15 bp, Homo sapiens
tttctaatacagttc

SEQ ID NO: 367374 - DNA, 15 bp, Homo sapiens
ttctaatacagttct

SEQ ID NO: 367375 - DNA, 15 bp, Homo sapiens
tctaatacagttctt

SEQ ID NO: 367376 - DNA, 15 bp, Homo sapiens
ctaatacagttcttg

SEQ ID NO: 367377 - DNA, 15 bp, Homo sapiens
taatacagttcttga

SEQ ID NO: 367378 - DNA, 15 bp, Homo sapiens
aatacagttcttgaa

SEQ ID NO: 367379 - DNA, 15 bp, Homo sapiens
atacagttcttgaat

SEQ ID NO: 367380 - DNA, 15 bp, Homo sapiens
tacagttcttgaatt

SEQ ID NO: 367381 - DNA, 15 bp, Homo sapiens
acagttcttgaattt

SEQ ID NO: 367382 - DNA, 15 bp, Homo sapiens
cagttcttgaatttt

SEQ ID NO: 367383 - DNA, 15 bp, Homo sapiens
agttcttgaattttc

SEQ ID NO: 367384 - DNA, 15 bp, Homo sapiens
gttcttgaattttcc

SEQ ID NO: 367385 - DNA, 15 bp, Homo sapiens
ttcttgaattttccc

SEQ ID NO: 367386 - DNA, 15 bp, Homo sapiens
tcttgaattttccct

SEQ ID NO: 367387 - DNA, 15 bp, Homo sapiens
cttgaattttccctt

SEQ ID NO: 367388 - DNA, 15 bp, Homo sapiens
ttgaattttccctta

SEQ ID NO: 367389 - DNA, 15 bp, Homo sapiens
tgaattttcccttat

SEQ ID NO: 367390 - DNA, 15 bp, Homo sapiens
gaattttcccttatc

SEQ ID NO: 367391 - DNA, 15 bp, Homo sapiens
aattttcccttatct

SEQ ID NO: 367392 - DNA, 15 bp, Homo sapiens
attttcccttatctg

SEQ ID NO: 367393 - DNA, 15 bp, Homo sapiens
ttttcccttatctga

SEQ ID NO: 367394 - DNA, 15 bp, Homo sapiens
tttcccttatctgac

SEQ ID NO: 367395 - DNA, 15 bp, Homo sapiens
ttcccttatctgact

SEQ ID NO: 367396 - DNA, 15 bp, Homo sapiens
tcccttatctgacta

SEQ ID NO: 367397 - DNA, 15 bp, Homo sapiens
cccttatctgactac

SEQ ID NO: 367398 - DNA, 15 bp, Homo sapiens
ccttatctgactacc

SEQ ID NO: 367399 - DNA, 15 bp, Homo sapiens
cttatctgactacct

SEQ ID NO: 367400 - DNA, 15 bp, Homo sapiens
ttatctgactacctt

SEQ ID NO: 367401 - DNA, 15 bp, Homo sapiens
tatctgactaccttc

SEQ ID NO: 367402 - DNA, 15 bp, Homo sapiens
atctgactaccttct

SEQ ID NO: 367403 - DNA, 15 bp, Homo sapiens
tctgactaccttcta

SEQ ID NO: 367404 - DNA, 15 bp, Homo sapiens
ctgactaccttctaa

SEQ ID NO: 367405 - DNA, 15 bp, Homo sapiens
tgactaccttctaac

SEQ ID NO: 367406 - DNA, 15 bp, Homo sapiens
gactaccttctaacc

SEQ ID NO: 367407 - DNA, 15 bp, Homo sapiens
actaccttctaacca

SEQ ID NO: 367408 - DNA, 15 bp, Homo sapiens
ctaccttctaaccac

SEQ ID NO: 367409 - DNA, 15 bp, Homo sapiens
taccttctaaccaca

SEQ ID NO: 367410 - DNA, 15 bp, Homo sapiens
accttctaaccacac

SEQ ID NO: 367411 - DNA, 15 bp, Homo sapiens
ccttctaaccacacc

SEQ ID NO: 367412 - DNA, 15 bp, Homo sapiens
cttctaaccacacct

SEQ ID NO: 367413 - DNA, 15 bp, Homo sapiens
ttctaaccacaccta

SEQ ID NO: 367414 - DNA, 15 bp, Homo sapiens
tctaaccacacctat

SEQ ID NO: 367415 - DNA, 15 bp, Homo sapiens
ctaaccacacctatc

SEQ ID NO: 367416 - DNA, 15 bp, Homo sapiens
taaccacacctatct

SEQ ID NO: 367417 - DNA, 15 bp, Homo sapiens
aaccacacctatctt

SEQ ID NO: 367418 - DNA, 15 bp, Homo sapiens
accacacctatcttt

SEQ ID NO: 367419 - DNA, 15 bp, Homo sapiens
ccacacctatctttt

SEQ ID NO: 367420 - DNA, 15 bp, Homo sapiens
cacacctatctttta

SEQ ID NO: 367421 - DNA, 15 bp, Homo sapiens
acacctatcttttaa

SEQ ID NO: 367422 - DNA, 15 bp, Homo sapiens
cacctatcttttaac

SEQ ID NO: 367423 - DNA, 15 bp, Homo sapiens
acctatcttttaact

SEQ ID NO: 367424 - DNA, 15 bp, Homo sapiens
cctatcttttaactt

SEQ ID NO: 367425 - DNA, 15 bp, Homo sapiens
ctatcttttaacttc

SEQ ID NO: 367426 - DNA, 15 bp, Homo sapiens
tatcttttaacttct

SEQ ID NO: 367427 - DNA, 15 bp, Homo sapiens
atcttttaacttctc

SEQ ID NO: 367428 - DNA, 15 bp, Homo sapiens
tcttttaacttctcc

SEQ ID NO: 367429 - DNA, 15 bp, Homo sapiens
cttttaacttctcca

SEQ ID NO: 367430 - DNA, 15 bp, Homo sapiens
ttttaacttctccag

SEQ ID NO: 367431 - DNA, 15 bp, Homo sapiens
tttaacttctccagg

SEQ ID NO: 367432 - DNA, 15 bp, Homo sapiens
ttaacttctccagga

SEQ ID NO: 367433 - DNA, 15 bp, Homo sapiens
taacttctccaggac

SEQ ID NO: 367434 - DNA, 15 bp, Homo sapiens
aacttctccaggact

SEQ ID NO: 367435 - DNA, 15 bp, Homo sapiens
acttctccaggactt

SEQ ID NO: 367436 - DNA, 15 bp, Homo sapiens
cttctccaggactta

SEQ ID NO: 367437 - DNA, 15 bp, Homo sapiens
ttctccaggacttaa

SEQ ID NO: 367438 - DNA, 15 bp, Homo sapiens
tctccaggacttaac

SEQ ID NO: 367439 - DNA, 15 bp, Homo sapiens
ctccaggacttaact

SEQ ID NO: 367440 - DNA, 15 bp, Homo sapiens
tccaggacttaactc

SEQ ID NO: 367441 - DNA, 15 bp, Homo sapiens
ccaggacttaactca

SEQ ID NO: 367442 - DNA, 15 bp, Homo sapiens
caggacttaactcaa

SEQ ID NO: 367443 - DNA, 15 bp, Homo sapiens
aggacttaactcaag

SEQ ID NO: 367444 - DNA, 15 bp, Homo sapiens
ggacttaactcaaga

SEQ ID NO: 367445 - DNA, 15 bp, Homo sapiens
gacttaactcaagaa

SEQ ID NO: 367446 - DNA, 15 bp, Homo sapiens
acttaactcaagaaa

SEQ ID NO: 367447 - DNA, 15 bp, Homo sapiens
cttaactcaagaaat

SEQ ID NO: 367448 - DNA, 15 bp, Homo sapiens
ttaactcaagaaatg

SEQ ID NO: 367449 - DNA, 15 bp, Homo sapiens
taactcaagaaatgg

SEQ ID NO: 367450 - DNA, 15 bp, Homo sapiens
aactcaagaaatgga

SEQ ID NO: 367451 - DNA, 15 bp, Homo sapiens
actcaagaaatggaa

SEQ ID NO: 367452 - DNA, 15 bp, Homo sapiens
ctcaagaaatggaag

SEQ ID NO: 367453 - DNA, 15 bp, Homo sapiens
tcaagaaatggaagt

SEQ ID NO: 367454 - DNA, 15 bp, Homo sapiens
caagaaatggaagta

SEQ ID NO: 367455 - DNA, 15 bp, Homo sapiens
aagaaatggaagtac

SEQ ID NO: 367456 - DNA, 15 bp, Homo sapiens
agaaatggaagtaca

SEQ ID NO: 367457 - DNA, 15 bp, Homo sapiens
gaaatggaagtacat

SEQ ID NO: 367458 - DNA, 15 bp, Homo sapiens
aaatggaagtacatg

SEQ ID NO: 367459 - DNA, 15 bp, Homo sapiens
aatggaagtacatgc

SEQ ID NO: 367460 - DNA, 15 bp, Homo sapiens
atggaagtacatgct

SEQ ID NO: 367461 - DNA, 15 bp, Homo sapiens
tggaagtacatgctg

SEQ ID NO: 367462 - DNA, 15 bp, Homo sapiens
ggaagtacatgctga

SEQ ID NO: 367463 - DNA, 15 bp, Homo sapiens
gaagtacatgctgaa

SEQ ID NO: 367464 - DNA, 15 bp, Homo sapiens
aagtacatgctgaaa

SEQ ID NO: 367465 - DNA, 15 bp, Homo sapiens
agtacatgctgaaaa

SEQ ID NO: 367466 - DNA, 15 bp, Homo sapiens
gtacatgctgaaaaa

SEQ ID NO: 367467 - DNA, 15 bp, Homo sapiens
tacatgctgaaaaac

SEQ ID NO: 367468 - DNA, 15 bp, Homo sapiens
acatgctgaaaaact

SEQ ID NO: 367469 - DNA, 15 bp, Homo sapiens
catgctgaaaaactc

SEQ ID NO: 367470 - DNA, 15 bp, Homo sapiens
atgctgaaaaactca

SEQ ID NO: 367471 - DNA, 15 bp, Homo sapiens
tgctgaaaaactcaa

SEQ ID NO: 367472 - DNA, 15 bp, Homo sapiens
gctgaaaaactcaaa

SEQ ID NO: 367473 - DNA, 15 bp, Homo sapiens
ctgaaaaactcaaat

SEQ ID NO: 367474 - DNA, 15 bp, Homo sapiens
tgaaaaactcaaatg

SEQ ID NO: 367475 - DNA, 15 bp, Homo sapiens
gaaaaactcaaatgg

SEQ ID NO: 367476 - DNA, 15 bp, Homo sapiens
aaaaactcaaatggc

SEQ ID NO: 367477 - DNA, 15 bp, Homo sapiens
aaaactcaaatggct

SEQ ID NO: 367478 - DNA, 15 bp, Homo sapiens
aaactcaaatggctg

SEQ ID NO: 367479 - DNA, 15 bp, Homo sapiens
aactcaaatggctga

SEQ ID NO: 367480 - DNA, 15 bp, Homo sapiens
actcaaatggctgaa

SEQ ID NO: 367481 - DNA, 15 bp, Homo sapiens
ctcaaatggctgaat

SEQ ID NO: 367482 - DNA, 15 bp, Homo sapiens
tcaaatggctgaata

SEQ ID NO: 367483 - DNA, 15 bp, Homo sapiens
caaatggctgaatag

SEQ ID NO: 367484 - DNA, 15 bp, Homo sapiens
aaatggctgaataga

SEQ ID NO: 367485 - DNA, 15 bp, Homo sapiens
aatggctgaatagaa

SEQ ID NO: 367486 - DNA, 15 bp, Homo sapiens
atggctgaatagaac

SEQ ID NO: 367487 - DNA, 15 bp, Homo sapiens
tggctgaatagaact

SEQ ID NO: 367488 - DNA, 15 bp, Homo sapiens
ggctgaatagaactg

SEQ ID NO: 367489 - DNA, 15 bp, Homo sapiens
gctgaatagaactga

SEQ ID NO: 367490 - DNA, 15 bp, Homo sapiens
ctgaatagaactgaa

SEQ ID NO: 367491 - DNA, 15 bp, Homo sapiens
tgaatagaactgaat

SEQ ID NO: 367492 - DNA, 15 bp, Homo sapiens
gaatagaactgaatt

SEQ ID NO: 367493 - DNA, 15 bp, Homo sapiens
aatagaactgaattg

SEQ ID NO: 367494 - DNA, 15 bp, Homo sapiens
atagaactgaattgg

SEQ ID NO: 367495 - DNA, 15 bp, Homo sapiens
tagaactgaattgga

SEQ ID NO: 367496 - DNA, 15 bp, Homo sapiens
agaactgaattggag

SEQ ID NO: 367497 - DNA, 15 bp, Homo sapiens
gaactgaattggaga

SEQ ID NO: 367498 - DNA, 15 bp, Homo sapiens
aactgaattggagat

SEQ ID NO: 367499 - DNA, 15 bp, Homo sapiens
actgaattggagatg

SEQ ID NO: 367500 - DNA, 15 bp, Homo sapiens
ctgaattggagatgc

SEQ ID NO: 367501 - DNA, 15 bp, Homo sapiens
tgaattggagatgct

SEQ ID NO: 367502 - DNA, 15 bp, Homo sapiens
gaattggagatgctt

SEQ ID NO: 367503 - DNA, 15 bp, Homo sapiens
aattggagatgcttt

SEQ ID NO: 367504 - DNA, 15 bp, Homo sapiens
attggagatgctttc

SEQ ID NO: 367505 - DNA, 15 bp, Homo sapiens
ttggagatgctttca

SEQ ID NO: 367506 - DNA, 15 bp, Homo sapiens
tggagatgctttcag

SEQ ID NO: 367507 - DNA, 15 bp, Homo sapiens
ggagatgctttcaga

SEQ ID NO: 367508 - DNA, 15 bp, Homo sapiens
gagatgctttcagat

SEQ ID NO: 367509 - DNA, 15 bp, Homo sapiens
agatgctttcagata

SEQ ID NO: 367510 - DNA, 15 bp, Homo sapiens
gatgctttcagataa

SEQ ID NO: 367511 - DNA, 15 bp, Homo sapiens
atgctttcagataaa

SEQ ID NO: 367512 - DNA, 15 bp, Homo sapiens
tgctttcagataaaa

SEQ ID NO: 367513 - DNA, 15 bp, Homo sapiens
gctttcagataaaag

SEQ ID NO: 367514 - DNA, 15 bp, Homo sapiens
ctttcagataaaagt

SEQ ID NO: 367515 - DNA, 15 bp, Homo sapiens
tttcagataaaagtc

SEQ ID NO: 367516 - DNA, 15 bp, Homo sapiens
ttcagataaaagtct

SEQ ID NO: 367517 - DNA, 15 bp, Homo sapiens
tcagataaaagtctg

SEQ ID NO: 367518 - DNA, 15 bp, Homo sapiens
cagataaaagtctga

SEQ ID NO: 367519 - DNA, 15 bp, Homo sapiens
agataaaagtctgag

SEQ ID NO: 367520 - DNA, 15 bp, Homo sapiens
gataaaagtctgagt

SEQ ID NO: 367521 - DNA, 15 bp, Homo sapiens
ataaaagtctgagtt

SEQ ID NO: 367522 - DNA, 15 bp, Homo sapiens
taaaagtctgagttt

SEQ ID NO: 367523 - DNA, 15 bp, Homo sapiens
aaaagtctgagttta

SEQ ID NO: 367524 - DNA, 15 bp, Homo sapiens
aaagtctgagtttac

SEQ ID NO: 367525 - DNA, 15 bp, Homo sapiens
aagtctgagtttacc

SEQ ID NO: 367526 - DNA, 15 bp, Homo sapiens
agtctgagtttacct

SEQ ID NO: 367527 - DNA, 15 bp, Homo sapiens
gtctgagtttacctg

SEQ ID NO: 367528 - DNA, 15 bp, Homo sapiens
tctgagtttacctga

SEQ ID NO: 367529 - DNA, 15 bp, Homo sapiens
ctgagtttacctgaa

SEQ ID NO: 367530 - DNA, 15 bp, Homo sapiens
tgagtttacctgaaa

SEQ ID NO: 367531 - DNA, 15 bp, Homo sapiens
gagtttacctgaaag

SEQ ID NO: 367532 - DNA, 15 bp, Homo sapiens
agtttacctgaaagg

SEQ ID NO: 367533 - DNA, 15 bp, Homo sapiens
gtttacctgaaaggg

SEQ ID NO: 367534 - DNA, 15 bp, Homo sapiens
tttacctgaaaggga

SEQ ID NO: 367535 - DNA, 15 bp, Homo sapiens
ttacctgaaagggat

SEQ ID NO: 367536 - DNA, 15 bp, Homo sapiens
tacctgaaagggata

SEQ ID NO: 367537 - DNA, 15 bp, Homo sapiens
acctgaaagggataa

SEQ ID NO: 367538 - DNA, 15 bp, Homo sapiens
cctgaaagggataaa

SEQ ID NO: 367539 - DNA, 15 bp, Homo sapiens
ctgaaagggataaaa

SEQ ID NO: 367540 - DNA, 15 bp, Homo sapiens
tgaaagggataaaat

SEQ ID NO: 367541 - DNA, 15 bp, Homo sapiens
gaaagggataaaatt

SEQ ID NO: 367542 - DNA, 15 bp, Homo sapiens
aaagggataaaattt

SEQ ID NO: 367543 - DNA, 15 bp, Homo sapiens
aagggataaaatttc

SEQ ID NO: 367544 - DNA, 15 bp, Homo sapiens
agggataaaatttca

SEQ ID NO: 367545 - DNA, 15 bp, Homo sapiens
gggataaaatttcag

SEQ ID NO: 367546 - DNA, 15 bp, Homo sapiens
ggataaaatttcaga

SEQ ID NO: 367547 - DNA, 15 bp, Homo sapiens
gataaaatttcagaa

SEQ ID NO: 367548 - DNA, 15 bp, Homo sapiens
ataaaatttcagaaa

SEQ ID NO: 367549 - DNA, 15 bp, Homo sapiens
taaaatttcagaaag

SEQ ID NO: 367550 - DNA, 15 bp, Homo sapiens
aaaatttcagaaagc

SEQ ID NO: 367551 - DNA, 15 bp, Homo sapiens
aaatttcagaaagct

SEQ ID NO: 367552 - DNA, 15 bp, Homo sapiens
aatttcagaaagctt

SEQ ID NO: 367553 - DNA, 15 bp, Homo sapiens
atttcagaaagctta

SEQ ID NO: 367554 - DNA, 15 bp, Homo sapiens
tttcagaaagcttaa

SEQ ID NO: 367555 - DNA, 15 bp, Homo sapiens
ttcagaaagcttaag

SEQ ID NO: 367556 - DNA, 15 bp, Homo sapiens
tcagaaagcttaagg

SEQ ID NO: 367557 - DNA, 15 bp, Homo sapiens
cagaaagcttaagga

SEQ ID NO: 367558 - DNA, 15 bp, Homo sapiens
agaaagcttaaggac

SEQ ID NO: 367559 - DNA, 15 bp, Homo sapiens
gaaagcttaaggact

SEQ ID NO: 367560 - DNA, 15 bp, Homo sapiens
aaagcttaaggactg

SEQ ID NO: 367561 - DNA, 15 bp, Homo sapiens
aagcttaaggactgt

SEQ ID NO: 367562 - DNA, 15 bp, Homo sapiens
agcttaaggactgta

SEQ ID NO: 367563 - DNA, 15 bp, Homo sapiens
gcttaaggactgtaa

SEQ ID NO: 367564 - DNA, 15 bp, Homo sapiens
cttaaggactgtaaa

SEQ ID NO: 367565 - DNA, 15 bp, Homo sapiens
ttaaggactgtaaat

SEQ ID NO: 367566 - DNA, 15 bp, Homo sapiens
taaggactgtaaata

SEQ ID NO: 367567 - DNA, 15 bp, Homo sapiens
aaggactgtaaatat

SEQ ID NO: 367568 - DNA, 15 bp, Homo sapiens
aggactgtaaatatg

SEQ ID NO: 367569 - DNA, 15 bp, Homo sapiens
ggactgtaaatatga

SEQ ID NO: 367570 - DNA, 15 bp, Homo sapiens
gactgtaaatatgac

SEQ ID NO: 367571 - DNA, 15 bp, Homo sapiens
actgtaaatatgaca

SEQ ID NO: 367572 - DNA, 15 bp, Homo sapiens
ctgtaaatatgacat

SEQ ID NO: 367573 - DNA, 15 bp, Homo sapiens
tgtaaatatgacatg

SEQ ID NO: 367574 - DNA, 15 bp, Homo sapiens
gtaaatatgacatgg

SEQ ID NO: 367575 - DNA, 15 bp, Homo sapiens
taaatatgacatgga

SEQ ID NO: 367576 - DNA, 15 bp, Homo sapiens
aaatatgacatggaa

SEQ ID NO: 367577 - DNA, 15 bp, Homo sapiens
aatatgacatggaat

SEQ ID NO: 367578 - DNA, 15 bp, Homo sapiens
atatgacatggaata

SEQ ID NO: 367579 - DNA, 15 bp, Homo sapiens
tatgacatggaataa

SEQ ID NO: 367580 - DNA, 15 bp, Homo sapiens
atgacatggaataag

SEQ ID NO: 367581 - DNA, 15 bp, Homo sapiens
tgacatggaataagg

SEQ ID NO: 367582 - DNA, 15 bp, Homo sapiens
gacatggaataaggt

SEQ ID NO: 367583 - DNA, 15 bp, Homo sapiens
acatggaataaggtg

SEQ ID NO: 367584 - DNA, 15 bp, Homo sapiens
catggaataaggtgt

SEQ ID NO: 367585 - DNA, 15 bp, Homo sapiens
atggaataaggtgtg

SEQ ID NO: 367586 - DNA, 15 bp, Homo sapiens
tggaataaggtgtgt

SEQ ID NO: 367587 - DNA, 15 bp, Homo sapiens
ggaataaggtgtgtg

SEQ ID NO: 367588 - DNA, 15 bp, Homo sapiens
gaataaggtgtgtgt

SEQ ID NO: 367589 - DNA, 15 bp, Homo sapiens
aataaggtgtgtgta

SEQ ID NO: 367590 - DNA, 15 bp, Homo sapiens
ataaggtgtgtgtaa

SEQ ID NO: 367591 - DNA, 15 bp, Homo sapiens
taaggtgtgtgtaaa

SEQ ID NO: 367592 - DNA, 15 bp, Homo sapiens
aaggtgtgtgtaaag

SEQ ID NO: 367593 - DNA, 15 bp, Homo sapiens
aggtgtgtgtaaagt

SEQ ID NO: 367594 - DNA, 15 bp, Homo sapiens
ggtgtgtgtaaagtt

SEQ ID NO: 367595 - DNA, 15 bp, Homo sapiens
gtgtgtgtaaagtta

SEQ ID NO: 367596 - DNA, 15 bp, Homo sapiens
tgtgtgtaaagttac

SEQ ID NO: 367597 - DNA, 15 bp, Homo sapiens
gtgtgtaaagttact

SEQ ID NO: 367598 - DNA, 15 bp, Homo sapiens
tgtgtaaagttacta

SEQ ID NO: 367599 - DNA, 15 bp, Homo sapiens
gtgtaaagttactat

SEQ ID NO: 367600 - DNA, 15 bp, Homo sapiens
tgtaaagttactatc

SEQ ID NO: 367601 - DNA, 15 bp, Homo sapiens
gtaaagttactatca

SEQ ID NO: 367602 - DNA, 15 bp, Homo sapiens
taaagttactatcac

SEQ ID NO: 367603 - DNA, 15 bp, Homo sapiens
aaagttactatcaca

SEQ ID NO: 367604 - DNA, 15 bp, Homo sapiens
aagttactatcacac

SEQ ID NO: 367605 - DNA, 15 bp, Homo sapiens
agttactatcacaca

SEQ ID NO: 367606 - DNA, 15 bp, Homo sapiens
gttactatcacacat

SEQ ID NO: 367607 - DNA, 15 bp, Homo sapiens
ttactatcacacatt

SEQ ID NO: 367608 - DNA, 15 bp, Homo sapiens
tactatcacacattt

SEQ ID NO: 367609 - DNA, 15 bp, Homo sapiens
actatcacacatttc

SEQ ID NO: 367610 - DNA, 15 bp, Homo sapiens
ctatcacacatttct

SEQ ID NO: 367611 - DNA, 15 bp, Homo sapiens
tatcacacatttctc

SEQ ID NO: 367612 - DNA, 15 bp, Homo sapiens
atcacacatttctca

SEQ ID NO: 367613 - DNA, 15 bp, Homo sapiens
tcacacatttctcat

SEQ ID NO: 367614 - DNA, 15 bp, Homo sapiens
cacacatttctcata

SEQ ID NO: 367615 - DNA, 15 bp, Homo sapiens
acacatttctcatat

SEQ ID NO: 367616 - DNA, 15 bp, Homo sapiens
acatttctcatattt

SEQ ID NO: 367617 - DNA, 15 bp, Homo sapiens
catttctcatattta

SEQ ID NO: 367618 - DNA, 15 bp, Homo sapiens
atttctcatatttat

SEQ ID NO: 367619 - DNA, 15 bp, Homo sapiens
tttctcatatttatt

SEQ ID NO: 367620 - DNA, 15 bp, Homo sapiens
ttctcatatttattg

SEQ ID NO: 367621 - DNA, 15 bp, Homo sapiens
tctcatatttattga

SEQ ID NO: 367622 - DNA, 15 bp, Homo sapiens
ctcatatttattgat

SEQ ID NO: 367623 - DNA, 15 bp, Homo sapiens
tcatatttattgatt

SEQ ID NO: 367624 - DNA, 15 bp, Homo sapiens
catatttattgattt

SEQ ID NO: 367625 - DNA, 15 bp, Homo sapiens
atatttattgatttt

SEQ ID NO: 367626 - DNA, 15 bp, Homo sapiens
tatttattgattttg

SEQ ID NO: 367627 - DNA, 15 bp, Homo sapiens
atttattgattttgt

SEQ ID NO: 367628 - DNA, 15 bp, Homo sapiens
tttattgattttgtt

SEQ ID NO: 367629 - DNA, 15 bp, Homo sapiens
ttattgattttgttg

SEQ ID NO: 367630 - DNA, 15 bp, Homo sapiens
tattgattttgttgt

SEQ ID NO: 367631 - DNA, 15 bp, Homo sapiens
attgattttgttgtc

SEQ ID NO: 367632 - DNA, 15 bp, Homo sapiens
ttgattttgttgtca

SEQ ID NO: 367633 - DNA, 15 bp, Homo sapiens
tgattttgttgtcag

SEQ ID NO: 367634 - DNA, 15 bp, Homo sapiens
gattttgttgtcaga

SEQ ID NO: 367635 - DNA, 15 bp, Homo sapiens
attttgttgtcagag

SEQ ID NO: 367636 - DNA, 15 bp, Homo sapiens
ttttgttgtcagaga

SEQ ID NO: 367637 - DNA, 15 bp, Homo sapiens
tttgttgtcagagat

SEQ ID NO: 367638 - DNA, 15 bp, Homo sapiens
ttgttgtcagagatg

SEQ ID NO: 367639 - DNA, 15 bp, Homo sapiens
tgttgtcagagatgt

SEQ ID NO: 367640 - DNA, 15 bp, Homo sapiens
gttgtcagagatgtg

SEQ ID NO: 367641 - DNA, 15 bp, Homo sapiens
ttgtcagagatgtgg

SEQ ID NO: 367642 - DNA, 15 bp, Homo sapiens
tgtcagagatgtggg

SEQ ID NO: 367643 - DNA, 15 bp, Homo sapiens
gtcagagatgtggga

SEQ ID NO: 367644 - DNA, 15 bp, Homo sapiens
tcagagatgtgggat

SEQ ID NO: 367645 - DNA, 15 bp, Homo sapiens
cagagatgtgggatc

SEQ ID NO: 367646 - DNA, 15 bp, Homo sapiens
agagatgtgggatca

SEQ ID NO: 367647 - DNA, 15 bp, Homo sapiens
gagatgtgggatcat

SEQ ID NO: 367648 - DNA, 15 bp, Homo sapiens
agatgtgggatcatg

SEQ ID NO: 367649 - DNA, 15 bp, Homo sapiens
gatgtgggatcatgt

SEQ ID NO: 367650 - DNA, 15 bp, Homo sapiens
atgtgggatcatgta

SEQ ID NO: 367651 - DNA, 15 bp, Homo sapiens
tgtgggatcatgtaa

SEQ ID NO: 367652 - DNA, 15 bp, Homo sapiens
gtgggatcatgtaac

SEQ ID NO: 367653 - DNA, 15 bp, Homo sapiens
tgggatcatgtaact

SEQ ID NO: 367654 - DNA, 15 bp, Homo sapiens
gggatcatgtaactg

SEQ ID NO: 367655 - DNA, 15 bp, Homo sapiens
ggatcatgtaactgc

SEQ ID NO: 367656 - DNA, 15 bp, Homo sapiens
gatcatgtaactgct

SEQ ID NO: 367657 - DNA, 15 bp, Homo sapiens
atcatgtaactgctt

SEQ ID NO: 367658 - DNA, 15 bp, Homo sapiens
tcatgtaactgcttt

SEQ ID NO: 367659 - DNA, 15 bp, Homo sapiens
catgtaactgcttta

SEQ ID NO: 367660 - DNA, 15 bp, Homo sapiens
tgtaactgctttact

SEQ ID NO: 367661 - DNA, 15 bp, Homo sapiens
gtaactgctttactt

SEQ ID NO: 367662 - DNA, 15 bp, Homo sapiens
taactgctttacttt

SEQ ID NO: 367663 - DNA, 15 bp, Homo sapiens
aactgctttactttc

SEQ ID NO: 367664 - DNA, 15 bp, Homo sapiens
actgctttactttca

SEQ ID NO: 367665 - DNA, 15 bp, Homo sapiens
ctgctttactttcaa

SEQ ID NO: 367666 - DNA, 15 bp, Homo sapiens
tgctttactttcaag

SEQ ID NO: 367667 - DNA, 15 bp, Homo sapiens
gctttactttcaagt

SEQ ID NO: 367668 - DNA, 15 bp, Homo sapiens
ctttactttcaagta

SEQ ID NO: 367669 - DNA, 15 bp, Homo sapiens
tttactttcaagtat

SEQ ID NO: 367670 - DNA, 15 bp, Homo sapiens
ttactttcaagtatg

SEQ ID NO: 367671 - DNA, 15 bp, Homo sapiens
tactttcaagtatgt

SEQ ID NO: 367672 - DNA, 15 bp, Homo sapiens
actttcaagtatgtc

SEQ ID NO: 367673 - DNA, 15 bp, Homo sapiens
ctttcaagtatgtcc

SEQ ID NO: 367674 - DNA, 15 bp, Homo sapiens
tttcaagtatgtcca

SEQ ID NO: 367675 - DNA, 15 bp, Homo sapiens
ttcaagtatgtccaa

SEQ ID NO: 367676 - DNA, 15 bp, Homo sapiens
tcaagtatgtccaaa

SEQ ID NO: 367677 - DNA, 15 bp, Homo sapiens
caagtatgtccaaat

SEQ ID NO: 367678 - DNA, 15 bp, Homo sapiens
aagtatgtccaaatg

SEQ ID NO: 367679 - DNA, 15 bp, Homo sapiens
agtatgtccaaatgg

SEQ ID NO: 367680 - DNA, 15 bp, Homo sapiens
gtatgtccaaatggg

SEQ ID NO: 367681 - DNA, 15 bp, Homo sapiens
tatgtccaaatgggg

SEQ ID NO: 367682 - DNA, 15 bp, Homo sapiens
atgtccaaatggggc

SEQ ID NO: 367683 - DNA, 15 bp, Homo sapiens
tgtccaaatggggca

SEQ ID NO: 367684 - DNA, 15 bp, Homo sapiens
gtccaaatggggcaa

SEQ ID NO: 367685 - DNA, 15 bp, Homo sapiens
tccaaatggggcaaa

SEQ ID NO: 367686 - DNA, 15 bp, Homo sapiens
ccaaatggggcaaat

SEQ ID NO: 367687 - DNA, 15 bp, Homo sapiens
caaatggggcaaatt

SEQ ID NO: 367688 - DNA, 15 bp, Homo sapiens
aaatggggcaaattt

SEQ ID NO: 367689 - DNA, 15 bp, Homo sapiens
aatggggcaaatttt

SEQ ID NO: 367690 - DNA, 15 bp, Homo sapiens
atggggcaaatttta

SEQ ID NO: 367691 - DNA, 15 bp, Homo sapiens
tggggcaaattttac

SEQ ID NO: 367692 - DNA, 15 bp, Homo sapiens
ggggcaaattttact

SEQ ID NO: 367693 - DNA, 15 bp, Homo sapiens
gggcaaattttacta

SEQ ID NO: 367694 - DNA, 15 bp, Homo sapiens
ggcaaattttactaa

SEQ ID NO: 367695 - DNA, 15 bp, Homo sapiens
gcaaattttactaaa

SEQ ID NO: 367696 - DNA, 15 bp, Homo sapiens
caaattttactaaag

SEQ ID NO: 367697 - DNA, 15 bp, Homo sapiens
aaattttactaaagc

SEQ ID NO: 367698 - DNA, 15 bp, Homo sapiens
aattttactaaagct

SEQ ID NO: 367699 - DNA, 15 bp, Homo sapiens
attttactaaagctt

SEQ ID NO: 367700 - DNA, 15 bp, Homo sapiens
ttttactaaagctta

SEQ ID NO: 367701 - DNA, 15 bp, Homo sapiens
tttactaaagcttac

SEQ ID NO: 367702 - DNA, 15 bp, Homo sapiens
ttactaaagcttact

SEQ ID NO: 367703 - DNA, 15 bp, Homo sapiens
tactaaagcttacta

SEQ ID NO: 367704 - DNA, 15 bp, Homo sapiens
actaaagcttactaa

SEQ ID NO: 367705 - DNA, 15 bp, Homo sapiens
ctaaagcttactaat

SEQ ID NO: 367706 - DNA, 15 bp, Homo sapiens
taaagcttactaatg

SEQ ID NO: 367707 - DNA, 15 bp, Homo sapiens
aaagcttactaatgt

SEQ ID NO: 367708 - DNA, 15 bp, Homo sapiens
aagcttactaatgtt

SEQ ID NO: 367709 - DNA, 15 bp, Homo sapiens
agcttactaatgttt

SEQ ID NO: 367710 - DNA, 15 bp, Homo sapiens
gcttactaatgttta

SEQ ID NO: 367711 - DNA, 15 bp, Homo sapiens
cttactaatgtttat

SEQ ID NO: 367712 - DNA, 15 bp, Homo sapiens
ttactaatgtttata

SEQ ID NO: 367713 - DNA, 15 bp, Homo sapiens
tactaatgtttatat

SEQ ID NO: 367714 - DNA, 15 bp, Homo sapiens
actaatgtttatatt

SEQ ID NO: 367715 - DNA, 15 bp, Homo sapiens
ctaatgtttatattt

SEQ ID NO: 367716 - DNA, 15 bp, Homo sapiens
taatgtttatatttt

SEQ ID NO: 367717 - DNA, 15 bp, Homo sapiens
aatgtttatattttt

SEQ ID NO: 367718 - DNA, 15 bp, Homo sapiens
atgtttatatttttt

SEQ ID NO: 367719 - DNA, 15 bp, Homo sapiens
tgtttatatttttta

SEQ ID NO: 367720 - DNA, 15 bp, Homo sapiens
gtttatattttttat

SEQ ID NO: 367721 - DNA, 15 bp, Homo sapiens
tttatattttttatc

SEQ ID NO: 367722 - DNA, 15 bp, Homo sapiens
ttatattttttatct

SEQ ID NO: 367723 - DNA, 15 bp, Homo sapiens
tatattttttatctg

SEQ ID NO: 367724 - DNA, 15 bp, Homo sapiens
atattttttatctgt

SEQ ID NO: 367725 - DNA, 15 bp, Homo sapiens
tattttttatctgtc

SEQ ID NO: 367726 - DNA, 15 bp, Homo sapiens
attttttatctgtca

SEQ ID NO: 367727 - DNA, 15 bp, Homo sapiens
ttttttatctgtcat

SEQ ID NO: 367728 - DNA, 15 bp, Homo sapiens
tttttatctgtcata

SEQ ID NO: 367729 - DNA, 15 bp, Homo sapiens
ttttatctgtcatag

SEQ ID NO: 367730 - DNA, 15 bp, Homo sapiens
tttatctgtcataga

SEQ ID NO: 367731 - DNA, 15 bp, Homo sapiens
ttatctgtcatagac

SEQ ID NO: 367732 - DNA, 15 bp, Homo sapiens
tatctgtcatagaca

SEQ ID NO: 367733 - DNA, 15 bp, Homo sapiens
atctgtcatagacag

SEQ ID NO: 367734 - DNA, 15 bp, Homo sapiens
tctgtcatagacaga

SEQ ID NO: 367735 - DNA, 15 bp, Homo sapiens
ctgtcatagacagag

SEQ ID NO: 367736 - DNA, 15 bp, Homo sapiens
tgtcatagacagagg

SEQ ID NO: 367737 - DNA, 15 bp, Homo sapiens
gtcatagacagaggc

SEQ ID NO: 367738 - DNA, 15 bp, Homo sapiens
tcatagacagaggca

SEQ ID NO: 367739 - DNA, 15 bp, Homo sapiens
catagacagaggcat

SEQ ID NO: 367740 - DNA, 15 bp, Homo sapiens
atagacagaggcata

SEQ ID NO: 367741 - DNA, 15 bp, Homo sapiens
tagacagaggcatat

SEQ ID NO: 367742 - DNA, 15 bp, Homo sapiens
agacagaggcatata

SEQ ID NO: 367743 - DNA, 15 bp, Homo sapiens
gacagaggcatatat

SEQ ID NO: 367744 - DNA, 15 bp, Homo sapiens
acagaggcatatatt

SEQ ID NO: 367745 - DNA, 15 bp, Homo sapiens
cagaggcatatattc

SEQ ID NO: 367746 - DNA, 15 bp, Homo sapiens
agaggcatatattct

SEQ ID NO: 367747 - DNA, 15 bp, Homo sapiens
gaggcatatattcta

SEQ ID NO: 367748 - DNA, 15 bp, Homo sapiens
aggcatatattctag

SEQ ID NO: 367749 - DNA, 15 bp, Homo sapiens
ggcatatattctaga

SEQ ID NO: 367750 - DNA, 15 bp, Homo sapiens
gcatatattctagaa

SEQ ID NO: 367751 - DNA, 15 bp, Homo sapiens
catatattctagaag

SEQ ID NO: 367752 - DNA, 15 bp, Homo sapiens
atatattctagaaga

SEQ ID NO: 367753 - DNA, 15 bp, Homo sapiens
tatattctagaagaa

SEQ ID NO: 367754 - DNA, 15 bp, Homo sapiens
atattctagaagaat

SEQ ID NO: 367755 - DNA, 15 bp, Homo sapiens
tattctagaagaata

SEQ ID NO: 367756 - DNA, 15 bp, Homo sapiens
attctagaagaatac

SEQ ID NO: 367757 - DNA, 15 bp, Homo sapiens
ttctagaagaatact

SEQ ID NO: 367758 - DNA, 15 bp, Homo sapiens
tctagaagaatactt

SEQ ID NO: 367759 - DNA, 15 bp, Homo sapiens
ctagaagaatacttt

SEQ ID NO: 367760 - DNA, 15 bp, Homo sapiens
tagaagaatactttt

SEQ ID NO: 367761 - DNA, 15 bp, Homo sapiens
agaagaatacttttt

SEQ ID NO: 367762 - DNA, 15 bp, Homo sapiens
gaagaatacttttta

SEQ ID NO: 367763 - DNA, 15 bp, Homo sapiens
aagaatactttttat

SEQ ID NO: 367764 - DNA, 15 bp, Homo sapiens
agaatactttttatt

SEQ ID NO: 367765 - DNA, 15 bp, Homo sapiens
gaatactttttattt

SEQ ID NO: 367766 - DNA, 15 bp, Homo sapiens
aatactttttatttt

SEQ ID NO: 367767 - DNA, 15 bp, Homo sapiens
atactttttatttta

SEQ ID NO: 367768 - DNA, 15 bp, Homo sapiens
tactttttattttat

SEQ ID NO: 367769 - DNA, 15 bp, Homo sapiens
actttttattttata

SEQ ID NO: 367770 - DNA, 15 bp, Homo sapiens
ctttttattttatac

SEQ ID NO: 367771 - DNA, 15 bp, Homo sapiens
tttttattttataca

SEQ ID NO: 367772 - DNA, 15 bp, Homo sapiens
ttttattttatacag

SEQ ID NO: 367773 - DNA, 15 bp, Homo sapiens
tttattttatacaga

SEQ ID NO: 367774 - DNA, 15 bp, Homo sapiens
ttattttatacagaa

SEQ ID NO: 367775 - DNA, 15 bp, Homo sapiens
tattttatacagaac

SEQ ID NO: 367776 - DNA, 15 bp, Homo sapiens
attttatacagaact

SEQ ID NO: 367777 - DNA, 15 bp, Homo sapiens
ttttatacagaactc

SEQ ID NO: 367778 - DNA, 15 bp, Homo sapiens
tttatacagaactct

SEQ ID NO: 367779 - DNA, 15 bp, Homo sapiens
ttatacagaactctt

SEQ ID NO: 367780 - DNA, 15 bp, Homo sapiens
tatacagaactcttt

SEQ ID NO: 367781 - DNA, 15 bp, Homo sapiens
atacagaactctttg

SEQ ID NO: 367782 - DNA, 15 bp, Homo sapiens
tacagaactctttgg

SEQ ID NO: 367783 - DNA, 15 bp, Homo sapiens
acagaactctttggc

SEQ ID NO: 367784 - DNA, 15 bp, Homo sapiens
cagaactctttggcc

SEQ ID NO: 367785 - DNA, 15 bp, Homo sapiens
agaactctttggcct

SEQ ID NO: 367786 - DNA, 15 bp, Homo sapiens
gaactctttggccta

SEQ ID NO: 367787 - DNA, 15 bp, Homo sapiens
aactctttggcctag

SEQ ID NO: 367788 - DNA, 15 bp, Homo sapiens
actctttggcctagg

SEQ ID NO: 367789 - DNA, 15 bp, Homo sapiens
ctctttggcctaggg

SEQ ID NO: 367790 - DNA, 15 bp, Homo sapiens
tctttggcctagggg

SEQ ID NO: 367791 - DNA, 15 bp, Homo sapiens
ctttggcctagggga

SEQ ID NO: 367792 - DNA, 15 bp, Homo sapiens
tttggcctaggggat

SEQ ID NO: 367793 - DNA, 15 bp, Homo sapiens
ttggcctaggggatt

SEQ ID NO: 367794 - DNA, 15 bp, Homo sapiens
tggcctaggggattt

SEQ ID NO: 367795 - DNA, 15 bp, Homo sapiens
ggcctaggggattta

SEQ ID NO: 367796 - DNA, 15 bp, Homo sapiens
gcctaggggatttat

SEQ ID NO: 367797 - DNA, 15 bp, Homo sapiens
cctaggggatttata

SEQ ID NO: 367798 - DNA, 15 bp, Homo sapiens
ctaggggatttatac

SEQ ID NO: 367799 - DNA, 15 bp, Homo sapiens
taggggatttataca

SEQ ID NO: 367800 - DNA, 15 bp, Homo sapiens
aggggatttatacat

SEQ ID NO: 367801 - DNA, 15 bp, Homo sapiens
ggggatttatacatt

SEQ ID NO: 367802 - DNA, 15 bp, Homo sapiens
gggatttatacatta

SEQ ID NO: 367803 - DNA, 15 bp, Homo sapiens
ggatttatacattat

SEQ ID NO: 367804 - DNA, 15 bp, Homo sapiens
gatttatacattata

SEQ ID NO: 367805 - DNA, 15 bp, Homo sapiens
atttatacattatat

SEQ ID NO: 367806 - DNA, 15 bp, Homo sapiens
tttatacattatata

SEQ ID NO: 367807 - DNA, 15 bp, Homo sapiens
ttatacattatatac

SEQ ID NO: 367808 - DNA, 15 bp, Homo sapiens
tatacattatatact

SEQ ID NO: 367809 - DNA, 15 bp, Homo sapiens
atacattatatacta

SEQ ID NO: 367810 - DNA, 15 bp, Homo sapiens
tacattatatactac

SEQ ID NO: 367811 - DNA, 15 bp, Homo sapiens
acattatatactaca

SEQ ID NO: 367812 - DNA, 15 bp, Homo sapiens
cattatatactacat

SEQ ID NO: 367813 - DNA, 15 bp, Homo sapiens
attatatactacatt

SEQ ID NO: 367814 - DNA, 15 bp, Homo sapiens
ttatatactacatta

SEQ ID NO: 367815 - DNA, 15 bp, Homo sapiens
tatatactacattaa

SEQ ID NO: 367816 - DNA, 15 bp, Homo sapiens
atatactacattaaa

SEQ ID NO: 367817 - DNA, 15 bp, Homo sapiens
tatactacattaaat

SEQ ID NO: 367818 - DNA, 15 bp, Homo sapiens
atactacattaaata

SEQ ID NO: 367819 - DNA, 15 bp, Homo sapiens
tactacattaaataa

SEQ ID NO: 367820 - DNA, 15 bp, Homo sapiens
actacattaaataat

SEQ ID NO: 367821 - DNA, 15 bp, Homo sapiens
ctacattaaataatg

SEQ ID NO: 367822 - DNA, 15 bp, Homo sapiens
tacattaaataatga

SEQ ID NO: 367823 - DNA, 15 bp, Homo sapiens
acattaaataatgaa

SEQ ID NO: 367824 - DNA, 15 bp, Homo sapiens
cattaaataatgaat

SEQ ID NO: 367825 - DNA, 15 bp, Homo sapiens
attaaataatgaata

SEQ ID NO: 367826 - DNA, 15 bp, Homo sapiens
ttaaataatgaatat

SEQ ID NO: 367827 - DNA, 15 bp, Homo sapiens
taaataatgaatata

SEQ ID NO: 367828 - DNA, 15 bp, Homo sapiens
aaataatgaatatat

SEQ ID NO: 367829 - DNA, 15 bp, Homo sapiens
aataatgaatatatg

SEQ ID NO: 367830 - DNA, 15 bp, Homo sapiens
ataatgaatatatgt

SEQ ID NO: 367831 - DNA, 15 bp, Homo sapiens
taatgaatatatgtt

SEQ ID NO: 367832 - DNA, 15 bp, Homo sapiens
aatgaatatatgttg

SEQ ID NO: 367833 - DNA, 15 bp, Homo sapiens
atgaatatatgttgg

SEQ ID NO: 367834 - DNA, 15 bp, Homo sapiens
tgaatatatgttgga

SEQ ID NO: 367835 - DNA, 15 bp, Homo sapiens
gaatatatgttggaa

SEQ ID NO: 367836 - DNA, 15 bp, Homo sapiens
aatatatgttggaat

SEQ ID NO: 367837 - DNA, 15 bp, Homo sapiens
atatatgttggaatt

SEQ ID NO: 367838 - DNA, 15 bp, Homo sapiens
tatatgttggaatta

SEQ ID NO: 367839 - DNA, 15 bp, Homo sapiens
atatgttggaattag

SEQ ID NO: 367840 - DNA, 15 bp, Homo sapiens
tatgttggaattagt

SEQ ID NO: 367841 - DNA, 15 bp, Homo sapiens
atgttggaattagta

SEQ ID NO: 367842 - DNA, 15 bp, Homo sapiens
tgttggaattagtaa

SEQ ID NO: 367843 - DNA, 15 bp, Homo sapiens
gttggaattagtaag

SEQ ID NO: 367844 - DNA, 15 bp, Homo sapiens
ttggaattagtaaga

SEQ ID NO: 367845 - DNA, 15 bp, Homo sapiens
tggaattagtaagaa

SEQ ID NO: 367846 - DNA, 15 bp, Homo sapiens
ggaattagtaagaaa

SEQ ID NO: 367847 - DNA, 15 bp, Homo sapiens
gaattagtaagaaaa

SEQ ID NO: 367848 - DNA, 15 bp, Homo sapiens
aattagtaagaaaat

SEQ ID NO: 367849 - DNA, 15 bp, Homo sapiens
attagtaagaaaatt

SEQ ID NO: 367850 - DNA, 15 bp, Homo sapiens
ttagtaagaaaattc

SEQ ID NO: 367851 - DNA, 15 bp, Homo sapiens
tagtaagaaaattcc

SEQ ID NO: 367852 - DNA, 15 bp, Homo sapiens
agtaagaaaattcca

SEQ ID NO: 367853 - DNA, 15 bp, Homo sapiens
gtaagaaaattccag

SEQ ID NO: 367854 - DNA, 15 bp, Homo sapiens
taagaaaattccagt

SEQ ID NO: 367855 - DNA, 15 bp, Homo sapiens
aagaaaattccagtg

SEQ ID NO: 367856 - DNA, 15 bp, Homo sapiens
agaaaattccagtga

SEQ ID NO: 367857 - DNA, 15 bp, Homo sapiens
gaaaattccagtgat

SEQ ID NO: 367858 - DNA, 15 bp, Homo sapiens
aaaattccagtgatg

SEQ ID NO: 367859 - DNA, 15 bp, Homo sapiens
aaattccagtgatga

SEQ ID NO: 367860 - DNA, 15 bp, Homo sapiens
aattccagtgatgat

SEQ ID NO: 367861 - DNA, 15 bp, Homo sapiens
attccagtgatgata

SEQ ID NO: 367862 - DNA, 15 bp, Homo sapiens
ttccagtgatgatat

SEQ ID NO: 367863 - DNA, 15 bp, Homo sapiens
tccagtgatgatatt

SEQ ID NO: 367864 - DNA, 15 bp, Homo sapiens
ccagtgatgatattc

SEQ ID NO: 367865 - DNA, 15 bp, Homo sapiens
cagtgatgatattct

SEQ ID NO: 367866 - DNA, 15 bp, Homo sapiens
agtgatgatattctg

SEQ ID NO: 367867 - DNA, 15 bp, Homo sapiens
gtgatgatattctga

SEQ ID NO: 367868 - DNA, 15 bp, Homo sapiens
tgatgatattctgaa

SEQ ID NO: 367869 - DNA, 15 bp, Homo sapiens
gatgatattctgaaa

SEQ ID NO: 367870 - DNA, 15 bp, Homo sapiens
atgatattctgaaaa

SEQ ID NO: 367871 - DNA, 15 bp, Homo sapiens
tgatattctgaaaat

SEQ ID NO: 367872 - DNA, 15 bp, Homo sapiens
gatattctgaaaatg

SEQ ID NO: 367873 - DNA, 15 bp, Homo sapiens
atattctgaaaatga

SEQ ID NO: 367874 - DNA, 15 bp, Homo sapiens
tattctgaaaatgaa

SEQ ID NO: 367875 - DNA, 15 bp, Homo sapiens
attctgaaaatgaag

SEQ ID NO: 367876 - DNA, 15 bp, Homo sapiens
tctgaaaatgaagac

SEQ ID NO: 367877 - DNA, 15 bp, Homo sapiens
ctgaaaatgaagacc

SEQ ID NO: 367878 - DNA, 15 bp, Homo sapiens
tgaaaatgaagacct

SEQ ID NO: 367879 - DNA, 15 bp, Homo sapiens
gaaaatgaagacctt

SEQ ID NO: 367880 - DNA, 15 bp, Homo sapiens
aaaatgaagacctta

SEQ ID NO: 367881 - DNA, 15 bp, Homo sapiens
aaatgaagaccttaa

SEQ ID NO: 367882 - DNA, 15 bp, Homo sapiens
aatgaagaccttaaa

SEQ ID NO: 367883 - DNA, 15 bp, Homo sapiens
atgaagaccttaaaa

SEQ ID NO: 367884 - DNA, 15 bp, Homo sapiens
tgaagaccttaaaat

SEQ ID NO: 367885 - DNA, 15 bp, Homo sapiens
gaagaccttaaaata

SEQ ID NO: 367886 - DNA, 15 bp, Homo sapiens
aagaccttaaaatag

SEQ ID NO: 367887 - DNA, 15 bp, Homo sapiens
agaccttaaaatagc

SEQ ID NO: 367888 - DNA, 15 bp, Homo sapiens
gaccttaaaatagca

SEQ ID NO: 367889 - DNA, 15 bp, Homo sapiens
accttaaaatagcat

SEQ ID NO: 367890 - DNA, 15 bp, Homo sapiens
ccttaaaatagcatt

SEQ ID NO: 367891 - DNA, 15 bp, Homo sapiens
cttaaaatagcattc

SEQ ID NO: 367892 - DNA, 15 bp, Homo sapiens
ttaaaatagcattct

SEQ ID NO: 367893 - DNA, 15 bp, Homo sapiens
taaaatagcattctg

SEQ ID NO: 367894 - DNA, 15 bp, Homo sapiens
aaaatagcattctga

SEQ ID NO: 367895 - DNA, 15 bp, Homo sapiens
aaatagcattctgag

SEQ ID NO: 367896 - DNA, 15 bp, Homo sapiens
aatagcattctgagc

SEQ ID NO: 367897 - DNA, 15 bp, Homo sapiens
atagcattctgagcc

SEQ ID NO: 367898 - DNA, 15 bp, Homo sapiens
tagcattctgagccg

SEQ ID NO: 367899 - DNA, 15 bp, Homo sapiens
agcattctgagccgg

SEQ ID NO: 367900 - DNA, 15 bp, Homo sapiens
gcattctgagccggg

SEQ ID NO: 367901 - DNA, 15 bp, Homo sapiens
cattctgagccgggt

SEQ ID NO: 367902 - DNA, 15 bp, Homo sapiens
attctgagccgggtg

SEQ ID NO: 367903 - DNA, 15 bp, Homo sapiens
ttctgagccgggtgt

SEQ ID NO: 367904 - DNA, 15 bp, Homo sapiens
tctgagccgggtgtg

SEQ ID NO: 367905 - DNA, 15 bp, Homo sapiens
ctgagccgggtgtgt

SEQ ID NO: 367906 - DNA, 15 bp, Homo sapiens
tgagccgggtgtgtt

SEQ ID NO: 367907 - DNA, 15 bp, Homo sapiens
gagccgggtgtgttg

SEQ ID NO: 367908 - DNA, 15 bp, Homo sapiens
agccgggtgtgttgg

SEQ ID NO: 367909 - DNA, 15 bp, Homo sapiens
gccgggtgtgttggc

SEQ ID NO: 367910 - DNA, 15 bp, Homo sapiens
ccgggtgtgttggct

SEQ ID NO: 367911 - DNA, 15 bp, Homo sapiens
cgggtgtgttggctc

SEQ ID NO: 367912 - DNA, 15 bp, Homo sapiens
gggtgtgttggctca

SEQ ID NO: 367913 - DNA, 15 bp, Homo sapiens
ggtgtgttggctcat

SEQ ID NO: 367914 - DNA, 15 bp, Homo sapiens
gtgtgttggctcata

SEQ ID NO: 367915 - DNA, 15 bp, Homo sapiens
tgtgttggctcatac

SEQ ID NO: 367916 - DNA, 15 bp, Homo sapiens
gtgttggctcatacc

SEQ ID NO: 367917 - DNA, 15 bp, Homo sapiens
tacctgtaatcccaa

SEQ ID NO: 367918 - DNA, 15 bp, Homo sapiens
atcccaacactttga

SEQ ID NO: 367919 - DNA, 15 bp, Homo sapiens
tcccaacactttgag

SEQ ID NO: 367920 - DNA, 15 bp, Homo sapiens
cccaacactttgaga

SEQ ID NO: 367921 - DNA, 15 bp, Homo sapiens
ccaacactttgagag

SEQ ID NO: 367922 - DNA, 15 bp, Homo sapiens
caacactttgagagg

SEQ ID NO: 367923 - DNA, 15 bp, Homo sapiens
aacactttgagaggc

SEQ ID NO: 367924 - DNA, 15 bp, Homo sapiens
acactttgagaggcc

SEQ ID NO: 367925 - DNA, 15 bp, Homo sapiens
cactttgagaggccg

SEQ ID NO: 367926 - DNA, 15 bp, Homo sapiens
actttgagaggccga

SEQ ID NO: 367927 - DNA, 15 bp, Homo sapiens
ctttgagaggccgag

SEQ ID NO: 367928 - DNA, 15 bp, Homo sapiens
tttgagaggccgaga

SEQ ID NO: 367929 - DNA, 15 bp, Homo sapiens
ttgagaggccgagat

SEQ ID NO: 367930 - DNA, 15 bp, Homo sapiens
tgagaggccgagatg

SEQ ID NO: 367931 - DNA, 15 bp, Homo sapiens
gagaggccgagatgg

SEQ ID NO: 367932 - DNA, 15 bp, Homo sapiens
agaggccgagatggg

SEQ ID NO: 367933 - DNA, 15 bp, Homo sapiens
gaggccgagatgggg

SEQ ID NO: 367934 - DNA, 15 bp, Homo sapiens
aggccgagatggggg

SEQ ID NO: 367935 - DNA, 15 bp, Homo sapiens
ggccgagatgggggg

SEQ ID NO: 367936 - DNA, 15 bp, Homo sapiens
gccgagatgggggga

SEQ ID NO: 367937 - DNA, 15 bp, Homo sapiens
ccgagatggggggaa

SEQ ID NO: 367938 - DNA, 15 bp, Homo sapiens
cgagatggggggaat

SEQ ID NO: 367939 - DNA, 15 bp, Homo sapiens
gagatggggggaatc

SEQ ID NO: 367940 - DNA, 15 bp, Homo sapiens
agatggggggaatca

SEQ ID NO: 367941 - DNA, 15 bp, Homo sapiens
gatggggggaatcac

SEQ ID NO: 367942 - DNA, 15 bp, Homo sapiens
atggggggaatcaca

SEQ ID NO: 367943 - DNA, 15 bp, Homo sapiens
tggggggaatcacat

SEQ ID NO: 367944 - DNA, 15 bp, Homo sapiens
ggggggaatcacatg

SEQ ID NO: 367945 - DNA, 15 bp, Homo sapiens
gggggaatcacatga

SEQ ID NO: 367946 - DNA, 15 bp, Homo sapiens
ggggaatcacatgag

SEQ ID NO: 367947 - DNA, 15 bp, Homo sapiens
gggaatcacatgagt

SEQ ID NO: 367948 - DNA, 15 bp, Homo sapiens
ggaatcacatgagtc

SEQ ID NO: 367949 - DNA, 15 bp, Homo sapiens
gaatcacatgagtcc

SEQ ID NO: 367950 - DNA, 15 bp, Homo sapiens
aatcacatgagtcca

SEQ ID NO: 367951 - DNA, 15 bp, Homo sapiens
atcacatgagtccag

SEQ ID NO: 367952 - DNA, 15 bp, Homo sapiens
tcacatgagtccagg

SEQ ID NO: 367953 - DNA, 15 bp, Homo sapiens
cacatgagtccagga

SEQ ID NO: 367954 - DNA, 15 bp, Homo sapiens
acatgagtccaggag

SEQ ID NO: 367955 - DNA, 15 bp, Homo sapiens
catgagtccaggagt

SEQ ID NO: 367956 - DNA, 15 bp, Homo sapiens
atgagtccaggagtt

SEQ ID NO: 367957 - DNA, 15 bp, Homo sapiens
tgagtccaggagttt

SEQ ID NO: 367958 - DNA, 15 bp, Homo sapiens
gagtccaggagtttg

SEQ ID NO: 367959 - DNA, 15 bp, Homo sapiens
agtccaggagtttga

SEQ ID NO: 367960 - DNA, 15 bp, Homo sapiens
gtccaggagtttgag

SEQ ID NO: 367961 - DNA, 15 bp, Homo sapiens
tccaggagtttgaga

SEQ ID NO: 367962 - DNA, 15 bp, Homo sapiens
agcctggccaacaca

SEQ ID NO: 367963 - DNA, 15 bp, Homo sapiens
gcctggccaacacag

SEQ ID NO: 367964 - DNA, 15 bp, Homo sapiens
cctggccaacacagt

SEQ ID NO: 367965 - DNA, 15 bp, Homo sapiens
ctggccaacacagtg

SEQ ID NO: 367966 - DNA, 15 bp, Homo sapiens
tggccaacacagtga

SEQ ID NO: 367967 - DNA, 15 bp, Homo sapiens
ggccaacacagtgaa

SEQ ID NO: 367968 - DNA, 15 bp, Homo sapiens
gccaacacagtgaaa

SEQ ID NO: 367969 - DNA, 15 bp, Homo sapiens
ccaacacagtgaaac

SEQ ID NO: 367970 - DNA, 15 bp, Homo sapiens
caacacagtgaaacc

SEQ ID NO: 367971 - DNA, 15 bp, Homo sapiens
aacacagtgaaaccc

SEQ ID NO: 367972 - DNA, 15 bp, Homo sapiens
acacagtgaaacccc

SEQ ID NO: 367973 - DNA, 15 bp, Homo sapiens
cacagtgaaacccca

SEQ ID NO: 367974 - DNA, 15 bp, Homo sapiens
acagtgaaaccccat

SEQ ID NO: 367975 - DNA, 15 bp, Homo sapiens
cagtgaaaccccatc

SEQ ID NO: 367976 - DNA, 15 bp, Homo sapiens
ccatctctactaaag

SEQ ID NO: 367977 - DNA, 15 bp, Homo sapiens
catctctactaaaga

SEQ ID NO: 367978 - DNA, 15 bp, Homo sapiens
atctctactaaagat

SEQ ID NO: 367979 - DNA, 15 bp, Homo sapiens
tctctactaaagata

SEQ ID NO: 367980 - DNA, 15 bp, Homo sapiens
ctctactaaagatag

SEQ ID NO: 367981 - DNA, 15 bp, Homo sapiens
tctactaaagataga

SEQ ID NO: 367982 - DNA, 15 bp, Homo sapiens
ctactaaagatagaa

SEQ ID NO: 367983 - DNA, 15 bp, Homo sapiens
tactaaagatagaaa

SEQ ID NO: 367984 - DNA, 15 bp, Homo sapiens
actaaagatagaaaa

SEQ ID NO: 367985 - DNA, 15 bp, Homo sapiens
ctaaagatagaaaaa

SEQ ID NO: 367986 - DNA, 15 bp, Homo sapiens
taaagatagaaaaat

SEQ ID NO: 367987 - DNA, 15 bp, Homo sapiens
aaagatagaaaaatt

SEQ ID NO: 367988 - DNA, 15 bp, Homo sapiens
aagatagaaaaattt

SEQ ID NO: 367989 - DNA, 15 bp, Homo sapiens
agatagaaaaatttg

SEQ ID NO: 367990 - DNA, 15 bp, Homo sapiens
gatagaaaaatttgc

SEQ ID NO: 367991 - DNA, 15 bp, Homo sapiens
atagaaaaatttgcc

SEQ ID NO: 367992 - DNA, 15 bp, Homo sapiens
tagaaaaatttgcca

SEQ ID NO: 367993 - DNA, 15 bp, Homo sapiens
agaaaaatttgccag

SEQ ID NO: 367994 - DNA, 15 bp, Homo sapiens
gaaaaatttgccagg

SEQ ID NO: 367995 - DNA, 15 bp, Homo sapiens
aaaaatttgccaggc

SEQ ID NO: 367996 - DNA, 15 bp, Homo sapiens
aaaatttgccaggcg

SEQ ID NO: 367997 - DNA, 15 bp, Homo sapiens
aaatttgccaggcgt

SEQ ID NO: 367998 - DNA, 15 bp, Homo sapiens
aatttgccaggcgta

SEQ ID NO: 367999 - DNA, 15 bp, Homo sapiens
atttgccaggcgtag

SEQ ID NO: 368000 - DNA, 15 bp, Homo sapiens
tttgccaggcgtagt

SEQ ID NO: 368001 - DNA, 15 bp, Homo sapiens
ttgccaggcgtagtg

SEQ ID NO: 368002 - DNA, 15 bp, Homo sapiens
tgccaggcgtagtgg

SEQ ID NO: 368003 - DNA, 15 bp, Homo sapiens
gccaggcgtagtggc

SEQ ID NO: 368004 - DNA, 15 bp, Homo sapiens
ccaggcgtagtggca

SEQ ID NO: 368005 - DNA, 15 bp, Homo sapiens
caggcgtagtggcac

SEQ ID NO: 368006 - DNA, 15 bp, Homo sapiens
aggcgtagtggcaca

SEQ ID NO: 368007 - DNA, 15 bp, Homo sapiens
ggcgtagtggcacac

SEQ ID NO: 368008 - DNA, 15 bp, Homo sapiens
gcgtagtggcacacg

SEQ ID NO: 368009 - DNA, 15 bp, Homo sapiens
cgtagtggcacacgc

SEQ ID NO: 368010 - DNA, 15 bp, Homo sapiens
ggcacacgcctgtaa

SEQ ID NO: 368011 - DNA, 15 bp, Homo sapiens
gcacacgcctgtaat

SEQ ID NO: 368012 - DNA, 15 bp, Homo sapiens
cacacgcctgtaatc

SEQ ID NO: 368013 - DNA, 15 bp, Homo sapiens
acacgcctgtaatcg

SEQ ID NO: 368014 - DNA, 15 bp, Homo sapiens
cacgcctgtaatcgc

SEQ ID NO: 368015 - DNA, 15 bp, Homo sapiens
acgcctgtaatcgca

SEQ ID NO: 368016 - DNA, 15 bp, Homo sapiens
cgcctgtaatcgcag

SEQ ID NO: 368017 - DNA, 15 bp, Homo sapiens
gcctgtaatcgcagc

SEQ ID NO: 368018 - DNA, 15 bp, Homo sapiens
cctgtaatcgcagct

SEQ ID NO: 368019 - DNA, 15 bp, Homo sapiens
ctgtaatcgcagcta

SEQ ID NO: 368020 - DNA, 15 bp, Homo sapiens
tgtaatcgcagctac

SEQ ID NO: 368021 - DNA, 15 bp, Homo sapiens
gtaatcgcagctact

SEQ ID NO: 368022 - DNA, 15 bp, Homo sapiens
taatcgcagctactt

SEQ ID NO: 368023 - DNA, 15 bp, Homo sapiens
aatcgcagctacttg

SEQ ID NO: 368024 - DNA, 15 bp, Homo sapiens
atcgcagctacttgg

SEQ ID NO: 368025 - DNA, 15 bp, Homo sapiens
tcgcagctacttggg

SEQ ID NO: 368026 - DNA, 15 bp, Homo sapiens
cgcagctacttggga

SEQ ID NO: 368027 - DNA, 15 bp, Homo sapiens
gcagctacttgggag

SEQ ID NO: 368028 - DNA, 15 bp, Homo sapiens
gctacttgggaggcc

SEQ ID NO: 368029 - DNA, 15 bp, Homo sapiens
ctacttgggaggccg

SEQ ID NO: 368030 - DNA, 15 bp, Homo sapiens
tacttgggaggccga

SEQ ID NO: 368031 - DNA, 15 bp, Homo sapiens
acttgggaggccgag

SEQ ID NO: 368032 - DNA, 15 bp, Homo sapiens
cttgggaggccgagg

SEQ ID NO: 368033 - DNA, 15 bp, Homo sapiens
gggaggccgaggcac

SEQ ID NO: 368034 - DNA, 15 bp, Homo sapiens
ggaggccgaggcacg

SEQ ID NO: 368035 - DNA, 15 bp, Homo sapiens
gaggccgaggcacga

SEQ ID NO: 368036 - DNA, 15 bp, Homo sapiens
aggccgaggcacgag

SEQ ID NO: 368037 - DNA, 15 bp, Homo sapiens
ggccgaggcacgaga

SEQ ID NO: 368038 - DNA, 15 bp, Homo sapiens
gccgaggcacgagaa

SEQ ID NO: 368039 - DNA, 15 bp, Homo sapiens
ccgaggcacgagaat

SEQ ID NO: 368040 - DNA, 15 bp, Homo sapiens
cgaggcacgagaatt

SEQ ID NO: 368041 - DNA, 15 bp, Homo sapiens
gaggcacgagaattg

SEQ ID NO: 368042 - DNA, 15 bp, Homo sapiens
aggcacgagaattgc

SEQ ID NO: 368043 - DNA, 15 bp, Homo sapiens
ggcacgagaattgcc

SEQ ID NO: 368044 - DNA, 15 bp, Homo sapiens
gcacgagaattgcct

SEQ ID NO: 368045 - DNA, 15 bp, Homo sapiens
cacgagaattgccta

SEQ ID NO: 368046 - DNA, 15 bp, Homo sapiens
acgagaattgcctat

SEQ ID NO: 368047 - DNA, 15 bp, Homo sapiens
cgagaattgcctata

SEQ ID NO: 368048 - DNA, 15 bp, Homo sapiens
gagaattgcctatac

SEQ ID NO: 368049 - DNA, 15 bp, Homo sapiens
agaattgcctatacc

SEQ ID NO: 368050 - DNA, 15 bp, Homo sapiens
gaattgcctatacct

SEQ ID NO: 368051 - DNA, 15 bp, Homo sapiens
aattgcctatacctg

SEQ ID NO: 368052 - DNA, 15 bp, Homo sapiens
attgcctatacctgg

SEQ ID NO: 368053 - DNA, 15 bp, Homo sapiens
ttgcctatacctggg

SEQ ID NO: 368054 - DNA, 15 bp, Homo sapiens
tgcctatacctggga

SEQ ID NO: 368055 - DNA, 15 bp, Homo sapiens
gcctatacctgggag

SEQ ID NO: 368056 - DNA, 15 bp, Homo sapiens
cctatacctgggagg

SEQ ID NO: 368057 - DNA, 15 bp, Homo sapiens
ctatacctgggaggt

SEQ ID NO: 368058 - DNA, 15 bp, Homo sapiens
tatacctgggaggtg

SEQ ID NO: 368059 - DNA, 15 bp, Homo sapiens
atacctgggaggtgg

SEQ ID NO: 368060 - DNA, 15 bp, Homo sapiens
tacctgggaggtgga

SEQ ID NO: 368061 - DNA, 15 bp, Homo sapiens
gttgcagtgagctgc

SEQ ID NO: 368062 - DNA, 15 bp, Homo sapiens
ttgcagtgagctgca

SEQ ID NO: 368063 - DNA, 15 bp, Homo sapiens
tgcagtgagctgcag

SEQ ID NO: 368064 - DNA, 15 bp, Homo sapiens
gcagtgagctgcagt

SEQ ID NO: 368065 - DNA, 15 bp, Homo sapiens
cagtgagctgcagtc

SEQ ID NO: 368066 - DNA, 15 bp, Homo sapiens
agtgagctgcagtca

SEQ ID NO: 368067 - DNA, 15 bp, Homo sapiens
gtgagctgcagtcac

SEQ ID NO: 368068 - DNA, 15 bp, Homo sapiens
tgagctgcagtcaca

SEQ ID NO: 368069 - DNA, 15 bp, Homo sapiens
gagctgcagtcacac

SEQ ID NO: 368070 - DNA, 15 bp, Homo sapiens
agctgcagtcacacc

SEQ ID NO: 368071 - DNA, 15 bp, Homo sapiens
gctgcagtcacacca

SEQ ID NO: 368072 - DNA, 15 bp, Homo sapiens
ctgcagtcacaccac

SEQ ID NO: 368073 - DNA, 15 bp, Homo sapiens
tgcagtcacaccact

SEQ ID NO: 368074 - DNA, 15 bp, Homo sapiens
gcagtcacaccactg

SEQ ID NO: 368075 - DNA, 15 bp, Homo sapiens
cagtcacaccactgg

SEQ ID NO: 368076 - DNA, 15 bp, Homo sapiens
agtcacaccactgga

SEQ ID NO: 368077 - DNA, 15 bp, Homo sapiens
gtcacaccactggac

SEQ ID NO: 368078 - DNA, 15 bp, Homo sapiens
tcacaccactggacc

SEQ ID NO: 368079 - DNA, 15 bp, Homo sapiens
cacaccactggaccc

SEQ ID NO: 368080 - DNA, 15 bp, Homo sapiens
acaccactggacccc

SEQ ID NO: 368081 - DNA, 15 bp, Homo sapiens
caccactggacccca

SEQ ID NO: 368082 - DNA, 15 bp, Homo sapiens
accactggaccccag

SEQ ID NO: 368083 - DNA, 15 bp, Homo sapiens
ccactggaccccagc

SEQ ID NO: 368084 - DNA, 15 bp, Homo sapiens
cactggaccccagcc

SEQ ID NO: 368085 - DNA, 15 bp, Homo sapiens
actggaccccagcct

SEQ ID NO: 368086 - DNA, 15 bp, Homo sapiens
ctggaccccagcctg

SEQ ID NO: 368087 - DNA, 15 bp, Homo sapiens
tggaccccagcctgg

SEQ ID NO: 368088 - DNA, 15 bp, Homo sapiens
ggaccccagcctggg

SEQ ID NO: 368089 - DNA, 15 bp, Homo sapiens
gaccccagcctgggt

SEQ ID NO: 368090 - DNA, 15 bp, Homo sapiens
cccagcctgggtgag

SEQ ID NO: 368091 - DNA, 15 bp, Homo sapiens
ccagcctgggtgaga

SEQ ID NO: 368092 - DNA, 15 bp, Homo sapiens
cagcctgggtgagac

SEQ ID NO: 368093 - DNA, 15 bp, Homo sapiens
agcctgggtgagaca

SEQ ID NO: 368094 - DNA, 15 bp, Homo sapiens
gcctgggtgagacag

SEQ ID NO: 368095 - DNA, 15 bp, Homo sapiens
cctgggtgagacagg

SEQ ID NO: 368096 - DNA, 15 bp, Homo sapiens
ctgggtgagacaggg

SEQ ID NO: 368097 - DNA, 15 bp, Homo sapiens
tgggtgagacaggga

SEQ ID NO: 368098 - DNA, 15 bp, Homo sapiens
gggtgagacagggag

SEQ ID NO: 368099 - DNA, 15 bp, Homo sapiens
ggtgagacagggaga

SEQ ID NO: 368100 - DNA, 15 bp, Homo sapiens
gtgagacagggagac

SEQ ID NO: 368101 - DNA, 15 bp, Homo sapiens
tgagacagggagacc

SEQ ID NO: 368102 - DNA, 15 bp, Homo sapiens
gagacagggagaccc

SEQ ID NO: 368103 - DNA, 15 bp, Homo sapiens
agacagggagaccct

SEQ ID NO: 368104 - DNA, 15 bp, Homo sapiens
gacagggagaccctg

SEQ ID NO: 368105 - DNA, 15 bp, Homo sapiens
acagggagaccctgt

SEQ ID NO: 368106 - DNA, 15 bp, Homo sapiens
cagggagaccctgtc

SEQ ID NO: 368107 - DNA, 15 bp, Homo sapiens
agggagaccctgtct

SEQ ID NO: 368108 - DNA, 15 bp, Homo sapiens
gggagaccctgtctc

SEQ ID NO: 368109 - DNA, 15 bp, Homo sapiens
ggagaccctgtctca

SEQ ID NO: 368110 - DNA, 15 bp, Homo sapiens
aaaaaaaaagaaata

SEQ ID NO: 368111 - DNA, 15 bp, Homo sapiens
aaaaaaaagaaataa

SEQ ID NO: 368112 - DNA, 15 bp, Homo sapiens
aaaaaaagaaataaa

SEQ ID NO: 368113 - DNA, 15 bp, Homo sapiens
aaaaaagaaataaat

SEQ ID NO: 368114 - DNA, 15 bp, Homo sapiens
aaaaagaaataaata

SEQ ID NO: 368115 - DNA, 15 bp, Homo sapiens
aaaagaaataaataa

SEQ ID NO: 368116 - DNA, 15 bp, Homo sapiens
aaagaaataaataaa

SEQ ID NO: 368117 - DNA, 15 bp, Homo sapiens
aagaaataaataaag

SEQ ID NO: 368118 - DNA, 15 bp, Homo sapiens
agaaataaataaaga

SEQ ID NO: 368119 - DNA, 15 bp, Homo sapiens
gaaataaataaagaa

SEQ ID NO: 368120 - DNA, 15 bp, Homo sapiens
aaataaataaagaaa

SEQ ID NO: 368121 - DNA, 15 bp, Homo sapiens
aataaataaagaaaa

SEQ ID NO: 368122 - DNA, 15 bp, Homo sapiens
ataaataaagaaaat

SEQ ID NO: 368123 - DNA, 15 bp, Homo sapiens
taaataaagaaaata

SEQ ID NO: 368124 - DNA, 15 bp, Homo sapiens
aaataaagaaaatag

SEQ ID NO: 368125 - DNA, 15 bp, Homo sapiens
aataaagaaaatagc

SEQ ID NO: 368126 - DNA, 15 bp, Homo sapiens
ataaagaaaatagca

SEQ ID NO: 368127 - DNA, 15 bp, Homo sapiens
taaagaaaatagcat

SEQ ID NO: 368128 - DNA, 15 bp, Homo sapiens
aaagaaaatagcatc

SEQ ID NO: 368129 - DNA, 15 bp, Homo sapiens
aagaaaatagcatcc

SEQ ID NO: 368130 - DNA, 15 bp, Homo sapiens
agaaaatagcatcct

SEQ ID NO: 368131 - DNA, 15 bp, Homo sapiens
gaaaatagcatcctg

SEQ ID NO: 368132 - DNA, 15 bp, Homo sapiens
aaaatagcatcctga

SEQ ID NO: 368133 - DNA, 15 bp, Homo sapiens
aaatagcatcctgat

SEQ ID NO: 368134 - DNA, 15 bp, Homo sapiens
aatagcatcctgatt

SEQ ID NO: 368135 - DNA, 15 bp, Homo sapiens
atagcatcctgattt

SEQ ID NO: 368136 - DNA, 15 bp, Homo sapiens
tagcatcctgatttt

SEQ ID NO: 368137 - DNA, 15 bp, Homo sapiens
agcatcctgattttg

SEQ ID NO: 368138 - DNA, 15 bp, Homo sapiens
gcatcctgattttgc

SEQ ID NO: 368139 - DNA, 15 bp, Homo sapiens
catcctgattttgca

SEQ ID NO: 368140 - DNA, 15 bp, Homo sapiens
atcctgattttgcac

SEQ ID NO: 368141 - DNA, 15 bp, Homo sapiens
tcctgattttgcaca

SEQ ID NO: 368142 - DNA, 15 bp, Homo sapiens
cctgattttgcacat

SEQ ID NO: 368143 - DNA, 15 bp, Homo sapiens
ctgattttgcacatg

SEQ ID NO: 368144 - DNA, 15 bp, Homo sapiens
tgattttgcacatga

SEQ ID NO: 368145 - DNA, 15 bp, Homo sapiens
gattttgcacatgac

SEQ ID NO: 368146 - DNA, 15 bp, Homo sapiens
attttgcacatgact

SEQ ID NO: 368147 - DNA, 15 bp, Homo sapiens
ttttgcacatgactt

SEQ ID NO: 368148 - DNA, 15 bp, Homo sapiens
tttgcacatgacttt

SEQ ID NO: 368149 - DNA, 15 bp, Homo sapiens
ttgcacatgactttt

SEQ ID NO: 368150 - DNA, 15 bp, Homo sapiens
tgcacatgacttttc

SEQ ID NO: 368151 - DNA, 15 bp, Homo sapiens
gcacatgacttttca

SEQ ID NO: 368152 - DNA, 15 bp, Homo sapiens
cacatgacttttcac

SEQ ID NO: 368153 - DNA, 15 bp, Homo sapiens
acatgacttttcaca

SEQ ID NO: 368154 - DNA, 15 bp, Homo sapiens
catgacttttcacac

SEQ ID NO: 368155 - DNA, 15 bp, Homo sapiens
atgacttttcacaca

SEQ ID NO: 368156 - DNA, 15 bp, Homo sapiens
tgacttttcacacat

SEQ ID NO: 368157 - DNA, 15 bp, Homo sapiens
gacttttcacacatg

SEQ ID NO: 368158 - DNA, 15 bp, Homo sapiens
acttttcacacatgt

SEQ ID NO: 368159 - DNA, 15 bp, Homo sapiens
cttttcacacatgta

SEQ ID NO: 368160 - DNA, 15 bp, Homo sapiens
ttttcacacatgtat

SEQ ID NO: 368161 - DNA, 15 bp, Homo sapiens
tttcacacatgtatg

SEQ ID NO: 368162 - DNA, 15 bp, Homo sapiens
ttcacacatgtatgt

SEQ ID NO: 368163 - DNA, 15 bp, Homo sapiens
tcacacatgtatgtt

SEQ ID NO: 368164 - DNA, 15 bp, Homo sapiens
cacacatgtatgttt

SEQ ID NO: 368165 - DNA, 15 bp, Homo sapiens
acacatgtatgttta

SEQ ID NO: 368166 - DNA, 15 bp, Homo sapiens
cacatgtatgtttat

SEQ ID NO: 368167 - DNA, 15 bp, Homo sapiens
acatgtatgtttatt

SEQ ID NO: 368168 - DNA, 15 bp, Homo sapiens
catgtatgtttattt

SEQ ID NO: 368169 - DNA, 15 bp, Homo sapiens
atgtatgtttatttt

SEQ ID NO: 368170 - DNA, 15 bp, Homo sapiens
tgtatgtttattttc

SEQ ID NO: 368171 - DNA, 15 bp, Homo sapiens
gtatgtttattttca

SEQ ID NO: 368172 - DNA, 15 bp, Homo sapiens
tatgtttattttcaa

SEQ ID NO: 368173 - DNA, 15 bp, Homo sapiens
atgtttattttcaat

SEQ ID NO: 368174 - DNA, 15 bp, Homo sapiens
tgtttattttcaatg

SEQ ID NO: 368175 - DNA, 15 bp, Homo sapiens
gtttattttcaatga

SEQ ID NO: 368176 - DNA, 15 bp, Homo sapiens
tttattttcaatgat

SEQ ID NO: 368177 - DNA, 15 bp, Homo sapiens
ttattttcaatgatt

SEQ ID NO: 368178 - DNA, 15 bp, Homo sapiens
tattttcaatgattt

SEQ ID NO: 368179 - DNA, 15 bp, Homo sapiens
attttcaatgatttt

SEQ ID NO: 368180 - DNA, 15 bp, Homo sapiens
ttttcaatgattttt

SEQ ID NO: 368181 - DNA, 15 bp, Homo sapiens
tttcaatgatttttt

SEQ ID NO: 368182 - DNA, 15 bp, Homo sapiens
ttcaatgattttttt

SEQ ID NO: 368183 - DNA, 15 bp, Homo sapiens
tcaatgatttttttc

SEQ ID NO: 368184 - DNA, 15 bp, Homo sapiens
caatgatttttttca

SEQ ID NO: 368185 - DNA, 15 bp, Homo sapiens
aatgatttttttcat

SEQ ID NO: 368186 - DNA, 15 bp, Homo sapiens
atgatttttttcatt

SEQ ID NO: 368187 - DNA, 15 bp, Homo sapiens
tgatttttttcatta

SEQ ID NO: 368188 - DNA, 15 bp, Homo sapiens
atttttttcattaaa

SEQ ID NO: 368189 - DNA, 15 bp, Homo sapiens
tttttttcattaaat

SEQ ID NO: 368190 - DNA, 15 bp, Homo sapiens
ttttttcattaaata

SEQ ID NO: 368191 - DNA, 15 bp, Homo sapiens
tttttcattaaatat

SEQ ID NO: 368192 - DNA, 15 bp, Homo sapiens
ttttcattaaatata

SEQ ID NO: 368193 - DNA, 15 bp, Homo sapiens
tttcattaaatatat

SEQ ID NO: 368194 - DNA, 15 bp, Homo sapiens
ttcattaaatatata

SEQ ID NO: 368195 - DNA, 15 bp, Homo sapiens
tcattaaatatatat

SEQ ID NO: 368196 - DNA, 15 bp, Homo sapiens
cattaaatatatatt

SEQ ID NO: 368197 - DNA, 15 bp, Homo sapiens
attaaatatatattt

SEQ ID NO: 368198 - DNA, 15 bp, Homo sapiens
ttaaatatatattta

SEQ ID NO: 368199 - DNA, 15 bp, Homo sapiens
taaatatatatttac

SEQ ID NO: 368200 - DNA, 15 bp, Homo sapiens
aaatatatatttact

SEQ ID NO: 368201 - DNA, 15 bp, Homo sapiens
aatatatatttacta

SEQ ID NO: 368202 - DNA, 15 bp, Homo sapiens
atatatatttactag

SEQ ID NO: 368203 - DNA, 15 bp, Homo sapiens
tatatatttactagg

SEQ ID NO: 368204 - DNA, 15 bp, Homo sapiens
atatatttactaggt

SEQ ID NO: 368205 - DNA, 15 bp, Homo sapiens
tatatttactaggtt

SEQ ID NO: 368206 - DNA, 15 bp, Homo sapiens
atatttactaggttc

SEQ ID NO: 368207 - DNA, 15 bp, Homo sapiens
tatttactaggttcc

SEQ ID NO: 368208 - DNA, 15 bp, Homo sapiens
atttactaggttcca

SEQ ID NO: 368209 - DNA, 15 bp, Homo sapiens
tttactaggttccag

SEQ ID NO: 368210 - DNA, 15 bp, Homo sapiens
ttactaggttccagt

SEQ ID NO: 368211 - DNA, 15 bp, Homo sapiens
tactaggttccagtg

SEQ ID NO: 368212 - DNA, 15 bp, Homo sapiens
actaggttccagtga

SEQ ID NO: 368213 - DNA, 15 bp, Homo sapiens
ctaggttccagtgaa

SEQ ID NO: 368214 - DNA, 15 bp, Homo sapiens
taggttccagtgaaa

SEQ ID NO: 368215 - DNA, 15 bp, Homo sapiens
aggttccagtgaaat

SEQ ID NO: 368216 - DNA, 15 bp, Homo sapiens
ggttccagtgaaatg

SEQ ID NO: 368217 - DNA, 15 bp, Homo sapiens
gttccagtgaaatgt

SEQ ID NO: 368218 - DNA, 15 bp, Homo sapiens
ttccagtgaaatgta

SEQ ID NO: 368219 - DNA, 15 bp, Homo sapiens
tccagtgaaatgtaa

SEQ ID NO: 368220 - DNA, 15 bp, Homo sapiens
ccagtgaaatgtaat

SEQ ID NO: 368221 - DNA, 15 bp, Homo sapiens
cagtgaaatgtaatg

SEQ ID NO: 368222 - DNA, 15 bp, Homo sapiens
agtgaaatgtaatgg

SEQ ID NO: 368223 - DNA, 15 bp, Homo sapiens
gtgaaatgtaatggc

SEQ ID NO: 368224 - DNA, 15 bp, Homo sapiens
tgaaatgtaatggca

SEQ ID NO: 368225 - DNA, 15 bp, Homo sapiens
gaaatgtaatggcat

SEQ ID NO: 368226 - DNA, 15 bp, Homo sapiens
aaatgtaatggcatg

SEQ ID NO: 368227 - DNA, 15 bp, Homo sapiens
aatgtaatggcatgt

SEQ ID NO: 368228 - DNA, 15 bp, Homo sapiens
atgtaatggcatgtg

SEQ ID NO: 368229 - DNA, 15 bp, Homo sapiens
tgtaatggcatgtga

SEQ ID NO: 368230 - DNA, 15 bp, Homo sapiens
gtaatggcatgtgac

SEQ ID NO: 368231 - DNA, 15 bp, Homo sapiens
taatggcatgtgact

SEQ ID NO: 368232 - DNA, 15 bp, Homo sapiens
aatggcatgtgacta

SEQ ID NO: 368233 - DNA, 15 bp, Homo sapiens
atggcatgtgactac

SEQ ID NO: 368234 - DNA, 15 bp, Homo sapiens
tggcatgtgactaca

SEQ ID NO: 368235 - DNA, 15 bp, Homo sapiens
ggcatgtgactacaa

SEQ ID NO: 368236 - DNA, 15 bp, Homo sapiens
gcatgtgactacaaa

SEQ ID NO: 368237 - DNA, 15 bp, Homo sapiens
catgtgactacaaat

SEQ ID NO: 368238 - DNA, 15 bp, Homo sapiens
atgtgactacaaata

SEQ ID NO: 368239 - DNA, 15 bp, Homo sapiens
tgtgactacaaatac

SEQ ID NO: 368240 - DNA, 15 bp, Homo sapiens
gtgactacaaataca

SEQ ID NO: 368241 - DNA, 15 bp, Homo sapiens
tgactacaaatacaa

SEQ ID NO: 368242 - DNA, 15 bp, Homo sapiens
gactacaaatacaac

SEQ ID NO: 368243 - DNA, 15 bp, Homo sapiens
actacaaatacaact

SEQ ID NO: 368244 - DNA, 15 bp, Homo sapiens
ctacaaatacaacta

SEQ ID NO: 368245 - DNA, 15 bp, Homo sapiens
tacaaatacaactaa

SEQ ID NO: 368246 - DNA, 15 bp, Homo sapiens
acaaatacaactaat

SEQ ID NO: 368247 - DNA, 15 bp, Homo sapiens
caaatacaactaata

SEQ ID NO: 368248 - DNA, 15 bp, Homo sapiens
aaatacaactaatat

SEQ ID NO: 368249 - DNA, 15 bp, Homo sapiens
aatacaactaatatc

SEQ ID NO: 368250 - DNA, 15 bp, Homo sapiens
atacaactaatatct

SEQ ID NO: 368251 - DNA, 15 bp, Homo sapiens
tacaactaatatctt

SEQ ID NO: 368252 - DNA, 15 bp, Homo sapiens
acaactaatatcttt

SEQ ID NO: 368253 - DNA, 15 bp, Homo sapiens
caactaatatctttc

SEQ ID NO: 368254 - DNA, 15 bp, Homo sapiens
aactaatatctttcc

SEQ ID NO: 368255 - DNA, 15 bp, Homo sapiens
actaatatctttccc

SEQ ID NO: 368256 - DNA, 15 bp, Homo sapiens
ctaatatctttccct

SEQ ID NO: 368257 - DNA, 15 bp, Homo sapiens
taatatctttccctc

SEQ ID NO: 368258 - DNA, 15 bp, Homo sapiens
aatatctttccctcc

SEQ ID NO: 368259 - DNA, 15 bp, Homo sapiens
atatctttccctcct

SEQ ID NO: 368260 - DNA, 15 bp, Homo sapiens
tatctttccctccta

SEQ ID NO: 368261 - DNA, 15 bp, Homo sapiens
atctttccctcctac

SEQ ID NO: 368262 - DNA, 15 bp, Homo sapiens
tctttccctcctacc

SEQ ID NO: 368263 - DNA, 15 bp, Homo sapiens
ctttccctcctacca

SEQ ID NO: 368264 - DNA, 15 bp, Homo sapiens
tttccctcctaccat

SEQ ID NO: 368265 - DNA, 15 bp, Homo sapiens
ttccctcctaccatt

SEQ ID NO: 368266 - DNA, 15 bp, Homo sapiens
tccctcctaccatta

SEQ ID NO: 368267 - DNA, 15 bp, Homo sapiens
ccctcctaccattat

SEQ ID NO: 368268 - DNA, 15 bp, Homo sapiens
cctcctaccattatt

SEQ ID NO: 368269 - DNA, 15 bp, Homo sapiens
ctcctaccattattt

SEQ ID NO: 368270 - DNA, 15 bp, Homo sapiens
tcctaccattatttt

SEQ ID NO: 368271 - DNA, 15 bp, Homo sapiens
cctaccattattttt

SEQ ID NO: 368272 - DNA, 15 bp, Homo sapiens
ctaccattatttttt

SEQ ID NO: 368273 - DNA, 15 bp, Homo sapiens
taccattattttttt

SEQ ID NO: 368274 - DNA, 15 bp, Homo sapiens
accattatttttttt

SEQ ID NO: 368275 - DNA, 15 bp, Homo sapiens
ccattattttttttt

SEQ ID NO: 368276 - DNA, 15 bp, Homo sapiens
cattatttttttttt

SEQ ID NO: 368277 - DNA, 15 bp, Homo sapiens
attattttttttttg

SEQ ID NO: 368278 - DNA, 15 bp, Homo sapiens
ttattttttttttgc

SEQ ID NO: 368279 - DNA, 15 bp, Homo sapiens
tattttttttttgcc

SEQ ID NO: 368280 - DNA, 15 bp, Homo sapiens
attttttttttgcca

SEQ ID NO: 368281 - DNA, 15 bp, Homo sapiens
ttttttttttgccat

SEQ ID NO: 368282 - DNA, 15 bp, Homo sapiens
tttttttttgccatt

SEQ ID NO: 368283 - DNA, 15 bp, Homo sapiens
ttttttttgccattg

SEQ ID NO: 368284 - DNA, 15 bp, Homo sapiens
ttttttgccattgaa

SEQ ID NO: 368285 - DNA, 15 bp, Homo sapiens
tttttgccattgaaa

SEQ ID NO: 368286 - DNA, 15 bp, Homo sapiens
ttttgccattgaaac

SEQ ID NO: 368287 - DNA, 15 bp, Homo sapiens
tttgccattgaaacg

SEQ ID NO: 368288 - DNA, 15 bp, Homo sapiens
ttgccattgaaacgg

SEQ ID NO: 368289 - DNA, 15 bp, Homo sapiens
tgccattgaaacggt

SEQ ID NO: 368290 - DNA, 15 bp, Homo sapiens
gccattgaaacggtt

SEQ ID NO: 368291 - DNA, 15 bp, Homo sapiens
ccattgaaacggtta

SEQ ID NO: 368292 - DNA, 15 bp, Homo sapiens
cattgaaacggttaa

SEQ ID NO: 368293 - DNA, 15 bp, Homo sapiens
attgaaacggttaaa

SEQ ID NO: 368294 - DNA, 15 bp, Homo sapiens
ttgaaacggttaaaa

SEQ ID NO: 368295 - DNA, 15 bp, Homo sapiens
tgaaacggttaaaag

SEQ ID NO: 368296 - DNA, 15 bp, Homo sapiens
gaaacggttaaaagt

SEQ ID NO: 368297 - DNA, 15 bp, Homo sapiens
aaacggttaaaagta

SEQ ID NO: 368298 - DNA, 15 bp, Homo sapiens
aacggttaaaagtag

SEQ ID NO: 368299 - DNA, 15 bp, Homo sapiens
acggttaaaagtaga

SEQ ID NO: 368300 - DNA, 15 bp, Homo sapiens
cggttaaaagtagat

SEQ ID NO: 368301 - DNA, 15 bp, Homo sapiens
ggttaaaagtagata

SEQ ID NO: 368302 - DNA, 15 bp, Homo sapiens
gttaaaagtagataa

SEQ ID NO: 368303 - DNA, 15 bp, Homo sapiens
ttaaaagtagataaa

SEQ ID NO: 368304 - DNA, 15 bp, Homo sapiens
taaaagtagataaag

SEQ ID NO: 368305 - DNA, 15 bp, Homo sapiens
aaaagtagataaagt

SEQ ID NO: 368306 - DNA, 15 bp, Homo sapiens
aaagtagataaagtc

SEQ ID NO: 368307 - DNA, 15 bp, Homo sapiens
aagtagataaagtca

SEQ ID NO: 368308 - DNA, 15 bp, Homo sapiens
agtagataaagtcat

SEQ ID NO: 368309 - DNA, 15 bp, Homo sapiens
gtagataaagtcata

SEQ ID NO: 368310 - DNA, 15 bp, Homo sapiens
tagataaagtcatag

SEQ ID NO: 368311 - DNA, 15 bp, Homo sapiens
agataaagtcataga

SEQ ID NO: 368312 - DNA, 15 bp, Homo sapiens
gataaagtcatagat

SEQ ID NO: 368313 - DNA, 15 bp, Homo sapiens
ataaagtcatagata

SEQ ID NO: 368314 - DNA, 15 bp, Homo sapiens
taaagtcatagatat

SEQ ID NO: 368315 - DNA, 15 bp, Homo sapiens
aaagtcatagatatc

SEQ ID NO: 368316 - DNA, 15 bp, Homo sapiens
aagtcatagatatct

SEQ ID NO: 368317 - DNA, 15 bp, Homo sapiens
agtcatagatatctt

SEQ ID NO: 368318 - DNA, 15 bp, Homo sapiens
gtcatagatatcttt

SEQ ID NO: 368319 - DNA, 15 bp, Homo sapiens
tcatagatatctttt

SEQ ID NO: 368320 - DNA, 15 bp, Homo sapiens
catagatatcttttt

SEQ ID NO: 368321 - DNA, 15 bp, Homo sapiens
tagatatcttttttg

SEQ ID NO: 368322 - DNA, 15 bp, Homo sapiens
agatatcttttttgt

SEQ ID NO: 368323 - DNA, 15 bp, Homo sapiens
gatatcttttttgtt

SEQ ID NO: 368324 - DNA, 15 bp, Homo sapiens
atatcttttttgttt

SEQ ID NO: 368325 - DNA, 15 bp, Homo sapiens
tatcttttttgtttg

SEQ ID NO: 368326 - DNA, 15 bp, Homo sapiens
atcttttttgtttga

SEQ ID NO: 368327 - DNA, 15 bp, Homo sapiens
tcttttttgtttgac

SEQ ID NO: 368328 - DNA, 15 bp, Homo sapiens
cttttttgtttgacc

SEQ ID NO: 368329 - DNA, 15 bp, Homo sapiens
ttttttgtttgacct

SEQ ID NO: 368330 - DNA, 15 bp, Homo sapiens
tttttgtttgacctg

SEQ ID NO: 368331 - DNA, 15 bp, Homo sapiens
ttttgtttgacctgg

SEQ ID NO: 368332 - DNA, 15 bp, Homo sapiens
tttgtttgacctggt

SEQ ID NO: 368333 - DNA, 15 bp, Homo sapiens
ttgtttgacctggta

SEQ ID NO: 368334 - DNA, 15 bp, Homo sapiens
tgtttgacctggtac

SEQ ID NO: 368335 - DNA, 15 bp, Homo sapiens
gtttgacctggtaca

SEQ ID NO: 368336 - DNA, 15 bp, Homo sapiens
tttgacctggtacac

SEQ ID NO: 368337 - DNA, 15 bp, Homo sapiens
ttgacctggtacaca

SEQ ID NO: 368338 - DNA, 15 bp, Homo sapiens
tgacctggtacacac

SEQ ID NO: 368339 - DNA, 15 bp, Homo sapiens
gacctggtacacacc

SEQ ID NO: 368340 - DNA, 15 bp, Homo sapiens
acctggtacacacca

SEQ ID NO: 368341 - DNA, 15 bp, Homo sapiens
cctggtacacaccat

SEQ ID NO: 368342 - DNA, 15 bp, Homo sapiens
ctggtacacaccatt

SEQ ID NO: 368343 - DNA, 15 bp, Homo sapiens
tggtacacaccattt

SEQ ID NO: 368344 - DNA, 15 bp, Homo sapiens
ggtacacaccatttc

SEQ ID NO: 368345 - DNA, 15 bp, Homo sapiens
gtacacaccatttca

SEQ ID NO: 368346 - DNA, 15 bp, Homo sapiens
tacacaccatttcag

SEQ ID NO: 368347 - DNA, 15 bp, Homo sapiens
acacaccatttcaga

SEQ ID NO: 368348 - DNA, 15 bp, Homo sapiens
cacaccatttcagag

SEQ ID NO: 368349 - DNA, 15 bp, Homo sapiens
acaccatttcagagt

SEQ ID NO: 368350 - DNA, 15 bp, Homo sapiens
caccatttcagagta

SEQ ID NO: 368351 - DNA, 15 bp, Homo sapiens
accatttcagagtat

SEQ ID NO: 368352 - DNA, 15 bp, Homo sapiens
ccatttcagagtatg

SEQ ID NO: 368353 - DNA, 15 bp, Homo sapiens
catttcagagtatga

SEQ ID NO: 368354 - DNA, 15 bp, Homo sapiens
atttcagagtatgac

SEQ ID NO: 368355 - DNA, 15 bp, Homo sapiens
tttcagagtatgacg

SEQ ID NO: 368356 - DNA, 15 bp, Homo sapiens
ttcagagtatgacgt

SEQ ID NO: 368357 - DNA, 15 bp, Homo sapiens
tcagagtatgacgtc

SEQ ID NO: 368358 - DNA, 15 bp, Homo sapiens
cagagtatgacgtct

SEQ ID NO: 368359 - DNA, 15 bp, Homo sapiens
agagtatgacgtctg

SEQ ID NO: 368360 - DNA, 15 bp, Homo sapiens
gagtatgacgtctgt

SEQ ID NO: 368361 - DNA, 15 bp, Homo sapiens
agtatgacgtctgta

SEQ ID NO: 368362 - DNA, 15 bp, Homo sapiens
gtatgacgtctgtat

SEQ ID NO: 368363 - DNA, 15 bp, Homo sapiens
tatgacgtctgtata

SEQ ID NO: 368364 - DNA, 15 bp, Homo sapiens
atgacgtctgtatag

SEQ ID NO: 368365 - DNA, 15 bp, Homo sapiens
tgacgtctgtatagg

SEQ ID NO: 368366 - DNA, 15 bp, Homo sapiens
gacgtctgtatagga

SEQ ID NO: 368367 - DNA, 15 bp, Homo sapiens
acgtctgtataggac

SEQ ID NO: 368368 - DNA, 15 bp, Homo sapiens
cgtctgtataggaca

SEQ ID NO: 368369 - DNA, 15 bp, Homo sapiens
gtctgtataggacat

SEQ ID NO: 368370 - DNA, 15 bp, Homo sapiens
tctgtataggacatt

SEQ ID NO: 368371 - DNA, 15 bp, Homo sapiens
ctgtataggacattg

SEQ ID NO: 368372 - DNA, 15 bp, Homo sapiens
tgtataggacattga

SEQ ID NO: 368373 - DNA, 15 bp, Homo sapiens
gtataggacattgaa

SEQ ID NO: 368374 - DNA, 15 bp, Homo sapiens
tataggacattgaat

SEQ ID NO: 368375 - DNA, 15 bp, Homo sapiens
ataggacattgaatg

SEQ ID NO: 368376 - DNA, 15 bp, Homo sapiens
taggacattgaatgg

SEQ ID NO: 368377 - DNA, 15 bp, Homo sapiens
aggacattgaatgga

SEQ ID NO: 368378 - DNA, 15 bp, Homo sapiens
ggacattgaatggat

SEQ ID NO: 368379 - DNA, 15 bp, Homo sapiens
gacattgaatggata

SEQ ID NO: 368380 - DNA, 15 bp, Homo sapiens
acattgaatggatat

SEQ ID NO: 368381 - DNA, 15 bp, Homo sapiens
cattgaatggatatg

SEQ ID NO: 368382 - DNA, 15 bp, Homo sapiens
attgaatggatatgt

SEQ ID NO: 368383 - DNA, 15 bp, Homo sapiens
ttgaatggatatgtc

SEQ ID NO: 368384 - DNA, 15 bp, Homo sapiens
tgaatggatatgtct

SEQ ID NO: 368385 - DNA, 15 bp, Homo sapiens
gaatggatatgtctc

SEQ ID NO: 368386 - DNA, 15 bp, Homo sapiens
aatggatatgtctct

SEQ ID NO: 368387 - DNA, 15 bp, Homo sapiens
atggatatgtctctg

SEQ ID NO: 368388 - DNA, 15 bp, Homo sapiens
tggatatgtctctgt

SEQ ID NO: 368389 - DNA, 15 bp, Homo sapiens
ggatatgtctctgtc

SEQ ID NO: 368390 - DNA, 15 bp, Homo sapiens
gatatgtctctgtcc

SEQ ID NO: 368391 - DNA, 15 bp, Homo sapiens
atatgtctctgtcct

SEQ ID NO: 368392 - DNA, 15 bp, Homo sapiens
tatgtctctgtcctt

SEQ ID NO: 368393 - DNA, 15 bp, Homo sapiens
atgtctctgtccttg

SEQ ID NO: 368394 - DNA, 15 bp, Homo sapiens
tgtctctgtccttgg

SEQ ID NO: 368395 - DNA, 15 bp, Homo sapiens
gtctctgtccttggt

SEQ ID NO: 368396 - DNA, 15 bp, Homo sapiens
tctctgtccttggtt

SEQ ID NO: 368397 - DNA, 15 bp, Homo sapiens
ctctgtccttggttt

SEQ ID NO: 368398 - DNA, 15 bp, Homo sapiens
tctgtccttggtttg

SEQ ID NO: 368399 - DNA, 15 bp, Homo sapiens
ctgtccttggtttgg

SEQ ID NO: 368400 - DNA, 15 bp, Homo sapiens
tgtccttggtttgga

SEQ ID NO: 368401 - DNA, 15 bp, Homo sapiens
gtccttggtttggat

SEQ ID NO: 368402 - DNA, 15 bp, Homo sapiens
tccttggtttggatg

SEQ ID NO: 368403 - DNA, 15 bp, Homo sapiens
ccttggtttggatgg

SEQ ID NO: 368404 - DNA, 15 bp, Homo sapiens
cttggtttggatgga

SEQ ID NO: 368405 - DNA, 15 bp, Homo sapiens
ttggtttggatggac

SEQ ID NO: 368406 - DNA, 15 bp, Homo sapiens
tggtttggatggact

SEQ ID NO: 368407 - DNA, 15 bp, Homo sapiens
ggtttggatggactc

SEQ ID NO: 368408 - DNA, 15 bp, Homo sapiens
gtttggatggactcc

SEQ ID NO: 368409 - DNA, 15 bp, Homo sapiens
tttggatggactcca

SEQ ID NO: 368410 - DNA, 15 bp, Homo sapiens
ttggatggactccat

SEQ ID NO: 368411 - DNA, 15 bp, Homo sapiens
tggatggactccata

SEQ ID NO: 368412 - DNA, 15 bp, Homo sapiens
ggatggactccatat

SEQ ID NO: 368413 - DNA, 15 bp, Homo sapiens
gatggactccatatc

SEQ ID NO: 368414 - DNA, 15 bp, Homo sapiens
atggactccatatca

SEQ ID NO: 368415 - DNA, 15 bp, Homo sapiens
tggactccatatcag

SEQ ID NO: 368416 - DNA, 15 bp, Homo sapiens
ggactccatatcagt

SEQ ID NO: 368417 - DNA, 15 bp, Homo sapiens
gactccatatcagtc

SEQ ID NO: 368418 - DNA, 15 bp, Homo sapiens
actccatatcagtca

SEQ ID NO: 368419 - DNA, 15 bp, Homo sapiens
ctccatatcagtcat

SEQ ID NO: 368420 - DNA, 15 bp, Homo sapiens
tccatatcagtcatt

SEQ ID NO: 368421 - DNA, 15 bp, Homo sapiens
ccatatcagtcattt

SEQ ID NO: 368422 - DNA, 15 bp, Homo sapiens
catatcagtcatttt

SEQ ID NO: 368423 - DNA, 15 bp, Homo sapiens
atatcagtcattttc

SEQ ID NO: 368424 - DNA, 15 bp, Homo sapiens
tatcagtcattttct

SEQ ID NO: 368425 - DNA, 15 bp, Homo sapiens
atcagtcattttctc

SEQ ID NO: 368426 - DNA, 15 bp, Homo sapiens
tcagtcattttctct

SEQ ID NO: 368427 - DNA, 15 bp, Homo sapiens
cagtcattttctctc

SEQ ID NO: 368428 - DNA, 15 bp, Homo sapiens
agtcattttctctct

SEQ ID NO: 368429 - DNA, 15 bp, Homo sapiens
gtcattttctctctc

SEQ ID NO: 368430 - DNA, 15 bp, Homo sapiens
tcattttctctctca

SEQ ID NO: 368431 - DNA, 15 bp, Homo sapiens
cattttctctctcat

SEQ ID NO: 368432 - DNA, 15 bp, Homo sapiens
attttctctctcatc

SEQ ID NO: 368433 - DNA, 15 bp, Homo sapiens
ttttctctctcatcc

SEQ ID NO: 368434 - DNA, 15 bp, Homo sapiens
tttctctctcatcct

SEQ ID NO: 368435 - DNA, 15 bp, Homo sapiens
ttctctctcatcctc

SEQ ID NO: 368436 - DNA, 15 bp, Homo sapiens
tctctctcatcctct

SEQ ID NO: 368437 - DNA, 15 bp, Homo sapiens
ctctctcatcctctt

SEQ ID NO: 368438 - DNA, 15 bp, Homo sapiens
tctctcatcctcttt

SEQ ID NO: 368439 - DNA, 15 bp, Homo sapiens
ctctcatcctcttta

SEQ ID NO: 368440 - DNA, 15 bp, Homo sapiens
tctcatcctctttaa

SEQ ID NO: 368441 - DNA, 15 bp, Homo sapiens
ctcatcctctttaaa

SEQ ID NO: 368442 - DNA, 15 bp, Homo sapiens
tcatcctctttaaat

SEQ ID NO: 368443 - DNA, 15 bp, Homo sapiens
catcctctttaaatg

SEQ ID NO: 368444 - DNA, 15 bp, Homo sapiens
atcctctttaaatgg

SEQ ID NO: 368445 - DNA, 15 bp, Homo sapiens
tcctctttaaatggt

SEQ ID NO: 368446 - DNA, 15 bp, Homo sapiens
cctctttaaatggta

SEQ ID NO: 368447 - DNA, 15 bp, Homo sapiens
ctctttaaatggtag

SEQ ID NO: 368448 - DNA, 15 bp, Homo sapiens
tctttaaatggtagc

SEQ ID NO: 368449 - DNA, 15 bp, Homo sapiens
ctttaaatggtagcc

SEQ ID NO: 368450 - DNA, 15 bp, Homo sapiens
tttaaatggtagcca

SEQ ID NO: 368451 - DNA, 15 bp, Homo sapiens
ttaaatggtagccat

SEQ ID NO: 368452 - DNA, 15 bp, Homo sapiens
taaatggtagccatt

SEQ ID NO: 368453 - DNA, 15 bp, Homo sapiens
aaatggtagccatta

SEQ ID NO: 368454 - DNA, 15 bp, Homo sapiens
aatggtagccattat

SEQ ID NO: 368455 - DNA, 15 bp, Homo sapiens
atggtagccattatc

SEQ ID NO: 368456 - DNA, 15 bp, Homo sapiens
tggtagccattatcc

SEQ ID NO: 368457 - DNA, 15 bp, Homo sapiens
ggtagccattatcct

SEQ ID NO: 368458 - DNA, 15 bp, Homo sapiens
gtagccattatccta

SEQ ID NO: 368459 - DNA, 15 bp, Homo sapiens
tagccattatcctat

SEQ ID NO: 368460 - DNA, 15 bp, Homo sapiens
agccattatcctata

SEQ ID NO: 368461 - DNA, 15 bp, Homo sapiens
gccattatcctatag

SEQ ID NO: 368462 - DNA, 15 bp, Homo sapiens
ccattatcctatagc

SEQ ID NO: 368463 - DNA, 15 bp, Homo sapiens
cattatcctatagct

SEQ ID NO: 368464 - DNA, 15 bp, Homo sapiens
attatcctatagcta

SEQ ID NO: 368465 - DNA, 15 bp, Homo sapiens
ttatcctatagctaa

SEQ ID NO: 368466 - DNA, 15 bp, Homo sapiens
tatcctatagctaat

SEQ ID NO: 368467 - DNA, 15 bp, Homo sapiens
atcctatagctaatg

SEQ ID NO: 368468 - DNA, 15 bp, Homo sapiens
tcctatagctaatga

SEQ ID NO: 368469 - DNA, 15 bp, Homo sapiens
cctatagctaatgat

SEQ ID NO: 368470 - DNA, 15 bp, Homo sapiens
ctatagctaatgatg

SEQ ID NO: 368471 - DNA, 15 bp, Homo sapiens
tatagctaatgatgc

SEQ ID NO: 368472 - DNA, 15 bp, Homo sapiens
atagctaatgatgca

SEQ ID NO: 368473 - DNA, 15 bp, Homo sapiens
tagctaatgatgcag

SEQ ID NO: 368474 - DNA, 15 bp, Homo sapiens
agctaatgatgcagg

SEQ ID NO: 368475 - DNA, 15 bp, Homo sapiens
gctaatgatgcaggt

SEQ ID NO: 368476 - DNA, 15 bp, Homo sapiens
ctaatgatgcaggtg

SEQ ID NO: 368477 - DNA, 15 bp, Homo sapiens
taatgatgcaggtgc

SEQ ID NO: 368478 - DNA, 15 bp, Homo sapiens
aatgatgcaggtgct

SEQ ID NO: 368479 - DNA, 15 bp, Homo sapiens
atgatgcaggtgctt

SEQ ID NO: 368480 - DNA, 15 bp, Homo sapiens
tgatgcaggtgcttt

SEQ ID NO: 368481 - DNA, 15 bp, Homo sapiens
gatgcaggtgcttta

SEQ ID NO: 368482 - DNA, 15 bp, Homo sapiens
atgcaggtgctttat

SEQ ID NO: 368483 - DNA, 15 bp, Homo sapiens
tgcaggtgctttatt

SEQ ID NO: 368484 - DNA, 15 bp, Homo sapiens
gcaggtgctttattg

SEQ ID NO: 368485 - DNA, 15 bp, Homo sapiens
caggtgctttattga

SEQ ID NO: 368486 - DNA, 15 bp, Homo sapiens
aggtgctttattgat

SEQ ID NO: 368487 - DNA, 15 bp, Homo sapiens
ggtgctttattgatc

SEQ ID NO: 368488 - DNA, 15 bp, Homo sapiens
gtgctttattgatct

SEQ ID NO: 368489 - DNA, 15 bp, Homo sapiens
tgctttattgatctg

SEQ ID NO: 368490 - DNA, 15 bp, Homo sapiens
gctttattgatctgg

SEQ ID NO: 368491 - DNA, 15 bp, Homo sapiens
ctttattgatctggt

SEQ ID NO: 368492 - DNA, 15 bp, Homo sapiens
tttattgatctggtc

SEQ ID NO: 368493 - DNA, 15 bp, Homo sapiens
ttattgatctggtct

SEQ ID NO: 368494 - DNA, 15 bp, Homo sapiens
tattgatctggtctc

SEQ ID NO: 368495 - DNA, 15 bp, Homo sapiens
attgatctggtctct

SEQ ID NO: 368496 - DNA, 15 bp, Homo sapiens
ttgatctggtctctc

SEQ ID NO: 368497 - DNA, 15 bp, Homo sapiens
tgatctggtctctct

SEQ ID NO: 368498 - DNA, 15 bp, Homo sapiens
gatctggtctctctg

SEQ ID NO: 368499 - DNA, 15 bp, Homo sapiens
atctggtctctctga

SEQ ID NO: 368500 - DNA, 15 bp, Homo sapiens
tctggtctctctgat

SEQ ID NO: 368501 - DNA, 15 bp, Homo sapiens
ctggtctctctgatt

SEQ ID NO: 368502 - DNA, 15 bp, Homo sapiens
tggtctctctgattg

SEQ ID NO: 368503 - DNA, 15 bp, Homo sapiens
ggtctctctgattgg

SEQ ID NO: 368504 - DNA, 15 bp, Homo sapiens
gtctctctgattggg

SEQ ID NO: 368505 - DNA, 15 bp, Homo sapiens
tctctctgattggga

SEQ ID NO: 368506 - DNA, 15 bp, Homo sapiens
ctctctgattgggaa

SEQ ID NO: 368507 - DNA, 15 bp, Homo sapiens
tctctgattgggaat

SEQ ID NO: 368508 - DNA, 15 bp, Homo sapiens
ctctgattgggaatc

SEQ ID NO: 368509 - DNA, 15 bp, Homo sapiens
tctgattgggaatca

SEQ ID NO: 368510 - DNA, 15 bp, Homo sapiens
ctgattgggaatcac

SEQ ID NO: 368511 - DNA, 15 bp, Homo sapiens
tgattgggaatcact

SEQ ID NO: 368512 - DNA, 15 bp, Homo sapiens
gattgggaatcactg

SEQ ID NO: 368513 - DNA, 15 bp, Homo sapiens
attgggaatcactgc

SEQ ID NO: 368514 - DNA, 15 bp, Homo sapiens
ttgggaatcactgcc

SEQ ID NO: 368515 - DNA, 15 bp, Homo sapiens
tgggaatcactgcct

SEQ ID NO: 368516 - DNA, 15 bp, Homo sapiens
gggaatcactgcctg

SEQ ID NO: 368517 - DNA, 15 bp, Homo sapiens
ggaatcactgcctgt

SEQ ID NO: 368518 - DNA, 15 bp, Homo sapiens
gaatcactgcctgtt

SEQ ID NO: 368519 - DNA, 15 bp, Homo sapiens
aatcactgcctgttg

SEQ ID NO: 368520 - DNA, 15 bp, Homo sapiens
atcactgcctgttga

SEQ ID NO: 368521 - DNA, 15 bp, Homo sapiens
tcactgcctgttgag

SEQ ID NO: 368522 - DNA, 15 bp, Homo sapiens
cactgcctgttgagt

SEQ ID NO: 368523 - DNA, 15 bp, Homo sapiens
actgcctgttgagtc

SEQ ID NO: 368524 - DNA, 15 bp, Homo sapiens
ctgcctgttgagtca

SEQ ID NO: 368525 - DNA, 15 bp, Homo sapiens
tgcctgttgagtcac

SEQ ID NO: 368526 - DNA, 15 bp, Homo sapiens
gcctgttgagtcact

SEQ ID NO: 368527 - DNA, 15 bp, Homo sapiens
cctgttgagtcactg

SEQ ID NO: 368528 - DNA, 15 bp, Homo sapiens
ctgttgagtcactgt

SEQ ID NO: 368529 - DNA, 15 bp, Homo sapiens
tgttgagtcactgtg

SEQ ID NO: 368530 - DNA, 15 bp, Homo sapiens
gttgagtcactgtga

SEQ ID NO: 368531 - DNA, 15 bp, Homo sapiens
ttgagtcactgtgat

SEQ ID NO: 368532 - DNA, 15 bp, Homo sapiens
tgagtcactgtgatt

SEQ ID NO: 368533 - DNA, 15 bp, Homo sapiens
gagtcactgtgattc

SEQ ID NO: 368534 - DNA, 15 bp, Homo sapiens
agtcactgtgattca

SEQ ID NO: 368535 - DNA, 15 bp, Homo sapiens
gtcactgtgattcac

SEQ ID NO: 368536 - DNA, 15 bp, Homo sapiens
tcactgtgattcaca

SEQ ID NO: 368537 - DNA, 15 bp, Homo sapiens
cactgtgattcacac

SEQ ID NO: 368538 - DNA, 15 bp, Homo sapiens
actgtgattcacaca

SEQ ID NO: 368539 - DNA, 15 bp, Homo sapiens
ctgtgattcacacat

SEQ ID NO: 368540 - DNA, 15 bp, Homo sapiens
tgtgattcacacatg

SEQ ID NO: 368541 - DNA, 15 bp, Homo sapiens
gtgattcacacatgt

SEQ ID NO: 368542 - DNA, 15 bp, Homo sapiens
tgattcacacatgtg

SEQ ID NO: 368543 - DNA, 15 bp, Homo sapiens
gattcacacatgtgt

SEQ ID NO: 368544 - DNA, 15 bp, Homo sapiens
attcacacatgtgta

SEQ ID NO: 368545 - DNA, 15 bp, Homo sapiens
ttcacacatgtgtat

SEQ ID NO: 368546 - DNA, 15 bp, Homo sapiens
tcacacatgtgtatc

SEQ ID NO: 368547 - DNA, 15 bp, Homo sapiens
cacacatgtgtatct

SEQ ID NO: 368548 - DNA, 15 bp, Homo sapiens
acacatgtgtatctc

SEQ ID NO: 368549 - DNA, 15 bp, Homo sapiens
cacatgtgtatctct

SEQ ID NO: 368550 - DNA, 15 bp, Homo sapiens
acatgtgtatctctg

SEQ ID NO: 368551 - DNA, 15 bp, Homo sapiens
catgtgtatctctgg

SEQ ID NO: 368552 - DNA, 15 bp, Homo sapiens
atgtgtatctctggt

SEQ ID NO: 368553 - DNA, 15 bp, Homo sapiens
tgtgtatctctggtc

SEQ ID NO: 368554 - DNA, 15 bp, Homo sapiens
gtgtatctctggtct

SEQ ID NO: 368555 - DNA, 15 bp, Homo sapiens
tgtatctctggtctg

SEQ ID NO: 368556 - DNA, 15 bp, Homo sapiens
gtatctctggtctgg

SEQ ID NO: 368557 - DNA, 15 bp, Homo sapiens
tatctctggtctgga

SEQ ID NO: 368558 - DNA, 15 bp, Homo sapiens
atctctggtctggac

SEQ ID NO: 368559 - DNA, 15 bp, Homo sapiens
tctctggtctggacc

SEQ ID NO: 368560 - DNA, 15 bp, Homo sapiens
ctctggtctggacct

SEQ ID NO: 368561 - DNA, 15 bp, Homo sapiens
tctggtctggacctt

SEQ ID NO: 368562 - DNA, 15 bp, Homo sapiens
ctggtctggaccttt

SEQ ID NO: 368563 - DNA, 15 bp, Homo sapiens
tggtctggacctttc

SEQ ID NO: 368564 - DNA, 15 bp, Homo sapiens
ggtctggacctttct

SEQ ID NO: 368565 - DNA, 15 bp, Homo sapiens
gtctggacctttctc

SEQ ID NO: 368566 - DNA, 15 bp, Homo sapiens
tctggacctttctcc

SEQ ID NO: 368567 - DNA, 15 bp, Homo sapiens
ctggacctttctcca

SEQ ID NO: 368568 - DNA, 15 bp, Homo sapiens
tggacctttctccat

SEQ ID NO: 368569 - DNA, 15 bp, Homo sapiens
ggacctttctccata

SEQ ID NO: 368570 - DNA, 15 bp, Homo sapiens
gacctttctccatac

SEQ ID NO: 368571 - DNA, 15 bp, Homo sapiens
acctttctccatact

SEQ ID NO: 368572 - DNA, 15 bp, Homo sapiens
cctttctccatactc

SEQ ID NO: 368573 - DNA, 15 bp, Homo sapiens
ctttctccatactct

SEQ ID NO: 368574 - DNA, 15 bp, Homo sapiens
tttctccatactcta

SEQ ID NO: 368575 - DNA, 15 bp, Homo sapiens
ttctccatactctaa

SEQ ID NO: 368576 - DNA, 15 bp, Homo sapiens
tctccatactctaaa

SEQ ID NO: 368577 - DNA, 15 bp, Homo sapiens
ctccatactctaaac

SEQ ID NO: 368578 - DNA, 15 bp, Homo sapiens
tccatactctaaact

SEQ ID NO: 368579 - DNA, 15 bp, Homo sapiens
ccatactctaaactt

SEQ ID NO: 368580 - DNA, 15 bp, Homo sapiens
catactctaaacttg

SEQ ID NO: 368581 - DNA, 15 bp, Homo sapiens
atactctaaacttgt

SEQ ID NO: 368582 - DNA, 15 bp, Homo sapiens
tactctaaacttgtg

SEQ ID NO: 368583 - DNA, 15 bp, Homo sapiens
actctaaacttgtgt

SEQ ID NO: 368584 - DNA, 15 bp, Homo sapiens
ctctaaacttgtgta

SEQ ID NO: 368585 - DNA, 15 bp, Homo sapiens
tctaaacttgtgtat

SEQ ID NO: 368586 - DNA, 15 bp, Homo sapiens
ctaaacttgtgtatg

SEQ ID NO: 368587 - DNA, 15 bp, Homo sapiens
taaacttgtgtatgc

SEQ ID NO: 368588 - DNA, 15 bp, Homo sapiens
aaacttgtgtatgca

SEQ ID NO: 368589 - DNA, 15 bp, Homo sapiens
aacttgtgtatgcaa

SEQ ID NO: 368590 - DNA, 15 bp, Homo sapiens
acttgtgtatgcaac

SEQ ID NO: 368591 - DNA, 15 bp, Homo sapiens
cttgtgtatgcaact

SEQ ID NO: 368592 - DNA, 15 bp, Homo sapiens
ttgtgtatgcaacta

SEQ ID NO: 368593 - DNA, 15 bp, Homo sapiens
tgtgtatgcaactac

SEQ ID NO: 368594 - DNA, 15 bp, Homo sapiens
gtgtatgcaactacc

SEQ ID NO: 368595 - DNA, 15 bp, Homo sapiens
tgtatgcaactacct

SEQ ID NO: 368596 - DNA, 15 bp, Homo sapiens
gtatgcaactacctg

SEQ ID NO: 368597 - DNA, 15 bp, Homo sapiens
tatgcaactacctgc

SEQ ID NO: 368598 - DNA, 15 bp, Homo sapiens
atgcaactacctgct

SEQ ID NO: 368599 - DNA, 15 bp, Homo sapiens
tgcaactacctgctc

SEQ ID NO: 368600 - DNA, 15 bp, Homo sapiens
gcaactacctgctca

SEQ ID NO: 368601 - DNA, 15 bp, Homo sapiens
caactacctgctcaa

SEQ ID NO: 368602 - DNA, 15 bp, Homo sapiens
aactacctgctcaac

SEQ ID NO: 368603 - DNA, 15 bp, Homo sapiens
actacctgctcaaca

SEQ ID NO: 368604 - DNA, 15 bp, Homo sapiens
ctacctgctcaacat

SEQ ID NO: 368605 - DNA, 15 bp, Homo sapiens
tacctgctcaacatc

SEQ ID NO: 368606 - DNA, 15 bp, Homo sapiens
acctgctcaacatct

SEQ ID NO: 368607 - DNA, 15 bp, Homo sapiens
cctgctcaacatctc

SEQ ID NO: 368608 - DNA, 15 bp, Homo sapiens
ctgctcaacatctct

SEQ ID NO: 368609 - DNA, 15 bp, Homo sapiens
tgctcaacatctctc

SEQ ID NO: 368610 - DNA, 15 bp, Homo sapiens
gctcaacatctctcc

SEQ ID NO: 368611 - DNA, 15 bp, Homo sapiens
ctcaacatctctcct

SEQ ID NO: 368612 - DNA, 15 bp, Homo sapiens
tcaacatctctcctt

SEQ ID NO: 368613 - DNA, 15 bp, Homo sapiens
caacatctctcctta

SEQ ID NO: 368614 - DNA, 15 bp, Homo sapiens
aacatctctccttaa

SEQ ID NO: 368615 - DNA, 15 bp, Homo sapiens
acatctctccttaaa

SEQ ID NO: 368616 - DNA, 15 bp, Homo sapiens
catctctccttaaat

SEQ ID NO: 368617 - DNA, 15 bp, Homo sapiens
atctctccttaaatg

SEQ ID NO: 368618 - DNA, 15 bp, Homo sapiens
tctctccttaaatgt

SEQ ID NO: 368619 - DNA, 15 bp, Homo sapiens
ctctccttaaatgtc

SEQ ID NO: 368620 - DNA, 15 bp, Homo sapiens
tctccttaaatgtct

SEQ ID NO: 368621 - DNA, 15 bp, Homo sapiens
ctccttaaatgtcta

SEQ ID NO: 368622 - DNA, 15 bp, Homo sapiens
tccttaaatgtctaa

SEQ ID NO: 368623 - DNA, 15 bp, Homo sapiens
ccttaaatgtctaat

SEQ ID NO: 368624 - DNA, 15 bp, Homo sapiens
cttaaatgtctaata

SEQ ID NO: 368625 - DNA, 15 bp, Homo sapiens
ttaaatgtctaatag

SEQ ID NO: 368626 - DNA, 15 bp, Homo sapiens
taaatgtctaatagg

SEQ ID NO: 368627 - DNA, 15 bp, Homo sapiens
aaatgtctaataggc

SEQ ID NO: 368628 - DNA, 15 bp, Homo sapiens
aatgtctaataggca

SEQ ID NO: 368629 - DNA, 15 bp, Homo sapiens
atgtctaataggcac

SEQ ID NO: 368630 - DNA, 15 bp, Homo sapiens
tgtctaataggcacc

SEQ ID NO: 368631 - DNA, 15 bp, Homo sapiens
gtctaataggcacct

SEQ ID NO: 368632 - DNA, 15 bp, Homo sapiens
tctaataggcacctc

SEQ ID NO: 368633 - DNA, 15 bp, Homo sapiens
ctaataggcacctca

SEQ ID NO: 368634 - DNA, 15 bp, Homo sapiens
taataggcacctcaa

SEQ ID NO: 368635 - DNA, 15 bp, Homo sapiens
aataggcacctcaaa

SEQ ID NO: 368636 - DNA, 15 bp, Homo sapiens
ataggcacctcaaac

SEQ ID NO: 368637 - DNA, 15 bp, Homo sapiens
taggcacctcaaact

SEQ ID NO: 368638 - DNA, 15 bp, Homo sapiens
aggcacctcaaacta

SEQ ID NO: 368639 - DNA, 15 bp, Homo sapiens
ggcacctcaaactaa

SEQ ID NO: 368640 - DNA, 15 bp, Homo sapiens
gcacctcaaactaac

SEQ ID NO: 368641 - DNA, 15 bp, Homo sapiens
cacctcaaactaaca

SEQ ID NO: 368642 - DNA, 15 bp, Homo sapiens
acctcaaactaacat

SEQ ID NO: 368643 - DNA, 15 bp, Homo sapiens
cctcaaactaacata

SEQ ID NO: 368644 - DNA, 15 bp, Homo sapiens
ctcaaactaacatac

SEQ ID NO: 368645 - DNA, 15 bp, Homo sapiens
tcaaactaacataca

SEQ ID NO: 368646 - DNA, 15 bp, Homo sapiens
caaactaacatacac

SEQ ID NO: 368647 - DNA, 15 bp, Homo sapiens
aaactaacatacaca

SEQ ID NO: 368648 - DNA, 15 bp, Homo sapiens
aactaacatacacaa

SEQ ID NO: 368649 - DNA, 15 bp, Homo sapiens
actaacatacacaat

SEQ ID NO: 368650 - DNA, 15 bp, Homo sapiens
ctaacatacacaatc

SEQ ID NO: 368651 - DNA, 15 bp, Homo sapiens
taacatacacaatcg

SEQ ID NO: 368652 - DNA, 15 bp, Homo sapiens
aacatacacaatcga

SEQ ID NO: 368653 - DNA, 15 bp, Homo sapiens
acatacacaatcgag

SEQ ID NO: 368654 - DNA, 15 bp, Homo sapiens
catacacaatcgagc

SEQ ID NO: 368655 - DNA, 15 bp, Homo sapiens
atacacaatcgagct

SEQ ID NO: 368656 - DNA, 15 bp, Homo sapiens
tacacaatcgagctt

SEQ ID NO: 368657 - DNA, 15 bp, Homo sapiens
acacaatcgagcttt

SEQ ID NO: 368658 - DNA, 15 bp, Homo sapiens
cacaatcgagctttt

SEQ ID NO: 368659 - DNA, 15 bp, Homo sapiens
acaatcgagcttttg

SEQ ID NO: 368660 - DNA, 15 bp, Homo sapiens
caatcgagcttttga

SEQ ID NO: 368661 - DNA, 15 bp, Homo sapiens
aatcgagcttttgat

SEQ ID NO: 368662 - DNA, 15 bp, Homo sapiens
atcgagcttttgata

SEQ ID NO: 368663 - DNA, 15 bp, Homo sapiens
tcgagcttttgatat

SEQ ID NO: 368664 - DNA, 15 bp, Homo sapiens
cgagcttttgatatc

SEQ ID NO: 368665 - DNA, 15 bp, Homo sapiens
gagcttttgatatcc

SEQ ID NO: 368666 - DNA, 15 bp, Homo sapiens
agcttttgatatccc

SEQ ID NO: 368667 - DNA, 15 bp, Homo sapiens
gcttttgatatccct

SEQ ID NO: 368668 - DNA, 15 bp, Homo sapiens
cttttgatatccctc

SEQ ID NO: 368669 - DNA, 15 bp, Homo sapiens
ttttgatatccctct

SEQ ID NO: 368670 - DNA, 15 bp, Homo sapiens
tttgatatccctctc

SEQ ID NO: 368671 - DNA, 15 bp, Homo sapiens
ttgatatccctctcc

SEQ ID NO: 368672 - DNA, 15 bp, Homo sapiens
tgatatccctctccc

SEQ ID NO: 368673 - DNA, 15 bp, Homo sapiens
gatatccctctccct

SEQ ID NO: 368674 - DNA, 15 bp, Homo sapiens
atatccctctccctt

SEQ ID NO: 368675 - DNA, 15 bp, Homo sapiens
tatccctctcccttc

SEQ ID NO: 368676 - DNA, 15 bp, Homo sapiens
atccctctcccttct

SEQ ID NO: 368677 - DNA, 15 bp, Homo sapiens
tccctctcccttctg

SEQ ID NO: 368678 - DNA, 15 bp, Homo sapiens
ccctctcccttctgt

SEQ ID NO: 368679 - DNA, 15 bp, Homo sapiens
cctctcccttctgtg

SEQ ID NO: 368680 - DNA, 15 bp, Homo sapiens
ctctcccttctgtgc

SEQ ID NO: 368681 - DNA, 15 bp, Homo sapiens
tctcccttctgtgcc

SEQ ID NO: 368682 - DNA, 15 bp, Homo sapiens
ctcccttctgtgcct

SEQ ID NO: 368683 - DNA, 15 bp, Homo sapiens
tcccttctgtgcctt

SEQ ID NO: 368684 - DNA, 15 bp, Homo sapiens
cccttctgtgcctta

SEQ ID NO: 368685 - DNA, 15 bp, Homo sapiens
ccttctgtgccttaa

SEQ ID NO: 368686 - DNA, 15 bp, Homo sapiens
cttctgtgccttaat

SEQ ID NO: 368687 - DNA, 15 bp, Homo sapiens
ttctgtgccttaata

SEQ ID NO: 368688 - DNA, 15 bp, Homo sapiens
tctgtgccttaatat

SEQ ID NO: 368689 - DNA, 15 bp, Homo sapiens
ctgtgccttaatata

SEQ ID NO: 368690 - DNA, 15 bp, Homo sapiens
tgtgccttaatatac

SEQ ID NO: 368691 - DNA, 15 bp, Homo sapiens
gtgccttaatataca

SEQ ID NO: 368692 - DNA, 15 bp, Homo sapiens
tgccttaatatacat

SEQ ID NO: 368693 - DNA, 15 bp, Homo sapiens
gccttaatatacatc

SEQ ID NO: 368694 - DNA, 15 bp, Homo sapiens
ccttaatatacatct

SEQ ID NO: 368695 - DNA, 15 bp, Homo sapiens
cttaatatacatctc

SEQ ID NO: 368696 - DNA, 15 bp, Homo sapiens
ttaatatacatctcc

SEQ ID NO: 368697 - DNA, 15 bp, Homo sapiens
taatatacatctccc

SEQ ID NO: 368698 - DNA, 15 bp, Homo sapiens
aatatacatctccca

SEQ ID NO: 368699 - DNA, 15 bp, Homo sapiens
atatacatctcccac

SEQ ID NO: 368700 - DNA, 15 bp, Homo sapiens
tatacatctcccacc

SEQ ID NO: 368701 - DNA, 15 bp, Homo sapiens
atacatctcccacct

SEQ ID NO: 368702 - DNA, 15 bp, Homo sapiens
tacatctcccacctt

SEQ ID NO: 368703 - DNA, 15 bp, Homo sapiens
acatctcccacctta

SEQ ID NO: 368704 - DNA, 15 bp, Homo sapiens
catctcccaccttag

SEQ ID NO: 368705 - DNA, 15 bp, Homo sapiens
atctcccaccttagt

SEQ ID NO: 368706 - DNA, 15 bp, Homo sapiens
tctcccaccttagtc

SEQ ID NO: 368707 - DNA, 15 bp, Homo sapiens
ctcccaccttagtca

SEQ ID NO: 368708 - DNA, 15 bp, Homo sapiens
tcccaccttagtcaa

SEQ ID NO: 368709 - DNA, 15 bp, Homo sapiens
cccaccttagtcaat

SEQ ID NO: 368710 - DNA, 15 bp, Homo sapiens
ccaccttagtcaatg

SEQ ID NO: 368711 - DNA, 15 bp, Homo sapiens
caccttagtcaatgg

SEQ ID NO: 368712 - DNA, 15 bp, Homo sapiens
accttagtcaatgga

SEQ ID NO: 368713 - DNA, 15 bp, Homo sapiens
ccttagtcaatggaa

SEQ ID NO: 368714 - DNA, 15 bp, Homo sapiens
cttagtcaatggaag

SEQ ID NO: 368715 - DNA, 15 bp, Homo sapiens
ttagtcaatggaagt

SEQ ID NO: 368716 - DNA, 15 bp, Homo sapiens
tagtcaatggaagtt

SEQ ID NO: 368717 - DNA, 15 bp, Homo sapiens
agtcaatggaagttt

SEQ ID NO: 368718 - DNA, 15 bp, Homo sapiens
gtcaatggaagtttc

SEQ ID NO: 368719 - DNA, 15 bp, Homo sapiens
tcaatggaagtttca

SEQ ID NO: 368720 - DNA, 15 bp, Homo sapiens
caatggaagtttcat

SEQ ID NO: 368721 - DNA, 15 bp, Homo sapiens
aatggaagtttcatc

SEQ ID NO: 368722 - DNA, 15 bp, Homo sapiens
atggaagtttcatct

SEQ ID NO: 368723 - DNA, 15 bp, Homo sapiens
tggaagtttcatctt

SEQ ID NO: 368724 - DNA, 15 bp, Homo sapiens
ggaagtttcatctta

SEQ ID NO: 368725 - DNA, 15 bp, Homo sapiens
gaagtttcatcttat

SEQ ID NO: 368726 - DNA, 15 bp, Homo sapiens
aagtttcatcttatt

SEQ ID NO: 368727 - DNA, 15 bp, Homo sapiens
agtttcatcttatta

SEQ ID NO: 368728 - DNA, 15 bp, Homo sapiens
gtttcatcttattat

SEQ ID NO: 368729 - DNA, 15 bp, Homo sapiens
tttcatcttattatt

SEQ ID NO: 368730 - DNA, 15 bp, Homo sapiens
ttcatcttattatta

SEQ ID NO: 368731 - DNA, 15 bp, Homo sapiens
tcatcttattattac

SEQ ID NO: 368732 - DNA, 15 bp, Homo sapiens
catcttattattact

SEQ ID NO: 368733 - DNA, 15 bp, Homo sapiens
atcttattattactt

SEQ ID NO: 368734 - DNA, 15 bp, Homo sapiens
tcttattattactta

SEQ ID NO: 368735 - DNA, 15 bp, Homo sapiens
cttattattacttaa

SEQ ID NO: 368736 - DNA, 15 bp, Homo sapiens
ttattattacttaag

SEQ ID NO: 368737 - DNA, 15 bp, Homo sapiens
tattattacttaagt

SEQ ID NO: 368738 - DNA, 15 bp, Homo sapiens
attattacttaagtc

SEQ ID NO: 368739 - DNA, 15 bp, Homo sapiens
ttattacttaagtca

SEQ ID NO: 368740 - DNA, 15 bp, Homo sapiens
tattacttaagtcag

SEQ ID NO: 368741 - DNA, 15 bp, Homo sapiens
attacttaagtcaga

SEQ ID NO: 368742 - DNA, 15 bp, Homo sapiens
ttacttaagtcagaa

SEQ ID NO: 368743 - DNA, 15 bp, Homo sapiens
tacttaagtcagaaa

SEQ ID NO: 368744 - DNA, 15 bp, Homo sapiens
acttaagtcagaaat

SEQ ID NO: 368745 - DNA, 15 bp, Homo sapiens
cttaagtcagaaata

SEQ ID NO: 368746 - DNA, 15 bp, Homo sapiens
ttaagtcagaaatat

SEQ ID NO: 368747 - DNA, 15 bp, Homo sapiens
taagtcagaaatatt

SEQ ID NO: 368748 - DNA, 15 bp, Homo sapiens
aagtcagaaatattg

SEQ ID NO: 368749 - DNA, 15 bp, Homo sapiens
agtcagaaatattgg

SEQ ID NO: 368750 - DNA, 15 bp, Homo sapiens
gtcagaaatattgga

SEQ ID NO: 368751 - DNA, 15 bp, Homo sapiens
tcagaaatattggag

SEQ ID NO: 368752 - DNA, 15 bp, Homo sapiens
cagaaatattggagt

SEQ ID NO: 368753 - DNA, 15 bp, Homo sapiens
agaaatattggagtc

SEQ ID NO: 368754 - DNA, 15 bp, Homo sapiens
gaaatattggagtca

SEQ ID NO: 368755 - DNA, 15 bp, Homo sapiens
aaatattggagtcaa

SEQ ID NO: 368756 - DNA, 15 bp, Homo sapiens
aatattggagtcaat

SEQ ID NO: 368757 - DNA, 15 bp, Homo sapiens
atattggagtcaatc

SEQ ID NO: 368758 - DNA, 15 bp, Homo sapiens
tattggagtcaatcc

SEQ ID NO: 368759 - DNA, 15 bp, Homo sapiens
attggagtcaatcct

SEQ ID NO: 368760 - DNA, 15 bp, Homo sapiens
ttggagtcaatccta

SEQ ID NO: 368761 - DNA, 15 bp, Homo sapiens
tggagtcaatcctat

SEQ ID NO: 368762 - DNA, 15 bp, Homo sapiens
ggagtcaatcctatg

SEQ ID NO: 368763 - DNA, 15 bp, Homo sapiens
gagtcaatcctatgg

SEQ ID NO: 368764 - DNA, 15 bp, Homo sapiens
agtcaatcctatggt

SEQ ID NO: 368765 - DNA, 15 bp, Homo sapiens
gtcaatcctatggta

SEQ ID NO: 368766 - DNA, 15 bp, Homo sapiens
tcaatcctatggtat

SEQ ID NO: 368767 - DNA, 15 bp, Homo sapiens
caatcctatggtata

SEQ ID NO: 368768 - DNA, 15 bp, Homo sapiens
aatcctatggtatat

SEQ ID NO: 368769 - DNA, 15 bp, Homo sapiens
atcctatggtatatg

SEQ ID NO: 368770 - DNA, 15 bp, Homo sapiens
tcctatggtatatga

SEQ ID NO: 368771 - DNA, 15 bp, Homo sapiens
cctatggtatatgaa

SEQ ID NO: 368772 - DNA, 15 bp, Homo sapiens
ctatggtatatgaat

SEQ ID NO: 368773 - DNA, 15 bp, Homo sapiens
tatggtatatgaatt

SEQ ID NO: 368774 - DNA, 15 bp, Homo sapiens
atggtatatgaattc

SEQ ID NO: 368775 - DNA, 15 bp, Homo sapiens
tggtatatgaattct

SEQ ID NO: 368776 - DNA, 15 bp, Homo sapiens
ggtatatgaattcta

SEQ ID NO: 368777 - DNA, 15 bp, Homo sapiens
gtatatgaattctat

SEQ ID NO: 368778 - DNA, 15 bp, Homo sapiens
tatatgaattctatc

SEQ ID NO: 368779 - DNA, 15 bp, Homo sapiens
atatgaattctatca

SEQ ID NO: 368780 - DNA, 15 bp, Homo sapiens
tatgaattctatcac

SEQ ID NO: 368781 - DNA, 15 bp, Homo sapiens
atgaattctatcaca

SEQ ID NO: 368782 - DNA, 15 bp, Homo sapiens
tgaattctatcacaa

SEQ ID NO: 368783 - DNA, 15 bp, Homo sapiens
gaattctatcacaaa

SEQ ID NO: 368784 - DNA, 15 bp, Homo sapiens
aattctatcacaaaa

SEQ ID NO: 368785 - DNA, 15 bp, Homo sapiens
attctatcacaaaaa

SEQ ID NO: 368786 - DNA, 15 bp, Homo sapiens
ttctatcacaaaaag

SEQ ID NO: 368787 - DNA, 15 bp, Homo sapiens
tctatcacaaaaaga

SEQ ID NO: 368788 - DNA, 15 bp, Homo sapiens
ctatcacaaaaagaa

SEQ ID NO: 368789 - DNA, 15 bp, Homo sapiens
tatcacaaaaagaaa

SEQ ID NO: 368790 - DNA, 15 bp, Homo sapiens
atcacaaaaagaaac

SEQ ID NO: 368791 - DNA, 15 bp, Homo sapiens
tcacaaaaagaaaca

SEQ ID NO: 368792 - DNA, 15 bp, Homo sapiens
cacaaaaagaaacaa

SEQ ID NO: 368793 - DNA, 15 bp, Homo sapiens
acaaaaagaaacaaa

SEQ ID NO: 368794 - DNA, 15 bp, Homo sapiens
caaaaagaaacaaag

SEQ ID NO: 368795 - DNA, 15 bp, Homo sapiens
aaaaagaaacaaaga

SEQ ID NO: 368796 - DNA, 15 bp, Homo sapiens
aaaagaaacaaagaa

SEQ ID NO: 368797 - DNA, 15 bp, Homo sapiens
aaagaaacaaagaaa

SEQ ID NO: 368798 - DNA, 15 bp, Homo sapiens
aagaaacaaagaaaa

SEQ ID NO: 368799 - DNA, 15 bp, Homo sapiens
agaaacaaagaaaac

SEQ ID NO: 368800 - DNA, 15 bp, Homo sapiens
gaaacaaagaaaacc

SEQ ID NO: 368801 - DNA, 15 bp, Homo sapiens
aaacaaagaaaaccc

SEQ ID NO: 368802 - DNA, 15 bp, Homo sapiens
aacaaagaaaacccc

SEQ ID NO: 368803 - DNA, 15 bp, Homo sapiens
acaaagaaaaccccc

SEQ ID NO: 368804 - DNA, 15 bp, Homo sapiens
caaagaaaaccccca

SEQ ID NO: 368805 - DNA, 15 bp, Homo sapiens
aaagaaaacccccaa

SEQ ID NO: 368806 - DNA, 15 bp, Homo sapiens
aagaaaacccccaaa

SEQ ID NO: 368807 - DNA, 15 bp, Homo sapiens
agaaaacccccaaac

SEQ ID NO: 368808 - DNA, 15 bp, Homo sapiens
gaaaacccccaaacc

SEQ ID NO: 368809 - DNA, 15 bp, Homo sapiens
aaaacccccaaacca

SEQ ID NO: 368810 - DNA, 15 bp, Homo sapiens
aaacccccaaaccaa

SEQ ID NO: 368811 - DNA, 15 bp, Homo sapiens
aacccccaaaccaaa

SEQ ID NO: 368812 - DNA, 15 bp, Homo sapiens
acccccaaaccaaaa

SEQ ID NO: 368813 - DNA, 15 bp, Homo sapiens
cccccaaaccaaaaa

SEQ ID NO: 368814 - DNA, 15 bp, Homo sapiens
ccccaaaccaaaaac

SEQ ID NO: 368815 - DNA, 15 bp, Homo sapiens
cccaaaccaaaaact

SEQ ID NO: 368816 - DNA, 15 bp, Homo sapiens
ccaaaccaaaaacta

SEQ ID NO: 368817 - DNA, 15 bp, Homo sapiens
caaaccaaaaactat

SEQ ID NO: 368818 - DNA, 15 bp, Homo sapiens
aaaccaaaaactata

SEQ ID NO: 368819 - DNA, 15 bp, Homo sapiens
aaccaaaaactatac

SEQ ID NO: 368820 - DNA, 15 bp, Homo sapiens
accaaaaactatacc

SEQ ID NO: 368821 - DNA, 15 bp, Homo sapiens
ccaaaaactatacct

SEQ ID NO: 368822 - DNA, 15 bp, Homo sapiens
caaaaactatacctc

SEQ ID NO: 368823 - DNA, 15 bp, Homo sapiens
aaaaactatacctca

SEQ ID NO: 368824 - DNA, 15 bp, Homo sapiens
aaaactatacctcag

SEQ ID NO: 368825 - DNA, 15 bp, Homo sapiens
aaactatacctcagt

SEQ ID NO: 368826 - DNA, 15 bp, Homo sapiens
aactatacctcagtc

SEQ ID NO: 368827 - DNA, 15 bp, Homo sapiens
actatacctcagtca

SEQ ID NO: 368828 - DNA, 15 bp, Homo sapiens
ctatacctcagtcac

SEQ ID NO: 368829 - DNA, 15 bp, Homo sapiens
tatacctcagtcacc

SEQ ID NO: 368830 - DNA, 15 bp, Homo sapiens
atacctcagtcacca

SEQ ID NO: 368831 - DNA, 15 bp, Homo sapiens
tacctcagtcaccat

SEQ ID NO: 368832 - DNA, 15 bp, Homo sapiens
acctcagtcaccatt

SEQ ID NO: 368833 - DNA, 15 bp, Homo sapiens
cctcagtcaccatta

SEQ ID NO: 368834 - DNA, 15 bp, Homo sapiens
ctcagtcaccattag

SEQ ID NO: 368835 - DNA, 15 bp, Homo sapiens
tcagtcaccattagc

SEQ ID NO: 368836 - DNA, 15 bp, Homo sapiens
cagtcaccattagca

SEQ ID NO: 368837 - DNA, 15 bp, Homo sapiens
agtcaccattagcag

SEQ ID NO: 368838 - DNA, 15 bp, Homo sapiens
gtcaccattagcagc

SEQ ID NO: 368839 - DNA, 15 bp, Homo sapiens
tcaccattagcagct

SEQ ID NO: 368840 - DNA, 15 bp, Homo sapiens
caccattagcagctt

SEQ ID NO: 368841 - DNA, 15 bp, Homo sapiens
accattagcagcttt

SEQ ID NO: 368842 - DNA, 15 bp, Homo sapiens
ccattagcagctttt

SEQ ID NO: 368843 - DNA, 15 bp, Homo sapiens
cattagcagcttttc

SEQ ID NO: 368844 - DNA, 15 bp, Homo sapiens
attagcagcttttcc

SEQ ID NO: 368845 - DNA, 15 bp, Homo sapiens
ttagcagcttttcct

SEQ ID NO: 368846 - DNA, 15 bp, Homo sapiens
tagcagcttttcctt

SEQ ID NO: 368847 - DNA, 15 bp, Homo sapiens
agcagcttttccttc

SEQ ID NO: 368848 - DNA, 15 bp, Homo sapiens
gcagcttttccttca

SEQ ID NO: 368849 - DNA, 15 bp, Homo sapiens
cagcttttccttcaa

SEQ ID NO: 368850 - DNA, 15 bp, Homo sapiens
agcttttccttcaaa

SEQ ID NO: 368851 - DNA, 15 bp, Homo sapiens
gcttttccttcaaaa

SEQ ID NO: 368852 - DNA, 15 bp, Homo sapiens
cttttccttcaaaat

SEQ ID NO: 368853 - DNA, 15 bp, Homo sapiens
ttttccttcaaaata

SEQ ID NO: 368854 - DNA, 15 bp, Homo sapiens
tttccttcaaaatac

SEQ ID NO: 368855 - DNA, 15 bp, Homo sapiens
ttccttcaaaatacg

SEQ ID NO: 368856 - DNA, 15 bp, Homo sapiens
tccttcaaaatacgt

SEQ ID NO: 368857 - DNA, 15 bp, Homo sapiens
ccttcaaaatacgta

SEQ ID NO: 368858 - DNA, 15 bp, Homo sapiens
cttcaaaatacgtat

SEQ ID NO: 368859 - DNA, 15 bp, Homo sapiens
ttcaaaatacgtatc

SEQ ID NO: 368860 - DNA, 15 bp, Homo sapiens
tcaaaatacgtatct

SEQ ID NO: 368861 - DNA, 15 bp, Homo sapiens
caaaatacgtatcta

SEQ ID NO: 368862 - DNA, 15 bp, Homo sapiens
aaaatacgtatctac

SEQ ID NO: 368863 - DNA, 15 bp, Homo sapiens
aaatacgtatctact

SEQ ID NO: 368864 - DNA, 15 bp, Homo sapiens
aatacgtatctactg

SEQ ID NO: 368865 - DNA, 15 bp, Homo sapiens
atacgtatctactgg

SEQ ID NO: 368866 - DNA, 15 bp, Homo sapiens
tacgtatctactgga

SEQ ID NO: 368867 - DNA, 15 bp, Homo sapiens
acgtatctactggat

SEQ ID NO: 368868 - DNA, 15 bp, Homo sapiens
cgtatctactggatg

SEQ ID NO: 368869 - DNA, 15 bp, Homo sapiens
gtatctactggatgg

SEQ ID NO: 368870 - DNA, 15 bp, Homo sapiens
tatctactggatgga

SEQ ID NO: 368871 - DNA, 15 bp, Homo sapiens
atctactggatggat

SEQ ID NO: 368872 - DNA, 15 bp, Homo sapiens
tctactggatggatg

SEQ ID NO: 368873 - DNA, 15 bp, Homo sapiens
ctactggatggatgg

SEQ ID NO: 368874 - DNA, 15 bp, Homo sapiens
tactggatggatggt

SEQ ID NO: 368875 - DNA, 15 bp, Homo sapiens
actggatggatggtt

SEQ ID NO: 368876 - DNA, 15 bp, Homo sapiens
ctggatggatggttt

SEQ ID NO: 368877 - DNA, 15 bp, Homo sapiens
tggatggatggttta

SEQ ID NO: 368878 - DNA, 15 bp, Homo sapiens
ggatggatggtttat

SEQ ID NO: 368879 - DNA, 15 bp, Homo sapiens
gatggatggtttatt

SEQ ID NO: 368880 - DNA, 15 bp, Homo sapiens
atggatggtttattg

SEQ ID NO: 368881 - DNA, 15 bp, Homo sapiens
tggatggtttattgg

SEQ ID NO: 368882 - DNA, 15 bp, Homo sapiens
ggatggtttattgga

SEQ ID NO: 368883 - DNA, 15 bp, Homo sapiens
gatggtttattggat

SEQ ID NO: 368884 - DNA, 15 bp, Homo sapiens
atggtttattggata

SEQ ID NO: 368885 - DNA, 15 bp, Homo sapiens
tggtttattggatag

SEQ ID NO: 368886 - DNA, 15 bp, Homo sapiens
ggtttattggatagc

SEQ ID NO: 368887 - DNA, 15 bp, Homo sapiens
gtttattggatagcc

SEQ ID NO: 368888 - DNA, 15 bp, Homo sapiens
tttattggatagcca

SEQ ID NO: 368889 - DNA, 15 bp, Homo sapiens
ttattggatagccag

SEQ ID NO: 368890 - DNA, 15 bp, Homo sapiens
tattggatagccaga

SEQ ID NO: 368891 - DNA, 15 bp, Homo sapiens
attggatagccagat

SEQ ID NO: 368892 - DNA, 15 bp, Homo sapiens
ttggatagccagatg

SEQ ID NO: 368893 - DNA, 15 bp, Homo sapiens
tggatagccagatgg

SEQ ID NO: 368894 - DNA, 15 bp, Homo sapiens
ggatagccagatggc

SEQ ID NO: 368895 - DNA, 15 bp, Homo sapiens
gatagccagatggct

SEQ ID NO: 368896 - DNA, 15 bp, Homo sapiens
atagccagatggcta

SEQ ID NO: 368897 - DNA, 15 bp, Homo sapiens
tagccagatggctat

SEQ ID NO: 368898 - DNA, 15 bp, Homo sapiens
agccagatggctatg

SEQ ID NO: 368899 - DNA, 15 bp, Homo sapiens
gccagatggctatgt

SEQ ID NO: 368900 - DNA, 15 bp, Homo sapiens
ccagatggctatgtg

SEQ ID NO: 368901 - DNA, 15 bp, Homo sapiens
cagatggctatgtgt

SEQ ID NO: 368902 - DNA, 15 bp, Homo sapiens
agatggctatgtgtg

SEQ ID NO: 368903 - DNA, 15 bp, Homo sapiens
gatggctatgtgtga

SEQ ID NO: 368904 - DNA, 15 bp, Homo sapiens
atggctatgtgtgat

SEQ ID NO: 368905 - DNA, 15 bp, Homo sapiens
tggctatgtgtgata

SEQ ID NO: 368906 - DNA, 15 bp, Homo sapiens
ggctatgtgtgataa

SEQ ID NO: 368907 - DNA, 15 bp, Homo sapiens
ctatgtgtgataagg

SEQ ID NO: 368908 - DNA, 15 bp, Homo sapiens
tatgtgtgataaggc

SEQ ID NO: 368909 - DNA, 15 bp, Homo sapiens
atgtgtgataaggca

SEQ ID NO: 368910 - DNA, 15 bp, Homo sapiens
tgtgtgataaggcaa

SEQ ID NO: 368911 - DNA, 15 bp, Homo sapiens
gtgtgataaggcaaa

SEQ ID NO: 368912 - DNA, 15 bp, Homo sapiens
tgtgataaggcaaat

SEQ ID NO: 368913 - DNA, 15 bp, Homo sapiens
gtgataaggcaaatg

SEQ ID NO: 368914 - DNA, 15 bp, Homo sapiens
tgataaggcaaatgt

SEQ ID NO: 368915 - DNA, 15 bp, Homo sapiens
gataaggcaaatgta

SEQ ID NO: 368916 - DNA, 15 bp, Homo sapiens
ataaggcaaatgtag

SEQ ID NO: 368917 - DNA, 15 bp, Homo sapiens
taaggcaaatgtagc

SEQ ID NO: 368918 - DNA, 15 bp, Homo sapiens
aaggcaaatgtagca

SEQ ID NO: 368919 - DNA, 15 bp, Homo sapiens
aggcaaatgtagcag

SEQ ID NO: 368920 - DNA, 15 bp, Homo sapiens
ggcaaatgtagcaga

SEQ ID NO: 368921 - DNA, 15 bp, Homo sapiens
gcaaatgtagcagaa

SEQ ID NO: 368922 - DNA, 15 bp, Homo sapiens
caaatgtagcagaag

SEQ ID NO: 368923 - DNA, 15 bp, Homo sapiens
aaatgtagcagaagt

SEQ ID NO: 368924 - DNA, 15 bp, Homo sapiens
aatgtagcagaagtt

SEQ ID NO: 368925 - DNA, 15 bp, Homo sapiens
atgtagcagaagttt

SEQ ID NO: 368926 - DNA, 15 bp, Homo sapiens
tgtagcagaagtttg

SEQ ID NO: 368927 - DNA, 15 bp, Homo sapiens
gtagcagaagtttga

SEQ ID NO: 368928 - DNA, 15 bp, Homo sapiens
tagcagaagtttgac

SEQ ID NO: 368929 - DNA, 15 bp, Homo sapiens
agcagaagtttgaca

SEQ ID NO: 368930 - DNA, 15 bp, Homo sapiens
gcagaagtttgacag

SEQ ID NO: 368931 - DNA, 15 bp, Homo sapiens
cagaagtttgacagt

SEQ ID NO: 368932 - DNA, 15 bp, Homo sapiens
agaagtttgacagtt

SEQ ID NO: 368933 - DNA, 15 bp, Homo sapiens
gaagtttgacagttg

SEQ ID NO: 368934 - DNA, 15 bp, Homo sapiens
aagtttgacagttgt

SEQ ID NO: 368935 - DNA, 15 bp, Homo sapiens
agtttgacagttgta

SEQ ID NO: 368936 - DNA, 15 bp, Homo sapiens
gtttgacagttgtag

SEQ ID NO: 368937 - DNA, 15 bp, Homo sapiens
tttgacagttgtaga

SEQ ID NO: 368938 - DNA, 15 bp, Homo sapiens
ttgacagttgtagat

SEQ ID NO: 368939 - DNA, 15 bp, Homo sapiens
tgacagttgtagatg

SEQ ID NO: 368940 - DNA, 15 bp, Homo sapiens
gacagttgtagatgt

SEQ ID NO: 368941 - DNA, 15 bp, Homo sapiens
acagttgtagatgtc

SEQ ID NO: 368942 - DNA, 15 bp, Homo sapiens
cagttgtagatgtca

SEQ ID NO: 368943 - DNA, 15 bp, Homo sapiens
agttgtagatgtcag

SEQ ID NO: 368944 - DNA, 15 bp, Homo sapiens
gttgtagatgtcaga

SEQ ID NO: 368945 - DNA, 15 bp, Homo sapiens
ttgtagatgtcagag

SEQ ID NO: 368946 - DNA, 15 bp, Homo sapiens
tgtagatgtcagagg

SEQ ID NO: 368947 - DNA, 15 bp, Homo sapiens
gtagatgtcagaggg

SEQ ID NO: 368948 - DNA, 15 bp, Homo sapiens
tagatgtcagagggc

SEQ ID NO: 368949 - DNA, 15 bp, Homo sapiens
agatgtcagagggca

SEQ ID NO: 368950 - DNA, 15 bp, Homo sapiens
gatgtcagagggcac

SEQ ID NO: 368951 - DNA, 15 bp, Homo sapiens
atgtcagagggcaca

SEQ ID NO: 368952 - DNA, 15 bp, Homo sapiens
tgtcagagggcacat

SEQ ID NO: 368953 - DNA, 15 bp, Homo sapiens
gtcagagggcacata

SEQ ID NO: 368954 - DNA, 15 bp, Homo sapiens
tcagagggcacatag

SEQ ID NO: 368955 - DNA, 15 bp, Homo sapiens
cagagggcacataga

SEQ ID NO: 368956 - DNA, 15 bp, Homo sapiens
agagggcacatagat

SEQ ID NO: 368957 - DNA, 15 bp, Homo sapiens
gagggcacatagata

SEQ ID NO: 368958 - DNA, 15 bp, Homo sapiens
agggcacatagatat

SEQ ID NO: 368959 - DNA, 15 bp, Homo sapiens
gggcacatagatatt

SEQ ID NO: 368960 - DNA, 15 bp, Homo sapiens
ggcacatagatattt

SEQ ID NO: 368961 - DNA, 15 bp, Homo sapiens
gcacatagatatttc

SEQ ID NO: 368962 - DNA, 15 bp, Homo sapiens
cacatagatatttcc

SEQ ID NO: 368963 - DNA, 15 bp, Homo sapiens
acatagatatttcct

SEQ ID NO: 368964 - DNA, 15 bp, Homo sapiens
catagatatttcctc

SEQ ID NO: 368965 - DNA, 15 bp, Homo sapiens
atagatatttcctct

SEQ ID NO: 368966 - DNA, 15 bp, Homo sapiens
tagatatttcctcta

SEQ ID NO: 368967 - DNA, 15 bp, Homo sapiens
agatatttcctctac

SEQ ID NO: 368968 - DNA, 15 bp, Homo sapiens
gatatttcctctaca

SEQ ID NO: 368969 - DNA, 15 bp, Homo sapiens
atatttcctctacaa

SEQ ID NO: 368970 - DNA, 15 bp, Homo sapiens
tatttcctctacaat

SEQ ID NO: 368971 - DNA, 15 bp, Homo sapiens
atttcctctacaatt

SEQ ID NO: 368972 - DNA, 15 bp, Homo sapiens
tttcctctacaattc

SEQ ID NO: 368973 - DNA, 15 bp, Homo sapiens
ttcctctacaattct

SEQ ID NO: 368974 - DNA, 15 bp, Homo sapiens
tcctctacaattctt

SEQ ID NO: 368975 - DNA, 15 bp, Homo sapiens
cctctacaattcttt

SEQ ID NO: 368976 - DNA, 15 bp, Homo sapiens
ctctacaattctttc

SEQ ID NO: 368977 - DNA, 15 bp, Homo sapiens
tctacaattctttcg

SEQ ID NO: 368978 - DNA, 15 bp, Homo sapiens
ctacaattctttcga

SEQ ID NO: 368979 - DNA, 15 bp, Homo sapiens
tacaattctttcgac

SEQ ID NO: 368980 - DNA, 15 bp, Homo sapiens
acaattctttcgact

SEQ ID NO: 368981 - DNA, 15 bp, Homo sapiens
caattctttcgactt

SEQ ID NO: 368982 - DNA, 15 bp, Homo sapiens
aattctttcgacttt

SEQ ID NO: 368983 - DNA, 15 bp, Homo sapiens
attctttcgactttt

SEQ ID NO: 368984 - DNA, 15 bp, Homo sapiens
ttctttcgacttttc

SEQ ID NO: 368985 - DNA, 15 bp, Homo sapiens
tctttcgacttttct

SEQ ID NO: 368986 - DNA, 15 bp, Homo sapiens
ctttcgacttttctt

SEQ ID NO: 368987 - DNA, 15 bp, Homo sapiens
tttcgacttttctta

SEQ ID NO: 368988 - DNA, 15 bp, Homo sapiens
ttcgacttttcttag

SEQ ID NO: 368989 - DNA, 15 bp, Homo sapiens
tcgacttttcttagg

SEQ ID NO: 368990 - DNA, 15 bp, Homo sapiens
cgacttttcttaggt

SEQ ID NO: 368991 - DNA, 15 bp, Homo sapiens
gacttttcttaggtc

SEQ ID NO: 368992 - DNA, 15 bp, Homo sapiens
acttttcttaggtca

SEQ ID NO: 368993 - DNA, 15 bp, Homo sapiens
cttttcttaggtcaa

SEQ ID NO: 368994 - DNA, 15 bp, Homo sapiens
ttttcttaggtcaaa

SEQ ID NO: 368995 - DNA, 15 bp, Homo sapiens
tttcttaggtcaaaa

SEQ ID NO: 368996 - DNA, 15 bp, Homo sapiens
ttcttaggtcaaaaa

SEQ ID NO: 368997 - DNA, 15 bp, Homo sapiens
tcttaggtcaaaaaa

SEQ ID NO: 368998 - DNA, 15 bp, Homo sapiens
cttaggtcaaaaaat

SEQ ID NO: 368999 - DNA, 15 bp, Homo sapiens
ttaggtcaaaaaata

SEQ ID NO: 369000 - DNA, 15 bp, Homo sapiens
taggtcaaaaaatat

SEQ ID NO: 369001 - DNA, 15 bp, Homo sapiens
aggtcaaaaaatatc

SEQ ID NO: 369002 - DNA, 15 bp, Homo sapiens
ggtcaaaaaatatca

SEQ ID NO: 369003 - DNA, 15 bp, Homo sapiens
gtcaaaaaatatcat

SEQ ID NO: 369004 - DNA, 15 bp, Homo sapiens
tcaaaaaatatcata

SEQ ID NO: 369005 - DNA, 15 bp, Homo sapiens
caaaaaatatcatac

SEQ ID NO: 369006 - DNA, 15 bp, Homo sapiens
aaaaaatatcataca

SEQ ID NO: 369007 - DNA, 15 bp, Homo sapiens
aaaaatatcatacat

SEQ ID NO: 369008 - DNA, 15 bp, Homo sapiens
aaaatatcatacatt

SEQ ID NO: 369009 - DNA, 15 bp, Homo sapiens
aaatatcatacattt

SEQ ID NO: 369010 - DNA, 15 bp, Homo sapiens
aatatcatacatttg

SEQ ID NO: 369011 - DNA, 15 bp, Homo sapiens
atatcatacatttga

SEQ ID NO: 369012 - DNA, 15 bp, Homo sapiens
tatcatacatttgac

SEQ ID NO: 369013 - DNA, 15 bp, Homo sapiens
atcatacatttgact

SEQ ID NO: 369014 - DNA, 15 bp, Homo sapiens
tcatacatttgactg

SEQ ID NO: 369015 - DNA, 15 bp, Homo sapiens
catacatttgactgc

SEQ ID NO: 369016 - DNA, 15 bp, Homo sapiens
atacatttgactgct

SEQ ID NO: 369017 - DNA, 15 bp, Homo sapiens
tacatttgactgctt

SEQ ID NO: 369018 - DNA, 15 bp, Homo sapiens
acatttgactgcttc

SEQ ID NO: 369019 - DNA, 15 bp, Homo sapiens
catttgactgcttct

SEQ ID NO: 369020 - DNA, 15 bp, Homo sapiens
atttgactgcttctt

SEQ ID NO: 369021 - DNA, 15 bp, Homo sapiens
tttgactgcttctta

SEQ ID NO: 369022 - DNA, 15 bp, Homo sapiens
ttgactgcttcttac

SEQ ID NO: 369023 - DNA, 15 bp, Homo sapiens
tgactgcttcttaca

SEQ ID NO: 369024 - DNA, 15 bp, Homo sapiens
gactgcttcttacaa

SEQ ID NO: 369025 - DNA, 15 bp, Homo sapiens
actgcttcttacaac

SEQ ID NO: 369026 - DNA, 15 bp, Homo sapiens
ctgcttcttacaacc

SEQ ID NO: 369027 - DNA, 15 bp, Homo sapiens
tgcttcttacaaccc

SEQ ID NO: 369028 - DNA, 15 bp, Homo sapiens
gcttcttacaacccc

SEQ ID NO: 369029 - DNA, 15 bp, Homo sapiens
cttcttacaaccccc

SEQ ID NO: 369030 - DNA, 15 bp, Homo sapiens
ttcttacaaccccca

SEQ ID NO: 369031 - DNA, 15 bp, Homo sapiens
tcttacaacccccat

SEQ ID NO: 369032 - DNA, 15 bp, Homo sapiens
cttacaacccccatt

SEQ ID NO: 369033 - DNA, 15 bp, Homo sapiens
ttacaacccccattg

SEQ ID NO: 369034 - DNA, 15 bp, Homo sapiens
tacaacccccattgc

SEQ ID NO: 369035 - DNA, 15 bp, Homo sapiens
acaacccccattgcc

SEQ ID NO: 369036 - DNA, 15 bp, Homo sapiens
caacccccattgcca

SEQ ID NO: 369037 - DNA, 15 bp, Homo sapiens
aacccccattgccac

SEQ ID NO: 369038 - DNA, 15 bp, Homo sapiens
acccccattgccact

SEQ ID NO: 369039 - DNA, 15 bp, Homo sapiens
cccccattgccacta

SEQ ID NO: 369040 - DNA, 15 bp, Homo sapiens
ccccattgccactaa

SEQ ID NO: 369041 - DNA, 15 bp, Homo sapiens
cccattgccactaac

SEQ ID NO: 369042 - DNA, 15 bp, Homo sapiens
ccattgccactaact

SEQ ID NO: 369043 - DNA, 15 bp, Homo sapiens
cattgccactaactt

SEQ ID NO: 369044 - DNA, 15 bp, Homo sapiens
attgccactaacttg

SEQ ID NO: 369045 - DNA, 15 bp, Homo sapiens
ttgccactaacttgt

SEQ ID NO: 369046 - DNA, 15 bp, Homo sapiens
tgccactaacttgtt

SEQ ID NO: 369047 - DNA, 15 bp, Homo sapiens
gccactaacttgttt

SEQ ID NO: 369048 - DNA, 15 bp, Homo sapiens
ccactaacttgtttc

SEQ ID NO: 369049 - DNA, 15 bp, Homo sapiens
cactaacttgtttca

SEQ ID NO: 369050 - DNA, 15 bp, Homo sapiens
actaacttgtttcaa

SEQ ID NO: 369051 - DNA, 15 bp, Homo sapiens
ctaacttgtttcaag

SEQ ID NO: 369052 - DNA, 15 bp, Homo sapiens
taacttgtttcaagc

SEQ ID NO: 369053 - DNA, 15 bp, Homo sapiens
aacttgtttcaagcc

SEQ ID NO: 369054 - DNA, 15 bp, Homo sapiens
acttgtttcaagcct

SEQ ID NO: 369055 - DNA, 15 bp, Homo sapiens
cttgtttcaagcctg

SEQ ID NO: 369056 - DNA, 15 bp, Homo sapiens
ttgtttcaagcctgc

SEQ ID NO: 369057 - DNA, 15 bp, Homo sapiens
tgtttcaagcctgcc

SEQ ID NO: 369058 - DNA, 15 bp, Homo sapiens
gtttcaagcctgcca

SEQ ID NO: 369059 - DNA, 15 bp, Homo sapiens
tttcaagcctgccat

SEQ ID NO: 369060 - DNA, 15 bp, Homo sapiens
ttcaagcctgccatc

SEQ ID NO: 369061 - DNA, 15 bp, Homo sapiens
tcaagcctgccatca

SEQ ID NO: 369062 - DNA, 15 bp, Homo sapiens
caagcctgccatcat

SEQ ID NO: 369063 - DNA, 15 bp, Homo sapiens
aagcctgccatcatc

SEQ ID NO: 369064 - DNA, 15 bp, Homo sapiens
agcctgccatcatct

SEQ ID NO: 369065 - DNA, 15 bp, Homo sapiens
gcctgccatcatctc

SEQ ID NO: 369066 - DNA, 15 bp, Homo sapiens
cctgccatcatctct

SEQ ID NO: 369067 - DNA, 15 bp, Homo sapiens
ctgccatcatctctt

SEQ ID NO: 369068 - DNA, 15 bp, Homo sapiens
tgccatcatctcttg

SEQ ID NO: 369069 - DNA, 15 bp, Homo sapiens
gccatcatctcttgt

SEQ ID NO: 369070 - DNA, 15 bp, Homo sapiens
ccatcatctcttgtc

SEQ ID NO: 369071 - DNA, 15 bp, Homo sapiens
catcatctcttgtct

SEQ ID NO: 369072 - DNA, 15 bp, Homo sapiens
atcatctcttgtctt

SEQ ID NO: 369073 - DNA, 15 bp, Homo sapiens
tcatctcttgtcttg

SEQ ID NO: 369074 - DNA, 15 bp, Homo sapiens
catctcttgtcttga

SEQ ID NO: 369075 - DNA, 15 bp, Homo sapiens
atctcttgtcttgat

SEQ ID NO: 369076 - DNA, 15 bp, Homo sapiens
tctcttgtcttgatg

SEQ ID NO: 369077 - DNA, 15 bp, Homo sapiens
ctcttgtcttgatga

SEQ ID NO: 369078 - DNA, 15 bp, Homo sapiens
tcttgtcttgatgac

SEQ ID NO: 369079 - DNA, 15 bp, Homo sapiens
cttgtcttgatgact

SEQ ID NO: 369080 - DNA, 15 bp, Homo sapiens
ttgtcttgatgacta

SEQ ID NO: 369081 - DNA, 15 bp, Homo sapiens
tgtcttgatgactac

SEQ ID NO: 369082 - DNA, 15 bp, Homo sapiens
gtcttgatgactaca

SEQ ID NO: 369083 - DNA, 15 bp, Homo sapiens
tcttgatgactacaa

SEQ ID NO: 369084 - DNA, 15 bp, Homo sapiens
cttgatgactacaaa

SEQ ID NO: 369085 - DNA, 15 bp, Homo sapiens
ttgatgactacaaag

SEQ ID NO: 369086 - DNA, 15 bp, Homo sapiens
tgatgactacaaagg

SEQ ID NO: 369087 - DNA, 15 bp, Homo sapiens
gatgactacaaaggc

SEQ ID NO: 369088 - DNA, 15 bp, Homo sapiens
atgactacaaaggct

SEQ ID NO: 369089 - DNA, 15 bp, Homo sapiens
tgactacaaaggctg

SEQ ID NO: 369090 - DNA, 15 bp, Homo sapiens
gactacaaaggctgc

SEQ ID NO: 369091 - DNA, 15 bp, Homo sapiens
actacaaaggctgcc

SEQ ID NO: 369092 - DNA, 15 bp, Homo sapiens
ctacaaaggctgccc

SEQ ID NO: 369093 - DNA, 15 bp, Homo sapiens
tacaaaggctgcccc

SEQ ID NO: 369094 - DNA, 15 bp, Homo sapiens
acaaaggctgcccca

SEQ ID NO: 369095 - DNA, 15 bp, Homo sapiens
caaaggctgccccac

SEQ ID NO: 369096 - DNA, 15 bp, Homo sapiens
aaaggctgccccact

SEQ ID NO: 369097 - DNA, 15 bp, Homo sapiens
aaggctgccccactc

SEQ ID NO: 369098 - DNA, 15 bp, Homo sapiens
aggctgccccactca

SEQ ID NO: 369099 - DNA, 15 bp, Homo sapiens
ggctgccccactcat

SEQ ID NO: 369100 - DNA, 15 bp, Homo sapiens
gctgccccactcatc

SEQ ID NO: 369101 - DNA, 15 bp, Homo sapiens
ctgccccactcatct

SEQ ID NO: 369102 - DNA, 15 bp, Homo sapiens
tgccccactcatctc

SEQ ID NO: 369103 - DNA, 15 bp, Homo sapiens
gccccactcatctcc

SEQ ID NO: 369104 - DNA, 15 bp, Homo sapiens
ccccactcatctccc

SEQ ID NO: 369105 - DNA, 15 bp, Homo sapiens
cccactcatctcccc

SEQ ID NO: 369106 - DNA, 15 bp, Homo sapiens
ccactcatctcccct

SEQ ID NO: 369107 - DNA, 15 bp, Homo sapiens
cactcatctcccctg

SEQ ID NO: 369108 - DNA, 15 bp, Homo sapiens
actcatctcccctgc

SEQ ID NO: 369109 - DNA, 15 bp, Homo sapiens
ctcatctcccctgct

SEQ ID NO: 369110 - DNA, 15 bp, Homo sapiens
tcatctcccctgctt

SEQ ID NO: 369111 - DNA, 15 bp, Homo sapiens
catctcccctgcttc

SEQ ID NO: 369112 - DNA, 15 bp, Homo sapiens
atctcccctgcttct

SEQ ID NO: 369113 - DNA, 15 bp, Homo sapiens
tctcccctgcttctt

SEQ ID NO: 369114 - DNA, 15 bp, Homo sapiens
ctcccctgcttcttc

SEQ ID NO: 369115 - DNA, 15 bp, Homo sapiens
tcccctgcttcttcc

SEQ ID NO: 369116 - DNA, 15 bp, Homo sapiens
cccctgcttcttcct

SEQ ID NO: 369117 - DNA, 15 bp, Homo sapiens
ccctgcttcttcctt

SEQ ID NO: 369118 - DNA, 15 bp, Homo sapiens
cctgcttcttccttt

SEQ ID NO: 369119 - DNA, 15 bp, Homo sapiens
ctgcttcttcctttg

SEQ ID NO: 369120 - DNA, 15 bp, Homo sapiens
tgcttcttcctttgc

SEQ ID NO: 369121 - DNA, 15 bp, Homo sapiens
gcttcttcctttgcc

SEQ ID NO: 369122 - DNA, 15 bp, Homo sapiens
cttcttcctttgccc

SEQ ID NO: 369123 - DNA, 15 bp, Homo sapiens
ttcttcctttgccct

SEQ ID NO: 369124 - DNA, 15 bp, Homo sapiens
tcttcctttgccctt

SEQ ID NO: 369125 - DNA, 15 bp, Homo sapiens
cttcctttgcccttt

SEQ ID NO: 369126 - DNA, 15 bp, Homo sapiens
ttcctttgccctttg

SEQ ID NO: 369127 - DNA, 15 bp, Homo sapiens
tcctttgccctttgt

SEQ ID NO: 369128 - DNA, 15 bp, Homo sapiens
cctttgccctttgtt

SEQ ID NO: 369129 - DNA, 15 bp, Homo sapiens
ctttgccctttgtta

SEQ ID NO: 369130 - DNA, 15 bp, Homo sapiens
tttgccctttgttat

SEQ ID NO: 369131 - DNA, 15 bp, Homo sapiens
ttgccctttgttatt

SEQ ID NO: 369132 - DNA, 15 bp, Homo sapiens
tgccctttgttattc

SEQ ID NO: 369133 - DNA, 15 bp, Homo sapiens
gccctttgttattct

SEQ ID NO: 369134 - DNA, 15 bp, Homo sapiens
ccctttgttattctg

SEQ ID NO: 369135 - DNA, 15 bp, Homo sapiens
cctttgttattctgt

SEQ ID NO: 369136 - DNA, 15 bp, Homo sapiens
ctttgttattctgtt

SEQ ID NO: 369137 - DNA, 15 bp, Homo sapiens
tttgttattctgttc

SEQ ID NO: 369138 - DNA, 15 bp, Homo sapiens
ttgttattctgttct

SEQ ID NO: 369139 - DNA, 15 bp, Homo sapiens
tgttattctgttcta

SEQ ID NO: 369140 - DNA, 15 bp, Homo sapiens
gttattctgttctag

SEQ ID NO: 369141 - DNA, 15 bp, Homo sapiens
ttattctgttctaga

SEQ ID NO: 369142 - DNA, 15 bp, Homo sapiens
tattctgttctagac

SEQ ID NO: 369143 - DNA, 15 bp, Homo sapiens
attctgttctagaca

SEQ ID NO: 369144 - DNA, 15 bp, Homo sapiens
ttctgttctagacaa

SEQ ID NO: 369145 - DNA, 15 bp, Homo sapiens
tctgttctagacaaa

SEQ ID NO: 369146 - DNA, 15 bp, Homo sapiens
ctgttctagacaaag

SEQ ID NO: 369147 - DNA, 15 bp, Homo sapiens
tgttctagacaaagc

SEQ ID NO: 369148 - DNA, 15 bp, Homo sapiens
gttctagacaaagca

SEQ ID NO: 369149 - DNA, 15 bp, Homo sapiens
ttctagacaaagcag

SEQ ID NO: 369150 - DNA, 15 bp, Homo sapiens
tctagacaaagcagc

SEQ ID NO: 369151 - DNA, 15 bp, Homo sapiens
ctagacaaagcagcc

SEQ ID NO: 369152 - DNA, 15 bp, Homo sapiens
tagacaaagcagcca

SEQ ID NO: 369153 - DNA, 15 bp, Homo sapiens
agacaaagcagccaa

SEQ ID NO: 369154 - DNA, 15 bp, Homo sapiens
gacaaagcagccaat

SEQ ID NO: 369155 - DNA, 15 bp, Homo sapiens
acaaagcagccaata

SEQ ID NO: 369156 - DNA, 15 bp, Homo sapiens
caaagcagccaatat

SEQ ID NO: 369157 - DNA, 15 bp, Homo sapiens
aaagcagccaatatg

SEQ ID NO: 369158 - DNA, 15 bp, Homo sapiens
aagcagccaatatga

SEQ ID NO: 369159 - DNA, 15 bp, Homo sapiens
agcagccaatatgat

SEQ ID NO: 369160 - DNA, 15 bp, Homo sapiens
gcagccaatatgatt

SEQ ID NO: 369161 - DNA, 15 bp, Homo sapiens
cagccaatatgattg

SEQ ID NO: 369162 - DNA, 15 bp, Homo sapiens
agccaatatgattgg

SEQ ID NO: 369163 - DNA, 15 bp, Homo sapiens
gccaatatgattggt

SEQ ID NO: 369164 - DNA, 15 bp, Homo sapiens
ccaatatgattggtt

SEQ ID NO: 369165 - DNA, 15 bp, Homo sapiens
caatatgattggtta

SEQ ID NO: 369166 - DNA, 15 bp, Homo sapiens
aatatgattggttaa

SEQ ID NO: 369167 - DNA, 15 bp, Homo sapiens
atatgattggttaaa

SEQ ID NO: 369168 - DNA, 15 bp, Homo sapiens
tatgattggttaaaa

SEQ ID NO: 369169 - DNA, 15 bp, Homo sapiens
atgattggttaaaac

SEQ ID NO: 369170 - DNA, 15 bp, Homo sapiens
tgattggttaaaaca

SEQ ID NO: 369171 - DNA, 15 bp, Homo sapiens
gattggttaaaacat

SEQ ID NO: 369172 - DNA, 15 bp, Homo sapiens
attggttaaaacata

SEQ ID NO: 369173 - DNA, 15 bp, Homo sapiens
ttggttaaaacataa

SEQ ID NO: 369174 - DNA, 15 bp, Homo sapiens
tggttaaaacataat

SEQ ID NO: 369175 - DNA, 15 bp, Homo sapiens
ggttaaaacataatt

SEQ ID NO: 369176 - DNA, 15 bp, Homo sapiens
gttaaaacataattc

SEQ ID NO: 369177 - DNA, 15 bp, Homo sapiens
ttaaaacataattca

SEQ ID NO: 369178 - DNA, 15 bp, Homo sapiens
taaaacataattcag

SEQ ID NO: 369179 - DNA, 15 bp, Homo sapiens
aaaacataattcaga

SEQ ID NO: 369180 - DNA, 15 bp, Homo sapiens
aaacataattcagat

SEQ ID NO: 369181 - DNA, 15 bp, Homo sapiens
aacataattcagatc

SEQ ID NO: 369182 - DNA, 15 bp, Homo sapiens
acataattcagatca

SEQ ID NO: 369183 - DNA, 15 bp, Homo sapiens
cataattcagatcaa

SEQ ID NO: 369184 - DNA, 15 bp, Homo sapiens
ataattcagatcaag

SEQ ID NO: 369185 - DNA, 15 bp, Homo sapiens
taattcagatcaagt

SEQ ID NO: 369186 - DNA, 15 bp, Homo sapiens
aattcagatcaagtg

SEQ ID NO: 369187 - DNA, 15 bp, Homo sapiens
attcagatcaagtga

SEQ ID NO: 369188 - DNA, 15 bp, Homo sapiens
ttcagatcaagtgac

SEQ ID NO: 369189 - DNA, 15 bp, Homo sapiens
tcagatcaagtgact

SEQ ID NO: 369190 - DNA, 15 bp, Homo sapiens
cagatcaagtgactt

SEQ ID NO: 369191 - DNA, 15 bp, Homo sapiens
agatcaagtgactta

SEQ ID NO: 369192 - DNA, 15 bp, Homo sapiens
gatcaagtgacttat

SEQ ID NO: 369193 - DNA, 15 bp, Homo sapiens
atcaagtgacttatc

SEQ ID NO: 369194 - DNA, 15 bp, Homo sapiens
tcaagtgacttatct

SEQ ID NO: 369195 - DNA, 15 bp, Homo sapiens
caagtgacttatctg

SEQ ID NO: 369196 - DNA, 15 bp, Homo sapiens
aagtgacttatctga

SEQ ID NO: 369197 - DNA, 15 bp, Homo sapiens
agtgacttatctgag

SEQ ID NO: 369198 - DNA, 15 bp, Homo sapiens
gtgacttatctgagc

SEQ ID NO: 369199 - DNA, 15 bp, Homo sapiens
tgacttatctgagca

SEQ ID NO: 369200 - DNA, 15 bp, Homo sapiens
gacttatctgagcaa

SEQ ID NO: 369201 - DNA, 15 bp, Homo sapiens
acttatctgagcaaa

SEQ ID NO: 369202 - DNA, 15 bp, Homo sapiens
cttatctgagcaaag

SEQ ID NO: 369203 - DNA, 15 bp, Homo sapiens
ttatctgagcaaagt

SEQ ID NO: 369204 - DNA, 15 bp, Homo sapiens
tatctgagcaaagtc

SEQ ID NO: 369205 - DNA, 15 bp, Homo sapiens
atctgagcaaagtcc

SEQ ID NO: 369206 - DNA, 15 bp, Homo sapiens
tctgagcaaagtcca

SEQ ID NO: 369207 - DNA, 15 bp, Homo sapiens
ctgagcaaagtccac

SEQ ID NO: 369208 - DNA, 15 bp, Homo sapiens
tgagcaaagtccacc

SEQ ID NO: 369209 - DNA, 15 bp, Homo sapiens
gagcaaagtccacca

SEQ ID NO: 369210 - DNA, 15 bp, Homo sapiens
agcaaagtccaccaa

SEQ ID NO: 369211 - DNA, 15 bp, Homo sapiens
gcaaagtccaccaat

SEQ ID NO: 369212 - DNA, 15 bp, Homo sapiens
caaagtccaccaatg

SEQ ID NO: 369213 - DNA, 15 bp, Homo sapiens
aaagtccaccaatgg

SEQ ID NO: 369214 - DNA, 15 bp, Homo sapiens
aagtccaccaatggt

SEQ ID NO: 369215 - DNA, 15 bp, Homo sapiens
agtccaccaatggtt

SEQ ID NO: 369216 - DNA, 15 bp, Homo sapiens
gtccaccaatggttt

SEQ ID NO: 369217 - DNA, 15 bp, Homo sapiens
tccaccaatggtttt

SEQ ID NO: 369218 - DNA, 15 bp, Homo sapiens
ccaccaatggttttc

SEQ ID NO: 369219 - DNA, 15 bp, Homo sapiens
caccaatggttttct

SEQ ID NO: 369220 - DNA, 15 bp, Homo sapiens
accaatggttttcta

SEQ ID NO: 369221 - DNA, 15 bp, Homo sapiens
ccaatggttttctat

SEQ ID NO: 369222 - DNA, 15 bp, Homo sapiens
caatggttttctatc

SEQ ID NO: 369223 - DNA, 15 bp, Homo sapiens
aatggttttctatct

SEQ ID NO: 369224 - DNA, 15 bp, Homo sapiens
atggttttctatctt

SEQ ID NO: 369225 - DNA, 15 bp, Homo sapiens
tggttttctatcttg

SEQ ID NO: 369226 - DNA, 15 bp, Homo sapiens
ggttttctatcttgc

SEQ ID NO: 369227 - DNA, 15 bp, Homo sapiens
gttttctatcttgct

SEQ ID NO: 369228 - DNA, 15 bp, Homo sapiens
ttttctatcttgctc

SEQ ID NO: 369229 - DNA, 15 bp, Homo sapiens
tttctatcttgctca

SEQ ID NO: 369230 - DNA, 15 bp, Homo sapiens
ttctatcttgctcag

SEQ ID NO: 369231 - DNA, 15 bp, Homo sapiens
tctatcttgctcagg

SEQ ID NO: 369232 - DNA, 15 bp, Homo sapiens
ctatcttgctcaggg

SEQ ID NO: 369233 - DNA, 15 bp, Homo sapiens
tatcttgctcagggt

SEQ ID NO: 369234 - DNA, 15 bp, Homo sapiens
atcttgctcagggtg

SEQ ID NO: 369235 - DNA, 15 bp, Homo sapiens
tcttgctcagggtga

SEQ ID NO: 369236 - DNA, 15 bp, Homo sapiens
cttgctcagggtgaa

SEQ ID NO: 369237 - DNA, 15 bp, Homo sapiens
ttgctcagggtgaaa

SEQ ID NO: 369238 - DNA, 15 bp, Homo sapiens
tgctcagggtgaaag

SEQ ID NO: 369239 - DNA, 15 bp, Homo sapiens
gctcagggtgaaagc

SEQ ID NO: 369240 - DNA, 15 bp, Homo sapiens
ctcagggtgaaagcc

SEQ ID NO: 369241 - DNA, 15 bp, Homo sapiens
tcagggtgaaagcca

SEQ ID NO: 369242 - DNA, 15 bp, Homo sapiens
cagggtgaaagccaa

SEQ ID NO: 369243 - DNA, 15 bp, Homo sapiens
agggtgaaagccaaa

SEQ ID NO: 369244 - DNA, 15 bp, Homo sapiens
gggtgaaagccaaaa

SEQ ID NO: 369245 - DNA, 15 bp, Homo sapiens
ggtgaaagccaaaat

SEQ ID NO: 369246 - DNA, 15 bp, Homo sapiens
gtgaaagccaaaatg

SEQ ID NO: 369247 - DNA, 15 bp, Homo sapiens
tgaaagccaaaatgc

SEQ ID NO: 369248 - DNA, 15 bp, Homo sapiens
gaaagccaaaatgct

SEQ ID NO: 369249 - DNA, 15 bp, Homo sapiens
aaagccaaaatgctt

SEQ ID NO: 369250 - DNA, 15 bp, Homo sapiens
aagccaaaatgcttt

SEQ ID NO: 369251 - DNA, 15 bp, Homo sapiens
agccaaaatgctttt

SEQ ID NO: 369252 - DNA, 15 bp, Homo sapiens
gccaaaatgcttttt

SEQ ID NO: 369253 - DNA, 15 bp, Homo sapiens
ccaaaatgctttttt

SEQ ID NO: 369254 - DNA, 15 bp, Homo sapiens
caaaatgcttttttg

SEQ ID NO: 369255 - DNA, 15 bp, Homo sapiens
aaaatgcttttttgg

SEQ ID NO: 369256 - DNA, 15 bp, Homo sapiens
aaatgcttttttggc

SEQ ID NO: 369257 - DNA, 15 bp, Homo sapiens
aatgcttttttggct

SEQ ID NO: 369258 - DNA, 15 bp, Homo sapiens
atgcttttttggctt

SEQ ID NO: 369259 - DNA, 15 bp, Homo sapiens
tgcttttttggctta

SEQ ID NO: 369260 - DNA, 15 bp, Homo sapiens
gcttttttggcttat

SEQ ID NO: 369261 - DNA, 15 bp, Homo sapiens
cttttttggcttatg

SEQ ID NO: 369262 - DNA, 15 bp, Homo sapiens
ttttttggcttatga

SEQ ID NO: 369263 - DNA, 15 bp, Homo sapiens
tttttggcttatgag

SEQ ID NO: 369264 - DNA, 15 bp, Homo sapiens
ttttggcttatgagg

SEQ ID NO: 369265 - DNA, 15 bp, Homo sapiens
tttggcttatgaggc

SEQ ID NO: 369266 - DNA, 15 bp, Homo sapiens
ttggcttatgaggct

SEQ ID NO: 369267 - DNA, 15 bp, Homo sapiens
tggcttatgaggctt

SEQ ID NO: 369268 - DNA, 15 bp, Homo sapiens
ggcttatgaggcttc

SEQ ID NO: 369269 - DNA, 15 bp, Homo sapiens
gcttatgaggcttct

SEQ ID NO: 369270 - DNA, 15 bp, Homo sapiens
cttatgaggcttctc

SEQ ID NO: 369271 - DNA, 15 bp, Homo sapiens
ttatgaggcttctca

SEQ ID NO: 369272 - DNA, 15 bp, Homo sapiens
tatgaggcttctcat

SEQ ID NO: 369273 - DNA, 15 bp, Homo sapiens
atgaggcttctcatg

SEQ ID NO: 369274 - DNA, 15 bp, Homo sapiens
tgaggcttctcatgg

SEQ ID NO: 369275 - DNA, 15 bp, Homo sapiens
gaggcttctcatggc

SEQ ID NO: 369276 - DNA, 15 bp, Homo sapiens
aggcttctcatggcc

SEQ ID NO: 369277 - DNA, 15 bp, Homo sapiens
ggcttctcatggcct

SEQ ID NO: 369278 - DNA, 15 bp, Homo sapiens
gcttctcatggcctg

SEQ ID NO: 369279 - DNA, 15 bp, Homo sapiens
cttctcatggcctgg

SEQ ID NO: 369280 - DNA, 15 bp, Homo sapiens
ttctcatggcctggc

SEQ ID NO: 369281 - DNA, 15 bp, Homo sapiens
tctcatggcctggcg

SEQ ID NO: 369282 - DNA, 15 bp, Homo sapiens
ctcatggcctggcgt

SEQ ID NO: 369283 - DNA, 15 bp, Homo sapiens
tcatggcctggcgtc

SEQ ID NO: 369284 - DNA, 15 bp, Homo sapiens
catggcctggcgtcc

SEQ ID NO: 369285 - DNA, 15 bp, Homo sapiens
atggcctggcgtcct

SEQ ID NO: 369286 - DNA, 15 bp, Homo sapiens
tggcctggcgtcctg

SEQ ID NO: 369287 - DNA, 15 bp, Homo sapiens
ggcctggcgtcctgt

SEQ ID NO: 369288 - DNA, 15 bp, Homo sapiens
gcctggcgtcctgtg

SEQ ID NO: 369289 - DNA, 15 bp, Homo sapiens
cctggcgtcctgtga

SEQ ID NO: 369290 - DNA, 15 bp, Homo sapiens
ctggcgtcctgtgat

SEQ ID NO: 369291 - DNA, 15 bp, Homo sapiens
tggcgtcctgtgatc

SEQ ID NO: 369292 - DNA, 15 bp, Homo sapiens
ggcgtcctgtgatct

SEQ ID NO: 369293 - DNA, 15 bp, Homo sapiens
gcgtcctgtgatctc

SEQ ID NO: 369294 - DNA, 15 bp, Homo sapiens
cgtcctgtgatctct

SEQ ID NO: 369295 - DNA, 15 bp, Homo sapiens
gtcctgtgatctctc

SEQ ID NO: 369296 - DNA, 15 bp, Homo sapiens
tcctgtgatctctcc

SEQ ID NO: 369297 - DNA, 15 bp, Homo sapiens
cctgtgatctctcct

SEQ ID NO: 369298 - DNA, 15 bp, Homo sapiens
ctgtgatctctccta

SEQ ID NO: 369299 - DNA, 15 bp, Homo sapiens
tgtgatctctcctac

SEQ ID NO: 369300 - DNA, 15 bp, Homo sapiens
gtgatctctcctaca

SEQ ID NO: 369301 - DNA, 15 bp, Homo sapiens
tgatctctcctacaa

SEQ ID NO: 369302 - DNA, 15 bp, Homo sapiens
gatctctcctacaat

SEQ ID NO: 369303 - DNA, 15 bp, Homo sapiens
atctctcctacaata

SEQ ID NO: 369304 - DNA, 15 bp, Homo sapiens
tctctcctacaatat

SEQ ID NO: 369305 - DNA, 15 bp, Homo sapiens
ctctcctacaatatc

SEQ ID NO: 369306 - DNA, 15 bp, Homo sapiens
tctcctacaatatcc

SEQ ID NO: 369307 - DNA, 15 bp, Homo sapiens
ctcctacaatatcca

SEQ ID NO: 369308 - DNA, 15 bp, Homo sapiens
tcctacaatatccac

SEQ ID NO: 369309 - DNA, 15 bp, Homo sapiens
cctacaatatccact

SEQ ID NO: 369310 - DNA, 15 bp, Homo sapiens
ctacaatatccactg

SEQ ID NO: 369311 - DNA, 15 bp, Homo sapiens
tacaatatccactgc

SEQ ID NO: 369312 - DNA, 15 bp, Homo sapiens
acaatatccactgct

SEQ ID NO: 369313 - DNA, 15 bp, Homo sapiens
caatatccactgctc

SEQ ID NO: 369314 - DNA, 15 bp, Homo sapiens
aatatccactgctct

SEQ ID NO: 369315 - DNA, 15 bp, Homo sapiens
atatccactgctctc

SEQ ID NO: 369316 - DNA, 15 bp, Homo sapiens
tatccactgctctct

SEQ ID NO: 369317 - DNA, 15 bp, Homo sapiens
atccactgctctctc

SEQ ID NO: 369318 - DNA, 15 bp, Homo sapiens
tccactgctctctct

SEQ ID NO: 369319 - DNA, 15 bp, Homo sapiens
ccactgctctctctc

SEQ ID NO: 369320 - DNA, 15 bp, Homo sapiens
cactgctctctctcc

SEQ ID NO: 369321 - DNA, 15 bp, Homo sapiens
actgctctctctccc

SEQ ID NO: 369322 - DNA, 15 bp, Homo sapiens
ctgctctctctcccc

SEQ ID NO: 369323 - DNA, 15 bp, Homo sapiens
tgctctctctcccct

SEQ ID NO: 369324 - DNA, 15 bp, Homo sapiens
gctctctctccccta

SEQ ID NO: 369325 - DNA, 15 bp, Homo sapiens
ctctctctcccctac

SEQ ID NO: 369326 - DNA, 15 bp, Homo sapiens
tctctctcccctaca

SEQ ID NO: 369327 - DNA, 15 bp, Homo sapiens
ctctctcccctacac

SEQ ID NO: 369328 - DNA, 15 bp, Homo sapiens
tctctcccctacact

SEQ ID NO: 369329 - DNA, 15 bp, Homo sapiens
ctctcccctacactc

SEQ ID NO: 369330 - DNA, 15 bp, Homo sapiens
tctcccctacactcc

SEQ ID NO: 369331 - DNA, 15 bp, Homo sapiens
ctcccctacactcct

SEQ ID NO: 369332 - DNA, 15 bp, Homo sapiens
tcccctacactcctt

SEQ ID NO: 369333 - DNA, 15 bp, Homo sapiens
cccctacactccttt

SEQ ID NO: 369334 - DNA, 15 bp, Homo sapiens
ccctacactcctttc

SEQ ID NO: 369335 - DNA, 15 bp, Homo sapiens
cctacactcctttcc

SEQ ID NO: 369336 - DNA, 15 bp, Homo sapiens
ctacactcctttcca

SEQ ID NO: 369337 - DNA, 15 bp, Homo sapiens
tacactcctttccag

SEQ ID NO: 369338 - DNA, 15 bp, Homo sapiens
acactcctttccaga

SEQ ID NO: 369339 - DNA, 15 bp, Homo sapiens
cactcctttccagac

SEQ ID NO: 369340 - DNA, 15 bp, Homo sapiens
actcctttccagaca

SEQ ID NO: 369341 - DNA, 15 bp, Homo sapiens
ctcctttccagacat

SEQ ID NO: 369342 - DNA, 15 bp, Homo sapiens
tcctttccagacatg

SEQ ID NO: 369343 - DNA, 15 bp, Homo sapiens
cctttccagacatgt

SEQ ID NO: 369344 - DNA, 15 bp, Homo sapiens
ctttccagacatgtt

SEQ ID NO: 369345 - DNA, 15 bp, Homo sapiens
tttccagacatgtta

SEQ ID NO: 369346 - DNA, 15 bp, Homo sapiens
ttccagacatgttag

SEQ ID NO: 369347 - DNA, 15 bp, Homo sapiens
tccagacatgttagg

SEQ ID NO: 369348 - DNA, 15 bp, Homo sapiens
ccagacatgttaggt

SEQ ID NO: 369349 - DNA, 15 bp, Homo sapiens
cagacatgttaggtc

SEQ ID NO: 369350 - DNA, 15 bp, Homo sapiens
agacatgttaggtcc

SEQ ID NO: 369351 - DNA, 15 bp, Homo sapiens
gacatgttaggtcct

SEQ ID NO: 369352 - DNA, 15 bp, Homo sapiens
acatgttaggtcctg

SEQ ID NO: 369353 - DNA, 15 bp, Homo sapiens
catgttaggtcctgt

SEQ ID NO: 369354 - DNA, 15 bp, Homo sapiens
atgttaggtcctgtg

SEQ ID NO: 369355 - DNA, 15 bp, Homo sapiens
tgttaggtcctgtgt

SEQ ID NO: 369356 - DNA, 15 bp, Homo sapiens
gttaggtcctgtgtc

SEQ ID NO: 369357 - DNA, 15 bp, Homo sapiens
ttaggtcctgtgtca

SEQ ID NO: 369358 - DNA, 15 bp, Homo sapiens
taggtcctgtgtcac

SEQ ID NO: 369359 - DNA, 15 bp, Homo sapiens
aggtcctgtgtcact

SEQ ID NO: 369360 - DNA, 15 bp, Homo sapiens
ggtcctgtgtcactt

SEQ ID NO: 369361 - DNA, 15 bp, Homo sapiens
gtcctgtgtcacttg

SEQ ID NO: 369362 - DNA, 15 bp, Homo sapiens
tcctgtgtcacttgc

SEQ ID NO: 369363 - DNA, 15 bp, Homo sapiens
cctgtgtcacttgcc

SEQ ID NO: 369364 - DNA, 15 bp, Homo sapiens
ctgtgtcacttgcca

SEQ ID NO: 369365 - DNA, 15 bp, Homo sapiens
tgtgtcacttgccag

SEQ ID NO: 369366 - DNA, 15 bp, Homo sapiens
gtgtcacttgccaga

SEQ ID NO: 369367 - DNA, 15 bp, Homo sapiens
tgtcacttgccagaa

SEQ ID NO: 369368 - DNA, 15 bp, Homo sapiens
gtcacttgccagaaa

SEQ ID NO: 369369 - DNA, 15 bp, Homo sapiens
tcacttgccagaaag

SEQ ID NO: 369370 - DNA, 15 bp, Homo sapiens
cacttgccagaaagg

SEQ ID NO: 369371 - DNA, 15 bp, Homo sapiens
acttgccagaaaggt

SEQ ID NO: 369372 - DNA, 15 bp, Homo sapiens
cttgccagaaaggtt

SEQ ID NO: 369373 - DNA, 15 bp, Homo sapiens
ttgccagaaaggttg

SEQ ID NO: 369374 - DNA, 15 bp, Homo sapiens
tgccagaaaggttgt

SEQ ID NO: 369375 - DNA, 15 bp, Homo sapiens
gccagaaaggttgtc

SEQ ID NO: 369376 - DNA, 15 bp, Homo sapiens
ccagaaaggttgtcc

SEQ ID NO: 369377 - DNA, 15 bp, Homo sapiens
cagaaaggttgtcca

SEQ ID NO: 369378 - DNA, 15 bp, Homo sapiens
agaaaggttgtccat

SEQ ID NO: 369379 - DNA, 15 bp, Homo sapiens
gaaaggttgtccata

SEQ ID NO: 369380 - DNA, 15 bp, Homo sapiens
aaaggttgtccatat

SEQ ID NO: 369381 - DNA, 15 bp, Homo sapiens
aaggttgtccatatt

SEQ ID NO: 369382 - DNA, 15 bp, Homo sapiens
aggttgtccatattc

SEQ ID NO: 369383 - DNA, 15 bp, Homo sapiens
ggttgtccatattca

SEQ ID NO: 369384 - DNA, 15 bp, Homo sapiens
gttgtccatattcag

SEQ ID NO: 369385 - DNA, 15 bp, Homo sapiens
ttgtccatattcagt

SEQ ID NO: 369386 - DNA, 15 bp, Homo sapiens
tgtccatattcagtc

SEQ ID NO: 369387 - DNA, 15 bp, Homo sapiens
gtccatattcagtcg

SEQ ID NO: 369388 - DNA, 15 bp, Homo sapiens
tccatattcagtcgg

SEQ ID NO: 369389 - DNA, 15 bp, Homo sapiens
ccatattcagtcgga

SEQ ID NO: 369390 - DNA, 15 bp, Homo sapiens
catattcagtcggag

SEQ ID NO: 369391 - DNA, 15 bp, Homo sapiens
atattcagtcggagc

SEQ ID NO: 369392 - DNA, 15 bp, Homo sapiens
tattcagtcggagca

SEQ ID NO: 369393 - DNA, 15 bp, Homo sapiens
attcagtcggagcac

SEQ ID NO: 369394 - DNA, 15 bp, Homo sapiens
ttcagtcggagcaca

SEQ ID NO: 369395 - DNA, 15 bp, Homo sapiens
tcagtcggagcacac

SEQ ID NO: 369396 - DNA, 15 bp, Homo sapiens
cagtcggagcacaca

SEQ ID NO: 369397 - DNA, 15 bp, Homo sapiens
agtcggagcacacat

SEQ ID NO: 369398 - DNA, 15 bp, Homo sapiens
gtcggagcacacata

SEQ ID NO: 369399 - DNA, 15 bp, Homo sapiens
tcggagcacacatat

SEQ ID NO: 369400 - DNA, 15 bp, Homo sapiens
cggagcacacatatt

SEQ ID NO: 369401 - DNA, 15 bp, Homo sapiens
ggagcacacatattt

SEQ ID NO: 369402 - DNA, 15 bp, Homo sapiens
gagcacacatattta

SEQ ID NO: 369403 - DNA, 15 bp, Homo sapiens
agcacacatatttat

SEQ ID NO: 369404 - DNA, 15 bp, Homo sapiens
gcacacatatttatt

SEQ ID NO: 369405 - DNA, 15 bp, Homo sapiens
cacacatatttattt

SEQ ID NO: 369406 - DNA, 15 bp, Homo sapiens
acacatatttattta

SEQ ID NO: 369407 - DNA, 15 bp, Homo sapiens
cacatatttatttaa

SEQ ID NO: 369408 - DNA, 15 bp, Homo sapiens
acatatttatttaac

SEQ ID NO: 369409 - DNA, 15 bp, Homo sapiens
catatttatttaaca

SEQ ID NO: 369410 - DNA, 15 bp, Homo sapiens
atatttatttaacac

SEQ ID NO: 369411 - DNA, 15 bp, Homo sapiens
tatttatttaacaca

SEQ ID NO: 369412 - DNA, 15 bp, Homo sapiens
atttatttaacacaa

SEQ ID NO: 369413 - DNA, 15 bp, Homo sapiens
tttatttaacacaaa

SEQ ID NO: 369414 - DNA, 15 bp, Homo sapiens
ttatttaacacaaag

SEQ ID NO: 369415 - DNA, 15 bp, Homo sapiens
tatttaacacaaagg

SEQ ID NO: 369416 - DNA, 15 bp, Homo sapiens
atttaacacaaaggg

SEQ ID NO: 369417 - DNA, 15 bp, Homo sapiens
tttaacacaaagggt

SEQ ID NO: 369418 - DNA, 15 bp, Homo sapiens
ttaacacaaagggta

SEQ ID NO: 369419 - DNA, 15 bp, Homo sapiens
taacacaaagggtat

SEQ ID NO: 369420 - DNA, 15 bp, Homo sapiens
aacacaaagggtatc

SEQ ID NO: 369421 - DNA, 15 bp, Homo sapiens
acacaaagggtatca

SEQ ID NO: 369422 - DNA, 15 bp, Homo sapiens
cacaaagggtatcag

SEQ ID NO: 369423 - DNA, 15 bp, Homo sapiens
acaaagggtatcagt

SEQ ID NO: 369424 - DNA, 15 bp, Homo sapiens
caaagggtatcagtg

SEQ ID NO: 369425 - DNA, 15 bp, Homo sapiens
aaagggtatcagtgg

SEQ ID NO: 369426 - DNA, 15 bp, Homo sapiens
aagggtatcagtggg

SEQ ID NO: 369427 - DNA, 15 bp, Homo sapiens
agggtatcagtgggt

SEQ ID NO: 369428 - DNA, 15 bp, Homo sapiens
gggtatcagtgggta

SEQ ID NO: 369429 - DNA, 15 bp, Homo sapiens
ggtatcagtgggtat

SEQ ID NO: 369430 - DNA, 15 bp, Homo sapiens
gtatcagtgggtatt

SEQ ID NO: 369431 - DNA, 15 bp, Homo sapiens
tatcagtgggtattc

SEQ ID NO: 369432 - DNA, 15 bp, Homo sapiens
atcagtgggtattct

SEQ ID NO: 369433 - DNA, 15 bp, Homo sapiens
tcagtgggtattctg

SEQ ID NO: 369434 - DNA, 15 bp, Homo sapiens
cagtgggtattctgc

SEQ ID NO: 369435 - DNA, 15 bp, Homo sapiens
agtgggtattctgca

SEQ ID NO: 369436 - DNA, 15 bp, Homo sapiens
gtgggtattctgcag

SEQ ID NO: 369437 - DNA, 15 bp, Homo sapiens
tgggtattctgcaga

SEQ ID NO: 369438 - DNA, 15 bp, Homo sapiens
gggtattctgcagaa

SEQ ID NO: 369439 - DNA, 15 bp, Homo sapiens
ggtattctgcagaaa

SEQ ID NO: 369440 - DNA, 15 bp, Homo sapiens
gtattctgcagaaaa

SEQ ID NO: 369441 - DNA, 15 bp, Homo sapiens
tattctgcagaaaag

SEQ ID NO: 369442 - DNA, 15 bp, Homo sapiens
attctgcagaaaagg

SEQ ID NO: 369443 - DNA, 15 bp, Homo sapiens
ttctgcagaaaaggg

SEQ ID NO: 369444 - DNA, 15 bp, Homo sapiens
tctgcagaaaagggc

SEQ ID NO: 369445 - DNA, 15 bp, Homo sapiens
ctgcagaaaagggca

SEQ ID NO: 369446 - DNA, 15 bp, Homo sapiens
tgcagaaaagggcac

SEQ ID NO: 369447 - DNA, 15 bp, Homo sapiens
gcagaaaagggcaca

SEQ ID NO: 369448 - DNA, 15 bp, Homo sapiens
cagaaaagggcacag

SEQ ID NO: 369449 - DNA, 15 bp, Homo sapiens
agaaaagggcacagt

SEQ ID NO: 369450 - DNA, 15 bp, Homo sapiens
gaaaagggcacagtt

SEQ ID NO: 369451 - DNA, 15 bp, Homo sapiens
aaaagggcacagttg

SEQ ID NO: 369452 - DNA, 15 bp, Homo sapiens
aaagggcacagttgt

SEQ ID NO: 369453 - DNA, 15 bp, Homo sapiens
aagggcacagttgtt

SEQ ID NO: 369454 - DNA, 15 bp, Homo sapiens
agggcacagttgtta

SEQ ID NO: 369455 - DNA, 15 bp, Homo sapiens
gggcacagttgttaa

SEQ ID NO: 369456 - DNA, 15 bp, Homo sapiens
ggcacagttgttaat

SEQ ID NO: 369457 - DNA, 15 bp, Homo sapiens
gcacagttgttaatt

SEQ ID NO: 369458 - DNA, 15 bp, Homo sapiens
cacagttgttaattt

SEQ ID NO: 369459 - DNA, 15 bp, Homo sapiens
acagttgttaatttg

SEQ ID NO: 369460 - DNA, 15 bp, Homo sapiens
cagttgttaatttgg

SEQ ID NO: 369461 - DNA, 15 bp, Homo sapiens
agttgttaatttggg

SEQ ID NO: 369462 - DNA, 15 bp, Homo sapiens
gttgttaatttgggt

SEQ ID NO: 369463 - DNA, 15 bp, Homo sapiens
ttgttaatttgggtg

SEQ ID NO: 369464 - DNA, 15 bp, Homo sapiens
tgttaatttgggtgc

SEQ ID NO: 369465 - DNA, 15 bp, Homo sapiens
gttaatttgggtgca

SEQ ID NO: 369466 - DNA, 15 bp, Homo sapiens
ttaatttgggtgcac

SEQ ID NO: 369467 - DNA, 15 bp, Homo sapiens
taatttgggtgcact

SEQ ID NO: 369468 - DNA, 15 bp, Homo sapiens
aatttgggtgcacta

SEQ ID NO: 369469 - DNA, 15 bp, Homo sapiens
atttgggtgcactat

SEQ ID NO: 369470 - DNA, 15 bp, Homo sapiens
tttgggtgcactatg

SEQ ID NO: 369471 - DNA, 15 bp, Homo sapiens
ttgggtgcactatgt

SEQ ID NO: 369472 - DNA, 15 bp, Homo sapiens
tgggtgcactatgtc

SEQ ID NO: 369473 - DNA, 15 bp, Homo sapiens
gggtgcactatgtca

SEQ ID NO: 369474 - DNA, 15 bp, Homo sapiens
ggtgcactatgtcag

SEQ ID NO: 369475 - DNA, 15 bp, Homo sapiens
gtgcactatgtcaga

SEQ ID NO: 369476 - DNA, 15 bp, Homo sapiens
tgcactatgtcagac

SEQ ID NO: 369477 - DNA, 15 bp, Homo sapiens
gcactatgtcagaca

SEQ ID NO: 369478 - DNA, 15 bp, Homo sapiens
cactatgtcagacaa

SEQ ID NO: 369479 - DNA, 15 bp, Homo sapiens
actatgtcagacaaa

SEQ ID NO: 369480 - DNA, 15 bp, Homo sapiens
ctatgtcagacaaag

SEQ ID NO: 369481 - DNA, 15 bp, Homo sapiens
tatgtcagacaaagc

SEQ ID NO: 369482 - DNA, 15 bp, Homo sapiens
atgtcagacaaagct

SEQ ID NO: 369483 - DNA, 15 bp, Homo sapiens
tgtcagacaaagcta

SEQ ID NO: 369484 - DNA, 15 bp, Homo sapiens
gtcagacaaagctag

SEQ ID NO: 369485 - DNA, 15 bp, Homo sapiens
tcagacaaagctaga

SEQ ID NO: 369486 - DNA, 15 bp, Homo sapiens
cagacaaagctagag

SEQ ID NO: 369487 - DNA, 15 bp, Homo sapiens
agacaaagctagagc

SEQ ID NO: 369488 - DNA, 15 bp, Homo sapiens
gacaaagctagagct

SEQ ID NO: 369489 - DNA, 15 bp, Homo sapiens
acaaagctagagctt

SEQ ID NO: 369490 - DNA, 15 bp, Homo sapiens
caaagctagagcttt

SEQ ID NO: 369491 - DNA, 15 bp, Homo sapiens
aaagctagagctttg

SEQ ID NO: 369492 - DNA, 15 bp, Homo sapiens
aagctagagctttgg

SEQ ID NO: 369493 - DNA, 15 bp, Homo sapiens
agctagagctttggt

SEQ ID NO: 369494 - DNA, 15 bp, Homo sapiens
gctagagctttggtt

SEQ ID NO: 369495 - DNA, 15 bp, Homo sapiens
ctagagctttggtta

SEQ ID NO: 369496 - DNA, 15 bp, Homo sapiens
tagagctttggttat

SEQ ID NO: 369497 - DNA, 15 bp, Homo sapiens
agagctttggttatt

SEQ ID NO: 369498 - DNA, 15 bp, Homo sapiens
gagctttggttattg

SEQ ID NO: 369499 - DNA, 15 bp, Homo sapiens
agctttggttattgc

SEQ ID NO: 369500 - DNA, 15 bp, Homo sapiens
gctttggttattgca

SEQ ID NO: 369501 - DNA, 15 bp, Homo sapiens
ctttggttattgcag

SEQ ID NO: 369502 - DNA, 15 bp, Homo sapiens
tttggttattgcaga

SEQ ID NO: 369503 - DNA, 15 bp, Homo sapiens
ttggttattgcagaa

SEQ ID NO: 369504 - DNA, 15 bp, Homo sapiens
tggttattgcagaat

SEQ ID NO: 369505 - DNA, 15 bp, Homo sapiens
ggttattgcagaatt

SEQ ID NO: 369506 - DNA, 15 bp, Homo sapiens
gttattgcagaattt

SEQ ID NO: 369507 - DNA, 15 bp, Homo sapiens
ttattgcagaatttc

SEQ ID NO: 369508 - DNA, 15 bp, Homo sapiens
tattgcagaatttca

SEQ ID NO: 369509 - DNA, 15 bp, Homo sapiens
attgcagaatttcat

SEQ ID NO: 369510 - DNA, 15 bp, Homo sapiens
ttgcagaatttcatg

SEQ ID NO: 369511 - DNA, 15 bp, Homo sapiens
tgcagaatttcatgt

SEQ ID NO: 369512 - DNA, 15 bp, Homo sapiens
gcagaatttcatgta

SEQ ID NO: 369513 - DNA, 15 bp, Homo sapiens
cagaatttcatgtaa

SEQ ID NO: 369514 - DNA, 15 bp, Homo sapiens
agaatttcatgtaaa

SEQ ID NO: 369515 - DNA, 15 bp, Homo sapiens
gaatttcatgtaaat

SEQ ID NO: 369516 - DNA, 15 bp, Homo sapiens
aatttcatgtaaatt

SEQ ID NO: 369517 - DNA, 15 bp, Homo sapiens
atttcatgtaaattt

SEQ ID NO: 369518 - DNA, 15 bp, Homo sapiens
tttcatgtaaatttt

SEQ ID NO: 369519 - DNA, 15 bp, Homo sapiens
ttcatgtaaatttta

SEQ ID NO: 369520 - DNA, 15 bp, Homo sapiens
tcatgtaaattttaa

SEQ ID NO: 369521 - DNA, 15 bp, Homo sapiens
catgtaaattttaat

SEQ ID NO: 369522 - DNA, 15 bp, Homo sapiens
aaattttaatataat

SEQ ID NO: 369523 - DNA, 15 bp, Homo sapiens
aattttaatataatt

SEQ ID NO: 369524 - DNA, 15 bp, Homo sapiens
attttaatataattc

SEQ ID NO: 369525 - DNA, 15 bp, Homo sapiens
ttttaatataattca

SEQ ID NO: 369526 - DNA, 15 bp, Homo sapiens
tttaatataattcac

SEQ ID NO: 369527 - DNA, 15 bp, Homo sapiens
ttaatataattcact

SEQ ID NO: 369528 - DNA, 15 bp, Homo sapiens
taatataattcactt

SEQ ID NO: 369529 - DNA, 15 bp, Homo sapiens
aatataattcacttt

SEQ ID NO: 369530 - DNA, 15 bp, Homo sapiens
atataattcactttg

SEQ ID NO: 369531 - DNA, 15 bp, Homo sapiens
tataattcactttgg

SEQ ID NO: 369532 - DNA, 15 bp, Homo sapiens
ataattcactttggt

SEQ ID NO: 369533 - DNA, 15 bp, Homo sapiens
taattcactttggtg

SEQ ID NO: 369534 - DNA, 15 bp, Homo sapiens
aattcactttggtga

SEQ ID NO: 369535 - DNA, 15 bp, Homo sapiens
attcactttggtgaa

SEQ ID NO: 369536 - DNA, 15 bp, Homo sapiens
ttcactttggtgaat

SEQ ID NO: 369537 - DNA, 15 bp, Homo sapiens
tcactttggtgaatt

SEQ ID NO: 369538 - DNA, 15 bp, Homo sapiens
cactttggtgaatta

SEQ ID NO: 369539 - DNA, 15 bp, Homo sapiens
actttggtgaattat

SEQ ID NO: 369540 - DNA, 15 bp, Homo sapiens
ctttggtgaattatg

SEQ ID NO: 369541 - DNA, 15 bp, Homo sapiens
tttggtgaattatga

SEQ ID NO: 369542 - DNA, 15 bp, Homo sapiens
ttggtgaattatgaa

SEQ ID NO: 369543 - DNA, 15 bp, Homo sapiens
tggtgaattatgaat

SEQ ID NO: 369544 - DNA, 15 bp, Homo sapiens
ggtgaattatgaatg

SEQ ID NO: 369545 - DNA, 15 bp, Homo sapiens
gtgaattatgaatgt

SEQ ID NO: 369546 - DNA, 15 bp, Homo sapiens
tgaattatgaatgtc

SEQ ID NO: 369547 - DNA, 15 bp, Homo sapiens
gaattatgaatgtct

SEQ ID NO: 369548 - DNA, 15 bp, Homo sapiens
aattatgaatgtcta

SEQ ID NO: 369549 - DNA, 15 bp, Homo sapiens
attatgaatgtctaa

SEQ ID NO: 369550 - DNA, 15 bp, Homo sapiens
ttatgaatgtctaag

SEQ ID NO: 369551 - DNA, 15 bp, Homo sapiens
tatgaatgtctaaga

SEQ ID NO: 369552 - DNA, 15 bp, Homo sapiens
atgaatgtctaagac

SEQ ID NO: 369553 - DNA, 15 bp, Homo sapiens
tgaatgtctaagacc

SEQ ID NO: 369554 - DNA, 15 bp, Homo sapiens
gaatgtctaagacca

SEQ ID NO: 369555 - DNA, 15 bp, Homo sapiens
aatgtctaagaccaa

SEQ ID NO: 369556 - DNA, 15 bp, Homo sapiens
atgtctaagaccaac

SEQ ID NO: 369557 - DNA, 15 bp, Homo sapiens
tgtctaagaccaaca

SEQ ID NO: 369558 - DNA, 15 bp, Homo sapiens
gtctaagaccaacaa

SEQ ID NO: 369559 - DNA, 15 bp, Homo sapiens
tctaagaccaacaat

SEQ ID NO: 369560 - DNA, 15 bp, Homo sapiens
ctaagaccaacaatg

SEQ ID NO: 369561 - DNA, 15 bp, Homo sapiens
taagaccaacaatgc

SEQ ID NO: 369562 - DNA, 15 bp, Homo sapiens
aagaccaacaatgct

SEQ ID NO: 369563 - DNA, 15 bp, Homo sapiens
agaccaacaatgctc

SEQ ID NO: 369564 - DNA, 15 bp, Homo sapiens
gaccaacaatgctca

SEQ ID NO: 369565 - DNA, 15 bp, Homo sapiens
accaacaatgctcat

SEQ ID NO: 369566 - DNA, 15 bp, Homo sapiens
ccaacaatgctcatt

SEQ ID NO: 369567 - DNA, 15 bp, Homo sapiens
caacaatgctcattg

SEQ ID NO: 369568 - DNA, 15 bp, Homo sapiens
aacaatgctcattgt

SEQ ID NO: 369569 - DNA, 15 bp, Homo sapiens
acaatgctcattgtg

SEQ ID NO: 369570 - DNA, 15 bp, Homo sapiens
caatgctcattgtgc

SEQ ID NO: 369571 - DNA, 15 bp, Homo sapiens
aatgctcattgtgca

SEQ ID NO: 369572 - DNA, 15 bp, Homo sapiens
atgctcattgtgcag

SEQ ID NO: 369573 - DNA, 15 bp, Homo sapiens
tgctcattgtgcaga

SEQ ID NO: 369574 - DNA, 15 bp, Homo sapiens
gctcattgtgcagaa

SEQ ID NO: 369575 - DNA, 15 bp, Homo sapiens
ctcattgtgcagaaa

SEQ ID NO: 369576 - DNA, 15 bp, Homo sapiens
tcattgtgcagaaaa

SEQ ID NO: 369577 - DNA, 15 bp, Homo sapiens
cattgtgcagaaaat

SEQ ID NO: 369578 - DNA, 15 bp, Homo sapiens
attgtgcagaaaatc

SEQ ID NO: 369579 - DNA, 15 bp, Homo sapiens
ttgtgcagaaaatct

SEQ ID NO: 369580 - DNA, 15 bp, Homo sapiens
tgtgcagaaaatctc

SEQ ID NO: 369581 - DNA, 15 bp, Homo sapiens
gtgcagaaaatctca

SEQ ID NO: 369582 - DNA, 15 bp, Homo sapiens
tgcagaaaatctcaa

SEQ ID NO: 369583 - DNA, 15 bp, Homo sapiens
gcagaaaatctcaac

SEQ ID NO: 369584 - DNA, 15 bp, Homo sapiens
cagaaaatctcaaca

SEQ ID NO: 369585 - DNA, 15 bp, Homo sapiens
agaaaatctcaacaa

SEQ ID NO: 369586 - DNA, 15 bp, Homo sapiens
gaaaatctcaacaaa

SEQ ID NO: 369587 - DNA, 15 bp, Homo sapiens
aaaatctcaacaaac

SEQ ID NO: 369588 - DNA, 15 bp, Homo sapiens
aaatctcaacaaaca

SEQ ID NO: 369589 - DNA, 15 bp, Homo sapiens
aatctcaacaaacat

SEQ ID NO: 369590 - DNA, 15 bp, Homo sapiens
atctcaacaaacata

SEQ ID NO: 369591 - DNA, 15 bp, Homo sapiens
tctcaacaaacataa

SEQ ID NO: 369592 - DNA, 15 bp, Homo sapiens
ctcaacaaacataat

SEQ ID NO: 369593 - DNA, 15 bp, Homo sapiens
tcaacaaacataatt

SEQ ID NO: 369594 - DNA, 15 bp, Homo sapiens
caacaaacataattt

SEQ ID NO: 369595 - DNA, 15 bp, Homo sapiens
aacaaacataatttg

SEQ ID NO: 369596 - DNA, 15 bp, Homo sapiens
acaaacataatttgg

SEQ ID NO: 369597 - DNA, 15 bp, Homo sapiens
caaacataatttggg

SEQ ID NO: 369598 - DNA, 15 bp, Homo sapiens
aaacataatttggga

SEQ ID NO: 369599 - DNA, 15 bp, Homo sapiens
aacataatttgggaa

SEQ ID NO: 369600 - DNA, 15 bp, Homo sapiens
acataatttgggaaa

SEQ ID NO: 369601 - DNA, 15 bp, Homo sapiens
cataatttgggaaat

SEQ ID NO: 369602 - DNA, 15 bp, Homo sapiens
ataatttgggaaatt

SEQ ID NO: 369603 - DNA, 15 bp, Homo sapiens
taatttgggaaattc

SEQ ID NO: 369604 - DNA, 15 bp, Homo sapiens
aatttgggaaattct

SEQ ID NO: 369605 - DNA, 15 bp, Homo sapiens
atttgggaaattcta

SEQ ID NO: 369606 - DNA, 15 bp, Homo sapiens
tttgggaaattctaa

SEQ ID NO: 369607 - DNA, 15 bp, Homo sapiens
ttgggaaattctaac

SEQ ID NO: 369608 - DNA, 15 bp, Homo sapiens
tgggaaattctaaca

SEQ ID NO: 369609 - DNA, 15 bp, Homo sapiens
gggaaattctaacat

SEQ ID NO: 369610 - DNA, 15 bp, Homo sapiens
ggaaattctaacatg

SEQ ID NO: 369611 - DNA, 15 bp, Homo sapiens
gaaattctaacatgg

SEQ ID NO: 369612 - DNA, 15 bp, Homo sapiens
aaattctaacatggt

SEQ ID NO: 369613 - DNA, 15 bp, Homo sapiens
aattctaacatggtt

SEQ ID NO: 369614 - DNA, 15 bp, Homo sapiens
attctaacatggttt

SEQ ID NO: 369615 - DNA, 15 bp, Homo sapiens
ttctaacatggttta

SEQ ID NO: 369616 - DNA, 15 bp, Homo sapiens
tctaacatggtttat

SEQ ID NO: 369617 - DNA, 15 bp, Homo sapiens
ctaacatggtttatt

SEQ ID NO: 369618 - DNA, 15 bp, Homo sapiens
taacatggtttattt

SEQ ID NO: 369619 - DNA, 15 bp, Homo sapiens
aacatggtttatttc

SEQ ID NO: 369620 - DNA, 15 bp, Homo sapiens
acatggtttatttca

SEQ ID NO: 369621 - DNA, 15 bp, Homo sapiens
catggtttatttcat

SEQ ID NO: 369622 - DNA, 15 bp, Homo sapiens
atggtttatttcatt

SEQ ID NO: 369623 - DNA, 15 bp, Homo sapiens
tggtttatttcattc

SEQ ID NO: 369624 - DNA, 15 bp, Homo sapiens
ggtttatttcattca

SEQ ID NO: 369625 - DNA, 15 bp, Homo sapiens
gtttatttcattcat

SEQ ID NO: 369626 - DNA, 15 bp, Homo sapiens
tttatttcattcatt

SEQ ID NO: 369627 - DNA, 15 bp, Homo sapiens
ttatttcattcattc

SEQ ID NO: 369628 - DNA, 15 bp, Homo sapiens
tatttcattcattca

SEQ ID NO: 369629 - DNA, 15 bp, Homo sapiens
atttcattcattcat

SEQ ID NO: 369630 - DNA, 15 bp, Homo sapiens
tttcattcattcata

SEQ ID NO: 369631 - DNA, 15 bp, Homo sapiens
ttcattcattcatac

SEQ ID NO: 369632 - DNA, 15 bp, Homo sapiens
tcattcattcataca

SEQ ID NO: 369633 - DNA, 15 bp, Homo sapiens
cattcattcatacag

SEQ ID NO: 369634 - DNA, 15 bp, Homo sapiens
attcattcatacagt

SEQ ID NO: 369635 - DNA, 15 bp, Homo sapiens
ttcattcatacagtc

SEQ ID NO: 369636 - DNA, 15 bp, Homo sapiens
tcattcatacagtca

SEQ ID NO: 369637 - DNA, 15 bp, Homo sapiens
cattcatacagtcat

SEQ ID NO: 369638 - DNA, 15 bp, Homo sapiens
attcatacagtcatt

SEQ ID NO: 369639 - DNA, 15 bp, Homo sapiens
ttcatacagtcattc

SEQ ID NO: 369640 - DNA, 15 bp, Homo sapiens
tcatacagtcattca

SEQ ID NO: 369641 - DNA, 15 bp, Homo sapiens
catacagtcattcat

SEQ ID NO: 369642 - DNA, 15 bp, Homo sapiens
atacagtcattcatt

SEQ ID NO: 369643 - DNA, 15 bp, Homo sapiens
tacagtcattcattc

SEQ ID NO: 369644 - DNA, 15 bp, Homo sapiens
acagtcattcattca

SEQ ID NO: 369645 - DNA, 15 bp, Homo sapiens
cagtcattcattcac

SEQ ID NO: 369646 - DNA, 15 bp, Homo sapiens
agtcattcattcact

SEQ ID NO: 369647 - DNA, 15 bp, Homo sapiens
gtcattcattcactc

SEQ ID NO: 369648 - DNA, 15 bp, Homo sapiens
tcattcattcactca

SEQ ID NO: 369649 - DNA, 15 bp, Homo sapiens
cattcattcactcaa

SEQ ID NO: 369650 - DNA, 15 bp, Homo sapiens
attcattcactcaat

SEQ ID NO: 369651 - DNA, 15 bp, Homo sapiens
ttcattcactcaata

SEQ ID NO: 369652 - DNA, 15 bp, Homo sapiens
tcattcactcaatag

SEQ ID NO: 369653 - DNA, 15 bp, Homo sapiens
cattcactcaatagg

SEQ ID NO: 369654 - DNA, 15 bp, Homo sapiens
attcactcaataggt

SEQ ID NO: 369655 - DNA, 15 bp, Homo sapiens
ttcactcaataggtt

SEQ ID NO: 369656 - DNA, 15 bp, Homo sapiens
tcactcaataggttt

SEQ ID NO: 369657 - DNA, 15 bp, Homo sapiens
cactcaataggtttt

SEQ ID NO: 369658 - DNA, 15 bp, Homo sapiens
actcaataggttttt

SEQ ID NO: 369659 - DNA, 15 bp, Homo sapiens
ctcaataggttttta

SEQ ID NO: 369660 - DNA, 15 bp, Homo sapiens
tcaataggtttttat

SEQ ID NO: 369661 - DNA, 15 bp, Homo sapiens
caataggtttttatt

SEQ ID NO: 369662 - DNA, 15 bp, Homo sapiens
aataggtttttattg

SEQ ID NO: 369663 - DNA, 15 bp, Homo sapiens
ataggtttttattgg

SEQ ID NO: 369664 - DNA, 15 bp, Homo sapiens
taggtttttattgga

SEQ ID NO: 369665 - DNA, 15 bp, Homo sapiens
aggtttttattggag

SEQ ID NO: 369666 - DNA, 15 bp, Homo sapiens
ggtttttattggagt

SEQ ID NO: 369667 - DNA, 15 bp, Homo sapiens
gtttttattggagtc

SEQ ID NO: 369668 - DNA, 15 bp, Homo sapiens
tttttattggagtct

SEQ ID NO: 369669 - DNA, 15 bp, Homo sapiens
ttttattggagtctc

SEQ ID NO: 369670 - DNA, 15 bp, Homo sapiens
tttattggagtctca

SEQ ID NO: 369671 - DNA, 15 bp, Homo sapiens
ttattggagtctcac

SEQ ID NO: 369672 - DNA, 15 bp, Homo sapiens
tattggagtctcact

SEQ ID NO: 369673 - DNA, 15 bp, Homo sapiens
attggagtctcactt

SEQ ID NO: 369674 - DNA, 15 bp, Homo sapiens
ttggagtctcacttt

SEQ ID NO: 369675 - DNA, 15 bp, Homo sapiens
tggagtctcactttc

SEQ ID NO: 369676 - DNA, 15 bp, Homo sapiens
ggagtctcactttct

SEQ ID NO: 369677 - DNA, 15 bp, Homo sapiens
gagtctcactttctg

SEQ ID NO: 369678 - DNA, 15 bp, Homo sapiens
agtctcactttctgc

SEQ ID NO: 369679 - DNA, 15 bp, Homo sapiens
gtctcactttctgcc

SEQ ID NO: 369680 - DNA, 15 bp, Homo sapiens
tctcactttctgcca

SEQ ID NO: 369681 - DNA, 15 bp, Homo sapiens
ctcactttctgccag

SEQ ID NO: 369682 - DNA, 15 bp, Homo sapiens
tcactttctgccagg

SEQ ID NO: 369683 - DNA, 15 bp, Homo sapiens
cactttctgccaggt

SEQ ID NO: 369684 - DNA, 15 bp, Homo sapiens
actttctgccaggta

SEQ ID NO: 369685 - DNA, 15 bp, Homo sapiens
ctttctgccaggtat

SEQ ID NO: 369686 - DNA, 15 bp, Homo sapiens
tttctgccaggtatc

SEQ ID NO: 369687 - DNA, 15 bp, Homo sapiens
ttctgccaggtatca

SEQ ID NO: 369688 - DNA, 15 bp, Homo sapiens
tctgccaggtatcat

SEQ ID NO: 369689 - DNA, 15 bp, Homo sapiens
ctgccaggtatcatt

SEQ ID NO: 369690 - DNA, 15 bp, Homo sapiens
tgccaggtatcattt

SEQ ID NO: 369691 - DNA, 15 bp, Homo sapiens
gccaggtatcatttt

SEQ ID NO: 369692 - DNA, 15 bp, Homo sapiens
ccaggtatcatttta

SEQ ID NO: 369693 - DNA, 15 bp, Homo sapiens
caggtatcattttaa

SEQ ID NO: 369694 - DNA, 15 bp, Homo sapiens
aggtatcattttaag

SEQ ID NO: 369695 - DNA, 15 bp, Homo sapiens
ggtatcattttaaga

SEQ ID NO: 369696 - DNA, 15 bp, Homo sapiens
gtatcattttaagag

SEQ ID NO: 369697 - DNA, 15 bp, Homo sapiens
tatcattttaagaga

SEQ ID NO: 369698 - DNA, 15 bp, Homo sapiens
atcattttaagagat

SEQ ID NO: 369699 - DNA, 15 bp, Homo sapiens
tcattttaagagata

SEQ ID NO: 369700 - DNA, 15 bp, Homo sapiens
cattttaagagatag

SEQ ID NO: 369701 - DNA, 15 bp, Homo sapiens
attttaagagatagg

SEQ ID NO: 369702 - DNA, 15 bp, Homo sapiens
ttttaagagatagga

SEQ ID NO: 369703 - DNA, 15 bp, Homo sapiens
tttaagagataggaa

SEQ ID NO: 369704 - DNA, 15 bp, Homo sapiens
ttaagagataggaat

SEQ ID NO: 369705 - DNA, 15 bp, Homo sapiens
taagagataggaatg

SEQ ID NO: 369706 - DNA, 15 bp, Homo sapiens
aagagataggaatgc

SEQ ID NO: 369707 - DNA, 15 bp, Homo sapiens
agagataggaatgca

SEQ ID NO: 369708 - DNA, 15 bp, Homo sapiens
gagataggaatgcat

SEQ ID NO: 369709 - DNA, 15 bp, Homo sapiens
agataggaatgcatt

SEQ ID NO: 369710 - DNA, 15 bp, Homo sapiens
gataggaatgcatta

SEQ ID NO: 369711 - DNA, 15 bp, Homo sapiens
ataggaatgcattaa

SEQ ID NO: 369712 - DNA, 15 bp, Homo sapiens
taggaatgcattaaa

SEQ ID NO: 369713 - DNA, 15 bp, Homo sapiens
aggaatgcattaaag

SEQ ID NO: 369714 - DNA, 15 bp, Homo sapiens
ggaatgcattaaaga

SEQ ID NO: 369715 - DNA, 15 bp, Homo sapiens
gaatgcattaaagag

SEQ ID NO: 369716 - DNA, 15 bp, Homo sapiens
aatgcattaaagagt

SEQ ID NO: 369717 - DNA, 15 bp, Homo sapiens
atgcattaaagagtg

SEQ ID NO: 369718 - DNA, 15 bp, Homo sapiens
tgcattaaagagtgt

SEQ ID NO: 369719 - DNA, 15 bp, Homo sapiens
gcattaaagagtgtg

SEQ ID NO: 369720 - DNA, 15 bp, Homo sapiens
cattaaagagtgtgg

SEQ ID NO: 369721 - DNA, 15 bp, Homo sapiens
attaaagagtgtggc

SEQ ID NO: 369722 - DNA, 15 bp, Homo sapiens
ttaaagagtgtggca

SEQ ID NO: 369723 - DNA, 15 bp, Homo sapiens
taaagagtgtggcat

SEQ ID NO: 369724 - DNA, 15 bp, Homo sapiens
aaagagtgtggcatt

SEQ ID NO: 369725 - DNA, 15 bp, Homo sapiens
aagagtgtggcattc

SEQ ID NO: 369726 - DNA, 15 bp, Homo sapiens
agagtgtggcattcc

SEQ ID NO: 369727 - DNA, 15 bp, Homo sapiens
gagtgtggcattcct

SEQ ID NO: 369728 - DNA, 15 bp, Homo sapiens
agtgtggcattcctt

SEQ ID NO: 369729 - DNA, 15 bp, Homo sapiens
gtgtggcattccttc

SEQ ID NO: 369730 - DNA, 15 bp, Homo sapiens
tgtggcattccttct

SEQ ID NO: 369731 - DNA, 15 bp, Homo sapiens
gtggcattccttcta

SEQ ID NO: 369732 - DNA, 15 bp, Homo sapiens
tggcattccttctaa

SEQ ID NO: 369733 - DNA, 15 bp, Homo sapiens
ggcattccttctaac

SEQ ID NO: 369734 - DNA, 15 bp, Homo sapiens
gcattccttctaact

SEQ ID NO: 369735 - DNA, 15 bp, Homo sapiens
cattccttctaactc

SEQ ID NO: 369736 - DNA, 15 bp, Homo sapiens
attccttctaactca

SEQ ID NO: 369737 - DNA, 15 bp, Homo sapiens
ttccttctaactcaa

SEQ ID NO: 369738 - DNA, 15 bp, Homo sapiens
tccttctaactcaaa

SEQ ID NO: 369739 - DNA, 15 bp, Homo sapiens
ccttctaactcaaag

SEQ ID NO: 369740 - DNA, 15 bp, Homo sapiens
cttctaactcaaaga

SEQ ID NO: 369741 - DNA, 15 bp, Homo sapiens
ttctaactcaaagag

SEQ ID NO: 369742 - DNA, 15 bp, Homo sapiens
tctaactcaaagagc

SEQ ID NO: 369743 - DNA, 15 bp, Homo sapiens
ctaactcaaagagct

SEQ ID NO: 369744 - DNA, 15 bp, Homo sapiens
taactcaaagagctt

SEQ ID NO: 369745 - DNA, 15 bp, Homo sapiens
aactcaaagagctta

SEQ ID NO: 369746 - DNA, 15 bp, Homo sapiens
actcaaagagcttat

SEQ ID NO: 369747 - DNA, 15 bp, Homo sapiens
ctcaaagagcttatc

SEQ ID NO: 369748 - DNA, 15 bp, Homo sapiens
tcaaagagcttatca

SEQ ID NO: 369749 - DNA, 15 bp, Homo sapiens
caaagagcttatcat

SEQ ID NO: 369750 - DNA, 15 bp, Homo sapiens
aaagagcttatcatg

SEQ ID NO: 369751 - DNA, 15 bp, Homo sapiens
aagagcttatcatgg

SEQ ID NO: 369752 - DNA, 15 bp, Homo sapiens
agagcttatcatgga

SEQ ID NO: 369753 - DNA, 15 bp, Homo sapiens
gagcttatcatggat

SEQ ID NO: 369754 - DNA, 15 bp, Homo sapiens
agcttatcatggatg

SEQ ID NO: 369755 - DNA, 15 bp, Homo sapiens
gcttatcatggatga

SEQ ID NO: 369756 - DNA, 15 bp, Homo sapiens
cttatcatggatgag

SEQ ID NO: 369757 - DNA, 15 bp, Homo sapiens
ttatcatggatgaga

SEQ ID NO: 369758 - DNA, 15 bp, Homo sapiens
tatcatggatgagac

SEQ ID NO: 369759 - DNA, 15 bp, Homo sapiens
atcatggatgagacc

SEQ ID NO: 369760 - DNA, 15 bp, Homo sapiens
tcatggatgagacca

SEQ ID NO: 369761 - DNA, 15 bp, Homo sapiens
catggatgagaccag

SEQ ID NO: 369762 - DNA, 15 bp, Homo sapiens
atggatgagaccagc

SEQ ID NO: 369763 - DNA, 15 bp, Homo sapiens
tggatgagaccagca

SEQ ID NO: 369764 - DNA, 15 bp, Homo sapiens
ggatgagaccagcag

SEQ ID NO: 369765 - DNA, 15 bp, Homo sapiens
gatgagaccagcaga

SEQ ID NO: 369766 - DNA, 15 bp, Homo sapiens
atgagaccagcagac

SEQ ID NO: 369767 - DNA, 15 bp, Homo sapiens
tgagaccagcagaca

SEQ ID NO: 369768 - DNA, 15 bp, Homo sapiens
gagaccagcagacaa

SEQ ID NO: 369769 - DNA, 15 bp, Homo sapiens
agaccagcagacaac

SEQ ID NO: 369770 - DNA, 15 bp, Homo sapiens
gaccagcagacaacc

SEQ ID NO: 369771 - DNA, 15 bp, Homo sapiens
accagcagacaacca

SEQ ID NO: 369772 - DNA, 15 bp, Homo sapiens
ccagcagacaaccaa

SEQ ID NO: 369773 - DNA, 15 bp, Homo sapiens
cagcagacaaccaat

SEQ ID NO: 369774 - DNA, 15 bp, Homo sapiens
agcagacaaccaatt

SEQ ID NO: 369775 - DNA, 15 bp, Homo sapiens
gcagacaaccaatta

SEQ ID NO: 369776 - DNA, 15 bp, Homo sapiens
cagacaaccaattat

SEQ ID NO: 369777 - DNA, 15 bp, Homo sapiens
agacaaccaattata

SEQ ID NO: 369778 - DNA, 15 bp, Homo sapiens
gacaaccaattataa

SEQ ID NO: 369779 - DNA, 15 bp, Homo sapiens
acaaccaattataac

SEQ ID NO: 369780 - DNA, 15 bp, Homo sapiens
caaccaattataaca

SEQ ID NO: 369781 - DNA, 15 bp, Homo sapiens
aaccaattataacat

SEQ ID NO: 369782 - DNA, 15 bp, Homo sapiens
accaattataacatc

SEQ ID NO: 369783 - DNA, 15 bp, Homo sapiens
ccaattataacatcc

SEQ ID NO: 369784 - DNA, 15 bp, Homo sapiens
caattataacatcca

SEQ ID NO: 369785 - DNA, 15 bp, Homo sapiens
aattataacatccag

SEQ ID NO: 369786 - DNA, 15 bp, Homo sapiens
attataacatccagg

SEQ ID NO: 369787 - DNA, 15 bp, Homo sapiens
ttataacatccaggt

SEQ ID NO: 369788 - DNA, 15 bp, Homo sapiens
tataacatccaggta

SEQ ID NO: 369789 - DNA, 15 bp, Homo sapiens
ataacatccaggtag

SEQ ID NO: 369790 - DNA, 15 bp, Homo sapiens
taacatccaggtagt

SEQ ID NO: 369791 - DNA, 15 bp, Homo sapiens
aacatccaggtagtg

SEQ ID NO: 369792 - DNA, 15 bp, Homo sapiens
acatccaggtagtga

SEQ ID NO: 369793 - DNA, 15 bp, Homo sapiens
catccaggtagtgat

SEQ ID NO: 369794 - DNA, 15 bp, Homo sapiens
atccaggtagtgatg

SEQ ID NO: 369795 - DNA, 15 bp, Homo sapiens
tccaggtagtgatgg

SEQ ID NO: 369796 - DNA, 15 bp, Homo sapiens
ccaggtagtgatggg

SEQ ID NO: 369797 - DNA, 15 bp, Homo sapiens
caggtagtgatgggt

SEQ ID NO: 369798 - DNA, 15 bp, Homo sapiens
aggtagtgatgggta

SEQ ID NO: 369799 - DNA, 15 bp, Homo sapiens
ggtagtgatgggtac

SEQ ID NO: 369800 - DNA, 15 bp, Homo sapiens
gtagtgatgggtaca

SEQ ID NO: 369801 - DNA, 15 bp, Homo sapiens
tagtgatgggtacat

SEQ ID NO: 369802 - DNA, 15 bp, Homo sapiens
agtgatgggtacata

SEQ ID NO: 369803 - DNA, 15 bp, Homo sapiens
gtgatgggtacataa

SEQ ID NO: 369804 - DNA, 15 bp, Homo sapiens
tgatgggtacataaa

SEQ ID NO: 369805 - DNA, 15 bp, Homo sapiens
gatgggtacataaag

SEQ ID NO: 369806 - DNA, 15 bp, Homo sapiens
atgggtacataaagg

SEQ ID NO: 369807 - DNA, 15 bp, Homo sapiens
tgggtacataaaggt

SEQ ID NO: 369808 - DNA, 15 bp, Homo sapiens
gggtacataaaggtg

SEQ ID NO: 369809 - DNA, 15 bp, Homo sapiens
ggtacataaaggtgg

SEQ ID NO: 369810 - DNA, 15 bp, Homo sapiens
gtacataaaggtgga

SEQ ID NO: 369811 - DNA, 15 bp, Homo sapiens
tacataaaggtggag

SEQ ID NO: 369812 - DNA, 15 bp, Homo sapiens
acataaaggtggagc

SEQ ID NO: 369813 - DNA, 15 bp, Homo sapiens
cataaaggtggagca

SEQ ID NO: 369814 - DNA, 15 bp, Homo sapiens
ataaaggtggagcac

SEQ ID NO: 369815 - DNA, 15 bp, Homo sapiens
taaaggtggagcacc

SEQ ID NO: 369816 - DNA, 15 bp, Homo sapiens
aaaggtggagcacct

SEQ ID NO: 369817 - DNA, 15 bp, Homo sapiens
aaggtggagcacctg

SEQ ID NO: 369818 - DNA, 15 bp, Homo sapiens
aggtggagcacctgc

SEQ ID NO: 369819 - DNA, 15 bp, Homo sapiens
ggtggagcacctgct

SEQ ID NO: 369820 - DNA, 15 bp, Homo sapiens
gtggagcacctgctt

SEQ ID NO: 369821 - DNA, 15 bp, Homo sapiens
tggagcacctgcttg

SEQ ID NO: 369822 - DNA, 15 bp, Homo sapiens
ggagcacctgcttgg

SEQ ID NO: 369823 - DNA, 15 bp, Homo sapiens
gagcacctgcttggc

SEQ ID NO: 369824 - DNA, 15 bp, Homo sapiens
agcacctgcttggct

SEQ ID NO: 369825 - DNA, 15 bp, Homo sapiens
gcacctgcttggctt

SEQ ID NO: 369826 - DNA, 15 bp, Homo sapiens
cacctgcttggcttt

SEQ ID NO: 369827 - DNA, 15 bp, Homo sapiens
acctgcttggctttg

SEQ ID NO: 369828 - DNA, 15 bp, Homo sapiens
cctgcttggctttga

SEQ ID NO: 369829 - DNA, 15 bp, Homo sapiens
ctgcttggctttgag

SEQ ID NO: 369830 - DNA, 15 bp, Homo sapiens
tgcttggctttgagg

SEQ ID NO: 369831 - DNA, 15 bp, Homo sapiens
gcttggctttgaggg

SEQ ID NO: 369832 - DNA, 15 bp, Homo sapiens
cttggctttgagggg

SEQ ID NO: 369833 - DNA, 15 bp, Homo sapiens
ttggctttgaggggt

SEQ ID NO: 369834 - DNA, 15 bp, Homo sapiens
tggctttgaggggta

SEQ ID NO: 369835 - DNA, 15 bp, Homo sapiens
ggctttgaggggtag

SEQ ID NO: 369836 - DNA, 15 bp, Homo sapiens
gctttgaggggtagc

SEQ ID NO: 369837 - DNA, 15 bp, Homo sapiens
ctttgaggggtagct

SEQ ID NO: 369838 - DNA, 15 bp, Homo sapiens
tttgaggggtagctg

SEQ ID NO: 369839 - DNA, 15 bp, Homo sapiens
ttgaggggtagctgt

SEQ ID NO: 369840 - DNA, 15 bp, Homo sapiens
tgaggggtagctgtg

SEQ ID NO: 369841 - DNA, 15 bp, Homo sapiens
gaggggtagctgtgg

SEQ ID NO: 369842 - DNA, 15 bp, Homo sapiens
aggggtagctgtgga

SEQ ID NO: 369843 - DNA, 15 bp, Homo sapiens
ggggtagctgtggaa

SEQ ID NO: 369844 - DNA, 15 bp, Homo sapiens
gggtagctgtggaag

SEQ ID NO: 369845 - DNA, 15 bp, Homo sapiens
ggtagctgtggaagg

SEQ ID NO: 369846 - DNA, 15 bp, Homo sapiens
gtagctgtggaaggt

SEQ ID NO: 369847 - DNA, 15 bp, Homo sapiens
tagctgtggaaggtt

SEQ ID NO: 369848 - DNA, 15 bp, Homo sapiens
agctgtggaaggttt

SEQ ID NO: 369849 - DNA, 15 bp, Homo sapiens
gctgtggaaggtttt

SEQ ID NO: 369850 - DNA, 15 bp, Homo sapiens
ctgtggaaggttttg

SEQ ID NO: 369851 - DNA, 15 bp, Homo sapiens
tgtggaaggttttgt

SEQ ID NO: 369852 - DNA, 15 bp, Homo sapiens
gtggaaggttttgtt

SEQ ID NO: 369853 - DNA, 15 bp, Homo sapiens
tggaaggttttgttg

SEQ ID NO: 369854 - DNA, 15 bp, Homo sapiens
ggaaggttttgttga

SEQ ID NO: 369855 - DNA, 15 bp, Homo sapiens
gaaggttttgttgaa

SEQ ID NO: 369856 - DNA, 15 bp, Homo sapiens
aaggttttgttgaaa

SEQ ID NO: 369857 - DNA, 15 bp, Homo sapiens
aggttttgttgaaaa

SEQ ID NO: 369858 - DNA, 15 bp, Homo sapiens
ggttttgttgaaaag

SEQ ID NO: 369859 - DNA, 15 bp, Homo sapiens
gttttgttgaaaaga

SEQ ID NO: 369860 - DNA, 15 bp, Homo sapiens
ttttgttgaaaagat

SEQ ID NO: 369861 - DNA, 15 bp, Homo sapiens
tttgttgaaaagatc

SEQ ID NO: 369862 - DNA, 15 bp, Homo sapiens
ttgttgaaaagatca

SEQ ID NO: 369863 - DNA, 15 bp, Homo sapiens
tgttgaaaagatcac

SEQ ID NO: 369864 - DNA, 15 bp, Homo sapiens
gttgaaaagatcaca

SEQ ID NO: 369865 - DNA, 15 bp, Homo sapiens
ttgaaaagatcacat

SEQ ID NO: 369866 - DNA, 15 bp, Homo sapiens
tgaaaagatcacatt

SEQ ID NO: 369867 - DNA, 15 bp, Homo sapiens
gaaaagatcacattc

SEQ ID NO: 369868 - DNA, 15 bp, Homo sapiens
aaaagatcacattct

SEQ ID NO: 369869 - DNA, 15 bp, Homo sapiens
aaagatcacattctg

SEQ ID NO: 369870 - DNA, 15 bp, Homo sapiens
aagatcacattctgg

SEQ ID NO: 369871 - DNA, 15 bp, Homo sapiens
agatcacattctggt

SEQ ID NO: 369872 - DNA, 15 bp, Homo sapiens
gatcacattctggtt

SEQ ID NO: 369873 - DNA, 15 bp, Homo sapiens
atcacattctggtta

SEQ ID NO: 369874 - DNA, 15 bp, Homo sapiens
tcacattctggttaa

SEQ ID NO: 369875 - DNA, 15 bp, Homo sapiens
cacattctggttaat

SEQ ID NO: 369876 - DNA, 15 bp, Homo sapiens
acattctggttaatt

SEQ ID NO: 369877 - DNA, 15 bp, Homo sapiens
cattctggttaattt

SEQ ID NO: 369878 - DNA, 15 bp, Homo sapiens
attctggttaattta

SEQ ID NO: 369879 - DNA, 15 bp, Homo sapiens
ttctggttaatttac

SEQ ID NO: 369880 - DNA, 15 bp, Homo sapiens
tctggttaatttacg

SEQ ID NO: 369881 - DNA, 15 bp, Homo sapiens
ctggttaatttacga

SEQ ID NO: 369882 - DNA, 15 bp, Homo sapiens
tggttaatttacgaa

SEQ ID NO: 369883 - DNA, 15 bp, Homo sapiens
ggttaatttacgaag

SEQ ID NO: 369884 - DNA, 15 bp, Homo sapiens
gttaatttacgaagg

SEQ ID NO: 369885 - DNA, 15 bp, Homo sapiens
ttaatttacgaagga

SEQ ID NO: 369886 - DNA, 15 bp, Homo sapiens
taatttacgaaggat

SEQ ID NO: 369887 - DNA, 15 bp, Homo sapiens
aatttacgaaggatg

SEQ ID NO: 369888 - DNA, 15 bp, Homo sapiens
atttacgaaggatga

SEQ ID NO: 369889 - DNA, 15 bp, Homo sapiens
tttacgaaggatgaa

SEQ ID NO: 369890 - DNA, 15 bp, Homo sapiens
ttacgaaggatgaat

SEQ ID NO: 369891 - DNA, 15 bp, Homo sapiens
tacgaaggatgaata

SEQ ID NO: 369892 - DNA, 15 bp, Homo sapiens
acgaaggatgaataa

SEQ ID NO: 369893 - DNA, 15 bp, Homo sapiens
cgaaggatgaataag

SEQ ID NO: 369894 - DNA, 15 bp, Homo sapiens
gaaggatgaataagt

SEQ ID NO: 369895 - DNA, 15 bp, Homo sapiens
aaggatgaataagta

SEQ ID NO: 369896 - DNA, 15 bp, Homo sapiens
aggatgaataagtat

SEQ ID NO: 369897 - DNA, 15 bp, Homo sapiens
ggatgaataagtatt

SEQ ID NO: 369898 - DNA, 15 bp, Homo sapiens
gatgaataagtattg

SEQ ID NO: 369899 - DNA, 15 bp, Homo sapiens
atgaataagtattgg

SEQ ID NO: 369900 - DNA, 15 bp, Homo sapiens
tgaataagtattggt

SEQ ID NO: 369901 - DNA, 15 bp, Homo sapiens
gaataagtattggtc

SEQ ID NO: 369902 - DNA, 15 bp, Homo sapiens
aataagtattggtcg

SEQ ID NO: 369903 - DNA, 15 bp, Homo sapiens
ataagtattggtcgg

SEQ ID NO: 369904 - DNA, 15 bp, Homo sapiens
taagtattggtcggg

SEQ ID NO: 369905 - DNA, 15 bp, Homo sapiens
aagtattggtcgggt

SEQ ID NO: 369906 - DNA, 15 bp, Homo sapiens
agtattggtcgggtg

SEQ ID NO: 369907 - DNA, 15 bp, Homo sapiens
gtattggtcgggtga

SEQ ID NO: 369908 - DNA, 15 bp, Homo sapiens
tattggtcgggtgaa

SEQ ID NO: 369909 - DNA, 15 bp, Homo sapiens
attggtcgggtgaag

SEQ ID NO: 369910 - DNA, 15 bp, Homo sapiens
ttggtcgggtgaaga

SEQ ID NO: 369911 - DNA, 15 bp, Homo sapiens
tggtcgggtgaagaa

SEQ ID NO: 369912 - DNA, 15 bp, Homo sapiens
ggtcgggtgaagaat

SEQ ID NO: 369913 - DNA, 15 bp, Homo sapiens
gtcgggtgaagaatg

SEQ ID NO: 369914 - DNA, 15 bp, Homo sapiens
tcgggtgaagaatga

SEQ ID NO: 369915 - DNA, 15 bp, Homo sapiens
cgggtgaagaatgag

SEQ ID NO: 369916 - DNA, 15 bp, Homo sapiens
gggtgaagaatgagg

SEQ ID NO: 369917 - DNA, 15 bp, Homo sapiens
ggtgaagaatgaggg

SEQ ID NO: 369918 - DNA, 15 bp, Homo sapiens
gtgaagaatgaggga

SEQ ID NO: 369919 - DNA, 15 bp, Homo sapiens
tgaagaatgagggaa

SEQ ID NO: 369920 - DNA, 15 bp, Homo sapiens
gaagaatgagggaaa

SEQ ID NO: 369921 - DNA, 15 bp, Homo sapiens
aagaatgagggaaag

SEQ ID NO: 369922 - DNA, 15 bp, Homo sapiens
agaatgagggaaagt

SEQ ID NO: 369923 - DNA, 15 bp, Homo sapiens
gaatgagggaaagtg

SEQ ID NO: 369924 - DNA, 15 bp, Homo sapiens
aatgagggaaagtgc

SEQ ID NO: 369925 - DNA, 15 bp, Homo sapiens
atgagggaaagtgca

SEQ ID NO: 369926 - DNA, 15 bp, Homo sapiens
tgagggaaagtgcag

SEQ ID NO: 369927 - DNA, 15 bp, Homo sapiens
gagggaaagtgcagt

SEQ ID NO: 369928 - DNA, 15 bp, Homo sapiens
agggaaagtgcagtg

SEQ ID NO: 369929 - DNA, 15 bp, Homo sapiens
gggaaagtgcagtgt

SEQ ID NO: 369930 - DNA, 15 bp, Homo sapiens
ggaaagtgcagtgta

SEQ ID NO: 369931 - DNA, 15 bp, Homo sapiens
gaaagtgcagtgtag

SEQ ID NO: 369932 - DNA, 15 bp, Homo sapiens
aaagtgcagtgtaga

SEQ ID NO: 369933 - DNA, 15 bp, Homo sapiens
aagtgcagtgtagag

SEQ ID NO: 369934 - DNA, 15 bp, Homo sapiens
agtgcagtgtagaga

SEQ ID NO: 369935 - DNA, 15 bp, Homo sapiens
gtgcagtgtagagag

SEQ ID NO: 369936 - DNA, 15 bp, Homo sapiens
tgcagtgtagagaga

SEQ ID NO: 369937 - DNA, 15 bp, Homo sapiens
gcagtgtagagagaa

SEQ ID NO: 369938 - DNA, 15 bp, Homo sapiens
cagtgtagagagaag

SEQ ID NO: 369939 - DNA, 15 bp, Homo sapiens
agtgtagagagaagt

SEQ ID NO: 369940 - DNA, 15 bp, Homo sapiens
gtgtagagagaagtg

SEQ ID NO: 369941 - DNA, 15 bp, Homo sapiens
tgtagagagaagtgg

SEQ ID NO: 369942 - DNA, 15 bp, Homo sapiens
gtagagagaagtggc

SEQ ID NO: 369943 - DNA, 15 bp, Homo sapiens
tagagagaagtggca

SEQ ID NO: 369944 - DNA, 15 bp, Homo sapiens
agagagaagtggcaa

SEQ ID NO: 369945 - DNA, 15 bp, Homo sapiens
gagagaagtggcaaa

SEQ ID NO: 369946 - DNA, 15 bp, Homo sapiens
agagaagtggcaaat

SEQ ID NO: 369947 - DNA, 15 bp, Homo sapiens
gagaagtggcaaatg

SEQ ID NO: 369948 - DNA, 15 bp, Homo sapiens
agaagtggcaaatga

SEQ ID NO: 369949 - DNA, 15 bp, Homo sapiens
gaagtggcaaatgaa

SEQ ID NO: 369950 - DNA, 15 bp, Homo sapiens
aagtggcaaatgaaa

SEQ ID NO: 369951 - DNA, 15 bp, Homo sapiens
agtggcaaatgaaag

SEQ ID NO: 369952 - DNA, 15 bp, Homo sapiens
gtggcaaatgaaagt

SEQ ID NO: 369953 - DNA, 15 bp, Homo sapiens
tggcaaatgaaagtg

SEQ ID NO: 369954 - DNA, 15 bp, Homo sapiens
ggcaaatgaaagtgt

SEQ ID NO: 369955 - DNA, 15 bp, Homo sapiens
gcaaatgaaagtgtc

SEQ ID NO: 369956 - DNA, 15 bp, Homo sapiens
caaatgaaagtgtct

SEQ ID NO: 369957 - DNA, 15 bp, Homo sapiens
aaatgaaagtgtcta

SEQ ID NO: 369958 - DNA, 15 bp, Homo sapiens
aatgaaagtgtctag

SEQ ID NO: 369959 - DNA, 15 bp, Homo sapiens
atgaaagtgtctaga

SEQ ID NO: 369960 - DNA, 15 bp, Homo sapiens
tgaaagtgtctagaa

SEQ ID NO: 369961 - DNA, 15 bp, Homo sapiens
gaaagtgtctagaag

SEQ ID NO: 369962 - DNA, 15 bp, Homo sapiens
aaagtgtctagaaga

SEQ ID NO: 369963 - DNA, 15 bp, Homo sapiens
aagtgtctagaagag

SEQ ID NO: 369964 - DNA, 15 bp, Homo sapiens
agtgtctagaagaga

SEQ ID NO: 369965 - DNA, 15 bp, Homo sapiens
gtgtctagaagagac

SEQ ID NO: 369966 - DNA, 15 bp, Homo sapiens
tgtctagaagagaca

SEQ ID NO: 369967 - DNA, 15 bp, Homo sapiens
gtctagaagagacag

SEQ ID NO: 369968 - DNA, 15 bp, Homo sapiens
tctagaagagacaga

SEQ ID NO: 369969 - DNA, 15 bp, Homo sapiens
ctagaagagacagag

SEQ ID NO: 369970 - DNA, 15 bp, Homo sapiens
tagaagagacagaga

SEQ ID NO: 369971 - DNA, 15 bp, Homo sapiens
agaagagacagagaa

SEQ ID NO: 369972 - DNA, 15 bp, Homo sapiens
gaagagacagagaat

SEQ ID NO: 369973 - DNA, 15 bp, Homo sapiens
aagagacagagaatg

SEQ ID NO: 369974 - DNA, 15 bp, Homo sapiens
agagacagagaatga

SEQ ID NO: 369975 - DNA, 15 bp, Homo sapiens
gagacagagaatgag

SEQ ID NO: 369976 - DNA, 15 bp, Homo sapiens
agacagagaatgagc

SEQ ID NO: 369977 - DNA, 15 bp, Homo sapiens
gacagagaatgagca

SEQ ID NO: 369978 - DNA, 15 bp, Homo sapiens
acagagaatgagcac

SEQ ID NO: 369979 - DNA, 15 bp, Homo sapiens
cagagaatgagcaca

SEQ ID NO: 369980 - DNA, 15 bp, Homo sapiens
agagaatgagcacag

SEQ ID NO: 369981 - DNA, 15 bp, Homo sapiens
gagaatgagcacagt

SEQ ID NO: 369982 - DNA, 15 bp, Homo sapiens
agaatgagcacagtg

SEQ ID NO: 369983 - DNA, 15 bp, Homo sapiens
gaatgagcacagtgt

SEQ ID NO: 369984 - DNA, 15 bp, Homo sapiens
aatgagcacagtgta

SEQ ID NO: 369985 - DNA, 15 bp, Homo sapiens
atgagcacagtgtat

SEQ ID NO: 369986 - DNA, 15 bp, Homo sapiens
tgagcacagtgtata

SEQ ID NO: 369987 - DNA, 15 bp, Homo sapiens
gagcacagtgtatat

SEQ ID NO: 369988 - DNA, 15 bp, Homo sapiens
agcacagtgtatata

SEQ ID NO: 369989 - DNA, 15 bp, Homo sapiens
gcacagtgtatatag

SEQ ID NO: 369990 - DNA, 15 bp, Homo sapiens
cacagtgtatatagg

SEQ ID NO: 369991 - DNA, 15 bp, Homo sapiens
acagtgtatataggt

SEQ ID NO: 369992 - DNA, 15 bp, Homo sapiens
cagtgtatataggtc

SEQ ID NO: 369993 - DNA, 15 bp, Homo sapiens
agtgtatataggtcc

SEQ ID NO: 369994 - DNA, 15 bp, Homo sapiens
gtgtatataggtcca

SEQ ID NO: 369995 - DNA, 15 bp, Homo sapiens
tgtatataggtccag

SEQ ID NO: 369996 - DNA, 15 bp, Homo sapiens
gtatataggtccagg

SEQ ID NO: 369997 - DNA, 15 bp, Homo sapiens
tatataggtccagga

SEQ ID NO: 369998 - DNA, 15 bp, Homo sapiens
atataggtccaggaa

SEQ ID NO: 369999 - DNA, 15 bp, Homo sapiens
tataggtccaggaag

SEQ ID NO: 370000 - DNA, 15 bp, Homo sapiens
ataggtccaggaagt

SEQ ID NO: 370001 - DNA, 15 bp, Homo sapiens
taggtccaggaagta

SEQ ID NO: 370002 - DNA, 15 bp, Homo sapiens
aggtccaggaagtag

SEQ ID NO: 370003 - DNA, 15 bp, Homo sapiens
ggtccaggaagtagc

SEQ ID NO: 370004 - DNA, 15 bp, Homo sapiens
gtccaggaagtagcc

SEQ ID NO: 370005 - DNA, 15 bp, Homo sapiens
tccaggaagtagccc

SEQ ID NO: 370006 - DNA, 15 bp, Homo sapiens
ccaggaagtagccca

SEQ ID NO: 370007 - DNA, 15 bp, Homo sapiens
caggaagtagcccac

SEQ ID NO: 370008 - DNA, 15 bp, Homo sapiens
aggaagtagcccact

SEQ ID NO: 370009 - DNA, 15 bp, Homo sapiens
ggaagtagcccactg

SEQ ID NO: 370010 - DNA, 15 bp, Homo sapiens
gaagtagcccactgt

SEQ ID NO: 370011 - DNA, 15 bp, Homo sapiens
aagtagcccactgta

SEQ ID NO: 370012 - DNA, 15 bp, Homo sapiens
agtagcccactgtag

SEQ ID NO: 370013 - DNA, 15 bp, Homo sapiens
gtagcccactgtaga

SEQ ID NO: 370014 - DNA, 15 bp, Homo sapiens
tagcccactgtagaa

SEQ ID NO: 370015 - DNA, 15 bp, Homo sapiens
agcccactgtagaat

SEQ ID NO: 370016 - DNA, 15 bp, Homo sapiens
gcccactgtagaatg

SEQ ID NO: 370017 - DNA, 15 bp, Homo sapiens
cccactgtagaatgg

SEQ ID NO: 370018 - DNA, 15 bp, Homo sapiens
ccactgtagaatgga

SEQ ID NO: 370019 - DNA, 15 bp, Homo sapiens
cactgtagaatggaa

SEQ ID NO: 370020 - DNA, 15 bp, Homo sapiens
actgtagaatggaag

SEQ ID NO: 370021 - DNA, 15 bp, Homo sapiens
ctgtagaatggaagg

SEQ ID NO: 370022 - DNA, 15 bp, Homo sapiens
tgtagaatggaaggc

SEQ ID NO: 370023 - DNA, 15 bp, Homo sapiens
gtagaatggaaggct

SEQ ID NO: 370024 - DNA, 15 bp, Homo sapiens
tagaatggaaggctg

SEQ ID NO: 370025 - DNA, 15 bp, Homo sapiens
agaatggaaggctga

SEQ ID NO: 370026 - DNA, 15 bp, Homo sapiens
gaatggaaggctgag

SEQ ID NO: 370027 - DNA, 15 bp, Homo sapiens
aatggaaggctgagg

SEQ ID NO: 370028 - DNA, 15 bp, Homo sapiens
atggaaggctgaggg

SEQ ID NO: 370029 - DNA, 15 bp, Homo sapiens
tggaaggctgaggga

SEQ ID NO: 370030 - DNA, 15 bp, Homo sapiens
ggaaggctgagggat

SEQ ID NO: 370031 - DNA, 15 bp, Homo sapiens
gaaggctgagggatg

SEQ ID NO: 370032 - DNA, 15 bp, Homo sapiens
aaggctgagggatgt

SEQ ID NO: 370033 - DNA, 15 bp, Homo sapiens
aggctgagggatgtt

SEQ ID NO: 370034 - DNA, 15 bp, Homo sapiens
ggctgagggatgttc

SEQ ID NO: 370035 - DNA, 15 bp, Homo sapiens
gctgagggatgttct

SEQ ID NO: 370036 - DNA, 15 bp, Homo sapiens
ctgagggatgttctc

SEQ ID NO: 370037 - DNA, 15 bp, Homo sapiens
tgagggatgttctca

SEQ ID NO: 370038 - DNA, 15 bp, Homo sapiens
gagggatgttctcag

SEQ ID NO: 370039 - DNA, 15 bp, Homo sapiens
agggatgttctcaga

SEQ ID NO: 370040 - DNA, 15 bp, Homo sapiens
gggatgttctcagag

SEQ ID NO: 370041 - DNA, 15 bp, Homo sapiens
ggatgttctcagaga

SEQ ID NO: 370042 - DNA, 15 bp, Homo sapiens
gatgttctcagagat

SEQ ID NO: 370043 - DNA, 15 bp, Homo sapiens
atgttctcagagatg

SEQ ID NO: 370044 - DNA, 15 bp, Homo sapiens
tgttctcagagatga

SEQ ID NO: 370045 - DNA, 15 bp, Homo sapiens
gttctcagagatgag

SEQ ID NO: 370046 - DNA, 15 bp, Homo sapiens
ttctcagagatgaga

SEQ ID NO: 370047 - DNA, 15 bp, Homo sapiens
tctcagagatgagat

SEQ ID NO: 370048 - DNA, 15 bp, Homo sapiens
ctcagagatgagatc

SEQ ID NO: 370049 - DNA, 15 bp, Homo sapiens
tcagagatgagatcc

SEQ ID NO: 370050 - DNA, 15 bp, Homo sapiens
cagagatgagatcct

SEQ ID NO: 370051 - DNA, 15 bp, Homo sapiens
agagatgagatcctg

SEQ ID NO: 370052 - DNA, 15 bp, Homo sapiens
gagatgagatcctgg

SEQ ID NO: 370053 - DNA, 15 bp, Homo sapiens
agatgagatcctgga

SEQ ID NO: 370054 - DNA, 15 bp, Homo sapiens
gatgagatcctggag

SEQ ID NO: 370055 - DNA, 15 bp, Homo sapiens
atgagatcctggagg

SEQ ID NO: 370056 - DNA, 15 bp, Homo sapiens
tgagatcctggagga

SEQ ID NO: 370057 - DNA, 15 bp, Homo sapiens
gagatcctggaggac

SEQ ID NO: 370058 - DNA, 15 bp, Homo sapiens
agatcctggaggact

SEQ ID NO: 370059 - DNA, 15 bp, Homo sapiens
gatcctggaggactc

SEQ ID NO: 370060 - DNA, 15 bp, Homo sapiens
atcctggaggactca

SEQ ID NO: 370061 - DNA, 15 bp, Homo sapiens
tcctggaggactcac

SEQ ID NO: 370062 - DNA, 15 bp, Homo sapiens
cctggaggactcact

SEQ ID NO: 370063 - DNA, 15 bp, Homo sapiens
ctggaggactcactg

SEQ ID NO: 370064 - DNA, 15 bp, Homo sapiens
tggaggactcactgt

SEQ ID NO: 370065 - DNA, 15 bp, Homo sapiens
ggaggactcactgtg

SEQ ID NO: 370066 - DNA, 15 bp, Homo sapiens
gaggactcactgtgc

SEQ ID NO: 370067 - DNA, 15 bp, Homo sapiens
aggactcactgtgca

SEQ ID NO: 370068 - DNA, 15 bp, Homo sapiens
ggactcactgtgcat

SEQ ID NO: 370069 - DNA, 15 bp, Homo sapiens
gactcactgtgcatc

SEQ ID NO: 370070 - DNA, 15 bp, Homo sapiens
actcactgtgcatca

SEQ ID NO: 370071 - DNA, 15 bp, Homo sapiens
ctcactgtgcatcac

SEQ ID NO: 370072 - DNA, 15 bp, Homo sapiens
tcactgtgcatcaca

SEQ ID NO: 370073 - DNA, 15 bp, Homo sapiens
cactgtgcatcacaa

SEQ ID NO: 370074 - DNA, 15 bp, Homo sapiens
actgtgcatcacaag

SEQ ID NO: 370075 - DNA, 15 bp, Homo sapiens
ctgtgcatcacaagg

SEQ ID NO: 370076 - DNA, 15 bp, Homo sapiens
tgtgcatcacaagga

SEQ ID NO: 370077 - DNA, 15 bp, Homo sapiens
gtgcatcacaaggaa

SEQ ID NO: 370078 - DNA, 15 bp, Homo sapiens
tgcatcacaaggaat

SEQ ID NO: 370079 - DNA, 15 bp, Homo sapiens
gcatcacaaggaatt

SEQ ID NO: 370080 - DNA, 15 bp, Homo sapiens
catcacaaggaattt

SEQ ID NO: 370081 - DNA, 15 bp, Homo sapiens
atcacaaggaatttg

SEQ ID NO: 370082 - DNA, 15 bp, Homo sapiens
tcacaaggaatttga

SEQ ID NO: 370083 - DNA, 15 bp, Homo sapiens
cacaaggaatttgag

SEQ ID NO: 370084 - DNA, 15 bp, Homo sapiens
acaaggaatttgagc

SEQ ID NO: 370085 - DNA, 15 bp, Homo sapiens
caaggaatttgagct

SEQ ID NO: 370086 - DNA, 15 bp, Homo sapiens
aaggaatttgagctc

SEQ ID NO: 370087 - DNA, 15 bp, Homo sapiens
aggaatttgagctcc

SEQ ID NO: 370088 - DNA, 15 bp, Homo sapiens
ggaatttgagctcca

SEQ ID NO: 370089 - DNA, 15 bp, Homo sapiens
gaatttgagctccat

SEQ ID NO: 370090 - DNA, 15 bp, Homo sapiens
aatttgagctccatg

SEQ ID NO: 370091 - DNA, 15 bp, Homo sapiens
atttgagctccatgt

SEQ ID NO: 370092 - DNA, 15 bp, Homo sapiens
tttgagctccatgtt

SEQ ID NO: 370093 - DNA, 15 bp, Homo sapiens
ttgagctccatgttg

SEQ ID NO: 370094 - DNA, 15 bp, Homo sapiens
tgagctccatgttgc

SEQ ID NO: 370095 - DNA, 15 bp, Homo sapiens
gagctccatgttgca

SEQ ID NO: 370096 - DNA, 15 bp, Homo sapiens
agctccatgttgcaa

SEQ ID NO: 370097 - DNA, 15 bp, Homo sapiens
gctccatgttgcaaa

SEQ ID NO: 370098 - DNA, 15 bp, Homo sapiens
ctccatgttgcaaac

SEQ ID NO: 370099 - DNA, 15 bp, Homo sapiens
tccatgttgcaaaca

SEQ ID NO: 370100 - DNA, 15 bp, Homo sapiens
ccatgttgcaaacaa

SEQ ID NO: 370101 - DNA, 15 bp, Homo sapiens
catgttgcaaacaat

SEQ ID NO: 370102 - DNA, 15 bp, Homo sapiens
atgttgcaaacaatc

SEQ ID NO: 370103 - DNA, 15 bp, Homo sapiens
tgttgcaaacaatct

SEQ ID NO: 370104 - DNA, 15 bp, Homo sapiens
gttgcaaacaatcta

SEQ ID NO: 370105 - DNA, 15 bp, Homo sapiens
ttgcaaacaatctac

SEQ ID NO: 370106 - DNA, 15 bp, Homo sapiens
tgcaaacaatctacc

SEQ ID NO: 370107 - DNA, 15 bp, Homo sapiens
gcaaacaatctacca

SEQ ID NO: 370108 - DNA, 15 bp, Homo sapiens
caaacaatctaccac

SEQ ID NO: 370109 - DNA, 15 bp, Homo sapiens
aaacaatctaccact

SEQ ID NO: 370110 - DNA, 15 bp, Homo sapiens
aacaatctaccactt

SEQ ID NO: 370111 - DNA, 15 bp, Homo sapiens
acaatctaccacttt

SEQ ID NO: 370112 - DNA, 15 bp, Homo sapiens
caatctaccactttg

SEQ ID NO: 370113 - DNA, 15 bp, Homo sapiens
aatctaccactttga

SEQ ID NO: 370114 - DNA, 15 bp, Homo sapiens
atctaccactttgag

SEQ ID NO: 370115 - DNA, 15 bp, Homo sapiens
tctaccactttgagg

SEQ ID NO: 370116 - DNA, 15 bp, Homo sapiens
ctaccactttgaggg

SEQ ID NO: 370117 - DNA, 15 bp, Homo sapiens
taccactttgagggt

SEQ ID NO: 370118 - DNA, 15 bp, Homo sapiens
accactttgagggta

SEQ ID NO: 370119 - DNA, 15 bp, Homo sapiens
ccactttgagggtag

SEQ ID NO: 370120 - DNA, 15 bp, Homo sapiens
cactttgagggtagt

SEQ ID NO: 370121 - DNA, 15 bp, Homo sapiens
actttgagggtagtg

SEQ ID NO: 370122 - DNA, 15 bp, Homo sapiens
ctttgagggtagtgg

SEQ ID NO: 370123 - DNA, 15 bp, Homo sapiens
tttgagggtagtggg

SEQ ID NO: 370124 - DNA, 15 bp, Homo sapiens
ttgagggtagtgggc

SEQ ID NO: 370125 - DNA, 15 bp, Homo sapiens
tgagggtagtgggca

SEQ ID NO: 370126 - DNA, 15 bp, Homo sapiens
gagggtagtgggcag

SEQ ID NO: 370127 - DNA, 15 bp, Homo sapiens
agggtagtgggcagc

SEQ ID NO: 370128 - DNA, 15 bp, Homo sapiens
gggtagtgggcagct

SEQ ID NO: 370129 - DNA, 15 bp, Homo sapiens
ggtagtgggcagcta

SEQ ID NO: 370130 - DNA, 15 bp, Homo sapiens
gtagtgggcagctat

SEQ ID NO: 370131 - DNA, 15 bp, Homo sapiens
tagtgggcagctatt

SEQ ID NO: 370132 - DNA, 15 bp, Homo sapiens
agtgggcagctattg

SEQ ID NO: 370133 - DNA, 15 bp, Homo sapiens
gtgggcagctattga

SEQ ID NO: 370134 - DNA, 15 bp, Homo sapiens
tgggcagctattgat

SEQ ID NO: 370135 - DNA, 15 bp, Homo sapiens
gggcagctattgatg

SEQ ID NO: 370136 - DNA, 15 bp, Homo sapiens
ggcagctattgatgg

SEQ ID NO: 370137 - DNA, 15 bp, Homo sapiens
gcagctattgatggg

SEQ ID NO: 370138 - DNA, 15 bp, Homo sapiens
cagctattgatgggt

SEQ ID NO: 370139 - DNA, 15 bp, Homo sapiens
agctattgatgggtt

SEQ ID NO: 370140 - DNA, 15 bp, Homo sapiens
gctattgatgggttt

SEQ ID NO: 370141 - DNA, 15 bp, Homo sapiens
ctattgatgggtttt

SEQ ID NO: 370142 - DNA, 15 bp, Homo sapiens
tattgatgggtttta

SEQ ID NO: 370143 - DNA, 15 bp, Homo sapiens
attgatgggttttaa

SEQ ID NO: 370144 - DNA, 15 bp, Homo sapiens
ttgatgggttttaag

SEQ ID NO: 370145 - DNA, 15 bp, Homo sapiens
tgatgggttttaagc

SEQ ID NO: 370146 - DNA, 15 bp, Homo sapiens
gatgggttttaagca

SEQ ID NO: 370147 - DNA, 15 bp, Homo sapiens
atgggttttaagcag

SEQ ID NO: 370148 - DNA, 15 bp, Homo sapiens
tgggttttaagcaga

SEQ ID NO: 370149 - DNA, 15 bp, Homo sapiens
gggttttaagcagag

SEQ ID NO: 370150 - DNA, 15 bp, Homo sapiens
ggttttaagcagagg

SEQ ID NO: 370151 - DNA, 15 bp, Homo sapiens
gttttaagcagagga

SEQ ID NO: 370152 - DNA, 15 bp, Homo sapiens
ttttaagcagaggaa

SEQ ID NO: 370153 - DNA, 15 bp, Homo sapiens
tttaagcagaggaaa

SEQ ID NO: 370154 - DNA, 15 bp, Homo sapiens
ttaagcagaggaaag

SEQ ID NO: 370155 - DNA, 15 bp, Homo sapiens
taagcagaggaaagt

SEQ ID NO: 370156 - DNA, 15 bp, Homo sapiens
aagcagaggaaagtc

SEQ ID NO: 370157 - DNA, 15 bp, Homo sapiens
agcagaggaaagtca

SEQ ID NO: 370158 - DNA, 15 bp, Homo sapiens
gcagaggaaagtcat

SEQ ID NO: 370159 - DNA, 15 bp, Homo sapiens
cagaggaaagtcatg

SEQ ID NO: 370160 - DNA, 15 bp, Homo sapiens
agaggaaagtcatgt

SEQ ID NO: 370161 - DNA, 15 bp, Homo sapiens
gaggaaagtcatgtt

SEQ ID NO: 370162 - DNA, 15 bp, Homo sapiens
aggaaagtcatgttt

SEQ ID NO: 370163 - DNA, 15 bp, Homo sapiens
ggaaagtcatgtttt

SEQ ID NO: 370164 - DNA, 15 bp, Homo sapiens
gaaagtcatgttttt

SEQ ID NO: 370165 - DNA, 15 bp, Homo sapiens
aaagtcatgtttttg

SEQ ID NO: 370166 - DNA, 15 bp, Homo sapiens
aagtcatgtttttga

SEQ ID NO: 370167 - DNA, 15 bp, Homo sapiens
agtcatgtttttgaa

SEQ ID NO: 370168 - DNA, 15 bp, Homo sapiens
gtcatgtttttgaaa

SEQ ID NO: 370169 - DNA, 15 bp, Homo sapiens
tcatgtttttgaaat

SEQ ID NO: 370170 - DNA, 15 bp, Homo sapiens
catgtttttgaaata

SEQ ID NO: 370171 - DNA, 15 bp, Homo sapiens
atgtttttgaaatat

SEQ ID NO: 370172 - DNA, 15 bp, Homo sapiens
tgtttttgaaatatt

SEQ ID NO: 370173 - DNA, 15 bp, Homo sapiens
gtttttgaaatattg

SEQ ID NO: 370174 - DNA, 15 bp, Homo sapiens
tttttgaaatattgc

SEQ ID NO: 370175 - DNA, 15 bp, Homo sapiens
ttttgaaatattgct

SEQ ID NO: 370176 - DNA, 15 bp, Homo sapiens
tttgaaatattgcta

SEQ ID NO: 370177 - DNA, 15 bp, Homo sapiens
ttgaaatattgctat

SEQ ID NO: 370178 - DNA, 15 bp, Homo sapiens
tgaaatattgctata

SEQ ID NO: 370179 - DNA, 15 bp, Homo sapiens
gaaatattgctatag

SEQ ID NO: 370180 - DNA, 15 bp, Homo sapiens
aaatattgctatagc

SEQ ID NO: 370181 - DNA, 15 bp, Homo sapiens
aatattgctatagct

SEQ ID NO: 370182 - DNA, 15 bp, Homo sapiens
atattgctatagctt

SEQ ID NO: 370183 - DNA, 15 bp, Homo sapiens
tattgctatagcttc

SEQ ID NO: 370184 - DNA, 15 bp, Homo sapiens
attgctatagcttca

SEQ ID NO: 370185 - DNA, 15 bp, Homo sapiens
ttgctatagcttcac

SEQ ID NO: 370186 - DNA, 15 bp, Homo sapiens
tgctatagcttcact

SEQ ID NO: 370187 - DNA, 15 bp, Homo sapiens
gctatagcttcacta

SEQ ID NO: 370188 - DNA, 15 bp, Homo sapiens
ctatagcttcactac

SEQ ID NO: 370189 - DNA, 15 bp, Homo sapiens
tatagcttcactacg

SEQ ID NO: 370190 - DNA, 15 bp, Homo sapiens
atagcttcactacgg

SEQ ID NO: 370191 - DNA, 15 bp, Homo sapiens
tagcttcactacgga

SEQ ID NO: 370192 - DNA, 15 bp, Homo sapiens
agcttcactacggag

SEQ ID NO: 370193 - DNA, 15 bp, Homo sapiens
gcttcactacggaga

SEQ ID NO: 370194 - DNA, 15 bp, Homo sapiens
cttcactacggagat

SEQ ID NO: 370195 - DNA, 15 bp, Homo sapiens
ttcactacggagata

SEQ ID NO: 370196 - DNA, 15 bp, Homo sapiens
tcactacggagatag

SEQ ID NO: 370197 - DNA, 15 bp, Homo sapiens
cactacggagataga

SEQ ID NO: 370198 - DNA, 15 bp, Homo sapiens
actacggagatagat

SEQ ID NO: 370199 - DNA, 15 bp, Homo sapiens
ctacggagatagatg

SEQ ID NO: 370200 - DNA, 15 bp, Homo sapiens
tacggagatagatga

SEQ ID NO: 370201 - DNA, 15 bp, Homo sapiens
acggagatagatgaa

SEQ ID NO: 370202 - DNA, 15 bp, Homo sapiens
cggagatagatgaag

SEQ ID NO: 370203 - DNA, 15 bp, Homo sapiens
ggagatagatgaagt

SEQ ID NO: 370204 - DNA, 15 bp, Homo sapiens
gagatagatgaagtg

SEQ ID NO: 370205 - DNA, 15 bp, Homo sapiens
agatagatgaagtga

SEQ ID NO: 370206 - DNA, 15 bp, Homo sapiens
gatagatgaagtgat

SEQ ID NO: 370207 - DNA, 15 bp, Homo sapiens
atagatgaagtgatc

SEQ ID NO: 370208 - DNA, 15 bp, Homo sapiens
tagatgaagtgatcc

SEQ ID NO: 370209 - DNA, 15 bp, Homo sapiens
agatgaagtgatcct

SEQ ID NO: 370210 - DNA, 15 bp, Homo sapiens
gatgaagtgatccta

SEQ ID NO: 370211 - DNA, 15 bp, Homo sapiens
atgaagtgatcctaa

SEQ ID NO: 370212 - DNA, 15 bp, Homo sapiens
tgaagtgatcctaag

SEQ ID NO: 370213 - DNA, 15 bp, Homo sapiens
gaagtgatcctaaga

SEQ ID NO: 370214 - DNA, 15 bp, Homo sapiens
aagtgatcctaagaa

SEQ ID NO: 370215 - DNA, 15 bp, Homo sapiens
agtgatcctaagaat

SEQ ID NO: 370216 - DNA, 15 bp, Homo sapiens
gtgatcctaagaatt

SEQ ID NO: 370217 - DNA, 15 bp, Homo sapiens
tgatcctaagaattg

SEQ ID NO: 370218 - DNA, 15 bp, Homo sapiens
gatcctaagaattga

SEQ ID NO: 370219 - DNA, 15 bp, Homo sapiens
atcctaagaattgat

SEQ ID NO: 370220 - DNA, 15 bp, Homo sapiens
tcctaagaattgata

SEQ ID NO: 370221 - DNA, 15 bp, Homo sapiens
cctaagaattgatat

SEQ ID NO: 370222 - DNA, 15 bp, Homo sapiens
ctaagaattgatata

SEQ ID NO: 370223 - DNA, 15 bp, Homo sapiens
taagaattgatatag

SEQ ID NO: 370224 - DNA, 15 bp, Homo sapiens
aagaattgatataga

SEQ ID NO: 370225 - DNA, 15 bp, Homo sapiens
agaattgatatagaa

SEQ ID NO: 370226 - DNA, 15 bp, Homo sapiens
gaattgatatagaaa

SEQ ID NO: 370227 - DNA, 15 bp, Homo sapiens
aattgatatagaaag

SEQ ID NO: 370228 - DNA, 15 bp, Homo sapiens
attgatatagaaaga

SEQ ID NO: 370229 - DNA, 15 bp, Homo sapiens
ttgatatagaaagat

SEQ ID NO: 370230 - DNA, 15 bp, Homo sapiens
tgatatagaaagatg

SEQ ID NO: 370231 - DNA, 15 bp, Homo sapiens
gatatagaaagatga

SEQ ID NO: 370232 - DNA, 15 bp, Homo sapiens
atatagaaagatgag

SEQ ID NO: 370233 - DNA, 15 bp, Homo sapiens
tatagaaagatgagt

SEQ ID NO: 370234 - DNA, 15 bp, Homo sapiens
atagaaagatgagtt

SEQ ID NO: 370235 - DNA, 15 bp, Homo sapiens
tagaaagatgagtta

SEQ ID NO: 370236 - DNA, 15 bp, Homo sapiens
agaaagatgagttag

SEQ ID NO: 370237 - DNA, 15 bp, Homo sapiens
gaaagatgagttaga

SEQ ID NO: 370238 - DNA, 15 bp, Homo sapiens
aaagatgagttagaa

SEQ ID NO: 370239 - DNA, 15 bp, Homo sapiens
aagatgagttagaat

SEQ ID NO: 370240 - DNA, 15 bp, Homo sapiens
agatgagttagaatc

SEQ ID NO: 370241 - DNA, 15 bp, Homo sapiens
gatgagttagaatct

SEQ ID NO: 370242 - DNA, 15 bp, Homo sapiens
atgagttagaatctt

SEQ ID NO: 370243 - DNA, 15 bp, Homo sapiens
tgagttagaatcttc

SEQ ID NO: 370244 - DNA, 15 bp, Homo sapiens
gagttagaatcttca

SEQ ID NO: 370245 - DNA, 15 bp, Homo sapiens
agttagaatcttcag

SEQ ID NO: 370246 - DNA, 15 bp, Homo sapiens
gttagaatcttcaga

SEQ ID NO: 370247 - DNA, 15 bp, Homo sapiens
ttagaatcttcagaa

SEQ ID NO: 370248 - DNA, 15 bp, Homo sapiens
tagaatcttcagaag

SEQ ID NO: 370249 - DNA, 15 bp, Homo sapiens
agaatcttcagaaga

SEQ ID NO: 370250 - DNA, 15 bp, Homo sapiens
gaatcttcagaagag

SEQ ID NO: 370251 - DNA, 15 bp, Homo sapiens
aatcttcagaagagt

SEQ ID NO: 370252 - DNA, 15 bp, Homo sapiens
atcttcagaagagtt

SEQ ID NO: 370253 - DNA, 15 bp, Homo sapiens
tcttcagaagagttt

SEQ ID NO: 370254 - DNA, 15 bp, Homo sapiens
cttcagaagagttta

SEQ ID NO: 370255 - DNA, 15 bp, Homo sapiens
ttcagaagagtttat

SEQ ID NO: 370256 - DNA, 15 bp, Homo sapiens
tcagaagagtttatg

SEQ ID NO: 370257 - DNA, 15 bp, Homo sapiens
cagaagagtttatga

SEQ ID NO: 370258 - DNA, 15 bp, Homo sapiens
agaagagtttatgaa

SEQ ID NO: 370259 - DNA, 15 bp, Homo sapiens
gaagagtttatgaaa

SEQ ID NO: 370260 - DNA, 15 bp, Homo sapiens
aagagtttatgaaac

SEQ ID NO: 370261 - DNA, 15 bp, Homo sapiens
agagtttatgaaacg

SEQ ID NO: 370262 - DNA, 15 bp, Homo sapiens
gagtttatgaaacgg

SEQ ID NO: 370263 - DNA, 15 bp, Homo sapiens
agtttatgaaacggg

SEQ ID NO: 370264 - DNA, 15 bp, Homo sapiens
gtttatgaaacgggt

SEQ ID NO: 370265 - DNA, 15 bp, Homo sapiens
tttatgaaacgggtg

SEQ ID NO: 370266 - DNA, 15 bp, Homo sapiens
ttatgaaacgggtgt

SEQ ID NO: 370267 - DNA, 15 bp, Homo sapiens
tatgaaacgggtgtc

SEQ ID NO: 370268 - DNA, 15 bp, Homo sapiens
atgaaacgggtgtca

SEQ ID NO: 370269 - DNA, 15 bp, Homo sapiens
tgaaacgggtgtcag

SEQ ID NO: 370270 - DNA, 15 bp, Homo sapiens
gaaacgggtgtcagg

SEQ ID NO: 370271 - DNA, 15 bp, Homo sapiens
aaacgggtgtcaggg

SEQ ID NO: 370272 - DNA, 15 bp, Homo sapiens
aacgggtgtcaggga

SEQ ID NO: 370273 - DNA, 15 bp, Homo sapiens
acgggtgtcagggaa

SEQ ID NO: 370274 - DNA, 15 bp, Homo sapiens
cgggtgtcagggaag

SEQ ID NO: 370275 - DNA, 15 bp, Homo sapiens
gggtgtcagggaaga

SEQ ID NO: 370276 - DNA, 15 bp, Homo sapiens
ggtgtcagggaagat

SEQ ID NO: 370277 - DNA, 15 bp, Homo sapiens
gtgtcagggaagata

SEQ ID NO: 370278 - DNA, 15 bp, Homo sapiens
tgtcagggaagatag

SEQ ID NO: 370279 - DNA, 15 bp, Homo sapiens
gtcagggaagatagg

SEQ ID NO: 370280 - DNA, 15 bp, Homo sapiens
tcagggaagataggg

SEQ ID NO: 370281 - DNA, 15 bp, Homo sapiens
cagggaagataggga

SEQ ID NO: 370282 - DNA, 15 bp, Homo sapiens
agggaagatagggat

SEQ ID NO: 370283 - DNA, 15 bp, Homo sapiens
gggaagatagggata

SEQ ID NO: 370284 - DNA, 15 bp, Homo sapiens
ggaagatagggataa

SEQ ID NO: 370285 - DNA, 15 bp, Homo sapiens
gaagatagggataag

SEQ ID NO: 370286 - DNA, 15 bp, Homo sapiens
aagatagggataagg

SEQ ID NO: 370287 - DNA, 15 bp, Homo sapiens
agatagggataagga

SEQ ID NO: 370288 - DNA, 15 bp, Homo sapiens
gatagggataaggaa

SEQ ID NO: 370289 - DNA, 15 bp, Homo sapiens
atagggataaggaat

SEQ ID NO: 370290 - DNA, 15 bp, Homo sapiens
tagggataaggaatt

SEQ ID NO: 370291 - DNA, 15 bp, Homo sapiens
agggataaggaattc

SEQ ID NO: 370292 - DNA, 15 bp, Homo sapiens
gggataaggaattca

SEQ ID NO: 370293 - DNA, 15 bp, Homo sapiens
ggataaggaattcag

SEQ ID NO: 370294 - DNA, 15 bp, Homo sapiens
gataaggaattcaga

SEQ ID NO: 370295 - DNA, 15 bp, Homo sapiens
ataaggaattcagat

SEQ ID NO: 370296 - DNA, 15 bp, Homo sapiens
taaggaattcagatg

SEQ ID NO: 370297 - DNA, 15 bp, Homo sapiens
aaggaattcagatgt

SEQ ID NO: 370298 - DNA, 15 bp, Homo sapiens
aggaattcagatgtg

SEQ ID NO: 370299 - DNA, 15 bp, Homo sapiens
ggaattcagatgtgg

SEQ ID NO: 370300 - DNA, 15 bp, Homo sapiens
gaattcagatgtgga

SEQ ID NO: 370301 - DNA, 15 bp, Homo sapiens
aattcagatgtggac

SEQ ID NO: 370302 - DNA, 15 bp, Homo sapiens
attcagatgtggaca

SEQ ID NO: 370303 - DNA, 15 bp, Homo sapiens
ttcagatgtggacat

SEQ ID NO: 370304 - DNA, 15 bp, Homo sapiens
tcagatgtggacata

SEQ ID NO: 370305 - DNA, 15 bp, Homo sapiens
cagatgtggacatat

SEQ ID NO: 370306 - DNA, 15 bp, Homo sapiens
agatgtggacatatc

SEQ ID NO: 370307 - DNA, 15 bp, Homo sapiens
gatgtggacatatct

SEQ ID NO: 370308 - DNA, 15 bp, Homo sapiens
atgtggacatatctg

SEQ ID NO: 370309 - DNA, 15 bp, Homo sapiens
tgtggacatatctga

SEQ ID NO: 370310 - DNA, 15 bp, Homo sapiens
gtggacatatctgaa

SEQ ID NO: 370311 - DNA, 15 bp, Homo sapiens
tggacatatctgaat

SEQ ID NO: 370312 - DNA, 15 bp, Homo sapiens
ggacatatctgaata

SEQ ID NO: 370313 - DNA, 15 bp, Homo sapiens
gacatatctgaatat

SEQ ID NO: 370314 - DNA, 15 bp, Homo sapiens
acatatctgaatatc

SEQ ID NO: 370315 - DNA, 15 bp, Homo sapiens
catatctgaatatct

SEQ ID NO: 370316 - DNA, 15 bp, Homo sapiens
atatctgaatatcta

SEQ ID NO: 370317 - DNA, 15 bp, Homo sapiens
tatctgaatatctag

SEQ ID NO: 370318 - DNA, 15 bp, Homo sapiens
atctgaatatctagt

SEQ ID NO: 370319 - DNA, 15 bp, Homo sapiens
tctgaatatctagtt

SEQ ID NO: 370320 - DNA, 15 bp, Homo sapiens
ctgaatatctagttc

SEQ ID NO: 370321 - DNA, 15 bp, Homo sapiens
tgaatatctagttca

SEQ ID NO: 370322 - DNA, 15 bp, Homo sapiens
gaatatctagttcac

SEQ ID NO: 370323 - DNA, 15 bp, Homo sapiens
aatatctagttcaca

SEQ ID NO: 370324 - DNA, 15 bp, Homo sapiens
atatctagttcacag

SEQ ID NO: 370325 - DNA, 15 bp, Homo sapiens
tatctagttcacaga

SEQ ID NO: 370326 - DNA, 15 bp, Homo sapiens
atctagttcacagag

SEQ ID NO: 370327 - DNA, 15 bp, Homo sapiens
tctagttcacagaga

SEQ ID NO: 370328 - DNA, 15 bp, Homo sapiens
ctagttcacagagag

SEQ ID NO: 370329 - DNA, 15 bp, Homo sapiens
tagttcacagagagg

SEQ ID NO: 370330 - DNA, 15 bp, Homo sapiens
agttcacagagaggg

SEQ ID NO: 370331 - DNA, 15 bp, Homo sapiens
gttcacagagagggc

SEQ ID NO: 370332 - DNA, 15 bp, Homo sapiens
ttcacagagagggct

SEQ ID NO: 370333 - DNA, 15 bp, Homo sapiens
tcacagagagggctg

SEQ ID NO: 370334 - DNA, 15 bp, Homo sapiens
cacagagagggctgg

SEQ ID NO: 370335 - DNA, 15 bp, Homo sapiens
acagagagggctgga

SEQ ID NO: 370336 - DNA, 15 bp, Homo sapiens
cagagagggctggac

SEQ ID NO: 370337 - DNA, 15 bp, Homo sapiens
agagagggctggact

SEQ ID NO: 370338 - DNA, 15 bp, Homo sapiens
gagagggctggactg

SEQ ID NO: 370339 - DNA, 15 bp, Homo sapiens
agagggctggactga

SEQ ID NO: 370340 - DNA, 15 bp, Homo sapiens
gagggctggactgaa

SEQ ID NO: 370341 - DNA, 15 bp, Homo sapiens
agggctggactgaag

SEQ ID NO: 370342 - DNA, 15 bp, Homo sapiens
gggctggactgaaga

SEQ ID NO: 370343 - DNA, 15 bp, Homo sapiens
ggctggactgaagat

SEQ ID NO: 370344 - DNA, 15 bp, Homo sapiens
gctggactgaagata

SEQ ID NO: 370345 - DNA, 15 bp, Homo sapiens
ctggactgaagatat

SEQ ID NO: 370346 - DNA, 15 bp, Homo sapiens
tggactgaagatatg

SEQ ID NO: 370347 - DNA, 15 bp, Homo sapiens
ggactgaagatatgt

SEQ ID NO: 370348 - DNA, 15 bp, Homo sapiens
gactgaagatatgtt

SEQ ID NO: 370349 - DNA, 15 bp, Homo sapiens
actgaagatatgttt

SEQ ID NO: 370350 - DNA, 15 bp, Homo sapiens
ctgaagatatgtttt

SEQ ID NO: 370351 - DNA, 15 bp, Homo sapiens
tgaagatatgttttg

SEQ ID NO: 370352 - DNA, 15 bp, Homo sapiens
gaagatatgttttgg

SEQ ID NO: 370353 - DNA, 15 bp, Homo sapiens
aagatatgttttggg

SEQ ID NO: 370354 - DNA, 15 bp, Homo sapiens
agatatgttttgggc

SEQ ID NO: 370355 - DNA, 15 bp, Homo sapiens
gatatgttttgggca

SEQ ID NO: 370356 - DNA, 15 bp, Homo sapiens
atatgttttgggcag

SEQ ID NO: 370357 - DNA, 15 bp, Homo sapiens
tatgttttgggcagt

SEQ ID NO: 370358 - DNA, 15 bp, Homo sapiens
atgttttgggcagtc

SEQ ID NO: 370359 - DNA, 15 bp, Homo sapiens
tgttttgggcagtct

SEQ ID NO: 370360 - DNA, 15 bp, Homo sapiens
gttttgggcagtctt

SEQ ID NO: 370361 - DNA, 15 bp, Homo sapiens
ttttgggcagtcttt

SEQ ID NO: 370362 - DNA, 15 bp, Homo sapiens
tttgggcagtcttta

SEQ ID NO: 370363 - DNA, 15 bp, Homo sapiens
ttgggcagtctttag

SEQ ID NO: 370364 - DNA, 15 bp, Homo sapiens
tgggcagtctttagc

SEQ ID NO: 370365 - DNA, 15 bp, Homo sapiens
gggcagtctttagcc

SEQ ID NO: 370366 - DNA, 15 bp, Homo sapiens
ggcagtctttagcct

SEQ ID NO: 370367 - DNA, 15 bp, Homo sapiens
gcagtctttagcctc

SEQ ID NO: 370368 - DNA, 15 bp, Homo sapiens
cagtctttagcctct

SEQ ID NO: 370369 - DNA, 15 bp, Homo sapiens
agtctttagcctctc

SEQ ID NO: 370370 - DNA, 15 bp, Homo sapiens
gtctttagcctctca

SEQ ID NO: 370371 - DNA, 15 bp, Homo sapiens
tctttagcctctcaa

SEQ ID NO: 370372 - DNA, 15 bp, Homo sapiens
ctttagcctctcaaa

SEQ ID NO: 370373 - DNA, 15 bp, Homo sapiens
tttagcctctcaaaa

SEQ ID NO: 370374 - DNA, 15 bp, Homo sapiens
ttagcctctcaaaac

SEQ ID NO: 370375 - DNA, 15 bp, Homo sapiens
tagcctctcaaaact

SEQ ID NO: 370376 - DNA, 15 bp, Homo sapiens
agcctctcaaaactc

SEQ ID NO: 370377 - DNA, 15 bp, Homo sapiens
gcctctcaaaactcc

SEQ ID NO: 370378 - DNA, 15 bp, Homo sapiens
cctctcaaaactcca

SEQ ID NO: 370379 - DNA, 15 bp, Homo sapiens
ctctcaaaactccat

SEQ ID NO: 370380 - DNA, 15 bp, Homo sapiens
tctcaaaactccatt

SEQ ID NO: 370381 - DNA, 15 bp, Homo sapiens
ctcaaaactccattt

SEQ ID NO: 370382 - DNA, 15 bp, Homo sapiens
tcaaaactccatttg

SEQ ID NO: 370383 - DNA, 15 bp, Homo sapiens
caaaactccatttga

SEQ ID NO: 370384 - DNA, 15 bp, Homo sapiens
aaaactccatttgat

SEQ ID NO: 370385 - DNA, 15 bp, Homo sapiens
aaactccatttgatt

SEQ ID NO: 370386 - DNA, 15 bp, Homo sapiens
aactccatttgattc

SEQ ID NO: 370387 - DNA, 15 bp, Homo sapiens
actccatttgattcc

SEQ ID NO: 370388 - DNA, 15 bp, Homo sapiens
ctccatttgattcct

SEQ ID NO: 370389 - DNA, 15 bp, Homo sapiens
tccatttgattcctg

SEQ ID NO: 370390 - DNA, 15 bp, Homo sapiens
ccatttgattcctga

SEQ ID NO: 370391 - DNA, 15 bp, Homo sapiens
catttgattcctgaa

SEQ ID NO: 370392 - DNA, 15 bp, Homo sapiens
atttgattcctgaaa

SEQ ID NO: 370393 - DNA, 15 bp, Homo sapiens
tttgattcctgaaat

SEQ ID NO: 370394 - DNA, 15 bp, Homo sapiens
ttgattcctgaaatc

SEQ ID NO: 370395 - DNA, 15 bp, Homo sapiens
tgattcctgaaatct

SEQ ID NO: 370396 - DNA, 15 bp, Homo sapiens
gattcctgaaatctt

SEQ ID NO: 370397 - DNA, 15 bp, Homo sapiens
attcctgaaatcttt

SEQ ID NO: 370398 - DNA, 15 bp, Homo sapiens
ttcctgaaatctttg

SEQ ID NO: 370399 - DNA, 15 bp, Homo sapiens
tcctgaaatctttgg

SEQ ID NO: 370400 - DNA, 15 bp, Homo sapiens
cctgaaatctttgga

SEQ ID NO: 370401 - DNA, 15 bp, Homo sapiens
ctgaaatctttggaa

SEQ ID NO: 370402 - DNA, 15 bp, Homo sapiens
tgaaatctttggaaa

SEQ ID NO: 370403 - DNA, 15 bp, Homo sapiens
gaaatctttggaaac

SEQ ID NO: 370404 - DNA, 15 bp, Homo sapiens
aaatctttggaaacc

SEQ ID NO: 370405 - DNA, 15 bp, Homo sapiens
aatctttggaaacca

SEQ ID NO: 370406 - DNA, 15 bp, Homo sapiens
atctttggaaaccag

SEQ ID NO: 370407 - DNA, 15 bp, Homo sapiens
tctttggaaaccagg

SEQ ID NO: 370408 - DNA, 15 bp, Homo sapiens
ctttggaaaccagga

SEQ ID NO: 370409 - DNA, 15 bp, Homo sapiens
tttggaaaccaggac

SEQ ID NO: 370410 - DNA, 15 bp, Homo sapiens
ttggaaaccaggact

SEQ ID NO: 370411 - DNA, 15 bp, Homo sapiens
tggaaaccaggactc

SEQ ID NO: 370412 - DNA, 15 bp, Homo sapiens
ggaaaccaggactca

SEQ ID NO: 370413 - DNA, 15 bp, Homo sapiens
gaaaccaggactcag

SEQ ID NO: 370414 - DNA, 15 bp, Homo sapiens
aaaccaggactcagg

SEQ ID NO: 370415 - DNA, 15 bp, Homo sapiens
aaccaggactcaggg

SEQ ID NO: 370416 - DNA, 15 bp, Homo sapiens
accaggactcaggga

SEQ ID NO: 370417 - DNA, 15 bp, Homo sapiens
ccaggactcagggag

SEQ ID NO: 370418 - DNA, 15 bp, Homo sapiens
caggactcagggaga

SEQ ID NO: 370419 - DNA, 15 bp, Homo sapiens
aggactcagggagag

SEQ ID NO: 370420 - DNA, 15 bp, Homo sapiens
ggactcagggagagc

SEQ ID NO: 370421 - DNA, 15 bp, Homo sapiens
gactcagggagagcc

SEQ ID NO: 370422 - DNA, 15 bp, Homo sapiens
actcagggagagccc

SEQ ID NO: 370423 - DNA, 15 bp, Homo sapiens
ctcagggagagccca

SEQ ID NO: 370424 - DNA, 15 bp, Homo sapiens
tcagggagagcccag

SEQ ID NO: 370425 - DNA, 15 bp, Homo sapiens
cagggagagcccagg

SEQ ID NO: 370426 - DNA, 15 bp, Homo sapiens
agggagagcccaggg

SEQ ID NO: 370427 - DNA, 15 bp, Homo sapiens
gggagagcccagggt

SEQ ID NO: 370428 - DNA, 15 bp, Homo sapiens
ggagagcccagggtg

SEQ ID NO: 370429 - DNA, 15 bp, Homo sapiens
gagagcccagggtga

SEQ ID NO: 370430 - DNA, 15 bp, Homo sapiens
agagcccagggtgaa

SEQ ID NO: 370431 - DNA, 15 bp, Homo sapiens
gagcccagggtgaag

SEQ ID NO: 370432 - DNA, 15 bp, Homo sapiens
agcccagggtgaagg

SEQ ID NO: 370433 - DNA, 15 bp, Homo sapiens
gcccagggtgaaggg

SEQ ID NO: 370434 - DNA, 15 bp, Homo sapiens
cccagggtgaagggc

SEQ ID NO: 370435 - DNA, 15 bp, Homo sapiens
ccagggtgaagggca

SEQ ID NO: 370436 - DNA, 15 bp, Homo sapiens
cagggtgaagggcaa

SEQ ID NO: 370437 - DNA, 15 bp, Homo sapiens
agggtgaagggcaag

SEQ ID NO: 370438 - DNA, 15 bp, Homo sapiens
gggtgaagggcaaga

SEQ ID NO: 370439 - DNA, 15 bp, Homo sapiens
ggtgaagggcaagaa

SEQ ID NO: 370440 - DNA, 15 bp, Homo sapiens
gtgaagggcaagaag

SEQ ID NO: 370441 - DNA, 15 bp, Homo sapiens
tgaagggcaagaaga

SEQ ID NO: 370442 - DNA, 15 bp, Homo sapiens
gaagggcaagaagag

SEQ ID NO: 370443 - DNA, 15 bp, Homo sapiens
aagggcaagaagagc

SEQ ID NO: 370444 - DNA, 15 bp, Homo sapiens
agggcaagaagagca

SEQ ID NO: 370445 - DNA, 15 bp, Homo sapiens
gggcaagaagagcaa

SEQ ID NO: 370446 - DNA, 15 bp, Homo sapiens
ggcaagaagagcaac

SEQ ID NO: 370447 - DNA, 15 bp, Homo sapiens
gcaagaagagcaaca

SEQ ID NO: 370448 - DNA, 15 bp, Homo sapiens
caagaagagcaacac

SEQ ID NO: 370449 - DNA, 15 bp, Homo sapiens
aagaagagcaacaca

SEQ ID NO: 370450 - DNA, 15 bp, Homo sapiens
agaagagcaacacag

SEQ ID NO: 370451 - DNA, 15 bp, Homo sapiens
gaagagcaacacagc

SEQ ID NO: 370452 - DNA, 15 bp, Homo sapiens
aagagcaacacagct

SEQ ID NO: 370453 - DNA, 15 bp, Homo sapiens
agagcaacacagctg

SEQ ID NO: 370454 - DNA, 15 bp, Homo sapiens
gagcaacacagctgc

SEQ ID NO: 370455 - DNA, 15 bp, Homo sapiens
agcaacacagctgcc

SEQ ID NO: 370456 - DNA, 15 bp, Homo sapiens
gcaacacagctgccc

SEQ ID NO: 370457 - DNA, 15 bp, Homo sapiens
caacacagctgccct

SEQ ID NO: 370458 - DNA, 15 bp, Homo sapiens
aacacagctgccctg

SEQ ID NO: 370459 - DNA, 15 bp, Homo sapiens
acacagctgccctga

SEQ ID NO: 370460 - DNA, 15 bp, Homo sapiens
cacagctgccctgaa

SEQ ID NO: 370461 - DNA, 15 bp, Homo sapiens
acagctgccctgaag

SEQ ID NO: 370462 - DNA, 15 bp, Homo sapiens
cagctgccctgaagg

SEQ ID NO: 370463 - DNA, 15 bp, Homo sapiens
agctgccctgaagga

SEQ ID NO: 370464 - DNA, 15 bp, Homo sapiens
gctgccctgaaggat

SEQ ID NO: 370465 - DNA, 15 bp, Homo sapiens
ctgccctgaaggata

SEQ ID NO: 370466 - DNA, 15 bp, Homo sapiens
tgccctgaaggatat

SEQ ID NO: 370467 - DNA, 15 bp, Homo sapiens
gccctgaaggatatt

SEQ ID NO: 370468 - DNA, 15 bp, Homo sapiens
ccctgaaggatattg

SEQ ID NO: 370469 - DNA, 15 bp, Homo sapiens
cctgaaggatattgg

SEQ ID NO: 370470 - DNA, 15 bp, Homo sapiens
ctgaaggatattggt

SEQ ID NO: 370471 - DNA, 15 bp, Homo sapiens
tgaaggatattggta

SEQ ID NO: 370472 - DNA, 15 bp, Homo sapiens
gaaggatattggtat

SEQ ID NO: 370473 - DNA, 15 bp, Homo sapiens
aaggatattggtatt

SEQ ID NO: 370474 - DNA, 15 bp, Homo sapiens
aggatattggtattt

SEQ ID NO: 370475 - DNA, 15 bp, Homo sapiens
ggatattggtatttg

SEQ ID NO: 370476 - DNA, 15 bp, Homo sapiens
gatattggtatttga

SEQ ID NO: 370477 - DNA, 15 bp, Homo sapiens
atattggtatttgat

SEQ ID NO: 370478 - DNA, 15 bp, Homo sapiens
tattggtatttgatg

SEQ ID NO: 370479 - DNA, 15 bp, Homo sapiens
attggtatttgatgg

SEQ ID NO: 370480 - DNA, 15 bp, Homo sapiens
ttggtatttgatgga

SEQ ID NO: 370481 - DNA, 15 bp, Homo sapiens
tggtatttgatggat

SEQ ID NO: 370482 - DNA, 15 bp, Homo sapiens
ggtatttgatggatg

SEQ ID NO: 370483 - DNA, 15 bp, Homo sapiens
gtatttgatggatgg

SEQ ID NO: 370484 - DNA, 15 bp, Homo sapiens
tatttgatggatggg

SEQ ID NO: 370485 - DNA, 15 bp, Homo sapiens
atttgatggatgggc

SEQ ID NO: 370486 - DNA, 15 bp, Homo sapiens
tttgatggatgggca

SEQ ID NO: 370487 - DNA, 15 bp, Homo sapiens
ttgatggatgggcag

SEQ ID NO: 370488 - DNA, 15 bp, Homo sapiens
tgatggatgggcaga

SEQ ID NO: 370489 - DNA, 15 bp, Homo sapiens
gatggatgggcagag

SEQ ID NO: 370490 - DNA, 15 bp, Homo sapiens
atggatgggcagagg

SEQ ID NO: 370491 - DNA, 15 bp, Homo sapiens
tggatgggcagagga

SEQ ID NO: 370492 - DNA, 15 bp, Homo sapiens
ggatgggcagaggaa

SEQ ID NO: 370493 - DNA, 15 bp, Homo sapiens
gatgggcagaggaaa

SEQ ID NO: 370494 - DNA, 15 bp, Homo sapiens
atgggcagaggaaaa

SEQ ID NO: 370495 - DNA, 15 bp, Homo sapiens
tgggcagaggaaaag

SEQ ID NO: 370496 - DNA, 15 bp, Homo sapiens
gggcagaggaaaagg

SEQ ID NO: 370497 - DNA, 15 bp, Homo sapiens
ggcagaggaaaagga

SEQ ID NO: 370498 - DNA, 15 bp, Homo sapiens
gcagaggaaaaggag

SEQ ID NO: 370499 - DNA, 15 bp, Homo sapiens
cagaggaaaaggagt

SEQ ID NO: 370500 - DNA, 15 bp, Homo sapiens
agaggaaaaggagtt

SEQ ID NO: 370501 - DNA, 15 bp, Homo sapiens
gaggaaaaggagttg

SEQ ID NO: 370502 - DNA, 15 bp, Homo sapiens
aggaaaaggagttgg

SEQ ID NO: 370503 - DNA, 15 bp, Homo sapiens
ggaaaaggagttggt

SEQ ID NO: 370504 - DNA, 15 bp, Homo sapiens
gaaaaggagttggtg

SEQ ID NO: 370505 - DNA, 15 bp, Homo sapiens
aaaaggagttggtga

SEQ ID NO: 370506 - DNA, 15 bp, Homo sapiens
aaaggagttggtgaa

SEQ ID NO: 370507 - DNA, 15 bp, Homo sapiens
aaggagttggtgaag

SEQ ID NO: 370508 - DNA, 15 bp, Homo sapiens
aggagttggtgaagg

SEQ ID NO: 370509 - DNA, 15 bp, Homo sapiens
ggagttggtgaagga

SEQ ID NO: 370510 - DNA, 15 bp, Homo sapiens
gagttggtgaaggaa

SEQ ID NO: 370511 - DNA, 15 bp, Homo sapiens
agttggtgaaggaaa

SEQ ID NO: 370512 - DNA, 15 bp, Homo sapiens
gttggtgaaggaaat

SEQ ID NO: 370513 - DNA, 15 bp, Homo sapiens
ttggtgaaggaaatt

SEQ ID NO: 370514 - DNA, 15 bp, Homo sapiens
tggtgaaggaaattc

SEQ ID NO: 370515 - DNA, 15 bp, Homo sapiens
ggtgaaggaaattca

SEQ ID NO: 370516 - DNA, 15 bp, Homo sapiens
gtgaaggaaattcag

SEQ ID NO: 370517 - DNA, 15 bp, Homo sapiens
tgaaggaaattcagg

SEQ ID NO: 370518 - DNA, 15 bp, Homo sapiens
gaaggaaattcagga

SEQ ID NO: 370519 - DNA, 15 bp, Homo sapiens
aaggaaattcaggag

SEQ ID NO: 370520 - DNA, 15 bp, Homo sapiens
aggaaattcaggaga

SEQ ID NO: 370521 - DNA, 15 bp, Homo sapiens
ggaaattcaggagag

SEQ ID NO: 370522 - DNA, 15 bp, Homo sapiens
gaaattcaggagagc

SEQ ID NO: 370523 - DNA, 15 bp, Homo sapiens
aaattcaggagagcc

SEQ ID NO: 370524 - DNA, 15 bp, Homo sapiens
aattcaggagagcca

SEQ ID NO: 370525 - DNA, 15 bp, Homo sapiens
attcaggagagccag

SEQ ID NO: 370526 - DNA, 15 bp, Homo sapiens
ttcaggagagccagc

SEQ ID NO: 370527 - DNA, 15 bp, Homo sapiens
tcaggagagccagcc

SEQ ID NO: 370528 - DNA, 15 bp, Homo sapiens
caggagagccagcca

SEQ ID NO: 370529 - DNA, 15 bp, Homo sapiens
aggagagccagccag

SEQ ID NO: 370530 - DNA, 15 bp, Homo sapiens
gagagccagccagag

SEQ ID NO: 370531 - DNA, 15 bp, Homo sapiens
agagccagccagaga

SEQ ID NO: 370532 - DNA, 15 bp, Homo sapiens
gagccagccagagag

SEQ ID NO: 370533 - DNA, 15 bp, Homo sapiens
agccagccagagagg

SEQ ID NO: 370534 - DNA, 15 bp, Homo sapiens
gccagccagagaggt

SEQ ID NO: 370535 - DNA, 15 bp, Homo sapiens
ccagccagagaggta

SEQ ID NO: 370536 - DNA, 15 bp, Homo sapiens
cagccagagaggtag

SEQ ID NO: 370537 - DNA, 15 bp, Homo sapiens
agccagagaggtagg

SEQ ID NO: 370538 - DNA, 15 bp, Homo sapiens
gccagagaggtagga

SEQ ID NO: 370539 - DNA, 15 bp, Homo sapiens
ccagagaggtaggag

SEQ ID NO: 370540 - DNA, 15 bp, Homo sapiens
cagagaggtaggagg

SEQ ID NO: 370541 - DNA, 15 bp, Homo sapiens
agagaggtaggagga

SEQ ID NO: 370542 - DNA, 15 bp, Homo sapiens
gagaggtaggaggaa

SEQ ID NO: 370543 - DNA, 15 bp, Homo sapiens
agaggtaggaggaaa

SEQ ID NO: 370544 - DNA, 15 bp, Homo sapiens
gaggtaggaggaaag

SEQ ID NO: 370545 - DNA, 15 bp, Homo sapiens
aggtaggaggaaagc

SEQ ID NO: 370546 - DNA, 15 bp, Homo sapiens
ggtaggaggaaagcc

SEQ ID NO: 370547 - DNA, 15 bp, Homo sapiens
gtaggaggaaagcca

SEQ ID NO: 370548 - DNA, 15 bp, Homo sapiens
taggaggaaagccag

SEQ ID NO: 370549 - DNA, 15 bp, Homo sapiens
aggaggaaagccaga

SEQ ID NO: 370550 - DNA, 15 bp, Homo sapiens
ggaggaaagccagaa

SEQ ID NO: 370551 - DNA, 15 bp, Homo sapiens
gaggaaagccagaat

SEQ ID NO: 370552 - DNA, 15 bp, Homo sapiens
aggaaagccagaatt

SEQ ID NO: 370553 - DNA, 15 bp, Homo sapiens
ggaaagccagaattg

SEQ ID NO: 370554 - DNA, 15 bp, Homo sapiens
gaaagccagaattgc

SEQ ID NO: 370555 - DNA, 15 bp, Homo sapiens
aaagccagaattgca

SEQ ID NO: 370556 - DNA, 15 bp, Homo sapiens
aagccagaattgcag

SEQ ID NO: 370557 - DNA, 15 bp, Homo sapiens
agccagaattgcaga

SEQ ID NO: 370558 - DNA, 15 bp, Homo sapiens
gccagaattgcagag

SEQ ID NO: 370559 - DNA, 15 bp, Homo sapiens
ccagaattgcagagt

SEQ ID NO: 370560 - DNA, 15 bp, Homo sapiens
cagaattgcagagta

SEQ ID NO: 370561 - DNA, 15 bp, Homo sapiens
agaattgcagagtaa

SEQ ID NO: 370562 - DNA, 15 bp, Homo sapiens
gaattgcagagtaat

SEQ ID NO: 370563 - DNA, 15 bp, Homo sapiens
aattgcagagtaata

SEQ ID NO: 370564 - DNA, 15 bp, Homo sapiens
attgcagagtaataa

SEQ ID NO: 370565 - DNA, 15 bp, Homo sapiens
ttgcagagtaataac

SEQ ID NO: 370566 - DNA, 15 bp, Homo sapiens
tgcagagtaataaca

SEQ ID NO: 370567 - DNA, 15 bp, Homo sapiens
gcagagtaataacag

SEQ ID NO: 370568 - DNA, 15 bp, Homo sapiens
cagagtaataacaga

SEQ ID NO: 370569 - DNA, 15 bp, Homo sapiens
agagtaataacagaa

SEQ ID NO: 370570 - DNA, 15 bp, Homo sapiens
gagtaataacagaat

SEQ ID NO: 370571 - DNA, 15 bp, Homo sapiens
agtaataacagaatt

SEQ ID NO: 370572 - DNA, 15 bp, Homo sapiens
gtaataacagaattc

SEQ ID NO: 370573 - DNA, 15 bp, Homo sapiens
taataacagaattca

SEQ ID NO: 370574 - DNA, 15 bp, Homo sapiens
aataacagaattcaa

SEQ ID NO: 370575 - DNA, 15 bp, Homo sapiens
ataacagaattcaag

SEQ ID NO: 370576 - DNA, 15 bp, Homo sapiens
taacagaattcaagg

SEQ ID NO: 370577 - DNA, 15 bp, Homo sapiens
aacagaattcaaggg

SEQ ID NO: 370578 - DNA, 15 bp, Homo sapiens
acagaattcaaggga

SEQ ID NO: 370579 - DNA, 15 bp, Homo sapiens
cagaattcaagggag

SEQ ID NO: 370580 - DNA, 15 bp, Homo sapiens
agaattcaagggagg

SEQ ID NO: 370581 - DNA, 15 bp, Homo sapiens
gaattcaagggaggg

SEQ ID NO: 370582 - DNA, 15 bp, Homo sapiens
aattcaagggagggg

SEQ ID NO: 370583 - DNA, 15 bp, Homo sapiens
attcaagggaggggg

SEQ ID NO: 370584 - DNA, 15 bp, Homo sapiens
ttcaagggaggggga

SEQ ID NO: 370585 - DNA, 15 bp, Homo sapiens
tcaagggagggggag

SEQ ID NO: 370586 - DNA, 15 bp, Homo sapiens
caagggagggggagt

SEQ ID NO: 370587 - DNA, 15 bp, Homo sapiens
aagggagggggagtg

SEQ ID NO: 370588 - DNA, 15 bp, Homo sapiens
agggagggggagtgg

SEQ ID NO: 370589 - DNA, 15 bp, Homo sapiens
gggagggggagtgga

SEQ ID NO: 370590 - DNA, 15 bp, Homo sapiens
ggagggggagtggac

SEQ ID NO: 370591 - DNA, 15 bp, Homo sapiens
gagggggagtggacg

SEQ ID NO: 370592 - DNA, 15 bp, Homo sapiens
agggggagtggacgg

SEQ ID NO: 370593 - DNA, 15 bp, Homo sapiens
gggggagtggacggc

SEQ ID NO: 370594 - DNA, 15 bp, Homo sapiens
ggggagtggacggca

SEQ ID NO: 370595 - DNA, 15 bp, Homo sapiens
gggagtggacggcat

SEQ ID NO: 370596 - DNA, 15 bp, Homo sapiens
ggagtggacggcatt

SEQ ID NO: 370597 - DNA, 15 bp, Homo sapiens
gagtggacggcatta

SEQ ID NO: 370598 - DNA, 15 bp, Homo sapiens
agtggacggcattaa

SEQ ID NO: 370599 - DNA, 15 bp, Homo sapiens
gtggacggcattaac

SEQ ID NO: 370600 - DNA, 15 bp, Homo sapiens
tggacggcattaact

SEQ ID NO: 370601 - DNA, 15 bp, Homo sapiens
ggacggcattaactg

SEQ ID NO: 370602 - DNA, 15 bp, Homo sapiens
gacggcattaactgg

SEQ ID NO: 370603 - DNA, 15 bp, Homo sapiens
acggcattaactggt

SEQ ID NO: 370604 - DNA, 15 bp, Homo sapiens
cggcattaactggtg

SEQ ID NO: 370605 - DNA, 15 bp, Homo sapiens
ggcattaactggtgc

SEQ ID NO: 370606 - DNA, 15 bp, Homo sapiens
gcattaactggtgca

SEQ ID NO: 370607 - DNA, 15 bp, Homo sapiens
cattaactggtgcac

SEQ ID NO: 370608 - DNA, 15 bp, Homo sapiens
attaactggtgcaca

SEQ ID NO: 370609 - DNA, 15 bp, Homo sapiens
ttaactggtgcacag

SEQ ID NO: 370610 - DNA, 15 bp, Homo sapiens
taactggtgcacagg

SEQ ID NO: 370611 - DNA, 15 bp, Homo sapiens
aactggtgcacaggg

SEQ ID NO: 370612 - DNA, 15 bp, Homo sapiens
actggtgcacagggg

SEQ ID NO: 370613 - DNA, 15 bp, Homo sapiens
ctggtgcacaggggt

SEQ ID NO: 370614 - DNA, 15 bp, Homo sapiens
tggtgcacaggggtc

SEQ ID NO: 370615 - DNA, 15 bp, Homo sapiens
ggtgcacaggggtca

SEQ ID NO: 370616 - DNA, 15 bp, Homo sapiens
gtgcacaggggtcag

SEQ ID NO: 370617 - DNA, 15 bp, Homo sapiens
tgcacaggggtcagg

SEQ ID NO: 370618 - DNA, 15 bp, Homo sapiens
gcacaggggtcagga

SEQ ID NO: 370619 - DNA, 15 bp, Homo sapiens
cacaggggtcaggac

SEQ ID NO: 370620 - DNA, 15 bp, Homo sapiens
acaggggtcaggaca

SEQ ID NO: 370621 - DNA, 15 bp, Homo sapiens
caggggtcaggacag

SEQ ID NO: 370622 - DNA, 15 bp, Homo sapiens
aggggtcaggacagc

SEQ ID NO: 370623 - DNA, 15 bp, Homo sapiens
ggggtcaggacagct

SEQ ID NO: 370624 - DNA, 15 bp, Homo sapiens
gggtcaggacagcta

SEQ ID NO: 370625 - DNA, 15 bp, Homo sapiens
ggtcaggacagctaa

SEQ ID NO: 370626 - DNA, 15 bp, Homo sapiens
gtcaggacagctaag

SEQ ID NO: 370627 - DNA, 15 bp, Homo sapiens
tcaggacagctaagg

SEQ ID NO: 370628 - DNA, 15 bp, Homo sapiens
caggacagctaagga

SEQ ID NO: 370629 - DNA, 15 bp, Homo sapiens
aggacagctaaggac

SEQ ID NO: 370630 - DNA, 15 bp, Homo sapiens
ggacagctaaggact

SEQ ID NO: 370631 - DNA, 15 bp, Homo sapiens
gacagctaaggactg

SEQ ID NO: 370632 - DNA, 15 bp, Homo sapiens
acagctaaggactgg

SEQ ID NO: 370633 - DNA, 15 bp, Homo sapiens
cagctaaggactggt

SEQ ID NO: 370634 - DNA, 15 bp, Homo sapiens
agctaaggactggtt

SEQ ID NO: 370635 - DNA, 15 bp, Homo sapiens
gctaaggactggttg

SEQ ID NO: 370636 - DNA, 15 bp, Homo sapiens
ctaaggactggttgg

SEQ ID NO: 370637 - DNA, 15 bp, Homo sapiens
taaggactggttggt

SEQ ID NO: 370638 - DNA, 15 bp, Homo sapiens
aaggactggttggtg

SEQ ID NO: 370639 - DNA, 15 bp, Homo sapiens
aggactggttggtgt

SEQ ID NO: 370640 - DNA, 15 bp, Homo sapiens
ggactggttggtgtt

SEQ ID NO: 370641 - DNA, 15 bp, Homo sapiens
gactggttggtgttt

SEQ ID NO: 370642 - DNA, 15 bp, Homo sapiens
actggttggtgtttt

SEQ ID NO: 370643 - DNA, 15 bp, Homo sapiens
ctggttggtgttttt

SEQ ID NO: 370644 - DNA, 15 bp, Homo sapiens
tggttggtgtttttg

SEQ ID NO: 370645 - DNA, 15 bp, Homo sapiens
ggttggtgtttttga

SEQ ID NO: 370646 - DNA, 15 bp, Homo sapiens
gttggtgtttttgat

SEQ ID NO: 370647 - DNA, 15 bp, Homo sapiens
ttggtgtttttgata

SEQ ID NO: 370648 - DNA, 15 bp, Homo sapiens
tggtgtttttgatag

SEQ ID NO: 370649 - DNA, 15 bp, Homo sapiens
ggtgtttttgatagc

SEQ ID NO: 370650 - DNA, 15 bp, Homo sapiens
gtgtttttgatagca

SEQ ID NO: 370651 - DNA, 15 bp, Homo sapiens
tgtttttgatagcaa

SEQ ID NO: 370652 - DNA, 15 bp, Homo sapiens
gtttttgatagcaat

SEQ ID NO: 370653 - DNA, 15 bp, Homo sapiens
tttttgatagcaatg

SEQ ID NO: 370654 - DNA, 15 bp, Homo sapiens
ttttgatagcaatgt

SEQ ID NO: 370655 - DNA, 15 bp, Homo sapiens
tttgatagcaatgtc

SEQ ID NO: 370656 - DNA, 15 bp, Homo sapiens
ttgatagcaatgtca

SEQ ID NO: 370657 - DNA, 15 bp, Homo sapiens
tgatagcaatgtcag

SEQ ID NO: 370658 - DNA, 15 bp, Homo sapiens
gatagcaatgtcagt

SEQ ID NO: 370659 - DNA, 15 bp, Homo sapiens
atagcaatgtcagtg

SEQ ID NO: 370660 - DNA, 15 bp, Homo sapiens
tagcaatgtcagtgg

SEQ ID NO: 370661 - DNA, 15 bp, Homo sapiens
agcaatgtcagtgga

SEQ ID NO: 370662 - DNA, 15 bp, Homo sapiens
gcaatgtcagtggag

SEQ ID NO: 370663 - DNA, 15 bp, Homo sapiens
caatgtcagtggagt

SEQ ID NO: 370664 - DNA, 15 bp, Homo sapiens
aatgtcagtggagtt

SEQ ID NO: 370665 - DNA, 15 bp, Homo sapiens
atgtcagtggagtta

SEQ ID NO: 370666 - DNA, 15 bp, Homo sapiens
tgtcagtggagttag

SEQ ID NO: 370667 - DNA, 15 bp, Homo sapiens
gtcagtggagttagg

SEQ ID NO: 370668 - DNA, 15 bp, Homo sapiens
tcagtggagttaggg

SEQ ID NO: 370669 - DNA, 15 bp, Homo sapiens
cagtggagttagggg

SEQ ID NO: 370670 - DNA, 15 bp, Homo sapiens
agtggagttaggggc

SEQ ID NO: 370671 - DNA, 15 bp, Homo sapiens
gtggagttaggggct

SEQ ID NO: 370672 - DNA, 15 bp, Homo sapiens
tggagttaggggctc

SEQ ID NO: 370673 - DNA, 15 bp, Homo sapiens
ggagttaggggctca

SEQ ID NO: 370674 - DNA, 15 bp, Homo sapiens
gagttaggggctcaa

SEQ ID NO: 370675 - DNA, 15 bp, Homo sapiens
agttaggggctcaaa

SEQ ID NO: 370676 - DNA, 15 bp, Homo sapiens
gttaggggctcaaac

SEQ ID NO: 370677 - DNA, 15 bp, Homo sapiens
ttaggggctcaaaca

SEQ ID NO: 370678 - DNA, 15 bp, Homo sapiens
taggggctcaaacaa

SEQ ID NO: 370679 - DNA, 15 bp, Homo sapiens
aggggctcaaacaag

SEQ ID NO: 370680 - DNA, 15 bp, Homo sapiens
ggggctcaaacaaga

SEQ ID NO: 370681 - DNA, 15 bp, Homo sapiens
gggctcaaacaagat

SEQ ID NO: 370682 - DNA, 15 bp, Homo sapiens
ggctcaaacaagatt

SEQ ID NO: 370683 - DNA, 15 bp, Homo sapiens
gctcaaacaagattg

SEQ ID NO: 370684 - DNA, 15 bp, Homo sapiens
ctcaaacaagattgc

SEQ ID NO: 370685 - DNA, 15 bp, Homo sapiens
tcaaacaagattgca

SEQ ID NO: 370686 - DNA, 15 bp, Homo sapiens
caaacaagattgcaa

SEQ ID NO: 370687 - DNA, 15 bp, Homo sapiens
aaacaagattgcaat

SEQ ID NO: 370688 - DNA, 15 bp, Homo sapiens
aacaagattgcaatg

SEQ ID NO: 370689 - DNA, 15 bp, Homo sapiens
acaagattgcaatgg

SEQ ID NO: 370690 - DNA, 15 bp, Homo sapiens
caagattgcaatgga

SEQ ID NO: 370691 - DNA, 15 bp, Homo sapiens
aagattgcaatggag

SEQ ID NO: 370692 - DNA, 15 bp, Homo sapiens
agattgcaatggaga

SEQ ID NO: 370693 - DNA, 15 bp, Homo sapiens
gattgcaatggagag

SEQ ID NO: 370694 - DNA, 15 bp, Homo sapiens
attgcaatggagagt

SEQ ID NO: 370695 - DNA, 15 bp, Homo sapiens
ttgcaatggagagtg

SEQ ID NO: 370696 - DNA, 15 bp, Homo sapiens
tgcaatggagagtga

SEQ ID NO: 370697 - DNA, 15 bp, Homo sapiens
gcaatggagagtgaa

SEQ ID NO: 370698 - DNA, 15 bp, Homo sapiens
caatggagagtgaag

SEQ ID NO: 370699 - DNA, 15 bp, Homo sapiens
aatggagagtgaagg

SEQ ID NO: 370700 - DNA, 15 bp, Homo sapiens
atggagagtgaaggt

SEQ ID NO: 370701 - DNA, 15 bp, Homo sapiens
tggagagtgaaggta

SEQ ID NO: 370702 - DNA, 15 bp, Homo sapiens
ggagagtgaaggtag

SEQ ID NO: 370703 - DNA, 15 bp, Homo sapiens
gagagtgaaggtaga

SEQ ID NO: 370704 - DNA, 15 bp, Homo sapiens
agagtgaaggtagag

SEQ ID NO: 370705 - DNA, 15 bp, Homo sapiens
gagtgaaggtagagc

SEQ ID NO: 370706 - DNA, 15 bp, Homo sapiens
agtgaaggtagagcc

SEQ ID NO: 370707 - DNA, 15 bp, Homo sapiens
gtgaaggtagagcca

SEQ ID NO: 370708 - DNA, 15 bp, Homo sapiens
tgaaggtagagccag

SEQ ID NO: 370709 - DNA, 15 bp, Homo sapiens
gaaggtagagccaga

SEQ ID NO: 370710 - DNA, 15 bp, Homo sapiens
aaggtagagccagaa

SEQ ID NO: 370711 - DNA, 15 bp, Homo sapiens
aggtagagccagaag

SEQ ID NO: 370712 - DNA, 15 bp, Homo sapiens
ggtagagccagaagt

SEQ ID NO: 370713 - DNA, 15 bp, Homo sapiens
gtagagccagaagtt

SEQ ID NO: 370714 - DNA, 15 bp, Homo sapiens
tagagccagaagttt

SEQ ID NO: 370715 - DNA, 15 bp, Homo sapiens
agagccagaagttta

SEQ ID NO: 370716 - DNA, 15 bp, Homo sapiens
gagccagaagtttag

SEQ ID NO: 370717 - DNA, 15 bp, Homo sapiens
agccagaagtttagg

SEQ ID NO: 370718 - DNA, 15 bp, Homo sapiens
gccagaagtttaggt

SEQ ID NO: 370719 - DNA, 15 bp, Homo sapiens
ccagaagtttaggtc

SEQ ID NO: 370720 - DNA, 15 bp, Homo sapiens
cagaagtttaggtcg

SEQ ID NO: 370721 - DNA, 15 bp, Homo sapiens
agaagtttaggtcgt

SEQ ID NO: 370722 - DNA, 15 bp, Homo sapiens
gaagtttaggtcgtt

SEQ ID NO: 370723 - DNA, 15 bp, Homo sapiens
aagtttaggtcgtta

SEQ ID NO: 370724 - DNA, 15 bp, Homo sapiens
agtttaggtcgttag

SEQ ID NO: 370725 - DNA, 15 bp, Homo sapiens
gtttaggtcgttagg

SEQ ID NO: 370726 - DNA, 15 bp, Homo sapiens
tttaggtcgttaggg

SEQ ID NO: 370727 - DNA, 15 bp, Homo sapiens
ttaggtcgttagggg

SEQ ID NO: 370728 - DNA, 15 bp, Homo sapiens
taggtcgttagggga

SEQ ID NO: 370729 - DNA, 15 bp, Homo sapiens
aggtcgttaggggaa

SEQ ID NO: 370730 - DNA, 15 bp, Homo sapiens
ggtcgttaggggaag

SEQ ID NO: 370731 - DNA, 15 bp, Homo sapiens
gtcgttaggggaaga

SEQ ID NO: 370732 - DNA, 15 bp, Homo sapiens
tcgttaggggaagaa

SEQ ID NO: 370733 - DNA, 15 bp, Homo sapiens
cgttaggggaagaaa

SEQ ID NO: 370734 - DNA, 15 bp, Homo sapiens
gttaggggaagaaaa

SEQ ID NO: 370735 - DNA, 15 bp, Homo sapiens
ttaggggaagaaaag

SEQ ID NO: 370736 - DNA, 15 bp, Homo sapiens
taggggaagaaaagt

SEQ ID NO: 370737 - DNA, 15 bp, Homo sapiens
aggggaagaaaagta

SEQ ID NO: 370738 - DNA, 15 bp, Homo sapiens
ggggaagaaaagtag

SEQ ID NO: 370739 - DNA, 15 bp, Homo sapiens
gggaagaaaagtagc

SEQ ID NO: 370740 - DNA, 15 bp, Homo sapiens
ggaagaaaagtagca

SEQ ID NO: 370741 - DNA, 15 bp, Homo sapiens
gaagaaaagtagcag

SEQ ID NO: 370742 - DNA, 15 bp, Homo sapiens
aagaaaagtagcaga

SEQ ID NO: 370743 - DNA, 15 bp, Homo sapiens
agaaaagtagcagag

SEQ ID NO: 370744 - DNA, 15 bp, Homo sapiens
gaaaagtagcagagc

SEQ ID NO: 370745 - DNA, 15 bp, Homo sapiens
aaaagtagcagagct

SEQ ID NO: 370746 - DNA, 15 bp, Homo sapiens
aaagtagcagagctg

SEQ ID NO: 370747 - DNA, 15 bp, Homo sapiens
aagtagcagagctgc

SEQ ID NO: 370748 - DNA, 15 bp, Homo sapiens
agtagcagagctgcc

SEQ ID NO: 370749 - DNA, 15 bp, Homo sapiens
gtagcagagctgcca

SEQ ID NO: 370750 - DNA, 15 bp, Homo sapiens
tagcagagctgccat

SEQ ID NO: 370751 - DNA, 15 bp, Homo sapiens
agcagagctgccatt

SEQ ID NO: 370752 - DNA, 15 bp, Homo sapiens
gcagagctgccattc

SEQ ID NO: 370753 - DNA, 15 bp, Homo sapiens
cagagctgccattca

SEQ ID NO: 370754 - DNA, 15 bp, Homo sapiens
agagctgccattcag

SEQ ID NO: 370755 - DNA, 15 bp, Homo sapiens
gagctgccattcaga

SEQ ID NO: 370756 - DNA, 15 bp, Homo sapiens
agctgccattcagaa

SEQ ID NO: 370757 - DNA, 15 bp, Homo sapiens
gctgccattcagaat

SEQ ID NO: 370758 - DNA, 15 bp, Homo sapiens
ctgccattcagaata

SEQ ID NO: 370759 - DNA, 15 bp, Homo sapiens
tgccattcagaataa

SEQ ID NO: 370760 - DNA, 15 bp, Homo sapiens
gccattcagaataac

SEQ ID NO: 370761 - DNA, 15 bp, Homo sapiens
ccattcagaataaca

SEQ ID NO: 370762 - DNA, 15 bp, Homo sapiens
cattcagaataacac

SEQ ID NO: 370763 - DNA, 15 bp, Homo sapiens
attcagaataacacc

SEQ ID NO: 370764 - DNA, 15 bp, Homo sapiens
ttcagaataacacct

SEQ ID NO: 370765 - DNA, 15 bp, Homo sapiens
tcagaataacacctc

SEQ ID NO: 370766 - DNA, 15 bp, Homo sapiens
cagaataacacctct

SEQ ID NO: 370767 - DNA, 15 bp, Homo sapiens
agaataacacctctt

SEQ ID NO: 370768 - DNA, 15 bp, Homo sapiens
gaataacacctcttc

SEQ ID NO: 370769 - DNA, 15 bp, Homo sapiens
aataacacctcttct

SEQ ID NO: 370770 - DNA, 15 bp, Homo sapiens
ataacacctcttctt

SEQ ID NO: 370771 - DNA, 15 bp, Homo sapiens
taacacctcttcttt

SEQ ID NO: 370772 - DNA, 15 bp, Homo sapiens
aacacctcttctttt

SEQ ID NO: 370773 - DNA, 15 bp, Homo sapiens
acacctcttcttttg

SEQ ID NO: 370774 - DNA, 15 bp, Homo sapiens
cacctcttcttttga

SEQ ID NO: 370775 - DNA, 15 bp, Homo sapiens
acctcttcttttgaa

SEQ ID NO: 370776 - DNA, 15 bp, Homo sapiens
cctcttcttttgaac

SEQ ID NO: 370777 - DNA, 15 bp, Homo sapiens
ctcttcttttgaact

SEQ ID NO: 370778 - DNA, 15 bp, Homo sapiens
tcttcttttgaacta

SEQ ID NO: 370779 - DNA, 15 bp, Homo sapiens
cttcttttgaactac

SEQ ID NO: 370780 - DNA, 15 bp, Homo sapiens
ttcttttgaactaca

SEQ ID NO: 370781 - DNA, 15 bp, Homo sapiens
tcttttgaactacag

SEQ ID NO: 370782 - DNA, 15 bp, Homo sapiens
cttttgaactacagt

SEQ ID NO: 370783 - DNA, 15 bp, Homo sapiens
ttttgaactacagtc

SEQ ID NO: 370784 - DNA, 15 bp, Homo sapiens
tttgaactacagtca

SEQ ID NO: 370785 - DNA, 15 bp, Homo sapiens
ttgaactacagtcat

SEQ ID NO: 370786 - DNA, 15 bp, Homo sapiens
tgaactacagtcatc

SEQ ID NO: 370787 - DNA, 15 bp, Homo sapiens
gaactacagtcatct

SEQ ID NO: 370788 - DNA, 15 bp, Homo sapiens
aactacagtcatctt

SEQ ID NO: 370789 - DNA, 15 bp, Homo sapiens
actacagtcatcttt

SEQ ID NO: 370790 - DNA, 15 bp, Homo sapiens
ctacagtcatcttta

SEQ ID NO: 370791 - DNA, 15 bp, Homo sapiens
tacagtcatctttat

SEQ ID NO: 370792 - DNA, 15 bp, Homo sapiens
acagtcatctttatt

SEQ ID NO: 370793 - DNA, 15 bp, Homo sapiens
cagtcatctttattt

SEQ ID NO: 370794 - DNA, 15 bp, Homo sapiens
agtcatctttattta

SEQ ID NO: 370795 - DNA, 15 bp, Homo sapiens
gtcatctttatttac

SEQ ID NO: 370796 - DNA, 15 bp, Homo sapiens
tcatctttatttacg

SEQ ID NO: 370797 - DNA, 15 bp, Homo sapiens
catctttatttacgt

SEQ ID NO: 370798 - DNA, 15 bp, Homo sapiens
atctttatttacgta

SEQ ID NO: 370799 - DNA, 15 bp, Homo sapiens
tctttatttacgtag

SEQ ID NO: 370800 - DNA, 15 bp, Homo sapiens
ctttatttacgtagt

SEQ ID NO: 370801 - DNA, 15 bp, Homo sapiens
tttatttacgtagta

SEQ ID NO: 370802 - DNA, 15 bp, Homo sapiens
ttatttacgtagtat

SEQ ID NO: 370803 - DNA, 15 bp, Homo sapiens
tatttacgtagtatt

SEQ ID NO: 370804 - DNA, 15 bp, Homo sapiens
atttacgtagtattc

SEQ ID NO: 370805 - DNA, 15 bp, Homo sapiens
tttacgtagtattct

SEQ ID NO: 370806 - DNA, 15 bp, Homo sapiens
ttacgtagtattctt

SEQ ID NO: 370807 - DNA, 15 bp, Homo sapiens
tacgtagtattcttc

SEQ ID NO: 370808 - DNA, 15 bp, Homo sapiens
acgtagtattcttct

SEQ ID NO: 370809 - DNA, 15 bp, Homo sapiens
cgtagtattcttctc

SEQ ID NO: 370810 - DNA, 15 bp, Homo sapiens
gtagtattcttctct

SEQ ID NO: 370811 - DNA, 15 bp, Homo sapiens
tagtattcttctctt

SEQ ID NO: 370812 - DNA, 15 bp, Homo sapiens
agtattcttctcttt

SEQ ID NO: 370813 - DNA, 15 bp, Homo sapiens
gtattcttctctttc

SEQ ID NO: 370814 - DNA, 15 bp, Homo sapiens
tattcttctctttct

SEQ ID NO: 370815 - DNA, 15 bp, Homo sapiens
attcttctctttctg

SEQ ID NO: 370816 - DNA, 15 bp, Homo sapiens
ttcttctctttctgt

SEQ ID NO: 370817 - DNA, 15 bp, Homo sapiens
tcttctctttctgtt

SEQ ID NO: 370818 - DNA, 15 bp, Homo sapiens
cttctctttctgttt

SEQ ID NO: 370819 - DNA, 15 bp, Homo sapiens
ttctctttctgtttg

SEQ ID NO: 370820 - DNA, 15 bp, Homo sapiens
tctctttctgtttgt

SEQ ID NO: 370821 - DNA, 15 bp, Homo sapiens
ctctttctgtttgtc

SEQ ID NO: 370822 - DNA, 15 bp, Homo sapiens
tctttctgtttgtcc

SEQ ID NO: 370823 - DNA, 15 bp, Homo sapiens
ctttctgtttgtcct

SEQ ID NO: 370824 - DNA, 15 bp, Homo sapiens
tttctgtttgtcctg

SEQ ID NO: 370825 - DNA, 15 bp, Homo sapiens
ttctgtttgtcctga

SEQ ID NO: 370826 - DNA, 15 bp, Homo sapiens
tctgtttgtcctgat

SEQ ID NO: 370827 - DNA, 15 bp, Homo sapiens
ctgtttgtcctgatg

SEQ ID NO: 370828 - DNA, 15 bp, Homo sapiens
tgtttgtcctgatgc

SEQ ID NO: 370829 - DNA, 15 bp, Homo sapiens
gtttgtcctgatgcg

SEQ ID NO: 370830 - DNA, 15 bp, Homo sapiens
tttgtcctgatgcgg

SEQ ID NO: 370831 - DNA, 15 bp, Homo sapiens
ttgtcctgatgcggt

SEQ ID NO: 370832 - DNA, 15 bp, Homo sapiens
tgtcctgatgcggta

SEQ ID NO: 370833 - DNA, 15 bp, Homo sapiens
gtcctgatgcggtag

SEQ ID NO: 370834 - DNA, 15 bp, Homo sapiens
tcctgatgcggtaga

SEQ ID NO: 370835 - DNA, 15 bp, Homo sapiens
cctgatgcggtagat

SEQ ID NO: 370836 - DNA, 15 bp, Homo sapiens
ctgatgcggtagatt

SEQ ID NO: 370837 - DNA, 15 bp, Homo sapiens
tgatgcggtagattt

SEQ ID NO: 370838 - DNA, 15 bp, Homo sapiens
gatgcggtagatttg

SEQ ID NO: 370839 - DNA, 15 bp, Homo sapiens
atgcggtagatttgc

SEQ ID NO: 370840 - DNA, 15 bp, Homo sapiens
tgcggtagatttgca

SEQ ID NO: 370841 - DNA, 15 bp, Homo sapiens
gcggtagatttgcag

SEQ ID NO: 370842 - DNA, 15 bp, Homo sapiens
cggtagatttgcaga

SEQ ID NO: 370843 - DNA, 15 bp, Homo sapiens
ggtagatttgcagag

SEQ ID NO: 370844 - DNA, 15 bp, Homo sapiens
gtagatttgcagaga

SEQ ID NO: 370845 - DNA, 15 bp, Homo sapiens
tagatttgcagagag

SEQ ID NO: 370846 - DNA, 15 bp, Homo sapiens
agatttgcagagagg

SEQ ID NO: 370847 - DNA, 15 bp, Homo sapiens
gatttgcagagaggt

SEQ ID NO: 370848 - DNA, 15 bp, Homo sapiens
atttgcagagaggtg

SEQ ID NO: 370849 - DNA, 15 bp, Homo sapiens
tttgcagagaggtgc

SEQ ID NO: 370850 - DNA, 15 bp, Homo sapiens
ttgcagagaggtgcc

SEQ ID NO: 370851 - DNA, 15 bp, Homo sapiens
tgcagagaggtgcct

SEQ ID NO: 370852 - DNA, 15 bp, Homo sapiens
gcagagaggtgccta

SEQ ID NO: 370853 - DNA, 15 bp, Homo sapiens
cagagaggtgcctac

SEQ ID NO: 370854 - DNA, 15 bp, Homo sapiens
agagaggtgcctacc

SEQ ID NO: 370855 - DNA, 15 bp, Homo sapiens
gagaggtgcctacca

SEQ ID NO: 370856 - DNA, 15 bp, Homo sapiens
agaggtgcctaccac

SEQ ID NO: 370857 - DNA, 15 bp, Homo sapiens
gaggtgcctaccacc

SEQ ID NO: 370858 - DNA, 15 bp, Homo sapiens
aggtgcctaccaccc

SEQ ID NO: 370859 - DNA, 15 bp, Homo sapiens
ggtgcctaccaccct

SEQ ID NO: 370860 - DNA, 15 bp, Homo sapiens
gtgcctaccaccctg

SEQ ID NO: 370861 - DNA, 15 bp, Homo sapiens
tgcctaccaccctga

SEQ ID NO: 370862 - DNA, 15 bp, Homo sapiens
gcctaccaccctgaa

SEQ ID NO: 370863 - DNA, 15 bp, Homo sapiens
cctaccaccctgaag

SEQ ID NO: 370864 - DNA, 15 bp, Homo sapiens
ctaccaccctgaagg

SEQ ID NO: 370865 - DNA, 15 bp, Homo sapiens
taccaccctgaagga

SEQ ID NO: 370866 - DNA, 15 bp, Homo sapiens
accaccctgaaggaa

SEQ ID NO: 370867 - DNA, 15 bp, Homo sapiens
ccaccctgaaggaat

SEQ ID NO: 370868 - DNA, 15 bp, Homo sapiens
caccctgaaggaatg

SEQ ID NO: 370869 - DNA, 15 bp, Homo sapiens
accctgaaggaatgc

SEQ ID NO: 370870 - DNA, 15 bp, Homo sapiens
ccctgaaggaatgca

SEQ ID NO: 370871 - DNA, 15 bp, Homo sapiens
cctgaaggaatgcat

SEQ ID NO: 370872 - DNA, 15 bp, Homo sapiens
ctgaaggaatgcatc

SEQ ID NO: 370873 - DNA, 15 bp, Homo sapiens
tgaaggaatgcatcc

SEQ ID NO: 370874 - DNA, 15 bp, Homo sapiens
gaaggaatgcatcca

SEQ ID NO: 370875 - DNA, 15 bp, Homo sapiens
aaggaatgcatccag

SEQ ID NO: 370876 - DNA, 15 bp, Homo sapiens
aggaatgcatccagg

SEQ ID NO: 370877 - DNA, 15 bp, Homo sapiens
ggaatgcatccagga

SEQ ID NO: 370878 - DNA, 15 bp, Homo sapiens
gaatgcatccaggag

SEQ ID NO: 370879 - DNA, 15 bp, Homo sapiens
aatgcatccaggagc

SEQ ID NO: 370880 - DNA, 15 bp, Homo sapiens
atgcatccaggagcc

SEQ ID NO: 370881 - DNA, 15 bp, Homo sapiens
tgcatccaggagccc

SEQ ID NO: 370882 - DNA, 15 bp, Homo sapiens
gcatccaggagccca

SEQ ID NO: 370883 - DNA, 15 bp, Homo sapiens
catccaggagcccag

SEQ ID NO: 370884 - DNA, 15 bp, Homo sapiens
atccaggagcccagt

SEQ ID NO: 370885 - DNA, 15 bp, Homo sapiens
tccaggagcccagtt

SEQ ID NO: 370886 - DNA, 15 bp, Homo sapiens
ccaggagcccagttc

SEQ ID NO: 370887 - DNA, 15 bp, Homo sapiens
caggagcccagttct

SEQ ID NO: 370888 - DNA, 15 bp, Homo sapiens
aggagcccagttctg

SEQ ID NO: 370889 - DNA, 15 bp, Homo sapiens
ggagcccagttctgt

SEQ ID NO: 370890 - DNA, 15 bp, Homo sapiens
gagcccagttctgtt

SEQ ID NO: 370891 - DNA, 15 bp, Homo sapiens
agcccagttctgttt

SEQ ID NO: 370892 - DNA, 15 bp, Homo sapiens
gcccagttctgtttc

SEQ ID NO: 370893 - DNA, 15 bp, Homo sapiens
cccagttctgtttca

SEQ ID NO: 370894 - DNA, 15 bp, Homo sapiens
ccagttctgtttcac

SEQ ID NO: 370895 - DNA, 15 bp, Homo sapiens
cagttctgtttcaca

SEQ ID NO: 370896 - DNA, 15 bp, Homo sapiens
agttctgtttcacag

SEQ ID NO: 370897 - DNA, 15 bp, Homo sapiens
gttctgtttcacaga

SEQ ID NO: 370898 - DNA, 15 bp, Homo sapiens
ttctgtttcacagac

SEQ ID NO: 370899 - DNA, 15 bp, Homo sapiens
tctgtttcacagaca

SEQ ID NO: 370900 - DNA, 15 bp, Homo sapiens
ctgtttcacagacaa

SEQ ID NO: 370901 - DNA, 15 bp, Homo sapiens
tgtttcacagacaag

SEQ ID NO: 370902 - DNA, 15 bp, Homo sapiens
gtttcacagacaagg

SEQ ID NO: 370903 - DNA, 15 bp, Homo sapiens
tttcacagacaagga

SEQ ID NO: 370904 - DNA, 15 bp, Homo sapiens
ttcacagacaaggat

SEQ ID NO: 370905 - DNA, 15 bp, Homo sapiens
tcacagacaaggatt

SEQ ID NO: 370906 - DNA, 15 bp, Homo sapiens
cacagacaaggattg

SEQ ID NO: 370907 - DNA, 15 bp, Homo sapiens
acagacaaggattgc

SEQ ID NO: 370908 - DNA, 15 bp, Homo sapiens
cagacaaggattgct

SEQ ID NO: 370909 - DNA, 15 bp, Homo sapiens
agacaaggattgctg

SEQ ID NO: 370910 - DNA, 15 bp, Homo sapiens
gacaaggattgctgg

SEQ ID NO: 370911 - DNA, 15 bp, Homo sapiens
acaaggattgctggt

SEQ ID NO: 370912 - DNA, 15 bp, Homo sapiens
caaggattgctggta

SEQ ID NO: 370913 - DNA, 15 bp, Homo sapiens
aaggattgctggtaa

SEQ ID NO: 370914 - DNA, 15 bp, Homo sapiens
aggattgctggtaag

SEQ ID NO: 370915 - DNA, 15 bp, Homo sapiens
ggattgctggtaaga

SEQ ID NO: 370916 - DNA, 15 bp, Homo sapiens
gattgctggtaagat

SEQ ID NO: 370917 - DNA, 15 bp, Homo sapiens
attgctggtaagata

SEQ ID NO: 370918 - DNA, 15 bp, Homo sapiens
ttgctggtaagatat

SEQ ID NO: 370919 - DNA, 15 bp, Homo sapiens
tgctggtaagatatg

SEQ ID NO: 370920 - DNA, 15 bp, Homo sapiens
gctggtaagatatgt

SEQ ID NO: 370921 - DNA, 15 bp, Homo sapiens
ctggtaagatatgtt

SEQ ID NO: 370922 - DNA, 15 bp, Homo sapiens
tggtaagatatgttt

SEQ ID NO: 370923 - DNA, 15 bp, Homo sapiens
ggtaagatatgttta

SEQ ID NO: 370924 - DNA, 15 bp, Homo sapiens
gtaagatatgtttat

SEQ ID NO: 370925 - DNA, 15 bp, Homo sapiens
taagatatgtttatc

SEQ ID NO: 370926 - DNA, 15 bp, Homo sapiens
aagatatgtttatct

SEQ ID NO: 370927 - DNA, 15 bp, Homo sapiens
agatatgtttatctt

SEQ ID NO: 370928 - DNA, 15 bp, Homo sapiens
gatatgtttatcttt

SEQ ID NO: 370929 - DNA, 15 bp, Homo sapiens
atatgtttatcttta

SEQ ID NO: 370930 - DNA, 15 bp, Homo sapiens
tatgtttatctttaa

SEQ ID NO: 370931 - DNA, 15 bp, Homo sapiens
atgtttatctttaac

SEQ ID NO: 370932 - DNA, 15 bp, Homo sapiens
tgtttatctttaaca

SEQ ID NO: 370933 - DNA, 15 bp, Homo sapiens
gtttatctttaacaa

SEQ ID NO: 370934 - DNA, 15 bp, Homo sapiens
tttatctttaacaaa

SEQ ID NO: 370935 - DNA, 15 bp, Homo sapiens
ttatctttaacaaag

SEQ ID NO: 370936 - DNA, 15 bp, Homo sapiens
tatctttaacaaagt

SEQ ID NO: 370937 - DNA, 15 bp, Homo sapiens
atctttaacaaagtt

SEQ ID NO: 370938 - DNA, 15 bp, Homo sapiens
tctttaacaaagttt

SEQ ID NO: 370939 - DNA, 15 bp, Homo sapiens
ctttaacaaagtttt

SEQ ID NO: 370940 - DNA, 15 bp, Homo sapiens
tttaacaaagttttt

SEQ ID NO: 370941 - DNA, 15 bp, Homo sapiens
ttaacaaagtttttt

SEQ ID NO: 370942 - DNA, 15 bp, Homo sapiens
taacaaagtttttta

SEQ ID NO: 370943 - DNA, 15 bp, Homo sapiens
aacaaagttttttaa

SEQ ID NO: 370944 - DNA, 15 bp, Homo sapiens
acaaagttttttaaa

SEQ ID NO: 370945 - DNA, 15 bp, Homo sapiens
caaagttttttaaaa

SEQ ID NO: 370946 - DNA, 15 bp, Homo sapiens
aaagttttttaaaaa

SEQ ID NO: 370947 - DNA, 15 bp, Homo sapiens
aagttttttaaaaaa

SEQ ID NO: 370948 - DNA, 15 bp, Homo sapiens
agttttttaaaaaat

SEQ ID NO: 370949 - DNA, 15 bp, Homo sapiens
gttttttaaaaaatc

SEQ ID NO: 370950 - DNA, 15 bp, Homo sapiens
ttttttaaaaaatca

SEQ ID NO: 370951 - DNA, 15 bp, Homo sapiens
tttttaaaaaatcag

SEQ ID NO: 370952 - DNA, 15 bp, Homo sapiens
ttttaaaaaatcagt

SEQ ID NO: 370953 - DNA, 15 bp, Homo sapiens
tttaaaaaatcagta

SEQ ID NO: 370954 - DNA, 15 bp, Homo sapiens
ttaaaaaatcagtat

SEQ ID NO: 370955 - DNA, 15 bp, Homo sapiens
taaaaaatcagtatg

SEQ ID NO: 370956 - DNA, 15 bp, Homo sapiens
aaaaaatcagtatgt

SEQ ID NO: 370957 - DNA, 15 bp, Homo sapiens
aaaaatcagtatgta

SEQ ID NO: 370958 - DNA, 15 bp, Homo sapiens
aaaatcagtatgtaa

SEQ ID NO: 370959 - DNA, 15 bp, Homo sapiens
aaatcagtatgtaaa

SEQ ID NO: 370960 - DNA, 15 bp, Homo sapiens
aatcagtatgtaaaa

SEQ ID NO: 370961 - DNA, 15 bp, Homo sapiens
atcagtatgtaaaat

SEQ ID NO: 370962 - DNA, 15 bp, Homo sapiens
tcagtatgtaaaatt

SEQ ID NO: 370963 - DNA, 15 bp, Homo sapiens
cagtatgtaaaattt

SEQ ID NO: 370964 - DNA, 15 bp, Homo sapiens
agtatgtaaaatttt

SEQ ID NO: 370965 - DNA, 15 bp, Homo sapiens
gtatgtaaaattttg

SEQ ID NO: 370966 - DNA, 15 bp, Homo sapiens
tatgtaaaattttgt

SEQ ID NO: 370967 - DNA, 15 bp, Homo sapiens
atgtaaaattttgtg

SEQ ID NO: 370968 - DNA, 15 bp, Homo sapiens
tgtaaaattttgtga

SEQ ID NO: 370969 - DNA, 15 bp, Homo sapiens
gtaaaattttgtgat

SEQ ID NO: 370970 - DNA, 15 bp, Homo sapiens
taaaattttgtgata

SEQ ID NO: 370971 - DNA, 15 bp, Homo sapiens
aaaattttgtgatat

SEQ ID NO: 370972 - DNA, 15 bp, Homo sapiens
aaattttgtgatatg

SEQ ID NO: 370973 - DNA, 15 bp, Homo sapiens
aattttgtgatatga

SEQ ID NO: 370974 - DNA, 15 bp, Homo sapiens
attttgtgatatgag

SEQ ID NO: 370975 - DNA, 15 bp, Homo sapiens
ttttgtgatatgagc

SEQ ID NO: 370976 - DNA, 15 bp, Homo sapiens
tttgtgatatgagcc

SEQ ID NO: 370977 - DNA, 15 bp, Homo sapiens
ttgtgatatgagcct

SEQ ID NO: 370978 - DNA, 15 bp, Homo sapiens
tgtgatatgagcctc

SEQ ID NO: 370979 - DNA, 15 bp, Homo sapiens
gtgatatgagcctca

SEQ ID NO: 370980 - DNA, 15 bp, Homo sapiens
tgatatgagcctcat

SEQ ID NO: 370981 - DNA, 15 bp, Homo sapiens
gatatgagcctcata

SEQ ID NO: 370982 - DNA, 15 bp, Homo sapiens
atatgagcctcatac

SEQ ID NO: 370983 - DNA, 15 bp, Homo sapiens
tatgagcctcataca

SEQ ID NO: 370984 - DNA, 15 bp, Homo sapiens
atgagcctcatacat

SEQ ID NO: 370985 - DNA, 15 bp, Homo sapiens
tgagcctcatacatg

SEQ ID NO: 370986 - DNA, 15 bp, Homo sapiens
gagcctcatacatga

SEQ ID NO: 370987 - DNA, 15 bp, Homo sapiens
agcctcatacatgaa

SEQ ID NO: 370988 - DNA, 15 bp, Homo sapiens
gcctcatacatgaat

SEQ ID NO: 370989 - DNA, 15 bp, Homo sapiens
cctcatacatgaatt

SEQ ID NO: 370990 - DNA, 15 bp, Homo sapiens
ctcatacatgaatta

SEQ ID NO: 370991 - DNA, 15 bp, Homo sapiens
tcatacatgaattag

SEQ ID NO: 370992 - DNA, 15 bp, Homo sapiens
catacatgaattaga

SEQ ID NO: 370993 - DNA, 15 bp, Homo sapiens
atacatgaattagaa

SEQ ID NO: 370994 - DNA, 15 bp, Homo sapiens
tacatgaattagaaa

SEQ ID NO: 370995 - DNA, 15 bp, Homo sapiens
acatgaattagaaag

SEQ ID NO: 370996 - DNA, 15 bp, Homo sapiens
catgaattagaaaga

SEQ ID NO: 370997 - DNA, 15 bp, Homo sapiens
atgaattagaaagac

SEQ ID NO: 370998 - DNA, 15 bp, Homo sapiens
tgaattagaaagact

SEQ ID NO: 370999 - DNA, 15 bp, Homo sapiens
gaattagaaagactt

SEQ ID NO: 371000 - DNA, 15 bp, Homo sapiens
aattagaaagactta

SEQ ID NO: 371001 - DNA, 15 bp, Homo sapiens
attagaaagacttag

SEQ ID NO: 371002 - DNA, 15 bp, Homo sapiens
ttagaaagacttaga

SEQ ID NO: 371003 - DNA, 15 bp, Homo sapiens
tagaaagacttagaa

SEQ ID NO: 371004 - DNA, 15 bp, Homo sapiens
agaaagacttagaaa

SEQ ID NO: 371005 - DNA, 15 bp, Homo sapiens
gaaagacttagaaac

SEQ ID NO: 371006 - DNA, 15 bp, Homo sapiens
aaagacttagaaacg

SEQ ID NO: 371007 - DNA, 15 bp, Homo sapiens
aagacttagaaacgt

SEQ ID NO: 371008 - DNA, 15 bp, Homo sapiens
agacttagaaacgtc

SEQ ID NO: 371009 - DNA, 15 bp, Homo sapiens
gacttagaaacgtcg

SEQ ID NO: 371010 - DNA, 15 bp, Homo sapiens
acttagaaacgtcgt

SEQ ID NO: 371011 - DNA, 15 bp, Homo sapiens
cttagaaacgtcgtg

SEQ ID NO: 371012 - DNA, 15 bp, Homo sapiens
ttagaaacgtcgtgc

SEQ ID NO: 371013 - DNA, 15 bp, Homo sapiens
tagaaacgtcgtgcc

SEQ ID NO: 371014 - DNA, 15 bp, Homo sapiens
agaaacgtcgtgcca

SEQ ID NO: 371015 - DNA, 15 bp, Homo sapiens
gaaacgtcgtgccat

SEQ ID NO: 371016 - DNA, 15 bp, Homo sapiens
aaacgtcgtgccatt

SEQ ID NO: 371017 - DNA, 15 bp, Homo sapiens
aacgtcgtgccattt

SEQ ID NO: 371018 - DNA, 15 bp, Homo sapiens
acgtcgtgccatttt

SEQ ID NO: 371019 - DNA, 15 bp, Homo sapiens
cgtcgtgccattttc

SEQ ID NO: 371020 - DNA, 15 bp, Homo sapiens
gtcgtgccattttct

SEQ ID NO: 371021 - DNA, 15 bp, Homo sapiens
tcgtgccattttctt

SEQ ID NO: 371022 - DNA, 15 bp, Homo sapiens
cgtgccattttcttt

SEQ ID NO: 371023 - DNA, 15 bp, Homo sapiens
gtgccattttcttta

SEQ ID NO: 371024 - DNA, 15 bp, Homo sapiens
tgccattttctttat

SEQ ID NO: 371025 - DNA, 15 bp, Homo sapiens
gccattttctttatt

SEQ ID NO: 371026 - DNA, 15 bp, Homo sapiens
ccattttctttattt

SEQ ID NO: 371027 - DNA, 15 bp, Homo sapiens
cattttctttattta

SEQ ID NO: 371028 - DNA, 15 bp, Homo sapiens
attttctttatttaa

SEQ ID NO: 371029 - DNA, 15 bp, Homo sapiens
ttttctttatttaat

SEQ ID NO: 371030 - DNA, 15 bp, Homo sapiens
tttctttatttaatc

SEQ ID NO: 371031 - DNA, 15 bp, Homo sapiens
ttctttatttaatct

SEQ ID NO: 371032 - DNA, 15 bp, Homo sapiens
tctttatttaatcta

SEQ ID NO: 371033 - DNA, 15 bp, Homo sapiens
ctttatttaatctac

SEQ ID NO: 371034 - DNA, 15 bp, Homo sapiens
tttatttaatctact

SEQ ID NO: 371035 - DNA, 15 bp, Homo sapiens
ttatttaatctactt

SEQ ID NO: 371036 - DNA, 15 bp, Homo sapiens
tatttaatctacttt

SEQ ID NO: 371037 - DNA, 15 bp, Homo sapiens
atttaatctactttc

SEQ ID NO: 371038 - DNA, 15 bp, Homo sapiens
tttaatctactttca

SEQ ID NO: 371039 - DNA, 15 bp, Homo sapiens
ttaatctactttcaa

SEQ ID NO: 371040 - DNA, 15 bp, Homo sapiens
taatctactttcaat

SEQ ID NO: 371041 - DNA, 15 bp, Homo sapiens
aatctactttcaatg

SEQ ID NO: 371042 - DNA, 15 bp, Homo sapiens
atctactttcaatga

SEQ ID NO: 371043 - DNA, 15 bp, Homo sapiens
tctactttcaatgat

SEQ ID NO: 371044 - DNA, 15 bp, Homo sapiens
ctactttcaatgatt

SEQ ID NO: 371045 - DNA, 15 bp, Homo sapiens
tactttcaatgattt

SEQ ID NO: 371046 - DNA, 15 bp, Homo sapiens
actttcaatgatttg

SEQ ID NO: 371047 - DNA, 15 bp, Homo sapiens
ctttcaatgatttgg

SEQ ID NO: 371048 - DNA, 15 bp, Homo sapiens
tttcaatgatttgga

SEQ ID NO: 371049 - DNA, 15 bp, Homo sapiens
ttcaatgatttggaa

SEQ ID NO: 371050 - DNA, 15 bp, Homo sapiens
tcaatgatttggaaa

SEQ ID NO: 371051 - DNA, 15 bp, Homo sapiens
caatgatttggaaag

SEQ ID NO: 371052 - DNA, 15 bp, Homo sapiens
aatgatttggaaaga

SEQ ID NO: 371053 - DNA, 15 bp, Homo sapiens
atgatttggaaagaa

SEQ ID NO: 371054 - DNA, 15 bp, Homo sapiens
tgatttggaaagaac

SEQ ID NO: 371055 - DNA, 15 bp, Homo sapiens
gatttggaaagaaca

SEQ ID NO: 371056 - DNA, 15 bp, Homo sapiens
atttggaaagaacat

SEQ ID NO: 371057 - DNA, 15 bp, Homo sapiens
tttggaaagaacatc

SEQ ID NO: 371058 - DNA, 15 bp, Homo sapiens
ttggaaagaacatct

SEQ ID NO: 371059 - DNA, 15 bp, Homo sapiens
tggaaagaacatctt

SEQ ID NO: 371060 - DNA, 15 bp, Homo sapiens
ggaaagaacatcttc

SEQ ID NO: 371061 - DNA, 15 bp, Homo sapiens
gaaagaacatcttct

SEQ ID NO: 371062 - DNA, 15 bp, Homo sapiens
aaagaacatcttctt

SEQ ID NO: 371063 - DNA, 15 bp, Homo sapiens
aagaacatcttcttt

SEQ ID NO: 371064 - DNA, 15 bp, Homo sapiens
agaacatcttcttta

SEQ ID NO: 371065 - DNA, 15 bp, Homo sapiens
gaacatcttctttaa

SEQ ID NO: 371066 - DNA, 15 bp, Homo sapiens
aacatcttctttaaa

SEQ ID NO: 371067 - DNA, 15 bp, Homo sapiens
acatcttctttaaac

SEQ ID NO: 371068 - DNA, 15 bp, Homo sapiens
catcttctttaaacc

SEQ ID NO: 371069 - DNA, 15 bp, Homo sapiens
atcttctttaaaccc

SEQ ID NO: 371070 - DNA, 15 bp, Homo sapiens
tcttctttaaaccca

SEQ ID NO: 371071 - DNA, 15 bp, Homo sapiens
cttctttaaacccaa

SEQ ID NO: 371072 - DNA, 15 bp, Homo sapiens
ttctttaaacccaag

SEQ ID NO: 371073 - DNA, 15 bp, Homo sapiens
tctttaaacccaaga

SEQ ID NO: 371074 - DNA, 15 bp, Homo sapiens
ctttaaacccaagac

SEQ ID NO: 371075 - DNA, 15 bp, Homo sapiens
tttaaacccaagaca

SEQ ID NO: 371076 - DNA, 15 bp, Homo sapiens
ttaaacccaagacac

SEQ ID NO: 371077 - DNA, 15 bp, Homo sapiens
taaacccaagacaca

SEQ ID NO: 371078 - DNA, 15 bp, Homo sapiens
aaacccaagacacat

SEQ ID NO: 371079 - DNA, 15 bp, Homo sapiens
aacccaagacacatt

SEQ ID NO: 371080 - DNA, 15 bp, Homo sapiens
acccaagacacattt

SEQ ID NO: 371081 - DNA, 15 bp, Homo sapiens
cccaagacacatttg

SEQ ID NO: 371082 - DNA, 15 bp, Homo sapiens
ccaagacacatttgg

SEQ ID NO: 371083 - DNA, 15 bp, Homo sapiens
caagacacatttggc

SEQ ID NO: 371084 - DNA, 15 bp, Homo sapiens
aagacacatttggct

SEQ ID NO: 371085 - DNA, 15 bp, Homo sapiens
agacacatttggctg

SEQ ID NO: 371086 - DNA, 15 bp, Homo sapiens
gacacatttggctgc

SEQ ID NO: 371087 - DNA, 15 bp, Homo sapiens
acacatttggctgcc

SEQ ID NO: 371088 - DNA, 15 bp, Homo sapiens
cacatttggctgccc

SEQ ID NO: 371089 - DNA, 15 bp, Homo sapiens
acatttggctgccca

SEQ ID NO: 371090 - DNA, 15 bp, Homo sapiens
catttggctgcccag

SEQ ID NO: 371091 - DNA, 15 bp, Homo sapiens
atttggctgcccagt

SEQ ID NO: 371092 - DNA, 15 bp, Homo sapiens
tttggctgcccagtg

SEQ ID NO: 371093 - DNA, 15 bp, Homo sapiens
ttggctgcccagtgt

SEQ ID NO: 371094 - DNA, 15 bp, Homo sapiens
tggctgcccagtgtg

SEQ ID NO: 371095 - DNA, 15 bp, Homo sapiens
ggctgcccagtgtgg

SEQ ID NO: 371096 - DNA, 15 bp, Homo sapiens
gctgcccagtgtggg

SEQ ID NO: 371097 - DNA, 15 bp, Homo sapiens
ctgcccagtgtgggt

SEQ ID NO: 371098 - DNA, 15 bp, Homo sapiens
tgcccagtgtgggta

SEQ ID NO: 371099 - DNA, 15 bp, Homo sapiens
gcccagtgtgggtaa

SEQ ID NO: 371100 - DNA, 15 bp, Homo sapiens
cccagtgtgggtaag

SEQ ID NO: 371101 - DNA, 15 bp, Homo sapiens
ccagtgtgggtaagg

SEQ ID NO: 371102 - DNA, 15 bp, Homo sapiens
cagtgtgggtaaggc

SEQ ID NO: 371103 - DNA, 15 bp, Homo sapiens
agtgtgggtaaggca

SEQ ID NO: 371104 - DNA, 15 bp, Homo sapiens
gtgtgggtaaggcat

SEQ ID NO: 371105 - DNA, 15 bp, Homo sapiens
tgtgggtaaggcatt

SEQ ID NO: 371106 - DNA, 15 bp, Homo sapiens
gtgggtaaggcattt

SEQ ID NO: 371107 - DNA, 15 bp, Homo sapiens
tgggtaaggcatttg

SEQ ID NO: 371108 - DNA, 15 bp, Homo sapiens
gggtaaggcatttgt

SEQ ID NO: 371109 - DNA, 15 bp, Homo sapiens
ggtaaggcatttgtt

SEQ ID NO: 371110 - DNA, 15 bp, Homo sapiens
gtaaggcatttgttc

SEQ ID NO: 371111 - DNA, 15 bp, Homo sapiens
taaggcatttgttct

SEQ ID NO: 371112 - DNA, 15 bp, Homo sapiens
aaggcatttgttctc

SEQ ID NO: 371113 - DNA, 15 bp, Homo sapiens
aggcatttgttctcg

SEQ ID NO: 371114 - DNA, 15 bp, Homo sapiens
ggcatttgttctcgc

SEQ ID NO: 371115 - DNA, 15 bp, Homo sapiens
gcatttgttctcgcg

SEQ ID NO: 371116 - DNA, 15 bp, Homo sapiens
catttgttctcgcgg

SEQ ID NO: 371117 - DNA, 15 bp, Homo sapiens
atttgttctcgcggc

SEQ ID NO: 371118 - DNA, 15 bp, Homo sapiens
tttgttctcgcggca

SEQ ID NO: 371119 - DNA, 15 bp, Homo sapiens
ttgttctcgcggcag

SEQ ID NO: 371120 - DNA, 15 bp, Homo sapiens
tgttctcgcggcaga

SEQ ID NO: 371121 - DNA, 15 bp, Homo sapiens
gttctcgcggcagat

SEQ ID NO: 371122 - DNA, 15 bp, Homo sapiens
ttctcgcggcagata

SEQ ID NO: 371123 - DNA, 15 bp, Homo sapiens
tctcgcggcagataa

SEQ ID NO: 371124 - DNA, 15 bp, Homo sapiens
ctcgcggcagataag

SEQ ID NO: 371125 - DNA, 15 bp, Homo sapiens
tcgcggcagataagg

SEQ ID NO: 371126 - DNA, 15 bp, Homo sapiens
cgcggcagataaggc

SEQ ID NO: 371127 - DNA, 15 bp, Homo sapiens
gcggcagataaggct

SEQ ID NO: 371128 - DNA, 15 bp, Homo sapiens
cggcagataaggctg

SEQ ID NO: 371129 - DNA, 15 bp, Homo sapiens
ggcagataaggctgg

SEQ ID NO: 371130 - DNA, 15 bp, Homo sapiens
gcagataaggctggc

SEQ ID NO: 371131 - DNA, 15 bp, Homo sapiens
cagataaggctggcc

SEQ ID NO: 371132 - DNA, 15 bp, Homo sapiens
agataaggctggcct

SEQ ID NO: 371133 - DNA, 15 bp, Homo sapiens
gataaggctggcctt

SEQ ID NO: 371134 - DNA, 15 bp, Homo sapiens
ataaggctggccttt

SEQ ID NO: 371135 - DNA, 15 bp, Homo sapiens
taaggctggcctttc

SEQ ID NO: 371136 - DNA, 15 bp, Homo sapiens
aaggctggcctttct

SEQ ID NO: 371137 - DNA, 15 bp, Homo sapiens
aggctggcctttctc

SEQ ID NO: 371138 - DNA, 15 bp, Homo sapiens
ggctggcctttctct

SEQ ID NO: 371139 - DNA, 15 bp, Homo sapiens
gctggcctttctctg

SEQ ID NO: 371140 - DNA, 15 bp, Homo sapiens
ctggcctttctctgg

SEQ ID NO: 371141 - DNA, 15 bp, Homo sapiens
tggcctttctctgga

SEQ ID NO: 371142 - DNA, 15 bp, Homo sapiens
ggcctttctctggac

SEQ ID NO: 371143 - DNA, 15 bp, Homo sapiens
gcctttctctggact

SEQ ID NO: 371144 - DNA, 15 bp, Homo sapiens
cctttctctggactc

SEQ ID NO: 371145 - DNA, 15 bp, Homo sapiens
ctttctctggactcc

SEQ ID NO: 371146 - DNA, 15 bp, Homo sapiens
tttctctggactcca

SEQ ID NO: 371147 - DNA, 15 bp, Homo sapiens
ttctctggactccag

SEQ ID NO: 371148 - DNA, 15 bp, Homo sapiens
tctctggactccagt

SEQ ID NO: 371149 - DNA, 15 bp, Homo sapiens
ctctggactccagtg

SEQ ID NO: 371150 - DNA, 15 bp, Homo sapiens
tctggactccagtgc

SEQ ID NO: 371151 - DNA, 15 bp, Homo sapiens
ctggactccagtgct

SEQ ID NO: 371152 - DNA, 15 bp, Homo sapiens
tggactccagtgcta

SEQ ID NO: 371153 - DNA, 15 bp, Homo sapiens
ggactccagtgctac

SEQ ID NO: 371154 - DNA, 15 bp, Homo sapiens
gactccagtgctacc

SEQ ID NO: 371155 - DNA, 15 bp, Homo sapiens
actccagtgctacct

SEQ ID NO: 371156 - DNA, 15 bp, Homo sapiens
ctccagtgctacctg

SEQ ID NO: 371157 - DNA, 15 bp, Homo sapiens
tccagtgctacctgg

SEQ ID NO: 371158 - DNA, 15 bp, Homo sapiens
ccagtgctacctggg

SEQ ID NO: 371159 - DNA, 15 bp, Homo sapiens
cagtgctacctgggc

SEQ ID NO: 371160 - DNA, 15 bp, Homo sapiens
agtgctacctgggca

SEQ ID NO: 371161 - DNA, 15 bp, Homo sapiens
gtgctacctgggcat

SEQ ID NO: 371162 - DNA, 15 bp, Homo sapiens
tgctacctgggcatc

SEQ ID NO: 371163 - DNA, 15 bp, Homo sapiens
gctacctgggcatcc

SEQ ID NO: 371164 - DNA, 15 bp, Homo sapiens
ctacctgggcatcca

SEQ ID NO: 371165 - DNA, 15 bp, Homo sapiens
tacctgggcatccac

SEQ ID NO: 371166 - DNA, 15 bp, Homo sapiens
acctgggcatccaca

SEQ ID NO: 371167 - DNA, 15 bp, Homo sapiens
cctgggcatccacag

SEQ ID NO: 371168 - DNA, 15 bp, Homo sapiens
ctgggcatccacagg

SEQ ID NO: 371169 - DNA, 15 bp, Homo sapiens
tgggcatccacaggt

SEQ ID NO: 371170 - DNA, 15 bp, Homo sapiens
gggcatccacaggtc

SEQ ID NO: 371171 - DNA, 15 bp, Homo sapiens
ggcatccacaggtcc

SEQ ID NO: 371172 - DNA, 15 bp, Homo sapiens
gcatccacaggtcct

SEQ ID NO: 371173 - DNA, 15 bp, Homo sapiens
catccacaggtcctg

SEQ ID NO: 371174 - DNA, 15 bp, Homo sapiens
atccacaggtcctgc

SEQ ID NO: 371175 - DNA, 15 bp, Homo sapiens
tccacaggtcctgcc

SEQ ID NO: 371176 - DNA, 15 bp, Homo sapiens
ccacaggtcctgccg

SEQ ID NO: 371177 - DNA, 15 bp, Homo sapiens
cacaggtcctgccga

SEQ ID NO: 371178 - DNA, 15 bp, Homo sapiens
acaggtcctgccgaa

SEQ ID NO: 371179 - DNA, 15 bp, Homo sapiens
caggtcctgccgaag

SEQ ID NO: 371180 - DNA, 15 bp, Homo sapiens
aggtcctgccgaagg

SEQ ID NO: 371181 - DNA, 15 bp, Homo sapiens
ggtcctgccgaaggg

SEQ ID NO: 371182 - DNA, 15 bp, Homo sapiens
gtcctgccgaaggga

SEQ ID NO: 371183 - DNA, 15 bp, Homo sapiens
tcctgccgaagggaa

SEQ ID NO: 371184 - DNA, 15 bp, Homo sapiens
cctgccgaagggaag

SEQ ID NO: 371185 - DNA, 15 bp, Homo sapiens
ctgccgaagggaaga

SEQ ID NO: 371186 - DNA, 15 bp, Homo sapiens
tgccgaagggaagat

SEQ ID NO: 371187 - DNA, 15 bp, Homo sapiens
gccgaagggaagatg

SEQ ID NO: 371188 - DNA, 15 bp, Homo sapiens
ccgaagggaagatga

SEQ ID NO: 371189 - DNA, 15 bp, Homo sapiens
cgaagggaagatgag

SEQ ID NO: 371190 - DNA, 15 bp, Homo sapiens
gaagggaagatgaga

SEQ ID NO: 371191 - DNA, 15 bp, Homo sapiens
aagggaagatgagag

SEQ ID NO: 371192 - DNA, 15 bp, Homo sapiens
agggaagatgagagg

SEQ ID NO: 371193 - DNA, 15 bp, Homo sapiens
gggaagatgagaggc

SEQ ID NO: 371194 - DNA, 15 bp, Homo sapiens
ggaagatgagaggct

SEQ ID NO: 371195 - DNA, 15 bp, Homo sapiens
gaagatgagaggcta

SEQ ID NO: 371196 - DNA, 15 bp, Homo sapiens
aagatgagaggctag

SEQ ID NO: 371197 - DNA, 15 bp, Homo sapiens
agatgagaggctagg

SEQ ID NO: 371198 - DNA, 15 bp, Homo sapiens
gatgagaggctaggt

SEQ ID NO: 371199 - DNA, 15 bp, Homo sapiens
atgagaggctaggtg

SEQ ID NO: 371200 - DNA, 15 bp, Homo sapiens
tgagaggctaggtgc

SEQ ID NO: 371201 - DNA, 15 bp, Homo sapiens
gagaggctaggtgca

SEQ ID NO: 371202 - DNA, 15 bp, Homo sapiens
agaggctaggtgcaa

SEQ ID NO: 371203 - DNA, 15 bp, Homo sapiens
gaggctaggtgcaaa

SEQ ID NO: 371204 - DNA, 15 bp, Homo sapiens
aggctaggtgcaaaa

SEQ ID NO: 371205 - DNA, 15 bp, Homo sapiens
ggctaggtgcaaaaa

SEQ ID NO: 371206 - DNA, 15 bp, Homo sapiens
gctaggtgcaaaaac

SEQ ID NO: 371207 - DNA, 15 bp, Homo sapiens
ctaggtgcaaaaact

SEQ ID NO: 371208 - DNA, 15 bp, Homo sapiens
taggtgcaaaaactg

SEQ ID NO: 371209 - DNA, 15 bp, Homo sapiens
aggtgcaaaaactgg

SEQ ID NO: 371210 - DNA, 15 bp, Homo sapiens
ggtgcaaaaactggg

SEQ ID NO: 371211 - DNA, 15 bp, Homo sapiens
gtgcaaaaactgggg

SEQ ID NO: 371212 - DNA, 15 bp, Homo sapiens
tgcaaaaactgggga

SEQ ID NO: 371213 - DNA, 15 bp, Homo sapiens
gcaaaaactggggac

SEQ ID NO: 371214 - DNA, 15 bp, Homo sapiens
caaaaactggggact

SEQ ID NO: 371215 - DNA, 15 bp, Homo sapiens
aaaaactggggacta

SEQ ID NO: 371216 - DNA, 15 bp, Homo sapiens
aaaactggggactag

SEQ ID NO: 371217 - DNA, 15 bp, Homo sapiens
aaactggggactagt

SEQ ID NO: 371218 - DNA, 15 bp, Homo sapiens
aactggggactagtt

SEQ ID NO: 371219 - DNA, 15 bp, Homo sapiens
actggggactagttt

SEQ ID NO: 371220 - DNA, 15 bp, Homo sapiens
ctggggactagtttt

SEQ ID NO: 371221 - DNA, 15 bp, Homo sapiens
tggggactagttttc

SEQ ID NO: 371222 - DNA, 15 bp, Homo sapiens
ggggactagttttct

SEQ ID NO: 371223 - DNA, 15 bp, Homo sapiens
gggactagttttctg

SEQ ID NO: 371224 - DNA, 15 bp, Homo sapiens
ggactagttttctgg

SEQ ID NO: 371225 - DNA, 15 bp, Homo sapiens
gactagttttctggg

SEQ ID NO: 371226 - DNA, 15 bp, Homo sapiens
actagttttctgggt

SEQ ID NO: 371227 - DNA, 15 bp, Homo sapiens
ctagttttctgggtc

SEQ ID NO: 371228 - DNA, 15 bp, Homo sapiens
tagttttctgggtcc

SEQ ID NO: 371229 - DNA, 15 bp, Homo sapiens
agttttctgggtcca

SEQ ID NO: 371230 - DNA, 15 bp, Homo sapiens
gttttctgggtccag

SEQ ID NO: 371231 - DNA, 15 bp, Homo sapiens
ttttctgggtccagg

SEQ ID NO: 371232 - DNA, 15 bp, Homo sapiens
tttctgggtccaggc

SEQ ID NO: 371233 - DNA, 15 bp, Homo sapiens
ttctgggtccaggca

SEQ ID NO: 371234 - DNA, 15 bp, Homo sapiens
tctgggtccaggcag

SEQ ID NO: 371235 - DNA, 15 bp, Homo sapiens
ctgggtccaggcagc

SEQ ID NO: 371236 - DNA, 15 bp, Homo sapiens
tgggtccaggcagct

SEQ ID NO: 371237 - DNA, 15 bp, Homo sapiens
gggtccaggcagctt

SEQ ID NO: 371238 - DNA, 15 bp, Homo sapiens
ggtccaggcagcttt

SEQ ID NO: 371239 - DNA, 15 bp, Homo sapiens
gtccaggcagctttt

SEQ ID NO: 371240 - DNA, 15 bp, Homo sapiens
tccaggcagcttttc

SEQ ID NO: 371241 - DNA, 15 bp, Homo sapiens
ccaggcagcttttca

SEQ ID NO: 371242 - DNA, 15 bp, Homo sapiens
caggcagcttttcag

SEQ ID NO: 371243 - DNA, 15 bp, Homo sapiens
aggcagcttttcagg

SEQ ID NO: 371244 - DNA, 15 bp, Homo sapiens
ggcagcttttcagga

SEQ ID NO: 371245 - DNA, 15 bp, Homo sapiens
gcagcttttcaggaa

SEQ ID NO: 371246 - DNA, 15 bp, Homo sapiens
cagcttttcaggaaa

SEQ ID NO: 371247 - DNA, 15 bp, Homo sapiens
agcttttcaggaaat

SEQ ID NO: 371248 - DNA, 15 bp, Homo sapiens
gcttttcaggaaatc

SEQ ID NO: 371249 - DNA, 15 bp, Homo sapiens
cttttcaggaaatca

SEQ ID NO: 371250 - DNA, 15 bp, Homo sapiens
ttttcaggaaatcag

SEQ ID NO: 371251 - DNA, 15 bp, Homo sapiens
tttcaggaaatcagc

SEQ ID NO: 371252 - DNA, 15 bp, Homo sapiens
ttcaggaaatcagct

SEQ ID NO: 371253 - DNA, 15 bp, Homo sapiens
tcaggaaatcagcta

SEQ ID NO: 371254 - DNA, 15 bp, Homo sapiens
caggaaatcagctat

SEQ ID NO: 371255 - DNA, 15 bp, Homo sapiens
aggaaatcagctata

SEQ ID NO: 371256 - DNA, 15 bp, Homo sapiens
ggaaatcagctataa

SEQ ID NO: 371257 - DNA, 15 bp, Homo sapiens
gaaatcagctataac

SEQ ID NO: 371258 - DNA, 15 bp, Homo sapiens
aaatcagctataact

SEQ ID NO: 371259 - DNA, 15 bp, Homo sapiens
aatcagctataactt

SEQ ID NO: 371260 - DNA, 15 bp, Homo sapiens
atcagctataacttg

SEQ ID NO: 371261 - DNA, 15 bp, Homo sapiens
tcagctataacttgt

SEQ ID NO: 371262 - DNA, 15 bp, Homo sapiens
cagctataacttgtt

SEQ ID NO: 371263 - DNA, 15 bp, Homo sapiens
agctataacttgttg

SEQ ID NO: 371264 - DNA, 15 bp, Homo sapiens
gctataacttgttgt

SEQ ID NO: 371265 - DNA, 15 bp, Homo sapiens
ctataacttgttgtg

SEQ ID NO: 371266 - DNA, 15 bp, Homo sapiens
tataacttgttgtgt

SEQ ID NO: 371267 - DNA, 15 bp, Homo sapiens
ataacttgttgtgtt

SEQ ID NO: 371268 - DNA, 15 bp, Homo sapiens
taacttgttgtgtta

SEQ ID NO: 371269 - DNA, 15 bp, Homo sapiens
aacttgttgtgttaa

SEQ ID NO: 371270 - DNA, 15 bp, Homo sapiens
acttgttgtgttaac

SEQ ID NO: 371271 - DNA, 15 bp, Homo sapiens
cttgttgtgttaaca

SEQ ID NO: 371272 - DNA, 15 bp, Homo sapiens
ttgttgtgttaacat

SEQ ID NO: 371273 - DNA, 15 bp, Homo sapiens
tgttgtgttaacatg

SEQ ID NO: 371274 - DNA, 15 bp, Homo sapiens
gttgtgttaacatga

SEQ ID NO: 371275 - DNA, 15 bp, Homo sapiens
ttgtgttaacatgag

SEQ ID NO: 371276 - DNA, 15 bp, Homo sapiens
tgtgttaacatgagc

SEQ ID NO: 371277 - DNA, 15 bp, Homo sapiens
gtgttaacatgagct

SEQ ID NO: 371278 - DNA, 15 bp, Homo sapiens
tgttaacatgagctt

SEQ ID NO: 371279 - DNA, 15 bp, Homo sapiens
gttaacatgagcttg

SEQ ID NO: 371280 - DNA, 15 bp, Homo sapiens
ttaacatgagcttgg

SEQ ID NO: 371281 - DNA, 15 bp, Homo sapiens
taacatgagcttggt

SEQ ID NO: 371282 - DNA, 15 bp, Homo sapiens
aacatgagcttggtt

SEQ ID NO: 371283 - DNA, 15 bp, Homo sapiens
acatgagcttggtta

SEQ ID NO: 371284 - DNA, 15 bp, Homo sapiens
catgagcttggttaa

SEQ ID NO: 371285 - DNA, 15 bp, Homo sapiens
atgagcttggttaac

SEQ ID NO: 371286 - DNA, 15 bp, Homo sapiens
tgagcttggttaaca

SEQ ID NO: 371287 - DNA, 15 bp, Homo sapiens
gagcttggttaacat

SEQ ID NO: 371288 - DNA, 15 bp, Homo sapiens
agcttggttaacata

SEQ ID NO: 371289 - DNA, 15 bp, Homo sapiens
gcttggttaacatat

SEQ ID NO: 371290 - DNA, 15 bp, Homo sapiens
cttggttaacatatg

SEQ ID NO: 371291 - DNA, 15 bp, Homo sapiens
ttggttaacatatgt

SEQ ID NO: 371292 - DNA, 15 bp, Homo sapiens
tggttaacatatgta

SEQ ID NO: 371293 - DNA, 15 bp, Homo sapiens
ggttaacatatgtaa

SEQ ID NO: 371294 - DNA, 15 bp, Homo sapiens
gttaacatatgtaat

SEQ ID NO: 371295 - DNA, 15 bp, Homo sapiens
ttaacatatgtaatt

SEQ ID NO: 371296 - DNA, 15 bp, Homo sapiens
taacatatgtaatta

SEQ ID NO: 371297 - DNA, 15 bp, Homo sapiens
aacatatgtaattag

SEQ ID NO: 371298 - DNA, 15 bp, Homo sapiens
acatatgtaattaga

SEQ ID NO: 371299 - DNA, 15 bp, Homo sapiens
catatgtaattagac

SEQ ID NO: 371300 - DNA, 15 bp, Homo sapiens
atatgtaattagacc

SEQ ID NO: 371301 - DNA, 15 bp, Homo sapiens
tatgtaattagaccc

SEQ ID NO: 371302 - DNA, 15 bp, Homo sapiens
atgtaattagaccct

SEQ ID NO: 371303 - DNA, 15 bp, Homo sapiens
tgtaattagaccctg

SEQ ID NO: 371304 - DNA, 15 bp, Homo sapiens
gtaattagaccctga

SEQ ID NO: 371305 - DNA, 15 bp, Homo sapiens
taattagaccctgat

SEQ ID NO: 371306 - DNA, 15 bp, Homo sapiens
aattagaccctgatc

SEQ ID NO: 371307 - DNA, 15 bp, Homo sapiens
attagaccctgatca

SEQ ID NO: 371308 - DNA, 15 bp, Homo sapiens
ttagaccctgatcat

SEQ ID NO: 371309 - DNA, 15 bp, Homo sapiens
tagaccctgatcatg

SEQ ID NO: 371310 - DNA, 15 bp, Homo sapiens
agaccctgatcatga

SEQ ID NO: 371311 - DNA, 15 bp, Homo sapiens
gaccctgatcatgac

SEQ ID NO: 371312 - DNA, 15 bp, Homo sapiens
accctgatcatgact

SEQ ID NO: 371313 - DNA, 15 bp, Homo sapiens
ccctgatcatgactg

SEQ ID NO: 371314 - DNA, 15 bp, Homo sapiens
cctgatcatgactga

SEQ ID NO: 371315 - DNA, 15 bp, Homo sapiens
ctgatcatgactgag

SEQ ID NO: 371316 - DNA, 15 bp, Homo sapiens
tgatcatgactgaga

SEQ ID NO: 371317 - DNA, 15 bp, Homo sapiens
gatcatgactgagaa

SEQ ID NO: 371318 - DNA, 15 bp, Homo sapiens
atcatgactgagaac

SEQ ID NO: 371319 - DNA, 15 bp, Homo sapiens
tcatgactgagaaca

SEQ ID NO: 371320 - DNA, 15 bp, Homo sapiens
catgactgagaacaa

SEQ ID NO: 371321 - DNA, 15 bp, Homo sapiens
atgactgagaacaaa

SEQ ID NO: 371322 - DNA, 15 bp, Homo sapiens
tgactgagaacaaaa

SEQ ID NO: 371323 - DNA, 15 bp, Homo sapiens
gactgagaacaaaag

SEQ ID NO: 371324 - DNA, 15 bp, Homo sapiens
actgagaacaaaagg

SEQ ID NO: 371325 - DNA, 15 bp, Homo sapiens
ctgagaacaaaaggc

SEQ ID NO: 371326 - DNA, 15 bp, Homo sapiens
tgagaacaaaaggct

SEQ ID NO: 371327 - DNA, 15 bp, Homo sapiens
gagaacaaaaggctt

SEQ ID NO: 371328 - DNA, 15 bp, Homo sapiens
agaacaaaaggctta

SEQ ID NO: 371329 - DNA, 15 bp, Homo sapiens
gaacaaaaggcttag

SEQ ID NO: 371330 - DNA, 15 bp, Homo sapiens
aacaaaaggcttaga

SEQ ID NO: 371331 - DNA, 15 bp, Homo sapiens
acaaaaggcttagat

SEQ ID NO: 371332 - DNA, 15 bp, Homo sapiens
caaaaggcttagata

SEQ ID NO: 371333 - DNA, 15 bp, Homo sapiens
aaaaggcttagatat

SEQ ID NO: 371334 - DNA, 15 bp, Homo sapiens
aaaggcttagatatc

SEQ ID NO: 371335 - DNA, 15 bp, Homo sapiens
aaggcttagatatcc

SEQ ID NO: 371336 - DNA, 15 bp, Homo sapiens
aggcttagatatcct

SEQ ID NO: 371337 - DNA, 15 bp, Homo sapiens
ggcttagatatcctg

SEQ ID NO: 371338 - DNA, 15 bp, Homo sapiens
gcttagatatcctgg

SEQ ID NO: 371339 - DNA, 15 bp, Homo sapiens
cttagatatcctggg

SEQ ID NO: 371340 - DNA, 15 bp, Homo sapiens
ttagatatcctggga

SEQ ID NO: 371341 - DNA, 15 bp, Homo sapiens
tagatatcctgggaa

SEQ ID NO: 371342 - DNA, 15 bp, Homo sapiens
agatatcctgggaag

SEQ ID NO: 371343 - DNA, 15 bp, Homo sapiens
gatatcctgggaagc

SEQ ID NO: 371344 - DNA, 15 bp, Homo sapiens
atatcctgggaagca

SEQ ID NO: 371345 - DNA, 15 bp, Homo sapiens
tatcctgggaagcag

SEQ ID NO: 371346 - DNA, 15 bp, Homo sapiens
atcctgggaagcagg

SEQ ID NO: 371347 - DNA, 15 bp, Homo sapiens
tcctgggaagcaggt

SEQ ID NO: 371348 - DNA, 15 bp, Homo sapiens
cctgggaagcaggtg

SEQ ID NO: 371349 - DNA, 15 bp, Homo sapiens
ctgggaagcaggtgg

SEQ ID NO: 371350 - DNA, 15 bp, Homo sapiens
tgggaagcaggtggg

SEQ ID NO: 371351 - DNA, 15 bp, Homo sapiens
gggaagcaggtgggg

SEQ ID NO: 371352 - DNA, 15 bp, Homo sapiens
ggaagcaggtggggg

SEQ ID NO: 371353 - DNA, 15 bp, Homo sapiens
gaagcaggtggggga

SEQ ID NO: 371354 - DNA, 15 bp, Homo sapiens
aagcaggtgggggat

SEQ ID NO: 371355 - DNA, 15 bp, Homo sapiens
agcaggtgggggatg

SEQ ID NO: 371356 - DNA, 15 bp, Homo sapiens
gcaggtgggggatgg

SEQ ID NO: 371357 - DNA, 15 bp, Homo sapiens
caggtgggggatgga

SEQ ID NO: 371358 - DNA, 15 bp, Homo sapiens
aggtgggggatggat

SEQ ID NO: 371359 - DNA, 15 bp, Homo sapiens
ggtgggggatggata

SEQ ID NO: 371360 - DNA, 15 bp, Homo sapiens
gtgggggatggatat

SEQ ID NO: 371361 - DNA, 15 bp, Homo sapiens
tgggggatggatatt

SEQ ID NO: 371362 - DNA, 15 bp, Homo sapiens
gggggatggatattt

SEQ ID NO: 371363 - DNA, 15 bp, Homo sapiens
ggggatggatattta

SEQ ID NO: 371364 - DNA, 15 bp, Homo sapiens
gggatggatatttag

SEQ ID NO: 371365 - DNA, 15 bp, Homo sapiens
ggatggatatttaga

SEQ ID NO: 371366 - DNA, 15 bp, Homo sapiens
gatggatatttagaa

SEQ ID NO: 371367 - DNA, 15 bp, Homo sapiens
atggatatttagaag

SEQ ID NO: 371368 - DNA, 15 bp, Homo sapiens
tggatatttagaagc

SEQ ID NO: 371369 - DNA, 15 bp, Homo sapiens
ggatatttagaagca

SEQ ID NO: 371370 - DNA, 15 bp, Homo sapiens
gatatttagaagcat

SEQ ID NO: 371371 - DNA, 15 bp, Homo sapiens
atatttagaagcatt

SEQ ID NO: 371372 - DNA, 15 bp, Homo sapiens
tatttagaagcattc

SEQ ID NO: 371373 - DNA, 15 bp, Homo sapiens
atttagaagcattct

SEQ ID NO: 371374 - DNA, 15 bp, Homo sapiens
tttagaagcattctc

SEQ ID NO: 371375 - DNA, 15 bp, Homo sapiens
ttagaagcattctcc

SEQ ID NO: 371376 - DNA, 15 bp, Homo sapiens
tagaagcattctcca

SEQ ID NO: 371377 - DNA, 15 bp, Homo sapiens
agaagcattctccaa

SEQ ID NO: 371378 - DNA, 15 bp, Homo sapiens
gaagcattctccaac

SEQ ID NO: 371379 - DNA, 15 bp, Homo sapiens
aagcattctccaacc

SEQ ID NO: 371380 - DNA, 15 bp, Homo sapiens
agcattctccaacct

SEQ ID NO: 371381 - DNA, 15 bp, Homo sapiens
gcattctccaaccta

SEQ ID NO: 371382 - DNA, 15 bp, Homo sapiens
cattctccaacctag

SEQ ID NO: 371383 - DNA, 15 bp, Homo sapiens
attctccaacctagg

SEQ ID NO: 371384 - DNA, 15 bp, Homo sapiens
ttctccaacctagga

SEQ ID NO: 371385 - DNA, 15 bp, Homo sapiens
tctccaacctaggag

SEQ ID NO: 371386 - DNA, 15 bp, Homo sapiens
ctccaacctaggaga

SEQ ID NO: 371387 - DNA, 15 bp, Homo sapiens
tccaacctaggagac

SEQ ID NO: 371388 - DNA, 15 bp, Homo sapiens
ccaacctaggagaca

SEQ ID NO: 371389 - DNA, 15 bp, Homo sapiens
caacctaggagacaa

SEQ ID NO: 371390 - DNA, 15 bp, Homo sapiens
aacctaggagacaaa

SEQ ID NO: 371391 - DNA, 15 bp, Homo sapiens
acctaggagacaaat

SEQ ID NO: 371392 - DNA, 15 bp, Homo sapiens
cctaggagacaaata

SEQ ID NO: 371393 - DNA, 15 bp, Homo sapiens
ctaggagacaaatac

SEQ ID NO: 371394 - DNA, 15 bp, Homo sapiens
taggagacaaatact

SEQ ID NO: 371395 - DNA, 15 bp, Homo sapiens
aggagacaaatactt

SEQ ID NO: 371396 - DNA, 15 bp, Homo sapiens
ggagacaaatacttc

SEQ ID NO: 371397 - DNA, 15 bp, Homo sapiens
agacaaatacttctc

SEQ ID NO: 371398 - DNA, 15 bp, Homo sapiens
gacaaatacttctca

SEQ ID NO: 371399 - DNA, 15 bp, Homo sapiens
acaaatacttctcac

SEQ ID NO: 371400 - DNA, 15 bp, Homo sapiens
caaatacttctcact

SEQ ID NO: 371401 - DNA, 15 bp, Homo sapiens
aaatacttctcactt

SEQ ID NO: 371402 - DNA, 15 bp, Homo sapiens
aatacttctcacttg

SEQ ID NO: 371403 - DNA, 15 bp, Homo sapiens
atacttctcacttgg

SEQ ID NO: 371404 - DNA, 15 bp, Homo sapiens
tacttctcacttgga

SEQ ID NO: 371405 - DNA, 15 bp, Homo sapiens
acttctcacttggat

SEQ ID NO: 371406 - DNA, 15 bp, Homo sapiens
cttctcacttggatg

SEQ ID NO: 371407 - DNA, 15 bp, Homo sapiens
ttctcacttggatgt

SEQ ID NO: 371408 - DNA, 15 bp, Homo sapiens
tctcacttggatgtg

SEQ ID NO: 371409 - DNA, 15 bp, Homo sapiens
ctcacttggatgtgg

SEQ ID NO: 371410 - DNA, 15 bp, Homo sapiens
tcacttggatgtgga

SEQ ID NO: 371411 - DNA, 15 bp, Homo sapiens
cacttggatgtggag

SEQ ID NO: 371412 - DNA, 15 bp, Homo sapiens
acttggatgtggaga

SEQ ID NO: 371413 - DNA, 15 bp, Homo sapiens
cttggatgtggagaa

SEQ ID NO: 371414 - DNA, 15 bp, Homo sapiens
ttggatgtggagaaa

SEQ ID NO: 371415 - DNA, 15 bp, Homo sapiens
tggatgtggagaaag

SEQ ID NO: 371416 - DNA, 15 bp, Homo sapiens
ggatgtggagaaaga

SEQ ID NO: 371417 - DNA, 15 bp, Homo sapiens
gatgtggagaaagaa

SEQ ID NO: 371418 - DNA, 15 bp, Homo sapiens
atgtggagaaagaag

SEQ ID NO: 371419 - DNA, 15 bp, Homo sapiens
tgtggagaaagaaga

SEQ ID NO: 371420 - DNA, 15 bp, Homo sapiens
gtggagaaagaagaa

SEQ ID NO: 371421 - DNA, 15 bp, Homo sapiens
tggagaaagaagaat

SEQ ID NO: 371422 - DNA, 15 bp, Homo sapiens
ggagaaagaagaatg

SEQ ID NO: 371423 - DNA, 15 bp, Homo sapiens
gagaaagaagaatgt

SEQ ID NO: 371424 - DNA, 15 bp, Homo sapiens
agaaagaagaatgtt

SEQ ID NO: 371425 - DNA, 15 bp, Homo sapiens
gaaagaagaatgttt

SEQ ID NO: 371426 - DNA, 15 bp, Homo sapiens
aaagaagaatgtttt

SEQ ID NO: 371427 - DNA, 15 bp, Homo sapiens
aagaagaatgttttc

SEQ ID NO: 371428 - DNA, 15 bp, Homo sapiens
agaagaatgttttct

SEQ ID NO: 371429 - DNA, 15 bp, Homo sapiens
gaagaatgttttctc

SEQ ID NO: 371430 - DNA, 15 bp, Homo sapiens
aagaatgttttctca

SEQ ID NO: 371431 - DNA, 15 bp, Homo sapiens
agaatgttttctcac

SEQ ID NO: 371432 - DNA, 15 bp, Homo sapiens
gaatgttttctcact

SEQ ID NO: 371433 - DNA, 15 bp, Homo sapiens
aatgttttctcacta

SEQ ID NO: 371434 - DNA, 15 bp, Homo sapiens
atgttttctcactat

SEQ ID NO: 371435 - DNA, 15 bp, Homo sapiens
tgttttctcactatt

SEQ ID NO: 371436 - DNA, 15 bp, Homo sapiens
gttttctcactattt

SEQ ID NO: 371437 - DNA, 15 bp, Homo sapiens
ttttctcactatttc

SEQ ID NO: 371438 - DNA, 15 bp, Homo sapiens
tttctcactatttcc

SEQ ID NO: 371439 - DNA, 15 bp, Homo sapiens
ttctcactatttcct

SEQ ID NO: 371440 - DNA, 15 bp, Homo sapiens
tctcactatttcctt

SEQ ID NO: 371441 - DNA, 15 bp, Homo sapiens
ctcactatttccttc

SEQ ID NO: 371442 - DNA, 15 bp, Homo sapiens
tcactatttccttct

SEQ ID NO: 371443 - DNA, 15 bp, Homo sapiens
cactatttccttctc

SEQ ID NO: 371444 - DNA, 15 bp, Homo sapiens
actatttccttctct

SEQ ID NO: 371445 - DNA, 15 bp, Homo sapiens
ctatttccttctctc

SEQ ID NO: 371446 - DNA, 15 bp, Homo sapiens
tatttccttctctct

SEQ ID NO: 371447 - DNA, 15 bp, Homo sapiens
atttccttctctctt

SEQ ID NO: 371448 - DNA, 15 bp, Homo sapiens
tttccttctctcttt

SEQ ID NO: 371449 - DNA, 15 bp, Homo sapiens
ttccttctctcttta

SEQ ID NO: 371450 - DNA, 15 bp, Homo sapiens
tccttctctctttat

SEQ ID NO: 371451 - DNA, 15 bp, Homo sapiens
ccttctctctttatc

SEQ ID NO: 371452 - DNA, 15 bp, Homo sapiens
cttctctctttatcc

SEQ ID NO: 371453 - DNA, 15 bp, Homo sapiens
ttctctctttatcca

SEQ ID NO: 371454 - DNA, 15 bp, Homo sapiens
tctctctttatccag

SEQ ID NO: 371455 - DNA, 15 bp, Homo sapiens
ctctctttatccaga

SEQ ID NO: 371456 - DNA, 15 bp, Homo sapiens
tctctttatccagat

SEQ ID NO: 371457 - DNA, 15 bp, Homo sapiens
ctctttatccagatt

SEQ ID NO: 371458 - DNA, 15 bp, Homo sapiens
tctttatccagatta

SEQ ID NO: 371459 - DNA, 15 bp, Homo sapiens
ctttatccagattag

SEQ ID NO: 371460 - DNA, 15 bp, Homo sapiens
tttatccagattaga

SEQ ID NO: 371461 - DNA, 15 bp, Homo sapiens
ttatccagattagat

SEQ ID NO: 371462 - DNA, 15 bp, Homo sapiens
tatccagattagatc

SEQ ID NO: 371463 - DNA, 15 bp, Homo sapiens
atccagattagatcg

SEQ ID NO: 371464 - DNA, 15 bp, Homo sapiens
tccagattagatcgc

SEQ ID NO: 371465 - DNA, 15 bp, Homo sapiens
ccagattagatcgca

SEQ ID NO: 371466 - DNA, 15 bp, Homo sapiens
cagattagatcgcag

SEQ ID NO: 371467 - DNA, 15 bp, Homo sapiens
agattagatcgcagg

SEQ ID NO: 371468 - DNA, 15 bp, Homo sapiens
gattagatcgcaggc

SEQ ID NO: 371469 - DNA, 15 bp, Homo sapiens
attagatcgcaggct

SEQ ID NO: 371470 - DNA, 15 bp, Homo sapiens
ttagatcgcaggctc

SEQ ID NO: 371471 - DNA, 15 bp, Homo sapiens
tagatcgcaggctcc

SEQ ID NO: 371472 - DNA, 15 bp, Homo sapiens
agatcgcaggctcct

SEQ ID NO: 371473 - DNA, 15 bp, Homo sapiens
gatcgcaggctcctg

SEQ ID NO: 371474 - DNA, 15 bp, Homo sapiens
atcgcaggctcctgc

SEQ ID NO: 371475 - DNA, 15 bp, Homo sapiens
tcgcaggctcctgcc

SEQ ID NO: 371476 - DNA, 15 bp, Homo sapiens
cgcaggctcctgccc

SEQ ID NO: 371477 - DNA, 15 bp, Homo sapiens
gcaggctcctgcccc

SEQ ID NO: 371478 - DNA, 15 bp, Homo sapiens
caggctcctgcccca

SEQ ID NO: 371479 - DNA, 15 bp, Homo sapiens
aggctcctgccccat

SEQ ID NO: 371480 - DNA, 15 bp, Homo sapiens
ggctcctgccccata

SEQ ID NO: 371481 - DNA, 15 bp, Homo sapiens
gctcctgccccatag

SEQ ID NO: 371482 - DNA, 15 bp, Homo sapiens
ctcctgccccatagc

SEQ ID NO: 371483 - DNA, 15 bp, Homo sapiens
tcctgccccatagcc

SEQ ID NO: 371484 - DNA, 15 bp, Homo sapiens
cctgccccatagcca

SEQ ID NO: 371485 - DNA, 15 bp, Homo sapiens
ctgccccatagccac

SEQ ID NO: 371486 - DNA, 15 bp, Homo sapiens
tgccccatagccact

SEQ ID NO: 371487 - DNA, 15 bp, Homo sapiens
gccccatagccactg

SEQ ID NO: 371488 - DNA, 15 bp, Homo sapiens
ccccatagccactgt

SEQ ID NO: 371489 - DNA, 15 bp, Homo sapiens
cccatagccactgtt

SEQ ID NO: 371490 - DNA, 15 bp, Homo sapiens
ccatagccactgttg

SEQ ID NO: 371491 - DNA, 15 bp, Homo sapiens
catagccactgttgc

SEQ ID NO: 371492 - DNA, 15 bp, Homo sapiens
atagccactgttgcc

SEQ ID NO: 371493 - DNA, 15 bp, Homo sapiens
tagccactgttgcca

SEQ ID NO: 371494 - DNA, 15 bp, Homo sapiens
agccactgttgccac

SEQ ID NO: 371495 - DNA, 15 bp, Homo sapiens
gccactgttgccact

SEQ ID NO: 371496 - DNA, 15 bp, Homo sapiens
ccactgttgccactg

SEQ ID NO: 371497 - DNA, 15 bp, Homo sapiens
cactgttgccactgc

SEQ ID NO: 371498 - DNA, 15 bp, Homo sapiens
actgttgccactgcc

SEQ ID NO: 371499 - DNA, 15 bp, Homo sapiens
ctgttgccactgcct

SEQ ID NO: 371500 - DNA, 15 bp, Homo sapiens
tgttgccactgcctt

SEQ ID NO: 371501 - DNA, 15 bp, Homo sapiens
gttgccactgccttg

SEQ ID NO: 371502 - DNA, 15 bp, Homo sapiens
ttgccactgccttgc

SEQ ID NO: 371503 - DNA, 15 bp, Homo sapiens
tgccactgccttgca

SEQ ID NO: 371504 - DNA, 15 bp, Homo sapiens
gccactgccttgcaa

SEQ ID NO: 371505 - DNA, 15 bp, Homo sapiens
ccactgccttgcaag

SEQ ID NO: 371506 - DNA, 15 bp, Homo sapiens
cactgccttgcaagt

SEQ ID NO: 371507 - DNA, 15 bp, Homo sapiens
actgccttgcaagtt

SEQ ID NO: 371508 - DNA, 15 bp, Homo sapiens
ctgccttgcaagttt

SEQ ID NO: 371509 - DNA, 15 bp, Homo sapiens
tgccttgcaagtttt

SEQ ID NO: 371510 - DNA, 15 bp, Homo sapiens
gccttgcaagttttc

SEQ ID NO: 371511 - DNA, 15 bp, Homo sapiens
ccttgcaagttttct

SEQ ID NO: 371512 - DNA, 15 bp, Homo sapiens
cttgcaagttttctg

SEQ ID NO: 371513 - DNA, 15 bp, Homo sapiens
ttgcaagttttctga

SEQ ID NO: 371514 - DNA, 15 bp, Homo sapiens
tgcaagttttctgaa

SEQ ID NO: 371515 - DNA, 15 bp, Homo sapiens
gcaagttttctgaac

SEQ ID NO: 371516 - DNA, 15 bp, Homo sapiens
caagttttctgaacc

SEQ ID NO: 371517 - DNA, 15 bp, Homo sapiens
aagttttctgaacca

SEQ ID NO: 371518 - DNA, 15 bp, Homo sapiens
agttttctgaaccat

SEQ ID NO: 371519 - DNA, 15 bp, Homo sapiens
gttttctgaaccatc

SEQ ID NO: 371520 - DNA, 15 bp, Homo sapiens
ttttctgaaccatca

SEQ ID NO: 371521 - DNA, 15 bp, Homo sapiens
tttctgaaccatcat

SEQ ID NO: 371522 - DNA, 15 bp, Homo sapiens
ttctgaaccatcatg

SEQ ID NO: 371523 - DNA, 15 bp, Homo sapiens
tctgaaccatcatgc

SEQ ID NO: 371524 - DNA, 15 bp, Homo sapiens
ctgaaccatcatgcc

SEQ ID NO: 371525 - DNA, 15 bp, Homo sapiens
tgaaccatcatgccc

SEQ ID NO: 371526 - DNA, 15 bp, Homo sapiens
gaaccatcatgccct

SEQ ID NO: 371527 - DNA, 15 bp, Homo sapiens
aaccatcatgccctg

SEQ ID NO: 371528 - DNA, 15 bp, Homo sapiens
accatcatgccctgc

SEQ ID NO: 371529 - DNA, 15 bp, Homo sapiens
ccatcatgccctgct

SEQ ID NO: 371530 - DNA, 15 bp, Homo sapiens
catcatgccctgctc

SEQ ID NO: 371531 - DNA, 15 bp, Homo sapiens
atcatgccctgctct

SEQ ID NO: 371532 - DNA, 15 bp, Homo sapiens
tcatgccctgctctt

SEQ ID NO: 371533 - DNA, 15 bp, Homo sapiens
catgccctgctcttc

SEQ ID NO: 371534 - DNA, 15 bp, Homo sapiens
atgccctgctcttcc

SEQ ID NO: 371535 - DNA, 15 bp, Homo sapiens
tgccctgctcttcct

SEQ ID NO: 371536 - DNA, 15 bp, Homo sapiens
gccctgctcttcctc

SEQ ID NO: 371537 - DNA, 15 bp, Homo sapiens
ccctgctcttcctct

SEQ ID NO: 371538 - DNA, 15 bp, Homo sapiens
cctgctcttcctctg

SEQ ID NO: 371539 - DNA, 15 bp, Homo sapiens
ctgctcttcctctgt

SEQ ID NO: 371540 - DNA, 15 bp, Homo sapiens
tgctcttcctctgtt

SEQ ID NO: 371541 - DNA, 15 bp, Homo sapiens
gctcttcctctgttg

SEQ ID NO: 371542 - DNA, 15 bp, Homo sapiens
ctcttcctctgttga

SEQ ID NO: 371543 - DNA, 15 bp, Homo sapiens
tcttcctctgttgag

SEQ ID NO: 371544 - DNA, 15 bp, Homo sapiens
cttcctctgttgagt

SEQ ID NO: 371545 - DNA, 15 bp, Homo sapiens
ttcctctgttgagtc

SEQ ID NO: 371546 - DNA, 15 bp, Homo sapiens
tcctctgttgagtca

SEQ ID NO: 371547 - DNA, 15 bp, Homo sapiens
cctctgttgagtcac

SEQ ID NO: 371548 - DNA, 15 bp, Homo sapiens
ctctgttgagtcacc

SEQ ID NO: 371549 - DNA, 15 bp, Homo sapiens
tctgttgagtcacct

SEQ ID NO: 371550 - DNA, 15 bp, Homo sapiens
ctgttgagtcacctg

SEQ ID NO: 371551 - DNA, 15 bp, Homo sapiens
tgttgagtcacctgg

SEQ ID NO: 371552 - DNA, 15 bp, Homo sapiens
gttgagtcacctggc

SEQ ID NO: 371553 - DNA, 15 bp, Homo sapiens
ttgagtcacctggca

SEQ ID NO: 371554 - DNA, 15 bp, Homo sapiens
tgagtcacctggcaa

SEQ ID NO: 371555 - DNA, 15 bp, Homo sapiens
gagtcacctggcaaa

SEQ ID NO: 371556 - DNA, 15 bp, Homo sapiens
agtcacctggcaaaa

SEQ ID NO: 371557 - DNA, 15 bp, Homo sapiens
gtcacctggcaaaac

SEQ ID NO: 371558 - DNA, 15 bp, Homo sapiens
tcacctggcaaaacc

SEQ ID NO: 371559 - DNA, 15 bp, Homo sapiens
cacctggcaaaaccg

SEQ ID NO: 371560 - DNA, 15 bp, Homo sapiens
acctggcaaaaccgc

SEQ ID NO: 371561 - DNA, 15 bp, Homo sapiens
cctggcaaaaccgca

SEQ ID NO: 371562 - DNA, 15 bp, Homo sapiens
ctggcaaaaccgcaa

SEQ ID NO: 371563 - DNA, 15 bp, Homo sapiens
tggcaaaaccgcaaa

SEQ ID NO: 371564 - DNA, 15 bp, Homo sapiens
ggcaaaaccgcaaat

SEQ ID NO: 371565 - DNA, 15 bp, Homo sapiens
gcaaaaccgcaaatg

SEQ ID NO: 371566 - DNA, 15 bp, Homo sapiens
caaaaccgcaaatgt

SEQ ID NO: 371567 - DNA, 15 bp, Homo sapiens
aaaaccgcaaatgtg

SEQ ID NO: 371568 - DNA, 15 bp, Homo sapiens
aaaccgcaaatgtga

SEQ ID NO: 371569 - DNA, 15 bp, Homo sapiens
aaccgcaaatgtgac

SEQ ID NO: 371570 - DNA, 15 bp, Homo sapiens
accgcaaatgtgacc

SEQ ID NO: 371571 - DNA, 15 bp, Homo sapiens
ccgcaaatgtgacca

SEQ ID NO: 371572 - DNA, 15 bp, Homo sapiens
cgcaaatgtgaccaa

SEQ ID NO: 371573 - DNA, 15 bp, Homo sapiens
gcaaatgtgaccaac

SEQ ID NO: 371574 - DNA, 15 bp, Homo sapiens
caaatgtgaccaact

SEQ ID NO: 371575 - DNA, 15 bp, Homo sapiens
aaatgtgaccaactc

SEQ ID NO: 371576 - DNA, 15 bp, Homo sapiens
aatgtgaccaactct

SEQ ID NO: 371577 - DNA, 15 bp, Homo sapiens
atgtgaccaactcta

SEQ ID NO: 371578 - DNA, 15 bp, Homo sapiens
tgtgaccaactctaa

SEQ ID NO: 371579 - DNA, 15 bp, Homo sapiens
gtgaccaactctaac

SEQ ID NO: 371580 - DNA, 15 bp, Homo sapiens
tgaccaactctaact

SEQ ID NO: 371581 - DNA, 15 bp, Homo sapiens
gaccaactctaactg

SEQ ID NO: 371582 - DNA, 15 bp, Homo sapiens
accaactctaactgt

SEQ ID NO: 371583 - DNA, 15 bp, Homo sapiens
ccaactctaactgtc

SEQ ID NO: 371584 - DNA, 15 bp, Homo sapiens
caactctaactgtcc

SEQ ID NO: 371585 - DNA, 15 bp, Homo sapiens
aactctaactgtcca

SEQ ID NO: 371586 - DNA, 15 bp, Homo sapiens
actctaactgtccac

SEQ ID NO: 371587 - DNA, 15 bp, Homo sapiens
ctctaactgtccact

SEQ ID NO: 371588 - DNA, 15 bp, Homo sapiens
tctaactgtccactc

SEQ ID NO: 371589 - DNA, 15 bp, Homo sapiens
ctaactgtccactca

SEQ ID NO: 371590 - DNA, 15 bp, Homo sapiens
taactgtccactcac

SEQ ID NO: 371591 - DNA, 15 bp, Homo sapiens
aactgtccactcact

SEQ ID NO: 371592 - DNA, 15 bp, Homo sapiens
actgtccactcactc

SEQ ID NO: 371593 - DNA, 15 bp, Homo sapiens
ctgtccactcactcc

SEQ ID NO: 371594 - DNA, 15 bp, Homo sapiens
tgtccactcactccc

SEQ ID NO: 371595 - DNA, 15 bp, Homo sapiens
gtccactcactccct

SEQ ID NO: 371596 - DNA, 15 bp, Homo sapiens
tccactcactccctg

SEQ ID NO: 371597 - DNA, 15 bp, Homo sapiens
ccactcactccctga

SEQ ID NO: 371598 - DNA, 15 bp, Homo sapiens
cactcactccctgac

SEQ ID NO: 371599 - DNA, 15 bp, Homo sapiens
actcactccctgaca

SEQ ID NO: 371600 - DNA, 15 bp, Homo sapiens
ctcactccctgacag

SEQ ID NO: 371601 - DNA, 15 bp, Homo sapiens
tcactccctgacagc

SEQ ID NO: 371602 - DNA, 15 bp, Homo sapiens
cactccctgacagct

SEQ ID NO: 371603 - DNA, 15 bp, Homo sapiens
actccctgacagctg

SEQ ID NO: 371604 - DNA, 15 bp, Homo sapiens
ctccctgacagctgc

SEQ ID NO: 371605 - DNA, 15 bp, Homo sapiens
tccctgacagctgct

SEQ ID NO: 371606 - DNA, 15 bp, Homo sapiens
ccctgacagctgctt

SEQ ID NO: 371607 - DNA, 15 bp, Homo sapiens
cctgacagctgcttc

SEQ ID NO: 371608 - DNA, 15 bp, Homo sapiens
ctgacagctgcttct

SEQ ID NO: 371609 - DNA, 15 bp, Homo sapiens
tgacagctgcttctg

SEQ ID NO: 371610 - DNA, 15 bp, Homo sapiens
gacagctgcttctgc

SEQ ID NO: 371611 - DNA, 15 bp, Homo sapiens
acagctgcttctgct

SEQ ID NO: 371612 - DNA, 15 bp, Homo sapiens
cagctgcttctgctg

SEQ ID NO: 371613 - DNA, 15 bp, Homo sapiens
agctgcttctgctga

SEQ ID NO: 371614 - DNA, 15 bp, Homo sapiens
gctgcttctgctgat

SEQ ID NO: 371615 - DNA, 15 bp, Homo sapiens
ctgcttctgctgatt

SEQ ID NO: 371616 - DNA, 15 bp, Homo sapiens
tgcttctgctgattc

SEQ ID NO: 371617 - DNA, 15 bp, Homo sapiens
gcttctgctgattct

SEQ ID NO: 371618 - DNA, 15 bp, Homo sapiens
cttctgctgattctt

SEQ ID NO: 371619 - DNA, 15 bp, Homo sapiens
ttctgctgattcttt

SEQ ID NO: 371620 - DNA, 15 bp, Homo sapiens
tctgctgattctttt

SEQ ID NO: 371621 - DNA, 15 bp, Homo sapiens
ctgctgattcttttt

SEQ ID NO: 371622 - DNA, 15 bp, Homo sapiens
tgctgattcttttta

SEQ ID NO: 371623 - DNA, 15 bp, Homo sapiens
gctgattctttttat

SEQ ID NO: 371624 - DNA, 15 bp, Homo sapiens
ctgattctttttatt

SEQ ID NO: 371625 - DNA, 15 bp, Homo sapiens
tgattctttttattg

SEQ ID NO: 371626 - DNA, 15 bp, Homo sapiens
gattctttttattgc

SEQ ID NO: 371627 - DNA, 15 bp, Homo sapiens
attctttttattgct

SEQ ID NO: 371628 - DNA, 15 bp, Homo sapiens
ttctttttattgctc

SEQ ID NO: 371629 - DNA, 15 bp, Homo sapiens
tctttttattgctcc

SEQ ID NO: 371630 - DNA, 15 bp, Homo sapiens
ctttttattgctcct

SEQ ID NO: 371631 - DNA, 15 bp, Homo sapiens
tttttattgctcctc

SEQ ID NO: 371632 - DNA, 15 bp, Homo sapiens
ttttattgctcctcc

SEQ ID NO: 371633 - DNA, 15 bp, Homo sapiens
tttattgctcctccc

SEQ ID NO: 371634 - DNA, 15 bp, Homo sapiens
ttattgctcctcccc

SEQ ID NO: 371635 - DNA, 15 bp, Homo sapiens
tattgctcctccccg

SEQ ID NO: 371636 - DNA, 15 bp, Homo sapiens
attgctcctccccgc

SEQ ID NO: 371637 - DNA, 15 bp, Homo sapiens
ttgctcctccccgct

SEQ ID NO: 371638 - DNA, 15 bp, Homo sapiens
tgctcctccccgctt

SEQ ID NO: 371639 - DNA, 15 bp, Homo sapiens
gctcctccccgcttt

SEQ ID NO: 371640 - DNA, 15 bp, Homo sapiens
ctcctccccgctttt

SEQ ID NO: 371641 - DNA, 15 bp, Homo sapiens
tcctccccgcttttt

SEQ ID NO: 371642 - DNA, 15 bp, Homo sapiens
cctccccgctttttt

SEQ ID NO: 371643 - DNA, 15 bp, Homo sapiens
ctccccgcttttttc

SEQ ID NO: 371644 - DNA, 15 bp, Homo sapiens
tccccgcttttttct

SEQ ID NO: 371645 - DNA, 15 bp, Homo sapiens
ccccgcttttttctt

SEQ ID NO: 371646 - DNA, 15 bp, Homo sapiens
cccgcttttttcttc

SEQ ID NO: 371647 - DNA, 15 bp, Homo sapiens
ccgcttttttcttct

SEQ ID NO: 371648 - DNA, 15 bp, Homo sapiens
cgcttttttcttctc

SEQ ID NO: 371649 - DNA, 15 bp, Homo sapiens
gcttttttcttctcc

SEQ ID NO: 371650 - DNA, 15 bp, Homo sapiens
cttttttcttctccc

SEQ ID NO: 371651 - DNA, 15 bp, Homo sapiens
ttttttcttctccct

SEQ ID NO: 371652 - DNA, 15 bp, Homo sapiens
tttttcttctccctt

SEQ ID NO: 371653 - DNA, 15 bp, Homo sapiens
ttttcttctcccttg

SEQ ID NO: 371654 - DNA, 15 bp, Homo sapiens
tttcttctcccttgt

SEQ ID NO: 371655 - DNA, 15 bp, Homo sapiens
ttcttctcccttgtc

SEQ ID NO: 371656 - DNA, 15 bp, Homo sapiens
tcttctcccttgtcc

SEQ ID NO: 371657 - DNA, 15 bp, Homo sapiens
cttctcccttgtcct

SEQ ID NO: 371658 - DNA, 15 bp, Homo sapiens
ttctcccttgtcctt

SEQ ID NO: 371659 - DNA, 15 bp, Homo sapiens
tctcccttgtccttc

SEQ ID NO: 371660 - DNA, 15 bp, Homo sapiens
ctcccttgtccttct

SEQ ID NO: 371661 - DNA, 15 bp, Homo sapiens
tcccttgtccttctc

SEQ ID NO: 371662 - DNA, 15 bp, Homo sapiens
cccttgtccttctcc

SEQ ID NO: 371663 - DNA, 15 bp, Homo sapiens
ccttgtccttctcct

SEQ ID NO: 371664 - DNA, 15 bp, Homo sapiens
cttgtccttctcctc

SEQ ID NO: 371665 - DNA, 15 bp, Homo sapiens
ttgtccttctcctcc

SEQ ID NO: 371666 - DNA, 15 bp, Homo sapiens
tgtccttctcctcct

SEQ ID NO: 371667 - DNA, 15 bp, Homo sapiens
gtccttctcctcctc

SEQ ID NO: 371668 - DNA, 15 bp, Homo sapiens
tccttctcctcctcc

SEQ ID NO: 371669 - DNA, 15 bp, Homo sapiens
ccttctcctcctcct

SEQ ID NO: 371670 - DNA, 15 bp, Homo sapiens
cttctcctcctcctt

SEQ ID NO: 371671 - DNA, 15 bp, Homo sapiens
ttctcctcctccttg

SEQ ID NO: 371672 - DNA, 15 bp, Homo sapiens
tctcctcctccttga

SEQ ID NO: 371673 - DNA, 15 bp, Homo sapiens
ctcctcctccttgac

SEQ ID NO: 371674 - DNA, 15 bp, Homo sapiens
tcctcctccttgact

SEQ ID NO: 371675 - DNA, 15 bp, Homo sapiens
cctcctccttgactt

SEQ ID NO: 371676 - DNA, 15 bp, Homo sapiens
ctcctccttgacttc

SEQ ID NO: 371677 - DNA, 15 bp, Homo sapiens
tcctccttgacttcc

SEQ ID NO: 371678 - DNA, 15 bp, Homo sapiens
cctccttgacttcca

SEQ ID NO: 371679 - DNA, 15 bp, Homo sapiens
ctccttgacttccat

SEQ ID NO: 371680 - DNA, 15 bp, Homo sapiens
tccttgacttccatg

SEQ ID NO: 371681 - DNA, 15 bp, Homo sapiens
ccttgacttccatgt

SEQ ID NO: 371682 - DNA, 15 bp, Homo sapiens
cttgacttccatgtc

SEQ ID NO: 371683 - DNA, 15 bp, Homo sapiens
ttgacttccatgtcc

SEQ ID NO: 371684 - DNA, 15 bp, Homo sapiens
tgacttccatgtcca

SEQ ID NO: 371685 - DNA, 15 bp, Homo sapiens
gacttccatgtccac

SEQ ID NO: 371686 - DNA, 15 bp, Homo sapiens
acttccatgtccacc

SEQ ID NO: 371687 - DNA, 15 bp, Homo sapiens
cttccatgtccacct

SEQ ID NO: 371688 - DNA, 15 bp, Homo sapiens
ttccatgtccacctt

SEQ ID NO: 371689 - DNA, 15 bp, Homo sapiens
tccatgtccaccttc

SEQ ID NO: 371690 - DNA, 15 bp, Homo sapiens
ccatgtccaccttct

SEQ ID NO: 371691 - DNA, 15 bp, Homo sapiens
catgtccaccttcta

SEQ ID NO: 371692 - DNA, 15 bp, Homo sapiens
atgtccaccttctac

SEQ ID NO: 371693 - DNA, 15 bp, Homo sapiens
tgtccaccttctact

SEQ ID NO: 371694 - DNA, 15 bp, Homo sapiens
gtccaccttctactt

SEQ ID NO: 371695 - DNA, 15 bp, Homo sapiens
tccaccttctacttt

SEQ ID NO: 371696 - DNA, 15 bp, Homo sapiens
ccaccttctactttc

SEQ ID NO: 371697 - DNA, 15 bp, Homo sapiens
caccttctactttct

SEQ ID NO: 371698 - DNA, 15 bp, Homo sapiens
accttctactttcta

SEQ ID NO: 371699 - DNA, 15 bp, Homo sapiens
ccttctactttctac

SEQ ID NO: 371700 - DNA, 15 bp, Homo sapiens
cttctactttctacc

SEQ ID NO: 371701 - DNA, 15 bp, Homo sapiens
ttctactttctacct

SEQ ID NO: 371702 - DNA, 15 bp, Homo sapiens
tctactttctacctc

SEQ ID NO: 371703 - DNA, 15 bp, Homo sapiens
ctactttctacctct

SEQ ID NO: 371704 - DNA, 15 bp, Homo sapiens
tactttctacctctt

SEQ ID NO: 371705 - DNA, 15 bp, Homo sapiens
actttctacctcttc

SEQ ID NO: 371706 - DNA, 15 bp, Homo sapiens
ctttctacctcttct

SEQ ID NO: 371707 - DNA, 15 bp, Homo sapiens
tttctacctcttctc

SEQ ID NO: 371708 - DNA, 15 bp, Homo sapiens
ttctacctcttctct

SEQ ID NO: 371709 - DNA, 15 bp, Homo sapiens
tctacctcttctctc

SEQ ID NO: 371710 - DNA, 15 bp, Homo sapiens
ctacctcttctctcg

SEQ ID NO: 371711 - DNA, 15 bp, Homo sapiens
tacctcttctctcgt

SEQ ID NO: 371712 - DNA, 15 bp, Homo sapiens
acctcttctctcgtc

SEQ ID NO: 371713 - DNA, 15 bp, Homo sapiens
cctcttctctcgtcc

SEQ ID NO: 371714 - DNA, 15 bp, Homo sapiens
ctcttctctcgtcct

SEQ ID NO: 371715 - DNA, 15 bp, Homo sapiens
tcttctctcgtcctc

SEQ ID NO: 371716 - DNA, 15 bp, Homo sapiens
cttctctcgtcctcc

SEQ ID NO: 371717 - DNA, 15 bp, Homo sapiens
ttctctcgtcctcca

SEQ ID NO: 371718 - DNA, 15 bp, Homo sapiens
tctctcgtcctccac

SEQ ID NO: 371719 - DNA, 15 bp, Homo sapiens
ctctcgtcctccacc

SEQ ID NO: 371720 - DNA, 15 bp, Homo sapiens
tctcgtcctccacct

SEQ ID NO: 371721 - DNA, 15 bp, Homo sapiens
ctcgtcctccacctc

SEQ ID NO: 371722 - DNA, 15 bp, Homo sapiens
tcgtcctccacctct

SEQ ID NO: 371723 - DNA, 15 bp, Homo sapiens
cgtcctccacctcta

SEQ ID NO: 371724 - DNA, 15 bp, Homo sapiens
gtcctccacctctac

SEQ ID NO: 371725 - DNA, 15 bp, Homo sapiens
tcctccacctctacc

SEQ ID NO: 371726 - DNA, 15 bp, Homo sapiens
cctccacctctacct

SEQ ID NO: 371727 - DNA, 15 bp, Homo sapiens
ctccacctctacctc

SEQ ID NO: 371728 - DNA, 15 bp, Homo sapiens
tccacctctacctct

SEQ ID NO: 371729 - DNA, 15 bp, Homo sapiens
ccacctctacctctt

SEQ ID NO: 371730 - DNA, 15 bp, Homo sapiens
cacctctacctcttc

SEQ ID NO: 371731 - DNA, 15 bp, Homo sapiens
acctctacctcttct

SEQ ID NO: 371732 - DNA, 15 bp, Homo sapiens
cctctacctcttcta

SEQ ID NO: 371733 - DNA, 15 bp, Homo sapiens
ctctacctcttctac

SEQ ID NO: 371734 - DNA, 15 bp, Homo sapiens
tctacctcttctacc

SEQ ID NO: 371735 - DNA, 15 bp, Homo sapiens
ctacctcttctacct

SEQ ID NO: 371736 - DNA, 15 bp, Homo sapiens
tacctcttctacctc

SEQ ID NO: 371737 - DNA, 15 bp, Homo sapiens
acctcttctacctct

SEQ ID NO: 371738 - DNA, 15 bp, Homo sapiens
cctcttctacctctt

SEQ ID NO: 371739 - DNA, 15 bp, Homo sapiens
ctcttctacctcttt

SEQ ID NO: 371740 - DNA, 15 bp, Homo sapiens
tcttctacctctttt

SEQ ID NO: 371741 - DNA, 15 bp, Homo sapiens
cttctacctcttttt

SEQ ID NO: 371742 - DNA, 15 bp, Homo sapiens
ttctacctctttttt

SEQ ID NO: 371743 - DNA, 15 bp, Homo sapiens
tctacctcttttttt

SEQ ID NO: 371744 - DNA, 15 bp, Homo sapiens
ctacctctttttttt

SEQ ID NO: 371745 - DNA, 15 bp, Homo sapiens
tacctcttttttttg

SEQ ID NO: 371746 - DNA, 15 bp, Homo sapiens
acctcttttttttgg

SEQ ID NO: 371747 - DNA, 15 bp, Homo sapiens
cctcttttttttggg

SEQ ID NO: 371748 - DNA, 15 bp, Homo sapiens
ctcttttttttggga

SEQ ID NO: 371749 - DNA, 15 bp, Homo sapiens
tcttttttttgggag

SEQ ID NO: 371750 - DNA, 15 bp, Homo sapiens
cttttttttgggagg

SEQ ID NO: 371751 - DNA, 15 bp, Homo sapiens
ttttttttgggaggg

SEQ ID NO: 371752 - DNA, 15 bp, Homo sapiens
tttttttgggagggt

SEQ ID NO: 371753 - DNA, 15 bp, Homo sapiens
ttttttgggagggtt

SEQ ID NO: 371754 - DNA, 15 bp, Homo sapiens
tttttgggagggttc

SEQ ID NO: 371755 - DNA, 15 bp, Homo sapiens
ttttgggagggttct

SEQ ID NO: 371756 - DNA, 15 bp, Homo sapiens
tttgggagggttctt

SEQ ID NO: 371757 - DNA, 15 bp, Homo sapiens
ttgggagggttcttt

SEQ ID NO: 371758 - DNA, 15 bp, Homo sapiens
tgggagggttctttt

SEQ ID NO: 371759 - DNA, 15 bp, Homo sapiens
gggagggttcttttt

SEQ ID NO: 371760 - DNA, 15 bp, Homo sapiens
ggagggttcttttta

SEQ ID NO: 371761 - DNA, 15 bp, Homo sapiens
gagggttctttttat

SEQ ID NO: 371762 - DNA, 15 bp, Homo sapiens
agggttctttttatt

SEQ ID NO: 371763 - DNA, 15 bp, Homo sapiens
gggttctttttattt

SEQ ID NO: 371764 - DNA, 15 bp, Homo sapiens
ggttctttttatttc

SEQ ID NO: 371765 - DNA, 15 bp, Homo sapiens
gttctttttatttct

SEQ ID NO: 371766 - DNA, 15 bp, Homo sapiens
ttctttttatttctc

SEQ ID NO: 371767 - DNA, 15 bp, Homo sapiens
tctttttatttctct

SEQ ID NO: 371768 - DNA, 15 bp, Homo sapiens
ctttttatttctctt

SEQ ID NO: 371769 - DNA, 15 bp, Homo sapiens
tttttatttctctta

SEQ ID NO: 371770 - DNA, 15 bp, Homo sapiens
ttttatttctcttat

SEQ ID NO: 371771 - DNA, 15 bp, Homo sapiens
tttatttctcttatt

SEQ ID NO: 371772 - DNA, 15 bp, Homo sapiens
ttatttctcttattc

SEQ ID NO: 371773 - DNA, 15 bp, Homo sapiens
tatttctcttattcc

SEQ ID NO: 371774 - DNA, 15 bp, Homo sapiens
atttctcttattcct

SEQ ID NO: 371775 - DNA, 15 bp, Homo sapiens
tttctcttattcctc

SEQ ID NO: 371776 - DNA, 15 bp, Homo sapiens
ttctcttattcctct

SEQ ID NO: 371777 - DNA, 15 bp, Homo sapiens
tctcttattcctctt

SEQ ID NO: 371778 - DNA, 15 bp, Homo sapiens
ctcttattcctctta

SEQ ID NO: 371779 - DNA, 15 bp, Homo sapiens
tcttattcctcttat

SEQ ID NO: 371780 - DNA, 15 bp, Homo sapiens
cttattcctcttatt

SEQ ID NO: 371781 - DNA, 15 bp, Homo sapiens
ttattcctcttattt

SEQ ID NO: 371782 - DNA, 15 bp, Homo sapiens
tattcctcttatttt

SEQ ID NO: 371783 - DNA, 15 bp, Homo sapiens
attcctcttattttt

SEQ ID NO: 371784 - DNA, 15 bp, Homo sapiens
ttcctcttatttttc

SEQ ID NO: 371785 - DNA, 15 bp, Homo sapiens
tcctcttatttttct

SEQ ID NO: 371786 - DNA, 15 bp, Homo sapiens
cctcttatttttctt

SEQ ID NO: 371787 - DNA, 15 bp, Homo sapiens
ctcttatttttcttt

SEQ ID NO: 371788 - DNA, 15 bp, Homo sapiens
tcttatttttctttt

SEQ ID NO: 371789 - DNA, 15 bp, Homo sapiens
cttatttttcttttc

SEQ ID NO: 371790 - DNA, 15 bp, Homo sapiens
ttatttttcttttct

SEQ ID NO: 371791 - DNA, 15 bp, Homo sapiens
tatttttcttttctt

SEQ ID NO: 371792 - DNA, 15 bp, Homo sapiens
ttttcttttcttttc

SEQ ID NO: 371793 - DNA, 15 bp, Homo sapiens
tttcttttcttttcc

SEQ ID NO: 371794 - DNA, 15 bp, Homo sapiens
ttcttttcttttcct

SEQ ID NO: 371795 - DNA, 15 bp, Homo sapiens
tcttttcttttcctt

SEQ ID NO: 371796 - DNA, 15 bp, Homo sapiens
cttttcttttccttc

SEQ ID NO: 371797 - DNA, 15 bp, Homo sapiens
ttttcttttccttct

SEQ ID NO: 371798 - DNA, 15 bp, Homo sapiens
tttcttttccttctc

SEQ ID NO: 371799 - DNA, 15 bp, Homo sapiens
ttcttttccttctct

SEQ ID NO: 371800 - DNA, 15 bp, Homo sapiens
tcttttccttctctt

SEQ ID NO: 371801 - DNA, 15 bp, Homo sapiens
cttttccttctcttc

SEQ ID NO: 371802 - DNA, 15 bp, Homo sapiens
ttttccttctcttcc

SEQ ID NO: 371803 - DNA, 15 bp, Homo sapiens
tttccttctcttcct

SEQ ID NO: 371804 - DNA, 15 bp, Homo sapiens
ttccttctcttcctc

SEQ ID NO: 371805 - DNA, 15 bp, Homo sapiens
tccttctcttcctcc

SEQ ID NO: 371806 - DNA, 15 bp, Homo sapiens
ccttctcttcctcct

SEQ ID NO: 371807 - DNA, 15 bp, Homo sapiens
cttctcttcctcctc

SEQ ID NO: 371808 - DNA, 15 bp, Homo sapiens
ttctcttcctcctcc

SEQ ID NO: 371809 - DNA, 15 bp, Homo sapiens
tctcttcctcctcct

SEQ ID NO: 371810 - DNA, 15 bp, Homo sapiens
ctcttcctcctcctc

SEQ ID NO: 371811 - DNA, 15 bp, Homo sapiens
tcttcctcctcctcc

SEQ ID NO: 371812 - DNA, 15 bp, Homo sapiens
cttcctcctcctccc

SEQ ID NO: 371813 - DNA, 15 bp, Homo sapiens
ttcctcctcctcccc

SEQ ID NO: 371814 - DNA, 15 bp, Homo sapiens
tcctcctcctcccct

SEQ ID NO: 371815 - DNA, 15 bp, Homo sapiens
cctcctcctcccctc

SEQ ID NO: 371816 - DNA, 15 bp, Homo sapiens
ctcctcctcccctca

SEQ ID NO: 371817 - DNA, 15 bp, Homo sapiens
tcctcctcccctcaa

SEQ ID NO: 371818 - DNA, 15 bp, Homo sapiens
cctcctcccctcaag

SEQ ID NO: 371819 - DNA, 15 bp, Homo sapiens
ctcctcccctcaagt

SEQ ID NO: 371820 - DNA, 15 bp, Homo sapiens
tcctcccctcaagtt

SEQ ID NO: 371821 - DNA, 15 bp, Homo sapiens
cctcccctcaagttt

SEQ ID NO: 371822 - DNA, 15 bp, Homo sapiens
ctcccctcaagtttt

SEQ ID NO: 371823 - DNA, 15 bp, Homo sapiens
tcccctcaagttttg

SEQ ID NO: 371824 - DNA, 15 bp, Homo sapiens
cccctcaagttttga

SEQ ID NO: 371825 - DNA, 15 bp, Homo sapiens
ccctcaagttttgaa

SEQ ID NO: 371826 - DNA, 15 bp, Homo sapiens
cctcaagttttgaaa

SEQ ID NO: 371827 - DNA, 15 bp, Homo sapiens
ctcaagttttgaaaa

SEQ ID NO: 371828 - DNA, 15 bp, Homo sapiens
tcaagttttgaaaaa

SEQ ID NO: 371829 - DNA, 15 bp, Homo sapiens
caagttttgaaaaaa

SEQ ID NO: 371830 - DNA, 15 bp, Homo sapiens
aagttttgaaaaaag

SEQ ID NO: 371831 - DNA, 15 bp, Homo sapiens
agttttgaaaaaagt

SEQ ID NO: 371832 - DNA, 15 bp, Homo sapiens
gttttgaaaaaagtg

SEQ ID NO: 371833 - DNA, 15 bp, Homo sapiens
ttttgaaaaaagtga

SEQ ID NO: 371834 - DNA, 15 bp, Homo sapiens
tttgaaaaaagtgat

SEQ ID NO: 371835 - DNA, 15 bp, Homo sapiens
ttgaaaaaagtgatg

SEQ ID NO: 371836 - DNA, 15 bp, Homo sapiens
tgaaaaaagtgatga

SEQ ID NO: 371837 - DNA, 15 bp, Homo sapiens
gaaaaaagtgatgac

SEQ ID NO: 371838 - DNA, 15 bp, Homo sapiens
aaaaaagtgatgaca

SEQ ID NO: 371839 - DNA, 15 bp, Homo sapiens
aaaaagtgatgacag

SEQ ID NO: 371840 - DNA, 15 bp, Homo sapiens
aaaagtgatgacaga

SEQ ID NO: 371841 - DNA, 15 bp, Homo sapiens
aaagtgatgacagac

SEQ ID NO: 371842 - DNA, 15 bp, Homo sapiens
aagtgatgacagaca

SEQ ID NO: 371843 - DNA, 15 bp, Homo sapiens
agtgatgacagacaa

SEQ ID NO: 371844 - DNA, 15 bp, Homo sapiens
gtgatgacagacaat

SEQ ID NO: 371845 - DNA, 15 bp, Homo sapiens
tgatgacagacaata

SEQ ID NO: 371846 - DNA, 15 bp, Homo sapiens
gatgacagacaatat

SEQ ID NO: 371847 - DNA, 15 bp, Homo sapiens
atgacagacaatata

SEQ ID NO: 371848 - DNA, 15 bp, Homo sapiens
tgacagacaatatat

SEQ ID NO: 371849 - DNA, 15 bp, Homo sapiens
gacagacaatatatt

SEQ ID NO: 371850 - DNA, 15 bp, Homo sapiens
acagacaatatattt

SEQ ID NO: 371851 - DNA, 15 bp, Homo sapiens
cagacaatatatttt

SEQ ID NO: 371852 - DNA, 15 bp, Homo sapiens
agacaatatattttt

SEQ ID NO: 371853 - DNA, 15 bp, Homo sapiens
gacaatatatttttt

SEQ ID NO: 371854 - DNA, 15 bp, Homo sapiens
acaatatattttttt

SEQ ID NO: 371855 - DNA, 15 bp, Homo sapiens
caatatatttttttt

SEQ ID NO: 371856 - DNA, 15 bp, Homo sapiens
aatatattttttttc

SEQ ID NO: 371857 - DNA, 15 bp, Homo sapiens
atatattttttttca

SEQ ID NO: 371858 - DNA, 15 bp, Homo sapiens
tatattttttttcat

SEQ ID NO: 371859 - DNA, 15 bp, Homo sapiens
atattttttttcatt

SEQ ID NO: 371860 - DNA, 15 bp, Homo sapiens
tttttttcatttttc

SEQ ID NO: 371861 - DNA, 15 bp, Homo sapiens
ttttttcatttttcg

SEQ ID NO: 371862 - DNA, 15 bp, Homo sapiens
tttttcatttttcga

SEQ ID NO: 371863 - DNA, 15 bp, Homo sapiens
ttttcatttttcgag

SEQ ID NO: 371864 - DNA, 15 bp, Homo sapiens
tttcatttttcgaga

SEQ ID NO: 371865 - DNA, 15 bp, Homo sapiens
ttcatttttcgagat

SEQ ID NO: 371866 - DNA, 15 bp, Homo sapiens
tcatttttcgagatt

SEQ ID NO: 371867 - DNA, 15 bp, Homo sapiens
catttttcgagattg

SEQ ID NO: 371868 - DNA, 15 bp, Homo sapiens
atttttcgagattgc

SEQ ID NO: 371869 - DNA, 15 bp, Homo sapiens
tttttcgagattgca

SEQ ID NO: 371870 - DNA, 15 bp, Homo sapiens
ttttcgagattgcaa

SEQ ID NO: 371871 - DNA, 15 bp, Homo sapiens
tttcgagattgcaag

SEQ ID NO: 371872 - DNA, 15 bp, Homo sapiens
ttcgagattgcaagc

SEQ ID NO: 371873 - DNA, 15 bp, Homo sapiens
tcgagattgcaagct

SEQ ID NO: 371874 - DNA, 15 bp, Homo sapiens
cgagattgcaagcta

SEQ ID NO: 371875 - DNA, 15 bp, Homo sapiens
gagattgcaagctaa

SEQ ID NO: 371876 - DNA, 15 bp, Homo sapiens
agattgcaagctaat

SEQ ID NO: 371877 - DNA, 15 bp, Homo sapiens
gattgcaagctaatt

SEQ ID NO: 371878 - DNA, 15 bp, Homo sapiens
attgcaagctaattg

SEQ ID NO: 371879 - DNA, 15 bp, Homo sapiens
ttgcaagctaattga

SEQ ID NO: 371880 - DNA, 15 bp, Homo sapiens
tgcaagctaattgag

SEQ ID NO: 371881 - DNA, 15 bp, Homo sapiens
gcaagctaattgagg

SEQ ID NO: 371882 - DNA, 15 bp, Homo sapiens
caagctaattgagga

SEQ ID NO: 371883 - DNA, 15 bp, Homo sapiens
aagctaattgaggac

SEQ ID NO: 371884 - DNA, 15 bp, Homo sapiens
agctaattgaggacc

SEQ ID NO: 371885 - DNA, 15 bp, Homo sapiens
gctaattgaggacca

SEQ ID NO: 371886 - DNA, 15 bp, Homo sapiens
ctaattgaggaccaa

SEQ ID NO: 371887 - DNA, 15 bp, Homo sapiens
taattgaggaccaag

SEQ ID NO: 371888 - DNA, 15 bp, Homo sapiens
aattgaggaccaagt

SEQ ID NO: 371889 - DNA, 15 bp, Homo sapiens
attgaggaccaagtt

SEQ ID NO: 371890 - DNA, 15 bp, Homo sapiens
ttgaggaccaagttt

SEQ ID NO: 371891 - DNA, 15 bp, Homo sapiens
tgaggaccaagtttg

SEQ ID NO: 371892 - DNA, 15 bp, Homo sapiens
gaggaccaagtttgt

SEQ ID NO: 371893 - DNA, 15 bp, Homo sapiens
aggaccaagtttgtg

SEQ ID NO: 371894 - DNA, 15 bp, Homo sapiens
ggaccaagtttgtgt

SEQ ID NO: 371895 - DNA, 15 bp, Homo sapiens
gaccaagtttgtgtt

SEQ ID NO: 371896 - DNA, 15 bp, Homo sapiens
accaagtttgtgttt

SEQ ID NO: 371897 - DNA, 15 bp, Homo sapiens
ccaagtttgtgtttt

SEQ ID NO: 371898 - DNA, 15 bp, Homo sapiens
caagtttgtgttttt

SEQ ID NO: 371899 - DNA, 15 bp, Homo sapiens
aagtttgtgtttttt

SEQ ID NO: 371900 - DNA, 15 bp, Homo sapiens
agtttgtgtttttta

SEQ ID NO: 371901 - DNA, 15 bp, Homo sapiens
gtttgtgttttttat

SEQ ID NO: 371902 - DNA, 15 bp, Homo sapiens
tttgtgttttttatt

SEQ ID NO: 371903 - DNA, 15 bp, Homo sapiens
ttgtgttttttatta

SEQ ID NO: 371904 - DNA, 15 bp, Homo sapiens
tgtgttttttattac

SEQ ID NO: 371905 - DNA, 15 bp, Homo sapiens
gtgttttttattact

SEQ ID NO: 371906 - DNA, 15 bp, Homo sapiens
tgttttttattactt

SEQ ID NO: 371907 - DNA, 15 bp, Homo sapiens
gttttttattacttg

SEQ ID NO: 371908 - DNA, 15 bp, Homo sapiens
ttttttattacttgt

SEQ ID NO: 371909 - DNA, 15 bp, Homo sapiens
tttttattacttgta

SEQ ID NO: 371910 - DNA, 15 bp, Homo sapiens
ttttattacttgtat

SEQ ID NO: 371911 - DNA, 15 bp, Homo sapiens
tttattacttgtatt

SEQ ID NO: 371912 - DNA, 15 bp, Homo sapiens
ttattacttgtattt

SEQ ID NO: 371913 - DNA, 15 bp, Homo sapiens
tattacttgtatttc

SEQ ID NO: 371914 - DNA, 15 bp, Homo sapiens
attacttgtatttct

SEQ ID NO: 371915 - DNA, 15 bp, Homo sapiens
ttacttgtatttctg

SEQ ID NO: 371916 - DNA, 15 bp, Homo sapiens
tacttgtatttctgg

SEQ ID NO: 371917 - DNA, 15 bp, Homo sapiens
acttgtatttctgga

SEQ ID NO: 371918 - DNA, 15 bp, Homo sapiens
cttgtatttctggaa

SEQ ID NO: 371919 - DNA, 15 bp, Homo sapiens
ttgtatttctggaaa

SEQ ID NO: 371920 - DNA, 15 bp, Homo sapiens
tgtatttctggaaat

SEQ ID NO: 371921 - DNA, 15 bp, Homo sapiens
gtatttctggaaatt

SEQ ID NO: 371922 - DNA, 15 bp, Homo sapiens
tatttctggaaattt

SEQ ID NO: 371923 - DNA, 15 bp, Homo sapiens
atttctggaaatttg

SEQ ID NO: 371924 - DNA, 15 bp, Homo sapiens
tttctggaaatttgc

SEQ ID NO: 371925 - DNA, 15 bp, Homo sapiens
ttctggaaatttgca

SEQ ID NO: 371926 - DNA, 15 bp, Homo sapiens
tctggaaatttgcac

SEQ ID NO: 371927 - DNA, 15 bp, Homo sapiens
ctggaaatttgcaca

SEQ ID NO: 371928 - DNA, 15 bp, Homo sapiens
tggaaatttgcacaa

SEQ ID NO: 371929 - DNA, 15 bp, Homo sapiens
ggaaatttgcacaaa

SEQ ID NO: 371930 - DNA, 15 bp, Homo sapiens
aaatttgcacaaaaa

SEQ ID NO: 371931 - DNA, 15 bp, Homo sapiens
aatttgcacaaaaag

SEQ ID NO: 371932 - DNA, 15 bp, Homo sapiens
atttgcacaaaaagt

SEQ ID NO: 371933 - DNA, 15 bp, Homo sapiens
tttgcacaaaaagta

SEQ ID NO: 371934 - DNA, 15 bp, Homo sapiens
ttgcacaaaaagtac

SEQ ID NO: 371935 - DNA, 15 bp, Homo sapiens
tgcacaaaaagtacc

SEQ ID NO: 371936 - DNA, 15 bp, Homo sapiens
gcacaaaaagtacct

SEQ ID NO: 371937 - DNA, 15 bp, Homo sapiens
cacaaaaagtacctg

SEQ ID NO: 371938 - DNA, 15 bp, Homo sapiens
acaaaaagtacctgg

SEQ ID NO: 371939 - DNA, 15 bp, Homo sapiens
caaaaagtacctggg

SEQ ID NO: 371940 - DNA, 15 bp, Homo sapiens
aaaaagtacctgggg

SEQ ID NO: 371941 - DNA, 15 bp, Homo sapiens
aaaagtacctggggc

SEQ ID NO: 371942 - DNA, 15 bp, Homo sapiens
aaagtacctggggcc

SEQ ID NO: 371943 - DNA, 15 bp, Homo sapiens
aagtacctggggcct

SEQ ID NO: 371944 - DNA, 15 bp, Homo sapiens
agtacctggggcctg

SEQ ID NO: 371945 - DNA, 15 bp, Homo sapiens
gtacctggggcctga

SEQ ID NO: 371946 - DNA, 15 bp, Homo sapiens
tacctggggcctgat

SEQ ID NO: 371947 - DNA, 15 bp, Homo sapiens
acctggggcctgatc

SEQ ID NO: 371948 - DNA, 15 bp, Homo sapiens
cctggggcctgatca

SEQ ID NO: 371949 - DNA, 15 bp, Homo sapiens
ctggggcctgatcaa

SEQ ID NO: 371950 - DNA, 15 bp, Homo sapiens
tggggcctgatcaag

SEQ ID NO: 371951 - DNA, 15 bp, Homo sapiens
ggggcctgatcaagt

SEQ ID NO: 371952 - DNA, 15 bp, Homo sapiens
gggcctgatcaagtt

SEQ ID NO: 371953 - DNA, 15 bp, Homo sapiens
ggcctgatcaagttt

SEQ ID NO: 371954 - DNA, 15 bp, Homo sapiens
gcctgatcaagtttc

SEQ ID NO: 371955 - DNA, 15 bp, Homo sapiens
cctgatcaagtttct

SEQ ID NO: 371956 - DNA, 15 bp, Homo sapiens
ctgatcaagtttctt

SEQ ID NO: 371957 - DNA, 15 bp, Homo sapiens
tgatcaagtttcttg

SEQ ID NO: 371958 - DNA, 15 bp, Homo sapiens
gatcaagtttcttga

SEQ ID NO: 371959 - DNA, 15 bp, Homo sapiens
atcaagtttcttgat

SEQ ID NO: 371960 - DNA, 15 bp, Homo sapiens
tcaagtttcttgatt

SEQ ID NO: 371961 - DNA, 15 bp, Homo sapiens
caagtttcttgatta

SEQ ID NO: 371962 - DNA, 15 bp, Homo sapiens
aagtttcttgattaa

SEQ ID NO: 371963 - DNA, 15 bp, Homo sapiens
agtttcttgattaat

SEQ ID NO: 371964 - DNA, 15 bp, Homo sapiens
gtttcttgattaata

SEQ ID NO: 371965 - DNA, 15 bp, Homo sapiens
tttcttgattaatat

SEQ ID NO: 371966 - DNA, 15 bp, Homo sapiens
ttcttgattaatatt

SEQ ID NO: 371967 - DNA, 15 bp, Homo sapiens
tcttgattaatattc

SEQ ID NO: 371968 - DNA, 15 bp, Homo sapiens
cttgattaatattca

SEQ ID NO: 371969 - DNA, 15 bp, Homo sapiens
ttgattaatattcag

SEQ ID NO: 371970 - DNA, 15 bp, Homo sapiens
tgattaatattcaga

SEQ ID NO: 371971 - DNA, 15 bp, Homo sapiens
gattaatattcagaa

SEQ ID NO: 371972 - DNA, 15 bp, Homo sapiens
attaatattcagaac

SEQ ID NO: 371973 - DNA, 15 bp, Homo sapiens
ttaatattcagaaca

SEQ ID NO: 371974 - DNA, 15 bp, Homo sapiens
taatattcagaacac

SEQ ID NO: 371975 - DNA, 15 bp, Homo sapiens
aatattcagaacact

SEQ ID NO: 371976 - DNA, 15 bp, Homo sapiens
atattcagaacactt

SEQ ID NO: 371977 - DNA, 15 bp, Homo sapiens
tattcagaacacttg

SEQ ID NO: 371978 - DNA, 15 bp, Homo sapiens
attcagaacacttga

SEQ ID NO: 371979 - DNA, 15 bp, Homo sapiens
ttcagaacacttgag

SEQ ID NO: 371980 - DNA, 15 bp, Homo sapiens
tcagaacacttgagt

SEQ ID NO: 371981 - DNA, 15 bp, Homo sapiens
cagaacacttgagtt

SEQ ID NO: 371982 - DNA, 15 bp, Homo sapiens
agaacacttgagttg

SEQ ID NO: 371983 - DNA, 15 bp, Homo sapiens
gaacacttgagttga

SEQ ID NO: 371984 - DNA, 15 bp, Homo sapiens
aacacttgagttgac

SEQ ID NO: 371985 - DNA, 15 bp, Homo sapiens
acacttgagttgaca

SEQ ID NO: 371986 - DNA, 15 bp, Homo sapiens
cacttgagttgacat

SEQ ID NO: 371987 - DNA, 15 bp, Homo sapiens
acttgagttgacatt

SEQ ID NO: 371988 - DNA, 15 bp, Homo sapiens
cttgagttgacattt

SEQ ID NO: 371989 - DNA, 15 bp, Homo sapiens
ttgagttgacatttg

SEQ ID NO: 371990 - DNA, 15 bp, Homo sapiens
tgagttgacatttgg

SEQ ID NO: 371991 - DNA, 15 bp, Homo sapiens
gagttgacatttggg

SEQ ID NO: 371992 - DNA, 15 bp, Homo sapiens
agttgacatttgggt

SEQ ID NO: 371993 - DNA, 15 bp, Homo sapiens
gttgacatttgggta

SEQ ID NO: 371994 - DNA, 15 bp, Homo sapiens
ttgacatttgggtac

SEQ ID NO: 371995 - DNA, 15 bp, Homo sapiens
tgacatttgggtact

SEQ ID NO: 371996 - DNA, 15 bp, Homo sapiens
gacatttgggtactg

SEQ ID NO: 371997 - DNA, 15 bp, Homo sapiens
acatttgggtactgc

SEQ ID NO: 371998 - DNA, 15 bp, Homo sapiens
catttgggtactgct

SEQ ID NO: 371999 - DNA, 15 bp, Homo sapiens
atttgggtactgctg

SEQ ID NO: 372000 - DNA, 15 bp, Homo sapiens
tttgggtactgctgc

SEQ ID NO: 372001 - DNA, 15 bp, Homo sapiens
ttgggtactgctgct

SEQ ID NO: 372002 - DNA, 15 bp, Homo sapiens
tgggtactgctgctt

SEQ ID NO: 372003 - DNA, 15 bp, Homo sapiens
gggtactgctgcttt

SEQ ID NO: 372004 - DNA, 15 bp, Homo sapiens
ggtactgctgctttg

SEQ ID NO: 372005 - DNA, 15 bp, Homo sapiens
gtactgctgctttgc

SEQ ID NO: 372006 - DNA, 15 bp, Homo sapiens
tactgctgctttgca

SEQ ID NO: 372007 - DNA, 15 bp, Homo sapiens
actgctgctttgcaa

SEQ ID NO: 372008 - DNA, 15 bp, Homo sapiens
ctgctgctttgcaaa

SEQ ID NO: 372009 - DNA, 15 bp, Homo sapiens
tgctgctttgcaaat

SEQ ID NO: 372010 - DNA, 15 bp, Homo sapiens
gctgctttgcaaata

SEQ ID NO: 372011 - DNA, 15 bp, Homo sapiens
ctgctttgcaaatac

SEQ ID NO: 372012 - DNA, 15 bp, Homo sapiens
tgctttgcaaataca

SEQ ID NO: 372013 - DNA, 15 bp, Homo sapiens
gctttgcaaatacag

SEQ ID NO: 372014 - DNA, 15 bp, Homo sapiens
ctttgcaaatacagg

SEQ ID NO: 372015 - DNA, 15 bp, Homo sapiens
tttgcaaatacaggc

SEQ ID NO: 372016 - DNA, 15 bp, Homo sapiens
ttgcaaatacaggct

SEQ ID NO: 372017 - DNA, 15 bp, Homo sapiens
tgcaaatacaggctc

SEQ ID NO: 372018 - DNA, 15 bp, Homo sapiens
gcaaatacaggctca

SEQ ID NO: 372019 - DNA, 15 bp, Homo sapiens
caaatacaggctcaa

SEQ ID NO: 372020 - DNA, 15 bp, Homo sapiens
aaatacaggctcaac

SEQ ID NO: 372021 - DNA, 15 bp, Homo sapiens
aatacaggctcaact

SEQ ID NO: 372022 - DNA, 15 bp, Homo sapiens
atacaggctcaactc

SEQ ID NO: 372023 - DNA, 15 bp, Homo sapiens
tacaggctcaactcc

SEQ ID NO: 372024 - DNA, 15 bp, Homo sapiens
acaggctcaactcca

SEQ ID NO: 372025 - DNA, 15 bp, Homo sapiens
caggctcaactccat

SEQ ID NO: 372026 - DNA, 15 bp, Homo sapiens
aggctcaactccata

SEQ ID NO: 372027 - DNA, 15 bp, Homo sapiens
ggctcaactccataa

SEQ ID NO: 372028 - DNA, 15 bp, Homo sapiens
gctcaactccataat

SEQ ID NO: 372029 - DNA, 15 bp, Homo sapiens
ctcaactccataatc

SEQ ID NO: 372030 - DNA, 15 bp, Homo sapiens
tcaactccataatca

SEQ ID NO: 372031 - DNA, 15 bp, Homo sapiens
caactccataatcat

SEQ ID NO: 372032 - DNA, 15 bp, Homo sapiens
aactccataatcata

SEQ ID NO: 372033 - DNA, 15 bp, Homo sapiens
actccataatcatag

SEQ ID NO: 372034 - DNA, 15 bp, Homo sapiens
ctccataatcatagg

SEQ ID NO: 372035 - DNA, 15 bp, Homo sapiens
tccataatcataggg

SEQ ID NO: 372036 - DNA, 15 bp, Homo sapiens
ccataatcataggga

SEQ ID NO: 372037 - DNA, 15 bp, Homo sapiens
cataatcatagggaa

SEQ ID NO: 372038 - DNA, 15 bp, Homo sapiens
ataatcatagggaaa

SEQ ID NO: 372039 - DNA, 15 bp, Homo sapiens
taatcatagggaaag

SEQ ID NO: 372040 - DNA, 15 bp, Homo sapiens
aatcatagggaaaga

SEQ ID NO: 372041 - DNA, 15 bp, Homo sapiens
atcatagggaaagaa

SEQ ID NO: 372042 - DNA, 15 bp, Homo sapiens
tcatagggaaagaat

SEQ ID NO: 372043 - DNA, 15 bp, Homo sapiens
catagggaaagaatt

SEQ ID NO: 372044 - DNA, 15 bp, Homo sapiens
atagggaaagaattt

SEQ ID NO: 372045 - DNA, 15 bp, Homo sapiens
tagggaaagaatttg

SEQ ID NO: 372046 - DNA, 15 bp, Homo sapiens
agggaaagaatttga

SEQ ID NO: 372047 - DNA, 15 bp, Homo sapiens
gggaaagaatttgat

SEQ ID NO: 372048 - DNA, 15 bp, Homo sapiens
ggaaagaatttgatg

SEQ ID NO: 372049 - DNA, 15 bp, Homo sapiens
gaaagaatttgatgc

SEQ ID NO: 372050 - DNA, 15 bp, Homo sapiens
aaagaatttgatgca

SEQ ID NO: 372051 - DNA, 15 bp, Homo sapiens
aagaatttgatgcat

SEQ ID NO: 372052 - DNA, 15 bp, Homo sapiens
agaatttgatgcatt

SEQ ID NO: 372053 - DNA, 15 bp, Homo sapiens
gaatttgatgcattt

SEQ ID NO: 372054 - DNA, 15 bp, Homo sapiens
aatttgatgcatttt

SEQ ID NO: 372055 - DNA, 15 bp, Homo sapiens
atttgatgcatttta

SEQ ID NO: 372056 - DNA, 15 bp, Homo sapiens
tttgatgcattttat

SEQ ID NO: 372057 - DNA, 15 bp, Homo sapiens
ttgatgcattttata

SEQ ID NO: 372058 - DNA, 15 bp, Homo sapiens
tgatgcattttataa

SEQ ID NO: 372059 - DNA, 15 bp, Homo sapiens
gatgcattttataaa

SEQ ID NO: 372060 - DNA, 15 bp, Homo sapiens
atgcattttataaaa

SEQ ID NO: 372061 - DNA, 15 bp, Homo sapiens
tgcattttataaaat

SEQ ID NO: 372062 - DNA, 15 bp, Homo sapiens
gcattttataaaatc

SEQ ID NO: 372063 - DNA, 15 bp, Homo sapiens
cattttataaaatcg

SEQ ID NO: 372064 - DNA, 15 bp, Homo sapiens
attttataaaatcgt

SEQ ID NO: 372065 - DNA, 15 bp, Homo sapiens
ttttataaaatcgtc

SEQ ID NO: 372066 - DNA, 15 bp, Homo sapiens
tttataaaatcgtca

SEQ ID NO: 372067 - DNA, 15 bp, Homo sapiens
ttataaaatcgtcat

SEQ ID NO: 372068 - DNA, 15 bp, Homo sapiens
tataaaatcgtcatg

SEQ ID NO: 372069 - DNA, 15 bp, Homo sapiens
ataaaatcgtcatgg

SEQ ID NO: 372070 - DNA, 15 bp, Homo sapiens
taaaatcgtcatggg

SEQ ID NO: 372071 - DNA, 15 bp, Homo sapiens
aaaatcgtcatgggt

SEQ ID NO: 372072 - DNA, 15 bp, Homo sapiens
aaatcgtcatgggtt

SEQ ID NO: 372073 - DNA, 15 bp, Homo sapiens
aatcgtcatgggtta

SEQ ID NO: 372074 - DNA, 15 bp, Homo sapiens
atcgtcatgggttat

SEQ ID NO: 372075 - DNA, 15 bp, Homo sapiens
tcgtcatgggttatc

SEQ ID NO: 372076 - DNA, 15 bp, Homo sapiens
cgtcatgggttatct

SEQ ID NO: 372077 - DNA, 15 bp, Homo sapiens
gtcatgggttatctt

SEQ ID NO: 372078 - DNA, 15 bp, Homo sapiens
tcatgggttatctta

SEQ ID NO: 372079 - DNA, 15 bp, Homo sapiens
catgggttatcttac

SEQ ID NO: 372080 - DNA, 15 bp, Homo sapiens
atgggttatcttact

SEQ ID NO: 372081 - DNA, 15 bp, Homo sapiens
tgggttatcttactt

SEQ ID NO: 372082 - DNA, 15 bp, Homo sapiens
gggttatcttacttt

SEQ ID NO: 372083 - DNA, 15 bp, Homo sapiens
ggttatcttactttt

SEQ ID NO: 372084 - DNA, 15 bp, Homo sapiens
gttatcttacttttt

SEQ ID NO: 372085 - DNA, 15 bp, Homo sapiens
ttatcttacttttta

SEQ ID NO: 372086 - DNA, 15 bp, Homo sapiens
tatcttactttttaa

SEQ ID NO: 372087 - DNA, 15 bp, Homo sapiens
atcttactttttaaa

SEQ ID NO: 372088 - DNA, 15 bp, Homo sapiens
tcttactttttaaaa

SEQ ID NO: 372089 - DNA, 15 bp, Homo sapiens
cttactttttaaaac

SEQ ID NO: 372090 - DNA, 15 bp, Homo sapiens
ttactttttaaaacc

SEQ ID NO: 372091 - DNA, 15 bp, Homo sapiens
tactttttaaaacct

SEQ ID NO: 372092 - DNA, 15 bp, Homo sapiens
actttttaaaacctc

SEQ ID NO: 372093 - DNA, 15 bp, Homo sapiens
ctttttaaaacctct

SEQ ID NO: 372094 - DNA, 15 bp, Homo sapiens
tttttaaaacctcta

SEQ ID NO: 372095 - DNA, 15 bp, Homo sapiens
ttttaaaacctctat

SEQ ID NO: 372096 - DNA, 15 bp, Homo sapiens
tttaaaacctctata

SEQ ID NO: 372097 - DNA, 15 bp, Homo sapiens
ttaaaacctctatat

SEQ ID NO: 372098 - DNA, 15 bp, Homo sapiens
taaaacctctatatg

SEQ ID NO: 372099 - DNA, 15 bp, Homo sapiens
aaaacctctatatgg

SEQ ID NO: 372100 - DNA, 15 bp, Homo sapiens
aaacctctatatggt

SEQ ID NO: 372101 - DNA, 15 bp, Homo sapiens
aacctctatatggta

SEQ ID NO: 372102 - DNA, 15 bp, Homo sapiens
acctctatatggtaa

SEQ ID NO: 372103 - DNA, 15 bp, Homo sapiens
cctctatatggtaaa

SEQ ID NO: 372104 - DNA, 15 bp, Homo sapiens
ctctatatggtaaag

SEQ ID NO: 372105 - DNA, 15 bp, Homo sapiens
tctatatggtaaagg

SEQ ID NO: 372106 - DNA, 15 bp, Homo sapiens
ctatatggtaaagga

SEQ ID NO: 372107 - DNA, 15 bp, Homo sapiens
tatatggtaaaggag

SEQ ID NO: 372108 - DNA, 15 bp, Homo sapiens
atatggtaaaggagc

SEQ ID NO: 372109 - DNA, 15 bp, Homo sapiens
tatggtaaaggagca

SEQ ID NO: 372110 - DNA, 15 bp, Homo sapiens
atggtaaaggagcag

SEQ ID NO: 372111 - DNA, 15 bp, Homo sapiens
tggtaaaggagcagg

SEQ ID NO: 372112 - DNA, 15 bp, Homo sapiens
ggtaaaggagcaggg

SEQ ID NO: 372113 - DNA, 15 bp, Homo sapiens
gtaaaggagcaggga

SEQ ID NO: 372114 - DNA, 15 bp, Homo sapiens
taaaggagcagggaa

SEQ ID NO: 372115 - DNA, 15 bp, Homo sapiens
aaaggagcagggaaa

SEQ ID NO: 372116 - DNA, 15 bp, Homo sapiens
aaggagcagggaaaa

SEQ ID NO: 372117 - DNA, 15 bp, Homo sapiens
aggagcagggaaaat

SEQ ID NO: 372118 - DNA, 15 bp, Homo sapiens
ggagcagggaaaatt

SEQ ID NO: 372119 - DNA, 15 bp, Homo sapiens
gagcagggaaaattt

SEQ ID NO: 372120 - DNA, 15 bp, Homo sapiens
agcagggaaaatttg

SEQ ID NO: 372121 - DNA, 15 bp, Homo sapiens
gcagggaaaatttga

SEQ ID NO: 372122 - DNA, 15 bp, Homo sapiens
cagggaaaatttgaa

SEQ ID NO: 372123 - DNA, 15 bp, Homo sapiens
agggaaaatttgaat

SEQ ID NO: 372124 - DNA, 15 bp, Homo sapiens
gggaaaatttgaata

SEQ ID NO: 372125 - DNA, 15 bp, Homo sapiens
ggaaaatttgaatac

SEQ ID NO: 372126 - DNA, 15 bp, Homo sapiens
gaaaatttgaataca

SEQ ID NO: 372127 - DNA, 15 bp, Homo sapiens
aaaatttgaatacat

SEQ ID NO: 372128 - DNA, 15 bp, Homo sapiens
aaatttgaatacata

SEQ ID NO: 372129 - DNA, 15 bp, Homo sapiens
aatttgaatacatat

SEQ ID NO: 372130 - DNA, 15 bp, Homo sapiens
atttgaatacatatt

SEQ ID NO: 372131 - DNA, 15 bp, Homo sapiens
tttgaatacatattt

SEQ ID NO: 372132 - DNA, 15 bp, Homo sapiens
ttgaatacatattta

SEQ ID NO: 372133 - DNA, 15 bp, Homo sapiens
tgaatacatatttag

SEQ ID NO: 372134 - DNA, 15 bp, Homo sapiens
gaatacatatttaga

SEQ ID NO: 372135 - DNA, 15 bp, Homo sapiens
aatacatatttagaa

SEQ ID NO: 372136 - DNA, 15 bp, Homo sapiens
atacatatttagaag

SEQ ID NO: 372137 - DNA, 15 bp, Homo sapiens
tacatatttagaagt

SEQ ID NO: 372138 - DNA, 15 bp, Homo sapiens
acatatttagaagta

SEQ ID NO: 372139 - DNA, 15 bp, Homo sapiens
catatttagaagtat

SEQ ID NO: 372140 - DNA, 15 bp, Homo sapiens
atatttagaagtata

SEQ ID NO: 372141 - DNA, 15 bp, Homo sapiens
tatttagaagtataa

SEQ ID NO: 372142 - DNA, 15 bp, Homo sapiens
atttagaagtataaa

SEQ ID NO: 372143 - DNA, 15 bp, Homo sapiens
tttagaagtataaaa

SEQ ID NO: 372144 - DNA, 15 bp, Homo sapiens
ttagaagtataaaaa

SEQ ID NO: 372145 - DNA, 15 bp, Homo sapiens
tagaagtataaaaag

SEQ ID NO: 372146 - DNA, 15 bp, Homo sapiens
agaagtataaaaagc

SEQ ID NO: 372147 - DNA, 15 bp, Homo sapiens
gaagtataaaaagct

SEQ ID NO: 372148 - DNA, 15 bp, Homo sapiens
aagtataaaaagcta

SEQ ID NO: 372149 - DNA, 15 bp, Homo sapiens
agtataaaaagctaa

SEQ ID NO: 372150 - DNA, 15 bp, Homo sapiens
gtataaaaagctaac

SEQ ID NO: 372151 - DNA, 15 bp, Homo sapiens
tataaaaagctaaca

SEQ ID NO: 372152 - DNA, 15 bp, Homo sapiens
ataaaaagctaacag

SEQ ID NO: 372153 - DNA, 15 bp, Homo sapiens
taaaaagctaacagc

SEQ ID NO: 372154 - DNA, 15 bp, Homo sapiens
aaaaagctaacagca

SEQ ID NO: 372155 - DNA, 15 bp, Homo sapiens
aaaagctaacagcaa

SEQ ID NO: 372156 - DNA, 15 bp, Homo sapiens
aaagctaacagcaaa

SEQ ID NO: 372157 - DNA, 15 bp, Homo sapiens
aagctaacagcaaag

SEQ ID NO: 372158 - DNA, 15 bp, Homo sapiens
agctaacagcaaagc

SEQ ID NO: 372159 - DNA, 15 bp, Homo sapiens
gctaacagcaaagct

SEQ ID NO: 372160 - DNA, 15 bp, Homo sapiens
ctaacagcaaagcta

SEQ ID NO: 372161 - DNA, 15 bp, Homo sapiens
taacagcaaagctac

SEQ ID NO: 372162 - DNA, 15 bp, Homo sapiens
aacagcaaagctaca

SEQ ID NO: 372163 - DNA, 15 bp, Homo sapiens
acagcaaagctacaa

SEQ ID NO: 372164 - DNA, 15 bp, Homo sapiens
cagcaaagctacaac

SEQ ID NO: 372165 - DNA, 15 bp, Homo sapiens
agcaaagctacaact

SEQ ID NO: 372166 - DNA, 15 bp, Homo sapiens
gcaaagctacaactt

SEQ ID NO: 372167 - DNA, 15 bp, Homo sapiens
caaagctacaacttc

SEQ ID NO: 372168 - DNA, 15 bp, Homo sapiens
aaagctacaacttcc

SEQ ID NO: 372169 - DNA, 15 bp, Homo sapiens
aagctacaacttcca

SEQ ID NO: 372170 - DNA, 15 bp, Homo sapiens
agctacaacttccat

SEQ ID NO: 372171 - DNA, 15 bp, Homo sapiens
gctacaacttccatt

SEQ ID NO: 372172 - DNA, 15 bp, Homo sapiens
ctacaacttccatta

SEQ ID NO: 372173 - DNA, 15 bp, Homo sapiens
tacaacttccattag

SEQ ID NO: 372174 - DNA, 15 bp, Homo sapiens
acaacttccattagg

SEQ ID NO: 372175 - DNA, 15 bp, Homo sapiens
caacttccattaggt

SEQ ID NO: 372176 - DNA, 15 bp, Homo sapiens
aacttccattaggtg

SEQ ID NO: 372177 - DNA, 15 bp, Homo sapiens
acttccattaggtgg

SEQ ID NO: 372178 - DNA, 15 bp, Homo sapiens
cttccattaggtgga

SEQ ID NO: 372179 - DNA, 15 bp, Homo sapiens
ttccattaggtggat

SEQ ID NO: 372180 - DNA, 15 bp, Homo sapiens
tccattaggtggatg

SEQ ID NO: 372181 - DNA, 15 bp, Homo sapiens
ccattaggtggatgg

SEQ ID NO: 372182 - DNA, 15 bp, Homo sapiens
cattaggtggatggc

SEQ ID NO: 372183 - DNA, 15 bp, Homo sapiens
attaggtggatggct

SEQ ID NO: 372184 - DNA, 15 bp, Homo sapiens
ttaggtggatggctc

SEQ ID NO: 372185 - DNA, 15 bp, Homo sapiens
taggtggatggctca

SEQ ID NO: 372186 - DNA, 15 bp, Homo sapiens
aggtggatggctcat

SEQ ID NO: 372187 - DNA, 15 bp, Homo sapiens
ggtggatggctcatt

SEQ ID NO: 372188 - DNA, 15 bp, Homo sapiens
gtggatggctcattt

SEQ ID NO: 372189 - DNA, 15 bp, Homo sapiens
tggatggctcatttt

SEQ ID NO: 372190 - DNA, 15 bp, Homo sapiens
ggatggctcattttt

SEQ ID NO: 372191 - DNA, 15 bp, Homo sapiens
gatggctcattttta

SEQ ID NO: 372192 - DNA, 15 bp, Homo sapiens
atggctcatttttaa

SEQ ID NO: 372193 - DNA, 15 bp, Homo sapiens
tggctcatttttaac

SEQ ID NO: 372194 - DNA, 15 bp, Homo sapiens
ggctcatttttaaca

SEQ ID NO: 372195 - DNA, 15 bp, Homo sapiens
gctcatttttaacag

SEQ ID NO: 372196 - DNA, 15 bp, Homo sapiens
ctcatttttaacagg

SEQ ID NO: 372197 - DNA, 15 bp, Homo sapiens
tcatttttaacagga

SEQ ID NO: 372198 - DNA, 15 bp, Homo sapiens
catttttaacaggat

SEQ ID NO: 372199 - DNA, 15 bp, Homo sapiens
atttttaacaggata

SEQ ID NO: 372200 - DNA, 15 bp, Homo sapiens
tttttaacaggatat

SEQ ID NO: 372201 - DNA, 15 bp, Homo sapiens
ttttaacaggatatt

SEQ ID NO: 372202 - DNA, 15 bp, Homo sapiens
tttaacaggatattc

SEQ ID NO: 372203 - DNA, 15 bp, Homo sapiens
ttaacaggatattcg

SEQ ID NO: 372204 - DNA, 15 bp, Homo sapiens
taacaggatattcgt

SEQ ID NO: 372205 - DNA, 15 bp, Homo sapiens
aacaggatattcgtc

SEQ ID NO: 372206 - DNA, 15 bp, Homo sapiens
acaggatattcgtcc

SEQ ID NO: 372207 - DNA, 15 bp, Homo sapiens
caggatattcgtcct

SEQ ID NO: 372208 - DNA, 15 bp, Homo sapiens
aggatattcgtcctt

SEQ ID NO: 372209 - DNA, 15 bp, Homo sapiens
ggatattcgtccttg

SEQ ID NO: 372210 - DNA, 15 bp, Homo sapiens
gatattcgtccttgg

SEQ ID NO: 372211 - DNA, 15 bp, Homo sapiens
atattcgtccttggg

SEQ ID NO: 372212 - DNA, 15 bp, Homo sapiens
tattcgtccttggga

SEQ ID NO: 372213 - DNA, 15 bp, Homo sapiens
attcgtccttgggat

SEQ ID NO: 372214 - DNA, 15 bp, Homo sapiens
ttcgtccttgggata

SEQ ID NO: 372215 - DNA, 15 bp, Homo sapiens
tcgtccttgggatag

SEQ ID NO: 372216 - DNA, 15 bp, Homo sapiens
cgtccttgggatagg

SEQ ID NO: 372217 - DNA, 15 bp, Homo sapiens
gtccttgggataggc

SEQ ID NO: 372218 - DNA, 15 bp, Homo sapiens
tccttgggataggcc

SEQ ID NO: 372219 - DNA, 15 bp, Homo sapiens
ccttgggataggcct

SEQ ID NO: 372220 - DNA, 15 bp, Homo sapiens
cttgggataggcctg

SEQ ID NO: 372221 - DNA, 15 bp, Homo sapiens
ttgggataggcctga

SEQ ID NO: 372222 - DNA, 15 bp, Homo sapiens
tgggataggcctgag

SEQ ID NO: 372223 - DNA, 15 bp, Homo sapiens
gggataggcctgaga

SEQ ID NO: 372224 - DNA, 15 bp, Homo sapiens
ggataggcctgagac

SEQ ID NO: 372225 - DNA, 15 bp, Homo sapiens
gataggcctgagacc

SEQ ID NO: 372226 - DNA, 15 bp, Homo sapiens
ataggcctgagacct

SEQ ID NO: 372227 - DNA, 15 bp, Homo sapiens
taggcctgagacctg

SEQ ID NO: 372228 - DNA, 15 bp, Homo sapiens
aggcctgagacctga

SEQ ID NO: 372229 - DNA, 15 bp, Homo sapiens
ggcctgagacctgaa

SEQ ID NO: 372230 - DNA, 15 bp, Homo sapiens
gcctgagacctgaag

SEQ ID NO: 372231 - DNA, 15 bp, Homo sapiens
cctgagacctgaagc

SEQ ID NO: 372232 - DNA, 15 bp, Homo sapiens
ctgagacctgaagct

SEQ ID NO: 372233 - DNA, 15 bp, Homo sapiens
tgagacctgaagcta

SEQ ID NO: 372234 - DNA, 15 bp, Homo sapiens
gagacctgaagctaa

SEQ ID NO: 372235 - DNA, 15 bp, Homo sapiens
agacctgaagctaat

SEQ ID NO: 372236 - DNA, 15 bp, Homo sapiens
gacctgaagctaatc

SEQ ID NO: 372237 - DNA, 15 bp, Homo sapiens
acctgaagctaatct

SEQ ID NO: 372238 - DNA, 15 bp, Homo sapiens
cctgaagctaatctt

SEQ ID NO: 372239 - DNA, 15 bp, Homo sapiens
ctgaagctaatctta

SEQ ID NO: 372240 - DNA, 15 bp, Homo sapiens
tgaagctaatcttag

SEQ ID NO: 372241 - DNA, 15 bp, Homo sapiens
gaagctaatcttagt

SEQ ID NO: 372242 - DNA, 15 bp, Homo sapiens
aagctaatcttagta

SEQ ID NO: 372243 - DNA, 15 bp, Homo sapiens
agctaatcttagtat

SEQ ID NO: 372244 - DNA, 15 bp, Homo sapiens
gctaatcttagtatg

SEQ ID NO: 372245 - DNA, 15 bp, Homo sapiens
ctaatcttagtatgt

SEQ ID NO: 372246 - DNA, 15 bp, Homo sapiens
taatcttagtatgtc

SEQ ID NO: 372247 - DNA, 15 bp, Homo sapiens
aatcttagtatgtct

SEQ ID NO: 372248 - DNA, 15 bp, Homo sapiens
atcttagtatgtctc

SEQ ID NO: 372249 - DNA, 15 bp, Homo sapiens
tcttagtatgtctct

SEQ ID NO: 372250 - DNA, 15 bp, Homo sapiens
cttagtatgtctctc

SEQ ID NO: 372251 - DNA, 15 bp, Homo sapiens
ttagtatgtctctct

SEQ ID NO: 372252 - DNA, 15 bp, Homo sapiens
tagtatgtctctctc

SEQ ID NO: 372253 - DNA, 15 bp, Homo sapiens
agtatgtctctctcc

SEQ ID NO: 372254 - DNA, 15 bp, Homo sapiens
gtatgtctctctcct

SEQ ID NO: 372255 - DNA, 15 bp, Homo sapiens
tatgtctctctcctc

SEQ ID NO: 372256 - DNA, 15 bp, Homo sapiens
atgtctctctcctcc

SEQ ID NO: 372257 - DNA, 15 bp, Homo sapiens
tgtctctctcctcct

SEQ ID NO: 372258 - DNA, 15 bp, Homo sapiens
gtctctctcctccta

SEQ ID NO: 372259 - DNA, 15 bp, Homo sapiens
tctctctcctcctac

SEQ ID NO: 372260 - DNA, 15 bp, Homo sapiens
ctctctcctcctacg

SEQ ID NO: 372261 - DNA, 15 bp, Homo sapiens
tctctcctcctacgc

SEQ ID NO: 372262 - DNA, 15 bp, Homo sapiens
ctctcctcctacgca

SEQ ID NO: 372263 - DNA, 15 bp, Homo sapiens
tctcctcctacgcag

SEQ ID NO: 372264 - DNA, 15 bp, Homo sapiens
ctcctcctacgcagt

SEQ ID NO: 372265 - DNA, 15 bp, Homo sapiens
tcctcctacgcagtg

SEQ ID NO: 372266 - DNA, 15 bp, Homo sapiens
cctcctacgcagtgt

SEQ ID NO: 372267 - DNA, 15 bp, Homo sapiens
ctcctacgcagtgtt

SEQ ID NO: 372268 - DNA, 15 bp, Homo sapiens
tcctacgcagtgttt

SEQ ID NO: 372269 - DNA, 15 bp, Homo sapiens
cctacgcagtgtttt

SEQ ID NO: 372270 - DNA, 15 bp, Homo sapiens
ctacgcagtgtttta

SEQ ID NO: 372271 - DNA, 15 bp, Homo sapiens
tacgcagtgttttaa

SEQ ID NO: 372272 - DNA, 15 bp, Homo sapiens
acgcagtgttttaat

SEQ ID NO: 372273 - DNA, 15 bp, Homo sapiens
cgcagtgttttaatt

SEQ ID NO: 372274 - DNA, 15 bp, Homo sapiens
gcagtgttttaattc

SEQ ID NO: 372275 - DNA, 15 bp, Homo sapiens
cagtgttttaattca

SEQ ID NO: 372276 - DNA, 15 bp, Homo sapiens
agtgttttaattcag

SEQ ID NO: 372277 - DNA, 15 bp, Homo sapiens
gtgttttaattcagt

SEQ ID NO: 372278 - DNA, 15 bp, Homo sapiens
tgttttaattcagtt

SEQ ID NO: 372279 - DNA, 15 bp, Homo sapiens
gttttaattcagttc

SEQ ID NO: 372280 - DNA, 15 bp, Homo sapiens
ttttaattcagttcc

SEQ ID NO: 372281 - DNA, 15 bp, Homo sapiens
tttaattcagttcct

SEQ ID NO: 372282 - DNA, 15 bp, Homo sapiens
ttaattcagttcctt

SEQ ID NO: 372283 - DNA, 15 bp, Homo sapiens
taattcagttccttc

SEQ ID NO: 372284 - DNA, 15 bp, Homo sapiens
aattcagttccttct

SEQ ID NO: 372285 - DNA, 15 bp, Homo sapiens
attcagttccttctt

SEQ ID NO: 372286 - DNA, 15 bp, Homo sapiens
ttcagttccttcttt

SEQ ID NO: 372287 - DNA, 15 bp, Homo sapiens
tcagttccttctttt

SEQ ID NO: 372288 - DNA, 15 bp, Homo sapiens
cagttccttcttttt

SEQ ID NO: 372289 - DNA, 15 bp, Homo sapiens
agttccttcttttta

SEQ ID NO: 372290 - DNA, 15 bp, Homo sapiens
gttccttctttttaa

SEQ ID NO: 372291 - DNA, 15 bp, Homo sapiens
ttccttctttttaac

SEQ ID NO: 372292 - DNA, 15 bp, Homo sapiens
tccttctttttaaca

SEQ ID NO: 372293 - DNA, 15 bp, Homo sapiens
ccttctttttaacat

SEQ ID NO: 372294 - DNA, 15 bp, Homo sapiens
cttctttttaacatt

SEQ ID NO: 372295 - DNA, 15 bp, Homo sapiens
ttctttttaacattt

SEQ ID NO: 372296 - DNA, 15 bp, Homo sapiens
tctttttaacatttt

SEQ ID NO: 372297 - DNA, 15 bp, Homo sapiens
ctttttaacatttta

SEQ ID NO: 372298 - DNA, 15 bp, Homo sapiens
tttttaacattttat

SEQ ID NO: 372299 - DNA, 15 bp, Homo sapiens
ttttaacattttatt

SEQ ID NO: 372300 - DNA, 15 bp, Homo sapiens
tttaacattttattt

SEQ ID NO: 372301 - DNA, 15 bp, Homo sapiens
ttaacattttattta

SEQ ID NO: 372302 - DNA, 15 bp, Homo sapiens
taacattttatttag

SEQ ID NO: 372303 - DNA, 15 bp, Homo sapiens
aacattttatttaga

SEQ ID NO: 372304 - DNA, 15 bp, Homo sapiens
acattttatttagaa

SEQ ID NO: 372305 - DNA, 15 bp, Homo sapiens
cattttatttagaaa

SEQ ID NO: 372306 - DNA, 15 bp, Homo sapiens
attttatttagaaaa

SEQ ID NO: 372307 - DNA, 15 bp, Homo sapiens
ttttatttagaaaat

SEQ ID NO: 372308 - DNA, 15 bp, Homo sapiens
tttatttagaaaata

SEQ ID NO: 372309 - DNA, 15 bp, Homo sapiens
ttatttagaaaataa

SEQ ID NO: 372310 - DNA, 15 bp, Homo sapiens
tatttagaaaataaa

SEQ ID NO: 372311 - DNA, 15 bp, Homo sapiens
atttagaaaataaaa

SEQ ID NO: 372312 - DNA, 15 bp, Homo sapiens
ttagaaaataaaatt

SEQ ID NO: 372313 - DNA, 15 bp, Homo sapiens
tagaaaataaaatta

SEQ ID NO: 372314 - DNA, 15 bp, Homo sapiens
agaaaataaaattaa

SEQ ID NO: 372315 - DNA, 15 bp, Homo sapiens
gaaaataaaattaac

SEQ ID NO: 372316 - DNA, 15 bp, Homo sapiens
aaaataaaattaacc

SEQ ID NO: 372317 - DNA, 15 bp, Homo sapiens
aaataaaattaacca

SEQ ID NO: 372318 - DNA, 15 bp, Homo sapiens
aataaaattaaccat

SEQ ID NO: 372319 - DNA, 15 bp, Homo sapiens
ataaaattaaccatt

SEQ ID NO: 372320 - DNA, 15 bp, Homo sapiens
taaaattaaccattt

SEQ ID NO: 372321 - DNA, 15 bp, Homo sapiens
aaaattaaccatttt

SEQ ID NO: 372322 - DNA, 15 bp, Homo sapiens
aaattaaccatttta

SEQ ID NO: 372323 - DNA, 15 bp, Homo sapiens
aattaaccattttaa

SEQ ID NO: 372324 - DNA, 15 bp, Homo sapiens
attaaccattttaaa

SEQ ID NO: 372325 - DNA, 15 bp, Homo sapiens
ttaaccattttaaag

SEQ ID NO: 372326 - DNA, 15 bp, Homo sapiens
taaccattttaaagt

SEQ ID NO: 372327 - DNA, 15 bp, Homo sapiens
aaccattttaaagtg

SEQ ID NO: 372328 - DNA, 15 bp, Homo sapiens
accattttaaagtga

SEQ ID NO: 372329 - DNA, 15 bp, Homo sapiens
ccattttaaagtgaa

SEQ ID NO: 372330 - DNA, 15 bp, Homo sapiens
cattttaaagtgaac

SEQ ID NO: 372331 - DNA, 15 bp, Homo sapiens
attttaaagtgaaca

SEQ ID NO: 372332 - DNA, 15 bp, Homo sapiens
ttttaaagtgaacaa

SEQ ID NO: 372333 - DNA, 15 bp, Homo sapiens
tttaaagtgaacaat

SEQ ID NO: 372334 - DNA, 15 bp, Homo sapiens
ttaaagtgaacaatt

SEQ ID NO: 372335 - DNA, 15 bp, Homo sapiens
taaagtgaacaattt

SEQ ID NO: 372336 - DNA, 15 bp, Homo sapiens
aaagtgaacaatttg

SEQ ID NO: 372337 - DNA, 15 bp, Homo sapiens
aagtgaacaatttgg

SEQ ID NO: 372338 - DNA, 15 bp, Homo sapiens
agtgaacaatttggt

SEQ ID NO: 372339 - DNA, 15 bp, Homo sapiens
gtgaacaatttggtg

SEQ ID NO: 372340 - DNA, 15 bp, Homo sapiens
tgaacaatttggtga

SEQ ID NO: 372341 - DNA, 15 bp, Homo sapiens
gaacaatttggtgac

SEQ ID NO: 372342 - DNA, 15 bp, Homo sapiens
aacaatttggtgaca

SEQ ID NO: 372343 - DNA, 15 bp, Homo sapiens
acaatttggtgacat

SEQ ID NO: 372344 - DNA, 15 bp, Homo sapiens
caatttggtgacatt

SEQ ID NO: 372345 - DNA, 15 bp, Homo sapiens
aatttggtgacattt

SEQ ID NO: 372346 - DNA, 15 bp, Homo sapiens
atttggtgacattta

SEQ ID NO: 372347 - DNA, 15 bp, Homo sapiens
tttggtgacatttaa

SEQ ID NO: 372348 - DNA, 15 bp, Homo sapiens
ttggtgacatttaat

SEQ ID NO: 372349 - DNA, 15 bp, Homo sapiens
tggtgacatttaatg

SEQ ID NO: 372350 - DNA, 15 bp, Homo sapiens
ggtgacatttaatgc

SEQ ID NO: 372351 - DNA, 15 bp, Homo sapiens
gtgacatttaatgca

SEQ ID NO: 372352 - DNA, 15 bp, Homo sapiens
tgacatttaatgcat

SEQ ID NO: 372353 - DNA, 15 bp, Homo sapiens
gacatttaatgcatt

SEQ ID NO: 372354 - DNA, 15 bp, Homo sapiens
acatttaatgcattc

SEQ ID NO: 372355 - DNA, 15 bp, Homo sapiens
catttaatgcattca

SEQ ID NO: 372356 - DNA, 15 bp, Homo sapiens
atttaatgcattcac

SEQ ID NO: 372357 - DNA, 15 bp, Homo sapiens
tttaatgcattcaca

SEQ ID NO: 372358 - DNA, 15 bp, Homo sapiens
ttaatgcattcacaa

SEQ ID NO: 372359 - DNA, 15 bp, Homo sapiens
taatgcattcacaat

SEQ ID NO: 372360 - DNA, 15 bp, Homo sapiens
aatgcattcacaatg

SEQ ID NO: 372361 - DNA, 15 bp, Homo sapiens
atgcattcacaatgt

SEQ ID NO: 372362 - DNA, 15 bp, Homo sapiens
tgcattcacaatgtt

SEQ ID NO: 372363 - DNA, 15 bp, Homo sapiens
gcattcacaatgttg

SEQ ID NO: 372364 - DNA, 15 bp, Homo sapiens
cattcacaatgttgt

SEQ ID NO: 372365 - DNA, 15 bp, Homo sapiens
attcacaatgttgta

SEQ ID NO: 372366 - DNA, 15 bp, Homo sapiens
ttcacaatgttgtac

SEQ ID NO: 372367 - DNA, 15 bp, Homo sapiens
tcacaatgttgtaca

SEQ ID NO: 372368 - DNA, 15 bp, Homo sapiens
cacaatgttgtacaa

SEQ ID NO: 372369 - DNA, 15 bp, Homo sapiens
acaatgttgtacaac

SEQ ID NO: 372370 - DNA, 15 bp, Homo sapiens
caatgttgtacaacc

SEQ ID NO: 372371 - DNA, 15 bp, Homo sapiens
aatgttgtacaacca

SEQ ID NO: 372372 - DNA, 15 bp, Homo sapiens
atgttgtacaaccac

SEQ ID NO: 372373 - DNA, 15 bp, Homo sapiens
tgttgtacaaccact

SEQ ID NO: 372374 - DNA, 15 bp, Homo sapiens
gttgtacaaccacta

SEQ ID NO: 372375 - DNA, 15 bp, Homo sapiens
ttgtacaaccactat

SEQ ID NO: 372376 - DNA, 15 bp, Homo sapiens
tgtacaaccactatt

SEQ ID NO: 372377 - DNA, 15 bp, Homo sapiens
gtacaaccactattt

SEQ ID NO: 372378 - DNA, 15 bp, Homo sapiens
tacaaccactatttc

SEQ ID NO: 372379 - DNA, 15 bp, Homo sapiens
acaaccactatttct

SEQ ID NO: 372380 - DNA, 15 bp, Homo sapiens
caaccactatttcta

SEQ ID NO: 372381 - DNA, 15 bp, Homo sapiens
aaccactatttctat

SEQ ID NO: 372382 - DNA, 15 bp, Homo sapiens
accactatttctatc

SEQ ID NO: 372383 - DNA, 15 bp, Homo sapiens
ccactatttctatct

SEQ ID NO: 372384 - DNA, 15 bp, Homo sapiens
cactatttctatcta

SEQ ID NO: 372385 - DNA, 15 bp, Homo sapiens
actatttctatctag

SEQ ID NO: 372386 - DNA, 15 bp, Homo sapiens
ctatttctatctagt

SEQ ID NO: 372387 - DNA, 15 bp, Homo sapiens
tatttctatctagtt

SEQ ID NO: 372388 - DNA, 15 bp, Homo sapiens
atttctatctagttc

SEQ ID NO: 372389 - DNA, 15 bp, Homo sapiens
tttctatctagttcc

SEQ ID NO: 372390 - DNA, 15 bp, Homo sapiens
ttctatctagttcca

SEQ ID NO: 372391 - DNA, 15 bp, Homo sapiens
tctatctagttccaa

SEQ ID NO: 372392 - DNA, 15 bp, Homo sapiens
ctatctagttccaaa

SEQ ID NO: 372393 - DNA, 15 bp, Homo sapiens
tatctagttccaaaa

SEQ ID NO: 372394 - DNA, 15 bp, Homo sapiens
atctagttccaaaat

SEQ ID NO: 372395 - DNA, 15 bp, Homo sapiens
tctagttccaaaata

SEQ ID NO: 372396 - DNA, 15 bp, Homo sapiens
ctagttccaaaatat

SEQ ID NO: 372397 - DNA, 15 bp, Homo sapiens
tagttccaaaatatt

SEQ ID NO: 372398 - DNA, 15 bp, Homo sapiens
agttccaaaatattt

SEQ ID NO: 372399 - DNA, 15 bp, Homo sapiens
gttccaaaatatttc

SEQ ID NO: 372400 - DNA, 15 bp, Homo sapiens
ttccaaaatatttct

SEQ ID NO: 372401 - DNA, 15 bp, Homo sapiens
tccaaaatatttcta

SEQ ID NO: 372402 - DNA, 15 bp, Homo sapiens
ccaaaatatttctat

SEQ ID NO: 372403 - DNA, 15 bp, Homo sapiens
aaaatatttctatca

SEQ ID NO: 372404 - DNA, 15 bp, Homo sapiens
aaatatttctatcac

SEQ ID NO: 372405 - DNA, 15 bp, Homo sapiens
aatatttctatcact

SEQ ID NO: 372406 - DNA, 15 bp, Homo sapiens
atatttctatcactc

SEQ ID NO: 372407 - DNA, 15 bp, Homo sapiens
tatttctatcactcc

SEQ ID NO: 372408 - DNA, 15 bp, Homo sapiens
atttctatcactcca

SEQ ID NO: 372409 - DNA, 15 bp, Homo sapiens
tttctatcactccaa

SEQ ID NO: 372410 - DNA, 15 bp, Homo sapiens
ttctatcactccaaa

SEQ ID NO: 372411 - DNA, 15 bp, Homo sapiens
tctatcactccaaac

SEQ ID NO: 372412 - DNA, 15 bp, Homo sapiens
ctatcactccaaact

SEQ ID NO: 372413 - DNA, 15 bp, Homo sapiens
tatcactccaaacta

SEQ ID NO: 372414 - DNA, 15 bp, Homo sapiens
atcactccaaactaa

SEQ ID NO: 372415 - DNA, 15 bp, Homo sapiens
tcactccaaactaaa

SEQ ID NO: 372416 - DNA, 15 bp, Homo sapiens
cactccaaactaaaa

SEQ ID NO: 372417 - DNA, 15 bp, Homo sapiens
actccaaactaaaac

SEQ ID NO: 372418 - DNA, 15 bp, Homo sapiens
ctccaaactaaaacc

SEQ ID NO: 372419 - DNA, 15 bp, Homo sapiens
tccaaactaaaacct

SEQ ID NO: 372420 - DNA, 15 bp, Homo sapiens
ccaaactaaaacctc

SEQ ID NO: 372421 - DNA, 15 bp, Homo sapiens
caaactaaaacctct

SEQ ID NO: 372422 - DNA, 15 bp, Homo sapiens
aaactaaaacctctt

SEQ ID NO: 372423 - DNA, 15 bp, Homo sapiens
aactaaaacctctta

SEQ ID NO: 372424 - DNA, 15 bp, Homo sapiens
actaaaacctcttac

SEQ ID NO: 372425 - DNA, 15 bp, Homo sapiens
ctaaaacctcttact

SEQ ID NO: 372426 - DNA, 15 bp, Homo sapiens
taaaacctcttactc

SEQ ID NO: 372427 - DNA, 15 bp, Homo sapiens
aaaacctcttactca

SEQ ID NO: 372428 - DNA, 15 bp, Homo sapiens
aaacctcttactcat

SEQ ID NO: 372429 - DNA, 15 bp, Homo sapiens
aacctcttactcatt

SEQ ID NO: 372430 - DNA, 15 bp, Homo sapiens
acctcttactcatta

SEQ ID NO: 372431 - DNA, 15 bp, Homo sapiens
cctcttactcattaa

SEQ ID NO: 372432 - DNA, 15 bp, Homo sapiens
ctcttactcattaag

SEQ ID NO: 372433 - DNA, 15 bp, Homo sapiens
tcttactcattaagc

SEQ ID NO: 372434 - DNA, 15 bp, Homo sapiens
cttactcattaagca

SEQ ID NO: 372435 - DNA, 15 bp, Homo sapiens
ttactcattaagcag

SEQ ID NO: 372436 - DNA, 15 bp, Homo sapiens
tactcattaagcagt

SEQ ID NO: 372437 - DNA, 15 bp, Homo sapiens
actcattaagcagtt

SEQ ID NO: 372438 - DNA, 15 bp, Homo sapiens
ctcattaagcagttt

SEQ ID NO: 372439 - DNA, 15 bp, Homo sapiens
tcattaagcagtttc

SEQ ID NO: 372440 - DNA, 15 bp, Homo sapiens
cattaagcagtttct

SEQ ID NO: 372441 - DNA, 15 bp, Homo sapiens
attaagcagtttctt

SEQ ID NO: 372442 - DNA, 15 bp, Homo sapiens
ttaagcagtttcttc

SEQ ID NO: 372443 - DNA, 15 bp, Homo sapiens
taagcagtttcttcc

SEQ ID NO: 372444 - DNA, 15 bp, Homo sapiens
aagcagtttcttccc

SEQ ID NO: 372445 - DNA, 15 bp, Homo sapiens
agcagtttcttccca

SEQ ID NO: 372446 - DNA, 15 bp, Homo sapiens
gcagtttcttcccat

SEQ ID NO: 372447 - DNA, 15 bp, Homo sapiens
cagtttcttcccatt

SEQ ID NO: 372448 - DNA, 15 bp, Homo sapiens
agtttcttcccattc

SEQ ID NO: 372449 - DNA, 15 bp, Homo sapiens
gtttcttcccattcc

SEQ ID NO: 372450 - DNA, 15 bp, Homo sapiens
tttcttcccattccc

SEQ ID NO: 372451 - DNA, 15 bp, Homo sapiens
ttcttcccattccct

SEQ ID NO: 372452 - DNA, 15 bp, Homo sapiens
tcttcccattccctc

SEQ ID NO: 372453 - DNA, 15 bp, Homo sapiens
cttcccattccctcc

SEQ ID NO: 372454 - DNA, 15 bp, Homo sapiens
ttcccattccctcct

SEQ ID NO: 372455 - DNA, 15 bp, Homo sapiens
tcccattccctccta

SEQ ID NO: 372456 - DNA, 15 bp, Homo sapiens
cccattccctcctac

SEQ ID NO: 372457 - DNA, 15 bp, Homo sapiens
ccattccctcctact

SEQ ID NO: 372458 - DNA, 15 bp, Homo sapiens
cattccctcctactc

SEQ ID NO: 372459 - DNA, 15 bp, Homo sapiens
attccctcctactcc

SEQ ID NO: 372460 - DNA, 15 bp, Homo sapiens
ttccctcctactccc

SEQ ID NO: 372461 - DNA, 15 bp, Homo sapiens
tccctcctactccca

SEQ ID NO: 372462 - DNA, 15 bp, Homo sapiens
ccctcctactcccag

SEQ ID NO: 372463 - DNA, 15 bp, Homo sapiens
cctcctactcccagc

SEQ ID NO: 372464 - DNA, 15 bp, Homo sapiens
ctcctactcccagcc

SEQ ID NO: 372465 - DNA, 15 bp, Homo sapiens
tcctactcccagccc

SEQ ID NO: 372466 - DNA, 15 bp, Homo sapiens
cctactcccagcccc

SEQ ID NO: 372467 - DNA, 15 bp, Homo sapiens
ctactcccagcccct

SEQ ID NO: 372468 - DNA, 15 bp, Homo sapiens
tactcccagcccctg

SEQ ID NO: 372469 - DNA, 15 bp, Homo sapiens
actcccagcccctgg

SEQ ID NO: 372470 - DNA, 15 bp, Homo sapiens
ctcccagcccctggc

SEQ ID NO: 372471 - DNA, 15 bp, Homo sapiens
tcccagcccctggca

SEQ ID NO: 372472 - DNA, 15 bp, Homo sapiens
cccagcccctggcaa

SEQ ID NO: 372473 - DNA, 15 bp, Homo sapiens
ccagcccctggcaac

SEQ ID NO: 372474 - DNA, 15 bp, Homo sapiens
cagcccctggcaacc

SEQ ID NO: 372475 - DNA, 15 bp, Homo sapiens
agcccctggcaacca

SEQ ID NO: 372476 - DNA, 15 bp, Homo sapiens
gcccctggcaaccac

SEQ ID NO: 372477 - DNA, 15 bp, Homo sapiens
cccctggcaaccacc

SEQ ID NO: 372478 - DNA, 15 bp, Homo sapiens
ccctggcaaccaccg

SEQ ID NO: 372479 - DNA, 15 bp, Homo sapiens
cctggcaaccaccga

SEQ ID NO: 372480 - DNA, 15 bp, Homo sapiens
ctggcaaccaccgat

SEQ ID NO: 372481 - DNA, 15 bp, Homo sapiens
tggcaaccaccgatc

SEQ ID NO: 372482 - DNA, 15 bp, Homo sapiens
ggcaaccaccgatct

SEQ ID NO: 372483 - DNA, 15 bp, Homo sapiens
gcaaccaccgatctg

SEQ ID NO: 372484 - DNA, 15 bp, Homo sapiens
caaccaccgatctgc

SEQ ID NO: 372485 - DNA, 15 bp, Homo sapiens
aaccaccgatctgca

SEQ ID NO: 372486 - DNA, 15 bp, Homo sapiens
accaccgatctgcat

SEQ ID NO: 372487 - DNA, 15 bp, Homo sapiens
ccaccgatctgcatt

SEQ ID NO: 372488 - DNA, 15 bp, Homo sapiens
caccgatctgcattc

SEQ ID NO: 372489 - DNA, 15 bp, Homo sapiens
accgatctgcattct

SEQ ID NO: 372490 - DNA, 15 bp, Homo sapiens
ccgatctgcattctg

SEQ ID NO: 372491 - DNA, 15 bp, Homo sapiens
cgatctgcattctgt

SEQ ID NO: 372492 - DNA, 15 bp, Homo sapiens
gatctgcattctgtt

SEQ ID NO: 372493 - DNA, 15 bp, Homo sapiens
atctgcattctgttt

SEQ ID NO: 372494 - DNA, 15 bp, Homo sapiens
tctgcattctgtttc

SEQ ID NO: 372495 - DNA, 15 bp, Homo sapiens
ctgcattctgtttcc

SEQ ID NO: 372496 - DNA, 15 bp, Homo sapiens
tgcattctgtttcca

SEQ ID NO: 372497 - DNA, 15 bp, Homo sapiens
gcattctgtttccat

SEQ ID NO: 372498 - DNA, 15 bp, Homo sapiens
cattctgtttccatg

SEQ ID NO: 372499 - DNA, 15 bp, Homo sapiens
attctgtttccatgg

SEQ ID NO: 372500 - DNA, 15 bp, Homo sapiens
ttctgtttccatgga

SEQ ID NO: 372501 - DNA, 15 bp, Homo sapiens
tctgtttccatggat

SEQ ID NO: 372502 - DNA, 15 bp, Homo sapiens
ctgtttccatggatt

SEQ ID NO: 372503 - DNA, 15 bp, Homo sapiens
tgtttccatggattt

SEQ ID NO: 372504 - DNA, 15 bp, Homo sapiens
gtttccatggatttc

SEQ ID NO: 372505 - DNA, 15 bp, Homo sapiens
tttccatggatttct

SEQ ID NO: 372506 - DNA, 15 bp, Homo sapiens
ttccatggatttctc

SEQ ID NO: 372507 - DNA, 15 bp, Homo sapiens
tccatggatttctct

SEQ ID NO: 372508 - DNA, 15 bp, Homo sapiens
ccatggatttctcta

SEQ ID NO: 372509 - DNA, 15 bp, Homo sapiens
catggatttctctat

SEQ ID NO: 372510 - DNA, 15 bp, Homo sapiens
atggatttctctatt

SEQ ID NO: 372511 - DNA, 15 bp, Homo sapiens
tggatttctctattc

SEQ ID NO: 372512 - DNA, 15 bp, Homo sapiens
ggatttctctattct

SEQ ID NO: 372513 - DNA, 15 bp, Homo sapiens
gatttctctattctg

SEQ ID NO: 372514 - DNA, 15 bp, Homo sapiens
atttctctattctgg

SEQ ID NO: 372515 - DNA, 15 bp, Homo sapiens
tttctctattctgga

SEQ ID NO: 372516 - DNA, 15 bp, Homo sapiens
ttctctattctggat

SEQ ID NO: 372517 - DNA, 15 bp, Homo sapiens
tctctattctggata

SEQ ID NO: 372518 - DNA, 15 bp, Homo sapiens
ctctattctggatat

SEQ ID NO: 372519 - DNA, 15 bp, Homo sapiens
tctattctggatatt

SEQ ID NO: 372520 - DNA, 15 bp, Homo sapiens
ctattctggatattt

SEQ ID NO: 372521 - DNA, 15 bp, Homo sapiens
tattctggatatttc

SEQ ID NO: 372522 - DNA, 15 bp, Homo sapiens
attctggatatttca

SEQ ID NO: 372523 - DNA, 15 bp, Homo sapiens
ttctggatatttcat

SEQ ID NO: 372524 - DNA, 15 bp, Homo sapiens
tctggatatttcata

SEQ ID NO: 372525 - DNA, 15 bp, Homo sapiens
ctggatatttcatat

SEQ ID NO: 372526 - DNA, 15 bp, Homo sapiens
tggatatttcatata

SEQ ID NO: 372527 - DNA, 15 bp, Homo sapiens
ggatatttcatataa

SEQ ID NO: 372528 - DNA, 15 bp, Homo sapiens
gatatttcatataaa

SEQ ID NO: 372529 - DNA, 15 bp, Homo sapiens
atatttcatataaat

SEQ ID NO: 372530 - DNA, 15 bp, Homo sapiens
tatttcatataaatg

SEQ ID NO: 372531 - DNA, 15 bp, Homo sapiens
ttcatataaatggag

SEQ ID NO: 372532 - DNA, 15 bp, Homo sapiens
tcatataaatggagt

SEQ ID NO: 372533 - DNA, 15 bp, Homo sapiens
catataaatggagtc

SEQ ID NO: 372534 - DNA, 15 bp, Homo sapiens
atataaatggagtca

SEQ ID NO: 372535 - DNA, 15 bp, Homo sapiens
tataaatggagtcat

SEQ ID NO: 372536 - DNA, 15 bp, Homo sapiens
ataaatggagtcata

SEQ ID NO: 372537 - DNA, 15 bp, Homo sapiens
taaatggagtcatac

SEQ ID NO: 372538 - DNA, 15 bp, Homo sapiens
aaatggagtcatacg

SEQ ID NO: 372539 - DNA, 15 bp, Homo sapiens
aatggagtcatacga

SEQ ID NO: 372540 - DNA, 15 bp, Homo sapiens
atggagtcatacgat

SEQ ID NO: 372541 - DNA, 15 bp, Homo sapiens
tggagtcatacgatg

SEQ ID NO: 372542 - DNA, 15 bp, Homo sapiens
ggagtcatacgatgc

SEQ ID NO: 372543 - DNA, 15 bp, Homo sapiens
gagtcatacgatgct

SEQ ID NO: 372544 - DNA, 15 bp, Homo sapiens
agtcatacgatgctt

SEQ ID NO: 372545 - DNA, 15 bp, Homo sapiens
gtcatacgatgcttc

SEQ ID NO: 372546 - DNA, 15 bp, Homo sapiens
tcatacgatgcttct

SEQ ID NO: 372547 - DNA, 15 bp, Homo sapiens
catacgatgcttctt

SEQ ID NO: 372548 - DNA, 15 bp, Homo sapiens
atacgatgcttcttt

SEQ ID NO: 372549 - DNA, 15 bp, Homo sapiens
tacgatgcttctttt

SEQ ID NO: 372550 - DNA, 15 bp, Homo sapiens
acgatgcttctttta

SEQ ID NO: 372551 - DNA, 15 bp, Homo sapiens
cgatgcttcttttac

SEQ ID NO: 372552 - DNA, 15 bp, Homo sapiens
gatgcttcttttact

SEQ ID NO: 372553 - DNA, 15 bp, Homo sapiens
atgcttcttttactt

SEQ ID NO: 372554 - DNA, 15 bp, Homo sapiens
tgcttcttttactta

SEQ ID NO: 372555 - DNA, 15 bp, Homo sapiens
gcttcttttacttag

SEQ ID NO: 372556 - DNA, 15 bp, Homo sapiens
cttcttttacttagc

SEQ ID NO: 372557 - DNA, 15 bp, Homo sapiens
ttcttttacttagca

SEQ ID NO: 372558 - DNA, 15 bp, Homo sapiens
tcttttacttagcat

SEQ ID NO: 372559 - DNA, 15 bp, Homo sapiens
cttttacttagcata

SEQ ID NO: 372560 - DNA, 15 bp, Homo sapiens
ttttacttagcataa

SEQ ID NO: 372561 - DNA, 15 bp, Homo sapiens
tttacttagcataat

SEQ ID NO: 372562 - DNA, 15 bp, Homo sapiens
ttacttagcataatg

SEQ ID NO: 372563 - DNA, 15 bp, Homo sapiens
tacttagcataatgt

SEQ ID NO: 372564 - DNA, 15 bp, Homo sapiens
acttagcataatgtt

SEQ ID NO: 372565 - DNA, 15 bp, Homo sapiens
cttagcataatgttt

SEQ ID NO: 372566 - DNA, 15 bp, Homo sapiens
ttagcataatgtttt

SEQ ID NO: 372567 - DNA, 15 bp, Homo sapiens
tagcataatgttttt

SEQ ID NO: 372568 - DNA, 15 bp, Homo sapiens
agcataatgtttttg

SEQ ID NO: 372569 - DNA, 15 bp, Homo sapiens
gcataatgtttttga

SEQ ID NO: 372570 - DNA, 15 bp, Homo sapiens
cataatgtttttgag

SEQ ID NO: 372571 - DNA, 15 bp, Homo sapiens
ataatgtttttgagg

SEQ ID NO: 372572 - DNA, 15 bp, Homo sapiens
taatgtttttgaggt

SEQ ID NO: 372573 - DNA, 15 bp, Homo sapiens
aatgtttttgaggtt

SEQ ID NO: 372574 - DNA, 15 bp, Homo sapiens
atgtttttgaggttc

SEQ ID NO: 372575 - DNA, 15 bp, Homo sapiens
tgtttttgaggttca

SEQ ID NO: 372576 - DNA, 15 bp, Homo sapiens
gtttttgaggttcat

SEQ ID NO: 372577 - DNA, 15 bp, Homo sapiens
tttttgaggttcatc

SEQ ID NO: 372578 - DNA, 15 bp, Homo sapiens
ttttgaggttcatcc

SEQ ID NO: 372579 - DNA, 15 bp, Homo sapiens
tttgaggttcatcct

SEQ ID NO: 372580 - DNA, 15 bp, Homo sapiens
ttgaggttcatcctt

SEQ ID NO: 372581 - DNA, 15 bp, Homo sapiens
tgaggttcatccttg

SEQ ID NO: 372582 - DNA, 15 bp, Homo sapiens
gaggttcatccttgc

SEQ ID NO: 372583 - DNA, 15 bp, Homo sapiens
aggttcatccttgcc

SEQ ID NO: 372584 - DNA, 15 bp, Homo sapiens
ggttcatccttgcca

SEQ ID NO: 372585 - DNA, 15 bp, Homo sapiens
gttcatccttgccaa

SEQ ID NO: 372586 - DNA, 15 bp, Homo sapiens
ttcatccttgccaac

SEQ ID NO: 372587 - DNA, 15 bp, Homo sapiens
tcatccttgccaaca

SEQ ID NO: 372588 - DNA, 15 bp, Homo sapiens
atccttgccaacacc

SEQ ID NO: 372589 - DNA, 15 bp, Homo sapiens
tccttgccaacacct

SEQ ID NO: 372590 - DNA, 15 bp, Homo sapiens
ccttgccaacacctt

SEQ ID NO: 372591 - DNA, 15 bp, Homo sapiens
cttgccaacaccttg

SEQ ID NO: 372592 - DNA, 15 bp, Homo sapiens
ttgccaacaccttgc

SEQ ID NO: 372593 - DNA, 15 bp, Homo sapiens
tgccaacaccttgcc

SEQ ID NO: 372594 - DNA, 15 bp, Homo sapiens
gccaacaccttgccg

SEQ ID NO: 372595 - DNA, 15 bp, Homo sapiens
ccaacaccttgccga

SEQ ID NO: 372596 - DNA, 15 bp, Homo sapiens
caacaccttgccgac

SEQ ID NO: 372597 - DNA, 15 bp, Homo sapiens
aacaccttgccgact

SEQ ID NO: 372598 - DNA, 15 bp, Homo sapiens
acaccttgccgactg

SEQ ID NO: 372599 - DNA, 15 bp, Homo sapiens
caccttgccgactgt

SEQ ID NO: 372600 - DNA, 15 bp, Homo sapiens
accttgccgactgta

SEQ ID NO: 372601 - DNA, 15 bp, Homo sapiens
ccttgccgactgtac

SEQ ID NO: 372602 - DNA, 15 bp, Homo sapiens
cttgccgactgtact

SEQ ID NO: 372603 - DNA, 15 bp, Homo sapiens
ttgccgactgtactc

SEQ ID NO: 372604 - DNA, 15 bp, Homo sapiens
tgccgactgtactca

SEQ ID NO: 372605 - DNA, 15 bp, Homo sapiens
gccgactgtactcat

SEQ ID NO: 372606 - DNA, 15 bp, Homo sapiens
ccgactgtactcatt

SEQ ID NO: 372607 - DNA, 15 bp, Homo sapiens
cgactgtactcattt

SEQ ID NO: 372608 - DNA, 15 bp, Homo sapiens
gactgtactcatttc

SEQ ID NO: 372609 - DNA, 15 bp, Homo sapiens
actgtactcatttca

SEQ ID NO: 372610 - DNA, 15 bp, Homo sapiens
ctgtactcatttcag

SEQ ID NO: 372611 - DNA, 15 bp, Homo sapiens
tgtactcatttcaga

SEQ ID NO: 372612 - DNA, 15 bp, Homo sapiens
gtactcatttcagag

SEQ ID NO: 372613 - DNA, 15 bp, Homo sapiens
tactcatttcagagc

SEQ ID NO: 372614 - DNA, 15 bp, Homo sapiens
actcatttcagagct

SEQ ID NO: 372615 - DNA, 15 bp, Homo sapiens
ctcatttcagagcta

SEQ ID NO: 372616 - DNA, 15 bp, Homo sapiens
tcatttcagagctat

SEQ ID NO: 372617 - DNA, 15 bp, Homo sapiens
catttcagagctatg

SEQ ID NO: 372618 - DNA, 15 bp, Homo sapiens
atttcagagctatga

SEQ ID NO: 372619 - DNA, 15 bp, Homo sapiens
tttcagagctatgac

SEQ ID NO: 372620 - DNA, 15 bp, Homo sapiens
ttcagagctatgact

SEQ ID NO: 372621 - DNA, 15 bp, Homo sapiens
tcagagctatgacta

SEQ ID NO: 372622 - DNA, 15 bp, Homo sapiens
cagagctatgactat

SEQ ID NO: 372623 - DNA, 15 bp, Homo sapiens
agagctatgactatt

SEQ ID NO: 372624 - DNA, 15 bp, Homo sapiens
gagctatgactattc

SEQ ID NO: 372625 - DNA, 15 bp, Homo sapiens
agctatgactattca

SEQ ID NO: 372626 - DNA, 15 bp, Homo sapiens
gctatgactattcat

SEQ ID NO: 372627 - DNA, 15 bp, Homo sapiens
ctatgactattcatt

SEQ ID NO: 372628 - DNA, 15 bp, Homo sapiens
tatgactattcattt

SEQ ID NO: 372629 - DNA, 15 bp, Homo sapiens
atgactattcatttc

SEQ ID NO: 372630 - DNA, 15 bp, Homo sapiens
tgactattcatttca

SEQ ID NO: 372631 - DNA, 15 bp, Homo sapiens
gactattcatttcaa

SEQ ID NO: 372632 - DNA, 15 bp, Homo sapiens
actattcatttcaaa

SEQ ID NO: 372633 - DNA, 15 bp, Homo sapiens
ctattcatttcaaat

SEQ ID NO: 372634 - DNA, 15 bp, Homo sapiens
tattcatttcaaata

SEQ ID NO: 372635 - DNA, 15 bp, Homo sapiens
attcatttcaaataa

SEQ ID NO: 372636 - DNA, 15 bp, Homo sapiens
ttcatttcaaataag

SEQ ID NO: 372637 - DNA, 15 bp, Homo sapiens
tcatttcaaataagc

SEQ ID NO: 372638 - DNA, 15 bp, Homo sapiens
catttcaaataagca

SEQ ID NO: 372639 - DNA, 15 bp, Homo sapiens
atttcaaataagcac

SEQ ID NO: 372640 - DNA, 15 bp, Homo sapiens
tttcaaataagcact

SEQ ID NO: 372641 - DNA, 15 bp, Homo sapiens
ttcaaataagcactc

SEQ ID NO: 372642 - DNA, 15 bp, Homo sapiens
tcaaataagcactca

SEQ ID NO: 372643 - DNA, 15 bp, Homo sapiens
caaataagcactcag

SEQ ID NO: 372644 - DNA, 15 bp, Homo sapiens
aaataagcactcagc

SEQ ID NO: 372645 - DNA, 15 bp, Homo sapiens
aataagcactcagcg

SEQ ID NO: 372646 - DNA, 15 bp, Homo sapiens
ataagcactcagcgc

SEQ ID NO: 372647 - DNA, 15 bp, Homo sapiens
taagcactcagcgct

SEQ ID NO: 372648 - DNA, 15 bp, Homo sapiens
aagcactcagcgcta

SEQ ID NO: 372649 - DNA, 15 bp, Homo sapiens
agcactcagcgctaa

SEQ ID NO: 372650 - DNA, 15 bp, Homo sapiens
gcactcagcgctaag

SEQ ID NO: 372651 - DNA, 15 bp, Homo sapiens
cactcagcgctaaga

SEQ ID NO: 372652 - DNA, 15 bp, Homo sapiens
actcagcgctaagag

SEQ ID NO: 372653 - DNA, 15 bp, Homo sapiens
ctcagcgctaagaga

SEQ ID NO: 372654 - DNA, 15 bp, Homo sapiens
tcagcgctaagagac

SEQ ID NO: 372655 - DNA, 15 bp, Homo sapiens
cagcgctaagagaca

SEQ ID NO: 372656 - DNA, 15 bp, Homo sapiens
agcgctaagagacag

SEQ ID NO: 372657 - DNA, 15 bp, Homo sapiens
gcgctaagagacagt

SEQ ID NO: 372658 - DNA, 15 bp, Homo sapiens
cgctaagagacagtc

SEQ ID NO: 372659 - DNA, 15 bp, Homo sapiens
gctaagagacagtcc

SEQ ID NO: 372660 - DNA, 15 bp, Homo sapiens
ctaagagacagtcct

SEQ ID NO: 372661 - DNA, 15 bp, Homo sapiens
taagagacagtccta

SEQ ID NO: 372662 - DNA, 15 bp, Homo sapiens
aagagacagtcctac

SEQ ID NO: 372663 - DNA, 15 bp, Homo sapiens
agagacagtcctacc

SEQ ID NO: 372664 - DNA, 15 bp, Homo sapiens
gagacagtcctaccg

SEQ ID NO: 372665 - DNA, 15 bp, Homo sapiens
agacagtcctaccgt

SEQ ID NO: 372666 - DNA, 15 bp, Homo sapiens
gacagtcctaccgta

SEQ ID NO: 372667 - DNA, 15 bp, Homo sapiens
acagtcctaccgtac

SEQ ID NO: 372668 - DNA, 15 bp, Homo sapiens
cagtcctaccgtact

SEQ ID NO: 372669 - DNA, 15 bp, Homo sapiens
agtcctaccgtactt

SEQ ID NO: 372670 - DNA, 15 bp, Homo sapiens
gtcctaccgtacttt

SEQ ID NO: 372671 - DNA, 15 bp, Homo sapiens
tcctaccgtactttc

SEQ ID NO: 372672 - DNA, 15 bp, Homo sapiens
cctaccgtactttct

SEQ ID NO: 372673 - DNA, 15 bp, Homo sapiens
ctaccgtactttctt

SEQ ID NO: 372674 - DNA, 15 bp, Homo sapiens
taccgtactttcttc

SEQ ID NO: 372675 - DNA, 15 bp, Homo sapiens
accgtactttcttct

SEQ ID NO: 372676 - DNA, 15 bp, Homo sapiens
ccgtactttcttctg

SEQ ID NO: 372677 - DNA, 15 bp, Homo sapiens
cgtactttcttctga

SEQ ID NO: 372678 - DNA, 15 bp, Homo sapiens
gtactttcttctgag

SEQ ID NO: 372679 - DNA, 15 bp, Homo sapiens
tactttcttctgagt

SEQ ID NO: 372680 - DNA, 15 bp, Homo sapiens
actttcttctgagta

SEQ ID NO: 372681 - DNA, 15 bp, Homo sapiens
ctttcttctgagtac

SEQ ID NO: 372682 - DNA, 15 bp, Homo sapiens
tttcttctgagtact

SEQ ID NO: 372683 - DNA, 15 bp, Homo sapiens
ttcttctgagtactc

SEQ ID NO: 372684 - DNA, 15 bp, Homo sapiens
tcttctgagtactcc

SEQ ID NO: 372685 - DNA, 15 bp, Homo sapiens
cttctgagtactcct

SEQ ID NO: 372686 - DNA, 15 bp, Homo sapiens
ttctgagtactcctt

SEQ ID NO: 372687 - DNA, 15 bp, Homo sapiens
tctgagtactccttg

SEQ ID NO: 372688 - DNA, 15 bp, Homo sapiens
ctgagtactccttgg

SEQ ID NO: 372689 - DNA, 15 bp, Homo sapiens
tgagtactccttggt

SEQ ID NO: 372690 - DNA, 15 bp, Homo sapiens
gagtactccttggta

SEQ ID NO: 372691 - DNA, 15 bp, Homo sapiens
agtactccttggtac

SEQ ID NO: 372692 - DNA, 15 bp, Homo sapiens
gtactccttggtact

SEQ ID NO: 372693 - DNA, 15 bp, Homo sapiens
tactccttggtactc

SEQ ID NO: 372694 - DNA, 15 bp, Homo sapiens
actccttggtactca

SEQ ID NO: 372695 - DNA, 15 bp, Homo sapiens
ctccttggtactcat

SEQ ID NO: 372696 - DNA, 15 bp, Homo sapiens
tccttggtactcatt

SEQ ID NO: 372697 - DNA, 15 bp, Homo sapiens
ccttggtactcattt

SEQ ID NO: 372698 - DNA, 15 bp, Homo sapiens
cttggtactcatttc

SEQ ID NO: 372699 - DNA, 15 bp, Homo sapiens
ttggtactcatttct

SEQ ID NO: 372700 - DNA, 15 bp, Homo sapiens
tggtactcatttctc

SEQ ID NO: 372701 - DNA, 15 bp, Homo sapiens
ggtactcatttctca

SEQ ID NO: 372702 - DNA, 15 bp, Homo sapiens
gtactcatttctcaa

SEQ ID NO: 372703 - DNA, 15 bp, Homo sapiens
tactcatttctcaac

SEQ ID NO: 372704 - DNA, 15 bp, Homo sapiens
actcatttctcaact

SEQ ID NO: 372705 - DNA, 15 bp, Homo sapiens
ctcatttctcaacta

SEQ ID NO: 372706 - DNA, 15 bp, Homo sapiens
tcatttctcaactag

SEQ ID NO: 372707 - DNA, 15 bp, Homo sapiens
catttctcaactagt

SEQ ID NO: 372708 - DNA, 15 bp, Homo sapiens
atttctcaactagtg

SEQ ID NO: 372709 - DNA, 15 bp, Homo sapiens
tttctcaactagtga

SEQ ID NO: 372710 - DNA, 15 bp, Homo sapiens
ttctcaactagtgac

SEQ ID NO: 372711 - DNA, 15 bp, Homo sapiens
tctcaactagtgacc

SEQ ID NO: 372712 - DNA, 15 bp, Homo sapiens
ctcaactagtgacct

SEQ ID NO: 372713 - DNA, 15 bp, Homo sapiens
tcaactagtgacctc

SEQ ID NO: 372714 - DNA, 15 bp, Homo sapiens
caactagtgacctca

SEQ ID NO: 372715 - DNA, 15 bp, Homo sapiens
aactagtgacctcat

SEQ ID NO: 372716 - DNA, 15 bp, Homo sapiens
actagtgacctcatc

SEQ ID NO: 372717 - DNA, 15 bp, Homo sapiens
ctagtgacctcatct

SEQ ID NO: 372718 - DNA, 15 bp, Homo sapiens
tagtgacctcatctc

SEQ ID NO: 372719 - DNA, 15 bp, Homo sapiens
agtgacctcatctca

SEQ ID NO: 372720 - DNA, 15 bp, Homo sapiens
gtgacctcatctcat

SEQ ID NO: 372721 - DNA, 15 bp, Homo sapiens
tgacctcatctcatt

SEQ ID NO: 372722 - DNA, 15 bp, Homo sapiens
gacctcatctcattt

SEQ ID NO: 372723 - DNA, 15 bp, Homo sapiens
acctcatctcatttt

SEQ ID NO: 372724 - DNA, 15 bp, Homo sapiens
cctcatctcattttc

SEQ ID NO: 372725 - DNA, 15 bp, Homo sapiens
ctcatctcattttca

SEQ ID NO: 372726 - DNA, 15 bp, Homo sapiens
tcatctcattttcaa

SEQ ID NO: 372727 - DNA, 15 bp, Homo sapiens
catctcattttcaaa

SEQ ID NO: 372728 - DNA, 15 bp, Homo sapiens
atctcattttcaaaa

SEQ ID NO: 372729 - DNA, 15 bp, Homo sapiens
tctcattttcaaaag

SEQ ID NO: 372730 - DNA, 15 bp, Homo sapiens
ctcattttcaaaaga

SEQ ID NO: 372731 - DNA, 15 bp, Homo sapiens
tcattttcaaaagaa

SEQ ID NO: 372732 - DNA, 15 bp, Homo sapiens
cattttcaaaagaaa

SEQ ID NO: 372733 - DNA, 15 bp, Homo sapiens
attttcaaaagaaaa

SEQ ID NO: 372734 - DNA, 15 bp, Homo sapiens
ttttcaaaagaaaaa

SEQ ID NO: 372735 - DNA, 15 bp, Homo sapiens
tttcaaaagaaaaaa

SEQ ID NO: 372736 - DNA, 15 bp, Homo sapiens
ttcaaaagaaaaaaa

SEQ ID NO: 372737 - DNA, 15 bp, Homo sapiens
aaaagaaaaaaaaaa

SEQ ID NO: 372738 - DNA, 15 bp, Homo sapiens
aaagaaaaaaaaaac

SEQ ID NO: 372739 - DNA, 15 bp, Homo sapiens
aagaaaaaaaaaacc

SEQ ID NO: 372740 - DNA, 15 bp, Homo sapiens
agaaaaaaaaaacct

SEQ ID NO: 372741 - DNA, 15 bp, Homo sapiens
gaaaaaaaaaacctt

SEQ ID NO: 372742 - DNA, 15 bp, Homo sapiens
aaaaaaaaaaccttt

SEQ ID NO: 372743 - DNA, 15 bp, Homo sapiens
aaaaaaaaacctttt

SEQ ID NO: 372744 - DNA, 15 bp, Homo sapiens
aaaaaaaaccttttt

SEQ ID NO: 372745 - DNA, 15 bp, Homo sapiens
aaaaaaacctttttc

SEQ ID NO: 372746 - DNA, 15 bp, Homo sapiens
aaaaaacctttttcg

SEQ ID NO: 372747 - DNA, 15 bp, Homo sapiens
aaaaacctttttcgt

SEQ ID NO: 372748 - DNA, 15 bp, Homo sapiens
aaaacctttttcgtt

SEQ ID NO: 372749 - DNA, 15 bp, Homo sapiens
aaacctttttcgttt

SEQ ID NO: 372750 - DNA, 15 bp, Homo sapiens
aacctttttcgtttt

SEQ ID NO: 372751 - DNA, 15 bp, Homo sapiens
acctttttcgttttc

SEQ ID NO: 372752 - DNA, 15 bp, Homo sapiens
cctttttcgttttcc

SEQ ID NO: 372753 - DNA, 15 bp, Homo sapiens
ctttttcgttttccc

SEQ ID NO: 372754 - DNA, 15 bp, Homo sapiens
tttttcgttttccca

SEQ ID NO: 372755 - DNA, 15 bp, Homo sapiens
ttttcgttttcccac

SEQ ID NO: 372756 - DNA, 15 bp, Homo sapiens
tttcgttttcccacc

SEQ ID NO: 372757 - DNA, 15 bp, Homo sapiens
ttcgttttcccacca

SEQ ID NO: 372758 - DNA, 15 bp, Homo sapiens
tcgttttcccaccag

SEQ ID NO: 372759 - DNA, 15 bp, Homo sapiens
cgttttcccaccaga

SEQ ID NO: 372760 - DNA, 15 bp, Homo sapiens
gttttcccaccagag

SEQ ID NO: 372761 - DNA, 15 bp, Homo sapiens
ttttcccaccagaga

SEQ ID NO: 372762 - DNA, 15 bp, Homo sapiens
tttcccaccagagaa

SEQ ID NO: 372763 - DNA, 15 bp, Homo sapiens
ttcccaccagagaat

SEQ ID NO: 372764 - DNA, 15 bp, Homo sapiens
tcccaccagagaatc

SEQ ID NO: 372765 - DNA, 15 bp, Homo sapiens
cccaccagagaatcc

SEQ ID NO: 372766 - DNA, 15 bp, Homo sapiens
ccaccagagaatcca

SEQ ID NO: 372767 - DNA, 15 bp, Homo sapiens
caccagagaatccat

SEQ ID NO: 372768 - DNA, 15 bp, Homo sapiens
accagagaatccatc

SEQ ID NO: 372769 - DNA, 15 bp, Homo sapiens
ccagagaatccatca

SEQ ID NO: 372770 - DNA, 15 bp, Homo sapiens
cagagaatccatcaa

SEQ ID NO: 372771 - DNA, 15 bp, Homo sapiens
agagaatccatcaag

SEQ ID NO: 372772 - DNA, 15 bp, Homo sapiens
gagaatccatcaagc

SEQ ID NO: 372773 - DNA, 15 bp, Homo sapiens
agaatccatcaagct

SEQ ID NO: 372774 - DNA, 15 bp, Homo sapiens
gaatccatcaagcta

SEQ ID NO: 372775 - DNA, 15 bp, Homo sapiens
aatccatcaagctac

SEQ ID NO: 372776 - DNA, 15 bp, Homo sapiens
atccatcaagctacc

SEQ ID NO: 372777 - DNA, 15 bp, Homo sapiens
tccatcaagctacct

SEQ ID NO: 372778 - DNA, 15 bp, Homo sapiens
ccatcaagctacctg

SEQ ID NO: 372779 - DNA, 15 bp, Homo sapiens
catcaagctacctgc

SEQ ID NO: 372780 - DNA, 15 bp, Homo sapiens
atcaagctacctgcg

SEQ ID NO: 372781 - DNA, 15 bp, Homo sapiens
tcaagctacctgcgg

SEQ ID NO: 372782 - DNA, 15 bp, Homo sapiens
caagctacctgcggc

SEQ ID NO: 372783 - DNA, 15 bp, Homo sapiens
aagctacctgcggct

SEQ ID NO: 372784 - DNA, 15 bp, Homo sapiens
agctacctgcggctg

SEQ ID NO: 372785 - DNA, 15 bp, Homo sapiens
gctacctgcggctgt

SEQ ID NO: 372786 - DNA, 15 bp, Homo sapiens
ctacctgcggctgta

SEQ ID NO: 372787 - DNA, 15 bp, Homo sapiens
tacctgcggctgtac

SEQ ID NO: 372788 - DNA, 15 bp, Homo sapiens
acctgcggctgtacc

SEQ ID NO: 372789 - DNA, 15 bp, Homo sapiens
cctgcggctgtaccc

SEQ ID NO: 372790 - DNA, 15 bp, Homo sapiens
ctgcggctgtaccca

SEQ ID NO: 372791 - DNA, 15 bp, Homo sapiens
tgcggctgtacccat

SEQ ID NO: 372792 - DNA, 15 bp, Homo sapiens
gcggctgtacccata

SEQ ID NO: 372793 - DNA, 15 bp, Homo sapiens
cggctgtacccatat

SEQ ID NO: 372794 - DNA, 15 bp, Homo sapiens
ggctgtacccatata

SEQ ID NO: 372795 - DNA, 15 bp, Homo sapiens
gctgtacccatatac

SEQ ID NO: 372796 - DNA, 15 bp, Homo sapiens
ctgtacccatatact

SEQ ID NO: 372797 - DNA, 15 bp, Homo sapiens
tgtacccatatactt

SEQ ID NO: 372798 - DNA, 15 bp, Homo sapiens
gtacccatatacttt

SEQ ID NO: 372799 - DNA, 15 bp, Homo sapiens
tacccatatacttta

SEQ ID NO: 372800 - DNA, 15 bp, Homo sapiens
acccatatactttac

SEQ ID NO: 372801 - DNA, 15 bp, Homo sapiens
cccatatactttaca

SEQ ID NO: 372802 - DNA, 15 bp, Homo sapiens
ccatatactttacac

SEQ ID NO: 372803 - DNA, 15 bp, Homo sapiens
catatactttacaca

SEQ ID NO: 372804 - DNA, 15 bp, Homo sapiens
atatactttacacac

SEQ ID NO: 372805 - DNA, 15 bp, Homo sapiens
tatactttacacact

SEQ ID NO: 372806 - DNA, 15 bp, Homo sapiens
atactttacacactt

SEQ ID NO: 372807 - DNA, 15 bp, Homo sapiens
tactttacacacttc

SEQ ID NO: 372808 - DNA, 15 bp, Homo sapiens
actttacacacttcc

SEQ ID NO: 372809 - DNA, 15 bp, Homo sapiens
ctttacacacttcct

SEQ ID NO: 372810 - DNA, 15 bp, Homo sapiens
tttacacacttcctt

SEQ ID NO: 372811 - DNA, 15 bp, Homo sapiens
ttacacacttccttc

SEQ ID NO: 372812 - DNA, 15 bp, Homo sapiens
tacacacttccttcc

SEQ ID NO: 372813 - DNA, 15 bp, Homo sapiens
acacacttccttcct

SEQ ID NO: 372814 - DNA, 15 bp, Homo sapiens
cacacttccttccta

SEQ ID NO: 372815 - DNA, 15 bp, Homo sapiens
acacttccttcctat

SEQ ID NO: 372816 - DNA, 15 bp, Homo sapiens
cacttccttcctatt

SEQ ID NO: 372817 - DNA, 15 bp, Homo sapiens
acttccttcctattc

SEQ ID NO: 372818 - DNA, 15 bp, Homo sapiens
cttccttcctattca

SEQ ID NO: 372819 - DNA, 15 bp, Homo sapiens
ttccttcctattcag

SEQ ID NO: 372820 - DNA, 15 bp, Homo sapiens
tccttcctattcagt

SEQ ID NO: 372821 - DNA, 15 bp, Homo sapiens
ccttcctattcagtg

SEQ ID NO: 372822 - DNA, 15 bp, Homo sapiens
cttcctattcagtga

SEQ ID NO: 372823 - DNA, 15 bp, Homo sapiens
ttcctattcagtgaa

SEQ ID NO: 372824 - DNA, 15 bp, Homo sapiens
tcctattcagtgaaa

SEQ ID NO: 372825 - DNA, 15 bp, Homo sapiens
cctattcagtgaaag

SEQ ID NO: 372826 - DNA, 15 bp, Homo sapiens
ctattcagtgaaagg

SEQ ID NO: 372827 - DNA, 15 bp, Homo sapiens
tattcagtgaaaggg

SEQ ID NO: 372828 - DNA, 15 bp, Homo sapiens
attcagtgaaagggt

SEQ ID NO: 372829 - DNA, 15 bp, Homo sapiens
ttcagtgaaagggtt

SEQ ID NO: 372830 - DNA, 15 bp, Homo sapiens
tcagtgaaagggtta

SEQ ID NO: 372831 - DNA, 15 bp, Homo sapiens
cagtgaaagggttat

SEQ ID NO: 372832 - DNA, 15 bp, Homo sapiens
agtgaaagggttatt

SEQ ID NO: 372833 - DNA, 15 bp, Homo sapiens
gtgaaagggttatta

SEQ ID NO: 372834 - DNA, 15 bp, Homo sapiens
tgaaagggttattat

SEQ ID NO: 372835 - DNA, 15 bp, Homo sapiens
gaaagggttattatc

SEQ ID NO: 372836 - DNA, 15 bp, Homo sapiens
aaagggttattatct

SEQ ID NO: 372837 - DNA, 15 bp, Homo sapiens
aagggttattatctc

SEQ ID NO: 372838 - DNA, 15 bp, Homo sapiens
agggttattatctct

SEQ ID NO: 372839 - DNA, 15 bp, Homo sapiens
gggttattatctctt

SEQ ID NO: 372840 - DNA, 15 bp, Homo sapiens
ggttattatctcttt

SEQ ID NO: 372841 - DNA, 15 bp, Homo sapiens
gttattatctctttt

SEQ ID NO: 372842 - DNA, 15 bp, Homo sapiens
ttattatctcttttc

SEQ ID NO: 372843 - DNA, 15 bp, Homo sapiens
tattatctcttttcc

SEQ ID NO: 372844 - DNA, 15 bp, Homo sapiens
attatctcttttcct

SEQ ID NO: 372845 - DNA, 15 bp, Homo sapiens
ttatctcttttccta

SEQ ID NO: 372846 - DNA, 15 bp, Homo sapiens
tatctcttttcctaa

SEQ ID NO: 372847 - DNA, 15 bp, Homo sapiens
atctcttttcctaag

SEQ ID NO: 372848 - DNA, 15 bp, Homo sapiens
tctcttttcctaaga

SEQ ID NO: 372849 - DNA, 15 bp, Homo sapiens
ctcttttcctaagac

SEQ ID NO: 372850 - DNA, 15 bp, Homo sapiens
tcttttcctaagacc

SEQ ID NO: 372851 - DNA, 15 bp, Homo sapiens
cttttcctaagacca

SEQ ID NO: 372852 - DNA, 15 bp, Homo sapiens
ttttcctaagaccag

SEQ ID NO: 372853 - DNA, 15 bp, Homo sapiens
tttcctaagaccagc

SEQ ID NO: 372854 - DNA, 15 bp, Homo sapiens
ttcctaagaccagct

SEQ ID NO: 372855 - DNA, 15 bp, Homo sapiens
tcctaagaccagctc

SEQ ID NO: 372856 - DNA, 15 bp, Homo sapiens
cctaagaccagctcc

SEQ ID NO: 372857 - DNA, 15 bp, Homo sapiens
ctaagaccagctcct

SEQ ID NO: 372858 - DNA, 15 bp, Homo sapiens
taagaccagctcctc

SEQ ID NO: 372859 - DNA, 15 bp, Homo sapiens
aagaccagctcctcc

SEQ ID NO: 372860 - DNA, 15 bp, Homo sapiens
agaccagctcctcca

SEQ ID NO: 372861 - DNA, 15 bp, Homo sapiens
gaccagctcctccac

SEQ ID NO: 372862 - DNA, 15 bp, Homo sapiens
accagctcctccact

SEQ ID NO: 372863 - DNA, 15 bp, Homo sapiens
ccagctcctccactt

SEQ ID NO: 372864 - DNA, 15 bp, Homo sapiens
cagctcctccactta

SEQ ID NO: 372865 - DNA, 15 bp, Homo sapiens
agctcctccacttat

SEQ ID NO: 372866 - DNA, 15 bp, Homo sapiens
gctcctccacttatg

SEQ ID NO: 372867 - DNA, 15 bp, Homo sapiens
ctcctccacttatgc

SEQ ID NO: 372868 - DNA, 15 bp, Homo sapiens
tcctccacttatgca

SEQ ID NO: 372869 - DNA, 15 bp, Homo sapiens
cctccacttatgcat

SEQ ID NO: 372870 - DNA, 15 bp, Homo sapiens
ctccacttatgcata

SEQ ID NO: 372871 - DNA, 15 bp, Homo sapiens
tccacttatgcatag

SEQ ID NO: 372872 - DNA, 15 bp, Homo sapiens
ccacttatgcatagg

SEQ ID NO: 372873 - DNA, 15 bp, Homo sapiens
cacttatgcatagga

SEQ ID NO: 372874 - DNA, 15 bp, Homo sapiens
acttatgcataggat

SEQ ID NO: 372875 - DNA, 15 bp, Homo sapiens
cttatgcataggatc

SEQ ID NO: 372876 - DNA, 15 bp, Homo sapiens
ttatgcataggatcc

SEQ ID NO: 372877 - DNA, 15 bp, Homo sapiens
tatgcataggatccc

SEQ ID NO: 372878 - DNA, 15 bp, Homo sapiens
atgcataggatccca

SEQ ID NO: 372879 - DNA, 15 bp, Homo sapiens
tgcataggatcccat

SEQ ID NO: 372880 - DNA, 15 bp, Homo sapiens
gcataggatcccata

SEQ ID NO: 372881 - DNA, 15 bp, Homo sapiens
cataggatcccatat

SEQ ID NO: 372882 - DNA, 15 bp, Homo sapiens
ataggatcccatatt

SEQ ID NO: 372883 - DNA, 15 bp, Homo sapiens
taggatcccatattc

SEQ ID NO: 372884 - DNA, 15 bp, Homo sapiens
aggatcccatattct

SEQ ID NO: 372885 - DNA, 15 bp, Homo sapiens
ggatcccatattctc

SEQ ID NO: 372886 - DNA, 15 bp, Homo sapiens
gatcccatattctct

SEQ ID NO: 372887 - DNA, 15 bp, Homo sapiens
atcccatattctctg

SEQ ID NO: 372888 - DNA, 15 bp, Homo sapiens
tcccatattctctgg

SEQ ID NO: 372889 - DNA, 15 bp, Homo sapiens
cccatattctctggg

SEQ ID NO: 372890 - DNA, 15 bp, Homo sapiens
ccatattctctgggc

SEQ ID NO: 372891 - DNA, 15 bp, Homo sapiens
catattctctgggct

SEQ ID NO: 372892 - DNA, 15 bp, Homo sapiens
atattctctgggctg

SEQ ID NO: 372893 - DNA, 15 bp, Homo sapiens
tattctctgggctgc

SEQ ID NO: 372894 - DNA, 15 bp, Homo sapiens
attctctgggctgct

SEQ ID NO: 372895 - DNA, 15 bp, Homo sapiens
ttctctgggctgctt

SEQ ID NO: 372896 - DNA, 15 bp, Homo sapiens
tctctgggctgctta

SEQ ID NO: 372897 - DNA, 15 bp, Homo sapiens
ctctgggctgcttac

SEQ ID NO: 372898 - DNA, 15 bp, Homo sapiens
tctgggctgcttacg

SEQ ID NO: 372899 - DNA, 15 bp, Homo sapiens
ctgggctgcttacgt

SEQ ID NO: 372900 - DNA, 15 bp, Homo sapiens
tgggctgcttacgta

SEQ ID NO: 372901 - DNA, 15 bp, Homo sapiens
gggctgcttacgtat

SEQ ID NO: 372902 - DNA, 15 bp, Homo sapiens
ggctgcttacgtatc

SEQ ID NO: 372903 - DNA, 15 bp, Homo sapiens
gctgcttacgtatcc

SEQ ID NO: 372904 - DNA, 15 bp, Homo sapiens
ctgcttacgtatcct

SEQ ID NO: 372905 - DNA, 15 bp, Homo sapiens
tgcttacgtatcctc

SEQ ID NO: 372906 - DNA, 15 bp, Homo sapiens
gcttacgtatcctct

SEQ ID NO: 372907 - DNA, 15 bp, Homo sapiens
cttacgtatcctctt

SEQ ID NO: 372908 - DNA, 15 bp, Homo sapiens
ttacgtatcctcttt

SEQ ID NO: 372909 - DNA, 15 bp, Homo sapiens
tacgtatcctctttc

SEQ ID NO: 372910 - DNA, 15 bp, Homo sapiens
acgtatcctctttct

SEQ ID NO: 372911 - DNA, 15 bp, Homo sapiens
cgtatcctctttctc

SEQ ID NO: 372912 - DNA, 15 bp, Homo sapiens
gtatcctctttctct

SEQ ID NO: 372913 - DNA, 15 bp, Homo sapiens
tatcctctttctctg

SEQ ID NO: 372914 - DNA, 15 bp, Homo sapiens
atcctctttctctga

SEQ ID NO: 372915 - DNA, 15 bp, Homo sapiens
tcctctttctctgat

SEQ ID NO: 372916 - DNA, 15 bp, Homo sapiens
cctctttctctgata

SEQ ID NO: 372917 - DNA, 15 bp, Homo sapiens
ctctttctctgatag

SEQ ID NO: 372918 - DNA, 15 bp, Homo sapiens
tctttctctgatagc

SEQ ID NO: 372919 - DNA, 15 bp, Homo sapiens
ctttctctgatagct

SEQ ID NO: 372920 - DNA, 15 bp, Homo sapiens
tttctctgatagcta

SEQ ID NO: 372921 - DNA, 15 bp, Homo sapiens
ttctctgatagctac

SEQ ID NO: 372922 - DNA, 15 bp, Homo sapiens
tctctgatagctact

SEQ ID NO: 372923 - DNA, 15 bp, Homo sapiens
ctctgatagctacta

SEQ ID NO: 372924 - DNA, 15 bp, Homo sapiens
tctgatagctactag

SEQ ID NO: 372925 - DNA, 15 bp, Homo sapiens
ctgatagctactaga

SEQ ID NO: 372926 - DNA, 15 bp, Homo sapiens
tgatagctactagat

SEQ ID NO: 372927 - DNA, 15 bp, Homo sapiens
gatagctactagatc

SEQ ID NO: 372928 - DNA, 15 bp, Homo sapiens
atagctactagatca

SEQ ID NO: 372929 - DNA, 15 bp, Homo sapiens
tagctactagatcat

SEQ ID NO: 372930 - DNA, 15 bp, Homo sapiens
agctactagatcatc

SEQ ID NO: 372931 - DNA, 15 bp, Homo sapiens
gctactagatcatcc

SEQ ID NO: 372932 - DNA, 15 bp, Homo sapiens
ctactagatcatcct

SEQ ID NO: 372933 - DNA, 15 bp, Homo sapiens
tactagatcatcctt

SEQ ID NO: 372934 - DNA, 15 bp, Homo sapiens
actagatcatcctta

SEQ ID NO: 372935 - DNA, 15 bp, Homo sapiens
ctagatcatccttat

SEQ ID NO: 372936 - DNA, 15 bp, Homo sapiens
tagatcatccttatt

SEQ ID NO: 372937 - DNA, 15 bp, Homo sapiens
agatcatccttattg

SEQ ID NO: 372938 - DNA, 15 bp, Homo sapiens
gatcatccttattgc

SEQ ID NO: 372939 - DNA, 15 bp, Homo sapiens
atcatccttattgcc

SEQ ID NO: 372940 - DNA, 15 bp, Homo sapiens
tcatccttattgcca

SEQ ID NO: 372941 - DNA, 15 bp, Homo sapiens
catccttattgccat

SEQ ID NO: 372942 - DNA, 15 bp, Homo sapiens
atccttattgccata

SEQ ID NO: 372943 - DNA, 15 bp, Homo sapiens
tccttattgccatac

SEQ ID NO: 372944 - DNA, 15 bp, Homo sapiens
ccttattgccatacc

SEQ ID NO: 372945 - DNA, 15 bp, Homo sapiens
cttattgccatacct

SEQ ID NO: 372946 - DNA, 15 bp, Homo sapiens
ttattgccatacctt

SEQ ID NO: 372947 - DNA, 15 bp, Homo sapiens
tattgccataccttt

SEQ ID NO: 372948 - DNA, 15 bp, Homo sapiens
attgccatacctttt

SEQ ID NO: 372949 - DNA, 15 bp, Homo sapiens
ttgccataccttttg

SEQ ID NO: 372950 - DNA, 15 bp, Homo sapiens
tgccataccttttga

SEQ ID NO: 372951 - DNA, 15 bp, Homo sapiens
gccataccttttgaa

SEQ ID NO: 372952 - DNA, 15 bp, Homo sapiens
ccataccttttgaag

SEQ ID NO: 372953 - DNA, 15 bp, Homo sapiens
cataccttttgaagc

SEQ ID NO: 372954 - DNA, 15 bp, Homo sapiens
ataccttttgaagca

SEQ ID NO: 372955 - DNA, 15 bp, Homo sapiens
taccttttgaagcat

SEQ ID NO: 372956 - DNA, 15 bp, Homo sapiens
accttttgaagcatg

SEQ ID NO: 372957 - DNA, 15 bp, Homo sapiens
ccttttgaagcatgt

SEQ ID NO: 372958 - DNA, 15 bp, Homo sapiens
cttttgaagcatgta

SEQ ID NO: 372959 - DNA, 15 bp, Homo sapiens
ttttgaagcatgtag

SEQ ID NO: 372960 - DNA, 15 bp, Homo sapiens
tttgaagcatgtagc

SEQ ID NO: 372961 - DNA, 15 bp, Homo sapiens
ttgaagcatgtagct

SEQ ID NO: 372962 - DNA, 15 bp, Homo sapiens
tgaagcatgtagctc

SEQ ID NO: 372963 - DNA, 15 bp, Homo sapiens
gaagcatgtagctct

SEQ ID NO: 372964 - DNA, 15 bp, Homo sapiens
aagcatgtagctcta

SEQ ID NO: 372965 - DNA, 15 bp, Homo sapiens
agcatgtagctctag

SEQ ID NO: 372966 - DNA, 15 bp, Homo sapiens
gcatgtagctctagt

SEQ ID NO: 372967 - DNA, 15 bp, Homo sapiens
catgtagctctagtc

SEQ ID NO: 372968 - DNA, 15 bp, Homo sapiens
atgtagctctagtct

SEQ ID NO: 372969 - DNA, 15 bp, Homo sapiens
tgtagctctagtcta

SEQ ID NO: 372970 - DNA, 15 bp, Homo sapiens
gtagctctagtctac

SEQ ID NO: 372971 - DNA, 15 bp, Homo sapiens
tagctctagtctact

SEQ ID NO: 372972 - DNA, 15 bp, Homo sapiens
agctctagtctactc

SEQ ID NO: 372973 - DNA, 15 bp, Homo sapiens
gctctagtctactca

SEQ ID NO: 372974 - DNA, 15 bp, Homo sapiens
ctctagtctactcat

SEQ ID NO: 372975 - DNA, 15 bp, Homo sapiens
tctagtctactcatt

SEQ ID NO: 372976 - DNA, 15 bp, Homo sapiens
ctagtctactcattt

SEQ ID NO: 372977 - DNA, 15 bp, Homo sapiens
tagtctactcattta

SEQ ID NO: 372978 - DNA, 15 bp, Homo sapiens
agtctactcatttaa

SEQ ID NO: 372979 - DNA, 15 bp, Homo sapiens
gtctactcatttaaa

SEQ ID NO: 372980 - DNA, 15 bp, Homo sapiens
tctactcatttaaac

SEQ ID NO: 372981 - DNA, 15 bp, Homo sapiens
ctactcatttaaact

SEQ ID NO: 372982 - DNA, 15 bp, Homo sapiens
tactcatttaaactg

SEQ ID NO: 372983 - DNA, 15 bp, Homo sapiens
actcatttaaactga

SEQ ID NO: 372984 - DNA, 15 bp, Homo sapiens
ctcatttaaactgat

SEQ ID NO: 372985 - DNA, 15 bp, Homo sapiens
tcatttaaactgatg

SEQ ID NO: 372986 - DNA, 15 bp, Homo sapiens
catttaaactgatgt

SEQ ID NO: 372987 - DNA, 15 bp, Homo sapiens
atttaaactgatgta

SEQ ID NO: 372988 - DNA, 15 bp, Homo sapiens
tttaaactgatgtac

SEQ ID NO: 372989 - DNA, 15 bp, Homo sapiens
ttaaactgatgtaca

SEQ ID NO: 372990 - DNA, 15 bp, Homo sapiens
taaactgatgtacag

SEQ ID NO: 372991 - DNA, 15 bp, Homo sapiens
aaactgatgtacagt

SEQ ID NO: 372992 - DNA, 15 bp, Homo sapiens
aactgatgtacagta

SEQ ID NO: 372993 - DNA, 15 bp, Homo sapiens
actgatgtacagtat

SEQ ID NO: 372994 - DNA, 15 bp, Homo sapiens
ctgatgtacagtatt

SEQ ID NO: 372995 - DNA, 15 bp, Homo sapiens
tgatgtacagtatta

SEQ ID NO: 372996 - DNA, 15 bp, Homo sapiens
gatgtacagtattac

SEQ ID NO: 372997 - DNA, 15 bp, Homo sapiens
atgtacagtattaca

SEQ ID NO: 372998 - DNA, 15 bp, Homo sapiens
tgtacagtattacat

SEQ ID NO: 372999 - DNA, 15 bp, Homo sapiens
gtacagtattacata

SEQ ID NO: 373000 - DNA, 15 bp, Homo sapiens
tacagtattacataa

SEQ ID NO: 373001 - DNA, 15 bp, Homo sapiens
acagtattacataac

SEQ ID NO: 373002 - DNA, 15 bp, Homo sapiens
cagtattacataaca

SEQ ID NO: 373003 - DNA, 15 bp, Homo sapiens
agtattacataacat

SEQ ID NO: 373004 - DNA, 15 bp, Homo sapiens
gtattacataacatt

SEQ ID NO: 373005 - DNA, 15 bp, Homo sapiens
tattacataacattg

SEQ ID NO: 373006 - DNA, 15 bp, Homo sapiens
attacataacattgg

SEQ ID NO: 373007 - DNA, 15 bp, Homo sapiens
ttacataacattgga

SEQ ID NO: 373008 - DNA, 15 bp, Homo sapiens
tacataacattggat

SEQ ID NO: 373009 - DNA, 15 bp, Homo sapiens
acataacattggata

SEQ ID NO: 373010 - DNA, 15 bp, Homo sapiens
cataacattggatat

SEQ ID NO: 373011 - DNA, 15 bp, Homo sapiens
ataacattggatata

SEQ ID NO: 373012 - DNA, 15 bp, Homo sapiens
taacattggatatac

SEQ ID NO: 373013 - DNA, 15 bp, Homo sapiens
aacattggatatact

SEQ ID NO: 373014 - DNA, 15 bp, Homo sapiens
acattggatatacta

SEQ ID NO: 373015 - DNA, 15 bp, Homo sapiens
cattggatatactac

SEQ ID NO: 373016 - DNA, 15 bp, Homo sapiens
attggatatactaca

SEQ ID NO: 373017 - DNA, 15 bp, Homo sapiens
ttggatatactacaa

SEQ ID NO: 373018 - DNA, 15 bp, Homo sapiens
tggatatactacaat

SEQ ID NO: 373019 - DNA, 15 bp, Homo sapiens
ggatatactacaatc

SEQ ID NO: 373020 - DNA, 15 bp, Homo sapiens
gatatactacaatcc

SEQ ID NO: 373021 - DNA, 15 bp, Homo sapiens
atatactacaatcct

SEQ ID NO: 373022 - DNA, 15 bp, Homo sapiens
tatactacaatcctc

SEQ ID NO: 373023 - DNA, 15 bp, Homo sapiens
atactacaatcctct

SEQ ID NO: 373024 - DNA, 15 bp, Homo sapiens
tactacaatcctcta

SEQ ID NO: 373025 - DNA, 15 bp, Homo sapiens
actacaatcctctaa

SEQ ID NO: 373026 - DNA, 15 bp, Homo sapiens
ctacaatcctctaaa

SEQ ID NO: 373027 - DNA, 15 bp, Homo sapiens
tacaatcctctaaat

SEQ ID NO: 373028 - DNA, 15 bp, Homo sapiens
acaatcctctaaatt

SEQ ID NO: 373029 - DNA, 15 bp, Homo sapiens
caatcctctaaattc

SEQ ID NO: 373030 - DNA, 15 bp, Homo sapiens
aatcctctaaattct

SEQ ID NO: 373031 - DNA, 15 bp, Homo sapiens
atcctctaaattctc

SEQ ID NO: 373032 - DNA, 15 bp, Homo sapiens
tcctctaaattctct

SEQ ID NO: 373033 - DNA, 15 bp, Homo sapiens
cctctaaattctctt

SEQ ID NO: 373034 - DNA, 15 bp, Homo sapiens
ctctaaattctcttt

SEQ ID NO: 373035 - DNA, 15 bp, Homo sapiens
tctaaattctctttt

SEQ ID NO: 373036 - DNA, 15 bp, Homo sapiens
ctaaattctcttttc

SEQ ID NO: 373037 - DNA, 15 bp, Homo sapiens
taaattctcttttct

SEQ ID NO: 373038 - DNA, 15 bp, Homo sapiens
aaattctcttttcta

SEQ ID NO: 373039 - DNA, 15 bp, Homo sapiens
aattctcttttctac

SEQ ID NO: 373040 - DNA, 15 bp, Homo sapiens
attctcttttctacc

SEQ ID NO: 373041 - DNA, 15 bp, Homo sapiens
ttctcttttctacct

SEQ ID NO: 373042 - DNA, 15 bp, Homo sapiens
tctcttttctaccta

SEQ ID NO: 373043 - DNA, 15 bp, Homo sapiens
ctcttttctacctat

SEQ ID NO: 373044 - DNA, 15 bp, Homo sapiens
tcttttctacctatg

SEQ ID NO: 373045 - DNA, 15 bp, Homo sapiens
cttttctacctatgc

SEQ ID NO: 373046 - DNA, 15 bp, Homo sapiens
ttttctacctatgct

SEQ ID NO: 373047 - DNA, 15 bp, Homo sapiens
tttctacctatgctt

SEQ ID NO: 373048 - DNA, 15 bp, Homo sapiens
ttctacctatgctta

SEQ ID NO: 373049 - DNA, 15 bp, Homo sapiens
tctacctatgcttac

SEQ ID NO: 373050 - DNA, 15 bp, Homo sapiens
ctacctatgcttacc

SEQ ID NO: 373051 - DNA, 15 bp, Homo sapiens
tacctatgcttacca

SEQ ID NO: 373052 - DNA, 15 bp, Homo sapiens
acctatgcttaccag

SEQ ID NO: 373053 - DNA, 15 bp, Homo sapiens
cctatgcttaccagt

SEQ ID NO: 373054 - DNA, 15 bp, Homo sapiens
ctatgcttaccagtc

SEQ ID NO: 373055 - DNA, 15 bp, Homo sapiens
tatgcttaccagtcc

SEQ ID NO: 373056 - DNA, 15 bp, Homo sapiens
atgcttaccagtccc

SEQ ID NO: 373057 - DNA, 15 bp, Homo sapiens
tgcttaccagtccca

SEQ ID NO: 373058 - DNA, 15 bp, Homo sapiens
gcttaccagtcccag

SEQ ID NO: 373059 - DNA, 15 bp, Homo sapiens
cttaccagtcccaga

SEQ ID NO: 373060 - DNA, 15 bp, Homo sapiens
ttaccagtcccagaa

SEQ ID NO: 373061 - DNA, 15 bp, Homo sapiens
taccagtcccagaac

SEQ ID NO: 373062 - DNA, 15 bp, Homo sapiens
accagtcccagaact

SEQ ID NO: 373063 - DNA, 15 bp, Homo sapiens
ccagtcccagaactg

SEQ ID NO: 373064 - DNA, 15 bp, Homo sapiens
cagtcccagaactgt

SEQ ID NO: 373065 - DNA, 15 bp, Homo sapiens
agtcccagaactgta

SEQ ID NO: 373066 - DNA, 15 bp, Homo sapiens
gtcccagaactgtag

SEQ ID NO: 373067 - DNA, 15 bp, Homo sapiens
tcccagaactgtaga

SEQ ID NO: 373068 - DNA, 15 bp, Homo sapiens
cccagaactgtagac

SEQ ID NO: 373069 - DNA, 15 bp, Homo sapiens
ccagaactgtagaca

SEQ ID NO: 373070 - DNA, 15 bp, Homo sapiens
cagaactgtagacat

SEQ ID NO: 373071 - DNA, 15 bp, Homo sapiens
agaactgtagacatt

SEQ ID NO: 373072 - DNA, 15 bp, Homo sapiens
gaactgtagacattt

SEQ ID NO: 373073 - DNA, 15 bp, Homo sapiens
aactgtagacatttt

SEQ ID NO: 373074 - DNA, 15 bp, Homo sapiens
actgtagacattttt

SEQ ID NO: 373075 - DNA, 15 bp, Homo sapiens
ctgtagacatttttt

SEQ ID NO: 373076 - DNA, 15 bp, Homo sapiens
tgtagacattttttt

SEQ ID NO: 373077 - DNA, 15 bp, Homo sapiens
gtagacatttttttt

SEQ ID NO: 373078 - DNA, 15 bp, Homo sapiens
tagacattttttttt

SEQ ID NO: 373079 - DNA, 15 bp, Homo sapiens
agacattttttttta

SEQ ID NO: 373080 - DNA, 15 bp, Homo sapiens
gacatttttttttag

SEQ ID NO: 373081 - DNA, 15 bp, Homo sapiens
acatttttttttaga

SEQ ID NO: 373082 - DNA, 15 bp, Homo sapiens
catttttttttagat

SEQ ID NO: 373083 - DNA, 15 bp, Homo sapiens
atttttttttagatg

SEQ ID NO: 373084 - DNA, 15 bp, Homo sapiens
tttttttttagatga

SEQ ID NO: 373085 - DNA, 15 bp, Homo sapiens
ttttttttagatgat

SEQ ID NO: 373086 - DNA, 15 bp, Homo sapiens
tttttttagatgatt

SEQ ID NO: 373087 - DNA, 15 bp, Homo sapiens
ttttttagatgattc

SEQ ID NO: 373088 - DNA, 15 bp, Homo sapiens
tttttagatgattca

SEQ ID NO: 373089 - DNA, 15 bp, Homo sapiens
ttttagatgattcac

SEQ ID NO: 373090 - DNA, 15 bp, Homo sapiens
tttagatgattcacc

SEQ ID NO: 373091 - DNA, 15 bp, Homo sapiens
ttagatgattcaccc

SEQ ID NO: 373092 - DNA, 15 bp, Homo sapiens
tagatgattcaccca

SEQ ID NO: 373093 - DNA, 15 bp, Homo sapiens
agatgattcacccag

SEQ ID NO: 373094 - DNA, 15 bp, Homo sapiens
gatgattcacccagt

SEQ ID NO: 373095 - DNA, 15 bp, Homo sapiens
atgattcacccagtc

SEQ ID NO: 373096 - DNA, 15 bp, Homo sapiens
tgattcacccagtcc

SEQ ID NO: 373097 - DNA, 15 bp, Homo sapiens
gattcacccagtcct

SEQ ID NO: 373098 - DNA, 15 bp, Homo sapiens
attcacccagtcctt

SEQ ID NO: 373099 - DNA, 15 bp, Homo sapiens
ttcacccagtcctta

SEQ ID NO: 373100 - DNA, 15 bp, Homo sapiens
tcacccagtccttag

SEQ ID NO: 373101 - DNA, 15 bp, Homo sapiens
cacccagtccttagg

SEQ ID NO: 373102 - DNA, 15 bp, Homo sapiens
acccagtccttaggc

SEQ ID NO: 373103 - DNA, 15 bp, Homo sapiens
cccagtccttaggcc

SEQ ID NO: 373104 - DNA, 15 bp, Homo sapiens
ccagtccttaggcca

SEQ ID NO: 373105 - DNA, 15 bp, Homo sapiens
cagtccttaggccaa

SEQ ID NO: 373106 - DNA, 15 bp, Homo sapiens
agtccttaggccaat

SEQ ID NO: 373107 - DNA, 15 bp, Homo sapiens
gtccttaggccaata

SEQ ID NO: 373108 - DNA, 15 bp, Homo sapiens
tccttaggccaataa

SEQ ID NO: 373109 - DNA, 15 bp, Homo sapiens
ccttaggccaataaa

SEQ ID NO: 373110 - DNA, 15 bp, Homo sapiens
cttaggccaataaac

SEQ ID NO: 373111 - DNA, 15 bp, Homo sapiens
ttaggccaataaact

SEQ ID NO: 373112 - DNA, 15 bp, Homo sapiens
taggccaataaactt

SEQ ID NO: 373113 - DNA, 15 bp, Homo sapiens
aggccaataaacttg

SEQ ID NO: 373114 - DNA, 15 bp, Homo sapiens
ggccaataaacttgt

SEQ ID NO: 373115 - DNA, 15 bp, Homo sapiens
gccaataaacttgta

SEQ ID NO: 373116 - DNA, 15 bp, Homo sapiens
ccaataaacttgtag

SEQ ID NO: 373117 - DNA, 15 bp, Homo sapiens
caataaacttgtagt

SEQ ID NO: 373118 - DNA, 15 bp, Homo sapiens
aataaacttgtagtc

SEQ ID NO: 373119 - DNA, 15 bp, Homo sapiens
ataaacttgtagtca

SEQ ID NO: 373120 - DNA, 15 bp, Homo sapiens
taaacttgtagtcaa

SEQ ID NO: 373121 - DNA, 15 bp, Homo sapiens
aaacttgtagtcaac

SEQ ID NO: 373122 - DNA, 15 bp, Homo sapiens
aacttgtagtcaacc

SEQ ID NO: 373123 - DNA, 15 bp, Homo sapiens
acttgtagtcaacct

SEQ ID NO: 373124 - DNA, 15 bp, Homo sapiens
cttgtagtcaacctc

SEQ ID NO: 373125 - DNA, 15 bp, Homo sapiens
ttgtagtcaacctca

SEQ ID NO: 373126 - DNA, 15 bp, Homo sapiens
tgtagtcaacctcaa

SEQ ID NO: 373127 - DNA, 15 bp, Homo sapiens
gtagtcaacctcaac

SEQ ID NO: 373128 - DNA, 15 bp, Homo sapiens
tagtcaacctcaact

SEQ ID NO: 373129 - DNA, 15 bp, Homo sapiens
agtcaacctcaactc

SEQ ID NO: 373130 - DNA, 15 bp, Homo sapiens
gtcaacctcaactct

SEQ ID NO: 373131 - DNA, 15 bp, Homo sapiens
tcaacctcaactctt

SEQ ID NO: 373132 - DNA, 15 bp, Homo sapiens
caacctcaactcttc

SEQ ID NO: 373133 - DNA, 15 bp, Homo sapiens
aacctcaactcttct

SEQ ID NO: 373134 - DNA, 15 bp, Homo sapiens
acctcaactcttctc

SEQ ID NO: 373135 - DNA, 15 bp, Homo sapiens
cctcaactcttctct

SEQ ID NO: 373136 - DNA, 15 bp, Homo sapiens
ctcaactcttctctg

SEQ ID NO: 373137 - DNA, 15 bp, Homo sapiens
tcaactcttctctgg

SEQ ID NO: 373138 - DNA, 15 bp, Homo sapiens
caactcttctctgga

SEQ ID NO: 373139 - DNA, 15 bp, Homo sapiens
aactcttctctggaa

SEQ ID NO: 373140 - DNA, 15 bp, Homo sapiens
actcttctctggaat

SEQ ID NO: 373141 - DNA, 15 bp, Homo sapiens
ctcttctctggaatt

SEQ ID NO: 373142 - DNA, 15 bp, Homo sapiens
tcttctctggaatta

SEQ ID NO: 373143 - DNA, 15 bp, Homo sapiens
cttctctggaattaa

SEQ ID NO: 373144 - DNA, 15 bp, Homo sapiens
ttctctggaattaat

SEQ ID NO: 373145 - DNA, 15 bp, Homo sapiens
tctctggaattaata

SEQ ID NO: 373146 - DNA, 15 bp, Homo sapiens
ctctggaattaatat

SEQ ID NO: 373147 - DNA, 15 bp, Homo sapiens
tctggaattaatatt

SEQ ID NO: 373148 - DNA, 15 bp, Homo sapiens
ctggaattaatattc

SEQ ID NO: 373149 - DNA, 15 bp, Homo sapiens
tggaattaatattca

SEQ ID NO: 373150 - DNA, 15 bp, Homo sapiens
ggaattaatattcaa

SEQ ID NO: 373151 - DNA, 15 bp, Homo sapiens
gaattaatattcaat

SEQ ID NO: 373152 - DNA, 15 bp, Homo sapiens
aattaatattcaatc

SEQ ID NO: 373153 - DNA, 15 bp, Homo sapiens
attaatattcaatcc

SEQ ID NO: 373154 - DNA, 15 bp, Homo sapiens
ttaatattcaatcca

SEQ ID NO: 373155 - DNA, 15 bp, Homo sapiens
taatattcaatccat

SEQ ID NO: 373156 - DNA, 15 bp, Homo sapiens
aatattcaatccatc

SEQ ID NO: 373157 - DNA, 15 bp, Homo sapiens
atattcaatccatca

SEQ ID NO: 373158 - DNA, 15 bp, Homo sapiens
tattcaatccatcag

SEQ ID NO: 373159 - DNA, 15 bp, Homo sapiens
attcaatccatcagc

SEQ ID NO: 373160 - DNA, 15 bp, Homo sapiens
ttcaatccatcagca

SEQ ID NO: 373161 - DNA, 15 bp, Homo sapiens
tcaatccatcagcaa

SEQ ID NO: 373162 - DNA, 15 bp, Homo sapiens
caatccatcagcaag

SEQ ID NO: 373163 - DNA, 15 bp, Homo sapiens
aatccatcagcaagt

SEQ ID NO: 373164 - DNA, 15 bp, Homo sapiens
atccatcagcaagta

SEQ ID NO: 373165 - DNA, 15 bp, Homo sapiens
tccatcagcaagtag

SEQ ID NO: 373166 - DNA, 15 bp, Homo sapiens
ccatcagcaagtagc

SEQ ID NO: 373167 - DNA, 15 bp, Homo sapiens
catcagcaagtagca

SEQ ID NO: 373168 - DNA, 15 bp, Homo sapiens
atcagcaagtagcat

SEQ ID NO: 373169 - DNA, 15 bp, Homo sapiens
tcagcaagtagcatc

SEQ ID NO: 373170 - DNA, 15 bp, Homo sapiens
cagcaagtagcatca

SEQ ID NO: 373171 - DNA, 15 bp, Homo sapiens
agcaagtagcatcat

SEQ ID NO: 373172 - DNA, 15 bp, Homo sapiens
gcaagtagcatcatt

SEQ ID NO: 373173 - DNA, 15 bp, Homo sapiens
caagtagcatcattt

SEQ ID NO: 373174 - DNA, 15 bp, Homo sapiens
aagtagcatcatttc

SEQ ID NO: 373175 - DNA, 15 bp, Homo sapiens
agtagcatcatttcc

SEQ ID NO: 373176 - DNA, 15 bp, Homo sapiens
gtagcatcatttcca

SEQ ID NO: 373177 - DNA, 15 bp, Homo sapiens
tagcatcatttccat

SEQ ID NO: 373178 - DNA, 15 bp, Homo sapiens
agcatcatttccatg

SEQ ID NO: 373179 - DNA, 15 bp, Homo sapiens
gcatcatttccatgt

SEQ ID NO: 373180 - DNA, 15 bp, Homo sapiens
catcatttccatgtt

SEQ ID NO: 373181 - DNA, 15 bp, Homo sapiens
atcatttccatgttc

SEQ ID NO: 373182 - DNA, 15 bp, Homo sapiens
tcatttccatgttcc

SEQ ID NO: 373183 - DNA, 15 bp, Homo sapiens
catttccatgttcca

SEQ ID NO: 373184 - DNA, 15 bp, Homo sapiens
atttccatgttccat

SEQ ID NO: 373185 - DNA, 15 bp, Homo sapiens
tttccatgttccatt

SEQ ID NO: 373186 - DNA, 15 bp, Homo sapiens
ttccatgttccattc

SEQ ID NO: 373187 - DNA, 15 bp, Homo sapiens
tccatgttccattcc

SEQ ID NO: 373188 - DNA, 15 bp, Homo sapiens
ccatgttccattcca

SEQ ID NO: 373189 - DNA, 15 bp, Homo sapiens
catgttccattccac

SEQ ID NO: 373190 - DNA, 15 bp, Homo sapiens
atgttccattccacc

SEQ ID NO: 373191 - DNA, 15 bp, Homo sapiens
tgttccattccacct

SEQ ID NO: 373192 - DNA, 15 bp, Homo sapiens
gttccattccaccta

SEQ ID NO: 373193 - DNA, 15 bp, Homo sapiens
ttccattccacctac

SEQ ID NO: 373194 - DNA, 15 bp, Homo sapiens
tccattccacctact

SEQ ID NO: 373195 - DNA, 15 bp, Homo sapiens
ccattccacctactt

SEQ ID NO: 373196 - DNA, 15 bp, Homo sapiens
cattccacctacttc

SEQ ID NO: 373197 - DNA, 15 bp, Homo sapiens
attccacctacttcc

SEQ ID NO: 373198 - DNA, 15 bp, Homo sapiens
ttccacctacttccg

SEQ ID NO: 373199 - DNA, 15 bp, Homo sapiens
tccacctacttccgt

SEQ ID NO: 373200 - DNA, 15 bp, Homo sapiens
ccacctacttccgtg

SEQ ID NO: 373201 - DNA, 15 bp, Homo sapiens
cacctacttccgtgg

SEQ ID NO: 373202 - DNA, 15 bp, Homo sapiens
acctacttccgtggt

SEQ ID NO: 373203 - DNA, 15 bp, Homo sapiens
cctacttccgtggtc

SEQ ID NO: 373204 - DNA, 15 bp, Homo sapiens
ctacttccgtggtct

SEQ ID NO: 373205 - DNA, 15 bp, Homo sapiens
tacttccgtggtctt

SEQ ID NO: 373206 - DNA, 15 bp, Homo sapiens
acttccgtggtcttg

SEQ ID NO: 373207 - DNA, 15 bp, Homo sapiens
cttccgtggtcttga

SEQ ID NO: 373208 - DNA, 15 bp, Homo sapiens
ttccgtggtcttgaa

SEQ ID NO: 373209 - DNA, 15 bp, Homo sapiens
tccgtggtcttgaac

SEQ ID NO: 373210 - DNA, 15 bp, Homo sapiens
ccgtggtcttgaaca

SEQ ID NO: 373211 - DNA, 15 bp, Homo sapiens
cgtggtcttgaacac

SEQ ID NO: 373212 - DNA, 15 bp, Homo sapiens
gtggtcttgaacacc

SEQ ID NO: 373213 - DNA, 15 bp, Homo sapiens
tggtcttgaacaccc

SEQ ID NO: 373214 - DNA, 15 bp, Homo sapiens
ggtcttgaacaccct

SEQ ID NO: 373215 - DNA, 15 bp, Homo sapiens
gtcttgaacaccctt

SEQ ID NO: 373216 - DNA, 15 bp, Homo sapiens
tcttgaacaccctta

SEQ ID NO: 373217 - DNA, 15 bp, Homo sapiens
cttgaacacccttat

SEQ ID NO: 373218 - DNA, 15 bp, Homo sapiens
ttgaacacccttatc

SEQ ID NO: 373219 - DNA, 15 bp, Homo sapiens
tgaacacccttatct

SEQ ID NO: 373220 - DNA, 15 bp, Homo sapiens
gaacacccttatctt

SEQ ID NO: 373221 - DNA, 15 bp, Homo sapiens
aacacccttatcttt

SEQ ID NO: 373222 - DNA, 15 bp, Homo sapiens
acacccttatctttc

SEQ ID NO: 373223 - DNA, 15 bp, Homo sapiens
cacccttatctttct

SEQ ID NO: 373224 - DNA, 15 bp, Homo sapiens
acccttatctttcta

SEQ ID NO: 373225 - DNA, 15 bp, Homo sapiens
cccttatctttctat

SEQ ID NO: 373226 - DNA, 15 bp, Homo sapiens
ccttatctttctatc

SEQ ID NO: 373227 - DNA, 15 bp, Homo sapiens
cttatctttctatct

SEQ ID NO: 373228 - DNA, 15 bp, Homo sapiens
ttatctttctatcta

SEQ ID NO: 373229 - DNA, 15 bp, Homo sapiens
tatctttctatctag

SEQ ID NO: 373230 - DNA, 15 bp, Homo sapiens
atctttctatctaga

SEQ ID NO: 373231 - DNA, 15 bp, Homo sapiens
tctttctatctagat

SEQ ID NO: 373232 - DNA, 15 bp, Homo sapiens
ctttctatctagatt

SEQ ID NO: 373233 - DNA, 15 bp, Homo sapiens
tttctatctagatta

SEQ ID NO: 373234 - DNA, 15 bp, Homo sapiens
ttctatctagattat

SEQ ID NO: 373235 - DNA, 15 bp, Homo sapiens
tctatctagattatt

SEQ ID NO: 373236 - DNA, 15 bp, Homo sapiens
ctatctagattattg

SEQ ID NO: 373237 - DNA, 15 bp, Homo sapiens
tatctagattattgg

SEQ ID NO: 373238 - DNA, 15 bp, Homo sapiens
atctagattattgga

SEQ ID NO: 373239 - DNA, 15 bp, Homo sapiens
tctagattattggaa

SEQ ID NO: 373240 - DNA, 15 bp, Homo sapiens
ctagattattggaat

SEQ ID NO: 373241 - DNA, 15 bp, Homo sapiens
tagattattggaata

SEQ ID NO: 373242 - DNA, 15 bp, Homo sapiens
agattattggaatat

SEQ ID NO: 373243 - DNA, 15 bp, Homo sapiens
gattattggaatatg

SEQ ID NO: 373244 - DNA, 15 bp, Homo sapiens
attattggaatatgc

SEQ ID NO: 373245 - DNA, 15 bp, Homo sapiens
ttattggaatatgct

SEQ ID NO: 373246 - DNA, 15 bp, Homo sapiens
tattggaatatgctc

SEQ ID NO: 373247 - DNA, 15 bp, Homo sapiens
attggaatatgctcc

SEQ ID NO: 373248 - DNA, 15 bp, Homo sapiens
ttggaatatgctcct

SEQ ID NO: 373249 - DNA, 15 bp, Homo sapiens
tggaatatgctccta

SEQ ID NO: 373250 - DNA, 15 bp, Homo sapiens
ggaatatgctcctaa

SEQ ID NO: 373251 - DNA, 15 bp, Homo sapiens
gaatatgctcctaac

SEQ ID NO: 373252 - DNA, 15 bp, Homo sapiens
aatatgctcctaact

SEQ ID NO: 373253 - DNA, 15 bp, Homo sapiens
atatgctcctaactc

SEQ ID NO: 373254 - DNA, 15 bp, Homo sapiens
tatgctcctaactca

SEQ ID NO: 373255 - DNA, 15 bp, Homo sapiens
atgctcctaactcat

SEQ ID NO: 373256 - DNA, 15 bp, Homo sapiens
tgctcctaactcata

SEQ ID NO: 373257 - DNA, 15 bp, Homo sapiens
gctcctaactcataa

SEQ ID NO: 373258 - DNA, 15 bp, Homo sapiens
ctcctaactcataat

SEQ ID NO: 373259 - DNA, 15 bp, Homo sapiens
tcctaactcataatc

SEQ ID NO: 373260 - DNA, 15 bp, Homo sapiens
cctaactcataatcc

SEQ ID NO: 373261 - DNA, 15 bp, Homo sapiens
ctaactcataatcct

SEQ ID NO: 373262 - DNA, 15 bp, Homo sapiens
taactcataatcctg

SEQ ID NO: 373263 - DNA, 15 bp, Homo sapiens
aactcataatcctga

SEQ ID NO: 373264 - DNA, 15 bp, Homo sapiens
actcataatcctgat

SEQ ID NO: 373265 - DNA, 15 bp, Homo sapiens
ctcataatcctgatt

SEQ ID NO: 373266 - DNA, 15 bp, Homo sapiens
tcataatcctgattt

SEQ ID NO: 373267 - DNA, 15 bp, Homo sapiens
cataatcctgatttt

SEQ ID NO: 373268 - DNA, 15 bp, Homo sapiens
ataatcctgatttta

SEQ ID NO: 373269 - DNA, 15 bp, Homo sapiens
taatcctgattttat

SEQ ID NO: 373270 - DNA, 15 bp, Homo sapiens
aatcctgattttatt

SEQ ID NO: 373271 - DNA, 15 bp, Homo sapiens
atcctgattttattc

SEQ ID NO: 373272 - DNA, 15 bp, Homo sapiens
tcctgattttattct

SEQ ID NO: 373273 - DNA, 15 bp, Homo sapiens
cctgattttattctt

SEQ ID NO: 373274 - DNA, 15 bp, Homo sapiens
ctgattttattcttg

SEQ ID NO: 373275 - DNA, 15 bp, Homo sapiens
tgattttattcttgc

SEQ ID NO: 373276 - DNA, 15 bp, Homo sapiens
gattttattcttgcc

SEQ ID NO: 373277 - DNA, 15 bp, Homo sapiens
attttattcttgcct

SEQ ID NO: 373278 - DNA, 15 bp, Homo sapiens
ttttattcttgcctc

SEQ ID NO: 373279 - DNA, 15 bp, Homo sapiens
tttattcttgcctca

SEQ ID NO: 373280 - DNA, 15 bp, Homo sapiens
ttattcttgcctcag

SEQ ID NO: 373281 - DNA, 15 bp, Homo sapiens
tattcttgcctcagt

SEQ ID NO: 373282 - DNA, 15 bp, Homo sapiens
attcttgcctcagta

SEQ ID NO: 373283 - DNA, 15 bp, Homo sapiens
ttcttgcctcagtac

SEQ ID NO: 373284 - DNA, 15 bp, Homo sapiens
tcttgcctcagtact

SEQ ID NO: 373285 - DNA, 15 bp, Homo sapiens
cttgcctcagtactt

SEQ ID NO: 373286 - DNA, 15 bp, Homo sapiens
ttgcctcagtacttc

SEQ ID NO: 373287 - DNA, 15 bp, Homo sapiens
tgcctcagtacttct

SEQ ID NO: 373288 - DNA, 15 bp, Homo sapiens
gcctcagtacttctc

SEQ ID NO: 373289 - DNA, 15 bp, Homo sapiens
cctcagtacttctcc

SEQ ID NO: 373290 - DNA, 15 bp, Homo sapiens
ctcagtacttctcca

SEQ ID NO: 373291 - DNA, 15 bp, Homo sapiens
tcagtacttctccat

SEQ ID NO: 373292 - DNA, 15 bp, Homo sapiens
cagtacttctccatg

SEQ ID NO: 373293 - DNA, 15 bp, Homo sapiens
agtacttctccatga

SEQ ID NO: 373294 - DNA, 15 bp, Homo sapiens
gtacttctccatgac

SEQ ID NO: 373295 - DNA, 15 bp, Homo sapiens
tacttctccatgacc

SEQ ID NO: 373296 - DNA, 15 bp, Homo sapiens
acttctccatgacct

SEQ ID NO: 373297 - DNA, 15 bp, Homo sapiens
cttctccatgaccta

SEQ ID NO: 373298 - DNA, 15 bp, Homo sapiens
ttctccatgacctat

SEQ ID NO: 373299 - DNA, 15 bp, Homo sapiens
tctccatgacctatt

SEQ ID NO: 373300 - DNA, 15 bp, Homo sapiens
ctccatgacctattc

SEQ ID NO: 373301 - DNA, 15 bp, Homo sapiens
tccatgacctattcc

SEQ ID NO: 373302 - DNA, 15 bp, Homo sapiens
ccatgacctattcct

SEQ ID NO: 373303 - DNA, 15 bp, Homo sapiens
catgacctattcctc

SEQ ID NO: 373304 - DNA, 15 bp, Homo sapiens
atgacctattcctct

SEQ ID NO: 373305 - DNA, 15 bp, Homo sapiens
tgacctattcctctg

SEQ ID NO: 373306 - DNA, 15 bp, Homo sapiens
gacctattcctctga

SEQ ID NO: 373307 - DNA, 15 bp, Homo sapiens
acctattcctctgat

SEQ ID NO: 373308 - DNA, 15 bp, Homo sapiens
cctattcctctgata

SEQ ID NO: 373309 - DNA, 15 bp, Homo sapiens
ctattcctctgatag

SEQ ID NO: 373310 - DNA, 15 bp, Homo sapiens
tattcctctgatagc

SEQ ID NO: 373311 - DNA, 15 bp, Homo sapiens
attcctctgatagca

SEQ ID NO: 373312 - DNA, 15 bp, Homo sapiens
ttcctctgatagcag

SEQ ID NO: 373313 - DNA, 15 bp, Homo sapiens
tcctctgatagcaga

SEQ ID NO: 373314 - DNA, 15 bp, Homo sapiens
cctctgatagcagat

SEQ ID NO: 373315 - DNA, 15 bp, Homo sapiens
ctctgatagcagata

SEQ ID NO: 373316 - DNA, 15 bp, Homo sapiens
tctgatagcagatag

SEQ ID NO: 373317 - DNA, 15 bp, Homo sapiens
ctgatagcagataga

SEQ ID NO: 373318 - DNA, 15 bp, Homo sapiens
tgatagcagatagag

SEQ ID NO: 373319 - DNA, 15 bp, Homo sapiens
gatagcagatagagt

SEQ ID NO: 373320 - DNA, 15 bp, Homo sapiens
atagcagatagagtg

SEQ ID NO: 373321 - DNA, 15 bp, Homo sapiens
tagcagatagagtga

SEQ ID NO: 373322 - DNA, 15 bp, Homo sapiens
agcagatagagtgat

SEQ ID NO: 373323 - DNA, 15 bp, Homo sapiens
gcagatagagtgatt

SEQ ID NO: 373324 - DNA, 15 bp, Homo sapiens
cagatagagtgattc

SEQ ID NO: 373325 - DNA, 15 bp, Homo sapiens
agatagagtgattct

SEQ ID NO: 373326 - DNA, 15 bp, Homo sapiens
gatagagtgattctt

SEQ ID NO: 373327 - DNA, 15 bp, Homo sapiens
atagagtgattcttt

SEQ ID NO: 373328 - DNA, 15 bp, Homo sapiens
tagagtgattctttt

SEQ ID NO: 373329 - DNA, 15 bp, Homo sapiens
agagtgattctttta

SEQ ID NO: 373330 - DNA, 15 bp, Homo sapiens
gagtgattcttttaa

SEQ ID NO: 373331 - DNA, 15 bp, Homo sapiens
agtgattcttttaaa

SEQ ID NO: 373332 - DNA, 15 bp, Homo sapiens
gtgattcttttaaac

SEQ ID NO: 373333 - DNA, 15 bp, Homo sapiens
tgattcttttaaacg

SEQ ID NO: 373334 - DNA, 15 bp, Homo sapiens
gattcttttaaacga

SEQ ID NO: 373335 - DNA, 15 bp, Homo sapiens
attcttttaaacgag

SEQ ID NO: 373336 - DNA, 15 bp, Homo sapiens
ttcttttaaacgagt

SEQ ID NO: 373337 - DNA, 15 bp, Homo sapiens
tcttttaaacgagtt

SEQ ID NO: 373338 - DNA, 15 bp, Homo sapiens
cttttaaacgagttt

SEQ ID NO: 373339 - DNA, 15 bp, Homo sapiens
ttttaaacgagtttg

SEQ ID NO: 373340 - DNA, 15 bp, Homo sapiens
tttaaacgagtttga

SEQ ID NO: 373341 - DNA, 15 bp, Homo sapiens
ttaaacgagtttgat

SEQ ID NO: 373342 - DNA, 15 bp, Homo sapiens
taaacgagtttgatt

SEQ ID NO: 373343 - DNA, 15 bp, Homo sapiens
aaacgagtttgattg

SEQ ID NO: 373344 - DNA, 15 bp, Homo sapiens
aacgagtttgattgt

SEQ ID NO: 373345 - DNA, 15 bp, Homo sapiens
acgagtttgattgtg

SEQ ID NO: 373346 - DNA, 15 bp, Homo sapiens
cgagtttgattgtgt

SEQ ID NO: 373347 - DNA, 15 bp, Homo sapiens
gagtttgattgtgtc

SEQ ID NO: 373348 - DNA, 15 bp, Homo sapiens
agtttgattgtgtcg

SEQ ID NO: 373349 - DNA, 15 bp, Homo sapiens
gtttgattgtgtcgt

SEQ ID NO: 373350 - DNA, 15 bp, Homo sapiens
tttgattgtgtcgtt

SEQ ID NO: 373351 - DNA, 15 bp, Homo sapiens
ttgattgtgtcgttt

SEQ ID NO: 373352 - DNA, 15 bp, Homo sapiens
tgattgtgtcgtttc

SEQ ID NO: 373353 - DNA, 15 bp, Homo sapiens
gattgtgtcgtttct

SEQ ID NO: 373354 - DNA, 15 bp, Homo sapiens
attgtgtcgtttctt

SEQ ID NO: 373355 - DNA, 15 bp, Homo sapiens
ttgtgtcgtttcttt

SEQ ID NO: 373356 - DNA, 15 bp, Homo sapiens
tgtgtcgtttctttg

SEQ ID NO: 373357 - DNA, 15 bp, Homo sapiens
gtgtcgtttctttgt

SEQ ID NO: 373358 - DNA, 15 bp, Homo sapiens
tgtcgtttctttgtt

SEQ ID NO: 373359 - DNA, 15 bp, Homo sapiens
gtcgtttctttgttc

SEQ ID NO: 373360 - DNA, 15 bp, Homo sapiens
tcgtttctttgttca

SEQ ID NO: 373361 - DNA, 15 bp, Homo sapiens
cgtttctttgttcac

SEQ ID NO: 373362 - DNA, 15 bp, Homo sapiens
gtttctttgttcaca

SEQ ID NO: 373363 - DNA, 15 bp, Homo sapiens
tttctttgttcacag

SEQ ID NO: 373364 - DNA, 15 bp, Homo sapiens
ttctttgttcacagt

SEQ ID NO: 373365 - DNA, 15 bp, Homo sapiens
tctttgttcacagtc

SEQ ID NO: 373366 - DNA, 15 bp, Homo sapiens
ctttgttcacagtct

SEQ ID NO: 373367 - DNA, 15 bp, Homo sapiens
tttgttcacagtctt

SEQ ID NO: 373368 - DNA, 15 bp, Homo sapiens
ttgttcacagtcttt

SEQ ID NO: 373369 - DNA, 15 bp, Homo sapiens
tgttcacagtctttt

SEQ ID NO: 373370 - DNA, 15 bp, Homo sapiens
gttcacagtctttta

SEQ ID NO: 373371 - DNA, 15 bp, Homo sapiens
ttcacagtcttttaa

SEQ ID NO: 373372 - DNA, 15 bp, Homo sapiens
tcacagtcttttaat

SEQ ID NO: 373373 - DNA, 15 bp, Homo sapiens
cacagtcttttaatc

SEQ ID NO: 373374 - DNA, 15 bp, Homo sapiens
acagtcttttaatca

SEQ ID NO: 373375 - DNA, 15 bp, Homo sapiens
cagtcttttaatcac

SEQ ID NO: 373376 - DNA, 15 bp, Homo sapiens
agtcttttaatcact

SEQ ID NO: 373377 - DNA, 15 bp, Homo sapiens
gtcttttaatcactt

SEQ ID NO: 373378 - DNA, 15 bp, Homo sapiens
tcttttaatcacttc

SEQ ID NO: 373379 - DNA, 15 bp, Homo sapiens
cttttaatcacttcc

SEQ ID NO: 373380 - DNA, 15 bp, Homo sapiens
ttttaatcacttcca

SEQ ID NO: 373381 - DNA, 15 bp, Homo sapiens
tttaatcacttccat

SEQ ID NO: 373382 - DNA, 15 bp, Homo sapiens
ttaatcacttccatc

SEQ ID NO: 373383 - DNA, 15 bp, Homo sapiens
taatcacttccatcc

SEQ ID NO: 373384 - DNA, 15 bp, Homo sapiens
aatcacttccatcca

SEQ ID NO: 373385 - DNA, 15 bp, Homo sapiens
atcacttccatccac

SEQ ID NO: 373386 - DNA, 15 bp, Homo sapiens
tcacttccatccaca

SEQ ID NO: 373387 - DNA, 15 bp, Homo sapiens
cacttccatccacat

SEQ ID NO: 373388 - DNA, 15 bp, Homo sapiens
acttccatccacata

SEQ ID NO: 373389 - DNA, 15 bp, Homo sapiens
cttccatccacataa

SEQ ID NO: 373390 - DNA, 15 bp, Homo sapiens
ttccatccacataaa

SEQ ID NO: 373391 - DNA, 15 bp, Homo sapiens
tccatccacataaat

SEQ ID NO: 373392 - DNA, 15 bp, Homo sapiens
ccatccacataaatg

SEQ ID NO: 373393 - DNA, 15 bp, Homo sapiens
catccacataaatga

SEQ ID NO: 373394 - DNA, 15 bp, Homo sapiens
atccacataaatgag

SEQ ID NO: 373395 - DNA, 15 bp, Homo sapiens
tccacataaatgagt

SEQ ID NO: 373396 - DNA, 15 bp, Homo sapiens
ccacataaatgagtt

SEQ ID NO: 373397 - DNA, 15 bp, Homo sapiens
cacataaatgagttc

SEQ ID NO: 373398 - DNA, 15 bp, Homo sapiens
acataaatgagttcc

SEQ ID NO: 373399 - DNA, 15 bp, Homo sapiens
cataaatgagttcca

SEQ ID NO: 373400 - DNA, 15 bp, Homo sapiens
ataaatgagttccaa

SEQ ID NO: 373401 - DNA, 15 bp, Homo sapiens
taaatgagttccaaa

SEQ ID NO: 373402 - DNA, 15 bp, Homo sapiens
aaatgagttccaaag

SEQ ID NO: 373403 - DNA, 15 bp, Homo sapiens
aatgagttccaaagt

SEQ ID NO: 373404 - DNA, 15 bp, Homo sapiens
atgagttccaaagtc

SEQ ID NO: 373405 - DNA, 15 bp, Homo sapiens
tgagttccaaagtct

SEQ ID NO: 373406 - DNA, 15 bp, Homo sapiens
gagttccaaagtctg

SEQ ID NO: 373407 - DNA, 15 bp, Homo sapiens
agttccaaagtctgg

SEQ ID NO: 373408 - DNA, 15 bp, Homo sapiens
gttccaaagtctggc

SEQ ID NO: 373409 - DNA, 15 bp, Homo sapiens
ttccaaagtctggcc

SEQ ID NO: 373410 - DNA, 15 bp, Homo sapiens
tccaaagtctggcct

SEQ ID NO: 373411 - DNA, 15 bp, Homo sapiens
ccaaagtctggcctt

SEQ ID NO: 373412 - DNA, 15 bp, Homo sapiens
caaagtctggcctta

SEQ ID NO: 373413 - DNA, 15 bp, Homo sapiens
aaagtctggccttag

SEQ ID NO: 373414 - DNA, 15 bp, Homo sapiens
aagtctggccttagt

SEQ ID NO: 373415 - DNA, 15 bp, Homo sapiens
agtctggccttagtc

SEQ ID NO: 373416 - DNA, 15 bp, Homo sapiens
gtctggccttagtcc

SEQ ID NO: 373417 - DNA, 15 bp, Homo sapiens
tctggccttagtcca

SEQ ID NO: 373418 - DNA, 15 bp, Homo sapiens
ctggccttagtccag

SEQ ID NO: 373419 - DNA, 15 bp, Homo sapiens
tggccttagtccaga

SEQ ID NO: 373420 - DNA, 15 bp, Homo sapiens
ggccttagtccagaa

SEQ ID NO: 373421 - DNA, 15 bp, Homo sapiens
gccttagtccagaac

SEQ ID NO: 373422 - DNA, 15 bp, Homo sapiens
ccttagtccagaaca

SEQ ID NO: 373423 - DNA, 15 bp, Homo sapiens
cttagtccagaacac

SEQ ID NO: 373424 - DNA, 15 bp, Homo sapiens
ttagtccagaacacc

SEQ ID NO: 373425 - DNA, 15 bp, Homo sapiens
tagtccagaacacca

SEQ ID NO: 373426 - DNA, 15 bp, Homo sapiens
agtccagaacaccat

SEQ ID NO: 373427 - DNA, 15 bp, Homo sapiens
gtccagaacaccatg

SEQ ID NO: 373428 - DNA, 15 bp, Homo sapiens
tccagaacaccatgc

SEQ ID NO: 373429 - DNA, 15 bp, Homo sapiens
ccagaacaccatgca

SEQ ID NO: 373430 - DNA, 15 bp, Homo sapiens
cagaacaccatgcat

SEQ ID NO: 373431 - DNA, 15 bp, Homo sapiens
agaacaccatgcata

SEQ ID NO: 373432 - DNA, 15 bp, Homo sapiens
gaacaccatgcatat

SEQ ID NO: 373433 - DNA, 15 bp, Homo sapiens
aacaccatgcatatc

SEQ ID NO: 373434 - DNA, 15 bp, Homo sapiens
acaccatgcatatct

SEQ ID NO: 373435 - DNA, 15 bp, Homo sapiens
caccatgcatatctg

SEQ ID NO: 373436 - DNA, 15 bp, Homo sapiens
accatgcatatctgc

SEQ ID NO: 373437 - DNA, 15 bp, Homo sapiens
ccatgcatatctgcc

SEQ ID NO: 373438 - DNA, 15 bp, Homo sapiens
catgcatatctgcct

SEQ ID NO: 373439 - DNA, 15 bp, Homo sapiens
atgcatatctgcctg

SEQ ID NO: 373440 - DNA, 15 bp, Homo sapiens
tgcatatctgcctgt

SEQ ID NO: 373441 - DNA, 15 bp, Homo sapiens
gcatatctgcctgtc

SEQ ID NO: 373442 - DNA, 15 bp, Homo sapiens
catatctgcctgtct

SEQ ID NO: 373443 - DNA, 15 bp, Homo sapiens
atatctgcctgtctc

SEQ ID NO: 373444 - DNA, 15 bp, Homo sapiens
tatctgcctgtctct

SEQ ID NO: 373445 - DNA, 15 bp, Homo sapiens
atctgcctgtctctt

SEQ ID NO: 373446 - DNA, 15 bp, Homo sapiens
tctgcctgtctcttt

SEQ ID NO: 373447 - DNA, 15 bp, Homo sapiens
ctgcctgtctcttta

SEQ ID NO: 373448 - DNA, 15 bp, Homo sapiens
tgcctgtctctttaa

SEQ ID NO: 373449 - DNA, 15 bp, Homo sapiens
gcctgtctctttaat

SEQ ID NO: 373450 - DNA, 15 bp, Homo sapiens
cctgtctctttaatc

SEQ ID NO: 373451 - DNA, 15 bp, Homo sapiens
ctgtctctttaatca

SEQ ID NO: 373452 - DNA, 15 bp, Homo sapiens
tgtctctttaatcac

SEQ ID NO: 373453 - DNA, 15 bp, Homo sapiens
gtctctttaatcaca

SEQ ID NO: 373454 - DNA, 15 bp, Homo sapiens
tctctttaatcacat

SEQ ID NO: 373455 - DNA, 15 bp, Homo sapiens
ctctttaatcacatt

SEQ ID NO: 373456 - DNA, 15 bp, Homo sapiens
tctttaatcacattt

SEQ ID NO: 373457 - DNA, 15 bp, Homo sapiens
ctttaatcacatttc

SEQ ID NO: 373458 - DNA, 15 bp, Homo sapiens
tttaatcacatttct

SEQ ID NO: 373459 - DNA, 15 bp, Homo sapiens
ttaatcacatttctt

SEQ ID NO: 373460 - DNA, 15 bp, Homo sapiens
taatcacatttctta

SEQ ID NO: 373461 - DNA, 15 bp, Homo sapiens
aatcacatttcttac

SEQ ID NO: 373462 - DNA, 15 bp, Homo sapiens
atcacatttcttact

SEQ ID NO: 373463 - DNA, 15 bp, Homo sapiens
tcacatttcttacta

SEQ ID NO: 373464 - DNA, 15 bp, Homo sapiens
cacatttcttactac

SEQ ID NO: 373465 - DNA, 15 bp, Homo sapiens
acatttcttactact

SEQ ID NO: 373466 - DNA, 15 bp, Homo sapiens
catttcttactactt

SEQ ID NO: 373467 - DNA, 15 bp, Homo sapiens
atttcttactacttt

SEQ ID NO: 373468 - DNA, 15 bp, Homo sapiens
tttcttactactttt

SEQ ID NO: 373469 - DNA, 15 bp, Homo sapiens
ttcttactacttttc

SEQ ID NO: 373470 - DNA, 15 bp, Homo sapiens
tcttactacttttcc

SEQ ID NO: 373471 - DNA, 15 bp, Homo sapiens
cttactacttttccc

SEQ ID NO: 373472 - DNA, 15 bp, Homo sapiens
ttactacttttccct

SEQ ID NO: 373473 - DNA, 15 bp, Homo sapiens
tactacttttccctt

SEQ ID NO: 373474 - DNA, 15 bp, Homo sapiens
actacttttcccttt

SEQ ID NO: 373475 - DNA, 15 bp, Homo sapiens
ctacttttccctttg

SEQ ID NO: 373476 - DNA, 15 bp, Homo sapiens
tacttttccctttgt

SEQ ID NO: 373477 - DNA, 15 bp, Homo sapiens
acttttccctttgtt

SEQ ID NO: 373478 - DNA, 15 bp, Homo sapiens
cttttccctttgttc

SEQ ID NO: 373479 - DNA, 15 bp, Homo sapiens
ttttccctttgttca

SEQ ID NO: 373480 - DNA, 15 bp, Homo sapiens
tttccctttgttcat

SEQ ID NO: 373481 - DNA, 15 bp, Homo sapiens
ttccctttgttcatt

SEQ ID NO: 373482 - DNA, 15 bp, Homo sapiens
tccctttgttcattc

SEQ ID NO: 373483 - DNA, 15 bp, Homo sapiens
ccctttgttcattct

SEQ ID NO: 373484 - DNA, 15 bp, Homo sapiens
cctttgttcattctg

SEQ ID NO: 373485 - DNA, 15 bp, Homo sapiens
ctttgttcattctgt

SEQ ID NO: 373486 - DNA, 15 bp, Homo sapiens
tttgttcattctgtt

SEQ ID NO: 373487 - DNA, 15 bp, Homo sapiens
ttgttcattctgttt

SEQ ID NO: 373488 - DNA, 15 bp, Homo sapiens
tgttcattctgtttc

SEQ ID NO: 373489 - DNA, 15 bp, Homo sapiens
gttcattctgtttca

SEQ ID NO: 373490 - DNA, 15 bp, Homo sapiens
ttcattctgtttcaa

SEQ ID NO: 373491 - DNA, 15 bp, Homo sapiens
tcattctgtttcaaa

SEQ ID NO: 373492 - DNA, 15 bp, Homo sapiens
cattctgtttcaaat

SEQ ID NO: 373493 - DNA, 15 bp, Homo sapiens
attctgtttcaaata

SEQ ID NO: 373494 - DNA, 15 bp, Homo sapiens
ttctgtttcaaatac

SEQ ID NO: 373495 - DNA, 15 bp, Homo sapiens
tctgtttcaaataca

SEQ ID NO: 373496 - DNA, 15 bp, Homo sapiens
ctgtttcaaatacac

SEQ ID NO: 373497 - DNA, 15 bp, Homo sapiens
tgtttcaaatacact

SEQ ID NO: 373498 - DNA, 15 bp, Homo sapiens
gtttcaaatacactg

SEQ ID NO: 373499 - DNA, 15 bp, Homo sapiens
tttcaaatacactgg

SEQ ID NO: 373500 - DNA, 15 bp, Homo sapiens
ttcaaatacactggt

SEQ ID NO: 373501 - DNA, 15 bp, Homo sapiens
tcaaatacactggtc

SEQ ID NO: 373502 - DNA, 15 bp, Homo sapiens
caaatacactggtct

SEQ ID NO: 373503 - DNA, 15 bp, Homo sapiens
aaatacactggtctt

SEQ ID NO: 373504 - DNA, 15 bp, Homo sapiens
aatacactggtcttc

SEQ ID NO: 373505 - DNA, 15 bp, Homo sapiens
atacactggtcttct

SEQ ID NO: 373506 - DNA, 15 bp, Homo sapiens
tacactggtcttctt

SEQ ID NO: 373507 - DNA, 15 bp, Homo sapiens
acactggtcttcttg

SEQ ID NO: 373508 - DNA, 15 bp, Homo sapiens
cactggtcttcttgc

SEQ ID NO: 373509 - DNA, 15 bp, Homo sapiens
actggtcttcttgct

SEQ ID NO: 373510 - DNA, 15 bp, Homo sapiens
ctggtcttcttgctg

SEQ ID NO: 373511 - DNA, 15 bp, Homo sapiens
tggtcttcttgctgt

SEQ ID NO: 373512 - DNA, 15 bp, Homo sapiens
ggtcttcttgctgtt

SEQ ID NO: 373513 - DNA, 15 bp, Homo sapiens
gtcttcttgctgttt

SEQ ID NO: 373514 - DNA, 15 bp, Homo sapiens
tcttcttgctgtttc

SEQ ID NO: 373515 - DNA, 15 bp, Homo sapiens
cttcttgctgtttca

SEQ ID NO: 373516 - DNA, 15 bp, Homo sapiens
ttcttgctgtttcaa

SEQ ID NO: 373517 - DNA, 15 bp, Homo sapiens
tcttgctgtttcaaa

SEQ ID NO: 373518 - DNA, 15 bp, Homo sapiens
cttgctgtttcaaac

SEQ ID NO: 373519 - DNA, 15 bp, Homo sapiens
ttgctgtttcaaaca

SEQ ID NO: 373520 - DNA, 15 bp, Homo sapiens
tgctgtttcaaacat

SEQ ID NO: 373521 - DNA, 15 bp, Homo sapiens
gctgtttcaaacatg

SEQ ID NO: 373522 - DNA, 15 bp, Homo sapiens
ctgtttcaaacatgc

SEQ ID NO: 373523 - DNA, 15 bp, Homo sapiens
tgtttcaaacatgcc

SEQ ID NO: 373524 - DNA, 15 bp, Homo sapiens
gtttcaaacatgcca

SEQ ID NO: 373525 - DNA, 15 bp, Homo sapiens
tttcaaacatgccaa

SEQ ID NO: 373526 - DNA, 15 bp, Homo sapiens
ttcaaacatgccaag

SEQ ID NO: 373527 - DNA, 15 bp, Homo sapiens
tcaaacatgccaaga

SEQ ID NO: 373528 - DNA, 15 bp, Homo sapiens
caaacatgccaagaa

SEQ ID NO: 373529 - DNA, 15 bp, Homo sapiens
aaacatgccaagaac

SEQ ID NO: 373530 - DNA, 15 bp, Homo sapiens
aacatgccaagaacg

SEQ ID NO: 373531 - DNA, 15 bp, Homo sapiens
acatgccaagaacgt

SEQ ID NO: 373532 - DNA, 15 bp, Homo sapiens
catgccaagaacgta

SEQ ID NO: 373533 - DNA, 15 bp, Homo sapiens
atgccaagaacgtaa

SEQ ID NO: 373534 - DNA, 15 bp, Homo sapiens
tgccaagaacgtaat

SEQ ID NO: 373535 - DNA, 15 bp, Homo sapiens
gccaagaacgtaatc

SEQ ID NO: 373536 - DNA, 15 bp, Homo sapiens
ccaagaacgtaatca

SEQ ID NO: 373537 - DNA, 15 bp, Homo sapiens
caagaacgtaatcat

SEQ ID NO: 373538 - DNA, 15 bp, Homo sapiens
aagaacgtaatcatt

SEQ ID NO: 373539 - DNA, 15 bp, Homo sapiens
agaacgtaatcattt

SEQ ID NO: 373540 - DNA, 15 bp, Homo sapiens
gaacgtaatcatttc

SEQ ID NO: 373541 - DNA, 15 bp, Homo sapiens
aacgtaatcatttct

SEQ ID NO: 373542 - DNA, 15 bp, Homo sapiens
acgtaatcatttctg

SEQ ID NO: 373543 - DNA, 15 bp, Homo sapiens
cgtaatcatttctgg

SEQ ID NO: 373544 - DNA, 15 bp, Homo sapiens
gtaatcatttctggt

SEQ ID NO: 373545 - DNA, 15 bp, Homo sapiens
taatcatttctggtc

SEQ ID NO: 373546 - DNA, 15 bp, Homo sapiens
aatcatttctggtct

SEQ ID NO: 373547 - DNA, 15 bp, Homo sapiens
atcatttctggtctt

SEQ ID NO: 373548 - DNA, 15 bp, Homo sapiens
tcatttctggtcttt

SEQ ID NO: 373549 - DNA, 15 bp, Homo sapiens
catttctggtctttg

SEQ ID NO: 373550 - DNA, 15 bp, Homo sapiens
atttctggtctttgt

SEQ ID NO: 373551 - DNA, 15 bp, Homo sapiens
tttctggtctttgtg

SEQ ID NO: 373552 - DNA, 15 bp, Homo sapiens
ttctggtctttgtgc

SEQ ID NO: 373553 - DNA, 15 bp, Homo sapiens
tctggtctttgtgct

SEQ ID NO: 373554 - DNA, 15 bp, Homo sapiens
ctggtctttgtgctt

SEQ ID NO: 373555 - DNA, 15 bp, Homo sapiens
tggtctttgtgcttg

SEQ ID NO: 373556 - DNA, 15 bp, Homo sapiens
ggtctttgtgcttgg

SEQ ID NO: 373557 - DNA, 15 bp, Homo sapiens
gtctttgtgcttggt

SEQ ID NO: 373558 - DNA, 15 bp, Homo sapiens
tctttgtgcttggtg

SEQ ID NO: 373559 - DNA, 15 bp, Homo sapiens
ctttgtgcttggtgt

SEQ ID NO: 373560 - DNA, 15 bp, Homo sapiens
tttgtgcttggtgtt

SEQ ID NO: 373561 - DNA, 15 bp, Homo sapiens
ttgtgcttggtgttc

SEQ ID NO: 373562 - DNA, 15 bp, Homo sapiens
tgtgcttggtgttcc

SEQ ID NO: 373563 - DNA, 15 bp, Homo sapiens
gtgcttggtgttcct

SEQ ID NO: 373564 - DNA, 15 bp, Homo sapiens
tgcttggtgttcctt

SEQ ID NO: 373565 - DNA, 15 bp, Homo sapiens
gcttggtgttccttc

SEQ ID NO: 373566 - DNA, 15 bp, Homo sapiens
cttggtgttccttct

SEQ ID NO: 373567 - DNA, 15 bp, Homo sapiens
ttggtgttccttctt

SEQ ID NO: 373568 - DNA, 15 bp, Homo sapiens
tggtgttccttcttc

SEQ ID NO: 373569 - DNA, 15 bp, Homo sapiens
ggtgttccttcttct

SEQ ID NO: 373570 - DNA, 15 bp, Homo sapiens
gtgttccttcttctt

SEQ ID NO: 373571 - DNA, 15 bp, Homo sapiens
tgttccttcttcttg

SEQ ID NO: 373572 - DNA, 15 bp, Homo sapiens
gttccttcttcttgt

SEQ ID NO: 373573 - DNA, 15 bp, Homo sapiens
ttccttcttcttgtc

SEQ ID NO: 373574 - DNA, 15 bp, Homo sapiens
tccttcttcttgtct

SEQ ID NO: 373575 - DNA, 15 bp, Homo sapiens
ccttcttcttgtctt

SEQ ID NO: 373576 - DNA, 15 bp, Homo sapiens
cttcttcttgtcttc

SEQ ID NO: 373577 - DNA, 15 bp, Homo sapiens
ttcttcttgtcttcc

SEQ ID NO: 373578 - DNA, 15 bp, Homo sapiens
tcttcttgtcttccc

SEQ ID NO: 373579 - DNA, 15 bp, Homo sapiens
cttcttgtcttcccc

SEQ ID NO: 373580 - DNA, 15 bp, Homo sapiens
ttcttgtcttcccca

SEQ ID NO: 373581 - DNA, 15 bp, Homo sapiens
tcttgtcttccccaa

SEQ ID NO: 373582 - DNA, 15 bp, Homo sapiens
cttgtcttccccaaa

SEQ ID NO: 373583 - DNA, 15 bp, Homo sapiens
ttgtcttccccaaat

SEQ ID NO: 373584 - DNA, 15 bp, Homo sapiens
tgtcttccccaaatg

SEQ ID NO: 373585 - DNA, 15 bp, Homo sapiens
gtcttccccaaatgt

SEQ ID NO: 373586 - DNA, 15 bp, Homo sapiens
tcttccccaaatgtt

SEQ ID NO: 373587 - DNA, 15 bp, Homo sapiens
cttccccaaatgttc

SEQ ID NO: 373588 - DNA, 15 bp, Homo sapiens
ttccccaaatgttct

SEQ ID NO: 373589 - DNA, 15 bp, Homo sapiens
tccccaaatgttctt

SEQ ID NO: 373590 - DNA, 15 bp, Homo sapiens
ccccaaatgttcttc

SEQ ID NO: 373591 - DNA, 15 bp, Homo sapiens
cccaaatgttcttct

SEQ ID NO: 373592 - DNA, 15 bp, Homo sapiens
ccaaatgttcttctc

SEQ ID NO: 373593 - DNA, 15 bp, Homo sapiens
caaatgttcttctct

SEQ ID NO: 373594 - DNA, 15 bp, Homo sapiens
aaatgttcttctctt

SEQ ID NO: 373595 - DNA, 15 bp, Homo sapiens
aatgttcttctctta

SEQ ID NO: 373596 - DNA, 15 bp, Homo sapiens
atgttcttctcttag

SEQ ID NO: 373597 - DNA, 15 bp, Homo sapiens
tgttcttctcttaga

SEQ ID NO: 373598 - DNA, 15 bp, Homo sapiens
gttcttctcttagat

SEQ ID NO: 373599 - DNA, 15 bp, Homo sapiens
ttcttctcttagata

SEQ ID NO: 373600 - DNA, 15 bp, Homo sapiens
tcttctcttagatat

SEQ ID NO: 373601 - DNA, 15 bp, Homo sapiens
cttctcttagatatt

SEQ ID NO: 373602 - DNA, 15 bp, Homo sapiens
ttctcttagatattt

SEQ ID NO: 373603 - DNA, 15 bp, Homo sapiens
tctcttagatatttt

SEQ ID NO: 373604 - DNA, 15 bp, Homo sapiens
ctcttagatattttc

SEQ ID NO: 373605 - DNA, 15 bp, Homo sapiens
tcttagatattttca

SEQ ID NO: 373606 - DNA, 15 bp, Homo sapiens
cttagatattttcat

SEQ ID NO: 373607 - DNA, 15 bp, Homo sapiens
ttagatattttcatg

SEQ ID NO: 373608 - DNA, 15 bp, Homo sapiens
tagatattttcatgt

SEQ ID NO: 373609 - DNA, 15 bp, Homo sapiens
agatattttcatgtt

SEQ ID NO: 373610 - DNA, 15 bp, Homo sapiens
gatattttcatgttt

SEQ ID NO: 373611 - DNA, 15 bp, Homo sapiens
atattttcatgtttc

SEQ ID NO: 373612 - DNA, 15 bp, Homo sapiens
tattttcatgtttca

SEQ ID NO: 373613 - DNA, 15 bp, Homo sapiens
attttcatgtttcac

SEQ ID NO: 373614 - DNA, 15 bp, Homo sapiens
ttttcatgtttcaca

SEQ ID NO: 373615 - DNA, 15 bp, Homo sapiens
tttcatgtttcacat

SEQ ID NO: 373616 - DNA, 15 bp, Homo sapiens
ttcatgtttcacata

SEQ ID NO: 373617 - DNA, 15 bp, Homo sapiens
tcatgtttcacatac

SEQ ID NO: 373618 - DNA, 15 bp, Homo sapiens
catgtttcacatact

SEQ ID NO: 373619 - DNA, 15 bp, Homo sapiens
atgtttcacatactc

SEQ ID NO: 373620 - DNA, 15 bp, Homo sapiens
tgtttcacatactca

SEQ ID NO: 373621 - DNA, 15 bp, Homo sapiens
gtttcacatactcac

SEQ ID NO: 373622 - DNA, 15 bp, Homo sapiens
tttcacatactcact

SEQ ID NO: 373623 - DNA, 15 bp, Homo sapiens
ttcacatactcactt

SEQ ID NO: 373624 - DNA, 15 bp, Homo sapiens
tcacatactcacttc

SEQ ID NO: 373625 - DNA, 15 bp, Homo sapiens
cacatactcacttcc

SEQ ID NO: 373626 - DNA, 15 bp, Homo sapiens
acatactcacttcct

SEQ ID NO: 373627 - DNA, 15 bp, Homo sapiens
catactcacttcctt

SEQ ID NO: 373628 - DNA, 15 bp, Homo sapiens
atactcacttccttt

SEQ ID NO: 373629 - DNA, 15 bp, Homo sapiens
tactcacttccttta

SEQ ID NO: 373630 - DNA, 15 bp, Homo sapiens
actcacttcctttag

SEQ ID NO: 373631 - DNA, 15 bp, Homo sapiens
ctcacttcctttagt

SEQ ID NO: 373632 - DNA, 15 bp, Homo sapiens
tcacttcctttagtt

SEQ ID NO: 373633 - DNA, 15 bp, Homo sapiens
cacttcctttagttc

SEQ ID NO: 373634 - DNA, 15 bp, Homo sapiens
acttcctttagttct

SEQ ID NO: 373635 - DNA, 15 bp, Homo sapiens
cttcctttagttctc

SEQ ID NO: 373636 - DNA, 15 bp, Homo sapiens
ttcctttagttctcc

SEQ ID NO: 373637 - DNA, 15 bp, Homo sapiens
tcctttagttctcct

SEQ ID NO: 373638 - DNA, 15 bp, Homo sapiens
cctttagttctcctt

SEQ ID NO: 373639 - DNA, 15 bp, Homo sapiens
ctttagttctccttc

SEQ ID NO: 373640 - DNA, 15 bp, Homo sapiens
tttagttctccttca

SEQ ID NO: 373641 - DNA, 15 bp, Homo sapiens
ttagttctccttcag

SEQ ID NO: 373642 - DNA, 15 bp, Homo sapiens
tagttctccttcaga

SEQ ID NO: 373643 - DNA, 15 bp, Homo sapiens
agttctccttcagat

SEQ ID NO: 373644 - DNA, 15 bp, Homo sapiens
gttctccttcagata

SEQ ID NO: 373645 - DNA, 15 bp, Homo sapiens
ttctccttcagatat

SEQ ID NO: 373646 - DNA, 15 bp, Homo sapiens
tctccttcagatatc

SEQ ID NO: 373647 - DNA, 15 bp, Homo sapiens
ctccttcagatatcc

SEQ ID NO: 373648 - DNA, 15 bp, Homo sapiens
tccttcagatatccc

SEQ ID NO: 373649 - DNA, 15 bp, Homo sapiens
ccttcagatatccct

SEQ ID NO: 373650 - DNA, 15 bp, Homo sapiens
cttcagatatccctt

SEQ ID NO: 373651 - DNA, 15 bp, Homo sapiens
ttcagatatcccttt

SEQ ID NO: 373652 - DNA, 15 bp, Homo sapiens
tcagatatccctttc

SEQ ID NO: 373653 - DNA, 15 bp, Homo sapiens
cagatatccctttct

SEQ ID NO: 373654 - DNA, 15 bp, Homo sapiens
agatatccctttcta

SEQ ID NO: 373655 - DNA, 15 bp, Homo sapiens
gatatccctttctag

SEQ ID NO: 373656 - DNA, 15 bp, Homo sapiens
atatccctttctaga

SEQ ID NO: 373657 - DNA, 15 bp, Homo sapiens
tatccctttctagaa

SEQ ID NO: 373658 - DNA, 15 bp, Homo sapiens
atccctttctagaat

SEQ ID NO: 373659 - DNA, 15 bp, Homo sapiens
tccctttctagaata

SEQ ID NO: 373660 - DNA, 15 bp, Homo sapiens
ccctttctagaatag

SEQ ID NO: 373661 - DNA, 15 bp, Homo sapiens
cctttctagaatagc

SEQ ID NO: 373662 - DNA, 15 bp, Homo sapiens
ctttctagaatagcc

SEQ ID NO: 373663 - DNA, 15 bp, Homo sapiens
tttctagaatagccc

SEQ ID NO: 373664 - DNA, 15 bp, Homo sapiens
ttctagaatagccct

SEQ ID NO: 373665 - DNA, 15 bp, Homo sapiens
tctagaatagccctt

SEQ ID NO: 373666 - DNA, 15 bp, Homo sapiens
ctagaatagcccttt

SEQ ID NO: 373667 - DNA, 15 bp, Homo sapiens
tagaatagccctttc

SEQ ID NO: 373668 - DNA, 15 bp, Homo sapiens
agaatagccctttct

SEQ ID NO: 373669 - DNA, 15 bp, Homo sapiens
gaatagccctttctt

SEQ ID NO: 373670 - DNA, 15 bp, Homo sapiens
aatagccctttcttg

SEQ ID NO: 373671 - DNA, 15 bp, Homo sapiens
atagccctttcttgc

SEQ ID NO: 373672 - DNA, 15 bp, Homo sapiens
tagccctttcttgcc

SEQ ID NO: 373673 - DNA, 15 bp, Homo sapiens
agccctttcttgccc

SEQ ID NO: 373674 - DNA, 15 bp, Homo sapiens
gccctttcttgccca

SEQ ID NO: 373675 - DNA, 15 bp, Homo sapiens
ccctttcttgcccac

SEQ ID NO: 373676 - DNA, 15 bp, Homo sapiens
cctttcttgcccaca

SEQ ID NO: 373677 - DNA, 15 bp, Homo sapiens
ctttcttgcccacaa

SEQ ID NO: 373678 - DNA, 15 bp, Homo sapiens
tttcttgcccacaat

SEQ ID NO: 373679 - DNA, 15 bp, Homo sapiens
ttcttgcccacaata

SEQ ID NO: 373680 - DNA, 15 bp, Homo sapiens
tcttgcccacaatat

SEQ ID NO: 373681 - DNA, 15 bp, Homo sapiens
cttgcccacaatatc

SEQ ID NO: 373682 - DNA, 15 bp, Homo sapiens
ttgcccacaatatct

SEQ ID NO: 373683 - DNA, 15 bp, Homo sapiens
tgcccacaatatctc

SEQ ID NO: 373684 - DNA, 15 bp, Homo sapiens
gcccacaatatctca

SEQ ID NO: 373685 - DNA, 15 bp, Homo sapiens
cccacaatatctcag

SEQ ID NO: 373686 - DNA, 15 bp, Homo sapiens
ccacaatatctcaga

SEQ ID NO: 373687 - DNA, 15 bp, Homo sapiens
cacaatatctcagat

SEQ ID NO: 373688 - DNA, 15 bp, Homo sapiens
acaatatctcagata

SEQ ID NO: 373689 - DNA, 15 bp, Homo sapiens
caatatctcagatac

SEQ ID NO: 373690 - DNA, 15 bp, Homo sapiens
aatatctcagataca

SEQ ID NO: 373691 - DNA, 15 bp, Homo sapiens
atatctcagatacac

SEQ ID NO: 373692 - DNA, 15 bp, Homo sapiens
tatctcagatacacc

SEQ ID NO: 373693 - DNA, 15 bp, Homo sapiens
atctcagatacaccc

SEQ ID NO: 373694 - DNA, 15 bp, Homo sapiens
tctcagatacaccct

SEQ ID NO: 373695 - DNA, 15 bp, Homo sapiens
ctcagatacaccctg

SEQ ID NO: 373696 - DNA, 15 bp, Homo sapiens
tcagatacaccctgt

SEQ ID NO: 373697 - DNA, 15 bp, Homo sapiens
cagatacaccctgtc

SEQ ID NO: 373698 - DNA, 15 bp, Homo sapiens
agatacaccctgtct

SEQ ID NO: 373699 - DNA, 15 bp, Homo sapiens
gatacaccctgtctc

SEQ ID NO: 373700 - DNA, 15 bp, Homo sapiens
atacaccctgtctct

SEQ ID NO: 373701 - DNA, 15 bp, Homo sapiens
tacaccctgtctctg

SEQ ID NO: 373702 - DNA, 15 bp, Homo sapiens
acaccctgtctctgt

SEQ ID NO: 373703 - DNA, 15 bp, Homo sapiens
caccctgtctctgtc

SEQ ID NO: 373704 - DNA, 15 bp, Homo sapiens
accctgtctctgtct

SEQ ID NO: 373705 - DNA, 15 bp, Homo sapiens
ccctgtctctgtctt

SEQ ID NO: 373706 - DNA, 15 bp, Homo sapiens
cctgtctctgtcttc

SEQ ID NO: 373707 - DNA, 15 bp, Homo sapiens
ctgtctctgtcttct

SEQ ID NO: 373708 - DNA, 15 bp, Homo sapiens
tgtctctgtcttctt

SEQ ID NO: 373709 - DNA, 15 bp, Homo sapiens
gtctctgtcttcttg

SEQ ID NO: 373710 - DNA, 15 bp, Homo sapiens
tctctgtcttcttgt

SEQ ID NO: 373711 - DNA, 15 bp, Homo sapiens
ctctgtcttcttgta

SEQ ID NO: 373712 - DNA, 15 bp, Homo sapiens
tctgtcttcttgtat

SEQ ID NO: 373713 - DNA, 15 bp, Homo sapiens
ctgtcttcttgtatt

SEQ ID NO: 373714 - DNA, 15 bp, Homo sapiens
tgtcttcttgtattg

SEQ ID NO: 373715 - DNA, 15 bp, Homo sapiens
gtcttcttgtattga

SEQ ID NO: 373716 - DNA, 15 bp, Homo sapiens
tcttcttgtattgat

SEQ ID NO: 373717 - DNA, 15 bp, Homo sapiens
cttcttgtattgatt

SEQ ID NO: 373718 - DNA, 15 bp, Homo sapiens
ttcttgtattgattt

SEQ ID NO: 373719 - DNA, 15 bp, Homo sapiens
cttgtattgatttta

SEQ ID NO: 373720 - DNA, 15 bp, Homo sapiens
ttgtattgattttac

SEQ ID NO: 373721 - DNA, 15 bp, Homo sapiens
tgtattgattttact

SEQ ID NO: 373722 - DNA, 15 bp, Homo sapiens
gtattgattttactt

SEQ ID NO: 373723 - DNA, 15 bp, Homo sapiens
tattgattttacttc

SEQ ID NO: 373724 - DNA, 15 bp, Homo sapiens
attgattttacttca

SEQ ID NO: 373725 - DNA, 15 bp, Homo sapiens
ttgattttacttcat

SEQ ID NO: 373726 - DNA, 15 bp, Homo sapiens
tgattttacttcata

SEQ ID NO: 373727 - DNA, 15 bp, Homo sapiens
gattttacttcataa

SEQ ID NO: 373728 - DNA, 15 bp, Homo sapiens
attttacttcataac

SEQ ID NO: 373729 - DNA, 15 bp, Homo sapiens
ttttacttcataaca

SEQ ID NO: 373730 - DNA, 15 bp, Homo sapiens
tttacttcataacac

SEQ ID NO: 373731 - DNA, 15 bp, Homo sapiens
ttacttcataacaca

SEQ ID NO: 373732 - DNA, 15 bp, Homo sapiens
tacttcataacacac

SEQ ID NO: 373733 - DNA, 15 bp, Homo sapiens
acttcataacacaca

SEQ ID NO: 373734 - DNA, 15 bp, Homo sapiens
cttcataacacacat

SEQ ID NO: 373735 - DNA, 15 bp, Homo sapiens
ttcataacacacatc

SEQ ID NO: 373736 - DNA, 15 bp, Homo sapiens
tcataacacacatcc

SEQ ID NO: 373737 - DNA, 15 bp, Homo sapiens
cataacacacatcca

SEQ ID NO: 373738 - DNA, 15 bp, Homo sapiens
ataacacacatccat

SEQ ID NO: 373739 - DNA, 15 bp, Homo sapiens
taacacacatccatt

SEQ ID NO: 373740 - DNA, 15 bp, Homo sapiens
aacacacatccattt

SEQ ID NO: 373741 - DNA, 15 bp, Homo sapiens
acacacatccatttt

SEQ ID NO: 373742 - DNA, 15 bp, Homo sapiens
cacacatccattttc

SEQ ID NO: 373743 - DNA, 15 bp, Homo sapiens
acacatccattttcc

SEQ ID NO: 373744 - DNA, 15 bp, Homo sapiens
cacatccattttcct

SEQ ID NO: 373745 - DNA, 15 bp, Homo sapiens
acatccattttcctg

SEQ ID NO: 373746 - DNA, 15 bp, Homo sapiens
catccattttcctga

SEQ ID NO: 373747 - DNA, 15 bp, Homo sapiens
atccattttcctgat

SEQ ID NO: 373748 - DNA, 15 bp, Homo sapiens
tccattttcctgata

SEQ ID NO: 373749 - DNA, 15 bp, Homo sapiens
ccattttcctgatag

SEQ ID NO: 373750 - DNA, 15 bp, Homo sapiens
cattttcctgataga

SEQ ID NO: 373751 - DNA, 15 bp, Homo sapiens
attttcctgatagaa

SEQ ID NO: 373752 - DNA, 15 bp, Homo sapiens
ttttcctgatagaat

SEQ ID NO: 373753 - DNA, 15 bp, Homo sapiens
tttcctgatagaatg

SEQ ID NO: 373754 - DNA, 15 bp, Homo sapiens
ttcctgatagaatgc

SEQ ID NO: 373755 - DNA, 15 bp, Homo sapiens
tcctgatagaatgca

SEQ ID NO: 373756 - DNA, 15 bp, Homo sapiens
cctgatagaatgcaa

SEQ ID NO: 373757 - DNA, 15 bp, Homo sapiens
ctgatagaatgcaag

SEQ ID NO: 373758 - DNA, 15 bp, Homo sapiens
tgatagaatgcaagc

SEQ ID NO: 373759 - DNA, 15 bp, Homo sapiens
gatagaatgcaagct

SEQ ID NO: 373760 - DNA, 15 bp, Homo sapiens
atagaatgcaagctc

SEQ ID NO: 373761 - DNA, 15 bp, Homo sapiens
tagaatgcaagctct

SEQ ID NO: 373762 - DNA, 15 bp, Homo sapiens
agaatgcaagctctg

SEQ ID NO: 373763 - DNA, 15 bp, Homo sapiens
gaatgcaagctctgg

SEQ ID NO: 373764 - DNA, 15 bp, Homo sapiens
aatgcaagctctggc

SEQ ID NO: 373765 - DNA, 15 bp, Homo sapiens
atgcaagctctggca

SEQ ID NO: 373766 - DNA, 15 bp, Homo sapiens
tgcaagctctggcag

SEQ ID NO: 373767 - DNA, 15 bp, Homo sapiens
gcaagctctggcagg

SEQ ID NO: 373768 - DNA, 15 bp, Homo sapiens
caagctctggcaggg

SEQ ID NO: 373769 - DNA, 15 bp, Homo sapiens
aagctctggcagggc

SEQ ID NO: 373770 - DNA, 15 bp, Homo sapiens
agctctggcagggca

SEQ ID NO: 373771 - DNA, 15 bp, Homo sapiens
gctctggcagggcac

SEQ ID NO: 373772 - DNA, 15 bp, Homo sapiens
ctctggcagggcacg

SEQ ID NO: 373773 - DNA, 15 bp, Homo sapiens
tctggcagggcacgg

SEQ ID NO: 373774 - DNA, 15 bp, Homo sapiens
ctggcagggcacggt

SEQ ID NO: 373775 - DNA, 15 bp, Homo sapiens
tggcagggcacggtg

SEQ ID NO: 373776 - DNA, 15 bp, Homo sapiens
ggcagggcacggtgg

SEQ ID NO: 373777 - DNA, 15 bp, Homo sapiens
gcagggcacggtggc

SEQ ID NO: 373778 - DNA, 15 bp, Homo sapiens
cagggcacggtggct

SEQ ID NO: 373779 - DNA, 15 bp, Homo sapiens
agggcacggtggctc

SEQ ID NO: 373780 - DNA, 15 bp, Homo sapiens
gcctgtaatcccagt

SEQ ID NO: 373781 - DNA, 15 bp, Homo sapiens
cctgtaatcccagtg

SEQ ID NO: 373782 - DNA, 15 bp, Homo sapiens
ctgtaatcccagtgc

SEQ ID NO: 373783 - DNA, 15 bp, Homo sapiens
tgtaatcccagtgct

SEQ ID NO: 373784 - DNA, 15 bp, Homo sapiens
gtaatcccagtgctt

SEQ ID NO: 373785 - DNA, 15 bp, Homo sapiens
taatcccagtgcttt

SEQ ID NO: 373786 - DNA, 15 bp, Homo sapiens
aatcccagtgctttg

SEQ ID NO: 373787 - DNA, 15 bp, Homo sapiens
atcccagtgctttgg

SEQ ID NO: 373788 - DNA, 15 bp, Homo sapiens
tcccagtgctttggg

SEQ ID NO: 373789 - DNA, 15 bp, Homo sapiens
cccagtgctttggga

SEQ ID NO: 373790 - DNA, 15 bp, Homo sapiens
ccagtgctttgggag

SEQ ID NO: 373791 - DNA, 15 bp, Homo sapiens
cagtgctttgggagg

SEQ ID NO: 373792 - DNA, 15 bp, Homo sapiens
agtgctttgggaggc

SEQ ID NO: 373793 - DNA, 15 bp, Homo sapiens
gtgctttgggaggcc

SEQ ID NO: 373794 - DNA, 15 bp, Homo sapiens
tgctttgggaggcca

SEQ ID NO: 373795 - DNA, 15 bp, Homo sapiens
gctttgggaggccaa

SEQ ID NO: 373796 - DNA, 15 bp, Homo sapiens
gaggccaaggcgggt

SEQ ID NO: 373797 - DNA, 15 bp, Homo sapiens
aggccaaggcgggtg

SEQ ID NO: 373798 - DNA, 15 bp, Homo sapiens
ggccaaggcgggtgg

SEQ ID NO: 373799 - DNA, 15 bp, Homo sapiens
gccaaggcgggtgga

SEQ ID NO: 373800 - DNA, 15 bp, Homo sapiens
ccaaggcgggtggat

SEQ ID NO: 373801 - DNA, 15 bp, Homo sapiens
caaggcgggtggatc

SEQ ID NO: 373802 - DNA, 15 bp, Homo sapiens
aaggcgggtggatca

SEQ ID NO: 373803 - DNA, 15 bp, Homo sapiens
gggtggatcacctga

SEQ ID NO: 373804 - DNA, 15 bp, Homo sapiens
tggtgaaactctgtt

SEQ ID NO: 373805 - DNA, 15 bp, Homo sapiens
ggtgaaactctgttt

SEQ ID NO: 373806 - DNA, 15 bp, Homo sapiens
gtgaaactctgtttc

SEQ ID NO: 373807 - DNA, 15 bp, Homo sapiens
tgaaactctgtttct

SEQ ID NO: 373808 - DNA, 15 bp, Homo sapiens
gaaactctgtttcta

SEQ ID NO: 373809 - DNA, 15 bp, Homo sapiens
aaactctgtttctac

SEQ ID NO: 373810 - DNA, 15 bp, Homo sapiens
aactctgtttctact

SEQ ID NO: 373811 - DNA, 15 bp, Homo sapiens
actctgtttctacta

SEQ ID NO: 373812 - DNA, 15 bp, Homo sapiens
ctctgtttctactaa

SEQ ID NO: 373813 - DNA, 15 bp, Homo sapiens
tctgtttctactaaa

SEQ ID NO: 373814 - DNA, 15 bp, Homo sapiens
ctgtttctactaaaa

SEQ ID NO: 373815 - DNA, 15 bp, Homo sapiens
tgtttctactaaaaa

SEQ ID NO: 373816 - DNA, 15 bp, Homo sapiens
gtttctactaaaaat

SEQ ID NO: 373817 - DNA, 15 bp, Homo sapiens
tttctactaaaaata

SEQ ID NO: 373818 - DNA, 15 bp, Homo sapiens
ggcgggcgcctgtaa

SEQ ID NO: 373819 - DNA, 15 bp, Homo sapiens
gcgggcgcctgtaat

SEQ ID NO: 373820 - DNA, 15 bp, Homo sapiens
cgggcgcctgtaatc

SEQ ID NO: 373821 - DNA, 15 bp, Homo sapiens
gggcgcctgtaatcc

SEQ ID NO: 373822 - DNA, 15 bp, Homo sapiens
ggcgcctgtaatccc

SEQ ID NO: 373823 - DNA, 15 bp, Homo sapiens
ccagctacttgggaa

SEQ ID NO: 373824 - DNA, 15 bp, Homo sapiens
ggcaggagaatcgcc

SEQ ID NO: 373825 - DNA, 15 bp, Homo sapiens
gcaggagaatcgcct

SEQ ID NO: 373826 - DNA, 15 bp, Homo sapiens
caggagaatcgcctg

SEQ ID NO: 373827 - DNA, 15 bp, Homo sapiens
aggagaatcgcctga

SEQ ID NO: 373828 - DNA, 15 bp, Homo sapiens
ggagaatcgcctgaa

SEQ ID NO: 373829 - DNA, 15 bp, Homo sapiens
gagaatcgcctgaac

SEQ ID NO: 373830 - DNA, 15 bp, Homo sapiens
agaatcgcctgaacc

SEQ ID NO: 373831 - DNA, 15 bp, Homo sapiens
gaatcgcctgaaccc

SEQ ID NO: 373832 - DNA, 15 bp, Homo sapiens
aatcgcctgaaccca

SEQ ID NO: 373833 - DNA, 15 bp, Homo sapiens
atcgcctgaacccag

SEQ ID NO: 373834 - DNA, 15 bp, Homo sapiens
tcgcctgaacccagg

SEQ ID NO: 373835 - DNA, 15 bp, Homo sapiens
cgcctgaacccagga

SEQ ID NO: 373836 - DNA, 15 bp, Homo sapiens
gcctgaacccaggag

SEQ ID NO: 373837 - DNA, 15 bp, Homo sapiens
cctgaacccaggagg

SEQ ID NO: 373838 - DNA, 15 bp, Homo sapiens
ctgaacccaggaggt

SEQ ID NO: 373839 - DNA, 15 bp, Homo sapiens
tgaacccaggaggtg

SEQ ID NO: 373840 - DNA, 15 bp, Homo sapiens
gaacccaggaggtgg

SEQ ID NO: 373841 - DNA, 15 bp, Homo sapiens
aacccaggaggtgga

SEQ ID NO: 373842 - DNA, 15 bp, Homo sapiens
acccaggaggtggag

SEQ ID NO: 373843 - DNA, 15 bp, Homo sapiens
cccaggaggtggagg

SEQ ID NO: 373844 - DNA, 15 bp, Homo sapiens
ccaggaggtggaggt

SEQ ID NO: 373845 - DNA, 15 bp, Homo sapiens
ggaggttgcagtgac

SEQ ID NO: 373846 - DNA, 15 bp, Homo sapiens
gaggttgcagtgacc

SEQ ID NO: 373847 - DNA, 15 bp, Homo sapiens
aggttgcagtgaccc

SEQ ID NO: 373848 - DNA, 15 bp, Homo sapiens
ggttgcagtgaccca

SEQ ID NO: 373849 - DNA, 15 bp, Homo sapiens
gttgcagtgacccaa

SEQ ID NO: 373850 - DNA, 15 bp, Homo sapiens
ttgcagtgacccaag

SEQ ID NO: 373851 - DNA, 15 bp, Homo sapiens
tgcagtgacccaaga

SEQ ID NO: 373852 - DNA, 15 bp, Homo sapiens
gcagtgacccaagac

SEQ ID NO: 373853 - DNA, 15 bp, Homo sapiens
cagtgacccaagacc

SEQ ID NO: 373854 - DNA, 15 bp, Homo sapiens
agtgacccaagaccg

SEQ ID NO: 373855 - DNA, 15 bp, Homo sapiens
gtgacccaagaccgt

SEQ ID NO: 373856 - DNA, 15 bp, Homo sapiens
tgacccaagaccgta

SEQ ID NO: 373857 - DNA, 15 bp, Homo sapiens
gacccaagaccgtac

SEQ ID NO: 373858 - DNA, 15 bp, Homo sapiens
acccaagaccgtacc

SEQ ID NO: 373859 - DNA, 15 bp, Homo sapiens
cccaagaccgtacca

SEQ ID NO: 373860 - DNA, 15 bp, Homo sapiens
ccaagaccgtaccat

SEQ ID NO: 373861 - DNA, 15 bp, Homo sapiens
caagaccgtaccatt

SEQ ID NO: 373862 - DNA, 15 bp, Homo sapiens
aagaccgtaccattg

SEQ ID NO: 373863 - DNA, 15 bp, Homo sapiens
agaccgtaccattgc

SEQ ID NO: 373864 - DNA, 15 bp, Homo sapiens
gaccgtaccattgca

SEQ ID NO: 373865 - DNA, 15 bp, Homo sapiens
accgtaccattgcac

SEQ ID NO: 373866 - DNA, 15 bp, Homo sapiens
ccgtaccattgcact

SEQ ID NO: 373867 - DNA, 15 bp, Homo sapiens
cgtaccattgcactc

SEQ ID NO: 373868 - DNA, 15 bp, Homo sapiens
gtaccattgcactcc

SEQ ID NO: 373869 - DNA, 15 bp, Homo sapiens
taccattgcactcca

SEQ ID NO: 373870 - DNA, 15 bp, Homo sapiens
attgcactccagccc

SEQ ID NO: 373871 - DNA, 15 bp, Homo sapiens
ttgcactccagccca

SEQ ID NO: 373872 - DNA, 15 bp, Homo sapiens
tgcactccagcccaa

SEQ ID NO: 373873 - DNA, 15 bp, Homo sapiens
gcactccagcccaaa

SEQ ID NO: 373874 - DNA, 15 bp, Homo sapiens
cactccagcccaaac

SEQ ID NO: 373875 - DNA, 15 bp, Homo sapiens
actccagcccaaact

SEQ ID NO: 373876 - DNA, 15 bp, Homo sapiens
ctccagcccaaactt

SEQ ID NO: 373877 - DNA, 15 bp, Homo sapiens
tccagcccaaacttt

SEQ ID NO: 373878 - DNA, 15 bp, Homo sapiens
ccagcccaaactttg

SEQ ID NO: 373879 - DNA, 15 bp, Homo sapiens
cagcccaaactttgt

SEQ ID NO: 373880 - DNA, 15 bp, Homo sapiens
agcccaaactttgtc

SEQ ID NO: 373881 - DNA, 15 bp, Homo sapiens
gcccaaactttgtct

SEQ ID NO: 373882 - DNA, 15 bp, Homo sapiens
cccaaactttgtctt

SEQ ID NO: 373883 - DNA, 15 bp, Homo sapiens
ccaaactttgtcttg

SEQ ID NO: 373884 - DNA, 15 bp, Homo sapiens
caaactttgtcttgc

SEQ ID NO: 373885 - DNA, 15 bp, Homo sapiens
aaactttgtcttgca

SEQ ID NO: 373886 - DNA, 15 bp, Homo sapiens
aactttgtcttgcac

SEQ ID NO: 373887 - DNA, 15 bp, Homo sapiens
actttgtcttgcaca

SEQ ID NO: 373888 - DNA, 15 bp, Homo sapiens
ctttgtcttgcacac

SEQ ID NO: 373889 - DNA, 15 bp, Homo sapiens
tttgtcttgcacact

SEQ ID NO: 373890 - DNA, 15 bp, Homo sapiens
ttgtcttgcacactc

SEQ ID NO: 373891 - DNA, 15 bp, Homo sapiens
tgtcttgcacactct

SEQ ID NO: 373892 - DNA, 15 bp, Homo sapiens
gtcttgcacactctc

SEQ ID NO: 373893 - DNA, 15 bp, Homo sapiens
tcttgcacactctca

SEQ ID NO: 373894 - DNA, 15 bp, Homo sapiens
cttgcacactctcat

SEQ ID NO: 373895 - DNA, 15 bp, Homo sapiens
ttgcacactctcatg

SEQ ID NO: 373896 - DNA, 15 bp, Homo sapiens
tgcacactctcatgc

SEQ ID NO: 373897 - DNA, 15 bp, Homo sapiens
gcacactctcatgcc

SEQ ID NO: 373898 - DNA, 15 bp, Homo sapiens
cacactctcatgcct

SEQ ID NO: 373899 - DNA, 15 bp, Homo sapiens
acactctcatgcctg

SEQ ID NO: 373900 - DNA, 15 bp, Homo sapiens
cactctcatgcctgc

SEQ ID NO: 373901 - DNA, 15 bp, Homo sapiens
actctcatgcctgca

SEQ ID NO: 373902 - DNA, 15 bp, Homo sapiens
ctctcatgcctgcag

SEQ ID NO: 373903 - DNA, 15 bp, Homo sapiens
tctcatgcctgcagc

SEQ ID NO: 373904 - DNA, 15 bp, Homo sapiens
ctcatgcctgcagcg

SEQ ID NO: 373905 - DNA, 15 bp, Homo sapiens
tcatgcctgcagcgt

SEQ ID NO: 373906 - DNA, 15 bp, Homo sapiens
catgcctgcagcgtc

SEQ ID NO: 373907 - DNA, 15 bp, Homo sapiens
atgcctgcagcgtct

SEQ ID NO: 373908 - DNA, 15 bp, Homo sapiens
tgcctgcagcgtcta

SEQ ID NO: 373909 - DNA, 15 bp, Homo sapiens
gcctgcagcgtctag

SEQ ID NO: 373910 - DNA, 15 bp, Homo sapiens
cctgcagcgtctaga

SEQ ID NO: 373911 - DNA, 15 bp, Homo sapiens
ctgcagcgtctagaa

SEQ ID NO: 373912 - DNA, 15 bp, Homo sapiens
tgcagcgtctagaat

SEQ ID NO: 373913 - DNA, 15 bp, Homo sapiens
gcagcgtctagaata

SEQ ID NO: 373914 - DNA, 15 bp, Homo sapiens
cagcgtctagaatag

SEQ ID NO: 373915 - DNA, 15 bp, Homo sapiens
agcgtctagaatagc

SEQ ID NO: 373916 - DNA, 15 bp, Homo sapiens
gcgtctagaatagcc

SEQ ID NO: 373917 - DNA, 15 bp, Homo sapiens
cgtctagaatagccc

SEQ ID NO: 373918 - DNA, 15 bp, Homo sapiens
gtctagaatagcccc

SEQ ID NO: 373919 - DNA, 15 bp, Homo sapiens
tctagaatagcccct

SEQ ID NO: 373920 - DNA, 15 bp, Homo sapiens
ctagaatagcccctt

SEQ ID NO: 373921 - DNA, 15 bp, Homo sapiens
tagaatagcccctta

SEQ ID NO: 373922 - DNA, 15 bp, Homo sapiens
agaatagccccttac

SEQ ID NO: 373923 - DNA, 15 bp, Homo sapiens
gaatagccccttaca

SEQ ID NO: 373924 - DNA, 15 bp, Homo sapiens
aatagccccttacac

SEQ ID NO: 373925 - DNA, 15 bp, Homo sapiens
atagccccttacaca

SEQ ID NO: 373926 - DNA, 15 bp, Homo sapiens
tagccccttacacat

SEQ ID NO: 373927 - DNA, 15 bp, Homo sapiens
agccccttacacata

SEQ ID NO: 373928 - DNA, 15 bp, Homo sapiens
gccccttacacataa

SEQ ID NO: 373929 - DNA, 15 bp, Homo sapiens
ccccttacacataat

SEQ ID NO: 373930 - DNA, 15 bp, Homo sapiens
cccttacacataata

SEQ ID NO: 373931 - DNA, 15 bp, Homo sapiens
ccttacacataatag

SEQ ID NO: 373932 - DNA, 15 bp, Homo sapiens
cttacacataatagg

SEQ ID NO: 373933 - DNA, 15 bp, Homo sapiens
ttacacataataggt

SEQ ID NO: 373934 - DNA, 15 bp, Homo sapiens
tacacataataggtt

SEQ ID NO: 373935 - DNA, 15 bp, Homo sapiens
acacataataggttc

SEQ ID NO: 373936 - DNA, 15 bp, Homo sapiens
cacataataggttct

SEQ ID NO: 373937 - DNA, 15 bp, Homo sapiens
acataataggttctt

SEQ ID NO: 373938 - DNA, 15 bp, Homo sapiens
cataataggttctta

SEQ ID NO: 373939 - DNA, 15 bp, Homo sapiens
ataataggttcttaa

SEQ ID NO: 373940 - DNA, 15 bp, Homo sapiens
taataggttcttaat

SEQ ID NO: 373941 - DNA, 15 bp, Homo sapiens
aataggttcttaata

SEQ ID NO: 373942 - DNA, 15 bp, Homo sapiens
ataggttcttaatag

SEQ ID NO: 373943 - DNA, 15 bp, Homo sapiens
taggttcttaatagg

SEQ ID NO: 373944 - DNA, 15 bp, Homo sapiens
aggttcttaataggt

SEQ ID NO: 373945 - DNA, 15 bp, Homo sapiens
ggttcttaataggta

SEQ ID NO: 373946 - DNA, 15 bp, Homo sapiens
gttcttaataggtat

SEQ ID NO: 373947 - DNA, 15 bp, Homo sapiens
ttcttaataggtatt

SEQ ID NO: 373948 - DNA, 15 bp, Homo sapiens
tcttaataggtattt

SEQ ID NO: 373949 - DNA, 15 bp, Homo sapiens
cttaataggtatttg

SEQ ID NO: 373950 - DNA, 15 bp, Homo sapiens
ttaataggtatttga

SEQ ID NO: 373951 - DNA, 15 bp, Homo sapiens
taataggtatttgat

SEQ ID NO: 373952 - DNA, 15 bp, Homo sapiens
aataggtatttgatg

SEQ ID NO: 373953 - DNA, 15 bp, Homo sapiens
ataggtatttgatga

SEQ ID NO: 373954 - DNA, 15 bp, Homo sapiens
taggtatttgatgaa

SEQ ID NO: 373955 - DNA, 15 bp, Homo sapiens
aggtatttgatgaat

SEQ ID NO: 373956 - DNA, 15 bp, Homo sapiens
ggtatttgatgaatt

SEQ ID NO: 373957 - DNA, 15 bp, Homo sapiens
gtatttgatgaatta

SEQ ID NO: 373958 - DNA, 15 bp, Homo sapiens
tatttgatgaattaa

SEQ ID NO: 373959 - DNA, 15 bp, Homo sapiens
atttgatgaattaaa

SEQ ID NO: 373960 - DNA, 15 bp, Homo sapiens
tttgatgaattaaaa

SEQ ID NO: 373961 - DNA, 15 bp, Homo sapiens
ttgatgaattaaaac

SEQ ID NO: 373962 - DNA, 15 bp, Homo sapiens
tgatgaattaaaaca

SEQ ID NO: 373963 - DNA, 15 bp, Homo sapiens
gatgaattaaaacaa

SEQ ID NO: 373964 - DNA, 15 bp, Homo sapiens
atgaattaaaacaat

SEQ ID NO: 373965 - DNA, 15 bp, Homo sapiens
tgaattaaaacaatg

SEQ ID NO: 373966 - DNA, 15 bp, Homo sapiens
gaattaaaacaatga

SEQ ID NO: 373967 - DNA, 15 bp, Homo sapiens
aattaaaacaatgaa

SEQ ID NO: 373968 - DNA, 15 bp, Homo sapiens
attaaaacaatgaat

SEQ ID NO: 373969 - DNA, 15 bp, Homo sapiens
ttaaaacaatgaatt

SEQ ID NO: 373970 - DNA, 15 bp, Homo sapiens
taaaacaatgaattt

SEQ ID NO: 373971 - DNA, 15 bp, Homo sapiens
aaaacaatgaatttt

SEQ ID NO: 373972 - DNA, 15 bp, Homo sapiens
aaacaatgaattttt

SEQ ID NO: 373973 - DNA, 15 bp, Homo sapiens
aacaatgaatttttt

SEQ ID NO: 373974 - DNA, 15 bp, Homo sapiens
acaatgaattttttt

SEQ ID NO: 373975 - DNA, 15 bp, Homo sapiens
caatgaatttttttt

SEQ ID NO: 373976 - DNA, 15 bp, Homo sapiens
aatgaatttttttta

SEQ ID NO: 373977 - DNA, 15 bp, Homo sapiens
atgaattttttttat

SEQ ID NO: 373978 - DNA, 15 bp, Homo sapiens
tgaattttttttatc

SEQ ID NO: 373979 - DNA, 15 bp, Homo sapiens
gaattttttttatct

SEQ ID NO: 373980 - DNA, 15 bp, Homo sapiens
aattttttttatcta

SEQ ID NO: 373981 - DNA, 15 bp, Homo sapiens
attttttttatctac

SEQ ID NO: 373982 - DNA, 15 bp, Homo sapiens
ttttttttatctaca

SEQ ID NO: 373983 - DNA, 15 bp, Homo sapiens
tttttttatctacaa

SEQ ID NO: 373984 - DNA, 15 bp, Homo sapiens
ttttttatctacaaa

SEQ ID NO: 373985 - DNA, 15 bp, Homo sapiens
tttttatctacaaaa

SEQ ID NO: 373986 - DNA, 15 bp, Homo sapiens
ttttatctacaaaaa

SEQ ID NO: 373987 - DNA, 15 bp, Homo sapiens
tttatctacaaaaaa

SEQ ID NO: 373988 - DNA, 15 bp, Homo sapiens
tatctacaaaaaaag

SEQ ID NO: 373989 - DNA, 15 bp, Homo sapiens
atctacaaaaaaagt

SEQ ID NO: 373990 - DNA, 15 bp, Homo sapiens
tctacaaaaaaagtt

SEQ ID NO: 373991 - DNA, 15 bp, Homo sapiens
ctacaaaaaaagtta

SEQ ID NO: 373992 - DNA, 15 bp, Homo sapiens
tacaaaaaaagttaa

SEQ ID NO: 373993 - DNA, 15 bp, Homo sapiens
acaaaaaaagttaaa

SEQ ID NO: 373994 - DNA, 15 bp, Homo sapiens
caaaaaaagttaaag

SEQ ID NO: 373995 - DNA, 15 bp, Homo sapiens
aaaaaaagttaaagt

SEQ ID NO: 373996 - DNA, 15 bp, Homo sapiens
aaaaaagttaaagtg

SEQ ID NO: 373997 - DNA, 15 bp, Homo sapiens
aaaaagttaaagtga

SEQ ID NO: 373998 - DNA, 15 bp, Homo sapiens
aaaagttaaagtgaa

SEQ ID NO: 373999 - DNA, 15 bp, Homo sapiens
aaagttaaagtgaag

SEQ ID NO: 374000 - DNA, 15 bp, Homo sapiens
aagttaaagtgaaga

SEQ ID NO: 374001 - DNA, 15 bp, Homo sapiens
agttaaagtgaagat

SEQ ID NO: 374002 - DNA, 15 bp, Homo sapiens
gttaaagtgaagatg

SEQ ID NO: 374003 - DNA, 15 bp, Homo sapiens
ttaaagtgaagatgg

SEQ ID NO: 374004 - DNA, 15 bp, Homo sapiens
taaagtgaagatggg

SEQ ID NO: 374005 - DNA, 15 bp, Homo sapiens
aaagtgaagatgggg

SEQ ID NO: 374006 - DNA, 15 bp, Homo sapiens
aagtgaagatggggc

SEQ ID NO: 374007 - DNA, 15 bp, Homo sapiens
agtgaagatggggca

SEQ ID NO: 374008 - DNA, 15 bp, Homo sapiens
gtgaagatggggcag

SEQ ID NO: 374009 - DNA, 15 bp, Homo sapiens
tgaagatggggcaga

SEQ ID NO: 374010 - DNA, 15 bp, Homo sapiens
gaagatggggcagaa

SEQ ID NO: 374011 - DNA, 15 bp, Homo sapiens
aagatggggcagaag

SEQ ID NO: 374012 - DNA, 15 bp, Homo sapiens
agatggggcagaagg

SEQ ID NO: 374013 - DNA, 15 bp, Homo sapiens
gatggggcagaagga

SEQ ID NO: 374014 - DNA, 15 bp, Homo sapiens
atggggcagaaggat

SEQ ID NO: 374015 - DNA, 15 bp, Homo sapiens
tggggcagaaggatg

SEQ ID NO: 374016 - DNA, 15 bp, Homo sapiens
ggggcagaaggatgt

SEQ ID NO: 374017 - DNA, 15 bp, Homo sapiens
gggcagaaggatgtg

SEQ ID NO: 374018 - DNA, 15 bp, Homo sapiens
ggcagaaggatgtgt

SEQ ID NO: 374019 - DNA, 15 bp, Homo sapiens
gcagaaggatgtgtg

SEQ ID NO: 374020 - DNA, 15 bp, Homo sapiens
cagaaggatgtgtga

SEQ ID NO: 374021 - DNA, 15 bp, Homo sapiens
agaaggatgtgtgag

SEQ ID NO: 374022 - DNA, 15 bp, Homo sapiens
gaaggatgtgtgaga

SEQ ID NO: 374023 - DNA, 15 bp, Homo sapiens
aaggatgtgtgagat

SEQ ID NO: 374024 - DNA, 15 bp, Homo sapiens
aggatgtgtgagata

SEQ ID NO: 374025 - DNA, 15 bp, Homo sapiens
ggatgtgtgagatat

SEQ ID NO: 374026 - DNA, 15 bp, Homo sapiens
gatgtgtgagatatt

SEQ ID NO: 374027 - DNA, 15 bp, Homo sapiens
atgtgtgagatattc

SEQ ID NO: 374028 - DNA, 15 bp, Homo sapiens
tgtgtgagatattct

SEQ ID NO: 374029 - DNA, 15 bp, Homo sapiens
gtgtgagatattctg

SEQ ID NO: 374030 - DNA, 15 bp, Homo sapiens
tgtgagatattctgt

SEQ ID NO: 374031 - DNA, 15 bp, Homo sapiens
gtgagatattctgta

SEQ ID NO: 374032 - DNA, 15 bp, Homo sapiens
tgagatattctgtag

SEQ ID NO: 374033 - DNA, 15 bp, Homo sapiens
gagatattctgtagg

SEQ ID NO: 374034 - DNA, 15 bp, Homo sapiens
agatattctgtaggg

SEQ ID NO: 374035 - DNA, 15 bp, Homo sapiens
gatattctgtagggt

SEQ ID NO: 374036 - DNA, 15 bp, Homo sapiens
atattctgtagggtg

SEQ ID NO: 374037 - DNA, 15 bp, Homo sapiens
tattctgtagggtgt

SEQ ID NO: 374038 - DNA, 15 bp, Homo sapiens
attctgtagggtgta

SEQ ID NO: 374039 - DNA, 15 bp, Homo sapiens
ttctgtagggtgtat

SEQ ID NO: 374040 - DNA, 15 bp, Homo sapiens
tctgtagggtgtata

SEQ ID NO: 374041 - DNA, 15 bp, Homo sapiens
ctgtagggtgtatat

SEQ ID NO: 374042 - DNA, 15 bp, Homo sapiens
tgtagggtgtatatc

SEQ ID NO: 374043 - DNA, 15 bp, Homo sapiens
gtagggtgtatatct

SEQ ID NO: 374044 - DNA, 15 bp, Homo sapiens
tagggtgtatatcta

SEQ ID NO: 374045 - DNA, 15 bp, Homo sapiens
agggtgtatatctag

SEQ ID NO: 374046 - DNA, 15 bp, Homo sapiens
gggtgtatatctagt

SEQ ID NO: 374047 - DNA, 15 bp, Homo sapiens
ggtgtatatctagtg

SEQ ID NO: 374048 - DNA, 15 bp, Homo sapiens
gtgtatatctagtga

SEQ ID NO: 374049 - DNA, 15 bp, Homo sapiens
tgtatatctagtgat

SEQ ID NO: 374050 - DNA, 15 bp, Homo sapiens
gtatatctagtgatg

SEQ ID NO: 374051 - DNA, 15 bp, Homo sapiens
tatatctagtgatgg

SEQ ID NO: 374052 - DNA, 15 bp, Homo sapiens
atatctagtgatgga

SEQ ID NO: 374053 - DNA, 15 bp, Homo sapiens
tatctagtgatggaa

SEQ ID NO: 374054 - DNA, 15 bp, Homo sapiens
atctagtgatggaat

SEQ ID NO: 374055 - DNA, 15 bp, Homo sapiens
tctagtgatggaatc

SEQ ID NO: 374056 - DNA, 15 bp, Homo sapiens
ctagtgatggaatca

SEQ ID NO: 374057 - DNA, 15 bp, Homo sapiens
tagtgatggaatcac

SEQ ID NO: 374058 - DNA, 15 bp, Homo sapiens
agtgatggaatcact

SEQ ID NO: 374059 - DNA, 15 bp, Homo sapiens
gtgatggaatcactg

SEQ ID NO: 374060 - DNA, 15 bp, Homo sapiens
tgatggaatcactgg

SEQ ID NO: 374061 - DNA, 15 bp, Homo sapiens
gatggaatcactggg

SEQ ID NO: 374062 - DNA, 15 bp, Homo sapiens
atggaatcactgggt

SEQ ID NO: 374063 - DNA, 15 bp, Homo sapiens
tggaatcactgggtt

SEQ ID NO: 374064 - DNA, 15 bp, Homo sapiens
ggaatcactgggttt

SEQ ID NO: 374065 - DNA, 15 bp, Homo sapiens
gaatcactgggttta

SEQ ID NO: 374066 - DNA, 15 bp, Homo sapiens
aatcactgggtttag

SEQ ID NO: 374067 - DNA, 15 bp, Homo sapiens
atcactgggtttagc

SEQ ID NO: 374068 - DNA, 15 bp, Homo sapiens
tcactgggtttagca

SEQ ID NO: 374069 - DNA, 15 bp, Homo sapiens
cactgggtttagcat

SEQ ID NO: 374070 - DNA, 15 bp, Homo sapiens
actgggtttagcata

SEQ ID NO: 374071 - DNA, 15 bp, Homo sapiens
ctgggtttagcatat

SEQ ID NO: 374072 - DNA, 15 bp, Homo sapiens
tgggtttagcatatg

SEQ ID NO: 374073 - DNA, 15 bp, Homo sapiens
gggtttagcatatgg

SEQ ID NO: 374074 - DNA, 15 bp, Homo sapiens
ggtttagcatatggg

SEQ ID NO: 374075 - DNA, 15 bp, Homo sapiens
gtttagcatatgggt

SEQ ID NO: 374076 - DNA, 15 bp, Homo sapiens
tttagcatatgggtg

SEQ ID NO: 374077 - DNA, 15 bp, Homo sapiens
ttagcatatgggtgc

SEQ ID NO: 374078 - DNA, 15 bp, Homo sapiens
tagcatatgggtgcc

SEQ ID NO: 374079 - DNA, 15 bp, Homo sapiens
agcatatgggtgcct

SEQ ID NO: 374080 - DNA, 15 bp, Homo sapiens
gcatatgggtgcctt

SEQ ID NO: 374081 - DNA, 15 bp, Homo sapiens
catatgggtgccttc

SEQ ID NO: 374082 - DNA, 15 bp, Homo sapiens
atatgggtgccttct

SEQ ID NO: 374083 - DNA, 15 bp, Homo sapiens
tatgggtgccttcta

SEQ ID NO: 374084 - DNA, 15 bp, Homo sapiens
atgggtgccttctac

SEQ ID NO: 374085 - DNA, 15 bp, Homo sapiens
tgggtgccttctact

SEQ ID NO: 374086 - DNA, 15 bp, Homo sapiens
gggtgccttctactt

SEQ ID NO: 374087 - DNA, 15 bp, Homo sapiens
ggtgccttctacttc

SEQ ID NO: 374088 - DNA, 15 bp, Homo sapiens
gtgccttctacttca

SEQ ID NO: 374089 - DNA, 15 bp, Homo sapiens
tgccttctacttcac

SEQ ID NO: 374090 - DNA, 15 bp, Homo sapiens
gccttctacttcact

SEQ ID NO: 374091 - DNA, 15 bp, Homo sapiens
ccttctacttcacta

SEQ ID NO: 374092 - DNA, 15 bp, Homo sapiens
cttctacttcactag

SEQ ID NO: 374093 - DNA, 15 bp, Homo sapiens
ttctacttcactagc

SEQ ID NO: 374094 - DNA, 15 bp, Homo sapiens
tctacttcactagct

SEQ ID NO: 374095 - DNA, 15 bp, Homo sapiens
ctacttcactagctg

SEQ ID NO: 374096 - DNA, 15 bp, Homo sapiens
tacttcactagctgc

SEQ ID NO: 374097 - DNA, 15 bp, Homo sapiens
acttcactagctgcc

SEQ ID NO: 374098 - DNA, 15 bp, Homo sapiens
cttcactagctgcca

SEQ ID NO: 374099 - DNA, 15 bp, Homo sapiens
ttcactagctgccat

SEQ ID NO: 374100 - DNA, 15 bp, Homo sapiens
tcactagctgccatt

SEQ ID NO: 374101 - DNA, 15 bp, Homo sapiens
cactagctgccatta

SEQ ID NO: 374102 - DNA, 15 bp, Homo sapiens
actagctgccattag

SEQ ID NO: 374103 - DNA, 15 bp, Homo sapiens
ctagctgccattagg

SEQ ID NO: 374104 - DNA, 15 bp, Homo sapiens
tagctgccattaggg

SEQ ID NO: 374105 - DNA, 15 bp, Homo sapiens
agctgccattagggt

SEQ ID NO: 374106 - DNA, 15 bp, Homo sapiens
gctgccattagggtg

SEQ ID NO: 374107 - DNA, 15 bp, Homo sapiens
ctgccattagggtgc

SEQ ID NO: 374108 - DNA, 15 bp, Homo sapiens
tgccattagggtgct

SEQ ID NO: 374109 - DNA, 15 bp, Homo sapiens
gccattagggtgctg

SEQ ID NO: 374110 - DNA, 15 bp, Homo sapiens
ccattagggtgctgt

SEQ ID NO: 374111 - DNA, 15 bp, Homo sapiens
cattagggtgctgtc

SEQ ID NO: 374112 - DNA, 15 bp, Homo sapiens
attagggtgctgtct

SEQ ID NO: 374113 - DNA, 15 bp, Homo sapiens
ttagggtgctgtctg

SEQ ID NO: 374114 - DNA, 15 bp, Homo sapiens
tagggtgctgtctgg

SEQ ID NO: 374115 - DNA, 15 bp, Homo sapiens
agggtgctgtctgga

SEQ ID NO: 374116 - DNA, 15 bp, Homo sapiens
gggtgctgtctggat

SEQ ID NO: 374117 - DNA, 15 bp, Homo sapiens
ggtgctgtctggatt

SEQ ID NO: 374118 - DNA, 15 bp, Homo sapiens
gtgctgtctggatta

SEQ ID NO: 374119 - DNA, 15 bp, Homo sapiens
tgctgtctggattac

SEQ ID NO: 374120 - DNA, 15 bp, Homo sapiens
gctgtctggattact

SEQ ID NO: 374121 - DNA, 15 bp, Homo sapiens
ctgtctggattactt

SEQ ID NO: 374122 - DNA, 15 bp, Homo sapiens
tgtctggattacttg

SEQ ID NO: 374123 - DNA, 15 bp, Homo sapiens
gtctggattacttgg

SEQ ID NO: 374124 - DNA, 15 bp, Homo sapiens
tctggattacttggc

SEQ ID NO: 374125 - DNA, 15 bp, Homo sapiens
ctggattacttggcc

SEQ ID NO: 374126 - DNA, 15 bp, Homo sapiens
tggattacttggccc

SEQ ID NO: 374127 - DNA, 15 bp, Homo sapiens
ggattacttggccca

SEQ ID NO: 374128 - DNA, 15 bp, Homo sapiens
gattacttggcccag

SEQ ID NO: 374129 - DNA, 15 bp, Homo sapiens
attacttggcccagt

SEQ ID NO: 374130 - DNA, 15 bp, Homo sapiens
ttacttggcccagtt

SEQ ID NO: 374131 - DNA, 15 bp, Homo sapiens
tacttggcccagttt

SEQ ID NO: 374132 - DNA, 15 bp, Homo sapiens
acttggcccagttta

SEQ ID NO: 374133 - DNA, 15 bp, Homo sapiens
cttggcccagtttac

SEQ ID NO: 374134 - DNA, 15 bp, Homo sapiens
ttggcccagtttaca

SEQ ID NO: 374135 - DNA, 15 bp, Homo sapiens
tggcccagtttacac

SEQ ID NO: 374136 - DNA, 15 bp, Homo sapiens
ggcccagtttacact

SEQ ID NO: 374137 - DNA, 15 bp, Homo sapiens
gcccagtttacactg

SEQ ID NO: 374138 - DNA, 15 bp, Homo sapiens
cccagtttacactga

SEQ ID NO: 374139 - DNA, 15 bp, Homo sapiens
ccagtttacactgac

SEQ ID NO: 374140 - DNA, 15 bp, Homo sapiens
cagtttacactgaca

SEQ ID NO: 374141 - DNA, 15 bp, Homo sapiens
agtttacactgacac

SEQ ID NO: 374142 - DNA, 15 bp, Homo sapiens
gtttacactgacact

SEQ ID NO: 374143 - DNA, 15 bp, Homo sapiens
tttacactgacactg

SEQ ID NO: 374144 - DNA, 15 bp, Homo sapiens
ttacactgacactgg

SEQ ID NO: 374145 - DNA, 15 bp, Homo sapiens
tacactgacactggc

SEQ ID NO: 374146 - DNA, 15 bp, Homo sapiens
acactgacactggct

SEQ ID NO: 374147 - DNA, 15 bp, Homo sapiens
cactgacactggctg

SEQ ID NO: 374148 - DNA, 15 bp, Homo sapiens
actgacactggctgt

SEQ ID NO: 374149 - DNA, 15 bp, Homo sapiens
ctgacactggctgtg

SEQ ID NO: 374150 - DNA, 15 bp, Homo sapiens
tgacactggctgtgt

SEQ ID NO: 374151 - DNA, 15 bp, Homo sapiens
gacactggctgtgtg

SEQ ID NO: 374152 - DNA, 15 bp, Homo sapiens
acactggctgtgtgt

SEQ ID NO: 374153 - DNA, 15 bp, Homo sapiens
cactggctgtgtgta

SEQ ID NO: 374154 - DNA, 15 bp, Homo sapiens
actggctgtgtgtaa

SEQ ID NO: 374155 - DNA, 15 bp, Homo sapiens
ctggctgtgtgtaat

SEQ ID NO: 374156 - DNA, 15 bp, Homo sapiens
tggctgtgtgtaatg

SEQ ID NO: 374157 - DNA, 15 bp, Homo sapiens
ggctgtgtgtaatgg

SEQ ID NO: 374158 - DNA, 15 bp, Homo sapiens
gctgtgtgtaatggg

SEQ ID NO: 374159 - DNA, 15 bp, Homo sapiens
ctgtgtgtaatgggt

SEQ ID NO: 374160 - DNA, 15 bp, Homo sapiens
tgtgtgtaatgggtt

SEQ ID NO: 374161 - DNA, 15 bp, Homo sapiens
gtgtgtaatgggttc

SEQ ID NO: 374162 - DNA, 15 bp, Homo sapiens
tgtgtaatgggttct

SEQ ID NO: 374163 - DNA, 15 bp, Homo sapiens
gtgtaatgggttctt

SEQ ID NO: 374164 - DNA, 15 bp, Homo sapiens
tgtaatgggttctta

SEQ ID NO: 374165 - DNA, 15 bp, Homo sapiens
gtaatgggttcttat

SEQ ID NO: 374166 - DNA, 15 bp, Homo sapiens
taatgggttcttatt

SEQ ID NO: 374167 - DNA, 15 bp, Homo sapiens
aatgggttcttattg

SEQ ID NO: 374168 - DNA, 15 bp, Homo sapiens
atgggttcttattgt

SEQ ID NO: 374169 - DNA, 15 bp, Homo sapiens
tgggttcttattgtt

SEQ ID NO: 374170 - DNA, 15 bp, Homo sapiens
gggttcttattgttc

SEQ ID NO: 374171 - DNA, 15 bp, Homo sapiens
ggttcttattgttct

SEQ ID NO: 374172 - DNA, 15 bp, Homo sapiens
gttcttattgttcta

SEQ ID NO: 374173 - DNA, 15 bp, Homo sapiens
ttcttattgttctac

SEQ ID NO: 374174 - DNA, 15 bp, Homo sapiens
tcttattgttctaca

SEQ ID NO: 374175 - DNA, 15 bp, Homo sapiens
cttattgttctacag

SEQ ID NO: 374176 - DNA, 15 bp, Homo sapiens
ttattgttctacagc

SEQ ID NO: 374177 - DNA, 15 bp, Homo sapiens
tattgttctacagca

SEQ ID NO: 374178 - DNA, 15 bp, Homo sapiens
attgttctacagcat

SEQ ID NO: 374179 - DNA, 15 bp, Homo sapiens
ttgttctacagcatt

SEQ ID NO: 374180 - DNA, 15 bp, Homo sapiens
tgttctacagcatta

SEQ ID NO: 374181 - DNA, 15 bp, Homo sapiens
gttctacagcattac

SEQ ID NO: 374182 - DNA, 15 bp, Homo sapiens
ttctacagcattacc

SEQ ID NO: 374183 - DNA, 15 bp, Homo sapiens
tctacagcattacca

SEQ ID NO: 374184 - DNA, 15 bp, Homo sapiens
ctacagcattaccag

SEQ ID NO: 374185 - DNA, 15 bp, Homo sapiens
tacagcattaccagc

SEQ ID NO: 374186 - DNA, 15 bp, Homo sapiens
acagcattaccagca

SEQ ID NO: 374187 - DNA, 15 bp, Homo sapiens
cagcattaccagcac

SEQ ID NO: 374188 - DNA, 15 bp, Homo sapiens
agcattaccagcacc

SEQ ID NO: 374189 - DNA, 15 bp, Homo sapiens
gcattaccagcacct

SEQ ID NO: 374190 - DNA, 15 bp, Homo sapiens
cattaccagcacctc

SEQ ID NO: 374191 - DNA, 15 bp, Homo sapiens
attaccagcacctca

SEQ ID NO: 374192 - DNA, 15 bp, Homo sapiens
ttaccagcacctcaa

SEQ ID NO: 374193 - DNA, 15 bp, Homo sapiens
taccagcacctcaac

SEQ ID NO: 374194 - DNA, 15 bp, Homo sapiens
accagcacctcaaca

SEQ ID NO: 374195 - DNA, 15 bp, Homo sapiens
ccagcacctcaacac

SEQ ID NO: 374196 - DNA, 15 bp, Homo sapiens
cagcacctcaacact

SEQ ID NO: 374197 - DNA, 15 bp, Homo sapiens
agcacctcaacactt

SEQ ID NO: 374198 - DNA, 15 bp, Homo sapiens
gcacctcaacacttt

SEQ ID NO: 374199 - DNA, 15 bp, Homo sapiens
cacctcaacactttg

SEQ ID NO: 374200 - DNA, 15 bp, Homo sapiens
acctcaacactttgc

SEQ ID NO: 374201 - DNA, 15 bp, Homo sapiens
cctcaacactttgct

SEQ ID NO: 374202 - DNA, 15 bp, Homo sapiens
ctcaacactttgctc

SEQ ID NO: 374203 - DNA, 15 bp, Homo sapiens
tcaacactttgctct

SEQ ID NO: 374204 - DNA, 15 bp, Homo sapiens
caacactttgctctc

SEQ ID NO: 374205 - DNA, 15 bp, Homo sapiens
aacactttgctctca

SEQ ID NO: 374206 - DNA, 15 bp, Homo sapiens
acactttgctctcag

SEQ ID NO: 374207 - DNA, 15 bp, Homo sapiens
cactttgctctcagg

SEQ ID NO: 374208 - DNA, 15 bp, Homo sapiens
actttgctctcagga

SEQ ID NO: 374209 - DNA, 15 bp, Homo sapiens
ctttgctctcaggac

SEQ ID NO: 374210 - DNA, 15 bp, Homo sapiens
tttgctctcaggacc

SEQ ID NO: 374211 - DNA, 15 bp, Homo sapiens
ttgctctcaggaccc

SEQ ID NO: 374212 - DNA, 15 bp, Homo sapiens
tgctctcaggacccc

SEQ ID NO: 374213 - DNA, 15 bp, Homo sapiens
gctctcaggacccct

SEQ ID NO: 374214 - DNA, 15 bp, Homo sapiens
ctctcaggacccctt

SEQ ID NO: 374215 - DNA, 15 bp, Homo sapiens
tctcaggaccccttt

SEQ ID NO: 374216 - DNA, 15 bp, Homo sapiens
ctcaggaccccttta

SEQ ID NO: 374217 - DNA, 15 bp, Homo sapiens
tcaggacccctttac

SEQ ID NO: 374218 - DNA, 15 bp, Homo sapiens
caggacccctttaca

SEQ ID NO: 374219 - DNA, 15 bp, Homo sapiens
aggacccctttacac

SEQ ID NO: 374220 - DNA, 15 bp, Homo sapiens
ggacccctttacact

SEQ ID NO: 374221 - DNA, 15 bp, Homo sapiens
gacccctttacactt

SEQ ID NO: 374222 - DNA, 15 bp, Homo sapiens
acccctttacacttg

SEQ ID NO: 374223 - DNA, 15 bp, Homo sapiens
cccctttacacttgt

SEQ ID NO: 374224 - DNA, 15 bp, Homo sapiens
ccctttacacttgta

SEQ ID NO: 374225 - DNA, 15 bp, Homo sapiens
cctttacacttgtaa

SEQ ID NO: 374226 - DNA, 15 bp, Homo sapiens
ctttacacttgtaaa

SEQ ID NO: 374227 - DNA, 15 bp, Homo sapiens
tttacacttgtaaaa

SEQ ID NO: 374228 - DNA, 15 bp, Homo sapiens
ttacacttgtaaaaa

SEQ ID NO: 374229 - DNA, 15 bp, Homo sapiens
tacacttgtaaaaat

SEQ ID NO: 374230 - DNA, 15 bp, Homo sapiens
acacttgtaaaaatt

SEQ ID NO: 374231 - DNA, 15 bp, Homo sapiens
cacttgtaaaaatta

SEQ ID NO: 374232 - DNA, 15 bp, Homo sapiens
acttgtaaaaattat

SEQ ID NO: 374233 - DNA, 15 bp, Homo sapiens
cttgtaaaaattatt

SEQ ID NO: 374234 - DNA, 15 bp, Homo sapiens
ttgtaaaaattattg

SEQ ID NO: 374235 - DNA, 15 bp, Homo sapiens
tgtaaaaattattga

SEQ ID NO: 374236 - DNA, 15 bp, Homo sapiens
gtaaaaattattgag

SEQ ID NO: 374237 - DNA, 15 bp, Homo sapiens
taaaaattattgagg

SEQ ID NO: 374238 - DNA, 15 bp, Homo sapiens
aaaaattattgagga

SEQ ID NO: 374239 - DNA, 15 bp, Homo sapiens
aaaattattgaggac

SEQ ID NO: 374240 - DNA, 15 bp, Homo sapiens
aaattattgaggacc

SEQ ID NO: 374241 - DNA, 15 bp, Homo sapiens
aattattgaggaccc

SEQ ID NO: 374242 - DNA, 15 bp, Homo sapiens
attattgaggaccct

SEQ ID NO: 374243 - DNA, 15 bp, Homo sapiens
ttattgaggaccctc

SEQ ID NO: 374244 - DNA, 15 bp, Homo sapiens
tattgaggaccctca

SEQ ID NO: 374245 - DNA, 15 bp, Homo sapiens
attgaggaccctcaa

SEQ ID NO: 374246 - DNA, 15 bp, Homo sapiens
ttgaggaccctcaaa

SEQ ID NO: 374247 - DNA, 15 bp, Homo sapiens
tgaggaccctcaaat

SEQ ID NO: 374248 - DNA, 15 bp, Homo sapiens
gaggaccctcaaata

SEQ ID NO: 374249 - DNA, 15 bp, Homo sapiens
aggaccctcaaatag

SEQ ID NO: 374250 - DNA, 15 bp, Homo sapiens
ggaccctcaaatagc

SEQ ID NO: 374251 - DNA, 15 bp, Homo sapiens
gaccctcaaatagct

SEQ ID NO: 374252 - DNA, 15 bp, Homo sapiens
accctcaaatagctt

SEQ ID NO: 374253 - DNA, 15 bp, Homo sapiens
ccctcaaatagcttt

SEQ ID NO: 374254 - DNA, 15 bp, Homo sapiens
cctcaaatagctttt

SEQ ID NO: 374255 - DNA, 15 bp, Homo sapiens
ctcaaatagcttttg

SEQ ID NO: 374256 - DNA, 15 bp, Homo sapiens
tcaaatagcttttgc

SEQ ID NO: 374257 - DNA, 15 bp, Homo sapiens
caaatagcttttgct

SEQ ID NO: 374258 - DNA, 15 bp, Homo sapiens
aaatagcttttgctt

SEQ ID NO: 374259 - DNA, 15 bp, Homo sapiens
aatagcttttgcttt

SEQ ID NO: 374260 - DNA, 15 bp, Homo sapiens
atagcttttgctttt

SEQ ID NO: 374261 - DNA, 15 bp, Homo sapiens
tagcttttgcttttg

SEQ ID NO: 374262 - DNA, 15 bp, Homo sapiens
agcttttgcttttgt

SEQ ID NO: 374263 - DNA, 15 bp, Homo sapiens
gcttttgcttttgtg

SEQ ID NO: 374264 - DNA, 15 bp, Homo sapiens
ttttgcttttgtgag

SEQ ID NO: 374265 - DNA, 15 bp, Homo sapiens
tttgcttttgtgagt

SEQ ID NO: 374266 - DNA, 15 bp, Homo sapiens
ttgcttttgtgagtg

SEQ ID NO: 374267 - DNA, 15 bp, Homo sapiens
tgcttttgtgagtga

SEQ ID NO: 374268 - DNA, 15 bp, Homo sapiens
gcttttgtgagtgat

SEQ ID NO: 374269 - DNA, 15 bp, Homo sapiens
cttttgtgagtgata

SEQ ID NO: 374270 - DNA, 15 bp, Homo sapiens
ttttgtgagtgatag

SEQ ID NO: 374271 - DNA, 15 bp, Homo sapiens
tttgtgagtgatagt

SEQ ID NO: 374272 - DNA, 15 bp, Homo sapiens
ttgtgagtgatagtt

SEQ ID NO: 374273 - DNA, 15 bp, Homo sapiens
tgtgagtgatagtta

SEQ ID NO: 374274 - DNA, 15 bp, Homo sapiens
gtgagtgatagttat

SEQ ID NO: 374275 - DNA, 15 bp, Homo sapiens
tgagtgatagttatc

SEQ ID NO: 374276 - DNA, 15 bp, Homo sapiens
gagtgatagttatcc

SEQ ID NO: 374277 - DNA, 15 bp, Homo sapiens
agtgatagttatccg

SEQ ID NO: 374278 - DNA, 15 bp, Homo sapiens
gtgatagttatccgt

SEQ ID NO: 374279 - DNA, 15 bp, Homo sapiens
tgatagttatccgta

SEQ ID NO: 374280 - DNA, 15 bp, Homo sapiens
gatagttatccgtat

SEQ ID NO: 374281 - DNA, 15 bp, Homo sapiens
atagttatccgtatt

SEQ ID NO: 374282 - DNA, 15 bp, Homo sapiens
tagttatccgtattt

SEQ ID NO: 374283 - DNA, 15 bp, Homo sapiens
agttatccgtattta

SEQ ID NO: 374284 - DNA, 15 bp, Homo sapiens
gttatccgtatttac

SEQ ID NO: 374285 - DNA, 15 bp, Homo sapiens
ttatccgtatttacc

SEQ ID NO: 374286 - DNA, 15 bp, Homo sapiens
tatccgtatttacct

SEQ ID NO: 374287 - DNA, 15 bp, Homo sapiens
atccgtatttaccta

SEQ ID NO: 374288 - DNA, 15 bp, Homo sapiens
tccgtatttacctaa

SEQ ID NO: 374289 - DNA, 15 bp, Homo sapiens
ccgtatttacctaac

SEQ ID NO: 374290 - DNA, 15 bp, Homo sapiens
cgtatttacctaact

SEQ ID NO: 374291 - DNA, 15 bp, Homo sapiens
gtatttacctaacta

SEQ ID NO: 374292 - DNA, 15 bp, Homo sapiens
tatttacctaactag

SEQ ID NO: 374293 - DNA, 15 bp, Homo sapiens
atttacctaactaga

SEQ ID NO: 374294 - DNA, 15 bp, Homo sapiens
tttacctaactagaa

SEQ ID NO: 374295 - DNA, 15 bp, Homo sapiens
ttacctaactagaaa

SEQ ID NO: 374296 - DNA, 15 bp, Homo sapiens
tacctaactagaaaa

SEQ ID NO: 374297 - DNA, 15 bp, Homo sapiens
acctaactagaaaaa

SEQ ID NO: 374298 - DNA, 15 bp, Homo sapiens
cctaactagaaaaat

SEQ ID NO: 374299 - DNA, 15 bp, Homo sapiens
ctaactagaaaaatt

SEQ ID NO: 374300 - DNA, 15 bp, Homo sapiens
taactagaaaaattt

SEQ ID NO: 374301 - DNA, 15 bp, Homo sapiens
tagaaaaattttcca

SEQ ID NO: 374302 - DNA, 15 bp, Homo sapiens
agaaaaattttccat

SEQ ID NO: 374303 - DNA, 15 bp, Homo sapiens
gaaaaattttccatt

SEQ ID NO: 374304 - DNA, 15 bp, Homo sapiens
aaaaattttccatta

SEQ ID NO: 374305 - DNA, 15 bp, Homo sapiens
aaaattttccattaa

SEQ ID NO: 374306 - DNA, 15 bp, Homo sapiens
aaattttccattaat

SEQ ID NO: 374307 - DNA, 15 bp, Homo sapiens
aattttccattaatt

SEQ ID NO: 374308 - DNA, 15 bp, Homo sapiens
attttccattaattc

SEQ ID NO: 374309 - DNA, 15 bp, Homo sapiens
ttttccattaattca

SEQ ID NO: 374310 - DNA, 15 bp, Homo sapiens
tttccattaattcat

SEQ ID NO: 374311 - DNA, 15 bp, Homo sapiens
ttccattaattcatt

SEQ ID NO: 374312 - DNA, 15 bp, Homo sapiens
tccattaattcattt

SEQ ID NO: 374313 - DNA, 15 bp, Homo sapiens
ccattaattcattta

SEQ ID NO: 374314 - DNA, 15 bp, Homo sapiens
cattaattcatttat

SEQ ID NO: 374315 - DNA, 15 bp, Homo sapiens
attaattcatttatt

SEQ ID NO: 374316 - DNA, 15 bp, Homo sapiens
ttaattcatttatta

SEQ ID NO: 374317 - DNA, 15 bp, Homo sapiens
taattcatttattaa

SEQ ID NO: 374318 - DNA, 15 bp, Homo sapiens
aattcatttattaag

SEQ ID NO: 374319 - DNA, 15 bp, Homo sapiens
attcatttattaagt

SEQ ID NO: 374320 - DNA, 15 bp, Homo sapiens
ttcatttattaagtt

SEQ ID NO: 374321 - DNA, 15 bp, Homo sapiens
tcatttattaagttg

SEQ ID NO: 374322 - DNA, 15 bp, Homo sapiens
catttattaagttgt

SEQ ID NO: 374323 - DNA, 15 bp, Homo sapiens
atttattaagttgtt

SEQ ID NO: 374324 - DNA, 15 bp, Homo sapiens
tttattaagttgttt

SEQ ID NO: 374325 - DNA, 15 bp, Homo sapiens
ttattaagttgttta

SEQ ID NO: 374326 - DNA, 15 bp, Homo sapiens
tattaagttgtttaa

SEQ ID NO: 374327 - DNA, 15 bp, Homo sapiens
attaagttgtttaaa

SEQ ID NO: 374328 - DNA, 15 bp, Homo sapiens
ttaagttgtttaaaa

SEQ ID NO: 374329 - DNA, 15 bp, Homo sapiens
taagttgtttaaaaa

SEQ ID NO: 374330 - DNA, 15 bp, Homo sapiens
aagttgtttaaaaat

SEQ ID NO: 374331 - DNA, 15 bp, Homo sapiens
agttgtttaaaaata

SEQ ID NO: 374332 - DNA, 15 bp, Homo sapiens
gttgtttaaaaataa

SEQ ID NO: 374333 - DNA, 15 bp, Homo sapiens
ttgtttaaaaataat

SEQ ID NO: 374334 - DNA, 15 bp, Homo sapiens
tgtttaaaaataata

SEQ ID NO: 374335 - DNA, 15 bp, Homo sapiens
gtttaaaaataataa

SEQ ID NO: 374336 - DNA, 15 bp, Homo sapiens
tttaaaaataataat

SEQ ID NO: 374337 - DNA, 15 bp, Homo sapiens
ttaaaaataataata

SEQ ID NO: 374338 - DNA, 15 bp, Homo sapiens
taaaaataataataa

SEQ ID NO: 374339 - DNA, 15 bp, Homo sapiens
aaaaataataataaa

SEQ ID NO: 374340 - DNA, 15 bp, Homo sapiens
aaaataataataaag

SEQ ID NO: 374341 - DNA, 15 bp, Homo sapiens
aaataataataaagc

SEQ ID NO: 374342 - DNA, 15 bp, Homo sapiens
aataataataaagcc

SEQ ID NO: 374343 - DNA, 15 bp, Homo sapiens
ataataataaagcca

SEQ ID NO: 374344 - DNA, 15 bp, Homo sapiens
tatcatacctgaagt

SEQ ID NO: 374345 - DNA, 15 bp, Homo sapiens
atcatacctgaagta

SEQ ID NO: 374346 - DNA, 15 bp, Homo sapiens
tcatacctgaagtag

SEQ ID NO: 374347 - DNA, 15 bp, Homo sapiens
catacctgaagtagg

SEQ ID NO: 374348 - DNA, 15 bp, Homo sapiens
atacctgaagtaggt

SEQ ID NO: 374349 - DNA, 15 bp, Homo sapiens
tacctgaagtaggtt

SEQ ID NO: 374350 - DNA, 15 bp, Homo sapiens
acctgaagtaggtta

SEQ ID NO: 374351 - DNA, 15 bp, Homo sapiens
cctgaagtaggttac

SEQ ID NO: 374352 - DNA, 15 bp, Homo sapiens
ctgaagtaggttaca

SEQ ID NO: 374353 - DNA, 15 bp, Homo sapiens
tgaagtaggttacag

SEQ ID NO: 374354 - DNA, 15 bp, Homo sapiens
gaagtaggttacaga

SEQ ID NO: 374355 - DNA, 15 bp, Homo sapiens
aagtaggttacagat

SEQ ID NO: 374356 - DNA, 15 bp, Homo sapiens
agtaggttacagata

SEQ ID NO: 374357 - DNA, 15 bp, Homo sapiens
gtaggttacagatag

SEQ ID NO: 374358 - DNA, 15 bp, Homo sapiens
taggttacagatagt

SEQ ID NO: 374359 - DNA, 15 bp, Homo sapiens
aggttacagatagtt

SEQ ID NO: 374360 - DNA, 15 bp, Homo sapiens
ggttacagatagttt

SEQ ID NO: 374361 - DNA, 15 bp, Homo sapiens
gttacagatagtttt

SEQ ID NO: 374362 - DNA, 15 bp, Homo sapiens
ttacagatagtttta

SEQ ID NO: 374363 - DNA, 15 bp, Homo sapiens
tacagatagttttaa

SEQ ID NO: 374364 - DNA, 15 bp, Homo sapiens
acagatagttttaat

SEQ ID NO: 374365 - DNA, 15 bp, Homo sapiens
cagatagttttaatt

SEQ ID NO: 374366 - DNA, 15 bp, Homo sapiens
agatagttttaatta

SEQ ID NO: 374367 - DNA, 15 bp, Homo sapiens
gatagttttaattac

SEQ ID NO: 374368 - DNA, 15 bp, Homo sapiens
atagttttaattact

SEQ ID NO: 374369 - DNA, 15 bp, Homo sapiens
tagttttaattacta

SEQ ID NO: 374370 - DNA, 15 bp, Homo sapiens
agttttaattactaa

SEQ ID NO: 374371 - DNA, 15 bp, Homo sapiens
gttttaattactaat

SEQ ID NO: 374372 - DNA, 15 bp, Homo sapiens
ttttaattactaatt

SEQ ID NO: 374373 - DNA, 15 bp, Homo sapiens
tttaattactaattc

SEQ ID NO: 374374 - DNA, 15 bp, Homo sapiens
ttaattactaattca

SEQ ID NO: 374375 - DNA, 15 bp, Homo sapiens
taattactaattcaa

SEQ ID NO: 374376 - DNA, 15 bp, Homo sapiens
aattactaattcaac

SEQ ID NO: 374377 - DNA, 15 bp, Homo sapiens
attactaattcaact

SEQ ID NO: 374378 - DNA, 15 bp, Homo sapiens
ttactaattcaacta

SEQ ID NO: 374379 - DNA, 15 bp, Homo sapiens
tactaattcaactac

SEQ ID NO: 374380 - DNA, 15 bp, Homo sapiens
actaattcaactact

SEQ ID NO: 374381 - DNA, 15 bp, Homo sapiens
ctaattcaactactt

SEQ ID NO: 374382 - DNA, 15 bp, Homo sapiens
taattcaactactta

SEQ ID NO: 374383 - DNA, 15 bp, Homo sapiens
aattcaactacttat

SEQ ID NO: 374384 - DNA, 15 bp, Homo sapiens
attcaactacttatt

SEQ ID NO: 374385 - DNA, 15 bp, Homo sapiens
ttcaactacttattg

SEQ ID NO: 374386 - DNA, 15 bp, Homo sapiens
tcaactacttattgt

SEQ ID NO: 374387 - DNA, 15 bp, Homo sapiens
caactacttattgta

SEQ ID NO: 374388 - DNA, 15 bp, Homo sapiens
aactacttattgtat

SEQ ID NO: 374389 - DNA, 15 bp, Homo sapiens
actacttattgtatc

SEQ ID NO: 374390 - DNA, 15 bp, Homo sapiens
ctacttattgtatca

SEQ ID NO: 374391 - DNA, 15 bp, Homo sapiens
tacttattgtatcaa

SEQ ID NO: 374392 - DNA, 15 bp, Homo sapiens
acttattgtatcaaa

SEQ ID NO: 374393 - DNA, 15 bp, Homo sapiens
cttattgtatcaaaa

SEQ ID NO: 374394 - DNA, 15 bp, Homo sapiens
ttattgtatcaaaac

SEQ ID NO: 374395 - DNA, 15 bp, Homo sapiens
tattgtatcaaaacc

SEQ ID NO: 374396 - DNA, 15 bp, Homo sapiens
attgtatcaaaacca

SEQ ID NO: 374397 - DNA, 15 bp, Homo sapiens
ttgtatcaaaaccaa

SEQ ID NO: 374398 - DNA, 15 bp, Homo sapiens
tgtatcaaaaccaat

SEQ ID NO: 374399 - DNA, 15 bp, Homo sapiens
gtatcaaaaccaatc

SEQ ID NO: 374400 - DNA, 15 bp, Homo sapiens
tatcaaaaccaatca

SEQ ID NO: 374401 - DNA, 15 bp, Homo sapiens
atcaaaaccaatcaa

SEQ ID NO: 374402 - DNA, 15 bp, Homo sapiens
tcaaaaccaatcaat

SEQ ID NO: 374403 - DNA, 15 bp, Homo sapiens
caaaaccaatcaatt

SEQ ID NO: 374404 - DNA, 15 bp, Homo sapiens
aaaaccaatcaattt

SEQ ID NO: 374405 - DNA, 15 bp, Homo sapiens
aaaccaatcaatttg

SEQ ID NO: 374406 - DNA, 15 bp, Homo sapiens
aaccaatcaatttgg

SEQ ID NO: 374407 - DNA, 15 bp, Homo sapiens
accaatcaatttggc

SEQ ID NO: 374408 - DNA, 15 bp, Homo sapiens
ccaatcaatttggca

SEQ ID NO: 374409 - DNA, 15 bp, Homo sapiens
caatcaatttggcaa

SEQ ID NO: 374410 - DNA, 15 bp, Homo sapiens
aatcaatttggcaat

SEQ ID NO: 374411 - DNA, 15 bp, Homo sapiens
atcaatttggcaatg

SEQ ID NO: 374412 - DNA, 15 bp, Homo sapiens
tcaatttggcaatga

SEQ ID NO: 374413 - DNA, 15 bp, Homo sapiens
caatttggcaatgaa

SEQ ID NO: 374414 - DNA, 15 bp, Homo sapiens
aatttggcaatgaat

SEQ ID NO: 374415 - DNA, 15 bp, Homo sapiens
atttggcaatgaata

SEQ ID NO: 374416 - DNA, 15 bp, Homo sapiens
tttggcaatgaatat

SEQ ID NO: 374417 - DNA, 15 bp, Homo sapiens
ttggcaatgaatatt

SEQ ID NO: 374418 - DNA, 15 bp, Homo sapiens
tggcaatgaatatta

SEQ ID NO: 374419 - DNA, 15 bp, Homo sapiens
ggcaatgaatattaa

SEQ ID NO: 374420 - DNA, 15 bp, Homo sapiens
gcaatgaatattaaa

SEQ ID NO: 374421 - DNA, 15 bp, Homo sapiens
caatgaatattaaat

SEQ ID NO: 374422 - DNA, 15 bp, Homo sapiens
aatgaatattaaata

SEQ ID NO: 374423 - DNA, 15 bp, Homo sapiens
atgaatattaaatac

SEQ ID NO: 374424 - DNA, 15 bp, Homo sapiens
tgaatattaaataca

SEQ ID NO: 374425 - DNA, 15 bp, Homo sapiens
gaatattaaatacat

SEQ ID NO: 374426 - DNA, 15 bp, Homo sapiens
aatattaaatacata

SEQ ID NO: 374427 - DNA, 15 bp, Homo sapiens
atattaaatacatac

SEQ ID NO: 374428 - DNA, 15 bp, Homo sapiens
tattaaatacatact

SEQ ID NO: 374429 - DNA, 15 bp, Homo sapiens
attaaatacatactt

SEQ ID NO: 374430 - DNA, 15 bp, Homo sapiens
ttaaatacatacttt

SEQ ID NO: 374431 - DNA, 15 bp, Homo sapiens
taaatacatactttt

SEQ ID NO: 374432 - DNA, 15 bp, Homo sapiens
aaatacatacttttt

SEQ ID NO: 374433 - DNA, 15 bp, Homo sapiens
aatacatactttttt

SEQ ID NO: 374434 - DNA, 15 bp, Homo sapiens
atacatacttttttt

SEQ ID NO: 374435 - DNA, 15 bp, Homo sapiens
tacatactttttttt

SEQ ID NO: 374436 - DNA, 15 bp, Homo sapiens
acatacttttttttg

SEQ ID NO: 374437 - DNA, 15 bp, Homo sapiens
catacttttttttgt

SEQ ID NO: 374438 - DNA, 15 bp, Homo sapiens
atacttttttttgta

SEQ ID NO: 374439 - DNA, 15 bp, Homo sapiens
tacttttttttgtat

SEQ ID NO: 374440 - DNA, 15 bp, Homo sapiens
acttttttttgtatt

SEQ ID NO: 374441 - DNA, 15 bp, Homo sapiens
cttttttttgtattt

SEQ ID NO: 374442 - DNA, 15 bp, Homo sapiens
tttttttgtattttc

SEQ ID NO: 374443 - DNA, 15 bp, Homo sapiens
ttttttgtattttct

SEQ ID NO: 374444 - DNA, 15 bp, Homo sapiens
tttttgtattttctg

SEQ ID NO: 374445 - DNA, 15 bp, Homo sapiens
ttttgtattttctga

SEQ ID NO: 374446 - DNA, 15 bp, Homo sapiens
tttgtattttctgac

SEQ ID NO: 374447 - DNA, 15 bp, Homo sapiens
ttgtattttctgact

SEQ ID NO: 374448 - DNA, 15 bp, Homo sapiens
tgtattttctgactc

SEQ ID NO: 374449 - DNA, 15 bp, Homo sapiens
gtattttctgactca

SEQ ID NO: 374450 - DNA, 15 bp, Homo sapiens
tattttctgactcag

SEQ ID NO: 374451 - DNA, 15 bp, Homo sapiens
attttctgactcagt

SEQ ID NO: 374452 - DNA, 15 bp, Homo sapiens
ttttctgactcagta

SEQ ID NO: 374453 - DNA, 15 bp, Homo sapiens
tttctgactcagtaa

SEQ ID NO: 374454 - DNA, 15 bp, Homo sapiens
ttctgactcagtaat

SEQ ID NO: 374455 - DNA, 15 bp, Homo sapiens
tctgactcagtaatt

SEQ ID NO: 374456 - DNA, 15 bp, Homo sapiens
ctgactcagtaattc

SEQ ID NO: 374457 - DNA, 15 bp, Homo sapiens
tgactcagtaattct

SEQ ID NO: 374458 - DNA, 15 bp, Homo sapiens
gactcagtaattcta

SEQ ID NO: 374459 - DNA, 15 bp, Homo sapiens
actcagtaattctac

SEQ ID NO: 374460 - DNA, 15 bp, Homo sapiens
ctcagtaattctact

SEQ ID NO: 374461 - DNA, 15 bp, Homo sapiens
tcagtaattctactt

SEQ ID NO: 374462 - DNA, 15 bp, Homo sapiens
cagtaattctacttg

SEQ ID NO: 374463 - DNA, 15 bp, Homo sapiens
agtaattctacttgg

SEQ ID NO: 374464 - DNA, 15 bp, Homo sapiens
gtaattctacttggg

SEQ ID NO: 374465 - DNA, 15 bp, Homo sapiens
taattctacttggga

SEQ ID NO: 374466 - DNA, 15 bp, Homo sapiens
aattctacttgggaa

SEQ ID NO: 374467 - DNA, 15 bp, Homo sapiens
attctacttgggaaa

SEQ ID NO: 374468 - DNA, 15 bp, Homo sapiens
ttctacttgggaaat

SEQ ID NO: 374469 - DNA, 15 bp, Homo sapiens
tctacttgggaaatc

SEQ ID NO: 374470 - DNA, 15 bp, Homo sapiens
ctacttgggaaatct

SEQ ID NO: 374471 - DNA, 15 bp, Homo sapiens
tacttgggaaatcta

SEQ ID NO: 374472 - DNA, 15 bp, Homo sapiens
acttgggaaatctat

SEQ ID NO: 374473 - DNA, 15 bp, Homo sapiens
cttgggaaatctatg

SEQ ID NO: 374474 - DNA, 15 bp, Homo sapiens
ttgggaaatctatgc

SEQ ID NO: 374475 - DNA, 15 bp, Homo sapiens
tgggaaatctatgct

SEQ ID NO: 374476 - DNA, 15 bp, Homo sapiens
gggaaatctatgcta

SEQ ID NO: 374477 - DNA, 15 bp, Homo sapiens
ggaaatctatgctaa

SEQ ID NO: 374478 - DNA, 15 bp, Homo sapiens
gaaatctatgctaag

SEQ ID NO: 374479 - DNA, 15 bp, Homo sapiens
aaatctatgctaaga

SEQ ID NO: 374480 - DNA, 15 bp, Homo sapiens
aatctatgctaagat

SEQ ID NO: 374481 - DNA, 15 bp, Homo sapiens
atctatgctaagata

SEQ ID NO: 374482 - DNA, 15 bp, Homo sapiens
tctatgctaagatag

SEQ ID NO: 374483 - DNA, 15 bp, Homo sapiens
ctatgctaagataga

SEQ ID NO: 374484 - DNA, 15 bp, Homo sapiens
tatgctaagatagag

SEQ ID NO: 374485 - DNA, 15 bp, Homo sapiens
atgctaagatagaga

SEQ ID NO: 374486 - DNA, 15 bp, Homo sapiens
tgctaagatagagat

SEQ ID NO: 374487 - DNA, 15 bp, Homo sapiens
gctaagatagagatc

SEQ ID NO: 374488 - DNA, 15 bp, Homo sapiens
ctaagatagagatca

SEQ ID NO: 374489 - DNA, 15 bp, Homo sapiens
taagatagagatcag

SEQ ID NO: 374490 - DNA, 15 bp, Homo sapiens
aagatagagatcaga

SEQ ID NO: 374491 - DNA, 15 bp, Homo sapiens
agatagagatcagaa

SEQ ID NO: 374492 - DNA, 15 bp, Homo sapiens
gatagagatcagaaa

SEQ ID NO: 374493 - DNA, 15 bp, Homo sapiens
atagagatcagaaat

SEQ ID NO: 374494 - DNA, 15 bp, Homo sapiens
tagagatcagaaatg

SEQ ID NO: 374495 - DNA, 15 bp, Homo sapiens
agagatcagaaatgt

SEQ ID NO: 374496 - DNA, 15 bp, Homo sapiens
gagatcagaaatgtg

SEQ ID NO: 374497 - DNA, 15 bp, Homo sapiens
agatcagaaatgtgc

SEQ ID NO: 374498 - DNA, 15 bp, Homo sapiens
gatcagaaatgtgca

SEQ ID NO: 374499 - DNA, 15 bp, Homo sapiens
atcagaaatgtgcaa

SEQ ID NO: 374500 - DNA, 15 bp, Homo sapiens
tcagaaatgtgcaaa

SEQ ID NO: 374501 - DNA, 15 bp, Homo sapiens
cagaaatgtgcaaaa

SEQ ID NO: 374502 - DNA, 15 bp, Homo sapiens
agaaatgtgcaaaat

SEQ ID NO: 374503 - DNA, 15 bp, Homo sapiens
gaaatgtgcaaaata

SEQ ID NO: 374504 - DNA, 15 bp, Homo sapiens
aaatgtgcaaaatac

SEQ ID NO: 374505 - DNA, 15 bp, Homo sapiens
aatgtgcaaaatact

SEQ ID NO: 374506 - DNA, 15 bp, Homo sapiens
atgtgcaaaatactc

SEQ ID NO: 374507 - DNA, 15 bp, Homo sapiens
tgtgcaaaatactct

SEQ ID NO: 374508 - DNA, 15 bp, Homo sapiens
gtgcaaaatactcta

SEQ ID NO: 374509 - DNA, 15 bp, Homo sapiens
tgcaaaatactctac

SEQ ID NO: 374510 - DNA, 15 bp, Homo sapiens
gcaaaatactctaca

SEQ ID NO: 374511 - DNA, 15 bp, Homo sapiens
caaaatactctacat

SEQ ID NO: 374512 - DNA, 15 bp, Homo sapiens
aaaatactctacatg

SEQ ID NO: 374513 - DNA, 15 bp, Homo sapiens
aaatactctacatga

SEQ ID NO: 374514 - DNA, 15 bp, Homo sapiens
aatactctacatgaa

SEQ ID NO: 374515 - DNA, 15 bp, Homo sapiens
atactctacatgaaa

SEQ ID NO: 374516 - DNA, 15 bp, Homo sapiens
tactctacatgaaaa

SEQ ID NO: 374517 - DNA, 15 bp, Homo sapiens
actctacatgaaaag

SEQ ID NO: 374518 - DNA, 15 bp, Homo sapiens
ctctacatgaaaaga

SEQ ID NO: 374519 - DNA, 15 bp, Homo sapiens
tctacatgaaaagat

SEQ ID NO: 374520 - DNA, 15 bp, Homo sapiens
ctacatgaaaagata

SEQ ID NO: 374521 - DNA, 15 bp, Homo sapiens
tacatgaaaagatat

SEQ ID NO: 374522 - DNA, 15 bp, Homo sapiens
acatgaaaagatatt

SEQ ID NO: 374523 - DNA, 15 bp, Homo sapiens
catgaaaagatattc

SEQ ID NO: 374524 - DNA, 15 bp, Homo sapiens
atgaaaagatattct

SEQ ID NO: 374525 - DNA, 15 bp, Homo sapiens
tgaaaagatattctt

SEQ ID NO: 374526 - DNA, 15 bp, Homo sapiens
gaaaagatattcttt

SEQ ID NO: 374527 - DNA, 15 bp, Homo sapiens
aaaagatattctttg

SEQ ID NO: 374528 - DNA, 15 bp, Homo sapiens
aaagatattctttgc

SEQ ID NO: 374529 - DNA, 15 bp, Homo sapiens
aagatattctttgca

SEQ ID NO: 374530 - DNA, 15 bp, Homo sapiens
agatattctttgcaa

SEQ ID NO: 374531 - DNA, 15 bp, Homo sapiens
gatattctttgcaag

SEQ ID NO: 374532 - DNA, 15 bp, Homo sapiens
atattctttgcaagt

SEQ ID NO: 374533 - DNA, 15 bp, Homo sapiens
tattctttgcaagtt

SEQ ID NO: 374534 - DNA, 15 bp, Homo sapiens
attctttgcaagttt

SEQ ID NO: 374535 - DNA, 15 bp, Homo sapiens
ttctttgcaagtttt

SEQ ID NO: 374536 - DNA, 15 bp, Homo sapiens
tctttgcaagttttt

SEQ ID NO: 374537 - DNA, 15 bp, Homo sapiens
ctttgcaagtttttt

SEQ ID NO: 374538 - DNA, 15 bp, Homo sapiens
tttgcaagtttttta

SEQ ID NO: 374539 - DNA, 15 bp, Homo sapiens
ttgcaagttttttaa

SEQ ID NO: 374540 - DNA, 15 bp, Homo sapiens
tgcaagttttttaaa

SEQ ID NO: 374541 - DNA, 15 bp, Homo sapiens
gcaagttttttaaaa

SEQ ID NO: 374542 - DNA, 15 bp, Homo sapiens
caagttttttaaaaa

SEQ ID NO: 374543 - DNA, 15 bp, Homo sapiens
gttttttaaaaaatt

SEQ ID NO: 374544 - DNA, 15 bp, Homo sapiens
ttttttaaaaaatta

SEQ ID NO: 374545 - DNA, 15 bp, Homo sapiens
tttttaaaaaattaa

SEQ ID NO: 374546 - DNA, 15 bp, Homo sapiens
ttttaaaaaattaaa

SEQ ID NO: 374547 - DNA, 15 bp, Homo sapiens
ttaaaaaattaaaat

SEQ ID NO: 374548 - DNA, 15 bp, Homo sapiens
taaaaaattaaaata

SEQ ID NO: 374549 - DNA, 15 bp, Homo sapiens
aaaaaattaaaataa

SEQ ID NO: 374550 - DNA, 15 bp, Homo sapiens
aaaaattaaaataaa

SEQ ID NO: 374551 - DNA, 15 bp, Homo sapiens
aaaattaaaataaaa

SEQ ID NO: 374552 - DNA, 15 bp, Homo sapiens
aaattaaaataaaat

SEQ ID NO: 374553 - DNA, 15 bp, Homo sapiens
aattaaaataaaatt

SEQ ID NO: 374554 - DNA, 15 bp, Homo sapiens
attaaaataaaattt

SEQ ID NO: 374555 - DNA, 15 bp, Homo sapiens
ttaaaataaaatttc

SEQ ID NO: 374556 - DNA, 15 bp, Homo sapiens
taaaataaaatttca

SEQ ID NO: 374557 - DNA, 15 bp, Homo sapiens
aaaataaaatttcag

SEQ ID NO: 374558 - DNA, 15 bp, Homo sapiens
aaataaaatttcagg

SEQ ID NO: 374559 - DNA, 15 bp, Homo sapiens
aataaaatttcagga

SEQ ID NO: 374560 - DNA, 15 bp, Homo sapiens
ataaaatttcaggag

SEQ ID NO: 374561 - DNA, 15 bp, Homo sapiens
taaaatttcaggagc

SEQ ID NO: 374562 - DNA, 15 bp, Homo sapiens
aaaatttcaggagca

SEQ ID NO: 374563 - DNA, 15 bp, Homo sapiens
aaatttcaggagcaa

SEQ ID NO: 374564 - DNA, 15 bp, Homo sapiens
aatttcaggagcaat

SEQ ID NO: 374565 - DNA, 15 bp, Homo sapiens
atttcaggagcaatc

SEQ ID NO: 374566 - DNA, 15 bp, Homo sapiens
tttcaggagcaatct

SEQ ID NO: 374567 - DNA, 15 bp, Homo sapiens
ttcaggagcaatcta

SEQ ID NO: 374568 - DNA, 15 bp, Homo sapiens
tcaggagcaatctaa

SEQ ID NO: 374569 - DNA, 15 bp, Homo sapiens
caggagcaatctaaa

SEQ ID NO: 374570 - DNA, 15 bp, Homo sapiens
aggagcaatctaaat

SEQ ID NO: 374571 - DNA, 15 bp, Homo sapiens
ggagcaatctaaata

SEQ ID NO: 374572 - DNA, 15 bp, Homo sapiens
gagcaatctaaatat

SEQ ID NO: 374573 - DNA, 15 bp, Homo sapiens
agcaatctaaatatc

SEQ ID NO: 374574 - DNA, 15 bp, Homo sapiens
gcaatctaaatatcc

SEQ ID NO: 374575 - DNA, 15 bp, Homo sapiens
caatctaaatatcca

SEQ ID NO: 374576 - DNA, 15 bp, Homo sapiens
aatctaaatatccaa

SEQ ID NO: 374577 - DNA, 15 bp, Homo sapiens
atctaaatatccaag

SEQ ID NO: 374578 - DNA, 15 bp, Homo sapiens
tctaaatatccaagg

SEQ ID NO: 374579 - DNA, 15 bp, Homo sapiens
ctaaatatccaaggg

SEQ ID NO: 374580 - DNA, 15 bp, Homo sapiens
taaatatccaagggt

SEQ ID NO: 374581 - DNA, 15 bp, Homo sapiens
aaatatccaagggtt

SEQ ID NO: 374582 - DNA, 15 bp, Homo sapiens
aatatccaagggtta

SEQ ID NO: 374583 - DNA, 15 bp, Homo sapiens
atatccaagggttaa

SEQ ID NO: 374584 - DNA, 15 bp, Homo sapiens
tatccaagggttaaa

SEQ ID NO: 374585 - DNA, 15 bp, Homo sapiens
atccaagggttaaat

SEQ ID NO: 374586 - DNA, 15 bp, Homo sapiens
tccaagggttaaata

SEQ ID NO: 374587 - DNA, 15 bp, Homo sapiens
ccaagggttaaataa

SEQ ID NO: 374588 - DNA, 15 bp, Homo sapiens
caagggttaaataaa

SEQ ID NO: 374589 - DNA, 15 bp, Homo sapiens
aagggttaaataaaa

SEQ ID NO: 374590 - DNA, 15 bp, Homo sapiens
agggttaaataaaag

SEQ ID NO: 374591 - DNA, 15 bp, Homo sapiens
gggttaaataaaagt

SEQ ID NO: 374592 - DNA, 15 bp, Homo sapiens
ggttaaataaaagtg

SEQ ID NO: 374593 - DNA, 15 bp, Homo sapiens
gttaaataaaagtga

SEQ ID NO: 374594 - DNA, 15 bp, Homo sapiens
ttaaataaaagtgaa

SEQ ID NO: 374595 - DNA, 15 bp, Homo sapiens
taaataaaagtgaat

SEQ ID NO: 374596 - DNA, 15 bp, Homo sapiens
aaataaaagtgaata

SEQ ID NO: 374597 - DNA, 15 bp, Homo sapiens
aataaaagtgaatat

SEQ ID NO: 374598 - DNA, 15 bp, Homo sapiens
ataaaagtgaatatg

SEQ ID NO: 374599 - DNA, 15 bp, Homo sapiens
taaaagtgaatatgg

SEQ ID NO: 374600 - DNA, 15 bp, Homo sapiens
aaaagtgaatatggg

SEQ ID NO: 374601 - DNA, 15 bp, Homo sapiens
aaagtgaatatgggt

SEQ ID NO: 374602 - DNA, 15 bp, Homo sapiens
aagtgaatatgggta

SEQ ID NO: 374603 - DNA, 15 bp, Homo sapiens
agtgaatatgggtat

SEQ ID NO: 374604 - DNA, 15 bp, Homo sapiens
gtgaatatgggtata

SEQ ID NO: 374605 - DNA, 15 bp, Homo sapiens
tgaatatgggtatag

SEQ ID NO: 374606 - DNA, 15 bp, Homo sapiens
gaatatgggtatagg

SEQ ID NO: 374607 - DNA, 15 bp, Homo sapiens
aatatgggtataggt

SEQ ID NO: 374608 - DNA, 15 bp, Homo sapiens
atatgggtataggtt

SEQ ID NO: 374609 - DNA, 15 bp, Homo sapiens
tatgggtataggtta

SEQ ID NO: 374610 - DNA, 15 bp, Homo sapiens
atgggtataggttat

SEQ ID NO: 374611 - DNA, 15 bp, Homo sapiens
tgggtataggttatt

SEQ ID NO: 374612 - DNA, 15 bp, Homo sapiens
gggtataggttatta

SEQ ID NO: 374613 - DNA, 15 bp, Homo sapiens
ggtataggttattac

SEQ ID NO: 374614 - DNA, 15 bp, Homo sapiens
gtataggttattaca

SEQ ID NO: 374615 - DNA, 15 bp, Homo sapiens
tataggttattacat

SEQ ID NO: 374616 - DNA, 15 bp, Homo sapiens
ataggttattacata

SEQ ID NO: 374617 - DNA, 15 bp, Homo sapiens
taggttattacatag

SEQ ID NO: 374618 - DNA, 15 bp, Homo sapiens
aggttattacatagg

SEQ ID NO: 374619 - DNA, 15 bp, Homo sapiens
ggttattacataggt

SEQ ID NO: 374620 - DNA, 15 bp, Homo sapiens
gttattacataggta

SEQ ID NO: 374621 - DNA, 15 bp, Homo sapiens
ttattacataggtat

SEQ ID NO: 374622 - DNA, 15 bp, Homo sapiens
tattacataggtatt

SEQ ID NO: 374623 - DNA, 15 bp, Homo sapiens
attacataggtattc

SEQ ID NO: 374624 - DNA, 15 bp, Homo sapiens
ttacataggtattca

SEQ ID NO: 374625 - DNA, 15 bp, Homo sapiens
tacataggtattcat

SEQ ID NO: 374626 - DNA, 15 bp, Homo sapiens
acataggtattcata

SEQ ID NO: 374627 - DNA, 15 bp, Homo sapiens
cataggtattcataa

SEQ ID NO: 374628 - DNA, 15 bp, Homo sapiens
ataggtattcataat

SEQ ID NO: 374629 - DNA, 15 bp, Homo sapiens
taggtattcataatt

SEQ ID NO: 374630 - DNA, 15 bp, Homo sapiens
aggtattcataattg

SEQ ID NO: 374631 - DNA, 15 bp, Homo sapiens
tattcataattgtgt

SEQ ID NO: 374632 - DNA, 15 bp, Homo sapiens
attcataattgtgtt

SEQ ID NO: 374633 - DNA, 15 bp, Homo sapiens
ttcataattgtgttt

SEQ ID NO: 374634 - DNA, 15 bp, Homo sapiens
tcataattgtgttta

SEQ ID NO: 374635 - DNA, 15 bp, Homo sapiens
cataattgtgtttac

SEQ ID NO: 374636 - DNA, 15 bp, Homo sapiens
ataattgtgtttact

SEQ ID NO: 374637 - DNA, 15 bp, Homo sapiens
taattgtgtttacta

SEQ ID NO: 374638 - DNA, 15 bp, Homo sapiens
aattgtgtttactaa

SEQ ID NO: 374639 - DNA, 15 bp, Homo sapiens
attgtgtttactaag

SEQ ID NO: 374640 - DNA, 15 bp, Homo sapiens
ttgtgtttactaaga

SEQ ID NO: 374641 - DNA, 15 bp, Homo sapiens
tgtgtttactaagaa

SEQ ID NO: 374642 - DNA, 15 bp, Homo sapiens
gtgtttactaagaat

SEQ ID NO: 374643 - DNA, 15 bp, Homo sapiens
tgtttactaagaata

SEQ ID NO: 374644 - DNA, 15 bp, Homo sapiens
gtttactaagaataa

SEQ ID NO: 374645 - DNA, 15 bp, Homo sapiens
tttactaagaataaa

SEQ ID NO: 374646 - DNA, 15 bp, Homo sapiens
ttactaagaataaaa

SEQ ID NO: 374647 - DNA, 15 bp, Homo sapiens
tactaagaataaaat

SEQ ID NO: 374648 - DNA, 15 bp, Homo sapiens
actaagaataaaata

SEQ ID NO: 374649 - DNA, 15 bp, Homo sapiens
ctaagaataaaatat

SEQ ID NO: 374650 - DNA, 15 bp, Homo sapiens
taagaataaaatatg

SEQ ID NO: 374651 - DNA, 15 bp, Homo sapiens
aagaataaaatatgc

SEQ ID NO: 374652 - DNA, 15 bp, Homo sapiens
aataaaatatgctca

SEQ ID NO: 374653 - DNA, 15 bp, Homo sapiens
ataaaatatgctcac

SEQ ID NO: 374654 - DNA, 15 bp, Homo sapiens
taaaatatgctcaca

SEQ ID NO: 374655 - DNA, 15 bp, Homo sapiens
aaaatatgctcacat

SEQ ID NO: 374656 - DNA, 15 bp, Homo sapiens
aaatatgctcacatt

SEQ ID NO: 374657 - DNA, 15 bp, Homo sapiens
aatatgctcacatta

SEQ ID NO: 374658 - DNA, 15 bp, Homo sapiens
atatgctcacattat

SEQ ID NO: 374659 - DNA, 15 bp, Homo sapiens
tatgctcacattata

SEQ ID NO: 374660 - DNA, 15 bp, Homo sapiens
atgctcacattataa

SEQ ID NO: 374661 - DNA, 15 bp, Homo sapiens
tgctcacattataaa

SEQ ID NO: 374662 - DNA, 15 bp, Homo sapiens
gctcacattataaag

SEQ ID NO: 374663 - DNA, 15 bp, Homo sapiens
ctcacattataaagt

SEQ ID NO: 374664 - DNA, 15 bp, Homo sapiens
tcacattataaagtt

SEQ ID NO: 374665 - DNA, 15 bp, Homo sapiens
cacattataaagtta

SEQ ID NO: 374666 - DNA, 15 bp, Homo sapiens
acattataaagttaa

SEQ ID NO: 374667 - DNA, 15 bp, Homo sapiens
cattataaagttaaa

SEQ ID NO: 374668 - DNA, 15 bp, Homo sapiens
attataaagttaaat

SEQ ID NO: 374669 - DNA, 15 bp, Homo sapiens
ttataaagttaaatg

SEQ ID NO: 374670 - DNA, 15 bp, Homo sapiens
tataaagttaaatga

SEQ ID NO: 374671 - DNA, 15 bp, Homo sapiens
ataaagttaaatgaa

SEQ ID NO: 374672 - DNA, 15 bp, Homo sapiens
taaagttaaatgaaa

SEQ ID NO: 374673 - DNA, 15 bp, Homo sapiens
aaagttaaatgaaaa

SEQ ID NO: 374674 - DNA, 15 bp, Homo sapiens
aagttaaatgaaaaa

SEQ ID NO: 374675 - DNA, 15 bp, Homo sapiens
agttaaatgaaaaaa

SEQ ID NO: 374676 - DNA, 15 bp, Homo sapiens
gttaaatgaaaaaaa

SEQ ID NO: 374677 - DNA, 15 bp, Homo sapiens
ttaaatgaaaaaaat

SEQ ID NO: 374678 - DNA, 15 bp, Homo sapiens
taaatgaaaaaaata

SEQ ID NO: 374679 - DNA, 15 bp, Homo sapiens
aaatgaaaaaaataa

SEQ ID NO: 374680 - DNA, 15 bp, Homo sapiens
aatgaaaaaaataaa

SEQ ID NO: 374681 - DNA, 15 bp, Homo sapiens
atgaaaaaaataaaa

SEQ ID NO: 374682 - DNA, 15 bp, Homo sapiens
tgaaaaaaataaaaa

SEQ ID NO: 374683 - DNA, 15 bp, Homo sapiens
aaaaaataaaaaatt

SEQ ID NO: 374684 - DNA, 15 bp, Homo sapiens
aaaaataaaaaatta

SEQ ID NO: 374685 - DNA, 15 bp, Homo sapiens
aaaataaaaaattat

SEQ ID NO: 374686 - DNA, 15 bp, Homo sapiens
aaataaaaaattatg

SEQ ID NO: 374687 - DNA, 15 bp, Homo sapiens
aataaaaaattatga

SEQ ID NO: 374688 - DNA, 15 bp, Homo sapiens
ataaaaaattatgaa

SEQ ID NO: 374689 - DNA, 15 bp, Homo sapiens
taaaaaattatgaat

SEQ ID NO: 374690 - DNA, 15 bp, Homo sapiens
aaaaaattatgaata

SEQ ID NO: 374691 - DNA, 15 bp, Homo sapiens
aaaaattatgaataa

SEQ ID NO: 374692 - DNA, 15 bp, Homo sapiens
aaaattatgaataag

SEQ ID NO: 374693 - DNA, 15 bp, Homo sapiens
aaattatgaataagt

SEQ ID NO: 374694 - DNA, 15 bp, Homo sapiens
aattatgaataagtt

SEQ ID NO: 374695 - DNA, 15 bp, Homo sapiens
attatgaataagttg

SEQ ID NO: 374696 - DNA, 15 bp, Homo sapiens
ttatgaataagttgg

SEQ ID NO: 374697 - DNA, 15 bp, Homo sapiens
tatgaataagttggc

SEQ ID NO: 374698 - DNA, 15 bp, Homo sapiens
atgaataagttggct

SEQ ID NO: 374699 - DNA, 15 bp, Homo sapiens
tgaataagttggctt

SEQ ID NO: 374700 - DNA, 15 bp, Homo sapiens
gaataagttggcttt

SEQ ID NO: 374701 - DNA, 15 bp, Homo sapiens
aataagttggcttta

SEQ ID NO: 374702 - DNA, 15 bp, Homo sapiens
ataagttggctttat

SEQ ID NO: 374703 - DNA, 15 bp, Homo sapiens
taagttggctttata

SEQ ID NO: 374704 - DNA, 15 bp, Homo sapiens
aagttggctttataa

SEQ ID NO: 374705 - DNA, 15 bp, Homo sapiens
agttggctttataat

SEQ ID NO: 374706 - DNA, 15 bp, Homo sapiens
gttggctttataatt

SEQ ID NO: 374707 - DNA, 15 bp, Homo sapiens
ttggctttataatta

SEQ ID NO: 374708 - DNA, 15 bp, Homo sapiens
tggctttataattaa

SEQ ID NO: 374709 - DNA, 15 bp, Homo sapiens
ggctttataattaaa

SEQ ID NO: 374710 - DNA, 15 bp, Homo sapiens
gctttataattaaaa

SEQ ID NO: 374711 - DNA, 15 bp, Homo sapiens
ctttataattaaaat

SEQ ID NO: 374712 - DNA, 15 bp, Homo sapiens
tttataattaaaatc

SEQ ID NO: 374713 - DNA, 15 bp, Homo sapiens
ttataattaaaatca

SEQ ID NO: 374714 - DNA, 15 bp, Homo sapiens
tataattaaaatcat

SEQ ID NO: 374715 - DNA, 15 bp, Homo sapiens
ataattaaaatcatc

SEQ ID NO: 374716 - DNA, 15 bp, Homo sapiens
taattaaaatcatct

SEQ ID NO: 374717 - DNA, 15 bp, Homo sapiens
aattaaaatcatctt

SEQ ID NO: 374718 - DNA, 15 bp, Homo sapiens
attaaaatcatcttg

SEQ ID NO: 374719 - DNA, 15 bp, Homo sapiens
ttaaaatcatcttgc

SEQ ID NO: 374720 - DNA, 15 bp, Homo sapiens
taaaatcatcttgcc

SEQ ID NO: 374721 - DNA, 15 bp, Homo sapiens
aaaatcatcttgcca

SEQ ID NO: 374722 - DNA, 15 bp, Homo sapiens
aaatcatcttgccaa

SEQ ID NO: 374723 - DNA, 15 bp, Homo sapiens
aatcatcttgccaaa

SEQ ID NO: 374724 - DNA, 15 bp, Homo sapiens
atcatcttgccaaaa

SEQ ID NO: 374725 - DNA, 15 bp, Homo sapiens
tcatcttgccaaaat

SEQ ID NO: 374726 - DNA, 15 bp, Homo sapiens
catcttgccaaaata

SEQ ID NO: 374727 - DNA, 15 bp, Homo sapiens
atcttgccaaaataa

SEQ ID NO: 374728 - DNA, 15 bp, Homo sapiens
tcttgccaaaataaa

SEQ ID NO: 374729 - DNA, 15 bp, Homo sapiens
cttgccaaaataaaa

SEQ ID NO: 374730 - DNA, 15 bp, Homo sapiens
ttgccaaaataaaat

SEQ ID NO: 374731 - DNA, 15 bp, Homo sapiens
tgccaaaataaaata

SEQ ID NO: 374732 - DNA, 15 bp, Homo sapiens
gccaaaataaaataa

SEQ ID NO: 374733 - DNA, 15 bp, Homo sapiens
ccaaaataaaataat

SEQ ID NO: 374734 - DNA, 15 bp, Homo sapiens
caaaataaaataata

SEQ ID NO: 374735 - DNA, 15 bp, Homo sapiens
aaaataaaataatac

SEQ ID NO: 374736 - DNA, 15 bp, Homo sapiens
aaataaaataatact

SEQ ID NO: 374737 - DNA, 15 bp, Homo sapiens
aataaaataatactt

SEQ ID NO: 374738 - DNA, 15 bp, Homo sapiens
ataaaataatacttc

SEQ ID NO: 374739 - DNA, 15 bp, Homo sapiens
taaaataatacttcc

SEQ ID NO: 374740 - DNA, 15 bp, Homo sapiens
aaaataatacttcca

SEQ ID NO: 374741 - DNA, 15 bp, Homo sapiens
aaataatacttccag

SEQ ID NO: 374742 - DNA, 15 bp, Homo sapiens
aataatacttccagt

SEQ ID NO: 374743 - DNA, 15 bp, Homo sapiens
ataatacttccagtt

SEQ ID NO: 374744 - DNA, 15 bp, Homo sapiens
taatacttccagttc

SEQ ID NO: 374745 - DNA, 15 bp, Homo sapiens
aatacttccagttct

SEQ ID NO: 374746 - DNA, 15 bp, Homo sapiens
atacttccagttctc

SEQ ID NO: 374747 - DNA, 15 bp, Homo sapiens
tacttccagttctcc

SEQ ID NO: 374748 - DNA, 15 bp, Homo sapiens
acttccagttctccc

SEQ ID NO: 374749 - DNA, 15 bp, Homo sapiens
cttccagttctccca

SEQ ID NO: 374750 - DNA, 15 bp, Homo sapiens
ttccagttctcccac

SEQ ID NO: 374751 - DNA, 15 bp, Homo sapiens
tccagttctcccaca

SEQ ID NO: 374752 - DNA, 15 bp, Homo sapiens
ccagttctcccacat

SEQ ID NO: 374753 - DNA, 15 bp, Homo sapiens
cagttctcccacatt

SEQ ID NO: 374754 - DNA, 15 bp, Homo sapiens
agttctcccacattt

SEQ ID NO: 374755 - DNA, 15 bp, Homo sapiens
gttctcccacatttg

SEQ ID NO: 374756 - DNA, 15 bp, Homo sapiens
ttctcccacatttgt

SEQ ID NO: 374757 - DNA, 15 bp, Homo sapiens
tctcccacatttgta

SEQ ID NO: 374758 - DNA, 15 bp, Homo sapiens
ctcccacatttgtac

SEQ ID NO: 374759 - DNA, 15 bp, Homo sapiens
tcccacatttgtact

SEQ ID NO: 374760 - DNA, 15 bp, Homo sapiens
cccacatttgtactt

SEQ ID NO: 374761 - DNA, 15 bp, Homo sapiens
ccacatttgtacttt

SEQ ID NO: 374762 - DNA, 15 bp, Homo sapiens
cacatttgtactttt

SEQ ID NO: 374763 - DNA, 15 bp, Homo sapiens
acatttgtactttta

SEQ ID NO: 374764 - DNA, 15 bp, Homo sapiens
catttgtacttttaa

SEQ ID NO: 374765 - DNA, 15 bp, Homo sapiens
atttgtacttttaat

SEQ ID NO: 374766 - DNA, 15 bp, Homo sapiens
tttgtacttttaatt

SEQ ID NO: 374767 - DNA, 15 bp, Homo sapiens
ttgtacttttaattt

SEQ ID NO: 374768 - DNA, 15 bp, Homo sapiens
tgtacttttaatttt

SEQ ID NO: 374769 - DNA, 15 bp, Homo sapiens
gtacttttaattttt

SEQ ID NO: 374770 - DNA, 15 bp, Homo sapiens
tacttttaatttttc

SEQ ID NO: 374771 - DNA, 15 bp, Homo sapiens
acttttaatttttct

SEQ ID NO: 374772 - DNA, 15 bp, Homo sapiens
cttttaatttttctc

SEQ ID NO: 374773 - DNA, 15 bp, Homo sapiens
ttttaatttttctca

SEQ ID NO: 374774 - DNA, 15 bp, Homo sapiens
tttaatttttctcag

SEQ ID NO: 374775 - DNA, 15 bp, Homo sapiens
ttaatttttctcagt

SEQ ID NO: 374776 - DNA, 15 bp, Homo sapiens
taatttttctcagtg

SEQ ID NO: 374777 - DNA, 15 bp, Homo sapiens
aatttttctcagtgt

SEQ ID NO: 374778 - DNA, 15 bp, Homo sapiens
atttttctcagtgtc

SEQ ID NO: 374779 - DNA, 15 bp, Homo sapiens
tttttctcagtgtca

SEQ ID NO: 374780 - DNA, 15 bp, Homo sapiens
ttttctcagtgtcag

SEQ ID NO: 374781 - DNA, 15 bp, Homo sapiens
tttctcagtgtcagt

SEQ ID NO: 374782 - DNA, 15 bp, Homo sapiens
ttctcagtgtcagtg

SEQ ID NO: 374783 - DNA, 15 bp, Homo sapiens
tctcagtgtcagtgc

SEQ ID NO: 374784 - DNA, 15 bp, Homo sapiens
ctcagtgtcagtgct

SEQ ID NO: 374785 - DNA, 15 bp, Homo sapiens
tcagtgtcagtgctg

SEQ ID NO: 374786 - DNA, 15 bp, Homo sapiens
cagtgtcagtgctga

SEQ ID NO: 374787 - DNA, 15 bp, Homo sapiens
agtgtcagtgctgat

SEQ ID NO: 374788 - DNA, 15 bp, Homo sapiens
gtgtcagtgctgatt

SEQ ID NO: 374789 - DNA, 15 bp, Homo sapiens
tgtcagtgctgatta

SEQ ID NO: 374790 - DNA, 15 bp, Homo sapiens
gtcagtgctgattat

SEQ ID NO: 374791 - DNA, 15 bp, Homo sapiens
tcagtgctgattatg

SEQ ID NO: 374792 - DNA, 15 bp, Homo sapiens
cagtgctgattatgt

SEQ ID NO: 374793 - DNA, 15 bp, Homo sapiens
agtgctgattatgtt

SEQ ID NO: 374794 - DNA, 15 bp, Homo sapiens
gtgctgattatgtta

SEQ ID NO: 374795 - DNA, 15 bp, Homo sapiens
tgctgattatgttat

SEQ ID NO: 374796 - DNA, 15 bp, Homo sapiens
gctgattatgttata

SEQ ID NO: 374797 - DNA, 15 bp, Homo sapiens
ctgattatgttatag

SEQ ID NO: 374798 - DNA, 15 bp, Homo sapiens
tgattatgttataga

SEQ ID NO: 374799 - DNA, 15 bp, Homo sapiens
gattatgttatagaa

SEQ ID NO: 374800 - DNA, 15 bp, Homo sapiens
attatgttatagaat

SEQ ID NO: 374801 - DNA, 15 bp, Homo sapiens
ttatgttatagaatg

SEQ ID NO: 374802 - DNA, 15 bp, Homo sapiens
tatgttatagaatgt

SEQ ID NO: 374803 - DNA, 15 bp, Homo sapiens
atgttatagaatgtt

SEQ ID NO: 374804 - DNA, 15 bp, Homo sapiens
tgttatagaatgttg

SEQ ID NO: 374805 - DNA, 15 bp, Homo sapiens
gttatagaatgttgc

SEQ ID NO: 374806 - DNA, 15 bp, Homo sapiens
ttatagaatgttgca

SEQ ID NO: 374807 - DNA, 15 bp, Homo sapiens
tatagaatgttgcaa

SEQ ID NO: 374808 - DNA, 15 bp, Homo sapiens
atagaatgttgcaaa

SEQ ID NO: 374809 - DNA, 15 bp, Homo sapiens
tagaatgttgcaaaa

SEQ ID NO: 374810 - DNA, 15 bp, Homo sapiens
agaatgttgcaaaac

SEQ ID NO: 374811 - DNA, 15 bp, Homo sapiens
gaatgttgcaaaact

SEQ ID NO: 374812 - DNA, 15 bp, Homo sapiens
aatgttgcaaaactg

SEQ ID NO: 374813 - DNA, 15 bp, Homo sapiens
atgttgcaaaactgt

SEQ ID NO: 374814 - DNA, 15 bp, Homo sapiens
tgttgcaaaactgtt

SEQ ID NO: 374815 - DNA, 15 bp, Homo sapiens
gttgcaaaactgttt

SEQ ID NO: 374816 - DNA, 15 bp, Homo sapiens
ttgcaaaactgtttt

SEQ ID NO: 374817 - DNA, 15 bp, Homo sapiens
tgcaaaactgttttg

SEQ ID NO: 374818 - DNA, 15 bp, Homo sapiens
gcaaaactgttttgt

SEQ ID NO: 374819 - DNA, 15 bp, Homo sapiens
caaaactgttttgtt

SEQ ID NO: 374820 - DNA, 15 bp, Homo sapiens
aaaactgttttgttg

SEQ ID NO: 374821 - DNA, 15 bp, Homo sapiens
aaactgttttgttgg

SEQ ID NO: 374822 - DNA, 15 bp, Homo sapiens
aactgttttgttggc

SEQ ID NO: 374823 - DNA, 15 bp, Homo sapiens
actgttttgttggct

SEQ ID NO: 374824 - DNA, 15 bp, Homo sapiens
ctgttttgttggctt

SEQ ID NO: 374825 - DNA, 15 bp, Homo sapiens
tgttttgttggcttg

SEQ ID NO: 374826 - DNA, 15 bp, Homo sapiens
gttttgttggcttga

SEQ ID NO: 374827 - DNA, 15 bp, Homo sapiens
ttttgttggcttgat

SEQ ID NO: 374828 - DNA, 15 bp, Homo sapiens
tttgttggcttgata

SEQ ID NO: 374829 - DNA, 15 bp, Homo sapiens
ttgttggcttgatag

SEQ ID NO: 374830 - DNA, 15 bp, Homo sapiens
tgttggcttgatagc

SEQ ID NO: 374831 - DNA, 15 bp, Homo sapiens
gttggcttgatagct

SEQ ID NO: 374832 - DNA, 15 bp, Homo sapiens
ttggcttgatagcta

SEQ ID NO: 374833 - DNA, 15 bp, Homo sapiens
tggcttgatagctac

SEQ ID NO: 374834 - DNA, 15 bp, Homo sapiens
ggcttgatagctacc

SEQ ID NO: 374835 - DNA, 15 bp, Homo sapiens
gcttgatagctacca

SEQ ID NO: 374836 - DNA, 15 bp, Homo sapiens
cttgatagctaccaa

SEQ ID NO: 374837 - DNA, 15 bp, Homo sapiens
ttgatagctaccaaa

SEQ ID NO: 374838 - DNA, 15 bp, Homo sapiens
tgatagctaccaaag

SEQ ID NO: 374839 - DNA, 15 bp, Homo sapiens
gatagctaccaaaga

SEQ ID NO: 374840 - DNA, 15 bp, Homo sapiens
atagctaccaaagac

SEQ ID NO: 374841 - DNA, 15 bp, Homo sapiens
tagctaccaaagaca

SEQ ID NO: 374842 - DNA, 15 bp, Homo sapiens
agctaccaaagacat

SEQ ID NO: 374843 - DNA, 15 bp, Homo sapiens
gctaccaaagacata

SEQ ID NO: 374844 - DNA, 15 bp, Homo sapiens
ctaccaaagacatat

SEQ ID NO: 374845 - DNA, 15 bp, Homo sapiens
taccaaagacatatg

SEQ ID NO: 374846 - DNA, 15 bp, Homo sapiens
accaaagacatatgg

SEQ ID NO: 374847 - DNA, 15 bp, Homo sapiens
ccaaagacatatgga

SEQ ID NO: 374848 - DNA, 15 bp, Homo sapiens
caaagacatatggat

SEQ ID NO: 374849 - DNA, 15 bp, Homo sapiens
aaagacatatggata

SEQ ID NO: 374850 - DNA, 15 bp, Homo sapiens
aagacatatggatat

SEQ ID NO: 374851 - DNA, 15 bp, Homo sapiens
agacatatggatatt

SEQ ID NO: 374852 - DNA, 15 bp, Homo sapiens
gacatatggatatta

SEQ ID NO: 374853 - DNA, 15 bp, Homo sapiens
acatatggatattac

SEQ ID NO: 374854 - DNA, 15 bp, Homo sapiens
catatggatattaca

SEQ ID NO: 374855 - DNA, 15 bp, Homo sapiens
atatggatattacag

SEQ ID NO: 374856 - DNA, 15 bp, Homo sapiens
tatggatattacagg

SEQ ID NO: 374857 - DNA, 15 bp, Homo sapiens
atggatattacaggt

SEQ ID NO: 374858 - DNA, 15 bp, Homo sapiens
tggatattacaggta

SEQ ID NO: 374859 - DNA, 15 bp, Homo sapiens
ggatattacaggtaa

SEQ ID NO: 374860 - DNA, 15 bp, Homo sapiens
gatattacaggtaat

SEQ ID NO: 374861 - DNA, 15 bp, Homo sapiens
atattacaggtaata

SEQ ID NO: 374862 - DNA, 15 bp, Homo sapiens
tattacaggtaatac

SEQ ID NO: 374863 - DNA, 15 bp, Homo sapiens
attacaggtaatacc

SEQ ID NO: 374864 - DNA, 15 bp, Homo sapiens
ttacaggtaatacca

SEQ ID NO: 374865 - DNA, 15 bp, Homo sapiens
tacaggtaataccat

SEQ ID NO: 374866 - DNA, 15 bp, Homo sapiens
acaggtaataccata

SEQ ID NO: 374867 - DNA, 15 bp, Homo sapiens
caggtaataccatag

SEQ ID NO: 374868 - DNA, 15 bp, Homo sapiens
aggtaataccatagc

SEQ ID NO: 374869 - DNA, 15 bp, Homo sapiens
ggtaataccatagcc

SEQ ID NO: 374870 - DNA, 15 bp, Homo sapiens
gtaataccatagcca

SEQ ID NO: 374871 - DNA, 15 bp, Homo sapiens
taataccatagccat

SEQ ID NO: 374872 - DNA, 15 bp, Homo sapiens
aataccatagccatt

SEQ ID NO: 374873 - DNA, 15 bp, Homo sapiens
ataccatagccattt

SEQ ID NO: 374874 - DNA, 15 bp, Homo sapiens
taccatagccatttc

SEQ ID NO: 374875 - DNA, 15 bp, Homo sapiens
accatagccatttca

SEQ ID NO: 374876 - DNA, 15 bp, Homo sapiens
ccatagccatttcag

SEQ ID NO: 374877 - DNA, 15 bp, Homo sapiens
catagccatttcagt

SEQ ID NO: 374878 - DNA, 15 bp, Homo sapiens
atagccatttcagta

SEQ ID NO: 374879 - DNA, 15 bp, Homo sapiens
tagccatttcagtat

SEQ ID NO: 374880 - DNA, 15 bp, Homo sapiens
agccatttcagtatg

SEQ ID NO: 374881 - DNA, 15 bp, Homo sapiens
gccatttcagtatga

SEQ ID NO: 374882 - DNA, 15 bp, Homo sapiens
ccatttcagtatgaa

SEQ ID NO: 374883 - DNA, 15 bp, Homo sapiens
catttcagtatgaaa

SEQ ID NO: 374884 - DNA, 15 bp, Homo sapiens
atttcagtatgaaaa

SEQ ID NO: 374885 - DNA, 15 bp, Homo sapiens
tttcagtatgaaaaa

SEQ ID NO: 374886 - DNA, 15 bp, Homo sapiens
ttcagtatgaaaaaa

SEQ ID NO: 374887 - DNA, 15 bp, Homo sapiens
tcagtatgaaaaaat

SEQ ID NO: 374888 - DNA, 15 bp, Homo sapiens
cagtatgaaaaaata

SEQ ID NO: 374889 - DNA, 15 bp, Homo sapiens
agtatgaaaaaataa

SEQ ID NO: 374890 - DNA, 15 bp, Homo sapiens
gtatgaaaaaataac

SEQ ID NO: 374891 - DNA, 15 bp, Homo sapiens
tatgaaaaaataacc

SEQ ID NO: 374892 - DNA, 15 bp, Homo sapiens
atgaaaaaataacct

SEQ ID NO: 374893 - DNA, 15 bp, Homo sapiens
tgaaaaaataacctc

SEQ ID NO: 374894 - DNA, 15 bp, Homo sapiens
gaaaaaataacctct

SEQ ID NO: 374895 - DNA, 15 bp, Homo sapiens
aaaaaataacctctt

SEQ ID NO: 374896 - DNA, 15 bp, Homo sapiens
aaaaataacctctta

SEQ ID NO: 374897 - DNA, 15 bp, Homo sapiens
aaaataacctcttag

SEQ ID NO: 374898 - DNA, 15 bp, Homo sapiens
aaataacctcttaga

SEQ ID NO: 374899 - DNA, 15 bp, Homo sapiens
aataacctcttagaa

SEQ ID NO: 374900 - DNA, 15 bp, Homo sapiens
ataacctcttagaat

SEQ ID NO: 374901 - DNA, 15 bp, Homo sapiens
taacctcttagaatt

SEQ ID NO: 374902 - DNA, 15 bp, Homo sapiens
aacctcttagaattt

SEQ ID NO: 374903 - DNA, 15 bp, Homo sapiens
acctcttagaatttt

SEQ ID NO: 374904 - DNA, 15 bp, Homo sapiens
cctcttagaattttt

SEQ ID NO: 374905 - DNA, 15 bp, Homo sapiens
tcttagaattttttt

SEQ ID NO: 374906 - DNA, 15 bp, Homo sapiens
cttagaatttttttt

SEQ ID NO: 374907 - DNA, 15 bp, Homo sapiens
ttagaatttttttta

SEQ ID NO: 374908 - DNA, 15 bp, Homo sapiens
tagaattttttttac

SEQ ID NO: 374909 - DNA, 15 bp, Homo sapiens
agaattttttttact

SEQ ID NO: 374910 - DNA, 15 bp, Homo sapiens
gaattttttttactt

SEQ ID NO: 374911 - DNA, 15 bp, Homo sapiens
aattttttttactta

SEQ ID NO: 374912 - DNA, 15 bp, Homo sapiens
attttttttacttaa

SEQ ID NO: 374913 - DNA, 15 bp, Homo sapiens
ttttttttacttaaa

SEQ ID NO: 374914 - DNA, 15 bp, Homo sapiens
tttttttacttaaac

SEQ ID NO: 374915 - DNA, 15 bp, Homo sapiens
ttttttacttaaact

SEQ ID NO: 374916 - DNA, 15 bp, Homo sapiens
tttttacttaaacta

SEQ ID NO: 374917 - DNA, 15 bp, Homo sapiens
ttttacttaaactaa

SEQ ID NO: 374918 - DNA, 15 bp, Homo sapiens
tttacttaaactaaa

SEQ ID NO: 374919 - DNA, 15 bp, Homo sapiens
tacttaaactaaatt

SEQ ID NO: 374920 - DNA, 15 bp, Homo sapiens
acttaaactaaattt

SEQ ID NO: 374921 - DNA, 15 bp, Homo sapiens
cttaaactaaatttt

SEQ ID NO: 374922 - DNA, 15 bp, Homo sapiens
ttaaactaaatttta

SEQ ID NO: 374923 - DNA, 15 bp, Homo sapiens
taaactaaattttat

SEQ ID NO: 374924 - DNA, 15 bp, Homo sapiens
aaactaaattttatt

SEQ ID NO: 374925 - DNA, 15 bp, Homo sapiens
aactaaattttattt

SEQ ID NO: 374926 - DNA, 15 bp, Homo sapiens
actaaattttattta

SEQ ID NO: 374927 - DNA, 15 bp, Homo sapiens
ctaaattttatttaa

SEQ ID NO: 374928 - DNA, 15 bp, Homo sapiens
taaattttatttaaa

SEQ ID NO: 374929 - DNA, 15 bp, Homo sapiens
aaattttatttaaat

SEQ ID NO: 374930 - DNA, 15 bp, Homo sapiens
aattttatttaaata

SEQ ID NO: 374931 - DNA, 15 bp, Homo sapiens
attttatttaaatac

SEQ ID NO: 374932 - DNA, 15 bp, Homo sapiens
ttttatttaaataca

SEQ ID NO: 374933 - DNA, 15 bp, Homo sapiens
tttatttaaatacac

SEQ ID NO: 374934 - DNA, 15 bp, Homo sapiens
ttatttaaatacaca

SEQ ID NO: 374935 - DNA, 15 bp, Homo sapiens
tatttaaatacacat

SEQ ID NO: 374936 - DNA, 15 bp, Homo sapiens
atttaaatacacata

SEQ ID NO: 374937 - DNA, 15 bp, Homo sapiens
tttaaatacacatac

SEQ ID NO: 374938 - DNA, 15 bp, Homo sapiens
ttaaatacacataca

SEQ ID NO: 374939 - DNA, 15 bp, Homo sapiens
taaatacacatacac

SEQ ID NO: 374940 - DNA, 15 bp, Homo sapiens
aaatacacatacacg

SEQ ID NO: 374941 - DNA, 15 bp, Homo sapiens
aatacacatacacgt

SEQ ID NO: 374942 - DNA, 15 bp, Homo sapiens
atacacatacacgtg

SEQ ID NO: 374943 - DNA, 15 bp, Homo sapiens
tacacatacacgtgt

SEQ ID NO: 374944 - DNA, 15 bp, Homo sapiens
acacatacacgtgtc

SEQ ID NO: 374945 - DNA, 15 bp, Homo sapiens
cacatacacgtgtca

SEQ ID NO: 374946 - DNA, 15 bp, Homo sapiens
acatacacgtgtcac

SEQ ID NO: 374947 - DNA, 15 bp, Homo sapiens
catacacgtgtcacc

SEQ ID NO: 374948 - DNA, 15 bp, Homo sapiens
atacacgtgtcacca

SEQ ID NO: 374949 - DNA, 15 bp, Homo sapiens
tacacgtgtcaccat

SEQ ID NO: 374950 - DNA, 15 bp, Homo sapiens
acacgtgtcaccatg

SEQ ID NO: 374951 - DNA, 15 bp, Homo sapiens
cacgtgtcaccatga

SEQ ID NO: 374952 - DNA, 15 bp, Homo sapiens
acgtgtcaccatgac

SEQ ID NO: 374953 - DNA, 15 bp, Homo sapiens
cgtgtcaccatgaca

SEQ ID NO: 374954 - DNA, 15 bp, Homo sapiens
gtgtcaccatgacac

SEQ ID NO: 374955 - DNA, 15 bp, Homo sapiens
tgtcaccatgacacc

SEQ ID NO: 374956 - DNA, 15 bp, Homo sapiens
gtcaccatgacacca

SEQ ID NO: 374957 - DNA, 15 bp, Homo sapiens
tcaccatgacaccac

SEQ ID NO: 374958 - DNA, 15 bp, Homo sapiens
caccatgacaccacc

SEQ ID NO: 374959 - DNA, 15 bp, Homo sapiens
accatgacaccacca

SEQ ID NO: 374960 - DNA, 15 bp, Homo sapiens
ccatgacaccaccat

SEQ ID NO: 374961 - DNA, 15 bp, Homo sapiens
catgacaccaccata

SEQ ID NO: 374962 - DNA, 15 bp, Homo sapiens
atgacaccaccataa

SEQ ID NO: 374963 - DNA, 15 bp, Homo sapiens
tgacaccaccataat

SEQ ID NO: 374964 - DNA, 15 bp, Homo sapiens
gacaccaccataatt

SEQ ID NO: 374965 - DNA, 15 bp, Homo sapiens
acaccaccataatta

SEQ ID NO: 374966 - DNA, 15 bp, Homo sapiens
caccaccataattaa

SEQ ID NO: 374967 - DNA, 15 bp, Homo sapiens
accaccataattaaa

SEQ ID NO: 374968 - DNA, 15 bp, Homo sapiens
ccaccataattaaaa

SEQ ID NO: 374969 - DNA, 15 bp, Homo sapiens
caccataattaaaac

SEQ ID NO: 374970 - DNA, 15 bp, Homo sapiens
accataattaaaaca

SEQ ID NO: 374971 - DNA, 15 bp, Homo sapiens
ccataattaaaacat

SEQ ID NO: 374972 - DNA, 15 bp, Homo sapiens
cataattaaaacatc

SEQ ID NO: 374973 - DNA, 15 bp, Homo sapiens
ataattaaaacatcc

SEQ ID NO: 374974 - DNA, 15 bp, Homo sapiens
taattaaaacatcct

SEQ ID NO: 374975 - DNA, 15 bp, Homo sapiens
aattaaaacatcctg

SEQ ID NO: 374976 - DNA, 15 bp, Homo sapiens
attaaaacatcctgt

SEQ ID NO: 374977 - DNA, 15 bp, Homo sapiens
ttaaaacatcctgtt

SEQ ID NO: 374978 - DNA, 15 bp, Homo sapiens
taaaacatcctgttg

SEQ ID NO: 374979 - DNA, 15 bp, Homo sapiens
aaaacatcctgttga

SEQ ID NO: 374980 - DNA, 15 bp, Homo sapiens
aaacatcctgttgat

SEQ ID NO: 374981 - DNA, 15 bp, Homo sapiens
aacatcctgttgatt

SEQ ID NO: 374982 - DNA, 15 bp, Homo sapiens
acatcctgttgatta

SEQ ID NO: 374983 - DNA, 15 bp, Homo sapiens
catcctgttgattaa

SEQ ID NO: 374984 - DNA, 15 bp, Homo sapiens
atcctgttgattaat

SEQ ID NO: 374985 - DNA, 15 bp, Homo sapiens
tcctgttgattaatt

SEQ ID NO: 374986 - DNA, 15 bp, Homo sapiens
cctgttgattaattt

SEQ ID NO: 374987 - DNA, 15 bp, Homo sapiens
ctgttgattaatttc

SEQ ID NO: 374988 - DNA, 15 bp, Homo sapiens
tgttgattaatttct

SEQ ID NO: 374989 - DNA, 15 bp, Homo sapiens
gttgattaatttctc

SEQ ID NO: 374990 - DNA, 15 bp, Homo sapiens
ttgattaatttctct

SEQ ID NO: 374991 - DNA, 15 bp, Homo sapiens
tgattaatttctctt

SEQ ID NO: 374992 - DNA, 15 bp, Homo sapiens
gattaatttctcttt

SEQ ID NO: 374993 - DNA, 15 bp, Homo sapiens
attaatttctctttt

SEQ ID NO: 374994 - DNA, 15 bp, Homo sapiens
ttaatttctcttttg

SEQ ID NO: 374995 - DNA, 15 bp, Homo sapiens
taatttctcttttgc

SEQ ID NO: 374996 - DNA, 15 bp, Homo sapiens
aatttctcttttgct

SEQ ID NO: 374997 - DNA, 15 bp, Homo sapiens
atttctcttttgcta

SEQ ID NO: 374998 - DNA, 15 bp, Homo sapiens
tttctcttttgctac

SEQ ID NO: 374999 - DNA, 15 bp, Homo sapiens
ttctcttttgctaca

SEQ ID NO: 375000 - DNA, 15 bp, Homo sapiens
tctcttttgctacat

SEQ ID NO: 375001 - DNA, 15 bp, Homo sapiens
ctcttttgctacatt

SEQ ID NO: 375002 - DNA, 15 bp, Homo sapiens
tcttttgctacattt

SEQ ID NO: 375003 - DNA, 15 bp, Homo sapiens
cttttgctacatttt

SEQ ID NO: 375004 - DNA, 15 bp, Homo sapiens
ttttgctacattttt

SEQ ID NO: 375005 - DNA, 15 bp, Homo sapiens
tttgctacatttttc

SEQ ID NO: 375006 - DNA, 15 bp, Homo sapiens
ttgctacatttttca

SEQ ID NO: 375007 - DNA, 15 bp, Homo sapiens
tgctacatttttcat

SEQ ID NO: 375008 - DNA, 15 bp, Homo sapiens
gctacatttttcatt

SEQ ID NO: 375009 - DNA, 15 bp, Homo sapiens
ctacatttttcattt

SEQ ID NO: 375010 - DNA, 15 bp, Homo sapiens
tacatttttcatttc

SEQ ID NO: 375011 - DNA, 15 bp, Homo sapiens
acatttttcatttca

SEQ ID NO: 375012 - DNA, 15 bp, Homo sapiens
catttttcatttcag

SEQ ID NO: 375013 - DNA, 15 bp, Homo sapiens
atttttcatttcagc

SEQ ID NO: 375014 - DNA, 15 bp, Homo sapiens
tttttcatttcagct

SEQ ID NO: 375015 - DNA, 15 bp, Homo sapiens
ttttcatttcagctc

SEQ ID NO: 375016 - DNA, 15 bp, Homo sapiens
tttcatttcagctca

SEQ ID NO: 375017 - DNA, 15 bp, Homo sapiens
ttcatttcagctcat

SEQ ID NO: 375018 - DNA, 15 bp, Homo sapiens
tcatttcagctcatc

SEQ ID NO: 375019 - DNA, 15 bp, Homo sapiens
catttcagctcatcc

SEQ ID NO: 375020 - DNA, 15 bp, Homo sapiens
atttcagctcatcct

SEQ ID NO: 375021 - DNA, 15 bp, Homo sapiens
tttcagctcatccta

SEQ ID NO: 375022 - DNA, 15 bp, Homo sapiens
ttcagctcatcctaa

SEQ ID NO: 375023 - DNA, 15 bp, Homo sapiens
tcagctcatcctaat

SEQ ID NO: 375024 - DNA, 15 bp, Homo sapiens
cagctcatcctaatg

SEQ ID NO: 375025 - DNA, 15 bp, Homo sapiens
agctcatcctaatgt

SEQ ID NO: 375026 - DNA, 15 bp, Homo sapiens
gctcatcctaatgtc

SEQ ID NO: 375027 - DNA, 15 bp, Homo sapiens
ctcatcctaatgtcc

SEQ ID NO: 375028 - DNA, 15 bp, Homo sapiens
tcatcctaatgtcca

SEQ ID NO: 375029 - DNA, 15 bp, Homo sapiens
catcctaatgtccaa

SEQ ID NO: 375030 - DNA, 15 bp, Homo sapiens
atcctaatgtccaaa

SEQ ID NO: 375031 - DNA, 15 bp, Homo sapiens
tcctaatgtccaaaa

SEQ ID NO: 375032 - DNA, 15 bp, Homo sapiens
cctaatgtccaaaag

SEQ ID NO: 375033 - DNA, 15 bp, Homo sapiens
ctaatgtccaaaagg

SEQ ID NO: 375034 - DNA, 15 bp, Homo sapiens
taatgtccaaaaggt

SEQ ID NO: 375035 - DNA, 15 bp, Homo sapiens
aatgtccaaaaggtg

SEQ ID NO: 375036 - DNA, 15 bp, Homo sapiens
atgtccaaaaggtgg

SEQ ID NO: 375037 - DNA, 15 bp, Homo sapiens
tgtccaaaaggtggt

SEQ ID NO: 375038 - DNA, 15 bp, Homo sapiens
gtccaaaaggtggtg

SEQ ID NO: 375039 - DNA, 15 bp, Homo sapiens
tccaaaaggtggtgc

SEQ ID NO: 375040 - DNA, 15 bp, Homo sapiens
ccaaaaggtggtgct

SEQ ID NO: 375041 - DNA, 15 bp, Homo sapiens
caaaaggtggtgcta

SEQ ID NO: 375042 - DNA, 15 bp, Homo sapiens
aaaaggtggtgctag

SEQ ID NO: 375043 - DNA, 15 bp, Homo sapiens
aaaggtggtgctagt

SEQ ID NO: 375044 - DNA, 15 bp, Homo sapiens
aaggtggtgctagta

SEQ ID NO: 375045 - DNA, 15 bp, Homo sapiens
aggtggtgctagtat

SEQ ID NO: 375046 - DNA, 15 bp, Homo sapiens
ggtggtgctagtatc

SEQ ID NO: 375047 - DNA, 15 bp, Homo sapiens
gtggtgctagtatca

SEQ ID NO: 375048 - DNA, 15 bp, Homo sapiens
tggtgctagtatcat

SEQ ID NO: 375049 - DNA, 15 bp, Homo sapiens
ggtgctagtatcatc

SEQ ID NO: 375050 - DNA, 15 bp, Homo sapiens
gtgctagtatcatct

SEQ ID NO: 375051 - DNA, 15 bp, Homo sapiens
tgctagtatcatctg

SEQ ID NO: 375052 - DNA, 15 bp, Homo sapiens
gctagtatcatctgc

SEQ ID NO: 375053 - DNA, 15 bp, Homo sapiens
ctagtatcatctgcg

SEQ ID NO: 375054 - DNA, 15 bp, Homo sapiens
tagtatcatctgcgt

SEQ ID NO: 375055 - DNA, 15 bp, Homo sapiens
agtatcatctgcgtc

SEQ ID NO: 375056 - DNA, 15 bp, Homo sapiens
gtatcatctgcgtca

SEQ ID NO: 375057 - DNA, 15 bp, Homo sapiens
tatcatctgcgtcag

SEQ ID NO: 375058 - DNA, 15 bp, Homo sapiens
atcatctgcgtcaga

SEQ ID NO: 375059 - DNA, 15 bp, Homo sapiens
tcatctgcgtcagat

SEQ ID NO: 375060 - DNA, 15 bp, Homo sapiens
catctgcgtcagata

SEQ ID NO: 375061 - DNA, 15 bp, Homo sapiens
atctgcgtcagatat

SEQ ID NO: 375062 - DNA, 15 bp, Homo sapiens
tctgcgtcagatatt

SEQ ID NO: 375063 - DNA, 15 bp, Homo sapiens
ctgcgtcagatattc

SEQ ID NO: 375064 - DNA, 15 bp, Homo sapiens
tgcgtcagatattcc

SEQ ID NO: 375065 - DNA, 15 bp, Homo sapiens
gcgtcagatattcct

SEQ ID NO: 375066 - DNA, 15 bp, Homo sapiens
cgtcagatattcctg

SEQ ID NO: 375067 - DNA, 15 bp, Homo sapiens
gtcagatattcctgt

SEQ ID NO: 375068 - DNA, 15 bp, Homo sapiens
tcagatattcctgtt

SEQ ID NO: 375069 - DNA, 15 bp, Homo sapiens
cagatattcctgttc

SEQ ID NO: 375070 - DNA, 15 bp, Homo sapiens
agatattcctgttca

SEQ ID NO: 375071 - DNA, 15 bp, Homo sapiens
gatattcctgttcag

SEQ ID NO: 375072 - DNA, 15 bp, Homo sapiens
atattcctgttcagt

SEQ ID NO: 375073 - DNA, 15 bp, Homo sapiens
tattcctgttcagtc

SEQ ID NO: 375074 - DNA, 15 bp, Homo sapiens
attcctgttcagtct

SEQ ID NO: 375075 - DNA, 15 bp, Homo sapiens
ttcctgttcagtctc

SEQ ID NO: 375076 - DNA, 15 bp, Homo sapiens
tcctgttcagtctca

SEQ ID NO: 375077 - DNA, 15 bp, Homo sapiens
cctgttcagtctcat

SEQ ID NO: 375078 - DNA, 15 bp, Homo sapiens
ctgttcagtctcatc

SEQ ID NO: 375079 - DNA, 15 bp, Homo sapiens
tgttcagtctcatcg

SEQ ID NO: 375080 - DNA, 15 bp, Homo sapiens
gttcagtctcatcgt

SEQ ID NO: 375081 - DNA, 15 bp, Homo sapiens
ttcagtctcatcgta

SEQ ID NO: 375082 - DNA, 15 bp, Homo sapiens
tcagtctcatcgtac

SEQ ID NO: 375083 - DNA, 15 bp, Homo sapiens
cagtctcatcgtact

SEQ ID NO: 375084 - DNA, 15 bp, Homo sapiens
agtctcatcgtactt

SEQ ID NO: 375085 - DNA, 15 bp, Homo sapiens
gtctcatcgtacttc

SEQ ID NO: 375086 - DNA, 15 bp, Homo sapiens
tctcatcgtacttcg

SEQ ID NO: 375087 - DNA, 15 bp, Homo sapiens
ctcatcgtacttcgg

SEQ ID NO: 375088 - DNA, 15 bp, Homo sapiens
tcatcgtacttcgga

SEQ ID NO: 375089 - DNA, 15 bp, Homo sapiens
catcgtacttcggaa

SEQ ID NO: 375090 - DNA, 15 bp, Homo sapiens
atcgtacttcggaaa

SEQ ID NO: 375091 - DNA, 15 bp, Homo sapiens
tcgtacttcggaaat

SEQ ID NO: 375092 - DNA, 15 bp, Homo sapiens
cgtacttcggaaatt

SEQ ID NO: 375093 - DNA, 15 bp, Homo sapiens
gtacttcggaaattt

SEQ ID NO: 375094 - DNA, 15 bp, Homo sapiens
tacttcggaaatttc

SEQ ID NO: 375095 - DNA, 15 bp, Homo sapiens
acttcggaaatttca

SEQ ID NO: 375096 - DNA, 15 bp, Homo sapiens
cttcggaaatttcaa

SEQ ID NO: 375097 - DNA, 15 bp, Homo sapiens
ttcggaaatttcaat

SEQ ID NO: 375098 - DNA, 15 bp, Homo sapiens
tcggaaatttcaatt

SEQ ID NO: 375099 - DNA, 15 bp, Homo sapiens
cggaaatttcaattc

SEQ ID NO: 375100 - DNA, 15 bp, Homo sapiens
ggaaatttcaattcc

SEQ ID NO: 375101 - DNA, 15 bp, Homo sapiens
gaaatttcaattcct

SEQ ID NO: 375102 - DNA, 15 bp, Homo sapiens
aaatttcaattcctg

SEQ ID NO: 375103 - DNA, 15 bp, Homo sapiens
aatttcaattcctgc

SEQ ID NO: 375104 - DNA, 15 bp, Homo sapiens
atttcaattcctgct

SEQ ID NO: 375105 - DNA, 15 bp, Homo sapiens
tttcaattcctgctg

SEQ ID NO: 375106 - DNA, 15 bp, Homo sapiens
ttcaattcctgctga

SEQ ID NO: 375107 - DNA, 15 bp, Homo sapiens
tcaattcctgctgat

SEQ ID NO: 375108 - DNA, 15 bp, Homo sapiens
caattcctgctgatc

SEQ ID NO: 375109 - DNA, 15 bp, Homo sapiens
aattcctgctgatct

SEQ ID NO: 375110 - DNA, 15 bp, Homo sapiens
attcctgctgatctt

SEQ ID NO: 375111 - DNA, 15 bp, Homo sapiens
ttcctgctgatcttg

SEQ ID NO: 375112 - DNA, 15 bp, Homo sapiens
tcctgctgatcttga

SEQ ID NO: 375113 - DNA, 15 bp, Homo sapiens
cctgctgatcttgat

SEQ ID NO: 375114 - DNA, 15 bp, Homo sapiens
ctgctgatcttgata

SEQ ID NO: 375115 - DNA, 15 bp, Homo sapiens
tgctgatcttgataa

SEQ ID NO: 375116 - DNA, 15 bp, Homo sapiens
gctgatcttgataaa

SEQ ID NO: 375117 - DNA, 15 bp, Homo sapiens
ctgatcttgataaaa

SEQ ID NO: 375118 - DNA, 15 bp, Homo sapiens
tgatcttgataaaac

SEQ ID NO: 375119 - DNA, 15 bp, Homo sapiens
gatcttgataaaact

SEQ ID NO: 375120 - DNA, 15 bp, Homo sapiens
atcttgataaaacta

SEQ ID NO: 375121 - DNA, 15 bp, Homo sapiens
tcttgataaaactat

SEQ ID NO: 375122 - DNA, 15 bp, Homo sapiens
cttgataaaactata

SEQ ID NO: 375123 - DNA, 15 bp, Homo sapiens
ttgataaaactataa

SEQ ID NO: 375124 - DNA, 15 bp, Homo sapiens
tgataaaactataac

SEQ ID NO: 375125 - DNA, 15 bp, Homo sapiens
gataaaactataaca

SEQ ID NO: 375126 - DNA, 15 bp, Homo sapiens
ataaaactataacag

SEQ ID NO: 375127 - DNA, 15 bp, Homo sapiens
taaaactataacaga

SEQ ID NO: 375128 - DNA, 15 bp, Homo sapiens
aaaactataacagaa

SEQ ID NO: 375129 - DNA, 15 bp, Homo sapiens
aaactataacagaac

SEQ ID NO: 375130 - DNA, 15 bp, Homo sapiens
aactataacagaact

SEQ ID NO: 375131 - DNA, 15 bp, Homo sapiens
actataacagaacta

SEQ ID NO: 375132 - DNA, 15 bp, Homo sapiens
ctataacagaactag

SEQ ID NO: 375133 - DNA, 15 bp, Homo sapiens
tataacagaactagc

SEQ ID NO: 375134 - DNA, 15 bp, Homo sapiens
ataacagaactagcc

SEQ ID NO: 375135 - DNA, 15 bp, Homo sapiens
taacagaactagccg

SEQ ID NO: 375136 - DNA, 15 bp, Homo sapiens
aacagaactagccga

SEQ ID NO: 375137 - DNA, 15 bp, Homo sapiens
acagaactagccgac

SEQ ID NO: 375138 - DNA, 15 bp, Homo sapiens
cagaactagccgact

SEQ ID NO: 375139 - DNA, 15 bp, Homo sapiens
agaactagccgactg

SEQ ID NO: 375140 - DNA, 15 bp, Homo sapiens
gaactagccgactgg

SEQ ID NO: 375141 - DNA, 15 bp, Homo sapiens
aactagccgactggc

SEQ ID NO: 375142 - DNA, 15 bp, Homo sapiens
actagccgactggct

SEQ ID NO: 375143 - DNA, 15 bp, Homo sapiens
ctagccgactggctg

SEQ ID NO: 375144 - DNA, 15 bp, Homo sapiens
tagccgactggctgg

SEQ ID NO: 375145 - DNA, 15 bp, Homo sapiens
agccgactggctggt

SEQ ID NO: 375146 - DNA, 15 bp, Homo sapiens
gccgactggctggta

SEQ ID NO: 375147 - DNA, 15 bp, Homo sapiens
ccgactggctggtat

SEQ ID NO: 375148 - DNA, 15 bp, Homo sapiens
cgactggctggtatt

SEQ ID NO: 375149 - DNA, 15 bp, Homo sapiens
gactggctggtatta

SEQ ID NO: 375150 - DNA, 15 bp, Homo sapiens
actggctggtattaa

SEQ ID NO: 375151 - DNA, 15 bp, Homo sapiens
ctggctggtattaat

SEQ ID NO: 375152 - DNA, 15 bp, Homo sapiens
tggctggtattaatc

SEQ ID NO: 375153 - DNA, 15 bp, Homo sapiens
ggctggtattaatcg

SEQ ID NO: 375154 - DNA, 15 bp, Homo sapiens
gctggtattaatcga

SEQ ID NO: 375155 - DNA, 15 bp, Homo sapiens
ctggtattaatcgac

SEQ ID NO: 375156 - DNA, 15 bp, Homo sapiens
tggtattaatcgacc

SEQ ID NO: 375157 - DNA, 15 bp, Homo sapiens
ggtattaatcgacca

SEQ ID NO: 375158 - DNA, 15 bp, Homo sapiens
gtattaatcgaccag

SEQ ID NO: 375159 - DNA, 15 bp, Homo sapiens
tattaatcgaccaga

SEQ ID NO: 375160 - DNA, 15 bp, Homo sapiens
attaatcgaccagat

SEQ ID NO: 375161 - DNA, 15 bp, Homo sapiens
ttaatcgaccagatg

SEQ ID NO: 375162 - DNA, 15 bp, Homo sapiens
taatcgaccagatgc

SEQ ID NO: 375163 - DNA, 15 bp, Homo sapiens
aatcgaccagatgct

SEQ ID NO: 375164 - DNA, 15 bp, Homo sapiens
atcgaccagatgctg

SEQ ID NO: 375165 - DNA, 15 bp, Homo sapiens
tcgaccagatgctga

SEQ ID NO: 375166 - DNA, 15 bp, Homo sapiens
cgaccagatgctgaa

SEQ ID NO: 375167 - DNA, 15 bp, Homo sapiens
gaccagatgctgaag

SEQ ID NO: 375168 - DNA, 15 bp, Homo sapiens
accagatgctgaagt

SEQ ID NO: 375169 - DNA, 15 bp, Homo sapiens
ccagatgctgaagtc

SEQ ID NO: 375170 - DNA, 15 bp, Homo sapiens
cagatgctgaagtcc

SEQ ID NO: 375171 - DNA, 15 bp, Homo sapiens
agatgctgaagtcca

SEQ ID NO: 375172 - DNA, 15 bp, Homo sapiens
gatgctgaagtccaa

SEQ ID NO: 375173 - DNA, 15 bp, Homo sapiens
atgctgaagtccaac

SEQ ID NO: 375174 - DNA, 15 bp, Homo sapiens
tgctgaagtccaaca

SEQ ID NO: 375175 - DNA, 15 bp, Homo sapiens
gctgaagtccaacat

SEQ ID NO: 375176 - DNA, 15 bp, Homo sapiens
ctgaagtccaacatt

SEQ ID NO: 375177 - DNA, 15 bp, Homo sapiens
tgaagtccaacattg

SEQ ID NO: 375178 - DNA, 15 bp, Homo sapiens
gaagtccaacattgt

SEQ ID NO: 375179 - DNA, 15 bp, Homo sapiens
aagtccaacattgtc

SEQ ID NO: 375180 - DNA, 15 bp, Homo sapiens
agtccaacattgtca

SEQ ID NO: 375181 - DNA, 15 bp, Homo sapiens
gtccaacattgtcac

SEQ ID NO: 375182 - DNA, 15 bp, Homo sapiens
tccaacattgtcact

SEQ ID NO: 375183 - DNA, 15 bp, Homo sapiens
ccaacattgtcactg

SEQ ID NO: 375184 - DNA, 15 bp, Homo sapiens
caacattgtcactgt

SEQ ID NO: 375185 - DNA, 15 bp, Homo sapiens
aacattgtcactgtt

SEQ ID NO: 375186 - DNA, 15 bp, Homo sapiens
acattgtcactgttg

SEQ ID NO: 375187 - DNA, 15 bp, Homo sapiens
cattgtcactgttgg

SEQ ID NO: 375188 - DNA, 15 bp, Homo sapiens
attgtcactgttggg

SEQ ID NO: 375189 - DNA, 15 bp, Homo sapiens
ttgtcactgttgggg

SEQ ID NO: 375190 - DNA, 15 bp, Homo sapiens
tgtcactgttgggga

SEQ ID NO: 375191 - DNA, 15 bp, Homo sapiens
gtcactgttggggat

SEQ ID NO: 375192 - DNA, 15 bp, Homo sapiens
tcactgttggggatg

SEQ ID NO: 375193 - DNA, 15 bp, Homo sapiens
cactgttggggatgt

SEQ ID NO: 375194 - DNA, 15 bp, Homo sapiens
actgttggggatgta

SEQ ID NO: 375195 - DNA, 15 bp, Homo sapiens
ctgttggggatgtag

SEQ ID NO: 375196 - DNA, 15 bp, Homo sapiens
tgttggggatgtaga

SEQ ID NO: 375197 - DNA, 15 bp, Homo sapiens
gttggggatgtagaa

SEQ ID NO: 375198 - DNA, 15 bp, Homo sapiens
ttggggatgtagaag

SEQ ID NO: 375199 - DNA, 15 bp, Homo sapiens
tggggatgtagaaga

SEQ ID NO: 375200 - DNA, 15 bp, Homo sapiens
ggggatgtagaagag

SEQ ID NO: 375201 - DNA, 15 bp, Homo sapiens
gggatgtagaagaga

SEQ ID NO: 375202 - DNA, 15 bp, Homo sapiens
ggatgtagaagagat

SEQ ID NO: 375203 - DNA, 15 bp, Homo sapiens
gatgtagaagagatc

SEQ ID NO: 375204 - DNA, 15 bp, Homo sapiens
atgtagaagagatca

SEQ ID NO: 375205 - DNA, 15 bp, Homo sapiens
tgtagaagagatcaa

SEQ ID NO: 375206 - DNA, 15 bp, Homo sapiens
gtagaagagatcaat

SEQ ID NO: 375207 - DNA, 15 bp, Homo sapiens
tagaagagatcaata

SEQ ID NO: 375208 - DNA, 15 bp, Homo sapiens
agaagagatcaataa

SEQ ID NO: 375209 - DNA, 15 bp, Homo sapiens
gaagagatcaataag

SEQ ID NO: 375210 - DNA, 15 bp, Homo sapiens
aagagatcaataaga

SEQ ID NO: 375211 - DNA, 15 bp, Homo sapiens
agagatcaataagac

SEQ ID NO: 375212 - DNA, 15 bp, Homo sapiens
gagatcaataagacc

SEQ ID NO: 375213 - DNA, 15 bp, Homo sapiens
agatcaataagaccg

SEQ ID NO: 375214 - DNA, 15 bp, Homo sapiens
gatcaataagaccgt

SEQ ID NO: 375215 - DNA, 15 bp, Homo sapiens
atcaataagaccgtt

SEQ ID NO: 375216 - DNA, 15 bp, Homo sapiens
tcaataagaccgttt

SEQ ID NO: 375217 - DNA, 15 bp, Homo sapiens
caataagaccgtttc

SEQ ID NO: 375218 - DNA, 15 bp, Homo sapiens
aataagaccgtttcc

SEQ ID NO: 375219 - DNA, 15 bp, Homo sapiens
ataagaccgtttccc

SEQ ID NO: 375220 - DNA, 15 bp, Homo sapiens
taagaccgtttcccg

SEQ ID NO: 375221 - DNA, 15 bp, Homo sapiens
aagaccgtttcccga

SEQ ID NO: 375222 - DNA, 15 bp, Homo sapiens
agaccgtttcccgaa

SEQ ID NO: 375223 - DNA, 15 bp, Homo sapiens
gaccgtttcccgaat

SEQ ID NO: 375224 - DNA, 15 bp, Homo sapiens
accgtttcccgaatg

SEQ ID NO: 375225 - DNA, 15 bp, Homo sapiens
ccgtttcccgaatga

SEQ ID NO: 375226 - DNA, 15 bp, Homo sapiens
cgtttcccgaatgaa

SEQ ID NO: 375227 - DNA, 15 bp, Homo sapiens
gtttcccgaatgaaa

SEQ ID NO: 375228 - DNA, 15 bp, Homo sapiens
tttcccgaatgaaag

SEQ ID NO: 375229 - DNA, 15 bp, Homo sapiens
ttcccgaatgaaagt

SEQ ID NO: 375230 - DNA, 15 bp, Homo sapiens
tcccgaatgaaagta

SEQ ID NO: 375231 - DNA, 15 bp, Homo sapiens
cccgaatgaaagtag

SEQ ID NO: 375232 - DNA, 15 bp, Homo sapiens
ccgaatgaaagtagg

SEQ ID NO: 375233 - DNA, 15 bp, Homo sapiens
cgaatgaaagtaggt

SEQ ID NO: 375234 - DNA, 15 bp, Homo sapiens
gaatgaaagtaggtg

SEQ ID NO: 375235 - DNA, 15 bp, Homo sapiens
aatgaaagtaggtgc

SEQ ID NO: 375236 - DNA, 15 bp, Homo sapiens
atgaaagtaggtgca

SEQ ID NO: 375237 - DNA, 15 bp, Homo sapiens
tgaaagtaggtgcat

SEQ ID NO: 375238 - DNA, 15 bp, Homo sapiens
gaaagtaggtgcata

SEQ ID NO: 375239 - DNA, 15 bp, Homo sapiens
aaagtaggtgcatag

SEQ ID NO: 375240 - DNA, 15 bp, Homo sapiens
aagtaggtgcatagt

SEQ ID NO: 375241 - DNA, 15 bp, Homo sapiens
agtaggtgcatagtg

SEQ ID NO: 375242 - DNA, 15 bp, Homo sapiens
gtaggtgcatagtgt

SEQ ID NO: 375243 - DNA, 15 bp, Homo sapiens
taggtgcatagtgta

SEQ ID NO: 375244 - DNA, 15 bp, Homo sapiens
aggtgcatagtgtaa

SEQ ID NO: 375245 - DNA, 15 bp, Homo sapiens
ggtgcatagtgtaaa

SEQ ID NO: 375246 - DNA, 15 bp, Homo sapiens
gtgcatagtgtaaaa

SEQ ID NO: 375247 - DNA, 15 bp, Homo sapiens
tgcatagtgtaaaag

SEQ ID NO: 375248 - DNA, 15 bp, Homo sapiens
gcatagtgtaaaagc

SEQ ID NO: 375249 - DNA, 15 bp, Homo sapiens
catagtgtaaaagct

SEQ ID NO: 375250 - DNA, 15 bp, Homo sapiens
atagtgtaaaagctt

SEQ ID NO: 375251 - DNA, 15 bp, Homo sapiens
tagtgtaaaagcttg

SEQ ID NO: 375252 - DNA, 15 bp, Homo sapiens
agtgtaaaagcttgt

SEQ ID NO: 375253 - DNA, 15 bp, Homo sapiens
gtgtaaaagcttgtc

SEQ ID NO: 375254 - DNA, 15 bp, Homo sapiens
tgtaaaagcttgtca

SEQ ID NO: 375255 - DNA, 15 bp, Homo sapiens
gtaaaagcttgtcat

SEQ ID NO: 375256 - DNA, 15 bp, Homo sapiens
taaaagcttgtcatg

SEQ ID NO: 375257 - DNA, 15 bp, Homo sapiens
aaaagcttgtcatgg

SEQ ID NO: 375258 - DNA, 15 bp, Homo sapiens
aaagcttgtcatgga

SEQ ID NO: 375259 - DNA, 15 bp, Homo sapiens
aagcttgtcatggaa

SEQ ID NO: 375260 - DNA, 15 bp, Homo sapiens
agcttgtcatggaaa

SEQ ID NO: 375261 - DNA, 15 bp, Homo sapiens
gcttgtcatggaaac

SEQ ID NO: 375262 - DNA, 15 bp, Homo sapiens
cttgtcatggaaacg

SEQ ID NO: 375263 - DNA, 15 bp, Homo sapiens
ttgtcatggaaacgc

SEQ ID NO: 375264 - DNA, 15 bp, Homo sapiens
tgtcatggaaacgcc

SEQ ID NO: 375265 - DNA, 15 bp, Homo sapiens
gtcatggaaacgcca

SEQ ID NO: 375266 - DNA, 15 bp, Homo sapiens
tcatggaaacgccac

SEQ ID NO: 375267 - DNA, 15 bp, Homo sapiens
catggaaacgccaca

SEQ ID NO: 375268 - DNA, 15 bp, Homo sapiens
atggaaacgccacaa

SEQ ID NO: 375269 - DNA, 15 bp, Homo sapiens
tggaaacgccacaac

SEQ ID NO: 375270 - DNA, 15 bp, Homo sapiens
ggaaacgccacaacc

SEQ ID NO: 375271 - DNA, 15 bp, Homo sapiens
gaaacgccacaaccc

SEQ ID NO: 375272 - DNA, 15 bp, Homo sapiens
aaacgccacaaccca

SEQ ID NO: 375273 - DNA, 15 bp, Homo sapiens
aacgccacaacccag

SEQ ID NO: 375274 - DNA, 15 bp, Homo sapiens
acgccacaacccaga

SEQ ID NO: 375275 - DNA, 15 bp, Homo sapiens
cgccacaacccagag

SEQ ID NO: 375276 - DNA, 15 bp, Homo sapiens
gccacaacccagagg

SEQ ID NO: 375277 - DNA, 15 bp, Homo sapiens
ccacaacccagaggt

SEQ ID NO: 375278 - DNA, 15 bp, Homo sapiens
cacaacccagaggta

SEQ ID NO: 375279 - DNA, 15 bp, Homo sapiens
acaacccagaggtag

SEQ ID NO: 375280 - DNA, 15 bp, Homo sapiens
caacccagaggtaga

SEQ ID NO: 375281 - DNA, 15 bp, Homo sapiens
aacccagaggtagac

SEQ ID NO: 375282 - DNA, 15 bp, Homo sapiens
acccagaggtagacc

SEQ ID NO: 375283 - DNA, 15 bp, Homo sapiens
cccagaggtagacca

SEQ ID NO: 375284 - DNA, 15 bp, Homo sapiens
ccagaggtagaccag

SEQ ID NO: 375285 - DNA, 15 bp, Homo sapiens
cagaggtagaccaga

SEQ ID NO: 375286 - DNA, 15 bp, Homo sapiens
agaggtagaccagat

SEQ ID NO: 375287 - DNA, 15 bp, Homo sapiens
gaggtagaccagatc

SEQ ID NO: 375288 - DNA, 15 bp, Homo sapiens
aggtagaccagatct

SEQ ID NO: 375289 - DNA, 15 bp, Homo sapiens
ggtagaccagatctg

SEQ ID NO: 375290 - DNA, 15 bp, Homo sapiens
gtagaccagatctgt

SEQ ID NO: 375291 - DNA, 15 bp, Homo sapiens
tagaccagatctgtt

SEQ ID NO: 375292 - DNA, 15 bp, Homo sapiens
agaccagatctgttt

SEQ ID NO: 375293 - DNA, 15 bp, Homo sapiens
gaccagatctgtttg

SEQ ID NO: 375294 - DNA, 15 bp, Homo sapiens
accagatctgtttga

SEQ ID NO: 375295 - DNA, 15 bp, Homo sapiens
ccagatctgtttgaa

SEQ ID NO: 375296 - DNA, 15 bp, Homo sapiens
cagatctgtttgaat

SEQ ID NO: 375297 - DNA, 15 bp, Homo sapiens
agatctgtttgaatc

SEQ ID NO: 375298 - DNA, 15 bp, Homo sapiens
gatctgtttgaatcc

SEQ ID NO: 375299 - DNA, 15 bp, Homo sapiens
atctgtttgaatccc

SEQ ID NO: 375300 - DNA, 15 bp, Homo sapiens
tctgtttgaatccct

SEQ ID NO: 375301 - DNA, 15 bp, Homo sapiens
ctgtttgaatccctt

SEQ ID NO: 375302 - DNA, 15 bp, Homo sapiens
tgtttgaatcccttt

SEQ ID NO: 375303 - DNA, 15 bp, Homo sapiens
gtttgaatccctttt

SEQ ID NO: 375304 - DNA, 15 bp, Homo sapiens
tttgaatcccttttg

SEQ ID NO: 375305 - DNA, 15 bp, Homo sapiens
ttgaatcccttttgt

SEQ ID NO: 375306 - DNA, 15 bp, Homo sapiens
tgaatcccttttgtt

SEQ ID NO: 375307 - DNA, 15 bp, Homo sapiens
gaatcccttttgttt

SEQ ID NO: 375308 - DNA, 15 bp, Homo sapiens
aatcccttttgttta

SEQ ID NO: 375309 - DNA, 15 bp, Homo sapiens
atcccttttgtttat

SEQ ID NO: 375310 - DNA, 15 bp, Homo sapiens
tcccttttgtttatc

SEQ ID NO: 375311 - DNA, 15 bp, Homo sapiens
cccttttgtttatcc

SEQ ID NO: 375312 - DNA, 15 bp, Homo sapiens
ccttttgtttatcct

SEQ ID NO: 375313 - DNA, 15 bp, Homo sapiens
cttttgtttatccta

SEQ ID NO: 375314 - DNA, 15 bp, Homo sapiens
ttttgtttatcctaa

SEQ ID NO: 375315 - DNA, 15 bp, Homo sapiens
tttgtttatcctaaa

SEQ ID NO: 375316 - DNA, 15 bp, Homo sapiens
ttgtttatcctaaac

SEQ ID NO: 375317 - DNA, 15 bp, Homo sapiens
tgtttatcctaaact

SEQ ID NO: 375318 - DNA, 15 bp, Homo sapiens
gtttatcctaaacta

SEQ ID NO: 375319 - DNA, 15 bp, Homo sapiens
tttatcctaaactat

SEQ ID NO: 375320 - DNA, 15 bp, Homo sapiens
ttatcctaaactatg

SEQ ID NO: 375321 - DNA, 15 bp, Homo sapiens
tatcctaaactatga

SEQ ID NO: 375322 - DNA, 15 bp, Homo sapiens
atcctaaactatgag

SEQ ID NO: 375323 - DNA, 15 bp, Homo sapiens
tcctaaactatgaga

SEQ ID NO: 375324 - DNA, 15 bp, Homo sapiens
cctaaactatgagag

SEQ ID NO: 375325 - DNA, 15 bp, Homo sapiens
ctaaactatgagaga

SEQ ID NO: 375326 - DNA, 15 bp, Homo sapiens
taaactatgagagaa

SEQ ID NO: 375327 - DNA, 15 bp, Homo sapiens
aaactatgagagaat

SEQ ID NO: 375328 - DNA, 15 bp, Homo sapiens
aactatgagagaatg

SEQ ID NO: 375329 - DNA, 15 bp, Homo sapiens
actatgagagaatga

SEQ ID NO: 375330 - DNA, 15 bp, Homo sapiens
ctatgagagaatgag

SEQ ID NO: 375331 - DNA, 15 bp, Homo sapiens
tatgagagaatgagg

SEQ ID NO: 375332 - DNA, 15 bp, Homo sapiens
atgagagaatgaggt

SEQ ID NO: 375333 - DNA, 15 bp, Homo sapiens
tgagagaatgaggtt

SEQ ID NO: 375334 - DNA, 15 bp, Homo sapiens
gagagaatgaggttt

SEQ ID NO: 375335 - DNA, 15 bp, Homo sapiens
agagaatgaggttta

SEQ ID NO: 375336 - DNA, 15 bp, Homo sapiens
gagaatgaggtttaa

SEQ ID NO: 375337 - DNA, 15 bp, Homo sapiens
agaatgaggtttaaa

SEQ ID NO: 375338 - DNA, 15 bp, Homo sapiens
gaatgaggtttaaaa

SEQ ID NO: 375339 - DNA, 15 bp, Homo sapiens
aatgaggtttaaaaa

SEQ ID NO: 375340 - DNA, 15 bp, Homo sapiens
atgaggtttaaaaaa

SEQ ID NO: 375341 - DNA, 15 bp, Homo sapiens
tgaggtttaaaaaat

SEQ ID NO: 375342 - DNA, 15 bp, Homo sapiens
gaggtttaaaaaatt

SEQ ID NO: 375343 - DNA, 15 bp, Homo sapiens
aggtttaaaaaattc

SEQ ID NO: 375344 - DNA, 15 bp, Homo sapiens
ggtttaaaaaattct

SEQ ID NO: 375345 - DNA, 15 bp, Homo sapiens
gtttaaaaaattctg

SEQ ID NO: 375346 - DNA, 15 bp, Homo sapiens
tttaaaaaattctgt

SEQ ID NO: 375347 - DNA, 15 bp, Homo sapiens
ttaaaaaattctgta

SEQ ID NO: 375348 - DNA, 15 bp, Homo sapiens
taaaaaattctgtat

SEQ ID NO: 375349 - DNA, 15 bp, Homo sapiens
aaaaaattctgtatc

SEQ ID NO: 375350 - DNA, 15 bp, Homo sapiens
aaaaattctgtatct

SEQ ID NO: 375351 - DNA, 15 bp, Homo sapiens
aaaattctgtatctg

SEQ ID NO: 375352 - DNA, 15 bp, Homo sapiens
aaattctgtatctgt

SEQ ID NO: 375353 - DNA, 15 bp, Homo sapiens
aattctgtatctgtc

SEQ ID NO: 375354 - DNA, 15 bp, Homo sapiens
attctgtatctgtca

SEQ ID NO: 375355 - DNA, 15 bp, Homo sapiens
ttctgtatctgtcaa

SEQ ID NO: 375356 - DNA, 15 bp, Homo sapiens
tctgtatctgtcaaa

SEQ ID NO: 375357 - DNA, 15 bp, Homo sapiens
ctgtatctgtcaaac

SEQ ID NO: 375358 - DNA, 15 bp, Homo sapiens
tgtatctgtcaaaca

SEQ ID NO: 375359 - DNA, 15 bp, Homo sapiens
gtatctgtcaaacaa

SEQ ID NO: 375360 - DNA, 15 bp, Homo sapiens
tatctgtcaaacaac

SEQ ID NO: 375361 - DNA, 15 bp, Homo sapiens
atctgtcaaacaacc

SEQ ID NO: 375362 - DNA, 15 bp, Homo sapiens
tctgtcaaacaacca

SEQ ID NO: 375363 - DNA, 15 bp, Homo sapiens
ctgtcaaacaaccat

SEQ ID NO: 375364 - DNA, 15 bp, Homo sapiens
tgtcaaacaaccatt

SEQ ID NO: 375365 - DNA, 15 bp, Homo sapiens
gtcaaacaaccattc

SEQ ID NO: 375366 - DNA, 15 bp, Homo sapiens
tcaaacaaccattca

SEQ ID NO: 375367 - DNA, 15 bp, Homo sapiens
caaacaaccattcag

SEQ ID NO: 375368 - DNA, 15 bp, Homo sapiens
aaacaaccattcagg

SEQ ID NO: 375369 - DNA, 15 bp, Homo sapiens
aacaaccattcaggg

SEQ ID NO: 375370 - DNA, 15 bp, Homo sapiens
acaaccattcagggc

SEQ ID NO: 375371 - DNA, 15 bp, Homo sapiens
caaccattcagggct

SEQ ID NO: 375372 - DNA, 15 bp, Homo sapiens
aaccattcagggcta

SEQ ID NO: 375373 - DNA, 15 bp, Homo sapiens
accattcagggctaa

SEQ ID NO: 375374 - DNA, 15 bp, Homo sapiens
ccattcagggctaac

SEQ ID NO: 375375 - DNA, 15 bp, Homo sapiens
cattcagggctaact

SEQ ID NO: 375376 - DNA, 15 bp, Homo sapiens
attcagggctaacta

SEQ ID NO: 375377 - DNA, 15 bp, Homo sapiens
ttcagggctaactac

SEQ ID NO: 375378 - DNA, 15 bp, Homo sapiens
tcagggctaactaca

SEQ ID NO: 375379 - DNA, 15 bp, Homo sapiens
cagggctaactacaa

SEQ ID NO: 375380 - DNA, 15 bp, Homo sapiens
agggctaactacaaa

SEQ ID NO: 375381 - DNA, 15 bp, Homo sapiens
gggctaactacaaag

SEQ ID NO: 375382 - DNA, 15 bp, Homo sapiens
ggctaactacaaagc

SEQ ID NO: 375383 - DNA, 15 bp, Homo sapiens
gctaactacaaagca

SEQ ID NO: 375384 - DNA, 15 bp, Homo sapiens
ctaactacaaagcat

SEQ ID NO: 375385 - DNA, 15 bp, Homo sapiens
taactacaaagcata

SEQ ID NO: 375386 - DNA, 15 bp, Homo sapiens
aactacaaagcatag

SEQ ID NO: 375387 - DNA, 15 bp, Homo sapiens
actacaaagcataga

SEQ ID NO: 375388 - DNA, 15 bp, Homo sapiens
ctacaaagcatagag

SEQ ID NO: 375389 - DNA, 15 bp, Homo sapiens
tacaaagcatagagc

SEQ ID NO: 375390 - DNA, 15 bp, Homo sapiens
acaaagcatagagct

SEQ ID NO: 375391 - DNA, 15 bp, Homo sapiens
caaagcatagagctt

SEQ ID NO: 375392 - DNA, 15 bp, Homo sapiens
aaagcatagagcttt

SEQ ID NO: 375393 - DNA, 15 bp, Homo sapiens
aagcatagagctttt

SEQ ID NO: 375394 - DNA, 15 bp, Homo sapiens
agcatagagcttttc

SEQ ID NO: 375395 - DNA, 15 bp, Homo sapiens
gcatagagcttttct

SEQ ID NO: 375396 - DNA, 15 bp, Homo sapiens
catagagcttttctt

SEQ ID NO: 375397 - DNA, 15 bp, Homo sapiens
atagagcttttcttg

SEQ ID NO: 375398 - DNA, 15 bp, Homo sapiens
tagagcttttcttgc

SEQ ID NO: 375399 - DNA, 15 bp, Homo sapiens
agagcttttcttgca

SEQ ID NO: 375400 - DNA, 15 bp, Homo sapiens
gagcttttcttgcat

SEQ ID NO: 375401 - DNA, 15 bp, Homo sapiens
agcttttcttgcatt

SEQ ID NO: 375402 - DNA, 15 bp, Homo sapiens
gcttttcttgcattt

SEQ ID NO: 375403 - DNA, 15 bp, Homo sapiens
cttttcttgcattta

SEQ ID NO: 375404 - DNA, 15 bp, Homo sapiens
ttttcttgcatttat

SEQ ID NO: 375405 - DNA, 15 bp, Homo sapiens
tttcttgcatttata

SEQ ID NO: 375406 - DNA, 15 bp, Homo sapiens
ttcttgcatttatac

SEQ ID NO: 375407 - DNA, 15 bp, Homo sapiens
tcttgcatttatact

SEQ ID NO: 375408 - DNA, 15 bp, Homo sapiens
cttgcatttatactg

SEQ ID NO: 375409 - DNA, 15 bp, Homo sapiens
ttgcatttatactgt

SEQ ID NO: 375410 - DNA, 15 bp, Homo sapiens
tgcatttatactgtt

SEQ ID NO: 375411 - DNA, 15 bp, Homo sapiens
gcatttatactgttg

SEQ ID NO: 375412 - DNA, 15 bp, Homo sapiens
catttatactgttgt

SEQ ID NO: 375413 - DNA, 15 bp, Homo sapiens
atttatactgttgtg

SEQ ID NO: 375414 - DNA, 15 bp, Homo sapiens
tttatactgttgtga

SEQ ID NO: 375415 - DNA, 15 bp, Homo sapiens
ttatactgttgtgat

SEQ ID NO: 375416 - DNA, 15 bp, Homo sapiens
tatactgttgtgata

SEQ ID NO: 375417 - DNA, 15 bp, Homo sapiens
atactgttgtgatat

SEQ ID NO: 375418 - DNA, 15 bp, Homo sapiens
tactgttgtgatatg

SEQ ID NO: 375419 - DNA, 15 bp, Homo sapiens
actgttgtgatatga

SEQ ID NO: 375420 - DNA, 15 bp, Homo sapiens
ctgttgtgatatgat

SEQ ID NO: 375421 - DNA, 15 bp, Homo sapiens
tgttgtgatatgatc

SEQ ID NO: 375422 - DNA, 15 bp, Homo sapiens
gttgtgatatgatca

SEQ ID NO: 375423 - DNA, 15 bp, Homo sapiens
ttgtgatatgatcag

SEQ ID NO: 375424 - DNA, 15 bp, Homo sapiens
tgtgatatgatcagg

SEQ ID NO: 375425 - DNA, 15 bp, Homo sapiens
gtgatatgatcaggt

SEQ ID NO: 375426 - DNA, 15 bp, Homo sapiens
tgatatgatcaggtt

SEQ ID NO: 375427 - DNA, 15 bp, Homo sapiens
gatatgatcaggttt

SEQ ID NO: 375428 - DNA, 15 bp, Homo sapiens
atatgatcaggttta

SEQ ID NO: 375429 - DNA, 15 bp, Homo sapiens
tatgatcaggtttac

SEQ ID NO: 375430 - DNA, 15 bp, Homo sapiens
atgatcaggtttact

SEQ ID NO: 375431 - DNA, 15 bp, Homo sapiens
tgatcaggtttactg

SEQ ID NO: 375432 - DNA, 15 bp, Homo sapiens
gatcaggtttactga

SEQ ID NO: 375433 - DNA, 15 bp, Homo sapiens
atcaggtttactgac

SEQ ID NO: 375434 - DNA, 15 bp, Homo sapiens
tcaggtttactgact

SEQ ID NO: 375435 - DNA, 15 bp, Homo sapiens
caggtttactgactt

SEQ ID NO: 375436 - DNA, 15 bp, Homo sapiens
aggtttactgactta

SEQ ID NO: 375437 - DNA, 15 bp, Homo sapiens
ggtttactgacttaa

SEQ ID NO: 375438 - DNA, 15 bp, Homo sapiens
gtttactgacttaaa

SEQ ID NO: 375439 - DNA, 15 bp, Homo sapiens
tttactgacttaaac

SEQ ID NO: 375440 - DNA, 15 bp, Homo sapiens
ttactgacttaaact

SEQ ID NO: 375441 - DNA, 15 bp, Homo sapiens
tactgacttaaacta

SEQ ID NO: 375442 - DNA, 15 bp, Homo sapiens
actgacttaaactaa

SEQ ID NO: 375443 - DNA, 15 bp, Homo sapiens
ctgacttaaactaaa

SEQ ID NO: 375444 - DNA, 15 bp, Homo sapiens
tgacttaaactaaag

SEQ ID NO: 375445 - DNA, 15 bp, Homo sapiens
gacttaaactaaaga

SEQ ID NO: 375446 - DNA, 15 bp, Homo sapiens
acttaaactaaagac

SEQ ID NO: 375447 - DNA, 15 bp, Homo sapiens
cttaaactaaagacc

SEQ ID NO: 375448 - DNA, 15 bp, Homo sapiens
ttaaactaaagaccc

SEQ ID NO: 375449 - DNA, 15 bp, Homo sapiens
taaactaaagaccca

SEQ ID NO: 375450 - DNA, 15 bp, Homo sapiens
aaactaaagacccag

SEQ ID NO: 375451 - DNA, 15 bp, Homo sapiens
aactaaagacccagt

SEQ ID NO: 375452 - DNA, 15 bp, Homo sapiens
actaaagacccagtg

SEQ ID NO: 375453 - DNA, 15 bp, Homo sapiens
ctaaagacccagtgc

SEQ ID NO: 375454 - DNA, 15 bp, Homo sapiens
taaagacccagtgca

SEQ ID NO: 375455 - DNA, 15 bp, Homo sapiens
aaagacccagtgcat

SEQ ID NO: 375456 - DNA, 15 bp, Homo sapiens
aagacccagtgcatt

SEQ ID NO: 375457 - DNA, 15 bp, Homo sapiens
agacccagtgcattt

SEQ ID NO: 375458 - DNA, 15 bp, Homo sapiens
gacccagtgcatttt

SEQ ID NO: 375459 - DNA, 15 bp, Homo sapiens
acccagtgcattttt

SEQ ID NO: 375460 - DNA, 15 bp, Homo sapiens
cccagtgcattttta

SEQ ID NO: 375461 - DNA, 15 bp, Homo sapiens
ccagtgcatttttaa

SEQ ID NO: 375462 - DNA, 15 bp, Homo sapiens
cagtgcatttttaaa

SEQ ID NO: 375463 - DNA, 15 bp, Homo sapiens
agtgcatttttaaaa

SEQ ID NO: 375464 - DNA, 15 bp, Homo sapiens
gtgcatttttaaaat

SEQ ID NO: 375465 - DNA, 15 bp, Homo sapiens
tgcatttttaaaatc

SEQ ID NO: 375466 - DNA, 15 bp, Homo sapiens
gcatttttaaaatct

SEQ ID NO: 375467 - DNA, 15 bp, Homo sapiens
catttttaaaatcta

SEQ ID NO: 375468 - DNA, 15 bp, Homo sapiens
atttttaaaatctaa

SEQ ID NO: 375469 - DNA, 15 bp, Homo sapiens
tttttaaaatctaaa

SEQ ID NO: 375470 - DNA, 15 bp, Homo sapiens
ttttaaaatctaaaa

SEQ ID NO: 375471 - DNA, 15 bp, Homo sapiens
tttaaaatctaaaac

SEQ ID NO: 375472 - DNA, 15 bp, Homo sapiens
ttaaaatctaaaact

SEQ ID NO: 375473 - DNA, 15 bp, Homo sapiens
taaaatctaaaactg

SEQ ID NO: 375474 - DNA, 15 bp, Homo sapiens
aaaatctaaaactga

SEQ ID NO: 375475 - DNA, 15 bp, Homo sapiens
aaatctaaaactgat

SEQ ID NO: 375476 - DNA, 15 bp, Homo sapiens
aatctaaaactgata

SEQ ID NO: 375477 - DNA, 15 bp, Homo sapiens
atctaaaactgatac

SEQ ID NO: 375478 - DNA, 15 bp, Homo sapiens
tctaaaactgatacc

SEQ ID NO: 375479 - DNA, 15 bp, Homo sapiens
ctaaaactgataccg

SEQ ID NO: 375480 - DNA, 15 bp, Homo sapiens
taaaactgataccgt

SEQ ID NO: 375481 - DNA, 15 bp, Homo sapiens
aaaactgataccgta

SEQ ID NO: 375482 - DNA, 15 bp, Homo sapiens
aaactgataccgtaa

SEQ ID NO: 375483 - DNA, 15 bp, Homo sapiens
aactgataccgtaaa

SEQ ID NO: 375484 - DNA, 15 bp, Homo sapiens
actgataccgtaaag

SEQ ID NO: 375485 - DNA, 15 bp, Homo sapiens
ctgataccgtaaagc

SEQ ID NO: 375486 - DNA, 15 bp, Homo sapiens
tgataccgtaaagct

SEQ ID NO: 375487 - DNA, 15 bp, Homo sapiens
gataccgtaaagcta

SEQ ID NO: 375488 - DNA, 15 bp, Homo sapiens
ataccgtaaagctag

SEQ ID NO: 375489 - DNA, 15 bp, Homo sapiens
taccgtaaagctagg

SEQ ID NO: 375490 - DNA, 15 bp, Homo sapiens
accgtaaagctaggc

SEQ ID NO: 375491 - DNA, 15 bp, Homo sapiens
ccgtaaagctaggca

SEQ ID NO: 375492 - DNA, 15 bp, Homo sapiens
cgtaaagctaggcac

SEQ ID NO: 375493 - DNA, 15 bp, Homo sapiens
gtaaagctaggcaca

SEQ ID NO: 375494 - DNA, 15 bp, Homo sapiens
taaagctaggcacat

SEQ ID NO: 375495 - DNA, 15 bp, Homo sapiens
aaagctaggcacatt

SEQ ID NO: 375496 - DNA, 15 bp, Homo sapiens
aagctaggcacatta

SEQ ID NO: 375497 - DNA, 15 bp, Homo sapiens
agctaggcacattag

SEQ ID NO: 375498 - DNA, 15 bp, Homo sapiens
gctaggcacattagt

SEQ ID NO: 375499 - DNA, 15 bp, Homo sapiens
ctaggcacattagta

SEQ ID NO: 375500 - DNA, 15 bp, Homo sapiens
taggcacattagtat

SEQ ID NO: 375501 - DNA, 15 bp, Homo sapiens
aggcacattagtata

SEQ ID NO: 375502 - DNA, 15 bp, Homo sapiens
ggcacattagtataa

SEQ ID NO: 375503 - DNA, 15 bp, Homo sapiens
gcacattagtataaa

SEQ ID NO: 375504 - DNA, 15 bp, Homo sapiens
cacattagtataaat

SEQ ID NO: 375505 - DNA, 15 bp, Homo sapiens
acattagtataaata

SEQ ID NO: 375506 - DNA, 15 bp, Homo sapiens
cattagtataaatat

SEQ ID NO: 375507 - DNA, 15 bp, Homo sapiens
attagtataaatata

SEQ ID NO: 375508 - DNA, 15 bp, Homo sapiens
ttagtataaatataa

SEQ ID NO: 375509 - DNA, 15 bp, Homo sapiens
tagtataaatataag

SEQ ID NO: 375510 - DNA, 15 bp, Homo sapiens
agtataaatataagc

SEQ ID NO: 375511 - DNA, 15 bp, Homo sapiens
gtataaatataagct

SEQ ID NO: 375512 - DNA, 15 bp, Homo sapiens
tataaatataagctg

SEQ ID NO: 375513 - DNA, 15 bp, Homo sapiens
ataaatataagctgg

SEQ ID NO: 375514 - DNA, 15 bp, Homo sapiens
taaatataagctggc

SEQ ID NO: 375515 - DNA, 15 bp, Homo sapiens
aaatataagctggcg

SEQ ID NO: 375516 - DNA, 15 bp, Homo sapiens
aatataagctggcgt

SEQ ID NO: 375517 - DNA, 15 bp, Homo sapiens
atataagctggcgtt

SEQ ID NO: 375518 - DNA, 15 bp, Homo sapiens
tataagctggcgtta

SEQ ID NO: 375519 - DNA, 15 bp, Homo sapiens
ataagctggcgttag

SEQ ID NO: 375520 - DNA, 15 bp, Homo sapiens
taagctggcgttagc

SEQ ID NO: 375521 - DNA, 15 bp, Homo sapiens
aagctggcgttagca

SEQ ID NO: 375522 - DNA, 15 bp, Homo sapiens
agctggcgttagcat

SEQ ID NO: 375523 - DNA, 15 bp, Homo sapiens
gctggcgttagcatt

SEQ ID NO: 375524 - DNA, 15 bp, Homo sapiens
ctggcgttagcattt

SEQ ID NO: 375525 - DNA, 15 bp, Homo sapiens
tggcgttagcatttc

SEQ ID NO: 375526 - DNA, 15 bp, Homo sapiens
ggcgttagcatttca

SEQ ID NO: 375527 - DNA, 15 bp, Homo sapiens
gcgttagcatttcat

SEQ ID NO: 375528 - DNA, 15 bp, Homo sapiens
cgttagcatttcatg

SEQ ID NO: 375529 - DNA, 15 bp, Homo sapiens
gttagcatttcatgc

SEQ ID NO: 375530 - DNA, 15 bp, Homo sapiens
ttagcatttcatgcc

SEQ ID NO: 375531 - DNA, 15 bp, Homo sapiens
tagcatttcatgcct

SEQ ID NO: 375532 - DNA, 15 bp, Homo sapiens
agcatttcatgcctg

SEQ ID NO: 375533 - DNA, 15 bp, Homo sapiens
gcatttcatgcctgt

SEQ ID NO: 375534 - DNA, 15 bp, Homo sapiens
catttcatgcctgtt

SEQ ID NO: 375535 - DNA, 15 bp, Homo sapiens
atttcatgcctgttg

SEQ ID NO: 375536 - DNA, 15 bp, Homo sapiens
tttcatgcctgttgt

SEQ ID NO: 375537 - DNA, 15 bp, Homo sapiens
ttcatgcctgttgtg

SEQ ID NO: 375538 - DNA, 15 bp, Homo sapiens
tcatgcctgttgtgt

SEQ ID NO: 375539 - DNA, 15 bp, Homo sapiens
catgcctgttgtgtg

SEQ ID NO: 375540 - DNA, 15 bp, Homo sapiens
atgcctgttgtgtga

SEQ ID NO: 375541 - DNA, 15 bp, Homo sapiens
tgcctgttgtgtgat

SEQ ID NO: 375542 - DNA, 15 bp, Homo sapiens
gcctgttgtgtgatg

SEQ ID NO: 375543 - DNA, 15 bp, Homo sapiens
cctgttgtgtgatgt

SEQ ID NO: 375544 - DNA, 15 bp, Homo sapiens
ctgttgtgtgatgta

SEQ ID NO: 375545 - DNA, 15 bp, Homo sapiens
tgttgtgtgatgtag

SEQ ID NO: 375546 - DNA, 15 bp, Homo sapiens
gttgtgtgatgtagg

SEQ ID NO: 375547 - DNA, 15 bp, Homo sapiens
ttgtgtgatgtagga

SEQ ID NO: 375548 - DNA, 15 bp, Homo sapiens
tgtgtgatgtaggat

SEQ ID NO: 375549 - DNA, 15 bp, Homo sapiens
gtgtgatgtaggata

SEQ ID NO: 375550 - DNA, 15 bp, Homo sapiens
tgtgatgtaggataa

SEQ ID NO: 375551 - DNA, 15 bp, Homo sapiens
gtgatgtaggataat

SEQ ID NO: 375552 - DNA, 15 bp, Homo sapiens
tgatgtaggataatc

SEQ ID NO: 375553 - DNA, 15 bp, Homo sapiens
gatgtaggataatct

SEQ ID NO: 375554 - DNA, 15 bp, Homo sapiens
atgtaggataatctc

SEQ ID NO: 375555 - DNA, 15 bp, Homo sapiens
tgtaggataatctcc

SEQ ID NO: 375556 - DNA, 15 bp, Homo sapiens
gtaggataatctcct

SEQ ID NO: 375557 - DNA, 15 bp, Homo sapiens
taggataatctccta

SEQ ID NO: 375558 - DNA, 15 bp, Homo sapiens
aggataatctcctaa

SEQ ID NO: 375559 - DNA, 15 bp, Homo sapiens
ggataatctcctaaa

SEQ ID NO: 375560 - DNA, 15 bp, Homo sapiens
gataatctcctaaag

SEQ ID NO: 375561 - DNA, 15 bp, Homo sapiens
ataatctcctaaagt

SEQ ID NO: 375562 - DNA, 15 bp, Homo sapiens
taatctcctaaagtg

SEQ ID NO: 375563 - DNA, 15 bp, Homo sapiens
aatctcctaaagtgc

SEQ ID NO: 375564 - DNA, 15 bp, Homo sapiens
atctcctaaagtgcc

SEQ ID NO: 375565 - DNA, 15 bp, Homo sapiens
tctcctaaagtgcct

SEQ ID NO: 375566 - DNA, 15 bp, Homo sapiens
ctcctaaagtgcctt

SEQ ID NO: 375567 - DNA, 15 bp, Homo sapiens
tcctaaagtgccttt

SEQ ID NO: 375568 - DNA, 15 bp, Homo sapiens
cctaaagtgcctttg

SEQ ID NO: 375569 - DNA, 15 bp, Homo sapiens
ctaaagtgcctttgc

SEQ ID NO: 375570 - DNA, 15 bp, Homo sapiens
taaagtgcctttgca

SEQ ID NO: 375571 - DNA, 15 bp, Homo sapiens
aaagtgcctttgcaa

SEQ ID NO: 375572 - DNA, 15 bp, Homo sapiens
aagtgcctttgcaac

SEQ ID NO: 375573 - DNA, 15 bp, Homo sapiens
agtgcctttgcaact

SEQ ID NO: 375574 - DNA, 15 bp, Homo sapiens
gtgcctttgcaactt

SEQ ID NO: 375575 - DNA, 15 bp, Homo sapiens
tgcctttgcaactta

SEQ ID NO: 375576 - DNA, 15 bp, Homo sapiens
gcctttgcaacttat

SEQ ID NO: 375577 - DNA, 15 bp, Homo sapiens
cctttgcaacttata

SEQ ID NO: 375578 - DNA, 15 bp, Homo sapiens
ctttgcaacttatat

SEQ ID NO: 375579 - DNA, 15 bp, Homo sapiens
tttgcaacttatatt

SEQ ID NO: 375580 - DNA, 15 bp, Homo sapiens
ttgcaacttatattt

SEQ ID NO: 375581 - DNA, 15 bp, Homo sapiens
tgcaacttatatttc

SEQ ID NO: 375582 - DNA, 15 bp, Homo sapiens
gcaacttatatttca

SEQ ID NO: 375583 - DNA, 15 bp, Homo sapiens
caacttatatttcat

SEQ ID NO: 375584 - DNA, 15 bp, Homo sapiens
aacttatatttcata

SEQ ID NO: 375585 - DNA, 15 bp, Homo sapiens
acttatatttcataa

SEQ ID NO: 375586 - DNA, 15 bp, Homo sapiens
cttatatttcataat

SEQ ID NO: 375587 - DNA, 15 bp, Homo sapiens
ttatatttcataatg

SEQ ID NO: 375588 - DNA, 15 bp, Homo sapiens
tatatttcataatga

SEQ ID NO: 375589 - DNA, 15 bp, Homo sapiens
atatttcataatgag

SEQ ID NO: 375590 - DNA, 15 bp, Homo sapiens
tatttcataatgaga

SEQ ID NO: 375591 - DNA, 15 bp, Homo sapiens
atttcataatgagat

SEQ ID NO: 375592 - DNA, 15 bp, Homo sapiens
tttcataatgagatt

SEQ ID NO: 375593 - DNA, 15 bp, Homo sapiens
ttcataatgagatta

SEQ ID NO: 375594 - DNA, 15 bp, Homo sapiens
tcataatgagattaa

SEQ ID NO: 375595 - DNA, 15 bp, Homo sapiens
cataatgagattaat

SEQ ID NO: 375596 - DNA, 15 bp, Homo sapiens
ataatgagattaatt

SEQ ID NO: 375597 - DNA, 15 bp, Homo sapiens
taatgagattaattt

SEQ ID NO: 375598 - DNA, 15 bp, Homo sapiens
aatgagattaatttc

SEQ ID NO: 375599 - DNA, 15 bp, Homo sapiens
atgagattaatttct

SEQ ID NO: 375600 - DNA, 15 bp, Homo sapiens
tgagattaatttctg

SEQ ID NO: 375601 - DNA, 15 bp, Homo sapiens
gagattaatttctga

SEQ ID NO: 375602 - DNA, 15 bp, Homo sapiens
agattaatttctgat

SEQ ID NO: 375603 - DNA, 15 bp, Homo sapiens
gattaatttctgatt

SEQ ID NO: 375604 - DNA, 15 bp, Homo sapiens
attaatttctgattt

SEQ ID NO: 375605 - DNA, 15 bp, Homo sapiens
ttaatttctgatttt

SEQ ID NO: 375606 - DNA, 15 bp, Homo sapiens
taatttctgatttta

SEQ ID NO: 375607 - DNA, 15 bp, Homo sapiens
aatttctgattttaa

SEQ ID NO: 375608 - DNA, 15 bp, Homo sapiens
atttctgattttaaa

SEQ ID NO: 375609 - DNA, 15 bp, Homo sapiens
tttctgattttaaaa

SEQ ID NO: 375610 - DNA, 15 bp, Homo sapiens
ttctgattttaaaag

SEQ ID NO: 375611 - DNA, 15 bp, Homo sapiens
tctgattttaaaagt

SEQ ID NO: 375612 - DNA, 15 bp, Homo sapiens
ctgattttaaaagtg

SEQ ID NO: 375613 - DNA, 15 bp, Homo sapiens
tgattttaaaagtga

SEQ ID NO: 375614 - DNA, 15 bp, Homo sapiens
gattttaaaagtgaa

SEQ ID NO: 375615 - DNA, 15 bp, Homo sapiens
attttaaaagtgaat

SEQ ID NO: 375616 - DNA, 15 bp, Homo sapiens
ttttaaaagtgaata

SEQ ID NO: 375617 - DNA, 15 bp, Homo sapiens
tttaaaagtgaatat

SEQ ID NO: 375618 - DNA, 15 bp, Homo sapiens
ttaaaagtgaatatc

SEQ ID NO: 375619 - DNA, 15 bp, Homo sapiens
taaaagtgaatatct

SEQ ID NO: 375620 - DNA, 15 bp, Homo sapiens
aaaagtgaatatctc

SEQ ID NO: 375621 - DNA, 15 bp, Homo sapiens
aaagtgaatatctcc

SEQ ID NO: 375622 - DNA, 15 bp, Homo sapiens
aagtgaatatctcct

SEQ ID NO: 375623 - DNA, 15 bp, Homo sapiens
agtgaatatctccta

SEQ ID NO: 375624 - DNA, 15 bp, Homo sapiens
gtgaatatctcctat

SEQ ID NO: 375625 - DNA, 15 bp, Homo sapiens
tgaatatctcctata

SEQ ID NO: 375626 - DNA, 15 bp, Homo sapiens
gaatatctcctataa

SEQ ID NO: 375627 - DNA, 15 bp, Homo sapiens
aatatctcctataac

SEQ ID NO: 375628 - DNA, 15 bp, Homo sapiens
atatctcctataact

SEQ ID NO: 375629 - DNA, 15 bp, Homo sapiens
tatctcctataactt

SEQ ID NO: 375630 - DNA, 15 bp, Homo sapiens
atctcctataacttt

SEQ ID NO: 375631 - DNA, 15 bp, Homo sapiens
tctcctataacttta

SEQ ID NO: 375632 - DNA, 15 bp, Homo sapiens
ctcctataactttac

SEQ ID NO: 375633 - DNA, 15 bp, Homo sapiens
tcctataactttact

SEQ ID NO: 375634 - DNA, 15 bp, Homo sapiens
cctataactttacta

SEQ ID NO: 375635 - DNA, 15 bp, Homo sapiens
ctataactttactac

SEQ ID NO: 375636 - DNA, 15 bp, Homo sapiens
tataactttactact

SEQ ID NO: 375637 - DNA, 15 bp, Homo sapiens
ataactttactacta

SEQ ID NO: 375638 - DNA, 15 bp, Homo sapiens
taactttactactat

SEQ ID NO: 375639 - DNA, 15 bp, Homo sapiens
aactttactactata

SEQ ID NO: 375640 - DNA, 15 bp, Homo sapiens
actttactactatac

SEQ ID NO: 375641 - DNA, 15 bp, Homo sapiens
ctttactactataca

SEQ ID NO: 375642 - DNA, 15 bp, Homo sapiens
tttactactatacat

SEQ ID NO: 375643 - DNA, 15 bp, Homo sapiens
ttactactatacatg

SEQ ID NO: 375644 - DNA, 15 bp, Homo sapiens
tactactatacatgt

SEQ ID NO: 375645 - DNA, 15 bp, Homo sapiens
actactatacatgta

SEQ ID NO: 375646 - DNA, 15 bp, Homo sapiens
ctactatacatgtac

SEQ ID NO: 375647 - DNA, 15 bp, Homo sapiens
tactatacatgtacc

SEQ ID NO: 375648 - DNA, 15 bp, Homo sapiens
actatacatgtacca

SEQ ID NO: 375649 - DNA, 15 bp, Homo sapiens
ctatacatgtaccat

SEQ ID NO: 375650 - DNA, 15 bp, Homo sapiens
tatacatgtaccatc

SEQ ID NO: 375651 - DNA, 15 bp, Homo sapiens
atacatgtaccatct

SEQ ID NO: 375652 - DNA, 15 bp, Homo sapiens
tacatgtaccatcta

SEQ ID NO: 375653 - DNA, 15 bp, Homo sapiens
acatgtaccatctaa

SEQ ID NO: 375654 - DNA, 15 bp, Homo sapiens
catgtaccatctaat

SEQ ID NO: 375655 - DNA, 15 bp, Homo sapiens
atgtaccatctaata

SEQ ID NO: 375656 - DNA, 15 bp, Homo sapiens
tgtaccatctaatat

SEQ ID NO: 375657 - DNA, 15 bp, Homo sapiens
gtaccatctaatatt

SEQ ID NO: 375658 - DNA, 15 bp, Homo sapiens
taccatctaatattc

SEQ ID NO: 375659 - DNA, 15 bp, Homo sapiens
accatctaatattca

SEQ ID NO: 375660 - DNA, 15 bp, Homo sapiens
ccatctaatattcat

SEQ ID NO: 375661 - DNA, 15 bp, Homo sapiens
catctaatattcatt

SEQ ID NO: 375662 - DNA, 15 bp, Homo sapiens
atctaatattcattt

SEQ ID NO: 375663 - DNA, 15 bp, Homo sapiens
tctaatattcatttg

SEQ ID NO: 375664 - DNA, 15 bp, Homo sapiens
ctaatattcatttgt

SEQ ID NO: 375665 - DNA, 15 bp, Homo sapiens
taatattcatttgta

SEQ ID NO: 375666 - DNA, 15 bp, Homo sapiens
aatattcatttgtaa

SEQ ID NO: 375667 - DNA, 15 bp, Homo sapiens
atattcatttgtaaa

SEQ ID NO: 375668 - DNA, 15 bp, Homo sapiens
tattcatttgtaaaa

SEQ ID NO: 375669 - DNA, 15 bp, Homo sapiens
attcatttgtaaaaa

SEQ ID NO: 375670 - DNA, 15 bp, Homo sapiens
ttcatttgtaaaaat

SEQ ID NO: 375671 - DNA, 15 bp, Homo sapiens
tcatttgtaaaaatt

SEQ ID NO: 375672 - DNA, 15 bp, Homo sapiens
catttgtaaaaattc

SEQ ID NO: 375673 - DNA, 15 bp, Homo sapiens
atttgtaaaaattct

SEQ ID NO: 375674 - DNA, 15 bp, Homo sapiens
tttgtaaaaattctt

SEQ ID NO: 375675 - DNA, 15 bp, Homo sapiens
ttgtaaaaattcttt

SEQ ID NO: 375676 - DNA, 15 bp, Homo sapiens
tgtaaaaattctttt

SEQ ID NO: 375677 - DNA, 15 bp, Homo sapiens
gtaaaaattcttttt

SEQ ID NO: 375678 - DNA, 15 bp, Homo sapiens
taaaaattctttttc

SEQ ID NO: 375679 - DNA, 15 bp, Homo sapiens
aaaaattctttttcc

SEQ ID NO: 375680 - DNA, 15 bp, Homo sapiens
aaaattctttttccc

SEQ ID NO: 375681 - DNA, 15 bp, Homo sapiens
aaattctttttccct

SEQ ID NO: 375682 - DNA, 15 bp, Homo sapiens
aattctttttcccta

SEQ ID NO: 375683 - DNA, 15 bp, Homo sapiens
attctttttccctat

SEQ ID NO: 375684 - DNA, 15 bp, Homo sapiens
ttctttttccctatt

SEQ ID NO: 375685 - DNA, 15 bp, Homo sapiens
tctttttccctattt

SEQ ID NO: 375686 - DNA, 15 bp, Homo sapiens
ctttttccctattta

SEQ ID NO: 375687 - DNA, 15 bp, Homo sapiens
tttttccctatttag

SEQ ID NO: 375688 - DNA, 15 bp, Homo sapiens
ttttccctatttagt

SEQ ID NO: 375689 - DNA, 15 bp, Homo sapiens
tttccctatttagtg

SEQ ID NO: 375690 - DNA, 15 bp, Homo sapiens
ttccctatttagtgt

SEQ ID NO: 375691 - DNA, 15 bp, Homo sapiens
tccctatttagtgtg

SEQ ID NO: 375692 - DNA, 15 bp, Homo sapiens
ccctatttagtgtgt

SEQ ID NO: 375693 - DNA, 15 bp, Homo sapiens
cctatttagtgtgtg

SEQ ID NO: 375694 - DNA, 15 bp, Homo sapiens
ctatttagtgtgtgc

SEQ ID NO: 375695 - DNA, 15 bp, Homo sapiens
tatttagtgtgtgct

SEQ ID NO: 375696 - DNA, 15 bp, Homo sapiens
atttagtgtgtgcta

SEQ ID NO: 375697 - DNA, 15 bp, Homo sapiens
tttagtgtgtgctaa

SEQ ID NO: 375698 - DNA, 15 bp, Homo sapiens
ttagtgtgtgctaag

SEQ ID NO: 375699 - DNA, 15 bp, Homo sapiens
tagtgtgtgctaagt

SEQ ID NO: 375700 - DNA, 15 bp, Homo sapiens
agtgtgtgctaagtt

SEQ ID NO: 375701 - DNA, 15 bp, Homo sapiens
gtgtgtgctaagttc

SEQ ID NO: 375702 - DNA, 15 bp, Homo sapiens
tgtgtgctaagttct

SEQ ID NO: 375703 - DNA, 15 bp, Homo sapiens
gtgtgctaagttctg

SEQ ID NO: 375704 - DNA, 15 bp, Homo sapiens
tgtgctaagttctgg

SEQ ID NO: 375705 - DNA, 15 bp, Homo sapiens
gtgctaagttctggg

SEQ ID NO: 375706 - DNA, 15 bp, Homo sapiens
tgctaagttctgggc

SEQ ID NO: 375707 - DNA, 15 bp, Homo sapiens
gctaagttctgggct

SEQ ID NO: 375708 - DNA, 15 bp, Homo sapiens
ctaagttctgggctg

SEQ ID NO: 375709 - DNA, 15 bp, Homo sapiens
taagttctgggctgt

SEQ ID NO: 375710 - DNA, 15 bp, Homo sapiens
aagttctgggctgtg

SEQ ID NO: 375711 - DNA, 15 bp, Homo sapiens
agttctgggctgtga

SEQ ID NO: 375712 - DNA, 15 bp, Homo sapiens
gttctgggctgtgag

SEQ ID NO: 375713 - DNA, 15 bp, Homo sapiens
ttctgggctgtgagt

SEQ ID NO: 375714 - DNA, 15 bp, Homo sapiens
tctgggctgtgagtg

SEQ ID NO: 375715 - DNA, 15 bp, Homo sapiens
ctgggctgtgagtgg

SEQ ID NO: 375716 - DNA, 15 bp, Homo sapiens
tgggctgtgagtggt

SEQ ID NO: 375717 - DNA, 15 bp, Homo sapiens
gggctgtgagtggta

SEQ ID NO: 375718 - DNA, 15 bp, Homo sapiens
ggctgtgagtggtac

SEQ ID NO: 375719 - DNA, 15 bp, Homo sapiens
gctgtgagtggtaca

SEQ ID NO: 375720 - DNA, 15 bp, Homo sapiens
ctgtgagtggtacaa

SEQ ID NO: 375721 - DNA, 15 bp, Homo sapiens
tgtgagtggtacaag

SEQ ID NO: 375722 - DNA, 15 bp, Homo sapiens
gtgagtggtacaagg

SEQ ID NO: 375723 - DNA, 15 bp, Homo sapiens
tgagtggtacaagga

SEQ ID NO: 375724 - DNA, 15 bp, Homo sapiens
gagtggtacaaggat

SEQ ID NO: 375725 - DNA, 15 bp, Homo sapiens
agtggtacaaggata

SEQ ID NO: 375726 - DNA, 15 bp, Homo sapiens
gtggtacaaggatac

SEQ ID NO: 375727 - DNA, 15 bp, Homo sapiens
tggtacaaggatact

SEQ ID NO: 375728 - DNA, 15 bp, Homo sapiens
ggtacaaggatactg

SEQ ID NO: 375729 - DNA, 15 bp, Homo sapiens
gtacaaggatactga

SEQ ID NO: 375730 - DNA, 15 bp, Homo sapiens
tacaaggatactgac

SEQ ID NO: 375731 - DNA, 15 bp, Homo sapiens
acaaggatactgaca

SEQ ID NO: 375732 - DNA, 15 bp, Homo sapiens
caaggatactgacaa

SEQ ID NO: 375733 - DNA, 15 bp, Homo sapiens
aaggatactgacaag

SEQ ID NO: 375734 - DNA, 15 bp, Homo sapiens
aggatactgacaaga

SEQ ID NO: 375735 - DNA, 15 bp, Homo sapiens
ggatactgacaagaa

SEQ ID NO: 375736 - DNA, 15 bp, Homo sapiens
gatactgacaagaat

SEQ ID NO: 375737 - DNA, 15 bp, Homo sapiens
atactgacaagaata

SEQ ID NO: 375738 - DNA, 15 bp, Homo sapiens
tactgacaagaatat

SEQ ID NO: 375739 - DNA, 15 bp, Homo sapiens
actgacaagaatatt

SEQ ID NO: 375740 - DNA, 15 bp, Homo sapiens
ctgacaagaatattc

SEQ ID NO: 375741 - DNA, 15 bp, Homo sapiens
tgacaagaatattct

SEQ ID NO: 375742 - DNA, 15 bp, Homo sapiens
gacaagaatattcta

SEQ ID NO: 375743 - DNA, 15 bp, Homo sapiens
acaagaatattctag

SEQ ID NO: 375744 - DNA, 15 bp, Homo sapiens
caagaatattctagg

SEQ ID NO: 375745 - DNA, 15 bp, Homo sapiens
aagaatattctaggt

SEQ ID NO: 375746 - DNA, 15 bp, Homo sapiens
agaatattctaggta

SEQ ID NO: 375747 - DNA, 15 bp, Homo sapiens
gaatattctaggtag

SEQ ID NO: 375748 - DNA, 15 bp, Homo sapiens
aatattctaggtaga

SEQ ID NO: 375749 - DNA, 15 bp, Homo sapiens
atattctaggtagaa

SEQ ID NO: 375750 - DNA, 15 bp, Homo sapiens
tattctaggtagaaa

SEQ ID NO: 375751 - DNA, 15 bp, Homo sapiens
attctaggtagaaat

SEQ ID NO: 375752 - DNA, 15 bp, Homo sapiens
ttctaggtagaaatt

SEQ ID NO: 375753 - DNA, 15 bp, Homo sapiens
tctaggtagaaattg

SEQ ID NO: 375754 - DNA, 15 bp, Homo sapiens
ctaggtagaaattgg

SEQ ID NO: 375755 - DNA, 15 bp, Homo sapiens
taggtagaaattggg

SEQ ID NO: 375756 - DNA, 15 bp, Homo sapiens
aggtagaaattggga

SEQ ID NO: 375757 - DNA, 15 bp, Homo sapiens
ggtagaaattgggaa

SEQ ID NO: 375758 - DNA, 15 bp, Homo sapiens
gtagaaattgggaaa

SEQ ID NO: 375759 - DNA, 15 bp, Homo sapiens
tagaaattgggaaac

SEQ ID NO: 375760 - DNA, 15 bp, Homo sapiens
agaaattgggaaact

SEQ ID NO: 375761 - DNA, 15 bp, Homo sapiens
gaaattgggaaacta

SEQ ID NO: 375762 - DNA, 15 bp, Homo sapiens
aaattgggaaactac

SEQ ID NO: 375763 - DNA, 15 bp, Homo sapiens
aattgggaaactaca

SEQ ID NO: 375764 - DNA, 15 bp, Homo sapiens
attgggaaactacaa

SEQ ID NO: 375765 - DNA, 15 bp, Homo sapiens
ttgggaaactacaat

SEQ ID NO: 375766 - DNA, 15 bp, Homo sapiens
tgggaaactacaatg

SEQ ID NO: 375767 - DNA, 15 bp, Homo sapiens
gggaaactacaatga

SEQ ID NO: 375768 - DNA, 15 bp, Homo sapiens
ggaaactacaatgaa

SEQ ID NO: 375769 - DNA, 15 bp, Homo sapiens
gaaactacaatgaaa

SEQ ID NO: 375770 - DNA, 15 bp, Homo sapiens
aaactacaatgaaat

SEQ ID NO: 375771 - DNA, 15 bp, Homo sapiens
aactacaatgaaata

SEQ ID NO: 375772 - DNA, 15 bp, Homo sapiens
actacaatgaaataa

SEQ ID NO: 375773 - DNA, 15 bp, Homo sapiens
ctacaatgaaataat

SEQ ID NO: 375774 - DNA, 15 bp, Homo sapiens
tacaatgaaataata

SEQ ID NO: 375775 - DNA, 15 bp, Homo sapiens
acaatgaaataataa

SEQ ID NO: 375776 - DNA, 15 bp, Homo sapiens
caatgaaataataat

SEQ ID NO: 375777 - DNA, 15 bp, Homo sapiens
aatgaaataataata

SEQ ID NO: 375778 - DNA, 15 bp, Homo sapiens
atgaaataataataa

SEQ ID NO: 375779 - DNA, 15 bp, Homo sapiens
tgaaataataataac

SEQ ID NO: 375780 - DNA, 15 bp, Homo sapiens
gaaataataataaca

SEQ ID NO: 375781 - DNA, 15 bp, Homo sapiens
aaataataataacag

SEQ ID NO: 375782 - DNA, 15 bp, Homo sapiens
aataataataacagc

SEQ ID NO: 375783 - DNA, 15 bp, Homo sapiens
ataataataacagct

SEQ ID NO: 375784 - DNA, 15 bp, Homo sapiens
taataataacagctc

SEQ ID NO: 375785 - DNA, 15 bp, Homo sapiens
aataataacagctct

SEQ ID NO: 375786 - DNA, 15 bp, Homo sapiens
ataataacagctctt

SEQ ID NO: 375787 - DNA, 15 bp, Homo sapiens
taataacagctcttg

SEQ ID NO: 375788 - DNA, 15 bp, Homo sapiens
aataacagctcttgc

SEQ ID NO: 375789 - DNA, 15 bp, Homo sapiens
ataacagctcttgct

SEQ ID NO: 375790 - DNA, 15 bp, Homo sapiens
taacagctcttgcta

SEQ ID NO: 375791 - DNA, 15 bp, Homo sapiens
aacagctcttgctaa

SEQ ID NO: 375792 - DNA, 15 bp, Homo sapiens
acagctcttgctaaa

SEQ ID NO: 375793 - DNA, 15 bp, Homo sapiens
cagctcttgctaaat

SEQ ID NO: 375794 - DNA, 15 bp, Homo sapiens
agctcttgctaaatt

SEQ ID NO: 375795 - DNA, 15 bp, Homo sapiens
gctcttgctaaattt

SEQ ID NO: 375796 - DNA, 15 bp, Homo sapiens
ctcttgctaaatttt

SEQ ID NO: 375797 - DNA, 15 bp, Homo sapiens
tcttgctaaatttta

SEQ ID NO: 375798 - DNA, 15 bp, Homo sapiens
cttgctaaattttat

SEQ ID NO: 375799 - DNA, 15 bp, Homo sapiens
ttgctaaattttatt

SEQ ID NO: 375800 - DNA, 15 bp, Homo sapiens
tgctaaattttatta

SEQ ID NO: 375801 - DNA, 15 bp, Homo sapiens
gctaaattttattaa

SEQ ID NO: 375802 - DNA, 15 bp, Homo sapiens
ctaaattttattaag

SEQ ID NO: 375803 - DNA, 15 bp, Homo sapiens
taaattttattaagt

SEQ ID NO: 375804 - DNA, 15 bp, Homo sapiens
aaattttattaagtg

SEQ ID NO: 375805 - DNA, 15 bp, Homo sapiens
aattttattaagtgc

SEQ ID NO: 375806 - DNA, 15 bp, Homo sapiens
attttattaagtgct

SEQ ID NO: 375807 - DNA, 15 bp, Homo sapiens
ttttattaagtgctt

SEQ ID NO: 375808 - DNA, 15 bp, Homo sapiens
tttattaagtgcttc

SEQ ID NO: 375809 - DNA, 15 bp, Homo sapiens
ttattaagtgcttca

SEQ ID NO: 375810 - DNA, 15 bp, Homo sapiens
tattaagtgcttcat

SEQ ID NO: 375811 - DNA, 15 bp, Homo sapiens
attaagtgcttcatg

SEQ ID NO: 375812 - DNA, 15 bp, Homo sapiens
ttaagtgcttcatgt

SEQ ID NO: 375813 - DNA, 15 bp, Homo sapiens
taagtgcttcatgtg

SEQ ID NO: 375814 - DNA, 15 bp, Homo sapiens
aagtgcttcatgtgt

SEQ ID NO: 375815 - DNA, 15 bp, Homo sapiens
agtgcttcatgtgtg

SEQ ID NO: 375816 - DNA, 15 bp, Homo sapiens
gtgcttcatgtgtgc

SEQ ID NO: 375817 - DNA, 15 bp, Homo sapiens
tgcttcatgtgtgct

SEQ ID NO: 375818 - DNA, 15 bp, Homo sapiens
gcttcatgtgtgctg

SEQ ID NO: 375819 - DNA, 15 bp, Homo sapiens
cttcatgtgtgctgg

SEQ ID NO: 375820 - DNA, 15 bp, Homo sapiens
ttcatgtgtgctggt

SEQ ID NO: 375821 - DNA, 15 bp, Homo sapiens
tcatgtgtgctggtc

SEQ ID NO: 375822 - DNA, 15 bp, Homo sapiens
catgtgtgctggtca

SEQ ID NO: 375823 - DNA, 15 bp, Homo sapiens
atgtgtgctggtcat

SEQ ID NO: 375824 - DNA, 15 bp, Homo sapiens
tgtgtgctggtcatt

SEQ ID NO: 375825 - DNA, 15 bp, Homo sapiens
gtgtgctggtcattt

SEQ ID NO: 375826 - DNA, 15 bp, Homo sapiens
tgtgctggtcatttt

SEQ ID NO: 375827 - DNA, 15 bp, Homo sapiens
gtgctggtcattttt

SEQ ID NO: 375828 - DNA, 15 bp, Homo sapiens
tgctggtcatttttc

SEQ ID NO: 375829 - DNA, 15 bp, Homo sapiens
gctggtcatttttct

SEQ ID NO: 375830 - DNA, 15 bp, Homo sapiens
ctggtcatttttcta

SEQ ID NO: 375831 - DNA, 15 bp, Homo sapiens
tggtcatttttctaa

SEQ ID NO: 375832 - DNA, 15 bp, Homo sapiens
ggtcatttttctaag

SEQ ID NO: 375833 - DNA, 15 bp, Homo sapiens
gtcatttttctaagt

SEQ ID NO: 375834 - DNA, 15 bp, Homo sapiens
tcatttttctaagta

SEQ ID NO: 375835 - DNA, 15 bp, Homo sapiens
catttttctaagtat

SEQ ID NO: 375836 - DNA, 15 bp, Homo sapiens
atttttctaagtatt

SEQ ID NO: 375837 - DNA, 15 bp, Homo sapiens
tttttctaagtattg

SEQ ID NO: 375838 - DNA, 15 bp, Homo sapiens
ttttctaagtattgt

SEQ ID NO: 375839 - DNA, 15 bp, Homo sapiens
tttctaagtattgta

SEQ ID NO: 375840 - DNA, 15 bp, Homo sapiens
ttctaagtattgtac

SEQ ID NO: 375841 - DNA, 15 bp, Homo sapiens
tctaagtattgtaca

SEQ ID NO: 375842 - DNA, 15 bp, Homo sapiens
ctaagtattgtacac

SEQ ID NO: 375843 - DNA, 15 bp, Homo sapiens
taagtattgtacacg

SEQ ID NO: 375844 - DNA, 15 bp, Homo sapiens
aagtattgtacacgt

SEQ ID NO: 375845 - DNA, 15 bp, Homo sapiens
agtattgtacacgtt

SEQ ID NO: 375846 - DNA, 15 bp, Homo sapiens
gtattgtacacgtta

SEQ ID NO: 375847 - DNA, 15 bp, Homo sapiens
tattgtacacgttat

SEQ ID NO: 375848 - DNA, 15 bp, Homo sapiens
attgtacacgttatc

SEQ ID NO: 375849 - DNA, 15 bp, Homo sapiens
ttgtacacgttatct

SEQ ID NO: 375850 - DNA, 15 bp, Homo sapiens
tgtacacgttatctc

SEQ ID NO: 375851 - DNA, 15 bp, Homo sapiens
gtacacgttatctca

SEQ ID NO: 375852 - DNA, 15 bp, Homo sapiens
tacacgttatctcat

SEQ ID NO: 375853 - DNA, 15 bp, Homo sapiens
acacgttatctcatt

SEQ ID NO: 375854 - DNA, 15 bp, Homo sapiens
cacgttatctcattc

SEQ ID NO: 375855 - DNA, 15 bp, Homo sapiens
acgttatctcattca

SEQ ID NO: 375856 - DNA, 15 bp, Homo sapiens
cgttatctcattcaa

SEQ ID NO: 375857 - DNA, 15 bp, Homo sapiens
gttatctcattcaat

SEQ ID NO: 375858 - DNA, 15 bp, Homo sapiens
ttatctcattcaatt

SEQ ID NO: 375859 - DNA, 15 bp, Homo sapiens
tatctcattcaattc

SEQ ID NO: 375860 - DNA, 15 bp, Homo sapiens
atctcattcaattct

SEQ ID NO: 375861 - DNA, 15 bp, Homo sapiens
tctcattcaattctt

SEQ ID NO: 375862 - DNA, 15 bp, Homo sapiens
ctcattcaattcttt

SEQ ID NO: 375863 - DNA, 15 bp, Homo sapiens
tcattcaattcttta

SEQ ID NO: 375864 - DNA, 15 bp, Homo sapiens
cattcaattctttaa

SEQ ID NO: 375865 - DNA, 15 bp, Homo sapiens
attcaattctttaat

SEQ ID NO: 375866 - DNA, 15 bp, Homo sapiens
ttcaattctttaata

SEQ ID NO: 375867 - DNA, 15 bp, Homo sapiens
tcaattctttaatag

SEQ ID NO: 375868 - DNA, 15 bp, Homo sapiens
caattctttaatagt

SEQ ID NO: 375869 - DNA, 15 bp, Homo sapiens
aattctttaatagtc

SEQ ID NO: 375870 - DNA, 15 bp, Homo sapiens
attctttaatagtct

SEQ ID NO: 375871 - DNA, 15 bp, Homo sapiens
ttctttaatagtctt

SEQ ID NO: 375872 - DNA, 15 bp, Homo sapiens
tctttaatagtcttg

SEQ ID NO: 375873 - DNA, 15 bp, Homo sapiens
ctttaatagtcttgt

SEQ ID NO: 375874 - DNA, 15 bp, Homo sapiens
tttaatagtcttgtg

SEQ ID NO: 375875 - DNA, 15 bp, Homo sapiens
ttaatagtcttgtga

SEQ ID NO: 375876 - DNA, 15 bp, Homo sapiens
taatagtcttgtgag

SEQ ID NO: 375877 - DNA, 15 bp, Homo sapiens
aatagtcttgtgaga

SEQ ID NO: 375878 - DNA, 15 bp, Homo sapiens
atagtcttgtgagat

SEQ ID NO: 375879 - DNA, 15 bp, Homo sapiens
tagtcttgtgagata

SEQ ID NO: 375880 - DNA, 15 bp, Homo sapiens
agtcttgtgagatag

SEQ ID NO: 375881 - DNA, 15 bp, Homo sapiens
gtcttgtgagatagg

SEQ ID NO: 375882 - DNA, 15 bp, Homo sapiens
tcttgtgagataggt

SEQ ID NO: 375883 - DNA, 15 bp, Homo sapiens
cttgtgagataggta

SEQ ID NO: 375884 - DNA, 15 bp, Homo sapiens
ttgtgagataggtac

SEQ ID NO: 375885 - DNA, 15 bp, Homo sapiens
tgtgagataggtact

SEQ ID NO: 375886 - DNA, 15 bp, Homo sapiens
gtgagataggtactg

SEQ ID NO: 375887 - DNA, 15 bp, Homo sapiens
tgagataggtactgt

SEQ ID NO: 375888 - DNA, 15 bp, Homo sapiens
gagataggtactgtt

SEQ ID NO: 375889 - DNA, 15 bp, Homo sapiens
agataggtactgttt

SEQ ID NO: 375890 - DNA, 15 bp, Homo sapiens
gataggtactgtttt

SEQ ID NO: 375891 - DNA, 15 bp, Homo sapiens
ataggtactgttttt

SEQ ID NO: 375892 - DNA, 15 bp, Homo sapiens
taggtactgttttta

SEQ ID NO: 375893 - DNA, 15 bp, Homo sapiens
aggtactgtttttat

SEQ ID NO: 375894 - DNA, 15 bp, Homo sapiens
ggtactgtttttatc

SEQ ID NO: 375895 - DNA, 15 bp, Homo sapiens
gtactgtttttatcc

SEQ ID NO: 375896 - DNA, 15 bp, Homo sapiens
tactgtttttatccc

SEQ ID NO: 375897 - DNA, 15 bp, Homo sapiens
actgtttttatcccc

SEQ ID NO: 375898 - DNA, 15 bp, Homo sapiens
ctgtttttatcccca

SEQ ID NO: 375899 - DNA, 15 bp, Homo sapiens
tgtttttatccccac

SEQ ID NO: 375900 - DNA, 15 bp, Homo sapiens
gtttttatccccaca

SEQ ID NO: 375901 - DNA, 15 bp, Homo sapiens
tttttatccccacat

SEQ ID NO: 375902 - DNA, 15 bp, Homo sapiens
ttttatccccacatt

SEQ ID NO: 375903 - DNA, 15 bp, Homo sapiens
tttatccccacatta

SEQ ID NO: 375904 - DNA, 15 bp, Homo sapiens
ttatccccacattac

SEQ ID NO: 375905 - DNA, 15 bp, Homo sapiens
tatccccacattaca

SEQ ID NO: 375906 - DNA, 15 bp, Homo sapiens
atccccacattacaa

SEQ ID NO: 375907 - DNA, 15 bp, Homo sapiens
tccccacattacaaa

SEQ ID NO: 375908 - DNA, 15 bp, Homo sapiens
ccccacattacaaat

SEQ ID NO: 375909 - DNA, 15 bp, Homo sapiens
cccacattacaaata

SEQ ID NO: 375910 - DNA, 15 bp, Homo sapiens
ccacattacaaataa

SEQ ID NO: 375911 - DNA, 15 bp, Homo sapiens
cacattacaaataag

SEQ ID NO: 375912 - DNA, 15 bp, Homo sapiens
acattacaaataagt

SEQ ID NO: 375913 - DNA, 15 bp, Homo sapiens
cattacaaataagtc

SEQ ID NO: 375914 - DNA, 15 bp, Homo sapiens
attacaaataagtcc

SEQ ID NO: 375915 - DNA, 15 bp, Homo sapiens
ttacaaataagtcca

SEQ ID NO: 375916 - DNA, 15 bp, Homo sapiens
tacaaataagtccac

SEQ ID NO: 375917 - DNA, 15 bp, Homo sapiens
acaaataagtccaca

SEQ ID NO: 375918 - DNA, 15 bp, Homo sapiens
caaataagtccacac

SEQ ID NO: 375919 - DNA, 15 bp, Homo sapiens
aaataagtccacacc

SEQ ID NO: 375920 - DNA, 15 bp, Homo sapiens
aataagtccacaccg

SEQ ID NO: 375921 - DNA, 15 bp, Homo sapiens
ataagtccacaccga

SEQ ID NO: 375922 - DNA, 15 bp, Homo sapiens
taagtccacaccgag

SEQ ID NO: 375923 - DNA, 15 bp, Homo sapiens
aagtccacaccgagg

SEQ ID NO: 375924 - DNA, 15 bp, Homo sapiens
agtccacaccgaggc

SEQ ID NO: 375925 - DNA, 15 bp, Homo sapiens
gtccacaccgaggca

SEQ ID NO: 375926 - DNA, 15 bp, Homo sapiens
tccacaccgaggcag

SEQ ID NO: 375927 - DNA, 15 bp, Homo sapiens
ccacaccgaggcaga

SEQ ID NO: 375928 - DNA, 15 bp, Homo sapiens
cacaccgaggcagag

SEQ ID NO: 375929 - DNA, 15 bp, Homo sapiens
acaccgaggcagagg

SEQ ID NO: 375930 - DNA, 15 bp, Homo sapiens
caccgaggcagaggc

SEQ ID NO: 375931 - DNA, 15 bp, Homo sapiens
accgaggcagaggca

SEQ ID NO: 375932 - DNA, 15 bp, Homo sapiens
ccgaggcagaggcac

SEQ ID NO: 375933 - DNA, 15 bp, Homo sapiens
cgaggcagaggcact

SEQ ID NO: 375934 - DNA, 15 bp, Homo sapiens
gaggcagaggcactg

SEQ ID NO: 375935 - DNA, 15 bp, Homo sapiens
aggcagaggcactga

SEQ ID NO: 375936 - DNA, 15 bp, Homo sapiens
ggcagaggcactgag

SEQ ID NO: 375937 - DNA, 15 bp, Homo sapiens
gcagaggcactgagt

SEQ ID NO: 375938 - DNA, 15 bp, Homo sapiens
cagaggcactgagtg

SEQ ID NO: 375939 - DNA, 15 bp, Homo sapiens
agaggcactgagtgc

SEQ ID NO: 375940 - DNA, 15 bp, Homo sapiens
gaggcactgagtgca

SEQ ID NO: 375941 - DNA, 15 bp, Homo sapiens
aggcactgagtgcat

SEQ ID NO: 375942 - DNA, 15 bp, Homo sapiens
ggcactgagtgcata

SEQ ID NO: 375943 - DNA, 15 bp, Homo sapiens
gcactgagtgcatat

SEQ ID NO: 375944 - DNA, 15 bp, Homo sapiens
cactgagtgcatatg

SEQ ID NO: 375945 - DNA, 15 bp, Homo sapiens
actgagtgcatatga

SEQ ID NO: 375946 - DNA, 15 bp, Homo sapiens
ctgagtgcatatgag

SEQ ID NO: 375947 - DNA, 15 bp, Homo sapiens
tgagtgcatatgagt

SEQ ID NO: 375948 - DNA, 15 bp, Homo sapiens
gagtgcatatgagtt

SEQ ID NO: 375949 - DNA, 15 bp, Homo sapiens
agtgcatatgagttg

SEQ ID NO: 375950 - DNA, 15 bp, Homo sapiens
gtgcatatgagttga

SEQ ID NO: 375951 - DNA, 15 bp, Homo sapiens
tgcatatgagttgac

SEQ ID NO: 375952 - DNA, 15 bp, Homo sapiens
gcatatgagttgaca

SEQ ID NO: 375953 - DNA, 15 bp, Homo sapiens
catatgagttgacaa

SEQ ID NO: 375954 - DNA, 15 bp, Homo sapiens
atatgagttgacaaa

SEQ ID NO: 375955 - DNA, 15 bp, Homo sapiens
tatgagttgacaaat

SEQ ID NO: 375956 - DNA, 15 bp, Homo sapiens
atgagttgacaaatt

SEQ ID NO: 375957 - DNA, 15 bp, Homo sapiens
tgagttgacaaatta

SEQ ID NO: 375958 - DNA, 15 bp, Homo sapiens
gagttgacaaattac

SEQ ID NO: 375959 - DNA, 15 bp, Homo sapiens
agttgacaaattact

SEQ ID NO: 375960 - DNA, 15 bp, Homo sapiens
gttgacaaattactg

SEQ ID NO: 375961 - DNA, 15 bp, Homo sapiens
ttgacaaattactgt

SEQ ID NO: 375962 - DNA, 15 bp, Homo sapiens
tgacaaattactgta

SEQ ID NO: 375963 - DNA, 15 bp, Homo sapiens
gacaaattactgtag

SEQ ID NO: 375964 - DNA, 15 bp, Homo sapiens
acaaattactgtagc

SEQ ID NO: 375965 - DNA, 15 bp, Homo sapiens
caaattactgtagca

SEQ ID NO: 375966 - DNA, 15 bp, Homo sapiens
aaattactgtagcaa

SEQ ID NO: 375967 - DNA, 15 bp, Homo sapiens
aattactgtagcaag

SEQ ID NO: 375968 - DNA, 15 bp, Homo sapiens
attactgtagcaagg

SEQ ID NO: 375969 - DNA, 15 bp, Homo sapiens
ttactgtagcaaggc

SEQ ID NO: 375970 - DNA, 15 bp, Homo sapiens
tactgtagcaaggca

SEQ ID NO: 375971 - DNA, 15 bp, Homo sapiens
actgtagcaaggcaa

SEQ ID NO: 375972 - DNA, 15 bp, Homo sapiens
ctgtagcaaggcaag

SEQ ID NO: 375973 - DNA, 15 bp, Homo sapiens
tgtagcaaggcaaga

SEQ ID NO: 375974 - DNA, 15 bp, Homo sapiens
gtagcaaggcaagag

SEQ ID NO: 375975 - DNA, 15 bp, Homo sapiens
tagcaaggcaagagt

SEQ ID NO: 375976 - DNA, 15 bp, Homo sapiens
agcaaggcaagagtc

SEQ ID NO: 375977 - DNA, 15 bp, Homo sapiens
gcaaggcaagagtct

SEQ ID NO: 375978 - DNA, 15 bp, Homo sapiens
caaggcaagagtcta

SEQ ID NO: 375979 - DNA, 15 bp, Homo sapiens
aaggcaagagtctaa

SEQ ID NO: 375980 - DNA, 15 bp, Homo sapiens
aggcaagagtctaat

SEQ ID NO: 375981 - DNA, 15 bp, Homo sapiens
ggcaagagtctaata

SEQ ID NO: 375982 - DNA, 15 bp, Homo sapiens
gcaagagtctaataa

SEQ ID NO: 375983 - DNA, 15 bp, Homo sapiens
caagagtctaataaa

SEQ ID NO: 375984 - DNA, 15 bp, Homo sapiens
aagagtctaataaaa

SEQ ID NO: 375985 - DNA, 15 bp, Homo sapiens
agagtctaataaaag

SEQ ID NO: 375986 - DNA, 15 bp, Homo sapiens
gagtctaataaaagc

SEQ ID NO: 375987 - DNA, 15 bp, Homo sapiens
agtctaataaaagcc

SEQ ID NO: 375988 - DNA, 15 bp, Homo sapiens
gtctaataaaagcct

SEQ ID NO: 375989 - DNA, 15 bp, Homo sapiens
tctaataaaagcctc

SEQ ID NO: 375990 - DNA, 15 bp, Homo sapiens
ctaataaaagcctca

SEQ ID NO: 375991 - DNA, 15 bp, Homo sapiens
taataaaagcctcag

SEQ ID NO: 375992 - DNA, 15 bp, Homo sapiens
aataaaagcctcagg

SEQ ID NO: 375993 - DNA, 15 bp, Homo sapiens
ataaaagcctcagga

SEQ ID NO: 375994 - DNA, 15 bp, Homo sapiens
taaaagcctcaggag

SEQ ID NO: 375995 - DNA, 15 bp, Homo sapiens
aaaagcctcaggaga

SEQ ID NO: 375996 - DNA, 15 bp, Homo sapiens
aaagcctcaggagaa

SEQ ID NO: 375997 - DNA, 15 bp, Homo sapiens
aagcctcaggagaag

SEQ ID NO: 375998 - DNA, 15 bp, Homo sapiens
agcctcaggagaagt

SEQ ID NO: 375999 - DNA, 15 bp, Homo sapiens
gcctcaggagaagta

SEQ ID NO: 376000 - DNA, 15 bp, Homo sapiens
cctcaggagaagtac

SEQ ID NO: 376001 - DNA, 15 bp, Homo sapiens
ctcaggagaagtaca

SEQ ID NO: 376002 - DNA, 15 bp, Homo sapiens
tcaggagaagtacag

SEQ ID NO: 376003 - DNA, 15 bp, Homo sapiens
caggagaagtacagg

SEQ ID NO: 376004 - DNA, 15 bp, Homo sapiens
aggagaagtacaggc

SEQ ID NO: 376005 - DNA, 15 bp, Homo sapiens
ggagaagtacaggca

SEQ ID NO: 376006 - DNA, 15 bp, Homo sapiens
gagaagtacaggcaa

SEQ ID NO: 376007 - DNA, 15 bp, Homo sapiens
agaagtacaggcaac

SEQ ID NO: 376008 - DNA, 15 bp, Homo sapiens
gaagtacaggcaacc

SEQ ID NO: 376009 - DNA, 15 bp, Homo sapiens
aagtacaggcaacct

SEQ ID NO: 376010 - DNA, 15 bp, Homo sapiens
agtacaggcaacctg

SEQ ID NO: 376011 - DNA, 15 bp, Homo sapiens
gtacaggcaacctgt

SEQ ID NO: 376012 - DNA, 15 bp, Homo sapiens
tacaggcaacctgtt

SEQ ID NO: 376013 - DNA, 15 bp, Homo sapiens
acaggcaacctgttg

SEQ ID NO: 376014 - DNA, 15 bp, Homo sapiens
caggcaacctgttgg

SEQ ID NO: 376015 - DNA, 15 bp, Homo sapiens
aggcaacctgttggg

SEQ ID NO: 376016 - DNA, 15 bp, Homo sapiens
ggcaacctgttgggg

SEQ ID NO: 376017 - DNA, 15 bp, Homo sapiens
gcaacctgttggggg

SEQ ID NO: 376018 - DNA, 15 bp, Homo sapiens
caacctgttggggga

SEQ ID NO: 376019 - DNA, 15 bp, Homo sapiens
aacctgttgggggag

SEQ ID NO: 376020 - DNA, 15 bp, Homo sapiens
acctgttgggggagc

SEQ ID NO: 376021 - DNA, 15 bp, Homo sapiens
cctgttgggggagcc

SEQ ID NO: 376022 - DNA, 15 bp, Homo sapiens
ctgttgggggagcca

SEQ ID NO: 376023 - DNA, 15 bp, Homo sapiens
tgttgggggagccag

SEQ ID NO: 376024 - DNA, 15 bp, Homo sapiens
gttgggggagccagg

SEQ ID NO: 376025 - DNA, 15 bp, Homo sapiens
ttgggggagccagga

SEQ ID NO: 376026 - DNA, 15 bp, Homo sapiens
tgggggagccaggat

SEQ ID NO: 376027 - DNA, 15 bp, Homo sapiens
gggggagccaggatg

SEQ ID NO: 376028 - DNA, 15 bp, Homo sapiens
ggggagccaggatga

SEQ ID NO: 376029 - DNA, 15 bp, Homo sapiens
gggagccaggatgag

SEQ ID NO: 376030 - DNA, 15 bp, Homo sapiens
ggagccaggatgagg

SEQ ID NO: 376031 - DNA, 15 bp, Homo sapiens
gagccaggatgagga

SEQ ID NO: 376032 - DNA, 15 bp, Homo sapiens
agccaggatgaggaa

SEQ ID NO: 376033 - DNA, 15 bp, Homo sapiens
gccaggatgaggaag

SEQ ID NO: 376034 - DNA, 15 bp, Homo sapiens
ccaggatgaggaagg

SEQ ID NO: 376035 - DNA, 15 bp, Homo sapiens
caggatgaggaaggg

SEQ ID NO: 376036 - DNA, 15 bp, Homo sapiens
aggatgaggaagggg

SEQ ID NO: 376037 - DNA, 15 bp, Homo sapiens
ggatgaggaagggga

SEQ ID NO: 376038 - DNA, 15 bp, Homo sapiens
gatgaggaaggggat

SEQ ID NO: 376039 - DNA, 15 bp, Homo sapiens
atgaggaaggggatc

SEQ ID NO: 376040 - DNA, 15 bp, Homo sapiens
tgaggaaggggatca

SEQ ID NO: 376041 - DNA, 15 bp, Homo sapiens
gaggaaggggatcac

SEQ ID NO: 376042 - DNA, 15 bp, Homo sapiens
aggaaggggatcact

SEQ ID NO: 376043 - DNA, 15 bp, Homo sapiens
ggaaggggatcactt

SEQ ID NO: 376044 - DNA, 15 bp, Homo sapiens
gaaggggatcacttc

SEQ ID NO: 376045 - DNA, 15 bp, Homo sapiens
aaggggatcacttct

SEQ ID NO: 376046 - DNA, 15 bp, Homo sapiens
aggggatcacttctc

SEQ ID NO: 376047 - DNA, 15 bp, Homo sapiens
ggggatcacttctcc

SEQ ID NO: 376048 - DNA, 15 bp, Homo sapiens
gggatcacttctcca

SEQ ID NO: 376049 - DNA, 15 bp, Homo sapiens
ggatcacttctccag

SEQ ID NO: 376050 - DNA, 15 bp, Homo sapiens
gatcacttctccagt

SEQ ID NO: 376051 - DNA, 15 bp, Homo sapiens
atcacttctccagtg

SEQ ID NO: 376052 - DNA, 15 bp, Homo sapiens
tcacttctccagtga

SEQ ID NO: 376053 - DNA, 15 bp, Homo sapiens
cacttctccagtgat

SEQ ID NO: 376054 - DNA, 15 bp, Homo sapiens
acttctccagtgatg

SEQ ID NO: 376055 - DNA, 15 bp, Homo sapiens
cttctccagtgatgg

SEQ ID NO: 376056 - DNA, 15 bp, Homo sapiens
ttctccagtgatgga

SEQ ID NO: 376057 - DNA, 15 bp, Homo sapiens
tctccagtgatggaa

SEQ ID NO: 376058 - DNA, 15 bp, Homo sapiens
ctccagtgatggaaa

SEQ ID NO: 376059 - DNA, 15 bp, Homo sapiens
tccagtgatggaaag

SEQ ID NO: 376060 - DNA, 15 bp, Homo sapiens
ccagtgatggaaagc

SEQ ID NO: 376061 - DNA, 15 bp, Homo sapiens
cagtgatggaaagca

SEQ ID NO: 376062 - DNA, 15 bp, Homo sapiens
agtgatggaaagcaa

SEQ ID NO: 376063 - DNA, 15 bp, Homo sapiens
gtgatggaaagcaaa

SEQ ID NO: 376064 - DNA, 15 bp, Homo sapiens
tgatggaaagcaaac

SEQ ID NO: 376065 - DNA, 15 bp, Homo sapiens
gatggaaagcaaact

SEQ ID NO: 376066 - DNA, 15 bp, Homo sapiens
atggaaagcaaactg

SEQ ID NO: 376067 - DNA, 15 bp, Homo sapiens
tggaaagcaaactgt

SEQ ID NO: 376068 - DNA, 15 bp, Homo sapiens
ggaaagcaaactgtg

SEQ ID NO: 376069 - DNA, 15 bp, Homo sapiens
gaaagcaaactgtgt

SEQ ID NO: 376070 - DNA, 15 bp, Homo sapiens
aaagcaaactgtgtg

SEQ ID NO: 376071 - DNA, 15 bp, Homo sapiens
aagcaaactgtgtgg

SEQ ID NO: 376072 - DNA, 15 bp, Homo sapiens
agcaaactgtgtggg

SEQ ID NO: 376073 - DNA, 15 bp, Homo sapiens
gcaaactgtgtggga

SEQ ID NO: 376074 - DNA, 15 bp, Homo sapiens
caaactgtgtgggat

SEQ ID NO: 376075 - DNA, 15 bp, Homo sapiens
aaactgtgtgggatt

SEQ ID NO: 376076 - DNA, 15 bp, Homo sapiens
aactgtgtgggattt

SEQ ID NO: 376077 - DNA, 15 bp, Homo sapiens
actgtgtgggatttt

SEQ ID NO: 376078 - DNA, 15 bp, Homo sapiens
ctgtgtgggattttg

SEQ ID NO: 376079 - DNA, 15 bp, Homo sapiens
tgtgtgggattttgg

SEQ ID NO: 376080 - DNA, 15 bp, Homo sapiens
gtgtgggattttggc

SEQ ID NO: 376081 - DNA, 15 bp, Homo sapiens
tgtgggattttggca

SEQ ID NO: 376082 - DNA, 15 bp, Homo sapiens
gtgggattttggcat

SEQ ID NO: 376083 - DNA, 15 bp, Homo sapiens
tgggattttggcatc

SEQ ID NO: 376084 - DNA, 15 bp, Homo sapiens
gggattttggcatct

SEQ ID NO: 376085 - DNA, 15 bp, Homo sapiens
ggattttggcatctg

SEQ ID NO: 376086 - DNA, 15 bp, Homo sapiens
gattttggcatctgg

SEQ ID NO: 376087 - DNA, 15 bp, Homo sapiens
attttggcatctggg

SEQ ID NO: 376088 - DNA, 15 bp, Homo sapiens
ttttggcatctggga

SEQ ID NO: 376089 - DNA, 15 bp, Homo sapiens
tttggcatctgggac

SEQ ID NO: 376090 - DNA, 15 bp, Homo sapiens
ttggcatctgggaca

SEQ ID NO: 376091 - DNA, 15 bp, Homo sapiens
tggcatctgggacaa

SEQ ID NO: 376092 - DNA, 15 bp, Homo sapiens
ggcatctgggacaaa

SEQ ID NO: 376093 - DNA, 15 bp, Homo sapiens
gcatctgggacaaag

SEQ ID NO: 376094 - DNA, 15 bp, Homo sapiens
catctgggacaaagt

SEQ ID NO: 376095 - DNA, 15 bp, Homo sapiens
atctgggacaaagtg

SEQ ID NO: 376096 - DNA, 15 bp, Homo sapiens
tctgggacaaagtgg

SEQ ID NO: 376097 - DNA, 15 bp, Homo sapiens
ctgggacaaagtggt

SEQ ID NO: 376098 - DNA, 15 bp, Homo sapiens
tgggacaaagtggtg

SEQ ID NO: 376099 - DNA, 15 bp, Homo sapiens
gggacaaagtggtga

SEQ ID NO: 376100 - DNA, 15 bp, Homo sapiens
ggacaaagtggtgac

SEQ ID NO: 376101 - DNA, 15 bp, Homo sapiens
gacaaagtggtgaca

SEQ ID NO: 376102 - DNA, 15 bp, Homo sapiens
acaaagtggtgacat

SEQ ID NO: 376103 - DNA, 15 bp, Homo sapiens
caaagtggtgacatt

SEQ ID NO: 376104 - DNA, 15 bp, Homo sapiens
aaagtggtgacattc

SEQ ID NO: 376105 - DNA, 15 bp, Homo sapiens
aagtggtgacattcc

SEQ ID NO: 376106 - DNA, 15 bp, Homo sapiens
agtggtgacattcct

SEQ ID NO: 376107 - DNA, 15 bp, Homo sapiens
gtggtgacattcctg

SEQ ID NO: 376108 - DNA, 15 bp, Homo sapiens
tggtgacattcctgg

SEQ ID NO: 376109 - DNA, 15 bp, Homo sapiens
ggtgacattcctggt

SEQ ID NO: 376110 - DNA, 15 bp, Homo sapiens
gtgacattcctggta

SEQ ID NO: 376111 - DNA, 15 bp, Homo sapiens
tgacattcctggtat

SEQ ID NO: 376112 - DNA, 15 bp, Homo sapiens
gacattcctggtata

SEQ ID NO: 376113 - DNA, 15 bp, Homo sapiens
acattcctggtatag

SEQ ID NO: 376114 - DNA, 15 bp, Homo sapiens
cattcctggtatagg

SEQ ID NO: 376115 - DNA, 15 bp, Homo sapiens
attcctggtataggg

SEQ ID NO: 376116 - DNA, 15 bp, Homo sapiens
ttcctggtataggga

SEQ ID NO: 376117 - DNA, 15 bp, Homo sapiens
tcctggtatagggaa

SEQ ID NO: 376118 - DNA, 15 bp, Homo sapiens
cctggtatagggaac

SEQ ID NO: 376119 - DNA, 15 bp, Homo sapiens
ctggtatagggaaca

SEQ ID NO: 376120 - DNA, 15 bp, Homo sapiens
tggtatagggaacag

SEQ ID NO: 376121 - DNA, 15 bp, Homo sapiens
ggtatagggaacaga

SEQ ID NO: 376122 - DNA, 15 bp, Homo sapiens
gtatagggaacagag

SEQ ID NO: 376123 - DNA, 15 bp, Homo sapiens
tatagggaacagagt

SEQ ID NO: 376124 - DNA, 15 bp, Homo sapiens
atagggaacagagtg

SEQ ID NO: 376125 - DNA, 15 bp, Homo sapiens
tagggaacagagtga

SEQ ID NO: 376126 - DNA, 15 bp, Homo sapiens
agggaacagagtgaa

SEQ ID NO: 376127 - DNA, 15 bp, Homo sapiens
gggaacagagtgaat

SEQ ID NO: 376128 - DNA, 15 bp, Homo sapiens
ggaacagagtgaata

SEQ ID NO: 376129 - DNA, 15 bp, Homo sapiens
gaacagagtgaataa

SEQ ID NO: 376130 - DNA, 15 bp, Homo sapiens
aacagagtgaataaa

SEQ ID NO: 376131 - DNA, 15 bp, Homo sapiens
acagagtgaataaag

SEQ ID NO: 376132 - DNA, 15 bp, Homo sapiens
cagagtgaataaagt

SEQ ID NO: 376133 - DNA, 15 bp, Homo sapiens
agagtgaataaagtc

SEQ ID NO: 376134 - DNA, 15 bp, Homo sapiens
gagtgaataaagtca

SEQ ID NO: 376135 - DNA, 15 bp, Homo sapiens
agtgaataaagtcat

SEQ ID NO: 376136 - DNA, 15 bp, Homo sapiens
gtgaataaagtcatg

SEQ ID NO: 376137 - DNA, 15 bp, Homo sapiens
tgaataaagtcatgt

SEQ ID NO: 376138 - DNA, 15 bp, Homo sapiens
gaataaagtcatgtg

SEQ ID NO: 376139 - DNA, 15 bp, Homo sapiens
aataaagtcatgtgg

SEQ ID NO: 376140 - DNA, 15 bp, Homo sapiens
ataaagtcatgtggt

SEQ ID NO: 376141 - DNA, 15 bp, Homo sapiens
taaagtcatgtggta

SEQ ID NO: 376142 - DNA, 15 bp, Homo sapiens
aaagtcatgtggtac

SEQ ID NO: 376143 - DNA, 15 bp, Homo sapiens
aagtcatgtggtaca

SEQ ID NO: 376144 - DNA, 15 bp, Homo sapiens
agtcatgtggtacag

SEQ ID NO: 376145 - DNA, 15 bp, Homo sapiens
gtcatgtggtacagg

SEQ ID NO: 376146 - DNA, 15 bp, Homo sapiens
tcatgtggtacagga

SEQ ID NO: 376147 - DNA, 15 bp, Homo sapiens
catgtggtacaggag

SEQ ID NO: 376148 - DNA, 15 bp, Homo sapiens
atgtggtacaggagg

SEQ ID NO: 376149 - DNA, 15 bp, Homo sapiens
tgtggtacaggaggc

SEQ ID NO: 376150 - DNA, 15 bp, Homo sapiens
gtggtacaggaggca

SEQ ID NO: 376151 - DNA, 15 bp, Homo sapiens
tggtacaggaggcac

SEQ ID NO: 376152 - DNA, 15 bp, Homo sapiens
ggtacaggaggcaca

SEQ ID NO: 376153 - DNA, 15 bp, Homo sapiens
gtacaggaggcacaa

SEQ ID NO: 376154 - DNA, 15 bp, Homo sapiens
tacaggaggcacaaa

SEQ ID NO: 376155 - DNA, 15 bp, Homo sapiens
acaggaggcacaaag

SEQ ID NO: 376156 - DNA, 15 bp, Homo sapiens
caggaggcacaaagg

SEQ ID NO: 376157 - DNA, 15 bp, Homo sapiens
aggaggcacaaagga

SEQ ID NO: 376158 - DNA, 15 bp, Homo sapiens
ggaggcacaaaggac

SEQ ID NO: 376159 - DNA, 15 bp, Homo sapiens
gaggcacaaaggaca

SEQ ID NO: 376160 - DNA, 15 bp, Homo sapiens
aggcacaaaggacag

SEQ ID NO: 376161 - DNA, 15 bp, Homo sapiens
ggcacaaaggacagt

SEQ ID NO: 376162 - DNA, 15 bp, Homo sapiens
gcacaaaggacagta

SEQ ID NO: 376163 - DNA, 15 bp, Homo sapiens
cacaaaggacagtag

SEQ ID NO: 376164 - DNA, 15 bp, Homo sapiens
acaaaggacagtagg

SEQ ID NO: 376165 - DNA, 15 bp, Homo sapiens
caaaggacagtaggg

SEQ ID NO: 376166 - DNA, 15 bp, Homo sapiens
aaaggacagtagggc

SEQ ID NO: 376167 - DNA, 15 bp, Homo sapiens
aaggacagtagggcc

SEQ ID NO: 376168 - DNA, 15 bp, Homo sapiens
aggacagtagggcca

SEQ ID NO: 376169 - DNA, 15 bp, Homo sapiens
ggacagtagggccaa

SEQ ID NO: 376170 - DNA, 15 bp, Homo sapiens
gacagtagggccaac

SEQ ID NO: 376171 - DNA, 15 bp, Homo sapiens
acagtagggccaaca

SEQ ID NO: 376172 - DNA, 15 bp, Homo sapiens
cagtagggccaacat

SEQ ID NO: 376173 - DNA, 15 bp, Homo sapiens
agtagggccaacatt

SEQ ID NO: 376174 - DNA, 15 bp, Homo sapiens
gtagggccaacattt

SEQ ID NO: 376175 - DNA, 15 bp, Homo sapiens
tagggccaacatttg

SEQ ID NO: 376176 - DNA, 15 bp, Homo sapiens
agggccaacatttgt

SEQ ID NO: 376177 - DNA, 15 bp, Homo sapiens
gggccaacatttgtg

SEQ ID NO: 376178 - DNA, 15 bp, Homo sapiens
ggccaacatttgtgc

SEQ ID NO: 376179 - DNA, 15 bp, Homo sapiens
gccaacatttgtgca

SEQ ID NO: 376180 - DNA, 15 bp, Homo sapiens
ccaacatttgtgcaa

SEQ ID NO: 376181 - DNA, 15 bp, Homo sapiens
caacatttgtgcaat

SEQ ID NO: 376182 - DNA, 15 bp, Homo sapiens
aacatttgtgcaatt

SEQ ID NO: 376183 - DNA, 15 bp, Homo sapiens
acatttgtgcaatta

SEQ ID NO: 376184 - DNA, 15 bp, Homo sapiens
catttgtgcaattaa

SEQ ID NO: 376185 - DNA, 15 bp, Homo sapiens
atttgtgcaattaag

SEQ ID NO: 376186 - DNA, 15 bp, Homo sapiens
tttgtgcaattaaga

SEQ ID NO: 376187 - DNA, 15 bp, Homo sapiens
ttgtgcaattaagaa

SEQ ID NO: 376188 - DNA, 15 bp, Homo sapiens
tgtgcaattaagaaa

SEQ ID NO: 376189 - DNA, 15 bp, Homo sapiens
gtgcaattaagaaat

SEQ ID NO: 376190 - DNA, 15 bp, Homo sapiens
tgcaattaagaaata

SEQ ID NO: 376191 - DNA, 15 bp, Homo sapiens
gcaattaagaaatac

SEQ ID NO: 376192 - DNA, 15 bp, Homo sapiens
caattaagaaataca

SEQ ID NO: 376193 - DNA, 15 bp, Homo sapiens
aattaagaaatacag

SEQ ID NO: 376194 - DNA, 15 bp, Homo sapiens
attaagaaatacagt

SEQ ID NO: 376195 - DNA, 15 bp, Homo sapiens
ttaagaaatacagtg

SEQ ID NO: 376196 - DNA, 15 bp, Homo sapiens
taagaaatacagtgt

SEQ ID NO: 376197 - DNA, 15 bp, Homo sapiens
aagaaatacagtgtg

SEQ ID NO: 376198 - DNA, 15 bp, Homo sapiens
agaaatacagtgtga

SEQ ID NO: 376199 - DNA, 15 bp, Homo sapiens
gaaatacagtgtgaa

SEQ ID NO: 376200 - DNA, 15 bp, Homo sapiens
aaatacagtgtgaaa

SEQ ID NO: 376201 - DNA, 15 bp, Homo sapiens
aatacagtgtgaaac

SEQ ID NO: 376202 - DNA, 15 bp, Homo sapiens
atacagtgtgaaaca

SEQ ID NO: 376203 - DNA, 15 bp, Homo sapiens
tacagtgtgaaacaa

SEQ ID NO: 376204 - DNA, 15 bp, Homo sapiens
acagtgtgaaacaag

SEQ ID NO: 376205 - DNA, 15 bp, Homo sapiens
cagtgtgaaacaagg

SEQ ID NO: 376206 - DNA, 15 bp, Homo sapiens
agtgtgaaacaaggc

SEQ ID NO: 376207 - DNA, 15 bp, Homo sapiens
gtgtgaaacaaggca

SEQ ID NO: 376208 - DNA, 15 bp, Homo sapiens
tgtgaaacaaggcag

SEQ ID NO: 376209 - DNA, 15 bp, Homo sapiens
gtgaaacaaggcagg

SEQ ID NO: 376210 - DNA, 15 bp, Homo sapiens
tgaaacaaggcagga

SEQ ID NO: 376211 - DNA, 15 bp, Homo sapiens
gaaacaaggcaggaa

SEQ ID NO: 376212 - DNA, 15 bp, Homo sapiens
aaacaaggcaggaaa

SEQ ID NO: 376213 - DNA, 15 bp, Homo sapiens
aacaaggcaggaaaa

SEQ ID NO: 376214 - DNA, 15 bp, Homo sapiens
acaaggcaggaaaag

SEQ ID NO: 376215 - DNA, 15 bp, Homo sapiens
caaggcaggaaaagc

SEQ ID NO: 376216 - DNA, 15 bp, Homo sapiens
aaggcaggaaaagca

SEQ ID NO: 376217 - DNA, 15 bp, Homo sapiens
aggcaggaaaagcag

SEQ ID NO: 376218 - DNA, 15 bp, Homo sapiens
ggcaggaaaagcagc

SEQ ID NO: 376219 - DNA, 15 bp, Homo sapiens
gcaggaaaagcagct

SEQ ID NO: 376220 - DNA, 15 bp, Homo sapiens
caggaaaagcagctc

SEQ ID NO: 376221 - DNA, 15 bp, Homo sapiens
aggaaaagcagctca

SEQ ID NO: 376222 - DNA, 15 bp, Homo sapiens
ggaaaagcagctcaa

SEQ ID NO: 376223 - DNA, 15 bp, Homo sapiens
gaaaagcagctcaaa

SEQ ID NO: 376224 - DNA, 15 bp, Homo sapiens
aaaagcagctcaaat

SEQ ID NO: 376225 - DNA, 15 bp, Homo sapiens
aaagcagctcaaatt

SEQ ID NO: 376226 - DNA, 15 bp, Homo sapiens
aagcagctcaaattc

SEQ ID NO: 376227 - DNA, 15 bp, Homo sapiens
agcagctcaaattcc

SEQ ID NO: 376228 - DNA, 15 bp, Homo sapiens
gcagctcaaattccc

SEQ ID NO: 376229 - DNA, 15 bp, Homo sapiens
cagctcaaattccct

SEQ ID NO: 376230 - DNA, 15 bp, Homo sapiens
agctcaaattccctt

SEQ ID NO: 376231 - DNA, 15 bp, Homo sapiens
gctcaaattcccttt

SEQ ID NO: 376232 - DNA, 15 bp, Homo sapiens
ctcaaattccctttg

SEQ ID NO: 376233 - DNA, 15 bp, Homo sapiens
tcaaattccctttgt

SEQ ID NO: 376234 - DNA, 15 bp, Homo sapiens
caaattccctttgtg

SEQ ID NO: 376235 - DNA, 15 bp, Homo sapiens
aaattccctttgtga

SEQ ID NO: 376236 - DNA, 15 bp, Homo sapiens
aattccctttgtgaa

SEQ ID NO: 376237 - DNA, 15 bp, Homo sapiens
attccctttgtgaag

SEQ ID NO: 376238 - DNA, 15 bp, Homo sapiens
ttccctttgtgaagg

SEQ ID NO: 376239 - DNA, 15 bp, Homo sapiens
tccctttgtgaagga

SEQ ID NO: 376240 - DNA, 15 bp, Homo sapiens
ccctttgtgaaggag

SEQ ID NO: 376241 - DNA, 15 bp, Homo sapiens
cctttgtgaaggagc

SEQ ID NO: 376242 - DNA, 15 bp, Homo sapiens
ctttgtgaaggagcc

SEQ ID NO: 376243 - DNA, 15 bp, Homo sapiens
tttgtgaaggagcct

SEQ ID NO: 376244 - DNA, 15 bp, Homo sapiens
ttgtgaaggagcctg

SEQ ID NO: 376245 - DNA, 15 bp, Homo sapiens
tgtgaaggagcctgc

SEQ ID NO: 376246 - DNA, 15 bp, Homo sapiens
gtgaaggagcctgca

SEQ ID NO: 376247 - DNA, 15 bp, Homo sapiens
tgaaggagcctgcag

SEQ ID NO: 376248 - DNA, 15 bp, Homo sapiens
gaaggagcctgcagg

SEQ ID NO: 376249 - DNA, 15 bp, Homo sapiens
aaggagcctgcaggc

SEQ ID NO: 376250 - DNA, 15 bp, Homo sapiens
aggagcctgcaggct

SEQ ID NO: 376251 - DNA, 15 bp, Homo sapiens
ggagcctgcaggctg

SEQ ID NO: 376252 - DNA, 15 bp, Homo sapiens
gagcctgcaggctgt

SEQ ID NO: 376253 - DNA, 15 bp, Homo sapiens
agcctgcaggctgtg

SEQ ID NO: 376254 - DNA, 15 bp, Homo sapiens
gcctgcaggctgtgc

SEQ ID NO: 376255 - DNA, 15 bp, Homo sapiens
cctgcaggctgtgca

SEQ ID NO: 376256 - DNA, 15 bp, Homo sapiens
ctgcaggctgtgcaa

SEQ ID NO: 376257 - DNA, 15 bp, Homo sapiens
tgcaggctgtgcaaa

SEQ ID NO: 376258 - DNA, 15 bp, Homo sapiens
gcaggctgtgcaaag

SEQ ID NO: 376259 - DNA, 15 bp, Homo sapiens
caggctgtgcaaagc

SEQ ID NO: 376260 - DNA, 15 bp, Homo sapiens
aggctgtgcaaagcc

SEQ ID NO: 376261 - DNA, 15 bp, Homo sapiens
ggctgtgcaaagccc

SEQ ID NO: 376262 - DNA, 15 bp, Homo sapiens
gctgtgcaaagccct

SEQ ID NO: 376263 - DNA, 15 bp, Homo sapiens
ctgtgcaaagccctt

SEQ ID NO: 376264 - DNA, 15 bp, Homo sapiens
tgtgcaaagcccttt

SEQ ID NO: 376265 - DNA, 15 bp, Homo sapiens
gtgcaaagccctttg

SEQ ID NO: 376266 - DNA, 15 bp, Homo sapiens
tgcaaagccctttgg

SEQ ID NO: 376267 - DNA, 15 bp, Homo sapiens
gcaaagccctttgga

SEQ ID NO: 376268 - DNA, 15 bp, Homo sapiens
caaagccctttggat

SEQ ID NO: 376269 - DNA, 15 bp, Homo sapiens
aaagccctttggatt

SEQ ID NO: 376270 - DNA, 15 bp, Homo sapiens
aagccctttggattt

SEQ ID NO: 376271 - DNA, 15 bp, Homo sapiens
agccctttggatttt

SEQ ID NO: 376272 - DNA, 15 bp, Homo sapiens
gccctttggattttt

SEQ ID NO: 376273 - DNA, 15 bp, Homo sapiens
ccctttggattttta

SEQ ID NO: 376274 - DNA, 15 bp, Homo sapiens
cctttggatttttag

SEQ ID NO: 376275 - DNA, 15 bp, Homo sapiens
ctttggatttttagt

SEQ ID NO: 376276 - DNA, 15 bp, Homo sapiens
tttggatttttagtc

SEQ ID NO: 376277 - DNA, 15 bp, Homo sapiens
ttggatttttagtct

SEQ ID NO: 376278 - DNA, 15 bp, Homo sapiens
tggatttttagtctg

SEQ ID NO: 376279 - DNA, 15 bp, Homo sapiens
ggatttttagtctgt

SEQ ID NO: 376280 - DNA, 15 bp, Homo sapiens
gatttttagtctgta

SEQ ID NO: 376281 - DNA, 15 bp, Homo sapiens
atttttagtctgtaa

SEQ ID NO: 376282 - DNA, 15 bp, Homo sapiens
tttttagtctgtaag

SEQ ID NO: 376283 - DNA, 15 bp, Homo sapiens
ttttagtctgtaagc

SEQ ID NO: 376284 - DNA, 15 bp, Homo sapiens
tttagtctgtaagca

SEQ ID NO: 376285 - DNA, 15 bp, Homo sapiens
ttagtctgtaagcaa

SEQ ID NO: 376286 - DNA, 15 bp, Homo sapiens
tagtctgtaagcaat

SEQ ID NO: 376287 - DNA, 15 bp, Homo sapiens
agtctgtaagcaatt

SEQ ID NO: 376288 - DNA, 15 bp, Homo sapiens
gtctgtaagcaattg

SEQ ID NO: 376289 - DNA, 15 bp, Homo sapiens
tctgtaagcaattgg

SEQ ID NO: 376290 - DNA, 15 bp, Homo sapiens
ctgtaagcaattggt

SEQ ID NO: 376291 - DNA, 15 bp, Homo sapiens
tgtaagcaattggta

SEQ ID NO: 376292 - DNA, 15 bp, Homo sapiens
gtaagcaattggtaa

SEQ ID NO: 376293 - DNA, 15 bp, Homo sapiens
taagcaattggtaaa

SEQ ID NO: 376294 - DNA, 15 bp, Homo sapiens
aagcaattggtaaac

SEQ ID NO: 376295 - DNA, 15 bp, Homo sapiens
agcaattggtaaaca

SEQ ID NO: 376296 - DNA, 15 bp, Homo sapiens
gcaattggtaaacat

SEQ ID NO: 376297 - DNA, 15 bp, Homo sapiens
caattggtaaacatc

SEQ ID NO: 376298 - DNA, 15 bp, Homo sapiens
aattggtaaacatct

SEQ ID NO: 376299 - DNA, 15 bp, Homo sapiens
attggtaaacatctt

SEQ ID NO: 376300 - DNA, 15 bp, Homo sapiens
ttggtaaacatcttc

SEQ ID NO: 376301 - DNA, 15 bp, Homo sapiens
tggtaaacatcttcc

SEQ ID NO: 376302 - DNA, 15 bp, Homo sapiens
ggtaaacatcttcct

SEQ ID NO: 376303 - DNA, 15 bp, Homo sapiens
gtaaacatcttcctt

SEQ ID NO: 376304 - DNA, 15 bp, Homo sapiens
taaacatcttccttc

SEQ ID NO: 376305 - DNA, 15 bp, Homo sapiens
aaacatcttccttcc

SEQ ID NO: 376306 - DNA, 15 bp, Homo sapiens
aacatcttccttccc

SEQ ID NO: 376307 - DNA, 15 bp, Homo sapiens
acatcttccttccca

SEQ ID NO: 376308 - DNA, 15 bp, Homo sapiens
catcttccttcccat

SEQ ID NO: 376309 - DNA, 15 bp, Homo sapiens
atcttccttcccatt

SEQ ID NO: 376310 - DNA, 15 bp, Homo sapiens
tcttccttcccattt

SEQ ID NO: 376311 - DNA, 15 bp, Homo sapiens
cttccttcccatttc

SEQ ID NO: 376312 - DNA, 15 bp, Homo sapiens
ttccttcccatttct

SEQ ID NO: 376313 - DNA, 15 bp, Homo sapiens
tccttcccatttctt

SEQ ID NO: 376314 - DNA, 15 bp, Homo sapiens
ccttcccatttcttt

SEQ ID NO: 376315 - DNA, 15 bp, Homo sapiens
cttcccatttctttt

SEQ ID NO: 376316 - DNA, 15 bp, Homo sapiens
ttcccatttcttttt

SEQ ID NO: 376317 - DNA, 15 bp, Homo sapiens
tcccatttctttttc

SEQ ID NO: 376318 - DNA, 15 bp, Homo sapiens
cccatttctttttct

SEQ ID NO: 376319 - DNA, 15 bp, Homo sapiens
ccatttctttttctt

SEQ ID NO: 376320 - DNA, 15 bp, Homo sapiens
catttctttttcttt

SEQ ID NO: 376321 - DNA, 15 bp, Homo sapiens
atttctttttctttt

SEQ ID NO: 376322 - DNA, 15 bp, Homo sapiens
tttctttttcttttt

SEQ ID NO: 376323 - DNA, 15 bp, Homo sapiens
ttctttttcttttta

SEQ ID NO: 376324 - DNA, 15 bp, Homo sapiens
tctttttctttttaa

SEQ ID NO: 376325 - DNA, 15 bp, Homo sapiens
ctttttctttttaaa

SEQ ID NO: 376326 - DNA, 15 bp, Homo sapiens
tttctttttaaaatt

SEQ ID NO: 376327 - DNA, 15 bp, Homo sapiens
ttctttttaaaattg

SEQ ID NO: 376328 - DNA, 15 bp, Homo sapiens
tctttttaaaattgt

SEQ ID NO: 376329 - DNA, 15 bp, Homo sapiens
ctttttaaaattgtg

SEQ ID NO: 376330 - DNA, 15 bp, Homo sapiens
tttttaaaattgtgt

SEQ ID NO: 376331 - DNA, 15 bp, Homo sapiens
ttttaaaattgtgtt

SEQ ID NO: 376332 - DNA, 15 bp, Homo sapiens
tttaaaattgtgttt

SEQ ID NO: 376333 - DNA, 15 bp, Homo sapiens
ttaaaattgtgttta

SEQ ID NO: 376334 - DNA, 15 bp, Homo sapiens
taaaattgtgtttat

SEQ ID NO: 376335 - DNA, 15 bp, Homo sapiens
aaaattgtgtttatg

SEQ ID NO: 376336 - DNA, 15 bp, Homo sapiens
aaattgtgtttatga

SEQ ID NO: 376337 - DNA, 15 bp, Homo sapiens
aattgtgtttatgaa

SEQ ID NO: 376338 - DNA, 15 bp, Homo sapiens
attgtgtttatgaac

SEQ ID NO: 376339 - DNA, 15 bp, Homo sapiens
ttgtgtttatgaact

SEQ ID NO: 376340 - DNA, 15 bp, Homo sapiens
tgtgtttatgaactc

SEQ ID NO: 376341 - DNA, 15 bp, Homo sapiens
gtgtttatgaactca

SEQ ID NO: 376342 - DNA, 15 bp, Homo sapiens
tgtttatgaactcat

SEQ ID NO: 376343 - DNA, 15 bp, Homo sapiens
gtttatgaactcatg

SEQ ID NO: 376344 - DNA, 15 bp, Homo sapiens
tttatgaactcatga

SEQ ID NO: 376345 - DNA, 15 bp, Homo sapiens
ttatgaactcatgat

SEQ ID NO: 376346 - DNA, 15 bp, Homo sapiens
tatgaactcatgata

SEQ ID NO: 376347 - DNA, 15 bp, Homo sapiens
atgaactcatgataa

SEQ ID NO: 376348 - DNA, 15 bp, Homo sapiens
tgaactcatgataac

SEQ ID NO: 376349 - DNA, 15 bp, Homo sapiens
gaactcatgataacc

SEQ ID NO: 376350 - DNA, 15 bp, Homo sapiens
aactcatgataaccg

SEQ ID NO: 376351 - DNA, 15 bp, Homo sapiens
actcatgataaccgt

SEQ ID NO: 376352 - DNA, 15 bp, Homo sapiens
ctcatgataaccgtg

SEQ ID NO: 376353 - DNA, 15 bp, Homo sapiens
tcatgataaccgtgc

SEQ ID NO: 376354 - DNA, 15 bp, Homo sapiens
catgataaccgtgct

SEQ ID NO: 376355 - DNA, 15 bp, Homo sapiens
atgataaccgtgctc

SEQ ID NO: 376356 - DNA, 15 bp, Homo sapiens
tgataaccgtgctct

SEQ ID NO: 376357 - DNA, 15 bp, Homo sapiens
gataaccgtgctctg

SEQ ID NO: 376358 - DNA, 15 bp, Homo sapiens
ataaccgtgctctgc

SEQ ID NO: 376359 - DNA, 15 bp, Homo sapiens
taaccgtgctctgct

SEQ ID NO: 376360 - DNA, 15 bp, Homo sapiens
aaccgtgctctgctt

SEQ ID NO: 376361 - DNA, 15 bp, Homo sapiens
accgtgctctgcttt

SEQ ID NO: 376362 - DNA, 15 bp, Homo sapiens
ccgtgctctgcttta

SEQ ID NO: 376363 - DNA, 15 bp, Homo sapiens
cgtgctctgctttag

SEQ ID NO: 376364 - DNA, 15 bp, Homo sapiens
gtgctctgctttagt

SEQ ID NO: 376365 - DNA, 15 bp, Homo sapiens
tgctctgctttagta

SEQ ID NO: 376366 - DNA, 15 bp, Homo sapiens
gctctgctttagtag

SEQ ID NO: 376367 - DNA, 15 bp, Homo sapiens
ctctgctttagtaga

SEQ ID NO: 376368 - DNA, 15 bp, Homo sapiens
tctgctttagtagaa

SEQ ID NO: 376369 - DNA, 15 bp, Homo sapiens
ctgctttagtagaag

SEQ ID NO: 376370 - DNA, 15 bp, Homo sapiens
tgctttagtagaaga

SEQ ID NO: 376371 - DNA, 15 bp, Homo sapiens
gctttagtagaagac

SEQ ID NO: 376372 - DNA, 15 bp, Homo sapiens
ctttagtagaagact

SEQ ID NO: 376373 - DNA, 15 bp, Homo sapiens
tttagtagaagacta

SEQ ID NO: 376374 - DNA, 15 bp, Homo sapiens
ttagtagaagactag

SEQ ID NO: 376375 - DNA, 15 bp, Homo sapiens
tagtagaagactagg

SEQ ID NO: 376376 - DNA, 15 bp, Homo sapiens
agtagaagactagga

SEQ ID NO: 376377 - DNA, 15 bp, Homo sapiens
gtagaagactaggat

SEQ ID NO: 376378 - DNA, 15 bp, Homo sapiens
tagaagactaggatg

SEQ ID NO: 376379 - DNA, 15 bp, Homo sapiens
agaagactaggatgg

SEQ ID NO: 376380 - DNA, 15 bp, Homo sapiens
gaagactaggatgga

SEQ ID NO: 376381 - DNA, 15 bp, Homo sapiens
aagactaggatggat

SEQ ID NO: 376382 - DNA, 15 bp, Homo sapiens
agactaggatggatt

SEQ ID NO: 376383 - DNA, 15 bp, Homo sapiens
gactaggatggattg

SEQ ID NO: 376384 - DNA, 15 bp, Homo sapiens
actaggatggattgg

SEQ ID NO: 376385 - DNA, 15 bp, Homo sapiens
ctaggatggattgga

SEQ ID NO: 376386 - DNA, 15 bp, Homo sapiens
taggatggattggag

SEQ ID NO: 376387 - DNA, 15 bp, Homo sapiens
aggatggattggagg

SEQ ID NO: 376388 - DNA, 15 bp, Homo sapiens
ggatggattggaggc

SEQ ID NO: 376389 - DNA, 15 bp, Homo sapiens
gatggattggaggca

SEQ ID NO: 376390 - DNA, 15 bp, Homo sapiens
atggattggaggcaa

SEQ ID NO: 376391 - DNA, 15 bp, Homo sapiens
tggattggaggcaag

SEQ ID NO: 376392 - DNA, 15 bp, Homo sapiens
ggattggaggcaaga

SEQ ID NO: 376393 - DNA, 15 bp, Homo sapiens
gattggaggcaagaa

SEQ ID NO: 376394 - DNA, 15 bp, Homo sapiens
attggaggcaagaaa

SEQ ID NO: 376395 - DNA, 15 bp, Homo sapiens
ttggaggcaagaaat

SEQ ID NO: 376396 - DNA, 15 bp, Homo sapiens
tggaggcaagaaatg

SEQ ID NO: 376397 - DNA, 15 bp, Homo sapiens
ggaggcaagaaatgc

SEQ ID NO: 376398 - DNA, 15 bp, Homo sapiens
gaggcaagaaatgca

SEQ ID NO: 376399 - DNA, 15 bp, Homo sapiens
aggcaagaaatgcat

SEQ ID NO: 376400 - DNA, 15 bp, Homo sapiens
ggcaagaaatgcata

SEQ ID NO: 376401 - DNA, 15 bp, Homo sapiens
gcaagaaatgcataa

SEQ ID NO: 376402 - DNA, 15 bp, Homo sapiens
caagaaatgcataaa

SEQ ID NO: 376403 - DNA, 15 bp, Homo sapiens
aagaaatgcataaat

SEQ ID NO: 376404 - DNA, 15 bp, Homo sapiens
agaaatgcataaatc

SEQ ID NO: 376405 - DNA, 15 bp, Homo sapiens
gaaatgcataaatca

SEQ ID NO: 376406 - DNA, 15 bp, Homo sapiens
aatgcataaatcaag

SEQ ID NO: 376407 - DNA, 15 bp, Homo sapiens
atgcataaatcaagg

SEQ ID NO: 376408 - DNA, 15 bp, Homo sapiens
tgcataaatcaaggc

SEQ ID NO: 376409 - DNA, 15 bp, Homo sapiens
gcataaatcaaggca

SEQ ID NO: 376410 - DNA, 15 bp, Homo sapiens
cataaatcaaggcaa

SEQ ID NO: 376411 - DNA, 15 bp, Homo sapiens
ataaatcaaggcaaa

SEQ ID NO: 376412 - DNA, 15 bp, Homo sapiens
taaatcaaggcaaag

SEQ ID NO: 376413 - DNA, 15 bp, Homo sapiens
aaatcaaggcaaaga

SEQ ID NO: 376414 - DNA, 15 bp, Homo sapiens
aatcaaggcaaagag

SEQ ID NO: 376415 - DNA, 15 bp, Homo sapiens
atcaaggcaaagagc

SEQ ID NO: 376416 - DNA, 15 bp, Homo sapiens
tcaaggcaaagagcc

SEQ ID NO: 376417 - DNA, 15 bp, Homo sapiens
caaggcaaagagccc

SEQ ID NO: 376418 - DNA, 15 bp, Homo sapiens
aaggcaaagagccct

SEQ ID NO: 376419 - DNA, 15 bp, Homo sapiens
aggcaaagagccctt

SEQ ID NO: 376420 - DNA, 15 bp, Homo sapiens
ggcaaagagcccttt

SEQ ID NO: 376421 - DNA, 15 bp, Homo sapiens
gcaaagagccctttc

SEQ ID NO: 376422 - DNA, 15 bp, Homo sapiens
caaagagccctttct

SEQ ID NO: 376423 - DNA, 15 bp, Homo sapiens
aaagagccctttctg

SEQ ID NO: 376424 - DNA, 15 bp, Homo sapiens
aagagccctttctga

SEQ ID NO: 376425 - DNA, 15 bp, Homo sapiens
agagccctttctgaa

SEQ ID NO: 376426 - DNA, 15 bp, Homo sapiens
gagccctttctgaaa

SEQ ID NO: 376427 - DNA, 15 bp, Homo sapiens
agccctttctgaaat

SEQ ID NO: 376428 - DNA, 15 bp, Homo sapiens
gccctttctgaaatg

SEQ ID NO: 376429 - DNA, 15 bp, Homo sapiens
ccctttctgaaatga

SEQ ID NO: 376430 - DNA, 15 bp, Homo sapiens
cctttctgaaatgac

SEQ ID NO: 376431 - DNA, 15 bp, Homo sapiens
ctttctgaaatgact

SEQ ID NO: 376432 - DNA, 15 bp, Homo sapiens
tttctgaaatgacta

SEQ ID NO: 376433 - DNA, 15 bp, Homo sapiens
ttctgaaatgactaa

SEQ ID NO: 376434 - DNA, 15 bp, Homo sapiens
tctgaaatgactaag

SEQ ID NO: 376435 - DNA, 15 bp, Homo sapiens
ctgaaatgactaaga

SEQ ID NO: 376436 - DNA, 15 bp, Homo sapiens
tgaaatgactaagat

SEQ ID NO: 376437 - DNA, 15 bp, Homo sapiens
gaaatgactaagatg

SEQ ID NO: 376438 - DNA, 15 bp, Homo sapiens
aaatgactaagatga

SEQ ID NO: 376439 - DNA, 15 bp, Homo sapiens
aatgactaagatgat

SEQ ID NO: 376440 - DNA, 15 bp, Homo sapiens
atgactaagatgatg

SEQ ID NO: 376441 - DNA, 15 bp, Homo sapiens
tgactaagatgatgc

SEQ ID NO: 376442 - DNA, 15 bp, Homo sapiens
gactaagatgatgct

SEQ ID NO: 376443 - DNA, 15 bp, Homo sapiens
actaagatgatgctg

SEQ ID NO: 376444 - DNA, 15 bp, Homo sapiens
ctaagatgatgctgt

SEQ ID NO: 376445 - DNA, 15 bp, Homo sapiens
taagatgatgctgtt

SEQ ID NO: 376446 - DNA, 15 bp, Homo sapiens
aagatgatgctgttg

SEQ ID NO: 376447 - DNA, 15 bp, Homo sapiens
agatgatgctgttgc

SEQ ID NO: 376448 - DNA, 15 bp, Homo sapiens
gatgatgctgttgca

SEQ ID NO: 376449 - DNA, 15 bp, Homo sapiens
atgatgctgttgcaa

SEQ ID NO: 376450 - DNA, 15 bp, Homo sapiens
tgatgctgttgcaat

SEQ ID NO: 376451 - DNA, 15 bp, Homo sapiens
gatgctgttgcaatt

SEQ ID NO: 376452 - DNA, 15 bp, Homo sapiens
atgctgttgcaatta

SEQ ID NO: 376453 - DNA, 15 bp, Homo sapiens
tgctgttgcaattag

SEQ ID NO: 376454 - DNA, 15 bp, Homo sapiens
gctgttgcaattagc

SEQ ID NO: 376455 - DNA, 15 bp, Homo sapiens
ctgttgcaattagca

SEQ ID NO: 376456 - DNA, 15 bp, Homo sapiens
tgttgcaattagcag

SEQ ID NO: 376457 - DNA, 15 bp, Homo sapiens
gttgcaattagcaga

SEQ ID NO: 376458 - DNA, 15 bp, Homo sapiens
ttgcaattagcagaa

SEQ ID NO: 376459 - DNA, 15 bp, Homo sapiens
tgcaattagcagaaa

SEQ ID NO: 376460 - DNA, 15 bp, Homo sapiens
gcaattagcagaaat

SEQ ID NO: 376461 - DNA, 15 bp, Homo sapiens
caattagcagaaata

SEQ ID NO: 376462 - DNA, 15 bp, Homo sapiens
aattagcagaaataa

SEQ ID NO: 376463 - DNA, 15 bp, Homo sapiens
attagcagaaataag

SEQ ID NO: 376464 - DNA, 15 bp, Homo sapiens
ttagcagaaataagg

SEQ ID NO: 376465 - DNA, 15 bp, Homo sapiens
tagcagaaataagga

SEQ ID NO: 376466 - DNA, 15 bp, Homo sapiens
agcagaaataaggaa

SEQ ID NO: 376467 - DNA, 15 bp, Homo sapiens
gcagaaataaggaat

SEQ ID NO: 376468 - DNA, 15 bp, Homo sapiens
cagaaataaggaata

SEQ ID NO: 376469 - DNA, 15 bp, Homo sapiens
agaaataaggaatag

SEQ ID NO: 376470 - DNA, 15 bp, Homo sapiens
gaaataaggaataga

SEQ ID NO: 376471 - DNA, 15 bp, Homo sapiens
aaataaggaatagaa

SEQ ID NO: 376472 - DNA, 15 bp, Homo sapiens
aataaggaatagaag

SEQ ID NO: 376473 - DNA, 15 bp, Homo sapiens
ataaggaatagaaga

SEQ ID NO: 376474 - DNA, 15 bp, Homo sapiens
taaggaatagaagaa

SEQ ID NO: 376475 - DNA, 15 bp, Homo sapiens
aaggaatagaagaaa

SEQ ID NO: 376476 - DNA, 15 bp, Homo sapiens
aggaatagaagaaat

SEQ ID NO: 376477 - DNA, 15 bp, Homo sapiens
ggaatagaagaaatt

SEQ ID NO: 376478 - DNA, 15 bp, Homo sapiens
gaatagaagaaattg

SEQ ID NO: 376479 - DNA, 15 bp, Homo sapiens
aatagaagaaattga

SEQ ID NO: 376480 - DNA, 15 bp, Homo sapiens
atagaagaaattgag

SEQ ID NO: 376481 - DNA, 15 bp, Homo sapiens
tagaagaaattgagt

SEQ ID NO: 376482 - DNA, 15 bp, Homo sapiens
agaagaaattgagtg

SEQ ID NO: 376483 - DNA, 15 bp, Homo sapiens
gaagaaattgagtgt

SEQ ID NO: 376484 - DNA, 15 bp, Homo sapiens
aagaaattgagtgtg

SEQ ID NO: 376485 - DNA, 15 bp, Homo sapiens
agaaattgagtgtga

SEQ ID NO: 376486 - DNA, 15 bp, Homo sapiens
gaaattgagtgtgaa

SEQ ID NO: 376487 - DNA, 15 bp, Homo sapiens
aaattgagtgtgaat

SEQ ID NO: 376488 - DNA, 15 bp, Homo sapiens
aattgagtgtgaatg

SEQ ID NO: 376489 - DNA, 15 bp, Homo sapiens
attgagtgtgaatga

SEQ ID NO: 376490 - DNA, 15 bp, Homo sapiens
ttgagtgtgaatgag

SEQ ID NO: 376491 - DNA, 15 bp, Homo sapiens
tgagtgtgaatgagg

SEQ ID NO: 376492 - DNA, 15 bp, Homo sapiens
gagtgtgaatgaggg

SEQ ID NO: 376493 - DNA, 15 bp, Homo sapiens
agtgtgaatgagggt

SEQ ID NO: 376494 - DNA, 15 bp, Homo sapiens
gtgtgaatgagggtt

SEQ ID NO: 376495 - DNA, 15 bp, Homo sapiens
tgtgaatgagggttt

SEQ ID NO: 376496 - DNA, 15 bp, Homo sapiens
gtgaatgagggtttg

SEQ ID NO: 376497 - DNA, 15 bp, Homo sapiens
tgaatgagggtttga

SEQ ID NO: 376498 - DNA, 15 bp, Homo sapiens
gaatgagggtttgag

SEQ ID NO: 376499 - DNA, 15 bp, Homo sapiens
aatgagggtttgagt

SEQ ID NO: 376500 - DNA, 15 bp, Homo sapiens
atgagggtttgagtg

SEQ ID NO: 376501 - DNA, 15 bp, Homo sapiens
tgagggtttgagtga

SEQ ID NO: 376502 - DNA, 15 bp, Homo sapiens
gagggtttgagtgat

SEQ ID NO: 376503 - DNA, 15 bp, Homo sapiens
agggtttgagtgatt

SEQ ID NO: 376504 - DNA, 15 bp, Homo sapiens
gggtttgagtgattt

SEQ ID NO: 376505 - DNA, 15 bp, Homo sapiens
ggtttgagtgattta

SEQ ID NO: 376506 - DNA, 15 bp, Homo sapiens
gtttgagtgatttag

SEQ ID NO: 376507 - DNA, 15 bp, Homo sapiens
tttgagtgatttagt

SEQ ID NO: 376508 - DNA, 15 bp, Homo sapiens
ttgagtgatttagtt

SEQ ID NO: 376509 - DNA, 15 bp, Homo sapiens
tgagtgatttagttt

SEQ ID NO: 376510 - DNA, 15 bp, Homo sapiens
gagtgatttagtttc

SEQ ID NO: 376511 - DNA, 15 bp, Homo sapiens
agtgatttagtttca

SEQ ID NO: 376512 - DNA, 15 bp, Homo sapiens
gtgatttagtttcag

SEQ ID NO: 376513 - DNA, 15 bp, Homo sapiens
tgatttagtttcaga

SEQ ID NO: 376514 - DNA, 15 bp, Homo sapiens
gatttagtttcagac

SEQ ID NO: 376515 - DNA, 15 bp, Homo sapiens
atttagtttcagacg

SEQ ID NO: 376516 - DNA, 15 bp, Homo sapiens
tttagtttcagacgt

SEQ ID NO: 376517 - DNA, 15 bp, Homo sapiens
ttagtttcagacgtg

SEQ ID NO: 376518 - DNA, 15 bp, Homo sapiens
tagtttcagacgtgt

SEQ ID NO: 376519 - DNA, 15 bp, Homo sapiens
agtttcagacgtgtt

SEQ ID NO: 376520 - DNA, 15 bp, Homo sapiens
gtttcagacgtgttg

SEQ ID NO: 376521 - DNA, 15 bp, Homo sapiens
tttcagacgtgttgt

SEQ ID NO: 376522 - DNA, 15 bp, Homo sapiens
ttcagacgtgttgtg

SEQ ID NO: 376523 - DNA, 15 bp, Homo sapiens
tcagacgtgttgtgg

SEQ ID NO: 376524 - DNA, 15 bp, Homo sapiens
cagacgtgttgtggt

SEQ ID NO: 376525 - DNA, 15 bp, Homo sapiens
agacgtgttgtggtg

SEQ ID NO: 376526 - DNA, 15 bp, Homo sapiens
gacgtgttgtggtgg

SEQ ID NO: 376527 - DNA, 15 bp, Homo sapiens
acgtgttgtggtggg

SEQ ID NO: 376528 - DNA, 15 bp, Homo sapiens
cgtgttgtggtgggg

SEQ ID NO: 376529 - DNA, 15 bp, Homo sapiens
gtgttgtggtgggga

SEQ ID NO: 376530 - DNA, 15 bp, Homo sapiens
tgttgtggtggggag

SEQ ID NO: 376531 - DNA, 15 bp, Homo sapiens
gttgtggtggggagt

SEQ ID NO: 376532 - DNA, 15 bp, Homo sapiens
ttgtggtggggagtc

SEQ ID NO: 376533 - DNA, 15 bp, Homo sapiens
tgtggtggggagtcc

SEQ ID NO: 376534 - DNA, 15 bp, Homo sapiens
gtggtggggagtcct

SEQ ID NO: 376535 - DNA, 15 bp, Homo sapiens
tggtggggagtcctt

SEQ ID NO: 376536 - DNA, 15 bp, Homo sapiens
ggtggggagtcctta

SEQ ID NO: 376537 - DNA, 15 bp, Homo sapiens
gtggggagtccttat

SEQ ID NO: 376538 - DNA, 15 bp, Homo sapiens
tggggagtccttatg

SEQ ID NO: 376539 - DNA, 15 bp, Homo sapiens
ggggagtccttatgc

SEQ ID NO: 376540 - DNA, 15 bp, Homo sapiens
gggagtccttatgcc

SEQ ID NO: 376541 - DNA, 15 bp, Homo sapiens
ggagtccttatgcca

SEQ ID NO: 376542 - DNA, 15 bp, Homo sapiens
gagtccttatgccat

SEQ ID NO: 376543 - DNA, 15 bp, Homo sapiens
agtccttatgccatt

SEQ ID NO: 376544 - DNA, 15 bp, Homo sapiens
gtccttatgccattt

SEQ ID NO: 376545 - DNA, 15 bp, Homo sapiens
tccttatgccattta

SEQ ID NO: 376546 - DNA, 15 bp, Homo sapiens
ccttatgccatttag

SEQ ID NO: 376547 - DNA, 15 bp, Homo sapiens
cttatgccatttaga

SEQ ID NO: 376548 - DNA, 15 bp, Homo sapiens
ttatgccatttagaa

SEQ ID NO: 376549 - DNA, 15 bp, Homo sapiens
tatgccatttagaag

SEQ ID NO: 376550 - DNA, 15 bp, Homo sapiens
atgccatttagaagg

SEQ ID NO: 376551 - DNA, 15 bp, Homo sapiens
tgccatttagaagga

SEQ ID NO: 376552 - DNA, 15 bp, Homo sapiens
gccatttagaaggaa

SEQ ID NO: 376553 - DNA, 15 bp, Homo sapiens
ccatttagaaggaag

SEQ ID NO: 376554 - DNA, 15 bp, Homo sapiens
catttagaaggaagt

SEQ ID NO: 376555 - DNA, 15 bp, Homo sapiens
atttagaaggaagtg

SEQ ID NO: 376556 - DNA, 15 bp, Homo sapiens
tttagaaggaagtga

SEQ ID NO: 376557 - DNA, 15 bp, Homo sapiens
ttagaaggaagtgat

SEQ ID NO: 376558 - DNA, 15 bp, Homo sapiens
tagaaggaagtgatc

SEQ ID NO: 376559 - DNA, 15 bp, Homo sapiens
agaaggaagtgatca

SEQ ID NO: 376560 - DNA, 15 bp, Homo sapiens
gaaggaagtgatcag

SEQ ID NO: 376561 - DNA, 15 bp, Homo sapiens
aaggaagtgatcagt

SEQ ID NO: 376562 - DNA, 15 bp, Homo sapiens
aggaagtgatcagta

SEQ ID NO: 376563 - DNA, 15 bp, Homo sapiens
ggaagtgatcagtat

SEQ ID NO: 376564 - DNA, 15 bp, Homo sapiens
gaagtgatcagtatt

SEQ ID NO: 376565 - DNA, 15 bp, Homo sapiens
aagtgatcagtattc

SEQ ID NO: 376566 - DNA, 15 bp, Homo sapiens
agtgatcagtattca

SEQ ID NO: 376567 - DNA, 15 bp, Homo sapiens
gtgatcagtattcat

SEQ ID NO: 376568 - DNA, 15 bp, Homo sapiens
tgatcagtattcatt

SEQ ID NO: 376569 - DNA, 15 bp, Homo sapiens
gatcagtattcatta

SEQ ID NO: 376570 - DNA, 15 bp, Homo sapiens
atcagtattcattac

SEQ ID NO: 376571 - DNA, 15 bp, Homo sapiens
tcagtattcattacc

SEQ ID NO: 376572 - DNA, 15 bp, Homo sapiens
cagtattcattacca

SEQ ID NO: 376573 - DNA, 15 bp, Homo sapiens
agtattcattaccat

SEQ ID NO: 376574 - DNA, 15 bp, Homo sapiens
gtattcattaccatg

SEQ ID NO: 376575 - DNA, 15 bp, Homo sapiens
tattcattaccatgt

SEQ ID NO: 376576 - DNA, 15 bp, Homo sapiens
attcattaccatgtg

SEQ ID NO: 376577 - DNA, 15 bp, Homo sapiens
ttcattaccatgtgc

SEQ ID NO: 376578 - DNA, 15 bp, Homo sapiens
tcattaccatgtgcc

SEQ ID NO: 376579 - DNA, 15 bp, Homo sapiens
cattaccatgtgccc

SEQ ID NO: 376580 - DNA, 15 bp, Homo sapiens
attaccatgtgccct

SEQ ID NO: 376581 - DNA, 15 bp, Homo sapiens
ttaccatgtgccctg

SEQ ID NO: 376582 - DNA, 15 bp, Homo sapiens
taccatgtgccctgg

SEQ ID NO: 376583 - DNA, 15 bp, Homo sapiens
accatgtgccctggg

SEQ ID NO: 376584 - DNA, 15 bp, Homo sapiens
ccatgtgccctggga

SEQ ID NO: 376585 - DNA, 15 bp, Homo sapiens
catgtgccctgggat

SEQ ID NO: 376586 - DNA, 15 bp, Homo sapiens
atgtgccctgggatt

SEQ ID NO: 376587 - DNA, 15 bp, Homo sapiens
tgtgccctgggattt

SEQ ID NO: 376588 - DNA, 15 bp, Homo sapiens
gtgccctgggattta

SEQ ID NO: 376589 - DNA, 15 bp, Homo sapiens
tgccctgggatttag

SEQ ID NO: 376590 - DNA, 15 bp, Homo sapiens
gccctgggatttagg

SEQ ID NO: 376591 - DNA, 15 bp, Homo sapiens
ccctgggatttagga

SEQ ID NO: 376592 - DNA, 15 bp, Homo sapiens
cctgggatttaggat

SEQ ID NO: 376593 - DNA, 15 bp, Homo sapiens
ctgggatttaggatt

SEQ ID NO: 376594 - DNA, 15 bp, Homo sapiens
tgggatttaggattg

SEQ ID NO: 376595 - DNA, 15 bp, Homo sapiens
gggatttaggattga

SEQ ID NO: 376596 - DNA, 15 bp, Homo sapiens
ggatttaggattgaa

SEQ ID NO: 376597 - DNA, 15 bp, Homo sapiens
gatttaggattgaaa

SEQ ID NO: 376598 - DNA, 15 bp, Homo sapiens
atttaggattgaaag

SEQ ID NO: 376599 - DNA, 15 bp, Homo sapiens
tttaggattgaaagt

SEQ ID NO: 376600 - DNA, 15 bp, Homo sapiens
ttaggattgaaagtt

SEQ ID NO: 376601 - DNA, 15 bp, Homo sapiens
taggattgaaagttg

SEQ ID NO: 376602 - DNA, 15 bp, Homo sapiens
aggattgaaagttgt

SEQ ID NO: 376603 - DNA, 15 bp, Homo sapiens
ggattgaaagttgtg

SEQ ID NO: 376604 - DNA, 15 bp, Homo sapiens
gattgaaagttgtga

SEQ ID NO: 376605 - DNA, 15 bp, Homo sapiens
attgaaagttgtgag

SEQ ID NO: 376606 - DNA, 15 bp, Homo sapiens
ttgaaagttgtgagc

SEQ ID NO: 376607 - DNA, 15 bp, Homo sapiens
tgaaagttgtgagca

SEQ ID NO: 376608 - DNA, 15 bp, Homo sapiens
gaaagttgtgagcaa

SEQ ID NO: 376609 - DNA, 15 bp, Homo sapiens
aaagttgtgagcaat

SEQ ID NO: 376610 - DNA, 15 bp, Homo sapiens
aagttgtgagcaatc

SEQ ID NO: 376611 - DNA, 15 bp, Homo sapiens
agttgtgagcaatcc

SEQ ID NO: 376612 - DNA, 15 bp, Homo sapiens
gttgtgagcaatcca

SEQ ID NO: 376613 - DNA, 15 bp, Homo sapiens
ttgtgagcaatccat

SEQ ID NO: 376614 - DNA, 15 bp, Homo sapiens
tgtgagcaatccatt

SEQ ID NO: 376615 - DNA, 15 bp, Homo sapiens
gtgagcaatccattt

SEQ ID NO: 376616 - DNA, 15 bp, Homo sapiens
tgagcaatccattta

SEQ ID NO: 376617 - DNA, 15 bp, Homo sapiens
gagcaatccatttag

SEQ ID NO: 376618 - DNA, 15 bp, Homo sapiens
agcaatccatttaga

SEQ ID NO: 376619 - DNA, 15 bp, Homo sapiens
gcaatccatttagaa

SEQ ID NO: 376620 - DNA, 15 bp, Homo sapiens
caatccatttagaag

SEQ ID NO: 376621 - DNA, 15 bp, Homo sapiens
aatccatttagaagt

SEQ ID NO: 376622 - DNA, 15 bp, Homo sapiens
atccatttagaagta

SEQ ID NO: 376623 - DNA, 15 bp, Homo sapiens
tccatttagaagtaa

SEQ ID NO: 376624 - DNA, 15 bp, Homo sapiens
ccatttagaagtaat

SEQ ID NO: 376625 - DNA, 15 bp, Homo sapiens
catttagaagtaata

SEQ ID NO: 376626 - DNA, 15 bp, Homo sapiens
atttagaagtaatat

SEQ ID NO: 376627 - DNA, 15 bp, Homo sapiens
tttagaagtaatatt

SEQ ID NO: 376628 - DNA, 15 bp, Homo sapiens
ttagaagtaatattt

SEQ ID NO: 376629 - DNA, 15 bp, Homo sapiens
tagaagtaatatttg

SEQ ID NO: 376630 - DNA, 15 bp, Homo sapiens
agaagtaatatttga

SEQ ID NO: 376631 - DNA, 15 bp, Homo sapiens
gaagtaatatttgac

SEQ ID NO: 376632 - DNA, 15 bp, Homo sapiens
aagtaatatttgaca

SEQ ID NO: 376633 - DNA, 15 bp, Homo sapiens
agtaatatttgacac

SEQ ID NO: 376634 - DNA, 15 bp, Homo sapiens
gtaatatttgacacc

SEQ ID NO: 376635 - DNA, 15 bp, Homo sapiens
taatatttgacacca

SEQ ID NO: 376636 - DNA, 15 bp, Homo sapiens
aatatttgacaccaa

SEQ ID NO: 376637 - DNA, 15 bp, Homo sapiens
atatttgacaccaaa

SEQ ID NO: 376638 - DNA, 15 bp, Homo sapiens
tatttgacaccaaag

SEQ ID NO: 376639 - DNA, 15 bp, Homo sapiens
atttgacaccaaagg

SEQ ID NO: 376640 - DNA, 15 bp, Homo sapiens
tttgacaccaaagga

SEQ ID NO: 376641 - DNA, 15 bp, Homo sapiens
ttgacaccaaaggag

SEQ ID NO: 376642 - DNA, 15 bp, Homo sapiens
tgacaccaaaggagt

SEQ ID NO: 376643 - DNA, 15 bp, Homo sapiens
gacaccaaaggagta

SEQ ID NO: 376644 - DNA, 15 bp, Homo sapiens
acaccaaaggagtag

SEQ ID NO: 376645 - DNA, 15 bp, Homo sapiens
caccaaaggagtagc

SEQ ID NO: 376646 - DNA, 15 bp, Homo sapiens
accaaaggagtagct

SEQ ID NO: 376647 - DNA, 15 bp, Homo sapiens
ccaaaggagtagctg

SEQ ID NO: 376648 - DNA, 15 bp, Homo sapiens
caaaggagtagctgg

SEQ ID NO: 376649 - DNA, 15 bp, Homo sapiens
aaaggagtagctgga

SEQ ID NO: 376650 - DNA, 15 bp, Homo sapiens
aaggagtagctggaa

SEQ ID NO: 376651 - DNA, 15 bp, Homo sapiens
aggagtagctggaat

SEQ ID NO: 376652 - DNA, 15 bp, Homo sapiens
ggagtagctggaatc

SEQ ID NO: 376653 - DNA, 15 bp, Homo sapiens
gagtagctggaatct

SEQ ID NO: 376654 - DNA, 15 bp, Homo sapiens
agtagctggaatcta

SEQ ID NO: 376655 - DNA, 15 bp, Homo sapiens
gtagctggaatctac

SEQ ID NO: 376656 - DNA, 15 bp, Homo sapiens
tagctggaatctaca

SEQ ID NO: 376657 - DNA, 15 bp, Homo sapiens
agctggaatctacaa

SEQ ID NO: 376658 - DNA, 15 bp, Homo sapiens
gctggaatctacaaa

SEQ ID NO: 376659 - DNA, 15 bp, Homo sapiens
ctggaatctacaaaa

SEQ ID NO: 376660 - DNA, 15 bp, Homo sapiens
tggaatctacaaaac

SEQ ID NO: 376661 - DNA, 15 bp, Homo sapiens
ggaatctacaaaacg

SEQ ID NO: 376662 - DNA, 15 bp, Homo sapiens
gaatctacaaaacgg

SEQ ID NO: 376663 - DNA, 15 bp, Homo sapiens
aatctacaaaacggg

SEQ ID NO: 376664 - DNA, 15 bp, Homo sapiens
atctacaaaacgggt

SEQ ID NO: 376665 - DNA, 15 bp, Homo sapiens
tctacaaaacgggtg

SEQ ID NO: 376666 - DNA, 15 bp, Homo sapiens
ctacaaaacgggtga

SEQ ID NO: 376667 - DNA, 15 bp, Homo sapiens
tacaaaacgggtgaa

SEQ ID NO: 376668 - DNA, 15 bp, Homo sapiens
acaaaacgggtgaat

SEQ ID NO: 376669 - DNA, 15 bp, Homo sapiens
caaaacgggtgaatt

SEQ ID NO: 376670 - DNA, 15 bp, Homo sapiens
aaaacgggtgaattt

SEQ ID NO: 376671 - DNA, 15 bp, Homo sapiens
aaacgggtgaatttg

SEQ ID NO: 376672 - DNA, 15 bp, Homo sapiens
aacgggtgaatttgt

SEQ ID NO: 376673 - DNA, 15 bp, Homo sapiens
acgggtgaatttgta

SEQ ID NO: 376674 - DNA, 15 bp, Homo sapiens
cgggtgaatttgtaa

SEQ ID NO: 376675 - DNA, 15 bp, Homo sapiens
gggtgaatttgtaaa

SEQ ID NO: 376676 - DNA, 15 bp, Homo sapiens
ggtgaatttgtaaag

SEQ ID NO: 376677 - DNA, 15 bp, Homo sapiens
gtgaatttgtaaaga

SEQ ID NO: 376678 - DNA, 15 bp, Homo sapiens
tgaatttgtaaagag

SEQ ID NO: 376679 - DNA, 15 bp, Homo sapiens
gaatttgtaaagagg

SEQ ID NO: 376680 - DNA, 15 bp, Homo sapiens
aatttgtaaagagga

SEQ ID NO: 376681 - DNA, 15 bp, Homo sapiens
atttgtaaagaggaa

SEQ ID NO: 376682 - DNA, 15 bp, Homo sapiens
tttgtaaagaggaag

SEQ ID NO: 376683 - DNA, 15 bp, Homo sapiens
ttgtaaagaggaagg

SEQ ID NO: 376684 - DNA, 15 bp, Homo sapiens
tgtaaagaggaagga

SEQ ID NO: 376685 - DNA, 15 bp, Homo sapiens
gtaaagaggaaggac

SEQ ID NO: 376686 - DNA, 15 bp, Homo sapiens
taaagaggaaggact

SEQ ID NO: 376687 - DNA, 15 bp, Homo sapiens
aaagaggaaggactg

SEQ ID NO: 376688 - DNA, 15 bp, Homo sapiens
aagaggaaggactgg

SEQ ID NO: 376689 - DNA, 15 bp, Homo sapiens
agaggaaggactggg

SEQ ID NO: 376690 - DNA, 15 bp, Homo sapiens
gaggaaggactggga

SEQ ID NO: 376691 - DNA, 15 bp, Homo sapiens
aggaaggactgggaa

SEQ ID NO: 376692 - DNA, 15 bp, Homo sapiens
ggaaggactgggaaa

SEQ ID NO: 376693 - DNA, 15 bp, Homo sapiens
gaaggactgggaaaa

SEQ ID NO: 376694 - DNA, 15 bp, Homo sapiens
aaggactgggaaaaa

SEQ ID NO: 376695 - DNA, 15 bp, Homo sapiens
aggactgggaaaaag

SEQ ID NO: 376696 - DNA, 15 bp, Homo sapiens
ggactgggaaaaagt

SEQ ID NO: 376697 - DNA, 15 bp, Homo sapiens
gactgggaaaaagtc

SEQ ID NO: 376698 - DNA, 15 bp, Homo sapiens
actgggaaaaagtca

SEQ ID NO: 376699 - DNA, 15 bp, Homo sapiens
ctgggaaaaagtcat

SEQ ID NO: 376700 - DNA, 15 bp, Homo sapiens
tgggaaaaagtcatt

SEQ ID NO: 376701 - DNA, 15 bp, Homo sapiens
gggaaaaagtcattt

SEQ ID NO: 376702 - DNA, 15 bp, Homo sapiens
ggaaaaagtcatttg

SEQ ID NO: 376703 - DNA, 15 bp, Homo sapiens
gaaaaagtcatttgc

SEQ ID NO: 376704 - DNA, 15 bp, Homo sapiens
aaaaagtcatttgcc

SEQ ID NO: 376705 - DNA, 15 bp, Homo sapiens
aaaagtcatttgcca

SEQ ID NO: 376706 - DNA, 15 bp, Homo sapiens
aaagtcatttgccac

SEQ ID NO: 376707 - DNA, 15 bp, Homo sapiens
aagtcatttgccact

SEQ ID NO: 376708 - DNA, 15 bp, Homo sapiens
agtcatttgccacta

SEQ ID NO: 376709 - DNA, 15 bp, Homo sapiens
gtcatttgccactat

SEQ ID NO: 376710 - DNA, 15 bp, Homo sapiens
tcatttgccactatt

SEQ ID NO: 376711 - DNA, 15 bp, Homo sapiens
catttgccactattt

SEQ ID NO: 376712 - DNA, 15 bp, Homo sapiens
atttgccactatttg

SEQ ID NO: 376713 - DNA, 15 bp, Homo sapiens
tttgccactatttgt

SEQ ID NO: 376714 - DNA, 15 bp, Homo sapiens
ttgccactatttgta

SEQ ID NO: 376715 - DNA, 15 bp, Homo sapiens
tgccactatttgtat

SEQ ID NO: 376716 - DNA, 15 bp, Homo sapiens
gccactatttgtatt

SEQ ID NO: 376717 - DNA, 15 bp, Homo sapiens
ccactatttgtattt

SEQ ID NO: 376718 - DNA, 15 bp, Homo sapiens
cactatttgtatttt

SEQ ID NO: 376719 - DNA, 15 bp, Homo sapiens
actatttgtattttt

SEQ ID NO: 376720 - DNA, 15 bp, Homo sapiens
ctatttgtatttttt

SEQ ID NO: 376721 - DNA, 15 bp, Homo sapiens
tatttgtattttttg

SEQ ID NO: 376722 - DNA, 15 bp, Homo sapiens
atttgtattttttgt

SEQ ID NO: 376723 - DNA, 15 bp, Homo sapiens
ttgtattttttgtaa

SEQ ID NO: 376724 - DNA, 15 bp, Homo sapiens
tgtattttttgtaaa

SEQ ID NO: 376725 - DNA, 15 bp, Homo sapiens
gtattttttgtaaat

SEQ ID NO: 376726 - DNA, 15 bp, Homo sapiens
tattttttgtaaatt

SEQ ID NO: 376727 - DNA, 15 bp, Homo sapiens
attttttgtaaattg

SEQ ID NO: 376728 - DNA, 15 bp, Homo sapiens
ttttttgtaaattgc

SEQ ID NO: 376729 - DNA, 15 bp, Homo sapiens
tttttgtaaattgct

SEQ ID NO: 376730 - DNA, 15 bp, Homo sapiens
ttttgtaaattgctt

SEQ ID NO: 376731 - DNA, 15 bp, Homo sapiens
tttgtaaattgcttt

SEQ ID NO: 376732 - DNA, 15 bp, Homo sapiens
ttgtaaattgctttc

SEQ ID NO: 376733 - DNA, 15 bp, Homo sapiens
tgtaaattgctttct

SEQ ID NO: 376734 - DNA, 15 bp, Homo sapiens
gtaaattgctttcta

SEQ ID NO: 376735 - DNA, 15 bp, Homo sapiens
taaattgctttctag

SEQ ID NO: 376736 - DNA, 15 bp, Homo sapiens
aaattgctttctagt

SEQ ID NO: 376737 - DNA, 15 bp, Homo sapiens
aattgctttctagtc

SEQ ID NO: 376738 - DNA, 15 bp, Homo sapiens
attgctttctagtct

SEQ ID NO: 376739 - DNA, 15 bp, Homo sapiens
ttgctttctagtctc

SEQ ID NO: 376740 - DNA, 15 bp, Homo sapiens
tgctttctagtctct

SEQ ID NO: 376741 - DNA, 15 bp, Homo sapiens
gctttctagtctcta

SEQ ID NO: 376742 - DNA, 15 bp, Homo sapiens
ctttctagtctctat

SEQ ID NO: 376743 - DNA, 15 bp, Homo sapiens
tttctagtctctatg

SEQ ID NO: 376744 - DNA, 15 bp, Homo sapiens
ttctagtctctatga

SEQ ID NO: 376745 - DNA, 15 bp, Homo sapiens
tctagtctctatgac

SEQ ID NO: 376746 - DNA, 15 bp, Homo sapiens
ctagtctctatgact

SEQ ID NO: 376747 - DNA, 15 bp, Homo sapiens
tagtctctatgactg

SEQ ID NO: 376748 - DNA, 15 bp, Homo sapiens
agtctctatgactgt

SEQ ID NO: 376749 - DNA, 15 bp, Homo sapiens
gtctctatgactgtc

SEQ ID NO: 376750 - DNA, 15 bp, Homo sapiens
tctctatgactgtca

SEQ ID NO: 376751 - DNA, 15 bp, Homo sapiens
ctctatgactgtcat

SEQ ID NO: 376752 - DNA, 15 bp, Homo sapiens
tctatgactgtcatt

SEQ ID NO: 376753 - DNA, 15 bp, Homo sapiens
ctatgactgtcatta

SEQ ID NO: 376754 - DNA, 15 bp, Homo sapiens
tatgactgtcattag

SEQ ID NO: 376755 - DNA, 15 bp, Homo sapiens
atgactgtcattagt

SEQ ID NO: 376756 - DNA, 15 bp, Homo sapiens
tgactgtcattagtt

SEQ ID NO: 376757 - DNA, 15 bp, Homo sapiens
gactgtcattagttc

SEQ ID NO: 376758 - DNA, 15 bp, Homo sapiens
actgtcattagttct

SEQ ID NO: 376759 - DNA, 15 bp, Homo sapiens
ctgtcattagttctg

SEQ ID NO: 376760 - DNA, 15 bp, Homo sapiens
tgtcattagttctgt

SEQ ID NO: 376761 - DNA, 15 bp, Homo sapiens
gtcattagttctgta

SEQ ID NO: 376762 - DNA, 15 bp, Homo sapiens
tcattagttctgtac

SEQ ID NO: 376763 - DNA, 15 bp, Homo sapiens
cattagttctgtact

SEQ ID NO: 376764 - DNA, 15 bp, Homo sapiens
attagttctgtactg

SEQ ID NO: 376765 - DNA, 15 bp, Homo sapiens
ttagttctgtactga

SEQ ID NO: 376766 - DNA, 15 bp, Homo sapiens
tagttctgtactgaa

SEQ ID NO: 376767 - DNA, 15 bp, Homo sapiens
agttctgtactgaaa

SEQ ID NO: 376768 - DNA, 15 bp, Homo sapiens
gttctgtactgaaaa

SEQ ID NO: 376769 - DNA, 15 bp, Homo sapiens
ttctgtactgaaaac

SEQ ID NO: 376770 - DNA, 15 bp, Homo sapiens
tctgtactgaaaaca

SEQ ID NO: 376771 - DNA, 15 bp, Homo sapiens
ctgtactgaaaacac

SEQ ID NO: 376772 - DNA, 15 bp, Homo sapiens
tgtactgaaaacaca

SEQ ID NO: 376773 - DNA, 15 bp, Homo sapiens
ctgaaaacacatgat

SEQ ID NO: 376774 - DNA, 15 bp, Homo sapiens
tgaaaacacatgatt

SEQ ID NO: 376775 - DNA, 15 bp, Homo sapiens
gaaaacacatgattt

SEQ ID NO: 376776 - DNA, 15 bp, Homo sapiens
aaaacacatgatttt

SEQ ID NO: 376777 - DNA, 15 bp, Homo sapiens
aaacacatgattttc

SEQ ID NO: 376778 - DNA, 15 bp, Homo sapiens
aacacatgattttcc

SEQ ID NO: 376779 - DNA, 15 bp, Homo sapiens
acacatgattttcct

SEQ ID NO: 376780 - DNA, 15 bp, Homo sapiens
cacatgattttcctg

SEQ ID NO: 376781 - DNA, 15 bp, Homo sapiens
acatgattttcctga

SEQ ID NO: 376782 - DNA, 15 bp, Homo sapiens
catgattttcctgat

SEQ ID NO: 376783 - DNA, 15 bp, Homo sapiens
atgattttcctgatg

SEQ ID NO: 376784 - DNA, 15 bp, Homo sapiens
tgattttcctgatgt

SEQ ID NO: 376785 - DNA, 15 bp, Homo sapiens
gattttcctgatgtt

SEQ ID NO: 376786 - DNA, 15 bp, Homo sapiens
attttcctgatgttg

SEQ ID NO: 376787 - DNA, 15 bp, Homo sapiens
ttttcctgatgttgt

SEQ ID NO: 376788 - DNA, 15 bp, Homo sapiens
tttcctgatgttgtt

SEQ ID NO: 376789 - DNA, 15 bp, Homo sapiens
ttcctgatgttgtta

SEQ ID NO: 376790 - DNA, 15 bp, Homo sapiens
tcctgatgttgttac

SEQ ID NO: 376791 - DNA, 15 bp, Homo sapiens
cctgatgttgttacc

SEQ ID NO: 376792 - DNA, 15 bp, Homo sapiens
ctgatgttgttacca

SEQ ID NO: 376793 - DNA, 15 bp, Homo sapiens
tgatgttgttaccat

SEQ ID NO: 376794 - DNA, 15 bp, Homo sapiens
gatgttgttaccatt

SEQ ID NO: 376795 - DNA, 15 bp, Homo sapiens
atgttgttaccattt

SEQ ID NO: 376796 - DNA, 15 bp, Homo sapiens
tgttgttaccatttc

SEQ ID NO: 376797 - DNA, 15 bp, Homo sapiens
gttgttaccatttct

SEQ ID NO: 376798 - DNA, 15 bp, Homo sapiens
ttgttaccatttctc

SEQ ID NO: 376799 - DNA, 15 bp, Homo sapiens
tgttaccatttctcc

SEQ ID NO: 376800 - DNA, 15 bp, Homo sapiens
gttaccatttctccc

SEQ ID NO: 376801 - DNA, 15 bp, Homo sapiens
ttaccatttctccca

SEQ ID NO: 376802 - DNA, 15 bp, Homo sapiens
taccatttctcccat

SEQ ID NO: 376803 - DNA, 15 bp, Homo sapiens
accatttctcccata

SEQ ID NO: 376804 - DNA, 15 bp, Homo sapiens
ccatttctcccatat

SEQ ID NO: 376805 - DNA, 15 bp, Homo sapiens
catttctcccatatt

SEQ ID NO: 376806 - DNA, 15 bp, Homo sapiens
atttctcccatattt

SEQ ID NO: 376807 - DNA, 15 bp, Homo sapiens
tttctcccatattta

SEQ ID NO: 376808 - DNA, 15 bp, Homo sapiens
ttctcccatatttat

SEQ ID NO: 376809 - DNA, 15 bp, Homo sapiens
tctcccatatttatt

SEQ ID NO: 376810 - DNA, 15 bp, Homo sapiens
ctcccatatttatta

SEQ ID NO: 376811 - DNA, 15 bp, Homo sapiens
tcccatatttattag

SEQ ID NO: 376812 - DNA, 15 bp, Homo sapiens
cccatatttattagc

SEQ ID NO: 376813 - DNA, 15 bp, Homo sapiens
ccatatttattagca

SEQ ID NO: 376814 - DNA, 15 bp, Homo sapiens
catatttattagcac

SEQ ID NO: 376815 - DNA, 15 bp, Homo sapiens
atatttattagcact

SEQ ID NO: 376816 - DNA, 15 bp, Homo sapiens
tatttattagcactg

SEQ ID NO: 376817 - DNA, 15 bp, Homo sapiens
atttattagcactga

SEQ ID NO: 376818 - DNA, 15 bp, Homo sapiens
tttattagcactgag

SEQ ID NO: 376819 - DNA, 15 bp, Homo sapiens
ttattagcactgaga

SEQ ID NO: 376820 - DNA, 15 bp, Homo sapiens
tattagcactgagag

SEQ ID NO: 376821 - DNA, 15 bp, Homo sapiens
attagcactgagaga

SEQ ID NO: 376822 - DNA, 15 bp, Homo sapiens
ttagcactgagagac

SEQ ID NO: 376823 - DNA, 15 bp, Homo sapiens
tagcactgagagaca

SEQ ID NO: 376824 - DNA, 15 bp, Homo sapiens
agcactgagagacaa

SEQ ID NO: 376825 - DNA, 15 bp, Homo sapiens
gcactgagagacaaa

SEQ ID NO: 376826 - DNA, 15 bp, Homo sapiens
cactgagagacaaac

SEQ ID NO: 376827 - DNA, 15 bp, Homo sapiens
actgagagacaaacc

SEQ ID NO: 376828 - DNA, 15 bp, Homo sapiens
ctgagagacaaacca

SEQ ID NO: 376829 - DNA, 15 bp, Homo sapiens
tgagagacaaaccat

SEQ ID NO: 376830 - DNA, 15 bp, Homo sapiens
gagagacaaaccatc

SEQ ID NO: 376831 - DNA, 15 bp, Homo sapiens
agagacaaaccatct

SEQ ID NO: 376832 - DNA, 15 bp, Homo sapiens
gagacaaaccatcta

SEQ ID NO: 376833 - DNA, 15 bp, Homo sapiens
agacaaaccatctac

SEQ ID NO: 376834 - DNA, 15 bp, Homo sapiens
gacaaaccatctaca

SEQ ID NO: 376835 - DNA, 15 bp, Homo sapiens
acaaaccatctacag

SEQ ID NO: 376836 - DNA, 15 bp, Homo sapiens
caaaccatctacagc

SEQ ID NO: 376837 - DNA, 15 bp, Homo sapiens
aaaccatctacagca

SEQ ID NO: 376838 - DNA, 15 bp, Homo sapiens
aaccatctacagcag

SEQ ID NO: 376839 - DNA, 15 bp, Homo sapiens
accatctacagcagc

SEQ ID NO: 376840 - DNA, 15 bp, Homo sapiens
ccatctacagcagca

SEQ ID NO: 376841 - DNA, 15 bp, Homo sapiens
catctacagcagcag

SEQ ID NO: 376842 - DNA, 15 bp, Homo sapiens
atctacagcagcagt

SEQ ID NO: 376843 - DNA, 15 bp, Homo sapiens
tctacagcagcagtt

SEQ ID NO: 376844 - DNA, 15 bp, Homo sapiens
ctacagcagcagttt

SEQ ID NO: 376845 - DNA, 15 bp, Homo sapiens
tacagcagcagtttt

SEQ ID NO: 376846 - DNA, 15 bp, Homo sapiens
acagcagcagttttt

SEQ ID NO: 376847 - DNA, 15 bp, Homo sapiens
cagcagcagtttttc

SEQ ID NO: 376848 - DNA, 15 bp, Homo sapiens
agcagcagtttttcg

SEQ ID NO: 376849 - DNA, 15 bp, Homo sapiens
gcagcagtttttcgt

SEQ ID NO: 376850 - DNA, 15 bp, Homo sapiens
cagcagtttttcgtg

SEQ ID NO: 376851 - DNA, 15 bp, Homo sapiens
agcagtttttcgtgt

SEQ ID NO: 376852 - DNA, 15 bp, Homo sapiens
gcagtttttcgtgtc

SEQ ID NO: 376853 - DNA, 15 bp, Homo sapiens
cagtttttcgtgtct

SEQ ID NO: 376854 - DNA, 15 bp, Homo sapiens
agtttttcgtgtcta

SEQ ID NO: 376855 - DNA, 15 bp, Homo sapiens
gtttttcgtgtctaa

SEQ ID NO: 376856 - DNA, 15 bp, Homo sapiens
tttttcgtgtctaag

SEQ ID NO: 376857 - DNA, 15 bp, Homo sapiens
ttttcgtgtctaaga

SEQ ID NO: 376858 - DNA, 15 bp, Homo sapiens
tttcgtgtctaagag

SEQ ID NO: 376859 - DNA, 15 bp, Homo sapiens
ttcgtgtctaagagg

SEQ ID NO: 376860 - DNA, 15 bp, Homo sapiens
tcgtgtctaagagga

SEQ ID NO: 376861 - DNA, 15 bp, Homo sapiens
cgtgtctaagaggat

SEQ ID NO: 376862 - DNA, 15 bp, Homo sapiens
gtgtctaagaggatt

SEQ ID NO: 376863 - DNA, 15 bp, Homo sapiens
tgtctaagaggattt

SEQ ID NO: 376864 - DNA, 15 bp, Homo sapiens
gtctaagaggattta

SEQ ID NO: 376865 - DNA, 15 bp, Homo sapiens
tctaagaggatttaa

SEQ ID NO: 376866 - DNA, 15 bp, Homo sapiens
ctaagaggatttaat

SEQ ID NO: 376867 - DNA, 15 bp, Homo sapiens
taagaggatttaatt

SEQ ID NO: 376868 - DNA, 15 bp, Homo sapiens
aagaggatttaattt

SEQ ID NO: 376869 - DNA, 15 bp, Homo sapiens
agaggatttaattta

SEQ ID NO: 376870 - DNA, 15 bp, Homo sapiens
gaggatttaatttat

SEQ ID NO: 376871 - DNA, 15 bp, Homo sapiens
aggatttaatttata

SEQ ID NO: 376872 - DNA, 15 bp, Homo sapiens
ggatttaatttatag

SEQ ID NO: 376873 - DNA, 15 bp, Homo sapiens
gatttaatttatagt

SEQ ID NO: 376874 - DNA, 15 bp, Homo sapiens
atttaatttatagtt

SEQ ID NO: 376875 - DNA, 15 bp, Homo sapiens
tttaatttatagtta

SEQ ID NO: 376876 - DNA, 15 bp, Homo sapiens
ttaatttatagttat

SEQ ID NO: 376877 - DNA, 15 bp, Homo sapiens
taatttatagttatt

SEQ ID NO: 376878 - DNA, 15 bp, Homo sapiens
aatttatagttattc

SEQ ID NO: 376879 - DNA, 15 bp, Homo sapiens
atttatagttattcc

SEQ ID NO: 376880 - DNA, 15 bp, Homo sapiens
tttatagttattcct

SEQ ID NO: 376881 - DNA, 15 bp, Homo sapiens
ttatagttattcctc

SEQ ID NO: 376882 - DNA, 15 bp, Homo sapiens
tatagttattcctct

SEQ ID NO: 376883 - DNA, 15 bp, Homo sapiens
atagttattcctctt

SEQ ID NO: 376884 - DNA, 15 bp, Homo sapiens
tagttattcctctta

SEQ ID NO: 376885 - DNA, 15 bp, Homo sapiens
agttattcctcttag

SEQ ID NO: 376886 - DNA, 15 bp, Homo sapiens
gttattcctcttagc

SEQ ID NO: 376887 - DNA, 15 bp, Homo sapiens
ttattcctcttagca

SEQ ID NO: 376888 - DNA, 15 bp, Homo sapiens
tattcctcttagcac

SEQ ID NO: 376889 - DNA, 15 bp, Homo sapiens
attcctcttagcact

SEQ ID NO: 376890 - DNA, 15 bp, Homo sapiens
ttcctcttagcactt

SEQ ID NO: 376891 - DNA, 15 bp, Homo sapiens
tcctcttagcacttt

SEQ ID NO: 376892 - DNA, 15 bp, Homo sapiens
cctcttagcactttt

SEQ ID NO: 376893 - DNA, 15 bp, Homo sapiens
ctcttagcacttttc

SEQ ID NO: 376894 - DNA, 15 bp, Homo sapiens
tcttagcacttttct

SEQ ID NO: 376895 - DNA, 15 bp, Homo sapiens
cttagcacttttctg

SEQ ID NO: 376896 - DNA, 15 bp, Homo sapiens
ttagcacttttctgt

SEQ ID NO: 376897 - DNA, 15 bp, Homo sapiens
tagcacttttctgtg

SEQ ID NO: 376898 - DNA, 15 bp, Homo sapiens
agcacttttctgtgt

SEQ ID NO: 376899 - DNA, 15 bp, Homo sapiens
gcacttttctgtgtc

SEQ ID NO: 376900 - DNA, 15 bp, Homo sapiens
cacttttctgtgtca

SEQ ID NO: 376901 - DNA, 15 bp, Homo sapiens
acttttctgtgtcac

SEQ ID NO: 376902 - DNA, 15 bp, Homo sapiens
cttttctgtgtcacc

SEQ ID NO: 376903 - DNA, 15 bp, Homo sapiens
ttttctgtgtcaccc

SEQ ID NO: 376904 - DNA, 15 bp, Homo sapiens
tttctgtgtcacccc

SEQ ID NO: 376905 - DNA, 15 bp, Homo sapiens
ttctgtgtcaccccc

SEQ ID NO: 376906 - DNA, 15 bp, Homo sapiens
tctgtgtcaccccca

SEQ ID NO: 376907 - DNA, 15 bp, Homo sapiens
ctgtgtcacccccaa

SEQ ID NO: 376908 - DNA, 15 bp, Homo sapiens
tgtgtcacccccaac

SEQ ID NO: 376909 - DNA, 15 bp, Homo sapiens
gtgtcacccccaacc

SEQ ID NO: 376910 - DNA, 15 bp, Homo sapiens
tgtcacccccaaccc

SEQ ID NO: 376911 - DNA, 15 bp, Homo sapiens
gtcacccccaaccct

SEQ ID NO: 376912 - DNA, 15 bp, Homo sapiens
tcacccccaacccta

SEQ ID NO: 376913 - DNA, 15 bp, Homo sapiens
cacccccaaccctat

SEQ ID NO: 376914 - DNA, 15 bp, Homo sapiens
acccccaaccctatg

SEQ ID NO: 376915 - DNA, 15 bp, Homo sapiens
cccccaaccctatga

SEQ ID NO: 376916 - DNA, 15 bp, Homo sapiens
ccccaaccctatgac

SEQ ID NO: 376917 - DNA, 15 bp, Homo sapiens
cccaaccctatgaca

SEQ ID NO: 376918 - DNA, 15 bp, Homo sapiens
ccaaccctatgacat

SEQ ID NO: 376919 - DNA, 15 bp, Homo sapiens
caaccctatgacatt

SEQ ID NO: 376920 - DNA, 15 bp, Homo sapiens
aaccctatgacatta

SEQ ID NO: 376921 - DNA, 15 bp, Homo sapiens
accctatgacattag

SEQ ID NO: 376922 - DNA, 15 bp, Homo sapiens
ccctatgacattagt

SEQ ID NO: 376923 - DNA, 15 bp, Homo sapiens
cctatgacattagtt

SEQ ID NO: 376924 - DNA, 15 bp, Homo sapiens
ctatgacattagttt

SEQ ID NO: 376925 - DNA, 15 bp, Homo sapiens
tatgacattagtttg

SEQ ID NO: 376926 - DNA, 15 bp, Homo sapiens
atgacattagtttgt

SEQ ID NO: 376927 - DNA, 15 bp, Homo sapiens
tgacattagtttgtg

SEQ ID NO: 376928 - DNA, 15 bp, Homo sapiens
gacattagtttgtgt

SEQ ID NO: 376929 - DNA, 15 bp, Homo sapiens
acattagtttgtgtt

SEQ ID NO: 376930 - DNA, 15 bp, Homo sapiens
cattagtttgtgttc

SEQ ID NO: 376931 - DNA, 15 bp, Homo sapiens
attagtttgtgttcg

SEQ ID NO: 376932 - DNA, 15 bp, Homo sapiens
ttagtttgtgttcgt

SEQ ID NO: 376933 - DNA, 15 bp, Homo sapiens
tagtttgtgttcgta

SEQ ID NO: 376934 - DNA, 15 bp, Homo sapiens
agtttgtgttcgtac

SEQ ID NO: 376935 - DNA, 15 bp, Homo sapiens
gtttgtgttcgtacc

SEQ ID NO: 376936 - DNA, 15 bp, Homo sapiens
tttgtgttcgtacct

SEQ ID NO: 376937 - DNA, 15 bp, Homo sapiens
ttgtgttcgtacctg

SEQ ID NO: 376938 - DNA, 15 bp, Homo sapiens
tgtgttcgtacctga

SEQ ID NO: 376939 - DNA, 15 bp, Homo sapiens
gtgttcgtacctgac

SEQ ID NO: 376940 - DNA, 15 bp, Homo sapiens
tgttcgtacctgaca

SEQ ID NO: 376941 - DNA, 15 bp, Homo sapiens
gttcgtacctgacac

SEQ ID NO: 376942 - DNA, 15 bp, Homo sapiens
ttcgtacctgacaca

SEQ ID NO: 376943 - DNA, 15 bp, Homo sapiens
tcgtacctgacacag

SEQ ID NO: 376944 - DNA, 15 bp, Homo sapiens
cgtacctgacacaga

SEQ ID NO: 376945 - DNA, 15 bp, Homo sapiens
gtacctgacacagaa

SEQ ID NO: 376946 - DNA, 15 bp, Homo sapiens
tacctgacacagaac

SEQ ID NO: 376947 - DNA, 15 bp, Homo sapiens
acctgacacagaaca

SEQ ID NO: 376948 - DNA, 15 bp, Homo sapiens
cctgacacagaacag

SEQ ID NO: 376949 - DNA, 15 bp, Homo sapiens
ctgacacagaacaga

SEQ ID NO: 376950 - DNA, 15 bp, Homo sapiens
tgacacagaacagat

SEQ ID NO: 376951 - DNA, 15 bp, Homo sapiens
gacacagaacagata

SEQ ID NO: 376952 - DNA, 15 bp, Homo sapiens
acacagaacagatat

SEQ ID NO: 376953 - DNA, 15 bp, Homo sapiens
cacagaacagatatg

SEQ ID NO: 376954 - DNA, 15 bp, Homo sapiens
acagaacagatatgc

SEQ ID NO: 376955 - DNA, 15 bp, Homo sapiens
cagaacagatatgca

SEQ ID NO: 376956 - DNA, 15 bp, Homo sapiens
agaacagatatgcaa

SEQ ID NO: 376957 - DNA, 15 bp, Homo sapiens
gaacagatatgcaag

SEQ ID NO: 376958 - DNA, 15 bp, Homo sapiens
aacagatatgcaagt

SEQ ID NO: 376959 - DNA, 15 bp, Homo sapiens
acagatatgcaagtc

SEQ ID NO: 376960 - DNA, 15 bp, Homo sapiens
cagatatgcaagtca

SEQ ID NO: 376961 - DNA, 15 bp, Homo sapiens
agatatgcaagtcat

SEQ ID NO: 376962 - DNA, 15 bp, Homo sapiens
gatatgcaagtcatc

SEQ ID NO: 376963 - DNA, 15 bp, Homo sapiens
atatgcaagtcatca

SEQ ID NO: 376964 - DNA, 15 bp, Homo sapiens
tatgcaagtcatcat

SEQ ID NO: 376965 - DNA, 15 bp, Homo sapiens
atgcaagtcatcatc

SEQ ID NO: 376966 - DNA, 15 bp, Homo sapiens
tgcaagtcatcatca

SEQ ID NO: 376967 - DNA, 15 bp, Homo sapiens
gcaagtcatcatcag

SEQ ID NO: 376968 - DNA, 15 bp, Homo sapiens
caagtcatcatcagc

SEQ ID NO: 376969 - DNA, 15 bp, Homo sapiens
aagtcatcatcagca

SEQ ID NO: 376970 - DNA, 15 bp, Homo sapiens
agtcatcatcagcag

SEQ ID NO: 376971 - DNA, 15 bp, Homo sapiens
catcatcagcagcaa

SEQ ID NO: 376972 - DNA, 15 bp, Homo sapiens
atcatcagcagcaat

SEQ ID NO: 376973 - DNA, 15 bp, Homo sapiens
tcatcagcagcaata

SEQ ID NO: 376974 - DNA, 15 bp, Homo sapiens
catcagcagcaataa

SEQ ID NO: 376975 - DNA, 15 bp, Homo sapiens
atcagcagcaataac

SEQ ID NO: 376976 - DNA, 15 bp, Homo sapiens
tcagcagcaataact

SEQ ID NO: 376977 - DNA, 15 bp, Homo sapiens
cagcagcaataactg

SEQ ID NO: 376978 - DNA, 15 bp, Homo sapiens
agcagcaataactgc

SEQ ID NO: 376979 - DNA, 15 bp, Homo sapiens
gcagcaataactgct

SEQ ID NO: 376980 - DNA, 15 bp, Homo sapiens
cagcaataactgcta

SEQ ID NO: 376981 - DNA, 15 bp, Homo sapiens
agcaataactgctaa

SEQ ID NO: 376982 - DNA, 15 bp, Homo sapiens
gcaataactgctaat

SEQ ID NO: 376983 - DNA, 15 bp, Homo sapiens
caataactgctaatg

SEQ ID NO: 376984 - DNA, 15 bp, Homo sapiens
aataactgctaatgt

SEQ ID NO: 376985 - DNA, 15 bp, Homo sapiens
ataactgctaatgtt

SEQ ID NO: 376986 - DNA, 15 bp, Homo sapiens
taactgctaatgttt

SEQ ID NO: 376987 - DNA, 15 bp, Homo sapiens
aactgctaatgtttt

SEQ ID NO: 376988 - DNA, 15 bp, Homo sapiens
actgctaatgttttc

SEQ ID NO: 376989 - DNA, 15 bp, Homo sapiens
ctgctaatgttttca

SEQ ID NO: 376990 - DNA, 15 bp, Homo sapiens
tgctaatgttttcag

SEQ ID NO: 376991 - DNA, 15 bp, Homo sapiens
gctaatgttttcagg

SEQ ID NO: 376992 - DNA, 15 bp, Homo sapiens
ctaatgttttcaggg

SEQ ID NO: 376993 - DNA, 15 bp, Homo sapiens
taatgttttcagggc

SEQ ID NO: 376994 - DNA, 15 bp, Homo sapiens
aatgttttcagggca

SEQ ID NO: 376995 - DNA, 15 bp, Homo sapiens
atgttttcagggcat

SEQ ID NO: 376996 - DNA, 15 bp, Homo sapiens
tgttttcagggcatt

SEQ ID NO: 376997 - DNA, 15 bp, Homo sapiens
gttttcagggcattt

SEQ ID NO: 376998 - DNA, 15 bp, Homo sapiens
ttttcagggcatttt

SEQ ID NO: 376999 - DNA, 15 bp, Homo sapiens
tttcagggcattttt

SEQ ID NO: 377000 - DNA, 15 bp, Homo sapiens
ttcagggcatttttc

SEQ ID NO: 377001 - DNA, 15 bp, Homo sapiens
tcagggcatttttca

SEQ ID NO: 377002 - DNA, 15 bp, Homo sapiens
cagggcatttttcag

SEQ ID NO: 377003 - DNA, 15 bp, Homo sapiens
agggcatttttcagc

SEQ ID NO: 377004 - DNA, 15 bp, Homo sapiens
gggcatttttcagct

SEQ ID NO: 377005 - DNA, 15 bp, Homo sapiens
ggcatttttcagctt

SEQ ID NO: 377006 - DNA, 15 bp, Homo sapiens
gcatttttcagcttt

SEQ ID NO: 377007 - DNA, 15 bp, Homo sapiens
catttttcagctttt

SEQ ID NO: 377008 - DNA, 15 bp, Homo sapiens
atttttcagcttttg

SEQ ID NO: 377009 - DNA, 15 bp, Homo sapiens
tttttcagcttttga

SEQ ID NO: 377010 - DNA, 15 bp, Homo sapiens
ttttcagcttttgaa

SEQ ID NO: 377011 - DNA, 15 bp, Homo sapiens
tttcagcttttgaag

SEQ ID NO: 377012 - DNA, 15 bp, Homo sapiens
ttcagcttttgaagg

SEQ ID NO: 377013 - DNA, 15 bp, Homo sapiens
tcagcttttgaaggg

SEQ ID NO: 377014 - DNA, 15 bp, Homo sapiens
cagcttttgaaggga

SEQ ID NO: 377015 - DNA, 15 bp, Homo sapiens
agcttttgaagggat

SEQ ID NO: 377016 - DNA, 15 bp, Homo sapiens
gcttttgaagggatt

SEQ ID NO: 377017 - DNA, 15 bp, Homo sapiens
cttttgaagggattt

SEQ ID NO: 377018 - DNA, 15 bp, Homo sapiens
ttttgaagggatttt

SEQ ID NO: 377019 - DNA, 15 bp, Homo sapiens
tttgaagggattttc

SEQ ID NO: 377020 - DNA, 15 bp, Homo sapiens
ttgaagggattttct

SEQ ID NO: 377021 - DNA, 15 bp, Homo sapiens
tgaagggattttctt

SEQ ID NO: 377022 - DNA, 15 bp, Homo sapiens
gaagggattttcttt

SEQ ID NO: 377023 - DNA, 15 bp, Homo sapiens
aagggattttctttg

SEQ ID NO: 377024 - DNA, 15 bp, Homo sapiens
agggattttctttgt

SEQ ID NO: 377025 - DNA, 15 bp, Homo sapiens
gggattttctttgtt

SEQ ID NO: 377026 - DNA, 15 bp, Homo sapiens
ggattttctttgttt

SEQ ID NO: 377027 - DNA, 15 bp, Homo sapiens
gattttctttgttta

SEQ ID NO: 377028 - DNA, 15 bp, Homo sapiens
attttctttgtttaa

SEQ ID NO: 377029 - DNA, 15 bp, Homo sapiens
ttttctttgtttaat

SEQ ID NO: 377030 - DNA, 15 bp, Homo sapiens
tttctttgtttaatg

SEQ ID NO: 377031 - DNA, 15 bp, Homo sapiens
ttctttgtttaatgt

SEQ ID NO: 377032 - DNA, 15 bp, Homo sapiens
tctttgtttaatgtc

SEQ ID NO: 377033 - DNA, 15 bp, Homo sapiens
ctttgtttaatgtcc

SEQ ID NO: 377034 - DNA, 15 bp, Homo sapiens
tttgtttaatgtcct

SEQ ID NO: 377035 - DNA, 15 bp, Homo sapiens
ttgtttaatgtcctc

SEQ ID NO: 377036 - DNA, 15 bp, Homo sapiens
tgtttaatgtcctca

SEQ ID NO: 377037 - DNA, 15 bp, Homo sapiens
gtttaatgtcctcag

SEQ ID NO: 377038 - DNA, 15 bp, Homo sapiens
tttaatgtcctcaga

SEQ ID NO: 377039 - DNA, 15 bp, Homo sapiens
ttaatgtcctcagac

SEQ ID NO: 377040 - DNA, 15 bp, Homo sapiens
taatgtcctcagact

SEQ ID NO: 377041 - DNA, 15 bp, Homo sapiens
aatgtcctcagactg

SEQ ID NO: 377042 - DNA, 15 bp, Homo sapiens
atgtcctcagactgg

SEQ ID NO: 377043 - DNA, 15 bp, Homo sapiens
tgtcctcagactgga

SEQ ID NO: 377044 - DNA, 15 bp, Homo sapiens
gtcctcagactggat

SEQ ID NO: 377045 - DNA, 15 bp, Homo sapiens
tcctcagactggatg

SEQ ID NO: 377046 - DNA, 15 bp, Homo sapiens
cctcagactggatgt

SEQ ID NO: 377047 - DNA, 15 bp, Homo sapiens
ctcagactggatgta

SEQ ID NO: 377048 - DNA, 15 bp, Homo sapiens
tcagactggatgtaa

SEQ ID NO: 377049 - DNA, 15 bp, Homo sapiens
cagactggatgtaat

SEQ ID NO: 377050 - DNA, 15 bp, Homo sapiens
agactggatgtaatt

SEQ ID NO: 377051 - DNA, 15 bp, Homo sapiens
gactggatgtaattg

SEQ ID NO: 377052 - DNA, 15 bp, Homo sapiens
actggatgtaattga

SEQ ID NO: 377053 - DNA, 15 bp, Homo sapiens
ctggatgtaattgag

SEQ ID NO: 377054 - DNA, 15 bp, Homo sapiens
tggatgtaattgagc

SEQ ID NO: 377055 - DNA, 15 bp, Homo sapiens
ggatgtaattgagct

SEQ ID NO: 377056 - DNA, 15 bp, Homo sapiens
gatgtaattgagctg

SEQ ID NO: 377057 - DNA, 15 bp, Homo sapiens
atgtaattgagctgt

SEQ ID NO: 377058 - DNA, 15 bp, Homo sapiens
tgtaattgagctgtc

SEQ ID NO: 377059 - DNA, 15 bp, Homo sapiens
gtaattgagctgtca

SEQ ID NO: 377060 - DNA, 15 bp, Homo sapiens
taattgagctgtcag

SEQ ID NO: 377061 - DNA, 15 bp, Homo sapiens
aattgagctgtcagt

SEQ ID NO: 377062 - DNA, 15 bp, Homo sapiens
attgagctgtcagta

SEQ ID NO: 377063 - DNA, 15 bp, Homo sapiens
ttgagctgtcagtat

SEQ ID NO: 377064 - DNA, 15 bp, Homo sapiens
tgagctgtcagtatt

SEQ ID NO: 377065 - DNA, 15 bp, Homo sapiens
gagctgtcagtattt

SEQ ID NO: 377066 - DNA, 15 bp, Homo sapiens
agctgtcagtatttt

SEQ ID NO: 377067 - DNA, 15 bp, Homo sapiens
gctgtcagtatttta

SEQ ID NO: 377068 - DNA, 15 bp, Homo sapiens
ctgtcagtattttat

SEQ ID NO: 377069 - DNA, 15 bp, Homo sapiens
tgtcagtattttatt

SEQ ID NO: 377070 - DNA, 15 bp, Homo sapiens
gtcagtattttatta

SEQ ID NO: 377071 - DNA, 15 bp, Homo sapiens
tcagtattttattat

SEQ ID NO: 377072 - DNA, 15 bp, Homo sapiens
cagtattttattatt

SEQ ID NO: 377073 - DNA, 15 bp, Homo sapiens
agtattttattattt

SEQ ID NO: 377074 - DNA, 15 bp, Homo sapiens
gtattttattatttc

SEQ ID NO: 377075 - DNA, 15 bp, Homo sapiens
tattttattatttct

SEQ ID NO: 377076 - DNA, 15 bp, Homo sapiens
attttattatttctt

SEQ ID NO: 377077 - DNA, 15 bp, Homo sapiens
ttttattatttcttt

SEQ ID NO: 377078 - DNA, 15 bp, Homo sapiens
tttattatttctttt

SEQ ID NO: 377079 - DNA, 15 bp, Homo sapiens
ttattatttcttttt

SEQ ID NO: 377080 - DNA, 15 bp, Homo sapiens
tattatttctttttt

SEQ ID NO: 377081 - DNA, 15 bp, Homo sapiens
attatttcttttttg

SEQ ID NO: 377082 - DNA, 15 bp, Homo sapiens
ttatttcttttttgt

SEQ ID NO: 377083 - DNA, 15 bp, Homo sapiens
tatttcttttttgtg

SEQ ID NO: 377084 - DNA, 15 bp, Homo sapiens
atttcttttttgtga

SEQ ID NO: 377085 - DNA, 15 bp, Homo sapiens
tttcttttttgtgaa

SEQ ID NO: 377086 - DNA, 15 bp, Homo sapiens
ttcttttttgtgaaa

SEQ ID NO: 377087 - DNA, 15 bp, Homo sapiens
tcttttttgtgaaaa

SEQ ID NO: 377088 - DNA, 15 bp, Homo sapiens
cttttttgtgaaaac

SEQ ID NO: 377089 - DNA, 15 bp, Homo sapiens
ttttttgtgaaaaca

SEQ ID NO: 377090 - DNA, 15 bp, Homo sapiens
tttttgtgaaaacaa

SEQ ID NO: 377091 - DNA, 15 bp, Homo sapiens
ttttgtgaaaacaaa

SEQ ID NO: 377092 - DNA, 15 bp, Homo sapiens
tttgtgaaaacaaaa

SEQ ID NO: 377093 - DNA, 15 bp, Homo sapiens
ttgtgaaaacaaaaa

SEQ ID NO: 377094 - DNA, 15 bp, Homo sapiens
tgtgaaaacaaaaac

SEQ ID NO: 377095 - DNA, 15 bp, Homo sapiens
gtgaaaacaaaaaca

SEQ ID NO: 377096 - DNA, 15 bp, Homo sapiens
tgaaaacaaaaacac

SEQ ID NO: 377097 - DNA, 15 bp, Homo sapiens
gaaaacaaaaacaca

SEQ ID NO: 377098 - DNA, 15 bp, Homo sapiens
aaaacaaaaacacag

SEQ ID NO: 377099 - DNA, 15 bp, Homo sapiens
aaacaaaaacacaga

SEQ ID NO: 377100 - DNA, 15 bp, Homo sapiens
aacaaaaacacagag

SEQ ID NO: 377101 - DNA, 15 bp, Homo sapiens
acaaaaacacagaga

SEQ ID NO: 377102 - DNA, 15 bp, Homo sapiens
caaaaacacagagag

SEQ ID NO: 377103 - DNA, 15 bp, Homo sapiens
aaaaacacagagagg

SEQ ID NO: 377104 - DNA, 15 bp, Homo sapiens
aaaacacagagaggt

SEQ ID NO: 377105 - DNA, 15 bp, Homo sapiens
aaacacagagaggta

SEQ ID NO: 377106 - DNA, 15 bp, Homo sapiens
aacacagagaggtaa

SEQ ID NO: 377107 - DNA, 15 bp, Homo sapiens
acacagagaggtaaa

SEQ ID NO: 377108 - DNA, 15 bp, Homo sapiens
cacagagaggtaaag

SEQ ID NO: 377109 - DNA, 15 bp, Homo sapiens
acagagaggtaaagc

SEQ ID NO: 377110 - DNA, 15 bp, Homo sapiens
cagagaggtaaagct

SEQ ID NO: 377111 - DNA, 15 bp, Homo sapiens
agagaggtaaagctc

SEQ ID NO: 377112 - DNA, 15 bp, Homo sapiens
gagaggtaaagctcc

SEQ ID NO: 377113 - DNA, 15 bp, Homo sapiens
agaggtaaagctcct

SEQ ID NO: 377114 - DNA, 15 bp, Homo sapiens
gaggtaaagctcctt

SEQ ID NO: 377115 - DNA, 15 bp, Homo sapiens
aggtaaagctccttg

SEQ ID NO: 377116 - DNA, 15 bp, Homo sapiens
ggtaaagctccttgc

SEQ ID NO: 377117 - DNA, 15 bp, Homo sapiens
gtaaagctccttgcc

SEQ ID NO: 377118 - DNA, 15 bp, Homo sapiens
taaagctccttgcct

SEQ ID NO: 377119 - DNA, 15 bp, Homo sapiens
aaagctccttgcctg

SEQ ID NO: 377120 - DNA, 15 bp, Homo sapiens
aagctccttgcctgg

SEQ ID NO: 377121 - DNA, 15 bp, Homo sapiens
agctccttgcctggt

SEQ ID NO: 377122 - DNA, 15 bp, Homo sapiens
gctccttgcctggtg

SEQ ID NO: 377123 - DNA, 15 bp, Homo sapiens
ctccttgcctggtga

SEQ ID NO: 377124 - DNA, 15 bp, Homo sapiens
tccttgcctggtgac

SEQ ID NO: 377125 - DNA, 15 bp, Homo sapiens
ccttgcctggtgact

SEQ ID NO: 377126 - DNA, 15 bp, Homo sapiens
cttgcctggtgactc

SEQ ID NO: 377127 - DNA, 15 bp, Homo sapiens
ttgcctggtgactca

SEQ ID NO: 377128 - DNA, 15 bp, Homo sapiens
tgcctggtgactcag

SEQ ID NO: 377129 - DNA, 15 bp, Homo sapiens
gcctggtgactcagg

SEQ ID NO: 377130 - DNA, 15 bp, Homo sapiens
cctggtgactcaggt

SEQ ID NO: 377131 - DNA, 15 bp, Homo sapiens
ctggtgactcaggtg

SEQ ID NO: 377132 - DNA, 15 bp, Homo sapiens
tggtgactcaggtgc

SEQ ID NO: 377133 - DNA, 15 bp, Homo sapiens
ggtgactcaggtgct

SEQ ID NO: 377134 - DNA, 15 bp, Homo sapiens
gtgactcaggtgcta

SEQ ID NO: 377135 - DNA, 15 bp, Homo sapiens
tgactcaggtgctaa

SEQ ID NO: 377136 - DNA, 15 bp, Homo sapiens
gactcaggtgctaaa

SEQ ID NO: 377137 - DNA, 15 bp, Homo sapiens
actcaggtgctaaat

SEQ ID NO: 377138 - DNA, 15 bp, Homo sapiens
ctcaggtgctaaatg

SEQ ID NO: 377139 - DNA, 15 bp, Homo sapiens
tcaggtgctaaatgg

SEQ ID NO: 377140 - DNA, 15 bp, Homo sapiens
caggtgctaaatgga

SEQ ID NO: 377141 - DNA, 15 bp, Homo sapiens
aggtgctaaatggaa

SEQ ID NO: 377142 - DNA, 15 bp, Homo sapiens
ggtgctaaatggaag

SEQ ID NO: 377143 - DNA, 15 bp, Homo sapiens
gtgctaaatggaaga

SEQ ID NO: 377144 - DNA, 15 bp, Homo sapiens
tgctaaatggaagaa

SEQ ID NO: 377145 - DNA, 15 bp, Homo sapiens
gctaaatggaagaac

SEQ ID NO: 377146 - DNA, 15 bp, Homo sapiens
ctaaatggaagaact

SEQ ID NO: 377147 - DNA, 15 bp, Homo sapiens
taaatggaagaactg

SEQ ID NO: 377148 - DNA, 15 bp, Homo sapiens
aaatggaagaactga

SEQ ID NO: 377149 - DNA, 15 bp, Homo sapiens
aatggaagaactgag

SEQ ID NO: 377150 - DNA, 15 bp, Homo sapiens
atggaagaactgaga

SEQ ID NO: 377151 - DNA, 15 bp, Homo sapiens
tggaagaactgagat

SEQ ID NO: 377152 - DNA, 15 bp, Homo sapiens
ggaagaactgagatt

SEQ ID NO: 377153 - DNA, 15 bp, Homo sapiens
gaagaactgagattt

SEQ ID NO: 377154 - DNA, 15 bp, Homo sapiens
aagaactgagatttg

SEQ ID NO: 377155 - DNA, 15 bp, Homo sapiens
agaactgagatttga

SEQ ID NO: 377156 - DNA, 15 bp, Homo sapiens
gaactgagatttgaa

SEQ ID NO: 377157 - DNA, 15 bp, Homo sapiens
aactgagatttgaat

SEQ ID NO: 377158 - DNA, 15 bp, Homo sapiens
actgagatttgaatg

SEQ ID NO: 377159 - DNA, 15 bp, Homo sapiens
ctgagatttgaatgc

SEQ ID NO: 377160 - DNA, 15 bp, Homo sapiens
tgagatttgaatgca

SEQ ID NO: 377161 - DNA, 15 bp, Homo sapiens
gagatttgaatgcag

SEQ ID NO: 377162 - DNA, 15 bp, Homo sapiens
agatttgaatgcagg

SEQ ID NO: 377163 - DNA, 15 bp, Homo sapiens
gatttgaatgcagga

SEQ ID NO: 377164 - DNA, 15 bp, Homo sapiens
atttgaatgcaggat

SEQ ID NO: 377165 - DNA, 15 bp, Homo sapiens
tttgaatgcaggatc

SEQ ID NO: 377166 - DNA, 15 bp, Homo sapiens
ttgaatgcaggatcc

SEQ ID NO: 377167 - DNA, 15 bp, Homo sapiens
tgaatgcaggatcct

SEQ ID NO: 377168 - DNA, 15 bp, Homo sapiens
gaatgcaggatcctt

SEQ ID NO: 377169 - DNA, 15 bp, Homo sapiens
aatgcaggatccttg

SEQ ID NO: 377170 - DNA, 15 bp, Homo sapiens
atgcaggatccttga

SEQ ID NO: 377171 - DNA, 15 bp, Homo sapiens
tgcaggatccttgac

SEQ ID NO: 377172 - DNA, 15 bp, Homo sapiens
gcaggatccttgact

SEQ ID NO: 377173 - DNA, 15 bp, Homo sapiens
caggatccttgactt

SEQ ID NO: 377174 - DNA, 15 bp, Homo sapiens
aggatccttgacttt

SEQ ID NO: 377175 - DNA, 15 bp, Homo sapiens
ggatccttgacttta

SEQ ID NO: 377176 - DNA, 15 bp, Homo sapiens
gatccttgactttaa

SEQ ID NO: 377177 - DNA, 15 bp, Homo sapiens
atccttgactttaaa

SEQ ID NO: 377178 - DNA, 15 bp, Homo sapiens
tccttgactttaaat

SEQ ID NO: 377179 - DNA, 15 bp, Homo sapiens
ccttgactttaaatc

SEQ ID NO: 377180 - DNA, 15 bp, Homo sapiens
cttgactttaaatca

SEQ ID NO: 377181 - DNA, 15 bp, Homo sapiens
ttgactttaaatcat

SEQ ID NO: 377182 - DNA, 15 bp, Homo sapiens
tgactttaaatcatg

SEQ ID NO: 377183 - DNA, 15 bp, Homo sapiens
gactttaaatcatgc

SEQ ID NO: 377184 - DNA, 15 bp, Homo sapiens
actttaaatcatgca

SEQ ID NO: 377185 - DNA, 15 bp, Homo sapiens
ctttaaatcatgcac

SEQ ID NO: 377186 - DNA, 15 bp, Homo sapiens
tttaaatcatgcact

SEQ ID NO: 377187 - DNA, 15 bp, Homo sapiens
ttaaatcatgcactc

SEQ ID NO: 377188 - DNA, 15 bp, Homo sapiens
taaatcatgcactca

SEQ ID NO: 377189 - DNA, 15 bp, Homo sapiens
aaatcatgcactcat

SEQ ID NO: 377190 - DNA, 15 bp, Homo sapiens
aatcatgcactcatt

SEQ ID NO: 377191 - DNA, 15 bp, Homo sapiens
atcatgcactcattt

SEQ ID NO: 377192 - DNA, 15 bp, Homo sapiens
tcatgcactcatttt

SEQ ID NO: 377193 - DNA, 15 bp, Homo sapiens
catgcactcattttc

SEQ ID NO: 377194 - DNA, 15 bp, Homo sapiens
atgcactcattttct

SEQ ID NO: 377195 - DNA, 15 bp, Homo sapiens
tgcactcattttctg

SEQ ID NO: 377196 - DNA, 15 bp, Homo sapiens
gcactcattttctgc

SEQ ID NO: 377197 - DNA, 15 bp, Homo sapiens
cactcattttctgcc

SEQ ID NO: 377198 - DNA, 15 bp, Homo sapiens
actcattttctgcca

SEQ ID NO: 377199 - DNA, 15 bp, Homo sapiens
ctcattttctgccac

SEQ ID NO: 377200 - DNA, 15 bp, Homo sapiens
tcattttctgccacg

SEQ ID NO: 377201 - DNA, 15 bp, Homo sapiens
cattttctgccacgt

SEQ ID NO: 377202 - DNA, 15 bp, Homo sapiens
attttctgccacgtt

SEQ ID NO: 377203 - DNA, 15 bp, Homo sapiens
ttttctgccacgttg

SEQ ID NO: 377204 - DNA, 15 bp, Homo sapiens
tttctgccacgttgc

SEQ ID NO: 377205 - DNA, 15 bp, Homo sapiens
ttctgccacgttgct

SEQ ID NO: 377206 - DNA, 15 bp, Homo sapiens
tctgccacgttgctg

SEQ ID NO: 377207 - DNA, 15 bp, Homo sapiens
ctgccacgttgctga

SEQ ID NO: 377208 - DNA, 15 bp, Homo sapiens
tgccacgttgctgat

SEQ ID NO: 377209 - DNA, 15 bp, Homo sapiens
gccacgttgctgatg

SEQ ID NO: 377210 - DNA, 15 bp, Homo sapiens
ccacgttgctgatgc

SEQ ID NO: 377211 - DNA, 15 bp, Homo sapiens
cacgttgctgatgct

SEQ ID NO: 377212 - DNA, 15 bp, Homo sapiens
acgttgctgatgctt

SEQ ID NO: 377213 - DNA, 15 bp, Homo sapiens
cgttgctgatgcttc

SEQ ID NO: 377214 - DNA, 15 bp, Homo sapiens
gttgctgatgcttca

SEQ ID NO: 377215 - DNA, 15 bp, Homo sapiens
ttgctgatgcttcac

SEQ ID NO: 377216 - DNA, 15 bp, Homo sapiens
tgctgatgcttcact

SEQ ID NO: 377217 - DNA, 15 bp, Homo sapiens
gctgatgcttcacta

SEQ ID NO: 377218 - DNA, 15 bp, Homo sapiens
ctgatgcttcactat

SEQ ID NO: 377219 - DNA, 15 bp, Homo sapiens
tgatgcttcactatg

SEQ ID NO: 377220 - DNA, 15 bp, Homo sapiens
gatgcttcactatgc

SEQ ID NO: 377221 - DNA, 15 bp, Homo sapiens
atgcttcactatgcc

SEQ ID NO: 377222 - DNA, 15 bp, Homo sapiens
tgcttcactatgcca

SEQ ID NO: 377223 - DNA, 15 bp, Homo sapiens
gcttcactatgccat

SEQ ID NO: 377224 - DNA, 15 bp, Homo sapiens
cttcactatgccata

SEQ ID NO: 377225 - DNA, 15 bp, Homo sapiens
ttcactatgccatag

SEQ ID NO: 377226 - DNA, 15 bp, Homo sapiens
tcactatgccataga

SEQ ID NO: 377227 - DNA, 15 bp, Homo sapiens
cactatgccatagag

SEQ ID NO: 377228 - DNA, 15 bp, Homo sapiens
actatgccatagagg

SEQ ID NO: 377229 - DNA, 15 bp, Homo sapiens
ctatgccatagagga

SEQ ID NO: 377230 - DNA, 15 bp, Homo sapiens
tatgccatagaggag

SEQ ID NO: 377231 - DNA, 15 bp, Homo sapiens
atgccatagaggagg

SEQ ID NO: 377232 - DNA, 15 bp, Homo sapiens
tgccatagaggagga

SEQ ID NO: 377233 - DNA, 15 bp, Homo sapiens
gccatagaggaggaa

SEQ ID NO: 377234 - DNA, 15 bp, Homo sapiens
ccatagaggaggaaa

SEQ ID NO: 377235 - DNA, 15 bp, Homo sapiens
catagaggaggaaaa

SEQ ID NO: 377236 - DNA, 15 bp, Homo sapiens
atagaggaggaaaac

SEQ ID NO: 377237 - DNA, 15 bp, Homo sapiens
tagaggaggaaaaca

SEQ ID NO: 377238 - DNA, 15 bp, Homo sapiens
agaggaggaaaacaa

SEQ ID NO: 377239 - DNA, 15 bp, Homo sapiens
gaggaggaaaacaac

SEQ ID NO: 377240 - DNA, 15 bp, Homo sapiens
aggaggaaaacaacg

SEQ ID NO: 377241 - DNA, 15 bp, Homo sapiens
ggaggaaaacaacga

SEQ ID NO: 377242 - DNA, 15 bp, Homo sapiens
gaggaaaacaacgac

SEQ ID NO: 377243 - DNA, 15 bp, Homo sapiens
aggaaaacaacgaca

SEQ ID NO: 377244 - DNA, 15 bp, Homo sapiens
ggaaaacaacgacaa

SEQ ID NO: 377245 - DNA, 15 bp, Homo sapiens
gaaaacaacgacaac

SEQ ID NO: 377246 - DNA, 15 bp, Homo sapiens
aaaacaacgacaact

SEQ ID NO: 377247 - DNA, 15 bp, Homo sapiens
aaacaacgacaactt

SEQ ID NO: 377248 - DNA, 15 bp, Homo sapiens
aacaacgacaacttt

SEQ ID NO: 377249 - DNA, 15 bp, Homo sapiens
acaacgacaactttg

SEQ ID NO: 377250 - DNA, 15 bp, Homo sapiens
caacgacaactttga

SEQ ID NO: 377251 - DNA, 15 bp, Homo sapiens
aacgacaactttgat

SEQ ID NO: 377252 - DNA, 15 bp, Homo sapiens
acgacaactttgatg

SEQ ID NO: 377253 - DNA, 15 bp, Homo sapiens
cgacaactttgatgt

SEQ ID NO: 377254 - DNA, 15 bp, Homo sapiens
gacaactttgatgtc

SEQ ID NO: 377255 - DNA, 15 bp, Homo sapiens
acaactttgatgtca

SEQ ID NO: 377256 - DNA, 15 bp, Homo sapiens
caactttgatgtcag

SEQ ID NO: 377257 - DNA, 15 bp, Homo sapiens
aactttgatgtcagc

SEQ ID NO: 377258 - DNA, 15 bp, Homo sapiens
actttgatgtcagca

SEQ ID NO: 377259 - DNA, 15 bp, Homo sapiens
ctttgatgtcagcac

SEQ ID NO: 377260 - DNA, 15 bp, Homo sapiens
tttgatgtcagcaca

SEQ ID NO: 377261 - DNA, 15 bp, Homo sapiens
ttgatgtcagcacaa

SEQ ID NO: 377262 - DNA, 15 bp, Homo sapiens
tgatgtcagcacaac

SEQ ID NO: 377263 - DNA, 15 bp, Homo sapiens
gatgtcagcacaact

SEQ ID NO: 377264 - DNA, 15 bp, Homo sapiens
atgtcagcacaactg

SEQ ID NO: 377265 - DNA, 15 bp, Homo sapiens
tgtcagcacaactgt

SEQ ID NO: 377266 - DNA, 15 bp, Homo sapiens
gtcagcacaactgtt

SEQ ID NO: 377267 - DNA, 15 bp, Homo sapiens
tcagcacaactgttt

SEQ ID NO: 377268 - DNA, 15 bp, Homo sapiens
cagcacaactgtttt

SEQ ID NO: 377269 - DNA, 15 bp, Homo sapiens
agcacaactgttttg

SEQ ID NO: 377270 - DNA, 15 bp, Homo sapiens
gcacaactgttttgc

SEQ ID NO: 377271 - DNA, 15 bp, Homo sapiens
cacaactgttttgct

SEQ ID NO: 377272 - DNA, 15 bp, Homo sapiens
acaactgttttgctt

SEQ ID NO: 377273 - DNA, 15 bp, Homo sapiens
caactgttttgctta

SEQ ID NO: 377274 - DNA, 15 bp, Homo sapiens
aactgttttgcttat

SEQ ID NO: 377275 - DNA, 15 bp, Homo sapiens
actgttttgcttatt

SEQ ID NO: 377276 - DNA, 15 bp, Homo sapiens
ctgttttgcttatta

SEQ ID NO: 377277 - DNA, 15 bp, Homo sapiens
tgttttgcttattat

SEQ ID NO: 377278 - DNA, 15 bp, Homo sapiens
gttttgcttattatt

SEQ ID NO: 377279 - DNA, 15 bp, Homo sapiens
ttttgcttattattc

SEQ ID NO: 377280 - DNA, 15 bp, Homo sapiens
tttgcttattattct

SEQ ID NO: 377281 - DNA, 15 bp, Homo sapiens
ttgcttattattctt

SEQ ID NO: 377282 - DNA, 15 bp, Homo sapiens
tgcttattattcttc

SEQ ID NO: 377283 - DNA, 15 bp, Homo sapiens
gcttattattcttct

SEQ ID NO: 377284 - DNA, 15 bp, Homo sapiens
cttattattcttctc

SEQ ID NO: 377285 - DNA, 15 bp, Homo sapiens
ttattattcttctca

SEQ ID NO: 377286 - DNA, 15 bp, Homo sapiens
tattattcttctcat

SEQ ID NO: 377287 - DNA, 15 bp, Homo sapiens
attattcttctcata

SEQ ID NO: 377288 - DNA, 15 bp, Homo sapiens
ttattcttctcatat

SEQ ID NO: 377289 - DNA, 15 bp, Homo sapiens
tattcttctcatatg

SEQ ID NO: 377290 - DNA, 15 bp, Homo sapiens
attcttctcatatgg

SEQ ID NO: 377291 - DNA, 15 bp, Homo sapiens
ttcttctcatatggc

SEQ ID NO: 377292 - DNA, 15 bp, Homo sapiens
tcttctcatatggct

SEQ ID NO: 377293 - DNA, 15 bp, Homo sapiens
cttctcatatggctt

SEQ ID NO: 377294 - DNA, 15 bp, Homo sapiens
ttctcatatggctta

SEQ ID NO: 377295 - DNA, 15 bp, Homo sapiens
tctcatatggcttat

SEQ ID NO: 377296 - DNA, 15 bp, Homo sapiens
ctcatatggcttatt

SEQ ID NO: 377297 - DNA, 15 bp, Homo sapiens
tcatatggcttatta

SEQ ID NO: 377298 - DNA, 15 bp, Homo sapiens
catatggcttattaa

SEQ ID NO: 377299 - DNA, 15 bp, Homo sapiens
atatggcttattaac

SEQ ID NO: 377300 - DNA, 15 bp, Homo sapiens
tatggcttattaacc

SEQ ID NO: 377301 - DNA, 15 bp, Homo sapiens
atggcttattaacct

SEQ ID NO: 377302 - DNA, 15 bp, Homo sapiens
tggcttattaaccta

SEQ ID NO: 377303 - DNA, 15 bp, Homo sapiens
ggcttattaacctat

SEQ ID NO: 377304 - DNA, 15 bp, Homo sapiens
gcttattaacctatc

SEQ ID NO: 377305 - DNA, 15 bp, Homo sapiens
cttattaacctatcc

SEQ ID NO: 377306 - DNA, 15 bp, Homo sapiens
ttattaacctatccg

SEQ ID NO: 377307 - DNA, 15 bp, Homo sapiens
tattaacctatccga

SEQ ID NO: 377308 - DNA, 15 bp, Homo sapiens
attaacctatccgaa

SEQ ID NO: 377309 - DNA, 15 bp, Homo sapiens
ttaacctatccgaat

SEQ ID NO: 377310 - DNA, 15 bp, Homo sapiens
taacctatccgaata

SEQ ID NO: 377311 - DNA, 15 bp, Homo sapiens
aacctatccgaataa

SEQ ID NO: 377312 - DNA, 15 bp, Homo sapiens
acctatccgaataat

SEQ ID NO: 377313 - DNA, 15 bp, Homo sapiens
cctatccgaataatc

SEQ ID NO: 377314 - DNA, 15 bp, Homo sapiens
ctatccgaataatca

SEQ ID NO: 377315 - DNA, 15 bp, Homo sapiens
tatccgaataatcat

SEQ ID NO: 377316 - DNA, 15 bp, Homo sapiens
atccgaataatcatt

SEQ ID NO: 377317 - DNA, 15 bp, Homo sapiens
tccgaataatcattt

SEQ ID NO: 377318 - DNA, 15 bp, Homo sapiens
ccgaataatcatttc

SEQ ID NO: 377319 - DNA, 15 bp, Homo sapiens
cgaataatcatttct

SEQ ID NO: 377320 - DNA, 15 bp, Homo sapiens
gaataatcatttcta

SEQ ID NO: 377321 - DNA, 15 bp, Homo sapiens
aataatcatttctac

SEQ ID NO: 377322 - DNA, 15 bp, Homo sapiens
ataatcatttctact

SEQ ID NO: 377323 - DNA, 15 bp, Homo sapiens
taatcatttctactt

SEQ ID NO: 377324 - DNA, 15 bp, Homo sapiens
aatcatttctactta

SEQ ID NO: 377325 - DNA, 15 bp, Homo sapiens
atcatttctacttaa

SEQ ID NO: 377326 - DNA, 15 bp, Homo sapiens
tcatttctacttaac

SEQ ID NO: 377327 - DNA, 15 bp, Homo sapiens
catttctacttaaca

SEQ ID NO: 377328 - DNA, 15 bp, Homo sapiens
atttctacttaacag

SEQ ID NO: 377329 - DNA, 15 bp, Homo sapiens
tttctacttaacaga

SEQ ID NO: 377330 - DNA, 15 bp, Homo sapiens
ttctacttaacagat

SEQ ID NO: 377331 - DNA, 15 bp, Homo sapiens
tctacttaacagatt

SEQ ID NO: 377332 - DNA, 15 bp, Homo sapiens
ctacttaacagatta

SEQ ID NO: 377333 - DNA, 15 bp, Homo sapiens
tacttaacagattac

SEQ ID NO: 377334 - DNA, 15 bp, Homo sapiens
acttaacagattaca

SEQ ID NO: 377335 - DNA, 15 bp, Homo sapiens
cttaacagattacaa

SEQ ID NO: 377336 - DNA, 15 bp, Homo sapiens
ttaacagattacaaa

SEQ ID NO: 377337 - DNA, 15 bp, Homo sapiens
taacagattacaaag

SEQ ID NO: 377338 - DNA, 15 bp, Homo sapiens
aacagattacaaagg

SEQ ID NO: 377339 - DNA, 15 bp, Homo sapiens
acagattacaaaggc

SEQ ID NO: 377340 - DNA, 15 bp, Homo sapiens
cagattacaaaggct

SEQ ID NO: 377341 - DNA, 15 bp, Homo sapiens
agattacaaaggctg

SEQ ID NO: 377342 - DNA, 15 bp, Homo sapiens
gattacaaaggctga

SEQ ID NO: 377343 - DNA, 15 bp, Homo sapiens
attacaaaggctgac

SEQ ID NO: 377344 - DNA, 15 bp, Homo sapiens
ttacaaaggctgact

SEQ ID NO: 377345 - DNA, 15 bp, Homo sapiens
tacaaaggctgactt

SEQ ID NO: 377346 - DNA, 15 bp, Homo sapiens
acaaaggctgactta

SEQ ID NO: 377347 - DNA, 15 bp, Homo sapiens
caaaggctgacttag

SEQ ID NO: 377348 - DNA, 15 bp, Homo sapiens
aaaggctgacttaga

SEQ ID NO: 377349 - DNA, 15 bp, Homo sapiens
aaggctgacttagaa

SEQ ID NO: 377350 - DNA, 15 bp, Homo sapiens
aggctgacttagaac

SEQ ID NO: 377351 - DNA, 15 bp, Homo sapiens
ggctgacttagaaca

SEQ ID NO: 377352 - DNA, 15 bp, Homo sapiens
gctgacttagaacag

SEQ ID NO: 377353 - DNA, 15 bp, Homo sapiens
ctgacttagaacagc

SEQ ID NO: 377354 - DNA, 15 bp, Homo sapiens
tgacttagaacagcg

SEQ ID NO: 377355 - DNA, 15 bp, Homo sapiens
gacttagaacagcgc

SEQ ID NO: 377356 - DNA, 15 bp, Homo sapiens
acttagaacagcgcc

SEQ ID NO: 377357 - DNA, 15 bp, Homo sapiens
cttagaacagcgcca

SEQ ID NO: 377358 - DNA, 15 bp, Homo sapiens
ttagaacagcgccat

SEQ ID NO: 377359 - DNA, 15 bp, Homo sapiens
tagaacagcgccatc

SEQ ID NO: 377360 - DNA, 15 bp, Homo sapiens
agaacagcgccatcc

SEQ ID NO: 377361 - DNA, 15 bp, Homo sapiens
gaacagcgccatcct

SEQ ID NO: 377362 - DNA, 15 bp, Homo sapiens
aacagcgccatcctc

SEQ ID NO: 377363 - DNA, 15 bp, Homo sapiens
acagcgccatcctca

SEQ ID NO: 377364 - DNA, 15 bp, Homo sapiens
cagcgccatcctcag

SEQ ID NO: 377365 - DNA, 15 bp, Homo sapiens
agcgccatcctcagc

SEQ ID NO: 377366 - DNA, 15 bp, Homo sapiens
gcgccatcctcagct

SEQ ID NO: 377367 - DNA, 15 bp, Homo sapiens
cgccatcctcagctg

SEQ ID NO: 377368 - DNA, 15 bp, Homo sapiens
gccatcctcagctgg

SEQ ID NO: 377369 - DNA, 15 bp, Homo sapiens
ccatcctcagctgga

SEQ ID NO: 377370 - DNA, 15 bp, Homo sapiens
catcctcagctggat

SEQ ID NO: 377371 - DNA, 15 bp, Homo sapiens
atcctcagctggatt

SEQ ID NO: 377372 - DNA, 15 bp, Homo sapiens
tcctcagctggatta

SEQ ID NO: 377373 - DNA, 15 bp, Homo sapiens
cctcagctggattat

SEQ ID NO: 377374 - DNA, 15 bp, Homo sapiens
ctcagctggattatg

SEQ ID NO: 377375 - DNA, 15 bp, Homo sapiens
tcagctggattatgt

SEQ ID NO: 377376 - DNA, 15 bp, Homo sapiens
cagctggattatgtt

SEQ ID NO: 377377 - DNA, 15 bp, Homo sapiens
agctggattatgttt

SEQ ID NO: 377378 - DNA, 15 bp, Homo sapiens
gctggattatgtttt

SEQ ID NO: 377379 - DNA, 15 bp, Homo sapiens
ctggattatgttttt

SEQ ID NO: 377380 - DNA, 15 bp, Homo sapiens
tggattatgttttta

SEQ ID NO: 377381 - DNA, 15 bp, Homo sapiens
ggattatgtttttac

SEQ ID NO: 377382 - DNA, 15 bp, Homo sapiens
gattatgtttttaca

SEQ ID NO: 377383 - DNA, 15 bp, Homo sapiens
attatgtttttacat

SEQ ID NO: 377384 - DNA, 15 bp, Homo sapiens
ttatgtttttacatt

SEQ ID NO: 377385 - DNA, 15 bp, Homo sapiens
tatgtttttacattg

SEQ ID NO: 377386 - DNA, 15 bp, Homo sapiens
atgtttttacattgg

SEQ ID NO: 377387 - DNA, 15 bp, Homo sapiens
tgtttttacattggc

SEQ ID NO: 377388 - DNA, 15 bp, Homo sapiens
gtttttacattggca

SEQ ID NO: 377389 - DNA, 15 bp, Homo sapiens
tttttacattggcac

SEQ ID NO: 377390 - DNA, 15 bp, Homo sapiens
ttttacattggcaca

SEQ ID NO: 377391 - DNA, 15 bp, Homo sapiens
tttacattggcacag

SEQ ID NO: 377392 - DNA, 15 bp, Homo sapiens
ttacattggcacaga

SEQ ID NO: 377393 - DNA, 15 bp, Homo sapiens
tacattggcacagaa

SEQ ID NO: 377394 - DNA, 15 bp, Homo sapiens
acattggcacagaat

SEQ ID NO: 377395 - DNA, 15 bp, Homo sapiens
cattggcacagaatt

SEQ ID NO: 377396 - DNA, 15 bp, Homo sapiens
attggcacagaattt

SEQ ID NO: 377397 - DNA, 15 bp, Homo sapiens
ttggcacagaatttg

SEQ ID NO: 377398 - DNA, 15 bp, Homo sapiens
tggcacagaatttga

SEQ ID NO: 377399 - DNA, 15 bp, Homo sapiens
ggcacagaatttgaa

SEQ ID NO: 377400 - DNA, 15 bp, Homo sapiens
gcacagaatttgaaa

SEQ ID NO: 377401 - DNA, 15 bp, Homo sapiens
cacagaatttgaaaa

SEQ ID NO: 377402 - DNA, 15 bp, Homo sapiens
acagaatttgaaaaa

SEQ ID NO: 377403 - DNA, 15 bp, Homo sapiens
cagaatttgaaaaat

SEQ ID NO: 377404 - DNA, 15 bp, Homo sapiens
agaatttgaaaaata

SEQ ID NO: 377405 - DNA, 15 bp, Homo sapiens
gaatttgaaaaataa

SEQ ID NO: 377406 - DNA, 15 bp, Homo sapiens
aatttgaaaaataaa

SEQ ID NO: 377407 - DNA, 15 bp, Homo sapiens
atttgaaaaataaag

SEQ ID NO: 377408 - DNA, 15 bp, Homo sapiens
tttgaaaaataaagc

SEQ ID NO: 377409 - DNA, 15 bp, Homo sapiens
ttgaaaaataaagct

SEQ ID NO: 377410 - DNA, 15 bp, Homo sapiens
tgaaaaataaagctt

SEQ ID NO: 377411 - DNA, 15 bp, Homo sapiens
gaaaaataaagcttc

SEQ ID NO: 377412 - DNA, 15 bp, Homo sapiens
aaaaataaagcttcc

SEQ ID NO: 377413 - DNA, 15 bp, Homo sapiens
aaaataaagcttcca

SEQ ID NO: 377414 - DNA, 15 bp, Homo sapiens
aaataaagcttccag

SEQ ID NO: 377415 - DNA, 15 bp, Homo sapiens
aataaagcttccagt

SEQ ID NO: 377416 - DNA, 15 bp, Homo sapiens
ataaagcttccagtt

SEQ ID NO: 377417 - DNA, 15 bp, Homo sapiens
taaagcttccagttc

SEQ ID NO: 377418 - DNA, 15 bp, Homo sapiens
aaagcttccagttca

SEQ ID NO: 377419 - DNA, 15 bp, Homo sapiens
aagcttccagttcag

SEQ ID NO: 377420 - DNA, 15 bp, Homo sapiens
agcttccagttcaga

SEQ ID NO: 377421 - DNA, 15 bp, Homo sapiens
gcttccagttcagat

SEQ ID NO: 377422 - DNA, 15 bp, Homo sapiens
cttccagttcagata

SEQ ID NO: 377423 - DNA, 15 bp, Homo sapiens
ttccagttcagatat

SEQ ID NO: 377424 - DNA, 15 bp, Homo sapiens
tccagttcagatatg

SEQ ID NO: 377425 - DNA, 15 bp, Homo sapiens
ccagttcagatatga

SEQ ID NO: 377426 - DNA, 15 bp, Homo sapiens
cagttcagatatgag

SEQ ID NO: 377427 - DNA, 15 bp, Homo sapiens
agttcagatatgaga

SEQ ID NO: 377428 - DNA, 15 bp, Homo sapiens
gttcagatatgagaa

SEQ ID NO: 377429 - DNA, 15 bp, Homo sapiens
ttcagatatgagaac

SEQ ID NO: 377430 - DNA, 15 bp, Homo sapiens
tcagatatgagaaca

SEQ ID NO: 377431 - DNA, 15 bp, Homo sapiens
cagatatgagaacag

SEQ ID NO: 377432 - DNA, 15 bp, Homo sapiens
agatatgagaacagc

SEQ ID NO: 377433 - DNA, 15 bp, Homo sapiens
gatatgagaacagca

SEQ ID NO: 377434 - DNA, 15 bp, Homo sapiens
atatgagaacagcaa

SEQ ID NO: 377435 - DNA, 15 bp, Homo sapiens
tatgagaacagcaat

SEQ ID NO: 377436 - DNA, 15 bp, Homo sapiens
atgagaacagcaatt

SEQ ID NO: 377437 - DNA, 15 bp, Homo sapiens
tgagaacagcaatta

SEQ ID NO: 377438 - DNA, 15 bp, Homo sapiens
gagaacagcaattac

SEQ ID NO: 377439 - DNA, 15 bp, Homo sapiens
agaacagcaattaca

SEQ ID NO: 377440 - DNA, 15 bp, Homo sapiens
gaacagcaattacag

SEQ ID NO: 377441 - DNA, 15 bp, Homo sapiens
aacagcaattacaga

SEQ ID NO: 377442 - DNA, 15 bp, Homo sapiens
acagcaattacagaa

SEQ ID NO: 377443 - DNA, 15 bp, Homo sapiens
cagcaattacagaaa

SEQ ID NO: 377444 - DNA, 15 bp, Homo sapiens
agcaattacagaaaa

SEQ ID NO: 377445 - DNA, 15 bp, Homo sapiens
gcaattacagaaaaa

SEQ ID NO: 377446 - DNA, 15 bp, Homo sapiens
caattacagaaaaat

SEQ ID NO: 377447 - DNA, 15 bp, Homo sapiens
aattacagaaaaatg

SEQ ID NO: 377448 - DNA, 15 bp, Homo sapiens
attacagaaaaatgt

SEQ ID NO: 377449 - DNA, 15 bp, Homo sapiens
ttacagaaaaatgta

SEQ ID NO: 377450 - DNA, 15 bp, Homo sapiens
tacagaaaaatgtaa

SEQ ID NO: 377451 - DNA, 15 bp, Homo sapiens
acagaaaaatgtaag

SEQ ID NO: 377452 - DNA, 15 bp, Homo sapiens
cagaaaaatgtaagt

SEQ ID NO: 377453 - DNA, 15 bp, Homo sapiens
agaaaaatgtaagtt

SEQ ID NO: 377454 - DNA, 15 bp, Homo sapiens
gaaaaatgtaagttt

SEQ ID NO: 377455 - DNA, 15 bp, Homo sapiens
aaaaatgtaagtttt

SEQ ID NO: 377456 - DNA, 15 bp, Homo sapiens
aaaatgtaagttttt

SEQ ID NO: 377457 - DNA, 15 bp, Homo sapiens
aaatgtaagtttttt

SEQ ID NO: 377458 - DNA, 15 bp, Homo sapiens
aatgtaagtttttta

SEQ ID NO: 377459 - DNA, 15 bp, Homo sapiens
atgtaagttttttaa

SEQ ID NO: 377460 - DNA, 15 bp, Homo sapiens
tgtaagttttttaaa

SEQ ID NO: 377461 - DNA, 15 bp, Homo sapiens
gtaagttttttaaaa

SEQ ID NO: 377462 - DNA, 15 bp, Homo sapiens
taagttttttaaaaa

SEQ ID NO: 377463 - DNA, 15 bp, Homo sapiens
agttttttaaaaaaa

SEQ ID NO: 377464 - DNA, 15 bp, Homo sapiens
tttttaaaaaaagtt

SEQ ID NO: 377465 - DNA, 15 bp, Homo sapiens
ttttaaaaaaagtta

SEQ ID NO: 377466 - DNA, 15 bp, Homo sapiens
tttaaaaaaagttat

SEQ ID NO: 377467 - DNA, 15 bp, Homo sapiens
ttaaaaaaagttatg

SEQ ID NO: 377468 - DNA, 15 bp, Homo sapiens
taaaaaaagttatgt

SEQ ID NO: 377469 - DNA, 15 bp, Homo sapiens
aaaaaaagttatgta

SEQ ID NO: 377470 - DNA, 15 bp, Homo sapiens
aaaaaagttatgtat

SEQ ID NO: 377471 - DNA, 15 bp, Homo sapiens
aaaaagttatgtatt

SEQ ID NO: 377472 - DNA, 15 bp, Homo sapiens
aaaagttatgtatta

SEQ ID NO: 377473 - DNA, 15 bp, Homo sapiens
aaagttatgtattat

SEQ ID NO: 377474 - DNA, 15 bp, Homo sapiens
aagttatgtattatc

SEQ ID NO: 377475 - DNA, 15 bp, Homo sapiens
agttatgtattatca

SEQ ID NO: 377476 - DNA, 15 bp, Homo sapiens
gttatgtattatcat

SEQ ID NO: 377477 - DNA, 15 bp, Homo sapiens
ttatgtattatcatc

SEQ ID NO: 377478 - DNA, 15 bp, Homo sapiens
tatgtattatcatcc

SEQ ID NO: 377479 - DNA, 15 bp, Homo sapiens
atgtattatcatcca

SEQ ID NO: 377480 - DNA, 15 bp, Homo sapiens
tgtattatcatccac

SEQ ID NO: 377481 - DNA, 15 bp, Homo sapiens
gtattatcatccact

SEQ ID NO: 377482 - DNA, 15 bp, Homo sapiens
tattatcatccactt

SEQ ID NO: 377483 - DNA, 15 bp, Homo sapiens
attatcatccacttt

SEQ ID NO: 377484 - DNA, 15 bp, Homo sapiens
ttatcatccactttc

SEQ ID NO: 377485 - DNA, 15 bp, Homo sapiens
tatcatccactttcc

SEQ ID NO: 377486 - DNA, 15 bp, Homo sapiens
atcatccactttccc

SEQ ID NO: 377487 - DNA, 15 bp, Homo sapiens
tcatccactttccct

SEQ ID NO: 377488 - DNA, 15 bp, Homo sapiens
catccactttccctg

SEQ ID NO: 377489 - DNA, 15 bp, Homo sapiens
atccactttccctgc

SEQ ID NO: 377490 - DNA, 15 bp, Homo sapiens
tccactttccctgca

SEQ ID NO: 377491 - DNA, 15 bp, Homo sapiens
ccactttccctgcaa

SEQ ID NO: 377492 - DNA, 15 bp, Homo sapiens
cactttccctgcaaa

SEQ ID NO: 377493 - DNA, 15 bp, Homo sapiens
actttccctgcaaat

SEQ ID NO: 377494 - DNA, 15 bp, Homo sapiens
ctttccctgcaaatg

SEQ ID NO: 377495 - DNA, 15 bp, Homo sapiens
tttccctgcaaatgg

SEQ ID NO: 377496 - DNA, 15 bp, Homo sapiens
ttccctgcaaatggt

SEQ ID NO: 377497 - DNA, 15 bp, Homo sapiens
tccctgcaaatggtg

SEQ ID NO: 377498 - DNA, 15 bp, Homo sapiens
ccctgcaaatggtga

SEQ ID NO: 377499 - DNA, 15 bp, Homo sapiens
cctgcaaatggtgac

SEQ ID NO: 377500 - DNA, 15 bp, Homo sapiens
ctgcaaatggtgaca

SEQ ID NO: 377501 - DNA, 15 bp, Homo sapiens
tgcaaatggtgacac

SEQ ID NO: 377502 - DNA, 15 bp, Homo sapiens
gcaaatggtgacaca

SEQ ID NO: 377503 - DNA, 15 bp, Homo sapiens
caaatggtgacacac

SEQ ID NO: 377504 - DNA, 15 bp, Homo sapiens
aaatggtgacacaca

SEQ ID NO: 377505 - DNA, 15 bp, Homo sapiens
aatggtgacacacac

SEQ ID NO: 377506 - DNA, 15 bp, Homo sapiens
atggtgacacacaca

SEQ ID NO: 377507 - DNA, 15 bp, Homo sapiens
tggtgacacacacac

SEQ ID NO: 377508 - DNA, 15 bp, Homo sapiens
ggtgacacacacaca

SEQ ID NO: 377509 - DNA, 15 bp, Homo sapiens
gtgacacacacacac

SEQ ID NO: 377510 - DNA, 15 bp, Homo sapiens
tgacacacacacaca

SEQ ID NO: 377511 - DNA, 15 bp, Homo sapiens
cacacacaaacacat

SEQ ID NO: 377512 - DNA, 15 bp, Homo sapiens
acacacaaacacatt

SEQ ID NO: 377513 - DNA, 15 bp, Homo sapiens
cacacaaacacattt

SEQ ID NO: 377514 - DNA, 15 bp, Homo sapiens
acacaaacacatttt

SEQ ID NO: 377515 - DNA, 15 bp, Homo sapiens
cacaaacacattttc

SEQ ID NO: 377516 - DNA, 15 bp, Homo sapiens
acaaacacattttca

SEQ ID NO: 377517 - DNA, 15 bp, Homo sapiens
caaacacattttcaa

SEQ ID NO: 377518 - DNA, 15 bp, Homo sapiens
aaacacattttcaaa

SEQ ID NO: 377519 - DNA, 15 bp, Homo sapiens
aacacattttcaaag

SEQ ID NO: 377520 - DNA, 15 bp, Homo sapiens
acacattttcaaaga

SEQ ID NO: 377521 - DNA, 15 bp, Homo sapiens
cacattttcaaagat

SEQ ID NO: 377522 - DNA, 15 bp, Homo sapiens
acattttcaaagatt

SEQ ID NO: 377523 - DNA, 15 bp, Homo sapiens
cattttcaaagatta

SEQ ID NO: 377524 - DNA, 15 bp, Homo sapiens
attttcaaagattat

SEQ ID NO: 377525 - DNA, 15 bp, Homo sapiens
ttttcaaagattatt

SEQ ID NO: 377526 - DNA, 15 bp, Homo sapiens
tttcaaagattattc

SEQ ID NO: 377527 - DNA, 15 bp, Homo sapiens
ttcaaagattattca

SEQ ID NO: 377528 - DNA, 15 bp, Homo sapiens
tcaaagattattcaa

SEQ ID NO: 377529 - DNA, 15 bp, Homo sapiens
caaagattattcaac

SEQ ID NO: 377530 - DNA, 15 bp, Homo sapiens
aaagattattcaact

SEQ ID NO: 377531 - DNA, 15 bp, Homo sapiens
aagattattcaacta

SEQ ID NO: 377532 - DNA, 15 bp, Homo sapiens
agattattcaactag

SEQ ID NO: 377533 - DNA, 15 bp, Homo sapiens
gattattcaactaga

SEQ ID NO: 377534 - DNA, 15 bp, Homo sapiens
attattcaactagaa

SEQ ID NO: 377535 - DNA, 15 bp, Homo sapiens
ttattcaactagaaa

SEQ ID NO: 377536 - DNA, 15 bp, Homo sapiens
tattcaactagaaag

SEQ ID NO: 377537 - DNA, 15 bp, Homo sapiens
attcaactagaaagt

SEQ ID NO: 377538 - DNA, 15 bp, Homo sapiens
ttcaactagaaagta

SEQ ID NO: 377539 - DNA, 15 bp, Homo sapiens
tcaactagaaagtaa

SEQ ID NO: 377540 - DNA, 15 bp, Homo sapiens
caactagaaagtaat

SEQ ID NO: 377541 - DNA, 15 bp, Homo sapiens
aactagaaagtaata

SEQ ID NO: 377542 - DNA, 15 bp, Homo sapiens
actagaaagtaatag

SEQ ID NO: 377543 - DNA, 15 bp, Homo sapiens
ctagaaagtaatagt

SEQ ID NO: 377544 - DNA, 15 bp, Homo sapiens
tagaaagtaatagtg

SEQ ID NO: 377545 - DNA, 15 bp, Homo sapiens
agaaagtaatagtgt

SEQ ID NO: 377546 - DNA, 15 bp, Homo sapiens
gaaagtaatagtgtt

SEQ ID NO: 377547 - DNA, 15 bp, Homo sapiens
aaagtaatagtgttt

SEQ ID NO: 377548 - DNA, 15 bp, Homo sapiens
aagtaatagtgttta

SEQ ID NO: 377549 - DNA, 15 bp, Homo sapiens
agtaatagtgtttaa

SEQ ID NO: 377550 - DNA, 15 bp, Homo sapiens
gtaatagtgtttaat

SEQ ID NO: 377551 - DNA, 15 bp, Homo sapiens
taatagtgtttaata

SEQ ID NO: 377552 - DNA, 15 bp, Homo sapiens
aatagtgtttaatat

SEQ ID NO: 377553 - DNA, 15 bp, Homo sapiens
atagtgtttaatatt

SEQ ID NO: 377554 - DNA, 15 bp, Homo sapiens
tagtgtttaatattt

SEQ ID NO: 377555 - DNA, 15 bp, Homo sapiens
agtgtttaatatttg

SEQ ID NO: 377556 - DNA, 15 bp, Homo sapiens
gtgtttaatatttgt

SEQ ID NO: 377557 - DNA, 15 bp, Homo sapiens
tgtttaatatttgtt

SEQ ID NO: 377558 - DNA, 15 bp, Homo sapiens
gtttaatatttgtta

SEQ ID NO: 377559 - DNA, 15 bp, Homo sapiens
tttaatatttgttac

SEQ ID NO: 377560 - DNA, 15 bp, Homo sapiens
ttaatatttgttact

SEQ ID NO: 377561 - DNA, 15 bp, Homo sapiens
taatatttgttactc

SEQ ID NO: 377562 - DNA, 15 bp, Homo sapiens
aatatttgttactct

SEQ ID NO: 377563 - DNA, 15 bp, Homo sapiens
atatttgttactctt

SEQ ID NO: 377564 - DNA, 15 bp, Homo sapiens
tatttgttactcttt

SEQ ID NO: 377565 - DNA, 15 bp, Homo sapiens
atttgttactcttta

SEQ ID NO: 377566 - DNA, 15 bp, Homo sapiens
tttgttactctttat

SEQ ID NO: 377567 - DNA, 15 bp, Homo sapiens
ttgttactctttatt

SEQ ID NO: 377568 - DNA, 15 bp, Homo sapiens
tgttactctttattt

SEQ ID NO: 377569 - DNA, 15 bp, Homo sapiens
gttactctttattta

SEQ ID NO: 377570 - DNA, 15 bp, Homo sapiens
ttactctttatttat

SEQ ID NO: 377571 - DNA, 15 bp, Homo sapiens
tactctttatttata

SEQ ID NO: 377572 - DNA, 15 bp, Homo sapiens
actctttatttatac

SEQ ID NO: 377573 - DNA, 15 bp, Homo sapiens
ctctttatttataca

SEQ ID NO: 377574 - DNA, 15 bp, Homo sapiens
tctttatttatacag

SEQ ID NO: 377575 - DNA, 15 bp, Homo sapiens
ctttatttatacaga

SEQ ID NO: 377576 - DNA, 15 bp, Homo sapiens
tttatttatacagaa

SEQ ID NO: 377577 - DNA, 15 bp, Homo sapiens
ttatttatacagaaa

SEQ ID NO: 377578 - DNA, 15 bp, Homo sapiens
tatttatacagaaat

SEQ ID NO: 377579 - DNA, 15 bp, Homo sapiens
atttatacagaaatg

SEQ ID NO: 377580 - DNA, 15 bp, Homo sapiens
tttatacagaaatgt

SEQ ID NO: 377581 - DNA, 15 bp, Homo sapiens
ttatacagaaatgta

SEQ ID NO: 377582 - DNA, 15 bp, Homo sapiens
tatacagaaatgtag

SEQ ID NO: 377583 - DNA, 15 bp, Homo sapiens
atacagaaatgtagc

SEQ ID NO: 377584 - DNA, 15 bp, Homo sapiens
tacagaaatgtagct

SEQ ID NO: 377585 - DNA, 15 bp, Homo sapiens
acagaaatgtagctt

SEQ ID NO: 377586 - DNA, 15 bp, Homo sapiens
cagaaatgtagcttt

SEQ ID NO: 377587 - DNA, 15 bp, Homo sapiens
agaaatgtagctttc

SEQ ID NO: 377588 - DNA, 15 bp, Homo sapiens
gaaatgtagctttcc

SEQ ID NO: 377589 - DNA, 15 bp, Homo sapiens
aaatgtagctttccc

SEQ ID NO: 377590 - DNA, 15 bp, Homo sapiens
aatgtagctttccct

SEQ ID NO: 377591 - DNA, 15 bp, Homo sapiens
atgtagctttccctt

SEQ ID NO: 377592 - DNA, 15 bp, Homo sapiens
tgtagctttcccttg

SEQ ID NO: 377593 - DNA, 15 bp, Homo sapiens
gtagctttcccttgt

SEQ ID NO: 377594 - DNA, 15 bp, Homo sapiens
tagctttcccttgtt

SEQ ID NO: 377595 - DNA, 15 bp, Homo sapiens
agctttcccttgttt

SEQ ID NO: 377596 - DNA, 15 bp, Homo sapiens
gctttcccttgtttt

SEQ ID NO: 377597 - DNA, 15 bp, Homo sapiens
ctttcccttgttttt

SEQ ID NO: 377598 - DNA, 15 bp, Homo sapiens
tttcccttgttttta

SEQ ID NO: 377599 - DNA, 15 bp, Homo sapiens
ttcccttgtttttat

SEQ ID NO: 377600 - DNA, 15 bp, Homo sapiens
tcccttgtttttatg

SEQ ID NO: 377601 - DNA, 15 bp, Homo sapiens
cccttgtttttatgt

SEQ ID NO: 377602 - DNA, 15 bp, Homo sapiens
ccttgtttttatgtt

SEQ ID NO: 377603 - DNA, 15 bp, Homo sapiens
cttgtttttatgttt

SEQ ID NO: 377604 - DNA, 15 bp, Homo sapiens
ttgtttttatgtttt

SEQ ID NO: 377605 - DNA, 15 bp, Homo sapiens
tgtttttatgttttg

SEQ ID NO: 377606 - DNA, 15 bp, Homo sapiens
gtttttatgttttgt

SEQ ID NO: 377607 - DNA, 15 bp, Homo sapiens
tttttatgttttgtg

SEQ ID NO: 377608 - DNA, 15 bp, Homo sapiens
ttttatgttttgtga

SEQ ID NO: 377609 - DNA, 15 bp, Homo sapiens
tttatgttttgtgaa

SEQ ID NO: 377610 - DNA, 15 bp, Homo sapiens
ttatgttttgtgaac

SEQ ID NO: 377611 - DNA, 15 bp, Homo sapiens
tatgttttgtgaaca

SEQ ID NO: 377612 - DNA, 15 bp, Homo sapiens
atgttttgtgaacat

SEQ ID NO: 377613 - DNA, 15 bp, Homo sapiens
tgttttgtgaacatt

SEQ ID NO: 377614 - DNA, 15 bp, Homo sapiens
gttttgtgaacattg

SEQ ID NO: 377615 - DNA, 15 bp, Homo sapiens
ttttgtgaacattgt

SEQ ID NO: 377616 - DNA, 15 bp, Homo sapiens
tttgtgaacattgtt

SEQ ID NO: 377617 - DNA, 15 bp, Homo sapiens
ttgtgaacattgtta

SEQ ID NO: 377618 - DNA, 15 bp, Homo sapiens
tgtgaacattgttac

SEQ ID NO: 377619 - DNA, 15 bp, Homo sapiens
gtgaacattgttaca

SEQ ID NO: 377620 - DNA, 15 bp, Homo sapiens
tgaacattgttacaa

SEQ ID NO: 377621 - DNA, 15 bp, Homo sapiens
gaacattgttacaat

SEQ ID NO: 377622 - DNA, 15 bp, Homo sapiens
aacattgttacaata

SEQ ID NO: 377623 - DNA, 15 bp, Homo sapiens
acattgttacaataa

SEQ ID NO: 377624 - DNA, 15 bp, Homo sapiens
cattgttacaataac

SEQ ID NO: 377625 - DNA, 15 bp, Homo sapiens
attgttacaataacc

SEQ ID NO: 377626 - DNA, 15 bp, Homo sapiens
ttgttacaataacct

SEQ ID NO: 377627 - DNA, 15 bp, Homo sapiens
tgttacaataacctt

SEQ ID NO: 377628 - DNA, 15 bp, Homo sapiens
gttacaataacctta

SEQ ID NO: 377629 - DNA, 15 bp, Homo sapiens
ttacaataaccttat

SEQ ID NO: 377630 - DNA, 15 bp, Homo sapiens
tacaataaccttatg

SEQ ID NO: 377631 - DNA, 15 bp, Homo sapiens
acaataaccttatga

SEQ ID NO: 377632 - DNA, 15 bp, Homo sapiens
caataaccttatgaa

SEQ ID NO: 377633 - DNA, 15 bp, Homo sapiens
aataaccttatgaag

SEQ ID NO: 377634 - DNA, 15 bp, Homo sapiens
ataaccttatgaagt

SEQ ID NO: 377635 - DNA, 15 bp, Homo sapiens
taaccttatgaagtc

SEQ ID NO: 377636 - DNA, 15 bp, Homo sapiens
aaccttatgaagtcc

SEQ ID NO: 377637 - DNA, 15 bp, Homo sapiens
accttatgaagtcct

SEQ ID NO: 377638 - DNA, 15 bp, Homo sapiens
ccttatgaagtcctt

SEQ ID NO: 377639 - DNA, 15 bp, Homo sapiens
cttatgaagtcctta

SEQ ID NO: 377640 - DNA, 15 bp, Homo sapiens
ttatgaagtccttaa

SEQ ID NO: 377641 - DNA, 15 bp, Homo sapiens
tatgaagtccttaat

SEQ ID NO: 377642 - DNA, 15 bp, Homo sapiens
atgaagtccttaatt

SEQ ID NO: 377643 - DNA, 15 bp, Homo sapiens
tgaagtccttaatta

SEQ ID NO: 377644 - DNA, 15 bp, Homo sapiens
gaagtccttaattat

SEQ ID NO: 377645 - DNA, 15 bp, Homo sapiens
aagtccttaattatt

SEQ ID NO: 377646 - DNA, 15 bp, Homo sapiens
agtccttaattatta

SEQ ID NO: 377647 - DNA, 15 bp, Homo sapiens
gtccttaattattaa

SEQ ID NO: 377648 - DNA, 15 bp, Homo sapiens
tccttaattattaac

SEQ ID NO: 377649 - DNA, 15 bp, Homo sapiens
ccttaattattaaca

SEQ ID NO: 377650 - DNA, 15 bp, Homo sapiens
cttaattattaacat

SEQ ID NO: 377651 - DNA, 15 bp, Homo sapiens
ttaattattaacatc

SEQ ID NO: 377652 - DNA, 15 bp, Homo sapiens
taattattaacatca

SEQ ID NO: 377653 - DNA, 15 bp, Homo sapiens
aattattaacatcac

SEQ ID NO: 377654 - DNA, 15 bp, Homo sapiens
attattaacatcacg

SEQ ID NO: 377655 - DNA, 15 bp, Homo sapiens
ttattaacatcacga

SEQ ID NO: 377656 - DNA, 15 bp, Homo sapiens
tattaacatcacgac

SEQ ID NO: 377657 - DNA, 15 bp, Homo sapiens
attaacatcacgact

SEQ ID NO: 377658 - DNA, 15 bp, Homo sapiens
ttaacatcacgactc

SEQ ID NO: 377659 - DNA, 15 bp, Homo sapiens
taacatcacgactct

SEQ ID NO: 377660 - DNA, 15 bp, Homo sapiens
aacatcacgactctt

SEQ ID NO: 377661 - DNA, 15 bp, Homo sapiens
acatcacgactctta

SEQ ID NO: 377662 - DNA, 15 bp, Homo sapiens
catcacgactcttaa

SEQ ID NO: 377663 - DNA, 15 bp, Homo sapiens
atcacgactcttaag

SEQ ID NO: 377664 - DNA, 15 bp, Homo sapiens
tcacgactcttaagt

SEQ ID NO: 377665 - DNA, 15 bp, Homo sapiens
cacgactcttaagta

SEQ ID NO: 377666 - DNA, 15 bp, Homo sapiens
acgactcttaagtaa

SEQ ID NO: 377667 - DNA, 15 bp, Homo sapiens
cgactcttaagtaat

SEQ ID NO: 377668 - DNA, 15 bp, Homo sapiens
gactcttaagtaatt

SEQ ID NO: 377669 - DNA, 15 bp, Homo sapiens
actcttaagtaatta

SEQ ID NO: 377670 - DNA, 15 bp, Homo sapiens
ctcttaagtaattac

SEQ ID NO: 377671 - DNA, 15 bp, Homo sapiens
tcttaagtaattact

SEQ ID NO: 377672 - DNA, 15 bp, Homo sapiens
cttaagtaattactt

SEQ ID NO: 377673 - DNA, 15 bp, Homo sapiens
ttaagtaattactta

SEQ ID NO: 377674 - DNA, 15 bp, Homo sapiens
taagtaattacttac

SEQ ID NO: 377675 - DNA, 15 bp, Homo sapiens
aagtaattacttaca

SEQ ID NO: 377676 - DNA, 15 bp, Homo sapiens
agtaattacttacac

SEQ ID NO: 377677 - DNA, 15 bp, Homo sapiens
gtaattacttacaca

SEQ ID NO: 377678 - DNA, 15 bp, Homo sapiens
taattacttacacat

SEQ ID NO: 377679 - DNA, 15 bp, Homo sapiens
aattacttacacatt

SEQ ID NO: 377680 - DNA, 15 bp, Homo sapiens
attacttacacattg

SEQ ID NO: 377681 - DNA, 15 bp, Homo sapiens
ttacttacacattgg

SEQ ID NO: 377682 - DNA, 15 bp, Homo sapiens
tacttacacattggg

SEQ ID NO: 377683 - DNA, 15 bp, Homo sapiens
acttacacattgggt

SEQ ID NO: 377684 - DNA, 15 bp, Homo sapiens
cttacacattgggtt

SEQ ID NO: 377685 - DNA, 15 bp, Homo sapiens
ttacacattgggttt

SEQ ID NO: 377686 - DNA, 15 bp, Homo sapiens
tacacattgggtttt

SEQ ID NO: 377687 - DNA, 15 bp, Homo sapiens
acacattgggttttc

SEQ ID NO: 377688 - DNA, 15 bp, Homo sapiens
cacattgggttttct

SEQ ID NO: 377689 - DNA, 15 bp, Homo sapiens
acattgggttttctt

SEQ ID NO: 377690 - DNA, 15 bp, Homo sapiens
cattgggttttcttc

SEQ ID NO: 377691 - DNA, 15 bp, Homo sapiens
attgggttttcttct

SEQ ID NO: 377692 - DNA, 15 bp, Homo sapiens
ttgggttttcttctc

SEQ ID NO: 377693 - DNA, 15 bp, Homo sapiens
tgggttttcttctct

SEQ ID NO: 377694 - DNA, 15 bp, Homo sapiens
gggttttcttctctt

SEQ ID NO: 377695 - DNA, 15 bp, Homo sapiens
ggttttcttctctta

SEQ ID NO: 377696 - DNA, 15 bp, Homo sapiens
gttttcttctcttaa

SEQ ID NO: 377697 - DNA, 15 bp, Homo sapiens
ttttcttctcttaac

SEQ ID NO: 377698 - DNA, 15 bp, Homo sapiens
tttcttctcttaact

SEQ ID NO: 377699 - DNA, 15 bp, Homo sapiens
ttcttctcttaactt

SEQ ID NO: 377700 - DNA, 15 bp, Homo sapiens
tcttctcttaactta

SEQ ID NO: 377701 - DNA, 15 bp, Homo sapiens
cttctcttaacttag

SEQ ID NO: 377702 - DNA, 15 bp, Homo sapiens
ttctcttaacttagg

SEQ ID NO: 377703 - DNA, 15 bp, Homo sapiens
tctcttaacttaggc

SEQ ID NO: 377704 - DNA, 15 bp, Homo sapiens
ctcttaacttaggct

SEQ ID NO: 377705 - DNA, 15 bp, Homo sapiens
tcttaacttaggctt

SEQ ID NO: 377706 - DNA, 15 bp, Homo sapiens
cttaacttaggcttt

SEQ ID NO: 377707 - DNA, 15 bp, Homo sapiens
ttaacttaggctttc

SEQ ID NO: 377708 - DNA, 15 bp, Homo sapiens
taacttaggctttct

SEQ ID NO: 377709 - DNA, 15 bp, Homo sapiens
aacttaggctttctt

SEQ ID NO: 377710 - DNA, 15 bp, Homo sapiens
acttaggctttcttt

SEQ ID NO: 377711 - DNA, 15 bp, Homo sapiens
cttaggctttctttt

SEQ ID NO: 377712 - DNA, 15 bp, Homo sapiens
ttaggctttctttta

SEQ ID NO: 377713 - DNA, 15 bp, Homo sapiens
taggctttcttttag

SEQ ID NO: 377714 - DNA, 15 bp, Homo sapiens
aggctttcttttaga

SEQ ID NO: 377715 - DNA, 15 bp, Homo sapiens
ggctttcttttagag

SEQ ID NO: 377716 - DNA, 15 bp, Homo sapiens
gctttcttttagagg

SEQ ID NO: 377717 - DNA, 15 bp, Homo sapiens
ctttcttttagagga

SEQ ID NO: 377718 - DNA, 15 bp, Homo sapiens
tttcttttagaggaa

SEQ ID NO: 377719 - DNA, 15 bp, Homo sapiens
ttcttttagaggaat

SEQ ID NO: 377720 - DNA, 15 bp, Homo sapiens
tcttttagaggaata

SEQ ID NO: 377721 - DNA, 15 bp, Homo sapiens
cttttagaggaataa

SEQ ID NO: 377722 - DNA, 15 bp, Homo sapiens
ttttagaggaataaa

SEQ ID NO: 377723 - DNA, 15 bp, Homo sapiens
tttagaggaataaaa

SEQ ID NO: 377724 - DNA, 15 bp, Homo sapiens
ttagaggaataaaaa

SEQ ID NO: 377725 - DNA, 15 bp, Homo sapiens
tagaggaataaaaaa

SEQ ID NO: 377726 - DNA, 15 bp, Homo sapiens
agaggaataaaaaaa

SEQ ID NO: 377727 - DNA, 15 bp, Homo sapiens
gaggaataaaaaaag

SEQ ID NO: 377728 - DNA, 15 bp, Homo sapiens
aggaataaaaaaagg

SEQ ID NO: 377729 - DNA, 15 bp, Homo sapiens
ggaataaaaaaaggt

SEQ ID NO: 377730 - DNA, 15 bp, Homo sapiens
gaataaaaaaaggtt

SEQ ID NO: 377731 - DNA, 15 bp, Homo sapiens
aataaaaaaaggtta

SEQ ID NO: 377732 - DNA, 15 bp, Homo sapiens
ataaaaaaaggttaa

SEQ ID NO: 377733 - DNA, 15 bp, Homo sapiens
taaaaaaaggttaaa

SEQ ID NO: 377734 - DNA, 15 bp, Homo sapiens
aaaaaaaggttaaag

SEQ ID NO: 377735 - DNA, 15 bp, Homo sapiens
aaaaaaggttaaagg

SEQ ID NO: 377736 - DNA, 15 bp, Homo sapiens
aaaaaggttaaagga

SEQ ID NO: 377737 - DNA, 15 bp, Homo sapiens
aaaaggttaaaggaa

SEQ ID NO: 377738 - DNA, 15 bp, Homo sapiens
aaaggttaaaggaac

SEQ ID NO: 377739 - DNA, 15 bp, Homo sapiens
aaggttaaaggaact

SEQ ID NO: 377740 - DNA, 15 bp, Homo sapiens
aggttaaaggaactc

SEQ ID NO: 377741 - DNA, 15 bp, Homo sapiens
ggttaaaggaactca

SEQ ID NO: 377742 - DNA, 15 bp, Homo sapiens
gttaaaggaactcac

SEQ ID NO: 377743 - DNA, 15 bp, Homo sapiens
ttaaaggaactcaca

SEQ ID NO: 377744 - DNA, 15 bp, Homo sapiens
taaaggaactcacaa

SEQ ID NO: 377745 - DNA, 15 bp, Homo sapiens
aaaggaactcacaag

SEQ ID NO: 377746 - DNA, 15 bp, Homo sapiens
aaggaactcacaaga

SEQ ID NO: 377747 - DNA, 15 bp, Homo sapiens
aggaactcacaagaa

SEQ ID NO: 377748 - DNA, 15 bp, Homo sapiens
ggaactcacaagaat

SEQ ID NO: 377749 - DNA, 15 bp, Homo sapiens
gaactcacaagaatg

SEQ ID NO: 377750 - DNA, 15 bp, Homo sapiens
aactcacaagaatgc

SEQ ID NO: 377751 - DNA, 15 bp, Homo sapiens
actcacaagaatgca

SEQ ID NO: 377752 - DNA, 15 bp, Homo sapiens
ctcacaagaatgcaa

SEQ ID NO: 377753 - DNA, 15 bp, Homo sapiens
tcacaagaatgcaaa

SEQ ID NO: 377754 - DNA, 15 bp, Homo sapiens
cacaagaatgcaaat

SEQ ID NO: 377755 - DNA, 15 bp, Homo sapiens
acaagaatgcaaatc

SEQ ID NO: 377756 - DNA, 15 bp, Homo sapiens
caagaatgcaaatcc

SEQ ID NO: 377757 - DNA, 15 bp, Homo sapiens
aagaatgcaaatcct

SEQ ID NO: 377758 - DNA, 15 bp, Homo sapiens
agaatgcaaatcctt

SEQ ID NO: 377759 - DNA, 15 bp, Homo sapiens
gaatgcaaatccttt

SEQ ID NO: 377760 - DNA, 15 bp, Homo sapiens
aatgcaaatcctttc

SEQ ID NO: 377761 - DNA, 15 bp, Homo sapiens
atgcaaatcctttct

SEQ ID NO: 377762 - DNA, 15 bp, Homo sapiens
tgcaaatcctttctc

SEQ ID NO: 377763 - DNA, 15 bp, Homo sapiens
gcaaatcctttctct

SEQ ID NO: 377764 - DNA, 15 bp, Homo sapiens
caaatcctttctctc

SEQ ID NO: 377765 - DNA, 15 bp, Homo sapiens
aaatcctttctctca

SEQ ID NO: 377766 - DNA, 15 bp, Homo sapiens
aatcctttctctcat

SEQ ID NO: 377767 - DNA, 15 bp, Homo sapiens
atcctttctctcatt

SEQ ID NO: 377768 - DNA, 15 bp, Homo sapiens
tcctttctctcatta

SEQ ID NO: 377769 - DNA, 15 bp, Homo sapiens
cctttctctcattat

SEQ ID NO: 377770 - DNA, 15 bp, Homo sapiens
ctttctctcattata

SEQ ID NO: 377771 - DNA, 15 bp, Homo sapiens
tttctctcattatac

SEQ ID NO: 377772 - DNA, 15 bp, Homo sapiens
ttctctcattatact

SEQ ID NO: 377773 - DNA, 15 bp, Homo sapiens
tctctcattatactt

SEQ ID NO: 377774 - DNA, 15 bp, Homo sapiens
ctctcattatacttt

SEQ ID NO: 377775 - DNA, 15 bp, Homo sapiens
tctcattatacttta

SEQ ID NO: 377776 - DNA, 15 bp, Homo sapiens
ctcattatactttat

SEQ ID NO: 377777 - DNA, 15 bp, Homo sapiens
tcattatactttatt

SEQ ID NO: 377778 - DNA, 15 bp, Homo sapiens
cattatactttattc

SEQ ID NO: 377779 - DNA, 15 bp, Homo sapiens
attatactttattct

SEQ ID NO: 377780 - DNA, 15 bp, Homo sapiens
ttatactttattctc

SEQ ID NO: 377781 - DNA, 15 bp, Homo sapiens
tatactttattctct

SEQ ID NO: 377782 - DNA, 15 bp, Homo sapiens
atactttattctcta

SEQ ID NO: 377783 - DNA, 15 bp, Homo sapiens
tactttattctctaa

SEQ ID NO: 377784 - DNA, 15 bp, Homo sapiens
actttattctctaaa

SEQ ID NO: 377785 - DNA, 15 bp, Homo sapiens
ctttattctctaaaa

SEQ ID NO: 377786 - DNA, 15 bp, Homo sapiens
tttattctctaaaat

SEQ ID NO: 377787 - DNA, 15 bp, Homo sapiens
ttattctctaaaatc

SEQ ID NO: 377788 - DNA, 15 bp, Homo sapiens
tattctctaaaatca

SEQ ID NO: 377789 - DNA, 15 bp, Homo sapiens
attctctaaaatcag

SEQ ID NO: 377790 - DNA, 15 bp, Homo sapiens
ttctctaaaatcagg

SEQ ID NO: 377791 - DNA, 15 bp, Homo sapiens
tctctaaaatcaggt

SEQ ID NO: 377792 - DNA, 15 bp, Homo sapiens
ctctaaaatcaggtc

SEQ ID NO: 377793 - DNA, 15 bp, Homo sapiens
tctaaaatcaggtct

SEQ ID NO: 377794 - DNA, 15 bp, Homo sapiens
ctaaaatcaggtctt

SEQ ID NO: 377795 - DNA, 15 bp, Homo sapiens
taaaatcaggtctta

SEQ ID NO: 377796 - DNA, 15 bp, Homo sapiens
aaaatcaggtcttac

SEQ ID NO: 377797 - DNA, 15 bp, Homo sapiens
aaatcaggtcttact

SEQ ID NO: 377798 - DNA, 15 bp, Homo sapiens
aatcaggtcttactg

SEQ ID NO: 377799 - DNA, 15 bp, Homo sapiens
atcaggtcttactgt

SEQ ID NO: 377800 - DNA, 15 bp, Homo sapiens
tcaggtcttactgtg

SEQ ID NO: 377801 - DNA, 15 bp, Homo sapiens
caggtcttactgtgt

SEQ ID NO: 377802 - DNA, 15 bp, Homo sapiens
aggtcttactgtgtc

SEQ ID NO: 377803 - DNA, 15 bp, Homo sapiens
ggtcttactgtgtct

SEQ ID NO: 377804 - DNA, 15 bp, Homo sapiens
gtcttactgtgtctt

SEQ ID NO: 377805 - DNA, 15 bp, Homo sapiens
tcttactgtgtcttt

SEQ ID NO: 377806 - DNA, 15 bp, Homo sapiens
cttactgtgtctttt

SEQ ID NO: 377807 - DNA, 15 bp, Homo sapiens
ttactgtgtctttta

SEQ ID NO: 377808 - DNA, 15 bp, Homo sapiens
tactgtgtcttttaa

SEQ ID NO: 377809 - DNA, 15 bp, Homo sapiens
actgtgtcttttaac

SEQ ID NO: 377810 - DNA, 15 bp, Homo sapiens
ctgtgtcttttaact

SEQ ID NO: 377811 - DNA, 15 bp, Homo sapiens
tgtgtcttttaactc

SEQ ID NO: 377812 - DNA, 15 bp, Homo sapiens
gtgtcttttaactca

SEQ ID NO: 377813 - DNA, 15 bp, Homo sapiens
tgtcttttaactcaa

SEQ ID NO: 377814 - DNA, 15 bp, Homo sapiens
gtcttttaactcaac

SEQ ID NO: 377815 - DNA, 15 bp, Homo sapiens
tcttttaactcaacc

SEQ ID NO: 377816 - DNA, 15 bp, Homo sapiens
cttttaactcaaccc

SEQ ID NO: 377817 - DNA, 15 bp, Homo sapiens
ttttaactcaaccca

SEQ ID NO: 377818 - DNA, 15 bp, Homo sapiens
tttaactcaacccaa

SEQ ID NO: 377819 - DNA, 15 bp, Homo sapiens
ttaactcaacccaaa

SEQ ID NO: 377820 - DNA, 15 bp, Homo sapiens
taactcaacccaaaa

SEQ ID NO: 377821 - DNA, 15 bp, Homo sapiens
aactcaacccaaaat

SEQ ID NO: 377822 - DNA, 15 bp, Homo sapiens
actcaacccaaaatt

SEQ ID NO: 377823 - DNA, 15 bp, Homo sapiens
ctcaacccaaaattc

SEQ ID NO: 377824 - DNA, 15 bp, Homo sapiens
tcaacccaaaattca

SEQ ID NO: 377825 - DNA, 15 bp, Homo sapiens
caacccaaaattcag

SEQ ID NO: 377826 - DNA, 15 bp, Homo sapiens
aacccaaaattcagt

SEQ ID NO: 377827 - DNA, 15 bp, Homo sapiens
acccaaaattcagtc

SEQ ID NO: 377828 - DNA, 15 bp, Homo sapiens
cccaaaattcagtcc

SEQ ID NO: 377829 - DNA, 15 bp, Homo sapiens
ccaaaattcagtcca

SEQ ID NO: 377830 - DNA, 15 bp, Homo sapiens
caaaattcagtccac

SEQ ID NO: 377831 - DNA, 15 bp, Homo sapiens
aaaattcagtccaca

SEQ ID NO: 377832 - DNA, 15 bp, Homo sapiens
aaattcagtccacaa

SEQ ID NO: 377833 - DNA, 15 bp, Homo sapiens
aattcagtccacaaa

SEQ ID NO: 377834 - DNA, 15 bp, Homo sapiens
attcagtccacaaat

SEQ ID NO: 377835 - DNA, 15 bp, Homo sapiens
ttcagtccacaaata

SEQ ID NO: 377836 - DNA, 15 bp, Homo sapiens
tcagtccacaaatat

SEQ ID NO: 377837 - DNA, 15 bp, Homo sapiens
cagtccacaaatatt

SEQ ID NO: 377838 - DNA, 15 bp, Homo sapiens
agtccacaaatattt

SEQ ID NO: 377839 - DNA, 15 bp, Homo sapiens
gtccacaaatattta

SEQ ID NO: 377840 - DNA, 15 bp, Homo sapiens
tccacaaatatttat

SEQ ID NO: 377841 - DNA, 15 bp, Homo sapiens
ccacaaatatttatt

SEQ ID NO: 377842 - DNA, 15 bp, Homo sapiens
cacaaatatttattg

SEQ ID NO: 377843 - DNA, 15 bp, Homo sapiens
acaaatatttattga

SEQ ID NO: 377844 - DNA, 15 bp, Homo sapiens
aaatatttattgagc

SEQ ID NO: 377845 - DNA, 15 bp, Homo sapiens
aatatttattgagca

SEQ ID NO: 377846 - DNA, 15 bp, Homo sapiens
atatttattgagcaa

SEQ ID NO: 377847 - DNA, 15 bp, Homo sapiens
tatttattgagcaac

SEQ ID NO: 377848 - DNA, 15 bp, Homo sapiens
tttattgagcaacta

SEQ ID NO: 377849 - DNA, 15 bp, Homo sapiens
ttattgagcaactac

SEQ ID NO: 377850 - DNA, 15 bp, Homo sapiens
tattgagcaactact

SEQ ID NO: 377851 - DNA, 15 bp, Homo sapiens
attgagcaactacta

SEQ ID NO: 377852 - DNA, 15 bp, Homo sapiens
ttgagcaactactat

SEQ ID NO: 377853 - DNA, 15 bp, Homo sapiens
tgagcaactactatg

SEQ ID NO: 377854 - DNA, 15 bp, Homo sapiens
gagcaactactatgt

SEQ ID NO: 377855 - DNA, 15 bp, Homo sapiens
agcaactactatgtg

SEQ ID NO: 377856 - DNA, 15 bp, Homo sapiens
gcaactactatgtgc

SEQ ID NO: 377857 - DNA, 15 bp, Homo sapiens
caactactatgtgct

SEQ ID NO: 377858 - DNA, 15 bp, Homo sapiens
aactactatgtgctt

SEQ ID NO: 377859 - DNA, 15 bp, Homo sapiens
actactatgtgctta

SEQ ID NO: 377860 - DNA, 15 bp, Homo sapiens
ctactatgtgcttat

SEQ ID NO: 377861 - DNA, 15 bp, Homo sapiens
tactatgtgcttatg

SEQ ID NO: 377862 - DNA, 15 bp, Homo sapiens
actatgtgcttatgt

SEQ ID NO: 377863 - DNA, 15 bp, Homo sapiens
ctatgtgcttatgtg

SEQ ID NO: 377864 - DNA, 15 bp, Homo sapiens
tatgtgcttatgtga

SEQ ID NO: 377865 - DNA, 15 bp, Homo sapiens
atgtgcttatgtgac

SEQ ID NO: 377866 - DNA, 15 bp, Homo sapiens
tgtgcttatgtgact

SEQ ID NO: 377867 - DNA, 15 bp, Homo sapiens
gtgcttatgtgactg

SEQ ID NO: 377868 - DNA, 15 bp, Homo sapiens
tgcttatgtgactgg

SEQ ID NO: 377869 - DNA, 15 bp, Homo sapiens
gcttatgtgactggc

SEQ ID NO: 377870 - DNA, 15 bp, Homo sapiens
cttatgtgactggca

SEQ ID NO: 377871 - DNA, 15 bp, Homo sapiens
ttatgtgactggcat

SEQ ID NO: 377872 - DNA, 15 bp, Homo sapiens
tatgtgactggcatt

SEQ ID NO: 377873 - DNA, 15 bp, Homo sapiens
atgtgactggcatta

SEQ ID NO: 377874 - DNA, 15 bp, Homo sapiens
tgtgactggcattaa

SEQ ID NO: 377875 - DNA, 15 bp, Homo sapiens
gtgactggcattaat

SEQ ID NO: 377876 - DNA, 15 bp, Homo sapiens
tgactggcattaatt

SEQ ID NO: 377877 - DNA, 15 bp, Homo sapiens
gactggcattaattt

SEQ ID NO: 377878 - DNA, 15 bp, Homo sapiens
actggcattaatttg

SEQ ID NO: 377879 - DNA, 15 bp, Homo sapiens
ctggcattaatttgg

SEQ ID NO: 377880 - DNA, 15 bp, Homo sapiens
tggcattaatttggg

SEQ ID NO: 377881 - DNA, 15 bp, Homo sapiens
ggcattaatttgggg

SEQ ID NO: 377882 - DNA, 15 bp, Homo sapiens
gcattaatttgggga

SEQ ID NO: 377883 - DNA, 15 bp, Homo sapiens
cattaatttggggat

SEQ ID NO: 377884 - DNA, 15 bp, Homo sapiens
attaatttggggata

SEQ ID NO: 377885 - DNA, 15 bp, Homo sapiens
ttaatttggggatac

SEQ ID NO: 377886 - DNA, 15 bp, Homo sapiens
taatttggggatact

SEQ ID NO: 377887 - DNA, 15 bp, Homo sapiens
aatttggggatactt

SEQ ID NO: 377888 - DNA, 15 bp, Homo sapiens
atttggggatacttt

SEQ ID NO: 377889 - DNA, 15 bp, Homo sapiens
tttggggatacttta

SEQ ID NO: 377890 - DNA, 15 bp, Homo sapiens
ttggggatactttag

SEQ ID NO: 377891 - DNA, 15 bp, Homo sapiens
tggggatactttagt

SEQ ID NO: 377892 - DNA, 15 bp, Homo sapiens
ggggatactttagtt

SEQ ID NO: 377893 - DNA, 15 bp, Homo sapiens
gggatactttagtta

SEQ ID NO: 377894 - DNA, 15 bp, Homo sapiens
ggatactttagttat

SEQ ID NO: 377895 - DNA, 15 bp, Homo sapiens
gatactttagttata

SEQ ID NO: 377896 - DNA, 15 bp, Homo sapiens
atactttagttataa

SEQ ID NO: 377897 - DNA, 15 bp, Homo sapiens
tactttagttataaa

SEQ ID NO: 377898 - DNA, 15 bp, Homo sapiens
tttagttataaatga

SEQ ID NO: 377899 - DNA, 15 bp, Homo sapiens
ttagttataaatgag

SEQ ID NO: 377900 - DNA, 15 bp, Homo sapiens
tagttataaatgaga

SEQ ID NO: 377901 - DNA, 15 bp, Homo sapiens
agttataaatgagag

SEQ ID NO: 377902 - DNA, 15 bp, Homo sapiens
gttataaatgagaga

SEQ ID NO: 377903 - DNA, 15 bp, Homo sapiens
ttataaatgagagaa

SEQ ID NO: 377904 - DNA, 15 bp, Homo sapiens
tataaatgagagaaa

SEQ ID NO: 377905 - DNA, 15 bp, Homo sapiens
ataaatgagagaaaa

SEQ ID NO: 377906 - DNA, 15 bp, Homo sapiens
taaatgagagaaaac

SEQ ID NO: 377907 - DNA, 15 bp, Homo sapiens
aaatgagagaaaaca

SEQ ID NO: 377908 - DNA, 15 bp, Homo sapiens
aatgagagaaaacaa

SEQ ID NO: 377909 - DNA, 15 bp, Homo sapiens
atgagagaaaacaac

SEQ ID NO: 377910 - DNA, 15 bp, Homo sapiens
tgagagaaaacaaca

SEQ ID NO: 377911 - DNA, 15 bp, Homo sapiens
gagagaaaacaacaa

SEQ ID NO: 377912 - DNA, 15 bp, Homo sapiens
agagaaaacaacaac

SEQ ID NO: 377913 - DNA, 15 bp, Homo sapiens
gagaaaacaacaaca

SEQ ID NO: 377914 - DNA, 15 bp, Homo sapiens
agaaaacaacaacaa

SEQ ID NO: 377915 - DNA, 15 bp, Homo sapiens
gaaaacaacaacaaa

SEQ ID NO: 377916 - DNA, 15 bp, Homo sapiens
aaaacaacaacaaaa

SEQ ID NO: 377917 - DNA, 15 bp, Homo sapiens
aaacaacaacaaaaa

SEQ ID NO: 377918 - DNA, 15 bp, Homo sapiens
acaacaacaaaaaat

SEQ ID NO: 377919 - DNA, 15 bp, Homo sapiens
caacaacaaaaaata

SEQ ID NO: 377920 - DNA, 15 bp, Homo sapiens
aacaacaaaaaataa

SEQ ID NO: 377921 - DNA, 15 bp, Homo sapiens
acaacaaaaaataaa

SEQ ID NO: 377922 - DNA, 15 bp, Homo sapiens
caacaaaaaataaac

SEQ ID NO: 377923 - DNA, 15 bp, Homo sapiens
aacaaaaaataaaca

SEQ ID NO: 377924 - DNA, 15 bp, Homo sapiens
acaaaaaataaacat

SEQ ID NO: 377925 - DNA, 15 bp, Homo sapiens
caaaaaataaacata

SEQ ID NO: 377926 - DNA, 15 bp, Homo sapiens
aaaaaataaacatac

SEQ ID NO: 377927 - DNA, 15 bp, Homo sapiens
aaaaataaacataca

SEQ ID NO: 377928 - DNA, 15 bp, Homo sapiens
aaaataaacatacaa

SEQ ID NO: 377929 - DNA, 15 bp, Homo sapiens
aaataaacatacaaa

SEQ ID NO: 377930 - DNA, 15 bp, Homo sapiens
aataaacatacaaaa

SEQ ID NO: 377931 - DNA, 15 bp, Homo sapiens
ataaacatacaaaac

SEQ ID NO: 377932 - DNA, 15 bp, Homo sapiens
taaacatacaaaaca

SEQ ID NO: 377933 - DNA, 15 bp, Homo sapiens
aaacatacaaaacaa

SEQ ID NO: 377934 - DNA, 15 bp, Homo sapiens
aacatacaaaacaat

SEQ ID NO: 377935 - DNA, 15 bp, Homo sapiens
acatacaaaacaata

SEQ ID NO: 377936 - DNA, 15 bp, Homo sapiens
catacaaaacaatag

SEQ ID NO: 377937 - DNA, 15 bp, Homo sapiens
atacaaaacaatagc

SEQ ID NO: 377938 - DNA, 15 bp, Homo sapiens
tacaaaacaatagca

SEQ ID NO: 377939 - DNA, 15 bp, Homo sapiens
acaaaacaatagcaa

SEQ ID NO: 377940 - DNA, 15 bp, Homo sapiens
caaaacaatagcaaa

SEQ ID NO: 377941 - DNA, 15 bp, Homo sapiens
aaaacaatagcaaac

SEQ ID NO: 377942 - DNA, 15 bp, Homo sapiens
aaacaatagcaaaca

SEQ ID NO: 377943 - DNA, 15 bp, Homo sapiens
aacaatagcaaacaa

SEQ ID NO: 377944 - DNA, 15 bp, Homo sapiens
acaatagcaaacaaa

SEQ ID NO: 377945 - DNA, 15 bp, Homo sapiens
caatagcaaacaaag

SEQ ID NO: 377946 - DNA, 15 bp, Homo sapiens
aatagcaaacaaaga

SEQ ID NO: 377947 - DNA, 15 bp, Homo sapiens
atagcaaacaaagat

SEQ ID NO: 377948 - DNA, 15 bp, Homo sapiens
tagcaaacaaagatc

SEQ ID NO: 377949 - DNA, 15 bp, Homo sapiens
agcaaacaaagatcc

SEQ ID NO: 377950 - DNA, 15 bp, Homo sapiens
gcaaacaaagatcct

SEQ ID NO: 377951 - DNA, 15 bp, Homo sapiens
caaacaaagatcctt

SEQ ID NO: 377952 - DNA, 15 bp, Homo sapiens
aaacaaagatccttg

SEQ ID NO: 377953 - DNA, 15 bp, Homo sapiens
aacaaagatccttgc

SEQ ID NO: 377954 - DNA, 15 bp, Homo sapiens
acaaagatccttgct

SEQ ID NO: 377955 - DNA, 15 bp, Homo sapiens
caaagatccttgctt

SEQ ID NO: 377956 - DNA, 15 bp, Homo sapiens
aaagatccttgcttg

SEQ ID NO: 377957 - DNA, 15 bp, Homo sapiens
aagatccttgcttgg

SEQ ID NO: 377958 - DNA, 15 bp, Homo sapiens
agatccttgcttggg

SEQ ID NO: 377959 - DNA, 15 bp, Homo sapiens
gatccttgcttgggg

SEQ ID NO: 377960 - DNA, 15 bp, Homo sapiens
atccttgcttggggt

SEQ ID NO: 377961 - DNA, 15 bp, Homo sapiens
tccttgcttggggtt

SEQ ID NO: 377962 - DNA, 15 bp, Homo sapiens
ccttgcttggggttt

SEQ ID NO: 377963 - DNA, 15 bp, Homo sapiens
cttgcttggggtttg

SEQ ID NO: 377964 - DNA, 15 bp, Homo sapiens
ttgcttggggtttgc

SEQ ID NO: 377965 - DNA, 15 bp, Homo sapiens
tgcttggggtttgca

SEQ ID NO: 377966 - DNA, 15 bp, Homo sapiens
gcttggggtttgcat

SEQ ID NO: 377967 - DNA, 15 bp, Homo sapiens
cttggggtttgcatt

SEQ ID NO: 377968 - DNA, 15 bp, Homo sapiens
ttggggtttgcattc

SEQ ID NO: 377969 - DNA, 15 bp, Homo sapiens
tggggtttgcattct

SEQ ID NO: 377970 - DNA, 15 bp, Homo sapiens
ggggtttgcattcta

SEQ ID NO: 377971 - DNA, 15 bp, Homo sapiens
gggtttgcattctag

SEQ ID NO: 377972 - DNA, 15 bp, Homo sapiens
ggtttgcattctagc

SEQ ID NO: 377973 - DNA, 15 bp, Homo sapiens
gtttgcattctagct

SEQ ID NO: 377974 - DNA, 15 bp, Homo sapiens
tttgcattctagctc

SEQ ID NO: 377975 - DNA, 15 bp, Homo sapiens
ttgcattctagctca

SEQ ID NO: 377976 - DNA, 15 bp, Homo sapiens
tgcattctagctcag

SEQ ID NO: 377977 - DNA, 15 bp, Homo sapiens
gcattctagctcaga

SEQ ID NO: 377978 - DNA, 15 bp, Homo sapiens
cattctagctcagaa

SEQ ID NO: 377979 - DNA, 15 bp, Homo sapiens
attctagctcagaag

SEQ ID NO: 377980 - DNA, 15 bp, Homo sapiens
ttctagctcagaagc

SEQ ID NO: 377981 - DNA, 15 bp, Homo sapiens
tctagctcagaagca

SEQ ID NO: 377982 - DNA, 15 bp, Homo sapiens
ctagctcagaagcat

SEQ ID NO: 377983 - DNA, 15 bp, Homo sapiens
tagctcagaagcatc

SEQ ID NO: 377984 - DNA, 15 bp, Homo sapiens
agctcagaagcatct

SEQ ID NO: 377985 - DNA, 15 bp, Homo sapiens
gctcagaagcatcta

SEQ ID NO: 377986 - DNA, 15 bp, Homo sapiens
ctcagaagcatctag

SEQ ID NO: 377987 - DNA, 15 bp, Homo sapiens
tcagaagcatctagg

SEQ ID NO: 377988 - DNA, 15 bp, Homo sapiens
cagaagcatctaggt

SEQ ID NO: 377989 - DNA, 15 bp, Homo sapiens
agaagcatctaggtt

SEQ ID NO: 377990 - DNA, 15 bp, Homo sapiens
gaagcatctaggttc

SEQ ID NO: 377991 - DNA, 15 bp, Homo sapiens
aagcatctaggttct

SEQ ID NO: 377992 - DNA, 15 bp, Homo sapiens
agcatctaggttcta

SEQ ID NO: 377993 - DNA, 15 bp, Homo sapiens
gcatctaggttctac

SEQ ID NO: 377994 - DNA, 15 bp, Homo sapiens
catctaggttctaca

SEQ ID NO: 377995 - DNA, 15 bp, Homo sapiens
atctaggttctacaa

SEQ ID NO: 377996 - DNA, 15 bp, Homo sapiens
tctaggttctacaaa

SEQ ID NO: 377997 - DNA, 15 bp, Homo sapiens
ctaggttctacaaac

SEQ ID NO: 377998 - DNA, 15 bp, Homo sapiens
taggttctacaaacc

SEQ ID NO: 377999 - DNA, 15 bp, Homo sapiens
aggttctacaaaccc

SEQ ID NO: 378000 - DNA, 15 bp, Homo sapiens
ggttctacaaaccct

SEQ ID NO: 378001 - DNA, 15 bp, Homo sapiens
gttctacaaaccctt

SEQ ID NO: 378002 - DNA, 15 bp, Homo sapiens
ttctacaaacccttc

SEQ ID NO: 378003 - DNA, 15 bp, Homo sapiens
tctacaaacccttct

SEQ ID NO: 378004 - DNA, 15 bp, Homo sapiens
ctacaaacccttctt

SEQ ID NO: 378005 - DNA, 15 bp, Homo sapiens
tacaaacccttctta

SEQ ID NO: 378006 - DNA, 15 bp, Homo sapiens
acaaacccttcttag

SEQ ID NO: 378007 - DNA, 15 bp, Homo sapiens
caaacccttcttagt

SEQ ID NO: 378008 - DNA, 15 bp, Homo sapiens
aaacccttcttagtg

SEQ ID NO: 378009 - DNA, 15 bp, Homo sapiens
aacccttcttagtgg

SEQ ID NO: 378010 - DNA, 15 bp, Homo sapiens
acccttcttagtggg

SEQ ID NO: 378011 - DNA, 15 bp, Homo sapiens
cccttcttagtggga

SEQ ID NO: 378012 - DNA, 15 bp, Homo sapiens
ccttcttagtgggaa

SEQ ID NO: 378013 - DNA, 15 bp, Homo sapiens
cttcttagtgggaat

SEQ ID NO: 378014 - DNA, 15 bp, Homo sapiens
ttcttagtgggaatg

SEQ ID NO: 378015 - DNA, 15 bp, Homo sapiens
tcttagtgggaatgt

SEQ ID NO: 378016 - DNA, 15 bp, Homo sapiens
cttagtgggaatgta

SEQ ID NO: 378017 - DNA, 15 bp, Homo sapiens
ttagtgggaatgtac

SEQ ID NO: 378018 - DNA, 15 bp, Homo sapiens
tagtgggaatgtact

SEQ ID NO: 378019 - DNA, 15 bp, Homo sapiens
agtgggaatgtacta

SEQ ID NO: 378020 - DNA, 15 bp, Homo sapiens
gtgggaatgtactac

SEQ ID NO: 378021 - DNA, 15 bp, Homo sapiens
tgggaatgtactacc

SEQ ID NO: 378022 - DNA, 15 bp, Homo sapiens
gggaatgtactacca

SEQ ID NO: 378023 - DNA, 15 bp, Homo sapiens
ggaatgtactaccaa

SEQ ID NO: 378024 - DNA, 15 bp, Homo sapiens
gaatgtactaccaat

SEQ ID NO: 378025 - DNA, 15 bp, Homo sapiens
aatgtactaccaata

SEQ ID NO: 378026 - DNA, 15 bp, Homo sapiens
atgtactaccaatag

SEQ ID NO: 378027 - DNA, 15 bp, Homo sapiens
tgtactaccaatagc

SEQ ID NO: 378028 - DNA, 15 bp, Homo sapiens
gtactaccaatagca

SEQ ID NO: 378029 - DNA, 15 bp, Homo sapiens
tactaccaatagcaa

SEQ ID NO: 378030 - DNA, 15 bp, Homo sapiens
actaccaatagcaaa

SEQ ID NO: 378031 - DNA, 15 bp, Homo sapiens
ctaccaatagcaaac

SEQ ID NO: 378032 - DNA, 15 bp, Homo sapiens
taccaatagcaaacg

SEQ ID NO: 378033 - DNA, 15 bp, Homo sapiens
accaatagcaaacga

SEQ ID NO: 378034 - DNA, 15 bp, Homo sapiens
ccaatagcaaacgaa

SEQ ID NO: 378035 - DNA, 15 bp, Homo sapiens
caatagcaaacgaag

SEQ ID NO: 378036 - DNA, 15 bp, Homo sapiens
aatagcaaacgaagt

SEQ ID NO: 378037 - DNA, 15 bp, Homo sapiens
atagcaaacgaagtc

SEQ ID NO: 378038 - DNA, 15 bp, Homo sapiens
tagcaaacgaagtct

SEQ ID NO: 378039 - DNA, 15 bp, Homo sapiens
agcaaacgaagtcta

SEQ ID NO: 378040 - DNA, 15 bp, Homo sapiens
gcaaacgaagtctaa

SEQ ID NO: 378041 - DNA, 15 bp, Homo sapiens
caaacgaagtctaaa

SEQ ID NO: 378042 - DNA, 15 bp, Homo sapiens
aaacgaagtctaaat

SEQ ID NO: 378043 - DNA, 15 bp, Homo sapiens
aacgaagtctaaatt

SEQ ID NO: 378044 - DNA, 15 bp, Homo sapiens
acgaagtctaaattc

SEQ ID NO: 378045 - DNA, 15 bp, Homo sapiens
cgaagtctaaattct

SEQ ID NO: 378046 - DNA, 15 bp, Homo sapiens
gaagtctaaattctc

SEQ ID NO: 378047 - DNA, 15 bp, Homo sapiens
aagtctaaattctca

SEQ ID NO: 378048 - DNA, 15 bp, Homo sapiens
agtctaaattctcaa

SEQ ID NO: 378049 - DNA, 15 bp, Homo sapiens
gtctaaattctcaag

SEQ ID NO: 378050 - DNA, 15 bp, Homo sapiens
tctaaattctcaaga

SEQ ID NO: 378051 - DNA, 15 bp, Homo sapiens
ctaaattctcaagag

SEQ ID NO: 378052 - DNA, 15 bp, Homo sapiens
taaattctcaagagt

SEQ ID NO: 378053 - DNA, 15 bp, Homo sapiens
aaattctcaagagtg

SEQ ID NO: 378054 - DNA, 15 bp, Homo sapiens
aattctcaagagtga

SEQ ID NO: 378055 - DNA, 15 bp, Homo sapiens
attctcaagagtgac

SEQ ID NO: 378056 - DNA, 15 bp, Homo sapiens
ttctcaagagtgaca

SEQ ID NO: 378057 - DNA, 15 bp, Homo sapiens
tctcaagagtgacac

SEQ ID NO: 378058 - DNA, 15 bp, Homo sapiens
ctcaagagtgacacc

SEQ ID NO: 378059 - DNA, 15 bp, Homo sapiens
tcaagagtgacacct

SEQ ID NO: 378060 - DNA, 15 bp, Homo sapiens
caagagtgacaccta

SEQ ID NO: 378061 - DNA, 15 bp, Homo sapiens
aagagtgacacctag

SEQ ID NO: 378062 - DNA, 15 bp, Homo sapiens
agagtgacacctagg

SEQ ID NO: 378063 - DNA, 15 bp, Homo sapiens
gagtgacacctaggg

SEQ ID NO: 378064 - DNA, 15 bp, Homo sapiens
agtgacacctaggga

SEQ ID NO: 378065 - DNA, 15 bp, Homo sapiens
gtgacacctagggat

SEQ ID NO: 378066 - DNA, 15 bp, Homo sapiens
tgacacctagggatt

SEQ ID NO: 378067 - DNA, 15 bp, Homo sapiens
gacacctagggattg

SEQ ID NO: 378068 - DNA, 15 bp, Homo sapiens
acacctagggattgt

SEQ ID NO: 378069 - DNA, 15 bp, Homo sapiens
cacctagggattgtc

SEQ ID NO: 378070 - DNA, 15 bp, Homo sapiens
acctagggattgtca

SEQ ID NO: 378071 - DNA, 15 bp, Homo sapiens
cctagggattgtcac

SEQ ID NO: 378072 - DNA, 15 bp, Homo sapiens
ctagggattgtcaca

SEQ ID NO: 378073 - DNA, 15 bp, Homo sapiens
tagggattgtcacaa

SEQ ID NO: 378074 - DNA, 15 bp, Homo sapiens
agggattgtcacaat

SEQ ID NO: 378075 - DNA, 15 bp, Homo sapiens
gggattgtcacaatc

SEQ ID NO: 378076 - DNA, 15 bp, Homo sapiens
ggattgtcacaatct

SEQ ID NO: 378077 - DNA, 15 bp, Homo sapiens
gattgtcacaatctg

SEQ ID NO: 378078 - DNA, 15 bp, Homo sapiens
attgtcacaatctgc

SEQ ID NO: 378079 - DNA, 15 bp, Homo sapiens
ttgtcacaatctgct

SEQ ID NO: 378080 - DNA, 15 bp, Homo sapiens
tgtcacaatctgctg

SEQ ID NO: 378081 - DNA, 15 bp, Homo sapiens
gtcacaatctgctgc

SEQ ID NO: 378082 - DNA, 15 bp, Homo sapiens
tcacaatctgctgcc

SEQ ID NO: 378083 - DNA, 15 bp, Homo sapiens
cacaatctgctgcca

SEQ ID NO: 378084 - DNA, 15 bp, Homo sapiens
acaatctgctgccac

SEQ ID NO: 378085 - DNA, 15 bp, Homo sapiens
caatctgctgccact

SEQ ID NO: 378086 - DNA, 15 bp, Homo sapiens
aatctgctgccacta

SEQ ID NO: 378087 - DNA, 15 bp, Homo sapiens
atctgctgccactac

SEQ ID NO: 378088 - DNA, 15 bp, Homo sapiens
tctgctgccactacc

SEQ ID NO: 378089 - DNA, 15 bp, Homo sapiens
ctgctgccactaccc

SEQ ID NO: 378090 - DNA, 15 bp, Homo sapiens
tgctgccactacccc

SEQ ID NO: 378091 - DNA, 15 bp, Homo sapiens
gctgccactacccct

SEQ ID NO: 378092 - DNA, 15 bp, Homo sapiens
ctgccactacccctt

SEQ ID NO: 378093 - DNA, 15 bp, Homo sapiens
tgccactaccccttt

SEQ ID NO: 378094 - DNA, 15 bp, Homo sapiens
gccactacccctttt

SEQ ID NO: 378095 - DNA, 15 bp, Homo sapiens
ccactaccccttttc

SEQ ID NO: 378096 - DNA, 15 bp, Homo sapiens
cactaccccttttct

SEQ ID NO: 378097 - DNA, 15 bp, Homo sapiens
actaccccttttctc

SEQ ID NO: 378098 - DNA, 15 bp, Homo sapiens
ctaccccttttctca

SEQ ID NO: 378099 - DNA, 15 bp, Homo sapiens
taccccttttctcac

SEQ ID NO: 378100 - DNA, 15 bp, Homo sapiens
accccttttctcact

SEQ ID NO: 378101 - DNA, 15 bp, Homo sapiens
ccccttttctcactt

SEQ ID NO: 378102 - DNA, 15 bp, Homo sapiens
cccttttctcacttc

SEQ ID NO: 378103 - DNA, 15 bp, Homo sapiens
ccttttctcacttca

SEQ ID NO: 378104 - DNA, 15 bp, Homo sapiens
cttttctcacttcag

SEQ ID NO: 378105 - DNA, 15 bp, Homo sapiens
ttttctcacttcagc

SEQ ID NO: 378106 - DNA, 15 bp, Homo sapiens
tttctcacttcagcc

SEQ ID NO: 378107 - DNA, 15 bp, Homo sapiens
ttctcacttcagccc

SEQ ID NO: 378108 - DNA, 15 bp, Homo sapiens
tctcacttcagccct

SEQ ID NO: 378109 - DNA, 15 bp, Homo sapiens
ctcacttcagccctc

SEQ ID NO: 378110 - DNA, 15 bp, Homo sapiens
tcacttcagccctca

SEQ ID NO: 378111 - DNA, 15 bp, Homo sapiens
cacttcagccctcag

SEQ ID NO: 378112 - DNA, 15 bp, Homo sapiens
acttcagccctcagc

SEQ ID NO: 378113 - DNA, 15 bp, Homo sapiens
cttcagccctcagcc

SEQ ID NO: 378114 - DNA, 15 bp, Homo sapiens
ttcagccctcagccc

SEQ ID NO: 378115 - DNA, 15 bp, Homo sapiens
tcagccctcagcccg

SEQ ID NO: 378116 - DNA, 15 bp, Homo sapiens
cagccctcagcccgg

SEQ ID NO: 378117 - DNA, 15 bp, Homo sapiens
agccctcagcccggc

SEQ ID NO: 378118 - DNA, 15 bp, Homo sapiens
gccctcagcccggcc

SEQ ID NO: 378119 - DNA, 15 bp, Homo sapiens
ccctcagcccggcct

SEQ ID NO: 378120 - DNA, 15 bp, Homo sapiens
cctcagcccggcctg

SEQ ID NO: 378121 - DNA, 15 bp, Homo sapiens
ctcagcccggcctgt

SEQ ID NO: 378122 - DNA, 15 bp, Homo sapiens
tcagcccggcctgta

SEQ ID NO: 378123 - DNA, 15 bp, Homo sapiens
cagcccggcctgtaa

SEQ ID NO: 378124 - DNA, 15 bp, Homo sapiens
agcccggcctgtaat

SEQ ID NO: 378125 - DNA, 15 bp, Homo sapiens
gcccggcctgtaatt

SEQ ID NO: 378126 - DNA, 15 bp, Homo sapiens
cccggcctgtaatta

SEQ ID NO: 378127 - DNA, 15 bp, Homo sapiens
ccggcctgtaattat

SEQ ID NO: 378128 - DNA, 15 bp, Homo sapiens
cggcctgtaattatg

SEQ ID NO: 378129 - DNA, 15 bp, Homo sapiens
ggcctgtaattatgc

SEQ ID NO: 378130 - DNA, 15 bp, Homo sapiens
gcctgtaattatgct

SEQ ID NO: 378131 - DNA, 15 bp, Homo sapiens
cctgtaattatgctg

SEQ ID NO: 378132 - DNA, 15 bp, Homo sapiens
ctgtaattatgctgt

SEQ ID NO: 378133 - DNA, 15 bp, Homo sapiens
tgtaattatgctgtt

SEQ ID NO: 378134 - DNA, 15 bp, Homo sapiens
gtaattatgctgtta

SEQ ID NO: 378135 - DNA, 15 bp, Homo sapiens
taattatgctgttat

SEQ ID NO: 378136 - DNA, 15 bp, Homo sapiens
aattatgctgttatt

SEQ ID NO: 378137 - DNA, 15 bp, Homo sapiens
attatgctgttattc

SEQ ID NO: 378138 - DNA, 15 bp, Homo sapiens
ttatgctgttattcc

SEQ ID NO: 378139 - DNA, 15 bp, Homo sapiens
tatgctgttattcct

SEQ ID NO: 378140 - DNA, 15 bp, Homo sapiens
atgctgttattcctt

SEQ ID NO: 378141 - DNA, 15 bp, Homo sapiens
tgctgttattcctta

SEQ ID NO: 378142 - DNA, 15 bp, Homo sapiens
gctgttattccttaa

SEQ ID NO: 378143 - DNA, 15 bp, Homo sapiens
ctgttattccttaaa

SEQ ID NO: 378144 - DNA, 15 bp, Homo sapiens
tgttattccttaaaa

SEQ ID NO: 378145 - DNA, 15 bp, Homo sapiens
gttattccttaaaat

SEQ ID NO: 378146 - DNA, 15 bp, Homo sapiens
ttattccttaaaata

SEQ ID NO: 378147 - DNA, 15 bp, Homo sapiens
tattccttaaaatat

SEQ ID NO: 378148 - DNA, 15 bp, Homo sapiens
attccttaaaatatc

SEQ ID NO: 378149 - DNA, 15 bp, Homo sapiens
ttccttaaaatatcc

SEQ ID NO: 378150 - DNA, 15 bp, Homo sapiens
tccttaaaatatcct

SEQ ID NO: 378151 - DNA, 15 bp, Homo sapiens
ccttaaaatatcctg

SEQ ID NO: 378152 - DNA, 15 bp, Homo sapiens
cttaaaatatcctga

SEQ ID NO: 378153 - DNA, 15 bp, Homo sapiens
ttaaaatatcctgac

SEQ ID NO: 378154 - DNA, 15 bp, Homo sapiens
taaaatatcctgaca

SEQ ID NO: 378155 - DNA, 15 bp, Homo sapiens
aaaatatcctgacat

SEQ ID NO: 378156 - DNA, 15 bp, Homo sapiens
aaatatcctgacatt

SEQ ID NO: 378157 - DNA, 15 bp, Homo sapiens
aatatcctgacattt

SEQ ID NO: 378158 - DNA, 15 bp, Homo sapiens
atatcctgacatttc

SEQ ID NO: 378159 - DNA, 15 bp, Homo sapiens
tatcctgacatttcc

SEQ ID NO: 378160 - DNA, 15 bp, Homo sapiens
atcctgacatttcct

SEQ ID NO: 378161 - DNA, 15 bp, Homo sapiens
tcctgacatttccta

SEQ ID NO: 378162 - DNA, 15 bp, Homo sapiens
cctgacatttcctag

SEQ ID NO: 378163 - DNA, 15 bp, Homo sapiens
ctgacatttcctagt

SEQ ID NO: 378164 - DNA, 15 bp, Homo sapiens
tgacatttcctagtc

SEQ ID NO: 378165 - DNA, 15 bp, Homo sapiens
gacatttcctagtct

SEQ ID NO: 378166 - DNA, 15 bp, Homo sapiens
acatttcctagtctt

SEQ ID NO: 378167 - DNA, 15 bp, Homo sapiens
catttcctagtcttc

SEQ ID NO: 378168 - DNA, 15 bp, Homo sapiens
atttcctagtcttct

SEQ ID NO: 378169 - DNA, 15 bp, Homo sapiens
tttcctagtcttctt

SEQ ID NO: 378170 - DNA, 15 bp, Homo sapiens
ttcctagtcttctta

SEQ ID NO: 378171 - DNA, 15 bp, Homo sapiens
tcctagtcttcttac

SEQ ID NO: 378172 - DNA, 15 bp, Homo sapiens
cctagtcttcttacc

SEQ ID NO: 378173 - DNA, 15 bp, Homo sapiens
ctagtcttcttacct

SEQ ID NO: 378174 - DNA, 15 bp, Homo sapiens
tagtcttcttacctt

SEQ ID NO: 378175 - DNA, 15 bp, Homo sapiens
agtcttcttaccttt

SEQ ID NO: 378176 - DNA, 15 bp, Homo sapiens
gtcttcttaccttta

SEQ ID NO: 378177 - DNA, 15 bp, Homo sapiens
tcttcttacctttat

SEQ ID NO: 378178 - DNA, 15 bp, Homo sapiens
cttcttacctttatt

SEQ ID NO: 378179 - DNA, 15 bp, Homo sapiens
ttcttacctttattt

SEQ ID NO: 378180 - DNA, 15 bp, Homo sapiens
tcttacctttatttg

SEQ ID NO: 378181 - DNA, 15 bp, Homo sapiens
cttacctttatttgc

SEQ ID NO: 378182 - DNA, 15 bp, Homo sapiens
ttacctttatttgca

SEQ ID NO: 378183 - DNA, 15 bp, Homo sapiens
tacctttatttgcat

SEQ ID NO: 378184 - DNA, 15 bp, Homo sapiens
acctttatttgcatt

SEQ ID NO: 378185 - DNA, 15 bp, Homo sapiens
cctttatttgcatta

SEQ ID NO: 378186 - DNA, 15 bp, Homo sapiens
ctttatttgcattat

SEQ ID NO: 378187 - DNA, 15 bp, Homo sapiens
tttatttgcattatt

SEQ ID NO: 378188 - DNA, 15 bp, Homo sapiens
ttatttgcattattt

SEQ ID NO: 378189 - DNA, 15 bp, Homo sapiens
tatttgcattatttt

SEQ ID NO: 378190 - DNA, 15 bp, Homo sapiens
atttgcattatttta

SEQ ID NO: 378191 - DNA, 15 bp, Homo sapiens
tttgcattattttat

SEQ ID NO: 378192 - DNA, 15 bp, Homo sapiens
ttgcattattttatt

SEQ ID NO: 378193 - DNA, 15 bp, Homo sapiens
tgcattattttattt

SEQ ID NO: 378194 - DNA, 15 bp, Homo sapiens
gcattattttatttc

SEQ ID NO: 378195 - DNA, 15 bp, Homo sapiens
cattattttatttct

SEQ ID NO: 378196 - DNA, 15 bp, Homo sapiens
attattttatttctc

SEQ ID NO: 378197 - DNA, 15 bp, Homo sapiens
ttattttatttctct

SEQ ID NO: 378198 - DNA, 15 bp, Homo sapiens
tattttatttctctt

SEQ ID NO: 378199 - DNA, 15 bp, Homo sapiens
attttatttctcttg

SEQ ID NO: 378200 - DNA, 15 bp, Homo sapiens
ttttatttctcttgg

SEQ ID NO: 378201 - DNA, 15 bp, Homo sapiens
tttatttctcttggc

SEQ ID NO: 378202 - DNA, 15 bp, Homo sapiens
ttatttctcttggcc

SEQ ID NO: 378203 - DNA, 15 bp, Homo sapiens
tatttctcttggcct

SEQ ID NO: 378204 - DNA, 15 bp, Homo sapiens
atttctcttggcctt

SEQ ID NO: 378205 - DNA, 15 bp, Homo sapiens
tttctcttggccttt

SEQ ID NO: 378206 - DNA, 15 bp, Homo sapiens
ttctcttggcctttt

SEQ ID NO: 378207 - DNA, 15 bp, Homo sapiens
tctcttggccttttc

SEQ ID NO: 378208 - DNA, 15 bp, Homo sapiens
ctcttggccttttct

SEQ ID NO: 378209 - DNA, 15 bp, Homo sapiens
tcttggccttttctt

SEQ ID NO: 378210 - DNA, 15 bp, Homo sapiens
cttggccttttcttc

SEQ ID NO: 378211 - DNA, 15 bp, Homo sapiens
ttggccttttcttcc

SEQ ID NO: 378212 - DNA, 15 bp, Homo sapiens
tggccttttcttccc

SEQ ID NO: 378213 - DNA, 15 bp, Homo sapiens
ggccttttcttccca

SEQ ID NO: 378214 - DNA, 15 bp, Homo sapiens
gccttttcttcccag

SEQ ID NO: 378215 - DNA, 15 bp, Homo sapiens
ccttttcttcccagg

SEQ ID NO: 378216 - DNA, 15 bp, Homo sapiens
cttttcttcccaggt

SEQ ID NO: 378217 - DNA, 15 bp, Homo sapiens
ttttcttcccaggtg

SEQ ID NO: 378218 - DNA, 15 bp, Homo sapiens
tttcttcccaggtgc

SEQ ID NO: 378219 - DNA, 15 bp, Homo sapiens
ttcttcccaggtgca

SEQ ID NO: 378220 - DNA, 15 bp, Homo sapiens
tcttcccaggtgcaa

SEQ ID NO: 378221 - DNA, 15 bp, Homo sapiens
cttcccaggtgcaat

SEQ ID NO: 378222 - DNA, 15 bp, Homo sapiens
tcccaggtgcaattc

SEQ ID NO: 378223 - DNA, 15 bp, Homo sapiens
cccaggtgcaattct

SEQ ID NO: 378224 - DNA, 15 bp, Homo sapiens
ccaggtgcaattcta

SEQ ID NO: 378225 - DNA, 15 bp, Homo sapiens
caggtgcaattctac

SEQ ID NO: 378226 - DNA, 15 bp, Homo sapiens
aggtgcaattctacg

SEQ ID NO: 378227 - DNA, 15 bp, Homo sapiens
ggtgcaattctacgc

SEQ ID NO: 378228 - DNA, 15 bp, Homo sapiens
gtgcaattctacgca

SEQ ID NO: 378229 - DNA, 15 bp, Homo sapiens
tgcaattctacgcag

SEQ ID NO: 378230 - DNA, 15 bp, Homo sapiens
gcaattctacgcagc

SEQ ID NO: 378231 - DNA, 15 bp, Homo sapiens
caattctacgcagca

SEQ ID NO: 378232 - DNA, 15 bp, Homo sapiens
aattctacgcagcag

SEQ ID NO: 378233 - DNA, 15 bp, Homo sapiens
attctacgcagcagc

SEQ ID NO: 378234 - DNA, 15 bp, Homo sapiens
ttctacgcagcagct

SEQ ID NO: 378235 - DNA, 15 bp, Homo sapiens
tctacgcagcagcta

SEQ ID NO: 378236 - DNA, 15 bp, Homo sapiens
ctacgcagcagctaa

SEQ ID NO: 378237 - DNA, 15 bp, Homo sapiens
tacgcagcagctaaa

SEQ ID NO: 378238 - DNA, 15 bp, Homo sapiens
acgcagcagctaaaa

SEQ ID NO: 378239 - DNA, 15 bp, Homo sapiens
cgcagcagctaaaat

SEQ ID NO: 378240 - DNA, 15 bp, Homo sapiens
gcagcagctaaaatg

SEQ ID NO: 378241 - DNA, 15 bp, Homo sapiens
cagcagctaaaatgt

SEQ ID NO: 378242 - DNA, 15 bp, Homo sapiens
agcagctaaaatgtc

SEQ ID NO: 378243 - DNA, 15 bp, Homo sapiens
gcagctaaaatgtca

SEQ ID NO: 378244 - DNA, 15 bp, Homo sapiens
cagctaaaatgtcat

SEQ ID NO: 378245 - DNA, 15 bp, Homo sapiens
agctaaaatgtcatc

SEQ ID NO: 378246 - DNA, 15 bp, Homo sapiens
gctaaaatgtcatcc

SEQ ID NO: 378247 - DNA, 15 bp, Homo sapiens
ctaaaatgtcatccc

SEQ ID NO: 378248 - DNA, 15 bp, Homo sapiens
taaaatgtcatcccc

SEQ ID NO: 378249 - DNA, 15 bp, Homo sapiens
aaaatgtcatcccct

SEQ ID NO: 378250 - DNA, 15 bp, Homo sapiens
aaatgtcatcccctt

SEQ ID NO: 378251 - DNA, 15 bp, Homo sapiens
aatgtcatccccttt

SEQ ID NO: 378252 - DNA, 15 bp, Homo sapiens
atgtcatcccctttg

SEQ ID NO: 378253 - DNA, 15 bp, Homo sapiens
tgtcatcccctttgt

SEQ ID NO: 378254 - DNA, 15 bp, Homo sapiens
gtcatcccctttgtg

SEQ ID NO: 378255 - DNA, 15 bp, Homo sapiens
tcatcccctttgtga

SEQ ID NO: 378256 - DNA, 15 bp, Homo sapiens
catcccctttgtgac

SEQ ID NO: 378257 - DNA, 15 bp, Homo sapiens
atcccctttgtgaca

SEQ ID NO: 378258 - DNA, 15 bp, Homo sapiens
tcccctttgtgacat

SEQ ID NO: 378259 - DNA, 15 bp, Homo sapiens
cccctttgtgacatc

SEQ ID NO: 378260 - DNA, 15 bp, Homo sapiens
ccctttgtgacatct

SEQ ID NO: 378261 - DNA, 15 bp, Homo sapiens
cctttgtgacatctt

SEQ ID NO: 378262 - DNA, 15 bp, Homo sapiens
ctttgtgacatcttt

SEQ ID NO: 378263 - DNA, 15 bp, Homo sapiens
tttgtgacatctttc

SEQ ID NO: 378264 - DNA, 15 bp, Homo sapiens
ttgtgacatctttcc

SEQ ID NO: 378265 - DNA, 15 bp, Homo sapiens
tgtgacatctttccc

SEQ ID NO: 378266 - DNA, 15 bp, Homo sapiens
gtgacatctttccct

SEQ ID NO: 378267 - DNA, 15 bp, Homo sapiens
tgacatctttccctc

SEQ ID NO: 378268 - DNA, 15 bp, Homo sapiens
gacatctttccctcc

SEQ ID NO: 378269 - DNA, 15 bp, Homo sapiens
acatctttccctcct

SEQ ID NO: 378270 - DNA, 15 bp, Homo sapiens
catctttccctcctc

SEQ ID NO: 378271 - DNA, 15 bp, Homo sapiens
atctttccctcctct

SEQ ID NO: 378272 - DNA, 15 bp, Homo sapiens
tctttccctcctctt

SEQ ID NO: 378273 - DNA, 15 bp, Homo sapiens
ctttccctcctcttc

SEQ ID NO: 378274 - DNA, 15 bp, Homo sapiens
tttccctcctcttct

SEQ ID NO: 378275 - DNA, 15 bp, Homo sapiens
ttccctcctcttctg

SEQ ID NO: 378276 - DNA, 15 bp, Homo sapiens
tccctcctcttctgg

SEQ ID NO: 378277 - DNA, 15 bp, Homo sapiens
ccctcctcttctggt

SEQ ID NO: 378278 - DNA, 15 bp, Homo sapiens
cctcctcttctggtc

SEQ ID NO: 378279 - DNA, 15 bp, Homo sapiens
ctcctcttctggtcc

SEQ ID NO: 378280 - DNA, 15 bp, Homo sapiens
tcctcttctggtccc

SEQ ID NO: 378281 - DNA, 15 bp, Homo sapiens
cctcttctggtccct

SEQ ID NO: 378282 - DNA, 15 bp, Homo sapiens
ctcttctggtccctg

SEQ ID NO: 378283 - DNA, 15 bp, Homo sapiens
tcttctggtccctgg

SEQ ID NO: 378284 - DNA, 15 bp, Homo sapiens
cttctggtccctggt

SEQ ID NO: 378285 - DNA, 15 bp, Homo sapiens
ttctggtccctggtg

SEQ ID NO: 378286 - DNA, 15 bp, Homo sapiens
tctggtccctggtga

SEQ ID NO: 378287 - DNA, 15 bp, Homo sapiens
ctggtccctggtgaa

SEQ ID NO: 378288 - DNA, 15 bp, Homo sapiens
tggtccctggtgaat

SEQ ID NO: 378289 - DNA, 15 bp, Homo sapiens
ggtccctggtgaatg

SEQ ID NO: 378290 - DNA, 15 bp, Homo sapiens
gtccctggtgaatgt

SEQ ID NO: 378291 - DNA, 15 bp, Homo sapiens
tccctggtgaatgtt

SEQ ID NO: 378292 - DNA, 15 bp, Homo sapiens
ccctggtgaatgtta

SEQ ID NO: 378293 - DNA, 15 bp, Homo sapiens
cctggtgaatgttaa

SEQ ID NO: 378294 - DNA, 15 bp, Homo sapiens
ctggtgaatgttaat

SEQ ID NO: 378295 - DNA, 15 bp, Homo sapiens
tggtgaatgttaatt

SEQ ID NO: 378296 - DNA, 15 bp, Homo sapiens
ggtgaatgttaattt

SEQ ID NO: 378297 - DNA, 15 bp, Homo sapiens
gtgaatgttaatttc

SEQ ID NO: 378298 - DNA, 15 bp, Homo sapiens
tgaatgttaatttct

SEQ ID NO: 378299 - DNA, 15 bp, Homo sapiens
gaatgttaatttcta

SEQ ID NO: 378300 - DNA, 15 bp, Homo sapiens
aatgttaatttctat

SEQ ID NO: 378301 - DNA, 15 bp, Homo sapiens
atgttaatttctatt

SEQ ID NO: 378302 - DNA, 15 bp, Homo sapiens
tgttaatttctattt

SEQ ID NO: 378303 - DNA, 15 bp, Homo sapiens
gttaatttctatttt

SEQ ID NO: 378304 - DNA, 15 bp, Homo sapiens
ttaatttctattttt

SEQ ID NO: 378305 - DNA, 15 bp, Homo sapiens
taatttctattttta

SEQ ID NO: 378306 - DNA, 15 bp, Homo sapiens
aatttctatttttag

SEQ ID NO: 378307 - DNA, 15 bp, Homo sapiens
atttctatttttagt

SEQ ID NO: 378308 - DNA, 15 bp, Homo sapiens
tttctatttttagtt

SEQ ID NO: 378309 - DNA, 15 bp, Homo sapiens
ttctatttttagttc

SEQ ID NO: 378310 - DNA, 15 bp, Homo sapiens
tctatttttagttcc

SEQ ID NO: 378311 - DNA, 15 bp, Homo sapiens
ctatttttagttcct

SEQ ID NO: 378312 - DNA, 15 bp, Homo sapiens
tatttttagttcctt

SEQ ID NO: 378313 - DNA, 15 bp, Homo sapiens
atttttagttccttc

SEQ ID NO: 378314 - DNA, 15 bp, Homo sapiens
tttttagttccttct

SEQ ID NO: 378315 - DNA, 15 bp, Homo sapiens
ttttagttccttcta

SEQ ID NO: 378316 - DNA, 15 bp, Homo sapiens
tttagttccttctat

SEQ ID NO: 378317 - DNA, 15 bp, Homo sapiens
ttagttccttctatg

SEQ ID NO: 378318 - DNA, 15 bp, Homo sapiens
tagttccttctatgg

SEQ ID NO: 378319 - DNA, 15 bp, Homo sapiens
agttccttctatggc

SEQ ID NO: 378320 - DNA, 15 bp, Homo sapiens
gttccttctatggcc

SEQ ID NO: 378321 - DNA, 15 bp, Homo sapiens
ttccttctatggcct

SEQ ID NO: 378322 - DNA, 15 bp, Homo sapiens
tccttctatggcctt

SEQ ID NO: 378323 - DNA, 15 bp, Homo sapiens
ccttctatggccttt

SEQ ID NO: 378324 - DNA, 15 bp, Homo sapiens
cttctatggcctttc

SEQ ID NO: 378325 - DNA, 15 bp, Homo sapiens
ttctatggcctttcc

SEQ ID NO: 378326 - DNA, 15 bp, Homo sapiens
tctatggcctttccc

SEQ ID NO: 378327 - DNA, 15 bp, Homo sapiens
ctatggcctttcccc

SEQ ID NO: 378328 - DNA, 15 bp, Homo sapiens
tatggcctttccccc

SEQ ID NO: 378329 - DNA, 15 bp, Homo sapiens
atggcctttcccccc

SEQ ID NO: 378330 - DNA, 15 bp, Homo sapiens
tggcctttcccccca

SEQ ID NO: 378331 - DNA, 15 bp, Homo sapiens
ggcctttccccccat

SEQ ID NO: 378332 - DNA, 15 bp, Homo sapiens
gcctttccccccatt

SEQ ID NO: 378333 - DNA, 15 bp, Homo sapiens
cctttccccccattg

SEQ ID NO: 378334 - DNA, 15 bp, Homo sapiens
ctttccccccattgc

SEQ ID NO: 378335 - DNA, 15 bp, Homo sapiens
tttccccccattgct

SEQ ID NO: 378336 - DNA, 15 bp, Homo sapiens
ttccccccattgctt

SEQ ID NO: 378337 - DNA, 15 bp, Homo sapiens
tccccccattgcttt

SEQ ID NO: 378338 - DNA, 15 bp, Homo sapiens
ccccccattgcttta

SEQ ID NO: 378339 - DNA, 15 bp, Homo sapiens
cccccattgctttat

SEQ ID NO: 378340 - DNA, 15 bp, Homo sapiens
ccccattgctttatt

SEQ ID NO: 378341 - DNA, 15 bp, Homo sapiens
cccattgctttatta

SEQ ID NO: 378342 - DNA, 15 bp, Homo sapiens
ccattgctttattat

SEQ ID NO: 378343 - DNA, 15 bp, Homo sapiens
cattgctttattata

SEQ ID NO: 378344 - DNA, 15 bp, Homo sapiens
attgctttattatag

SEQ ID NO: 378345 - DNA, 15 bp, Homo sapiens
ttgctttattataga

SEQ ID NO: 378346 - DNA, 15 bp, Homo sapiens
tgctttattatagat

SEQ ID NO: 378347 - DNA, 15 bp, Homo sapiens
gctttattatagatc

SEQ ID NO: 378348 - DNA, 15 bp, Homo sapiens
ctttattatagatct

SEQ ID NO: 378349 - DNA, 15 bp, Homo sapiens
tttattatagatctt

SEQ ID NO: 378350 - DNA, 15 bp, Homo sapiens
ttattatagatctta

SEQ ID NO: 378351 - DNA, 15 bp, Homo sapiens
tattatagatcttac

SEQ ID NO: 378352 - DNA, 15 bp, Homo sapiens
attatagatcttaca

SEQ ID NO: 378353 - DNA, 15 bp, Homo sapiens
ttatagatcttacaa

SEQ ID NO: 378354 - DNA, 15 bp, Homo sapiens
tatagatcttacaac

SEQ ID NO: 378355 - DNA, 15 bp, Homo sapiens
atagatcttacaact

SEQ ID NO: 378356 - DNA, 15 bp, Homo sapiens
tagatcttacaacta

SEQ ID NO: 378357 - DNA, 15 bp, Homo sapiens
agatcttacaactac

SEQ ID NO: 378358 - DNA, 15 bp, Homo sapiens
gatcttacaactact

SEQ ID NO: 378359 - DNA, 15 bp, Homo sapiens
atcttacaactactt

SEQ ID NO: 378360 - DNA, 15 bp, Homo sapiens
tcttacaactacttt

SEQ ID NO: 378361 - DNA, 15 bp, Homo sapiens
cttacaactacttta

SEQ ID NO: 378362 - DNA, 15 bp, Homo sapiens
ttacaactactttaa

SEQ ID NO: 378363 - DNA, 15 bp, Homo sapiens
tacaactactttaat

SEQ ID NO: 378364 - DNA, 15 bp, Homo sapiens
acaactactttaatt

SEQ ID NO: 378365 - DNA, 15 bp, Homo sapiens
caactactttaattg

SEQ ID NO: 378366 - DNA, 15 bp, Homo sapiens
aactactttaattgt

SEQ ID NO: 378367 - DNA, 15 bp, Homo sapiens
actactttaattgtc

SEQ ID NO: 378368 - DNA, 15 bp, Homo sapiens
ctactttaattgtct

SEQ ID NO: 378369 - DNA, 15 bp, Homo sapiens
tactttaattgtctc

SEQ ID NO: 378370 - DNA, 15 bp, Homo sapiens
actttaattgtctct

SEQ ID NO: 378371 - DNA, 15 bp, Homo sapiens
ctttaattgtctctc

SEQ ID NO: 378372 - DNA, 15 bp, Homo sapiens
tttaattgtctctct

SEQ ID NO: 378373 - DNA, 15 bp, Homo sapiens
ttaattgtctctctc

SEQ ID NO: 378374 - DNA, 15 bp, Homo sapiens
taattgtctctctct

SEQ ID NO: 378375 - DNA, 15 bp, Homo sapiens
aattgtctctctctt

SEQ ID NO: 378376 - DNA, 15 bp, Homo sapiens
attgtctctctcttc

SEQ ID NO: 378377 - DNA, 15 bp, Homo sapiens
ttgtctctctcttcc

SEQ ID NO: 378378 - DNA, 15 bp, Homo sapiens
tgtctctctcttcca

SEQ ID NO: 378379 - DNA, 15 bp, Homo sapiens
gtctctctcttccat

SEQ ID NO: 378380 - DNA, 15 bp, Homo sapiens
tctctctcttccata

SEQ ID NO: 378381 - DNA, 15 bp, Homo sapiens
ctctctcttccatag

SEQ ID NO: 378382 - DNA, 15 bp, Homo sapiens
tctctcttccataga

SEQ ID NO: 378383 - DNA, 15 bp, Homo sapiens
ctctcttccatagat

SEQ ID NO: 378384 - DNA, 15 bp, Homo sapiens
tctcttccatagatt

SEQ ID NO: 378385 - DNA, 15 bp, Homo sapiens
ctcttccatagattg

SEQ ID NO: 378386 - DNA, 15 bp, Homo sapiens
tcttccatagattgt

SEQ ID NO: 378387 - DNA, 15 bp, Homo sapiens
cttccatagattgtg

SEQ ID NO: 378388 - DNA, 15 bp, Homo sapiens
ttccatagattgtga

SEQ ID NO: 378389 - DNA, 15 bp, Homo sapiens
tccatagattgtgaa

SEQ ID NO: 378390 - DNA, 15 bp, Homo sapiens
ccatagattgtgaat

SEQ ID NO: 378391 - DNA, 15 bp, Homo sapiens
catagattgtgaata

SEQ ID NO: 378392 - DNA, 15 bp, Homo sapiens
atagattgtgaatat

SEQ ID NO: 378393 - DNA, 15 bp, Homo sapiens
tagattgtgaatatc

SEQ ID NO: 378394 - DNA, 15 bp, Homo sapiens
agattgtgaatatcc

SEQ ID NO: 378395 - DNA, 15 bp, Homo sapiens
gattgtgaatatccg

SEQ ID NO: 378396 - DNA, 15 bp, Homo sapiens
attgtgaatatccgt

SEQ ID NO: 378397 - DNA, 15 bp, Homo sapiens
ttgtgaatatccgtc

SEQ ID NO: 378398 - DNA, 15 bp, Homo sapiens
tgtgaatatccgtct

SEQ ID NO: 378399 - DNA, 15 bp, Homo sapiens
gtgaatatccgtctt

SEQ ID NO: 378400 - DNA, 15 bp, Homo sapiens
tgaatatccgtcttt

SEQ ID NO: 378401 - DNA, 15 bp, Homo sapiens
gaatatccgtctttc

SEQ ID NO: 378402 - DNA, 15 bp, Homo sapiens
aatatccgtctttct

SEQ ID NO: 378403 - DNA, 15 bp, Homo sapiens
atatccgtctttctg

SEQ ID NO: 378404 - DNA, 15 bp, Homo sapiens
tatccgtctttctgc

SEQ ID NO: 378405 - DNA, 15 bp, Homo sapiens
atccgtctttctgcc

SEQ ID NO: 378406 - DNA, 15 bp, Homo sapiens
tccgtctttctgccc

SEQ ID NO: 378407 - DNA, 15 bp, Homo sapiens
ccgtctttctgccct

SEQ ID NO: 378408 - DNA, 15 bp, Homo sapiens
cgtctttctgccctt

SEQ ID NO: 378409 - DNA, 15 bp, Homo sapiens
gtctttctgcccttg

SEQ ID NO: 378410 - DNA, 15 bp, Homo sapiens
tctttctgcccttgg

SEQ ID NO: 378411 - DNA, 15 bp, Homo sapiens
ctttctgcccttggg

SEQ ID NO: 378412 - DNA, 15 bp, Homo sapiens
tttctgcccttgggc

SEQ ID NO: 378413 - DNA, 15 bp, Homo sapiens
ttctgcccttgggcc

SEQ ID NO: 378414 - DNA, 15 bp, Homo sapiens
tctgcccttgggcct

SEQ ID NO: 378415 - DNA, 15 bp, Homo sapiens
ctgcccttgggcctt

SEQ ID NO: 378416 - DNA, 15 bp, Homo sapiens
tgcccttgggccttt

SEQ ID NO: 378417 - DNA, 15 bp, Homo sapiens
gcccttgggccttta

SEQ ID NO: 378418 - DNA, 15 bp, Homo sapiens
cccttgggcctttaa

SEQ ID NO: 378419 - DNA, 15 bp, Homo sapiens
ccttgggcctttaac

SEQ ID NO: 378420 - DNA, 15 bp, Homo sapiens
cttgggcctttaaca

SEQ ID NO: 378421 - DNA, 15 bp, Homo sapiens
ttgggcctttaacag

SEQ ID NO: 378422 - DNA, 15 bp, Homo sapiens
tgggcctttaacagt

SEQ ID NO: 378423 - DNA, 15 bp, Homo sapiens
gggcctttaacagtg

SEQ ID NO: 378424 - DNA, 15 bp, Homo sapiens
ggcctttaacagtgc

SEQ ID NO: 378425 - DNA, 15 bp, Homo sapiens
gcctttaacagtgcc

SEQ ID NO: 378426 - DNA, 15 bp, Homo sapiens
cctttaacagtgcca

SEQ ID NO: 378427 - DNA, 15 bp, Homo sapiens
ctttaacagtgccaa

SEQ ID NO: 378428 - DNA, 15 bp, Homo sapiens
tttaacagtgccaat

SEQ ID NO: 378429 - DNA, 15 bp, Homo sapiens
ttaacagtgccaata

SEQ ID NO: 378430 - DNA, 15 bp, Homo sapiens
taacagtgccaatac

SEQ ID NO: 378431 - DNA, 15 bp, Homo sapiens
aacagtgccaataca

SEQ ID NO: 378432 - DNA, 15 bp, Homo sapiens
acagtgccaatacaa

SEQ ID NO: 378433 - DNA, 15 bp, Homo sapiens
cagtgccaatacaaa

SEQ ID NO: 378434 - DNA, 15 bp, Homo sapiens
agtgccaatacaaat

SEQ ID NO: 378435 - DNA, 15 bp, Homo sapiens
gtgccaatacaaatt

SEQ ID NO: 378436 - DNA, 15 bp, Homo sapiens
tgccaatacaaatta

SEQ ID NO: 378437 - DNA, 15 bp, Homo sapiens
gccaatacaaattaa

SEQ ID NO: 378438 - DNA, 15 bp, Homo sapiens
ccaatacaaattaac

SEQ ID NO: 378439 - DNA, 15 bp, Homo sapiens
caatacaaattaact

SEQ ID NO: 378440 - DNA, 15 bp, Homo sapiens
aatacaaattaacta

SEQ ID NO: 378441 - DNA, 15 bp, Homo sapiens
atacaaattaactac

SEQ ID NO: 378442 - DNA, 15 bp, Homo sapiens
tacaaattaactacc

SEQ ID NO: 378443 - DNA, 15 bp, Homo sapiens
acaaattaactacct

SEQ ID NO: 378444 - DNA, 15 bp, Homo sapiens
caaattaactaccta

SEQ ID NO: 378445 - DNA, 15 bp, Homo sapiens
aaattaactacctaa

SEQ ID NO: 378446 - DNA, 15 bp, Homo sapiens
aattaactacctaat

SEQ ID NO: 378447 - DNA, 15 bp, Homo sapiens
attaactacctaata

SEQ ID NO: 378448 - DNA, 15 bp, Homo sapiens
ttaactacctaataa

SEQ ID NO: 378449 - DNA, 15 bp, Homo sapiens
taactacctaataaa

SEQ ID NO: 378450 - DNA, 15 bp, Homo sapiens
aactacctaataaat

SEQ ID NO: 378451 - DNA, 15 bp, Homo sapiens
actacctaataaata

SEQ ID NO: 378452 - DNA, 15 bp, Homo sapiens
ctacctaataaatat

SEQ ID NO: 378453 - DNA, 15 bp, Homo sapiens
tacctaataaatatt

SEQ ID NO: 378454 - DNA, 15 bp, Homo sapiens
acctaataaatattt

SEQ ID NO: 378455 - DNA, 15 bp, Homo sapiens
cctaataaatatttg

SEQ ID NO: 378456 - DNA, 15 bp, Homo sapiens
ctaataaatatttgt

SEQ ID NO: 378457 - DNA, 15 bp, Homo sapiens
taataaatatttgtg

SEQ ID NO: 378458 - DNA, 15 bp, Homo sapiens
aataaatatttgtga

SEQ ID NO: 378459 - DNA, 15 bp, Homo sapiens
ataaatatttgtgac

SEQ ID NO: 378460 - DNA, 15 bp, Homo sapiens
taaatatttgtgaca

SEQ ID NO: 378461 - DNA, 15 bp, Homo sapiens
aaatatttgtgacaa

SEQ ID NO: 378462 - DNA, 15 bp, Homo sapiens
aatatttgtgacaaa

SEQ ID NO: 378463 - DNA, 15 bp, Homo sapiens
atatttgtgacaaaa

SEQ ID NO: 378464 - DNA, 15 bp, Homo sapiens
tatttgtgacaaaat

SEQ ID NO: 378465 - DNA, 15 bp, Homo sapiens
atttgtgacaaaata

SEQ ID NO: 378466 - DNA, 15 bp, Homo sapiens
tttgtgacaaaatat

SEQ ID NO: 378467 - DNA, 15 bp, Homo sapiens
ttgtgacaaaatata

SEQ ID NO: 378468 - DNA, 15 bp, Homo sapiens
tgtgacaaaatataa

SEQ ID NO: 378469 - DNA, 15 bp, Homo sapiens
gtgacaaaatataaa

SEQ ID NO: 378470 - DNA, 15 bp, Homo sapiens
tgacaaaatataaac

SEQ ID NO: 378471 - DNA, 15 bp, Homo sapiens
gacaaaatataaact

SEQ ID NO: 378472 - DNA, 15 bp, Homo sapiens
acaaaatataaactg

SEQ ID NO: 378473 - DNA, 15 bp, Homo sapiens
caaaatataaactgg

SEQ ID NO: 378474 - DNA, 15 bp, Homo sapiens
aaaatataaactgga

SEQ ID NO: 378475 - DNA, 15 bp, Homo sapiens
aaatataaactggaa

SEQ ID NO: 378476 - DNA, 15 bp, Homo sapiens
aatataaactggaag

SEQ ID NO: 378477 - DNA, 15 bp, Homo sapiens
atataaactggaagg

SEQ ID NO: 378478 - DNA, 15 bp, Homo sapiens
tataaactggaagga

SEQ ID NO: 378479 - DNA, 15 bp, Homo sapiens
ataaactggaaggat

SEQ ID NO: 378480 - DNA, 15 bp, Homo sapiens
taaactggaaggata

SEQ ID NO: 378481 - DNA, 15 bp, Homo sapiens
aaactggaaggataa

SEQ ID NO: 378482 - DNA, 15 bp, Homo sapiens
aactggaaggataaa

SEQ ID NO: 378483 - DNA, 15 bp, Homo sapiens
actggaaggataaat

SEQ ID NO: 378484 - DNA, 15 bp, Homo sapiens
ctggaaggataaatc

SEQ ID NO: 378485 - DNA, 15 bp, Homo sapiens
tggaaggataaatcc

SEQ ID NO: 378486 - DNA, 15 bp, Homo sapiens
ggaaggataaatcct

SEQ ID NO: 378487 - DNA, 15 bp, Homo sapiens
gaaggataaatccta

SEQ ID NO: 378488 - DNA, 15 bp, Homo sapiens
aaggataaatcctaa

SEQ ID NO: 378489 - DNA, 15 bp, Homo sapiens
aggataaatcctaat

SEQ ID NO: 378490 - DNA, 15 bp, Homo sapiens
ggataaatcctaata

SEQ ID NO: 378491 - DNA, 15 bp, Homo sapiens
gataaatcctaatat

SEQ ID NO: 378492 - DNA, 15 bp, Homo sapiens
ataaatcctaatatt

SEQ ID NO: 378493 - DNA, 15 bp, Homo sapiens
taaatcctaatattt

SEQ ID NO: 378494 - DNA, 15 bp, Homo sapiens
aaatcctaatatttg

SEQ ID NO: 378495 - DNA, 15 bp, Homo sapiens
aatcctaatatttgt

SEQ ID NO: 378496 - DNA, 15 bp, Homo sapiens
atcctaatatttgtc

SEQ ID NO: 378497 - DNA, 15 bp, Homo sapiens
tcctaatatttgtca

SEQ ID NO: 378498 - DNA, 15 bp, Homo sapiens
cctaatatttgtcaa

SEQ ID NO: 378499 - DNA, 15 bp, Homo sapiens
ctaatatttgtcaag

SEQ ID NO: 378500 - DNA, 15 bp, Homo sapiens
taatatttgtcaagg

SEQ ID NO: 378501 - DNA, 15 bp, Homo sapiens
aatatttgtcaaggg

SEQ ID NO: 378502 - DNA, 15 bp, Homo sapiens
atatttgtcaaggga

SEQ ID NO: 378503 - DNA, 15 bp, Homo sapiens
tatttgtcaagggaa

SEQ ID NO: 378504 - DNA, 15 bp, Homo sapiens
atttgtcaagggaag

SEQ ID NO: 378505 - DNA, 15 bp, Homo sapiens
tttgtcaagggaaga

SEQ ID NO: 378506 - DNA, 15 bp, Homo sapiens
ttgtcaagggaagaa

SEQ ID NO: 378507 - DNA, 15 bp, Homo sapiens
tgtcaagggaagaaa

SEQ ID NO: 378508 - DNA, 15 bp, Homo sapiens
gtcaagggaagaaag

SEQ ID NO: 378509 - DNA, 15 bp, Homo sapiens
tcaagggaagaaagt

SEQ ID NO: 378510 - DNA, 15 bp, Homo sapiens
caagggaagaaagtc

SEQ ID NO: 378511 - DNA, 15 bp, Homo sapiens
aagggaagaaagtca

SEQ ID NO: 378512 - DNA, 15 bp, Homo sapiens
agggaagaaagtcag

SEQ ID NO: 378513 - DNA, 15 bp, Homo sapiens
gggaagaaagtcagc

SEQ ID NO: 378514 - DNA, 15 bp, Homo sapiens
ggaagaaagtcagct

SEQ ID NO: 378515 - DNA, 15 bp, Homo sapiens
gaagaaagtcagcta

SEQ ID NO: 378516 - DNA, 15 bp, Homo sapiens
aagaaagtcagctac

SEQ ID NO: 378517 - DNA, 15 bp, Homo sapiens
agaaagtcagctact

SEQ ID NO: 378518 - DNA, 15 bp, Homo sapiens
gaaagtcagctactc

SEQ ID NO: 378519 - DNA, 15 bp, Homo sapiens
aaagtcagctactct

SEQ ID NO: 378520 - DNA, 15 bp, Homo sapiens
aagtcagctactctc

SEQ ID NO: 378521 - DNA, 15 bp, Homo sapiens
agtcagctactctcc

SEQ ID NO: 378522 - DNA, 15 bp, Homo sapiens
gtcagctactctccc

SEQ ID NO: 378523 - DNA, 15 bp, Homo sapiens
tcagctactctccct

SEQ ID NO: 378524 - DNA, 15 bp, Homo sapiens
cagctactctccctg

SEQ ID NO: 378525 - DNA, 15 bp, Homo sapiens
agctactctccctgt

SEQ ID NO: 378526 - DNA, 15 bp, Homo sapiens
gctactctccctgta

SEQ ID NO: 378527 - DNA, 15 bp, Homo sapiens
ctactctccctgtaa

SEQ ID NO: 378528 - DNA, 15 bp, Homo sapiens
tactctccctgtaaa

SEQ ID NO: 378529 - DNA, 15 bp, Homo sapiens
actctccctgtaaaa

SEQ ID NO: 378530 - DNA, 15 bp, Homo sapiens
ctctccctgtaaaaa

SEQ ID NO: 378531 - DNA, 15 bp, Homo sapiens
tctccctgtaaaaag

SEQ ID NO: 378532 - DNA, 15 bp, Homo sapiens
ctccctgtaaaaagt

SEQ ID NO: 378533 - DNA, 15 bp, Homo sapiens
tccctgtaaaaagta

SEQ ID NO: 378534 - DNA, 15 bp, Homo sapiens
ccctgtaaaaagtat

SEQ ID NO: 378535 - DNA, 15 bp, Homo sapiens
cctgtaaaaagtatg

SEQ ID NO: 378536 - DNA, 15 bp, Homo sapiens
ctgtaaaaagtatgt

SEQ ID NO: 378537 - DNA, 15 bp, Homo sapiens
tgtaaaaagtatgtt

SEQ ID NO: 378538 - DNA, 15 bp, Homo sapiens
gtaaaaagtatgttt

SEQ ID NO: 378539 - DNA, 15 bp, Homo sapiens
taaaaagtatgtttt

SEQ ID NO: 378540 - DNA, 15 bp, Homo sapiens
aaaaagtatgttttg

SEQ ID NO: 378541 - DNA, 15 bp, Homo sapiens
aaaagtatgttttga

SEQ ID NO: 378542 - DNA, 15 bp, Homo sapiens
aaagtatgttttgat

SEQ ID NO: 378543 - DNA, 15 bp, Homo sapiens
aagtatgttttgatt

SEQ ID NO: 378544 - DNA, 15 bp, Homo sapiens
agtatgttttgattt

SEQ ID NO: 378545 - DNA, 15 bp, Homo sapiens
gtatgttttgatttc

SEQ ID NO: 378546 - DNA, 15 bp, Homo sapiens
tatgttttgatttca

SEQ ID NO: 378547 - DNA, 15 bp, Homo sapiens
atgttttgatttcaa

SEQ ID NO: 378548 - DNA, 15 bp, Homo sapiens
tgttttgatttcaaa

SEQ ID NO: 378549 - DNA, 15 bp, Homo sapiens
gttttgatttcaaaa

SEQ ID NO: 378550 - DNA, 15 bp, Homo sapiens
ttttgatttcaaaat

SEQ ID NO: 378551 - DNA, 15 bp, Homo sapiens
tttgatttcaaaata

SEQ ID NO: 378552 - DNA, 15 bp, Homo sapiens
ttgatttcaaaatag

SEQ ID NO: 378553 - DNA, 15 bp, Homo sapiens
tgatttcaaaatagt

SEQ ID NO: 378554 - DNA, 15 bp, Homo sapiens
gatttcaaaatagtc

SEQ ID NO: 378555 - DNA, 15 bp, Homo sapiens
atttcaaaatagtca

SEQ ID NO: 378556 - DNA, 15 bp, Homo sapiens
tttcaaaatagtcat

SEQ ID NO: 378557 - DNA, 15 bp, Homo sapiens
ttcaaaatagtcatg

SEQ ID NO: 378558 - DNA, 15 bp, Homo sapiens
tcaaaatagtcatgg

SEQ ID NO: 378559 - DNA, 15 bp, Homo sapiens
caaaatagtcatggt

SEQ ID NO: 378560 - DNA, 15 bp, Homo sapiens
aaaatagtcatggta

SEQ ID NO: 378561 - DNA, 15 bp, Homo sapiens
aaatagtcatggtag

SEQ ID NO: 378562 - DNA, 15 bp, Homo sapiens
aatagtcatggtagc

SEQ ID NO: 378563 - DNA, 15 bp, Homo sapiens
atagtcatggtagca

SEQ ID NO: 378564 - DNA, 15 bp, Homo sapiens
tagtcatggtagcaa

SEQ ID NO: 378565 - DNA, 15 bp, Homo sapiens
agtcatggtagcaac

SEQ ID NO: 378566 - DNA, 15 bp, Homo sapiens
gtcatggtagcaaca

SEQ ID NO: 378567 - DNA, 15 bp, Homo sapiens
tcatggtagcaacag

SEQ ID NO: 378568 - DNA, 15 bp, Homo sapiens
catggtagcaacagg

SEQ ID NO: 378569 - DNA, 15 bp, Homo sapiens
atggtagcaacaggg

SEQ ID NO: 378570 - DNA, 15 bp, Homo sapiens
tggtagcaacagggt

SEQ ID NO: 378571 - DNA, 15 bp, Homo sapiens
ggtagcaacagggtt

SEQ ID NO: 378572 - DNA, 15 bp, Homo sapiens
gtagcaacagggtta

SEQ ID NO: 378573 - DNA, 15 bp, Homo sapiens
tagcaacagggttat

SEQ ID NO: 378574 - DNA, 15 bp, Homo sapiens
agcaacagggttatt

SEQ ID NO: 378575 - DNA, 15 bp, Homo sapiens
gcaacagggttatta

SEQ ID NO: 378576 - DNA, 15 bp, Homo sapiens
caacagggttattat

SEQ ID NO: 378577 - DNA, 15 bp, Homo sapiens
aacagggttattata

SEQ ID NO: 378578 - DNA, 15 bp, Homo sapiens
acagggttattatag

SEQ ID NO: 378579 - DNA, 15 bp, Homo sapiens
cagggttattatagg

SEQ ID NO: 378580 - DNA, 15 bp, Homo sapiens
agggttattatagga

SEQ ID NO: 378581 - DNA, 15 bp, Homo sapiens
gggttattataggag

SEQ ID NO: 378582 - DNA, 15 bp, Homo sapiens
ggttattataggaga

SEQ ID NO: 378583 - DNA, 15 bp, Homo sapiens
gttattataggagat

SEQ ID NO: 378584 - DNA, 15 bp, Homo sapiens
ttattataggagata

SEQ ID NO: 378585 - DNA, 15 bp, Homo sapiens
tattataggagatac

SEQ ID NO: 378586 - DNA, 15 bp, Homo sapiens
attataggagataca

SEQ ID NO: 378587 - DNA, 15 bp, Homo sapiens
ttataggagatacat

SEQ ID NO: 378588 - DNA, 15 bp, Homo sapiens
tataggagatacatt

SEQ ID NO: 378589 - DNA, 15 bp, Homo sapiens
ataggagatacatta

SEQ ID NO: 378590 - DNA, 15 bp, Homo sapiens
taggagatacattag

SEQ ID NO: 378591 - DNA, 15 bp, Homo sapiens
aggagatacattaga

SEQ ID NO: 378592 - DNA, 15 bp, Homo sapiens
ggagatacattagaa

SEQ ID NO: 378593 - DNA, 15 bp, Homo sapiens
gagatacattagaaa

SEQ ID NO: 378594 - DNA, 15 bp, Homo sapiens
agatacattagaaaa

SEQ ID NO: 378595 - DNA, 15 bp, Homo sapiens
gatacattagaaaag

SEQ ID NO: 378596 - DNA, 15 bp, Homo sapiens
atacattagaaaaga

SEQ ID NO: 378597 - DNA, 15 bp, Homo sapiens
tacattagaaaagaa

SEQ ID NO: 378598 - DNA, 15 bp, Homo sapiens
acattagaaaagaac

SEQ ID NO: 378599 - DNA, 15 bp, Homo sapiens
cattagaaaagaact

SEQ ID NO: 378600 - DNA, 15 bp, Homo sapiens
attagaaaagaactt

SEQ ID NO: 378601 - DNA, 15 bp, Homo sapiens
ttagaaaagaacttt

SEQ ID NO: 378602 - DNA, 15 bp, Homo sapiens
tagaaaagaactttt

SEQ ID NO: 378603 - DNA, 15 bp, Homo sapiens
agaaaagaactttta

SEQ ID NO: 378604 - DNA, 15 bp, Homo sapiens
gaaaagaacttttaa

SEQ ID NO: 378605 - DNA, 15 bp, Homo sapiens
aaaagaacttttaat

SEQ ID NO: 378606 - DNA, 15 bp, Homo sapiens
aaagaacttttaatg

SEQ ID NO: 378607 - DNA, 15 bp, Homo sapiens
aagaacttttaatgt

SEQ ID NO: 378608 - DNA, 15 bp, Homo sapiens
agaacttttaatgtc

SEQ ID NO: 378609 - DNA, 15 bp, Homo sapiens
gaacttttaatgtct

SEQ ID NO: 378610 - DNA, 15 bp, Homo sapiens
aacttttaatgtcta

SEQ ID NO: 378611 - DNA, 15 bp, Homo sapiens
acttttaatgtctaa

SEQ ID NO: 378612 - DNA, 15 bp, Homo sapiens
cttttaatgtctaac

SEQ ID NO: 378613 - DNA, 15 bp, Homo sapiens
ttttaatgtctaaca

SEQ ID NO: 378614 - DNA, 15 bp, Homo sapiens
tttaatgtctaacag

SEQ ID NO: 378615 - DNA, 15 bp, Homo sapiens
ttaatgtctaacagt

SEQ ID NO: 378616 - DNA, 15 bp, Homo sapiens
taatgtctaacagtg

SEQ ID NO: 378617 - DNA, 15 bp, Homo sapiens
aatgtctaacagtgt

SEQ ID NO: 378618 - DNA, 15 bp, Homo sapiens
atgtctaacagtgtt

SEQ ID NO: 378619 - DNA, 15 bp, Homo sapiens
tgtctaacagtgttg

SEQ ID NO: 378620 - DNA, 15 bp, Homo sapiens
gtctaacagtgttgg

SEQ ID NO: 378621 - DNA, 15 bp, Homo sapiens
tctaacagtgttggc

SEQ ID NO: 378622 - DNA, 15 bp, Homo sapiens
ctaacagtgttggct

SEQ ID NO: 378623 - DNA, 15 bp, Homo sapiens
taacagtgttggctt

SEQ ID NO: 378624 - DNA, 15 bp, Homo sapiens
aacagtgttggctta

SEQ ID NO: 378625 - DNA, 15 bp, Homo sapiens
acagtgttggcttat

SEQ ID NO: 378626 - DNA, 15 bp, Homo sapiens
cagtgttggcttatt

SEQ ID NO: 378627 - DNA, 15 bp, Homo sapiens
agtgttggcttattt

SEQ ID NO: 378628 - DNA, 15 bp, Homo sapiens
gtgttggcttatttt

SEQ ID NO: 378629 - DNA, 15 bp, Homo sapiens
tgttggcttattttt

SEQ ID NO: 378630 - DNA, 15 bp, Homo sapiens
gttggcttattttta

SEQ ID NO: 378631 - DNA, 15 bp, Homo sapiens
ttggcttatttttac

SEQ ID NO: 378632 - DNA, 15 bp, Homo sapiens
tggcttatttttact

SEQ ID NO: 378633 - DNA, 15 bp, Homo sapiens
ggcttatttttacta

SEQ ID NO: 378634 - DNA, 15 bp, Homo sapiens
gcttatttttactaa

SEQ ID NO: 378635 - DNA, 15 bp, Homo sapiens
cttatttttactaaa

SEQ ID NO: 378636 - DNA, 15 bp, Homo sapiens
ttatttttactaaat

SEQ ID NO: 378637 - DNA, 15 bp, Homo sapiens
tatttttactaaata

SEQ ID NO: 378638 - DNA, 15 bp, Homo sapiens
atttttactaaatac

SEQ ID NO: 378639 - DNA, 15 bp, Homo sapiens
tttttactaaataca

SEQ ID NO: 378640 - DNA, 15 bp, Homo sapiens
ttttactaaatacat

SEQ ID NO: 378641 - DNA, 15 bp, Homo sapiens
tttactaaatacatc

SEQ ID NO: 378642 - DNA, 15 bp, Homo sapiens
ttactaaatacatca

SEQ ID NO: 378643 - DNA, 15 bp, Homo sapiens
tactaaatacatcat

SEQ ID NO: 378644 - DNA, 15 bp, Homo sapiens
actaaatacatcatt

SEQ ID NO: 378645 - DNA, 15 bp, Homo sapiens
ctaaatacatcattt

SEQ ID NO: 378646 - DNA, 15 bp, Homo sapiens
taaatacatcatttt

SEQ ID NO: 378647 - DNA, 15 bp, Homo sapiens
aaatacatcattttc

SEQ ID NO: 378648 - DNA, 15 bp, Homo sapiens
aatacatcattttcc

SEQ ID NO: 378649 - DNA, 15 bp, Homo sapiens
atacatcattttcct

SEQ ID NO: 378650 - DNA, 15 bp, Homo sapiens
tacatcattttcctt

SEQ ID NO: 378651 - DNA, 15 bp, Homo sapiens
acatcattttccttc

SEQ ID NO: 378652 - DNA, 15 bp, Homo sapiens
catcattttccttct

SEQ ID NO: 378653 - DNA, 15 bp, Homo sapiens
atcattttccttctt

SEQ ID NO: 378654 - DNA, 15 bp, Homo sapiens
tcattttccttcttt

SEQ ID NO: 378655 - DNA, 15 bp, Homo sapiens
cattttccttctttt

SEQ ID NO: 378656 - DNA, 15 bp, Homo sapiens
attttccttcttttc

SEQ ID NO: 378657 - DNA, 15 bp, Homo sapiens
ttttccttcttttct

SEQ ID NO: 378658 - DNA, 15 bp, Homo sapiens
tttccttcttttctc

SEQ ID NO: 378659 - DNA, 15 bp, Homo sapiens
ttccttcttttctct

SEQ ID NO: 378660 - DNA, 15 bp, Homo sapiens
tccttcttttctctt

SEQ ID NO: 378661 - DNA, 15 bp, Homo sapiens
ccttcttttctcttt

SEQ ID NO: 378662 - DNA, 15 bp, Homo sapiens
cttcttttctctttt

SEQ ID NO: 378663 - DNA, 15 bp, Homo sapiens
ttcttttctcttttt

SEQ ID NO: 378664 - DNA, 15 bp, Homo sapiens
tcttttctcttttta

SEQ ID NO: 378665 - DNA, 15 bp, Homo sapiens
cttttctctttttat

SEQ ID NO: 378666 - DNA, 15 bp, Homo sapiens
ttttctctttttatg

SEQ ID NO: 378667 - DNA, 15 bp, Homo sapiens
tttctctttttatga

SEQ ID NO: 378668 - DNA, 15 bp, Homo sapiens
ttctctttttatgaa

SEQ ID NO: 378669 - DNA, 15 bp, Homo sapiens
tctctttttatgaat

SEQ ID NO: 378670 - DNA, 15 bp, Homo sapiens
ctctttttatgaatg

SEQ ID NO: 378671 - DNA, 15 bp, Homo sapiens
tctttttatgaatgg

SEQ ID NO: 378672 - DNA, 15 bp, Homo sapiens
ctttttatgaatgga

SEQ ID NO: 378673 - DNA, 15 bp, Homo sapiens
tttttatgaatggat

SEQ ID NO: 378674 - DNA, 15 bp, Homo sapiens
ttttatgaatggatg

SEQ ID NO: 378675 - DNA, 15 bp, Homo sapiens
tttatgaatggatgg

SEQ ID NO: 378676 - DNA, 15 bp, Homo sapiens
ttatgaatggatgga

SEQ ID NO: 378677 - DNA, 15 bp, Homo sapiens
tatgaatggatggat

SEQ ID NO: 378678 - DNA, 15 bp, Homo sapiens
atgaatggatggatt

SEQ ID NO: 378679 - DNA, 15 bp, Homo sapiens
tgaatggatggattg

SEQ ID NO: 378680 - DNA, 15 bp, Homo sapiens
gaatggatggattgt

SEQ ID NO: 378681 - DNA, 15 bp, Homo sapiens
aatggatggattgtg

SEQ ID NO: 378682 - DNA, 15 bp, Homo sapiens
atggatggattgtgc

SEQ ID NO: 378683 - DNA, 15 bp, Homo sapiens
tggatggattgtgcc

SEQ ID NO: 378684 - DNA, 15 bp, Homo sapiens
ggatggattgtgcct

SEQ ID NO: 378685 - DNA, 15 bp, Homo sapiens
gatggattgtgccta

SEQ ID NO: 378686 - DNA, 15 bp, Homo sapiens
atggattgtgcctat

SEQ ID NO: 378687 - DNA, 15 bp, Homo sapiens
tggattgtgcctatt

SEQ ID NO: 378688 - DNA, 15 bp, Homo sapiens
ggattgtgcctatta

SEQ ID NO: 378689 - DNA, 15 bp, Homo sapiens
gattgtgcctattat

SEQ ID NO: 378690 - DNA, 15 bp, Homo sapiens
attgtgcctattatg

SEQ ID NO: 378691 - DNA, 15 bp, Homo sapiens
ttgtgcctattatgg

SEQ ID NO: 378692 - DNA, 15 bp, Homo sapiens
tgtgcctattatgga

SEQ ID NO: 378693 - DNA, 15 bp, Homo sapiens
gtgcctattatggaa

SEQ ID NO: 378694 - DNA, 15 bp, Homo sapiens
tgcctattatggaac

SEQ ID NO: 378695 - DNA, 15 bp, Homo sapiens
gcctattatggaact

SEQ ID NO: 378696 - DNA, 15 bp, Homo sapiens
cctattatggaactt

SEQ ID NO: 378697 - DNA, 15 bp, Homo sapiens
ctattatggaacttt

SEQ ID NO: 378698 - DNA, 15 bp, Homo sapiens
tattatggaactttg

SEQ ID NO: 378699 - DNA, 15 bp, Homo sapiens
attatggaactttgg

SEQ ID NO: 378700 - DNA, 15 bp, Homo sapiens
ttatggaactttgga

SEQ ID NO: 378701 - DNA, 15 bp, Homo sapiens
tatggaactttggag

SEQ ID NO: 378702 - DNA, 15 bp, Homo sapiens
atggaactttggagt

SEQ ID NO: 378703 - DNA, 15 bp, Homo sapiens
tggaactttggagtg

SEQ ID NO: 378704 - DNA, 15 bp, Homo sapiens
ggaactttggagtga

SEQ ID NO: 378705 - DNA, 15 bp, Homo sapiens
gaactttggagtgag

SEQ ID NO: 378706 - DNA, 15 bp, Homo sapiens
aactttggagtgagc

SEQ ID NO: 378707 - DNA, 15 bp, Homo sapiens
actttggagtgagct

SEQ ID NO: 378708 - DNA, 15 bp, Homo sapiens
ctttggagtgagctg

SEQ ID NO: 378709 - DNA, 15 bp, Homo sapiens
tttggagtgagctgg

SEQ ID NO: 378710 - DNA, 15 bp, Homo sapiens
ttggagtgagctggt

SEQ ID NO: 378711 - DNA, 15 bp, Homo sapiens
tggagtgagctggtt

SEQ ID NO: 378712 - DNA, 15 bp, Homo sapiens
ggagtgagctggttt

SEQ ID NO: 378713 - DNA, 15 bp, Homo sapiens
gagtgagctggtttc

SEQ ID NO: 378714 - DNA, 15 bp, Homo sapiens
agtgagctggtttcc

SEQ ID NO: 378715 - DNA, 15 bp, Homo sapiens
gtgagctggtttccc

SEQ ID NO: 378716 - DNA, 15 bp, Homo sapiens
tgagctggtttccct

SEQ ID NO: 378717 - DNA, 15 bp, Homo sapiens
gagctggtttccctc

SEQ ID NO: 378718 - DNA, 15 bp, Homo sapiens
agctggtttccctca

SEQ ID NO: 378719 - DNA, 15 bp, Homo sapiens
gctggtttccctcac

SEQ ID NO: 378720 - DNA, 15 bp, Homo sapiens
ctggtttccctcaca

SEQ ID NO: 378721 - DNA, 15 bp, Homo sapiens
tggtttccctcacat

SEQ ID NO: 378722 - DNA, 15 bp, Homo sapiens
ggtttccctcacatc

SEQ ID NO: 378723 - DNA, 15 bp, Homo sapiens
gtttccctcacatca

SEQ ID NO: 378724 - DNA, 15 bp, Homo sapiens
tttccctcacatcac

SEQ ID NO: 378725 - DNA, 15 bp, Homo sapiens
ttccctcacatcaca

SEQ ID NO: 378726 - DNA, 15 bp, Homo sapiens
tccctcacatcacag

SEQ ID NO: 378727 - DNA, 15 bp, Homo sapiens
ccctcacatcacagg

SEQ ID NO: 378728 - DNA, 15 bp, Homo sapiens
cctcacatcacaggg

SEQ ID NO: 378729 - DNA, 15 bp, Homo sapiens
ctcacatcacagggg

SEQ ID NO: 378730 - DNA, 15 bp, Homo sapiens
tcacatcacagggga

SEQ ID NO: 378731 - DNA, 15 bp, Homo sapiens
cacatcacaggggag

SEQ ID NO: 378732 - DNA, 15 bp, Homo sapiens
acatcacaggggagc

SEQ ID NO: 378733 - DNA, 15 bp, Homo sapiens
catcacaggggagct

SEQ ID NO: 378734 - DNA, 15 bp, Homo sapiens
atcacaggggagctc

SEQ ID NO: 378735 - DNA, 15 bp, Homo sapiens
tcacaggggagctcc

SEQ ID NO: 378736 - DNA, 15 bp, Homo sapiens
cacaggggagctcct

SEQ ID NO: 378737 - DNA, 15 bp, Homo sapiens
acaggggagctcctc

SEQ ID NO: 378738 - DNA, 15 bp, Homo sapiens
caggggagctcctct

SEQ ID NO: 378739 - DNA, 15 bp, Homo sapiens
aggggagctcctctg

SEQ ID NO: 378740 - DNA, 15 bp, Homo sapiens
ggggagctcctctgc

SEQ ID NO: 378741 - DNA, 15 bp, Homo sapiens
gggagctcctctgct

SEQ ID NO: 378742 - DNA, 15 bp, Homo sapiens
ggagctcctctgctc

SEQ ID NO: 378743 - DNA, 15 bp, Homo sapiens
gagctcctctgctct

SEQ ID NO: 378744 - DNA, 15 bp, Homo sapiens
agctcctctgctcta

SEQ ID NO: 378745 - DNA, 15 bp, Homo sapiens
gctcctctgctctag

SEQ ID NO: 378746 - DNA, 15 bp, Homo sapiens
ctcctctgctctagt

SEQ ID NO: 378747 - DNA, 15 bp, Homo sapiens
tcctctgctctagtg

SEQ ID NO: 378748 - DNA, 15 bp, Homo sapiens
cctctgctctagtga

SEQ ID NO: 378749 - DNA, 15 bp, Homo sapiens
ctctgctctagtgat

SEQ ID NO: 378750 - DNA, 15 bp, Homo sapiens
tctgctctagtgata

SEQ ID NO: 378751 - DNA, 15 bp, Homo sapiens
ctgctctagtgatac

SEQ ID NO: 378752 - DNA, 15 bp, Homo sapiens
tgctctagtgatacc

SEQ ID NO: 378753 - DNA, 15 bp, Homo sapiens
gctctagtgatacca

SEQ ID NO: 378754 - DNA, 15 bp, Homo sapiens
ctctagtgataccaa

SEQ ID NO: 378755 - DNA, 15 bp, Homo sapiens
tctagtgataccaaa

SEQ ID NO: 378756 - DNA, 15 bp, Homo sapiens
ctagtgataccaaac

SEQ ID NO: 378757 - DNA, 15 bp, Homo sapiens
tagtgataccaaact

SEQ ID NO: 378758 - DNA, 15 bp, Homo sapiens
agtgataccaaacta

SEQ ID NO: 378759 - DNA, 15 bp, Homo sapiens
gtgataccaaactat

SEQ ID NO: 378760 - DNA, 15 bp, Homo sapiens
tgataccaaactatt

SEQ ID NO: 378761 - DNA, 15 bp, Homo sapiens
gataccaaactattg

SEQ ID NO: 378762 - DNA, 15 bp, Homo sapiens
ataccaaactattga

SEQ ID NO: 378763 - DNA, 15 bp, Homo sapiens
taccaaactattgac

SEQ ID NO: 378764 - DNA, 15 bp, Homo sapiens
accaaactattgaca

SEQ ID NO: 378765 - DNA, 15 bp, Homo sapiens
ccaaactattgacaa

SEQ ID NO: 378766 - DNA, 15 bp, Homo sapiens
caaactattgacaag

SEQ ID NO: 378767 - DNA, 15 bp, Homo sapiens
aaactattgacaagc

SEQ ID NO: 378768 - DNA, 15 bp, Homo sapiens
aactattgacaagcc

SEQ ID NO: 378769 - DNA, 15 bp, Homo sapiens
actattgacaagcca

SEQ ID NO: 378770 - DNA, 15 bp, Homo sapiens
ctattgacaagccat

SEQ ID NO: 378771 - DNA, 15 bp, Homo sapiens
tattgacaagccatt

SEQ ID NO: 378772 - DNA, 15 bp, Homo sapiens
attgacaagccattt

SEQ ID NO: 378773 - DNA, 15 bp, Homo sapiens
ttgacaagccatttc

SEQ ID NO: 378774 - DNA, 15 bp, Homo sapiens
tgacaagccatttcc

SEQ ID NO: 378775 - DNA, 15 bp, Homo sapiens
gacaagccatttcca

SEQ ID NO: 378776 - DNA, 15 bp, Homo sapiens
acaagccatttccag

SEQ ID NO: 378777 - DNA, 15 bp, Homo sapiens
caagccatttccagt

SEQ ID NO: 378778 - DNA, 15 bp, Homo sapiens
aagccatttccagtt

SEQ ID NO: 378779 - DNA, 15 bp, Homo sapiens
agccatttccagttt

SEQ ID NO: 378780 - DNA, 15 bp, Homo sapiens
gccatttccagtttg

SEQ ID NO: 378781 - DNA, 15 bp, Homo sapiens
ccatttccagtttgc

SEQ ID NO: 378782 - DNA, 15 bp, Homo sapiens
catttccagtttgct

SEQ ID NO: 378783 - DNA, 15 bp, Homo sapiens
atttccagtttgctt

SEQ ID NO: 378784 - DNA, 15 bp, Homo sapiens
tttccagtttgcttt

SEQ ID NO: 378785 - DNA, 15 bp, Homo sapiens
ttccagtttgctttt

SEQ ID NO: 378786 - DNA, 15 bp, Homo sapiens
tccagtttgcttttt

SEQ ID NO: 378787 - DNA, 15 bp, Homo sapiens
ccagtttgctttttc

SEQ ID NO: 378788 - DNA, 15 bp, Homo sapiens
cagtttgctttttct

SEQ ID NO: 378789 - DNA, 15 bp, Homo sapiens
agtttgctttttcta

SEQ ID NO: 378790 - DNA, 15 bp, Homo sapiens
gtttgctttttctat

SEQ ID NO: 378791 - DNA, 15 bp, Homo sapiens
tttgctttttctatc

SEQ ID NO: 378792 - DNA, 15 bp, Homo sapiens
ttgctttttctatca

SEQ ID NO: 378793 - DNA, 15 bp, Homo sapiens
tgctttttctatcat

SEQ ID NO: 378794 - DNA, 15 bp, Homo sapiens
gctttttctatcatc

SEQ ID NO: 378795 - DNA, 15 bp, Homo sapiens
ctttttctatcatct

SEQ ID NO: 378796 - DNA, 15 bp, Homo sapiens
tttttctatcatctt

SEQ ID NO: 378797 - DNA, 15 bp, Homo sapiens
ttttctatcatcttg

SEQ ID NO: 378798 - DNA, 15 bp, Homo sapiens
tttctatcatcttga

SEQ ID NO: 378799 - DNA, 15 bp, Homo sapiens
ttctatcatcttgat

SEQ ID NO: 378800 - DNA, 15 bp, Homo sapiens
tctatcatcttgatg

SEQ ID NO: 378801 - DNA, 15 bp, Homo sapiens
ctatcatcttgatgt

SEQ ID NO: 378802 - DNA, 15 bp, Homo sapiens
tatcatcttgatgtt

SEQ ID NO: 378803 - DNA, 15 bp, Homo sapiens
atcatcttgatgttt

SEQ ID NO: 378804 - DNA, 15 bp, Homo sapiens
tcatcttgatgtttt

SEQ ID NO: 378805 - DNA, 15 bp, Homo sapiens
catcttgatgttttc

SEQ ID NO: 378806 - DNA, 15 bp, Homo sapiens
atcttgatgttttct

SEQ ID NO: 378807 - DNA, 15 bp, Homo sapiens
tcttgatgttttctt

SEQ ID NO: 378808 - DNA, 15 bp, Homo sapiens
cttgatgttttcttt

SEQ ID NO: 378809 - DNA, 15 bp, Homo sapiens
ttgatgttttctttt

SEQ ID NO: 378810 - DNA, 15 bp, Homo sapiens
tgatgttttctttta

SEQ ID NO: 378811 - DNA, 15 bp, Homo sapiens
gatgttttcttttaa

SEQ ID NO: 378812 - DNA, 15 bp, Homo sapiens
atgttttcttttaat

SEQ ID NO: 378813 - DNA, 15 bp, Homo sapiens
tgttttcttttaatt

SEQ ID NO: 378814 - DNA, 15 bp, Homo sapiens
gttttcttttaatta

SEQ ID NO: 378815 - DNA, 15 bp, Homo sapiens
ttttcttttaattat

SEQ ID NO: 378816 - DNA, 15 bp, Homo sapiens
tttcttttaattatt

SEQ ID NO: 378817 - DNA, 15 bp, Homo sapiens
ttcttttaattatta

SEQ ID NO: 378818 - DNA, 15 bp, Homo sapiens
tcttttaattattat

SEQ ID NO: 378819 - DNA, 15 bp, Homo sapiens
cttttaattattatt

SEQ ID NO: 378820 - DNA, 15 bp, Homo sapiens
ttttaattattattt

SEQ ID NO: 378821 - DNA, 15 bp, Homo sapiens
tttaattattatttt

SEQ ID NO: 378822 - DNA, 15 bp, Homo sapiens
ttaattattattttt

SEQ ID NO: 378823 - DNA, 15 bp, Homo sapiens
taattattatttttt

SEQ ID NO: 378824 - DNA, 15 bp, Homo sapiens
aattattattttttc

SEQ ID NO: 378825 - DNA, 15 bp, Homo sapiens
attattattttttcc

SEQ ID NO: 378826 - DNA, 15 bp, Homo sapiens
ttattattttttcca

SEQ ID NO: 378827 - DNA, 15 bp, Homo sapiens
tattattttttccat

SEQ ID NO: 378828 - DNA, 15 bp, Homo sapiens
attattttttccatc

SEQ ID NO: 378829 - DNA, 15 bp, Homo sapiens
ttattttttccatca

SEQ ID NO: 378830 - DNA, 15 bp, Homo sapiens
tattttttccatcac

SEQ ID NO: 378831 - DNA, 15 bp, Homo sapiens
attttttccatcacc

SEQ ID NO: 378832 - DNA, 15 bp, Homo sapiens
ttttttccatcacct

SEQ ID NO: 378833 - DNA, 15 bp, Homo sapiens
tttttccatcacctc

SEQ ID NO: 378834 - DNA, 15 bp, Homo sapiens
ttttccatcacctct

SEQ ID NO: 378835 - DNA, 15 bp, Homo sapiens
tttccatcacctctc

SEQ ID NO: 378836 - DNA, 15 bp, Homo sapiens
ttccatcacctctct

SEQ ID NO: 378837 - DNA, 15 bp, Homo sapiens
tccatcacctctctt

SEQ ID NO: 378838 - DNA, 15 bp, Homo sapiens
ccatcacctctcttt

SEQ ID NO: 378839 - DNA, 15 bp, Homo sapiens
catcacctctctttt

SEQ ID NO: 378840 - DNA, 15 bp, Homo sapiens
atcacctctcttttt

SEQ ID NO: 378841 - DNA, 15 bp, Homo sapiens
tcacctctctttttg

SEQ ID NO: 378842 - DNA, 15 bp, Homo sapiens
cacctctctttttgt

SEQ ID NO: 378843 - DNA, 15 bp, Homo sapiens
acctctctttttgtc

SEQ ID NO: 378844 - DNA, 15 bp, Homo sapiens
cctctctttttgtcc

SEQ ID NO: 378845 - DNA, 15 bp, Homo sapiens
ctctctttttgtcca

SEQ ID NO: 378846 - DNA, 15 bp, Homo sapiens
tctctttttgtccaa

SEQ ID NO: 378847 - DNA, 15 bp, Homo sapiens
ctctttttgtccaaa

SEQ ID NO: 378848 - DNA, 15 bp, Homo sapiens
tctttttgtccaaaa

SEQ ID NO: 378849 - DNA, 15 bp, Homo sapiens
ctttttgtccaaaac

SEQ ID NO: 378850 - DNA, 15 bp, Homo sapiens
tttttgtccaaaact

SEQ ID NO: 378851 - DNA, 15 bp, Homo sapiens
ttttgtccaaaactt

SEQ ID NO: 378852 - DNA, 15 bp, Homo sapiens
tttgtccaaaacttc

SEQ ID NO: 378853 - DNA, 15 bp, Homo sapiens
ttgtccaaaacttct

SEQ ID NO: 378854 - DNA, 15 bp, Homo sapiens
tgtccaaaacttctt

SEQ ID NO: 378855 - DNA, 15 bp, Homo sapiens
gtccaaaacttcttt

SEQ ID NO: 378856 - DNA, 15 bp, Homo sapiens
tccaaaacttctttc

SEQ ID NO: 378857 - DNA, 15 bp, Homo sapiens
ccaaaacttctttca

SEQ ID NO: 378858 - DNA, 15 bp, Homo sapiens
caaaacttctttcag

SEQ ID NO: 378859 - DNA, 15 bp, Homo sapiens
aaaacttctttcagg

SEQ ID NO: 378860 - DNA, 15 bp, Homo sapiens
aaacttctttcaggt

SEQ ID NO: 378861 - DNA, 15 bp, Homo sapiens
aacttctttcaggtg

SEQ ID NO: 378862 - DNA, 15 bp, Homo sapiens
acttctttcaggtgt

SEQ ID NO: 378863 - DNA, 15 bp, Homo sapiens
cttctttcaggtgtt

SEQ ID NO: 378864 - DNA, 15 bp, Homo sapiens
ttctttcaggtgttt

SEQ ID NO: 378865 - DNA, 15 bp, Homo sapiens
tctttcaggtgtttg

SEQ ID NO: 378866 - DNA, 15 bp, Homo sapiens
ctttcaggtgtttgt

SEQ ID NO: 378867 - DNA, 15 bp, Homo sapiens
tttcaggtgtttgtt

SEQ ID NO: 378868 - DNA, 15 bp, Homo sapiens
ttcaggtgtttgttt

SEQ ID NO: 378869 - DNA, 15 bp, Homo sapiens
tcaggtgtttgtttt

SEQ ID NO: 378870 - DNA, 15 bp, Homo sapiens
caggtgtttgttttt

SEQ ID NO: 378871 - DNA, 15 bp, Homo sapiens
aggtgtttgtttttt

SEQ ID NO: 378872 - DNA, 15 bp, Homo sapiens
ggtgtttgttttttt

SEQ ID NO: 378873 - DNA, 15 bp, Homo sapiens
gtgtttgtttttttg

SEQ ID NO: 378874 - DNA, 15 bp, Homo sapiens
tgtttgtttttttgt

SEQ ID NO: 378875 - DNA, 15 bp, Homo sapiens
gtttgtttttttgtt

SEQ ID NO: 378876 - DNA, 15 bp, Homo sapiens
tttgtttttttgttt

SEQ ID NO: 378877 - DNA, 15 bp, Homo sapiens
ttgtttttttgtttt

SEQ ID NO: 378878 - DNA, 15 bp, Homo sapiens
tgtttttttgtttta

SEQ ID NO: 378879 - DNA, 15 bp, Homo sapiens
gtttttttgttttac

SEQ ID NO: 378880 - DNA, 15 bp, Homo sapiens
tttttttgttttaca

SEQ ID NO: 378881 - DNA, 15 bp, Homo sapiens
ttttttgttttacaa

SEQ ID NO: 378882 - DNA, 15 bp, Homo sapiens
tttttgttttacaag

SEQ ID NO: 378883 - DNA, 15 bp, Homo sapiens
ttttgttttacaaga

SEQ ID NO: 378884 - DNA, 15 bp, Homo sapiens
tttgttttacaagac

SEQ ID NO: 378885 - DNA, 15 bp, Homo sapiens
ttgttttacaagact

SEQ ID NO: 378886 - DNA, 15 bp, Homo sapiens
tgttttacaagactt

SEQ ID NO: 378887 - DNA, 15 bp, Homo sapiens
gttttacaagacttc

SEQ ID NO: 378888 - DNA, 15 bp, Homo sapiens
ttttacaagacttct

SEQ ID NO: 378889 - DNA, 15 bp, Homo sapiens
tttacaagacttctc

SEQ ID NO: 378890 - DNA, 15 bp, Homo sapiens
ttacaagacttctcc

SEQ ID NO: 378891 - DNA, 15 bp, Homo sapiens
tacaagacttctcct

SEQ ID NO: 378892 - DNA, 15 bp, Homo sapiens
acaagacttctccta

SEQ ID NO: 378893 - DNA, 15 bp, Homo sapiens
caagacttctcctaa

SEQ ID NO: 378894 - DNA, 15 bp, Homo sapiens
aagacttctcctaaa

SEQ ID NO: 378895 - DNA, 15 bp, Homo sapiens
agacttctcctaaat

SEQ ID NO: 378896 - DNA, 15 bp, Homo sapiens
gacttctcctaaata

SEQ ID NO: 378897 - DNA, 15 bp, Homo sapiens
acttctcctaaatat

SEQ ID NO: 378898 - DNA, 15 bp, Homo sapiens
cttctcctaaatatc

SEQ ID NO: 378899 - DNA, 15 bp, Homo sapiens
ttctcctaaatatct

SEQ ID NO: 378900 - DNA, 15 bp, Homo sapiens
tctcctaaatatctt

SEQ ID NO: 378901 - DNA, 15 bp, Homo sapiens
ctcctaaatatcttc

SEQ ID NO: 378902 - DNA, 15 bp, Homo sapiens
tcctaaatatcttcc

SEQ ID NO: 378903 - DNA, 15 bp, Homo sapiens
cctaaatatcttccc

SEQ ID NO: 378904 - DNA, 15 bp, Homo sapiens
ctaaatatcttccct

SEQ ID NO: 378905 - DNA, 15 bp, Homo sapiens
taaatatcttccctt

SEQ ID NO: 378906 - DNA, 15 bp, Homo sapiens
aaatatcttcccttt

SEQ ID NO: 378907 - DNA, 15 bp, Homo sapiens
aatatcttccctttc

SEQ ID NO: 378908 - DNA, 15 bp, Homo sapiens
atatcttccctttcc

SEQ ID NO: 378909 - DNA, 15 bp, Homo sapiens
tatcttccctttccc

SEQ ID NO: 378910 - DNA, 15 bp, Homo sapiens
atcttccctttccca

SEQ ID NO: 378911 - DNA, 15 bp, Homo sapiens
tcttccctttcccat

SEQ ID NO: 378912 - DNA, 15 bp, Homo sapiens
cttccctttcccatt

SEQ ID NO: 378913 - DNA, 15 bp, Homo sapiens
ttccctttcccattg

SEQ ID NO: 378914 - DNA, 15 bp, Homo sapiens
tccctttcccattga

SEQ ID NO: 378915 - DNA, 15 bp, Homo sapiens
ccctttcccattgaa

SEQ ID NO: 378916 - DNA, 15 bp, Homo sapiens
cctttcccattgaat

SEQ ID NO: 378917 - DNA, 15 bp, Homo sapiens
ctttcccattgaatg

SEQ ID NO: 378918 - DNA, 15 bp, Homo sapiens
tttcccattgaatgt

SEQ ID NO: 378919 - DNA, 15 bp, Homo sapiens
ttcccattgaatgta

SEQ ID NO: 378920 - DNA, 15 bp, Homo sapiens
tcccattgaatgtac

SEQ ID NO: 378921 - DNA, 15 bp, Homo sapiens
cccattgaatgtaca

SEQ ID NO: 378922 - DNA, 15 bp, Homo sapiens
ccattgaatgtacac

SEQ ID NO: 378923 - DNA, 15 bp, Homo sapiens
cattgaatgtacaca

SEQ ID NO: 378924 - DNA, 15 bp, Homo sapiens
attgaatgtacacac

SEQ ID NO: 378925 - DNA, 15 bp, Homo sapiens
ttgaatgtacacact

SEQ ID NO: 378926 - DNA, 15 bp, Homo sapiens
tgaatgtacacactc

SEQ ID NO: 378927 - DNA, 15 bp, Homo sapiens
gaatgtacacactct

SEQ ID NO: 378928 - DNA, 15 bp, Homo sapiens
aatgtacacactcta

SEQ ID NO: 378929 - DNA, 15 bp, Homo sapiens
atgtacacactctat

SEQ ID NO: 378930 - DNA, 15 bp, Homo sapiens
tgtacacactctatt

SEQ ID NO: 378931 - DNA, 15 bp, Homo sapiens
gtacacactctattt

SEQ ID NO: 378932 - DNA, 15 bp, Homo sapiens
tacacactctatttt

SEQ ID NO: 378933 - DNA, 15 bp, Homo sapiens
acacactctattttc

SEQ ID NO: 378934 - DNA, 15 bp, Homo sapiens
cacactctattttct

SEQ ID NO: 378935 - DNA, 15 bp, Homo sapiens
acactctattttctc

SEQ ID NO: 378936 - DNA, 15 bp, Homo sapiens
cactctattttctct

SEQ ID NO: 378937 - DNA, 15 bp, Homo sapiens
actctattttctctc

SEQ ID NO: 378938 - DNA, 15 bp, Homo sapiens
ctctattttctctct

SEQ ID NO: 378939 - DNA, 15 bp, Homo sapiens
tctattttctctcta

SEQ ID NO: 378940 - DNA, 15 bp, Homo sapiens
ctattttctctctat

SEQ ID NO: 378941 - DNA, 15 bp, Homo sapiens
tattttctctctata

SEQ ID NO: 378942 - DNA, 15 bp, Homo sapiens
attttctctctatat

SEQ ID NO: 378943 - DNA, 15 bp, Homo sapiens
ttttctctctatata

SEQ ID NO: 378944 - DNA, 15 bp, Homo sapiens
tttctctctatatat

SEQ ID NO: 378945 - DNA, 15 bp, Homo sapiens
ttctctctatatata

SEQ ID NO: 378946 - DNA, 15 bp, Homo sapiens
tctctctatatataa

SEQ ID NO: 378947 - DNA, 15 bp, Homo sapiens
ctctctatatataaa

SEQ ID NO: 378948 - DNA, 15 bp, Homo sapiens
tctctatatataaat

SEQ ID NO: 378949 - DNA, 15 bp, Homo sapiens
ctctatatataaata

SEQ ID NO: 378950 - DNA, 15 bp, Homo sapiens
tctatatataaatat

SEQ ID NO: 378951 - DNA, 15 bp, Homo sapiens
ctatatataaatatt

SEQ ID NO: 378952 - DNA, 15 bp, Homo sapiens
tatatataaatattt

SEQ ID NO: 378953 - DNA, 15 bp, Homo sapiens
atatataaatatttc

SEQ ID NO: 378954 - DNA, 15 bp, Homo sapiens
tatataaatatttct

SEQ ID NO: 378955 - DNA, 15 bp, Homo sapiens
atataaatatttctg

SEQ ID NO: 378956 - DNA, 15 bp, Homo sapiens
tataaatatttctgt

SEQ ID NO: 378957 - DNA, 15 bp, Homo sapiens
ataaatatttctgtg

SEQ ID NO: 378958 - DNA, 15 bp, Homo sapiens
taaatatttctgtgt

SEQ ID NO: 378959 - DNA, 15 bp, Homo sapiens
aaatatttctgtgtg

SEQ ID NO: 378960 - DNA, 15 bp, Homo sapiens
aatatttctgtgtgt

SEQ ID NO: 378961 - DNA, 15 bp, Homo sapiens
atatttctgtgtgtg

SEQ ID NO: 378962 - DNA, 15 bp, Homo sapiens
tatttctgtgtgtgt

SEQ ID NO: 378963 - DNA, 15 bp, Homo sapiens
atttctgtgtgtgta

SEQ ID NO: 378964 - DNA, 15 bp, Homo sapiens
tttctgtgtgtgtag

SEQ ID NO: 378965 - DNA, 15 bp, Homo sapiens
ttctgtgtgtgtaga

SEQ ID NO: 378966 - DNA, 15 bp, Homo sapiens
tctgtgtgtgtagag

SEQ ID NO: 378967 - DNA, 15 bp, Homo sapiens
ctgtgtgtgtagagg

SEQ ID NO: 378968 - DNA, 15 bp, Homo sapiens
tgtgtgtgtagaggt

SEQ ID NO: 378969 - DNA, 15 bp, Homo sapiens
gtgtgtgtagaggtt

SEQ ID NO: 378970 - DNA, 15 bp, Homo sapiens
tgtgtgtagaggttc

SEQ ID NO: 378971 - DNA, 15 bp, Homo sapiens
gtgtgtagaggttct

SEQ ID NO: 378972 - DNA, 15 bp, Homo sapiens
tgtgtagaggttcta

SEQ ID NO: 378973 - DNA, 15 bp, Homo sapiens
gtgtagaggttctat

SEQ ID NO: 378974 - DNA, 15 bp, Homo sapiens
tgtagaggttctata

SEQ ID NO: 378975 - DNA, 15 bp, Homo sapiens
gtagaggttctataa

SEQ ID NO: 378976 - DNA, 15 bp, Homo sapiens
tagaggttctataac

SEQ ID NO: 378977 - DNA, 15 bp, Homo sapiens
agaggttctataacc

SEQ ID NO: 378978 - DNA, 15 bp, Homo sapiens
gaggttctataacct

SEQ ID NO: 378979 - DNA, 15 bp, Homo sapiens
aggttctataacctt

SEQ ID NO: 378980 - DNA, 15 bp, Homo sapiens
ggttctataaccttc

SEQ ID NO: 378981 - DNA, 15 bp, Homo sapiens
gttctataaccttca

SEQ ID NO: 378982 - DNA, 15 bp, Homo sapiens
ttctataaccttcat

SEQ ID NO: 378983 - DNA, 15 bp, Homo sapiens
tctataaccttcatc

SEQ ID NO: 378984 - DNA, 15 bp, Homo sapiens
ctataaccttcatca

SEQ ID NO: 378985 - DNA, 15 bp, Homo sapiens
tataaccttcatcac

SEQ ID NO: 378986 - DNA, 15 bp, Homo sapiens
ataaccttcatcact

SEQ ID NO: 378987 - DNA, 15 bp, Homo sapiens
taaccttcatcactc

SEQ ID NO: 378988 - DNA, 15 bp, Homo sapiens
aaccttcatcactcc

SEQ ID NO: 378989 - DNA, 15 bp, Homo sapiens
accttcatcactcct

SEQ ID NO: 378990 - DNA, 15 bp, Homo sapiens
ccttcatcactcctc

SEQ ID NO: 378991 - DNA, 15 bp, Homo sapiens
cttcatcactcctca

SEQ ID NO: 378992 - DNA, 15 bp, Homo sapiens
ttcatcactcctcat

SEQ ID NO: 378993 - DNA, 15 bp, Homo sapiens
tcatcactcctcatt

SEQ ID NO: 378994 - DNA, 15 bp, Homo sapiens
catcactcctcatta

SEQ ID NO: 378995 - DNA, 15 bp, Homo sapiens
atcactcctcattat

SEQ ID NO: 378996 - DNA, 15 bp, Homo sapiens
tcactcctcattata

SEQ ID NO: 378997 - DNA, 15 bp, Homo sapiens
cactcctcattatat

SEQ ID NO: 378998 - DNA, 15 bp, Homo sapiens
actcctcattatatg

SEQ ID NO: 378999 - DNA, 15 bp, Homo sapiens
ctcctcattatatga

SEQ ID NO: 379000 - DNA, 15 bp, Homo sapiens
tcctcattatatgaa

SEQ ID NO: 379001 - DNA, 15 bp, Homo sapiens
cctcattatatgaaa

SEQ ID NO: 379002 - DNA, 15 bp, Homo sapiens
ctcattatatgaaaa

SEQ ID NO: 379003 - DNA, 15 bp, Homo sapiens
tcattatatgaaaaa

SEQ ID NO: 379004 - DNA, 15 bp, Homo sapiens
cattatatgaaaaac

SEQ ID NO: 379005 - DNA, 15 bp, Homo sapiens
attatatgaaaaacc

SEQ ID NO: 379006 - DNA, 15 bp, Homo sapiens
ttatatgaaaaaccc

SEQ ID NO: 379007 - DNA, 15 bp, Homo sapiens
tatatgaaaaaccct

SEQ ID NO: 379008 - DNA, 15 bp, Homo sapiens
atatgaaaaaccctt

SEQ ID NO: 379009 - DNA, 15 bp, Homo sapiens
tatgaaaaacccttc

SEQ ID NO: 379010 - DNA, 15 bp, Homo sapiens
atgaaaaacccttcc

SEQ ID NO: 379011 - DNA, 15 bp, Homo sapiens
tgaaaaacccttccc

SEQ ID NO: 379012 - DNA, 15 bp, Homo sapiens
gaaaaacccttccca

SEQ ID NO: 379013 - DNA, 15 bp, Homo sapiens
aaaaacccttcccag

SEQ ID NO: 379014 - DNA, 15 bp, Homo sapiens
aaaacccttcccagg

SEQ ID NO: 379015 - DNA, 15 bp, Homo sapiens
aaacccttcccaggg

SEQ ID NO: 379016 - DNA, 15 bp, Homo sapiens
aacccttcccagggg

SEQ ID NO: 379017 - DNA, 15 bp, Homo sapiens
acccttcccaggggg

SEQ ID NO: 379018 - DNA, 15 bp, Homo sapiens
cccttcccaggggga

SEQ ID NO: 379019 - DNA, 15 bp, Homo sapiens
ccttcccagggggaa

SEQ ID NO: 379020 - DNA, 15 bp, Homo sapiens
cttcccagggggaat

SEQ ID NO: 379021 - DNA, 15 bp, Homo sapiens
ttcccagggggaatg

SEQ ID NO: 379022 - DNA, 15 bp, Homo sapiens
tcccagggggaatgt

SEQ ID NO: 379023 - DNA, 15 bp, Homo sapiens
cccagggggaatgta

SEQ ID NO: 379024 - DNA, 15 bp, Homo sapiens
ccagggggaatgtat

SEQ ID NO: 379025 - DNA, 15 bp, Homo sapiens
cagggggaatgtatt

SEQ ID NO: 379026 - DNA, 15 bp, Homo sapiens
agggggaatgtattg

SEQ ID NO: 379027 - DNA, 15 bp, Homo sapiens
gggggaatgtattgc

SEQ ID NO: 379028 - DNA, 15 bp, Homo sapiens
ggggaatgtattgct

SEQ ID NO: 379029 - DNA, 15 bp, Homo sapiens
gggaatgtattgcta

SEQ ID NO: 379030 - DNA, 15 bp, Homo sapiens
ggaatgtattgctac

SEQ ID NO: 379031 - DNA, 15 bp, Homo sapiens
gaatgtattgctacc

SEQ ID NO: 379032 - DNA, 15 bp, Homo sapiens
aatgtattgctacca

SEQ ID NO: 379033 - DNA, 15 bp, Homo sapiens
atgtattgctaccaa

SEQ ID NO: 379034 - DNA, 15 bp, Homo sapiens
tgtattgctaccaat

SEQ ID NO: 379035 - DNA, 15 bp, Homo sapiens
gtattgctaccaata

SEQ ID NO: 379036 - DNA, 15 bp, Homo sapiens
tattgctaccaatag

SEQ ID NO: 379037 - DNA, 15 bp, Homo sapiens
attgctaccaatagt

SEQ ID NO: 379038 - DNA, 15 bp, Homo sapiens
ttgctaccaatagta

SEQ ID NO: 379039 - DNA, 15 bp, Homo sapiens
tgctaccaatagtaa

SEQ ID NO: 379040 - DNA, 15 bp, Homo sapiens
gctaccaatagtaac

SEQ ID NO: 379041 - DNA, 15 bp, Homo sapiens
ctaccaatagtaacc

SEQ ID NO: 379042 - DNA, 15 bp, Homo sapiens
taccaatagtaacct

SEQ ID NO: 379043 - DNA, 15 bp, Homo sapiens
accaatagtaacctc

SEQ ID NO: 379044 - DNA, 15 bp, Homo sapiens
ccaatagtaacctcg

SEQ ID NO: 379045 - DNA, 15 bp, Homo sapiens
caatagtaacctcgt

SEQ ID NO: 379046 - DNA, 15 bp, Homo sapiens
aatagtaacctcgtt

SEQ ID NO: 379047 - DNA, 15 bp, Homo sapiens
atagtaacctcgttt

SEQ ID NO: 379048 - DNA, 15 bp, Homo sapiens
tagtaacctcgtttt

SEQ ID NO: 379049 - DNA, 15 bp, Homo sapiens
agtaacctcgtttta

SEQ ID NO: 379050 - DNA, 15 bp, Homo sapiens
gtaacctcgttttag

SEQ ID NO: 379051 - DNA, 15 bp, Homo sapiens
taacctcgttttagg

SEQ ID NO: 379052 - DNA, 15 bp, Homo sapiens
aacctcgttttaggg

SEQ ID NO: 379053 - DNA, 15 bp, Homo sapiens
acctcgttttagggc

SEQ ID NO: 379054 - DNA, 15 bp, Homo sapiens
cctcgttttagggct

SEQ ID NO: 379055 - DNA, 15 bp, Homo sapiens
ctcgttttagggctt

SEQ ID NO: 379056 - DNA, 15 bp, Homo sapiens
tcgttttagggctta

SEQ ID NO: 379057 - DNA, 15 bp, Homo sapiens
cgttttagggcttaa

SEQ ID NO: 379058 - DNA, 15 bp, Homo sapiens
gttttagggcttaac

SEQ ID NO: 379059 - DNA, 15 bp, Homo sapiens
ttttagggcttaact

SEQ ID NO: 379060 - DNA, 15 bp, Homo sapiens
tttagggcttaactc

SEQ ID NO: 379061 - DNA, 15 bp, Homo sapiens
ttagggcttaactca

SEQ ID NO: 379062 - DNA, 15 bp, Homo sapiens
tagggcttaactcac

SEQ ID NO: 379063 - DNA, 15 bp, Homo sapiens
agggcttaactcaca

SEQ ID NO: 379064 - DNA, 15 bp, Homo sapiens
gggcttaactcacaa

SEQ ID NO: 379065 - DNA, 15 bp, Homo sapiens
ggcttaactcacaat

SEQ ID NO: 379066 - DNA, 15 bp, Homo sapiens
gcttaactcacaatg

SEQ ID NO: 379067 - DNA, 15 bp, Homo sapiens
cttaactcacaatga

SEQ ID NO: 379068 - DNA, 15 bp, Homo sapiens
ttaactcacaatgaa

SEQ ID NO: 379069 - DNA, 15 bp, Homo sapiens
taactcacaatgaat

SEQ ID NO: 379070 - DNA, 15 bp, Homo sapiens
aactcacaatgaatg

SEQ ID NO: 379071 - DNA, 15 bp, Homo sapiens
actcacaatgaatgg

SEQ ID NO: 379072 - DNA, 15 bp, Homo sapiens
ctcacaatgaatggg

SEQ ID NO: 379073 - DNA, 15 bp, Homo sapiens
tcacaatgaatggga

SEQ ID NO: 379074 - DNA, 15 bp, Homo sapiens
cacaatgaatgggat

SEQ ID NO: 379075 - DNA, 15 bp, Homo sapiens
acaatgaatgggata

SEQ ID NO: 379076 - DNA, 15 bp, Homo sapiens
caatgaatgggataa

SEQ ID NO: 379077 - DNA, 15 bp, Homo sapiens
aatgaatgggataat

SEQ ID NO: 379078 - DNA, 15 bp, Homo sapiens
atgaatgggataatt

SEQ ID NO: 379079 - DNA, 15 bp, Homo sapiens
tgaatgggataattt

SEQ ID NO: 379080 - DNA, 15 bp, Homo sapiens
gaatgggataatttg

SEQ ID NO: 379081 - DNA, 15 bp, Homo sapiens
aatgggataatttgc

SEQ ID NO: 379082 - DNA, 15 bp, Homo sapiens
atgggataatttgcc

SEQ ID NO: 379083 - DNA, 15 bp, Homo sapiens
tgggataatttgcct

SEQ ID NO: 379084 - DNA, 15 bp, Homo sapiens
gggataatttgccta

SEQ ID NO: 379085 - DNA, 15 bp, Homo sapiens
ggataatttgcctat

SEQ ID NO: 379086 - DNA, 15 bp, Homo sapiens
gataatttgcctatt

SEQ ID NO: 379087 - DNA, 15 bp, Homo sapiens
ataatttgcctattt

SEQ ID NO: 379088 - DNA, 15 bp, Homo sapiens
taatttgcctatttc

SEQ ID NO: 379089 - DNA, 15 bp, Homo sapiens
aatttgcctatttct

SEQ ID NO: 379090 - DNA, 15 bp, Homo sapiens
atttgcctatttctt

SEQ ID NO: 379091 - DNA, 15 bp, Homo sapiens
tttgcctatttctta

SEQ ID NO: 379092 - DNA, 15 bp, Homo sapiens
ttgcctatttcttat

SEQ ID NO: 379093 - DNA, 15 bp, Homo sapiens
tgcctatttcttatg

SEQ ID NO: 379094 - DNA, 15 bp, Homo sapiens
gcctatttcttatga

SEQ ID NO: 379095 - DNA, 15 bp, Homo sapiens
cctatttcttatgat

SEQ ID NO: 379096 - DNA, 15 bp, Homo sapiens
ctatttcttatgata

SEQ ID NO: 379097 - DNA, 15 bp, Homo sapiens
tatttcttatgataa

SEQ ID NO: 379098 - DNA, 15 bp, Homo sapiens
atttcttatgataaa

SEQ ID NO: 379099 - DNA, 15 bp, Homo sapiens
tttcttatgataaac

SEQ ID NO: 379100 - DNA, 15 bp, Homo sapiens
ttcttatgataaacc

SEQ ID NO: 379101 - DNA, 15 bp, Homo sapiens
tcttatgataaacct

SEQ ID NO: 379102 - DNA, 15 bp, Homo sapiens
cttatgataaacctg

SEQ ID NO: 379103 - DNA, 15 bp, Homo sapiens
ttatgataaacctgt

SEQ ID NO: 379104 - DNA, 15 bp, Homo sapiens
tatgataaacctgtg

SEQ ID NO: 379105 - DNA, 15 bp, Homo sapiens
atgataaacctgtga

SEQ ID NO: 379106 - DNA, 15 bp, Homo sapiens
tgataaacctgtgat

SEQ ID NO: 379107 - DNA, 15 bp, Homo sapiens
gataaacctgtgata

SEQ ID NO: 379108 - DNA, 15 bp, Homo sapiens
ataaacctgtgatat

SEQ ID NO: 379109 - DNA, 15 bp, Homo sapiens
taaacctgtgatatt

SEQ ID NO: 379110 - DNA, 15 bp, Homo sapiens
aaacctgtgatattt

SEQ ID NO: 379111 - DNA, 15 bp, Homo sapiens
aacctgtgatattta

SEQ ID NO: 379112 - DNA, 15 bp, Homo sapiens
acctgtgatatttac

SEQ ID NO: 379113 - DNA, 15 bp, Homo sapiens
cctgtgatatttact

SEQ ID NO: 379114 - DNA, 15 bp, Homo sapiens
ctgtgatatttactc

SEQ ID NO: 379115 - DNA, 15 bp, Homo sapiens
tgtgatatttactct

SEQ ID NO: 379116 - DNA, 15 bp, Homo sapiens
gtgatatttactctc

SEQ ID NO: 379117 - DNA, 15 bp, Homo sapiens
tgatatttactctcg

SEQ ID NO: 379118 - DNA, 15 bp, Homo sapiens
gatatttactctcgc

SEQ ID NO: 379119 - DNA, 15 bp, Homo sapiens
atatttactctcgct

SEQ ID NO: 379120 - DNA, 15 bp, Homo sapiens
tatttactctcgctt

SEQ ID NO: 379121 - DNA, 15 bp, Homo sapiens
atttactctcgcttg

SEQ ID NO: 379122 - DNA, 15 bp, Homo sapiens
tttactctcgcttga

SEQ ID NO: 379123 - DNA, 15 bp, Homo sapiens
ttactctcgcttgat

SEQ ID NO: 379124 - DNA, 15 bp, Homo sapiens
tactctcgcttgatg

SEQ ID NO: 379125 - DNA, 15 bp, Homo sapiens
actctcgcttgatgt

SEQ ID NO: 379126 - DNA, 15 bp, Homo sapiens
ctctcgcttgatgtc

SEQ ID NO: 379127 - DNA, 15 bp, Homo sapiens
tctcgcttgatgtct

SEQ ID NO: 379128 - DNA, 15 bp, Homo sapiens
ctcgcttgatgtctt

SEQ ID NO: 379129 - DNA, 15 bp, Homo sapiens
tcgcttgatgtcttt

SEQ ID NO: 379130 - DNA, 15 bp, Homo sapiens
cgcttgatgtctttg

SEQ ID NO: 379131 - DNA, 15 bp, Homo sapiens
gcttgatgtctttgg

SEQ ID NO: 379132 - DNA, 15 bp, Homo sapiens
cttgatgtctttggt

SEQ ID NO: 379133 - DNA, 15 bp, Homo sapiens
ttgatgtctttggtt

SEQ ID NO: 379134 - DNA, 15 bp, Homo sapiens
tgatgtctttggttt

SEQ ID NO: 379135 - DNA, 15 bp, Homo sapiens
gatgtctttggtttc

SEQ ID NO: 379136 - DNA, 15 bp, Homo sapiens
atgtctttggtttca

SEQ ID NO: 379137 - DNA, 15 bp, Homo sapiens
tgtctttggtttcat

SEQ ID NO: 379138 - DNA, 15 bp, Homo sapiens
gtctttggtttcatt

SEQ ID NO: 379139 - DNA, 15 bp, Homo sapiens
tctttggtttcattt

SEQ ID NO: 379140 - DNA, 15 bp, Homo sapiens
ctttggtttcatttg

SEQ ID NO: 379141 - DNA, 15 bp, Homo sapiens
tttggtttcatttgt

SEQ ID NO: 379142 - DNA, 15 bp, Homo sapiens
ttggtttcatttgtt

SEQ ID NO: 379143 - DNA, 15 bp, Homo sapiens
tggtttcatttgttt

SEQ ID NO: 379144 - DNA, 15 bp, Homo sapiens
ggtttcatttgttta

SEQ ID NO: 379145 - DNA, 15 bp, Homo sapiens
gtttcatttgtttac

SEQ ID NO: 379146 - DNA, 15 bp, Homo sapiens
tttcatttgtttact

SEQ ID NO: 379147 - DNA, 15 bp, Homo sapiens
ttcatttgtttactg

SEQ ID NO: 379148 - DNA, 15 bp, Homo sapiens
tcatttgtttactgt

SEQ ID NO: 379149 - DNA, 15 bp, Homo sapiens
catttgtttactgtt

SEQ ID NO: 379150 - DNA, 15 bp, Homo sapiens
atttgtttactgtta

SEQ ID NO: 379151 - DNA, 15 bp, Homo sapiens
tttgtttactgttaa

SEQ ID NO: 379152 - DNA, 15 bp, Homo sapiens
ttgtttactgttaaa

SEQ ID NO: 379153 - DNA, 15 bp, Homo sapiens
tgtttactgttaaag

SEQ ID NO: 379154 - DNA, 15 bp, Homo sapiens
gtttactgttaaagg

SEQ ID NO: 379155 - DNA, 15 bp, Homo sapiens
tttactgttaaagga

SEQ ID NO: 379156 - DNA, 15 bp, Homo sapiens
ttactgttaaaggat

SEQ ID NO: 379157 - DNA, 15 bp, Homo sapiens
tactgttaaaggatt

SEQ ID NO: 379158 - DNA, 15 bp, Homo sapiens
actgttaaaggattc

SEQ ID NO: 379159 - DNA, 15 bp, Homo sapiens
ctgttaaaggattct

SEQ ID NO: 379160 - DNA, 15 bp, Homo sapiens
tgttaaaggattcta

SEQ ID NO: 379161 - DNA, 15 bp, Homo sapiens
gttaaaggattctat

SEQ ID NO: 379162 - DNA, 15 bp, Homo sapiens
ttaaaggattctatt

SEQ ID NO: 379163 - DNA, 15 bp, Homo sapiens
taaaggattctatta

SEQ ID NO: 379164 - DNA, 15 bp, Homo sapiens
aaaggattctattag

SEQ ID NO: 379165 - DNA, 15 bp, Homo sapiens
aaggattctattagt

SEQ ID NO: 379166 - DNA, 15 bp, Homo sapiens
aggattctattagta

SEQ ID NO: 379167 - DNA, 15 bp, Homo sapiens
ggattctattagtaa

SEQ ID NO: 379168 - DNA, 15 bp, Homo sapiens
gattctattagtaat

SEQ ID NO: 379169 - DNA, 15 bp, Homo sapiens
attctattagtaata

SEQ ID NO: 379170 - DNA, 15 bp, Homo sapiens
ttctattagtaatag

SEQ ID NO: 379171 - DNA, 15 bp, Homo sapiens
tctattagtaataga

SEQ ID NO: 379172 - DNA, 15 bp, Homo sapiens
ctattagtaatagaa

SEQ ID NO: 379173 - DNA, 15 bp, Homo sapiens
tattagtaatagaat

SEQ ID NO: 379174 - DNA, 15 bp, Homo sapiens
attagtaatagaatt

SEQ ID NO: 379175 - DNA, 15 bp, Homo sapiens
ttagtaatagaattg

SEQ ID NO: 379176 - DNA, 15 bp, Homo sapiens
tagtaatagaattgg

SEQ ID NO: 379177 - DNA, 15 bp, Homo sapiens
agtaatagaattggt

SEQ ID NO: 379178 - DNA, 15 bp, Homo sapiens
gtaatagaattggtc

SEQ ID NO: 379179 - DNA, 15 bp, Homo sapiens
taatagaattggtca

SEQ ID NO: 379180 - DNA, 15 bp, Homo sapiens
aatagaattggtcat

SEQ ID NO: 379181 - DNA, 15 bp, Homo sapiens
atagaattggtcata

SEQ ID NO: 379182 - DNA, 15 bp, Homo sapiens
tagaattggtcataa

SEQ ID NO: 379183 - DNA, 15 bp, Homo sapiens
agaattggtcataag

SEQ ID NO: 379184 - DNA, 15 bp, Homo sapiens
gaattggtcataagt

SEQ ID NO: 379185 - DNA, 15 bp, Homo sapiens
aattggtcataagta

SEQ ID NO: 379186 - DNA, 15 bp, Homo sapiens
attggtcataagtac

SEQ ID NO: 379187 - DNA, 15 bp, Homo sapiens
ttggtcataagtact

SEQ ID NO: 379188 - DNA, 15 bp, Homo sapiens
tggtcataagtactt

SEQ ID NO: 379189 - DNA, 15 bp, Homo sapiens
ggtcataagtacttt

SEQ ID NO: 379190 - DNA, 15 bp, Homo sapiens
gtcataagtacttta

SEQ ID NO: 379191 - DNA, 15 bp, Homo sapiens
tcataagtactttat

SEQ ID NO: 379192 - DNA, 15 bp, Homo sapiens
cataagtactttatg

SEQ ID NO: 379193 - DNA, 15 bp, Homo sapiens
ataagtactttatgt

SEQ ID NO: 379194 - DNA, 15 bp, Homo sapiens
taagtactttatgta

SEQ ID NO: 379195 - DNA, 15 bp, Homo sapiens
aagtactttatgtaa

SEQ ID NO: 379196 - DNA, 15 bp, Homo sapiens
agtactttatgtaac

SEQ ID NO: 379197 - DNA, 15 bp, Homo sapiens
gtactttatgtaact

SEQ ID NO: 379198 - DNA, 15 bp, Homo sapiens
tactttatgtaactt

SEQ ID NO: 379199 - DNA, 15 bp, Homo sapiens
actttatgtaacttt

SEQ ID NO: 379200 - DNA, 15 bp, Homo sapiens
ctttatgtaactttt

SEQ ID NO: 379201 - DNA, 15 bp, Homo sapiens
tttatgtaacttttt

SEQ ID NO: 379202 - DNA, 15 bp, Homo sapiens
ttatgtaacttttta

SEQ ID NO: 379203 - DNA, 15 bp, Homo sapiens
tatgtaactttttaa

SEQ ID NO: 379204 - DNA, 15 bp, Homo sapiens
atgtaactttttaac

SEQ ID NO: 379205 - DNA, 15 bp, Homo sapiens
tgtaactttttaact

SEQ ID NO: 379206 - DNA, 15 bp, Homo sapiens
gtaactttttaactg

SEQ ID NO: 379207 - DNA, 15 bp, Homo sapiens
taactttttaactga

SEQ ID NO: 379208 - DNA, 15 bp, Homo sapiens
aactttttaactgac

SEQ ID NO: 379209 - DNA, 15 bp, Homo sapiens
actttttaactgaca

SEQ ID NO: 379210 - DNA, 15 bp, Homo sapiens
ctttttaactgacaa

SEQ ID NO: 379211 - DNA, 15 bp, Homo sapiens
tttttaactgacaag

SEQ ID NO: 379212 - DNA, 15 bp, Homo sapiens
ttttaactgacaaga

SEQ ID NO: 379213 - DNA, 15 bp, Homo sapiens
tttaactgacaagag

SEQ ID NO: 379214 - DNA, 15 bp, Homo sapiens
ttaactgacaagaga

SEQ ID NO: 379215 - DNA, 15 bp, Homo sapiens
taactgacaagagaa

SEQ ID NO: 379216 - DNA, 15 bp, Homo sapiens
aactgacaagagaac

SEQ ID NO: 379217 - DNA, 15 bp, Homo sapiens
actgacaagagaaca

SEQ ID NO: 379218 - DNA, 15 bp, Homo sapiens
ctgacaagagaacat

SEQ ID NO: 379219 - DNA, 15 bp, Homo sapiens
tgacaagagaacatt

SEQ ID NO: 379220 - DNA, 15 bp, Homo sapiens
gacaagagaacatta

SEQ ID NO: 379221 - DNA, 15 bp, Homo sapiens
acaagagaacattat

SEQ ID NO: 379222 - DNA, 15 bp, Homo sapiens
caagagaacattatg

SEQ ID NO: 379223 - DNA, 15 bp, Homo sapiens
aagagaacattatga

SEQ ID NO: 379224 - DNA, 15 bp, Homo sapiens
agagaacattatgat

SEQ ID NO: 379225 - DNA, 15 bp, Homo sapiens
gagaacattatgata

SEQ ID NO: 379226 - DNA, 15 bp, Homo sapiens
agaacattatgatag

SEQ ID NO: 379227 - DNA, 15 bp, Homo sapiens
gaacattatgataga

SEQ ID NO: 379228 - DNA, 15 bp, Homo sapiens
aacattatgatagat

SEQ ID NO: 379229 - DNA, 15 bp, Homo sapiens
acattatgatagatt

SEQ ID NO: 379230 - DNA, 15 bp, Homo sapiens
cattatgatagattt

SEQ ID NO: 379231 - DNA, 15 bp, Homo sapiens
attatgatagatttg

SEQ ID NO: 379232 - DNA, 15 bp, Homo sapiens
ttatgatagatttgg

SEQ ID NO: 379233 - DNA, 15 bp, Homo sapiens
tatgatagatttggc

SEQ ID NO: 379234 - DNA, 15 bp, Homo sapiens
atgatagatttggcc

SEQ ID NO: 379235 - DNA, 15 bp, Homo sapiens
tgatagatttggcct

SEQ ID NO: 379236 - DNA, 15 bp, Homo sapiens
gatagatttggcctc

SEQ ID NO: 379237 - DNA, 15 bp, Homo sapiens
atagatttggcctct

SEQ ID NO: 379238 - DNA, 15 bp, Homo sapiens
tagatttggcctctc

SEQ ID NO: 379239 - DNA, 15 bp, Homo sapiens
agatttggcctctct

SEQ ID NO: 379240 - DNA, 15 bp, Homo sapiens
gatttggcctctctt

SEQ ID NO: 379241 - DNA, 15 bp, Homo sapiens
atttggcctctcttc

SEQ ID NO: 379242 - DNA, 15 bp, Homo sapiens
tttggcctctcttcc

SEQ ID NO: 379243 - DNA, 15 bp, Homo sapiens
ttggcctctcttcct

SEQ ID NO: 379244 - DNA, 15 bp, Homo sapiens
tggcctctcttcctt

SEQ ID NO: 379245 - DNA, 15 bp, Homo sapiens
ggcctctcttcctta

SEQ ID NO: 379246 - DNA, 15 bp, Homo sapiens
gcctctcttccttaa

SEQ ID NO: 379247 - DNA, 15 bp, Homo sapiens
cctctcttccttaag

SEQ ID NO: 379248 - DNA, 15 bp, Homo sapiens
ctctcttccttaagt

SEQ ID NO: 379249 - DNA, 15 bp, Homo sapiens
tctcttccttaagtt

SEQ ID NO: 379250 - DNA, 15 bp, Homo sapiens
ctcttccttaagttt

SEQ ID NO: 379251 - DNA, 15 bp, Homo sapiens
tcttccttaagttta

SEQ ID NO: 379252 - DNA, 15 bp, Homo sapiens
cttccttaagtttaa

SEQ ID NO: 379253 - DNA, 15 bp, Homo sapiens
ttccttaagtttaaa

SEQ ID NO: 379254 - DNA, 15 bp, Homo sapiens
tccttaagtttaaaa

SEQ ID NO: 379255 - DNA, 15 bp, Homo sapiens
ccttaagtttaaaac

SEQ ID NO: 379256 - DNA, 15 bp, Homo sapiens
cttaagtttaaaact

SEQ ID NO: 379257 - DNA, 15 bp, Homo sapiens
ttaagtttaaaactt

SEQ ID NO: 379258 - DNA, 15 bp, Homo sapiens
taagtttaaaactta

SEQ ID NO: 379259 - DNA, 15 bp, Homo sapiens
aagtttaaaacttaa

SEQ ID NO: 379260 - DNA, 15 bp, Homo sapiens
agtttaaaacttaag

SEQ ID NO: 379261 - DNA, 15 bp, Homo sapiens
gtttaaaacttaagc

SEQ ID NO: 379262 - DNA, 15 bp, Homo sapiens
tttaaaacttaagca

SEQ ID NO: 379263 - DNA, 15 bp, Homo sapiens
ttaaaacttaagcaa

SEQ ID NO: 379264 - DNA, 15 bp, Homo sapiens
taaaacttaagcaat

SEQ ID NO: 379265 - DNA, 15 bp, Homo sapiens
aaaacttaagcaatt

SEQ ID NO: 379266 - DNA, 15 bp, Homo sapiens
aaacttaagcaattt

SEQ ID NO: 379267 - DNA, 15 bp, Homo sapiens
aacttaagcaattta

SEQ ID NO: 379268 - DNA, 15 bp, Homo sapiens
acttaagcaatttat

SEQ ID NO: 379269 - DNA, 15 bp, Homo sapiens
cttaagcaatttatt

SEQ ID NO: 379270 - DNA, 15 bp, Homo sapiens
ttaagcaatttattt

SEQ ID NO: 379271 - DNA, 15 bp, Homo sapiens
taagcaatttattta

SEQ ID NO: 379272 - DNA, 15 bp, Homo sapiens
aagcaatttatttaa

SEQ ID NO: 379273 - DNA, 15 bp, Homo sapiens
agcaatttatttaaa

SEQ ID NO: 379274 - DNA, 15 bp, Homo sapiens
gcaatttatttaaac

SEQ ID NO: 379275 - DNA, 15 bp, Homo sapiens
caatttatttaaaca

SEQ ID NO: 379276 - DNA, 15 bp, Homo sapiens
aatttatttaaacag

SEQ ID NO: 379277 - DNA, 15 bp, Homo sapiens
atttatttaaacagc

SEQ ID NO: 379278 - DNA, 15 bp, Homo sapiens
tttatttaaacagct

SEQ ID NO: 379279 - DNA, 15 bp, Homo sapiens
ttatttaaacagcta

SEQ ID NO: 379280 - DNA, 15 bp, Homo sapiens
tatttaaacagctaa

SEQ ID NO: 379281 - DNA, 15 bp, Homo sapiens
atttaaacagctaag

SEQ ID NO: 379282 - DNA, 15 bp, Homo sapiens
tttaaacagctaaga

SEQ ID NO: 379283 - DNA, 15 bp, Homo sapiens
ttaaacagctaagac

SEQ ID NO: 379284 - DNA, 15 bp, Homo sapiens
taaacagctaagaca

SEQ ID NO: 379285 - DNA, 15 bp, Homo sapiens
aaacagctaagacag

SEQ ID NO: 379286 - DNA, 15 bp, Homo sapiens
aacagctaagacaga

SEQ ID NO: 379287 - DNA, 15 bp, Homo sapiens
acagctaagacagaa

SEQ ID NO: 379288 - DNA, 15 bp, Homo sapiens
cagctaagacagaat

SEQ ID NO: 379289 - DNA, 15 bp, Homo sapiens
agctaagacagaatg

SEQ ID NO: 379290 - DNA, 15 bp, Homo sapiens
gctaagacagaatga

SEQ ID NO: 379291 - DNA, 15 bp, Homo sapiens
ctaagacagaatgaa

SEQ ID NO: 379292 - DNA, 15 bp, Homo sapiens
taagacagaatgaaa

SEQ ID NO: 379293 - DNA, 15 bp, Homo sapiens
aagacagaatgaaac

SEQ ID NO: 379294 - DNA, 15 bp, Homo sapiens
agacagaatgaaaca

SEQ ID NO: 379295 - DNA, 15 bp, Homo sapiens
gacagaatgaaacag

SEQ ID NO: 379296 - DNA, 15 bp, Homo sapiens
acagaatgaaacaga

SEQ ID NO: 379297 - DNA, 15 bp, Homo sapiens
cagaatgaaacagat

SEQ ID NO: 379298 - DNA, 15 bp, Homo sapiens
agaatgaaacagatt

SEQ ID NO: 379299 - DNA, 15 bp, Homo sapiens
gaatgaaacagattg

SEQ ID NO: 379300 - DNA, 15 bp, Homo sapiens
aatgaaacagattgt

SEQ ID NO: 379301 - DNA, 15 bp, Homo sapiens
atgaaacagattgtc

SEQ ID NO: 379302 - DNA, 15 bp, Homo sapiens
tgaaacagattgtct

SEQ ID NO: 379303 - DNA, 15 bp, Homo sapiens
gaaacagattgtctc

SEQ ID NO: 379304 - DNA, 15 bp, Homo sapiens
aaacagattgtctca

SEQ ID NO: 379305 - DNA, 15 bp, Homo sapiens
aacagattgtctcat

SEQ ID NO: 379306 - DNA, 15 bp, Homo sapiens
acagattgtctcatt

SEQ ID NO: 379307 - DNA, 15 bp, Homo sapiens
cagattgtctcattg

SEQ ID NO: 379308 - DNA, 15 bp, Homo sapiens
agattgtctcattga

SEQ ID NO: 379309 - DNA, 15 bp, Homo sapiens
gattgtctcattgag

SEQ ID NO: 379310 - DNA, 15 bp, Homo sapiens
attgtctcattgagc

SEQ ID NO: 379311 - DNA, 15 bp, Homo sapiens
ttgtctcattgagca

SEQ ID NO: 379312 - DNA, 15 bp, Homo sapiens
tgtctcattgagcaa

SEQ ID NO: 379313 - DNA, 15 bp, Homo sapiens
gtctcattgagcaag

SEQ ID NO: 379314 - DNA, 15 bp, Homo sapiens
tctcattgagcaagt

SEQ ID NO: 379315 - DNA, 15 bp, Homo sapiens
ctcattgagcaagtt

SEQ ID NO: 379316 - DNA, 15 bp, Homo sapiens
tcattgagcaagttt

SEQ ID NO: 379317 - DNA, 15 bp, Homo sapiens
cattgagcaagtttt

SEQ ID NO: 379318 - DNA, 15 bp, Homo sapiens
attgagcaagtttta

SEQ ID NO: 379319 - DNA, 15 bp, Homo sapiens
ttgagcaagttttaa

SEQ ID NO: 379320 - DNA, 15 bp, Homo sapiens
tgagcaagttttaaa

SEQ ID NO: 379321 - DNA, 15 bp, Homo sapiens
gagcaagttttaaag

SEQ ID NO: 379322 - DNA, 15 bp, Homo sapiens
agcaagttttaaaga

SEQ ID NO: 379323 - DNA, 15 bp, Homo sapiens
gcaagttttaaagaa

SEQ ID NO: 379324 - DNA, 15 bp, Homo sapiens
caagttttaaagaat

SEQ ID NO: 379325 - DNA, 15 bp, Homo sapiens
aagttttaaagaatg

SEQ ID NO: 379326 - DNA, 15 bp, Homo sapiens
agttttaaagaatga

SEQ ID NO: 379327 - DNA, 15 bp, Homo sapiens
gttttaaagaatgat

SEQ ID NO: 379328 - DNA, 15 bp, Homo sapiens
ttttaaagaatgatg

SEQ ID NO: 379329 - DNA, 15 bp, Homo sapiens
ttaaagaatgatgac

SEQ ID NO: 379330 - DNA, 15 bp, Homo sapiens
taaagaatgatgaca

SEQ ID NO: 379331 - DNA, 15 bp, Homo sapiens
aaagaatgatgacat

SEQ ID NO: 379332 - DNA, 15 bp, Homo sapiens
aagaatgatgacatg

SEQ ID NO: 379333 - DNA, 15 bp, Homo sapiens
agaatgatgacatgt

SEQ ID NO: 379334 - DNA, 15 bp, Homo sapiens
gaatgatgacatgta

SEQ ID NO: 379335 - DNA, 15 bp, Homo sapiens
aatgatgacatgtaa

SEQ ID NO: 379336 - DNA, 15 bp, Homo sapiens
atgatgacatgtaag

SEQ ID NO: 379337 - DNA, 15 bp, Homo sapiens
tgatgacatgtaagt

SEQ ID NO: 379338 - DNA, 15 bp, Homo sapiens
gatgacatgtaagta

SEQ ID NO: 379339 - DNA, 15 bp, Homo sapiens
atgacatgtaagtat

SEQ ID NO: 379340 - DNA, 15 bp, Homo sapiens
tgacatgtaagtata

SEQ ID NO: 379341 - DNA, 15 bp, Homo sapiens
gacatgtaagtataa

SEQ ID NO: 379342 - DNA, 15 bp, Homo sapiens
acatgtaagtataac

SEQ ID NO: 379343 - DNA, 15 bp, Homo sapiens
catgtaagtataact

SEQ ID NO: 379344 - DNA, 15 bp, Homo sapiens
atgtaagtataactt

SEQ ID NO: 379345 - DNA, 15 bp, Homo sapiens
tgtaagtataactta

SEQ ID NO: 379346 - DNA, 15 bp, Homo sapiens
gtaagtataacttaa

SEQ ID NO: 379347 - DNA, 15 bp, Homo sapiens
taagtataacttaag

SEQ ID NO: 379348 - DNA, 15 bp, Homo sapiens
aagtataacttaagg

SEQ ID NO: 379349 - DNA, 15 bp, Homo sapiens
agtataacttaaggc

SEQ ID NO: 379350 - DNA, 15 bp, Homo sapiens
gtataacttaaggcc

SEQ ID NO: 379351 - DNA, 15 bp, Homo sapiens
tataacttaaggcct

SEQ ID NO: 379352 - DNA, 15 bp, Homo sapiens
ataacttaaggcctg

SEQ ID NO: 379353 - DNA, 15 bp, Homo sapiens
taacttaaggcctga

SEQ ID NO: 379354 - DNA, 15 bp, Homo sapiens
aacttaaggcctgaa

SEQ ID NO: 379355 - DNA, 15 bp, Homo sapiens
acttaaggcctgaac

SEQ ID NO: 379356 - DNA, 15 bp, Homo sapiens
cttaaggcctgaaca

SEQ ID NO: 379357 - DNA, 15 bp, Homo sapiens
ttaaggcctgaacag

SEQ ID NO: 379358 - DNA, 15 bp, Homo sapiens
taaggcctgaacagc

SEQ ID NO: 379359 - DNA, 15 bp, Homo sapiens
aaggcctgaacagcc

SEQ ID NO: 379360 - DNA, 15 bp, Homo sapiens
aggcctgaacagcct

SEQ ID NO: 379361 - DNA, 15 bp, Homo sapiens
ggcctgaacagcctt

SEQ ID NO: 379362 - DNA, 15 bp, Homo sapiens
gcctgaacagccttg

SEQ ID NO: 379363 - DNA, 15 bp, Homo sapiens
cctgaacagccttgt

SEQ ID NO: 379364 - DNA, 15 bp, Homo sapiens
ctgaacagccttgtt

SEQ ID NO: 379365 - DNA, 15 bp, Homo sapiens
tgaacagccttgttg

SEQ ID NO: 379366 - DNA, 15 bp, Homo sapiens
gaacagccttgttga

SEQ ID NO: 379367 - DNA, 15 bp, Homo sapiens
aacagccttgttgat

SEQ ID NO: 379368 - DNA, 15 bp, Homo sapiens
acagccttgttgata

SEQ ID NO: 379369 - DNA, 15 bp, Homo sapiens
cagccttgttgatag

SEQ ID NO: 379370 - DNA, 15 bp, Homo sapiens
agccttgttgatagc

SEQ ID NO: 379371 - DNA, 15 bp, Homo sapiens
gccttgttgatagct

SEQ ID NO: 379372 - DNA, 15 bp, Homo sapiens
ccttgttgatagctt

SEQ ID NO: 379373 - DNA, 15 bp, Homo sapiens
cttgttgatagcttt

SEQ ID NO: 379374 - DNA, 15 bp, Homo sapiens
ttgttgatagctttt

SEQ ID NO: 379375 - DNA, 15 bp, Homo sapiens
tgttgatagcttttt

SEQ ID NO: 379376 - DNA, 15 bp, Homo sapiens
gttgatagctttttt

SEQ ID NO: 379377 - DNA, 15 bp, Homo sapiens
ttgatagcttttttg

SEQ ID NO: 379378 - DNA, 15 bp, Homo sapiens
tgatagcttttttgt

SEQ ID NO: 379379 - DNA, 15 bp, Homo sapiens
gatagcttttttgtt

SEQ ID NO: 379380 - DNA, 15 bp, Homo sapiens
atagcttttttgttt

SEQ ID NO: 379381 - DNA, 15 bp, Homo sapiens
tagcttttttgtttt

SEQ ID NO: 379382 - DNA, 15 bp, Homo sapiens
agcttttttgttttt

SEQ ID NO: 379383 - DNA, 15 bp, Homo sapiens
gcttttttgtttttt

SEQ ID NO: 379384 - DNA, 15 bp, Homo sapiens
cttttttgttttttg

SEQ ID NO: 379385 - DNA, 15 bp, Homo sapiens
ttttttgttttttga

SEQ ID NO: 379386 - DNA, 15 bp, Homo sapiens
ttgcccaggctggat

SEQ ID NO: 379387 - DNA, 15 bp, Homo sapiens
tgcccaggctggatg

SEQ ID NO: 379388 - DNA, 15 bp, Homo sapiens
gcccaggctggatgc

SEQ ID NO: 379389 - DNA, 15 bp, Homo sapiens
cccaggctggatgca

SEQ ID NO: 379390 - DNA, 15 bp, Homo sapiens
ccaggctggatgcaa

SEQ ID NO: 379391 - DNA, 15 bp, Homo sapiens
caggctggatgcaat

SEQ ID NO: 379392 - DNA, 15 bp, Homo sapiens
aggctggatgcaatg

SEQ ID NO: 379393 - DNA, 15 bp, Homo sapiens
ggctggatgcaatgg

SEQ ID NO: 379394 - DNA, 15 bp, Homo sapiens
gctggatgcaatggt

SEQ ID NO: 379395 - DNA, 15 bp, Homo sapiens
ctggatgcaatggtg

SEQ ID NO: 379396 - DNA, 15 bp, Homo sapiens
tggatgcaatggtgc

SEQ ID NO: 379397 - DNA, 15 bp, Homo sapiens
ggatgcaatggtgca

SEQ ID NO: 379398 - DNA, 15 bp, Homo sapiens
gatgcaatggtgcaa

SEQ ID NO: 379399 - DNA, 15 bp, Homo sapiens
atgcaatggtgcaat

SEQ ID NO: 379400 - DNA, 15 bp, Homo sapiens
gcaatggtgcaatct

SEQ ID NO: 379401 - DNA, 15 bp, Homo sapiens
caatggtgcaatctt

SEQ ID NO: 379402 - DNA, 15 bp, Homo sapiens
aatggtgcaatcttg

SEQ ID NO: 379403 - DNA, 15 bp, Homo sapiens
atggtgcaatcttga

SEQ ID NO: 379404 - DNA, 15 bp, Homo sapiens
tggtgcaatcttgac

SEQ ID NO: 379405 - DNA, 15 bp, Homo sapiens
ggtgcaatcttgact

SEQ ID NO: 379406 - DNA, 15 bp, Homo sapiens
gtgcaatcttgactc

SEQ ID NO: 379407 - DNA, 15 bp, Homo sapiens
tgcaatcttgactca

SEQ ID NO: 379408 - DNA, 15 bp, Homo sapiens
gcaatcttgactcac

SEQ ID NO: 379409 - DNA, 15 bp, Homo sapiens
ctctgcctcctggga

SEQ ID NO: 379410 - DNA, 15 bp, Homo sapiens
tctgcctcctgggat

SEQ ID NO: 379411 - DNA, 15 bp, Homo sapiens
ctgcctcctgggatc

SEQ ID NO: 379412 - DNA, 15 bp, Homo sapiens
tgcctcctgggatcc

SEQ ID NO: 379413 - DNA, 15 bp, Homo sapiens
gcctcctgggatcca

SEQ ID NO: 379414 - DNA, 15 bp, Homo sapiens
cctcctgggatccag

SEQ ID NO: 379415 - DNA, 15 bp, Homo sapiens
ctcctgggatccagc

SEQ ID NO: 379416 - DNA, 15 bp, Homo sapiens
tcctgggatccagcg

SEQ ID NO: 379417 - DNA, 15 bp, Homo sapiens
cctgggatccagcga

SEQ ID NO: 379418 - DNA, 15 bp, Homo sapiens
ctgggatccagcgat

SEQ ID NO: 379419 - DNA, 15 bp, Homo sapiens
tgggatccagcgatt

SEQ ID NO: 379420 - DNA, 15 bp, Homo sapiens
gggatccagcgattc

SEQ ID NO: 379421 - DNA, 15 bp, Homo sapiens
ggatccagcgattct

SEQ ID NO: 379422 - DNA, 15 bp, Homo sapiens
gatccagcgattctc

SEQ ID NO: 379423 - DNA, 15 bp, Homo sapiens
atccagcgattctcc

SEQ ID NO: 379424 - DNA, 15 bp, Homo sapiens
tccagcgattctcct

SEQ ID NO: 379425 - DNA, 15 bp, Homo sapiens
ccagcgattctcctg

SEQ ID NO: 379426 - DNA, 15 bp, Homo sapiens
ggcacctgccaccat

SEQ ID NO: 379427 - DNA, 15 bp, Homo sapiens
gcacctgccaccatg

SEQ ID NO: 379428 - DNA, 15 bp, Homo sapiens
cacctgccaccatgc

SEQ ID NO: 379429 - DNA, 15 bp, Homo sapiens
acctgccaccatgcc

SEQ ID NO: 379430 - DNA, 15 bp, Homo sapiens
cccagctaattttta

SEQ ID NO: 379431 - DNA, 15 bp, Homo sapiens
cagctaatttttata

SEQ ID NO: 379432 - DNA, 15 bp, Homo sapiens
agctaatttttatat

SEQ ID NO: 379433 - DNA, 15 bp, Homo sapiens
gacagggtttcacca

SEQ ID NO: 379434 - DNA, 15 bp, Homo sapiens
acagggtttcaccat

SEQ ID NO: 379435 - DNA, 15 bp, Homo sapiens
tcttgaacttctggc

SEQ ID NO: 379436 - DNA, 15 bp, Homo sapiens
cttgaacttctggct

SEQ ID NO: 379437 - DNA, 15 bp, Homo sapiens
ttgaacttctggctt

SEQ ID NO: 379438 - DNA, 15 bp, Homo sapiens
tgaacttctggcttc

SEQ ID NO: 379439 - DNA, 15 bp, Homo sapiens
gaacttctggcttca

SEQ ID NO: 379440 - DNA, 15 bp, Homo sapiens
aacttctggcttcag

SEQ ID NO: 379441 - DNA, 15 bp, Homo sapiens
acttctggcttcagg

SEQ ID NO: 379442 - DNA, 15 bp, Homo sapiens
cttctggcttcaggt

SEQ ID NO: 379443 - DNA, 15 bp, Homo sapiens
ttctggcttcaggtg

SEQ ID NO: 379444 - DNA, 15 bp, Homo sapiens
tctggcttcaggtga

SEQ ID NO: 379445 - DNA, 15 bp, Homo sapiens
ctggcttcaggtgat

SEQ ID NO: 379446 - DNA, 15 bp, Homo sapiens
tggcttcaggtgatc

SEQ ID NO: 379447 - DNA, 15 bp, Homo sapiens
ggcttcaggtgatcc

SEQ ID NO: 379448 - DNA, 15 bp, Homo sapiens
gcttcaggtgatcca

SEQ ID NO: 379449 - DNA, 15 bp, Homo sapiens
gggattacaggtgtc

SEQ ID NO: 379450 - DNA, 15 bp, Homo sapiens
ggattacaggtgtca

SEQ ID NO: 379451 - DNA, 15 bp, Homo sapiens
gattacaggtgtcag

SEQ ID NO: 379452 - DNA, 15 bp, Homo sapiens
attacaggtgtcagc

SEQ ID NO: 379453 - DNA, 15 bp, Homo sapiens
ttacaggtgtcagcc

SEQ ID NO: 379454 - DNA, 15 bp, Homo sapiens
tacaggtgtcagcca

SEQ ID NO: 379455 - DNA, 15 bp, Homo sapiens
acaggtgtcagccac

SEQ ID NO: 379456 - DNA, 15 bp, Homo sapiens
caggtgtcagccact

SEQ ID NO: 379457 - DNA, 15 bp, Homo sapiens
aggtgtcagccactg

SEQ ID NO: 379458 - DNA, 15 bp, Homo sapiens
ggtgtcagccactgc

SEQ ID NO: 379459 - DNA, 15 bp, Homo sapiens
gtgtcagccactgca

SEQ ID NO: 379460 - DNA, 15 bp, Homo sapiens
tgtcagccactgcac

SEQ ID NO: 379461 - DNA, 15 bp, Homo sapiens
gtcagccactgcacc

SEQ ID NO: 379462 - DNA, 15 bp, Homo sapiens
tcagccactgcaccc

SEQ ID NO: 379463 - DNA, 15 bp, Homo sapiens
cagccactgcaccca

SEQ ID NO: 379464 - DNA, 15 bp, Homo sapiens
cactgcacccagcca

SEQ ID NO: 379465 - DNA, 15 bp, Homo sapiens
actgcacccagccag

SEQ ID NO: 379466 - DNA, 15 bp, Homo sapiens
ctgcacccagccagt

SEQ ID NO: 379467 - DNA, 15 bp, Homo sapiens
tgcacccagccagtt

SEQ ID NO: 379468 - DNA, 15 bp, Homo sapiens
gcacccagccagttg

SEQ ID NO: 379469 - DNA, 15 bp, Homo sapiens
cacccagccagttga

SEQ ID NO: 379470 - DNA, 15 bp, Homo sapiens
acccagccagttgat

SEQ ID NO: 379471 - DNA, 15 bp, Homo sapiens
cccagccagttgata

SEQ ID NO: 379472 - DNA, 15 bp, Homo sapiens
ccagccagttgatag

SEQ ID NO: 379473 - DNA, 15 bp, Homo sapiens
cagccagttgatagc

SEQ ID NO: 379474 - DNA, 15 bp, Homo sapiens
agccagttgatagct

SEQ ID NO: 379475 - DNA, 15 bp, Homo sapiens
gccagttgatagctt

SEQ ID NO: 379476 - DNA, 15 bp, Homo sapiens
ccagttgatagcttt

SEQ ID NO: 379477 - DNA, 15 bp, Homo sapiens
cagttgatagctttt

SEQ ID NO: 379478 - DNA, 15 bp, Homo sapiens
agttgatagctttta

SEQ ID NO: 379479 - DNA, 15 bp, Homo sapiens
gttgatagcttttat

SEQ ID NO: 379480 - DNA, 15 bp, Homo sapiens
ttgatagcttttatg

SEQ ID NO: 379481 - DNA, 15 bp, Homo sapiens
tgatagcttttatgt

SEQ ID NO: 379482 - DNA, 15 bp, Homo sapiens
gatagcttttatgtt

SEQ ID NO: 379483 - DNA, 15 bp, Homo sapiens
atagcttttatgttt

SEQ ID NO: 379484 - DNA, 15 bp, Homo sapiens
tagcttttatgtttc

SEQ ID NO: 379485 - DNA, 15 bp, Homo sapiens
agcttttatgtttca

SEQ ID NO: 379486 - DNA, 15 bp, Homo sapiens
gcttttatgtttcac

SEQ ID NO: 379487 - DNA, 15 bp, Homo sapiens
cttttatgtttcact

SEQ ID NO: 379488 - DNA, 15 bp, Homo sapiens
ttttatgtttcacta

SEQ ID NO: 379489 - DNA, 15 bp, Homo sapiens
tttatgtttcactat

SEQ ID NO: 379490 - DNA, 15 bp, Homo sapiens
ttatgtttcactata

SEQ ID NO: 379491 - DNA, 15 bp, Homo sapiens
tatgtttcactataa

SEQ ID NO: 379492 - DNA, 15 bp, Homo sapiens
atgtttcactataac

SEQ ID NO: 379493 - DNA, 15 bp, Homo sapiens
tgtttcactataacc

SEQ ID NO: 379494 - DNA, 15 bp, Homo sapiens
gtttcactataacca

SEQ ID NO: 379495 - DNA, 15 bp, Homo sapiens
tttcactataaccat

SEQ ID NO: 379496 - DNA, 15 bp, Homo sapiens
ttcactataaccata

SEQ ID NO: 379497 - DNA, 15 bp, Homo sapiens
tcactataaccatat

SEQ ID NO: 379498 - DNA, 15 bp, Homo sapiens
cactataaccatata

SEQ ID NO: 379499 - DNA, 15 bp, Homo sapiens
actataaccatatat

SEQ ID NO: 379500 - DNA, 15 bp, Homo sapiens
ctataaccatatatt

SEQ ID NO: 379501 - DNA, 15 bp, Homo sapiens
tataaccatatatta

SEQ ID NO: 379502 - DNA, 15 bp, Homo sapiens
ataaccatatattat

SEQ ID NO: 379503 - DNA, 15 bp, Homo sapiens
taaccatatattatc

SEQ ID NO: 379504 - DNA, 15 bp, Homo sapiens
aaccatatattatcc

SEQ ID NO: 379505 - DNA, 15 bp, Homo sapiens
accatatattatccc

SEQ ID NO: 379506 - DNA, 15 bp, Homo sapiens
ccatatattatccca

SEQ ID NO: 379507 - DNA, 15 bp, Homo sapiens
catatattatcccaa

SEQ ID NO: 379508 - DNA, 15 bp, Homo sapiens
atatattatcccaag

SEQ ID NO: 379509 - DNA, 15 bp, Homo sapiens
tatattatcccaaga

SEQ ID NO: 379510 - DNA, 15 bp, Homo sapiens
atattatcccaagaa

SEQ ID NO: 379511 - DNA, 15 bp, Homo sapiens
tattatcccaagaac

SEQ ID NO: 379512 - DNA, 15 bp, Homo sapiens
attatcccaagaact

SEQ ID NO: 379513 - DNA, 15 bp, Homo sapiens
ttatcccaagaactt

SEQ ID NO: 379514 - DNA, 15 bp, Homo sapiens
tatcccaagaacttt

SEQ ID NO: 379515 - DNA, 15 bp, Homo sapiens
atcccaagaactttg

SEQ ID NO: 379516 - DNA, 15 bp, Homo sapiens
tcccaagaactttgc

SEQ ID NO: 379517 - DNA, 15 bp, Homo sapiens
cccaagaactttgcc

SEQ ID NO: 379518 - DNA, 15 bp, Homo sapiens
ccaagaactttgcca

SEQ ID NO: 379519 - DNA, 15 bp, Homo sapiens
caagaactttgccaa

SEQ ID NO: 379520 - DNA, 15 bp, Homo sapiens
aagaactttgccaaa

SEQ ID NO: 379521 - DNA, 15 bp, Homo sapiens
agaactttgccaaag

SEQ ID NO: 379522 - DNA, 15 bp, Homo sapiens
gaactttgccaaagt

SEQ ID NO: 379523 - DNA, 15 bp, Homo sapiens
aactttgccaaagtg

SEQ ID NO: 379524 - DNA, 15 bp, Homo sapiens
actttgccaaagtgt

SEQ ID NO: 379525 - DNA, 15 bp, Homo sapiens
ctttgccaaagtgtt

SEQ ID NO: 379526 - DNA, 15 bp, Homo sapiens
tttgccaaagtgttc

SEQ ID NO: 379527 - DNA, 15 bp, Homo sapiens
ttgccaaagtgttcc

SEQ ID NO: 379528 - DNA, 15 bp, Homo sapiens
tgccaaagtgttcca

SEQ ID NO: 379529 - DNA, 15 bp, Homo sapiens
gccaaagtgttccat

SEQ ID NO: 379530 - DNA, 15 bp, Homo sapiens
ccaaagtgttccatg

SEQ ID NO: 379531 - DNA, 15 bp, Homo sapiens
caaagtgttccatga

SEQ ID NO: 379532 - DNA, 15 bp, Homo sapiens
aaagtgttccatgat

SEQ ID NO: 379533 - DNA, 15 bp, Homo sapiens
aagtgttccatgata

SEQ ID NO: 379534 - DNA, 15 bp, Homo sapiens
agtgttccatgataa

SEQ ID NO: 379535 - DNA, 15 bp, Homo sapiens
gtgttccatgataac

SEQ ID NO: 379536 - DNA, 15 bp, Homo sapiens
tgttccatgataact

SEQ ID NO: 379537 - DNA, 15 bp, Homo sapiens
gttccatgataactc

SEQ ID NO: 379538 - DNA, 15 bp, Homo sapiens
ttccatgataactca

SEQ ID NO: 379539 - DNA, 15 bp, Homo sapiens
tccatgataactcag

SEQ ID NO: 379540 - DNA, 15 bp, Homo sapiens
ccatgataactcagc

SEQ ID NO: 379541 - DNA, 15 bp, Homo sapiens
catgataactcagct

SEQ ID NO: 379542 - DNA, 15 bp, Homo sapiens
atgataactcagctg

SEQ ID NO: 379543 - DNA, 15 bp, Homo sapiens
tgataactcagctgg

SEQ ID NO: 379544 - DNA, 15 bp, Homo sapiens
gataactcagctgga

SEQ ID NO: 379545 - DNA, 15 bp, Homo sapiens
ataactcagctggaa

SEQ ID NO: 379546 - DNA, 15 bp, Homo sapiens
taactcagctggaat

SEQ ID NO: 379547 - DNA, 15 bp, Homo sapiens
aactcagctggaatg

SEQ ID NO: 379548 - DNA, 15 bp, Homo sapiens
actcagctggaatgt

SEQ ID NO: 379549 - DNA, 15 bp, Homo sapiens
ctcagctggaatgtt

SEQ ID NO: 379550 - DNA, 15 bp, Homo sapiens
tcagctggaatgtta

SEQ ID NO: 379551 - DNA, 15 bp, Homo sapiens
cagctggaatgttat

SEQ ID NO: 379552 - DNA, 15 bp, Homo sapiens
agctggaatgttatc

SEQ ID NO: 379553 - DNA, 15 bp, Homo sapiens
gctggaatgttatct

SEQ ID NO: 379554 - DNA, 15 bp, Homo sapiens
ctggaatgttatctt

SEQ ID NO: 379555 - DNA, 15 bp, Homo sapiens
tggaatgttatcttg

SEQ ID NO: 379556 - DNA, 15 bp, Homo sapiens
ggaatgttatcttgt

SEQ ID NO: 379557 - DNA, 15 bp, Homo sapiens
gaatgttatcttgta

SEQ ID NO: 379558 - DNA, 15 bp, Homo sapiens
aatgttatcttgtag

SEQ ID NO: 379559 - DNA, 15 bp, Homo sapiens
atgttatcttgtagt

SEQ ID NO: 379560 - DNA, 15 bp, Homo sapiens
tgttatcttgtagtt

SEQ ID NO: 379561 - DNA, 15 bp, Homo sapiens
gttatcttgtagtta

SEQ ID NO: 379562 - DNA, 15 bp, Homo sapiens
ttatcttgtagttac

SEQ ID NO: 379563 - DNA, 15 bp, Homo sapiens
tatcttgtagttacg

SEQ ID NO: 379564 - DNA, 15 bp, Homo sapiens
atcttgtagttacgt

SEQ ID NO: 379565 - DNA, 15 bp, Homo sapiens
tcttgtagttacgtt

SEQ ID NO: 379566 - DNA, 15 bp, Homo sapiens
cttgtagttacgttc

SEQ ID NO: 379567 - DNA, 15 bp, Homo sapiens
ttgtagttacgttcc

SEQ ID NO: 379568 - DNA, 15 bp, Homo sapiens
tgtagttacgttcct

SEQ ID NO: 379569 - DNA, 15 bp, Homo sapiens
gtagttacgttcctc

SEQ ID NO: 379570 - DNA, 15 bp, Homo sapiens
tagttacgttcctct

SEQ ID NO: 379571 - DNA, 15 bp, Homo sapiens
agttacgttcctctt

SEQ ID NO: 379572 - DNA, 15 bp, Homo sapiens
gttacgttcctcttg

SEQ ID NO: 379573 - DNA, 15 bp, Homo sapiens
ttacgttcctcttgg

SEQ ID NO: 379574 - DNA, 15 bp, Homo sapiens
tacgttcctcttggg

SEQ ID NO: 379575 - DNA, 15 bp, Homo sapiens
acgttcctcttgggc

SEQ ID NO: 379576 - DNA, 15 bp, Homo sapiens
cgttcctcttgggcc

SEQ ID NO: 379577 - DNA, 15 bp, Homo sapiens
gttcctcttgggcct

SEQ ID NO: 379578 - DNA, 15 bp, Homo sapiens
ttcctcttgggcctg

SEQ ID NO: 379579 - DNA, 15 bp, Homo sapiens
tcctcttgggcctgg

SEQ ID NO: 379580 - DNA, 15 bp, Homo sapiens
cctcttgggcctggt

SEQ ID NO: 379581 - DNA, 15 bp, Homo sapiens
ctcttgggcctggta

SEQ ID NO: 379582 - DNA, 15 bp, Homo sapiens
tcttgggcctggtac

SEQ ID NO: 379583 - DNA, 15 bp, Homo sapiens
cttgggcctggtact

SEQ ID NO: 379584 - DNA, 15 bp, Homo sapiens
ttgggcctggtactt

SEQ ID NO: 379585 - DNA, 15 bp, Homo sapiens
tgggcctggtactta

SEQ ID NO: 379586 - DNA, 15 bp, Homo sapiens
gggcctggtacttaa

SEQ ID NO: 379587 - DNA, 15 bp, Homo sapiens
ggcctggtacttaac

SEQ ID NO: 379588 - DNA, 15 bp, Homo sapiens
gcctggtacttaact

SEQ ID NO: 379589 - DNA, 15 bp, Homo sapiens
cctggtacttaacta

SEQ ID NO: 379590 - DNA, 15 bp, Homo sapiens
ctggtacttaactat

SEQ ID NO: 379591 - DNA, 15 bp, Homo sapiens
tggtacttaactata

SEQ ID NO: 379592 - DNA, 15 bp, Homo sapiens
ggtacttaactatag

SEQ ID NO: 379593 - DNA, 15 bp, Homo sapiens
gtacttaactatagc

SEQ ID NO: 379594 - DNA, 15 bp, Homo sapiens
tacttaactatagcc

SEQ ID NO: 379595 - DNA, 15 bp, Homo sapiens
acttaactatagcct

SEQ ID NO: 379596 - DNA, 15 bp, Homo sapiens
cttaactatagcctt

SEQ ID NO: 379597 - DNA, 15 bp, Homo sapiens
ttaactatagccttt

SEQ ID NO: 379598 - DNA, 15 bp, Homo sapiens
taactatagcctttc

SEQ ID NO: 379599 - DNA, 15 bp, Homo sapiens
aactatagcctttct

SEQ ID NO: 379600 - DNA, 15 bp, Homo sapiens
actatagcctttctt

SEQ ID NO: 379601 - DNA, 15 bp, Homo sapiens
ctatagcctttcttt

SEQ ID NO: 379602 - DNA, 15 bp, Homo sapiens
tatagcctttctttt

SEQ ID NO: 379603 - DNA, 15 bp, Homo sapiens
atagcctttcttttt

SEQ ID NO: 379604 - DNA, 15 bp, Homo sapiens
tagcctttctttttg

SEQ ID NO: 379605 - DNA, 15 bp, Homo sapiens
agcctttctttttgt

SEQ ID NO: 379606 - DNA, 15 bp, Homo sapiens
gcctttctttttgtc

SEQ ID NO: 379607 - DNA, 15 bp, Homo sapiens
cctttctttttgtct

SEQ ID NO: 379608 - DNA, 15 bp, Homo sapiens
ctttctttttgtctg

SEQ ID NO: 379609 - DNA, 15 bp, Homo sapiens
tttctttttgtctga

SEQ ID NO: 379610 - DNA, 15 bp, Homo sapiens
ttctttttgtctgat

SEQ ID NO: 379611 - DNA, 15 bp, Homo sapiens
tctttttgtctgata

SEQ ID NO: 379612 - DNA, 15 bp, Homo sapiens
ctttttgtctgatat

SEQ ID NO: 379613 - DNA, 15 bp, Homo sapiens
tttttgtctgatatc

SEQ ID NO: 379614 - DNA, 15 bp, Homo sapiens
ttttgtctgatatcc

SEQ ID NO: 379615 - DNA, 15 bp, Homo sapiens
tttgtctgatatcca

SEQ ID NO: 379616 - DNA, 15 bp, Homo sapiens
ttgtctgatatccaa

SEQ ID NO: 379617 - DNA, 15 bp, Homo sapiens
tgtctgatatccaaa

SEQ ID NO: 379618 - DNA, 15 bp, Homo sapiens
gtctgatatccaaag

SEQ ID NO: 379619 - DNA, 15 bp, Homo sapiens
tctgatatccaaagc

SEQ ID NO: 379620 - DNA, 15 bp, Homo sapiens
ctgatatccaaagca

SEQ ID NO: 379621 - DNA, 15 bp, Homo sapiens
tgatatccaaagcat

SEQ ID NO: 379622 - DNA, 15 bp, Homo sapiens
gatatccaaagcatc

SEQ ID NO: 379623 - DNA, 15 bp, Homo sapiens
atatccaaagcatct

SEQ ID NO: 379624 - DNA, 15 bp, Homo sapiens
tatccaaagcatctt

SEQ ID NO: 379625 - DNA, 15 bp, Homo sapiens
atccaaagcatcttt

SEQ ID NO: 379626 - DNA, 15 bp, Homo sapiens
tccaaagcatctttc

SEQ ID NO: 379627 - DNA, 15 bp, Homo sapiens
ccaaagcatctttca

SEQ ID NO: 379628 - DNA, 15 bp, Homo sapiens
caaagcatctttcag

SEQ ID NO: 379629 - DNA, 15 bp, Homo sapiens
aaagcatctttcagc

SEQ ID NO: 379630 - DNA, 15 bp, Homo sapiens
aagcatctttcagca

SEQ ID NO: 379631 - DNA, 15 bp, Homo sapiens
agcatctttcagcag

SEQ ID NO: 379632 - DNA, 15 bp, Homo sapiens
gcatctttcagcagc

SEQ ID NO: 379633 - DNA, 15 bp, Homo sapiens
catctttcagcagcg

SEQ ID NO: 379634 - DNA, 15 bp, Homo sapiens
atctttcagcagcgt

SEQ ID NO: 379635 - DNA, 15 bp, Homo sapiens
tctttcagcagcgtg

SEQ ID NO: 379636 - DNA, 15 bp, Homo sapiens
ctttcagcagcgtgg

SEQ ID NO: 379637 - DNA, 15 bp, Homo sapiens
tttcagcagcgtggt

SEQ ID NO: 379638 - DNA, 15 bp, Homo sapiens
ttcagcagcgtggtt

SEQ ID NO: 379639 - DNA, 15 bp, Homo sapiens
tcagcagcgtggttt

SEQ ID NO: 379640 - DNA, 15 bp, Homo sapiens
cagcagcgtggtttt

SEQ ID NO: 379641 - DNA, 15 bp, Homo sapiens
agcagcgtggtttta

SEQ ID NO: 379642 - DNA, 15 bp, Homo sapiens
gcagcgtggttttaa

SEQ ID NO: 379643 - DNA, 15 bp, Homo sapiens
cagcgtggttttaac

SEQ ID NO: 379644 - DNA, 15 bp, Homo sapiens
agcgtggttttaaca

SEQ ID NO: 379645 - DNA, 15 bp, Homo sapiens
gcgtggttttaacat

SEQ ID NO: 379646 - DNA, 15 bp, Homo sapiens
cgtggttttaacatt

SEQ ID NO: 379647 - DNA, 15 bp, Homo sapiens
gtggttttaacattc

SEQ ID NO: 379648 - DNA, 15 bp, Homo sapiens
tggttttaacattct

SEQ ID NO: 379649 - DNA, 15 bp, Homo sapiens
ggttttaacattcta

SEQ ID NO: 379650 - DNA, 15 bp, Homo sapiens
gttttaacattctac

SEQ ID NO: 379651 - DNA, 15 bp, Homo sapiens
ttttaacattctacc

SEQ ID NO: 379652 - DNA, 15 bp, Homo sapiens
tttaacattctacct

SEQ ID NO: 379653 - DNA, 15 bp, Homo sapiens
ttaacattctaccta

SEQ ID NO: 379654 - DNA, 15 bp, Homo sapiens
taacattctacctac

SEQ ID NO: 379655 - DNA, 15 bp, Homo sapiens
aacattctacctact

SEQ ID NO: 379656 - DNA, 15 bp, Homo sapiens
acattctacctactt

SEQ ID NO: 379657 - DNA, 15 bp, Homo sapiens
cattctacctactta

SEQ ID NO: 379658 - DNA, 15 bp, Homo sapiens
attctacctacttat

SEQ ID NO: 379659 - DNA, 15 bp, Homo sapiens
ttctacctacttatt

SEQ ID NO: 379660 - DNA, 15 bp, Homo sapiens
tctacctacttatta

SEQ ID NO: 379661 - DNA, 15 bp, Homo sapiens
ctacctacttattat

SEQ ID NO: 379662 - DNA, 15 bp, Homo sapiens
tacctacttattatc

SEQ ID NO: 379663 - DNA, 15 bp, Homo sapiens
acctacttattatca

SEQ ID NO: 379664 - DNA, 15 bp, Homo sapiens
cctacttattatcag

SEQ ID NO: 379665 - DNA, 15 bp, Homo sapiens
ctacttattatcagc

SEQ ID NO: 379666 - DNA, 15 bp, Homo sapiens
tacttattatcagca

SEQ ID NO: 379667 - DNA, 15 bp, Homo sapiens
acttattatcagcag

SEQ ID NO: 379668 - DNA, 15 bp, Homo sapiens
cttattatcagcagg

SEQ ID NO: 379669 - DNA, 15 bp, Homo sapiens
ttattatcagcaggt

SEQ ID NO: 379670 - DNA, 15 bp, Homo sapiens
tattatcagcaggtt

SEQ ID NO: 379671 - DNA, 15 bp, Homo sapiens
attatcagcaggttc

SEQ ID NO: 379672 - DNA, 15 bp, Homo sapiens
ttatcagcaggttct

SEQ ID NO: 379673 - DNA, 15 bp, Homo sapiens
tatcagcaggttctt

SEQ ID NO: 379674 - DNA, 15 bp, Homo sapiens
atcagcaggttcttg

SEQ ID NO: 379675 - DNA, 15 bp, Homo sapiens
tcagcaggttcttgc

SEQ ID NO: 379676 - DNA, 15 bp, Homo sapiens
cagcaggttcttgcg

SEQ ID NO: 379677 - DNA, 15 bp, Homo sapiens
agcaggttcttgcgg

SEQ ID NO: 379678 - DNA, 15 bp, Homo sapiens
gcaggttcttgcgga

SEQ ID NO: 379679 - DNA, 15 bp, Homo sapiens
caggttcttgcggat

SEQ ID NO: 379680 - DNA, 15 bp, Homo sapiens
aggttcttgcggata

SEQ ID NO: 379681 - DNA, 15 bp, Homo sapiens
ggttcttgcggatat

SEQ ID NO: 379682 - DNA, 15 bp, Homo sapiens
gttcttgcggatatt

SEQ ID NO: 379683 - DNA, 15 bp, Homo sapiens
ttcttgcggatattc

SEQ ID NO: 379684 - DNA, 15 bp, Homo sapiens
tcttgcggatattct

SEQ ID NO: 379685 - DNA, 15 bp, Homo sapiens
cttgcggatattcta

SEQ ID NO: 379686 - DNA, 15 bp, Homo sapiens
ttgcggatattctaa

SEQ ID NO: 379687 - DNA, 15 bp, Homo sapiens
tgcggatattctaag

SEQ ID NO: 379688 - DNA, 15 bp, Homo sapiens
gcggatattctaagt

SEQ ID NO: 379689 - DNA, 15 bp, Homo sapiens
cggatattctaagtt

SEQ ID NO: 379690 - DNA, 15 bp, Homo sapiens
ggatattctaagtta

SEQ ID NO: 379691 - DNA, 15 bp, Homo sapiens
gatattctaagttat

SEQ ID NO: 379692 - DNA, 15 bp, Homo sapiens
atattctaagttatt

SEQ ID NO: 379693 - DNA, 15 bp, Homo sapiens
tattctaagttattg

SEQ ID NO: 379694 - DNA, 15 bp, Homo sapiens
attctaagttattgt

SEQ ID NO: 379695 - DNA, 15 bp, Homo sapiens
ttctaagttattgtt

SEQ ID NO: 379696 - DNA, 15 bp, Homo sapiens
tctaagttattgttt

SEQ ID NO: 379697 - DNA, 15 bp, Homo sapiens
ctaagttattgttta

SEQ ID NO: 379698 - DNA, 15 bp, Homo sapiens
taagttattgtttat

SEQ ID NO: 379699 - DNA, 15 bp, Homo sapiens
aagttattgtttatt

SEQ ID NO: 379700 - DNA, 15 bp, Homo sapiens
agttattgtttatta

SEQ ID NO: 379701 - DNA, 15 bp, Homo sapiens
gttattgtttattag

SEQ ID NO: 379702 - DNA, 15 bp, Homo sapiens
ttattgtttattagt

SEQ ID NO: 379703 - DNA, 15 bp, Homo sapiens
tattgtttattagta

SEQ ID NO: 379704 - DNA, 15 bp, Homo sapiens
attgtttattagtac

SEQ ID NO: 379705 - DNA, 15 bp, Homo sapiens
ttgtttattagtacc

SEQ ID NO: 379706 - DNA, 15 bp, Homo sapiens
tgtttattagtacct

SEQ ID NO: 379707 - DNA, 15 bp, Homo sapiens
gtttattagtacctc

SEQ ID NO: 379708 - DNA, 15 bp, Homo sapiens
tttattagtacctca

SEQ ID NO: 379709 - DNA, 15 bp, Homo sapiens
ttattagtacctcag

SEQ ID NO: 379710 - DNA, 15 bp, Homo sapiens
tattagtacctcagt

SEQ ID NO: 379711 - DNA, 15 bp, Homo sapiens
attagtacctcagtt

SEQ ID NO: 379712 - DNA, 15 bp, Homo sapiens
ttagtacctcagttc

SEQ ID NO: 379713 - DNA, 15 bp, Homo sapiens
tagtacctcagttca

SEQ ID NO: 379714 - DNA, 15 bp, Homo sapiens
agtacctcagttcaa

SEQ ID NO: 379715 - DNA, 15 bp, Homo sapiens
gtacctcagttcaag

SEQ ID NO: 379716 - DNA, 15 bp, Homo sapiens
tacctcagttcaaga

SEQ ID NO: 379717 - DNA, 15 bp, Homo sapiens
acctcagttcaagat

SEQ ID NO: 379718 - DNA, 15 bp, Homo sapiens
cctcagttcaagatt

SEQ ID NO: 379719 - DNA, 15 bp, Homo sapiens
ctcagttcaagatta

SEQ ID NO: 379720 - DNA, 15 bp, Homo sapiens
tcagttcaagattat

SEQ ID NO: 379721 - DNA, 15 bp, Homo sapiens
cagttcaagattatg

SEQ ID NO: 379722 - DNA, 15 bp, Homo sapiens
agttcaagattatga

SEQ ID NO: 379723 - DNA, 15 bp, Homo sapiens
gttcaagattatgaa

SEQ ID NO: 379724 - DNA, 15 bp, Homo sapiens
ttcaagattatgaac

SEQ ID NO: 379725 - DNA, 15 bp, Homo sapiens
tcaagattatgaact

SEQ ID NO: 379726 - DNA, 15 bp, Homo sapiens
caagattatgaacta

SEQ ID NO: 379727 - DNA, 15 bp, Homo sapiens
aagattatgaactaa

SEQ ID NO: 379728 - DNA, 15 bp, Homo sapiens
agattatgaactaac

SEQ ID NO: 379729 - DNA, 15 bp, Homo sapiens
gattatgaactaact

SEQ ID NO: 379730 - DNA, 15 bp, Homo sapiens
attatgaactaactc

SEQ ID NO: 379731 - DNA, 15 bp, Homo sapiens
ttatgaactaactct

SEQ ID NO: 379732 - DNA, 15 bp, Homo sapiens
tatgaactaactctg

SEQ ID NO: 379733 - DNA, 15 bp, Homo sapiens
atgaactaactctga

SEQ ID NO: 379734 - DNA, 15 bp, Homo sapiens
tgaactaactctgaa

SEQ ID NO: 379735 - DNA, 15 bp, Homo sapiens
gaactaactctgaag

SEQ ID NO: 379736 - DNA, 15 bp, Homo sapiens
aactaactctgaagt

SEQ ID NO: 379737 - DNA, 15 bp, Homo sapiens
actaactctgaagtg

SEQ ID NO: 379738 - DNA, 15 bp, Homo sapiens
ctaactctgaagtga

SEQ ID NO: 379739 - DNA, 15 bp, Homo sapiens
taactctgaagtgat

SEQ ID NO: 379740 - DNA, 15 bp, Homo sapiens
aactctgaagtgatt

SEQ ID NO: 379741 - DNA, 15 bp, Homo sapiens
actctgaagtgatta

SEQ ID NO: 379742 - DNA, 15 bp, Homo sapiens
ctctgaagtgattaa

SEQ ID NO: 379743 - DNA, 15 bp, Homo sapiens
tctgaagtgattaat

SEQ ID NO: 379744 - DNA, 15 bp, Homo sapiens
ctgaagtgattaata

SEQ ID NO: 379745 - DNA, 15 bp, Homo sapiens
tgaagtgattaataa

SEQ ID NO: 379746 - DNA, 15 bp, Homo sapiens
gaagtgattaataaa

SEQ ID NO: 379747 - DNA, 15 bp, Homo sapiens
aagtgattaataaaa

SEQ ID NO: 379748 - DNA, 15 bp, Homo sapiens
agtgattaataaaaa

SEQ ID NO: 379749 - DNA, 15 bp, Homo sapiens
gtgattaataaaaaa

SEQ ID NO: 379750 - DNA, 15 bp, Homo sapiens
tgattaataaaaaat

SEQ ID NO: 379751 - DNA, 15 bp, Homo sapiens
gattaataaaaaatt

SEQ ID NO: 379752 - DNA, 15 bp, Homo sapiens
attaataaaaaattt

SEQ ID NO: 379753 - DNA, 15 bp, Homo sapiens
ttaataaaaaattta

SEQ ID NO: 379754 - DNA, 15 bp, Homo sapiens
taataaaaaatttaa

SEQ ID NO: 379755 - DNA, 15 bp, Homo sapiens
aataaaaaatttaag

SEQ ID NO: 379756 - DNA, 15 bp, Homo sapiens
ataaaaaatttaagt

SEQ ID NO: 379757 - DNA, 15 bp, Homo sapiens
taaaaaatttaagtt

SEQ ID NO: 379758 - DNA, 15 bp, Homo sapiens
aaaaaatttaagttt

SEQ ID NO: 379759 - DNA, 15 bp, Homo sapiens
aaaaatttaagtttc

SEQ ID NO: 379760 - DNA, 15 bp, Homo sapiens
aaaatttaagtttcc

SEQ ID NO: 379761 - DNA, 15 bp, Homo sapiens
aaatttaagtttcca

SEQ ID NO: 379762 - DNA, 15 bp, Homo sapiens
aatttaagtttccag

SEQ ID NO: 379763 - DNA, 15 bp, Homo sapiens
atttaagtttccagc

SEQ ID NO: 379764 - DNA, 15 bp, Homo sapiens
tttaagtttccagcc

SEQ ID NO: 379765 - DNA, 15 bp, Homo sapiens
ttaagtttccagccg

SEQ ID NO: 379766 - DNA, 15 bp, Homo sapiens
taagtttccagccgg

SEQ ID NO: 379767 - DNA, 15 bp, Homo sapiens
aagtttccagccggg

SEQ ID NO: 379768 - DNA, 15 bp, Homo sapiens
agtttccagccgggt

SEQ ID NO: 379769 - DNA, 15 bp, Homo sapiens
gtttccagccgggtg

SEQ ID NO: 379770 - DNA, 15 bp, Homo sapiens
tttccagccgggtgc

SEQ ID NO: 379771 - DNA, 15 bp, Homo sapiens
ttccagccgggtgcg

SEQ ID NO: 379772 - DNA, 15 bp, Homo sapiens
tccagccgggtgcgt

SEQ ID NO: 379773 - DNA, 15 bp, Homo sapiens
ccagccgggtgcgtt

SEQ ID NO: 379774 - DNA, 15 bp, Homo sapiens
cagccgggtgcgttg

SEQ ID NO: 379775 - DNA, 15 bp, Homo sapiens
agccgggtgcgttgg

SEQ ID NO: 379776 - DNA, 15 bp, Homo sapiens
gccgggtgcgttggc

SEQ ID NO: 379777 - DNA, 15 bp, Homo sapiens
ccgggtgcgttggct

SEQ ID NO: 379778 - DNA, 15 bp, Homo sapiens
cgggtgcgttggctc

SEQ ID NO: 379779 - DNA, 15 bp, Homo sapiens
gggtgcgttggctca

SEQ ID NO: 379780 - DNA, 15 bp, Homo sapiens
ggtgcgttggctcat

SEQ ID NO: 379781 - DNA, 15 bp, Homo sapiens
gtgcgttggctcatg

SEQ ID NO: 379782 - DNA, 15 bp, Homo sapiens
tgcgttggctcatgc

SEQ ID NO: 379783 - DNA, 15 bp, Homo sapiens
gcgttggctcatgcc

SEQ ID NO: 379784 - DNA, 15 bp, Homo sapiens
cgttggctcatgcct

SEQ ID NO: 379785 - DNA, 15 bp, Homo sapiens
gttggctcatgcctg

SEQ ID NO: 379786 - DNA, 15 bp, Homo sapiens
ttggctcatgcctgt

SEQ ID NO: 379787 - DNA, 15 bp, Homo sapiens
ggaggccgaggcaga

SEQ ID NO: 379788 - DNA, 15 bp, Homo sapiens
gaggccgaggcagac

SEQ ID NO: 379789 - DNA, 15 bp, Homo sapiens
aggccgaggcagaca

SEQ ID NO: 379790 - DNA, 15 bp, Homo sapiens
ggccgaggcagacag

SEQ ID NO: 379791 - DNA, 15 bp, Homo sapiens
gccgaggcagacaga

SEQ ID NO: 379792 - DNA, 15 bp, Homo sapiens
ccgaggcagacagat

SEQ ID NO: 379793 - DNA, 15 bp, Homo sapiens
cgaggcagacagatc

SEQ ID NO: 379794 - DNA, 15 bp, Homo sapiens
gaggcagacagatca

SEQ ID NO: 379795 - DNA, 15 bp, Homo sapiens
aggcagacagatcac

SEQ ID NO: 379796 - DNA, 15 bp, Homo sapiens
ggcagacagatcacg

SEQ ID NO: 379797 - DNA, 15 bp, Homo sapiens
gcagacagatcacga

SEQ ID NO: 379798 - DNA, 15 bp, Homo sapiens
cagacagatcacgag

SEQ ID NO: 379799 - DNA, 15 bp, Homo sapiens
agacagatcacgagg

SEQ ID NO: 379800 - DNA, 15 bp, Homo sapiens
gacagatcacgaggt

SEQ ID NO: 379801 - DNA, 15 bp, Homo sapiens
acagatcacgaggtc

SEQ ID NO: 379802 - DNA, 15 bp, Homo sapiens
aggagttcgagacct

SEQ ID NO: 379803 - DNA, 15 bp, Homo sapiens
ggagttcgagacctg

SEQ ID NO: 379804 - DNA, 15 bp, Homo sapiens
gagttcgagacctgg

SEQ ID NO: 379805 - DNA, 15 bp, Homo sapiens
agttcgagacctggc

SEQ ID NO: 379806 - DNA, 15 bp, Homo sapiens
gttcgagacctggcc

SEQ ID NO: 379807 - DNA, 15 bp, Homo sapiens
ttcgagacctggcca

SEQ ID NO: 379808 - DNA, 15 bp, Homo sapiens
tcgagacctggccaa

SEQ ID NO: 379809 - DNA, 15 bp, Homo sapiens
cgagacctggccaac

SEQ ID NO: 379810 - DNA, 15 bp, Homo sapiens
gagacctggccaaca

SEQ ID NO: 379811 - DNA, 15 bp, Homo sapiens
agacctggccaacat

SEQ ID NO: 379812 - DNA, 15 bp, Homo sapiens
gacctggccaacatg

SEQ ID NO: 379813 - DNA, 15 bp, Homo sapiens
acctggccaacatgg

SEQ ID NO: 379814 - DNA, 15 bp, Homo sapiens
cctggccaacatggg

SEQ ID NO: 379815 - DNA, 15 bp, Homo sapiens
ctggccaacatgggg

SEQ ID NO: 379816 - DNA, 15 bp, Homo sapiens
tggccaacatgggga

SEQ ID NO: 379817 - DNA, 15 bp, Homo sapiens
ggccaacatggggaa

SEQ ID NO: 379818 - DNA, 15 bp, Homo sapiens
gccaacatggggaaa

SEQ ID NO: 379819 - DNA, 15 bp, Homo sapiens
ccaacatggggaaac

SEQ ID NO: 379820 - DNA, 15 bp, Homo sapiens
caacatggggaaacc

SEQ ID NO: 379821 - DNA, 15 bp, Homo sapiens
aacatggggaaaccc

SEQ ID NO: 379822 - DNA, 15 bp, Homo sapiens
acatggggaaaccct

SEQ ID NO: 379823 - DNA, 15 bp, Homo sapiens
catggggaaaccctc

SEQ ID NO: 379824 - DNA, 15 bp, Homo sapiens
atggggaaaccctct

SEQ ID NO: 379825 - DNA, 15 bp, Homo sapiens
tggggaaaccctctc

SEQ ID NO: 379826 - DNA, 15 bp, Homo sapiens
ggggaaaccctctct

SEQ ID NO: 379827 - DNA, 15 bp, Homo sapiens
gggaaaccctctctc

SEQ ID NO: 379828 - DNA, 15 bp, Homo sapiens
ggaaaccctctctct

SEQ ID NO: 379829 - DNA, 15 bp, Homo sapiens
gaaaccctctctcta

SEQ ID NO: 379830 - DNA, 15 bp, Homo sapiens
aaaccctctctctac

SEQ ID NO: 379831 - DNA, 15 bp, Homo sapiens
aaccctctctctact

SEQ ID NO: 379832 - DNA, 15 bp, Homo sapiens
accctctctctacta

SEQ ID NO: 379833 - DNA, 15 bp, Homo sapiens
ccctctctctactaa

SEQ ID NO: 379834 - DNA, 15 bp, Homo sapiens
cctctctctactaaa

SEQ ID NO: 379835 - DNA, 15 bp, Homo sapiens
ctctctctactaaaa

SEQ ID NO: 379836 - DNA, 15 bp, Homo sapiens
tctctctactaaaaa

SEQ ID NO: 379837 - DNA, 15 bp, Homo sapiens
ctctctactaaaaat

SEQ ID NO: 379838 - DNA, 15 bp, Homo sapiens
ctaaaaatacaaaag

SEQ ID NO: 379839 - DNA, 15 bp, Homo sapiens
taaaaatacaaaagt

SEQ ID NO: 379840 - DNA, 15 bp, Homo sapiens
aaaaatacaaaagta

SEQ ID NO: 379841 - DNA, 15 bp, Homo sapiens
aaaatacaaaagtag

SEQ ID NO: 379842 - DNA, 15 bp, Homo sapiens
aaatacaaaagtagc

SEQ ID NO: 379843 - DNA, 15 bp, Homo sapiens
aatacaaaagtagcc

SEQ ID NO: 379844 - DNA, 15 bp, Homo sapiens
atacaaaagtagccg

SEQ ID NO: 379845 - DNA, 15 bp, Homo sapiens
tacaaaagtagccgg

SEQ ID NO: 379846 - DNA, 15 bp, Homo sapiens
acaaaagtagccggg

SEQ ID NO: 379847 - DNA, 15 bp, Homo sapiens
caaaagtagccgggt

SEQ ID NO: 379848 - DNA, 15 bp, Homo sapiens
aaaagtagccgggtg

SEQ ID NO: 379849 - DNA, 15 bp, Homo sapiens
aaagtagccgggtgt

SEQ ID NO: 379850 - DNA, 15 bp, Homo sapiens
aagtagccgggtgtg

SEQ ID NO: 379851 - DNA, 15 bp, Homo sapiens
agtagccgggtgtgg

SEQ ID NO: 379852 - DNA, 15 bp, Homo sapiens
gtagccgggtgtggt

SEQ ID NO: 379853 - DNA, 15 bp, Homo sapiens
ccgggtgtggtggca

SEQ ID NO: 379854 - DNA, 15 bp, Homo sapiens
cgggtgtggtggcac

SEQ ID NO: 379855 - DNA, 15 bp, Homo sapiens
gtgtggtggcacaca

SEQ ID NO: 379856 - DNA, 15 bp, Homo sapiens
tgtggtggcacacac

SEQ ID NO: 379857 - DNA, 15 bp, Homo sapiens
gtggtggcacacacc

SEQ ID NO: 379858 - DNA, 15 bp, Homo sapiens
ggtggcacacaccta

SEQ ID NO: 379859 - DNA, 15 bp, Homo sapiens
gtggcacacacctat

SEQ ID NO: 379860 - DNA, 15 bp, Homo sapiens
tggcacacacctata

SEQ ID NO: 379861 - DNA, 15 bp, Homo sapiens
ggcacacacctatag

SEQ ID NO: 379862 - DNA, 15 bp, Homo sapiens
gcacacacctatagt

SEQ ID NO: 379863 - DNA, 15 bp, Homo sapiens
cacacacctatagtc

SEQ ID NO: 379864 - DNA, 15 bp, Homo sapiens
acacacctatagtcc

SEQ ID NO: 379865 - DNA, 15 bp, Homo sapiens
cacacctatagtccc

SEQ ID NO: 379866 - DNA, 15 bp, Homo sapiens
acacctatagtccca

SEQ ID NO: 379867 - DNA, 15 bp, Homo sapiens
cacctatagtcccag

SEQ ID NO: 379868 - DNA, 15 bp, Homo sapiens
acctatagtcccagc

SEQ ID NO: 379869 - DNA, 15 bp, Homo sapiens
atagtcccagctaca

SEQ ID NO: 379870 - DNA, 15 bp, Homo sapiens
tagtcccagctacat

SEQ ID NO: 379871 - DNA, 15 bp, Homo sapiens
agtcccagctacatg

SEQ ID NO: 379872 - DNA, 15 bp, Homo sapiens
gtcccagctacatgg

SEQ ID NO: 379873 - DNA, 15 bp, Homo sapiens
tcccagctacatggg

SEQ ID NO: 379874 - DNA, 15 bp, Homo sapiens
cccagctacatggga

SEQ ID NO: 379875 - DNA, 15 bp, Homo sapiens
ccagctacatgggag

SEQ ID NO: 379876 - DNA, 15 bp, Homo sapiens
cagctacatgggagg

SEQ ID NO: 379877 - DNA, 15 bp, Homo sapiens
agctacatgggaggc

SEQ ID NO: 379878 - DNA, 15 bp, Homo sapiens
gctacatgggaggct

SEQ ID NO: 379879 - DNA, 15 bp, Homo sapiens
ctacatgggaggctg

SEQ ID NO: 379880 - DNA, 15 bp, Homo sapiens
tacatgggaggctga

SEQ ID NO: 379881 - DNA, 15 bp, Homo sapiens
acatgggaggctgag

SEQ ID NO: 379882 - DNA, 15 bp, Homo sapiens
catgggaggctgagg

SEQ ID NO: 379883 - DNA, 15 bp, Homo sapiens
atgggaggctgaggc

SEQ ID NO: 379884 - DNA, 15 bp, Homo sapiens
aggagaatcacttgt

SEQ ID NO: 379885 - DNA, 15 bp, Homo sapiens
ggagaatcacttgta

SEQ ID NO: 379886 - DNA, 15 bp, Homo sapiens
gagaatcacttgtac

SEQ ID NO: 379887 - DNA, 15 bp, Homo sapiens
agaatcacttgtacc

SEQ ID NO: 379888 - DNA, 15 bp, Homo sapiens
gaatcacttgtacct

SEQ ID NO: 379889 - DNA, 15 bp, Homo sapiens
aatcacttgtacctg

SEQ ID NO: 379890 - DNA, 15 bp, Homo sapiens
atcacttgtacctgg

SEQ ID NO: 379891 - DNA, 15 bp, Homo sapiens
tcacttgtacctggg

SEQ ID NO: 379892 - DNA, 15 bp, Homo sapiens
cacttgtacctgggg

SEQ ID NO: 379893 - DNA, 15 bp, Homo sapiens
acttgtacctggggg

SEQ ID NO: 379894 - DNA, 15 bp, Homo sapiens
cttgtacctgggggc

SEQ ID NO: 379895 - DNA, 15 bp, Homo sapiens
ttgtacctgggggcg

SEQ ID NO: 379896 - DNA, 15 bp, Homo sapiens
tgtacctgggggcgg

SEQ ID NO: 379897 - DNA, 15 bp, Homo sapiens
gtacctgggggcgga

SEQ ID NO: 379898 - DNA, 15 bp, Homo sapiens
tacctgggggcggag

SEQ ID NO: 379899 - DNA, 15 bp, Homo sapiens
acctgggggcggagg

SEQ ID NO: 379900 - DNA, 15 bp, Homo sapiens
cctgggggcggaggt

SEQ ID NO: 379901 - DNA, 15 bp, Homo sapiens
ctgggggcggaggtt

SEQ ID NO: 379902 - DNA, 15 bp, Homo sapiens
tgggggcggaggttg

SEQ ID NO: 379903 - DNA, 15 bp, Homo sapiens
gggggcggaggttgc

SEQ ID NO: 379904 - DNA, 15 bp, Homo sapiens
ggggcggaggttgca

SEQ ID NO: 379905 - DNA, 15 bp, Homo sapiens
gggcggaggttgcag

SEQ ID NO: 379906 - DNA, 15 bp, Homo sapiens
ggcggaggttgcagc

SEQ ID NO: 379907 - DNA, 15 bp, Homo sapiens
gcggaggttgcagcg

SEQ ID NO: 379908 - DNA, 15 bp, Homo sapiens
cggaggttgcagcga

SEQ ID NO: 379909 - DNA, 15 bp, Homo sapiens
ggaggttgcagcgag

SEQ ID NO: 379910 - DNA, 15 bp, Homo sapiens
gaggttgcagcgagc

SEQ ID NO: 379911 - DNA, 15 bp, Homo sapiens
aggttgcagcgagct

SEQ ID NO: 379912 - DNA, 15 bp, Homo sapiens
ggttgcagcgagctg

SEQ ID NO: 379913 - DNA, 15 bp, Homo sapiens
gttgcagcgagctga

SEQ ID NO: 379914 - DNA, 15 bp, Homo sapiens
ttgcagcgagctgaa

SEQ ID NO: 379915 - DNA, 15 bp, Homo sapiens
tgcagcgagctgaaa

SEQ ID NO: 379916 - DNA, 15 bp, Homo sapiens
gcagcgagctgaaag

SEQ ID NO: 379917 - DNA, 15 bp, Homo sapiens
cagcgagctgaaagc

SEQ ID NO: 379918 - DNA, 15 bp, Homo sapiens
agcgagctgaaagcc

SEQ ID NO: 379919 - DNA, 15 bp, Homo sapiens
gcgagctgaaagcca

SEQ ID NO: 379920 - DNA, 15 bp, Homo sapiens
cgagctgaaagccag

SEQ ID NO: 379921 - DNA, 15 bp, Homo sapiens
gagctgaaagccagg

SEQ ID NO: 379922 - DNA, 15 bp, Homo sapiens
agctgaaagccagga

SEQ ID NO: 379923 - DNA, 15 bp, Homo sapiens
gctgaaagccaggat

SEQ ID NO: 379924 - DNA, 15 bp, Homo sapiens
ctgaaagccaggatc

SEQ ID NO: 379925 - DNA, 15 bp, Homo sapiens
tgaaagccaggatcg

SEQ ID NO: 379926 - DNA, 15 bp, Homo sapiens
gaaagccaggatcgt

SEQ ID NO: 379927 - DNA, 15 bp, Homo sapiens
aaagccaggatcgtg

SEQ ID NO: 379928 - DNA, 15 bp, Homo sapiens
aagccaggatcgtgc

SEQ ID NO: 379929 - DNA, 15 bp, Homo sapiens
agccaggatcgtgcc

SEQ ID NO: 379930 - DNA, 15 bp, Homo sapiens
gccaggatcgtgcca

SEQ ID NO: 379931 - DNA, 15 bp, Homo sapiens
ccaggatcgtgccac

SEQ ID NO: 379932 - DNA, 15 bp, Homo sapiens
caggatcgtgccact

SEQ ID NO: 379933 - DNA, 15 bp, Homo sapiens
aggatcgtgccactg

SEQ ID NO: 379934 - DNA, 15 bp, Homo sapiens
ggatcgtgccactgc

SEQ ID NO: 379935 - DNA, 15 bp, Homo sapiens
cctgggcgacagagc

SEQ ID NO: 379936 - DNA, 15 bp, Homo sapiens
ctgggcgacagagca

SEQ ID NO: 379937 - DNA, 15 bp, Homo sapiens
cagagcaagactctc

SEQ ID NO: 379938 - DNA, 15 bp, Homo sapiens
agagcaagactctct

SEQ ID NO: 379939 - DNA, 15 bp, Homo sapiens
gagcaagactctctc

SEQ ID NO: 379940 - DNA, 15 bp, Homo sapiens
agcaagactctctct

SEQ ID NO: 379941 - DNA, 15 bp, Homo sapiens
gcaagactctctctc

SEQ ID NO: 379942 - DNA, 15 bp, Homo sapiens
caagactctctctca

SEQ ID NO: 379943 - DNA, 15 bp, Homo sapiens
aagactctctctcaa

SEQ ID NO: 379944 - DNA, 15 bp, Homo sapiens
agactctctctcaaa

SEQ ID NO: 379945 - DNA, 15 bp, Homo sapiens
gactctctctcaaaa

SEQ ID NO: 379946 - DNA, 15 bp, Homo sapiens
actctctctcaaaaa

SEQ ID NO: 379947 - DNA, 15 bp, Homo sapiens
ctctctctcaaaaaa

SEQ ID NO: 379948 - DNA, 15 bp, Homo sapiens
tctctctcaaaaaaa

SEQ ID NO: 379949 - DNA, 15 bp, Homo sapiens
ctctctcaaaaaaaa

SEQ ID NO: 379950 - DNA, 15 bp, Homo sapiens
tctctcaaaaaaaaa

SEQ ID NO: 379951 - DNA, 15 bp, Homo sapiens
aaaaaaaagtttcct

SEQ ID NO: 379952 - DNA, 15 bp, Homo sapiens
aaaaaaagtttcctt

SEQ ID NO: 379953 - DNA, 15 bp, Homo sapiens
aaaaaagtttcctta

SEQ ID NO: 379954 - DNA, 15 bp, Homo sapiens
aaaaagtttccttag

SEQ ID NO: 379955 - DNA, 15 bp, Homo sapiens
aaaagtttccttaga

SEQ ID NO: 379956 - DNA, 15 bp, Homo sapiens
aaagtttccttagat

SEQ ID NO: 379957 - DNA, 15 bp, Homo sapiens
aagtttccttagatc

SEQ ID NO: 379958 - DNA, 15 bp, Homo sapiens
agtttccttagatct

SEQ ID NO: 379959 - DNA, 15 bp, Homo sapiens
gtttccttagatctg

SEQ ID NO: 379960 - DNA, 15 bp, Homo sapiens
tttccttagatctgt

SEQ ID NO: 379961 - DNA, 15 bp, Homo sapiens
ttccttagatctgtc

SEQ ID NO: 379962 - DNA, 15 bp, Homo sapiens
tccttagatctgtct

SEQ ID NO: 379963 - DNA, 15 bp, Homo sapiens
ccttagatctgtctg

SEQ ID NO: 379964 - DNA, 15 bp, Homo sapiens
cttagatctgtctgt

SEQ ID NO: 379965 - DNA, 15 bp, Homo sapiens
ttagatctgtctgtc

SEQ ID NO: 379966 - DNA, 15 bp, Homo sapiens
tagatctgtctgtcc

SEQ ID NO: 379967 - DNA, 15 bp, Homo sapiens
agatctgtctgtcct

SEQ ID NO: 379968 - DNA, 15 bp, Homo sapiens
gatctgtctgtcctt

SEQ ID NO: 379969 - DNA, 15 bp, Homo sapiens
atctgtctgtcctta

SEQ ID NO: 379970 - DNA, 15 bp, Homo sapiens
tctgtctgtccttaa

SEQ ID NO: 379971 - DNA, 15 bp, Homo sapiens
ctgtctgtccttaaa

SEQ ID NO: 379972 - DNA, 15 bp, Homo sapiens
tgtctgtccttaaaa

SEQ ID NO: 379973 - DNA, 15 bp, Homo sapiens
gtctgtccttaaaac

SEQ ID NO: 379974 - DNA, 15 bp, Homo sapiens
tctgtccttaaaacc

SEQ ID NO: 379975 - DNA, 15 bp, Homo sapiens
ctgtccttaaaacct

SEQ ID NO: 379976 - DNA, 15 bp, Homo sapiens
tgtccttaaaacctt

SEQ ID NO: 379977 - DNA, 15 bp, Homo sapiens
gtccttaaaaccttg

SEQ ID NO: 379978 - DNA, 15 bp, Homo sapiens
tccttaaaaccttgt

SEQ ID NO: 379979 - DNA, 15 bp, Homo sapiens
ccttaaaaccttgtt

SEQ ID NO: 379980 - DNA, 15 bp, Homo sapiens
cttaaaaccttgtta

SEQ ID NO: 379981 - DNA, 15 bp, Homo sapiens
ttaaaaccttgttaa

SEQ ID NO: 379982 - DNA, 15 bp, Homo sapiens
taaaaccttgttaaa

SEQ ID NO: 379983 - DNA, 15 bp, Homo sapiens
aaaaccttgttaaaa

SEQ ID NO: 379984 - DNA, 15 bp, Homo sapiens
aaaccttgttaaaaa

SEQ ID NO: 379985 - DNA, 15 bp, Homo sapiens
aaccttgttaaaaat

SEQ ID NO: 379986 - DNA, 15 bp, Homo sapiens
accttgttaaaaata

SEQ ID NO: 379987 - DNA, 15 bp, Homo sapiens
ccttgttaaaaatag

SEQ ID NO: 379988 - DNA, 15 bp, Homo sapiens
cttgttaaaaataga

SEQ ID NO: 379989 - DNA, 15 bp, Homo sapiens
ttgttaaaaatagag

SEQ ID NO: 379990 - DNA, 15 bp, Homo sapiens
tgttaaaaatagaga

SEQ ID NO: 379991 - DNA, 15 bp, Homo sapiens
gttaaaaatagagaa

SEQ ID NO: 379992 - DNA, 15 bp, Homo sapiens
ttaaaaatagagaaa

SEQ ID NO: 379993 - DNA, 15 bp, Homo sapiens
taaaaatagagaaag

SEQ ID NO: 379994 - DNA, 15 bp, Homo sapiens
aaaaatagagaaagg

SEQ ID NO: 379995 - DNA, 15 bp, Homo sapiens
aaaatagagaaagga

SEQ ID NO: 379996 - DNA, 15 bp, Homo sapiens
aaatagagaaaggag

SEQ ID NO: 379997 - DNA, 15 bp, Homo sapiens
aatagagaaaggaga

SEQ ID NO: 379998 - DNA, 15 bp, Homo sapiens
atagagaaaggagaa

SEQ ID NO: 379999 - DNA, 15 bp, Homo sapiens
tagagaaaggagaag

SEQ ID NO: 380000 - DNA, 15 bp, Homo sapiens
agagaaaggagaaga

SEQ ID NO: 380001 - DNA, 15 bp, Homo sapiens
gagaaaggagaagag

SEQ ID NO: 380002 - DNA, 15 bp, Homo sapiens
agaaaggagaagaga

SEQ ID NO: 380003 - DNA, 15 bp, Homo sapiens
gaaaggagaagagag

SEQ ID NO: 380004 - DNA, 15 bp, Homo sapiens
aaaggagaagagaga

SEQ ID NO: 380005 - DNA, 15 bp, Homo sapiens
aaggagaagagagaa

SEQ ID NO: 380006 - DNA, 15 bp, Homo sapiens
aggagaagagagaaa

SEQ ID NO: 380007 - DNA, 15 bp, Homo sapiens
ggagaagagagaaag

SEQ ID NO: 380008 - DNA, 15 bp, Homo sapiens
gagaagagagaaagc

SEQ ID NO: 380009 - DNA, 15 bp, Homo sapiens
agaagagagaaagct

SEQ ID NO: 380010 - DNA, 15 bp, Homo sapiens
gaagagagaaagctt

SEQ ID NO: 380011 - DNA, 15 bp, Homo sapiens
aagagagaaagcttg

SEQ ID NO: 380012 - DNA, 15 bp, Homo sapiens
agagagaaagcttga

SEQ ID NO: 380013 - DNA, 15 bp, Homo sapiens
gagagaaagcttgag

SEQ ID NO: 380014 - DNA, 15 bp, Homo sapiens
agagaaagcttgagg

SEQ ID NO: 380015 - DNA, 15 bp, Homo sapiens
gagaaagcttgagga

SEQ ID NO: 380016 - DNA, 15 bp, Homo sapiens
agaaagcttgaggag

SEQ ID NO: 380017 - DNA, 15 bp, Homo sapiens
gaaagcttgaggaga

SEQ ID NO: 380018 - DNA, 15 bp, Homo sapiens
aaagcttgaggagaa

SEQ ID NO: 380019 - DNA, 15 bp, Homo sapiens
aagcttgaggagaaa

SEQ ID NO: 380020 - DNA, 15 bp, Homo sapiens
agcttgaggagaaat

SEQ ID NO: 380021 - DNA, 15 bp, Homo sapiens
gcttgaggagaaata

SEQ ID NO: 380022 - DNA, 15 bp, Homo sapiens
cttgaggagaaatag

SEQ ID NO: 380023 - DNA, 15 bp, Homo sapiens
ttgaggagaaataga

SEQ ID NO: 380024 - DNA, 15 bp, Homo sapiens
tgaggagaaatagaa

SEQ ID NO: 380025 - DNA, 15 bp, Homo sapiens
gaggagaaatagaaa

SEQ ID NO: 380026 - DNA, 15 bp, Homo sapiens
aggagaaatagaaag

SEQ ID NO: 380027 - DNA, 15 bp, Homo sapiens
gagaaatagaaagag

SEQ ID NO: 380028 - DNA, 15 bp, Homo sapiens
agaaatagaaagaga

SEQ ID NO: 380029 - DNA, 15 bp, Homo sapiens
gaaatagaaagagag

SEQ ID NO: 380030 - DNA, 15 bp, Homo sapiens
aaatagaaagagaga

SEQ ID NO: 380031 - DNA, 15 bp, Homo sapiens
aatagaaagagagag

SEQ ID NO: 380032 - DNA, 15 bp, Homo sapiens
atagaaagagagaga

SEQ ID NO: 380033 - DNA, 15 bp, Homo sapiens
tagaaagagagagaa

SEQ ID NO: 380034 - DNA, 15 bp, Homo sapiens
agaaagagagagaag

SEQ ID NO: 380035 - DNA, 15 bp, Homo sapiens
gaaagagagagaagg

SEQ ID NO: 380036 - DNA, 15 bp, Homo sapiens
aaagagagagaaggt

SEQ ID NO: 380037 - DNA, 15 bp, Homo sapiens
aagagagagaaggtg

SEQ ID NO: 380038 - DNA, 15 bp, Homo sapiens
agagagagaaggtga

SEQ ID NO: 380039 - DNA, 15 bp, Homo sapiens
gagagagaaggtgat

SEQ ID NO: 380040 - DNA, 15 bp, Homo sapiens
agagagaaggtgata

SEQ ID NO: 380041 - DNA, 15 bp, Homo sapiens
gagagaaggtgataa

SEQ ID NO: 380042 - DNA, 15 bp, Homo sapiens
agagaaggtgataat

SEQ ID NO: 380043 - DNA, 15 bp, Homo sapiens
gagaaggtgataatg

SEQ ID NO: 380044 - DNA, 15 bp, Homo sapiens
agaaggtgataatga

SEQ ID NO: 380045 - DNA, 15 bp, Homo sapiens
gaaggtgataatgag

SEQ ID NO: 380046 - DNA, 15 bp, Homo sapiens
aaggtgataatgagt

SEQ ID NO: 380047 - DNA, 15 bp, Homo sapiens
aggtgataatgagtg

SEQ ID NO: 380048 - DNA, 15 bp, Homo sapiens
ggtgataatgagtga

SEQ ID NO: 380049 - DNA, 15 bp, Homo sapiens
gtgataatgagtgaa

SEQ ID NO: 380050 - DNA, 15 bp, Homo sapiens
tgataatgagtgaaa

SEQ ID NO: 380051 - DNA, 15 bp, Homo sapiens
gataatgagtgaaag

SEQ ID NO: 380052 - DNA, 15 bp, Homo sapiens
ataatgagtgaaagg

SEQ ID NO: 380053 - DNA, 15 bp, Homo sapiens
taatgagtgaaagga

SEQ ID NO: 380054 - DNA, 15 bp, Homo sapiens
aatgagtgaaaggaa

SEQ ID NO: 380055 - DNA, 15 bp, Homo sapiens
atgagtgaaaggaat

SEQ ID NO: 380056 - DNA, 15 bp, Homo sapiens
tgagtgaaaggaatg

SEQ ID NO: 380057 - DNA, 15 bp, Homo sapiens
gagtgaaaggaatga

SEQ ID NO: 380058 - DNA, 15 bp, Homo sapiens
agtgaaaggaatgaa

SEQ ID NO: 380059 - DNA, 15 bp, Homo sapiens
gtgaaaggaatgaac

SEQ ID NO: 380060 - DNA, 15 bp, Homo sapiens
tgaaaggaatgaaca

SEQ ID NO: 380061 - DNA, 15 bp, Homo sapiens
gaaaggaatgaacaa

SEQ ID NO: 380062 - DNA, 15 bp, Homo sapiens
aaaggaatgaacaat

SEQ ID NO: 380063 - DNA, 15 bp, Homo sapiens
aaggaatgaacaata

SEQ ID NO: 380064 - DNA, 15 bp, Homo sapiens
aggaatgaacaataa

SEQ ID NO: 380065 - DNA, 15 bp, Homo sapiens
ggaatgaacaataat

SEQ ID NO: 380066 - DNA, 15 bp, Homo sapiens
gaatgaacaataata

SEQ ID NO: 380067 - DNA, 15 bp, Homo sapiens
aatgaacaataataa

SEQ ID NO: 380068 - DNA, 15 bp, Homo sapiens
atgaacaataataaa

SEQ ID NO: 380069 - DNA, 15 bp, Homo sapiens
tgaacaataataaaa

SEQ ID NO: 380070 - DNA, 15 bp, Homo sapiens
gaacaataataaaag

SEQ ID NO: 380071 - DNA, 15 bp, Homo sapiens
aacaataataaaaga

SEQ ID NO: 380072 - DNA, 15 bp, Homo sapiens
acaataataaaagag

SEQ ID NO: 380073 - DNA, 15 bp, Homo sapiens
caataataaaagagg

SEQ ID NO: 380074 - DNA, 15 bp, Homo sapiens
aataataaaagagga

SEQ ID NO: 380075 - DNA, 15 bp, Homo sapiens
ataataaaagaggaa

SEQ ID NO: 380076 - DNA, 15 bp, Homo sapiens
taataaaagaggaag

SEQ ID NO: 380077 - DNA, 15 bp, Homo sapiens
aataaaagaggaagg

SEQ ID NO: 380078 - DNA, 15 bp, Homo sapiens
ataaaagaggaagga

SEQ ID NO: 380079 - DNA, 15 bp, Homo sapiens
taaaagaggaaggac

SEQ ID NO: 380080 - DNA, 15 bp, Homo sapiens
aaaagaggaaggaca

SEQ ID NO: 380081 - DNA, 15 bp, Homo sapiens
aaagaggaaggacaa

SEQ ID NO: 380082 - DNA, 15 bp, Homo sapiens
aagaggaaggacaag

SEQ ID NO: 380083 - DNA, 15 bp, Homo sapiens
agaggaaggacaaga

SEQ ID NO: 380084 - DNA, 15 bp, Homo sapiens
gaggaaggacaagag

SEQ ID NO: 380085 - DNA, 15 bp, Homo sapiens
aggaaggacaagagc

SEQ ID NO: 380086 - DNA, 15 bp, Homo sapiens
ggaaggacaagagcc

SEQ ID NO: 380087 - DNA, 15 bp, Homo sapiens
gaaggacaagagcca

SEQ ID NO: 380088 - DNA, 15 bp, Homo sapiens
aaggacaagagccag

SEQ ID NO: 380089 - DNA, 15 bp, Homo sapiens
aggacaagagccagt

SEQ ID NO: 380090 - DNA, 15 bp, Homo sapiens
ggacaagagccagta

SEQ ID NO: 380091 - DNA, 15 bp, Homo sapiens
gacaagagccagtat

SEQ ID NO: 380092 - DNA, 15 bp, Homo sapiens
acaagagccagtatg

SEQ ID NO: 380093 - DNA, 15 bp, Homo sapiens
caagagccagtatgg

SEQ ID NO: 380094 - DNA, 15 bp, Homo sapiens
aagagccagtatgga

SEQ ID NO: 380095 - DNA, 15 bp, Homo sapiens
agagccagtatggaa

SEQ ID NO: 380096 - DNA, 15 bp, Homo sapiens
gagccagtatggaat

SEQ ID NO: 380097 - DNA, 15 bp, Homo sapiens
agccagtatggaatt

SEQ ID NO: 380098 - DNA, 15 bp, Homo sapiens
gccagtatggaattt

SEQ ID NO: 380099 - DNA, 15 bp, Homo sapiens
ccagtatggaatttt

SEQ ID NO: 380100 - DNA, 15 bp, Homo sapiens
cagtatggaattttt

SEQ ID NO: 380101 - DNA, 15 bp, Homo sapiens
agtatggaattttta

SEQ ID NO: 380102 - DNA, 15 bp, Homo sapiens
gtatggaatttttat

SEQ ID NO: 380103 - DNA, 15 bp, Homo sapiens
tatggaatttttatg

SEQ ID NO: 380104 - DNA, 15 bp, Homo sapiens
atggaatttttatga

SEQ ID NO: 380105 - DNA, 15 bp, Homo sapiens
tggaatttttatgat

SEQ ID NO: 380106 - DNA, 15 bp, Homo sapiens
ggaatttttatgatg

SEQ ID NO: 380107 - DNA, 15 bp, Homo sapiens
gaatttttatgatga

SEQ ID NO: 380108 - DNA, 15 bp, Homo sapiens
aatttttatgatgaa

SEQ ID NO: 380109 - DNA, 15 bp, Homo sapiens
atttttatgatgaag

SEQ ID NO: 380110 - DNA, 15 bp, Homo sapiens
tttttatgatgaaga

SEQ ID NO: 380111 - DNA, 15 bp, Homo sapiens
ttttatgatgaagag

SEQ ID NO: 380112 - DNA, 15 bp, Homo sapiens
tttatgatgaagagc

SEQ ID NO: 380113 - DNA, 15 bp, Homo sapiens
ttatgatgaagagct

SEQ ID NO: 380114 - DNA, 15 bp, Homo sapiens
tatgatgaagagctg

SEQ ID NO: 380115 - DNA, 15 bp, Homo sapiens
atgatgaagagctgc

SEQ ID NO: 380116 - DNA, 15 bp, Homo sapiens
tgatgaagagctgct

SEQ ID NO: 380117 - DNA, 15 bp, Homo sapiens
gatgaagagctgctg

SEQ ID NO: 380118 - DNA, 15 bp, Homo sapiens
atgaagagctgctgg

SEQ ID NO: 380119 - DNA, 15 bp, Homo sapiens
tgaagagctgctggg

SEQ ID NO: 380120 - DNA, 15 bp, Homo sapiens
gaagagctgctgggt

SEQ ID NO: 380121 - DNA, 15 bp, Homo sapiens
aagagctgctgggtg

SEQ ID NO: 380122 - DNA, 15 bp, Homo sapiens
agagctgctgggtgc

SEQ ID NO: 380123 - DNA, 15 bp, Homo sapiens
gagctgctgggtgca

SEQ ID NO: 380124 - DNA, 15 bp, Homo sapiens
agctgctgggtgcac

SEQ ID NO: 380125 - DNA, 15 bp, Homo sapiens
gctgctgggtgcaca

SEQ ID NO: 380126 - DNA, 15 bp, Homo sapiens
ctgctgggtgcacag

SEQ ID NO: 380127 - DNA, 15 bp, Homo sapiens
tgctgggtgcacagt

SEQ ID NO: 380128 - DNA, 15 bp, Homo sapiens
gctgggtgcacagtt

SEQ ID NO: 380129 - DNA, 15 bp, Homo sapiens
ctgggtgcacagttc

SEQ ID NO: 380130 - DNA, 15 bp, Homo sapiens
tgggtgcacagttca

SEQ ID NO: 380131 - DNA, 15 bp, Homo sapiens
gggtgcacagttcat

SEQ ID NO: 380132 - DNA, 15 bp, Homo sapiens
ggtgcacagttcatg

SEQ ID NO: 380133 - DNA, 15 bp, Homo sapiens
gtgcacagttcatga

SEQ ID NO: 380134 - DNA, 15 bp, Homo sapiens
tgcacagttcatgag

SEQ ID NO: 380135 - DNA, 15 bp, Homo sapiens
gcacagttcatgagt

SEQ ID NO: 380136 - DNA, 15 bp, Homo sapiens
cacagttcatgagtc

SEQ ID NO: 380137 - DNA, 15 bp, Homo sapiens
acagttcatgagtct

SEQ ID NO: 380138 - DNA, 15 bp, Homo sapiens
cagttcatgagtctc

SEQ ID NO: 380139 - DNA, 15 bp, Homo sapiens
agttcatgagtctct

SEQ ID NO: 380140 - DNA, 15 bp, Homo sapiens
gttcatgagtctctt

SEQ ID NO: 380141 - DNA, 15 bp, Homo sapiens
ttcatgagtctcttt

SEQ ID NO: 380142 - DNA, 15 bp, Homo sapiens
tcatgagtctctttt

SEQ ID NO: 380143 - DNA, 15 bp, Homo sapiens
catgagtctctttta

SEQ ID NO: 380144 - DNA, 15 bp, Homo sapiens
atgagtctcttttac

SEQ ID NO: 380145 - DNA, 15 bp, Homo sapiens
tgagtctcttttact

SEQ ID NO: 380146 - DNA, 15 bp, Homo sapiens
gagtctcttttactt

SEQ ID NO: 380147 - DNA, 15 bp, Homo sapiens
agtctcttttacttt

SEQ ID NO: 380148 - DNA, 15 bp, Homo sapiens
gtctcttttactttt

SEQ ID NO: 380149 - DNA, 15 bp, Homo sapiens
tctcttttactttta

SEQ ID NO: 380150 - DNA, 15 bp, Homo sapiens
ctcttttacttttag

SEQ ID NO: 380151 - DNA, 15 bp, Homo sapiens
tcttttacttttagc

SEQ ID NO: 380152 - DNA, 15 bp, Homo sapiens
cttttacttttagca

SEQ ID NO: 380153 - DNA, 15 bp, Homo sapiens
ttttacttttagcat

SEQ ID NO: 380154 - DNA, 15 bp, Homo sapiens
tttacttttagcatt

SEQ ID NO: 380155 - DNA, 15 bp, Homo sapiens
ttacttttagcattt

SEQ ID NO: 380156 - DNA, 15 bp, Homo sapiens
tacttttagcatttc

SEQ ID NO: 380157 - DNA, 15 bp, Homo sapiens
acttttagcatttct

SEQ ID NO: 380158 - DNA, 15 bp, Homo sapiens
cttttagcatttctc

SEQ ID NO: 380159 - DNA, 15 bp, Homo sapiens
ttttagcatttctct

SEQ ID NO: 380160 - DNA, 15 bp, Homo sapiens
tttagcatttctctt

SEQ ID NO: 380161 - DNA, 15 bp, Homo sapiens
ttagcatttctcttg

SEQ ID NO: 380162 - DNA, 15 bp, Homo sapiens
tagcatttctcttga

SEQ ID NO: 380163 - DNA, 15 bp, Homo sapiens
agcatttctcttgaa

SEQ ID NO: 380164 - DNA, 15 bp, Homo sapiens
gcatttctcttgaac

SEQ ID NO: 380165 - DNA, 15 bp, Homo sapiens
catttctcttgaact

SEQ ID NO: 380166 - DNA, 15 bp, Homo sapiens
atttctcttgaactt

SEQ ID NO: 380167 - DNA, 15 bp, Homo sapiens
tttctcttgaacttg

SEQ ID NO: 380168 - DNA, 15 bp, Homo sapiens
ttctcttgaacttga

SEQ ID NO: 380169 - DNA, 15 bp, Homo sapiens
tctcttgaacttgaa

SEQ ID NO: 380170 - DNA, 15 bp, Homo sapiens
ctcttgaacttgaat

SEQ ID NO: 380171 - DNA, 15 bp, Homo sapiens
tcttgaacttgaata

SEQ ID NO: 380172 - DNA, 15 bp, Homo sapiens
cttgaacttgaatat

SEQ ID NO: 380173 - DNA, 15 bp, Homo sapiens
ttgaacttgaatata

SEQ ID NO: 380174 - DNA, 15 bp, Homo sapiens
tgaacttgaatatat

SEQ ID NO: 380175 - DNA, 15 bp, Homo sapiens
gaacttgaatatata

SEQ ID NO: 380176 - DNA, 15 bp, Homo sapiens
aacttgaatatataa

SEQ ID NO: 380177 - DNA, 15 bp, Homo sapiens
acttgaatatataaa

SEQ ID NO: 380178 - DNA, 15 bp, Homo sapiens
cttgaatatataaaa

SEQ ID NO: 380179 - DNA, 15 bp, Homo sapiens
tgaatatataaaatt

SEQ ID NO: 380180 - DNA, 15 bp, Homo sapiens
gaatatataaaattc

SEQ ID NO: 380181 - DNA, 15 bp, Homo sapiens
aatatataaaattcc

SEQ ID NO: 380182 - DNA, 15 bp, Homo sapiens
atatataaaattcct

SEQ ID NO: 380183 - DNA, 15 bp, Homo sapiens
tatataaaattcctt

SEQ ID NO: 380184 - DNA, 15 bp, Homo sapiens
atataaaattccttt

SEQ ID NO: 380185 - DNA, 15 bp, Homo sapiens
tataaaattcctttt

SEQ ID NO: 380186 - DNA, 15 bp, Homo sapiens
ataaaattcctttta

SEQ ID NO: 380187 - DNA, 15 bp, Homo sapiens
taaaattccttttag

SEQ ID NO: 380188 - DNA, 15 bp, Homo sapiens
aaaattccttttaga

SEQ ID NO: 380189 - DNA, 15 bp, Homo sapiens
aaattccttttagag

SEQ ID NO: 380190 - DNA, 15 bp, Homo sapiens
aattccttttagaga

SEQ ID NO: 380191 - DNA, 15 bp, Homo sapiens
attccttttagagag

SEQ ID NO: 380192 - DNA, 15 bp, Homo sapiens
ttccttttagagagt

SEQ ID NO: 380193 - DNA, 15 bp, Homo sapiens
tccttttagagagtt

SEQ ID NO: 380194 - DNA, 15 bp, Homo sapiens
ccttttagagagttt

SEQ ID NO: 380195 - DNA, 15 bp, Homo sapiens
cttttagagagtttt

SEQ ID NO: 380196 - DNA, 15 bp, Homo sapiens
ttttagagagttttc

SEQ ID NO: 380197 - DNA, 15 bp, Homo sapiens
tttagagagttttcc

SEQ ID NO: 380198 - DNA, 15 bp, Homo sapiens
ttagagagttttcct

SEQ ID NO: 380199 - DNA, 15 bp, Homo sapiens
tagagagttttcctg

SEQ ID NO: 380200 - DNA, 15 bp, Homo sapiens
agagagttttcctgc

SEQ ID NO: 380201 - DNA, 15 bp, Homo sapiens
gagagttttcctgct

SEQ ID NO: 380202 - DNA, 15 bp, Homo sapiens
agagttttcctgcta

SEQ ID NO: 380203 - DNA, 15 bp, Homo sapiens
gagttttcctgctac

SEQ ID NO: 380204 - DNA, 15 bp, Homo sapiens
agttttcctgctaca

SEQ ID NO: 380205 - DNA, 15 bp, Homo sapiens
gttttcctgctacag

SEQ ID NO: 380206 - DNA, 15 bp, Homo sapiens
ttttcctgctacagt

SEQ ID NO: 380207 - DNA, 15 bp, Homo sapiens
tttcctgctacagta

SEQ ID NO: 380208 - DNA, 15 bp, Homo sapiens
ttcctgctacagtaa

SEQ ID NO: 380209 - DNA, 15 bp, Homo sapiens
tcctgctacagtaaa

SEQ ID NO: 380210 - DNA, 15 bp, Homo sapiens
cctgctacagtaaaa

SEQ ID NO: 380211 - DNA, 15 bp, Homo sapiens
ctgctacagtaaaac

SEQ ID NO: 380212 - DNA, 15 bp, Homo sapiens
tgctacagtaaaaca

SEQ ID NO: 380213 - DNA, 15 bp, Homo sapiens
gctacagtaaaacaa

SEQ ID NO: 380214 - DNA, 15 bp, Homo sapiens
ctacagtaaaacaaa

SEQ ID NO: 380215 - DNA, 15 bp, Homo sapiens
tacagtaaaacaaat

SEQ ID NO: 380216 - DNA, 15 bp, Homo sapiens
acagtaaaacaaatg

SEQ ID NO: 380217 - DNA, 15 bp, Homo sapiens
cagtaaaacaaatgc

SEQ ID NO: 380218 - DNA, 15 bp, Homo sapiens
agtaaaacaaatgca

SEQ ID NO: 380219 - DNA, 15 bp, Homo sapiens
gtaaaacaaatgcaa

SEQ ID NO: 380220 - DNA, 15 bp, Homo sapiens
taaaacaaatgcaaa

SEQ ID NO: 380221 - DNA, 15 bp, Homo sapiens
aaaacaaatgcaaaa

SEQ ID NO: 380222 - DNA, 15 bp, Homo sapiens
aaacaaatgcaaaaa

SEQ ID NO: 380223 - DNA, 15 bp, Homo sapiens
aacaaatgcaaaaaa

SEQ ID NO: 380224 - DNA, 15 bp, Homo sapiens
acaaatgcaaaaaaa

SEQ ID NO: 380225 - DNA, 15 bp, Homo sapiens
caaatgcaaaaaaaa

SEQ ID NO: 380226 - DNA, 15 bp, Homo sapiens
aaatgcaaaaaaaaa

SEQ ID NO: 380227 - DNA, 15 bp, Homo sapiens
aatgcaaaaaaaaat

SEQ ID NO: 380228 - DNA, 15 bp, Homo sapiens
atgcaaaaaaaaatt

SEQ ID NO: 380229 - DNA, 15 bp, Homo sapiens
tgcaaaaaaaaattc

SEQ ID NO: 380230 - DNA, 15 bp, Homo sapiens
gcaaaaaaaaattct

SEQ ID NO: 380231 - DNA, 15 bp, Homo sapiens
caaaaaaaaattctt

SEQ ID NO: 380232 - DNA, 15 bp, Homo sapiens
aaaaaaaaattctta

SEQ ID NO: 380233 - DNA, 15 bp, Homo sapiens
aaaaaaaattcttac

SEQ ID NO: 380234 - DNA, 15 bp, Homo sapiens
aaaaaaattcttaca

SEQ ID NO: 380235 - DNA, 15 bp, Homo sapiens
aaaaaattcttacac

SEQ ID NO: 380236 - DNA, 15 bp, Homo sapiens
aaaaattcttacaca

SEQ ID NO: 380237 - DNA, 15 bp, Homo sapiens
aaaattcttacacag

SEQ ID NO: 380238 - DNA, 15 bp, Homo sapiens
aaattcttacacagt

SEQ ID NO: 380239 - DNA, 15 bp, Homo sapiens
aattcttacacagtt

SEQ ID NO: 380240 - DNA, 15 bp, Homo sapiens
attcttacacagttc

SEQ ID NO: 380241 - DNA, 15 bp, Homo sapiens
ttcttacacagttca

SEQ ID NO: 380242 - DNA, 15 bp, Homo sapiens
tcttacacagttcag

SEQ ID NO: 380243 - DNA, 15 bp, Homo sapiens
cttacacagttcagt

SEQ ID NO: 380244 - DNA, 15 bp, Homo sapiens
ttacacagttcagtt

SEQ ID NO: 380245 - DNA, 15 bp, Homo sapiens
tacacagttcagttt

SEQ ID NO: 380246 - DNA, 15 bp, Homo sapiens
acacagttcagtttc

SEQ ID NO: 380247 - DNA, 15 bp, Homo sapiens
cacagttcagtttct

SEQ ID NO: 380248 - DNA, 15 bp, Homo sapiens
acagttcagtttctt

SEQ ID NO: 380249 - DNA, 15 bp, Homo sapiens
cagttcagtttcttc

SEQ ID NO: 380250 - DNA, 15 bp, Homo sapiens
agttcagtttcttct

SEQ ID NO: 380251 - DNA, 15 bp, Homo sapiens
gttcagtttcttcta

SEQ ID NO: 380252 - DNA, 15 bp, Homo sapiens
ttcagtttcttctaa

SEQ ID NO: 380253 - DNA, 15 bp, Homo sapiens
tcagtttcttctaaa

SEQ ID NO: 380254 - DNA, 15 bp, Homo sapiens
cagtttcttctaaaa

SEQ ID NO: 380255 - DNA, 15 bp, Homo sapiens
agtttcttctaaaat

SEQ ID NO: 380256 - DNA, 15 bp, Homo sapiens
gtttcttctaaaatc

SEQ ID NO: 380257 - DNA, 15 bp, Homo sapiens
tttcttctaaaatca

SEQ ID NO: 380258 - DNA, 15 bp, Homo sapiens
ttcttctaaaatcaa

SEQ ID NO: 380259 - DNA, 15 bp, Homo sapiens
tcttctaaaatcaag

SEQ ID NO: 380260 - DNA, 15 bp, Homo sapiens
cttctaaaatcaaga

SEQ ID NO: 380261 - DNA, 15 bp, Homo sapiens
ttctaaaatcaagac

SEQ ID NO: 380262 - DNA, 15 bp, Homo sapiens
tctaaaatcaagact

SEQ ID NO: 380263 - DNA, 15 bp, Homo sapiens
ctaaaatcaagactg

SEQ ID NO: 380264 - DNA, 15 bp, Homo sapiens
taaaatcaagactgc

SEQ ID NO: 380265 - DNA, 15 bp, Homo sapiens
aaaatcaagactgcc

SEQ ID NO: 380266 - DNA, 15 bp, Homo sapiens
aaatcaagactgcct

SEQ ID NO: 380267 - DNA, 15 bp, Homo sapiens
aatcaagactgcctt

SEQ ID NO: 380268 - DNA, 15 bp, Homo sapiens
atcaagactgcctta

SEQ ID NO: 380269 - DNA, 15 bp, Homo sapiens
tcaagactgccttag

SEQ ID NO: 380270 - DNA, 15 bp, Homo sapiens
caagactgccttaga

SEQ ID NO: 380271 - DNA, 15 bp, Homo sapiens
aagactgccttagaa

SEQ ID NO: 380272 - DNA, 15 bp, Homo sapiens
agactgccttagaaa

SEQ ID NO: 380273 - DNA, 15 bp, Homo sapiens
gactgccttagaaaa

SEQ ID NO: 380274 - DNA, 15 bp, Homo sapiens
actgccttagaaaat

SEQ ID NO: 380275 - DNA, 15 bp, Homo sapiens
ctgccttagaaaatt

SEQ ID NO: 380276 - DNA, 15 bp, Homo sapiens
tgccttagaaaattc

SEQ ID NO: 380277 - DNA, 15 bp, Homo sapiens
gccttagaaaattct

SEQ ID NO: 380278 - DNA, 15 bp, Homo sapiens
ccttagaaaattctc

SEQ ID NO: 380279 - DNA, 15 bp, Homo sapiens
cttagaaaattctcc

SEQ ID NO: 380280 - DNA, 15 bp, Homo sapiens
ttagaaaattctcct

SEQ ID NO: 380281 - DNA, 15 bp, Homo sapiens
tagaaaattctcctt

SEQ ID NO: 380282 - DNA, 15 bp, Homo sapiens
agaaaattctccttt

SEQ ID NO: 380283 - DNA, 15 bp, Homo sapiens
gaaaattctcctttg

SEQ ID NO: 380284 - DNA, 15 bp, Homo sapiens
aaaattctcctttga

SEQ ID NO: 380285 - DNA, 15 bp, Homo sapiens
aaattctcctttgag

SEQ ID NO: 380286 - DNA, 15 bp, Homo sapiens
aattctcctttgagg

SEQ ID NO: 380287 - DNA, 15 bp, Homo sapiens
attctcctttgaggg

SEQ ID NO: 380288 - DNA, 15 bp, Homo sapiens
ttctcctttgagggt

SEQ ID NO: 380289 - DNA, 15 bp, Homo sapiens
tctcctttgagggta

SEQ ID NO: 380290 - DNA, 15 bp, Homo sapiens
ctcctttgagggtaa

SEQ ID NO: 380291 - DNA, 15 bp, Homo sapiens
tcctttgagggtaac

SEQ ID NO: 380292 - DNA, 15 bp, Homo sapiens
cctttgagggtaaca

SEQ ID NO: 380293 - DNA, 15 bp, Homo sapiens
ctttgagggtaacag

SEQ ID NO: 380294 - DNA, 15 bp, Homo sapiens
tttgagggtaacagg

SEQ ID NO: 380295 - DNA, 15 bp, Homo sapiens
ttgagggtaacaggt

SEQ ID NO: 380296 - DNA, 15 bp, Homo sapiens
tgagggtaacaggtg

SEQ ID NO: 380297 - DNA, 15 bp, Homo sapiens
gagggtaacaggtga

SEQ ID NO: 380298 - DNA, 15 bp, Homo sapiens
agggtaacaggtgac

SEQ ID NO: 380299 - DNA, 15 bp, Homo sapiens
gggtaacaggtgact

SEQ ID NO: 380300 - DNA, 15 bp, Homo sapiens
ggtaacaggtgacta

SEQ ID NO: 380301 - DNA, 15 bp, Homo sapiens
gtaacaggtgactat

SEQ ID NO: 380302 - DNA, 15 bp, Homo sapiens
taacaggtgactatc

SEQ ID NO: 380303 - DNA, 15 bp, Homo sapiens
aacaggtgactatct

SEQ ID NO: 380304 - DNA, 15 bp, Homo sapiens
acaggtgactatctc

SEQ ID NO: 380305 - DNA, 15 bp, Homo sapiens
caggtgactatctct

SEQ ID NO: 380306 - DNA, 15 bp, Homo sapiens
aggtgactatctctc

SEQ ID NO: 380307 - DNA, 15 bp, Homo sapiens
ggtgactatctctct

SEQ ID NO: 380308 - DNA, 15 bp, Homo sapiens
gtgactatctctctg

SEQ ID NO: 380309 - DNA, 15 bp, Homo sapiens
tgactatctctctgt

SEQ ID NO: 380310 - DNA, 15 bp, Homo sapiens
gactatctctctgtc

SEQ ID NO: 380311 - DNA, 15 bp, Homo sapiens
ctatctctctgtctt

SEQ ID NO: 380312 - DNA, 15 bp, Homo sapiens
tatctctctgtctta

SEQ ID NO: 380313 - DNA, 15 bp, Homo sapiens
atctctctgtcttaa

SEQ ID NO: 380314 - DNA, 15 bp, Homo sapiens
tctctctgtcttaaa

SEQ ID NO: 380315 - DNA, 15 bp, Homo sapiens
ctctctgtcttaaag

SEQ ID NO: 380316 - DNA, 15 bp, Homo sapiens
tctctgtcttaaagt

SEQ ID NO: 380317 - DNA, 15 bp, Homo sapiens
ctctgtcttaaagtt

SEQ ID NO: 380318 - DNA, 15 bp, Homo sapiens
tctgtcttaaagttc

SEQ ID NO: 380319 - DNA, 15 bp, Homo sapiens
ctgtcttaaagttct

SEQ ID NO: 380320 - DNA, 15 bp, Homo sapiens
tgtcttaaagttctg

SEQ ID NO: 380321 - DNA, 15 bp, Homo sapiens
gtcttaaagttctgt

SEQ ID NO: 380322 - DNA, 15 bp, Homo sapiens
tcttaaagttctgtc

SEQ ID NO: 380323 - DNA, 15 bp, Homo sapiens
cttaaagttctgtca

SEQ ID NO: 380324 - DNA, 15 bp, Homo sapiens
ttaaagttctgtcat

SEQ ID NO: 380325 - DNA, 15 bp, Homo sapiens
taaagttctgtcatg

SEQ ID NO: 380326 - DNA, 15 bp, Homo sapiens
aaagttctgtcatga

SEQ ID NO: 380327 - DNA, 15 bp, Homo sapiens
aagttctgtcatgaa

SEQ ID NO: 380328 - DNA, 15 bp, Homo sapiens
agttctgtcatgaag

SEQ ID NO: 380329 - DNA, 15 bp, Homo sapiens
gttctgtcatgaagt

SEQ ID NO: 380330 - DNA, 15 bp, Homo sapiens
ttctgtcatgaagta

SEQ ID NO: 380331 - DNA, 15 bp, Homo sapiens
tctgtcatgaagtac

SEQ ID NO: 380332 - DNA, 15 bp, Homo sapiens
ctgtcatgaagtact

SEQ ID NO: 380333 - DNA, 15 bp, Homo sapiens
tgtcatgaagtactg

SEQ ID NO: 380334 - DNA, 15 bp, Homo sapiens
gtcatgaagtactgt

SEQ ID NO: 380335 - DNA, 15 bp, Homo sapiens
tcatgaagtactgtt

SEQ ID NO: 380336 - DNA, 15 bp, Homo sapiens
catgaagtactgtta

SEQ ID NO: 380337 - DNA, 15 bp, Homo sapiens
atgaagtactgttaa

SEQ ID NO: 380338 - DNA, 15 bp, Homo sapiens
tgaagtactgttaaa

SEQ ID NO: 380339 - DNA, 15 bp, Homo sapiens
gaagtactgttaaac

SEQ ID NO: 380340 - DNA, 15 bp, Homo sapiens
aagtactgttaaacc

SEQ ID NO: 380341 - DNA, 15 bp, Homo sapiens
agtactgttaaaccc

SEQ ID NO: 380342 - DNA, 15 bp, Homo sapiens
gtactgttaaaccct

SEQ ID NO: 380343 - DNA, 15 bp, Homo sapiens
tactgttaaacccta

SEQ ID NO: 380344 - DNA, 15 bp, Homo sapiens
actgttaaaccctac

SEQ ID NO: 380345 - DNA, 15 bp, Homo sapiens
ctgttaaaccctacc

SEQ ID NO: 380346 - DNA, 15 bp, Homo sapiens
tgttaaaccctacct

SEQ ID NO: 380347 - DNA, 15 bp, Homo sapiens
gttaaaccctacctt

SEQ ID NO: 380348 - DNA, 15 bp, Homo sapiens
ttaaaccctaccttc

SEQ ID NO: 380349 - DNA, 15 bp, Homo sapiens
taaaccctaccttca

SEQ ID NO: 380350 - DNA, 15 bp, Homo sapiens
aaaccctaccttcat

SEQ ID NO: 380351 - DNA, 15 bp, Homo sapiens
aaccctaccttcatc

SEQ ID NO: 380352 - DNA, 15 bp, Homo sapiens
accctaccttcatca

SEQ ID NO: 380353 - DNA, 15 bp, Homo sapiens
ccctaccttcatcaa

SEQ ID NO: 380354 - DNA, 15 bp, Homo sapiens
cctaccttcatcaaa

SEQ ID NO: 380355 - DNA, 15 bp, Homo sapiens
ctaccttcatcaaac

SEQ ID NO: 380356 - DNA, 15 bp, Homo sapiens
taccttcatcaaacc

SEQ ID NO: 380357 - DNA, 15 bp, Homo sapiens
accttcatcaaacca

SEQ ID NO: 380358 - DNA, 15 bp, Homo sapiens
ccttcatcaaaccag

SEQ ID NO: 380359 - DNA, 15 bp, Homo sapiens
cttcatcaaaccagg

SEQ ID NO: 380360 - DNA, 15 bp, Homo sapiens
ttcatcaaaccaggt

SEQ ID NO: 380361 - DNA, 15 bp, Homo sapiens
tcatcaaaccaggtc

SEQ ID NO: 380362 - DNA, 15 bp, Homo sapiens
catcaaaccaggtct

SEQ ID NO: 380363 - DNA, 15 bp, Homo sapiens
atcaaaccaggtcta

SEQ ID NO: 380364 - DNA, 15 bp, Homo sapiens
tcaaaccaggtctat

SEQ ID NO: 380365 - DNA, 15 bp, Homo sapiens
caaaccaggtctata

SEQ ID NO: 380366 - DNA, 15 bp, Homo sapiens
aaaccaggtctataa

SEQ ID NO: 380367 - DNA, 15 bp, Homo sapiens
aaccaggtctataaa

SEQ ID NO: 380368 - DNA, 15 bp, Homo sapiens
accaggtctataaat

SEQ ID NO: 380369 - DNA, 15 bp, Homo sapiens
ccaggtctataaata

SEQ ID NO: 380370 - DNA, 15 bp, Homo sapiens
caggtctataaatac

SEQ ID NO: 380371 - DNA, 15 bp, Homo sapiens
aggtctataaataca

SEQ ID NO: 380372 - DNA, 15 bp, Homo sapiens
ggtctataaatacaa

SEQ ID NO: 380373 - DNA, 15 bp, Homo sapiens
gtctataaatacaac

SEQ ID NO: 380374 - DNA, 15 bp, Homo sapiens
tctataaatacaact

SEQ ID NO: 380375 - DNA, 15 bp, Homo sapiens
ctataaatacaactg

SEQ ID NO: 380376 - DNA, 15 bp, Homo sapiens
tataaatacaactgt

SEQ ID NO: 380377 - DNA, 15 bp, Homo sapiens
ataaatacaactgta

SEQ ID NO: 380378 - DNA, 15 bp, Homo sapiens
taaatacaactgtaa

SEQ ID NO: 380379 - DNA, 15 bp, Homo sapiens
aaatacaactgtaaa

SEQ ID NO: 380380 - DNA, 15 bp, Homo sapiens
aatacaactgtaaat

SEQ ID NO: 380381 - DNA, 15 bp, Homo sapiens
atacaactgtaaata

SEQ ID NO: 380382 - DNA, 15 bp, Homo sapiens
tacaactgtaaatac

SEQ ID NO: 380383 - DNA, 15 bp, Homo sapiens
acaactgtaaataca

SEQ ID NO: 380384 - DNA, 15 bp, Homo sapiens
caactgtaaatacaa

SEQ ID NO: 380385 - DNA, 15 bp, Homo sapiens
aactgtaaatacaaa

SEQ ID NO: 380386 - DNA, 15 bp, Homo sapiens
actgtaaatacaaaa

SEQ ID NO: 380387 - DNA, 15 bp, Homo sapiens
ctgtaaatacaaaat

SEQ ID NO: 380388 - DNA, 15 bp, Homo sapiens
tgtaaatacaaaatt

SEQ ID NO: 380389 - DNA, 15 bp, Homo sapiens
gtaaatacaaaatta

SEQ ID NO: 380390 - DNA, 15 bp, Homo sapiens
taaatacaaaattaa

SEQ ID NO: 380391 - DNA, 15 bp, Homo sapiens
aaatacaaaattaaa

SEQ ID NO: 380392 - DNA, 15 bp, Homo sapiens
aatacaaaattaaat

SEQ ID NO: 380393 - DNA, 15 bp, Homo sapiens
atacaaaattaaata

SEQ ID NO: 380394 - DNA, 15 bp, Homo sapiens
tacaaaattaaatag

SEQ ID NO: 380395 - DNA, 15 bp, Homo sapiens
acaaaattaaataga

SEQ ID NO: 380396 - DNA, 15 bp, Homo sapiens
caaaattaaatagaa

SEQ ID NO: 380397 - DNA, 15 bp, Homo sapiens
aaaattaaatagaac

SEQ ID NO: 380398 - DNA, 15 bp, Homo sapiens
aaattaaatagaaca

SEQ ID NO: 380399 - DNA, 15 bp, Homo sapiens
aattaaatagaacag

SEQ ID NO: 380400 - DNA, 15 bp, Homo sapiens
attaaatagaacagt

SEQ ID NO: 380401 - DNA, 15 bp, Homo sapiens
ttaaatagaacagta

SEQ ID NO: 380402 - DNA, 15 bp, Homo sapiens
taaatagaacagtat

SEQ ID NO: 380403 - DNA, 15 bp, Homo sapiens
aaatagaacagtatt

SEQ ID NO: 380404 - DNA, 15 bp, Homo sapiens
aatagaacagtattt

SEQ ID NO: 380405 - DNA, 15 bp, Homo sapiens
atagaacagtatttt

SEQ ID NO: 380406 - DNA, 15 bp, Homo sapiens
tagaacagtattttc

SEQ ID NO: 380407 - DNA, 15 bp, Homo sapiens
agaacagtattttct

SEQ ID NO: 380408 - DNA, 15 bp, Homo sapiens
gaacagtattttctt

SEQ ID NO: 380409 - DNA, 15 bp, Homo sapiens
aacagtattttcttt

SEQ ID NO: 380410 - DNA, 15 bp, Homo sapiens
acagtattttcttta

SEQ ID NO: 380411 - DNA, 15 bp, Homo sapiens
cagtattttctttat

SEQ ID NO: 380412 - DNA, 15 bp, Homo sapiens
agtattttctttata

SEQ ID NO: 380413 - DNA, 15 bp, Homo sapiens
gtattttctttataa

SEQ ID NO: 380414 - DNA, 15 bp, Homo sapiens
ttttctttataattg

SEQ ID NO: 380415 - DNA, 15 bp, Homo sapiens
tttctttataattgt

SEQ ID NO: 380416 - DNA, 15 bp, Homo sapiens
ttctttataattgtt

SEQ ID NO: 380417 - DNA, 15 bp, Homo sapiens
tctttataattgttt

SEQ ID NO: 380418 - DNA, 15 bp, Homo sapiens
ctttataattgtttg

SEQ ID NO: 380419 - DNA, 15 bp, Homo sapiens
tttataattgtttgg

SEQ ID NO: 380420 - DNA, 15 bp, Homo sapiens
ttataattgtttggc

SEQ ID NO: 380421 - DNA, 15 bp, Homo sapiens
tataattgtttggca

SEQ ID NO: 380422 - DNA, 15 bp, Homo sapiens
ataattgtttggcag

SEQ ID NO: 380423 - DNA, 15 bp, Homo sapiens
taattgtttggcagt

SEQ ID NO: 380424 - DNA, 15 bp, Homo sapiens
aattgtttggcagta

SEQ ID NO: 380425 - DNA, 15 bp, Homo sapiens
attgtttggcagtat

SEQ ID NO: 380426 - DNA, 15 bp, Homo sapiens
ttgtttggcagtatc

SEQ ID NO: 380427 - DNA, 15 bp, Homo sapiens
tgtttggcagtatca

SEQ ID NO: 380428 - DNA, 15 bp, Homo sapiens
gtttggcagtatcag

SEQ ID NO: 380429 - DNA, 15 bp, Homo sapiens
tttggcagtatcagt

SEQ ID NO: 380430 - DNA, 15 bp, Homo sapiens
ttggcagtatcagtt

SEQ ID NO: 380431 - DNA, 15 bp, Homo sapiens
tggcagtatcagttt

SEQ ID NO: 380432 - DNA, 15 bp, Homo sapiens
ggcagtatcagttta

SEQ ID NO: 380433 - DNA, 15 bp, Homo sapiens
gcagtatcagtttat

SEQ ID NO: 380434 - DNA, 15 bp, Homo sapiens
cagtatcagtttata

SEQ ID NO: 380435 - DNA, 15 bp, Homo sapiens
agtatcagtttataa

SEQ ID NO: 380436 - DNA, 15 bp, Homo sapiens
gtatcagtttataat

SEQ ID NO: 380437 - DNA, 15 bp, Homo sapiens
tatcagtttataata

SEQ ID NO: 380438 - DNA, 15 bp, Homo sapiens
atcagtttataatag

SEQ ID NO: 380439 - DNA, 15 bp, Homo sapiens
tcagtttataatagt

SEQ ID NO: 380440 - DNA, 15 bp, Homo sapiens
cagtttataatagta

SEQ ID NO: 380441 - DNA, 15 bp, Homo sapiens
agtttataatagtag

SEQ ID NO: 380442 - DNA, 15 bp, Homo sapiens
gtttataatagtaga

SEQ ID NO: 380443 - DNA, 15 bp, Homo sapiens
tttataatagtagat

SEQ ID NO: 380444 - DNA, 15 bp, Homo sapiens
ttataatagtagata

SEQ ID NO: 380445 - DNA, 15 bp, Homo sapiens
tataatagtagatat

SEQ ID NO: 380446 - DNA, 15 bp, Homo sapiens
ataatagtagatatt

SEQ ID NO: 380447 - DNA, 15 bp, Homo sapiens
taatagtagatattt

SEQ ID NO: 380448 - DNA, 15 bp, Homo sapiens
aatagtagatatttt

SEQ ID NO: 380449 - DNA, 15 bp, Homo sapiens
atagtagatattttt

SEQ ID NO: 380450 - DNA, 15 bp, Homo sapiens
tagtagatatttttt

SEQ ID NO: 380451 - DNA, 15 bp, Homo sapiens
agtagatattttttt

SEQ ID NO: 380452 - DNA, 15 bp, Homo sapiens
gtagatatttttttg

SEQ ID NO: 380453 - DNA, 15 bp, Homo sapiens
tagatatttttttgg

SEQ ID NO: 380454 - DNA, 15 bp, Homo sapiens
agatatttttttggg

SEQ ID NO: 380455 - DNA, 15 bp, Homo sapiens
gatatttttttggga

SEQ ID NO: 380456 - DNA, 15 bp, Homo sapiens
atatttttttgggag

SEQ ID NO: 380457 - DNA, 15 bp, Homo sapiens
tatttttttgggagt

SEQ ID NO: 380458 - DNA, 15 bp, Homo sapiens
atttttttgggagtt

SEQ ID NO: 380459 - DNA, 15 bp, Homo sapiens
tttttttgggagttg

SEQ ID NO: 380460 - DNA, 15 bp, Homo sapiens
ttttttgggagttgt

SEQ ID NO: 380461 - DNA, 15 bp, Homo sapiens
tttttgggagttgtt

SEQ ID NO: 380462 - DNA, 15 bp, Homo sapiens
ttttgggagttgttt

SEQ ID NO: 380463 - DNA, 15 bp, Homo sapiens
tttgggagttgtttt

SEQ ID NO: 380464 - DNA, 15 bp, Homo sapiens
ttgggagttgtttta

SEQ ID NO: 380465 - DNA, 15 bp, Homo sapiens
tgggagttgttttag

SEQ ID NO: 380466 - DNA, 15 bp, Homo sapiens
gggagttgttttaga

SEQ ID NO: 380467 - DNA, 15 bp, Homo sapiens
ggagttgttttagag

SEQ ID NO: 380468 - DNA, 15 bp, Homo sapiens
gagttgttttagagc

SEQ ID NO: 380469 - DNA, 15 bp, Homo sapiens
agttgttttagagca

SEQ ID NO: 380470 - DNA, 15 bp, Homo sapiens
gttgttttagagcac

SEQ ID NO: 380471 - DNA, 15 bp, Homo sapiens
ttgttttagagcact

SEQ ID NO: 380472 - DNA, 15 bp, Homo sapiens
tgttttagagcactg

SEQ ID NO: 380473 - DNA, 15 bp, Homo sapiens
gttttagagcactga

SEQ ID NO: 380474 - DNA, 15 bp, Homo sapiens
ttttagagcactgaa

SEQ ID NO: 380475 - DNA, 15 bp, Homo sapiens
tttagagcactgaaa

SEQ ID NO: 380476 - DNA, 15 bp, Homo sapiens
ttagagcactgaaaa

SEQ ID NO: 380477 - DNA, 15 bp, Homo sapiens
tagagcactgaaaat

SEQ ID NO: 380478 - DNA, 15 bp, Homo sapiens
agagcactgaaaata

SEQ ID NO: 380479 - DNA, 15 bp, Homo sapiens
gagcactgaaaataa

SEQ ID NO: 380480 - DNA, 15 bp, Homo sapiens
agcactgaaaataag

SEQ ID NO: 380481 - DNA, 15 bp, Homo sapiens
gcactgaaaataaga

SEQ ID NO: 380482 - DNA, 15 bp, Homo sapiens
cactgaaaataagag

SEQ ID NO: 380483 - DNA, 15 bp, Homo sapiens
actgaaaataagagt

SEQ ID NO: 380484 - DNA, 15 bp, Homo sapiens
ctgaaaataagagtt

SEQ ID NO: 380485 - DNA, 15 bp, Homo sapiens
tgaaaataagagttc

SEQ ID NO: 380486 - DNA, 15 bp, Homo sapiens
gaaaataagagttca

SEQ ID NO: 380487 - DNA, 15 bp, Homo sapiens
aaaataagagttcaa

SEQ ID NO: 380488 - DNA, 15 bp, Homo sapiens
aaataagagttcaag

SEQ ID NO: 380489 - DNA, 15 bp, Homo sapiens
aataagagttcaaga

SEQ ID NO: 380490 - DNA, 15 bp, Homo sapiens
ataagagttcaagat

SEQ ID NO: 380491 - DNA, 15 bp, Homo sapiens
taagagttcaagatt

SEQ ID NO: 380492 - DNA, 15 bp, Homo sapiens
aagagttcaagattt

SEQ ID NO: 380493 - DNA, 15 bp, Homo sapiens
agagttcaagatttt

SEQ ID NO: 380494 - DNA, 15 bp, Homo sapiens
gagttcaagattttt

SEQ ID NO: 380495 - DNA, 15 bp, Homo sapiens
agttcaagatttttt

SEQ ID NO: 380496 - DNA, 15 bp, Homo sapiens
gttcaagattttttt

SEQ ID NO: 380497 - DNA, 15 bp, Homo sapiens
ttcaagatttttttt

SEQ ID NO: 380498 - DNA, 15 bp, Homo sapiens
tcaagattttttttt

SEQ ID NO: 380499 - DNA, 15 bp, Homo sapiens
caagatttttttttc

SEQ ID NO: 380500 - DNA, 15 bp, Homo sapiens
aagatttttttttct

SEQ ID NO: 380501 - DNA, 15 bp, Homo sapiens
agatttttttttctc

SEQ ID NO: 380502 - DNA, 15 bp, Homo sapiens
gatttttttttctca

SEQ ID NO: 380503 - DNA, 15 bp, Homo sapiens
atttttttttctcaa

SEQ ID NO: 380504 - DNA, 15 bp, Homo sapiens
tttttttttctcaaa

SEQ ID NO: 380505 - DNA, 15 bp, Homo sapiens
ttttttttctcaaac

SEQ ID NO: 380506 - DNA, 15 bp, Homo sapiens
tttttttctcaaaca

SEQ ID NO: 380507 - DNA, 15 bp, Homo sapiens
ttttttctcaaacac

SEQ ID NO: 380508 - DNA, 15 bp, Homo sapiens
tttttctcaaacacc

SEQ ID NO: 380509 - DNA, 15 bp, Homo sapiens
ttttctcaaacaccg

SEQ ID NO: 380510 - DNA, 15 bp, Homo sapiens
tttctcaaacaccgt

SEQ ID NO: 380511 - DNA, 15 bp, Homo sapiens
ttctcaaacaccgtt

SEQ ID NO: 380512 - DNA, 15 bp, Homo sapiens
tctcaaacaccgttt

SEQ ID NO: 380513 - DNA, 15 bp, Homo sapiens
ctcaaacaccgtttc

SEQ ID NO: 380514 - DNA, 15 bp, Homo sapiens
tcaaacaccgtttca

SEQ ID NO: 380515 - DNA, 15 bp, Homo sapiens
caaacaccgtttcag

SEQ ID NO: 380516 - DNA, 15 bp, Homo sapiens
aaacaccgtttcaga

SEQ ID NO: 380517 - DNA, 15 bp, Homo sapiens
aacaccgtttcagaa

SEQ ID NO: 380518 - DNA, 15 bp, Homo sapiens
acaccgtttcagaaa

SEQ ID NO: 380519 - DNA, 15 bp, Homo sapiens
caccgtttcagaaat

SEQ ID NO: 380520 - DNA, 15 bp, Homo sapiens
accgtttcagaaata

SEQ ID NO: 380521 - DNA, 15 bp, Homo sapiens
ccgtttcagaaatat

SEQ ID NO: 380522 - DNA, 15 bp, Homo sapiens
cgtttcagaaatata

SEQ ID NO: 380523 - DNA, 15 bp, Homo sapiens
gtttcagaaatatat

SEQ ID NO: 380524 - DNA, 15 bp, Homo sapiens
tttcagaaatatatc

SEQ ID NO: 380525 - DNA, 15 bp, Homo sapiens
ttcagaaatatatca

SEQ ID NO: 380526 - DNA, 15 bp, Homo sapiens
tcagaaatatatcaa

SEQ ID NO: 380527 - DNA, 15 bp, Homo sapiens
cagaaatatatcaat

SEQ ID NO: 380528 - DNA, 15 bp, Homo sapiens
agaaatatatcaatt

SEQ ID NO: 380529 - DNA, 15 bp, Homo sapiens
gaaatatatcaattg

SEQ ID NO: 380530 - DNA, 15 bp, Homo sapiens
aaatatatcaattgt

SEQ ID NO: 380531 - DNA, 15 bp, Homo sapiens
aatatatcaattgta

SEQ ID NO: 380532 - DNA, 15 bp, Homo sapiens
atatatcaattgtat

SEQ ID NO: 380533 - DNA, 15 bp, Homo sapiens
tatatcaattgtata

SEQ ID NO: 380534 - DNA, 15 bp, Homo sapiens
atatcaattgtatag

SEQ ID NO: 380535 - DNA, 15 bp, Homo sapiens
tatcaattgtatagg

SEQ ID NO: 380536 - DNA, 15 bp, Homo sapiens
atcaattgtatagga

SEQ ID NO: 380537 - DNA, 15 bp, Homo sapiens
tcaattgtataggat

SEQ ID NO: 380538 - DNA, 15 bp, Homo sapiens
caattgtataggatg

SEQ ID NO: 380539 - DNA, 15 bp, Homo sapiens
aattgtataggatgg

SEQ ID NO: 380540 - DNA, 15 bp, Homo sapiens
attgtataggatggc

SEQ ID NO: 380541 - DNA, 15 bp, Homo sapiens
ttgtataggatggca

SEQ ID NO: 380542 - DNA, 15 bp, Homo sapiens
tgtataggatggcag

SEQ ID NO: 380543 - DNA, 15 bp, Homo sapiens
gtataggatggcaga

SEQ ID NO: 380544 - DNA, 15 bp, Homo sapiens
tataggatggcagat

SEQ ID NO: 380545 - DNA, 15 bp, Homo sapiens
ataggatggcagatg

SEQ ID NO: 380546 - DNA, 15 bp, Homo sapiens
taggatggcagatgt

SEQ ID NO: 380547 - DNA, 15 bp, Homo sapiens
aggatggcagatgta

SEQ ID NO: 380548 - DNA, 15 bp, Homo sapiens
ggatggcagatgtat

SEQ ID NO: 380549 - DNA, 15 bp, Homo sapiens
gatggcagatgtata

SEQ ID NO: 380550 - DNA, 15 bp, Homo sapiens
atggcagatgtatat

SEQ ID NO: 380551 - DNA, 15 bp, Homo sapiens
tggcagatgtatatt

SEQ ID NO: 380552 - DNA, 15 bp, Homo sapiens
ggcagatgtatatta

SEQ ID NO: 380553 - DNA, 15 bp, Homo sapiens
gcagatgtatattaa

SEQ ID NO: 380554 - DNA, 15 bp, Homo sapiens
cagatgtatattaaa

SEQ ID NO: 380555 - DNA, 15 bp, Homo sapiens
agatgtatattaaaa

SEQ ID NO: 380556 - DNA, 15 bp, Homo sapiens
gatgtatattaaaat

SEQ ID NO: 380557 - DNA, 15 bp, Homo sapiens
atgtatattaaaatt

SEQ ID NO: 380558 - DNA, 15 bp, Homo sapiens
tgtatattaaaattc

SEQ ID NO: 380559 - DNA, 15 bp, Homo sapiens
gtatattaaaattcc

SEQ ID NO: 380560 - DNA, 15 bp, Homo sapiens
tatattaaaattcct

SEQ ID NO: 380561 - DNA, 15 bp, Homo sapiens
atattaaaattcctt

SEQ ID NO: 380562 - DNA, 15 bp, Homo sapiens
tattaaaattccttc

SEQ ID NO: 380563 - DNA, 15 bp, Homo sapiens
attaaaattccttca

SEQ ID NO: 380564 - DNA, 15 bp, Homo sapiens
ttaaaattccttcaa

SEQ ID NO: 380565 - DNA, 15 bp, Homo sapiens
taaaattccttcaaa

SEQ ID NO: 380566 - DNA, 15 bp, Homo sapiens
aaaattccttcaaaa

SEQ ID NO: 380567 - DNA, 15 bp, Homo sapiens
aaattccttcaaaat

SEQ ID NO: 380568 - DNA, 15 bp, Homo sapiens
aattccttcaaaatg

SEQ ID NO: 380569 - DNA, 15 bp, Homo sapiens
attccttcaaaatgt

SEQ ID NO: 380570 - DNA, 15 bp, Homo sapiens
ttccttcaaaatgtg

SEQ ID NO: 380571 - DNA, 15 bp, Homo sapiens
tccttcaaaatgtgt

SEQ ID NO: 380572 - DNA, 15 bp, Homo sapiens
ccttcaaaatgtgtt

SEQ ID NO: 380573 - DNA, 15 bp, Homo sapiens
cttcaaaatgtgttt

SEQ ID NO: 380574 - DNA, 15 bp, Homo sapiens
ttcaaaatgtgttta

SEQ ID NO: 380575 - DNA, 15 bp, Homo sapiens
tcaaaatgtgtttat

SEQ ID NO: 380576 - DNA, 15 bp, Homo sapiens
caaaatgtgtttatc

SEQ ID NO: 380577 - DNA, 15 bp, Homo sapiens
aaaatgtgtttatca

SEQ ID NO: 380578 - DNA, 15 bp, Homo sapiens
aaatgtgtttatcag

SEQ ID NO: 380579 - DNA, 15 bp, Homo sapiens
aatgtgtttatcagc

SEQ ID NO: 380580 - DNA, 15 bp, Homo sapiens
atgtgtttatcagct

SEQ ID NO: 380581 - DNA, 15 bp, Homo sapiens
tgtgtttatcagctt

SEQ ID NO: 380582 - DNA, 15 bp, Homo sapiens
gtgtttatcagcttg

SEQ ID NO: 380583 - DNA, 15 bp, Homo sapiens
tgtttatcagcttgc

SEQ ID NO: 380584 - DNA, 15 bp, Homo sapiens
gtttatcagcttgcc

SEQ ID NO: 380585 - DNA, 15 bp, Homo sapiens
tttatcagcttgcct

SEQ ID NO: 380586 - DNA, 15 bp, Homo sapiens
ttatcagcttgcctt

SEQ ID NO: 380587 - DNA, 15 bp, Homo sapiens
tatcagcttgccttc

SEQ ID NO: 380588 - DNA, 15 bp, Homo sapiens
atcagcttgccttct

SEQ ID NO: 380589 - DNA, 15 bp, Homo sapiens
tcagcttgccttctt

SEQ ID NO: 380590 - DNA, 15 bp, Homo sapiens
cagcttgccttcttc

SEQ ID NO: 380591 - DNA, 15 bp, Homo sapiens
agcttgccttcttct

SEQ ID NO: 380592 - DNA, 15 bp, Homo sapiens
gcttgccttcttctg

SEQ ID NO: 380593 - DNA, 15 bp, Homo sapiens
cttgccttcttctgt

SEQ ID NO: 380594 - DNA, 15 bp, Homo sapiens
ttgccttcttctgtt

SEQ ID NO: 380595 - DNA, 15 bp, Homo sapiens
tgccttcttctgttt

SEQ ID NO: 380596 - DNA, 15 bp, Homo sapiens
gccttcttctgttta

SEQ ID NO: 380597 - DNA, 15 bp, Homo sapiens
ccttcttctgtttat

SEQ ID NO: 380598 - DNA, 15 bp, Homo sapiens
cttcttctgtttata

SEQ ID NO: 380599 - DNA, 15 bp, Homo sapiens
ttcttctgtttatag

SEQ ID NO: 380600 - DNA, 15 bp, Homo sapiens
tcttctgtttataga

SEQ ID NO: 380601 - DNA, 15 bp, Homo sapiens
cttctgtttatagac

SEQ ID NO: 380602 - DNA, 15 bp, Homo sapiens
ttctgtttatagact

SEQ ID NO: 380603 - DNA, 15 bp, Homo sapiens
tctgtttatagactt

SEQ ID NO: 380604 - DNA, 15 bp, Homo sapiens
ctgtttatagactta

SEQ ID NO: 380605 - DNA, 15 bp, Homo sapiens
tgtttatagacttat

SEQ ID NO: 380606 - DNA, 15 bp, Homo sapiens
gtttatagacttatt

SEQ ID NO: 380607 - DNA, 15 bp, Homo sapiens
tttatagacttattt

SEQ ID NO: 380608 - DNA, 15 bp, Homo sapiens
ttatagacttatttg

SEQ ID NO: 380609 - DNA, 15 bp, Homo sapiens
tatagacttatttgt

SEQ ID NO: 380610 - DNA, 15 bp, Homo sapiens
atagacttatttgtg

SEQ ID NO: 380611 - DNA, 15 bp, Homo sapiens
tagacttatttgtga

SEQ ID NO: 380612 - DNA, 15 bp, Homo sapiens
agacttatttgtgat

SEQ ID NO: 380613 - DNA, 15 bp, Homo sapiens
gacttatttgtgata

SEQ ID NO: 380614 - DNA, 15 bp, Homo sapiens
acttatttgtgatac

SEQ ID NO: 380615 - DNA, 15 bp, Homo sapiens
cttatttgtgataca

SEQ ID NO: 380616 - DNA, 15 bp, Homo sapiens
ttatttgtgatacat

SEQ ID NO: 380617 - DNA, 15 bp, Homo sapiens
tatttgtgatacatt

SEQ ID NO: 380618 - DNA, 15 bp, Homo sapiens
atttgtgatacattt

SEQ ID NO: 380619 - DNA, 15 bp, Homo sapiens
tttgtgatacatttg

SEQ ID NO: 380620 - DNA, 15 bp, Homo sapiens
ttgtgatacatttga

SEQ ID NO: 380621 - DNA, 15 bp, Homo sapiens
tgtgatacatttgat

SEQ ID NO: 380622 - DNA, 15 bp, Homo sapiens
gtgatacatttgata

SEQ ID NO: 380623 - DNA, 15 bp, Homo sapiens
tgatacatttgatat

SEQ ID NO: 380624 - DNA, 15 bp, Homo sapiens
gatacatttgatata

SEQ ID NO: 380625 - DNA, 15 bp, Homo sapiens
atacatttgatatat

SEQ ID NO: 380626 - DNA, 15 bp, Homo sapiens
tacatttgatatatg

SEQ ID NO: 380627 - DNA, 15 bp, Homo sapiens
acatttgatatatga

SEQ ID NO: 380628 - DNA, 15 bp, Homo sapiens
catttgatatatgat

SEQ ID NO: 380629 - DNA, 15 bp, Homo sapiens
atttgatatatgata

SEQ ID NO: 380630 - DNA, 15 bp, Homo sapiens
tttgatatatgatat

SEQ ID NO: 380631 - DNA, 15 bp, Homo sapiens
ttgatatatgatatt

SEQ ID NO: 380632 - DNA, 15 bp, Homo sapiens
tgatatatgatattt

SEQ ID NO: 380633 - DNA, 15 bp, Homo sapiens
gatatatgatatttt

SEQ ID NO: 380634 - DNA, 15 bp, Homo sapiens
atatatgatattttt

SEQ ID NO: 380635 - DNA, 15 bp, Homo sapiens
tatatgatatttttt

SEQ ID NO: 380636 - DNA, 15 bp, Homo sapiens
atatgatattttttc

SEQ ID NO: 380637 - DNA, 15 bp, Homo sapiens
tatgatattttttct

SEQ ID NO: 380638 - DNA, 15 bp, Homo sapiens
atgatattttttctt

SEQ ID NO: 380639 - DNA, 15 bp, Homo sapiens
tgatattttttcttt

SEQ ID NO: 380640 - DNA, 15 bp, Homo sapiens
gatattttttctttc

SEQ ID NO: 380641 - DNA, 15 bp, Homo sapiens
atattttttctttct

SEQ ID NO: 380642 - DNA, 15 bp, Homo sapiens
tattttttctttctc

SEQ ID NO: 380643 - DNA, 15 bp, Homo sapiens
attttttctttctcc

SEQ ID NO: 380644 - DNA, 15 bp, Homo sapiens
ttttttctttctcct

SEQ ID NO: 380645 - DNA, 15 bp, Homo sapiens
tttttctttctcctg

SEQ ID NO: 380646 - DNA, 15 bp, Homo sapiens
ttttctttctcctga

SEQ ID NO: 380647 - DNA, 15 bp, Homo sapiens
tttctttctcctgag

SEQ ID NO: 380648 - DNA, 15 bp, Homo sapiens
ttctttctcctgagg

SEQ ID NO: 380649 - DNA, 15 bp, Homo sapiens
tctttctcctgaggg

SEQ ID NO: 380650 - DNA, 15 bp, Homo sapiens
ctttctcctgagggt

SEQ ID NO: 380651 - DNA, 15 bp, Homo sapiens
tttctcctgagggtt

SEQ ID NO: 380652 - DNA, 15 bp, Homo sapiens
ttctcctgagggtta

SEQ ID NO: 380653 - DNA, 15 bp, Homo sapiens
tctcctgagggttac

SEQ ID NO: 380654 - DNA, 15 bp, Homo sapiens
ctcctgagggttaca

SEQ ID NO: 380655 - DNA, 15 bp, Homo sapiens
tcctgagggttacat

SEQ ID NO: 380656 - DNA, 15 bp, Homo sapiens
cctgagggttacatg

SEQ ID NO: 380657 - DNA, 15 bp, Homo sapiens
ctgagggttacatgt

SEQ ID NO: 380658 - DNA, 15 bp, Homo sapiens
tgagggttacatgtt

SEQ ID NO: 380659 - DNA, 15 bp, Homo sapiens
gagggttacatgttg

SEQ ID NO: 380660 - DNA, 15 bp, Homo sapiens
agggttacatgttgg

SEQ ID NO: 380661 - DNA, 15 bp, Homo sapiens
gggttacatgttggg

SEQ ID NO: 380662 - DNA, 15 bp, Homo sapiens
ggttacatgttggga

SEQ ID NO: 380663 - DNA, 15 bp, Homo sapiens
gttacatgttgggat

SEQ ID NO: 380664 - DNA, 15 bp, Homo sapiens
ttacatgttgggatt

SEQ ID NO: 380665 - DNA, 15 bp, Homo sapiens
tacatgttgggattt

SEQ ID NO: 380666 - DNA, 15 bp, Homo sapiens
acatgttgggatttt

SEQ ID NO: 380667 - DNA, 15 bp, Homo sapiens
catgttgggattttt

SEQ ID NO: 380668 - DNA, 15 bp, Homo sapiens
atgttgggatttttt

SEQ ID NO: 380669 - DNA, 15 bp, Homo sapiens
tgttgggattttttt

SEQ ID NO: 380670 - DNA, 15 bp, Homo sapiens
gttgggatttttttt

SEQ ID NO: 380671 - DNA, 15 bp, Homo sapiens
ttgggattttttttt

SEQ ID NO: 380672 - DNA, 15 bp, Homo sapiens
tgggatttttttttc

SEQ ID NO: 380673 - DNA, 15 bp, Homo sapiens
gggatttttttttct

SEQ ID NO: 380674 - DNA, 15 bp, Homo sapiens
ggatttttttttctt

SEQ ID NO: 380675 - DNA, 15 bp, Homo sapiens
gatttttttttcttt

SEQ ID NO: 380676 - DNA, 15 bp, Homo sapiens
ttttttttcttttat

SEQ ID NO: 380677 - DNA, 15 bp, Homo sapiens
tttttttcttttata

SEQ ID NO: 380678 - DNA, 15 bp, Homo sapiens
ttttttcttttataa

SEQ ID NO: 380679 - DNA, 15 bp, Homo sapiens
tttttcttttataat

SEQ ID NO: 380680 - DNA, 15 bp, Homo sapiens
ttttcttttataatg

SEQ ID NO: 380681 - DNA, 15 bp, Homo sapiens
tttcttttataatgc

SEQ ID NO: 380682 - DNA, 15 bp, Homo sapiens
ttcttttataatgct

SEQ ID NO: 380683 - DNA, 15 bp, Homo sapiens
tcttttataatgcta

SEQ ID NO: 380684 - DNA, 15 bp, Homo sapiens
cttttataatgctac

SEQ ID NO: 380685 - DNA, 15 bp, Homo sapiens
ttttataatgctacc

SEQ ID NO: 380686 - DNA, 15 bp, Homo sapiens
tttataatgctaccc

SEQ ID NO: 380687 - DNA, 15 bp, Homo sapiens
ttataatgctaccct

SEQ ID NO: 380688 - DNA, 15 bp, Homo sapiens
tataatgctaccctc

SEQ ID NO: 380689 - DNA, 15 bp, Homo sapiens
ataatgctaccctca

SEQ ID NO: 380690 - DNA, 15 bp, Homo sapiens
taatgctaccctcag

SEQ ID NO: 380691 - DNA, 15 bp, Homo sapiens
aatgctaccctcagt

SEQ ID NO: 380692 - DNA, 15 bp, Homo sapiens
atgctaccctcagtg

SEQ ID NO: 380693 - DNA, 15 bp, Homo sapiens
tgctaccctcagtgg

SEQ ID NO: 380694 - DNA, 15 bp, Homo sapiens
gctaccctcagtgga

SEQ ID NO: 380695 - DNA, 15 bp, Homo sapiens
ctaccctcagtggaa

SEQ ID NO: 380696 - DNA, 15 bp, Homo sapiens
taccctcagtggaaa

SEQ ID NO: 380697 - DNA, 15 bp, Homo sapiens
accctcagtggaaag

SEQ ID NO: 380698 - DNA, 15 bp, Homo sapiens
ccctcagtggaaagg

SEQ ID NO: 380699 - DNA, 15 bp, Homo sapiens
cctcagtggaaaggg

SEQ ID NO: 380700 - DNA, 15 bp, Homo sapiens
ctcagtggaaagggt

SEQ ID NO: 380701 - DNA, 15 bp, Homo sapiens
tcagtggaaagggtc

SEQ ID NO: 380702 - DNA, 15 bp, Homo sapiens
cagtggaaagggtca

SEQ ID NO: 380703 - DNA, 15 bp, Homo sapiens
agtggaaagggtcaa

SEQ ID NO: 380704 - DNA, 15 bp, Homo sapiens
gtggaaagggtcaag

SEQ ID NO: 380705 - DNA, 15 bp, Homo sapiens
tggaaagggtcaaga

SEQ ID NO: 380706 - DNA, 15 bp, Homo sapiens
ggaaagggtcaagaa

SEQ ID NO: 380707 - DNA, 15 bp, Homo sapiens
gaaagggtcaagaac

SEQ ID NO: 380708 - DNA, 15 bp, Homo sapiens
aaagggtcaagaacc

SEQ ID NO: 380709 - DNA, 15 bp, Homo sapiens
aagggtcaagaacca

SEQ ID NO: 380710 - DNA, 15 bp, Homo sapiens
agggtcaagaaccag

SEQ ID NO: 380711 - DNA, 15 bp, Homo sapiens
gggtcaagaaccagt

SEQ ID NO: 380712 - DNA, 15 bp, Homo sapiens
ggtcaagaaccagtg

SEQ ID NO: 380713 - DNA, 15 bp, Homo sapiens
gtcaagaaccagtgg

SEQ ID NO: 380714 - DNA, 15 bp, Homo sapiens
tcaagaaccagtggg

SEQ ID NO: 380715 - DNA, 15 bp, Homo sapiens
caagaaccagtggga

SEQ ID NO: 380716 - DNA, 15 bp, Homo sapiens
aagaaccagtgggat

SEQ ID NO: 380717 - DNA, 15 bp, Homo sapiens
agaaccagtgggatg

SEQ ID NO: 380718 - DNA, 15 bp, Homo sapiens
gaaccagtgggatgg

SEQ ID NO: 380719 - DNA, 15 bp, Homo sapiens
aaccagtgggatggc

SEQ ID NO: 380720 - DNA, 15 bp, Homo sapiens
accagtgggatggca

SEQ ID NO: 380721 - DNA, 15 bp, Homo sapiens
ccagtgggatggcac

SEQ ID NO: 380722 - DNA, 15 bp, Homo sapiens
cagtgggatggcacc

SEQ ID NO: 380723 - DNA, 15 bp, Homo sapiens
agtgggatggcaccc

SEQ ID NO: 380724 - DNA, 15 bp, Homo sapiens
gtgggatggcaccca

SEQ ID NO: 380725 - DNA, 15 bp, Homo sapiens
tgggatggcacccag

SEQ ID NO: 380726 - DNA, 15 bp, Homo sapiens
gggatggcacccagc

SEQ ID NO: 380727 - DNA, 15 bp, Homo sapiens
ggatggcacccagca

SEQ ID NO: 380728 - DNA, 15 bp, Homo sapiens
gatggcacccagcat

SEQ ID NO: 380729 - DNA, 15 bp, Homo sapiens
atggcacccagcatg

SEQ ID NO: 380730 - DNA, 15 bp, Homo sapiens
tggcacccagcatgg

SEQ ID NO: 380731 - DNA, 15 bp, Homo sapiens
ggcacccagcatggc

SEQ ID NO: 380732 - DNA, 15 bp, Homo sapiens
gcacccagcatggcg

SEQ ID NO: 380733 - DNA, 15 bp, Homo sapiens
cacccagcatggcgt

SEQ ID NO: 380734 - DNA, 15 bp, Homo sapiens
acccagcatggcgtt

SEQ ID NO: 380735 - DNA, 15 bp, Homo sapiens
cccagcatggcgttg

SEQ ID NO: 380736 - DNA, 15 bp, Homo sapiens
ccagcatggcgttga

SEQ ID NO: 380737 - DNA, 15 bp, Homo sapiens
cagcatggcgttgag

SEQ ID NO: 380738 - DNA, 15 bp, Homo sapiens
agcatggcgttgagc

SEQ ID NO: 380739 - DNA, 15 bp, Homo sapiens
gcatggcgttgagct

SEQ ID NO: 380740 - DNA, 15 bp, Homo sapiens
catggcgttgagcta

SEQ ID NO: 380741 - DNA, 15 bp, Homo sapiens
atggcgttgagctaa

SEQ ID NO: 380742 - DNA, 15 bp, Homo sapiens
tggcgttgagctaag

SEQ ID NO: 380743 - DNA, 15 bp, Homo sapiens
ggcgttgagctaaga

SEQ ID NO: 380744 - DNA, 15 bp, Homo sapiens
gcgttgagctaagac

SEQ ID NO: 380745 - DNA, 15 bp, Homo sapiens
cgttgagctaagaca

SEQ ID NO: 380746 - DNA, 15 bp, Homo sapiens
gttgagctaagacag

SEQ ID NO: 380747 - DNA, 15 bp, Homo sapiens
ttgagctaagacagc

SEQ ID NO: 380748 - DNA, 15 bp, Homo sapiens
tgagctaagacagca

SEQ ID NO: 380749 - DNA, 15 bp, Homo sapiens
gagctaagacagcag

SEQ ID NO: 380750 - DNA, 15 bp, Homo sapiens
agctaagacagcagc

SEQ ID NO: 380751 - DNA, 15 bp, Homo sapiens
gctaagacagcagca

SEQ ID NO: 380752 - DNA, 15 bp, Homo sapiens
ctaagacagcagcag

SEQ ID NO: 380753 - DNA, 15 bp, Homo sapiens
taagacagcagcagc

SEQ ID NO: 380754 - DNA, 15 bp, Homo sapiens
aagacagcagcagct

SEQ ID NO: 380755 - DNA, 15 bp, Homo sapiens
agacagcagcagctt

SEQ ID NO: 380756 - DNA, 15 bp, Homo sapiens
gacagcagcagcttg

SEQ ID NO: 380757 - DNA, 15 bp, Homo sapiens
acagcagcagcttga

SEQ ID NO: 380758 - DNA, 15 bp, Homo sapiens
cagcagcagcttgag

SEQ ID NO: 380759 - DNA, 15 bp, Homo sapiens
agcagcagcttgagg

SEQ ID NO: 380760 - DNA, 15 bp, Homo sapiens
gcagcagcttgagga

SEQ ID NO: 380761 - DNA, 15 bp, Homo sapiens
cagcagcttgaggac

SEQ ID NO: 380762 - DNA, 15 bp, Homo sapiens
agcagcttgaggaca

SEQ ID NO: 380763 - DNA, 15 bp, Homo sapiens
gcagcttgaggacat

SEQ ID NO: 380764 - DNA, 15 bp, Homo sapiens
cagcttgaggacatg

SEQ ID NO: 380765 - DNA, 15 bp, Homo sapiens
agcttgaggacatga

SEQ ID NO: 380766 - DNA, 15 bp, Homo sapiens
gcttgaggacatgat

SEQ ID NO: 380767 - DNA, 15 bp, Homo sapiens
cttgaggacatgatt

SEQ ID NO: 380768 - DNA, 15 bp, Homo sapiens
ttgaggacatgatta

SEQ ID NO: 380769 - DNA, 15 bp, Homo sapiens
tgaggacatgattat

SEQ ID NO: 380770 - DNA, 15 bp, Homo sapiens
gaggacatgattatt

SEQ ID NO: 380771 - DNA, 15 bp, Homo sapiens
aggacatgattattg

SEQ ID NO: 380772 - DNA, 15 bp, Homo sapiens
ggacatgattattga

SEQ ID NO: 380773 - DNA, 15 bp, Homo sapiens
gacatgattattgac

SEQ ID NO: 380774 - DNA, 15 bp, Homo sapiens
acatgattattgaca

SEQ ID NO: 380775 - DNA, 15 bp, Homo sapiens
catgattattgacag

SEQ ID NO: 380776 - DNA, 15 bp, Homo sapiens
atgattattgacagt

SEQ ID NO: 380777 - DNA, 15 bp, Homo sapiens
tgattattgacagtc

SEQ ID NO: 380778 - DNA, 15 bp, Homo sapiens
gattattgacagtct

SEQ ID NO: 380779 - DNA, 15 bp, Homo sapiens
attattgacagtctt

SEQ ID NO: 380780 - DNA, 15 bp, Homo sapiens
ttattgacagtcttc

SEQ ID NO: 380781 - DNA, 15 bp, Homo sapiens
tattgacagtcttca

SEQ ID NO: 380782 - DNA, 15 bp, Homo sapiens
attgacagtcttcag

SEQ ID NO: 380783 - DNA, 15 bp, Homo sapiens
ttgacagtcttcagt

SEQ ID NO: 380784 - DNA, 15 bp, Homo sapiens
tgacagtcttcagtg

SEQ ID NO: 380785 - DNA, 15 bp, Homo sapiens
gacagtcttcagtgg

SEQ ID NO: 380786 - DNA, 15 bp, Homo sapiens
acagtcttcagtggg

SEQ ID NO: 380787 - DNA, 15 bp, Homo sapiens
cagtcttcagtggga

SEQ ID NO: 380788 - DNA, 15 bp, Homo sapiens
agtcttcagtgggat

SEQ ID NO: 380789 - DNA, 15 bp, Homo sapiens
gtcttcagtgggatg

SEQ ID NO: 380790 - DNA, 15 bp, Homo sapiens
tcttcagtgggatga

SEQ ID NO: 380791 - DNA, 15 bp, Homo sapiens
cttcagtgggatgac

SEQ ID NO: 380792 - DNA, 15 bp, Homo sapiens
ttcagtgggatgacc

SEQ ID NO: 380793 - DNA, 15 bp, Homo sapiens
tcagtgggatgacca

SEQ ID NO: 380794 - DNA, 15 bp, Homo sapiens
cagtgggatgaccat

SEQ ID NO: 380795 - DNA, 15 bp, Homo sapiens
agtgggatgaccata

SEQ ID NO: 380796 - DNA, 15 bp, Homo sapiens
gtgggatgaccatag

SEQ ID NO: 380797 - DNA, 15 bp, Homo sapiens
tgggatgaccatagg

SEQ ID NO: 380798 - DNA, 15 bp, Homo sapiens
gggatgaccataggg

SEQ ID NO: 380799 - DNA, 15 bp, Homo sapiens
ggatgaccataggga

SEQ ID NO: 380800 - DNA, 15 bp, Homo sapiens
gatgaccatagggag

SEQ ID NO: 380801 - DNA, 15 bp, Homo sapiens
atgaccatagggagg

SEQ ID NO: 380802 - DNA, 15 bp, Homo sapiens
tgaccatagggagga

SEQ ID NO: 380803 - DNA, 15 bp, Homo sapiens
gaccatagggaggag

SEQ ID NO: 380804 - DNA, 15 bp, Homo sapiens
accatagggaggaga

SEQ ID NO: 380805 - DNA, 15 bp, Homo sapiens
ccatagggaggagac

SEQ ID NO: 380806 - DNA, 15 bp, Homo sapiens
catagggaggagact

SEQ ID NO: 380807 - DNA, 15 bp, Homo sapiens
atagggaggagactg

SEQ ID NO: 380808 - DNA, 15 bp, Homo sapiens
tagggaggagactga

SEQ ID NO: 380809 - DNA, 15 bp, Homo sapiens
agggaggagactgaa

SEQ ID NO: 380810 - DNA, 15 bp, Homo sapiens
gggaggagactgaag

SEQ ID NO: 380811 - DNA, 15 bp, Homo sapiens
ggaggagactgaaga

SEQ ID NO: 380812 - DNA, 15 bp, Homo sapiens
gaggagactgaagaa

SEQ ID NO: 380813 - DNA, 15 bp, Homo sapiens
aggagactgaagaac

SEQ ID NO: 380814 - DNA, 15 bp, Homo sapiens
ggagactgaagaact

SEQ ID NO: 380815 - DNA, 15 bp, Homo sapiens
gagactgaagaactg

SEQ ID NO: 380816 - DNA, 15 bp, Homo sapiens
agactgaagaactga

SEQ ID NO: 380817 - DNA, 15 bp, Homo sapiens
gactgaagaactgat

SEQ ID NO: 380818 - DNA, 15 bp, Homo sapiens
actgaagaactgatg

SEQ ID NO: 380819 - DNA, 15 bp, Homo sapiens
ctgaagaactgatga

SEQ ID NO: 380820 - DNA, 15 bp, Homo sapiens
tgaagaactgatgag

SEQ ID NO: 380821 - DNA, 15 bp, Homo sapiens
gaagaactgatgaga

SEQ ID NO: 380822 - DNA, 15 bp, Homo sapiens
aagaactgatgagaa

SEQ ID NO: 380823 - DNA, 15 bp, Homo sapiens
agaactgatgagaaa

SEQ ID NO: 380824 - DNA, 15 bp, Homo sapiens
gaactgatgagaaaa

SEQ ID NO: 380825 - DNA, 15 bp, Homo sapiens
aactgatgagaaaat

SEQ ID NO: 380826 - DNA, 15 bp, Homo sapiens
actgatgagaaaata

SEQ ID NO: 380827 - DNA, 15 bp, Homo sapiens
ctgatgagaaaatat

SEQ ID NO: 380828 - DNA, 15 bp, Homo sapiens
tgatgagaaaatatg

SEQ ID NO: 380829 - DNA, 15 bp, Homo sapiens
gatgagaaaatatga

SEQ ID NO: 380830 - DNA, 15 bp, Homo sapiens
atgagaaaatatgag

SEQ ID NO: 380831 - DNA, 15 bp, Homo sapiens
tgagaaaatatgagg

SEQ ID NO: 380832 - DNA, 15 bp, Homo sapiens
gagaaaatatgaggc

SEQ ID NO: 380833 - DNA, 15 bp, Homo sapiens
agaaaatatgaggct

SEQ ID NO: 380834 - DNA, 15 bp, Homo sapiens
gaaaatatgaggctc

SEQ ID NO: 380835 - DNA, 15 bp, Homo sapiens
aaaatatgaggctcg

SEQ ID NO: 380836 - DNA, 15 bp, Homo sapiens
aaatatgaggctcga

SEQ ID NO: 380837 - DNA, 15 bp, Homo sapiens
aatatgaggctcgac

SEQ ID NO: 380838 - DNA, 15 bp, Homo sapiens
atatgaggctcgact

SEQ ID NO: 380839 - DNA, 15 bp, Homo sapiens
tatgaggctcgactc

SEQ ID NO: 380840 - DNA, 15 bp, Homo sapiens
atgaggctcgactct

SEQ ID NO: 380841 - DNA, 15 bp, Homo sapiens
tgaggctcgactcta

SEQ ID NO: 380842 - DNA, 15 bp, Homo sapiens
gaggctcgactctat

SEQ ID NO: 380843 - DNA, 15 bp, Homo sapiens
aggctcgactctata

SEQ ID NO: 380844 - DNA, 15 bp, Homo sapiens
ggctcgactctatat

SEQ ID NO: 380845 - DNA, 15 bp, Homo sapiens
gctcgactctatatt

SEQ ID NO: 380846 - DNA, 15 bp, Homo sapiens
ctcgactctatattc

SEQ ID NO: 380847 - DNA, 15 bp, Homo sapiens
tcgactctatattct

SEQ ID NO: 380848 - DNA, 15 bp, Homo sapiens
cgactctatattctt

SEQ ID NO: 380849 - DNA, 15 bp, Homo sapiens
gactctatattcttc

SEQ ID NO: 380850 - DNA, 15 bp, Homo sapiens
actctatattcttca

SEQ ID NO: 380851 - DNA, 15 bp, Homo sapiens
ctctatattcttcag

SEQ ID NO: 380852 - DNA, 15 bp, Homo sapiens
tctatattcttcagc

SEQ ID NO: 380853 - DNA, 15 bp, Homo sapiens
ctatattcttcagca

SEQ ID NO: 380854 - DNA, 15 bp, Homo sapiens
tatattcttcagcaa

SEQ ID NO: 380855 - DNA, 15 bp, Homo sapiens
atattcttcagcaag

SEQ ID NO: 380856 - DNA, 15 bp, Homo sapiens
tattcttcagcaagc

SEQ ID NO: 380857 - DNA, 15 bp, Homo sapiens
attcttcagcaagcc

SEQ ID NO: 380858 - DNA, 15 bp, Homo sapiens
ttcttcagcaagccc

SEQ ID NO: 380859 - DNA, 15 bp, Homo sapiens
tcttcagcaagcccg

SEQ ID NO: 380860 - DNA, 15 bp, Homo sapiens
cttcagcaagcccga

SEQ ID NO: 380861 - DNA, 15 bp, Homo sapiens
ttcagcaagcccgac

SEQ ID NO: 380862 - DNA, 15 bp, Homo sapiens
tcagcaagcccgacg

SEQ ID NO: 380863 - DNA, 15 bp, Homo sapiens
cagcaagcccgacgg

SEQ ID NO: 380864 - DNA, 15 bp, Homo sapiens
agcaagcccgacggg

SEQ ID NO: 380865 - DNA, 15 bp, Homo sapiens
gcaagcccgacggga

SEQ ID NO: 380866 - DNA, 15 bp, Homo sapiens
caagcccgacgggat

SEQ ID NO: 380867 - DNA, 15 bp, Homo sapiens
aagcccgacgggatc

SEQ ID NO: 380868 - DNA, 15 bp, Homo sapiens
agcccgacgggatcc

SEQ ID NO: 380869 - DNA, 15 bp, Homo sapiens
gcccgacgggatcca

SEQ ID NO: 380870 - DNA, 15 bp, Homo sapiens
cccgacgggatccac

SEQ ID NO: 380871 - DNA, 15 bp, Homo sapiens
ccgacgggatccact

SEQ ID NO: 380872 - DNA, 15 bp, Homo sapiens
cgacgggatccactc

SEQ ID NO: 380873 - DNA, 15 bp, Homo sapiens
gacgggatccactca

SEQ ID NO: 380874 - DNA, 15 bp, Homo sapiens
acgggatccactcac

SEQ ID NO: 380875 - DNA, 15 bp, Homo sapiens
cgggatccactcacc

SEQ ID NO: 380876 - DNA, 15 bp, Homo sapiens
gggatccactcacca

SEQ ID NO: 380877 - DNA, 15 bp, Homo sapiens
ggatccactcaccaa

SEQ ID NO: 380878 - DNA, 15 bp, Homo sapiens
gatccactcaccaaa

SEQ ID NO: 380879 - DNA, 15 bp, Homo sapiens
atccactcaccaaac

SEQ ID NO: 380880 - DNA, 15 bp, Homo sapiens
tccactcaccaaaca

SEQ ID NO: 380881 - DNA, 15 bp, Homo sapiens
ccactcaccaaacaa

SEQ ID NO: 380882 - DNA, 15 bp, Homo sapiens
cactcaccaaacaaa

SEQ ID NO: 380883 - DNA, 15 bp, Homo sapiens
actcaccaaacaaat

SEQ ID NO: 380884 - DNA, 15 bp, Homo sapiens
ctcaccaaacaaatt

SEQ ID NO: 380885 - DNA, 15 bp, Homo sapiens
tcaccaaacaaattt

SEQ ID NO: 380886 - DNA, 15 bp, Homo sapiens
caccaaacaaatttc

SEQ ID NO: 380887 - DNA, 15 bp, Homo sapiens
accaaacaaatttct

SEQ ID NO: 380888 - DNA, 15 bp, Homo sapiens
ccaaacaaatttctg

SEQ ID NO: 380889 - DNA, 15 bp, Homo sapiens
caaacaaatttctga

SEQ ID NO: 380890 - DNA, 15 bp, Homo sapiens
aaacaaatttctgat

SEQ ID NO: 380891 - DNA, 15 bp, Homo sapiens
aacaaatttctgata

SEQ ID NO: 380892 - DNA, 15 bp, Homo sapiens
acaaatttctgataa

SEQ ID NO: 380893 - DNA, 15 bp, Homo sapiens
caaatttctgataac

SEQ ID NO: 380894 - DNA, 15 bp, Homo sapiens
aaatttctgataacc

SEQ ID NO: 380895 - DNA, 15 bp, Homo sapiens
aatttctgataacca

SEQ ID NO: 380896 - DNA, 15 bp, Homo sapiens
atttctgataaccaa

SEQ ID NO: 380897 - DNA, 15 bp, Homo sapiens
tttctgataaccaag

SEQ ID NO: 380898 - DNA, 15 bp, Homo sapiens
ttctgataaccaagt

SEQ ID NO: 380899 - DNA, 15 bp, Homo sapiens
tctgataaccaagta

SEQ ID NO: 380900 - DNA, 15 bp, Homo sapiens
ctgataaccaagtaa

SEQ ID NO: 380901 - DNA, 15 bp, Homo sapiens
tgataaccaagtaag

SEQ ID NO: 380902 - DNA, 15 bp, Homo sapiens
gataaccaagtaaga

SEQ ID NO: 380903 - DNA, 15 bp, Homo sapiens
ataaccaagtaagac

SEQ ID NO: 380904 - DNA, 15 bp, Homo sapiens
taaccaagtaagact

SEQ ID NO: 380905 - DNA, 15 bp, Homo sapiens
aaccaagtaagactc

SEQ ID NO: 380906 - DNA, 15 bp, Homo sapiens
accaagtaagactca

SEQ ID NO: 380907 - DNA, 15 bp, Homo sapiens
ccaagtaagactcat

SEQ ID NO: 380908 - DNA, 15 bp, Homo sapiens
caagtaagactcatc

SEQ ID NO: 380909 - DNA, 15 bp, Homo sapiens
aagtaagactcatca

SEQ ID NO: 380910 - DNA, 15 bp, Homo sapiens
agtaagactcatcag

SEQ ID NO: 380911 - DNA, 15 bp, Homo sapiens
gtaagactcatcaga

SEQ ID NO: 380912 - DNA, 15 bp, Homo sapiens
taagactcatcagat

SEQ ID NO: 380913 - DNA, 15 bp, Homo sapiens
aagactcatcagata

SEQ ID NO: 380914 - DNA, 15 bp, Homo sapiens
agactcatcagatat

SEQ ID NO: 380915 - DNA, 15 bp, Homo sapiens
gactcatcagatatt

SEQ ID NO: 380916 - DNA, 15 bp, Homo sapiens
actcatcagatattt

SEQ ID NO: 380917 - DNA, 15 bp, Homo sapiens
ctcatcagatatttt

SEQ ID NO: 380918 - DNA, 15 bp, Homo sapiens
tcatcagatattttt

SEQ ID NO: 380919 - DNA, 15 bp, Homo sapiens
catcagatatttttt

SEQ ID NO: 380920 - DNA, 15 bp, Homo sapiens
atcagatattttttg

SEQ ID NO: 380921 - DNA, 15 bp, Homo sapiens
tcagatattttttgg

SEQ ID NO: 380922 - DNA, 15 bp, Homo sapiens
cagatattttttggc

SEQ ID NO: 380923 - DNA, 15 bp, Homo sapiens
agatattttttggca

SEQ ID NO: 380924 - DNA, 15 bp, Homo sapiens
gatattttttggcag

SEQ ID NO: 380925 - DNA, 15 bp, Homo sapiens
atattttttggcagt

SEQ ID NO: 380926 - DNA, 15 bp, Homo sapiens
tattttttggcagta

SEQ ID NO: 380927 - DNA, 15 bp, Homo sapiens
attttttggcagtat

SEQ ID NO: 380928 - DNA, 15 bp, Homo sapiens
ttttttggcagtatt

SEQ ID NO: 380929 - DNA, 15 bp, Homo sapiens
tttttggcagtattg

SEQ ID NO: 380930 - DNA, 15 bp, Homo sapiens
ttttggcagtattgt

SEQ ID NO: 380931 - DNA, 15 bp, Homo sapiens
tttggcagtattgtt

SEQ ID NO: 380932 - DNA, 15 bp, Homo sapiens
ttggcagtattgttt

SEQ ID NO: 380933 - DNA, 15 bp, Homo sapiens
tggcagtattgtttt

SEQ ID NO: 380934 - DNA, 15 bp, Homo sapiens
ggcagtattgttttg

SEQ ID NO: 380935 - DNA, 15 bp, Homo sapiens
gcagtattgttttgt

SEQ ID NO: 380936 - DNA, 15 bp, Homo sapiens
cagtattgttttgtt

SEQ ID NO: 380937 - DNA, 15 bp, Homo sapiens
agtattgttttgttg

SEQ ID NO: 380938 - DNA, 15 bp, Homo sapiens
gtattgttttgttgg

SEQ ID NO: 380939 - DNA, 15 bp, Homo sapiens
tattgttttgttgga

SEQ ID NO: 380940 - DNA, 15 bp, Homo sapiens
attgttttgttggat

SEQ ID NO: 380941 - DNA, 15 bp, Homo sapiens
ttgttttgttggata

SEQ ID NO: 380942 - DNA, 15 bp, Homo sapiens
tgttttgttggatat

SEQ ID NO: 380943 - DNA, 15 bp, Homo sapiens
gttttgttggatata

SEQ ID NO: 380944 - DNA, 15 bp, Homo sapiens
ttttgttggatatac

SEQ ID NO: 380945 - DNA, 15 bp, Homo sapiens
tttgttggatatact

SEQ ID NO: 380946 - DNA, 15 bp, Homo sapiens
ttgttggatatactt

SEQ ID NO: 380947 - DNA, 15 bp, Homo sapiens
tgttggatatacttt

SEQ ID NO: 380948 - DNA, 15 bp, Homo sapiens
gttggatatactttt

SEQ ID NO: 380949 - DNA, 15 bp, Homo sapiens
ttggatatacttttt

SEQ ID NO: 380950 - DNA, 15 bp, Homo sapiens
tggatatactttttt

SEQ ID NO: 380951 - DNA, 15 bp, Homo sapiens
ggatatacttttttt

SEQ ID NO: 380952 - DNA, 15 bp, Homo sapiens
gatatactttttttc

SEQ ID NO: 380953 - DNA, 15 bp, Homo sapiens
atatactttttttct

SEQ ID NO: 380954 - DNA, 15 bp, Homo sapiens
tatactttttttcta

SEQ ID NO: 380955 - DNA, 15 bp, Homo sapiens
atactttttttctat

SEQ ID NO: 380956 - DNA, 15 bp, Homo sapiens
tactttttttctatt

SEQ ID NO: 380957 - DNA, 15 bp, Homo sapiens
actttttttctattg

SEQ ID NO: 380958 - DNA, 15 bp, Homo sapiens
ctttttttctattgt

SEQ ID NO: 380959 - DNA, 15 bp, Homo sapiens
tttttttctattgtt

SEQ ID NO: 380960 - DNA, 15 bp, Homo sapiens
ttttttctattgttc

SEQ ID NO: 380961 - DNA, 15 bp, Homo sapiens
tttttctattgttca

SEQ ID NO: 380962 - DNA, 15 bp, Homo sapiens
ttttctattgttcac

SEQ ID NO: 380963 - DNA, 15 bp, Homo sapiens
tttctattgttcact

SEQ ID NO: 380964 - DNA, 15 bp, Homo sapiens
ttctattgttcactg

SEQ ID NO: 380965 - DNA, 15 bp, Homo sapiens
tctattgttcactgt

SEQ ID NO: 380966 - DNA, 15 bp, Homo sapiens
ctattgttcactgta

SEQ ID NO: 380967 - DNA, 15 bp, Homo sapiens
tattgttcactgtaa

SEQ ID NO: 380968 - DNA, 15 bp, Homo sapiens
attgttcactgtaat

SEQ ID NO: 380969 - DNA, 15 bp, Homo sapiens
ttgttcactgtaatt

SEQ ID NO: 380970 - DNA, 15 bp, Homo sapiens
tgttcactgtaattc

SEQ ID NO: 380971 - DNA, 15 bp, Homo sapiens
gttcactgtaattct

SEQ ID NO: 380972 - DNA, 15 bp, Homo sapiens
cactgtaattcttaa

SEQ ID NO: 380973 - DNA, 15 bp, Homo sapiens
actgtaattcttaac

SEQ ID NO: 380974 - DNA, 15 bp, Homo sapiens
ctgtaattcttaaca

SEQ ID NO: 380975 - DNA, 15 bp, Homo sapiens
tgtaattcttaacaa

SEQ ID NO: 380976 - DNA, 15 bp, Homo sapiens
gtaattcttaacaat

SEQ ID NO: 380977 - DNA, 15 bp, Homo sapiens
taattcttaacaata

SEQ ID NO: 380978 - DNA, 15 bp, Homo sapiens
aattcttaacaatag

SEQ ID NO: 380979 - DNA, 15 bp, Homo sapiens
attcttaacaatagg

SEQ ID NO: 380980 - DNA, 15 bp, Homo sapiens
ttcttaacaatagga

SEQ ID NO: 380981 - DNA, 15 bp, Homo sapiens
tcttaacaataggac

SEQ ID NO: 380982 - DNA, 15 bp, Homo sapiens
cttaacaataggacc

SEQ ID NO: 380983 - DNA, 15 bp, Homo sapiens
ttaacaataggaccc

SEQ ID NO: 380984 - DNA, 15 bp, Homo sapiens
taacaataggaccct

SEQ ID NO: 380985 - DNA, 15 bp, Homo sapiens
aacaataggaccctg

SEQ ID NO: 380986 - DNA, 15 bp, Homo sapiens
acaataggaccctgc

SEQ ID NO: 380987 - DNA, 15 bp, Homo sapiens
caataggaccctgcc

SEQ ID NO: 380988 - DNA, 15 bp, Homo sapiens
aataggaccctgcca

SEQ ID NO: 380989 - DNA, 15 bp, Homo sapiens
ataggaccctgccat

SEQ ID NO: 380990 - DNA, 15 bp, Homo sapiens
taggaccctgccatg

SEQ ID NO: 380991 - DNA, 15 bp, Homo sapiens
aggaccctgccatgt

SEQ ID NO: 380992 - DNA, 15 bp, Homo sapiens
ggaccctgccatgtt

SEQ ID NO: 380993 - DNA, 15 bp, Homo sapiens
gaccctgccatgttt

SEQ ID NO: 380994 - DNA, 15 bp, Homo sapiens
accctgccatgtttt

SEQ ID NO: 380995 - DNA, 15 bp, Homo sapiens
ccctgccatgttttt

SEQ ID NO: 380996 - DNA, 15 bp, Homo sapiens
cctgccatgtttttt

SEQ ID NO: 380997 - DNA, 15 bp, Homo sapiens
ctgccatgttttttc

SEQ ID NO: 380998 - DNA, 15 bp, Homo sapiens
tgccatgttttttcc

SEQ ID NO: 380999 - DNA, 15 bp, Homo sapiens
gccatgttttttcct

SEQ ID NO: 381000 - DNA, 15 bp, Homo sapiens
ccatgttttttccta

SEQ ID NO: 381001 - DNA, 15 bp, Homo sapiens
catgttttttcctaa

SEQ ID NO: 381002 - DNA, 15 bp, Homo sapiens
atgttttttcctaag

SEQ ID NO: 381003 - DNA, 15 bp, Homo sapiens
tgttttttcctaagt

SEQ ID NO: 381004 - DNA, 15 bp, Homo sapiens
gttttttcctaagtt

SEQ ID NO: 381005 - DNA, 15 bp, Homo sapiens
ttttttcctaagttc

SEQ ID NO: 381006 - DNA, 15 bp, Homo sapiens
tttttcctaagttct

SEQ ID NO: 381007 - DNA, 15 bp, Homo sapiens
ttttcctaagttctt

SEQ ID NO: 381008 - DNA, 15 bp, Homo sapiens
tttcctaagttctta

SEQ ID NO: 381009 - DNA, 15 bp, Homo sapiens
ttcctaagttcttag

SEQ ID NO: 381010 - DNA, 15 bp, Homo sapiens
tcctaagttcttaga

SEQ ID NO: 381011 - DNA, 15 bp, Homo sapiens
cctaagttcttagag

SEQ ID NO: 381012 - DNA, 15 bp, Homo sapiens
ctaagttcttagagt

SEQ ID NO: 381013 - DNA, 15 bp, Homo sapiens
taagttcttagagtg

SEQ ID NO: 381014 - DNA, 15 bp, Homo sapiens
aagttcttagagtgt

SEQ ID NO: 381015 - DNA, 15 bp, Homo sapiens
agttcttagagtgtc

SEQ ID NO: 381016 - DNA, 15 bp, Homo sapiens
gttcttagagtgtct

SEQ ID NO: 381017 - DNA, 15 bp, Homo sapiens
ttcttagagtgtcta

SEQ ID NO: 381018 - DNA, 15 bp, Homo sapiens
tcttagagtgtctaa

SEQ ID NO: 381019 - DNA, 15 bp, Homo sapiens
cttagagtgtctaat

SEQ ID NO: 381020 - DNA, 15 bp, Homo sapiens
ttagagtgtctaatg

SEQ ID NO: 381021 - DNA, 15 bp, Homo sapiens
tagagtgtctaatga

SEQ ID NO: 381022 - DNA, 15 bp, Homo sapiens
agagtgtctaatgaa

SEQ ID NO: 381023 - DNA, 15 bp, Homo sapiens
gagtgtctaatgaaa

SEQ ID NO: 381024 - DNA, 15 bp, Homo sapiens
agtgtctaatgaaat

SEQ ID NO: 381025 - DNA, 15 bp, Homo sapiens
gtgtctaatgaaatt

SEQ ID NO: 381026 - DNA, 15 bp, Homo sapiens
tgtctaatgaaattt

SEQ ID NO: 381027 - DNA, 15 bp, Homo sapiens
gtctaatgaaattta

SEQ ID NO: 381028 - DNA, 15 bp, Homo sapiens
tctaatgaaatttat

SEQ ID NO: 381029 - DNA, 15 bp, Homo sapiens
ctaatgaaatttata

SEQ ID NO: 381030 - DNA, 15 bp, Homo sapiens
taatgaaatttatat

SEQ ID NO: 381031 - DNA, 15 bp, Homo sapiens
aatgaaatttatatg

SEQ ID NO: 381032 - DNA, 15 bp, Homo sapiens
atgaaatttatatga

SEQ ID NO: 381033 - DNA, 15 bp, Homo sapiens
tgaaatttatatgaa

SEQ ID NO: 381034 - DNA, 15 bp, Homo sapiens
gaaatttatatgaag

SEQ ID NO: 381035 - DNA, 15 bp, Homo sapiens
aaatttatatgaaga

SEQ ID NO: 381036 - DNA, 15 bp, Homo sapiens
aatttatatgaagaa

SEQ ID NO: 381037 - DNA, 15 bp, Homo sapiens
atttatatgaagaat

SEQ ID NO: 381038 - DNA, 15 bp, Homo sapiens
tttatatgaagaatt

SEQ ID NO: 381039 - DNA, 15 bp, Homo sapiens
ttatatgaagaattt

SEQ ID NO: 381040 - DNA, 15 bp, Homo sapiens
tatatgaagaatttg

SEQ ID NO: 381041 - DNA, 15 bp, Homo sapiens
atatgaagaatttga

SEQ ID NO: 381042 - DNA, 15 bp, Homo sapiens
tatgaagaatttgat

SEQ ID NO: 381043 - DNA, 15 bp, Homo sapiens
atgaagaatttgatc

SEQ ID NO: 381044 - DNA, 15 bp, Homo sapiens
tgaagaatttgatct

SEQ ID NO: 381045 - DNA, 15 bp, Homo sapiens
gaagaatttgatctg

SEQ ID NO: 381046 - DNA, 15 bp, Homo sapiens
aagaatttgatctgg

SEQ ID NO: 381047 - DNA, 15 bp, Homo sapiens
agaatttgatctgga

SEQ ID NO: 381048 - DNA, 15 bp, Homo sapiens
gaatttgatctggaa

SEQ ID NO: 381049 - DNA, 15 bp, Homo sapiens
aatttgatctggaag

SEQ ID NO: 381050 - DNA, 15 bp, Homo sapiens
atttgatctggaaga

SEQ ID NO: 381051 - DNA, 15 bp, Homo sapiens
tttgatctggaagat

SEQ ID NO: 381052 - DNA, 15 bp, Homo sapiens
ttgatctggaagatt

SEQ ID NO: 381053 - DNA, 15 bp, Homo sapiens
tgatctggaagattt

SEQ ID NO: 381054 - DNA, 15 bp, Homo sapiens
gatctggaagatttt

SEQ ID NO: 381055 - DNA, 15 bp, Homo sapiens
atctggaagattttt

SEQ ID NO: 381056 - DNA, 15 bp, Homo sapiens
tctggaagatttttt

SEQ ID NO: 381057 - DNA, 15 bp, Homo sapiens
ctggaagattttttt

SEQ ID NO: 381058 - DNA, 15 bp, Homo sapiens
tggaagatttttttc

SEQ ID NO: 381059 - DNA, 15 bp, Homo sapiens
ggaagatttttttcg

SEQ ID NO: 381060 - DNA, 15 bp, Homo sapiens
gaagatttttttcga

SEQ ID NO: 381061 - DNA, 15 bp, Homo sapiens
aagatttttttcgaa

SEQ ID NO: 381062 - DNA, 15 bp, Homo sapiens
agatttttttcgaaa

SEQ ID NO: 381063 - DNA, 15 bp, Homo sapiens
gatttttttcgaaaa

SEQ ID NO: 381064 - DNA, 15 bp, Homo sapiens
atttttttcgaaaaa

SEQ ID NO: 381065 - DNA, 15 bp, Homo sapiens
tttttttcgaaaaat

SEQ ID NO: 381066 - DNA, 15 bp, Homo sapiens
ttttttcgaaaaatt

SEQ ID NO: 381067 - DNA, 15 bp, Homo sapiens
tttttcgaaaaattt

SEQ ID NO: 381068 - DNA, 15 bp, Homo sapiens
ttttcgaaaaatttc

SEQ ID NO: 381069 - DNA, 15 bp, Homo sapiens
tttcgaaaaatttct

SEQ ID NO: 381070 - DNA, 15 bp, Homo sapiens
ttcgaaaaatttctg

SEQ ID NO: 381071 - DNA, 15 bp, Homo sapiens
tcgaaaaatttctgg

SEQ ID NO: 381072 - DNA, 15 bp, Homo sapiens
cgaaaaatttctgga

SEQ ID NO: 381073 - DNA, 15 bp, Homo sapiens
gaaaaatttctggag

SEQ ID NO: 381074 - DNA, 15 bp, Homo sapiens
aaaaatttctggagg

SEQ ID NO: 381075 - DNA, 15 bp, Homo sapiens
aaaatttctggaggc

SEQ ID NO: 381076 - DNA, 15 bp, Homo sapiens
aaatttctggaggca

SEQ ID NO: 381077 - DNA, 15 bp, Homo sapiens
aatttctggaggcat

SEQ ID NO: 381078 - DNA, 15 bp, Homo sapiens
atttctggaggcata

SEQ ID NO: 381079 - DNA, 15 bp, Homo sapiens
tttctggaggcataa

SEQ ID NO: 381080 - DNA, 15 bp, Homo sapiens
ttctggaggcataac

SEQ ID NO: 381081 - DNA, 15 bp, Homo sapiens
tctggaggcataaca

SEQ ID NO: 381082 - DNA, 15 bp, Homo sapiens
ctggaggcataacaa

SEQ ID NO: 381083 - DNA, 15 bp, Homo sapiens
tggaggcataacaag

SEQ ID NO: 381084 - DNA, 15 bp, Homo sapiens
ggaggcataacaagt

SEQ ID NO: 381085 - DNA, 15 bp, Homo sapiens
gaggcataacaagta

SEQ ID NO: 381086 - DNA, 15 bp, Homo sapiens
aggcataacaagtaa

SEQ ID NO: 381087 - DNA, 15 bp, Homo sapiens
ggcataacaagtaag

SEQ ID NO: 381088 - DNA, 15 bp, Homo sapiens
gcataacaagtaaga

SEQ ID NO: 381089 - DNA, 15 bp, Homo sapiens
cataacaagtaagaa

SEQ ID NO: 381090 - DNA, 15 bp, Homo sapiens
ataacaagtaagaat

SEQ ID NO: 381091 - DNA, 15 bp, Homo sapiens
taacaagtaagaata

SEQ ID NO: 381092 - DNA, 15 bp, Homo sapiens
aacaagtaagaatat

SEQ ID NO: 381093 - DNA, 15 bp, Homo sapiens
acaagtaagaatatg

SEQ ID NO: 381094 - DNA, 15 bp, Homo sapiens
caagtaagaatatgc

SEQ ID NO: 381095 - DNA, 15 bp, Homo sapiens
aagtaagaatatgca

SEQ ID NO: 381096 - DNA, 15 bp, Homo sapiens
agtaagaatatgcat

SEQ ID NO: 381097 - DNA, 15 bp, Homo sapiens
gtaagaatatgcatg

SEQ ID NO: 381098 - DNA, 15 bp, Homo sapiens
taagaatatgcatgt

SEQ ID NO: 381099 - DNA, 15 bp, Homo sapiens
aagaatatgcatgtc

SEQ ID NO: 381100 - DNA, 15 bp, Homo sapiens
agaatatgcatgtct

SEQ ID NO: 381101 - DNA, 15 bp, Homo sapiens
gaatatgcatgtctc

SEQ ID NO: 381102 - DNA, 15 bp, Homo sapiens
aatatgcatgtctcc

SEQ ID NO: 381103 - DNA, 15 bp, Homo sapiens
atatgcatgtctccg

SEQ ID NO: 381104 - DNA, 15 bp, Homo sapiens
tatgcatgtctccga

SEQ ID NO: 381105 - DNA, 15 bp, Homo sapiens
atgcatgtctccgag

SEQ ID NO: 381106 - DNA, 15 bp, Homo sapiens
tgcatgtctccgaga

SEQ ID NO: 381107 - DNA, 15 bp, Homo sapiens
gcatgtctccgagat

SEQ ID NO: 381108 - DNA, 15 bp, Homo sapiens
catgtctccgagatt

SEQ ID NO: 381109 - DNA, 15 bp, Homo sapiens
atgtctccgagattt

SEQ ID NO: 381110 - DNA, 15 bp, Homo sapiens
tgtctccgagattta

SEQ ID NO: 381111 - DNA, 15 bp, Homo sapiens
gtctccgagatttat

SEQ ID NO: 381112 - DNA, 15 bp, Homo sapiens
tctccgagatttata

SEQ ID NO: 381113 - DNA, 15 bp, Homo sapiens
ctccgagatttatag

SEQ ID NO: 381114 - DNA, 15 bp, Homo sapiens
tccgagatttatagc

SEQ ID NO: 381115 - DNA, 15 bp, Homo sapiens
ccgagatttatagct

SEQ ID NO: 381116 - DNA, 15 bp, Homo sapiens
cgagatttatagctc

SEQ ID NO: 381117 - DNA, 15 bp, Homo sapiens
gagatttatagctca

SEQ ID NO: 381118 - DNA, 15 bp, Homo sapiens
agatttatagctcac

SEQ ID NO: 381119 - DNA, 15 bp, Homo sapiens
gatttatagctcact

SEQ ID NO: 381120 - DNA, 15 bp, Homo sapiens
atttatagctcactg

SEQ ID NO: 381121 - DNA, 15 bp, Homo sapiens
tttatagctcactga

SEQ ID NO: 381122 - DNA, 15 bp, Homo sapiens
ttatagctcactgac

SEQ ID NO: 381123 - DNA, 15 bp, Homo sapiens
tatagctcactgact

SEQ ID NO: 381124 - DNA, 15 bp, Homo sapiens
atagctcactgactt

SEQ ID NO: 381125 - DNA, 15 bp, Homo sapiens
tagctcactgacttt

SEQ ID NO: 381126 - DNA, 15 bp, Homo sapiens
agctcactgactttt

SEQ ID NO: 381127 - DNA, 15 bp, Homo sapiens
gctcactgacttttt

SEQ ID NO: 381128 - DNA, 15 bp, Homo sapiens
ctcactgactttttg

SEQ ID NO: 381129 - DNA, 15 bp, Homo sapiens
tcactgactttttgc

SEQ ID NO: 381130 - DNA, 15 bp, Homo sapiens
cactgactttttgca

SEQ ID NO: 381131 - DNA, 15 bp, Homo sapiens
actgactttttgcaa

SEQ ID NO: 381132 - DNA, 15 bp, Homo sapiens
ctgactttttgcaag

SEQ ID NO: 381133 - DNA, 15 bp, Homo sapiens
tgactttttgcaagt

SEQ ID NO: 381134 - DNA, 15 bp, Homo sapiens
gactttttgcaagtg

SEQ ID NO: 381135 - DNA, 15 bp, Homo sapiens
actttttgcaagtga

SEQ ID NO: 381136 - DNA, 15 bp, Homo sapiens
ctttttgcaagtgaa

SEQ ID NO: 381137 - DNA, 15 bp, Homo sapiens
tttttgcaagtgaaa

SEQ ID NO: 381138 - DNA, 15 bp, Homo sapiens
ttttgcaagtgaaac

SEQ ID NO: 381139 - DNA, 15 bp, Homo sapiens
tttgcaagtgaaaca

SEQ ID NO: 381140 - DNA, 15 bp, Homo sapiens
ttgcaagtgaaacac

SEQ ID NO: 381141 - DNA, 15 bp, Homo sapiens
tgcaagtgaaacaca

SEQ ID NO: 381142 - DNA, 15 bp, Homo sapiens
gcaagtgaaacacac

SEQ ID NO: 381143 - DNA, 15 bp, Homo sapiens
caagtgaaacacacc

SEQ ID NO: 381144 - DNA, 15 bp, Homo sapiens
aagtgaaacacaccc

SEQ ID NO: 381145 - DNA, 15 bp, Homo sapiens
agtgaaacacaccct

SEQ ID NO: 381146 - DNA, 15 bp, Homo sapiens
gtgaaacacaccctc

SEQ ID NO: 381147 - DNA, 15 bp, Homo sapiens
tgaaacacaccctca

SEQ ID NO: 381148 - DNA, 15 bp, Homo sapiens
gaaacacaccctcaa

SEQ ID NO: 381149 - DNA, 15 bp, Homo sapiens
aaacacaccctcaaa

SEQ ID NO: 381150 - DNA, 15 bp, Homo sapiens
aacacaccctcaaat

SEQ ID NO: 381151 - DNA, 15 bp, Homo sapiens
acacaccctcaaatc

SEQ ID NO: 381152 - DNA, 15 bp, Homo sapiens
cacaccctcaaatca

SEQ ID NO: 381153 - DNA, 15 bp, Homo sapiens
acaccctcaaatcag

SEQ ID NO: 381154 - DNA, 15 bp, Homo sapiens
caccctcaaatcagc

SEQ ID NO: 381155 - DNA, 15 bp, Homo sapiens
accctcaaatcagca

SEQ ID NO: 381156 - DNA, 15 bp, Homo sapiens
ccctcaaatcagcat

SEQ ID NO: 381157 - DNA, 15 bp, Homo sapiens
cctcaaatcagcatc

SEQ ID NO: 381158 - DNA, 15 bp, Homo sapiens
ctcaaatcagcatct

SEQ ID NO: 381159 - DNA, 15 bp, Homo sapiens
tcaaatcagcatcta

SEQ ID NO: 381160 - DNA, 15 bp, Homo sapiens
caaatcagcatctag

SEQ ID NO: 381161 - DNA, 15 bp, Homo sapiens
aaatcagcatctaga

SEQ ID NO: 381162 - DNA, 15 bp, Homo sapiens
aatcagcatctagaa

SEQ ID NO: 381163 - DNA, 15 bp, Homo sapiens
atcagcatctagaaa

SEQ ID NO: 381164 - DNA, 15 bp, Homo sapiens
tcagcatctagaaag

SEQ ID NO: 381165 - DNA, 15 bp, Homo sapiens
cagcatctagaaaga

SEQ ID NO: 381166 - DNA, 15 bp, Homo sapiens
agcatctagaaagag

SEQ ID NO: 381167 - DNA, 15 bp, Homo sapiens
gcatctagaaagaga

SEQ ID NO: 381168 - DNA, 15 bp, Homo sapiens
catctagaaagagaa

SEQ ID NO: 381169 - DNA, 15 bp, Homo sapiens
atctagaaagagaac

SEQ ID NO: 381170 - DNA, 15 bp, Homo sapiens
tctagaaagagaaca

SEQ ID NO: 381171 - DNA, 15 bp, Homo sapiens
ctagaaagagaacac

SEQ ID NO: 381172 - DNA, 15 bp, Homo sapiens
tagaaagagaacact

SEQ ID NO: 381173 - DNA, 15 bp, Homo sapiens
agaaagagaacactt

SEQ ID NO: 381174 - DNA, 15 bp, Homo sapiens
gaaagagaacacttt

SEQ ID NO: 381175 - DNA, 15 bp, Homo sapiens
aaagagaacactttc

SEQ ID NO: 381176 - DNA, 15 bp, Homo sapiens
aagagaacactttca

SEQ ID NO: 381177 - DNA, 15 bp, Homo sapiens
agagaacactttcaa

SEQ ID NO: 381178 - DNA, 15 bp, Homo sapiens
gagaacactttcaag

SEQ ID NO: 381179 - DNA, 15 bp, Homo sapiens
agaacactttcaaga

SEQ ID NO: 381180 - DNA, 15 bp, Homo sapiens
gaacactttcaagat

SEQ ID NO: 381181 - DNA, 15 bp, Homo sapiens
aacactttcaagatt

SEQ ID NO: 381182 - DNA, 15 bp, Homo sapiens
acactttcaagattc

SEQ ID NO: 381183 - DNA, 15 bp, Homo sapiens
cactttcaagattcc

SEQ ID NO: 381184 - DNA, 15 bp, Homo sapiens
actttcaagattcca

SEQ ID NO: 381185 - DNA, 15 bp, Homo sapiens
ctttcaagattccag

SEQ ID NO: 381186 - DNA, 15 bp, Homo sapiens
tttcaagattccagg

SEQ ID NO: 381187 - DNA, 15 bp, Homo sapiens
ttcaagattccagga

SEQ ID NO: 381188 - DNA, 15 bp, Homo sapiens
tcaagattccaggaa

SEQ ID NO: 381189 - DNA, 15 bp, Homo sapiens
caagattccaggaac

SEQ ID NO: 381190 - DNA, 15 bp, Homo sapiens
aagattccaggaacc

SEQ ID NO: 381191 - DNA, 15 bp, Homo sapiens
agattccaggaaccc

SEQ ID NO: 381192 - DNA, 15 bp, Homo sapiens
gattccaggaaccct

SEQ ID NO: 381193 - DNA, 15 bp, Homo sapiens
attccaggaaccctc

SEQ ID NO: 381194 - DNA, 15 bp, Homo sapiens
ttccaggaaccctct

SEQ ID NO: 381195 - DNA, 15 bp, Homo sapiens
tccaggaaccctctt

SEQ ID NO: 381196 - DNA, 15 bp, Homo sapiens
ccaggaaccctcttt

SEQ ID NO: 381197 - DNA, 15 bp, Homo sapiens
caggaaccctctttt

SEQ ID NO: 381198 - DNA, 15 bp, Homo sapiens
aggaaccctcttttg

SEQ ID NO: 381199 - DNA, 15 bp, Homo sapiens
ggaaccctcttttgc

SEQ ID NO: 381200 - DNA, 15 bp, Homo sapiens
gaaccctcttttgct

SEQ ID NO: 381201 - DNA, 15 bp, Homo sapiens
aaccctcttttgctc

SEQ ID NO: 381202 - DNA, 15 bp, Homo sapiens
accctcttttgctcc

SEQ ID NO: 381203 - DNA, 15 bp, Homo sapiens
ccctcttttgctccc

SEQ ID NO: 381204 - DNA, 15 bp, Homo sapiens
cctcttttgctccct

SEQ ID NO: 381205 - DNA, 15 bp, Homo sapiens
ctcttttgctccctt

SEQ ID NO: 381206 - DNA, 15 bp, Homo sapiens
tcttttgctcccttc

SEQ ID NO: 381207 - DNA, 15 bp, Homo sapiens
cttttgctcccttct

SEQ ID NO: 381208 - DNA, 15 bp, Homo sapiens
ttttgctcccttctg

SEQ ID NO: 381209 - DNA, 15 bp, Homo sapiens
tttgctcccttctgt

SEQ ID NO: 381210 - DNA, 15 bp, Homo sapiens
ttgctcccttctgta

SEQ ID NO: 381211 - DNA, 15 bp, Homo sapiens
tgctcccttctgtac

SEQ ID NO: 381212 - DNA, 15 bp, Homo sapiens
gctcccttctgtact

SEQ ID NO: 381213 - DNA, 15 bp, Homo sapiens
ctcccttctgtactg

SEQ ID NO: 381214 - DNA, 15 bp, Homo sapiens
tcccttctgtactgt

SEQ ID NO: 381215 - DNA, 15 bp, Homo sapiens
cccttctgtactgta

SEQ ID NO: 381216 - DNA, 15 bp, Homo sapiens
ccttctgtactgtat

SEQ ID NO: 381217 - DNA, 15 bp, Homo sapiens
cttctgtactgtatt

SEQ ID NO: 381218 - DNA, 15 bp, Homo sapiens
ttctgtactgtatta

SEQ ID NO: 381219 - DNA, 15 bp, Homo sapiens
tctgtactgtattag

SEQ ID NO: 381220 - DNA, 15 bp, Homo sapiens
ctgtactgtattagt

SEQ ID NO: 381221 - DNA, 15 bp, Homo sapiens
tgtactgtattagtc

SEQ ID NO: 381222 - DNA, 15 bp, Homo sapiens
gtactgtattagtct

SEQ ID NO: 381223 - DNA, 15 bp, Homo sapiens
tactgtattagtctg

SEQ ID NO: 381224 - DNA, 15 bp, Homo sapiens
actgtattagtctgt

SEQ ID NO: 381225 - DNA, 15 bp, Homo sapiens
ctgtattagtctgtt

SEQ ID NO: 381226 - DNA, 15 bp, Homo sapiens
ttagtctgttctcac

SEQ ID NO: 381227 - DNA, 15 bp, Homo sapiens
tagtctgttctcaca

SEQ ID NO: 381228 - DNA, 15 bp, Homo sapiens
agtctgttctcacat

SEQ ID NO: 381229 - DNA, 15 bp, Homo sapiens
gtctgttctcacatt

SEQ ID NO: 381230 - DNA, 15 bp, Homo sapiens
tctgttctcacattg

SEQ ID NO: 381231 - DNA, 15 bp, Homo sapiens
ctgttctcacattgc

SEQ ID NO: 381232 - DNA, 15 bp, Homo sapiens
tgttctcacattgct

SEQ ID NO: 381233 - DNA, 15 bp, Homo sapiens
gttctcacattgcta

SEQ ID NO: 381234 - DNA, 15 bp, Homo sapiens
ttctcacattgctat

SEQ ID NO: 381235 - DNA, 15 bp, Homo sapiens
tctcacattgctata

SEQ ID NO: 381236 - DNA, 15 bp, Homo sapiens
ctcacattgctataa

SEQ ID NO: 381237 - DNA, 15 bp, Homo sapiens
tcacattgctataaa

SEQ ID NO: 381238 - DNA, 15 bp, Homo sapiens
cacattgctataaat

SEQ ID NO: 381239 - DNA, 15 bp, Homo sapiens
acattgctataaata

SEQ ID NO: 381240 - DNA, 15 bp, Homo sapiens
cattgctataaataa

SEQ ID NO: 381241 - DNA, 15 bp, Homo sapiens
attgctataaataac

SEQ ID NO: 381242 - DNA, 15 bp, Homo sapiens
ttgctataaataact

SEQ ID NO: 381243 - DNA, 15 bp, Homo sapiens
tgctataaataacta

SEQ ID NO: 381244 - DNA, 15 bp, Homo sapiens
gctataaataactac

SEQ ID NO: 381245 - DNA, 15 bp, Homo sapiens
ctataaataactacc

SEQ ID NO: 381246 - DNA, 15 bp, Homo sapiens
tataaataactacct

SEQ ID NO: 381247 - DNA, 15 bp, Homo sapiens
ataaataactacctg

SEQ ID NO: 381248 - DNA, 15 bp, Homo sapiens
taaataactacctga

SEQ ID NO: 381249 - DNA, 15 bp, Homo sapiens
aaataactacctgag

SEQ ID NO: 381250 - DNA, 15 bp, Homo sapiens
aataactacctgaga

SEQ ID NO: 381251 - DNA, 15 bp, Homo sapiens
ataactacctgagac

SEQ ID NO: 381252 - DNA, 15 bp, Homo sapiens
taactacctgagact

SEQ ID NO: 381253 - DNA, 15 bp, Homo sapiens
aactacctgagactg

SEQ ID NO: 381254 - DNA, 15 bp, Homo sapiens
actacctgagactga

SEQ ID NO: 381255 - DNA, 15 bp, Homo sapiens
ctacctgagactgag

SEQ ID NO: 381256 - DNA, 15 bp, Homo sapiens
tacctgagactgagt

SEQ ID NO: 381257 - DNA, 15 bp, Homo sapiens
acctgagactgagta

SEQ ID NO: 381258 - DNA, 15 bp, Homo sapiens
cctgagactgagtaa

SEQ ID NO: 381259 - DNA, 15 bp, Homo sapiens
ctgagactgagtaat

SEQ ID NO: 381260 - DNA, 15 bp, Homo sapiens
tgagactgagtaatt

SEQ ID NO: 381261 - DNA, 15 bp, Homo sapiens
gagactgagtaattt

SEQ ID NO: 381262 - DNA, 15 bp, Homo sapiens
agactgagtaattta

SEQ ID NO: 381263 - DNA, 15 bp, Homo sapiens
gactgagtaatttat

SEQ ID NO: 381264 - DNA, 15 bp, Homo sapiens
actgagtaatttatg

SEQ ID NO: 381265 - DNA, 15 bp, Homo sapiens
ctgagtaatttatga

SEQ ID NO: 381266 - DNA, 15 bp, Homo sapiens
tgagtaatttatgaa

SEQ ID NO: 381267 - DNA, 15 bp, Homo sapiens
gagtaatttatgaag

SEQ ID NO: 381268 - DNA, 15 bp, Homo sapiens
agtaatttatgaaga

SEQ ID NO: 381269 - DNA, 15 bp, Homo sapiens
gtaatttatgaagaa

SEQ ID NO: 381270 - DNA, 15 bp, Homo sapiens
taatttatgaagaaa

SEQ ID NO: 381271 - DNA, 15 bp, Homo sapiens
aatttatgaagaaag

SEQ ID NO: 381272 - DNA, 15 bp, Homo sapiens
atttatgaagaaagg

SEQ ID NO: 381273 - DNA, 15 bp, Homo sapiens
tttatgaagaaagga

SEQ ID NO: 381274 - DNA, 15 bp, Homo sapiens
ttatgaagaaaggag

SEQ ID NO: 381275 - DNA, 15 bp, Homo sapiens
tatgaagaaaggaga

SEQ ID NO: 381276 - DNA, 15 bp, Homo sapiens
atgaagaaaggagat

SEQ ID NO: 381277 - DNA, 15 bp, Homo sapiens
tgaagaaaggagatt

SEQ ID NO: 381278 - DNA, 15 bp, Homo sapiens
gaagaaaggagattt

SEQ ID NO: 381279 - DNA, 15 bp, Homo sapiens
aagaaaggagattta

SEQ ID NO: 381280 - DNA, 15 bp, Homo sapiens
agaaaggagatttaa

SEQ ID NO: 381281 - DNA, 15 bp, Homo sapiens
gaaaggagatttaat

SEQ ID NO: 381282 - DNA, 15 bp, Homo sapiens
aaaggagatttaatt

SEQ ID NO: 381283 - DNA, 15 bp, Homo sapiens
aaggagatttaattg

SEQ ID NO: 381284 - DNA, 15 bp, Homo sapiens
aggagatttaattga

SEQ ID NO: 381285 - DNA, 15 bp, Homo sapiens
ggagatttaattgac

SEQ ID NO: 381286 - DNA, 15 bp, Homo sapiens
gagatttaattgact

SEQ ID NO: 381287 - DNA, 15 bp, Homo sapiens
agatttaattgactc

SEQ ID NO: 381288 - DNA, 15 bp, Homo sapiens
gatttaattgactca

SEQ ID NO: 381289 - DNA, 15 bp, Homo sapiens
atttaattgactcac

SEQ ID NO: 381290 - DNA, 15 bp, Homo sapiens
tttaattgactcaca

SEQ ID NO: 381291 - DNA, 15 bp, Homo sapiens
ttaattgactcacag

SEQ ID NO: 381292 - DNA, 15 bp, Homo sapiens
taattgactcacagt

SEQ ID NO: 381293 - DNA, 15 bp, Homo sapiens
aattgactcacagtt

SEQ ID NO: 381294 - DNA, 15 bp, Homo sapiens
attgactcacagttc

SEQ ID NO: 381295 - DNA, 15 bp, Homo sapiens
ttgactcacagttca

SEQ ID NO: 381296 - DNA, 15 bp, Homo sapiens
tgactcacagttcat

SEQ ID NO: 381297 - DNA, 15 bp, Homo sapiens
gactcacagttcatt

SEQ ID NO: 381298 - DNA, 15 bp, Homo sapiens
actcacagttcattt

SEQ ID NO: 381299 - DNA, 15 bp, Homo sapiens
ctcacagttcatttg

SEQ ID NO: 381300 - DNA, 15 bp, Homo sapiens
tcacagttcatttga

SEQ ID NO: 381301 - DNA, 15 bp, Homo sapiens
cacagttcatttgag

SEQ ID NO: 381302 - DNA, 15 bp, Homo sapiens
acagttcatttgagg

SEQ ID NO: 381303 - DNA, 15 bp, Homo sapiens
cagttcatttgaggg

SEQ ID NO: 381304 - DNA, 15 bp, Homo sapiens
agttcatttgagggc

SEQ ID NO: 381305 - DNA, 15 bp, Homo sapiens
gttcatttgagggct

SEQ ID NO: 381306 - DNA, 15 bp, Homo sapiens
ttcatttgagggcta

SEQ ID NO: 381307 - DNA, 15 bp, Homo sapiens
tcatttgagggctac

SEQ ID NO: 381308 - DNA, 15 bp, Homo sapiens
catttgagggctact

SEQ ID NO: 381309 - DNA, 15 bp, Homo sapiens
atttgagggctactg

SEQ ID NO: 381310 - DNA, 15 bp, Homo sapiens
tttgagggctactgt

SEQ ID NO: 381311 - DNA, 15 bp, Homo sapiens
ttgagggctactgta

SEQ ID NO: 381312 - DNA, 15 bp, Homo sapiens
tgagggctactgtag

SEQ ID NO: 381313 - DNA, 15 bp, Homo sapiens
gagggctactgtagt

SEQ ID NO: 381314 - DNA, 15 bp, Homo sapiens
agggctactgtagtg

SEQ ID NO: 381315 - DNA, 15 bp, Homo sapiens
gggctactgtagtga

SEQ ID NO: 381316 - DNA, 15 bp, Homo sapiens
ggctactgtagtgaa

SEQ ID NO: 381317 - DNA, 15 bp, Homo sapiens
gctactgtagtgaag

SEQ ID NO: 381318 - DNA, 15 bp, Homo sapiens
ctactgtagtgaagc

SEQ ID NO: 381319 - DNA, 15 bp, Homo sapiens
tactgtagtgaagca

SEQ ID NO: 381320 - DNA, 15 bp, Homo sapiens
actgtagtgaagcat

SEQ ID NO: 381321 - DNA, 15 bp, Homo sapiens
ctgtagtgaagcatg

SEQ ID NO: 381322 - DNA, 15 bp, Homo sapiens
tgtagtgaagcatga

SEQ ID NO: 381323 - DNA, 15 bp, Homo sapiens
gtagtgaagcatgac

SEQ ID NO: 381324 - DNA, 15 bp, Homo sapiens
tagtgaagcatgact

SEQ ID NO: 381325 - DNA, 15 bp, Homo sapiens
agtgaagcatgactg

SEQ ID NO: 381326 - DNA, 15 bp, Homo sapiens
gtgaagcatgactgg

SEQ ID NO: 381327 - DNA, 15 bp, Homo sapiens
tgaagcatgactggg

SEQ ID NO: 381328 - DNA, 15 bp, Homo sapiens
gaagcatgactggga

SEQ ID NO: 381329 - DNA, 15 bp, Homo sapiens
aagcatgactgggag

SEQ ID NO: 381330 - DNA, 15 bp, Homo sapiens
agcatgactgggagg

SEQ ID NO: 381331 - DNA, 15 bp, Homo sapiens
gcatgactgggaggt

SEQ ID NO: 381332 - DNA, 15 bp, Homo sapiens
catgactgggaggta

SEQ ID NO: 381333 - DNA, 15 bp, Homo sapiens
atgactgggaggtac

SEQ ID NO: 381334 - DNA, 15 bp, Homo sapiens
tgactgggaggtacc

SEQ ID NO: 381335 - DNA, 15 bp, Homo sapiens
gactgggaggtacca

SEQ ID NO: 381336 - DNA, 15 bp, Homo sapiens
actgggaggtaccag

SEQ ID NO: 381337 - DNA, 15 bp, Homo sapiens
ctgggaggtaccagg

SEQ ID NO: 381338 - DNA, 15 bp, Homo sapiens
tgggaggtaccagga

SEQ ID NO: 381339 - DNA, 15 bp, Homo sapiens
gggaggtaccaggaa

SEQ ID NO: 381340 - DNA, 15 bp, Homo sapiens
ggaggtaccaggaaa

SEQ ID NO: 381341 - DNA, 15 bp, Homo sapiens
gaggtaccaggaaac

SEQ ID NO: 381342 - DNA, 15 bp, Homo sapiens
aggtaccaggaaact

SEQ ID NO: 381343 - DNA, 15 bp, Homo sapiens
ggtaccaggaaactt

SEQ ID NO: 381344 - DNA, 15 bp, Homo sapiens
gtaccaggaaactta

SEQ ID NO: 381345 - DNA, 15 bp, Homo sapiens
taccaggaaacttaa

SEQ ID NO: 381346 - DNA, 15 bp, Homo sapiens
accaggaaacttaaa

SEQ ID NO: 381347 - DNA, 15 bp, Homo sapiens
ccaggaaacttaaaa

SEQ ID NO: 381348 - DNA, 15 bp, Homo sapiens
caggaaacttaaaat

SEQ ID NO: 381349 - DNA, 15 bp, Homo sapiens
aggaaacttaaaatc

SEQ ID NO: 381350 - DNA, 15 bp, Homo sapiens
ggaaacttaaaatca

SEQ ID NO: 381351 - DNA, 15 bp, Homo sapiens
gaaacttaaaatcat

SEQ ID NO: 381352 - DNA, 15 bp, Homo sapiens
aaacttaaaatcatg

SEQ ID NO: 381353 - DNA, 15 bp, Homo sapiens
aacttaaaatcatgg

SEQ ID NO: 381354 - DNA, 15 bp, Homo sapiens
acttaaaatcatggt

SEQ ID NO: 381355 - DNA, 15 bp, Homo sapiens
cttaaaatcatggtg

SEQ ID NO: 381356 - DNA, 15 bp, Homo sapiens
ttaaaatcatggtgg

SEQ ID NO: 381357 - DNA, 15 bp, Homo sapiens
taaaatcatggtgga

SEQ ID NO: 381358 - DNA, 15 bp, Homo sapiens
aaaatcatggtggaa

SEQ ID NO: 381359 - DNA, 15 bp, Homo sapiens
aaatcatggtggaag

SEQ ID NO: 381360 - DNA, 15 bp, Homo sapiens
atggtggaaggcaaa

SEQ ID NO: 381361 - DNA, 15 bp, Homo sapiens
tggtggaaggcaaag

SEQ ID NO: 381362 - DNA, 15 bp, Homo sapiens
ggtggaaggcaaagg

SEQ ID NO: 381363 - DNA, 15 bp, Homo sapiens
gtggaaggcaaaggg

SEQ ID NO: 381364 - DNA, 15 bp, Homo sapiens
tggaaggcaaagggg

SEQ ID NO: 381365 - DNA, 15 bp, Homo sapiens
ggaaggcaaagggga

SEQ ID NO: 381366 - DNA, 15 bp, Homo sapiens
gaaggcaaaggggaa

SEQ ID NO: 381367 - DNA, 15 bp, Homo sapiens
aaggcaaaggggaag

SEQ ID NO: 381368 - DNA, 15 bp, Homo sapiens
aggcaaaggggaagc

SEQ ID NO: 381369 - DNA, 15 bp, Homo sapiens
ggcaaaggggaagca

SEQ ID NO: 381370 - DNA, 15 bp, Homo sapiens
gcaaaggggaagcag

SEQ ID NO: 381371 - DNA, 15 bp, Homo sapiens
caaaggggaagcagg

SEQ ID NO: 381372 - DNA, 15 bp, Homo sapiens
aaaggggaagcaggc

SEQ ID NO: 381373 - DNA, 15 bp, Homo sapiens
aaggggaagcaggca

SEQ ID NO: 381374 - DNA, 15 bp, Homo sapiens
aggggaagcaggcac

SEQ ID NO: 381375 - DNA, 15 bp, Homo sapiens
ggggaagcaggcacc

SEQ ID NO: 381376 - DNA, 15 bp, Homo sapiens
gggaagcaggcacct

SEQ ID NO: 381377 - DNA, 15 bp, Homo sapiens
ggaagcaggcacctt

SEQ ID NO: 381378 - DNA, 15 bp, Homo sapiens
gaagcaggcaccttc

SEQ ID NO: 381379 - DNA, 15 bp, Homo sapiens
aagcaggcaccttct

SEQ ID NO: 381380 - DNA, 15 bp, Homo sapiens
agcaggcaccttctt

SEQ ID NO: 381381 - DNA, 15 bp, Homo sapiens
gcaggcaccttcttt

SEQ ID NO: 381382 - DNA, 15 bp, Homo sapiens
caggcaccttcttta

SEQ ID NO: 381383 - DNA, 15 bp, Homo sapiens
aggcaccttctttac

SEQ ID NO: 381384 - DNA, 15 bp, Homo sapiens
ggcaccttctttaca

SEQ ID NO: 381385 - DNA, 15 bp, Homo sapiens
gcaccttctttacaa

SEQ ID NO: 381386 - DNA, 15 bp, Homo sapiens
caccttctttacaag

SEQ ID NO: 381387 - DNA, 15 bp, Homo sapiens
accttctttacaagg

SEQ ID NO: 381388 - DNA, 15 bp, Homo sapiens
ccttctttacaaggc

SEQ ID NO: 381389 - DNA, 15 bp, Homo sapiens
cttctttacaaggca

SEQ ID NO: 381390 - DNA, 15 bp, Homo sapiens
ttctttacaaggcag

SEQ ID NO: 381391 - DNA, 15 bp, Homo sapiens
tctttacaaggcagc

SEQ ID NO: 381392 - DNA, 15 bp, Homo sapiens
ctttacaaggcagca

SEQ ID NO: 381393 - DNA, 15 bp, Homo sapiens
tttacaaggcagcaa

SEQ ID NO: 381394 - DNA, 15 bp, Homo sapiens
ttacaaggcagcaag

SEQ ID NO: 381395 - DNA, 15 bp, Homo sapiens
tacaaggcagcaaga

SEQ ID NO: 381396 - DNA, 15 bp, Homo sapiens
acaaggcagcaagac

SEQ ID NO: 381397 - DNA, 15 bp, Homo sapiens
caaggcagcaagaca

SEQ ID NO: 381398 - DNA, 15 bp, Homo sapiens
aaggcagcaagacag

SEQ ID NO: 381399 - DNA, 15 bp, Homo sapiens
aggcagcaagacaga

SEQ ID NO: 381400 - DNA, 15 bp, Homo sapiens
ggcagcaagacagag

SEQ ID NO: 381401 - DNA, 15 bp, Homo sapiens
gcagcaagacagaga

SEQ ID NO: 381402 - DNA, 15 bp, Homo sapiens
cagcaagacagagag

SEQ ID NO: 381403 - DNA, 15 bp, Homo sapiens
agcaagacagagaga

SEQ ID NO: 381404 - DNA, 15 bp, Homo sapiens
gcaagacagagagag

SEQ ID NO: 381405 - DNA, 15 bp, Homo sapiens
caagacagagagaga

SEQ ID NO: 381406 - DNA, 15 bp, Homo sapiens
aagacagagagagat

SEQ ID NO: 381407 - DNA, 15 bp, Homo sapiens
agacagagagagata

SEQ ID NO: 381408 - DNA, 15 bp, Homo sapiens
gacagagagagatag

SEQ ID NO: 381409 - DNA, 15 bp, Homo sapiens
acagagagagataga

SEQ ID NO: 381410 - DNA, 15 bp, Homo sapiens
cagagagagatagaa

SEQ ID NO: 381411 - DNA, 15 bp, Homo sapiens
agagagagatagaag

SEQ ID NO: 381412 - DNA, 15 bp, Homo sapiens
gagagagatagaagg

SEQ ID NO: 381413 - DNA, 15 bp, Homo sapiens
agagagatagaaggg

SEQ ID NO: 381414 - DNA, 15 bp, Homo sapiens
gagagatagaaggga

SEQ ID NO: 381415 - DNA, 15 bp, Homo sapiens
agagatagaagggag

SEQ ID NO: 381416 - DNA, 15 bp, Homo sapiens
gagatagaagggaga

SEQ ID NO: 381417 - DNA, 15 bp, Homo sapiens
agatagaagggagaa

SEQ ID NO: 381418 - DNA, 15 bp, Homo sapiens
gatagaagggagaag

SEQ ID NO: 381419 - DNA, 15 bp, Homo sapiens
atagaagggagaagt

SEQ ID NO: 381420 - DNA, 15 bp, Homo sapiens
tagaagggagaagtg

SEQ ID NO: 381421 - DNA, 15 bp, Homo sapiens
agaagggagaagtgc

SEQ ID NO: 381422 - DNA, 15 bp, Homo sapiens
gaagggagaagtgcc

SEQ ID NO: 381423 - DNA, 15 bp, Homo sapiens
aagggagaagtgcca

SEQ ID NO: 381424 - DNA, 15 bp, Homo sapiens
agggagaagtgccac

SEQ ID NO: 381425 - DNA, 15 bp, Homo sapiens
gggagaagtgccaca

SEQ ID NO: 381426 - DNA, 15 bp, Homo sapiens
ggagaagtgccacac

SEQ ID NO: 381427 - DNA, 15 bp, Homo sapiens
gagaagtgccacaca

SEQ ID NO: 381428 - DNA, 15 bp, Homo sapiens
agaagtgccacacat

SEQ ID NO: 381429 - DNA, 15 bp, Homo sapiens
gaagtgccacacatt

SEQ ID NO: 381430 - DNA, 15 bp, Homo sapiens
aagtgccacacattt

SEQ ID NO: 381431 - DNA, 15 bp, Homo sapiens
agtgccacacatttt

SEQ ID NO: 381432 - DNA, 15 bp, Homo sapiens
gtgccacacatttta

SEQ ID NO: 381433 - DNA, 15 bp, Homo sapiens
tgccacacattttat

SEQ ID NO: 381434 - DNA, 15 bp, Homo sapiens
gccacacattttatt

SEQ ID NO: 381435 - DNA, 15 bp, Homo sapiens
ccacacattttattt

SEQ ID NO: 381436 - DNA, 15 bp, Homo sapiens
cacacattttattta

SEQ ID NO: 381437 - DNA, 15 bp, Homo sapiens
acacattttatttat

SEQ ID NO: 381438 - DNA, 15 bp, Homo sapiens
cacattttatttatt

SEQ ID NO: 381439 - DNA, 15 bp, Homo sapiens
tttatttatttattg

SEQ ID NO: 381440 - DNA, 15 bp, Homo sapiens
ttatttatttattgg

SEQ ID NO: 381441 - DNA, 15 bp, Homo sapiens
tatttatttattgga

SEQ ID NO: 381442 - DNA, 15 bp, Homo sapiens
atttatttattggag

SEQ ID NO: 381443 - DNA, 15 bp, Homo sapiens
tttatttattggaga

SEQ ID NO: 381444 - DNA, 15 bp, Homo sapiens
ttatttattggagac

SEQ ID NO: 381445 - DNA, 15 bp, Homo sapiens
tatttattggagaca

SEQ ID NO: 381446 - DNA, 15 bp, Homo sapiens
atttattggagacat

SEQ ID NO: 381447 - DNA, 15 bp, Homo sapiens
tttattggagacatt

SEQ ID NO: 381448 - DNA, 15 bp, Homo sapiens
ttattggagacattg

SEQ ID NO: 381449 - DNA, 15 bp, Homo sapiens
tattggagacattgt

SEQ ID NO: 381450 - DNA, 15 bp, Homo sapiens
attggagacattgtc

SEQ ID NO: 381451 - DNA, 15 bp, Homo sapiens
ttggagacattgtct

SEQ ID NO: 381452 - DNA, 15 bp, Homo sapiens
tggagacattgtctc

SEQ ID NO: 381453 - DNA, 15 bp, Homo sapiens
ggagacattgtctca

SEQ ID NO: 381454 - DNA, 15 bp, Homo sapiens
gagacattgtctcac

SEQ ID NO: 381455 - DNA, 15 bp, Homo sapiens
agacattgtctcact

SEQ ID NO: 381456 - DNA, 15 bp, Homo sapiens
gacattgtctcactc

SEQ ID NO: 381457 - DNA, 15 bp, Homo sapiens
acattgtctcactct

SEQ ID NO: 381458 - DNA, 15 bp, Homo sapiens
cattgtctcactctg

SEQ ID NO: 381459 - DNA, 15 bp, Homo sapiens
attgtctcactctgc

SEQ ID NO: 381460 - DNA, 15 bp, Homo sapiens
ttgtctcactctgcc

SEQ ID NO: 381461 - DNA, 15 bp, Homo sapiens
tgtctcactctgccg

SEQ ID NO: 381462 - DNA, 15 bp, Homo sapiens
gtctcactctgccgc

SEQ ID NO: 381463 - DNA, 15 bp, Homo sapiens
tctcactctgccgcc

SEQ ID NO: 381464 - DNA, 15 bp, Homo sapiens
ctcactctgccgccc

SEQ ID NO: 381465 - DNA, 15 bp, Homo sapiens
tcactctgccgccca

SEQ ID NO: 381466 - DNA, 15 bp, Homo sapiens
cactctgccgcccag

SEQ ID NO: 381467 - DNA, 15 bp, Homo sapiens
actctgccgcccagg

SEQ ID NO: 381468 - DNA, 15 bp, Homo sapiens
ctgccgcccaggctg

SEQ ID NO: 381469 - DNA, 15 bp, Homo sapiens
tgccgcccaggctgg

SEQ ID NO: 381470 - DNA, 15 bp, Homo sapiens
gccgcccaggctgga

SEQ ID NO: 381471 - DNA, 15 bp, Homo sapiens
ccgcccaggctggaa

SEQ ID NO: 381472 - DNA, 15 bp, Homo sapiens
cgcccaggctggaat

SEQ ID NO: 381473 - DNA, 15 bp, Homo sapiens
ctggaatgcagtggc

SEQ ID NO: 381474 - DNA, 15 bp, Homo sapiens
tggaatgcagtggca

SEQ ID NO: 381475 - DNA, 15 bp, Homo sapiens
ggaatgcagtggcac

SEQ ID NO: 381476 - DNA, 15 bp, Homo sapiens
gaatgcagtggcact

SEQ ID NO: 381477 - DNA, 15 bp, Homo sapiens
aatgcagtggcacta

SEQ ID NO: 381478 - DNA, 15 bp, Homo sapiens
atgcagtggcactat

SEQ ID NO: 381479 - DNA, 15 bp, Homo sapiens
tgcagtggcactatc

SEQ ID NO: 381480 - DNA, 15 bp, Homo sapiens
gcagtggcactatct

SEQ ID NO: 381481 - DNA, 15 bp, Homo sapiens
cagtggcactatctc

SEQ ID NO: 381482 - DNA, 15 bp, Homo sapiens
agtggcactatctca

SEQ ID NO: 381483 - DNA, 15 bp, Homo sapiens
gtggcactatctcag

SEQ ID NO: 381484 - DNA, 15 bp, Homo sapiens
tggcactatctcagc

SEQ ID NO: 381485 - DNA, 15 bp, Homo sapiens
ggcactatctcagct

SEQ ID NO: 381486 - DNA, 15 bp, Homo sapiens
gcactatctcagctc

SEQ ID NO: 381487 - DNA, 15 bp, Homo sapiens
cactatctcagctca

SEQ ID NO: 381488 - DNA, 15 bp, Homo sapiens
actatctcagctcat

SEQ ID NO: 381489 - DNA, 15 bp, Homo sapiens
ctatctcagctcatt

SEQ ID NO: 381490 - DNA, 15 bp, Homo sapiens
tatctcagctcattg

SEQ ID NO: 381491 - DNA, 15 bp, Homo sapiens
atctcagctcattgc

SEQ ID NO: 381492 - DNA, 15 bp, Homo sapiens
tctcagctcattgca

SEQ ID NO: 381493 - DNA, 15 bp, Homo sapiens
ctcagctcattgcaa

SEQ ID NO: 381494 - DNA, 15 bp, Homo sapiens
tcagctcattgcaac

SEQ ID NO: 381495 - DNA, 15 bp, Homo sapiens
cagctcattgcaaca

SEQ ID NO: 381496 - DNA, 15 bp, Homo sapiens
agctcattgcaacag

SEQ ID NO: 381497 - DNA, 15 bp, Homo sapiens
gctcattgcaacagc

SEQ ID NO: 381498 - DNA, 15 bp, Homo sapiens
ctcattgcaacagcc

SEQ ID NO: 381499 - DNA, 15 bp, Homo sapiens
tcattgcaacagcca

SEQ ID NO: 381500 - DNA, 15 bp, Homo sapiens
cattgcaacagccac

SEQ ID NO: 381501 - DNA, 15 bp, Homo sapiens
attgcaacagccacc

SEQ ID NO: 381502 - DNA, 15 bp, Homo sapiens
ttgcaacagccacct

SEQ ID NO: 381503 - DNA, 15 bp, Homo sapiens
tgcaacagccacctc

SEQ ID NO: 381504 - DNA, 15 bp, Homo sapiens
gcaacagccacctct

SEQ ID NO: 381505 - DNA, 15 bp, Homo sapiens
caacagccacctctt

SEQ ID NO: 381506 - DNA, 15 bp, Homo sapiens
aacagccacctcttg

SEQ ID NO: 381507 - DNA, 15 bp, Homo sapiens
acagccacctcttgg

SEQ ID NO: 381508 - DNA, 15 bp, Homo sapiens
cagccacctcttggg

SEQ ID NO: 381509 - DNA, 15 bp, Homo sapiens
agccacctcttgggt

SEQ ID NO: 381510 - DNA, 15 bp, Homo sapiens
gccacctcttgggtt

SEQ ID NO: 381511 - DNA, 15 bp, Homo sapiens
ccacctcttgggttc

SEQ ID NO: 381512 - DNA, 15 bp, Homo sapiens
cacctcttgggttcc

SEQ ID NO: 381513 - DNA, 15 bp, Homo sapiens
acctcttgggttcca

SEQ ID NO: 381514 - DNA, 15 bp, Homo sapiens
cctcttgggttccag

SEQ ID NO: 381515 - DNA, 15 bp, Homo sapiens
ctcttgggttccagc

SEQ ID NO: 381516 - DNA, 15 bp, Homo sapiens
tcttgggttccagcg

SEQ ID NO: 381517 - DNA, 15 bp, Homo sapiens
cttgggttccagcga

SEQ ID NO: 381518 - DNA, 15 bp, Homo sapiens
ttgggttccagcgat

SEQ ID NO: 381519 - DNA, 15 bp, Homo sapiens
tgggttccagcgatt

SEQ ID NO: 381520 - DNA, 15 bp, Homo sapiens
gggttccagcgattc

SEQ ID NO: 381521 - DNA, 15 bp, Homo sapiens
ggttccagcgattct

SEQ ID NO: 381522 - DNA, 15 bp, Homo sapiens
gttccagcgattctt

SEQ ID NO: 381523 - DNA, 15 bp, Homo sapiens
ttccagcgattcttg

SEQ ID NO: 381524 - DNA, 15 bp, Homo sapiens
tccagcgattcttgc

SEQ ID NO: 381525 - DNA, 15 bp, Homo sapiens
ccagcgattcttgcc

SEQ ID NO: 381526 - DNA, 15 bp, Homo sapiens
cagcgattcttgcct

SEQ ID NO: 381527 - DNA, 15 bp, Homo sapiens
agcgattcttgcctc

SEQ ID NO: 381528 - DNA, 15 bp, Homo sapiens
gcgattcttgcctca

SEQ ID NO: 381529 - DNA, 15 bp, Homo sapiens
cgattcttgcctcag

SEQ ID NO: 381530 - DNA, 15 bp, Homo sapiens
gattcttgcctcagc

SEQ ID NO: 381531 - DNA, 15 bp, Homo sapiens
attcttgcctcagcc

SEQ ID NO: 381532 - DNA, 15 bp, Homo sapiens
ttcttgcctcagcct

SEQ ID NO: 381533 - DNA, 15 bp, Homo sapiens
tcttgcctcagcctt

SEQ ID NO: 381534 - DNA, 15 bp, Homo sapiens
cttgcctcagccttc

SEQ ID NO: 381535 - DNA, 15 bp, Homo sapiens
ttgcctcagccttcc

SEQ ID NO: 381536 - DNA, 15 bp, Homo sapiens
tgcctcagccttcca

SEQ ID NO: 381537 - DNA, 15 bp, Homo sapiens
gcctcagccttccaa

SEQ ID NO: 381538 - DNA, 15 bp, Homo sapiens
cctcagccttccaag

SEQ ID NO: 381539 - DNA, 15 bp, Homo sapiens
ctcagccttccaagt

SEQ ID NO: 381540 - DNA, 15 bp, Homo sapiens
tcagccttccaagta

SEQ ID NO: 381541 - DNA, 15 bp, Homo sapiens
cagccttccaagtag

SEQ ID NO: 381542 - DNA, 15 bp, Homo sapiens
agccttccaagtagc

SEQ ID NO: 381543 - DNA, 15 bp, Homo sapiens
gccttccaagtagct

SEQ ID NO: 381544 - DNA, 15 bp, Homo sapiens
ccttccaagtagctg

SEQ ID NO: 381545 - DNA, 15 bp, Homo sapiens
cttccaagtagctgg

SEQ ID NO: 381546 - DNA, 15 bp, Homo sapiens
ttccaagtagctggg

SEQ ID NO: 381547 - DNA, 15 bp, Homo sapiens
tccaagtagctggga

SEQ ID NO: 381548 - DNA, 15 bp, Homo sapiens
caagtagctgggatg

SEQ ID NO: 381549 - DNA, 15 bp, Homo sapiens
aagtagctgggatga

SEQ ID NO: 381550 - DNA, 15 bp, Homo sapiens
agtagctgggatgac

SEQ ID NO: 381551 - DNA, 15 bp, Homo sapiens
gtagctgggatgaca

SEQ ID NO: 381552 - DNA, 15 bp, Homo sapiens
tagctgggatgacag

SEQ ID NO: 381553 - DNA, 15 bp, Homo sapiens
agctgggatgacagg

SEQ ID NO: 381554 - DNA, 15 bp, Homo sapiens
gctgggatgacaggc

SEQ ID NO: 381555 - DNA, 15 bp, Homo sapiens
ctgggatgacaggcg

SEQ ID NO: 381556 - DNA, 15 bp, Homo sapiens
tgggatgacaggcgt

SEQ ID NO: 381557 - DNA, 15 bp, Homo sapiens
gggatgacaggcgtg

SEQ ID NO: 381558 - DNA, 15 bp, Homo sapiens
ggatgacaggcgtgc

SEQ ID NO: 381559 - DNA, 15 bp, Homo sapiens
gatgacaggcgtgca

SEQ ID NO: 381560 - DNA, 15 bp, Homo sapiens
atgacaggcgtgcac

SEQ ID NO: 381561 - DNA, 15 bp, Homo sapiens
tgacaggcgtgcacc

SEQ ID NO: 381562 - DNA, 15 bp, Homo sapiens
gacaggcgtgcacca

SEQ ID NO: 381563 - DNA, 15 bp, Homo sapiens
acaggcgtgcaccac

SEQ ID NO: 381564 - DNA, 15 bp, Homo sapiens
caggcgtgcaccacc

SEQ ID NO: 381565 - DNA, 15 bp, Homo sapiens
aggcgtgcaccacca

SEQ ID NO: 381566 - DNA, 15 bp, Homo sapiens
ggcgtgcaccaccat

SEQ ID NO: 381567 - DNA, 15 bp, Homo sapiens
gcgtgcaccaccatg

SEQ ID NO: 381568 - DNA, 15 bp, Homo sapiens
cgtgcaccaccatgc

SEQ ID NO: 381569 - DNA, 15 bp, Homo sapiens
gtgcaccaccatgcc

SEQ ID NO: 381570 - DNA, 15 bp, Homo sapiens
tgcaccaccatgccc

SEQ ID NO: 381571 - DNA, 15 bp, Homo sapiens
gcaccaccatgccca

SEQ ID NO: 381572 - DNA, 15 bp, Homo sapiens
caccaccatgcccag

SEQ ID NO: 381573 - DNA, 15 bp, Homo sapiens
accaccatgcccagc

SEQ ID NO: 381574 - DNA, 15 bp, Homo sapiens
aatttttgtattttc

SEQ ID NO: 381575 - DNA, 15 bp, Homo sapiens
atttttgtattttct

SEQ ID NO: 381576 - DNA, 15 bp, Homo sapiens
ttttgtattttctgt

SEQ ID NO: 381577 - DNA, 15 bp, Homo sapiens
tttgtattttctgta

SEQ ID NO: 381578 - DNA, 15 bp, Homo sapiens
ttgtattttctgtag

SEQ ID NO: 381579 - DNA, 15 bp, Homo sapiens
tgtattttctgtaga

SEQ ID NO: 381580 - DNA, 15 bp, Homo sapiens
gtattttctgtagag

SEQ ID NO: 381581 - DNA, 15 bp, Homo sapiens
tattttctgtagaga

SEQ ID NO: 381582 - DNA, 15 bp, Homo sapiens
attttctgtagagac

SEQ ID NO: 381583 - DNA, 15 bp, Homo sapiens
ttttctgtagagacg

SEQ ID NO: 381584 - DNA, 15 bp, Homo sapiens
tttctgtagagacgg

SEQ ID NO: 381585 - DNA, 15 bp, Homo sapiens
ttctgtagagacggg

SEQ ID NO: 381586 - DNA, 15 bp, Homo sapiens
tctgtagagacgggg

SEQ ID NO: 381587 - DNA, 15 bp, Homo sapiens
ctgtagagacggggt

SEQ ID NO: 381588 - DNA, 15 bp, Homo sapiens
tgtagagacggggtt

SEQ ID NO: 381589 - DNA, 15 bp, Homo sapiens
gtagagacggggttc

SEQ ID NO: 381590 - DNA, 15 bp, Homo sapiens
tagagacggggttcc

SEQ ID NO: 381591 - DNA, 15 bp, Homo sapiens
agagacggggttccg

SEQ ID NO: 381592 - DNA, 15 bp, Homo sapiens
gagacggggttccgc

SEQ ID NO: 381593 - DNA, 15 bp, Homo sapiens
agacggggttccgcc

SEQ ID NO: 381594 - DNA, 15 bp, Homo sapiens
gacggggttccgcca

SEQ ID NO: 381595 - DNA, 15 bp, Homo sapiens
acggggttccgccat

SEQ ID NO: 381596 - DNA, 15 bp, Homo sapiens
cggggttccgccatg

SEQ ID NO: 381597 - DNA, 15 bp, Homo sapiens
ggggttccgccatgt

SEQ ID NO: 381598 - DNA, 15 bp, Homo sapiens
gggttccgccatgtt

SEQ ID NO: 381599 - DNA, 15 bp, Homo sapiens
ggttccgccatgttg

SEQ ID NO: 381600 - DNA, 15 bp, Homo sapiens
gttccgccatgttgc

SEQ ID NO: 381601 - DNA, 15 bp, Homo sapiens
ttccgccatgttgcc

SEQ ID NO: 381602 - DNA, 15 bp, Homo sapiens
tccgccatgttgccc

SEQ ID NO: 381603 - DNA, 15 bp, Homo sapiens
ccgccatgttgccca

SEQ ID NO: 381604 - DNA, 15 bp, Homo sapiens
cgccatgttgcccag

SEQ ID NO: 381605 - DNA, 15 bp, Homo sapiens
atgttgcccaggctt

SEQ ID NO: 381606 - DNA, 15 bp, Homo sapiens
tgttgcccaggcttg

SEQ ID NO: 381607 - DNA, 15 bp, Homo sapiens
gttgcccaggcttgt

SEQ ID NO: 381608 - DNA, 15 bp, Homo sapiens
ttgcccaggcttgtc

SEQ ID NO: 381609 - DNA, 15 bp, Homo sapiens
tgcccaggcttgtct

SEQ ID NO: 381610 - DNA, 15 bp, Homo sapiens
gcccaggcttgtctg

SEQ ID NO: 381611 - DNA, 15 bp, Homo sapiens
cccaggcttgtctgc

SEQ ID NO: 381612 - DNA, 15 bp, Homo sapiens
ccaggcttgtctgca

SEQ ID NO: 381613 - DNA, 15 bp, Homo sapiens
caggcttgtctgcaa

SEQ ID NO: 381614 - DNA, 15 bp, Homo sapiens
aggcttgtctgcaat

SEQ ID NO: 381615 - DNA, 15 bp, Homo sapiens
ggcttgtctgcaatt

SEQ ID NO: 381616 - DNA, 15 bp, Homo sapiens
gcttgtctgcaattc

SEQ ID NO: 381617 - DNA, 15 bp, Homo sapiens
cttgtctgcaattcc

SEQ ID NO: 381618 - DNA, 15 bp, Homo sapiens
ttgtctgcaattcct

SEQ ID NO: 381619 - DNA, 15 bp, Homo sapiens
tgtctgcaattcctg

SEQ ID NO: 381620 - DNA, 15 bp, Homo sapiens
gtctgcaattcctga

SEQ ID NO: 381621 - DNA, 15 bp, Homo sapiens
tctgcaattcctgag

SEQ ID NO: 381622 - DNA, 15 bp, Homo sapiens
ctgcaattcctgagc

SEQ ID NO: 381623 - DNA, 15 bp, Homo sapiens
tgcaattcctgagct

SEQ ID NO: 381624 - DNA, 15 bp, Homo sapiens
gcaattcctgagctc

SEQ ID NO: 381625 - DNA, 15 bp, Homo sapiens
caattcctgagctca

SEQ ID NO: 381626 - DNA, 15 bp, Homo sapiens
aattcctgagctcaa

SEQ ID NO: 381627 - DNA, 15 bp, Homo sapiens
attcctgagctcaag

SEQ ID NO: 381628 - DNA, 15 bp, Homo sapiens
ttcctgagctcaagt

SEQ ID NO: 381629 - DNA, 15 bp, Homo sapiens
tcctgagctcaagta

SEQ ID NO: 381630 - DNA, 15 bp, Homo sapiens
cctgagctcaagtaa

SEQ ID NO: 381631 - DNA, 15 bp, Homo sapiens
ctgagctcaagtaat

SEQ ID NO: 381632 - DNA, 15 bp, Homo sapiens
tgagctcaagtaatc

SEQ ID NO: 381633 - DNA, 15 bp, Homo sapiens
gagctcaagtaatct

SEQ ID NO: 381634 - DNA, 15 bp, Homo sapiens
agctcaagtaatctg

SEQ ID NO: 381635 - DNA, 15 bp, Homo sapiens
gctcaagtaatctgc

SEQ ID NO: 381636 - DNA, 15 bp, Homo sapiens
ctcaagtaatctgct

SEQ ID NO: 381637 - DNA, 15 bp, Homo sapiens
tcaagtaatctgctc

SEQ ID NO: 381638 - DNA, 15 bp, Homo sapiens
caagtaatctgctca

SEQ ID NO: 381639 - DNA, 15 bp, Homo sapiens
aagtaatctgctcac

SEQ ID NO: 381640 - DNA, 15 bp, Homo sapiens
agtaatctgctcact

SEQ ID NO: 381641 - DNA, 15 bp, Homo sapiens
gtaatctgctcactt

SEQ ID NO: 381642 - DNA, 15 bp, Homo sapiens
taatctgctcacttt

SEQ ID NO: 381643 - DNA, 15 bp, Homo sapiens
aatctgctcactttg

SEQ ID NO: 381644 - DNA, 15 bp, Homo sapiens
atctgctcactttgg

SEQ ID NO: 381645 - DNA, 15 bp, Homo sapiens
tctgctcactttggc

SEQ ID NO: 381646 - DNA, 15 bp, Homo sapiens
ctgctcactttggcc

SEQ ID NO: 381647 - DNA, 15 bp, Homo sapiens
tgctcactttggcct

SEQ ID NO: 381648 - DNA, 15 bp, Homo sapiens
gctcactttggcctc

SEQ ID NO: 381649 - DNA, 15 bp, Homo sapiens
ctcactttggcctcc

SEQ ID NO: 381650 - DNA, 15 bp, Homo sapiens
tcactttggcctccc

SEQ ID NO: 381651 - DNA, 15 bp, Homo sapiens
cactttggcctccca

SEQ ID NO: 381652 - DNA, 15 bp, Homo sapiens
actttggcctcccaa

SEQ ID NO: 381653 - DNA, 15 bp, Homo sapiens
ctttggcctcccaag

SEQ ID NO: 381654 - DNA, 15 bp, Homo sapiens
tttggcctcccaagt

SEQ ID NO: 381655 - DNA, 15 bp, Homo sapiens
tggcctcccaagtgt

SEQ ID NO: 381656 - DNA, 15 bp, Homo sapiens
ggcctcccaagtgtc

SEQ ID NO: 381657 - DNA, 15 bp, Homo sapiens
gcctcccaagtgtca

SEQ ID NO: 381658 - DNA, 15 bp, Homo sapiens
cctcccaagtgtcac

SEQ ID NO: 381659 - DNA, 15 bp, Homo sapiens
ctcccaagtgtcaca

SEQ ID NO: 381660 - DNA, 15 bp, Homo sapiens
tcccaagtgtcacac

SEQ ID NO: 381661 - DNA, 15 bp, Homo sapiens
cccaagtgtcacaca

SEQ ID NO: 381662 - DNA, 15 bp, Homo sapiens
ccaagtgtcacacac

SEQ ID NO: 381663 - DNA, 15 bp, Homo sapiens
caagtgtcacacact

SEQ ID NO: 381664 - DNA, 15 bp, Homo sapiens
aagtgtcacacactg

SEQ ID NO: 381665 - DNA, 15 bp, Homo sapiens
agtgtcacacactgt

SEQ ID NO: 381666 - DNA, 15 bp, Homo sapiens
gtgtcacacactgtt

SEQ ID NO: 381667 - DNA, 15 bp, Homo sapiens
tgtcacacactgtta

SEQ ID NO: 381668 - DNA, 15 bp, Homo sapiens
gtcacacactgttaa

SEQ ID NO: 381669 - DNA, 15 bp, Homo sapiens
tcacacactgttaaa

SEQ ID NO: 381670 - DNA, 15 bp, Homo sapiens
cacacactgttaaac

SEQ ID NO: 381671 - DNA, 15 bp, Homo sapiens
acacactgttaaacc

SEQ ID NO: 381672 - DNA, 15 bp, Homo sapiens
cacactgttaaacca

SEQ ID NO: 381673 - DNA, 15 bp, Homo sapiens
acactgttaaaccat

SEQ ID NO: 381674 - DNA, 15 bp, Homo sapiens
cactgttaaaccatc

SEQ ID NO: 381675 - DNA, 15 bp, Homo sapiens
actgttaaaccatct

SEQ ID NO: 381676 - DNA, 15 bp, Homo sapiens
ctgttaaaccatctg

SEQ ID NO: 381677 - DNA, 15 bp, Homo sapiens
tgttaaaccatctga

SEQ ID NO: 381678 - DNA, 15 bp, Homo sapiens
gttaaaccatctgat

SEQ ID NO: 381679 - DNA, 15 bp, Homo sapiens
ttaaaccatctgatc

SEQ ID NO: 381680 - DNA, 15 bp, Homo sapiens
taaaccatctgatct

SEQ ID NO: 381681 - DNA, 15 bp, Homo sapiens
aaaccatctgatctt

SEQ ID NO: 381682 - DNA, 15 bp, Homo sapiens
aaccatctgatcttg

SEQ ID NO: 381683 - DNA, 15 bp, Homo sapiens
accatctgatcttgt

SEQ ID NO: 381684 - DNA, 15 bp, Homo sapiens
ccatctgatcttgtg

SEQ ID NO: 381685 - DNA, 15 bp, Homo sapiens
catctgatcttgtga

SEQ ID NO: 381686 - DNA, 15 bp, Homo sapiens
atctgatcttgtgag

SEQ ID NO: 381687 - DNA, 15 bp, Homo sapiens
tctgatcttgtgaga

SEQ ID NO: 381688 - DNA, 15 bp, Homo sapiens
ctgatcttgtgagaa

SEQ ID NO: 381689 - DNA, 15 bp, Homo sapiens
tgatcttgtgagaac

SEQ ID NO: 381690 - DNA, 15 bp, Homo sapiens
gatcttgtgagaact

SEQ ID NO: 381691 - DNA, 15 bp, Homo sapiens
atcttgtgagaactc

SEQ ID NO: 381692 - DNA, 15 bp, Homo sapiens
tcttgtgagaactca

SEQ ID NO: 381693 - DNA, 15 bp, Homo sapiens
cttgtgagaactcac

SEQ ID NO: 381694 - DNA, 15 bp, Homo sapiens
ttgtgagaactcact

SEQ ID NO: 381695 - DNA, 15 bp, Homo sapiens
tgtgagaactcacta

SEQ ID NO: 381696 - DNA, 15 bp, Homo sapiens
gtgagaactcactat

SEQ ID NO: 381697 - DNA, 15 bp, Homo sapiens
tgagaactcactatc

SEQ ID NO: 381698 - DNA, 15 bp, Homo sapiens
gagaactcactatca

SEQ ID NO: 381699 - DNA, 15 bp, Homo sapiens
agaactcactatcac

SEQ ID NO: 381700 - DNA, 15 bp, Homo sapiens
gaactcactatcaca

SEQ ID NO: 381701 - DNA, 15 bp, Homo sapiens
aactcactatcacaa

SEQ ID NO: 381702 - DNA, 15 bp, Homo sapiens
tcacaagaacagcac

SEQ ID NO: 381703 - DNA, 15 bp, Homo sapiens
cacaagaacagcaca

SEQ ID NO: 381704 - DNA, 15 bp, Homo sapiens
acaagaacagcacag

SEQ ID NO: 381705 - DNA, 15 bp, Homo sapiens
caagaacagcacagg

SEQ ID NO: 381706 - DNA, 15 bp, Homo sapiens
aagaacagcacaggg

SEQ ID NO: 381707 - DNA, 15 bp, Homo sapiens
agaacagcacagggg

SEQ ID NO: 381708 - DNA, 15 bp, Homo sapiens
gaacagcacagggga

SEQ ID NO: 381709 - DNA, 15 bp, Homo sapiens
aacagcacaggggaa

SEQ ID NO: 381710 - DNA, 15 bp, Homo sapiens
acagcacaggggaaa

SEQ ID NO: 381711 - DNA, 15 bp, Homo sapiens
cagcacaggggaaat

SEQ ID NO: 381712 - DNA, 15 bp, Homo sapiens
agcacaggggaaatt

SEQ ID NO: 381713 - DNA, 15 bp, Homo sapiens
gcacaggggaaattc

SEQ ID NO: 381714 - DNA, 15 bp, Homo sapiens
cacaggggaaattca

SEQ ID NO: 381715 - DNA, 15 bp, Homo sapiens
acaggggaaattcat

SEQ ID NO: 381716 - DNA, 15 bp, Homo sapiens
caggggaaattcatc

SEQ ID NO: 381717 - DNA, 15 bp, Homo sapiens
aggggaaattcatcc

SEQ ID NO: 381718 - DNA, 15 bp, Homo sapiens
ggggaaattcatccc

SEQ ID NO: 381719 - DNA, 15 bp, Homo sapiens
gggaaattcatcccc

SEQ ID NO: 381720 - DNA, 15 bp, Homo sapiens
ggaaattcatcccca

SEQ ID NO: 381721 - DNA, 15 bp, Homo sapiens
gaaattcatccccat

SEQ ID NO: 381722 - DNA, 15 bp, Homo sapiens
aaattcatccccatg

SEQ ID NO: 381723 - DNA, 15 bp, Homo sapiens
aattcatccccatga

SEQ ID NO: 381724 - DNA, 15 bp, Homo sapiens
attcatccccatgat

SEQ ID NO: 381725 - DNA, 15 bp, Homo sapiens
ttcatccccatgatc

SEQ ID NO: 381726 - DNA, 15 bp, Homo sapiens
tcatccccatgatcc

SEQ ID NO: 381727 - DNA, 15 bp, Homo sapiens
catccccatgatcca

SEQ ID NO: 381728 - DNA, 15 bp, Homo sapiens
atccccatgatccag

SEQ ID NO: 381729 - DNA, 15 bp, Homo sapiens
tccccatgatccagt

SEQ ID NO: 381730 - DNA, 15 bp, Homo sapiens
ccccatgatccagtc

SEQ ID NO: 381731 - DNA, 15 bp, Homo sapiens
cccatgatccagtca

SEQ ID NO: 381732 - DNA, 15 bp, Homo sapiens
ccatgatccagtcac

SEQ ID NO: 381733 - DNA, 15 bp, Homo sapiens
catgatccagtcacc

SEQ ID NO: 381734 - DNA, 15 bp, Homo sapiens
atgatccagtcacct

SEQ ID NO: 381735 - DNA, 15 bp, Homo sapiens
tgatccagtcacctc

SEQ ID NO: 381736 - DNA, 15 bp, Homo sapiens
gatccagtcacctcc

SEQ ID NO: 381737 - DNA, 15 bp, Homo sapiens
atccagtcacctccc

SEQ ID NO: 381738 - DNA, 15 bp, Homo sapiens
tccagtcacctccca

SEQ ID NO: 381739 - DNA, 15 bp, Homo sapiens
ccagtcacctcccac

SEQ ID NO: 381740 - DNA, 15 bp, Homo sapiens
cagtcacctcccacc

SEQ ID NO: 381741 - DNA, 15 bp, Homo sapiens
agtcacctcccacca

SEQ ID NO: 381742 - DNA, 15 bp, Homo sapiens
gtcacctcccaccag

SEQ ID NO: 381743 - DNA, 15 bp, Homo sapiens
tcacctcccaccagg

SEQ ID NO: 381744 - DNA, 15 bp, Homo sapiens
cacctcccaccaggc

SEQ ID NO: 381745 - DNA, 15 bp, Homo sapiens
acctcccaccaggct

SEQ ID NO: 381746 - DNA, 15 bp, Homo sapiens
cctcccaccaggctc

SEQ ID NO: 381747 - DNA, 15 bp, Homo sapiens
ctcccaccaggctcc

SEQ ID NO: 381748 - DNA, 15 bp, Homo sapiens
tcccaccaggctcct

SEQ ID NO: 381749 - DNA, 15 bp, Homo sapiens
cccaccaggctcctc

SEQ ID NO: 381750 - DNA, 15 bp, Homo sapiens
ccaccaggctcctcc

SEQ ID NO: 381751 - DNA, 15 bp, Homo sapiens
caccaggctcctcct

SEQ ID NO: 381752 - DNA, 15 bp, Homo sapiens
accaggctcctcctt

SEQ ID NO: 381753 - DNA, 15 bp, Homo sapiens
ccaggctcctccttc

SEQ ID NO: 381754 - DNA, 15 bp, Homo sapiens
caggctcctccttcg

SEQ ID NO: 381755 - DNA, 15 bp, Homo sapiens
aggctcctccttcga

SEQ ID NO: 381756 - DNA, 15 bp, Homo sapiens
ggctcctccttcgat

SEQ ID NO: 381757 - DNA, 15 bp, Homo sapiens
gctcctccttcgatt

SEQ ID NO: 381758 - DNA, 15 bp, Homo sapiens
ctcctccttcgattg

SEQ ID NO: 381759 - DNA, 15 bp, Homo sapiens
tcctccttcgattgg

SEQ ID NO: 381760 - DNA, 15 bp, Homo sapiens
cctccttcgattgga

SEQ ID NO: 381761 - DNA, 15 bp, Homo sapiens
ctccttcgattggac

SEQ ID NO: 381762 - DNA, 15 bp, Homo sapiens
tccttcgattggaca

SEQ ID NO: 381763 - DNA, 15 bp, Homo sapiens
ccttcgattggacat

SEQ ID NO: 381764 - DNA, 15 bp, Homo sapiens
cttcgattggacatg

SEQ ID NO: 381765 - DNA, 15 bp, Homo sapiens
ttcgattggacatga

SEQ ID NO: 381766 - DNA, 15 bp, Homo sapiens
tcgattggacatgag

SEQ ID NO: 381767 - DNA, 15 bp, Homo sapiens
cgattggacatgaga

SEQ ID NO: 381768 - DNA, 15 bp, Homo sapiens
gattggacatgagat

SEQ ID NO: 381769 - DNA, 15 bp, Homo sapiens
attggacatgagatt

SEQ ID NO: 381770 - DNA, 15 bp, Homo sapiens
ttggacatgagattt

SEQ ID NO: 381771 - DNA, 15 bp, Homo sapiens
tggacatgagatttg

SEQ ID NO: 381772 - DNA, 15 bp, Homo sapiens
ggacatgagatttgg

SEQ ID NO: 381773 - DNA, 15 bp, Homo sapiens
gacatgagatttggg

SEQ ID NO: 381774 - DNA, 15 bp, Homo sapiens
acatgagatttgggt

SEQ ID NO: 381775 - DNA, 15 bp, Homo sapiens
catgagatttgggtg

SEQ ID NO: 381776 - DNA, 15 bp, Homo sapiens
gggtggggacacaaa

SEQ ID NO: 381777 - DNA, 15 bp, Homo sapiens
ggtggggacacaaat

SEQ ID NO: 381778 - DNA, 15 bp, Homo sapiens
gtggggacacaaatc

SEQ ID NO: 381779 - DNA, 15 bp, Homo sapiens
tggggacacaaatcc

SEQ ID NO: 381780 - DNA, 15 bp, Homo sapiens
ggggacacaaatcca

SEQ ID NO: 381781 - DNA, 15 bp, Homo sapiens
gggacacaaatccaa

SEQ ID NO: 381782 - DNA, 15 bp, Homo sapiens
ggacacaaatccaaa

SEQ ID NO: 381783 - DNA, 15 bp, Homo sapiens
gacacaaatccaaac

SEQ ID NO: 381784 - DNA, 15 bp, Homo sapiens
acacaaatccaaacc

SEQ ID NO: 381785 - DNA, 15 bp, Homo sapiens
cacaaatccaaacca

SEQ ID NO: 381786 - DNA, 15 bp, Homo sapiens
acaaatccaaaccat

SEQ ID NO: 381787 - DNA, 15 bp, Homo sapiens
caaatccaaaccata

SEQ ID NO: 381788 - DNA, 15 bp, Homo sapiens
aaatccaaaccatat

SEQ ID NO: 381789 - DNA, 15 bp, Homo sapiens
aatccaaaccatatt

SEQ ID NO: 381790 - DNA, 15 bp, Homo sapiens
atccaaaccatatta

SEQ ID NO: 381791 - DNA, 15 bp, Homo sapiens
tccaaaccatattac

SEQ ID NO: 381792 - DNA, 15 bp, Homo sapiens
ccaaaccatattact

SEQ ID NO: 381793 - DNA, 15 bp, Homo sapiens
caaaccatattactt

SEQ ID NO: 381794 - DNA, 15 bp, Homo sapiens
aaaccatattactta

SEQ ID NO: 381795 - DNA, 15 bp, Homo sapiens
aaccatattacttac

SEQ ID NO: 381796 - DNA, 15 bp, Homo sapiens
accatattacttact

SEQ ID NO: 381797 - DNA, 15 bp, Homo sapiens
ccatattacttactt

SEQ ID NO: 381798 - DNA, 15 bp, Homo sapiens
catattacttactta

SEQ ID NO: 381799 - DNA, 15 bp, Homo sapiens
atattacttacttac

SEQ ID NO: 381800 - DNA, 15 bp, Homo sapiens
tattacttacttacc

SEQ ID NO: 381801 - DNA, 15 bp, Homo sapiens
attacttacttaccc

SEQ ID NO: 381802 - DNA, 15 bp, Homo sapiens
ttacttacttaccct

SEQ ID NO: 381803 - DNA, 15 bp, Homo sapiens
tacttacttaccctg

SEQ ID NO: 381804 - DNA, 15 bp, Homo sapiens
acttacttaccctga

SEQ ID NO: 381805 - DNA, 15 bp, Homo sapiens
cttacttaccctgaa

SEQ ID NO: 381806 - DNA, 15 bp, Homo sapiens
ttacttaccctgaag

SEQ ID NO: 381807 - DNA, 15 bp, Homo sapiens
tacttaccctgaagg

SEQ ID NO: 381808 - DNA, 15 bp, Homo sapiens
acttaccctgaaggt

SEQ ID NO: 381809 - DNA, 15 bp, Homo sapiens
cttaccctgaaggtt

SEQ ID NO: 381810 - DNA, 15 bp, Homo sapiens
ttaccctgaaggtta

SEQ ID NO: 381811 - DNA, 15 bp, Homo sapiens
taccctgaaggttat

SEQ ID NO: 381812 - DNA, 15 bp, Homo sapiens
accctgaaggttatt

SEQ ID NO: 381813 - DNA, 15 bp, Homo sapiens
ccctgaaggttattt

SEQ ID NO: 381814 - DNA, 15 bp, Homo sapiens
cctgaaggttatttt

SEQ ID NO: 381815 - DNA, 15 bp, Homo sapiens
ctgaaggttattttt

SEQ ID NO: 381816 - DNA, 15 bp, Homo sapiens
tgaaggttattttta

SEQ ID NO: 381817 - DNA, 15 bp, Homo sapiens
gaaggttatttttat

SEQ ID NO: 381818 - DNA, 15 bp, Homo sapiens
aaggttatttttatt

SEQ ID NO: 381819 - DNA, 15 bp, Homo sapiens
aggttatttttatta

SEQ ID NO: 381820 - DNA, 15 bp, Homo sapiens
ggttatttttattaa

SEQ ID NO: 381821 - DNA, 15 bp, Homo sapiens
gttatttttattaat

SEQ ID NO: 381822 - DNA, 15 bp, Homo sapiens
ttatttttattaata

SEQ ID NO: 381823 - DNA, 15 bp, Homo sapiens
tatttttattaataa

SEQ ID NO: 381824 - DNA, 15 bp, Homo sapiens
atttttattaataag

SEQ ID NO: 381825 - DNA, 15 bp, Homo sapiens
tttttattaataagt

SEQ ID NO: 381826 - DNA, 15 bp, Homo sapiens
ttttattaataagtt

SEQ ID NO: 381827 - DNA, 15 bp, Homo sapiens
tttattaataagttt

SEQ ID NO: 381828 - DNA, 15 bp, Homo sapiens
ttattaataagtttt

SEQ ID NO: 381829 - DNA, 15 bp, Homo sapiens
tattaataagttttt

SEQ ID NO: 381830 - DNA, 15 bp, Homo sapiens
attaataagtttttc

SEQ ID NO: 381831 - DNA, 15 bp, Homo sapiens
ttaataagtttttcc

SEQ ID NO: 381832 - DNA, 15 bp, Homo sapiens
taataagtttttcca

SEQ ID NO: 381833 - DNA, 15 bp, Homo sapiens
aataagtttttccaa

SEQ ID NO: 381834 - DNA, 15 bp, Homo sapiens
ataagtttttccaag

SEQ ID NO: 381835 - DNA, 15 bp, Homo sapiens
taagtttttccaaga

SEQ ID NO: 381836 - DNA, 15 bp, Homo sapiens
aagtttttccaagac

SEQ ID NO: 381837 - DNA, 15 bp, Homo sapiens
agtttttccaagact

SEQ ID NO: 381838 - DNA, 15 bp, Homo sapiens
gtttttccaagactt

SEQ ID NO: 381839 - DNA, 15 bp, Homo sapiens
tttttccaagacttt

SEQ ID NO: 381840 - DNA, 15 bp, Homo sapiens
ttttccaagactttc

SEQ ID NO: 381841 - DNA, 15 bp, Homo sapiens
tttccaagactttca

SEQ ID NO: 381842 - DNA, 15 bp, Homo sapiens
ttccaagactttcat

SEQ ID NO: 381843 - DNA, 15 bp, Homo sapiens
tccaagactttcatt

SEQ ID NO: 381844 - DNA, 15 bp, Homo sapiens
ccaagactttcattt

SEQ ID NO: 381845 - DNA, 15 bp, Homo sapiens
caagactttcatttg

SEQ ID NO: 381846 - DNA, 15 bp, Homo sapiens
aagactttcatttga

SEQ ID NO: 381847 - DNA, 15 bp, Homo sapiens
agactttcatttgag

SEQ ID NO: 381848 - DNA, 15 bp, Homo sapiens
gactttcatttgagg

SEQ ID NO: 381849 - DNA, 15 bp, Homo sapiens
actttcatttgagga

SEQ ID NO: 381850 - DNA, 15 bp, Homo sapiens
ctttcatttgaggac

SEQ ID NO: 381851 - DNA, 15 bp, Homo sapiens
tttcatttgaggact

SEQ ID NO: 381852 - DNA, 15 bp, Homo sapiens
ttcatttgaggacta

SEQ ID NO: 381853 - DNA, 15 bp, Homo sapiens
tcatttgaggactac

SEQ ID NO: 381854 - DNA, 15 bp, Homo sapiens
catttgaggactact

SEQ ID NO: 381855 - DNA, 15 bp, Homo sapiens
atttgaggactacta

SEQ ID NO: 381856 - DNA, 15 bp, Homo sapiens
tttgaggactactat

SEQ ID NO: 381857 - DNA, 15 bp, Homo sapiens
ttgaggactactata

SEQ ID NO: 381858 - DNA, 15 bp, Homo sapiens
tgaggactactatag

SEQ ID NO: 381859 - DNA, 15 bp, Homo sapiens
gaggactactatagt

SEQ ID NO: 381860 - DNA, 15 bp, Homo sapiens
aggactactatagtg

SEQ ID NO: 381861 - DNA, 15 bp, Homo sapiens
ggactactatagtga

SEQ ID NO: 381862 - DNA, 15 bp, Homo sapiens
gactactatagtgaa

SEQ ID NO: 381863 - DNA, 15 bp, Homo sapiens
actactatagtgaac

SEQ ID NO: 381864 - DNA, 15 bp, Homo sapiens
ctactatagtgaaca

SEQ ID NO: 381865 - DNA, 15 bp, Homo sapiens
tactatagtgaacaa

SEQ ID NO: 381866 - DNA, 15 bp, Homo sapiens
actatagtgaacaaa

SEQ ID NO: 381867 - DNA, 15 bp, Homo sapiens
ctatagtgaacaaat

SEQ ID NO: 381868 - DNA, 15 bp, Homo sapiens
tatagtgaacaaatc

SEQ ID NO: 381869 - DNA, 15 bp, Homo sapiens
atagtgaacaaatca

SEQ ID NO: 381870 - DNA, 15 bp, Homo sapiens
tagtgaacaaatcag

SEQ ID NO: 381871 - DNA, 15 bp, Homo sapiens
agtgaacaaatcaga

SEQ ID NO: 381872 - DNA, 15 bp, Homo sapiens
gtgaacaaatcagat

SEQ ID NO: 381873 - DNA, 15 bp, Homo sapiens
tgaacaaatcagata

SEQ ID NO: 381874 - DNA, 15 bp, Homo sapiens
gaacaaatcagataa

SEQ ID NO: 381875 - DNA, 15 bp, Homo sapiens
aacaaatcagataag

SEQ ID NO: 381876 - DNA, 15 bp, Homo sapiens
acaaatcagataagt

SEQ ID NO: 381877 - DNA, 15 bp, Homo sapiens
caaatcagataagta

SEQ ID NO: 381878 - DNA, 15 bp, Homo sapiens
aaatcagataagtaa

SEQ ID NO: 381879 - DNA, 15 bp, Homo sapiens
aatcagataagtaag

SEQ ID NO: 381880 - DNA, 15 bp, Homo sapiens
atcagataagtaagt

SEQ ID NO: 381881 - DNA, 15 bp, Homo sapiens
tcagataagtaagtt

SEQ ID NO: 381882 - DNA, 15 bp, Homo sapiens
cagataagtaagttt

SEQ ID NO: 381883 - DNA, 15 bp, Homo sapiens
agataagtaagttta

SEQ ID NO: 381884 - DNA, 15 bp, Homo sapiens
gataagtaagtttag

SEQ ID NO: 381885 - DNA, 15 bp, Homo sapiens
ataagtaagtttagt

SEQ ID NO: 381886 - DNA, 15 bp, Homo sapiens
taagtaagtttagtt

SEQ ID NO: 381887 - DNA, 15 bp, Homo sapiens
aagtaagtttagttt

SEQ ID NO: 381888 - DNA, 15 bp, Homo sapiens
agtaagtttagtttc

SEQ ID NO: 381889 - DNA, 15 bp, Homo sapiens
gtaagtttagtttcc

SEQ ID NO: 381890 - DNA, 15 bp, Homo sapiens
taagtttagtttcct

SEQ ID NO: 381891 - DNA, 15 bp, Homo sapiens
aagtttagtttcctt

SEQ ID NO: 381892 - DNA, 15 bp, Homo sapiens
agtttagtttccttt

SEQ ID NO: 381893 - DNA, 15 bp, Homo sapiens
gtttagtttccttta

SEQ ID NO: 381894 - DNA, 15 bp, Homo sapiens
tttagtttcctttaa

SEQ ID NO: 381895 - DNA, 15 bp, Homo sapiens
ttagtttcctttaat

SEQ ID NO: 381896 - DNA, 15 bp, Homo sapiens
tagtttcctttaatg

SEQ ID NO: 381897 - DNA, 15 bp, Homo sapiens
agtttcctttaatga

SEQ ID NO: 381898 - DNA, 15 bp, Homo sapiens
gtttcctttaatgac

SEQ ID NO: 381899 - DNA, 15 bp, Homo sapiens
tttcctttaatgact

SEQ ID NO: 381900 - DNA, 15 bp, Homo sapiens
ttcctttaatgactt

SEQ ID NO: 381901 - DNA, 15 bp, Homo sapiens
tcctttaatgacttt

SEQ ID NO: 381902 - DNA, 15 bp, Homo sapiens
cctttaatgactttt

SEQ ID NO: 381903 - DNA, 15 bp, Homo sapiens
ctttaatgacttttt

SEQ ID NO: 381904 - DNA, 15 bp, Homo sapiens
tttaatgacttttta

SEQ ID NO: 381905 - DNA, 15 bp, Homo sapiens
ttaatgactttttaa

SEQ ID NO: 381906 - DNA, 15 bp, Homo sapiens
taatgactttttaac

SEQ ID NO: 381907 - DNA, 15 bp, Homo sapiens
aatgactttttaacc

SEQ ID NO: 381908 - DNA, 15 bp, Homo sapiens
atgactttttaacca

SEQ ID NO: 381909 - DNA, 15 bp, Homo sapiens
tgactttttaaccaa

SEQ ID NO: 381910 - DNA, 15 bp, Homo sapiens
gactttttaaccaaa

SEQ ID NO: 381911 - DNA, 15 bp, Homo sapiens
actttttaaccaaac

SEQ ID NO: 381912 - DNA, 15 bp, Homo sapiens
ctttttaaccaaact

SEQ ID NO: 381913 - DNA, 15 bp, Homo sapiens
tttttaaccaaactg

SEQ ID NO: 381914 - DNA, 15 bp, Homo sapiens
ttttaaccaaactgt

SEQ ID NO: 381915 - DNA, 15 bp, Homo sapiens
tttaaccaaactgtt

SEQ ID NO: 381916 - DNA, 15 bp, Homo sapiens
ttaaccaaactgttt

SEQ ID NO: 381917 - DNA, 15 bp, Homo sapiens
taaccaaactgtttt

SEQ ID NO: 381918 - DNA, 15 bp, Homo sapiens
aaccaaactgtttta

SEQ ID NO: 381919 - DNA, 15 bp, Homo sapiens
accaaactgttttat

SEQ ID NO: 381920 - DNA, 15 bp, Homo sapiens
ccaaactgttttatc

SEQ ID NO: 381921 - DNA, 15 bp, Homo sapiens
caaactgttttatca

SEQ ID NO: 381922 - DNA, 15 bp, Homo sapiens
aaactgttttatcaa

SEQ ID NO: 381923 - DNA, 15 bp, Homo sapiens
aactgttttatcaat

SEQ ID NO: 381924 - DNA, 15 bp, Homo sapiens
actgttttatcaatt

SEQ ID NO: 381925 - DNA, 15 bp, Homo sapiens
ctgttttatcaattt

SEQ ID NO: 381926 - DNA, 15 bp, Homo sapiens
tgttttatcaatttc

SEQ ID NO: 381927 - DNA, 15 bp, Homo sapiens
gttttatcaatttcg

SEQ ID NO: 381928 - DNA, 15 bp, Homo sapiens
tttatcaatttcgta

SEQ ID NO: 381929 - DNA, 15 bp, Homo sapiens
ttatcaatttcgtaa

SEQ ID NO: 381930 - DNA, 15 bp, Homo sapiens
tatcaatttcgtaat

SEQ ID NO: 381931 - DNA, 15 bp, Homo sapiens
atcaatttcgtaata

SEQ ID NO: 381932 - DNA, 15 bp, Homo sapiens
tcaatttcgtaatag

SEQ ID NO: 381933 - DNA, 15 bp, Homo sapiens
caatttcgtaatagc

SEQ ID NO: 381934 - DNA, 15 bp, Homo sapiens
aatttcgtaatagca

SEQ ID NO: 381935 - DNA, 15 bp, Homo sapiens
atttcgtaatagcag

SEQ ID NO: 381936 - DNA, 15 bp, Homo sapiens
tttcgtaatagcaga

SEQ ID NO: 381937 - DNA, 15 bp, Homo sapiens
ttcgtaatagcagac

SEQ ID NO: 381938 - DNA, 15 bp, Homo sapiens
tcgtaatagcagaca

SEQ ID NO: 381939 - DNA, 15 bp, Homo sapiens
cgtaatagcagacat

SEQ ID NO: 381940 - DNA, 15 bp, Homo sapiens
gtaatagcagacatc

SEQ ID NO: 381941 - DNA, 15 bp, Homo sapiens
taatagcagacatct

SEQ ID NO: 381942 - DNA, 15 bp, Homo sapiens
aatagcagacatctt

SEQ ID NO: 381943 - DNA, 15 bp, Homo sapiens
atagcagacatcttt

SEQ ID NO: 381944 - DNA, 15 bp, Homo sapiens
tagcagacatctttt

SEQ ID NO: 381945 - DNA, 15 bp, Homo sapiens
agcagacatcttttt

SEQ ID NO: 381946 - DNA, 15 bp, Homo sapiens
gcagacatctttttt

SEQ ID NO: 381947 - DNA, 15 bp, Homo sapiens
cagacatcttttttg

SEQ ID NO: 381948 - DNA, 15 bp, Homo sapiens
agacatcttttttgt

SEQ ID NO: 381949 - DNA, 15 bp, Homo sapiens
gacatcttttttgtc

SEQ ID NO: 381950 - DNA, 15 bp, Homo sapiens
acatcttttttgtca

SEQ ID NO: 381951 - DNA, 15 bp, Homo sapiens
catcttttttgtcat

SEQ ID NO: 381952 - DNA, 15 bp, Homo sapiens
atcttttttgtcatc

SEQ ID NO: 381953 - DNA, 15 bp, Homo sapiens
tcttttttgtcatca

SEQ ID NO: 381954 - DNA, 15 bp, Homo sapiens
cttttttgtcatcag

SEQ ID NO: 381955 - DNA, 15 bp, Homo sapiens
ttttttgtcatcagt

SEQ ID NO: 381956 - DNA, 15 bp, Homo sapiens
tttttgtcatcagtt

SEQ ID NO: 381957 - DNA, 15 bp, Homo sapiens
ttttgtcatcagttc

SEQ ID NO: 381958 - DNA, 15 bp, Homo sapiens
tttgtcatcagttca

SEQ ID NO: 381959 - DNA, 15 bp, Homo sapiens
ttgtcatcagttcag

SEQ ID NO: 381960 - DNA, 15 bp, Homo sapiens
tgtcatcagttcagt

SEQ ID NO: 381961 - DNA, 15 bp, Homo sapiens
gtcatcagttcagtt

SEQ ID NO: 381962 - DNA, 15 bp, Homo sapiens
tcatcagttcagtta

SEQ ID NO: 381963 - DNA, 15 bp, Homo sapiens
catcagttcagttat

SEQ ID NO: 381964 - DNA, 15 bp, Homo sapiens
atcagttcagttata

SEQ ID NO: 381965 - DNA, 15 bp, Homo sapiens
tcagttcagttatag

SEQ ID NO: 381966 - DNA, 15 bp, Homo sapiens
cagttcagttataga

SEQ ID NO: 381967 - DNA, 15 bp, Homo sapiens
agttcagttatagag

SEQ ID NO: 381968 - DNA, 15 bp, Homo sapiens
gttcagttatagagt

SEQ ID NO: 381969 - DNA, 15 bp, Homo sapiens
ttcagttatagagtt

SEQ ID NO: 381970 - DNA, 15 bp, Homo sapiens
tcagttatagagttg

SEQ ID NO: 381971 - DNA, 15 bp, Homo sapiens
cagttatagagttga

SEQ ID NO: 381972 - DNA, 15 bp, Homo sapiens
agttatagagttgat

SEQ ID NO: 381973 - DNA, 15 bp, Homo sapiens
gttatagagttgata

SEQ ID NO: 381974 - DNA, 15 bp, Homo sapiens
ttatagagttgataa

SEQ ID NO: 381975 - DNA, 15 bp, Homo sapiens
tatagagttgataat

SEQ ID NO: 381976 - DNA, 15 bp, Homo sapiens
atagagttgataata

SEQ ID NO: 381977 - DNA, 15 bp, Homo sapiens
tagagttgataatat

SEQ ID NO: 381978 - DNA, 15 bp, Homo sapiens
agagttgataatatt

SEQ ID NO: 381979 - DNA, 15 bp, Homo sapiens
gagttgataatattg

SEQ ID NO: 381980 - DNA, 15 bp, Homo sapiens
agttgataatattga

SEQ ID NO: 381981 - DNA, 15 bp, Homo sapiens
gttgataatattgaa

SEQ ID NO: 381982 - DNA, 15 bp, Homo sapiens
ttgataatattgaac

SEQ ID NO: 381983 - DNA, 15 bp, Homo sapiens
tgataatattgaaca

SEQ ID NO: 381984 - DNA, 15 bp, Homo sapiens
gataatattgaacaa

SEQ ID NO: 381985 - DNA, 15 bp, Homo sapiens
ataatattgaacaac

SEQ ID NO: 381986 - DNA, 15 bp, Homo sapiens
taatattgaacaact

SEQ ID NO: 381987 - DNA, 15 bp, Homo sapiens
aatattgaacaacta

SEQ ID NO: 381988 - DNA, 15 bp, Homo sapiens
atattgaacaactat

SEQ ID NO: 381989 - DNA, 15 bp, Homo sapiens
tattgaacaactatg

SEQ ID NO: 381990 - DNA, 15 bp, Homo sapiens
attgaacaactatgg

SEQ ID NO: 381991 - DNA, 15 bp, Homo sapiens
ttgaacaactatggt

SEQ ID NO: 381992 - DNA, 15 bp, Homo sapiens
tgaacaactatggta

SEQ ID NO: 381993 - DNA, 15 bp, Homo sapiens
gaacaactatggtat

SEQ ID NO: 381994 - DNA, 15 bp, Homo sapiens
aacaactatggtatt

SEQ ID NO: 381995 - DNA, 15 bp, Homo sapiens
acaactatggtattt

SEQ ID NO: 381996 - DNA, 15 bp, Homo sapiens
caactatggtatttt

SEQ ID NO: 381997 - DNA, 15 bp, Homo sapiens
aactatggtattttt

SEQ ID NO: 381998 - DNA, 15 bp, Homo sapiens
actatggtattttta

SEQ ID NO: 381999 - DNA, 15 bp, Homo sapiens
ctatggtatttttaa

SEQ ID NO: 382000 - DNA, 15 bp, Homo sapiens
tatggtatttttaaa

SEQ ID NO: 382001 - DNA, 15 bp, Homo sapiens
atggtatttttaaaa

SEQ ID NO: 382002 - DNA, 15 bp, Homo sapiens
tggtatttttaaaag

SEQ ID NO: 382003 - DNA, 15 bp, Homo sapiens
ggtatttttaaaagt

SEQ ID NO: 382004 - DNA, 15 bp, Homo sapiens
gtatttttaaaagtg

SEQ ID NO: 382005 - DNA, 15 bp, Homo sapiens
tatttttaaaagtgc

SEQ ID NO: 382006 - DNA, 15 bp, Homo sapiens
atttttaaaagtgct

SEQ ID NO: 382007 - DNA, 15 bp, Homo sapiens
tttttaaaagtgctt

SEQ ID NO: 382008 - DNA, 15 bp, Homo sapiens
ttttaaaagtgcttt

SEQ ID NO: 382009 - DNA, 15 bp, Homo sapiens
tttaaaagtgctttt

SEQ ID NO: 382010 - DNA, 15 bp, Homo sapiens
ttaaaagtgctttta

SEQ ID NO: 382011 - DNA, 15 bp, Homo sapiens
taaaagtgcttttaa

SEQ ID NO: 382012 - DNA, 15 bp, Homo sapiens
aaaagtgcttttaag

SEQ ID NO: 382013 - DNA, 15 bp, Homo sapiens
aaagtgcttttaaga

SEQ ID NO: 382014 - DNA, 15 bp, Homo sapiens
aagtgcttttaagat

SEQ ID NO: 382015 - DNA, 15 bp, Homo sapiens
agtgcttttaagatt

SEQ ID NO: 382016 - DNA, 15 bp, Homo sapiens
gtgcttttaagattc

SEQ ID NO: 382017 - DNA, 15 bp, Homo sapiens
gcttttaagattctc

SEQ ID NO: 382018 - DNA, 15 bp, Homo sapiens
cttttaagattctct

SEQ ID NO: 382019 - DNA, 15 bp, Homo sapiens
ttttaagattctctg

SEQ ID NO: 382020 - DNA, 15 bp, Homo sapiens
tttaagattctctgt

SEQ ID NO: 382021 - DNA, 15 bp, Homo sapiens
ttaagattctctgta

SEQ ID NO: 382022 - DNA, 15 bp, Homo sapiens
taagattctctgtat

SEQ ID NO: 382023 - DNA, 15 bp, Homo sapiens
aagattctctgtata

SEQ ID NO: 382024 - DNA, 15 bp, Homo sapiens
agattctctgtataa

SEQ ID NO: 382025 - DNA, 15 bp, Homo sapiens
gattctctgtataaa

SEQ ID NO: 382026 - DNA, 15 bp, Homo sapiens
attctctgtataaaa

SEQ ID NO: 382027 - DNA, 15 bp, Homo sapiens
ttctctgtataaaat

SEQ ID NO: 382028 - DNA, 15 bp, Homo sapiens
tctctgtataaaatt

SEQ ID NO: 382029 - DNA, 15 bp, Homo sapiens
ctctgtataaaatta

SEQ ID NO: 382030 - DNA, 15 bp, Homo sapiens
tctgtataaaattat

SEQ ID NO: 382031 - DNA, 15 bp, Homo sapiens
ctgtataaaattata

SEQ ID NO: 382032 - DNA, 15 bp, Homo sapiens
tgtataaaattataa

SEQ ID NO: 382033 - DNA, 15 bp, Homo sapiens
gtataaaattataaa

SEQ ID NO: 382034 - DNA, 15 bp, Homo sapiens
tataaaattataaaa

SEQ ID NO: 382035 - DNA, 15 bp, Homo sapiens
ataaaattataaaat

SEQ ID NO: 382036 - DNA, 15 bp, Homo sapiens
taaaattataaaata

SEQ ID NO: 382037 - DNA, 15 bp, Homo sapiens
aaaattataaaatat

SEQ ID NO: 382038 - DNA, 15 bp, Homo sapiens
aaattataaaatatt

SEQ ID NO: 382039 - DNA, 15 bp, Homo sapiens
aattataaaatattc

SEQ ID NO: 382040 - DNA, 15 bp, Homo sapiens
attataaaatattct

SEQ ID NO: 382041 - DNA, 15 bp, Homo sapiens
ttataaaatattctt

SEQ ID NO: 382042 - DNA, 15 bp, Homo sapiens
tataaaatattcttg

SEQ ID NO: 382043 - DNA, 15 bp, Homo sapiens
ataaaatattcttga

SEQ ID NO: 382044 - DNA, 15 bp, Homo sapiens
taaaatattcttgaa

SEQ ID NO: 382045 - DNA, 15 bp, Homo sapiens
aaaatattcttgaat

SEQ ID NO: 382046 - DNA, 15 bp, Homo sapiens
aaatattcttgaatt

SEQ ID NO: 382047 - DNA, 15 bp, Homo sapiens
aatattcttgaattg

SEQ ID NO: 382048 - DNA, 15 bp, Homo sapiens
atattcttgaattgg

SEQ ID NO: 382049 - DNA, 15 bp, Homo sapiens
tattcttgaattgga

SEQ ID NO: 382050 - DNA, 15 bp, Homo sapiens
attcttgaattggag

SEQ ID NO: 382051 - DNA, 15 bp, Homo sapiens
ttcttgaattggagg

SEQ ID NO: 382052 - DNA, 15 bp, Homo sapiens
tcttgaattggaggt

SEQ ID NO: 382053 - DNA, 15 bp, Homo sapiens
cttgaattggaggtt

SEQ ID NO: 382054 - DNA, 15 bp, Homo sapiens
ttgaattggaggttt

SEQ ID NO: 382055 - DNA, 15 bp, Homo sapiens
tgaattggaggtttt

SEQ ID NO: 382056 - DNA, 15 bp, Homo sapiens
gaattggaggtttta

SEQ ID NO: 382057 - DNA, 15 bp, Homo sapiens
aattggaggttttag

SEQ ID NO: 382058 - DNA, 15 bp, Homo sapiens
attggaggttttagt

SEQ ID NO: 382059 - DNA, 15 bp, Homo sapiens
ttggaggttttagtt

SEQ ID NO: 382060 - DNA, 15 bp, Homo sapiens
tggaggttttagttg

SEQ ID NO: 382061 - DNA, 15 bp, Homo sapiens
ggaggttttagttgt

SEQ ID NO: 382062 - DNA, 15 bp, Homo sapiens
gaggttttagttgtg

SEQ ID NO: 382063 - DNA, 15 bp, Homo sapiens
aggttttagttgtga

SEQ ID NO: 382064 - DNA, 15 bp, Homo sapiens
ggttttagttgtgag

SEQ ID NO: 382065 - DNA, 15 bp, Homo sapiens
gttttagttgtgagg

SEQ ID NO: 382066 - DNA, 15 bp, Homo sapiens
ttttagttgtgaggt

SEQ ID NO: 382067 - DNA, 15 bp, Homo sapiens
tttagttgtgaggtt

SEQ ID NO: 382068 - DNA, 15 bp, Homo sapiens
ttagttgtgaggtta

SEQ ID NO: 382069 - DNA, 15 bp, Homo sapiens
tagttgtgaggttat

SEQ ID NO: 382070 - DNA, 15 bp, Homo sapiens
agttgtgaggttata

SEQ ID NO: 382071 - DNA, 15 bp, Homo sapiens
gttgtgaggttatag

SEQ ID NO: 382072 - DNA, 15 bp, Homo sapiens
ttgtgaggttatagt

SEQ ID NO: 382073 - DNA, 15 bp, Homo sapiens
tgtgaggttatagtt

SEQ ID NO: 382074 - DNA, 15 bp, Homo sapiens
gtgaggttatagttt

SEQ ID NO: 382075 - DNA, 15 bp, Homo sapiens
tgaggttatagtttg

SEQ ID NO: 382076 - DNA, 15 bp, Homo sapiens
gaggttatagtttgg

SEQ ID NO: 382077 - DNA, 15 bp, Homo sapiens
aggttatagtttggt

SEQ ID NO: 382078 - DNA, 15 bp, Homo sapiens
ggttatagtttggta

SEQ ID NO: 382079 - DNA, 15 bp, Homo sapiens
gttatagtttggtat

SEQ ID NO: 382080 - DNA, 15 bp, Homo sapiens
ttatagtttggtata

SEQ ID NO: 382081 - DNA, 15 bp, Homo sapiens
tatagtttggtataa

SEQ ID NO: 382082 - DNA, 15 bp, Homo sapiens
atagtttggtataac

SEQ ID NO: 382083 - DNA, 15 bp, Homo sapiens
tagtttggtataaca

SEQ ID NO: 382084 - DNA, 15 bp, Homo sapiens
agtttggtataacat

SEQ ID NO: 382085 - DNA, 15 bp, Homo sapiens
gtttggtataacatt

SEQ ID NO: 382086 - DNA, 15 bp, Homo sapiens
tttggtataacattt

SEQ ID NO: 382087 - DNA, 15 bp, Homo sapiens
ttggtataacattta

SEQ ID NO: 382088 - DNA, 15 bp, Homo sapiens
tggtataacatttat

SEQ ID NO: 382089 - DNA, 15 bp, Homo sapiens
ggtataacatttatt

SEQ ID NO: 382090 - DNA, 15 bp, Homo sapiens
gtataacatttattt

SEQ ID NO: 382091 - DNA, 15 bp, Homo sapiens
tataacatttatttg

SEQ ID NO: 382092 - DNA, 15 bp, Homo sapiens
ataacatttatttgc

SEQ ID NO: 382093 - DNA, 15 bp, Homo sapiens
taacatttatttgcc

SEQ ID NO: 382094 - DNA, 15 bp, Homo sapiens
aacatttatttgccc

SEQ ID NO: 382095 - DNA, 15 bp, Homo sapiens
acatttatttgccct

SEQ ID NO: 382096 - DNA, 15 bp, Homo sapiens
catttatttgccctt

SEQ ID NO: 382097 - DNA, 15 bp, Homo sapiens
atttatttgcccttc

SEQ ID NO: 382098 - DNA, 15 bp, Homo sapiens
tttatttgcccttca

SEQ ID NO: 382099 - DNA, 15 bp, Homo sapiens
ttatttgcccttcag

SEQ ID NO: 382100 - DNA, 15 bp, Homo sapiens
tatttgcccttcagc

SEQ ID NO: 382101 - DNA, 15 bp, Homo sapiens
atttgcccttcagct

SEQ ID NO: 382102 - DNA, 15 bp, Homo sapiens
tttgcccttcagcta

SEQ ID NO: 382103 - DNA, 15 bp, Homo sapiens
ttgcccttcagctag

SEQ ID NO: 382104 - DNA, 15 bp, Homo sapiens
tgcccttcagctagc

SEQ ID NO: 382105 - DNA, 15 bp, Homo sapiens
gcccttcagctagcc

SEQ ID NO: 382106 - DNA, 15 bp, Homo sapiens
cccttcagctagcct

SEQ ID NO: 382107 - DNA, 15 bp, Homo sapiens
ccttcagctagccta

SEQ ID NO: 382108 - DNA, 15 bp, Homo sapiens
cttcagctagcctaa

SEQ ID NO: 382109 - DNA, 15 bp, Homo sapiens
ttcagctagcctaag

SEQ ID NO: 382110 - DNA, 15 bp, Homo sapiens
tcagctagcctaaga

SEQ ID NO: 382111 - DNA, 15 bp, Homo sapiens
cagctagcctaagat

SEQ ID NO: 382112 - DNA, 15 bp, Homo sapiens
agctagcctaagatg

SEQ ID NO: 382113 - DNA, 15 bp, Homo sapiens
gctagcctaagatgg

SEQ ID NO: 382114 - DNA, 15 bp, Homo sapiens
ctagcctaagatgga

SEQ ID NO: 382115 - DNA, 15 bp, Homo sapiens
tagcctaagatggaa

SEQ ID NO: 382116 - DNA, 15 bp, Homo sapiens
agcctaagatggaag

SEQ ID NO: 382117 - DNA, 15 bp, Homo sapiens
gcctaagatggaagt

SEQ ID NO: 382118 - DNA, 15 bp, Homo sapiens
cctaagatggaagtg

SEQ ID NO: 382119 - DNA, 15 bp, Homo sapiens
ctaagatggaagtgt

SEQ ID NO: 382120 - DNA, 15 bp, Homo sapiens
taagatggaagtgta

SEQ ID NO: 382121 - DNA, 15 bp, Homo sapiens
aagatggaagtgtat

SEQ ID NO: 382122 - DNA, 15 bp, Homo sapiens
agatggaagtgtata

SEQ ID NO: 382123 - DNA, 15 bp, Homo sapiens
gatggaagtgtatat

SEQ ID NO: 382124 - DNA, 15 bp, Homo sapiens
atggaagtgtatatt

SEQ ID NO: 382125 - DNA, 15 bp, Homo sapiens
tggaagtgtatattt

SEQ ID NO: 382126 - DNA, 15 bp, Homo sapiens
ggaagtgtatatttg

SEQ ID NO: 382127 - DNA, 15 bp, Homo sapiens
gaagtgtatatttgt

SEQ ID NO: 382128 - DNA, 15 bp, Homo sapiens
aagtgtatatttgtg

SEQ ID NO: 382129 - DNA, 15 bp, Homo sapiens
agtgtatatttgtga

SEQ ID NO: 382130 - DNA, 15 bp, Homo sapiens
gtgtatatttgtgaa

SEQ ID NO: 382131 - DNA, 15 bp, Homo sapiens
tgtatatttgtgaag

SEQ ID NO: 382132 - DNA, 15 bp, Homo sapiens
gtatatttgtgaaga

SEQ ID NO: 382133 - DNA, 15 bp, Homo sapiens
tatatttgtgaagaa

SEQ ID NO: 382134 - DNA, 15 bp, Homo sapiens
atatttgtgaagaat

SEQ ID NO: 382135 - DNA, 15 bp, Homo sapiens
tatttgtgaagaatt

SEQ ID NO: 382136 - DNA, 15 bp, Homo sapiens
atttgtgaagaattt

SEQ ID NO: 382137 - DNA, 15 bp, Homo sapiens
tttgtgaagaattta

SEQ ID NO: 382138 - DNA, 15 bp, Homo sapiens
ttgtgaagaatttaa

SEQ ID NO: 382139 - DNA, 15 bp, Homo sapiens
tgtgaagaatttaag

SEQ ID NO: 382140 - DNA, 15 bp, Homo sapiens
gtgaagaatttaaga

SEQ ID NO: 382141 - DNA, 15 bp, Homo sapiens
tgaagaatttaagaa

SEQ ID NO: 382142 - DNA, 15 bp, Homo sapiens
gaagaatttaagaaa

SEQ ID NO: 382143 - DNA, 15 bp, Homo sapiens
aagaatttaagaaag

SEQ ID NO: 382144 - DNA, 15 bp, Homo sapiens
agaatttaagaaagt

SEQ ID NO: 382145 - DNA, 15 bp, Homo sapiens
gaatttaagaaagta

SEQ ID NO: 382146 - DNA, 15 bp, Homo sapiens
aatttaagaaagtat

SEQ ID NO: 382147 - DNA, 15 bp, Homo sapiens
atttaagaaagtata

SEQ ID NO: 382148 - DNA, 15 bp, Homo sapiens
tttaagaaagtatat

SEQ ID NO: 382149 - DNA, 15 bp, Homo sapiens
ttaagaaagtatatg

SEQ ID NO: 382150 - DNA, 15 bp, Homo sapiens
taagaaagtatatgt

SEQ ID NO: 382151 - DNA, 15 bp, Homo sapiens
aagaaagtatatgta

SEQ ID NO: 382152 - DNA, 15 bp, Homo sapiens
agaaagtatatgtag

SEQ ID NO: 382153 - DNA, 15 bp, Homo sapiens
gaaagtatatgtaga

SEQ ID NO: 382154 - DNA, 15 bp, Homo sapiens
aaagtatatgtagaa

SEQ ID NO: 382155 - DNA, 15 bp, Homo sapiens
aagtatatgtagaaa

SEQ ID NO: 382156 - DNA, 15 bp, Homo sapiens
agtatatgtagaaaa

SEQ ID NO: 382157 - DNA, 15 bp, Homo sapiens
gtatatgtagaaaac

SEQ ID NO: 382158 - DNA, 15 bp, Homo sapiens
tatatgtagaaaaca

SEQ ID NO: 382159 - DNA, 15 bp, Homo sapiens
atatgtagaaaacaa

SEQ ID NO: 382160 - DNA, 15 bp, Homo sapiens
tatgtagaaaacaat

SEQ ID NO: 382161 - DNA, 15 bp, Homo sapiens
atgtagaaaacaatc

SEQ ID NO: 382162 - DNA, 15 bp, Homo sapiens
tgtagaaaacaatcg

SEQ ID NO: 382163 - DNA, 15 bp, Homo sapiens
gtagaaaacaatcga

SEQ ID NO: 382164 - DNA, 15 bp, Homo sapiens
tagaaaacaatcgaa

SEQ ID NO: 382165 - DNA, 15 bp, Homo sapiens
agaaaacaatcgaaa

SEQ ID NO: 382166 - DNA, 15 bp, Homo sapiens
gaaaacaatcgaaaa

SEQ ID NO: 382167 - DNA, 15 bp, Homo sapiens
aaaacaatcgaaaat

SEQ ID NO: 382168 - DNA, 15 bp, Homo sapiens
aaacaatcgaaaatg

SEQ ID NO: 382169 - DNA, 15 bp, Homo sapiens
aacaatcgaaaatgt

SEQ ID NO: 382170 - DNA, 15 bp, Homo sapiens
acaatcgaaaatgtg

SEQ ID NO: 382171 - DNA, 15 bp, Homo sapiens
caatcgaaaatgtgg

SEQ ID NO: 382172 - DNA, 15 bp, Homo sapiens
aatcgaaaatgtgga

SEQ ID NO: 382173 - DNA, 15 bp, Homo sapiens
atcgaaaatgtggaa

SEQ ID NO: 382174 - DNA, 15 bp, Homo sapiens
tcgaaaatgtggaag

SEQ ID NO: 382175 - DNA, 15 bp, Homo sapiens
cgaaaatgtggaagt

SEQ ID NO: 382176 - DNA, 15 bp, Homo sapiens
gaaaatgtggaagta

SEQ ID NO: 382177 - DNA, 15 bp, Homo sapiens
aaaatgtggaagtat

SEQ ID NO: 382178 - DNA, 15 bp, Homo sapiens
aaatgtggaagtatg

SEQ ID NO: 382179 - DNA, 15 bp, Homo sapiens
aatgtggaagtatgt

SEQ ID NO: 382180 - DNA, 15 bp, Homo sapiens
atgtggaagtatgtt

SEQ ID NO: 382181 - DNA, 15 bp, Homo sapiens
tgtggaagtatgttt

SEQ ID NO: 382182 - DNA, 15 bp, Homo sapiens
gtggaagtatgtttt

SEQ ID NO: 382183 - DNA, 15 bp, Homo sapiens
tggaagtatgttttt

SEQ ID NO: 382184 - DNA, 15 bp, Homo sapiens
ggaagtatgttttta

SEQ ID NO: 382185 - DNA, 15 bp, Homo sapiens
gaagtatgtttttat

SEQ ID NO: 382186 - DNA, 15 bp, Homo sapiens
aagtatgtttttatt

SEQ ID NO: 382187 - DNA, 15 bp, Homo sapiens
agtatgtttttattc

SEQ ID NO: 382188 - DNA, 15 bp, Homo sapiens
gtatgtttttattct

SEQ ID NO: 382189 - DNA, 15 bp, Homo sapiens
tatgtttttattctc

SEQ ID NO: 382190 - DNA, 15 bp, Homo sapiens
atgtttttattctcc

SEQ ID NO: 382191 - DNA, 15 bp, Homo sapiens
tgtttttattctcca

SEQ ID NO: 382192 - DNA, 15 bp, Homo sapiens
gtttttattctccac

SEQ ID NO: 382193 - DNA, 15 bp, Homo sapiens
tttttattctccaca

SEQ ID NO: 382194 - DNA, 15 bp, Homo sapiens
ttttattctccacaa

SEQ ID NO: 382195 - DNA, 15 bp, Homo sapiens
tttattctccacaaa

SEQ ID NO: 382196 - DNA, 15 bp, Homo sapiens
ttattctccacaaat

SEQ ID NO: 382197 - DNA, 15 bp, Homo sapiens
tattctccacaaatg

SEQ ID NO: 382198 - DNA, 15 bp, Homo sapiens
attctccacaaatgc

SEQ ID NO: 382199 - DNA, 15 bp, Homo sapiens
ttctccacaaatgca

SEQ ID NO: 382200 - DNA, 15 bp, Homo sapiens
tctccacaaatgcag

SEQ ID NO: 382201 - DNA, 15 bp, Homo sapiens
ctccacaaatgcaga

SEQ ID NO: 382202 - DNA, 15 bp, Homo sapiens
tccacaaatgcagac

SEQ ID NO: 382203 - DNA, 15 bp, Homo sapiens
ccacaaatgcagact

SEQ ID NO: 382204 - DNA, 15 bp, Homo sapiens
cacaaatgcagactt

SEQ ID NO: 382205 - DNA, 15 bp, Homo sapiens
acaaatgcagacttt

SEQ ID NO: 382206 - DNA, 15 bp, Homo sapiens
caaatgcagacttta

SEQ ID NO: 382207 - DNA, 15 bp, Homo sapiens
aaatgcagactttac

SEQ ID NO: 382208 - DNA, 15 bp, Homo sapiens
aatgcagactttact

SEQ ID NO: 382209 - DNA, 15 bp, Homo sapiens
atgcagactttactt

SEQ ID NO: 382210 - DNA, 15 bp, Homo sapiens
tgcagactttacttg

SEQ ID NO: 382211 - DNA, 15 bp, Homo sapiens
gcagactttacttgg

SEQ ID NO: 382212 - DNA, 15 bp, Homo sapiens
cagactttacttggt

SEQ ID NO: 382213 - DNA, 15 bp, Homo sapiens
agactttacttggtt

SEQ ID NO: 382214 - DNA, 15 bp, Homo sapiens
gactttacttggtta

SEQ ID NO: 382215 - DNA, 15 bp, Homo sapiens
actttacttggttac

SEQ ID NO: 382216 - DNA, 15 bp, Homo sapiens
ctttacttggttaca

SEQ ID NO: 382217 - DNA, 15 bp, Homo sapiens
tttacttggttacag

SEQ ID NO: 382218 - DNA, 15 bp, Homo sapiens
ttacttggttacagt

SEQ ID NO: 382219 - DNA, 15 bp, Homo sapiens
tacttggttacagtt

SEQ ID NO: 382220 - DNA, 15 bp, Homo sapiens
acttggttacagttt

SEQ ID NO: 382221 - DNA, 15 bp, Homo sapiens
cttggttacagtttt

SEQ ID NO: 382222 - DNA, 15 bp, Homo sapiens
ttggttacagtttta

SEQ ID NO: 382223 - DNA, 15 bp, Homo sapiens
tggttacagttttaa

SEQ ID NO: 382224 - DNA, 15 bp, Homo sapiens
ggttacagttttaaa

SEQ ID NO: 382225 - DNA, 15 bp, Homo sapiens
gttacagttttaaaa

SEQ ID NO: 382226 - DNA, 15 bp, Homo sapiens
ttacagttttaaaag

SEQ ID NO: 382227 - DNA, 15 bp, Homo sapiens
tacagttttaaaagc

SEQ ID NO: 382228 - DNA, 15 bp, Homo sapiens
acagttttaaaagca

SEQ ID NO: 382229 - DNA, 15 bp, Homo sapiens
cagttttaaaagcaa

SEQ ID NO: 382230 - DNA, 15 bp, Homo sapiens
agttttaaaagcaag

SEQ ID NO: 382231 - DNA, 15 bp, Homo sapiens
gttttaaaagcaagt

SEQ ID NO: 382232 - DNA, 15 bp, Homo sapiens
ttttaaaagcaagtg

SEQ ID NO: 382233 - DNA, 15 bp, Homo sapiens
tttaaaagcaagtgg

SEQ ID NO: 382234 - DNA, 15 bp, Homo sapiens
ttaaaagcaagtggc

SEQ ID NO: 382235 - DNA, 15 bp, Homo sapiens
taaaagcaagtggcc

SEQ ID NO: 382236 - DNA, 15 bp, Homo sapiens
aaaagcaagtggcca

SEQ ID NO: 382237 - DNA, 15 bp, Homo sapiens
aaagcaagtggccag

SEQ ID NO: 382238 - DNA, 15 bp, Homo sapiens
aagcaagtggccagt

SEQ ID NO: 382239 - DNA, 15 bp, Homo sapiens
agcaagtggccagtt

SEQ ID NO: 382240 - DNA, 15 bp, Homo sapiens
gcaagtggccagtta

SEQ ID NO: 382241 - DNA, 15 bp, Homo sapiens
caagtggccagttat

SEQ ID NO: 382242 - DNA, 15 bp, Homo sapiens
aagtggccagttata

SEQ ID NO: 382243 - DNA, 15 bp, Homo sapiens
agtggccagttatat

SEQ ID NO: 382244 - DNA, 15 bp, Homo sapiens
gtggccagttatatg

SEQ ID NO: 382245 - DNA, 15 bp, Homo sapiens
tggccagttatatgc

SEQ ID NO: 382246 - DNA, 15 bp, Homo sapiens
ggccagttatatgca

SEQ ID NO: 382247 - DNA, 15 bp, Homo sapiens
gccagttatatgcat

SEQ ID NO: 382248 - DNA, 15 bp, Homo sapiens
ccagttatatgcatt

SEQ ID NO: 382249 - DNA, 15 bp, Homo sapiens
cagttatatgcattt

SEQ ID NO: 382250 - DNA, 15 bp, Homo sapiens
agttatatgcatttc

SEQ ID NO: 382251 - DNA, 15 bp, Homo sapiens
gttatatgcatttct

SEQ ID NO: 382252 - DNA, 15 bp, Homo sapiens
ttatatgcatttctg

SEQ ID NO: 382253 - DNA, 15 bp, Homo sapiens
tatatgcatttctgg

SEQ ID NO: 382254 - DNA, 15 bp, Homo sapiens
atatgcatttctgga

SEQ ID NO: 382255 - DNA, 15 bp, Homo sapiens
tatgcatttctggat

SEQ ID NO: 382256 - DNA, 15 bp, Homo sapiens
atgcatttctggatc

SEQ ID NO: 382257 - DNA, 15 bp, Homo sapiens
tgcatttctggatca

SEQ ID NO: 382258 - DNA, 15 bp, Homo sapiens
gcatttctggatcat

SEQ ID NO: 382259 - DNA, 15 bp, Homo sapiens
catttctggatcatt

SEQ ID NO: 382260 - DNA, 15 bp, Homo sapiens
atttctggatcattc

SEQ ID NO: 382261 - DNA, 15 bp, Homo sapiens
tttctggatcattct

SEQ ID NO: 382262 - DNA, 15 bp, Homo sapiens
ttctggatcattctg

SEQ ID NO: 382263 - DNA, 15 bp, Homo sapiens
tctggatcattctgt

SEQ ID NO: 382264 - DNA, 15 bp, Homo sapiens
ctggatcattctgtg

SEQ ID NO: 382265 - DNA, 15 bp, Homo sapiens
tggatcattctgtgt

SEQ ID NO: 382266 - DNA, 15 bp, Homo sapiens
ggatcattctgtgtg

SEQ ID NO: 382267 - DNA, 15 bp, Homo sapiens
gatcattctgtgtgt

SEQ ID NO: 382268 - DNA, 15 bp, Homo sapiens
atcattctgtgtgtt

SEQ ID NO: 382269 - DNA, 15 bp, Homo sapiens
tcattctgtgtgttt

SEQ ID NO: 382270 - DNA, 15 bp, Homo sapiens
cattctgtgtgtttg

SEQ ID NO: 382271 - DNA, 15 bp, Homo sapiens
attctgtgtgtttgt

SEQ ID NO: 382272 - DNA, 15 bp, Homo sapiens
tctgtgtgtttgtga

SEQ ID NO: 382273 - DNA, 15 bp, Homo sapiens
ctgtgtgtttgtgat

SEQ ID NO: 382274 - DNA, 15 bp, Homo sapiens
tgtgtgtttgtgata

SEQ ID NO: 382275 - DNA, 15 bp, Homo sapiens
gtgtgtttgtgatac

SEQ ID NO: 382276 - DNA, 15 bp, Homo sapiens
tgtgtttgtgatact

SEQ ID NO: 382277 - DNA, 15 bp, Homo sapiens
gtgtttgtgatactg

SEQ ID NO: 382278 - DNA, 15 bp, Homo sapiens
tgtttgtgatactgc

SEQ ID NO: 382279 - DNA, 15 bp, Homo sapiens
gtttgtgatactgct

SEQ ID NO: 382280 - DNA, 15 bp, Homo sapiens
tttgtgatactgctg

SEQ ID NO: 382281 - DNA, 15 bp, Homo sapiens
ttgtgatactgctga

SEQ ID NO: 382282 - DNA, 15 bp, Homo sapiens
tgtgatactgctgac

SEQ ID NO: 382283 - DNA, 15 bp, Homo sapiens
gtgatactgctgact

SEQ ID NO: 382284 - DNA, 15 bp, Homo sapiens
tgatactgctgactg

SEQ ID NO: 382285 - DNA, 15 bp, Homo sapiens
gatactgctgactgt

SEQ ID NO: 382286 - DNA, 15 bp, Homo sapiens
atactgctgactgtt

SEQ ID NO: 382287 - DNA, 15 bp, Homo sapiens
tactgctgactgttt

SEQ ID NO: 382288 - DNA, 15 bp, Homo sapiens
actgctgactgtttc

SEQ ID NO: 382289 - DNA, 15 bp, Homo sapiens
ctgctgactgtttcc

SEQ ID NO: 382290 - DNA, 15 bp, Homo sapiens
tgctgactgtttcca

SEQ ID NO: 382291 - DNA, 15 bp, Homo sapiens
gctgactgtttccac

SEQ ID NO: 382292 - DNA, 15 bp, Homo sapiens
ctgactgtttccacc

SEQ ID NO: 382293 - DNA, 15 bp, Homo sapiens
tgactgtttccacca

SEQ ID NO: 382294 - DNA, 15 bp, Homo sapiens
gactgtttccaccaa

SEQ ID NO: 382295 - DNA, 15 bp, Homo sapiens
actgtttccaccaaa

SEQ ID NO: 382296 - DNA, 15 bp, Homo sapiens
ctgtttccaccaaat

SEQ ID NO: 382297 - DNA, 15 bp, Homo sapiens
tgtttccaccaaatg

SEQ ID NO: 382298 - DNA, 15 bp, Homo sapiens
gtttccaccaaatga

SEQ ID NO: 382299 - DNA, 15 bp, Homo sapiens
tttccaccaaatgac

SEQ ID NO: 382300 - DNA, 15 bp, Homo sapiens
ttccaccaaatgact

SEQ ID NO: 382301 - DNA, 15 bp, Homo sapiens
tccaccaaatgactc

SEQ ID NO: 382302 - DNA, 15 bp, Homo sapiens
ccaccaaatgactcc

SEQ ID NO: 382303 - DNA, 15 bp, Homo sapiens
caccaaatgactccc

SEQ ID NO: 382304 - DNA, 15 bp, Homo sapiens
accaaatgactccca

SEQ ID NO: 382305 - DNA, 15 bp, Homo sapiens
ccaaatgactcccaa

SEQ ID NO: 382306 - DNA, 15 bp, Homo sapiens
caaatgactcccaag

SEQ ID NO: 382307 - DNA, 15 bp, Homo sapiens
aaatgactcccaagt

SEQ ID NO: 382308 - DNA, 15 bp, Homo sapiens
aatgactcccaagta

SEQ ID NO: 382309 - DNA, 15 bp, Homo sapiens
atgactcccaagtaa

SEQ ID NO: 382310 - DNA, 15 bp, Homo sapiens
tgactcccaagtaat

SEQ ID NO: 382311 - DNA, 15 bp, Homo sapiens
gactcccaagtaata

SEQ ID NO: 382312 - DNA, 15 bp, Homo sapiens
actcccaagtaatag

SEQ ID NO: 382313 - DNA, 15 bp, Homo sapiens
ctcccaagtaatagt

SEQ ID NO: 382314 - DNA, 15 bp, Homo sapiens
tcccaagtaatagtg

SEQ ID NO: 382315 - DNA, 15 bp, Homo sapiens
cccaagtaatagtga

SEQ ID NO: 382316 - DNA, 15 bp, Homo sapiens
ccaagtaatagtgaa

SEQ ID NO: 382317 - DNA, 15 bp, Homo sapiens
caagtaatagtgaag

SEQ ID NO: 382318 - DNA, 15 bp, Homo sapiens
aagtaatagtgaagc

SEQ ID NO: 382319 - DNA, 15 bp, Homo sapiens
agtaatagtgaagcc

SEQ ID NO: 382320 - DNA, 15 bp, Homo sapiens
gtaatagtgaagccc

SEQ ID NO: 382321 - DNA, 15 bp, Homo sapiens
taatagtgaagcccc

SEQ ID NO: 382322 - DNA, 15 bp, Homo sapiens
aatagtgaagcccct

SEQ ID NO: 382323 - DNA, 15 bp, Homo sapiens
atagtgaagcccctg

SEQ ID NO: 382324 - DNA, 15 bp, Homo sapiens
tagtgaagcccctgg

SEQ ID NO: 382325 - DNA, 15 bp, Homo sapiens
agtgaagcccctggc

SEQ ID NO: 382326 - DNA, 15 bp, Homo sapiens
gtgaagcccctggcc

SEQ ID NO: 382327 - DNA, 15 bp, Homo sapiens
tgaagcccctggccc

SEQ ID NO: 382328 - DNA, 15 bp, Homo sapiens
gaagcccctggcccc

SEQ ID NO: 382329 - DNA, 15 bp, Homo sapiens
aagcccctggcccct

SEQ ID NO: 382330 - DNA, 15 bp, Homo sapiens
agcccctggcccctt

SEQ ID NO: 382331 - DNA, 15 bp, Homo sapiens
gcccctggcccctta

SEQ ID NO: 382332 - DNA, 15 bp, Homo sapiens
cccctggccccttaa

SEQ ID NO: 382333 - DNA, 15 bp, Homo sapiens
ccctggccccttaac

SEQ ID NO: 382334 - DNA, 15 bp, Homo sapiens
cctggccccttaact

SEQ ID NO: 382335 - DNA, 15 bp, Homo sapiens
ctggccccttaacta

SEQ ID NO: 382336 - DNA, 15 bp, Homo sapiens
tggccccttaactag

SEQ ID NO: 382337 - DNA, 15 bp, Homo sapiens
ggccccttaactaga

SEQ ID NO: 382338 - DNA, 15 bp, Homo sapiens
gccccttaactagag

SEQ ID NO: 382339 - DNA, 15 bp, Homo sapiens
ccccttaactagagg

SEQ ID NO: 382340 - DNA, 15 bp, Homo sapiens
cccttaactagagga

SEQ ID NO: 382341 - DNA, 15 bp, Homo sapiens
ccttaactagaggaa

SEQ ID NO: 382342 - DNA, 15 bp, Homo sapiens
cttaactagaggaat

SEQ ID NO: 382343 - DNA, 15 bp, Homo sapiens
ttaactagaggaata

SEQ ID NO: 382344 - DNA, 15 bp, Homo sapiens
taactagaggaatac

SEQ ID NO: 382345 - DNA, 15 bp, Homo sapiens
aactagaggaataca

SEQ ID NO: 382346 - DNA, 15 bp, Homo sapiens
actagaggaatacaa

SEQ ID NO: 382347 - DNA, 15 bp, Homo sapiens
ctagaggaatacaat

SEQ ID NO: 382348 - DNA, 15 bp, Homo sapiens
tagaggaatacaatt

SEQ ID NO: 382349 - DNA, 15 bp, Homo sapiens
agaggaatacaatta

SEQ ID NO: 382350 - DNA, 15 bp, Homo sapiens
gaggaatacaattaa

SEQ ID NO: 382351 - DNA, 15 bp, Homo sapiens
aggaatacaattaaa

SEQ ID NO: 382352 - DNA, 15 bp, Homo sapiens
ggaatacaattaaaa

SEQ ID NO: 382353 - DNA, 15 bp, Homo sapiens
gaatacaattaaaag

SEQ ID NO: 382354 - DNA, 15 bp, Homo sapiens
aatacaattaaaagt

SEQ ID NO: 382355 - DNA, 15 bp, Homo sapiens
atacaattaaaagtg

SEQ ID NO: 382356 - DNA, 15 bp, Homo sapiens
tacaattaaaagtga

SEQ ID NO: 382357 - DNA, 15 bp, Homo sapiens
acaattaaaagtgat

SEQ ID NO: 382358 - DNA, 15 bp, Homo sapiens
caattaaaagtgatg

SEQ ID NO: 382359 - DNA, 15 bp, Homo sapiens
aattaaaagtgatgt

SEQ ID NO: 382360 - DNA, 15 bp, Homo sapiens
attaaaagtgatgtc

SEQ ID NO: 382361 - DNA, 15 bp, Homo sapiens
ttaaaagtgatgtca

SEQ ID NO: 382362 - DNA, 15 bp, Homo sapiens
taaaagtgatgtcag

SEQ ID NO: 382363 - DNA, 15 bp, Homo sapiens
aaaagtgatgtcagt

SEQ ID NO: 382364 - DNA, 15 bp, Homo sapiens
aaagtgatgtcagtg

SEQ ID NO: 382365 - DNA, 15 bp, Homo sapiens
aagtgatgtcagtgt

SEQ ID NO: 382366 - DNA, 15 bp, Homo sapiens
agtgatgtcagtgtt

SEQ ID NO: 382367 - DNA, 15 bp, Homo sapiens
gtgatgtcagtgttt

SEQ ID NO: 382368 - DNA, 15 bp, Homo sapiens
tgatgtcagtgtttc

SEQ ID NO: 382369 - DNA, 15 bp, Homo sapiens
gatgtcagtgtttca

SEQ ID NO: 382370 - DNA, 15 bp, Homo sapiens
atgtcagtgtttcag

SEQ ID NO: 382371 - DNA, 15 bp, Homo sapiens
tgtcagtgtttcagt

SEQ ID NO: 382372 - DNA, 15 bp, Homo sapiens
gtcagtgtttcagtt

SEQ ID NO: 382373 - DNA, 15 bp, Homo sapiens
tcagtgtttcagtta

SEQ ID NO: 382374 - DNA, 15 bp, Homo sapiens
cagtgtttcagttat

SEQ ID NO: 382375 - DNA, 15 bp, Homo sapiens
agtgtttcagttatc

SEQ ID NO: 382376 - DNA, 15 bp, Homo sapiens
gtgtttcagttatca

SEQ ID NO: 382377 - DNA, 15 bp, Homo sapiens
tgtttcagttatcat

SEQ ID NO: 382378 - DNA, 15 bp, Homo sapiens
gtttcagttatcata

SEQ ID NO: 382379 - DNA, 15 bp, Homo sapiens
tttcagttatcatat

SEQ ID NO: 382380 - DNA, 15 bp, Homo sapiens
ttcagttatcatatt

SEQ ID NO: 382381 - DNA, 15 bp, Homo sapiens
tcagttatcatatta

SEQ ID NO: 382382 - DNA, 15 bp, Homo sapiens
cagttatcatattag

SEQ ID NO: 382383 - DNA, 15 bp, Homo sapiens
agttatcatattaga

SEQ ID NO: 382384 - DNA, 15 bp, Homo sapiens
gttatcatattagaa

SEQ ID NO: 382385 - DNA, 15 bp, Homo sapiens
ttatcatattagaac

SEQ ID NO: 382386 - DNA, 15 bp, Homo sapiens
tatcatattagaaca

SEQ ID NO: 382387 - DNA, 15 bp, Homo sapiens
atcatattagaacat

SEQ ID NO: 382388 - DNA, 15 bp, Homo sapiens
tcatattagaacatt

SEQ ID NO: 382389 - DNA, 15 bp, Homo sapiens
catattagaacatta

SEQ ID NO: 382390 - DNA, 15 bp, Homo sapiens
atattagaacattat

SEQ ID NO: 382391 - DNA, 15 bp, Homo sapiens
tattagaacattatt

SEQ ID NO: 382392 - DNA, 15 bp, Homo sapiens
attagaacattattt

SEQ ID NO: 382393 - DNA, 15 bp, Homo sapiens
ttagaacattatttt

SEQ ID NO: 382394 - DNA, 15 bp, Homo sapiens
tagaacattattttt

SEQ ID NO: 382395 - DNA, 15 bp, Homo sapiens
agaacattatttttt

SEQ ID NO: 382396 - DNA, 15 bp, Homo sapiens
gaacattatttttta

SEQ ID NO: 382397 - DNA, 15 bp, Homo sapiens
aacattattttttaa

SEQ ID NO: 382398 - DNA, 15 bp, Homo sapiens
acattattttttaat

SEQ ID NO: 382399 - DNA, 15 bp, Homo sapiens
cattattttttaatc

SEQ ID NO: 382400 - DNA, 15 bp, Homo sapiens
attattttttaatca

SEQ ID NO: 382401 - DNA, 15 bp, Homo sapiens
ttattttttaatcag

SEQ ID NO: 382402 - DNA, 15 bp, Homo sapiens
tattttttaatcagc

SEQ ID NO: 382403 - DNA, 15 bp, Homo sapiens
attttttaatcagca

SEQ ID NO: 382404 - DNA, 15 bp, Homo sapiens
ttttttaatcagcag

SEQ ID NO: 382405 - DNA, 15 bp, Homo sapiens
tttttaatcagcagt

SEQ ID NO: 382406 - DNA, 15 bp, Homo sapiens
ttttaatcagcagtg

SEQ ID NO: 382407 - DNA, 15 bp, Homo sapiens
tttaatcagcagtgt

SEQ ID NO: 382408 - DNA, 15 bp, Homo sapiens
ttaatcagcagtgtg

SEQ ID NO: 382409 - DNA, 15 bp, Homo sapiens
taatcagcagtgtga

SEQ ID NO: 382410 - DNA, 15 bp, Homo sapiens
aatcagcagtgtgat

SEQ ID NO: 382411 - DNA, 15 bp, Homo sapiens
atcagcagtgtgatt

SEQ ID NO: 382412 - DNA, 15 bp, Homo sapiens
tcagcagtgtgattc

SEQ ID NO: 382413 - DNA, 15 bp, Homo sapiens
cagcagtgtgattct

SEQ ID NO: 382414 - DNA, 15 bp, Homo sapiens
agcagtgtgattctt

SEQ ID NO: 382415 - DNA, 15 bp, Homo sapiens
gcagtgtgattcttt

SEQ ID NO: 382416 - DNA, 15 bp, Homo sapiens
cagtgtgattctttt

SEQ ID NO: 382417 - DNA, 15 bp, Homo sapiens
agtgtgattcttttc

SEQ ID NO: 382418 - DNA, 15 bp, Homo sapiens
gtgtgattcttttct

SEQ ID NO: 382419 - DNA, 15 bp, Homo sapiens
tgtgattcttttctt

SEQ ID NO: 382420 - DNA, 15 bp, Homo sapiens
gtgattcttttcttc

SEQ ID NO: 382421 - DNA, 15 bp, Homo sapiens
tgattcttttcttct

SEQ ID NO: 382422 - DNA, 15 bp, Homo sapiens
gattcttttcttctg

SEQ ID NO: 382423 - DNA, 15 bp, Homo sapiens
attcttttcttctga

SEQ ID NO: 382424 - DNA, 15 bp, Homo sapiens
ttcttttcttctgaa

SEQ ID NO: 382425 - DNA, 15 bp, Homo sapiens
tcttttcttctgaaa

SEQ ID NO: 382426 - DNA, 15 bp, Homo sapiens
cttttcttctgaaac

SEQ ID NO: 382427 - DNA, 15 bp, Homo sapiens
ttttcttctgaaacc

SEQ ID NO: 382428 - DNA, 15 bp, Homo sapiens
tttcttctgaaacct

SEQ ID NO: 382429 - DNA, 15 bp, Homo sapiens
ttcttctgaaacctt

SEQ ID NO: 382430 - DNA, 15 bp, Homo sapiens
tcttctgaaacctta

SEQ ID NO: 382431 - DNA, 15 bp, Homo sapiens
cttctgaaaccttag

SEQ ID NO: 382432 - DNA, 15 bp, Homo sapiens
ttctgaaaccttagg

SEQ ID NO: 382433 - DNA, 15 bp, Homo sapiens
tctgaaaccttaggc

SEQ ID NO: 382434 - DNA, 15 bp, Homo sapiens
ctgaaaccttaggct

SEQ ID NO: 382435 - DNA, 15 bp, Homo sapiens
tgaaaccttaggctg

SEQ ID NO: 382436 - DNA, 15 bp, Homo sapiens
gaaaccttaggctga

SEQ ID NO: 382437 - DNA, 15 bp, Homo sapiens
aaaccttaggctgat

SEQ ID NO: 382438 - DNA, 15 bp, Homo sapiens
aaccttaggctgatt

SEQ ID NO: 382439 - DNA, 15 bp, Homo sapiens
accttaggctgattt

SEQ ID NO: 382440 - DNA, 15 bp, Homo sapiens
ccttaggctgattta

SEQ ID NO: 382441 - DNA, 15 bp, Homo sapiens
cttaggctgatttaa

SEQ ID NO: 382442 - DNA, 15 bp, Homo sapiens
ttaggctgatttaaa

SEQ ID NO: 382443 - DNA, 15 bp, Homo sapiens
taggctgatttaaaa

SEQ ID NO: 382444 - DNA, 15 bp, Homo sapiens
aggctgatttaaaat

SEQ ID NO: 382445 - DNA, 15 bp, Homo sapiens
ggctgatttaaaatc

SEQ ID NO: 382446 - DNA, 15 bp, Homo sapiens
gctgatttaaaatct

SEQ ID NO: 382447 - DNA, 15 bp, Homo sapiens
ctgatttaaaatctt

SEQ ID NO: 382448 - DNA, 15 bp, Homo sapiens
tgatttaaaatcttc

SEQ ID NO: 382449 - DNA, 15 bp, Homo sapiens
gatttaaaatcttcc

SEQ ID NO: 382450 - DNA, 15 bp, Homo sapiens
atttaaaatcttccc

SEQ ID NO: 382451 - DNA, 15 bp, Homo sapiens
tttaaaatcttccca

SEQ ID NO: 382452 - DNA, 15 bp, Homo sapiens
ttaaaatcttcccaa

SEQ ID NO: 382453 - DNA, 15 bp, Homo sapiens
taaaatcttcccaat

SEQ ID NO: 382454 - DNA, 15 bp, Homo sapiens
aaaatcttcccaatt

SEQ ID NO: 382455 - DNA, 15 bp, Homo sapiens
aaatcttcccaattg

SEQ ID NO: 382456 - DNA, 15 bp, Homo sapiens
aatcttcccaattgc

SEQ ID NO: 382457 - DNA, 15 bp, Homo sapiens
atcttcccaattgct

SEQ ID NO: 382458 - DNA, 15 bp, Homo sapiens
tcttcccaattgcta

SEQ ID NO: 382459 - DNA, 15 bp, Homo sapiens
cttcccaattgctac

SEQ ID NO: 382460 - DNA, 15 bp, Homo sapiens
ttcccaattgctaca

SEQ ID NO: 382461 - DNA, 15 bp, Homo sapiens
tcccaattgctacaa

SEQ ID NO: 382462 - DNA, 15 bp, Homo sapiens
cccaattgctacaaa

SEQ ID NO: 382463 - DNA, 15 bp, Homo sapiens
ccaattgctacaaaa

SEQ ID NO: 382464 - DNA, 15 bp, Homo sapiens
caattgctacaaaaa

SEQ ID NO: 382465 - DNA, 15 bp, Homo sapiens
aattgctacaaaaag

SEQ ID NO: 382466 - DNA, 15 bp, Homo sapiens
attgctacaaaaagc

SEQ ID NO: 382467 - DNA, 15 bp, Homo sapiens
ttgctacaaaaagca

SEQ ID NO: 382468 - DNA, 15 bp, Homo sapiens
tgctacaaaaagcat

SEQ ID NO: 382469 - DNA, 15 bp, Homo sapiens
gctacaaaaagcatt

SEQ ID NO: 382470 - DNA, 15 bp, Homo sapiens
ctacaaaaagcatta

SEQ ID NO: 382471 - DNA, 15 bp, Homo sapiens
tacaaaaagcattat

SEQ ID NO: 382472 - DNA, 15 bp, Homo sapiens
acaaaaagcattata

SEQ ID NO: 382473 - DNA, 15 bp, Homo sapiens
caaaaagcattatat

SEQ ID NO: 382474 - DNA, 15 bp, Homo sapiens
aaaaagcattatatt

SEQ ID NO: 382475 - DNA, 15 bp, Homo sapiens
aaaagcattatatta

SEQ ID NO: 382476 - DNA, 15 bp, Homo sapiens
aaagcattatattaa

SEQ ID NO: 382477 - DNA, 15 bp, Homo sapiens
aagcattatattaaa

SEQ ID NO: 382478 - DNA, 15 bp, Homo sapiens
agcattatattaaag

SEQ ID NO: 382479 - DNA, 15 bp, Homo sapiens
gcattatattaaagg

SEQ ID NO: 382480 - DNA, 15 bp, Homo sapiens
cattatattaaaggt

SEQ ID NO: 382481 - DNA, 15 bp, Homo sapiens
attatattaaaggtt

SEQ ID NO: 382482 - DNA, 15 bp, Homo sapiens
ttatattaaaggttt

SEQ ID NO: 382483 - DNA, 15 bp, Homo sapiens
tatattaaaggtttc

SEQ ID NO: 382484 - DNA, 15 bp, Homo sapiens
atattaaaggtttca

SEQ ID NO: 382485 - DNA, 15 bp, Homo sapiens
tattaaaggtttcag

SEQ ID NO: 382486 - DNA, 15 bp, Homo sapiens
attaaaggtttcagt

SEQ ID NO: 382487 - DNA, 15 bp, Homo sapiens
ttaaaggtttcagtt

SEQ ID NO: 382488 - DNA, 15 bp, Homo sapiens
taaaggtttcagttg

SEQ ID NO: 382489 - DNA, 15 bp, Homo sapiens
aaaggtttcagttgt

SEQ ID NO: 382490 - DNA, 15 bp, Homo sapiens
aaggtttcagttgtc

SEQ ID NO: 382491 - DNA, 15 bp, Homo sapiens
aggtttcagttgtca

SEQ ID NO: 382492 - DNA, 15 bp, Homo sapiens
ggtttcagttgtcat

SEQ ID NO: 382493 - DNA, 15 bp, Homo sapiens
gtttcagttgtcatt

SEQ ID NO: 382494 - DNA, 15 bp, Homo sapiens
tttcagttgtcattt

SEQ ID NO: 382495 - DNA, 15 bp, Homo sapiens
ttcagttgtcattta

SEQ ID NO: 382496 - DNA, 15 bp, Homo sapiens
tcagttgtcatttag

SEQ ID NO: 382497 - DNA, 15 bp, Homo sapiens
cagttgtcatttaga

SEQ ID NO: 382498 - DNA, 15 bp, Homo sapiens
agttgtcatttagat

SEQ ID NO: 382499 - DNA, 15 bp, Homo sapiens
gttgtcatttagatt

SEQ ID NO: 382500 - DNA, 15 bp, Homo sapiens
ttgtcatttagattt

SEQ ID NO: 382501 - DNA, 15 bp, Homo sapiens
tgtcatttagatttc

SEQ ID NO: 382502 - DNA, 15 bp, Homo sapiens
gtcatttagatttca

SEQ ID NO: 382503 - DNA, 15 bp, Homo sapiens
tcatttagatttcat

SEQ ID NO: 382504 - DNA, 15 bp, Homo sapiens
catttagatttcatg

SEQ ID NO: 382505 - DNA, 15 bp, Homo sapiens
atttagatttcatgg

SEQ ID NO: 382506 - DNA, 15 bp, Homo sapiens
tttagatttcatggt

SEQ ID NO: 382507 - DNA, 15 bp, Homo sapiens
ttagatttcatggtg

SEQ ID NO: 382508 - DNA, 15 bp, Homo sapiens
tagatttcatggtga

SEQ ID NO: 382509 - DNA, 15 bp, Homo sapiens
agatttcatggtgag

SEQ ID NO: 382510 - DNA, 15 bp, Homo sapiens
gatttcatggtgagt

SEQ ID NO: 382511 - DNA, 15 bp, Homo sapiens
atttcatggtgagta

SEQ ID NO: 382512 - DNA, 15 bp, Homo sapiens
tttcatggtgagtac

SEQ ID NO: 382513 - DNA, 15 bp, Homo sapiens
ttcatggtgagtacc

SEQ ID NO: 382514 - DNA, 15 bp, Homo sapiens
tcatggtgagtacct

SEQ ID NO: 382515 - DNA, 15 bp, Homo sapiens
catggtgagtacctt

SEQ ID NO: 382516 - DNA, 15 bp, Homo sapiens
atggtgagtaccttg

SEQ ID NO: 382517 - DNA, 15 bp, Homo sapiens
tggtgagtaccttga

SEQ ID NO: 382518 - DNA, 15 bp, Homo sapiens
ggtgagtaccttgat

SEQ ID NO: 382519 - DNA, 15 bp, Homo sapiens
gtgagtaccttgatc

SEQ ID NO: 382520 - DNA, 15 bp, Homo sapiens
tgagtaccttgatcc

SEQ ID NO: 382521 - DNA, 15 bp, Homo sapiens
gagtaccttgatcca

SEQ ID NO: 382522 - DNA, 15 bp, Homo sapiens
agtaccttgatccag

SEQ ID NO: 382523 - DNA, 15 bp, Homo sapiens
gtaccttgatccaga

SEQ ID NO: 382524 - DNA, 15 bp, Homo sapiens
taccttgatccagag

SEQ ID NO: 382525 - DNA, 15 bp, Homo sapiens
accttgatccagaga

SEQ ID NO: 382526 - DNA, 15 bp, Homo sapiens
ccttgatccagagac

SEQ ID NO: 382527 - DNA, 15 bp, Homo sapiens
cttgatccagagact

SEQ ID NO: 382528 - DNA, 15 bp, Homo sapiens
ttgatccagagactc

SEQ ID NO: 382529 - DNA, 15 bp, Homo sapiens
tgatccagagactct

SEQ ID NO: 382530 - DNA, 15 bp, Homo sapiens
gatccagagactctc

SEQ ID NO: 382531 - DNA, 15 bp, Homo sapiens
atccagagactctca

SEQ ID NO: 382532 - DNA, 15 bp, Homo sapiens
tccagagactctcag

SEQ ID NO: 382533 - DNA, 15 bp, Homo sapiens
ccagagactctcaga

SEQ ID NO: 382534 - DNA, 15 bp, Homo sapiens
cagagactctcagag

SEQ ID NO: 382535 - DNA, 15 bp, Homo sapiens
agagactctcagagg

SEQ ID NO: 382536 - DNA, 15 bp, Homo sapiens
gagactctcagaggc

SEQ ID NO: 382537 - DNA, 15 bp, Homo sapiens
agactctcagaggct

SEQ ID NO: 382538 - DNA, 15 bp, Homo sapiens
gactctcagaggctg

SEQ ID NO: 382539 - DNA, 15 bp, Homo sapiens
actctcagaggctga

SEQ ID NO: 382540 - DNA, 15 bp, Homo sapiens
ctctcagaggctgaa

SEQ ID NO: 382541 - DNA, 15 bp, Homo sapiens
tctcagaggctgaaa

SEQ ID NO: 382542 - DNA, 15 bp, Homo sapiens
ctcagaggctgaaaa

SEQ ID NO: 382543 - DNA, 15 bp, Homo sapiens
tcagaggctgaaaaa

SEQ ID NO: 382544 - DNA, 15 bp, Homo sapiens
cagaggctgaaaaac

SEQ ID NO: 382545 - DNA, 15 bp, Homo sapiens
agaggctgaaaaact

SEQ ID NO: 382546 - DNA, 15 bp, Homo sapiens
gaggctgaaaaacta

SEQ ID NO: 382547 - DNA, 15 bp, Homo sapiens
aggctgaaaaactat

SEQ ID NO: 382548 - DNA, 15 bp, Homo sapiens
ggctgaaaaactatg

SEQ ID NO: 382549 - DNA, 15 bp, Homo sapiens
gctgaaaaactatgt

SEQ ID NO: 382550 - DNA, 15 bp, Homo sapiens
ctgaaaaactatgtc

SEQ ID NO: 382551 - DNA, 15 bp, Homo sapiens
tgaaaaactatgtca

SEQ ID NO: 382552 - DNA, 15 bp, Homo sapiens
gaaaaactatgtcaa

SEQ ID NO: 382553 - DNA, 15 bp, Homo sapiens
aaaaactatgtcaaa

SEQ ID NO: 382554 - DNA, 15 bp, Homo sapiens
aaaactatgtcaaag

SEQ ID NO: 382555 - DNA, 15 bp, Homo sapiens
aaactatgtcaaaga

SEQ ID NO: 382556 - DNA, 15 bp, Homo sapiens
aactatgtcaaagaa

SEQ ID NO: 382557 - DNA, 15 bp, Homo sapiens
actatgtcaaagaac

SEQ ID NO: 382558 - DNA, 15 bp, Homo sapiens
ctatgtcaaagaacc

SEQ ID NO: 382559 - DNA, 15 bp, Homo sapiens
tatgtcaaagaacca

SEQ ID NO: 382560 - DNA, 15 bp, Homo sapiens
atgtcaaagaaccaa

SEQ ID NO: 382561 - DNA, 15 bp, Homo sapiens
tgtcaaagaaccaat

SEQ ID NO: 382562 - DNA, 15 bp, Homo sapiens
gtcaaagaaccaatg

SEQ ID NO: 382563 - DNA, 15 bp, Homo sapiens
tcaaagaaccaatgc

SEQ ID NO: 382564 - DNA, 15 bp, Homo sapiens
caaagaaccaatgcc

SEQ ID NO: 382565 - DNA, 15 bp, Homo sapiens
aaagaaccaatgcca

SEQ ID NO: 382566 - DNA, 15 bp, Homo sapiens
aagaaccaatgccag

SEQ ID NO: 382567 - DNA, 15 bp, Homo sapiens
agaaccaatgccagt

SEQ ID NO: 382568 - DNA, 15 bp, Homo sapiens
gaaccaatgccagtg

SEQ ID NO: 382569 - DNA, 15 bp, Homo sapiens
aaccaatgccagtgg

SEQ ID NO: 382570 - DNA, 15 bp, Homo sapiens
accaatgccagtgga

SEQ ID NO: 382571 - DNA, 15 bp, Homo sapiens
ccaatgccagtggac

SEQ ID NO: 382572 - DNA, 15 bp, Homo sapiens
caatgccagtggaca

SEQ ID NO: 382573 - DNA, 15 bp, Homo sapiens
aatgccagtggacaa

SEQ ID NO: 382574 - DNA, 15 bp, Homo sapiens
atgccagtggacaaa

SEQ ID NO: 382575 - DNA, 15 bp, Homo sapiens
tgccagtggacaaat

SEQ ID NO: 382576 - DNA, 15 bp, Homo sapiens
gccagtggacaaatt

SEQ ID NO: 382577 - DNA, 15 bp, Homo sapiens
ccagtggacaaattc

SEQ ID NO: 382578 - DNA, 15 bp, Homo sapiens
cagtggacaaattca

SEQ ID NO: 382579 - DNA, 15 bp, Homo sapiens
agtggacaaattcag

SEQ ID NO: 382580 - DNA, 15 bp, Homo sapiens
gtggacaaattcagc

SEQ ID NO: 382581 - DNA, 15 bp, Homo sapiens
tggacaaattcagca

SEQ ID NO: 382582 - DNA, 15 bp, Homo sapiens
ggacaaattcagcat

SEQ ID NO: 382583 - DNA, 15 bp, Homo sapiens
gacaaattcagcatc

SEQ ID NO: 382584 - DNA, 15 bp, Homo sapiens
acaaattcagcatca

SEQ ID NO: 382585 - DNA, 15 bp, Homo sapiens
caaattcagcatcag

SEQ ID NO: 382586 - DNA, 15 bp, Homo sapiens
aaattcagcatcagt

SEQ ID NO: 382587 - DNA, 15 bp, Homo sapiens
aattcagcatcagtt

SEQ ID NO: 382588 - DNA, 15 bp, Homo sapiens
attcagcatcagttt

SEQ ID NO: 382589 - DNA, 15 bp, Homo sapiens
ttcagcatcagtttg

SEQ ID NO: 382590 - DNA, 15 bp, Homo sapiens
tcagcatcagtttgg

SEQ ID NO: 382591 - DNA, 15 bp, Homo sapiens
cagcatcagtttggc

SEQ ID NO: 382592 - DNA, 15 bp, Homo sapiens
agcatcagtttggct

SEQ ID NO: 382593 - DNA, 15 bp, Homo sapiens
tctgaaaactcaaag

SEQ ID NO: 382594 - DNA, 15 bp, Homo sapiens
ctgaaaactcaaaga

SEQ ID NO: 382595 - DNA, 15 bp, Homo sapiens
tgaaaactcaaagaa

SEQ ID NO: 382596 - DNA, 15 bp, Homo sapiens
gaaaactcaaagaag

SEQ ID NO: 382597 - DNA, 15 bp, Homo sapiens
aaaactcaaagaaga

SEQ ID NO: 382598 - DNA, 15 bp, Homo sapiens
aaactcaaagaagag

SEQ ID NO: 382599 - DNA, 15 bp, Homo sapiens
aactcaaagaagagg

SEQ ID NO: 382600 - DNA, 15 bp, Homo sapiens
actcaaagaagaggg

SEQ ID NO: 382601 - DNA, 15 bp, Homo sapiens
ctcaaagaagagggt

SEQ ID NO: 382602 - DNA, 15 bp, Homo sapiens
tcaaagaagagggtt

SEQ ID NO: 382603 - DNA, 15 bp, Homo sapiens
caaagaagagggtta

SEQ ID NO: 382604 - DNA, 15 bp, Homo sapiens
aaagaagagggttat

SEQ ID NO: 382605 - DNA, 15 bp, Homo sapiens
aagaagagggttatg

SEQ ID NO: 382606 - DNA, 15 bp, Homo sapiens
agaagagggttatga

SEQ ID NO: 382607 - DNA, 15 bp, Homo sapiens
gaagagggttatgat

SEQ ID NO: 382608 - DNA, 15 bp, Homo sapiens
aagagggttatgatg

SEQ ID NO: 382609 - DNA, 15 bp, Homo sapiens
agagggttatgatgg

SEQ ID NO: 382610 - DNA, 15 bp, Homo sapiens
gagggttatgatggc

SEQ ID NO: 382611 - DNA, 15 bp, Homo sapiens
agggttatgatggca

SEQ ID NO: 382612 - DNA, 15 bp, Homo sapiens
gggttatgatggcac

SEQ ID NO: 382613 - DNA, 15 bp, Homo sapiens
ggttatgatggcaca

SEQ ID NO: 382614 - DNA, 15 bp, Homo sapiens
gttatgatggcacaa

SEQ ID NO: 382615 - DNA, 15 bp, Homo sapiens
ttatgatggcacaat

SEQ ID NO: 382616 - DNA, 15 bp, Homo sapiens
tatgatggcacaatg

SEQ ID NO: 382617 - DNA, 15 bp, Homo sapiens
atgatggcacaatgt

SEQ ID NO: 382618 - DNA, 15 bp, Homo sapiens
tgatggcacaatgtg

SEQ ID NO: 382619 - DNA, 15 bp, Homo sapiens
gatggcacaatgtga

SEQ ID NO: 382620 - DNA, 15 bp, Homo sapiens
atggcacaatgtgag

SEQ ID NO: 382621 - DNA, 15 bp, Homo sapiens
tggcacaatgtgagg

SEQ ID NO: 382622 - DNA, 15 bp, Homo sapiens
ggcacaatgtgaggt

SEQ ID NO: 382623 - DNA, 15 bp, Homo sapiens
gcacaatgtgaggtt

SEQ ID NO: 382624 - DNA, 15 bp, Homo sapiens
cacaatgtgaggttg

SEQ ID NO: 382625 - DNA, 15 bp, Homo sapiens
acaatgtgaggttga

SEQ ID NO: 382626 - DNA, 15 bp, Homo sapiens
caatgtgaggttgaa

SEQ ID NO: 382627 - DNA, 15 bp, Homo sapiens
aatgtgaggttgaat

SEQ ID NO: 382628 - DNA, 15 bp, Homo sapiens
atgtgaggttgaatg

SEQ ID NO: 382629 - DNA, 15 bp, Homo sapiens
tgtgaggttgaatgt

SEQ ID NO: 382630 - DNA, 15 bp, Homo sapiens
gtgaggttgaatgtg

SEQ ID NO: 382631 - DNA, 15 bp, Homo sapiens
tgaggttgaatgtgt

SEQ ID NO: 382632 - DNA, 15 bp, Homo sapiens
gaggttgaatgtgtt

SEQ ID NO: 382633 - DNA, 15 bp, Homo sapiens
aggttgaatgtgttg

SEQ ID NO: 382634 - DNA, 15 bp, Homo sapiens
ggttgaatgtgttgt

SEQ ID NO: 382635 - DNA, 15 bp, Homo sapiens
gttgaatgtgttgtt

SEQ ID NO: 382636 - DNA, 15 bp, Homo sapiens
ttgaatgtgttgtta

SEQ ID NO: 382637 - DNA, 15 bp, Homo sapiens
tgaatgtgttgttag

SEQ ID NO: 382638 - DNA, 15 bp, Homo sapiens
gaatgtgttgttaga

SEQ ID NO: 382639 - DNA, 15 bp, Homo sapiens
aatgtgttgttagat

SEQ ID NO: 382640 - DNA, 15 bp, Homo sapiens
atgtgttgttagata

SEQ ID NO: 382641 - DNA, 15 bp, Homo sapiens
tgtgttgttagatat

SEQ ID NO: 382642 - DNA, 15 bp, Homo sapiens
gtgttgttagatata

SEQ ID NO: 382643 - DNA, 15 bp, Homo sapiens
tgttgttagatatac

SEQ ID NO: 382644 - DNA, 15 bp, Homo sapiens
gttgttagatatacc

SEQ ID NO: 382645 - DNA, 15 bp, Homo sapiens
ttgttagatatacct

SEQ ID NO: 382646 - DNA, 15 bp, Homo sapiens
tgttagatatacctt

SEQ ID NO: 382647 - DNA, 15 bp, Homo sapiens
gttagatataccttg

SEQ ID NO: 382648 - DNA, 15 bp, Homo sapiens
ttagatataccttgg

SEQ ID NO: 382649 - DNA, 15 bp, Homo sapiens
tagatataccttgga

SEQ ID NO: 382650 - DNA, 15 bp, Homo sapiens
agatataccttggat

SEQ ID NO: 382651 - DNA, 15 bp, Homo sapiens
gatataccttggata

SEQ ID NO: 382652 - DNA, 15 bp, Homo sapiens
atataccttggatac

SEQ ID NO: 382653 - DNA, 15 bp, Homo sapiens
tataccttggatact

SEQ ID NO: 382654 - DNA, 15 bp, Homo sapiens
ataccttggatactg

SEQ ID NO: 382655 - DNA, 15 bp, Homo sapiens
taccttggatactgg

SEQ ID NO: 382656 - DNA, 15 bp, Homo sapiens
accttggatactgga

SEQ ID NO: 382657 - DNA, 15 bp, Homo sapiens
ccttggatactggag

SEQ ID NO: 382658 - DNA, 15 bp, Homo sapiens
cttggatactggaga

SEQ ID NO: 382659 - DNA, 15 bp, Homo sapiens
ttggatactggagaa

SEQ ID NO: 382660 - DNA, 15 bp, Homo sapiens
tggatactggagaaa

SEQ ID NO: 382661 - DNA, 15 bp, Homo sapiens
ggatactggagaaaa

SEQ ID NO: 382662 - DNA, 15 bp, Homo sapiens
gatactggagaaaat

SEQ ID NO: 382663 - DNA, 15 bp, Homo sapiens
atactggagaaaata

SEQ ID NO: 382664 - DNA, 15 bp, Homo sapiens
tactggagaaaataa

SEQ ID NO: 382665 - DNA, 15 bp, Homo sapiens
actggagaaaataag

SEQ ID NO: 382666 - DNA, 15 bp, Homo sapiens
ctggagaaaataaga

SEQ ID NO: 382667 - DNA, 15 bp, Homo sapiens
tggagaaaataagac

SEQ ID NO: 382668 - DNA, 15 bp, Homo sapiens
ggagaaaataagact

SEQ ID NO: 382669 - DNA, 15 bp, Homo sapiens
gagaaaataagactg

SEQ ID NO: 382670 - DNA, 15 bp, Homo sapiens
agaaaataagactgg

SEQ ID NO: 382671 - DNA, 15 bp, Homo sapiens
gaaaataagactggg

SEQ ID NO: 382672 - DNA, 15 bp, Homo sapiens
aaaataagactgggt

SEQ ID NO: 382673 - DNA, 15 bp, Homo sapiens
aaataagactgggtt

SEQ ID NO: 382674 - DNA, 15 bp, Homo sapiens
aataagactgggtta

SEQ ID NO: 382675 - DNA, 15 bp, Homo sapiens
ataagactgggttag

SEQ ID NO: 382676 - DNA, 15 bp, Homo sapiens
taagactgggttagc

SEQ ID NO: 382677 - DNA, 15 bp, Homo sapiens
aagactgggttagca

SEQ ID NO: 382678 - DNA, 15 bp, Homo sapiens
agactgggttagcaa

SEQ ID NO: 382679 - DNA, 15 bp, Homo sapiens
gactgggttagcaaa

SEQ ID NO: 382680 - DNA, 15 bp, Homo sapiens
actgggttagcaaag

SEQ ID NO: 382681 - DNA, 15 bp, Homo sapiens
ctgggttagcaaaga

SEQ ID NO: 382682 - DNA, 15 bp, Homo sapiens
tgggttagcaaagac

SEQ ID NO: 382683 - DNA, 15 bp, Homo sapiens
gggttagcaaagaca

SEQ ID NO: 382684 - DNA, 15 bp, Homo sapiens
ggttagcaaagacaa

SEQ ID NO: 382685 - DNA, 15 bp, Homo sapiens
gttagcaaagacaaa

SEQ ID NO: 382686 - DNA, 15 bp, Homo sapiens
ttagcaaagacaaaa

SEQ ID NO: 382687 - DNA, 15 bp, Homo sapiens
tagcaaagacaaaac

SEQ ID NO: 382688 - DNA, 15 bp, Homo sapiens
agcaaagacaaaact

SEQ ID NO: 382689 - DNA, 15 bp, Homo sapiens
gcaaagacaaaactt

SEQ ID NO: 382690 - DNA, 15 bp, Homo sapiens
caaagacaaaacttc

SEQ ID NO: 382691 - DNA, 15 bp, Homo sapiens
aaagacaaaacttca

SEQ ID NO: 382692 - DNA, 15 bp, Homo sapiens
aagacaaaacttcac

SEQ ID NO: 382693 - DNA, 15 bp, Homo sapiens
agacaaaacttcaca

SEQ ID NO: 382694 - DNA, 15 bp, Homo sapiens
gacaaaacttcacaa

SEQ ID NO: 382695 - DNA, 15 bp, Homo sapiens
acaaaacttcacaag

SEQ ID NO: 382696 - DNA, 15 bp, Homo sapiens
caaaacttcacaagt

SEQ ID NO: 382697 - DNA, 15 bp, Homo sapiens
aaaacttcacaagtg

SEQ ID NO: 382698 - DNA, 15 bp, Homo sapiens
aaacttcacaagtgg

SEQ ID NO: 382699 - DNA, 15 bp, Homo sapiens
aacttcacaagtggt

SEQ ID NO: 382700 - DNA, 15 bp, Homo sapiens
acttcacaagtggtt

SEQ ID NO: 382701 - DNA, 15 bp, Homo sapiens
cttcacaagtggtta

SEQ ID NO: 382702 - DNA, 15 bp, Homo sapiens
ttcacaagtggttaa

SEQ ID NO: 382703 - DNA, 15 bp, Homo sapiens
tcacaagtggttaaa

SEQ ID NO: 382704 - DNA, 15 bp, Homo sapiens
cacaagtggttaaag

SEQ ID NO: 382705 - DNA, 15 bp, Homo sapiens
acaagtggttaaagc

SEQ ID NO: 382706 - DNA, 15 bp, Homo sapiens
caagtggttaaagca

SEQ ID NO: 382707 - DNA, 15 bp, Homo sapiens
aagtggttaaagcag

SEQ ID NO: 382708 - DNA, 15 bp, Homo sapiens
agtggttaaagcaga

SEQ ID NO: 382709 - DNA, 15 bp, Homo sapiens
gtggttaaagcagag

SEQ ID NO: 382710 - DNA, 15 bp, Homo sapiens
tggttaaagcagagt

SEQ ID NO: 382711 - DNA, 15 bp, Homo sapiens
ggttaaagcagagtg

SEQ ID NO: 382712 - DNA, 15 bp, Homo sapiens
gttaaagcagagtgg

SEQ ID NO: 382713 - DNA, 15 bp, Homo sapiens
ttaaagcagagtggc

SEQ ID NO: 382714 - DNA, 15 bp, Homo sapiens
taaagcagagtggct

SEQ ID NO: 382715 - DNA, 15 bp, Homo sapiens
aaagcagagtggcta

SEQ ID NO: 382716 - DNA, 15 bp, Homo sapiens
aagcagagtggctat

SEQ ID NO: 382717 - DNA, 15 bp, Homo sapiens
agcagagtggctata

SEQ ID NO: 382718 - DNA, 15 bp, Homo sapiens
gcagagtggctataa

SEQ ID NO: 382719 - DNA, 15 bp, Homo sapiens
cagagtggctataat

SEQ ID NO: 382720 - DNA, 15 bp, Homo sapiens
agagtggctataata

SEQ ID NO: 382721 - DNA, 15 bp, Homo sapiens
gagtggctataatat

SEQ ID NO: 382722 - DNA, 15 bp, Homo sapiens
agtggctataatatt

SEQ ID NO: 382723 - DNA, 15 bp, Homo sapiens
gtggctataatattg

SEQ ID NO: 382724 - DNA, 15 bp, Homo sapiens
tggctataatattgg

SEQ ID NO: 382725 - DNA, 15 bp, Homo sapiens
ggctataatattggt

SEQ ID NO: 382726 - DNA, 15 bp, Homo sapiens
gctataatattggtc

SEQ ID NO: 382727 - DNA, 15 bp, Homo sapiens
ctataatattggtct

SEQ ID NO: 382728 - DNA, 15 bp, Homo sapiens
tataatattggtctt

SEQ ID NO: 382729 - DNA, 15 bp, Homo sapiens
ataatattggtcttt

SEQ ID NO: 382730 - DNA, 15 bp, Homo sapiens
taatattggtctttc

SEQ ID NO: 382731 - DNA, 15 bp, Homo sapiens
aatattggtctttct

SEQ ID NO: 382732 - DNA, 15 bp, Homo sapiens
atattggtctttcta

SEQ ID NO: 382733 - DNA, 15 bp, Homo sapiens
tattggtctttctaa

SEQ ID NO: 382734 - DNA, 15 bp, Homo sapiens
attggtctttctaac

SEQ ID NO: 382735 - DNA, 15 bp, Homo sapiens
ttggtctttctaaca

SEQ ID NO: 382736 - DNA, 15 bp, Homo sapiens
tggtctttctaacat

SEQ ID NO: 382737 - DNA, 15 bp, Homo sapiens
ggtctttctaacatt

SEQ ID NO: 382738 - DNA, 15 bp, Homo sapiens
gtctttctaacattt

SEQ ID NO: 382739 - DNA, 15 bp, Homo sapiens
tctttctaacatttt

SEQ ID NO: 382740 - DNA, 15 bp, Homo sapiens
ctttctaacatttta

SEQ ID NO: 382741 - DNA, 15 bp, Homo sapiens
tttctaacattttac

SEQ ID NO: 382742 - DNA, 15 bp, Homo sapiens
ttctaacattttact

SEQ ID NO: 382743 - DNA, 15 bp, Homo sapiens
tctaacattttacta

SEQ ID NO: 382744 - DNA, 15 bp, Homo sapiens
ctaacattttactac

SEQ ID NO: 382745 - DNA, 15 bp, Homo sapiens
taacattttactaca

SEQ ID NO: 382746 - DNA, 15 bp, Homo sapiens
aacattttactacaa

SEQ ID NO: 382747 - DNA, 15 bp, Homo sapiens
acattttactacaac

SEQ ID NO: 382748 - DNA, 15 bp, Homo sapiens
cattttactacaact

SEQ ID NO: 382749 - DNA, 15 bp, Homo sapiens
attttactacaactt

SEQ ID NO: 382750 - DNA, 15 bp, Homo sapiens
ttttactacaacttt

SEQ ID NO: 382751 - DNA, 15 bp, Homo sapiens
tttactacaactttt

SEQ ID NO: 382752 - DNA, 15 bp, Homo sapiens
ttactacaacttttc

SEQ ID NO: 382753 - DNA, 15 bp, Homo sapiens
tactacaacttttct

SEQ ID NO: 382754 - DNA, 15 bp, Homo sapiens
actacaacttttctc

SEQ ID NO: 382755 - DNA, 15 bp, Homo sapiens
ctacaacttttctct

SEQ ID NO: 382756 - DNA, 15 bp, Homo sapiens
tacaacttttctctt

SEQ ID NO: 382757 - DNA, 15 bp, Homo sapiens
acaacttttctcttt

SEQ ID NO: 382758 - DNA, 15 bp, Homo sapiens
caacttttctctttt

SEQ ID NO: 382759 - DNA, 15 bp, Homo sapiens
aacttttctctttta

SEQ ID NO: 382760 - DNA, 15 bp, Homo sapiens
cttttctcttttatt

SEQ ID NO: 382761 - DNA, 15 bp, Homo sapiens
tttctcttttattat

SEQ ID NO: 382762 - DNA, 15 bp, Homo sapiens
ttctcttttattata

SEQ ID NO: 382763 - DNA, 15 bp, Homo sapiens
tctcttttattataa

SEQ ID NO: 382764 - DNA, 15 bp, Homo sapiens
ctcttttattataat

SEQ ID NO: 382765 - DNA, 15 bp, Homo sapiens
tcttttattataata

SEQ ID NO: 382766 - DNA, 15 bp, Homo sapiens
cttttattataatag

SEQ ID NO: 382767 - DNA, 15 bp, Homo sapiens
ttttattataatagg

SEQ ID NO: 382768 - DNA, 15 bp, Homo sapiens
tttattataataggt

SEQ ID NO: 382769 - DNA, 15 bp, Homo sapiens
ttattataataggtt

SEQ ID NO: 382770 - DNA, 15 bp, Homo sapiens
tattataataggtta

SEQ ID NO: 382771 - DNA, 15 bp, Homo sapiens
attataataggttat

SEQ ID NO: 382772 - DNA, 15 bp, Homo sapiens
ttataataggttatt

SEQ ID NO: 382773 - DNA, 15 bp, Homo sapiens
tataataggttattt

SEQ ID NO: 382774 - DNA, 15 bp, Homo sapiens
ataataggttatttg

SEQ ID NO: 382775 - DNA, 15 bp, Homo sapiens
taataggttatttgg

SEQ ID NO: 382776 - DNA, 15 bp, Homo sapiens
aataggttatttgga

SEQ ID NO: 382777 - DNA, 15 bp, Homo sapiens
ataggttatttggat

SEQ ID NO: 382778 - DNA, 15 bp, Homo sapiens
taggttatttggatt

SEQ ID NO: 382779 - DNA, 15 bp, Homo sapiens
aggttatttggattt

SEQ ID NO: 382780 - DNA, 15 bp, Homo sapiens
ggttatttggattta

SEQ ID NO: 382781 - DNA, 15 bp, Homo sapiens
gttatttggatttag

SEQ ID NO: 382782 - DNA, 15 bp, Homo sapiens
ttatttggatttagt

SEQ ID NO: 382783 - DNA, 15 bp, Homo sapiens
tatttggatttagta

SEQ ID NO: 382784 - DNA, 15 bp, Homo sapiens
atttggatttagtaa

SEQ ID NO: 382785 - DNA, 15 bp, Homo sapiens
tttggatttagtaag

SEQ ID NO: 382786 - DNA, 15 bp, Homo sapiens
ttggatttagtaagg

SEQ ID NO: 382787 - DNA, 15 bp, Homo sapiens
tggatttagtaagga

SEQ ID NO: 382788 - DNA, 15 bp, Homo sapiens
ggatttagtaaggat

SEQ ID NO: 382789 - DNA, 15 bp, Homo sapiens
gatttagtaaggata

SEQ ID NO: 382790 - DNA, 15 bp, Homo sapiens
atttagtaaggatat

SEQ ID NO: 382791 - DNA, 15 bp, Homo sapiens
tttagtaaggatatc

SEQ ID NO: 382792 - DNA, 15 bp, Homo sapiens
ttagtaaggatatca

SEQ ID NO: 382793 - DNA, 15 bp, Homo sapiens
tagtaaggatatcat

SEQ ID NO: 382794 - DNA, 15 bp, Homo sapiens
agtaaggatatcata

SEQ ID NO: 382795 - DNA, 15 bp, Homo sapiens
gtaaggatatcataa

SEQ ID NO: 382796 - DNA, 15 bp, Homo sapiens
taaggatatcataac

SEQ ID NO: 382797 - DNA, 15 bp, Homo sapiens
aaggatatcataact

SEQ ID NO: 382798 - DNA, 15 bp, Homo sapiens
aggatatcataactc

SEQ ID NO: 382799 - DNA, 15 bp, Homo sapiens
ggatatcataactca

SEQ ID NO: 382800 - DNA, 15 bp, Homo sapiens
gatatcataactcag

SEQ ID NO: 382801 - DNA, 15 bp, Homo sapiens
atatcataactcagg

SEQ ID NO: 382802 - DNA, 15 bp, Homo sapiens
tatcataactcaggc

SEQ ID NO: 382803 - DNA, 15 bp, Homo sapiens
atcataactcaggca

SEQ ID NO: 382804 - DNA, 15 bp, Homo sapiens
tcataactcaggcag

SEQ ID NO: 382805 - DNA, 15 bp, Homo sapiens
cataactcaggcagg

SEQ ID NO: 382806 - DNA, 15 bp, Homo sapiens
ataactcaggcaggg

SEQ ID NO: 382807 - DNA, 15 bp, Homo sapiens
taactcaggcaggga

SEQ ID NO: 382808 - DNA, 15 bp, Homo sapiens
aactcaggcagggaa

SEQ ID NO: 382809 - DNA, 15 bp, Homo sapiens
actcaggcagggaag

SEQ ID NO: 382810 - DNA, 15 bp, Homo sapiens
ctcaggcagggaaga

SEQ ID NO: 382811 - DNA, 15 bp, Homo sapiens
tcaggcagggaagaa

SEQ ID NO: 382812 - DNA, 15 bp, Homo sapiens
caggcagggaagaag

SEQ ID NO: 382813 - DNA, 15 bp, Homo sapiens
aggcagggaagaagg

SEQ ID NO: 382814 - DNA, 15 bp, Homo sapiens
ggcagggaagaaggt

SEQ ID NO: 382815 - DNA, 15 bp, Homo sapiens
gcagggaagaaggtg

SEQ ID NO: 382816 - DNA, 15 bp, Homo sapiens
cagggaagaaggtga

SEQ ID NO: 382817 - DNA, 15 bp, Homo sapiens
agggaagaaggtgaa

SEQ ID NO: 382818 - DNA, 15 bp, Homo sapiens
gggaagaaggtgaat

SEQ ID NO: 382819 - DNA, 15 bp, Homo sapiens
ggaagaaggtgaatt

SEQ ID NO: 382820 - DNA, 15 bp, Homo sapiens
gaagaaggtgaatta

SEQ ID NO: 382821 - DNA, 15 bp, Homo sapiens
aagaaggtgaattaa

SEQ ID NO: 382822 - DNA, 15 bp, Homo sapiens
agaaggtgaattaaa

SEQ ID NO: 382823 - DNA, 15 bp, Homo sapiens
gaaggtgaattaaaa

SEQ ID NO: 382824 - DNA, 15 bp, Homo sapiens
aaggtgaattaaaaa

SEQ ID NO: 382825 - DNA, 15 bp, Homo sapiens
aggtgaattaaaaac

SEQ ID NO: 382826 - DNA, 15 bp, Homo sapiens
ggtgaattaaaaaca

SEQ ID NO: 382827 - DNA, 15 bp, Homo sapiens
gtgaattaaaaacag

SEQ ID NO: 382828 - DNA, 15 bp, Homo sapiens
tgaattaaaaacagc

SEQ ID NO: 382829 - DNA, 15 bp, Homo sapiens
gaattaaaaacagct

SEQ ID NO: 382830 - DNA, 15 bp, Homo sapiens
aattaaaaacagctt

SEQ ID NO: 382831 - DNA, 15 bp, Homo sapiens
attaaaaacagcttt

SEQ ID NO: 382832 - DNA, 15 bp, Homo sapiens
ttaaaaacagcttta

SEQ ID NO: 382833 - DNA, 15 bp, Homo sapiens
taaaaacagctttaa

SEQ ID NO: 382834 - DNA, 15 bp, Homo sapiens
aaaaacagctttaac

SEQ ID NO: 382835 - DNA, 15 bp, Homo sapiens
aaaacagctttaacc

SEQ ID NO: 382836 - DNA, 15 bp, Homo sapiens
aaacagctttaacct

SEQ ID NO: 382837 - DNA, 15 bp, Homo sapiens
aacagctttaacctt

SEQ ID NO: 382838 - DNA, 15 bp, Homo sapiens
acagctttaacctta

SEQ ID NO: 382839 - DNA, 15 bp, Homo sapiens
cagctttaaccttaa

SEQ ID NO: 382840 - DNA, 15 bp, Homo sapiens
agctttaaccttaag

SEQ ID NO: 382841 - DNA, 15 bp, Homo sapiens
gctttaaccttaaga

SEQ ID NO: 382842 - DNA, 15 bp, Homo sapiens
ctttaaccttaagag

SEQ ID NO: 382843 - DNA, 15 bp, Homo sapiens
tttaaccttaagaga

SEQ ID NO: 382844 - DNA, 15 bp, Homo sapiens
ttaaccttaagagat

SEQ ID NO: 382845 - DNA, 15 bp, Homo sapiens
taaccttaagagata

SEQ ID NO: 382846 - DNA, 15 bp, Homo sapiens
aaccttaagagatag

SEQ ID NO: 382847 - DNA, 15 bp, Homo sapiens
accttaagagatagc

SEQ ID NO: 382848 - DNA, 15 bp, Homo sapiens
ccttaagagatagca

SEQ ID NO: 382849 - DNA, 15 bp, Homo sapiens
cttaagagatagcat

SEQ ID NO: 382850 - DNA, 15 bp, Homo sapiens
ttaagagatagcatt

SEQ ID NO: 382851 - DNA, 15 bp, Homo sapiens
taagagatagcatta

SEQ ID NO: 382852 - DNA, 15 bp, Homo sapiens
aagagatagcattag

SEQ ID NO: 382853 - DNA, 15 bp, Homo sapiens
agagatagcattagg

SEQ ID NO: 382854 - DNA, 15 bp, Homo sapiens
gagatagcattagga

SEQ ID NO: 382855 - DNA, 15 bp, Homo sapiens
agatagcattaggag

SEQ ID NO: 382856 - DNA, 15 bp, Homo sapiens
atagcattaggagat

SEQ ID NO: 382857 - DNA, 15 bp, Homo sapiens
tagcattaggagata

SEQ ID NO: 382858 - DNA, 15 bp, Homo sapiens
agcattaggagatat

SEQ ID NO: 382859 - DNA, 15 bp, Homo sapiens
gcattaggagatata

SEQ ID NO: 382860 - DNA, 15 bp, Homo sapiens
cattaggagatatac

SEQ ID NO: 382861 - DNA, 15 bp, Homo sapiens
attaggagatatacc

SEQ ID NO: 382862 - DNA, 15 bp, Homo sapiens
ttaggagatatacct

SEQ ID NO: 382863 - DNA, 15 bp, Homo sapiens
taggagatataccta

SEQ ID NO: 382864 - DNA, 15 bp, Homo sapiens
aggagatatacctaa

SEQ ID NO: 382865 - DNA, 15 bp, Homo sapiens
ggagatatacctaat

SEQ ID NO: 382866 - DNA, 15 bp, Homo sapiens
gagatatacctaatg

SEQ ID NO: 382867 - DNA, 15 bp, Homo sapiens
agatatacctaatgt

SEQ ID NO: 382868 - DNA, 15 bp, Homo sapiens
gatatacctaatgtt

SEQ ID NO: 382869 - DNA, 15 bp, Homo sapiens
atatacctaatgtta

SEQ ID NO: 382870 - DNA, 15 bp, Homo sapiens
tatacctaatgttaa

SEQ ID NO: 382871 - DNA, 15 bp, Homo sapiens
atacctaatgttaaa

SEQ ID NO: 382872 - DNA, 15 bp, Homo sapiens
tacctaatgttaaat

SEQ ID NO: 382873 - DNA, 15 bp, Homo sapiens
acctaatgttaaatg

SEQ ID NO: 382874 - DNA, 15 bp, Homo sapiens
cctaatgttaaatgt

SEQ ID NO: 382875 - DNA, 15 bp, Homo sapiens
ctaatgttaaatgtg

SEQ ID NO: 382876 - DNA, 15 bp, Homo sapiens
taatgttaaatgtga

SEQ ID NO: 382877 - DNA, 15 bp, Homo sapiens
aatgttaaatgtgag

SEQ ID NO: 382878 - DNA, 15 bp, Homo sapiens
atgttaaatgtgagt

SEQ ID NO: 382879 - DNA, 15 bp, Homo sapiens
tgttaaatgtgagtc

SEQ ID NO: 382880 - DNA, 15 bp, Homo sapiens
gttaaatgtgagtca

SEQ ID NO: 382881 - DNA, 15 bp, Homo sapiens
ttaaatgtgagtcaa

SEQ ID NO: 382882 - DNA, 15 bp, Homo sapiens
taaatgtgagtcaat

SEQ ID NO: 382883 - DNA, 15 bp, Homo sapiens
aaatgtgagtcaatg

SEQ ID NO: 382884 - DNA, 15 bp, Homo sapiens
aatgtgagtcaatgg

SEQ ID NO: 382885 - DNA, 15 bp, Homo sapiens
atgtgagtcaatggg

SEQ ID NO: 382886 - DNA, 15 bp, Homo sapiens
tgtgagtcaatgggt

SEQ ID NO: 382887 - DNA, 15 bp, Homo sapiens
gtgagtcaatgggtg

SEQ ID NO: 382888 - DNA, 15 bp, Homo sapiens
tgagtcaatgggtgc

SEQ ID NO: 382889 - DNA, 15 bp, Homo sapiens
gagtcaatgggtgca

SEQ ID NO: 382890 - DNA, 15 bp, Homo sapiens
agtcaatgggtgcag

SEQ ID NO: 382891 - DNA, 15 bp, Homo sapiens
gtcaatgggtgcagc

SEQ ID NO: 382892 - DNA, 15 bp, Homo sapiens
tcaatgggtgcagca

SEQ ID NO: 382893 - DNA, 15 bp, Homo sapiens
caatgggtgcagcac

SEQ ID NO: 382894 - DNA, 15 bp, Homo sapiens
aatgggtgcagcaca

SEQ ID NO: 382895 - DNA, 15 bp, Homo sapiens
atgggtgcagcacac

SEQ ID NO: 382896 - DNA, 15 bp, Homo sapiens
tgggtgcagcacacc

SEQ ID NO: 382897 - DNA, 15 bp, Homo sapiens
gggtgcagcacaccg

SEQ ID NO: 382898 - DNA, 15 bp, Homo sapiens
ggtgcagcacaccga

SEQ ID NO: 382899 - DNA, 15 bp, Homo sapiens
gtgcagcacaccgac

SEQ ID NO: 382900 - DNA, 15 bp, Homo sapiens
tgcagcacaccgaca

SEQ ID NO: 382901 - DNA, 15 bp, Homo sapiens
gcagcacaccgacat

SEQ ID NO: 382902 - DNA, 15 bp, Homo sapiens
cagcacaccgacatg

SEQ ID NO: 382903 - DNA, 15 bp, Homo sapiens
agcacaccgacatgg

SEQ ID NO: 382904 - DNA, 15 bp, Homo sapiens
gcacaccgacatggc

SEQ ID NO: 382905 - DNA, 15 bp, Homo sapiens
cacaccgacatggca

SEQ ID NO: 382906 - DNA, 15 bp, Homo sapiens
acaccgacatggcac

SEQ ID NO: 382907 - DNA, 15 bp, Homo sapiens
caccgacatggcaca

SEQ ID NO: 382908 - DNA, 15 bp, Homo sapiens
accgacatggcacat

SEQ ID NO: 382909 - DNA, 15 bp, Homo sapiens
ccgacatggcacatg

SEQ ID NO: 382910 - DNA, 15 bp, Homo sapiens
cgacatggcacatgt

SEQ ID NO: 382911 - DNA, 15 bp, Homo sapiens
gacatggcacatgta

SEQ ID NO: 382912 - DNA, 15 bp, Homo sapiens
tggcacatgtataca

SEQ ID NO: 382913 - DNA, 15 bp, Homo sapiens
ggcacatgtatacat

SEQ ID NO: 382914 - DNA, 15 bp, Homo sapiens
gcacatgtatacata

SEQ ID NO: 382915 - DNA, 15 bp, Homo sapiens
cacatgtatacatat

SEQ ID NO: 382916 - DNA, 15 bp, Homo sapiens
acatgtatacatatg

SEQ ID NO: 382917 - DNA, 15 bp, Homo sapiens
catgtatacatatgt

SEQ ID NO: 382918 - DNA, 15 bp, Homo sapiens
atgtatacatatgta

SEQ ID NO: 382919 - DNA, 15 bp, Homo sapiens
tgtatacatatgtaa

SEQ ID NO: 382920 - DNA, 15 bp, Homo sapiens
gtatacatatgtaac

SEQ ID NO: 382921 - DNA, 15 bp, Homo sapiens
tatacatatgtaaca

SEQ ID NO: 382922 - DNA, 15 bp, Homo sapiens
atacatatgtaacaa

SEQ ID NO: 382923 - DNA, 15 bp, Homo sapiens
tacatatgtaacaaa

SEQ ID NO: 382924 - DNA, 15 bp, Homo sapiens
acatatgtaacaaac

SEQ ID NO: 382925 - DNA, 15 bp, Homo sapiens
catatgtaacaaacc

SEQ ID NO: 382926 - DNA, 15 bp, Homo sapiens
atatgtaacaaacct

SEQ ID NO: 382927 - DNA, 15 bp, Homo sapiens
tatgtaacaaacctg

SEQ ID NO: 382928 - DNA, 15 bp, Homo sapiens
gtaacaaacctgcac

SEQ ID NO: 382929 - DNA, 15 bp, Homo sapiens
taacaaacctgcacg

SEQ ID NO: 382930 - DNA, 15 bp, Homo sapiens
aacaaacctgcacgt

SEQ ID NO: 382931 - DNA, 15 bp, Homo sapiens
acaaacctgcacgtt

SEQ ID NO: 382932 - DNA, 15 bp, Homo sapiens
caaacctgcacgttg

SEQ ID NO: 382933 - DNA, 15 bp, Homo sapiens
aaacctgcacgttgt

SEQ ID NO: 382934 - DNA, 15 bp, Homo sapiens
aacctgcacgttgtg

SEQ ID NO: 382935 - DNA, 15 bp, Homo sapiens
acctgcacgttgtgc

SEQ ID NO: 382936 - DNA, 15 bp, Homo sapiens
cctgcacgttgtgca

SEQ ID NO: 382937 - DNA, 15 bp, Homo sapiens
ctgcacgttgtgcac

SEQ ID NO: 382938 - DNA, 15 bp, Homo sapiens
tgcacgttgtgcaca

SEQ ID NO: 382939 - DNA, 15 bp, Homo sapiens
gcacgttgtgcacat

SEQ ID NO: 382940 - DNA, 15 bp, Homo sapiens
cacgttgtgcacatg

SEQ ID NO: 382941 - DNA, 15 bp, Homo sapiens
acgttgtgcacatgt

SEQ ID NO: 382942 - DNA, 15 bp, Homo sapiens
cgttgtgcacatgta

SEQ ID NO: 382943 - DNA, 15 bp, Homo sapiens
gttgtgcacatgtac

SEQ ID NO: 382944 - DNA, 15 bp, Homo sapiens
ttgtgcacatgtacc

SEQ ID NO: 382945 - DNA, 15 bp, Homo sapiens
tgtgcacatgtaccc

SEQ ID NO: 382946 - DNA, 15 bp, Homo sapiens
gtgcacatgtaccct

SEQ ID NO: 382947 - DNA, 15 bp, Homo sapiens
tgcacatgtacccta

SEQ ID NO: 382948 - DNA, 15 bp, Homo sapiens
gcacatgtaccctaa

SEQ ID NO: 382949 - DNA, 15 bp, Homo sapiens
cacatgtaccctaaa

SEQ ID NO: 382950 - DNA, 15 bp, Homo sapiens
acatgtaccctaaaa

SEQ ID NO: 382951 - DNA, 15 bp, Homo sapiens
catgtaccctaaaac

SEQ ID NO: 382952 - DNA, 15 bp, Homo sapiens
atgtaccctaaaact

SEQ ID NO: 382953 - DNA, 15 bp, Homo sapiens
tgtaccctaaaactt

SEQ ID NO: 382954 - DNA, 15 bp, Homo sapiens
gtaccctaaaactta

SEQ ID NO: 382955 - DNA, 15 bp, Homo sapiens
taccctaaaacttaa

SEQ ID NO: 382956 - DNA, 15 bp, Homo sapiens
accctaaaacttaaa

SEQ ID NO: 382957 - DNA, 15 bp, Homo sapiens
ccctaaaacttaaag

SEQ ID NO: 382958 - DNA, 15 bp, Homo sapiens
cctaaaacttaaagt

SEQ ID NO: 382959 - DNA, 15 bp, Homo sapiens
ctaaaacttaaagta

SEQ ID NO: 382960 - DNA, 15 bp, Homo sapiens
taaaacttaaagtat

SEQ ID NO: 382961 - DNA, 15 bp, Homo sapiens
aaaacttaaagtata

SEQ ID NO: 382962 - DNA, 15 bp, Homo sapiens
aaacttaaagtataa

SEQ ID NO: 382963 - DNA, 15 bp, Homo sapiens
aacttaaagtataat

SEQ ID NO: 382964 - DNA, 15 bp, Homo sapiens
acttaaagtataata

SEQ ID NO: 382965 - DNA, 15 bp, Homo sapiens
cttaaagtataataa

SEQ ID NO: 382966 - DNA, 15 bp, Homo sapiens
ttaaagtataataat

SEQ ID NO: 382967 - DNA, 15 bp, Homo sapiens
taaagtataataata

SEQ ID NO: 382968 - DNA, 15 bp, Homo sapiens
aaagtataataataa

SEQ ID NO: 382969 - DNA, 15 bp, Homo sapiens
aagtataataataat

SEQ ID NO: 382970 - DNA, 15 bp, Homo sapiens
agtataataataata

SEQ ID NO: 382971 - DNA, 15 bp, Homo sapiens
ataataataataatt

SEQ ID NO: 382972 - DNA, 15 bp, Homo sapiens
taataataataatta

SEQ ID NO: 382973 - DNA, 15 bp, Homo sapiens
aataataataattaa

SEQ ID NO: 382974 - DNA, 15 bp, Homo sapiens
ataataataattaaa

SEQ ID NO: 382975 - DNA, 15 bp, Homo sapiens
taataataattaaaa

SEQ ID NO: 382976 - DNA, 15 bp, Homo sapiens
aataataattaaaaa

SEQ ID NO: 382977 - DNA, 15 bp, Homo sapiens
ataataattaaaaaa

SEQ ID NO: 382978 - DNA, 15 bp, Homo sapiens
taataattaaaaaaa

SEQ ID NO: 382979 - DNA, 15 bp, Homo sapiens
aataattaaaaaaaa

SEQ ID NO: 382980 - DNA, 15 bp, Homo sapiens
ataattaaaaaaaag

SEQ ID NO: 382981 - DNA, 15 bp, Homo sapiens
taattaaaaaaaaga

SEQ ID NO: 382982 - DNA, 15 bp, Homo sapiens
aattaaaaaaaagaa

SEQ ID NO: 382983 - DNA, 15 bp, Homo sapiens
aaaaaaagaaaagac

SEQ ID NO: 382984 - DNA, 15 bp, Homo sapiens
aaaaaagaaaagacc

SEQ ID NO: 382985 - DNA, 15 bp, Homo sapiens
aaaaagaaaagacct

SEQ ID NO: 382986 - DNA, 15 bp, Homo sapiens
aaaagaaaagaccta

SEQ ID NO: 382987 - DNA, 15 bp, Homo sapiens
aaagaaaagacctac

SEQ ID NO: 382988 - DNA, 15 bp, Homo sapiens
aagaaaagacctaca

SEQ ID NO: 382989 - DNA, 15 bp, Homo sapiens
agaaaagacctacaa

SEQ ID NO: 382990 - DNA, 15 bp, Homo sapiens
gaaaagacctacaat

SEQ ID NO: 382991 - DNA, 15 bp, Homo sapiens
aaaagacctacaatc

SEQ ID NO: 382992 - DNA, 15 bp, Homo sapiens
aaagacctacaatca

SEQ ID NO: 382993 - DNA, 15 bp, Homo sapiens
aagacctacaatcag

SEQ ID NO: 382994 - DNA, 15 bp, Homo sapiens
agacctacaatcaga

SEQ ID NO: 382995 - DNA, 15 bp, Homo sapiens
gacctacaatcagac

SEQ ID NO: 382996 - DNA, 15 bp, Homo sapiens
acctacaatcagaca

SEQ ID NO: 382997 - DNA, 15 bp, Homo sapiens
cctacaatcagacaa

SEQ ID NO: 382998 - DNA, 15 bp, Homo sapiens
ctacaatcagacaaa

SEQ ID NO: 382999 - DNA, 15 bp, Homo sapiens
tacaatcagacaaag

SEQ ID NO: 383000 - DNA, 15 bp, Homo sapiens
acaatcagacaaagc

SEQ ID NO: 383001 - DNA, 15 bp, Homo sapiens
caatcagacaaagca

SEQ ID NO: 383002 - DNA, 15 bp, Homo sapiens
aatcagacaaagcag

SEQ ID NO: 383003 - DNA, 15 bp, Homo sapiens
atcagacaaagcagg

SEQ ID NO: 383004 - DNA, 15 bp, Homo sapiens
tcagacaaagcaggt

SEQ ID NO: 383005 - DNA, 15 bp, Homo sapiens
cagacaaagcaggtt

SEQ ID NO: 383006 - DNA, 15 bp, Homo sapiens
agacaaagcaggtta

SEQ ID NO: 383007 - DNA, 15 bp, Homo sapiens
gacaaagcaggttag

SEQ ID NO: 383008 - DNA, 15 bp, Homo sapiens
acaaagcaggttaga

SEQ ID NO: 383009 - DNA, 15 bp, Homo sapiens
caaagcaggttagag

SEQ ID NO: 383010 - DNA, 15 bp, Homo sapiens
aaagcaggttagaga

SEQ ID NO: 383011 - DNA, 15 bp, Homo sapiens
aagcaggttagagaa

SEQ ID NO: 383012 - DNA, 15 bp, Homo sapiens
agcaggttagagaat

SEQ ID NO: 383013 - DNA, 15 bp, Homo sapiens
gcaggttagagaatt

SEQ ID NO: 383014 - DNA, 15 bp, Homo sapiens
caggttagagaattt

SEQ ID NO: 383015 - DNA, 15 bp, Homo sapiens
aggttagagaatttc

SEQ ID NO: 383016 - DNA, 15 bp, Homo sapiens
ggttagagaatttct

SEQ ID NO: 383017 - DNA, 15 bp, Homo sapiens
gttagagaatttctt

SEQ ID NO: 383018 - DNA, 15 bp, Homo sapiens
ttagagaatttcttt

SEQ ID NO: 383019 - DNA, 15 bp, Homo sapiens
tagagaatttcttta

SEQ ID NO: 383020 - DNA, 15 bp, Homo sapiens
agagaatttctttat

SEQ ID NO: 383021 - DNA, 15 bp, Homo sapiens
gagaatttctttatg

SEQ ID NO: 383022 - DNA, 15 bp, Homo sapiens
agaatttctttatgg

SEQ ID NO: 383023 - DNA, 15 bp, Homo sapiens
gaatttctttatggc

SEQ ID NO: 383024 - DNA, 15 bp, Homo sapiens
aatttctttatggcc

SEQ ID NO: 383025 - DNA, 15 bp, Homo sapiens
atttctttatggcca

SEQ ID NO: 383026 - DNA, 15 bp, Homo sapiens
tttctttatggccat

SEQ ID NO: 383027 - DNA, 15 bp, Homo sapiens
ttctttatggccatc

SEQ ID NO: 383028 - DNA, 15 bp, Homo sapiens
tctttatggccatct

SEQ ID NO: 383029 - DNA, 15 bp, Homo sapiens
ctttatggccatctc

SEQ ID NO: 383030 - DNA, 15 bp, Homo sapiens
tttatggccatctcc

SEQ ID NO: 383031 - DNA, 15 bp, Homo sapiens
ttatggccatctcca

SEQ ID NO: 383032 - DNA, 15 bp, Homo sapiens
tatggccatctccaa

SEQ ID NO: 383033 - DNA, 15 bp, Homo sapiens
atggccatctccaag

SEQ ID NO: 383034 - DNA, 15 bp, Homo sapiens
tggccatctccaaga

SEQ ID NO: 383035 - DNA, 15 bp, Homo sapiens
ggccatctccaagac

SEQ ID NO: 383036 - DNA, 15 bp, Homo sapiens
gccatctccaagaca

SEQ ID NO: 383037 - DNA, 15 bp, Homo sapiens
ccatctccaagacag

SEQ ID NO: 383038 - DNA, 15 bp, Homo sapiens
catctccaagacaga

SEQ ID NO: 383039 - DNA, 15 bp, Homo sapiens
atctccaagacagaa

SEQ ID NO: 383040 - DNA, 15 bp, Homo sapiens
tctccaagacagaaa

SEQ ID NO: 383041 - DNA, 15 bp, Homo sapiens
ctccaagacagaaag

SEQ ID NO: 383042 - DNA, 15 bp, Homo sapiens
tccaagacagaaagg

SEQ ID NO: 383043 - DNA, 15 bp, Homo sapiens
ccaagacagaaaggt

SEQ ID NO: 383044 - DNA, 15 bp, Homo sapiens
caagacagaaaggta

SEQ ID NO: 383045 - DNA, 15 bp, Homo sapiens
aagacagaaaggtag

SEQ ID NO: 383046 - DNA, 15 bp, Homo sapiens
agacagaaaggtagg

SEQ ID NO: 383047 - DNA, 15 bp, Homo sapiens
gacagaaaggtaggg

SEQ ID NO: 383048 - DNA, 15 bp, Homo sapiens
acagaaaggtagggg

SEQ ID NO: 383049 - DNA, 15 bp, Homo sapiens
cagaaaggtagggga

SEQ ID NO: 383050 - DNA, 15 bp, Homo sapiens
agaaaggtaggggaa

SEQ ID NO: 383051 - DNA, 15 bp, Homo sapiens
gaaaggtaggggaag

SEQ ID NO: 383052 - DNA, 15 bp, Homo sapiens
aaaggtaggggaaga

SEQ ID NO: 383053 - DNA, 15 bp, Homo sapiens
aaggtaggggaagac

SEQ ID NO: 383054 - DNA, 15 bp, Homo sapiens
aggtaggggaagact

SEQ ID NO: 383055 - DNA, 15 bp, Homo sapiens
ggtaggggaagactc

SEQ ID NO: 383056 - DNA, 15 bp, Homo sapiens
gtaggggaagactcc

SEQ ID NO: 383057 - DNA, 15 bp, Homo sapiens
taggggaagactcct

SEQ ID NO: 383058 - DNA, 15 bp, Homo sapiens
aggggaagactcctg

SEQ ID NO: 383059 - DNA, 15 bp, Homo sapiens
ggggaagactcctgc

SEQ ID NO: 383060 - DNA, 15 bp, Homo sapiens
gggaagactcctgcc

SEQ ID NO: 383061 - DNA, 15 bp, Homo sapiens
ggaagactcctgcct

SEQ ID NO: 383062 - DNA, 15 bp, Homo sapiens
gaagactcctgcctt

SEQ ID NO: 383063 - DNA, 15 bp, Homo sapiens
aagactcctgccttc

SEQ ID NO: 383064 - DNA, 15 bp, Homo sapiens
agactcctgccttca

SEQ ID NO: 383065 - DNA, 15 bp, Homo sapiens
gactcctgccttcag

SEQ ID NO: 383066 - DNA, 15 bp, Homo sapiens
actcctgccttcagg

SEQ ID NO: 383067 - DNA, 15 bp, Homo sapiens
ctcctgccttcagga

SEQ ID NO: 383068 - DNA, 15 bp, Homo sapiens
tcctgccttcaggag

SEQ ID NO: 383069 - DNA, 15 bp, Homo sapiens
cctgccttcaggaga

SEQ ID NO: 383070 - DNA, 15 bp, Homo sapiens
ctgccttcaggagag

SEQ ID NO: 383071 - DNA, 15 bp, Homo sapiens
tgccttcaggagaga

SEQ ID NO: 383072 - DNA, 15 bp, Homo sapiens
gccttcaggagagaa

SEQ ID NO: 383073 - DNA, 15 bp, Homo sapiens
ccttcaggagagaaa

SEQ ID NO: 383074 - DNA, 15 bp, Homo sapiens
cttcaggagagaaag

SEQ ID NO: 383075 - DNA, 15 bp, Homo sapiens
ttcaggagagaaaga

SEQ ID NO: 383076 - DNA, 15 bp, Homo sapiens
tcaggagagaaagaa

SEQ ID NO: 383077 - DNA, 15 bp, Homo sapiens
caggagagaaagaag

SEQ ID NO: 383078 - DNA, 15 bp, Homo sapiens
aggagagaaagaagg

SEQ ID NO: 383079 - DNA, 15 bp, Homo sapiens
ggagagaaagaagga

SEQ ID NO: 383080 - DNA, 15 bp, Homo sapiens
gagagaaagaaggag

SEQ ID NO: 383081 - DNA, 15 bp, Homo sapiens
agagaaagaaggagg

SEQ ID NO: 383082 - DNA, 15 bp, Homo sapiens
gagaaagaaggaggt

SEQ ID NO: 383083 - DNA, 15 bp, Homo sapiens
agaaagaaggaggtg

SEQ ID NO: 383084 - DNA, 15 bp, Homo sapiens
gaaagaaggaggtga

SEQ ID NO: 383085 - DNA, 15 bp, Homo sapiens
aaagaaggaggtgaa

SEQ ID NO: 383086 - DNA, 15 bp, Homo sapiens
aagaaggaggtgaaa

SEQ ID NO: 383087 - DNA, 15 bp, Homo sapiens
agaaggaggtgaaag

SEQ ID NO: 383088 - DNA, 15 bp, Homo sapiens
gaaggaggtgaaagg

SEQ ID NO: 383089 - DNA, 15 bp, Homo sapiens
aaggaggtgaaaggg

SEQ ID NO: 383090 - DNA, 15 bp, Homo sapiens
aggaggtgaaagggc

SEQ ID NO: 383091 - DNA, 15 bp, Homo sapiens
ggaggtgaaagggca

SEQ ID NO: 383092 - DNA, 15 bp, Homo sapiens
gaggtgaaagggcag

SEQ ID NO: 383093 - DNA, 15 bp, Homo sapiens
aggtgaaagggcagg

SEQ ID NO: 383094 - DNA, 15 bp, Homo sapiens
ggtgaaagggcagga

SEQ ID NO: 383095 - DNA, 15 bp, Homo sapiens
gtgaaagggcaggag

SEQ ID NO: 383096 - DNA, 15 bp, Homo sapiens
tgaaagggcaggaga

SEQ ID NO: 383097 - DNA, 15 bp, Homo sapiens
gaaagggcaggagaa

SEQ ID NO: 383098 - DNA, 15 bp, Homo sapiens
aaagggcaggagaag

SEQ ID NO: 383099 - DNA, 15 bp, Homo sapiens
aagggcaggagaagg

SEQ ID NO: 383100 - DNA, 15 bp, Homo sapiens
agggcaggagaaggt

SEQ ID NO: 383101 - DNA, 15 bp, Homo sapiens
gggcaggagaaggtc

SEQ ID NO: 383102 - DNA, 15 bp, Homo sapiens
ggcaggagaaggtca

SEQ ID NO: 383103 - DNA, 15 bp, Homo sapiens
gcaggagaaggtcac

SEQ ID NO: 383104 - DNA, 15 bp, Homo sapiens
caggagaaggtcaca

SEQ ID NO: 383105 - DNA, 15 bp, Homo sapiens
aggagaaggtcacag

SEQ ID NO: 383106 - DNA, 15 bp, Homo sapiens
ggagaaggtcacaga

SEQ ID NO: 383107 - DNA, 15 bp, Homo sapiens
gagaaggtcacagag

SEQ ID NO: 383108 - DNA, 15 bp, Homo sapiens
agaaggtcacagaga

SEQ ID NO: 383109 - DNA, 15 bp, Homo sapiens
gaaggtcacagagag

SEQ ID NO: 383110 - DNA, 15 bp, Homo sapiens
aaggtcacagagaga

SEQ ID NO: 383111 - DNA, 15 bp, Homo sapiens
aggtcacagagagag

SEQ ID NO: 383112 - DNA, 15 bp, Homo sapiens
ggtcacagagagaga

SEQ ID NO: 383113 - DNA, 15 bp, Homo sapiens
gtcacagagagagat

SEQ ID NO: 383114 - DNA, 15 bp, Homo sapiens
tcacagagagagatt

SEQ ID NO: 383115 - DNA, 15 bp, Homo sapiens
cacagagagagattg

SEQ ID NO: 383116 - DNA, 15 bp, Homo sapiens
acagagagagattgt

SEQ ID NO: 383117 - DNA, 15 bp, Homo sapiens
cagagagagattgtt

SEQ ID NO: 383118 - DNA, 15 bp, Homo sapiens
agagagagattgttt

SEQ ID NO: 383119 - DNA, 15 bp, Homo sapiens
gagagagattgtttt

SEQ ID NO: 383120 - DNA, 15 bp, Homo sapiens
agagagattgttttc

SEQ ID NO: 383121 - DNA, 15 bp, Homo sapiens
gagagattgttttct

SEQ ID NO: 383122 - DNA, 15 bp, Homo sapiens
agagattgttttctg

SEQ ID NO: 383123 - DNA, 15 bp, Homo sapiens
gagattgttttctga

SEQ ID NO: 383124 - DNA, 15 bp, Homo sapiens
agattgttttctgag

SEQ ID NO: 383125 - DNA, 15 bp, Homo sapiens
gattgttttctgagg

SEQ ID NO: 383126 - DNA, 15 bp, Homo sapiens
attgttttctgaggc

SEQ ID NO: 383127 - DNA, 15 bp, Homo sapiens
ttgttttctgaggcc

SEQ ID NO: 383128 - DNA, 15 bp, Homo sapiens
tgttttctgaggcct

SEQ ID NO: 383129 - DNA, 15 bp, Homo sapiens
gttttctgaggcctg

SEQ ID NO: 383130 - DNA, 15 bp, Homo sapiens
ttttctgaggcctgc

SEQ ID NO: 383131 - DNA, 15 bp, Homo sapiens
tttctgaggcctgct

SEQ ID NO: 383132 - DNA, 15 bp, Homo sapiens
ttctgaggcctgctt

SEQ ID NO: 383133 - DNA, 15 bp, Homo sapiens
tctgaggcctgcttc

SEQ ID NO: 383134 - DNA, 15 bp, Homo sapiens
ctgaggcctgcttct

SEQ ID NO: 383135 - DNA, 15 bp, Homo sapiens
tgaggcctgcttctg

SEQ ID NO: 383136 - DNA, 15 bp, Homo sapiens
gaggcctgcttctga

SEQ ID NO: 383137 - DNA, 15 bp, Homo sapiens
aggcctgcttctgag

SEQ ID NO: 383138 - DNA, 15 bp, Homo sapiens
ggcctgcttctgagc

SEQ ID NO: 383139 - DNA, 15 bp, Homo sapiens
gcctgcttctgagcc

SEQ ID NO: 383140 - DNA, 15 bp, Homo sapiens
cctgcttctgagccc

SEQ ID NO: 383141 - DNA, 15 bp, Homo sapiens
ctgcttctgagccct

SEQ ID NO: 383142 - DNA, 15 bp, Homo sapiens
tgcttctgagccctg

SEQ ID NO: 383143 - DNA, 15 bp, Homo sapiens
gcttctgagccctga

SEQ ID NO: 383144 - DNA, 15 bp, Homo sapiens
cttctgagccctgag

SEQ ID NO: 383145 - DNA, 15 bp, Homo sapiens
ttctgagccctgagg

SEQ ID NO: 383146 - DNA, 15 bp, Homo sapiens
tctgagccctgaggc

SEQ ID NO: 383147 - DNA, 15 bp, Homo sapiens
ctgagccctgaggca

SEQ ID NO: 383148 - DNA, 15 bp, Homo sapiens
tgagccctgaggcac

SEQ ID NO: 383149 - DNA, 15 bp, Homo sapiens
gagccctgaggcacc

SEQ ID NO: 383150 - DNA, 15 bp, Homo sapiens
agccctgaggcaccc

SEQ ID NO: 383151 - DNA, 15 bp, Homo sapiens
gccctgaggcacccc

SEQ ID NO: 383152 - DNA, 15 bp, Homo sapiens
ccctgaggcacccca

SEQ ID NO: 383153 - DNA, 15 bp, Homo sapiens
cctgaggcaccccaa

SEQ ID NO: 383154 - DNA, 15 bp, Homo sapiens
ctgaggcaccccaat

SEQ ID NO: 383155 - DNA, 15 bp, Homo sapiens
tgaggcaccccaata

SEQ ID NO: 383156 - DNA, 15 bp, Homo sapiens
gaggcaccccaatat

SEQ ID NO: 383157 - DNA, 15 bp, Homo sapiens
aggcaccccaatatt

SEQ ID NO: 383158 - DNA, 15 bp, Homo sapiens
ggcaccccaatatta

SEQ ID NO: 383159 - DNA, 15 bp, Homo sapiens
gcaccccaatattag

SEQ ID NO: 383160 - DNA, 15 bp, Homo sapiens
caccccaatattaga

SEQ ID NO: 383161 - DNA, 15 bp, Homo sapiens
accccaatattagaa

SEQ ID NO: 383162 - DNA, 15 bp, Homo sapiens
ccccaatattagaac

SEQ ID NO: 383163 - DNA, 15 bp, Homo sapiens
cccaatattagaaca

SEQ ID NO: 383164 - DNA, 15 bp, Homo sapiens
ccaatattagaacaa

SEQ ID NO: 383165 - DNA, 15 bp, Homo sapiens
caatattagaacaaa

SEQ ID NO: 383166 - DNA, 15 bp, Homo sapiens
aatattagaacaaaa

SEQ ID NO: 383167 - DNA, 15 bp, Homo sapiens
atattagaacaaaag

SEQ ID NO: 383168 - DNA, 15 bp, Homo sapiens
tattagaacaaaagg

SEQ ID NO: 383169 - DNA, 15 bp, Homo sapiens
attagaacaaaaggc

SEQ ID NO: 383170 - DNA, 15 bp, Homo sapiens
ttagaacaaaaggct

SEQ ID NO: 383171 - DNA, 15 bp, Homo sapiens
tagaacaaaaggcta

SEQ ID NO: 383172 - DNA, 15 bp, Homo sapiens
agaacaaaaggctat

SEQ ID NO: 383173 - DNA, 15 bp, Homo sapiens
gaacaaaaggctata

SEQ ID NO: 383174 - DNA, 15 bp, Homo sapiens
aacaaaaggctataa

SEQ ID NO: 383175 - DNA, 15 bp, Homo sapiens
acaaaaggctataac

SEQ ID NO: 383176 - DNA, 15 bp, Homo sapiens
caaaaggctataaca

SEQ ID NO: 383177 - DNA, 15 bp, Homo sapiens
aaaaggctataacaa

SEQ ID NO: 383178 - DNA, 15 bp, Homo sapiens
aaaggctataacaag

SEQ ID NO: 383179 - DNA, 15 bp, Homo sapiens
aaggctataacaagt

SEQ ID NO: 383180 - DNA, 15 bp, Homo sapiens
aggctataacaagtg

SEQ ID NO: 383181 - DNA, 15 bp, Homo sapiens
ggctataacaagtgt

SEQ ID NO: 383182 - DNA, 15 bp, Homo sapiens
gctataacaagtgtt

SEQ ID NO: 383183 - DNA, 15 bp, Homo sapiens
ctataacaagtgtta

SEQ ID NO: 383184 - DNA, 15 bp, Homo sapiens
tataacaagtgttat

SEQ ID NO: 383185 - DNA, 15 bp, Homo sapiens
ataacaagtgttatg

SEQ ID NO: 383186 - DNA, 15 bp, Homo sapiens
taacaagtgttatgg

SEQ ID NO: 383187 - DNA, 15 bp, Homo sapiens
aacaagtgttatggg

SEQ ID NO: 383188 - DNA, 15 bp, Homo sapiens
acaagtgttatggga

SEQ ID NO: 383189 - DNA, 15 bp, Homo sapiens
caagtgttatgggag

SEQ ID NO: 383190 - DNA, 15 bp, Homo sapiens
aagtgttatgggagt

SEQ ID NO: 383191 - DNA, 15 bp, Homo sapiens
agtgttatgggagtt

SEQ ID NO: 383192 - DNA, 15 bp, Homo sapiens
gtgttatgggagtta

SEQ ID NO: 383193 - DNA, 15 bp, Homo sapiens
tgttatgggagttat

SEQ ID NO: 383194 - DNA, 15 bp, Homo sapiens
gttatgggagttatg

SEQ ID NO: 383195 - DNA, 15 bp, Homo sapiens
ttatgggagttatgt

SEQ ID NO: 383196 - DNA, 15 bp, Homo sapiens
tatgggagttatgtt

SEQ ID NO: 383197 - DNA, 15 bp, Homo sapiens
atgggagttatgttg

SEQ ID NO: 383198 - DNA, 15 bp, Homo sapiens
tgggagttatgttgc

SEQ ID NO: 383199 - DNA, 15 bp, Homo sapiens
gggagttatgttgca

SEQ ID NO: 383200 - DNA, 15 bp, Homo sapiens
ggagttatgttgcag

SEQ ID NO: 383201 - DNA, 15 bp, Homo sapiens
gagttatgttgcagg

SEQ ID NO: 383202 - DNA, 15 bp, Homo sapiens
agttatgttgcagga

SEQ ID NO: 383203 - DNA, 15 bp, Homo sapiens
gttatgttgcaggaa

SEQ ID NO: 383204 - DNA, 15 bp, Homo sapiens
ttatgttgcaggaac

SEQ ID NO: 383205 - DNA, 15 bp, Homo sapiens
tatgttgcaggaact

SEQ ID NO: 383206 - DNA, 15 bp, Homo sapiens
atgttgcaggaactg

SEQ ID NO: 383207 - DNA, 15 bp, Homo sapiens
tgttgcaggaactgt

SEQ ID NO: 383208 - DNA, 15 bp, Homo sapiens
gttgcaggaactgtg

SEQ ID NO: 383209 - DNA, 15 bp, Homo sapiens
ttgcaggaactgtgg

SEQ ID NO: 383210 - DNA, 15 bp, Homo sapiens
tgcaggaactgtgga

SEQ ID NO: 383211 - DNA, 15 bp, Homo sapiens
gcaggaactgtggat

SEQ ID NO: 383212 - DNA, 15 bp, Homo sapiens
caggaactgtggatg

SEQ ID NO: 383213 - DNA, 15 bp, Homo sapiens
aggaactgtggatga

SEQ ID NO: 383214 - DNA, 15 bp, Homo sapiens
ggaactgtggatgaa

SEQ ID NO: 383215 - DNA, 15 bp, Homo sapiens
gaactgtggatgaaa

SEQ ID NO: 383216 - DNA, 15 bp, Homo sapiens
aactgtggatgaaaa

SEQ ID NO: 383217 - DNA, 15 bp, Homo sapiens
actgtggatgaaaac

SEQ ID NO: 383218 - DNA, 15 bp, Homo sapiens
ctgtggatgaaaaca

SEQ ID NO: 383219 - DNA, 15 bp, Homo sapiens
tgtggatgaaaacat

SEQ ID NO: 383220 - DNA, 15 bp, Homo sapiens
gtggatgaaaacata

SEQ ID NO: 383221 - DNA, 15 bp, Homo sapiens
tggatgaaaacatat

SEQ ID NO: 383222 - DNA, 15 bp, Homo sapiens
ggatgaaaacatata

SEQ ID NO: 383223 - DNA, 15 bp, Homo sapiens
gatgaaaacatatac

SEQ ID NO: 383224 - DNA, 15 bp, Homo sapiens
atgaaaacatatacg

SEQ ID NO: 383225 - DNA, 15 bp, Homo sapiens
tgaaaacatatacgt

SEQ ID NO: 383226 - DNA, 15 bp, Homo sapiens
gaaaacatatacgta

SEQ ID NO: 383227 - DNA, 15 bp, Homo sapiens
aaaacatatacgtat

SEQ ID NO: 383228 - DNA, 15 bp, Homo sapiens
aaacatatacgtatt

SEQ ID NO: 383229 - DNA, 15 bp, Homo sapiens
aacatatacgtatta

SEQ ID NO: 383230 - DNA, 15 bp, Homo sapiens
acatatacgtattac

SEQ ID NO: 383231 - DNA, 15 bp, Homo sapiens
catatacgtattaca

SEQ ID NO: 383232 - DNA, 15 bp, Homo sapiens
atatacgtattacag

SEQ ID NO: 383233 - DNA, 15 bp, Homo sapiens
tatacgtattacagt

SEQ ID NO: 383234 - DNA, 15 bp, Homo sapiens
atacgtattacagta

SEQ ID NO: 383235 - DNA, 15 bp, Homo sapiens
tacgtattacagtaa

SEQ ID NO: 383236 - DNA, 15 bp, Homo sapiens
acgtattacagtaag

SEQ ID NO: 383237 - DNA, 15 bp, Homo sapiens
cgtattacagtaagt

SEQ ID NO: 383238 - DNA, 15 bp, Homo sapiens
gtattacagtaagta

SEQ ID NO: 383239 - DNA, 15 bp, Homo sapiens
tattacagtaagtac

SEQ ID NO: 383240 - DNA, 15 bp, Homo sapiens
attacagtaagtacg

SEQ ID NO: 383241 - DNA, 15 bp, Homo sapiens
ttacagtaagtacga

SEQ ID NO: 383242 - DNA, 15 bp, Homo sapiens
tacagtaagtacgat

SEQ ID NO: 383243 - DNA, 15 bp, Homo sapiens
acagtaagtacgatg

SEQ ID NO: 383244 - DNA, 15 bp, Homo sapiens
cagtaagtacgatga

SEQ ID NO: 383245 - DNA, 15 bp, Homo sapiens
agtaagtacgatgaa

SEQ ID NO: 383246 - DNA, 15 bp, Homo sapiens
gtaagtacgatgaat

SEQ ID NO: 383247 - DNA, 15 bp, Homo sapiens
taagtacgatgaata

SEQ ID NO: 383248 - DNA, 15 bp, Homo sapiens
aagtacgatgaataa

SEQ ID NO: 383249 - DNA, 15 bp, Homo sapiens
agtacgatgaataaa

SEQ ID NO: 383250 - DNA, 15 bp, Homo sapiens
gtacgatgaataaaa

SEQ ID NO: 383251 - DNA, 15 bp, Homo sapiens
tacgatgaataaaaa

SEQ ID NO: 383252 - DNA, 15 bp, Homo sapiens
acgatgaataaaaat

SEQ ID NO: 383253 - DNA, 15 bp, Homo sapiens
cgatgaataaaaatt

SEQ ID NO: 383254 - DNA, 15 bp, Homo sapiens
gatgaataaaaatta

SEQ ID NO: 383255 - DNA, 15 bp, Homo sapiens
atgaataaaaattat

SEQ ID NO: 383256 - DNA, 15 bp, Homo sapiens
tgaataaaaattatt

SEQ ID NO: 383257 - DNA, 15 bp, Homo sapiens
gaataaaaattattt

SEQ ID NO: 383258 - DNA, 15 bp, Homo sapiens
aataaaaattatttg

SEQ ID NO: 383259 - DNA, 15 bp, Homo sapiens
ataaaaattatttgc

SEQ ID NO: 383260 - DNA, 15 bp, Homo sapiens
taaaaattatttgca

SEQ ID NO: 383261 - DNA, 15 bp, Homo sapiens
aaaaattatttgcat

SEQ ID NO: 383262 - DNA, 15 bp, Homo sapiens
aaaattatttgcata

SEQ ID NO: 383263 - DNA, 15 bp, Homo sapiens
aaattatttgcataa

SEQ ID NO: 383264 - DNA, 15 bp, Homo sapiens
aattatttgcataat

SEQ ID NO: 383265 - DNA, 15 bp, Homo sapiens
attatttgcataata

SEQ ID NO: 383266 - DNA, 15 bp, Homo sapiens
ttatttgcataatat

SEQ ID NO: 383267 - DNA, 15 bp, Homo sapiens
tatttgcataatata

SEQ ID NO: 383268 - DNA, 15 bp, Homo sapiens
atttgcataatatag

SEQ ID NO: 383269 - DNA, 15 bp, Homo sapiens
tttgcataatatagc

SEQ ID NO: 383270 - DNA, 15 bp, Homo sapiens
ttgcataatatagct

SEQ ID NO: 383271 - DNA, 15 bp, Homo sapiens
tgcataatatagcta

SEQ ID NO: 383272 - DNA, 15 bp, Homo sapiens
gcataatatagctaa

SEQ ID NO: 383273 - DNA, 15 bp, Homo sapiens
cataatatagctaac

SEQ ID NO: 383274 - DNA, 15 bp, Homo sapiens
ataatatagctaaca

SEQ ID NO: 383275 - DNA, 15 bp, Homo sapiens
taatatagctaacat

SEQ ID NO: 383276 - DNA, 15 bp, Homo sapiens
aatatagctaacata

SEQ ID NO: 383277 - DNA, 15 bp, Homo sapiens
atatagctaacataa

SEQ ID NO: 383278 - DNA, 15 bp, Homo sapiens
tatagctaacataaa

SEQ ID NO: 383279 - DNA, 15 bp, Homo sapiens
atagctaacataaaa

SEQ ID NO: 383280 - DNA, 15 bp, Homo sapiens
tagctaacataaaaa

SEQ ID NO: 383281 - DNA, 15 bp, Homo sapiens
agctaacataaaaaa

SEQ ID NO: 383282 - DNA, 15 bp, Homo sapiens
gctaacataaaaaaa

SEQ ID NO: 383283 - DNA, 15 bp, Homo sapiens
ctaacataaaaaaaa

SEQ ID NO: 383284 - DNA, 15 bp, Homo sapiens
taacataaaaaaaag

SEQ ID NO: 383285 - DNA, 15 bp, Homo sapiens
aacataaaaaaaaga

SEQ ID NO: 383286 - DNA, 15 bp, Homo sapiens
acataaaaaaaagag

SEQ ID NO: 383287 - DNA, 15 bp, Homo sapiens
cataaaaaaaagaga

SEQ ID NO: 383288 - DNA, 15 bp, Homo sapiens
ataaaaaaaagagat

SEQ ID NO: 383289 - DNA, 15 bp, Homo sapiens
taaaaaaaagagata

SEQ ID NO: 383290 - DNA, 15 bp, Homo sapiens
aaaaaaaagagatat

SEQ ID NO: 383291 - DNA, 15 bp, Homo sapiens
aaaaaaagagatata

SEQ ID NO: 383292 - DNA, 15 bp, Homo sapiens
aaaaaagagatatag

SEQ ID NO: 383293 - DNA, 15 bp, Homo sapiens
aaaaagagatatagt

SEQ ID NO: 383294 - DNA, 15 bp, Homo sapiens
aaaagagatatagtc

SEQ ID NO: 383295 - DNA, 15 bp, Homo sapiens
aaagagatatagtcc

SEQ ID NO: 383296 - DNA, 15 bp, Homo sapiens
aagagatatagtcct

SEQ ID NO: 383297 - DNA, 15 bp, Homo sapiens
agagatatagtcctt

SEQ ID NO: 383298 - DNA, 15 bp, Homo sapiens
gagatatagtcctta

SEQ ID NO: 383299 - DNA, 15 bp, Homo sapiens
agatatagtccttaa

SEQ ID NO: 383300 - DNA, 15 bp, Homo sapiens
gatatagtccttaaa

SEQ ID NO: 383301 - DNA, 15 bp, Homo sapiens
atatagtccttaaat

SEQ ID NO: 383302 - DNA, 15 bp, Homo sapiens
tatagtccttaaata

SEQ ID NO: 383303 - DNA, 15 bp, Homo sapiens
atagtccttaaatat

SEQ ID NO: 383304 - DNA, 15 bp, Homo sapiens
tagtccttaaatatg

SEQ ID NO: 383305 - DNA, 15 bp, Homo sapiens
agtccttaaatatgc

SEQ ID NO: 383306 - DNA, 15 bp, Homo sapiens
gtccttaaatatgct

SEQ ID NO: 383307 - DNA, 15 bp, Homo sapiens
tccttaaatatgctc

SEQ ID NO: 383308 - DNA, 15 bp, Homo sapiens
ccttaaatatgctct

SEQ ID NO: 383309 - DNA, 15 bp, Homo sapiens
cttaaatatgctctg

SEQ ID NO: 383310 - DNA, 15 bp, Homo sapiens
ttaaatatgctctgt

SEQ ID NO: 383311 - DNA, 15 bp, Homo sapiens
taaatatgctctgtc

SEQ ID NO: 383312 - DNA, 15 bp, Homo sapiens
aaatatgctctgtct

SEQ ID NO: 383313 - DNA, 15 bp, Homo sapiens
aatatgctctgtctt

SEQ ID NO: 383314 - DNA, 15 bp, Homo sapiens
atatgctctgtcttt

SEQ ID NO: 383315 - DNA, 15 bp, Homo sapiens
tatgctctgtctttg

SEQ ID NO: 383316 - DNA, 15 bp, Homo sapiens
atgctctgtctttgt

SEQ ID NO: 383317 - DNA, 15 bp, Homo sapiens
tgctctgtctttgtg

SEQ ID NO: 383318 - DNA, 15 bp, Homo sapiens
gctctgtctttgtgt

SEQ ID NO: 383319 - DNA, 15 bp, Homo sapiens
ctctgtctttgtgtt

SEQ ID NO: 383320 - DNA, 15 bp, Homo sapiens
tctgtctttgtgttt

SEQ ID NO: 383321 - DNA, 15 bp, Homo sapiens
ctgtctttgtgtttc

SEQ ID NO: 383322 - DNA, 15 bp, Homo sapiens
tgtctttgtgtttcc

SEQ ID NO: 383323 - DNA, 15 bp, Homo sapiens
gtctttgtgtttcca

SEQ ID NO: 383324 - DNA, 15 bp, Homo sapiens
tctttgtgtttccaa

SEQ ID NO: 383325 - DNA, 15 bp, Homo sapiens
ctttgtgtttccaaa

SEQ ID NO: 383326 - DNA, 15 bp, Homo sapiens
tttgtgtttccaaaa

SEQ ID NO: 383327 - DNA, 15 bp, Homo sapiens
ttgtgtttccaaaaa

SEQ ID NO: 383328 - DNA, 15 bp, Homo sapiens
tgtgtttccaaaaat

SEQ ID NO: 383329 - DNA, 15 bp, Homo sapiens
gtgtttccaaaaatt

SEQ ID NO: 383330 - DNA, 15 bp, Homo sapiens
tgtttccaaaaattc

SEQ ID NO: 383331 - DNA, 15 bp, Homo sapiens
gtttccaaaaattcc

SEQ ID NO: 383332 - DNA, 15 bp, Homo sapiens
tttccaaaaattcca

SEQ ID NO: 383333 - DNA, 15 bp, Homo sapiens
ttccaaaaattccat

SEQ ID NO: 383334 - DNA, 15 bp, Homo sapiens
tccaaaaattccatg

SEQ ID NO: 383335 - DNA, 15 bp, Homo sapiens
ccaaaaattccatgt

SEQ ID NO: 383336 - DNA, 15 bp, Homo sapiens
caaaaattccatgta

SEQ ID NO: 383337 - DNA, 15 bp, Homo sapiens
aaaaattccatgtat

SEQ ID NO: 383338 - DNA, 15 bp, Homo sapiens
aaaattccatgtata

SEQ ID NO: 383339 - DNA, 15 bp, Homo sapiens
aaattccatgtataa

SEQ ID NO: 383340 - DNA, 15 bp, Homo sapiens
aattccatgtataag

SEQ ID NO: 383341 - DNA, 15 bp, Homo sapiens
attccatgtataaga

SEQ ID NO: 383342 - DNA, 15 bp, Homo sapiens
ttccatgtataagag

SEQ ID NO: 383343 - DNA, 15 bp, Homo sapiens
tccatgtataagagt

SEQ ID NO: 383344 - DNA, 15 bp, Homo sapiens
ccatgtataagagtt

SEQ ID NO: 383345 - DNA, 15 bp, Homo sapiens
catgtataagagtta

SEQ ID NO: 383346 - DNA, 15 bp, Homo sapiens
atgtataagagttag

SEQ ID NO: 383347 - DNA, 15 bp, Homo sapiens
tgtataagagttagg

SEQ ID NO: 383348 - DNA, 15 bp, Homo sapiens
gtataagagttagga

SEQ ID NO: 383349 - DNA, 15 bp, Homo sapiens
tataagagttaggac

SEQ ID NO: 383350 - DNA, 15 bp, Homo sapiens
ataagagttaggact

SEQ ID NO: 383351 - DNA, 15 bp, Homo sapiens
taagagttaggactt

SEQ ID NO: 383352 - DNA, 15 bp, Homo sapiens
aagagttaggacttt

SEQ ID NO: 383353 - DNA, 15 bp, Homo sapiens
agagttaggactttg

SEQ ID NO: 383354 - DNA, 15 bp, Homo sapiens
gagttaggactttgt

SEQ ID NO: 383355 - DNA, 15 bp, Homo sapiens
agttaggactttgtt

SEQ ID NO: 383356 - DNA, 15 bp, Homo sapiens
gttaggactttgttt

SEQ ID NO: 383357 - DNA, 15 bp, Homo sapiens
ttaggactttgtttt

SEQ ID NO: 383358 - DNA, 15 bp, Homo sapiens
taggactttgttttc

SEQ ID NO: 383359 - DNA, 15 bp, Homo sapiens
aggactttgttttcc

SEQ ID NO: 383360 - DNA, 15 bp, Homo sapiens
ggactttgttttcct

SEQ ID NO: 383361 - DNA, 15 bp, Homo sapiens
gactttgttttcctt

SEQ ID NO: 383362 - DNA, 15 bp, Homo sapiens
actttgttttccttg

SEQ ID NO: 383363 - DNA, 15 bp, Homo sapiens
ctttgttttccttgt

SEQ ID NO: 383364 - DNA, 15 bp, Homo sapiens
tttgttttccttgta

SEQ ID NO: 383365 - DNA, 15 bp, Homo sapiens
ttgttttccttgtaa

SEQ ID NO: 383366 - DNA, 15 bp, Homo sapiens
tgttttccttgtaaa

SEQ ID NO: 383367 - DNA, 15 bp, Homo sapiens
gttttccttgtaaac

SEQ ID NO: 383368 - DNA, 15 bp, Homo sapiens
ttttccttgtaaact

SEQ ID NO: 383369 - DNA, 15 bp, Homo sapiens
tttccttgtaaactt

SEQ ID NO: 383370 - DNA, 15 bp, Homo sapiens
ttccttgtaaactta

SEQ ID NO: 383371 - DNA, 15 bp, Homo sapiens
tccttgtaaacttaa

SEQ ID NO: 383372 - DNA, 15 bp, Homo sapiens
ccttgtaaacttaac

SEQ ID NO: 383373 - DNA, 15 bp, Homo sapiens
cttgtaaacttaaca

SEQ ID NO: 383374 - DNA, 15 bp, Homo sapiens
ttgtaaacttaacaa

SEQ ID NO: 383375 - DNA, 15 bp, Homo sapiens
tgtaaacttaacaaa

SEQ ID NO: 383376 - DNA, 15 bp, Homo sapiens
gtaaacttaacaaaa

SEQ ID NO: 383377 - DNA, 15 bp, Homo sapiens
taaacttaacaaaaa

SEQ ID NO: 383378 - DNA, 15 bp, Homo sapiens
aaacttaacaaaaaa

SEQ ID NO: 383379 - DNA, 15 bp, Homo sapiens
aacttaacaaaaaat

SEQ ID NO: 383380 - DNA, 15 bp, Homo sapiens
acttaacaaaaaatt

SEQ ID NO: 383381 - DNA, 15 bp, Homo sapiens
cttaacaaaaaattt

SEQ ID NO: 383382 - DNA, 15 bp, Homo sapiens
ttaacaaaaaattta

SEQ ID NO: 383383 - DNA, 15 bp, Homo sapiens
taacaaaaaatttat

SEQ ID NO: 383384 - DNA, 15 bp, Homo sapiens
aacaaaaaatttatc

SEQ ID NO: 383385 - DNA, 15 bp, Homo sapiens
acaaaaaatttatcc

SEQ ID NO: 383386 - DNA, 15 bp, Homo sapiens
caaaaaatttatccg

SEQ ID NO: 383387 - DNA, 15 bp, Homo sapiens
aaaaaatttatccgt

SEQ ID NO: 383388 - DNA, 15 bp, Homo sapiens
aaaaatttatccgtt

SEQ ID NO: 383389 - DNA, 15 bp, Homo sapiens
aaaatttatccgtta

SEQ ID NO: 383390 - DNA, 15 bp, Homo sapiens
aaatttatccgttag

SEQ ID NO: 383391 - DNA, 15 bp, Homo sapiens
aatttatccgttagg

SEQ ID NO: 383392 - DNA, 15 bp, Homo sapiens
atttatccgttagga

SEQ ID NO: 383393 - DNA, 15 bp, Homo sapiens
tttatccgttaggaa

SEQ ID NO: 383394 - DNA, 15 bp, Homo sapiens
ttatccgttaggaat

SEQ ID NO: 383395 - DNA, 15 bp, Homo sapiens
tatccgttaggaatg

SEQ ID NO: 383396 - DNA, 15 bp, Homo sapiens
atccgttaggaatgt

SEQ ID NO: 383397 - DNA, 15 bp, Homo sapiens
tccgttaggaatgtg

SEQ ID NO: 383398 - DNA, 15 bp, Homo sapiens
ccgttaggaatgtgt

SEQ ID NO: 383399 - DNA, 15 bp, Homo sapiens
cgttaggaatgtgtg

SEQ ID NO: 383400 - DNA, 15 bp, Homo sapiens
gttaggaatgtgtgg

SEQ ID NO: 383401 - DNA, 15 bp, Homo sapiens
ttaggaatgtgtggc

SEQ ID NO: 383402 - DNA, 15 bp, Homo sapiens
taggaatgtgtggcc

SEQ ID NO: 383403 - DNA, 15 bp, Homo sapiens
aggaatgtgtggcct

SEQ ID NO: 383404 - DNA, 15 bp, Homo sapiens
ggaatgtgtggcctg

SEQ ID NO: 383405 - DNA, 15 bp, Homo sapiens
gaatgtgtggcctgc

SEQ ID NO: 383406 - DNA, 15 bp, Homo sapiens
aatgtgtggcctgct

SEQ ID NO: 383407 - DNA, 15 bp, Homo sapiens
atgtgtggcctgctt

SEQ ID NO: 383408 - DNA, 15 bp, Homo sapiens
tgtgtggcctgcttt

SEQ ID NO: 383409 - DNA, 15 bp, Homo sapiens
gtgtggcctgcttta

SEQ ID NO: 383410 - DNA, 15 bp, Homo sapiens
tgtggcctgctttat

SEQ ID NO: 383411 - DNA, 15 bp, Homo sapiens
gtggcctgctttatt

SEQ ID NO: 383412 - DNA, 15 bp, Homo sapiens
tggcctgctttattt

SEQ ID NO: 383413 - DNA, 15 bp, Homo sapiens
ggcctgctttattta

SEQ ID NO: 383414 - DNA, 15 bp, Homo sapiens
gcctgctttatttag

SEQ ID NO: 383415 - DNA, 15 bp, Homo sapiens
cctgctttatttagc

SEQ ID NO: 383416 - DNA, 15 bp, Homo sapiens
ctgctttatttagca

SEQ ID NO: 383417 - DNA, 15 bp, Homo sapiens
tgctttatttagcac

SEQ ID NO: 383418 - DNA, 15 bp, Homo sapiens
gctttatttagcacc

SEQ ID NO: 383419 - DNA, 15 bp, Homo sapiens
ctttatttagcacct

SEQ ID NO: 383420 - DNA, 15 bp, Homo sapiens
tttatttagcacctc

SEQ ID NO: 383421 - DNA, 15 bp, Homo sapiens
ttatttagcacctcc

SEQ ID NO: 383422 - DNA, 15 bp, Homo sapiens
tatttagcacctcca

SEQ ID NO: 383423 - DNA, 15 bp, Homo sapiens
atttagcacctccaa

SEQ ID NO: 383424 - DNA, 15 bp, Homo sapiens
tttagcacctccaat

SEQ ID NO: 383425 - DNA, 15 bp, Homo sapiens
ttagcacctccaatt

SEQ ID NO: 383426 - DNA, 15 bp, Homo sapiens
tagcacctccaattc

SEQ ID NO: 383427 - DNA, 15 bp, Homo sapiens
agcacctccaattct

SEQ ID NO: 383428 - DNA, 15 bp, Homo sapiens
gcacctccaattctt

SEQ ID NO: 383429 - DNA, 15 bp, Homo sapiens
cacctccaattcttc

SEQ ID NO: 383430 - DNA, 15 bp, Homo sapiens
acctccaattcttct

SEQ ID NO: 383431 - DNA, 15 bp, Homo sapiens
cctccaattcttctt

SEQ ID NO: 383432 - DNA, 15 bp, Homo sapiens
ctccaattcttcttc

SEQ ID NO: 383433 - DNA, 15 bp, Homo sapiens
tccaattcttcttct

SEQ ID NO: 383434 - DNA, 15 bp, Homo sapiens
ccaattcttcttctt

SEQ ID NO: 383435 - DNA, 15 bp, Homo sapiens
caattcttcttctta

SEQ ID NO: 383436 - DNA, 15 bp, Homo sapiens
aattcttcttcttat

SEQ ID NO: 383437 - DNA, 15 bp, Homo sapiens
attcttcttcttatt

SEQ ID NO: 383438 - DNA, 15 bp, Homo sapiens
ttcttcttcttattt

SEQ ID NO: 383439 - DNA, 15 bp, Homo sapiens
tcttcttcttatttt

SEQ ID NO: 383440 - DNA, 15 bp, Homo sapiens
cttcttcttattttt

SEQ ID NO: 383441 - DNA, 15 bp, Homo sapiens
ttcttcttatttttt

SEQ ID NO: 383442 - DNA, 15 bp, Homo sapiens
tcttcttattttttt

SEQ ID NO: 383443 - DNA, 15 bp, Homo sapiens
cttcttatttttttt

SEQ ID NO: 383444 - DNA, 15 bp, Homo sapiens
ttcttattttttttt

SEQ ID NO: 383445 - DNA, 15 bp, Homo sapiens
tcttatttttttttt

SEQ ID NO: 383446 - DNA, 15 bp, Homo sapiens
cttattttttttttt

SEQ ID NO: 383447 - DNA, 15 bp, Homo sapiens
ttatttttttttttt

SEQ ID NO: 383448 - DNA, 15 bp, Homo sapiens
tattttttttttttg

SEQ ID NO: 383449 - DNA, 15 bp, Homo sapiens
attttttttttttgc

SEQ ID NO: 383450 - DNA, 15 bp, Homo sapiens
tttttttttgctttt

SEQ ID NO: 383451 - DNA, 15 bp, Homo sapiens
ttttttttgctttta

SEQ ID NO: 383452 - DNA, 15 bp, Homo sapiens
tttttttgcttttac

SEQ ID NO: 383453 - DNA, 15 bp, Homo sapiens
ttttttgcttttact

SEQ ID NO: 383454 - DNA, 15 bp, Homo sapiens
tttttgcttttactt

SEQ ID NO: 383455 - DNA, 15 bp, Homo sapiens
ttttgcttttacttt

SEQ ID NO: 383456 - DNA, 15 bp, Homo sapiens
tttgcttttactttg

SEQ ID NO: 383457 - DNA, 15 bp, Homo sapiens
ttgcttttactttgt

SEQ ID NO: 383458 - DNA, 15 bp, Homo sapiens
tgcttttactttgta

SEQ ID NO: 383459 - DNA, 15 bp, Homo sapiens
gcttttactttgtaa

SEQ ID NO: 383460 - DNA, 15 bp, Homo sapiens
cttttactttgtaaa

SEQ ID NO: 383461 - DNA, 15 bp, Homo sapiens
ttttactttgtaaat

SEQ ID NO: 383462 - DNA, 15 bp, Homo sapiens
tttactttgtaaata

SEQ ID NO: 383463 - DNA, 15 bp, Homo sapiens
ttactttgtaaatat

SEQ ID NO: 383464 - DNA, 15 bp, Homo sapiens
tactttgtaaatatt

SEQ ID NO: 383465 - DNA, 15 bp, Homo sapiens
actttgtaaatattt

SEQ ID NO: 383466 - DNA, 15 bp, Homo sapiens
ctttgtaaatatttt

SEQ ID NO: 383467 - DNA, 15 bp, Homo sapiens
tttgtaaatatttta

SEQ ID NO: 383468 - DNA, 15 bp, Homo sapiens
ttgtaaatattttaa

SEQ ID NO: 383469 - DNA, 15 bp, Homo sapiens
tgtaaatattttaag

SEQ ID NO: 383470 - DNA, 15 bp, Homo sapiens
gtaaatattttaaga

SEQ ID NO: 383471 - DNA, 15 bp, Homo sapiens
taaatattttaagac

SEQ ID NO: 383472 - DNA, 15 bp, Homo sapiens
aaatattttaagaca

SEQ ID NO: 383473 - DNA, 15 bp, Homo sapiens
aatattttaagacag

SEQ ID NO: 383474 - DNA, 15 bp, Homo sapiens
atattttaagacagc

SEQ ID NO: 383475 - DNA, 15 bp, Homo sapiens
tattttaagacagcc

SEQ ID NO: 383476 - DNA, 15 bp, Homo sapiens
attttaagacagcct

SEQ ID NO: 383477 - DNA, 15 bp, Homo sapiens
ttttaagacagccta

SEQ ID NO: 383478 - DNA, 15 bp, Homo sapiens
tttaagacagcctac

SEQ ID NO: 383479 - DNA, 15 bp, Homo sapiens
ttaagacagcctaca

SEQ ID NO: 383480 - DNA, 15 bp, Homo sapiens
taagacagcctacag

SEQ ID NO: 383481 - DNA, 15 bp, Homo sapiens
aagacagcctacagc

SEQ ID NO: 383482 - DNA, 15 bp, Homo sapiens
agacagcctacagca

SEQ ID NO: 383483 - DNA, 15 bp, Homo sapiens
gacagcctacagcag

SEQ ID NO: 383484 - DNA, 15 bp, Homo sapiens
acagcctacagcagt

SEQ ID NO: 383485 - DNA, 15 bp, Homo sapiens
cagcctacagcagta

SEQ ID NO: 383486 - DNA, 15 bp, Homo sapiens
agcctacagcagtag

SEQ ID NO: 383487 - DNA, 15 bp, Homo sapiens
gcctacagcagtagt

SEQ ID NO: 383488 - DNA, 15 bp, Homo sapiens
cctacagcagtagtt

SEQ ID NO: 383489 - DNA, 15 bp, Homo sapiens
ctacagcagtagttg

SEQ ID NO: 383490 - DNA, 15 bp, Homo sapiens
tacagcagtagttgg

SEQ ID NO: 383491 - DNA, 15 bp, Homo sapiens
acagcagtagttgga

SEQ ID NO: 383492 - DNA, 15 bp, Homo sapiens
cagcagtagttggat

SEQ ID NO: 383493 - DNA, 15 bp, Homo sapiens
agcagtagttggatt

SEQ ID NO: 383494 - DNA, 15 bp, Homo sapiens
gcagtagttggatta

SEQ ID NO: 383495 - DNA, 15 bp, Homo sapiens
cagtagttggattag

SEQ ID NO: 383496 - DNA, 15 bp, Homo sapiens
agtagttggattaga

SEQ ID NO: 383497 - DNA, 15 bp, Homo sapiens
gtagttggattagat

SEQ ID NO: 383498 - DNA, 15 bp, Homo sapiens
tagttggattagatg

SEQ ID NO: 383499 - DNA, 15 bp, Homo sapiens
agttggattagatgg

SEQ ID NO: 383500 - DNA, 15 bp, Homo sapiens
gttggattagatgga

SEQ ID NO: 383501 - DNA, 15 bp, Homo sapiens
ttggattagatggaa

SEQ ID NO: 383502 - DNA, 15 bp, Homo sapiens
tggattagatggaag

SEQ ID NO: 383503 - DNA, 15 bp, Homo sapiens
ggattagatggaaga

SEQ ID NO: 383504 - DNA, 15 bp, Homo sapiens
gattagatggaagag

SEQ ID NO: 383505 - DNA, 15 bp, Homo sapiens
attagatggaagagg

SEQ ID NO: 383506 - DNA, 15 bp, Homo sapiens
ttagatggaagaggc

SEQ ID NO: 383507 - DNA, 15 bp, Homo sapiens
tagatggaagaggca

SEQ ID NO: 383508 - DNA, 15 bp, Homo sapiens
agatggaagaggcaa

SEQ ID NO: 383509 - DNA, 15 bp, Homo sapiens
gatggaagaggcaat

SEQ ID NO: 383510 - DNA, 15 bp, Homo sapiens
atggaagaggcaatt

SEQ ID NO: 383511 - DNA, 15 bp, Homo sapiens
tggaagaggcaatta

SEQ ID NO: 383512 - DNA, 15 bp, Homo sapiens
ggaagaggcaattaa

SEQ ID NO: 383513 - DNA, 15 bp, Homo sapiens
gaagaggcaattaaa

SEQ ID NO: 383514 - DNA, 15 bp, Homo sapiens
aagaggcaattaaaa

SEQ ID NO: 383515 - DNA, 15 bp, Homo sapiens
agaggcaattaaaaa

SEQ ID NO: 383516 - DNA, 15 bp, Homo sapiens
gaggcaattaaaaat

SEQ ID NO: 383517 - DNA, 15 bp, Homo sapiens
aggcaattaaaaatg

SEQ ID NO: 383518 - DNA, 15 bp, Homo sapiens
ggcaattaaaaatga

SEQ ID NO: 383519 - DNA, 15 bp, Homo sapiens
gcaattaaaaatgaa

SEQ ID NO: 383520 - DNA, 15 bp, Homo sapiens
caattaaaaatgaat

SEQ ID NO: 383521 - DNA, 15 bp, Homo sapiens
aattaaaaatgaatt

SEQ ID NO: 383522 - DNA, 15 bp, Homo sapiens
attaaaaatgaatta

SEQ ID NO: 383523 - DNA, 15 bp, Homo sapiens
taaaaatgaattata

SEQ ID NO: 383524 - DNA, 15 bp, Homo sapiens
aaaaatgaattatat

SEQ ID NO: 383525 - DNA, 15 bp, Homo sapiens
aaaatgaattatatt

SEQ ID NO: 383526 - DNA, 15 bp, Homo sapiens
aaatgaattatattg

SEQ ID NO: 383527 - DNA, 15 bp, Homo sapiens
aatgaattatattgc

SEQ ID NO: 383528 - DNA, 15 bp, Homo sapiens
gaattatattgcaag

SEQ ID NO: 383529 - DNA, 15 bp, Homo sapiens
aattatattgcaagg

SEQ ID NO: 383530 - DNA, 15 bp, Homo sapiens
attatattgcaaggt

SEQ ID NO: 383531 - DNA, 15 bp, Homo sapiens
ttatattgcaaggtg

SEQ ID NO: 383532 - DNA, 15 bp, Homo sapiens
tatattgcaaggtga

SEQ ID NO: 383533 - DNA, 15 bp, Homo sapiens
atattgcaaggtgat

SEQ ID NO: 383534 - DNA, 15 bp, Homo sapiens
tattgcaaggtgatt

SEQ ID NO: 383535 - DNA, 15 bp, Homo sapiens
attgcaaggtgattt

SEQ ID NO: 383536 - DNA, 15 bp, Homo sapiens
ttgcaaggtgatttt

SEQ ID NO: 383537 - DNA, 15 bp, Homo sapiens
tgcaaggtgattttt

SEQ ID NO: 383538 - DNA, 15 bp, Homo sapiens
gcaaggtgatttttc

SEQ ID NO: 383539 - DNA, 15 bp, Homo sapiens
caaggtgatttttcg

SEQ ID NO: 383540 - DNA, 15 bp, Homo sapiens
aaggtgatttttcgt

SEQ ID NO: 383541 - DNA, 15 bp, Homo sapiens
aggtgatttttcgtt

SEQ ID NO: 383542 - DNA, 15 bp, Homo sapiens
ggtgatttttcgttt

SEQ ID NO: 383543 - DNA, 15 bp, Homo sapiens
gtgatttttcgttta

SEQ ID NO: 383544 - DNA, 15 bp, Homo sapiens
tgatttttcgtttat

SEQ ID NO: 383545 - DNA, 15 bp, Homo sapiens
gatttttcgtttatc

SEQ ID NO: 383546 - DNA, 15 bp, Homo sapiens
atttttcgtttatca

SEQ ID NO: 383547 - DNA, 15 bp, Homo sapiens
tttttcgtttatcat

SEQ ID NO: 383548 - DNA, 15 bp, Homo sapiens
ttttcgtttatcata

SEQ ID NO: 383549 - DNA, 15 bp, Homo sapiens
tttcgtttatcatag

SEQ ID NO: 383550 - DNA, 15 bp, Homo sapiens
ttcgtttatcatagc

SEQ ID NO: 383551 - DNA, 15 bp, Homo sapiens
tcgtttatcatagct

SEQ ID NO: 383552 - DNA, 15 bp, Homo sapiens
cgtttatcatagcta

SEQ ID NO: 383553 - DNA, 15 bp, Homo sapiens
gtttatcatagctaa

SEQ ID NO: 383554 - DNA, 15 bp, Homo sapiens
tttatcatagctaag

SEQ ID NO: 383555 - DNA, 15 bp, Homo sapiens
ttatcatagctaaga

SEQ ID NO: 383556 - DNA, 15 bp, Homo sapiens
tatcatagctaagac

SEQ ID NO: 383557 - DNA, 15 bp, Homo sapiens
atcatagctaagaca

SEQ ID NO: 383558 - DNA, 15 bp, Homo sapiens
tcatagctaagacaa

SEQ ID NO: 383559 - DNA, 15 bp, Homo sapiens
catagctaagacaat

SEQ ID NO: 383560 - DNA, 15 bp, Homo sapiens
atagctaagacaatt

SEQ ID NO: 383561 - DNA, 15 bp, Homo sapiens
tagctaagacaatta

SEQ ID NO: 383562 - DNA, 15 bp, Homo sapiens
agctaagacaattac

SEQ ID NO: 383563 - DNA, 15 bp, Homo sapiens
gctaagacaattaca

SEQ ID NO: 383564 - DNA, 15 bp, Homo sapiens
ctaagacaattacaa

SEQ ID NO: 383565 - DNA, 15 bp, Homo sapiens
taagacaattacaat

SEQ ID NO: 383566 - DNA, 15 bp, Homo sapiens
aagacaattacaatg

SEQ ID NO: 383567 - DNA, 15 bp, Homo sapiens
agacaattacaatgt

SEQ ID NO: 383568 - DNA, 15 bp, Homo sapiens
gacaattacaatgtt

SEQ ID NO: 383569 - DNA, 15 bp, Homo sapiens
acaattacaatgttc

SEQ ID NO: 383570 - DNA, 15 bp, Homo sapiens
caattacaatgttcc

SEQ ID NO: 383571 - DNA, 15 bp, Homo sapiens
aattacaatgttcca

SEQ ID NO: 383572 - DNA, 15 bp, Homo sapiens
attacaatgttccag

SEQ ID NO: 383573 - DNA, 15 bp, Homo sapiens
ttacaatgttccagt

SEQ ID NO: 383574 - DNA, 15 bp, Homo sapiens
tacaatgttccagtt

SEQ ID NO: 383575 - DNA, 15 bp, Homo sapiens
acaatgttccagttt

SEQ ID NO: 383576 - DNA, 15 bp, Homo sapiens
caatgttccagtttc

SEQ ID NO: 383577 - DNA, 15 bp, Homo sapiens
aatgttccagtttct

SEQ ID NO: 383578 - DNA, 15 bp, Homo sapiens
atgttccagtttctt

SEQ ID NO: 383579 - DNA, 15 bp, Homo sapiens
tgttccagtttcttt

SEQ ID NO: 383580 - DNA, 15 bp, Homo sapiens
gttccagtttctttg

SEQ ID NO: 383581 - DNA, 15 bp, Homo sapiens
ttccagtttctttgt

SEQ ID NO: 383582 - DNA, 15 bp, Homo sapiens
tccagtttctttgta

SEQ ID NO: 383583 - DNA, 15 bp, Homo sapiens
ccagtttctttgtag

SEQ ID NO: 383584 - DNA, 15 bp, Homo sapiens
cagtttctttgtagt

SEQ ID NO: 383585 - DNA, 15 bp, Homo sapiens
agtttctttgtagtt

SEQ ID NO: 383586 - DNA, 15 bp, Homo sapiens
gtttctttgtagtta

SEQ ID NO: 383587 - DNA, 15 bp, Homo sapiens
tttctttgtagttac

SEQ ID NO: 383588 - DNA, 15 bp, Homo sapiens
ttctttgtagttaca

SEQ ID NO: 383589 - DNA, 15 bp, Homo sapiens
tctttgtagttacaa

SEQ ID NO: 383590 - DNA, 15 bp, Homo sapiens
ctttgtagttacaag

SEQ ID NO: 383591 - DNA, 15 bp, Homo sapiens
tttgtagttacaagt

SEQ ID NO: 383592 - DNA, 15 bp, Homo sapiens
ttgtagttacaagtg

SEQ ID NO: 383593 - DNA, 15 bp, Homo sapiens
tgtagttacaagtgg

SEQ ID NO: 383594 - DNA, 15 bp, Homo sapiens
gtagttacaagtggt

SEQ ID NO: 383595 - DNA, 15 bp, Homo sapiens
tagttacaagtggtt

SEQ ID NO: 383596 - DNA, 15 bp, Homo sapiens
agttacaagtggttg

SEQ ID NO: 383597 - DNA, 15 bp, Homo sapiens
gttacaagtggttgt

SEQ ID NO: 383598 - DNA, 15 bp, Homo sapiens
ttacaagtggttgtc

SEQ ID NO: 383599 - DNA, 15 bp, Homo sapiens
tacaagtggttgtcc

SEQ ID NO: 383600 - DNA, 15 bp, Homo sapiens
acaagtggttgtcct

SEQ ID NO: 383601 - DNA, 15 bp, Homo sapiens
caagtggttgtcctt

SEQ ID NO: 383602 - DNA, 15 bp, Homo sapiens
aagtggttgtcctta

SEQ ID NO: 383603 - DNA, 15 bp, Homo sapiens
agtggttgtccttat

SEQ ID NO: 383604 - DNA, 15 bp, Homo sapiens
gtggttgtccttatt

SEQ ID NO: 383605 - DNA, 15 bp, Homo sapiens
tggttgtccttattg

SEQ ID NO: 383606 - DNA, 15 bp, Homo sapiens
ggttgtccttattgt

SEQ ID NO: 383607 - DNA, 15 bp, Homo sapiens
gttgtccttattgtg

SEQ ID NO: 383608 - DNA, 15 bp, Homo sapiens
ttgtccttattgtgt

SEQ ID NO: 383609 - DNA, 15 bp, Homo sapiens
tgtccttattgtgtt

SEQ ID NO: 383610 - DNA, 15 bp, Homo sapiens
gtccttattgtgttt

SEQ ID NO: 383611 - DNA, 15 bp, Homo sapiens
tccttattgtgtttt

SEQ ID NO: 383612 - DNA, 15 bp, Homo sapiens
ccttattgtgttttc

SEQ ID NO: 383613 - DNA, 15 bp, Homo sapiens
cttattgtgttttct

SEQ ID NO: 383614 - DNA, 15 bp, Homo sapiens
ttattgtgttttctc

SEQ ID NO: 383615 - DNA, 15 bp, Homo sapiens
tattgtgttttctct

SEQ ID NO: 383616 - DNA, 15 bp, Homo sapiens
attgtgttttctctc

SEQ ID NO: 383617 - DNA, 15 bp, Homo sapiens
ttgtgttttctctct

SEQ ID NO: 383618 - DNA, 15 bp, Homo sapiens
tgtgttttctctctg

SEQ ID NO: 383619 - DNA, 15 bp, Homo sapiens
gtgttttctctctgc

SEQ ID NO: 383620 - DNA, 15 bp, Homo sapiens
tgttttctctctgca

SEQ ID NO: 383621 - DNA, 15 bp, Homo sapiens
gttttctctctgcat

SEQ ID NO: 383622 - DNA, 15 bp, Homo sapiens
ttttctctctgcatt

SEQ ID NO: 383623 - DNA, 15 bp, Homo sapiens
tttctctctgcattt

SEQ ID NO: 383624 - DNA, 15 bp, Homo sapiens
ttctctctgcatttt

SEQ ID NO: 383625 - DNA, 15 bp, Homo sapiens
tctctctgcattttc

SEQ ID NO: 383626 - DNA, 15 bp, Homo sapiens
ctctctgcattttcc

SEQ ID NO: 383627 - DNA, 15 bp, Homo sapiens
tctctgcattttccg

SEQ ID NO: 383628 - DNA, 15 bp, Homo sapiens
ctctgcattttccgg

SEQ ID NO: 383629 - DNA, 15 bp, Homo sapiens
tctgcattttccggg

SEQ ID NO: 383630 - DNA, 15 bp, Homo sapiens
ctgcattttccgggg

SEQ ID NO: 383631 - DNA, 15 bp, Homo sapiens
tgcattttccggggg

SEQ ID NO: 383632 - DNA, 15 bp, Homo sapiens
gcattttccgggggg

SEQ ID NO: 383633 - DNA, 15 bp, Homo sapiens
cattttccggggggt

SEQ ID NO: 383634 - DNA, 15 bp, Homo sapiens
attttccggggggtg

SEQ ID NO: 383635 - DNA, 15 bp, Homo sapiens
ttttccggggggtgg

SEQ ID NO: 383636 - DNA, 15 bp, Homo sapiens
tttccggggggtgga

SEQ ID NO: 383637 - DNA, 15 bp, Homo sapiens
ttccggggggtggaa

SEQ ID NO: 383638 - DNA, 15 bp, Homo sapiens
tccggggggtggaaa

SEQ ID NO: 383639 - DNA, 15 bp, Homo sapiens
ccggggggtggaaat

SEQ ID NO: 383640 - DNA, 15 bp, Homo sapiens
cggggggtggaaata

SEQ ID NO: 383641 - DNA, 15 bp, Homo sapiens
ggggggtggaaataa

SEQ ID NO: 383642 - DNA, 15 bp, Homo sapiens
gggggtggaaataag

SEQ ID NO: 383643 - DNA, 15 bp, Homo sapiens
ggggtggaaataagt

SEQ ID NO: 383644 - DNA, 15 bp, Homo sapiens
gggtggaaataagta

SEQ ID NO: 383645 - DNA, 15 bp, Homo sapiens
ggtggaaataagtaa

SEQ ID NO: 383646 - DNA, 15 bp, Homo sapiens
gtggaaataagtaat

SEQ ID NO: 383647 - DNA, 15 bp, Homo sapiens
tggaaataagtaatt

SEQ ID NO: 383648 - DNA, 15 bp, Homo sapiens
ggaaataagtaatta

SEQ ID NO: 383649 - DNA, 15 bp, Homo sapiens
gaaataagtaattat

SEQ ID NO: 383650 - DNA, 15 bp, Homo sapiens
aaataagtaattata

SEQ ID NO: 383651 - DNA, 15 bp, Homo sapiens
aataagtaattatat

SEQ ID NO: 383652 - DNA, 15 bp, Homo sapiens
ataagtaattatatt

SEQ ID NO: 383653 - DNA, 15 bp, Homo sapiens
taagtaattatatta

SEQ ID NO: 383654 - DNA, 15 bp, Homo sapiens
aagtaattatattaa

SEQ ID NO: 383655 - DNA, 15 bp, Homo sapiens
agtaattatattaat

SEQ ID NO: 383656 - DNA, 15 bp, Homo sapiens
gtaattatattaata

SEQ ID NO: 383657 - DNA, 15 bp, Homo sapiens
taattatattaatat

SEQ ID NO: 383658 - DNA, 15 bp, Homo sapiens
aattatattaatatt

SEQ ID NO: 383659 - DNA, 15 bp, Homo sapiens
attatattaatattt

SEQ ID NO: 383660 - DNA, 15 bp, Homo sapiens
ttatattaatattta

SEQ ID NO: 383661 - DNA, 15 bp, Homo sapiens
tatattaatatttag

SEQ ID NO: 383662 - DNA, 15 bp, Homo sapiens
atattaatatttaga

SEQ ID NO: 383663 - DNA, 15 bp, Homo sapiens
tattaatatttagac

SEQ ID NO: 383664 - DNA, 15 bp, Homo sapiens
attaatatttagaca

SEQ ID NO: 383665 - DNA, 15 bp, Homo sapiens
ttaatatttagacat

SEQ ID NO: 383666 - DNA, 15 bp, Homo sapiens
taatatttagacatg

SEQ ID NO: 383667 - DNA, 15 bp, Homo sapiens
aatatttagacatga

SEQ ID NO: 383668 - DNA, 15 bp, Homo sapiens
atatttagacatgat

SEQ ID NO: 383669 - DNA, 15 bp, Homo sapiens
tatttagacatgatt

SEQ ID NO: 383670 - DNA, 15 bp, Homo sapiens
atttagacatgattt

SEQ ID NO: 383671 - DNA, 15 bp, Homo sapiens
tttagacatgattta

SEQ ID NO: 383672 - DNA, 15 bp, Homo sapiens
ttagacatgatttag

SEQ ID NO: 383673 - DNA, 15 bp, Homo sapiens
tagacatgatttaga

SEQ ID NO: 383674 - DNA, 15 bp, Homo sapiens
agacatgatttagat

SEQ ID NO: 383675 - DNA, 15 bp, Homo sapiens
gacatgatttagata

SEQ ID NO: 383676 - DNA, 15 bp, Homo sapiens
acatgatttagatat

SEQ ID NO: 383677 - DNA, 15 bp, Homo sapiens
catgatttagatata

SEQ ID NO: 383678 - DNA, 15 bp, Homo sapiens
atgatttagatatat

SEQ ID NO: 383679 - DNA, 15 bp, Homo sapiens
tgatttagatatatt

SEQ ID NO: 383680 - DNA, 15 bp, Homo sapiens
gatttagatatattg

SEQ ID NO: 383681 - DNA, 15 bp, Homo sapiens
atttagatatattgt

SEQ ID NO: 383682 - DNA, 15 bp, Homo sapiens
tttagatatattgtt

SEQ ID NO: 383683 - DNA, 15 bp, Homo sapiens
ttagatatattgtta

SEQ ID NO: 383684 - DNA, 15 bp, Homo sapiens
tagatatattgttat

SEQ ID NO: 383685 - DNA, 15 bp, Homo sapiens
agatatattgttatc

SEQ ID NO: 383686 - DNA, 15 bp, Homo sapiens
gatatattgttatct

SEQ ID NO: 383687 - DNA, 15 bp, Homo sapiens
atatattgttatcta

SEQ ID NO: 383688 - DNA, 15 bp, Homo sapiens
tatattgttatctat

SEQ ID NO: 383689 - DNA, 15 bp, Homo sapiens
atattgttatctata

SEQ ID NO: 383690 - DNA, 15 bp, Homo sapiens
tattgttatctataa

SEQ ID NO: 383691 - DNA, 15 bp, Homo sapiens
attgttatctataaa

SEQ ID NO: 383692 - DNA, 15 bp, Homo sapiens
ttgttatctataaaa

SEQ ID NO: 383693 - DNA, 15 bp, Homo sapiens
tgttatctataaaac

SEQ ID NO: 383694 - DNA, 15 bp, Homo sapiens
gttatctataaaaca

SEQ ID NO: 383695 - DNA, 15 bp, Homo sapiens
ttatctataaaacag

SEQ ID NO: 383696 - DNA, 15 bp, Homo sapiens
tatctataaaacagg

SEQ ID NO: 383697 - DNA, 15 bp, Homo sapiens
atctataaaacaggg

SEQ ID NO: 383698 - DNA, 15 bp, Homo sapiens
tctataaaacaggga

SEQ ID NO: 383699 - DNA, 15 bp, Homo sapiens
ctataaaacagggaa

SEQ ID NO: 383700 - DNA, 15 bp, Homo sapiens
tataaaacagggaaa

SEQ ID NO: 383701 - DNA, 15 bp, Homo sapiens
ataaaacagggaaaa

SEQ ID NO: 383702 - DNA, 15 bp, Homo sapiens
taaaacagggaaaac

SEQ ID NO: 383703 - DNA, 15 bp, Homo sapiens
aaaacagggaaaaca

SEQ ID NO: 383704 - DNA, 15 bp, Homo sapiens
aaacagggaaaacag

SEQ ID NO: 383705 - DNA, 15 bp, Homo sapiens
aacagggaaaacaga

SEQ ID NO: 383706 - DNA, 15 bp, Homo sapiens
acagggaaaacagag

SEQ ID NO: 383707 - DNA, 15 bp, Homo sapiens
cagggaaaacagagc

SEQ ID NO: 383708 - DNA, 15 bp, Homo sapiens
agggaaaacagagca

SEQ ID NO: 383709 - DNA, 15 bp, Homo sapiens
gggaaaacagagcaa

SEQ ID NO: 383710 - DNA, 15 bp, Homo sapiens
ggaaaacagagcaaa

SEQ ID NO: 383711 - DNA, 15 bp, Homo sapiens
gaaaacagagcaaaa

SEQ ID NO: 383712 - DNA, 15 bp, Homo sapiens
aaaacagagcaaaac

SEQ ID NO: 383713 - DNA, 15 bp, Homo sapiens
aaacagagcaaaact

SEQ ID NO: 383714 - DNA, 15 bp, Homo sapiens
aacagagcaaaactg

SEQ ID NO: 383715 - DNA, 15 bp, Homo sapiens
acagagcaaaactgg

SEQ ID NO: 383716 - DNA, 15 bp, Homo sapiens
cagagcaaaactggc

SEQ ID NO: 383717 - DNA, 15 bp, Homo sapiens
agagcaaaactggct

SEQ ID NO: 383718 - DNA, 15 bp, Homo sapiens
gagcaaaactggctc

SEQ ID NO: 383719 - DNA, 15 bp, Homo sapiens
agcaaaactggctca

SEQ ID NO: 383720 - DNA, 15 bp, Homo sapiens
gcaaaactggctcat

SEQ ID NO: 383721 - DNA, 15 bp, Homo sapiens
caaaactggctcata

SEQ ID NO: 383722 - DNA, 15 bp, Homo sapiens
aaaactggctcatag

SEQ ID NO: 383723 - DNA, 15 bp, Homo sapiens
aaactggctcatagg

SEQ ID NO: 383724 - DNA, 15 bp, Homo sapiens
aactggctcatagga

SEQ ID NO: 383725 - DNA, 15 bp, Homo sapiens
actggctcataggat

SEQ ID NO: 383726 - DNA, 15 bp, Homo sapiens
ctggctcataggatc

SEQ ID NO: 383727 - DNA, 15 bp, Homo sapiens
tggctcataggatcc

SEQ ID NO: 383728 - DNA, 15 bp, Homo sapiens
ggctcataggatccc

SEQ ID NO: 383729 - DNA, 15 bp, Homo sapiens
gctcataggatccct

SEQ ID NO: 383730 - DNA, 15 bp, Homo sapiens
ctcataggatccctt

SEQ ID NO: 383731 - DNA, 15 bp, Homo sapiens
tcataggatcccttc

SEQ ID NO: 383732 - DNA, 15 bp, Homo sapiens
cataggatcccttcg

SEQ ID NO: 383733 - DNA, 15 bp, Homo sapiens
ataggatcccttcgt

SEQ ID NO: 383734 - DNA, 15 bp, Homo sapiens
taggatcccttcgtg

SEQ ID NO: 383735 - DNA, 15 bp, Homo sapiens
aggatcccttcgtga

SEQ ID NO: 383736 - DNA, 15 bp, Homo sapiens
ggatcccttcgtgaa

SEQ ID NO: 383737 - DNA, 15 bp, Homo sapiens
gatcccttcgtgaat

SEQ ID NO: 383738 - DNA, 15 bp, Homo sapiens
atcccttcgtgaatg

SEQ ID NO: 383739 - DNA, 15 bp, Homo sapiens
tcccttcgtgaatga

SEQ ID NO: 383740 - DNA, 15 bp, Homo sapiens
cccttcgtgaatgat

SEQ ID NO: 383741 - DNA, 15 bp, Homo sapiens
ccttcgtgaatgata

SEQ ID NO: 383742 - DNA, 15 bp, Homo sapiens
cttcgtgaatgataa

SEQ ID NO: 383743 - DNA, 15 bp, Homo sapiens
ttcgtgaatgataac

SEQ ID NO: 383744 - DNA, 15 bp, Homo sapiens
tcgtgaatgataact

SEQ ID NO: 383745 - DNA, 15 bp, Homo sapiens
cgtgaatgataacta

SEQ ID NO: 383746 - DNA, 15 bp, Homo sapiens
gtgaatgataactag

SEQ ID NO: 383747 - DNA, 15 bp, Homo sapiens
tgaatgataactagg

SEQ ID NO: 383748 - DNA, 15 bp, Homo sapiens
gaatgataactaggg

SEQ ID NO: 383749 - DNA, 15 bp, Homo sapiens
aatgataactagggc

SEQ ID NO: 383750 - DNA, 15 bp, Homo sapiens
atgataactagggct

SEQ ID NO: 383751 - DNA, 15 bp, Homo sapiens
tgataactagggctt

SEQ ID NO: 383752 - DNA, 15 bp, Homo sapiens
gataactagggcttc

SEQ ID NO: 383753 - DNA, 15 bp, Homo sapiens
ataactagggcttct

SEQ ID NO: 383754 - DNA, 15 bp, Homo sapiens
taactagggcttcta

SEQ ID NO: 383755 - DNA, 15 bp, Homo sapiens
aactagggcttctat

SEQ ID NO: 383756 - DNA, 15 bp, Homo sapiens
actagggcttctata

SEQ ID NO: 383757 - DNA, 15 bp, Homo sapiens
ctagggcttctatat

SEQ ID NO: 383758 - DNA, 15 bp, Homo sapiens
tagggcttctatatg

SEQ ID NO: 383759 - DNA, 15 bp, Homo sapiens
agggcttctatatgt

SEQ ID NO: 383760 - DNA, 15 bp, Homo sapiens
gggcttctatatgta

SEQ ID NO: 383761 - DNA, 15 bp, Homo sapiens
ggcttctatatgtaa

SEQ ID NO: 383762 - DNA, 15 bp, Homo sapiens
gcttctatatgtaaa

SEQ ID NO: 383763 - DNA, 15 bp, Homo sapiens
cttctatatgtaaag

SEQ ID NO: 383764 - DNA, 15 bp, Homo sapiens
ttctatatgtaaaga

SEQ ID NO: 383765 - DNA, 15 bp, Homo sapiens
tctatatgtaaagag

SEQ ID NO: 383766 - DNA, 15 bp, Homo sapiens
ctatatgtaaagaga

SEQ ID NO: 383767 - DNA, 15 bp, Homo sapiens
tatatgtaaagagag

SEQ ID NO: 383768 - DNA, 15 bp, Homo sapiens
atatgtaaagagagt

SEQ ID NO: 383769 - DNA, 15 bp, Homo sapiens
tatgtaaagagagtt

SEQ ID NO: 383770 - DNA, 15 bp, Homo sapiens
atgtaaagagagttt

SEQ ID NO: 383771 - DNA, 15 bp, Homo sapiens
tgtaaagagagtttt

SEQ ID NO: 383772 - DNA, 15 bp, Homo sapiens
gtaaagagagttttc

SEQ ID NO: 383773 - DNA, 15 bp, Homo sapiens
taaagagagttttct

SEQ ID NO: 383774 - DNA, 15 bp, Homo sapiens
aaagagagttttctc

SEQ ID NO: 383775 - DNA, 15 bp, Homo sapiens
aagagagttttctct

SEQ ID NO: 383776 - DNA, 15 bp, Homo sapiens
agagagttttctctt

SEQ ID NO: 383777 - DNA, 15 bp, Homo sapiens
gagagttttctcttt

SEQ ID NO: 383778 - DNA, 15 bp, Homo sapiens
agagttttctctttt

SEQ ID NO: 383779 - DNA, 15 bp, Homo sapiens
gagttttctctttta

SEQ ID NO: 383780 - DNA, 15 bp, Homo sapiens
agttttctcttttaa

SEQ ID NO: 383781 - DNA, 15 bp, Homo sapiens
gttttctcttttaaa

SEQ ID NO: 383782 - DNA, 15 bp, Homo sapiens
ttttctcttttaaac

SEQ ID NO: 383783 - DNA, 15 bp, Homo sapiens
tttctcttttaaacc

SEQ ID NO: 383784 - DNA, 15 bp, Homo sapiens
ttctcttttaaaccc

SEQ ID NO: 383785 - DNA, 15 bp, Homo sapiens
tctcttttaaaccca

SEQ ID NO: 383786 - DNA, 15 bp, Homo sapiens
ctcttttaaacccag

SEQ ID NO: 383787 - DNA, 15 bp, Homo sapiens
tcttttaaacccagt

SEQ ID NO: 383788 - DNA, 15 bp, Homo sapiens
cttttaaacccagtg

SEQ ID NO: 383789 - DNA, 15 bp, Homo sapiens
ttttaaacccagtga

SEQ ID NO: 383790 - DNA, 15 bp, Homo sapiens
tttaaacccagtgaa

SEQ ID NO: 383791 - DNA, 15 bp, Homo sapiens
ttaaacccagtgaac

SEQ ID NO: 383792 - DNA, 15 bp, Homo sapiens
taaacccagtgaact

SEQ ID NO: 383793 - DNA, 15 bp, Homo sapiens
aaacccagtgaactt

SEQ ID NO: 383794 - DNA, 15 bp, Homo sapiens
aacccagtgaacttt

SEQ ID NO: 383795 - DNA, 15 bp, Homo sapiens
acccagtgaacttta

SEQ ID NO: 383796 - DNA, 15 bp, Homo sapiens
cccagtgaactttac

SEQ ID NO: 383797 - DNA, 15 bp, Homo sapiens
ccagtgaactttaca

SEQ ID NO: 383798 - DNA, 15 bp, Homo sapiens
cagtgaactttacaa

SEQ ID NO: 383799 - DNA, 15 bp, Homo sapiens
agtgaactttacaat

SEQ ID NO: 383800 - DNA, 15 bp, Homo sapiens
gtgaactttacaatt

SEQ ID NO: 383801 - DNA, 15 bp, Homo sapiens
tgaactttacaattt

SEQ ID NO: 383802 - DNA, 15 bp, Homo sapiens
gaactttacaatttt

SEQ ID NO: 383803 - DNA, 15 bp, Homo sapiens
aactttacaattttt

SEQ ID NO: 383804 - DNA, 15 bp, Homo sapiens
actttacaattttta

SEQ ID NO: 383805 - DNA, 15 bp, Homo sapiens
ctttacaatttttaa

SEQ ID NO: 383806 - DNA, 15 bp, Homo sapiens
tttacaatttttaac

SEQ ID NO: 383807 - DNA, 15 bp, Homo sapiens
ttacaatttttaact

SEQ ID NO: 383808 - DNA, 15 bp, Homo sapiens
tacaatttttaacta

SEQ ID NO: 383809 - DNA, 15 bp, Homo sapiens
acaatttttaactat

SEQ ID NO: 383810 - DNA, 15 bp, Homo sapiens
caatttttaactatt

SEQ ID NO: 383811 - DNA, 15 bp, Homo sapiens
aatttttaactattt

SEQ ID NO: 383812 - DNA, 15 bp, Homo sapiens
atttttaactatttt

SEQ ID NO: 383813 - DNA, 15 bp, Homo sapiens
tttttaactatttta

SEQ ID NO: 383814 - DNA, 15 bp, Homo sapiens
ttttaactattttaa

SEQ ID NO: 383815 - DNA, 15 bp, Homo sapiens
tttaactattttaaa

SEQ ID NO: 383816 - DNA, 15 bp, Homo sapiens
ttaactattttaaat

SEQ ID NO: 383817 - DNA, 15 bp, Homo sapiens
taactattttaaatg

SEQ ID NO: 383818 - DNA, 15 bp, Homo sapiens
aactattttaaatgg

SEQ ID NO: 383819 - DNA, 15 bp, Homo sapiens
actattttaaatgga

SEQ ID NO: 383820 - DNA, 15 bp, Homo sapiens
ctattttaaatggac

SEQ ID NO: 383821 - DNA, 15 bp, Homo sapiens
tattttaaatggaca

SEQ ID NO: 383822 - DNA, 15 bp, Homo sapiens
attttaaatggacat

SEQ ID NO: 383823 - DNA, 15 bp, Homo sapiens
ttttaaatggacatc

SEQ ID NO: 383824 - DNA, 15 bp, Homo sapiens
tttaaatggacatct

SEQ ID NO: 383825 - DNA, 15 bp, Homo sapiens
ttaaatggacatctt

SEQ ID NO: 383826 - DNA, 15 bp, Homo sapiens
taaatggacatcttt

SEQ ID NO: 383827 - DNA, 15 bp, Homo sapiens
aaatggacatctttg

SEQ ID NO: 383828 - DNA, 15 bp, Homo sapiens
aatggacatctttgt

SEQ ID NO: 383829 - DNA, 15 bp, Homo sapiens
atggacatctttgta

SEQ ID NO: 383830 - DNA, 15 bp, Homo sapiens
tggacatctttgtag

SEQ ID NO: 383831 - DNA, 15 bp, Homo sapiens
ggacatctttgtaga

SEQ ID NO: 383832 - DNA, 15 bp, Homo sapiens
gacatctttgtagaa

SEQ ID NO: 383833 - DNA, 15 bp, Homo sapiens
acatctttgtagaat

SEQ ID NO: 383834 - DNA, 15 bp, Homo sapiens
catctttgtagaata

SEQ ID NO: 383835 - DNA, 15 bp, Homo sapiens
atctttgtagaatat

SEQ ID NO: 383836 - DNA, 15 bp, Homo sapiens
tctttgtagaatata

SEQ ID NO: 383837 - DNA, 15 bp, Homo sapiens
ctttgtagaatatat

SEQ ID NO: 383838 - DNA, 15 bp, Homo sapiens
tttgtagaatatata

SEQ ID NO: 383839 - DNA, 15 bp, Homo sapiens
ttgtagaatatataa

SEQ ID NO: 383840 - DNA, 15 bp, Homo sapiens
tgtagaatatataaa

SEQ ID NO: 383841 - DNA, 15 bp, Homo sapiens
gtagaatatataaat

SEQ ID NO: 383842 - DNA, 15 bp, Homo sapiens
tagaatatataaatc

SEQ ID NO: 383843 - DNA, 15 bp, Homo sapiens
agaatatataaatct

SEQ ID NO: 383844 - DNA, 15 bp, Homo sapiens
gaatatataaatctt

SEQ ID NO: 383845 - DNA, 15 bp, Homo sapiens
aatatataaatcttt

SEQ ID NO: 383846 - DNA, 15 bp, Homo sapiens
atatataaatctttc

SEQ ID NO: 383847 - DNA, 15 bp, Homo sapiens
tatataaatctttct

SEQ ID NO: 383848 - DNA, 15 bp, Homo sapiens
atataaatctttctt

SEQ ID NO: 383849 - DNA, 15 bp, Homo sapiens
tataaatctttcttt

SEQ ID NO: 383850 - DNA, 15 bp, Homo sapiens
ataaatctttctttg

SEQ ID NO: 383851 - DNA, 15 bp, Homo sapiens
taaatctttctttgc

SEQ ID NO: 383852 - DNA, 15 bp, Homo sapiens
aaatctttctttgcc

SEQ ID NO: 383853 - DNA, 15 bp, Homo sapiens
aatctttctttgcct

SEQ ID NO: 383854 - DNA, 15 bp, Homo sapiens
atctttctttgcctt

SEQ ID NO: 383855 - DNA, 15 bp, Homo sapiens
tctttctttgccttc

SEQ ID NO: 383856 - DNA, 15 bp, Homo sapiens
ctttctttgccttct

SEQ ID NO: 383857 - DNA, 15 bp, Homo sapiens
tttctttgccttctt

SEQ ID NO: 383858 - DNA, 15 bp, Homo sapiens
ttctttgccttctta

SEQ ID NO: 383859 - DNA, 15 bp, Homo sapiens
tctttgccttcttaa

SEQ ID NO: 383860 - DNA, 15 bp, Homo sapiens
ctttgccttcttaaa

SEQ ID NO: 383861 - DNA, 15 bp, Homo sapiens
tttgccttcttaaag

SEQ ID NO: 383862 - DNA, 15 bp, Homo sapiens
ttgccttcttaaagc

SEQ ID NO: 383863 - DNA, 15 bp, Homo sapiens
tgccttcttaaagct

SEQ ID NO: 383864 - DNA, 15 bp, Homo sapiens
gccttcttaaagctt

SEQ ID NO: 383865 - DNA, 15 bp, Homo sapiens
ccttcttaaagcttg

SEQ ID NO: 383866 - DNA, 15 bp, Homo sapiens
cttcttaaagcttgt

SEQ ID NO: 383867 - DNA, 15 bp, Homo sapiens
ttcttaaagcttgtg

SEQ ID NO: 383868 - DNA, 15 bp, Homo sapiens
tcttaaagcttgtga

SEQ ID NO: 383869 - DNA, 15 bp, Homo sapiens
cttaaagcttgtgaa

SEQ ID NO: 383870 - DNA, 15 bp, Homo sapiens
ttaaagcttgtgaat

SEQ ID NO: 383871 - DNA, 15 bp, Homo sapiens
taaagcttgtgaatg

SEQ ID NO: 383872 - DNA, 15 bp, Homo sapiens
aaagcttgtgaatgt

SEQ ID NO: 383873 - DNA, 15 bp, Homo sapiens
aagcttgtgaatgta

SEQ ID NO: 383874 - DNA, 15 bp, Homo sapiens
agcttgtgaatgtat

SEQ ID NO: 383875 - DNA, 15 bp, Homo sapiens
gcttgtgaatgtata

SEQ ID NO: 383876 - DNA, 15 bp, Homo sapiens
cttgtgaatgtatat

SEQ ID NO: 383877 - DNA, 15 bp, Homo sapiens
ttgtgaatgtatatt

SEQ ID NO: 383878 - DNA, 15 bp, Homo sapiens
tgtgaatgtatattt

SEQ ID NO: 383879 - DNA, 15 bp, Homo sapiens
gtgaatgtatattta

SEQ ID NO: 383880 - DNA, 15 bp, Homo sapiens
tgaatgtatatttaa

SEQ ID NO: 383881 - DNA, 15 bp, Homo sapiens
gaatgtatatttaac

SEQ ID NO: 383882 - DNA, 15 bp, Homo sapiens
aatgtatatttaact

SEQ ID NO: 383883 - DNA, 15 bp, Homo sapiens
atgtatatttaactt

SEQ ID NO: 383884 - DNA, 15 bp, Homo sapiens
tgtatatttaacttt

SEQ ID NO: 383885 - DNA, 15 bp, Homo sapiens
gtatatttaactttt

SEQ ID NO: 383886 - DNA, 15 bp, Homo sapiens
tatatttaacttttt

SEQ ID NO: 383887 - DNA, 15 bp, Homo sapiens
atatttaactttttt

SEQ ID NO: 383888 - DNA, 15 bp, Homo sapiens
tatttaacttttttc

SEQ ID NO: 383889 - DNA, 15 bp, Homo sapiens
atttaacttttttct

SEQ ID NO: 383890 - DNA, 15 bp, Homo sapiens
tttaacttttttctg

SEQ ID NO: 383891 - DNA, 15 bp, Homo sapiens
ttaacttttttctga

SEQ ID NO: 383892 - DNA, 15 bp, Homo sapiens
taacttttttctgaa

SEQ ID NO: 383893 - DNA, 15 bp, Homo sapiens
aacttttttctgaat

SEQ ID NO: 383894 - DNA, 15 bp, Homo sapiens
acttttttctgaatt

SEQ ID NO: 383895 - DNA, 15 bp, Homo sapiens
cttttttctgaattc

SEQ ID NO: 383896 - DNA, 15 bp, Homo sapiens
ttttttctgaattct

SEQ ID NO: 383897 - DNA, 15 bp, Homo sapiens
tttttctgaattctt

SEQ ID NO: 383898 - DNA, 15 bp, Homo sapiens
ttttctgaattcttg

SEQ ID NO: 383899 - DNA, 15 bp, Homo sapiens
tttctgaattcttgg

SEQ ID NO: 383900 - DNA, 15 bp, Homo sapiens
ttctgaattcttggt

SEQ ID NO: 383901 - DNA, 15 bp, Homo sapiens
tctgaattcttggta

SEQ ID NO: 383902 - DNA, 15 bp, Homo sapiens
ctgaattcttggtag

SEQ ID NO: 383903 - DNA, 15 bp, Homo sapiens
tgaattcttggtagt

SEQ ID NO: 383904 - DNA, 15 bp, Homo sapiens
gaattcttggtagta

SEQ ID NO: 383905 - DNA, 15 bp, Homo sapiens
aattcttggtagtat

SEQ ID NO: 383906 - DNA, 15 bp, Homo sapiens
attcttggtagtatt

SEQ ID NO: 383907 - DNA, 15 bp, Homo sapiens
ttcttggtagtattg

SEQ ID NO: 383908 - DNA, 15 bp, Homo sapiens
tcttggtagtattgt

SEQ ID NO: 383909 - DNA, 15 bp, Homo sapiens
cttggtagtattgtt

SEQ ID NO: 383910 - DNA, 15 bp, Homo sapiens
ttggtagtattgttg

SEQ ID NO: 383911 - DNA, 15 bp, Homo sapiens
tggtagtattgttgc

SEQ ID NO: 383912 - DNA, 15 bp, Homo sapiens
ggtagtattgttgca

SEQ ID NO: 383913 - DNA, 15 bp, Homo sapiens
gtagtattgttgcaa

SEQ ID NO: 383914 - DNA, 15 bp, Homo sapiens
tagtattgttgcaaa

SEQ ID NO: 383915 - DNA, 15 bp, Homo sapiens
agtattgttgcaaag

SEQ ID NO: 383916 - DNA, 15 bp, Homo sapiens
gtattgttgcaaaga

SEQ ID NO: 383917 - DNA, 15 bp, Homo sapiens
tattgttgcaaagat

SEQ ID NO: 383918 - DNA, 15 bp, Homo sapiens
attgttgcaaagata

SEQ ID NO: 383919 - DNA, 15 bp, Homo sapiens
ttgttgcaaagatag

SEQ ID NO: 383920 - DNA, 15 bp, Homo sapiens
tgttgcaaagataga

SEQ ID NO: 383921 - DNA, 15 bp, Homo sapiens
gttgcaaagatagaa

SEQ ID NO: 383922 - DNA, 15 bp, Homo sapiens
ttgcaaagatagaat

SEQ ID NO: 383923 - DNA, 15 bp, Homo sapiens
tgcaaagatagaatt

SEQ ID NO: 383924 - DNA, 15 bp, Homo sapiens
gcaaagatagaatta

SEQ ID NO: 383925 - DNA, 15 bp, Homo sapiens
caaagatagaattaa

SEQ ID NO: 383926 - DNA, 15 bp, Homo sapiens
aaagatagaattaag

SEQ ID NO: 383927 - DNA, 15 bp, Homo sapiens
aagatagaattaagg

SEQ ID NO: 383928 - DNA, 15 bp, Homo sapiens
agatagaattaagga

SEQ ID NO: 383929 - DNA, 15 bp, Homo sapiens
gatagaattaaggaa

SEQ ID NO: 383930 - DNA, 15 bp, Homo sapiens
atagaattaaggaac

SEQ ID NO: 383931 - DNA, 15 bp, Homo sapiens
tagaattaaggaact

SEQ ID NO: 383932 - DNA, 15 bp, Homo sapiens
agaattaaggaactt

SEQ ID NO: 383933 - DNA, 15 bp, Homo sapiens
gaattaaggaacttt

SEQ ID NO: 383934 - DNA, 15 bp, Homo sapiens
aattaaggaacttta

SEQ ID NO: 383935 - DNA, 15 bp, Homo sapiens
attaaggaactttaa

SEQ ID NO: 383936 - DNA, 15 bp, Homo sapiens
ttaaggaactttaat

SEQ ID NO: 383937 - DNA, 15 bp, Homo sapiens
taaggaactttaatg

SEQ ID NO: 383938 - DNA, 15 bp, Homo sapiens
aaggaactttaatgg

SEQ ID NO: 383939 - DNA, 15 bp, Homo sapiens
aggaactttaatgga

SEQ ID NO: 383940 - DNA, 15 bp, Homo sapiens
ggaactttaatggat

SEQ ID NO: 383941 - DNA, 15 bp, Homo sapiens
gaactttaatggata

SEQ ID NO: 383942 - DNA, 15 bp, Homo sapiens
aactttaatggatac

SEQ ID NO: 383943 - DNA, 15 bp, Homo sapiens
actttaatggatacg

SEQ ID NO: 383944 - DNA, 15 bp, Homo sapiens
ctttaatggatacga

SEQ ID NO: 383945 - DNA, 15 bp, Homo sapiens
tttaatggatacgag

SEQ ID NO: 383946 - DNA, 15 bp, Homo sapiens
ttaatggatacgagt

SEQ ID NO: 383947 - DNA, 15 bp, Homo sapiens
taatggatacgagtg

SEQ ID NO: 383948 - DNA, 15 bp, Homo sapiens
aatggatacgagtga

SEQ ID NO: 383949 - DNA, 15 bp, Homo sapiens
atggatacgagtgac

SEQ ID NO: 383950 - DNA, 15 bp, Homo sapiens
tggatacgagtgacc

SEQ ID NO: 383951 - DNA, 15 bp, Homo sapiens
ggatacgagtgacct

SEQ ID NO: 383952 - DNA, 15 bp, Homo sapiens
gatacgagtgacctt

SEQ ID NO: 383953 - DNA, 15 bp, Homo sapiens
atacgagtgacctta

SEQ ID NO: 383954 - DNA, 15 bp, Homo sapiens
tacgagtgaccttag

SEQ ID NO: 383955 - DNA, 15 bp, Homo sapiens
acgagtgaccttaga

SEQ ID NO: 383956 - DNA, 15 bp, Homo sapiens
cgagtgaccttagag

SEQ ID NO: 383957 - DNA, 15 bp, Homo sapiens
gagtgaccttagagt

SEQ ID NO: 383958 - DNA, 15 bp, Homo sapiens
agtgaccttagagtt

SEQ ID NO: 383959 - DNA, 15 bp, Homo sapiens
gtgaccttagagttc

SEQ ID NO: 383960 - DNA, 15 bp, Homo sapiens
tgaccttagagttct

SEQ ID NO: 383961 - DNA, 15 bp, Homo sapiens
gaccttagagttctt

SEQ ID NO: 383962 - DNA, 15 bp, Homo sapiens
accttagagttcttc

SEQ ID NO: 383963 - DNA, 15 bp, Homo sapiens
ccttagagttcttct

SEQ ID NO: 383964 - DNA, 15 bp, Homo sapiens
cttagagttcttctg

SEQ ID NO: 383965 - DNA, 15 bp, Homo sapiens
ttagagttcttctga

SEQ ID NO: 383966 - DNA, 15 bp, Homo sapiens
tagagttcttctgaa

SEQ ID NO: 383967 - DNA, 15 bp, Homo sapiens
agagttcttctgaac

SEQ ID NO: 383968 - DNA, 15 bp, Homo sapiens
gagttcttctgaacc

SEQ ID NO: 383969 - DNA, 15 bp, Homo sapiens
agttcttctgaacca

SEQ ID NO: 383970 - DNA, 15 bp, Homo sapiens
gttcttctgaaccag

SEQ ID NO: 383971 - DNA, 15 bp, Homo sapiens
ttcttctgaaccagt

SEQ ID NO: 383972 - DNA, 15 bp, Homo sapiens
tcttctgaaccagtg

SEQ ID NO: 383973 - DNA, 15 bp, Homo sapiens
cttctgaaccagtgt

SEQ ID NO: 383974 - DNA, 15 bp, Homo sapiens
ttctgaaccagtgtt

SEQ ID NO: 383975 - DNA, 15 bp, Homo sapiens
tctgaaccagtgttt

SEQ ID NO: 383976 - DNA, 15 bp, Homo sapiens
ctgaaccagtgtttc

SEQ ID NO: 383977 - DNA, 15 bp, Homo sapiens
tgaaccagtgtttct

SEQ ID NO: 383978 - DNA, 15 bp, Homo sapiens
gaaccagtgtttctc

SEQ ID NO: 383979 - DNA, 15 bp, Homo sapiens
aaccagtgtttctca

SEQ ID NO: 383980 - DNA, 15 bp, Homo sapiens
accagtgtttctcaa

SEQ ID NO: 383981 - DNA, 15 bp, Homo sapiens
ccagtgtttctcaac

SEQ ID NO: 383982 - DNA, 15 bp, Homo sapiens
cagtgtttctcaacc

SEQ ID NO: 383983 - DNA, 15 bp, Homo sapiens
agtgtttctcaacct

SEQ ID NO: 383984 - DNA, 15 bp, Homo sapiens
gtgtttctcaacctt

SEQ ID NO: 383985 - DNA, 15 bp, Homo sapiens
tgtttctcaaccttt

SEQ ID NO: 383986 - DNA, 15 bp, Homo sapiens
gtttctcaacctttc

SEQ ID NO: 383987 - DNA, 15 bp, Homo sapiens
tttctcaacctttct

SEQ ID NO: 383988 - DNA, 15 bp, Homo sapiens
ttctcaacctttctt

SEQ ID NO: 383989 - DNA, 15 bp, Homo sapiens
tctcaacctttcttt

SEQ ID NO: 383990 - DNA, 15 bp, Homo sapiens
ctcaacctttcttta

SEQ ID NO: 383991 - DNA, 15 bp, Homo sapiens
tcaacctttctttac

SEQ ID NO: 383992 - DNA, 15 bp, Homo sapiens
caacctttctttaca

SEQ ID NO: 383993 - DNA, 15 bp, Homo sapiens
aacctttctttacat

SEQ ID NO: 383994 - DNA, 15 bp, Homo sapiens
acctttctttacatt

SEQ ID NO: 383995 - DNA, 15 bp, Homo sapiens
cctttctttacatta

SEQ ID NO: 383996 - DNA, 15 bp, Homo sapiens
ctttctttacattat

SEQ ID NO: 383997 - DNA, 15 bp, Homo sapiens
tttctttacattatc

SEQ ID NO: 383998 - DNA, 15 bp, Homo sapiens
ttctttacattatcg

SEQ ID NO: 383999 - DNA, 15 bp, Homo sapiens
tctttacattatcgc

SEQ ID NO: 384000 - DNA, 15 bp, Homo sapiens
ctttacattatcgct

SEQ ID NO: 384001 - DNA, 15 bp, Homo sapiens
tttacattatcgctt

SEQ ID NO: 384002 - DNA, 15 bp, Homo sapiens
ttacattatcgcttc

SEQ ID NO: 384003 - DNA, 15 bp, Homo sapiens
tacattatcgcttcc

SEQ ID NO: 384004 - DNA, 15 bp, Homo sapiens
acattatcgcttccc

SEQ ID NO: 384005 - DNA, 15 bp, Homo sapiens
cattatcgcttccct

SEQ ID NO: 384006 - DNA, 15 bp, Homo sapiens
attatcgcttcccta

SEQ ID NO: 384007 - DNA, 15 bp, Homo sapiens
ttatcgcttccctaa

SEQ ID NO: 384008 - DNA, 15 bp, Homo sapiens
tatcgcttccctaag

SEQ ID NO: 384009 - DNA, 15 bp, Homo sapiens
atcgcttccctaagg

SEQ ID NO: 384010 - DNA, 15 bp, Homo sapiens
tcgcttccctaagga

SEQ ID NO: 384011 - DNA, 15 bp, Homo sapiens
cgcttccctaaggag

SEQ ID NO: 384012 - DNA, 15 bp, Homo sapiens
gcttccctaaggagc

SEQ ID NO: 384013 - DNA, 15 bp, Homo sapiens
cttccctaaggagcc

SEQ ID NO: 384014 - DNA, 15 bp, Homo sapiens
ttccctaaggagcct

SEQ ID NO: 384015 - DNA, 15 bp, Homo sapiens
tccctaaggagcctg

SEQ ID NO: 384016 - DNA, 15 bp, Homo sapiens
ccctaaggagcctgt

SEQ ID NO: 384017 - DNA, 15 bp, Homo sapiens
cctaaggagcctgtg

SEQ ID NO: 384018 - DNA, 15 bp, Homo sapiens
ctaaggagcctgtgt

SEQ ID NO: 384019 - DNA, 15 bp, Homo sapiens
taaggagcctgtgta

SEQ ID NO: 384020 - DNA, 15 bp, Homo sapiens
aaggagcctgtgtag

SEQ ID NO: 384021 - DNA, 15 bp, Homo sapiens
aggagcctgtgtaga

SEQ ID NO: 384022 - DNA, 15 bp, Homo sapiens
ggagcctgtgtagac

SEQ ID NO: 384023 - DNA, 15 bp, Homo sapiens
gagcctgtgtagact

SEQ ID NO: 384024 - DNA, 15 bp, Homo sapiens
agcctgtgtagactc

SEQ ID NO: 384025 - DNA, 15 bp, Homo sapiens
gcctgtgtagactca

SEQ ID NO: 384026 - DNA, 15 bp, Homo sapiens
cctgtgtagactcat

SEQ ID NO: 384027 - DNA, 15 bp, Homo sapiens
ctgtgtagactcatc

SEQ ID NO: 384028 - DNA, 15 bp, Homo sapiens
tgtgtagactcatct

SEQ ID NO: 384029 - DNA, 15 bp, Homo sapiens
gtgtagactcatctt

SEQ ID NO: 384030 - DNA, 15 bp, Homo sapiens
tgtagactcatcttc

SEQ ID NO: 384031 - DNA, 15 bp, Homo sapiens
gtagactcatcttcc

SEQ ID NO: 384032 - DNA, 15 bp, Homo sapiens
tagactcatcttccc

SEQ ID NO: 384033 - DNA, 15 bp, Homo sapiens
agactcatcttccca

SEQ ID NO: 384034 - DNA, 15 bp, Homo sapiens
gactcatcttcccat

SEQ ID NO: 384035 - DNA, 15 bp, Homo sapiens
actcatcttcccatg

SEQ ID NO: 384036 - DNA, 15 bp, Homo sapiens
ctcatcttcccatga

SEQ ID NO: 384037 - DNA, 15 bp, Homo sapiens
tcatcttcccatgaa

SEQ ID NO: 384038 - DNA, 15 bp, Homo sapiens
catcttcccatgaaa

SEQ ID NO: 384039 - DNA, 15 bp, Homo sapiens
atcttcccatgaaat

SEQ ID NO: 384040 - DNA, 15 bp, Homo sapiens
tcttcccatgaaatt

SEQ ID NO: 384041 - DNA, 15 bp, Homo sapiens
cttcccatgaaattt

SEQ ID NO: 384042 - DNA, 15 bp, Homo sapiens
ttcccatgaaatttt

SEQ ID NO: 384043 - DNA, 15 bp, Homo sapiens
tcccatgaaatttta

SEQ ID NO: 384044 - DNA, 15 bp, Homo sapiens
cccatgaaattttaa

SEQ ID NO: 384045 - DNA, 15 bp, Homo sapiens
ccatgaaattttaat

SEQ ID NO: 384046 - DNA, 15 bp, Homo sapiens
catgaaattttaata

SEQ ID NO: 384047 - DNA, 15 bp, Homo sapiens
atgaaattttaatac

SEQ ID NO: 384048 - DNA, 15 bp, Homo sapiens
tgaaattttaatacc

SEQ ID NO: 384049 - DNA, 15 bp, Homo sapiens
gaaattttaatacca

SEQ ID NO: 384050 - DNA, 15 bp, Homo sapiens
aaattttaataccat

SEQ ID NO: 384051 - DNA, 15 bp, Homo sapiens
aattttaataccatg

SEQ ID NO: 384052 - DNA, 15 bp, Homo sapiens
attttaataccatga

SEQ ID NO: 384053 - DNA, 15 bp, Homo sapiens
ttttaataccatgat

SEQ ID NO: 384054 - DNA, 15 bp, Homo sapiens
tttaataccatgata

SEQ ID NO: 384055 - DNA, 15 bp, Homo sapiens
ttaataccatgatat

SEQ ID NO: 384056 - DNA, 15 bp, Homo sapiens
taataccatgatata

SEQ ID NO: 384057 - DNA, 15 bp, Homo sapiens
aataccatgatatac

SEQ ID NO: 384058 - DNA, 15 bp, Homo sapiens
ataccatgatatact

SEQ ID NO: 384059 - DNA, 15 bp, Homo sapiens
taccatgatatactg

SEQ ID NO: 384060 - DNA, 15 bp, Homo sapiens
accatgatatactgt

SEQ ID NO: 384061 - DNA, 15 bp, Homo sapiens
ccatgatatactgtg

SEQ ID NO: 384062 - DNA, 15 bp, Homo sapiens
catgatatactgtgt

SEQ ID NO: 384063 - DNA, 15 bp, Homo sapiens
atgatatactgtgta

SEQ ID NO: 384064 - DNA, 15 bp, Homo sapiens
tgatatactgtgtac

SEQ ID NO: 384065 - DNA, 15 bp, Homo sapiens
gatatactgtgtact

SEQ ID NO: 384066 - DNA, 15 bp, Homo sapiens
atatactgtgtactg

SEQ ID NO: 384067 - DNA, 15 bp, Homo sapiens
tatactgtgtactgt

SEQ ID NO: 384068 - DNA, 15 bp, Homo sapiens
atactgtgtactgta

SEQ ID NO: 384069 - DNA, 15 bp, Homo sapiens
tactgtgtactgtat

SEQ ID NO: 384070 - DNA, 15 bp, Homo sapiens
actgtgtactgtatg

SEQ ID NO: 384071 - DNA, 15 bp, Homo sapiens
ctgtgtactgtatgg

SEQ ID NO: 384072 - DNA, 15 bp, Homo sapiens
tgtgtactgtatggt

SEQ ID NO: 384073 - DNA, 15 bp, Homo sapiens
gtgtactgtatggtt

SEQ ID NO: 384074 - DNA, 15 bp, Homo sapiens
tgtactgtatggttg

SEQ ID NO: 384075 - DNA, 15 bp, Homo sapiens
gtactgtatggttgt

SEQ ID NO: 384076 - DNA, 15 bp, Homo sapiens
tactgtatggttgtg

SEQ ID NO: 384077 - DNA, 15 bp, Homo sapiens
actgtatggttgtgc

SEQ ID NO: 384078 - DNA, 15 bp, Homo sapiens
ctgtatggttgtgct

SEQ ID NO: 384079 - DNA, 15 bp, Homo sapiens
tgtatggttgtgctt

SEQ ID NO: 384080 - DNA, 15 bp, Homo sapiens
gtatggttgtgcttt

SEQ ID NO: 384081 - DNA, 15 bp, Homo sapiens
tatggttgtgcttta

SEQ ID NO: 384082 - DNA, 15 bp, Homo sapiens
atggttgtgctttat

SEQ ID NO: 384083 - DNA, 15 bp, Homo sapiens
tggttgtgctttata

SEQ ID NO: 384084 - DNA, 15 bp, Homo sapiens
ggttgtgctttatac

SEQ ID NO: 384085 - DNA, 15 bp, Homo sapiens
gttgtgctttataca

SEQ ID NO: 384086 - DNA, 15 bp, Homo sapiens
ttgtgctttatacat

SEQ ID NO: 384087 - DNA, 15 bp, Homo sapiens
tgtgctttatacata

SEQ ID NO: 384088 - DNA, 15 bp, Homo sapiens
gtgctttatacataa

SEQ ID NO: 384089 - DNA, 15 bp, Homo sapiens
tgctttatacataaa

SEQ ID NO: 384090 - DNA, 15 bp, Homo sapiens
gctttatacataaaa

SEQ ID NO: 384091 - DNA, 15 bp, Homo sapiens
ctttatacataaaaa

SEQ ID NO: 384092 - DNA, 15 bp, Homo sapiens
tttatacataaaaag

SEQ ID NO: 384093 - DNA, 15 bp, Homo sapiens
ttatacataaaaaga

SEQ ID NO: 384094 - DNA, 15 bp, Homo sapiens
tatacataaaaagaa

SEQ ID NO: 384095 - DNA, 15 bp, Homo sapiens
tacataaaaagaata

SEQ ID NO: 384096 - DNA, 15 bp, Homo sapiens
acataaaaagaatac

SEQ ID NO: 384097 - DNA, 15 bp, Homo sapiens
cataaaaagaataca

SEQ ID NO: 384098 - DNA, 15 bp, Homo sapiens
ataaaaagaatacat

SEQ ID NO: 384099 - DNA, 15 bp, Homo sapiens
taaaaagaatacatt

SEQ ID NO: 384100 - DNA, 15 bp, Homo sapiens
aaaaagaatacattt

SEQ ID NO: 384101 - DNA, 15 bp, Homo sapiens
aaaagaatacatttt

SEQ ID NO: 384102 - DNA, 15 bp, Homo sapiens
aaagaatacattttt

SEQ ID NO: 384103 - DNA, 15 bp, Homo sapiens
aagaatacatttttt

SEQ ID NO: 384104 - DNA, 15 bp, Homo sapiens
agaatacattttttc

SEQ ID NO: 384105 - DNA, 15 bp, Homo sapiens
gaatacattttttca

SEQ ID NO: 384106 - DNA, 15 bp, Homo sapiens
aatacattttttcac

SEQ ID NO: 384107 - DNA, 15 bp, Homo sapiens
atacattttttcacc

SEQ ID NO: 384108 - DNA, 15 bp, Homo sapiens
tacattttttcaccc

SEQ ID NO: 384109 - DNA, 15 bp, Homo sapiens
acattttttcaccct

SEQ ID NO: 384110 - DNA, 15 bp, Homo sapiens
cattttttcaccctc

SEQ ID NO: 384111 - DNA, 15 bp, Homo sapiens
attttttcaccctcc

SEQ ID NO: 384112 - DNA, 15 bp, Homo sapiens
ttttttcaccctccc

SEQ ID NO: 384113 - DNA, 15 bp, Homo sapiens
tttttcaccctcccc

SEQ ID NO: 384114 - DNA, 15 bp, Homo sapiens
ttttcaccctccccc

SEQ ID NO: 384115 - DNA, 15 bp, Homo sapiens
tttcaccctccccct

SEQ ID NO: 384116 - DNA, 15 bp, Homo sapiens
ttcaccctccccctg

SEQ ID NO: 384117 - DNA, 15 bp, Homo sapiens
tcaccctccccctga

SEQ ID NO: 384118 - DNA, 15 bp, Homo sapiens
caccctccccctgaa

SEQ ID NO: 384119 - DNA, 15 bp, Homo sapiens
accctccccctgaaa

SEQ ID NO: 384120 - DNA, 15 bp, Homo sapiens
ccctccccctgaaaa

SEQ ID NO: 384121 - DNA, 15 bp, Homo sapiens
cctccccctgaaaag

SEQ ID NO: 384122 - DNA, 15 bp, Homo sapiens
ctccccctgaaaaga

SEQ ID NO: 384123 - DNA, 15 bp, Homo sapiens
tccccctgaaaagaa

SEQ ID NO: 384124 - DNA, 15 bp, Homo sapiens
ccccctgaaaagaaa

SEQ ID NO: 384125 - DNA, 15 bp, Homo sapiens
cccctgaaaagaaat

SEQ ID NO: 384126 - DNA, 15 bp, Homo sapiens
ccctgaaaagaaata

SEQ ID NO: 384127 - DNA, 15 bp, Homo sapiens
cctgaaaagaaataa

SEQ ID NO: 384128 - DNA, 15 bp, Homo sapiens
ctgaaaagaaataac

SEQ ID NO: 384129 - DNA, 15 bp, Homo sapiens
tgaaaagaaataacc

SEQ ID NO: 384130 - DNA, 15 bp, Homo sapiens
gaaaagaaataacca

SEQ ID NO: 384131 - DNA, 15 bp, Homo sapiens
aaaagaaataaccat

SEQ ID NO: 384132 - DNA, 15 bp, Homo sapiens
aaagaaataaccatt

SEQ ID NO: 384133 - DNA, 15 bp, Homo sapiens
aagaaataaccattt

SEQ ID NO: 384134 - DNA, 15 bp, Homo sapiens
agaaataaccattta

SEQ ID NO: 384135 - DNA, 15 bp, Homo sapiens
gaaataaccatttat

SEQ ID NO: 384136 - DNA, 15 bp, Homo sapiens
aaataaccatttatt

SEQ ID NO: 384137 - DNA, 15 bp, Homo sapiens
aataaccatttatta

SEQ ID NO: 384138 - DNA, 15 bp, Homo sapiens
ataaccatttattac

SEQ ID NO: 384139 - DNA, 15 bp, Homo sapiens
taaccatttattacc

SEQ ID NO: 384140 - DNA, 15 bp, Homo sapiens
aaccatttattacct

SEQ ID NO: 384141 - DNA, 15 bp, Homo sapiens
accatttattacctg

SEQ ID NO: 384142 - DNA, 15 bp, Homo sapiens
ccatttattacctgt

SEQ ID NO: 384143 - DNA, 15 bp, Homo sapiens
catttattacctgtg

SEQ ID NO: 384144 - DNA, 15 bp, Homo sapiens
atttattacctgtgt

SEQ ID NO: 384145 - DNA, 15 bp, Homo sapiens
tttattacctgtgtt

SEQ ID NO: 384146 - DNA, 15 bp, Homo sapiens
ttattacctgtgttg

SEQ ID NO: 384147 - DNA, 15 bp, Homo sapiens
tattacctgtgttga

SEQ ID NO: 384148 - DNA, 15 bp, Homo sapiens
attacctgtgttgag

SEQ ID NO: 384149 - DNA, 15 bp, Homo sapiens
ttacctgtgttgaga

SEQ ID NO: 384150 - DNA, 15 bp, Homo sapiens
tacctgtgttgagaa

SEQ ID NO: 384151 - DNA, 15 bp, Homo sapiens
acctgtgttgagaat

SEQ ID NO: 384152 - DNA, 15 bp, Homo sapiens
cctgtgttgagaata

SEQ ID NO: 384153 - DNA, 15 bp, Homo sapiens
ctgtgttgagaatac

SEQ ID NO: 384154 - DNA, 15 bp, Homo sapiens
tgtgttgagaataca

SEQ ID NO: 384155 - DNA, 15 bp, Homo sapiens
gtgttgagaatacat

SEQ ID NO: 384156 - DNA, 15 bp, Homo sapiens
tgttgagaatacatg

SEQ ID NO: 384157 - DNA, 15 bp, Homo sapiens
gttgagaatacatgg

SEQ ID NO: 384158 - DNA, 15 bp, Homo sapiens
ttgagaatacatggt

SEQ ID NO: 384159 - DNA, 15 bp, Homo sapiens
tgagaatacatggtc

SEQ ID NO: 384160 - DNA, 15 bp, Homo sapiens
gagaatacatggtct

SEQ ID NO: 384161 - DNA, 15 bp, Homo sapiens
agaatacatggtcta

SEQ ID NO: 384162 - DNA, 15 bp, Homo sapiens
gaatacatggtctaa

SEQ ID NO: 384163 - DNA, 15 bp, Homo sapiens
aatacatggtctaat

SEQ ID NO: 384164 - DNA, 15 bp, Homo sapiens
atacatggtctaatc

SEQ ID NO: 384165 - DNA, 15 bp, Homo sapiens
tacatggtctaatct

SEQ ID NO: 384166 - DNA, 15 bp, Homo sapiens
acatggtctaatcta

SEQ ID NO: 384167 - DNA, 15 bp, Homo sapiens
catggtctaatctaa

SEQ ID NO: 384168 - DNA, 15 bp, Homo sapiens
atggtctaatctaat

SEQ ID NO: 384169 - DNA, 15 bp, Homo sapiens
tggtctaatctaata

SEQ ID NO: 384170 - DNA, 15 bp, Homo sapiens
ggtctaatctaatat

SEQ ID NO: 384171 - DNA, 15 bp, Homo sapiens
gtctaatctaatatt

SEQ ID NO: 384172 - DNA, 15 bp, Homo sapiens
tctaatctaatattc

SEQ ID NO: 384173 - DNA, 15 bp, Homo sapiens
ctaatctaatattct

SEQ ID NO: 384174 - DNA, 15 bp, Homo sapiens
taatctaatattctc

SEQ ID NO: 384175 - DNA, 15 bp, Homo sapiens
aatctaatattctca

SEQ ID NO: 384176 - DNA, 15 bp, Homo sapiens
atctaatattctcag

SEQ ID NO: 384177 - DNA, 15 bp, Homo sapiens
tctaatattctcagg

SEQ ID NO: 384178 - DNA, 15 bp, Homo sapiens
ctaatattctcaggc

SEQ ID NO: 384179 - DNA, 15 bp, Homo sapiens
taatattctcaggct

SEQ ID NO: 384180 - DNA, 15 bp, Homo sapiens
aatattctcaggctc

SEQ ID NO: 384181 - DNA, 15 bp, Homo sapiens
atattctcaggctca

SEQ ID NO: 384182 - DNA, 15 bp, Homo sapiens
tattctcaggctcag

SEQ ID NO: 384183 - DNA, 15 bp, Homo sapiens
attctcaggctcaga

SEQ ID NO: 384184 - DNA, 15 bp, Homo sapiens
ttctcaggctcagag

SEQ ID NO: 384185 - DNA, 15 bp, Homo sapiens
tctcaggctcagaga

SEQ ID NO: 384186 - DNA, 15 bp, Homo sapiens
ctcaggctcagagaa

SEQ ID NO: 384187 - DNA, 15 bp, Homo sapiens
tcaggctcagagaag

SEQ ID NO: 384188 - DNA, 15 bp, Homo sapiens
caggctcagagaagt

SEQ ID NO: 384189 - DNA, 15 bp, Homo sapiens
aggctcagagaagtt

SEQ ID NO: 384190 - DNA, 15 bp, Homo sapiens
ggctcagagaagtta

SEQ ID NO: 384191 - DNA, 15 bp, Homo sapiens
gctcagagaagttaa

SEQ ID NO: 384192 - DNA, 15 bp, Homo sapiens
ctcagagaagttaag

SEQ ID NO: 384193 - DNA, 15 bp, Homo sapiens
tcagagaagttaagt

SEQ ID NO: 384194 - DNA, 15 bp, Homo sapiens
cagagaagttaagtg

SEQ ID NO: 384195 - DNA, 15 bp, Homo sapiens
agagaagttaagtga

SEQ ID NO: 384196 - DNA, 15 bp, Homo sapiens
gagaagttaagtgac

SEQ ID NO: 384197 - DNA, 15 bp, Homo sapiens
agaagttaagtgaca

SEQ ID NO: 384198 - DNA, 15 bp, Homo sapiens
gaagttaagtgacat

SEQ ID NO: 384199 - DNA, 15 bp, Homo sapiens
aagttaagtgacatg

SEQ ID NO: 384200 - DNA, 15 bp, Homo sapiens
agttaagtgacatgt

SEQ ID NO: 384201 - DNA, 15 bp, Homo sapiens
gttaagtgacatgtt

SEQ ID NO: 384202 - DNA, 15 bp, Homo sapiens
ttaagtgacatgttc

SEQ ID NO: 384203 - DNA, 15 bp, Homo sapiens
taagtgacatgttca

SEQ ID NO: 384204 - DNA, 15 bp, Homo sapiens
aagtgacatgttcaa

SEQ ID NO: 384205 - DNA, 15 bp, Homo sapiens
agtgacatgttcaaa

SEQ ID NO: 384206 - DNA, 15 bp, Homo sapiens
gtgacatgttcaaag

SEQ ID NO: 384207 - DNA, 15 bp, Homo sapiens
tgacatgttcaaagt

SEQ ID NO: 384208 - DNA, 15 bp, Homo sapiens
gacatgttcaaagtc

SEQ ID NO: 384209 - DNA, 15 bp, Homo sapiens
acatgttcaaagtca

SEQ ID NO: 384210 - DNA, 15 bp, Homo sapiens
catgttcaaagtcat

SEQ ID NO: 384211 - DNA, 15 bp, Homo sapiens
atgttcaaagtcatg

SEQ ID NO: 384212 - DNA, 15 bp, Homo sapiens
tgttcaaagtcatgc

SEQ ID NO: 384213 - DNA, 15 bp, Homo sapiens
gttcaaagtcatgca

SEQ ID NO: 384214 - DNA, 15 bp, Homo sapiens
ttcaaagtcatgcaa

SEQ ID NO: 384215 - DNA, 15 bp, Homo sapiens
tcaaagtcatgcaac

SEQ ID NO: 384216 - DNA, 15 bp, Homo sapiens
caaagtcatgcaaca

SEQ ID NO: 384217 - DNA, 15 bp, Homo sapiens
aaagtcatgcaacac

SEQ ID NO: 384218 - DNA, 15 bp, Homo sapiens
aagtcatgcaacaca

SEQ ID NO: 384219 - DNA, 15 bp, Homo sapiens
agtcatgcaacacag

SEQ ID NO: 384220 - DNA, 15 bp, Homo sapiens
gtcatgcaacacagt

SEQ ID NO: 384221 - DNA, 15 bp, Homo sapiens
tcatgcaacacagtc

SEQ ID NO: 384222 - DNA, 15 bp, Homo sapiens
catgcaacacagtca

SEQ ID NO: 384223 - DNA, 15 bp, Homo sapiens
atgcaacacagtcag

SEQ ID NO: 384224 - DNA, 15 bp, Homo sapiens
tgcaacacagtcagg

SEQ ID NO: 384225 - DNA, 15 bp, Homo sapiens
gcaacacagtcagga

SEQ ID NO: 384226 - DNA, 15 bp, Homo sapiens
caacacagtcaggat

SEQ ID NO: 384227 - DNA, 15 bp, Homo sapiens
aacacagtcaggatg

SEQ ID NO: 384228 - DNA, 15 bp, Homo sapiens
acacagtcaggatga

SEQ ID NO: 384229 - DNA, 15 bp, Homo sapiens
cacagtcaggatgat

SEQ ID NO: 384230 - DNA, 15 bp, Homo sapiens
acagtcaggatgata

SEQ ID NO: 384231 - DNA, 15 bp, Homo sapiens
cagtcaggatgatat

SEQ ID NO: 384232 - DNA, 15 bp, Homo sapiens
agtcaggatgatatt

SEQ ID NO: 384233 - DNA, 15 bp, Homo sapiens
gtcaggatgatattt

SEQ ID NO: 384234 - DNA, 15 bp, Homo sapiens
tcaggatgatatttt

SEQ ID NO: 384235 - DNA, 15 bp, Homo sapiens
caggatgatattttt

SEQ ID NO: 384236 - DNA, 15 bp, Homo sapiens
aggatgatatttttc

SEQ ID NO: 384237 - DNA, 15 bp, Homo sapiens
ggatgatatttttct

SEQ ID NO: 384238 - DNA, 15 bp, Homo sapiens
gatgatatttttcta

SEQ ID NO: 384239 - DNA, 15 bp, Homo sapiens
atgatatttttctat

SEQ ID NO: 384240 - DNA, 15 bp, Homo sapiens
tgatatttttctata

SEQ ID NO: 384241 - DNA, 15 bp, Homo sapiens
gatatttttctatac

SEQ ID NO: 384242 - DNA, 15 bp, Homo sapiens
atatttttctatact

SEQ ID NO: 384243 - DNA, 15 bp, Homo sapiens
tatttttctatacta

SEQ ID NO: 384244 - DNA, 15 bp, Homo sapiens
atttttctatactaa

SEQ ID NO: 384245 - DNA, 15 bp, Homo sapiens
tttttctatactaaa

SEQ ID NO: 384246 - DNA, 15 bp, Homo sapiens
ttttctatactaaat

SEQ ID NO: 384247 - DNA, 15 bp, Homo sapiens
tttctatactaaatg

SEQ ID NO: 384248 - DNA, 15 bp, Homo sapiens
ttctatactaaatgg

SEQ ID NO: 384249 - DNA, 15 bp, Homo sapiens
tctatactaaatggt

SEQ ID NO: 384250 - DNA, 15 bp, Homo sapiens
ctatactaaatggta

SEQ ID NO: 384251 - DNA, 15 bp, Homo sapiens
tatactaaatggtaa

SEQ ID NO: 384252 - DNA, 15 bp, Homo sapiens
atactaaatggtaat

SEQ ID NO: 384253 - DNA, 15 bp, Homo sapiens
tactaaatggtaatg

SEQ ID NO: 384254 - DNA, 15 bp, Homo sapiens
actaaatggtaatgc

SEQ ID NO: 384255 - DNA, 15 bp, Homo sapiens
ctaaatggtaatgct

SEQ ID NO: 384256 - DNA, 15 bp, Homo sapiens
taaatggtaatgctc

SEQ ID NO: 384257 - DNA, 15 bp, Homo sapiens
aaatggtaatgctct

SEQ ID NO: 384258 - DNA, 15 bp, Homo sapiens
aatggtaatgctctt

SEQ ID NO: 384259 - DNA, 15 bp, Homo sapiens
atggtaatgctcttc

SEQ ID NO: 384260 - DNA, 15 bp, Homo sapiens
tggtaatgctcttca

SEQ ID NO: 384261 - DNA, 15 bp, Homo sapiens
ggtaatgctcttcat

SEQ ID NO: 384262 - DNA, 15 bp, Homo sapiens
gtaatgctcttcatg

SEQ ID NO: 384263 - DNA, 15 bp, Homo sapiens
taatgctcttcatgc

SEQ ID NO: 384264 - DNA, 15 bp, Homo sapiens
aatgctcttcatgct

SEQ ID NO: 384265 - DNA, 15 bp, Homo sapiens
atgctcttcatgctg

SEQ ID NO: 384266 - DNA, 15 bp, Homo sapiens
tgctcttcatgctgt

SEQ ID NO: 384267 - DNA, 15 bp, Homo sapiens
gctcttcatgctgtg

SEQ ID NO: 384268 - DNA, 15 bp, Homo sapiens
ctcttcatgctgtga

SEQ ID NO: 384269 - DNA, 15 bp, Homo sapiens
tcttcatgctgtgag

SEQ ID NO: 384270 - DNA, 15 bp, Homo sapiens
cttcatgctgtgagt

SEQ ID NO: 384271 - DNA, 15 bp, Homo sapiens
ttcatgctgtgagtt

SEQ ID NO: 384272 - DNA, 15 bp, Homo sapiens
tcatgctgtgagttc

SEQ ID NO: 384273 - DNA, 15 bp, Homo sapiens
catgctgtgagttct

SEQ ID NO: 384274 - DNA, 15 bp, Homo sapiens
atgctgtgagttctg

SEQ ID NO: 384275 - DNA, 15 bp, Homo sapiens
tgctgtgagttctga

SEQ ID NO: 384276 - DNA, 15 bp, Homo sapiens
gctgtgagttctgaa

SEQ ID NO: 384277 - DNA, 15 bp, Homo sapiens
ctgtgagttctgaag

SEQ ID NO: 384278 - DNA, 15 bp, Homo sapiens
tgtgagttctgaaga

SEQ ID NO: 384279 - DNA, 15 bp, Homo sapiens
gtgagttctgaagaa

SEQ ID NO: 384280 - DNA, 15 bp, Homo sapiens
tgagttctgaagaat

SEQ ID NO: 384281 - DNA, 15 bp, Homo sapiens
gagttctgaagaatt

SEQ ID NO: 384282 - DNA, 15 bp, Homo sapiens
agttctgaagaattg

SEQ ID NO: 384283 - DNA, 15 bp, Homo sapiens
gttctgaagaattgg

SEQ ID NO: 384284 - DNA, 15 bp, Homo sapiens
ttctgaagaattggc

SEQ ID NO: 384285 - DNA, 15 bp, Homo sapiens
tctgaagaattggca

SEQ ID NO: 384286 - DNA, 15 bp, Homo sapiens
ctgaagaattggcag

SEQ ID NO: 384287 - DNA, 15 bp, Homo sapiens
tgaagaattggcagt

SEQ ID NO: 384288 - DNA, 15 bp, Homo sapiens
gaagaattggcagta

SEQ ID NO: 384289 - DNA, 15 bp, Homo sapiens
aagaattggcagtaa

SEQ ID NO: 384290 - DNA, 15 bp, Homo sapiens
agaattggcagtaaa

SEQ ID NO: 384291 - DNA, 15 bp, Homo sapiens
gaattggcagtaaat

SEQ ID NO: 384292 - DNA, 15 bp, Homo sapiens
aattggcagtaaatt

SEQ ID NO: 384293 - DNA, 15 bp, Homo sapiens
attggcagtaaattt

SEQ ID NO: 384294 - DNA, 15 bp, Homo sapiens
ttggcagtaaattta

SEQ ID NO: 384295 - DNA, 15 bp, Homo sapiens
tggcagtaaatttat

SEQ ID NO: 384296 - DNA, 15 bp, Homo sapiens
ggcagtaaatttatt

SEQ ID NO: 384297 - DNA, 15 bp, Homo sapiens
gcagtaaatttattc

SEQ ID NO: 384298 - DNA, 15 bp, Homo sapiens
cagtaaatttattca

SEQ ID NO: 384299 - DNA, 15 bp, Homo sapiens
agtaaatttattcag

SEQ ID NO: 384300 - DNA, 15 bp, Homo sapiens
gtaaatttattcagg

SEQ ID NO: 384301 - DNA, 15 bp, Homo sapiens
taaatttattcaggc

SEQ ID NO: 384302 - DNA, 15 bp, Homo sapiens
aaatttattcaggct

SEQ ID NO: 384303 - DNA, 15 bp, Homo sapiens
aatttattcaggctg

SEQ ID NO: 384304 - DNA, 15 bp, Homo sapiens
atttattcaggctgc

SEQ ID NO: 384305 - DNA, 15 bp, Homo sapiens
tttattcaggctgct

SEQ ID NO: 384306 - DNA, 15 bp, Homo sapiens
ttattcaggctgcta

SEQ ID NO: 384307 - DNA, 15 bp, Homo sapiens
tattcaggctgctat

SEQ ID NO: 384308 - DNA, 15 bp, Homo sapiens
attcaggctgctata

SEQ ID NO: 384309 - DNA, 15 bp, Homo sapiens
ttcaggctgctatac

SEQ ID NO: 384310 - DNA, 15 bp, Homo sapiens
tcaggctgctatact

SEQ ID NO: 384311 - DNA, 15 bp, Homo sapiens
caggctgctatactt

SEQ ID NO: 384312 - DNA, 15 bp, Homo sapiens
aggctgctatacttt

SEQ ID NO: 384313 - DNA, 15 bp, Homo sapiens
ggctgctatactttg

SEQ ID NO: 384314 - DNA, 15 bp, Homo sapiens
gctgctatactttgt

SEQ ID NO: 384315 - DNA, 15 bp, Homo sapiens
ctgctatactttgtg

SEQ ID NO: 384316 - DNA, 15 bp, Homo sapiens
tgctatactttgtga

SEQ ID NO: 384317 - DNA, 15 bp, Homo sapiens
gctatactttgtgag

SEQ ID NO: 384318 - DNA, 15 bp, Homo sapiens
ctatactttgtgaga

SEQ ID NO: 384319 - DNA, 15 bp, Homo sapiens
tatactttgtgagat

SEQ ID NO: 384320 - DNA, 15 bp, Homo sapiens
atactttgtgagatt

SEQ ID NO: 384321 - DNA, 15 bp, Homo sapiens
tactttgtgagattt

SEQ ID NO: 384322 - DNA, 15 bp, Homo sapiens
actttgtgagatttg

SEQ ID NO: 384323 - DNA, 15 bp, Homo sapiens
ctttgtgagatttgg

SEQ ID NO: 384324 - DNA, 15 bp, Homo sapiens
tttgtgagatttggg

SEQ ID NO: 384325 - DNA, 15 bp, Homo sapiens
ttgtgagatttgggg

SEQ ID NO: 384326 - DNA, 15 bp, Homo sapiens
tgtgagatttggggc

SEQ ID NO: 384327 - DNA, 15 bp, Homo sapiens
gtgagatttggggct

SEQ ID NO: 384328 - DNA, 15 bp, Homo sapiens
tgagatttggggctt

SEQ ID NO: 384329 - DNA, 15 bp, Homo sapiens
gagatttggggcttt

SEQ ID NO: 384330 - DNA, 15 bp, Homo sapiens
agatttggggctttg

SEQ ID NO: 384331 - DNA, 15 bp, Homo sapiens
gatttggggctttgt

SEQ ID NO: 384332 - DNA, 15 bp, Homo sapiens
atttggggctttgtt

SEQ ID NO: 384333 - DNA, 15 bp, Homo sapiens
tttggggctttgttt

SEQ ID NO: 384334 - DNA, 15 bp, Homo sapiens
ttggggctttgtttt

SEQ ID NO: 384335 - DNA, 15 bp, Homo sapiens
tggggctttgttttg

SEQ ID NO: 384336 - DNA, 15 bp, Homo sapiens
ggggctttgttttgt

SEQ ID NO: 384337 - DNA, 15 bp, Homo sapiens
gggctttgttttgtg

SEQ ID NO: 384338 - DNA, 15 bp, Homo sapiens
ggctttgttttgtgc

SEQ ID NO: 384339 - DNA, 15 bp, Homo sapiens
gctttgttttgtgcg

SEQ ID NO: 384340 - DNA, 15 bp, Homo sapiens
ctttgttttgtgcgt

SEQ ID NO: 384341 - DNA, 15 bp, Homo sapiens
tttgttttgtgcgta

SEQ ID NO: 384342 - DNA, 15 bp, Homo sapiens
ttgttttgtgcgtat

SEQ ID NO: 384343 - DNA, 15 bp, Homo sapiens
tgttttgtgcgtata

SEQ ID NO: 384344 - DNA, 15 bp, Homo sapiens
gttttgtgcgtataa

SEQ ID NO: 384345 - DNA, 15 bp, Homo sapiens
ttttgtgcgtataaa

SEQ ID NO: 384346 - DNA, 15 bp, Homo sapiens
tttgtgcgtataaat

SEQ ID NO: 384347 - DNA, 15 bp, Homo sapiens
ttgtgcgtataaatt

SEQ ID NO: 384348 - DNA, 15 bp, Homo sapiens
tgtgcgtataaattt

SEQ ID NO: 384349 - DNA, 15 bp, Homo sapiens
gtgcgtataaatttt

SEQ ID NO: 384350 - DNA, 15 bp, Homo sapiens
tgcgtataaattttg

SEQ ID NO: 384351 - DNA, 15 bp, Homo sapiens
gcgtataaattttga

SEQ ID NO: 384352 - DNA, 15 bp, Homo sapiens
cgtataaattttgag

SEQ ID NO: 384353 - DNA, 15 bp, Homo sapiens
gtataaattttgagt

SEQ ID NO: 384354 - DNA, 15 bp, Homo sapiens
tataaattttgagtg

SEQ ID NO: 384355 - DNA, 15 bp, Homo sapiens
ataaattttgagtgt

SEQ ID NO: 384356 - DNA, 15 bp, Homo sapiens
taaattttgagtgtc

SEQ ID NO: 384357 - DNA, 15 bp, Homo sapiens
aaattttgagtgtcg

SEQ ID NO: 384358 - DNA, 15 bp, Homo sapiens
aattttgagtgtcgt

SEQ ID NO: 384359 - DNA, 15 bp, Homo sapiens
attttgagtgtcgtc

SEQ ID NO: 384360 - DNA, 15 bp, Homo sapiens
ttttgagtgtcgtct

SEQ ID NO: 384361 - DNA, 15 bp, Homo sapiens
tttgagtgtcgtctc

SEQ ID NO: 384362 - DNA, 15 bp, Homo sapiens
ttgagtgtcgtctca

SEQ ID NO: 384363 - DNA, 15 bp, Homo sapiens
tgagtgtcgtctcat

SEQ ID NO: 384364 - DNA, 15 bp, Homo sapiens
gagtgtcgtctcatt

SEQ ID NO: 384365 - DNA, 15 bp, Homo sapiens
agtgtcgtctcattg

SEQ ID NO: 384366 - DNA, 15 bp, Homo sapiens
gtgtcgtctcattgt

SEQ ID NO: 384367 - DNA, 15 bp, Homo sapiens
tgtcgtctcattgtc

SEQ ID NO: 384368 - DNA, 15 bp, Homo sapiens
gtcgtctcattgtca

SEQ ID NO: 384369 - DNA, 15 bp, Homo sapiens
tcgtctcattgtcag

SEQ ID NO: 384370 - DNA, 15 bp, Homo sapiens
cgtctcattgtcagg

SEQ ID NO: 384371 - DNA, 15 bp, Homo sapiens
gtctcattgtcaggc

SEQ ID NO: 384372 - DNA, 15 bp, Homo sapiens
tctcattgtcaggca

SEQ ID NO: 384373 - DNA, 15 bp, Homo sapiens
ctcattgtcaggcac

SEQ ID NO: 384374 - DNA, 15 bp, Homo sapiens
tcattgtcaggcact

SEQ ID NO: 384375 - DNA, 15 bp, Homo sapiens
cattgtcaggcactg

SEQ ID NO: 384376 - DNA, 15 bp, Homo sapiens
attgtcaggcactgt

SEQ ID NO: 384377 - DNA, 15 bp, Homo sapiens
ttgtcaggcactgta

SEQ ID NO: 384378 - DNA, 15 bp, Homo sapiens
tgtcaggcactgtac

SEQ ID NO: 384379 - DNA, 15 bp, Homo sapiens
gtcaggcactgtact

SEQ ID NO: 384380 - DNA, 15 bp, Homo sapiens
tcaggcactgtactg

SEQ ID NO: 384381 - DNA, 15 bp, Homo sapiens
caggcactgtactga

SEQ ID NO: 384382 - DNA, 15 bp, Homo sapiens
aggcactgtactgac

SEQ ID NO: 384383 - DNA, 15 bp, Homo sapiens
ggcactgtactgacc

SEQ ID NO: 384384 - DNA, 15 bp, Homo sapiens
gcactgtactgacct

SEQ ID NO: 384385 - DNA, 15 bp, Homo sapiens
cactgtactgacctc

SEQ ID NO: 384386 - DNA, 15 bp, Homo sapiens
actgtactgacctct

SEQ ID NO: 384387 - DNA, 15 bp, Homo sapiens
ctgtactgacctctt

SEQ ID NO: 384388 - DNA, 15 bp, Homo sapiens
tgtactgacctcttc

SEQ ID NO: 384389 - DNA, 15 bp, Homo sapiens
gtactgacctcttca

SEQ ID NO: 384390 - DNA, 15 bp, Homo sapiens
tactgacctcttcac

SEQ ID NO: 384391 - DNA, 15 bp, Homo sapiens
actgacctcttcaca

SEQ ID NO: 384392 - DNA, 15 bp, Homo sapiens
ctgacctcttcacac

SEQ ID NO: 384393 - DNA, 15 bp, Homo sapiens
tgacctcttcacaca

SEQ ID NO: 384394 - DNA, 15 bp, Homo sapiens
gacctcttcacacac

SEQ ID NO: 384395 - DNA, 15 bp, Homo sapiens
acctcttcacacaca

SEQ ID NO: 384396 - DNA, 15 bp, Homo sapiens
cctcttcacacacat

SEQ ID NO: 384397 - DNA, 15 bp, Homo sapiens
ctcttcacacacatc

SEQ ID NO: 384398 - DNA, 15 bp, Homo sapiens
tcttcacacacatca

SEQ ID NO: 384399 - DNA, 15 bp, Homo sapiens
cttcacacacatcat

SEQ ID NO: 384400 - DNA, 15 bp, Homo sapiens
ttcacacacatcatt

SEQ ID NO: 384401 - DNA, 15 bp, Homo sapiens
tcacacacatcattt

SEQ ID NO: 384402 - DNA, 15 bp, Homo sapiens
cacacacatcatttc

SEQ ID NO: 384403 - DNA, 15 bp, Homo sapiens
acacacatcatttca

SEQ ID NO: 384404 - DNA, 15 bp, Homo sapiens
cacacatcatttcat

SEQ ID NO: 384405 - DNA, 15 bp, Homo sapiens
acacatcatttcatt

SEQ ID NO: 384406 - DNA, 15 bp, Homo sapiens
cacatcatttcattt

SEQ ID NO: 384407 - DNA, 15 bp, Homo sapiens
acatcatttcattta

SEQ ID NO: 384408 - DNA, 15 bp, Homo sapiens
catcatttcatttaa

SEQ ID NO: 384409 - DNA, 15 bp, Homo sapiens
atcatttcatttaat

SEQ ID NO: 384410 - DNA, 15 bp, Homo sapiens
tcatttcatttaatc

SEQ ID NO: 384411 - DNA, 15 bp, Homo sapiens
catttcatttaatct

SEQ ID NO: 384412 - DNA, 15 bp, Homo sapiens
atttcatttaatctt

SEQ ID NO: 384413 - DNA, 15 bp, Homo sapiens
tttcatttaatcttc

SEQ ID NO: 384414 - DNA, 15 bp, Homo sapiens
ttcatttaatcttca

SEQ ID NO: 384415 - DNA, 15 bp, Homo sapiens
tcatttaatcttcac

SEQ ID NO: 384416 - DNA, 15 bp, Homo sapiens
catttaatcttcaca

SEQ ID NO: 384417 - DNA, 15 bp, Homo sapiens
atttaatcttcacaa

SEQ ID NO: 384418 - DNA, 15 bp, Homo sapiens
tttaatcttcacaac

SEQ ID NO: 384419 - DNA, 15 bp, Homo sapiens
ttaatcttcacaaca

SEQ ID NO: 384420 - DNA, 15 bp, Homo sapiens
taatcttcacaacaa

SEQ ID NO: 384421 - DNA, 15 bp, Homo sapiens
aatcttcacaacaac

SEQ ID NO: 384422 - DNA, 15 bp, Homo sapiens
atcttcacaacaact

SEQ ID NO: 384423 - DNA, 15 bp, Homo sapiens
tcttcacaacaactg

SEQ ID NO: 384424 - DNA, 15 bp, Homo sapiens
cttcacaacaactgc

SEQ ID NO: 384425 - DNA, 15 bp, Homo sapiens
ttcacaacaactgca

SEQ ID NO: 384426 - DNA, 15 bp, Homo sapiens
tcacaacaactgcag

SEQ ID NO: 384427 - DNA, 15 bp, Homo sapiens
cacaacaactgcagg

SEQ ID NO: 384428 - DNA, 15 bp, Homo sapiens
acaacaactgcagga

SEQ ID NO: 384429 - DNA, 15 bp, Homo sapiens
caacaactgcaggag

SEQ ID NO: 384430 - DNA, 15 bp, Homo sapiens
aacaactgcaggaga

SEQ ID NO: 384431 - DNA, 15 bp, Homo sapiens
acaactgcaggagag

SEQ ID NO: 384432 - DNA, 15 bp, Homo sapiens
caactgcaggagaga

SEQ ID NO: 384433 - DNA, 15 bp, Homo sapiens
aactgcaggagagag

SEQ ID NO: 384434 - DNA, 15 bp, Homo sapiens
actgcaggagagagg

SEQ ID NO: 384435 - DNA, 15 bp, Homo sapiens
ctgcaggagagaggt

SEQ ID NO: 384436 - DNA, 15 bp, Homo sapiens
tgcaggagagaggta

SEQ ID NO: 384437 - DNA, 15 bp, Homo sapiens
gcaggagagaggtag

SEQ ID NO: 384438 - DNA, 15 bp, Homo sapiens
caggagagaggtagc

SEQ ID NO: 384439 - DNA, 15 bp, Homo sapiens
aggagagaggtagca

SEQ ID NO: 384440 - DNA, 15 bp, Homo sapiens
ggagagaggtagcat

SEQ ID NO: 384441 - DNA, 15 bp, Homo sapiens
gagagaggtagcatt

SEQ ID NO: 384442 - DNA, 15 bp, Homo sapiens
agagaggtagcattt

SEQ ID NO: 384443 - DNA, 15 bp, Homo sapiens
gagaggtagcatttt

SEQ ID NO: 384444 - DNA, 15 bp, Homo sapiens
agaggtagcattttc

SEQ ID NO: 384445 - DNA, 15 bp, Homo sapiens
gaggtagcattttca

SEQ ID NO: 384446 - DNA, 15 bp, Homo sapiens
aggtagcattttcat

SEQ ID NO: 384447 - DNA, 15 bp, Homo sapiens
ggtagcattttcatc

SEQ ID NO: 384448 - DNA, 15 bp, Homo sapiens
gtagcattttcatca

SEQ ID NO: 384449 - DNA, 15 bp, Homo sapiens
tagcattttcatcag

SEQ ID NO: 384450 - DNA, 15 bp, Homo sapiens
agcattttcatcagt

SEQ ID NO: 384451 - DNA, 15 bp, Homo sapiens
gcattttcatcagtc

SEQ ID NO: 384452 - DNA, 15 bp, Homo sapiens
cattttcatcagtcc

SEQ ID NO: 384453 - DNA, 15 bp, Homo sapiens
attttcatcagtcct

SEQ ID NO: 384454 - DNA, 15 bp, Homo sapiens
ttttcatcagtccta

SEQ ID NO: 384455 - DNA, 15 bp, Homo sapiens
tttcatcagtcctat

SEQ ID NO: 384456 - DNA, 15 bp, Homo sapiens
ttcatcagtcctatg

SEQ ID NO: 384457 - DNA, 15 bp, Homo sapiens
tcatcagtcctatgt

SEQ ID NO: 384458 - DNA, 15 bp, Homo sapiens
catcagtcctatgtt

SEQ ID NO: 384459 - DNA, 15 bp, Homo sapiens
atcagtcctatgtta

SEQ ID NO: 384460 - DNA, 15 bp, Homo sapiens
tcagtcctatgttaa

SEQ ID NO: 384461 - DNA, 15 bp, Homo sapiens
cagtcctatgttaat

SEQ ID NO: 384462 - DNA, 15 bp, Homo sapiens
agtcctatgttaatg

SEQ ID NO: 384463 - DNA, 15 bp, Homo sapiens
gtcctatgttaatga

SEQ ID NO: 384464 - DNA, 15 bp, Homo sapiens
tcctatgttaatgaa

SEQ ID NO: 384465 - DNA, 15 bp, Homo sapiens
cctatgttaatgaat

SEQ ID NO: 384466 - DNA, 15 bp, Homo sapiens
ctatgttaatgaata

SEQ ID NO: 384467 - DNA, 15 bp, Homo sapiens
tatgttaatgaataa

SEQ ID NO: 384468 - DNA, 15 bp, Homo sapiens
atgttaatgaataaa

SEQ ID NO: 384469 - DNA, 15 bp, Homo sapiens
tgttaatgaataaac

SEQ ID NO: 384470 - DNA, 15 bp, Homo sapiens
gttaatgaataaact

SEQ ID NO: 384471 - DNA, 15 bp, Homo sapiens
ttaatgaataaactg

SEQ ID NO: 384472 - DNA, 15 bp, Homo sapiens
taatgaataaactga

SEQ ID NO: 384473 - DNA, 15 bp, Homo sapiens
aatgaataaactgaa

SEQ ID NO: 384474 - DNA, 15 bp, Homo sapiens
atgaataaactgaag

SEQ ID NO: 384475 - DNA, 15 bp, Homo sapiens
tgaataaactgaagt

SEQ ID NO: 384476 - DNA, 15 bp, Homo sapiens
gaataaactgaagta

SEQ ID NO: 384477 - DNA, 15 bp, Homo sapiens
aataaactgaagtac

SEQ ID NO: 384478 - DNA, 15 bp, Homo sapiens
ataaactgaagtaca

SEQ ID NO: 384479 - DNA, 15 bp, Homo sapiens
taaactgaagtacag

SEQ ID NO: 384480 - DNA, 15 bp, Homo sapiens
aaactgaagtacaga

SEQ ID NO: 384481 - DNA, 15 bp, Homo sapiens
aactgaagtacagag

SEQ ID NO: 384482 - DNA, 15 bp, Homo sapiens
actgaagtacagaga

SEQ ID NO: 384483 - DNA, 15 bp, Homo sapiens
ctgaagtacagagaa

SEQ ID NO: 384484 - DNA, 15 bp, Homo sapiens
tgaagtacagagaag

SEQ ID NO: 384485 - DNA, 15 bp, Homo sapiens
gaagtacagagaagt

SEQ ID NO: 384486 - DNA, 15 bp, Homo sapiens
aagtacagagaagtt

SEQ ID NO: 384487 - DNA, 15 bp, Homo sapiens
agtacagagaagtta

SEQ ID NO: 384488 - DNA, 15 bp, Homo sapiens
gtacagagaagttaa

SEQ ID NO: 384489 - DNA, 15 bp, Homo sapiens
tacagagaagttaag

SEQ ID NO: 384490 - DNA, 15 bp, Homo sapiens
acagagaagttaagg

SEQ ID NO: 384491 - DNA, 15 bp, Homo sapiens
cagagaagttaagga

SEQ ID NO: 384492 - DNA, 15 bp, Homo sapiens
agagaagttaaggaa

SEQ ID NO: 384493 - DNA, 15 bp, Homo sapiens
gagaagttaaggaat

SEQ ID NO: 384494 - DNA, 15 bp, Homo sapiens
agaagttaaggaatt

SEQ ID NO: 384495 - DNA, 15 bp, Homo sapiens
gaagttaaggaatta

SEQ ID NO: 384496 - DNA, 15 bp, Homo sapiens
aagttaaggaattac

SEQ ID NO: 384497 - DNA, 15 bp, Homo sapiens
agttaaggaattact

SEQ ID NO: 384498 - DNA, 15 bp, Homo sapiens
gttaaggaattactc

SEQ ID NO: 384499 - DNA, 15 bp, Homo sapiens
ttaaggaattactca

SEQ ID NO: 384500 - DNA, 15 bp, Homo sapiens
taaggaattactcaa

SEQ ID NO: 384501 - DNA, 15 bp, Homo sapiens
aaggaattactcaag

SEQ ID NO: 384502 - DNA, 15 bp, Homo sapiens
aggaattactcaaga

SEQ ID NO: 384503 - DNA, 15 bp, Homo sapiens
ggaattactcaagac

SEQ ID NO: 384504 - DNA, 15 bp, Homo sapiens
gaattactcaagact

SEQ ID NO: 384505 - DNA, 15 bp, Homo sapiens
aattactcaagacta

SEQ ID NO: 384506 - DNA, 15 bp, Homo sapiens
attactcaagactac

SEQ ID NO: 384507 - DNA, 15 bp, Homo sapiens
ttactcaagactaca

SEQ ID NO: 384508 - DNA, 15 bp, Homo sapiens
tactcaagactacac

SEQ ID NO: 384509 - DNA, 15 bp, Homo sapiens
actcaagactacaca

SEQ ID NO: 384510 - DNA, 15 bp, Homo sapiens
ctcaagactacacag

SEQ ID NO: 384511 - DNA, 15 bp, Homo sapiens
tcaagactacacagc

SEQ ID NO: 384512 - DNA, 15 bp, Homo sapiens
caagactacacagct

SEQ ID NO: 384513 - DNA, 15 bp, Homo sapiens
aagactacacagctt

SEQ ID NO: 384514 - DNA, 15 bp, Homo sapiens
agactacacagctta

SEQ ID NO: 384515 - DNA, 15 bp, Homo sapiens
gactacacagcttat

SEQ ID NO: 384516 - DNA, 15 bp, Homo sapiens
actacacagcttata

SEQ ID NO: 384517 - DNA, 15 bp, Homo sapiens
ctacacagcttataa

SEQ ID NO: 384518 - DNA, 15 bp, Homo sapiens
tacacagcttataat

SEQ ID NO: 384519 - DNA, 15 bp, Homo sapiens
acacagcttataatg

SEQ ID NO: 384520 - DNA, 15 bp, Homo sapiens
cacagcttataatgg

SEQ ID NO: 384521 - DNA, 15 bp, Homo sapiens
acagcttataatggc

SEQ ID NO: 384522 - DNA, 15 bp, Homo sapiens
cagcttataatggca

SEQ ID NO: 384523 - DNA, 15 bp, Homo sapiens
agcttataatggcag

SEQ ID NO: 384524 - DNA, 15 bp, Homo sapiens
gcttataatggcaga

SEQ ID NO: 384525 - DNA, 15 bp, Homo sapiens
cttataatggcagag

SEQ ID NO: 384526 - DNA, 15 bp, Homo sapiens
ttataatggcagagt

SEQ ID NO: 384527 - DNA, 15 bp, Homo sapiens
tataatggcagagtt

SEQ ID NO: 384528 - DNA, 15 bp, Homo sapiens
ataatggcagagttg

SEQ ID NO: 384529 - DNA, 15 bp, Homo sapiens
taatggcagagttgg

SEQ ID NO: 384530 - DNA, 15 bp, Homo sapiens
aatggcagagttggg

SEQ ID NO: 384531 - DNA, 15 bp, Homo sapiens
atggcagagttggga

SEQ ID NO: 384532 - DNA, 15 bp, Homo sapiens
tggcagagttgggat

SEQ ID NO: 384533 - DNA, 15 bp, Homo sapiens
ggcagagttgggatt

SEQ ID NO: 384534 - DNA, 15 bp, Homo sapiens
gcagagttgggattg

SEQ ID NO: 384535 - DNA, 15 bp, Homo sapiens
cagagttgggattgg

SEQ ID NO: 384536 - DNA, 15 bp, Homo sapiens
agagttgggattgga

SEQ ID NO: 384537 - DNA, 15 bp, Homo sapiens
gagttgggattggaa

SEQ ID NO: 384538 - DNA, 15 bp, Homo sapiens
agttgggattggaat

SEQ ID NO: 384539 - DNA, 15 bp, Homo sapiens
gttgggattggaatt

SEQ ID NO: 384540 - DNA, 15 bp, Homo sapiens
ttgggattggaattc

SEQ ID NO: 384541 - DNA, 15 bp, Homo sapiens
tgggattggaattca

SEQ ID NO: 384542 - DNA, 15 bp, Homo sapiens
gggattggaattcaa

SEQ ID NO: 384543 - DNA, 15 bp, Homo sapiens
ggattggaattcaag

SEQ ID NO: 384544 - DNA, 15 bp, Homo sapiens
gattggaattcaagc

SEQ ID NO: 384545 - DNA, 15 bp, Homo sapiens
attggaattcaagct

SEQ ID NO: 384546 - DNA, 15 bp, Homo sapiens
ttggaattcaagctt

SEQ ID NO: 384547 - DNA, 15 bp, Homo sapiens
tggaattcaagcttg

SEQ ID NO: 384548 - DNA, 15 bp, Homo sapiens
ggaattcaagcttga

SEQ ID NO: 384549 - DNA, 15 bp, Homo sapiens
gaattcaagcttgac

SEQ ID NO: 384550 - DNA, 15 bp, Homo sapiens
aattcaagcttgact

SEQ ID NO: 384551 - DNA, 15 bp, Homo sapiens
attcaagcttgactg

SEQ ID NO: 384552 - DNA, 15 bp, Homo sapiens
ttcaagcttgactgg

SEQ ID NO: 384553 - DNA, 15 bp, Homo sapiens
tcaagcttgactggc

SEQ ID NO: 384554 - DNA, 15 bp, Homo sapiens
caagcttgactggca

SEQ ID NO: 384555 - DNA, 15 bp, Homo sapiens
aagcttgactggcaa

SEQ ID NO: 384556 - DNA, 15 bp, Homo sapiens
agcttgactggcaag

SEQ ID NO: 384557 - DNA, 15 bp, Homo sapiens
gcttgactggcaagc

SEQ ID NO: 384558 - DNA, 15 bp, Homo sapiens
cttgactggcaagcc

SEQ ID NO: 384559 - DNA, 15 bp, Homo sapiens
ttgactggcaagcca

SEQ ID NO: 384560 - DNA, 15 bp, Homo sapiens
tgactggcaagccag

SEQ ID NO: 384561 - DNA, 15 bp, Homo sapiens
gactggcaagccagg

SEQ ID NO: 384562 - DNA, 15 bp, Homo sapiens
actggcaagccaggc

SEQ ID NO: 384563 - DNA, 15 bp, Homo sapiens
ctggcaagccaggct

SEQ ID NO: 384564 - DNA, 15 bp, Homo sapiens
tggcaagccaggctc

SEQ ID NO: 384565 - DNA, 15 bp, Homo sapiens
ggcaagccaggctct

SEQ ID NO: 384566 - DNA, 15 bp, Homo sapiens
gcaagccaggctctt

SEQ ID NO: 384567 - DNA, 15 bp, Homo sapiens
caagccaggctctta

SEQ ID NO: 384568 - DNA, 15 bp, Homo sapiens
aagccaggctcttat

SEQ ID NO: 384569 - DNA, 15 bp, Homo sapiens
agccaggctcttatt

SEQ ID NO: 384570 - DNA, 15 bp, Homo sapiens
gccaggctcttattg

SEQ ID NO: 384571 - DNA, 15 bp, Homo sapiens
ccaggctcttattgt

SEQ ID NO: 384572 - DNA, 15 bp, Homo sapiens
caggctcttattgtc

SEQ ID NO: 384573 - DNA, 15 bp, Homo sapiens
aggctcttattgtct

SEQ ID NO: 384574 - DNA, 15 bp, Homo sapiens
ggctcttattgtctc

SEQ ID NO: 384575 - DNA, 15 bp, Homo sapiens
gctcttattgtctct

SEQ ID NO: 384576 - DNA, 15 bp, Homo sapiens
ctcttattgtctcta

SEQ ID NO: 384577 - DNA, 15 bp, Homo sapiens
tcttattgtctctaa

SEQ ID NO: 384578 - DNA, 15 bp, Homo sapiens
cttattgtctctaaa

SEQ ID NO: 384579 - DNA, 15 bp, Homo sapiens
ttattgtctctaaaa

SEQ ID NO: 384580 - DNA, 15 bp, Homo sapiens
tattgtctctaaaaa

SEQ ID NO: 384581 - DNA, 15 bp, Homo sapiens
attgtctctaaaaac

SEQ ID NO: 384582 - DNA, 15 bp, Homo sapiens
ttgtctctaaaaaca

SEQ ID NO: 384583 - DNA, 15 bp, Homo sapiens
tgtctctaaaaacag

SEQ ID NO: 384584 - DNA, 15 bp, Homo sapiens
gtctctaaaaacagt

SEQ ID NO: 384585 - DNA, 15 bp, Homo sapiens
tctctaaaaacagtt

SEQ ID NO: 384586 - DNA, 15 bp, Homo sapiens
ctctaaaaacagttt

SEQ ID NO: 384587 - DNA, 15 bp, Homo sapiens
tctaaaaacagtttc

SEQ ID NO: 384588 - DNA, 15 bp, Homo sapiens
ctaaaaacagtttca

SEQ ID NO: 384589 - DNA, 15 bp, Homo sapiens
taaaaacagtttcat

SEQ ID NO: 384590 - DNA, 15 bp, Homo sapiens
aaaaacagtttcatt

SEQ ID NO: 384591 - DNA, 15 bp, Homo sapiens
aaaacagtttcattt

SEQ ID NO: 384592 - DNA, 15 bp, Homo sapiens
aaacagtttcatttt

SEQ ID NO: 384593 - DNA, 15 bp, Homo sapiens
aacagtttcattttt

SEQ ID NO: 384594 - DNA, 15 bp, Homo sapiens
acagtttcatttttg

SEQ ID NO: 384595 - DNA, 15 bp, Homo sapiens
cagtttcatttttgt

SEQ ID NO: 384596 - DNA, 15 bp, Homo sapiens
agtttcatttttgtt

SEQ ID NO: 384597 - DNA, 15 bp, Homo sapiens
gtttcatttttgttc

SEQ ID NO: 384598 - DNA, 15 bp, Homo sapiens
tttcatttttgttct

SEQ ID NO: 384599 - DNA, 15 bp, Homo sapiens
ttcatttttgttctt

SEQ ID NO: 384600 - DNA, 15 bp, Homo sapiens
tcatttttgttcttt

SEQ ID NO: 384601 - DNA, 15 bp, Homo sapiens
catttttgttctttg

SEQ ID NO: 384602 - DNA, 15 bp, Homo sapiens
atttttgttctttga

SEQ ID NO: 384603 - DNA, 15 bp, Homo sapiens
tttttgttctttgaa

SEQ ID NO: 384604 - DNA, 15 bp, Homo sapiens
ttttgttctttgaat

SEQ ID NO: 384605 - DNA, 15 bp, Homo sapiens
tttgttctttgaatc

SEQ ID NO: 384606 - DNA, 15 bp, Homo sapiens
ttgttctttgaatca

SEQ ID NO: 384607 - DNA, 15 bp, Homo sapiens
tgttctttgaatcag

SEQ ID NO: 384608 - DNA, 15 bp, Homo sapiens
gttctttgaatcaga

SEQ ID NO: 384609 - DNA, 15 bp, Homo sapiens
ttctttgaatcagac

SEQ ID NO: 384610 - DNA, 15 bp, Homo sapiens
tctttgaatcagact

SEQ ID NO: 384611 - DNA, 15 bp, Homo sapiens
ctttgaatcagactg

SEQ ID NO: 384612 - DNA, 15 bp, Homo sapiens
tttgaatcagactgt

SEQ ID NO: 384613 - DNA, 15 bp, Homo sapiens
ttgaatcagactgtc

SEQ ID NO: 384614 - DNA, 15 bp, Homo sapiens
tgaatcagactgtca

SEQ ID NO: 384615 - DNA, 15 bp, Homo sapiens
gaatcagactgtcag

SEQ ID NO: 384616 - DNA, 15 bp, Homo sapiens
aatcagactgtcagc

SEQ ID NO: 384617 - DNA, 15 bp, Homo sapiens
atcagactgtcagcc

SEQ ID NO: 384618 - DNA, 15 bp, Homo sapiens
tcagactgtcagccg

SEQ ID NO: 384619 - DNA, 15 bp, Homo sapiens
cagactgtcagccgt

SEQ ID NO: 384620 - DNA, 15 bp, Homo sapiens
agactgtcagccgtt

SEQ ID NO: 384621 - DNA, 15 bp, Homo sapiens
gactgtcagccgttg

SEQ ID NO: 384622 - DNA, 15 bp, Homo sapiens
actgtcagccgttgc

SEQ ID NO: 384623 - DNA, 15 bp, Homo sapiens
ctgtcagccgttgct

SEQ ID NO: 384624 - DNA, 15 bp, Homo sapiens
tgtcagccgttgctg

SEQ ID NO: 384625 - DNA, 15 bp, Homo sapiens
gtcagccgttgctga

SEQ ID NO: 384626 - DNA, 15 bp, Homo sapiens
tcagccgttgctgac

SEQ ID NO: 384627 - DNA, 15 bp, Homo sapiens
cagccgttgctgaca

SEQ ID NO: 384628 - DNA, 15 bp, Homo sapiens
agccgttgctgacat

SEQ ID NO: 384629 - DNA, 15 bp, Homo sapiens
gccgttgctgacatt

SEQ ID NO: 384630 - DNA, 15 bp, Homo sapiens
ccgttgctgacattc

SEQ ID NO: 384631 - DNA, 15 bp, Homo sapiens
cgttgctgacattct

SEQ ID NO: 384632 - DNA, 15 bp, Homo sapiens
gttgctgacattctt

SEQ ID NO: 384633 - DNA, 15 bp, Homo sapiens
ttgctgacattcttg

SEQ ID NO: 384634 - DNA, 15 bp, Homo sapiens
tgctgacattcttgg

SEQ ID NO: 384635 - DNA, 15 bp, Homo sapiens
gctgacattcttggt

SEQ ID NO: 384636 - DNA, 15 bp, Homo sapiens
ctgacattcttggtg

SEQ ID NO: 384637 - DNA, 15 bp, Homo sapiens
tgacattcttggtga

SEQ ID NO: 384638 - DNA, 15 bp, Homo sapiens
gacattcttggtgac

SEQ ID NO: 384639 - DNA, 15 bp, Homo sapiens
acattcttggtgact

SEQ ID NO: 384640 - DNA, 15 bp, Homo sapiens
cattcttggtgactg

SEQ ID NO: 384641 - DNA, 15 bp, Homo sapiens
attcttggtgactgc

SEQ ID NO: 384642 - DNA, 15 bp, Homo sapiens
ttcttggtgactgct

SEQ ID NO: 384643 - DNA, 15 bp, Homo sapiens
tcttggtgactgctt

SEQ ID NO: 384644 - DNA, 15 bp, Homo sapiens
cttggtgactgcttt

SEQ ID NO: 384645 - DNA, 15 bp, Homo sapiens
ttggtgactgctttg

SEQ ID NO: 384646 - DNA, 15 bp, Homo sapiens
tggtgactgctttgt

SEQ ID NO: 384647 - DNA, 15 bp, Homo sapiens
ggtgactgctttgtg

SEQ ID NO: 384648 - DNA, 15 bp, Homo sapiens
gtgactgctttgtgt

SEQ ID NO: 384649 - DNA, 15 bp, Homo sapiens
tgactgctttgtgta

SEQ ID NO: 384650 - DNA, 15 bp, Homo sapiens
gactgctttgtgtac

SEQ ID NO: 384651 - DNA, 15 bp, Homo sapiens
actgctttgtgtacc

SEQ ID NO: 384652 - DNA, 15 bp, Homo sapiens
ctgctttgtgtaccc

SEQ ID NO: 384653 - DNA, 15 bp, Homo sapiens
tgctttgtgtacccg

SEQ ID NO: 384654 - DNA, 15 bp, Homo sapiens
gctttgtgtacccgc

SEQ ID NO: 384655 - DNA, 15 bp, Homo sapiens
ctttgtgtacccgcc

SEQ ID NO: 384656 - DNA, 15 bp, Homo sapiens
tttgtgtacccgcct

SEQ ID NO: 384657 - DNA, 15 bp, Homo sapiens
ttgtgtacccgcctc

SEQ ID NO: 384658 - DNA, 15 bp, Homo sapiens
tgtgtacccgcctct

SEQ ID NO: 384659 - DNA, 15 bp, Homo sapiens
gtgtacccgcctctc

SEQ ID NO: 384660 - DNA, 15 bp, Homo sapiens
tgtacccgcctctca

SEQ ID NO: 384661 - DNA, 15 bp, Homo sapiens
gtacccgcctctcag

SEQ ID NO: 384662 - DNA, 15 bp, Homo sapiens
tacccgcctctcagt

SEQ ID NO: 384663 - DNA, 15 bp, Homo sapiens
acccgcctctcagtt

SEQ ID NO: 384664 - DNA, 15 bp, Homo sapiens
cccgcctctcagttc

SEQ ID NO: 384665 - DNA, 15 bp, Homo sapiens
ccgcctctcagttct

SEQ ID NO: 384666 - DNA, 15 bp, Homo sapiens
cgcctctcagttctg

SEQ ID NO: 384667 - DNA, 15 bp, Homo sapiens
gcctctcagttctgt

SEQ ID NO: 384668 - DNA, 15 bp, Homo sapiens
cctctcagttctgtc

SEQ ID NO: 384669 - DNA, 15 bp, Homo sapiens
ctctcagttctgtct

SEQ ID NO: 384670 - DNA, 15 bp, Homo sapiens
tctcagttctgtctg

SEQ ID NO: 384671 - DNA, 15 bp, Homo sapiens
ctcagttctgtctgt

SEQ ID NO: 384672 - DNA, 15 bp, Homo sapiens
tcagttctgtctgta

SEQ ID NO: 384673 - DNA, 15 bp, Homo sapiens
cagttctgtctgtaa

SEQ ID NO: 384674 - DNA, 15 bp, Homo sapiens
agttctgtctgtaat

SEQ ID NO: 384675 - DNA, 15 bp, Homo sapiens
gttctgtctgtaatt

SEQ ID NO: 384676 - DNA, 15 bp, Homo sapiens
ttctgtctgtaattc

SEQ ID NO: 384677 - DNA, 15 bp, Homo sapiens
tctgtctgtaattcc

SEQ ID NO: 384678 - DNA, 15 bp, Homo sapiens
ctgtctgtaattccg

SEQ ID NO: 384679 - DNA, 15 bp, Homo sapiens
tgtctgtaattccgc

SEQ ID NO: 384680 - DNA, 15 bp, Homo sapiens
gtctgtaattccgct

SEQ ID NO: 384681 - DNA, 15 bp, Homo sapiens
tctgtaattccgctt

SEQ ID NO: 384682 - DNA, 15 bp, Homo sapiens
ctgtaattccgctta

SEQ ID NO: 384683 - DNA, 15 bp, Homo sapiens
tgtaattccgcttac

SEQ ID NO: 384684 - DNA, 15 bp, Homo sapiens
gtaattccgcttact

SEQ ID NO: 384685 - DNA, 15 bp, Homo sapiens
taattccgcttactg

SEQ ID NO: 384686 - DNA, 15 bp, Homo sapiens
aattccgcttactga

SEQ ID NO: 384687 - DNA, 15 bp, Homo sapiens
attccgcttactgat

SEQ ID NO: 384688 - DNA, 15 bp, Homo sapiens
ttccgcttactgatt

SEQ ID NO: 384689 - DNA, 15 bp, Homo sapiens
tccgcttactgattc

SEQ ID NO: 384690 - DNA, 15 bp, Homo sapiens
ccgcttactgattct

SEQ ID NO: 384691 - DNA, 15 bp, Homo sapiens
cgcttactgattctt

SEQ ID NO: 384692 - DNA, 15 bp, Homo sapiens
gcttactgattctta

SEQ ID NO: 384693 - DNA, 15 bp, Homo sapiens
cttactgattcttat

SEQ ID NO: 384694 - DNA, 15 bp, Homo sapiens
ttactgattcttatc

SEQ ID NO: 384695 - DNA, 15 bp, Homo sapiens
tactgattcttatct

SEQ ID NO: 384696 - DNA, 15 bp, Homo sapiens
actgattcttatctg

SEQ ID NO: 384697 - DNA, 15 bp, Homo sapiens
ctgattcttatctgt

SEQ ID NO: 384698 - DNA, 15 bp, Homo sapiens
tgattcttatctgtg

SEQ ID NO: 384699 - DNA, 15 bp, Homo sapiens
gattcttatctgtgt

SEQ ID NO: 384700 - DNA, 15 bp, Homo sapiens
attcttatctgtgtt

SEQ ID NO: 384701 - DNA, 15 bp, Homo sapiens
ttcttatctgtgttg

SEQ ID NO: 384702 - DNA, 15 bp, Homo sapiens
tcttatctgtgttga

SEQ ID NO: 384703 - DNA, 15 bp, Homo sapiens
cttatctgtgttgag

SEQ ID NO: 384704 - DNA, 15 bp, Homo sapiens
ttatctgtgttgagt

SEQ ID NO: 384705 - DNA, 15 bp, Homo sapiens
tatctgtgttgagtt

SEQ ID NO: 384706 - DNA, 15 bp, Homo sapiens
atctgtgttgagttt

SEQ ID NO: 384707 - DNA, 15 bp, Homo sapiens
tctgtgttgagttta

SEQ ID NO: 384708 - DNA, 15 bp, Homo sapiens
ctgtgttgagtttag

SEQ ID NO: 384709 - DNA, 15 bp, Homo sapiens
tgtgttgagtttaga

SEQ ID NO: 384710 - DNA, 15 bp, Homo sapiens
gtgttgagtttagaa

SEQ ID NO: 384711 - DNA, 15 bp, Homo sapiens
tgttgagtttagaag

SEQ ID NO: 384712 - DNA, 15 bp, Homo sapiens
gttgagtttagaagc

SEQ ID NO: 384713 - DNA, 15 bp, Homo sapiens
ttgagtttagaagcc

SEQ ID NO: 384714 - DNA, 15 bp, Homo sapiens
tgagtttagaagcca

SEQ ID NO: 384715 - DNA, 15 bp, Homo sapiens
gagtttagaagccat

SEQ ID NO: 384716 - DNA, 15 bp, Homo sapiens
agtttagaagccata

SEQ ID NO: 384717 - DNA, 15 bp, Homo sapiens
gtttagaagccatat

SEQ ID NO: 384718 - DNA, 15 bp, Homo sapiens
tttagaagccatatc

SEQ ID NO: 384719 - DNA, 15 bp, Homo sapiens
ttagaagccatatca

SEQ ID NO: 384720 - DNA, 15 bp, Homo sapiens
tagaagccatatcag

SEQ ID NO: 384721 - DNA, 15 bp, Homo sapiens
agaagccatatcaga

SEQ ID NO: 384722 - DNA, 15 bp, Homo sapiens
gaagccatatcagat

SEQ ID NO: 384723 - DNA, 15 bp, Homo sapiens
aagccatatcagatg

SEQ ID NO: 384724 - DNA, 15 bp, Homo sapiens
agccatatcagatga

SEQ ID NO: 384725 - DNA, 15 bp, Homo sapiens
gccatatcagatgaa

SEQ ID NO: 384726 - DNA, 15 bp, Homo sapiens
ccatatcagatgaaa

SEQ ID NO: 384727 - DNA, 15 bp, Homo sapiens
catatcagatgaaag

SEQ ID NO: 384728 - DNA, 15 bp, Homo sapiens
atatcagatgaaaga

SEQ ID NO: 384729 - DNA, 15 bp, Homo sapiens
tatcagatgaaagat

SEQ ID NO: 384730 - DNA, 15 bp, Homo sapiens
atcagatgaaagata

SEQ ID NO: 384731 - DNA, 15 bp, Homo sapiens
tcagatgaaagatac

SEQ ID NO: 384732 - DNA, 15 bp, Homo sapiens
cagatgaaagatacg

SEQ ID NO: 384733 - DNA, 15 bp, Homo sapiens
agatgaaagatacgg

SEQ ID NO: 384734 - DNA, 15 bp, Homo sapiens
gatgaaagatacggg

SEQ ID NO: 384735 - DNA, 15 bp, Homo sapiens
atgaaagatacgggg

SEQ ID NO: 384736 - DNA, 15 bp, Homo sapiens
tgaaagatacggggc

SEQ ID NO: 384737 - DNA, 15 bp, Homo sapiens
gaaagatacggggcc

SEQ ID NO: 384738 - DNA, 15 bp, Homo sapiens
aaagatacggggcct

SEQ ID NO: 384739 - DNA, 15 bp, Homo sapiens
aagatacggggcctt

SEQ ID NO: 384740 - DNA, 15 bp, Homo sapiens
agatacggggccttt

SEQ ID NO: 384741 - DNA, 15 bp, Homo sapiens
gatacggggcctttt

SEQ ID NO: 384742 - DNA, 15 bp, Homo sapiens
atacggggccttttt

SEQ ID NO: 384743 - DNA, 15 bp, Homo sapiens
tacggggcctttttt

SEQ ID NO: 384744 - DNA, 15 bp, Homo sapiens
acggggcctttttta

SEQ ID NO: 384745 - DNA, 15 bp, Homo sapiens
cggggccttttttat

SEQ ID NO: 384746 - DNA, 15 bp, Homo sapiens
ggggccttttttatg

SEQ ID NO: 384747 - DNA, 15 bp, Homo sapiens
gggccttttttatgc

SEQ ID NO: 384748 - DNA, 15 bp, Homo sapiens
ggccttttttatgca

SEQ ID NO: 384749 - DNA, 15 bp, Homo sapiens
gccttttttatgcat

SEQ ID NO: 384750 - DNA, 15 bp, Homo sapiens
ccttttttatgcata

SEQ ID NO: 384751 - DNA, 15 bp, Homo sapiens
cttttttatgcataa

SEQ ID NO: 384752 - DNA, 15 bp, Homo sapiens
ttttttatgcataat

SEQ ID NO: 384753 - DNA, 15 bp, Homo sapiens
tttttatgcataatg

SEQ ID NO: 384754 - DNA, 15 bp, Homo sapiens
ttttatgcataatgt

SEQ ID NO: 384755 - DNA, 15 bp, Homo sapiens
tttatgcataatgta

SEQ ID NO: 384756 - DNA, 15 bp, Homo sapiens
ttatgcataatgtaa

SEQ ID NO: 384757 - DNA, 15 bp, Homo sapiens
tatgcataatgtaat

SEQ ID NO: 384758 - DNA, 15 bp, Homo sapiens
atgcataatgtaatg

SEQ ID NO: 384759 - DNA, 15 bp, Homo sapiens
tgcataatgtaatgc

SEQ ID NO: 384760 - DNA, 15 bp, Homo sapiens
gcataatgtaatgca

SEQ ID NO: 384761 - DNA, 15 bp, Homo sapiens
cataatgtaatgcac

SEQ ID NO: 384762 - DNA, 15 bp, Homo sapiens
ataatgtaatgcact

SEQ ID NO: 384763 - DNA, 15 bp, Homo sapiens
taatgtaatgcactc

SEQ ID NO: 384764 - DNA, 15 bp, Homo sapiens
aatgtaatgcactcc

SEQ ID NO: 384765 - DNA, 15 bp, Homo sapiens
atgtaatgcactcca

SEQ ID NO: 384766 - DNA, 15 bp, Homo sapiens
tgtaatgcactccag

SEQ ID NO: 384767 - DNA, 15 bp, Homo sapiens
gtaatgcactccagt

SEQ ID NO: 384768 - DNA, 15 bp, Homo sapiens
taatgcactccagta

SEQ ID NO: 384769 - DNA, 15 bp, Homo sapiens
aatgcactccagtac

SEQ ID NO: 384770 - DNA, 15 bp, Homo sapiens
atgcactccagtacg

SEQ ID NO: 384771 - DNA, 15 bp, Homo sapiens
tgcactccagtacgt

SEQ ID NO: 384772 - DNA, 15 bp, Homo sapiens
gcactccagtacgtg

SEQ ID NO: 384773 - DNA, 15 bp, Homo sapiens
cactccagtacgtgg

SEQ ID NO: 384774 - DNA, 15 bp, Homo sapiens
actccagtacgtggc

SEQ ID NO: 384775 - DNA, 15 bp, Homo sapiens
ctccagtacgtggcc

SEQ ID NO: 384776 - DNA, 15 bp, Homo sapiens
tccagtacgtggcca

SEQ ID NO: 384777 - DNA, 15 bp, Homo sapiens
ccagtacgtggccat

SEQ ID NO: 384778 - DNA, 15 bp, Homo sapiens
cagtacgtggccatc

SEQ ID NO: 384779 - DNA, 15 bp, Homo sapiens
agtacgtggccatca

SEQ ID NO: 384780 - DNA, 15 bp, Homo sapiens
gtacgtggccatcac

SEQ ID NO: 384781 - DNA, 15 bp, Homo sapiens
tacgtggccatcaca

SEQ ID NO: 384782 - DNA, 15 bp, Homo sapiens
acgtggccatcacac

SEQ ID NO: 384783 - DNA, 15 bp, Homo sapiens
cgtggccatcacacc

SEQ ID NO: 384784 - DNA, 15 bp, Homo sapiens
gtggccatcacaccc

SEQ ID NO: 384785 - DNA, 15 bp, Homo sapiens
tggccatcacacccc

SEQ ID NO: 384786 - DNA, 15 bp, Homo sapiens
ggccatcacaccccg

SEQ ID NO: 384787 - DNA, 15 bp, Homo sapiens
gccatcacaccccgt

SEQ ID NO: 384788 - DNA, 15 bp, Homo sapiens
ccatcacaccccgtc

SEQ ID NO: 384789 - DNA, 15 bp, Homo sapiens
catcacaccccgtct

SEQ ID NO: 384790 - DNA, 15 bp, Homo sapiens
atcacaccccgtcta

SEQ ID NO: 384791 - DNA, 15 bp, Homo sapiens
tcacaccccgtctaa

SEQ ID NO: 384792 - DNA, 15 bp, Homo sapiens
cacaccccgtctaat

SEQ ID NO: 384793 - DNA, 15 bp, Homo sapiens
acaccccgtctaatg

SEQ ID NO: 384794 - DNA, 15 bp, Homo sapiens
caccccgtctaatgg

SEQ ID NO: 384795 - DNA, 15 bp, Homo sapiens
accccgtctaatggc

SEQ ID NO: 384796 - DNA, 15 bp, Homo sapiens
ccccgtctaatggct

SEQ ID NO: 384797 - DNA, 15 bp, Homo sapiens
cccgtctaatggctg

SEQ ID NO: 384798 - DNA, 15 bp, Homo sapiens
ccgtctaatggctgc

SEQ ID NO: 384799 - DNA, 15 bp, Homo sapiens
cgtctaatggctgct

SEQ ID NO: 384800 - DNA, 15 bp, Homo sapiens
gtctaatggctgctg

SEQ ID NO: 384801 - DNA, 15 bp, Homo sapiens
tctaatggctgctga

SEQ ID NO: 384802 - DNA, 15 bp, Homo sapiens
ctaatggctgctgag

SEQ ID NO: 384803 - DNA, 15 bp, Homo sapiens
taatggctgctgaga

SEQ ID NO: 384804 - DNA, 15 bp, Homo sapiens
aatggctgctgagag

SEQ ID NO: 384805 - DNA, 15 bp, Homo sapiens
atggctgctgagagg

SEQ ID NO: 384806 - DNA, 15 bp, Homo sapiens
tggctgctgagaggc

SEQ ID NO: 384807 - DNA, 15 bp, Homo sapiens
ggctgctgagaggcc

SEQ ID NO: 384808 - DNA, 15 bp, Homo sapiens
gctgctgagaggcct

SEQ ID NO: 384809 - DNA, 15 bp, Homo sapiens
ctgctgagaggcctt

SEQ ID NO: 384810 - DNA, 15 bp, Homo sapiens
tgctgagaggccttt

SEQ ID NO: 384811 - DNA, 15 bp, Homo sapiens
gctgagaggcctttt

SEQ ID NO: 384812 - DNA, 15 bp, Homo sapiens
ctgagaggccttttt

SEQ ID NO: 384813 - DNA, 15 bp, Homo sapiens
tgagaggccttttta

SEQ ID NO: 384814 - DNA, 15 bp, Homo sapiens
gagaggcctttttac

SEQ ID NO: 384815 - DNA, 15 bp, Homo sapiens
agaggcctttttacc

SEQ ID NO: 384816 - DNA, 15 bp, Homo sapiens
gaggcctttttacca

SEQ ID NO: 384817 - DNA, 15 bp, Homo sapiens
aggcctttttaccat

SEQ ID NO: 384818 - DNA, 15 bp, Homo sapiens
ggcctttttaccatg

SEQ ID NO: 384819 - DNA, 15 bp, Homo sapiens
gcctttttaccatgg

SEQ ID NO: 384820 - DNA, 15 bp, Homo sapiens
cctttttaccatggc

SEQ ID NO: 384821 - DNA, 15 bp, Homo sapiens
ctttttaccatggct

SEQ ID NO: 384822 - DNA, 15 bp, Homo sapiens
tttttaccatggctg

SEQ ID NO: 384823 - DNA, 15 bp, Homo sapiens
ttttaccatggctgc

SEQ ID NO: 384824 - DNA, 15 bp, Homo sapiens
tttaccatggctgcc

SEQ ID NO: 384825 - DNA, 15 bp, Homo sapiens
ttaccatggctgccc

SEQ ID NO: 384826 - DNA, 15 bp, Homo sapiens
taccatggctgccct

SEQ ID NO: 384827 - DNA, 15 bp, Homo sapiens
accatggctgccctc

SEQ ID NO: 384828 - DNA, 15 bp, Homo sapiens
ccatggctgccctct

SEQ ID NO: 384829 - DNA, 15 bp, Homo sapiens
catggctgccctctt

SEQ ID NO: 384830 - DNA, 15 bp, Homo sapiens
atggctgccctctta

SEQ ID NO: 384831 - DNA, 15 bp, Homo sapiens
tggctgccctcttat

SEQ ID NO: 384832 - DNA, 15 bp, Homo sapiens
ggctgccctcttatc

SEQ ID NO: 384833 - DNA, 15 bp, Homo sapiens
gctgccctcttatct

SEQ ID NO: 384834 - DNA, 15 bp, Homo sapiens
ctgccctcttatctt

SEQ ID NO: 384835 - DNA, 15 bp, Homo sapiens
tgccctcttatcttc

SEQ ID NO: 384836 - DNA, 15 bp, Homo sapiens
gccctcttatcttcc

SEQ ID NO: 384837 - DNA, 15 bp, Homo sapiens
ccctcttatcttcca

SEQ ID NO: 384838 - DNA, 15 bp, Homo sapiens
cctcttatcttccag

SEQ ID NO: 384839 - DNA, 15 bp, Homo sapiens
ctcttatcttccagc

SEQ ID NO: 384840 - DNA, 15 bp, Homo sapiens
tcttatcttccagcc

SEQ ID NO: 384841 - DNA, 15 bp, Homo sapiens
cttatcttccagcct

SEQ ID NO: 384842 - DNA, 15 bp, Homo sapiens
ttatcttccagcctg

SEQ ID NO: 384843 - DNA, 15 bp, Homo sapiens
tatcttccagcctgt

SEQ ID NO: 384844 - DNA, 15 bp, Homo sapiens
atcttccagcctgtt

SEQ ID NO: 384845 - DNA, 15 bp, Homo sapiens
tcttccagcctgttc

SEQ ID NO: 384846 - DNA, 15 bp, Homo sapiens
cttccagcctgttct

SEQ ID NO: 384847 - DNA, 15 bp, Homo sapiens
ttccagcctgttctt

SEQ ID NO: 384848 - DNA, 15 bp, Homo sapiens
tccagcctgttcttt

SEQ ID NO: 384849 - DNA, 15 bp, Homo sapiens
ccagcctgttcttta

SEQ ID NO: 384850 - DNA, 15 bp, Homo sapiens
cagcctgttctttat

SEQ ID NO: 384851 - DNA, 15 bp, Homo sapiens
agcctgttctttata

SEQ ID NO: 384852 - DNA, 15 bp, Homo sapiens
gcctgttctttatat

SEQ ID NO: 384853 - DNA, 15 bp, Homo sapiens
cctgttctttatata

SEQ ID NO: 384854 - DNA, 15 bp, Homo sapiens
ctgttctttatatac

SEQ ID NO: 384855 - DNA, 15 bp, Homo sapiens
tgttctttatataca

SEQ ID NO: 384856 - DNA, 15 bp, Homo sapiens
gttctttatatacat

SEQ ID NO: 384857 - DNA, 15 bp, Homo sapiens
ttctttatatacatc

SEQ ID NO: 384858 - DNA, 15 bp, Homo sapiens
tctttatatacatca

SEQ ID NO: 384859 - DNA, 15 bp, Homo sapiens
ctttatatacatcat

SEQ ID NO: 384860 - DNA, 15 bp, Homo sapiens
tttatatacatcatt

SEQ ID NO: 384861 - DNA, 15 bp, Homo sapiens
ttatatacatcattg

SEQ ID NO: 384862 - DNA, 15 bp, Homo sapiens
tatatacatcattgt

SEQ ID NO: 384863 - DNA, 15 bp, Homo sapiens
atatacatcattgtc

SEQ ID NO: 384864 - DNA, 15 bp, Homo sapiens
tatacatcattgtca

SEQ ID NO: 384865 - DNA, 15 bp, Homo sapiens
atacatcattgtcag

SEQ ID NO: 384866 - DNA, 15 bp, Homo sapiens
tacatcattgtcagc

SEQ ID NO: 384867 - DNA, 15 bp, Homo sapiens
acatcattgtcagcc

SEQ ID NO: 384868 - DNA, 15 bp, Homo sapiens
catcattgtcagcca

SEQ ID NO: 384869 - DNA, 15 bp, Homo sapiens
atcattgtcagccaa

SEQ ID NO: 384870 - DNA, 15 bp, Homo sapiens
tcattgtcagccaaa

SEQ ID NO: 384871 - DNA, 15 bp, Homo sapiens
cattgtcagccaaat

SEQ ID NO: 384872 - DNA, 15 bp, Homo sapiens
attgtcagccaaatt

SEQ ID NO: 384873 - DNA, 15 bp, Homo sapiens
ttgtcagccaaattc

SEQ ID NO: 384874 - DNA, 15 bp, Homo sapiens
tgtcagccaaattct

SEQ ID NO: 384875 - DNA, 15 bp, Homo sapiens
gtcagccaaattctg

SEQ ID NO: 384876 - DNA, 15 bp, Homo sapiens
tcagccaaattctgg

SEQ ID NO: 384877 - DNA, 15 bp, Homo sapiens
cagccaaattctgga

SEQ ID NO: 384878 - DNA, 15 bp, Homo sapiens
agccaaattctggag

SEQ ID NO: 384879 - DNA, 15 bp, Homo sapiens
gccaaattctggagg

SEQ ID NO: 384880 - DNA, 15 bp, Homo sapiens
ccaaattctggaggg

SEQ ID NO: 384881 - DNA, 15 bp, Homo sapiens
caaattctggagggg

SEQ ID NO: 384882 - DNA, 15 bp, Homo sapiens
aaattctggaggggt

SEQ ID NO: 384883 - DNA, 15 bp, Homo sapiens
aattctggaggggtg

SEQ ID NO: 384884 - DNA, 15 bp, Homo sapiens
attctggaggggtga

SEQ ID NO: 384885 - DNA, 15 bp, Homo sapiens
ttctggaggggtgaa

SEQ ID NO: 384886 - DNA, 15 bp, Homo sapiens
tctggaggggtgaag

SEQ ID NO: 384887 - DNA, 15 bp, Homo sapiens
ctggaggggtgaagg

SEQ ID NO: 384888 - DNA, 15 bp, Homo sapiens
tggaggggtgaaggg

SEQ ID NO: 384889 - DNA, 15 bp, Homo sapiens
ggaggggtgaagggt

SEQ ID NO: 384890 - DNA, 15 bp, Homo sapiens
gaggggtgaagggtt

SEQ ID NO: 384891 - DNA, 15 bp, Homo sapiens
aggggtgaagggttg

SEQ ID NO: 384892 - DNA, 15 bp, Homo sapiens
ggggtgaagggttgt

SEQ ID NO: 384893 - DNA, 15 bp, Homo sapiens
gggtgaagggttgtt

SEQ ID NO: 384894 - DNA, 15 bp, Homo sapiens
ggtgaagggttgtta

SEQ ID NO: 384895 - DNA, 15 bp, Homo sapiens
gtgaagggttgttat

SEQ ID NO: 384896 - DNA, 15 bp, Homo sapiens
tgaagggttgttata

SEQ ID NO: 384897 - DNA, 15 bp, Homo sapiens
gaagggttgttatat

SEQ ID NO: 384898 - DNA, 15 bp, Homo sapiens
aagggttgttatatt

SEQ ID NO: 384899 - DNA, 15 bp, Homo sapiens
agggttgttatattt

SEQ ID NO: 384900 - DNA, 15 bp, Homo sapiens
gggttgttatatttg

SEQ ID NO: 384901 - DNA, 15 bp, Homo sapiens
ggttgttatatttgc

SEQ ID NO: 384902 - DNA, 15 bp, Homo sapiens
gttgttatatttgca

SEQ ID NO: 384903 - DNA, 15 bp, Homo sapiens
ttgttatatttgcac

SEQ ID NO: 384904 - DNA, 15 bp, Homo sapiens
tgttatatttgcaca

SEQ ID NO: 384905 - DNA, 15 bp, Homo sapiens
gttatatttgcacat

SEQ ID NO: 384906 - DNA, 15 bp, Homo sapiens
ttatatttgcacatg

SEQ ID NO: 384907 - DNA, 15 bp, Homo sapiens
tatatttgcacatgg

SEQ ID NO: 384908 - DNA, 15 bp, Homo sapiens
atatttgcacatgga

SEQ ID NO: 384909 - DNA, 15 bp, Homo sapiens
tatttgcacatggaa

SEQ ID NO: 384910 - DNA, 15 bp, Homo sapiens
atttgcacatggaat

SEQ ID NO: 384911 - DNA, 15 bp, Homo sapiens
tttgcacatggaata

SEQ ID NO: 384912 - DNA, 15 bp, Homo sapiens
ttgcacatggaatac

SEQ ID NO: 384913 - DNA, 15 bp, Homo sapiens
tgcacatggaatact

SEQ ID NO: 384914 - DNA, 15 bp, Homo sapiens
gcacatggaatactg

SEQ ID NO: 384915 - DNA, 15 bp, Homo sapiens
cacatggaatactgt

SEQ ID NO: 384916 - DNA, 15 bp, Homo sapiens
acatggaatactgtg

SEQ ID NO: 384917 - DNA, 15 bp, Homo sapiens
catggaatactgtgc

SEQ ID NO: 384918 - DNA, 15 bp, Homo sapiens
atggaatactgtgca

SEQ ID NO: 384919 - DNA, 15 bp, Homo sapiens
tggaatactgtgcag

SEQ ID NO: 384920 - DNA, 15 bp, Homo sapiens
ggaatactgtgcagc

SEQ ID NO: 384921 - DNA, 15 bp, Homo sapiens
gaatactgtgcagca

SEQ ID NO: 384922 - DNA, 15 bp, Homo sapiens
aatactgtgcagcat

SEQ ID NO: 384923 - DNA, 15 bp, Homo sapiens
atactgtgcagcata

SEQ ID NO: 384924 - DNA, 15 bp, Homo sapiens
tactgtgcagcataa

SEQ ID NO: 384925 - DNA, 15 bp, Homo sapiens
actgtgcagcataat

SEQ ID NO: 384926 - DNA, 15 bp, Homo sapiens
ctgtgcagcataatg

SEQ ID NO: 384927 - DNA, 15 bp, Homo sapiens
tgtgcagcataatgt

SEQ ID NO: 384928 - DNA, 15 bp, Homo sapiens
gtgcagcataatgtg

SEQ ID NO: 384929 - DNA, 15 bp, Homo sapiens
tgcagcataatgtgt

SEQ ID NO: 384930 - DNA, 15 bp, Homo sapiens
gcagcataatgtgtg

SEQ ID NO: 384931 - DNA, 15 bp, Homo sapiens
cagcataatgtgtga

SEQ ID NO: 384932 - DNA, 15 bp, Homo sapiens
agcataatgtgtgaa

SEQ ID NO: 384933 - DNA, 15 bp, Homo sapiens
gcataatgtgtgaag

SEQ ID NO: 384934 - DNA, 15 bp, Homo sapiens
cataatgtgtgaagt

SEQ ID NO: 384935 - DNA, 15 bp, Homo sapiens
ataatgtgtgaagtt

SEQ ID NO: 384936 - DNA, 15 bp, Homo sapiens
taatgtgtgaagttc

SEQ ID NO: 384937 - DNA, 15 bp, Homo sapiens
aatgtgtgaagttca

SEQ ID NO: 384938 - DNA, 15 bp, Homo sapiens
atgtgtgaagttcaa

SEQ ID NO: 384939 - DNA, 15 bp, Homo sapiens
tgtgtgaagttcaat

SEQ ID NO: 384940 - DNA, 15 bp, Homo sapiens
gtgtgaagttcaata

SEQ ID NO: 384941 - DNA, 15 bp, Homo sapiens
tgtgaagttcaatat

SEQ ID NO: 384942 - DNA, 15 bp, Homo sapiens
gtgaagttcaatatc

SEQ ID NO: 384943 - DNA, 15 bp, Homo sapiens
tgaagttcaatatca

SEQ ID NO: 384944 - DNA, 15 bp, Homo sapiens
gaagttcaatatcag

SEQ ID NO: 384945 - DNA, 15 bp, Homo sapiens
aagttcaatatcagc

SEQ ID NO: 384946 - DNA, 15 bp, Homo sapiens
agttcaatatcagct

SEQ ID NO: 384947 - DNA, 15 bp, Homo sapiens
gttcaatatcagctt

SEQ ID NO: 384948 - DNA, 15 bp, Homo sapiens
ttcaatatcagcttt

SEQ ID NO: 384949 - DNA, 15 bp, Homo sapiens
tcaatatcagctttc

SEQ ID NO: 384950 - DNA, 15 bp, Homo sapiens
caatatcagctttca

SEQ ID NO: 384951 - DNA, 15 bp, Homo sapiens
aatatcagctttcaa

SEQ ID NO: 384952 - DNA, 15 bp, Homo sapiens
atatcagctttcaaa

SEQ ID NO: 384953 - DNA, 15 bp, Homo sapiens
tatcagctttcaaag

SEQ ID NO: 384954 - DNA, 15 bp, Homo sapiens
atcagctttcaaagg

SEQ ID NO: 384955 - DNA, 15 bp, Homo sapiens
tcagctttcaaagga

SEQ ID NO: 384956 - DNA, 15 bp, Homo sapiens
cagctttcaaaggaa

SEQ ID NO: 384957 - DNA, 15 bp, Homo sapiens
agctttcaaaggaaa

SEQ ID NO: 384958 - DNA, 15 bp, Homo sapiens
gctttcaaaggaaat

SEQ ID NO: 384959 - DNA, 15 bp, Homo sapiens
ctttcaaaggaaatg

SEQ ID NO: 384960 - DNA, 15 bp, Homo sapiens
tttcaaaggaaatgt

SEQ ID NO: 384961 - DNA, 15 bp, Homo sapiens
ttcaaaggaaatgtt

SEQ ID NO: 384962 - DNA, 15 bp, Homo sapiens
tcaaaggaaatgttt

SEQ ID NO: 384963 - DNA, 15 bp, Homo sapiens
caaaggaaatgtttt

SEQ ID NO: 384964 - DNA, 15 bp, Homo sapiens
aaaggaaatgttttg

SEQ ID NO: 384965 - DNA, 15 bp, Homo sapiens
aaggaaatgttttgt

SEQ ID NO: 384966 - DNA, 15 bp, Homo sapiens
aggaaatgttttgta

SEQ ID NO: 384967 - DNA, 15 bp, Homo sapiens
ggaaatgttttgtat

SEQ ID NO: 384968 - DNA, 15 bp, Homo sapiens
gaaatgttttgtatg

SEQ ID NO: 384969 - DNA, 15 bp, Homo sapiens
aaatgttttgtatga

SEQ ID NO: 384970 - DNA, 15 bp, Homo sapiens
aatgttttgtatgaa

SEQ ID NO: 384971 - DNA, 15 bp, Homo sapiens
atgttttgtatgaat

SEQ ID NO: 384972 - DNA, 15 bp, Homo sapiens
tgttttgtatgaatt

SEQ ID NO: 384973 - DNA, 15 bp, Homo sapiens
gttttgtatgaattg

SEQ ID NO: 384974 - DNA, 15 bp, Homo sapiens
ttttgtatgaattgc

SEQ ID NO: 384975 - DNA, 15 bp, Homo sapiens
tttgtatgaattgca

SEQ ID NO: 384976 - DNA, 15 bp, Homo sapiens
ttgtatgaattgcag

SEQ ID NO: 384977 - DNA, 15 bp, Homo sapiens
tgtatgaattgcagt

SEQ ID NO: 384978 - DNA, 15 bp, Homo sapiens
gtatgaattgcagtt

SEQ ID NO: 384979 - DNA, 15 bp, Homo sapiens
tatgaattgcagtta

SEQ ID NO: 384980 - DNA, 15 bp, Homo sapiens
atgaattgcagttag

SEQ ID NO: 384981 - DNA, 15 bp, Homo sapiens
tgaattgcagttagc

SEQ ID NO: 384982 - DNA, 15 bp, Homo sapiens
gaattgcagttagcc

SEQ ID NO: 384983 - DNA, 15 bp, Homo sapiens
aattgcagttagcct

SEQ ID NO: 384984 - DNA, 15 bp, Homo sapiens
attgcagttagccta

SEQ ID NO: 384985 - DNA, 15 bp, Homo sapiens
ttgcagttagcctaa

SEQ ID NO: 384986 - DNA, 15 bp, Homo sapiens
tgcagttagcctaaa

SEQ ID NO: 384987 - DNA, 15 bp, Homo sapiens
gcagttagcctaaat

SEQ ID NO: 384988 - DNA, 15 bp, Homo sapiens
cagttagcctaaata

SEQ ID NO: 384989 - DNA, 15 bp, Homo sapiens
agttagcctaaataa

SEQ ID NO: 384990 - DNA, 15 bp, Homo sapiens
gttagcctaaataat

SEQ ID NO: 384991 - DNA, 15 bp, Homo sapiens
ttagcctaaataatt

SEQ ID NO: 384992 - DNA, 15 bp, Homo sapiens
tagcctaaataattt

SEQ ID NO: 384993 - DNA, 15 bp, Homo sapiens
agcctaaataattta

SEQ ID NO: 384994 - DNA, 15 bp, Homo sapiens
gcctaaataatttag

SEQ ID NO: 384995 - DNA, 15 bp, Homo sapiens
cctaaataatttagc

SEQ ID NO: 384996 - DNA, 15 bp, Homo sapiens
ctaaataatttagct

SEQ ID NO: 384997 - DNA, 15 bp, Homo sapiens
taaataatttagcta

SEQ ID NO: 384998 - DNA, 15 bp, Homo sapiens
aaataatttagctat

SEQ ID NO: 384999 - DNA, 15 bp, Homo sapiens
aataatttagctatt

SEQ ID NO: 385000 - DNA, 15 bp, Homo sapiens
ataatttagctattc

SEQ ID NO: 385001 - DNA, 15 bp, Homo sapiens
taatttagctattca

SEQ ID NO: 385002 - DNA, 15 bp, Homo sapiens
aatttagctattcac

SEQ ID NO: 385003 - DNA, 15 bp, Homo sapiens
atttagctattcaca

SEQ ID NO: 385004 - DNA, 15 bp, Homo sapiens
tttagctattcacaa

SEQ ID NO: 385005 - DNA, 15 bp, Homo sapiens
ttagctattcacaat

SEQ ID NO: 385006 - DNA, 15 bp, Homo sapiens
tagctattcacaatt

SEQ ID NO: 385007 - DNA, 15 bp, Homo sapiens
agctattcacaatta

SEQ ID NO: 385008 - DNA, 15 bp, Homo sapiens
gctattcacaattat

SEQ ID NO: 385009 - DNA, 15 bp, Homo sapiens
ctattcacaattata

SEQ ID NO: 385010 - DNA, 15 bp, Homo sapiens
tattcacaattataa

SEQ ID NO: 385011 - DNA, 15 bp, Homo sapiens
attcacaattataag

SEQ ID NO: 385012 - DNA, 15 bp, Homo sapiens
ttcacaattataagt

SEQ ID NO: 385013 - DNA, 15 bp, Homo sapiens
tcacaattataagtc

SEQ ID NO: 385014 - DNA, 15 bp, Homo sapiens
cacaattataagtcc

SEQ ID NO: 385015 - DNA, 15 bp, Homo sapiens
acaattataagtcca

SEQ ID NO: 385016 - DNA, 15 bp, Homo sapiens
caattataagtccac

SEQ ID NO: 385017 - DNA, 15 bp, Homo sapiens
aattataagtccaca

SEQ ID NO: 385018 - DNA, 15 bp, Homo sapiens
attataagtccacaa

SEQ ID NO: 385019 - DNA, 15 bp, Homo sapiens
ttataagtccacaat

SEQ ID NO: 385020 - DNA, 15 bp, Homo sapiens
tataagtccacaatc

SEQ ID NO: 385021 - DNA, 15 bp, Homo sapiens
ataagtccacaatcc

SEQ ID NO: 385022 - DNA, 15 bp, Homo sapiens
taagtccacaatccc

SEQ ID NO: 385023 - DNA, 15 bp, Homo sapiens
aagtccacaatccct

SEQ ID NO: 385024 - DNA, 15 bp, Homo sapiens
agtccacaatccctt

SEQ ID NO: 385025 - DNA, 15 bp, Homo sapiens
gtccacaatccctta

SEQ ID NO: 385026 - DNA, 15 bp, Homo sapiens
tccacaatcccttat

SEQ ID NO: 385027 - DNA, 15 bp, Homo sapiens
ccacaatcccttatc

SEQ ID NO: 385028 - DNA, 15 bp, Homo sapiens
cacaatcccttatct

SEQ ID NO: 385029 - DNA, 15 bp, Homo sapiens
acaatcccttatcta

SEQ ID NO: 385030 - DNA, 15 bp, Homo sapiens
caatcccttatctac

SEQ ID NO: 385031 - DNA, 15 bp, Homo sapiens
aatcccttatctaca

SEQ ID NO: 385032 - DNA, 15 bp, Homo sapiens
atcccttatctacaa

SEQ ID NO: 385033 - DNA, 15 bp, Homo sapiens
tcccttatctacaat

SEQ ID NO: 385034 - DNA, 15 bp, Homo sapiens
cccttatctacaatg

SEQ ID NO: 385035 - DNA, 15 bp, Homo sapiens
ccttatctacaatgc

SEQ ID NO: 385036 - DNA, 15 bp, Homo sapiens
cttatctacaatgcc

SEQ ID NO: 385037 - DNA, 15 bp, Homo sapiens
ttatctacaatgcca

SEQ ID NO: 385038 - DNA, 15 bp, Homo sapiens
tatctacaatgccaa

SEQ ID NO: 385039 - DNA, 15 bp, Homo sapiens
atctacaatgccaaa

SEQ ID NO: 385040 - DNA, 15 bp, Homo sapiens
tctacaatgccaaaa

SEQ ID NO: 385041 - DNA, 15 bp, Homo sapiens
ctacaatgccaaaat

SEQ ID NO: 385042 - DNA, 15 bp, Homo sapiens
tacaatgccaaaatc

SEQ ID NO: 385043 - DNA, 15 bp, Homo sapiens
acaatgccaaaatct

SEQ ID NO: 385044 - DNA, 15 bp, Homo sapiens
caatgccaaaatcta

SEQ ID NO: 385045 - DNA, 15 bp, Homo sapiens
aatgccaaaatctaa

SEQ ID NO: 385046 - DNA, 15 bp, Homo sapiens
atgccaaaatctaaa

SEQ ID NO: 385047 - DNA, 15 bp, Homo sapiens
tgccaaaatctaaaa

SEQ ID NO: 385048 - DNA, 15 bp, Homo sapiens
gccaaaatctaaaaa

SEQ ID NO: 385049 - DNA, 15 bp, Homo sapiens
ccaaaatctaaaaac

SEQ ID NO: 385050 - DNA, 15 bp, Homo sapiens
caaaatctaaaaaca

SEQ ID NO: 385051 - DNA, 15 bp, Homo sapiens
aaaatctaaaaacag

SEQ ID NO: 385052 - DNA, 15 bp, Homo sapiens
aaatctaaaaacagc

SEQ ID NO: 385053 - DNA, 15 bp, Homo sapiens
aatctaaaaacagct

SEQ ID NO: 385054 - DNA, 15 bp, Homo sapiens
atctaaaaacagctt

SEQ ID NO: 385055 - DNA, 15 bp, Homo sapiens
tctaaaaacagcttt

SEQ ID NO: 385056 - DNA, 15 bp, Homo sapiens
ctaaaaacagctttg

SEQ ID NO: 385057 - DNA, 15 bp, Homo sapiens
taaaaacagctttga

SEQ ID NO: 385058 - DNA, 15 bp, Homo sapiens
aaaaacagctttgat

SEQ ID NO: 385059 - DNA, 15 bp, Homo sapiens
aaaacagctttgata

SEQ ID NO: 385060 - DNA, 15 bp, Homo sapiens
aaacagctttgataa

SEQ ID NO: 385061 - DNA, 15 bp, Homo sapiens
aacagctttgataac

SEQ ID NO: 385062 - DNA, 15 bp, Homo sapiens
acagctttgataaca

SEQ ID NO: 385063 - DNA, 15 bp, Homo sapiens
cagctttgataacag

SEQ ID NO: 385064 - DNA, 15 bp, Homo sapiens
agctttgataacaga

SEQ ID NO: 385065 - DNA, 15 bp, Homo sapiens
gctttgataacagaa

SEQ ID NO: 385066 - DNA, 15 bp, Homo sapiens
ctttgataacagaaa

SEQ ID NO: 385067 - DNA, 15 bp, Homo sapiens
tttgataacagaaat

SEQ ID NO: 385068 - DNA, 15 bp, Homo sapiens
ttgataacagaaatc

SEQ ID NO: 385069 - DNA, 15 bp, Homo sapiens
tgataacagaaatct

SEQ ID NO: 385070 - DNA, 15 bp, Homo sapiens
gataacagaaatctt

SEQ ID NO: 385071 - DNA, 15 bp, Homo sapiens
ataacagaaatcttt

SEQ ID NO: 385072 - DNA, 15 bp, Homo sapiens
taacagaaatctttg

SEQ ID NO: 385073 - DNA, 15 bp, Homo sapiens
aacagaaatctttga

SEQ ID NO: 385074 - DNA, 15 bp, Homo sapiens
acagaaatctttgaa

SEQ ID NO: 385075 - DNA, 15 bp, Homo sapiens
cagaaatctttgaat

SEQ ID NO: 385076 - DNA, 15 bp, Homo sapiens
agaaatctttgaatt

SEQ ID NO: 385077 - DNA, 15 bp, Homo sapiens
gaaatctttgaatta

SEQ ID NO: 385078 - DNA, 15 bp, Homo sapiens
aaatctttgaattac

SEQ ID NO: 385079 - DNA, 15 bp, Homo sapiens
aatctttgaattacc

SEQ ID NO: 385080 - DNA, 15 bp, Homo sapiens
atctttgaattacca

SEQ ID NO: 385081 - DNA, 15 bp, Homo sapiens
tctttgaattaccat

SEQ ID NO: 385082 - DNA, 15 bp, Homo sapiens
ctttgaattaccatg

SEQ ID NO: 385083 - DNA, 15 bp, Homo sapiens
tttgaattaccatgc

SEQ ID NO: 385084 - DNA, 15 bp, Homo sapiens
ttgaattaccatgca

SEQ ID NO: 385085 - DNA, 15 bp, Homo sapiens
tgaattaccatgcag

SEQ ID NO: 385086 - DNA, 15 bp, Homo sapiens
gaattaccatgcagc

SEQ ID NO: 385087 - DNA, 15 bp, Homo sapiens
aattaccatgcagct

SEQ ID NO: 385088 - DNA, 15 bp, Homo sapiens
attaccatgcagctc

SEQ ID NO: 385089 - DNA, 15 bp, Homo sapiens
ttaccatgcagctct

SEQ ID NO: 385090 - DNA, 15 bp, Homo sapiens
taccatgcagctctt

SEQ ID NO: 385091 - DNA, 15 bp, Homo sapiens
accatgcagctcttt

SEQ ID NO: 385092 - DNA, 15 bp, Homo sapiens
ccatgcagctcttta

SEQ ID NO: 385093 - DNA, 15 bp, Homo sapiens
catgcagctctttat

SEQ ID NO: 385094 - DNA, 15 bp, Homo sapiens
atgcagctctttatt

SEQ ID NO: 385095 - DNA, 15 bp, Homo sapiens
tgcagctctttatta

SEQ ID NO: 385096 - DNA, 15 bp, Homo sapiens
gcagctctttattaa

SEQ ID NO: 385097 - DNA, 15 bp, Homo sapiens
cagctctttattaaa

SEQ ID NO: 385098 - DNA, 15 bp, Homo sapiens
agctctttattaaag

SEQ ID NO: 385099 - DNA, 15 bp, Homo sapiens
gctctttattaaagt

SEQ ID NO: 385100 - DNA, 15 bp, Homo sapiens
ctctttattaaagtc

SEQ ID NO: 385101 - DNA, 15 bp, Homo sapiens
tctttattaaagtct

SEQ ID NO: 385102 - DNA, 15 bp, Homo sapiens
ctttattaaagtctt

SEQ ID NO: 385103 - DNA, 15 bp, Homo sapiens
tttattaaagtcttt

SEQ ID NO: 385104 - DNA, 15 bp, Homo sapiens
ttattaaagtcttta

SEQ ID NO: 385105 - DNA, 15 bp, Homo sapiens
tattaaagtctttat

SEQ ID NO: 385106 - DNA, 15 bp, Homo sapiens
attaaagtctttatt

SEQ ID NO: 385107 - DNA, 15 bp, Homo sapiens
ttaaagtctttattt

SEQ ID NO: 385108 - DNA, 15 bp, Homo sapiens
taaagtctttattta

SEQ ID NO: 385109 - DNA, 15 bp, Homo sapiens
aaagtctttatttat

SEQ ID NO: 385110 - DNA, 15 bp, Homo sapiens
aagtctttatttatt

SEQ ID NO: 385111 - DNA, 15 bp, Homo sapiens
agtctttatttattc

SEQ ID NO: 385112 - DNA, 15 bp, Homo sapiens
gtctttatttattct

SEQ ID NO: 385113 - DNA, 15 bp, Homo sapiens
tctttatttattctg

SEQ ID NO: 385114 - DNA, 15 bp, Homo sapiens
ctttatttattctgg

SEQ ID NO: 385115 - DNA, 15 bp, Homo sapiens
tttatttattctggt

SEQ ID NO: 385116 - DNA, 15 bp, Homo sapiens
ttatttattctggtt

SEQ ID NO: 385117 - DNA, 15 bp, Homo sapiens
tatttattctggtta

SEQ ID NO: 385118 - DNA, 15 bp, Homo sapiens
atttattctggttag

SEQ ID NO: 385119 - DNA, 15 bp, Homo sapiens
tttattctggttagt

SEQ ID NO: 385120 - DNA, 15 bp, Homo sapiens
ttattctggttagta

SEQ ID NO: 385121 - DNA, 15 bp, Homo sapiens
tattctggttagtat

SEQ ID NO: 385122 - DNA, 15 bp, Homo sapiens
attctggttagtatg

SEQ ID NO: 385123 - DNA, 15 bp, Homo sapiens
ttctggttagtatga

SEQ ID NO: 385124 - DNA, 15 bp, Homo sapiens
tctggttagtatgaa

SEQ ID NO: 385125 - DNA, 15 bp, Homo sapiens
ctggttagtatgaat

SEQ ID NO: 385126 - DNA, 15 bp, Homo sapiens
tggttagtatgaata

SEQ ID NO: 385127 - DNA, 15 bp, Homo sapiens
ggttagtatgaatag

SEQ ID NO: 385128 - DNA, 15 bp, Homo sapiens
gttagtatgaatagc

SEQ ID NO: 385129 - DNA, 15 bp, Homo sapiens
ttagtatgaatagcc

SEQ ID NO: 385130 - DNA, 15 bp, Homo sapiens
tagtatgaatagcct

SEQ ID NO: 385131 - DNA, 15 bp, Homo sapiens
agtatgaatagcctt

SEQ ID NO: 385132 - DNA, 15 bp, Homo sapiens
gtatgaatagccttt

SEQ ID NO: 385133 - DNA, 15 bp, Homo sapiens
tatgaatagcctttt

SEQ ID NO: 385134 - DNA, 15 bp, Homo sapiens
atgaatagccttttt

SEQ ID NO: 385135 - DNA, 15 bp, Homo sapiens
tgaatagcctttttc

SEQ ID NO: 385136 - DNA, 15 bp, Homo sapiens
gaatagcctttttcc

SEQ ID NO: 385137 - DNA, 15 bp, Homo sapiens
aatagcctttttcct

SEQ ID NO: 385138 - DNA, 15 bp, Homo sapiens
atagcctttttcctt

SEQ ID NO: 385139 - DNA, 15 bp, Homo sapiens
tagcctttttccttg

SEQ ID NO: 385140 - DNA, 15 bp, Homo sapiens
agcctttttccttgc

SEQ ID NO: 385141 - DNA, 15 bp, Homo sapiens
gcctttttccttgct

SEQ ID NO: 385142 - DNA, 15 bp, Homo sapiens
cctttttccttgctg

SEQ ID NO: 385143 - DNA, 15 bp, Homo sapiens
ctttttccttgctgc

SEQ ID NO: 385144 - DNA, 15 bp, Homo sapiens
tttttccttgctgca

SEQ ID NO: 385145 - DNA, 15 bp, Homo sapiens
ttttccttgctgcag

SEQ ID NO: 385146 - DNA, 15 bp, Homo sapiens
tttccttgctgcaga

SEQ ID NO: 385147 - DNA, 15 bp, Homo sapiens
ttccttgctgcagaa

SEQ ID NO: 385148 - DNA, 15 bp, Homo sapiens
tccttgctgcagaaa

SEQ ID NO: 385149 - DNA, 15 bp, Homo sapiens
ccttgctgcagaaat

SEQ ID NO: 385150 - DNA, 15 bp, Homo sapiens
cttgctgcagaaata

SEQ ID NO: 385151 - DNA, 15 bp, Homo sapiens
ttgctgcagaaatat

SEQ ID NO: 385152 - DNA, 15 bp, Homo sapiens
tgctgcagaaatatt

SEQ ID NO: 385153 - DNA, 15 bp, Homo sapiens
gctgcagaaatatta

SEQ ID NO: 385154 - DNA, 15 bp, Homo sapiens
ctgcagaaatattaa

SEQ ID NO: 385155 - DNA, 15 bp, Homo sapiens
tgcagaaatattaat

SEQ ID NO: 385156 - DNA, 15 bp, Homo sapiens
gcagaaatattaatg

SEQ ID NO: 385157 - DNA, 15 bp, Homo sapiens
cagaaatattaatgt

SEQ ID NO: 385158 - DNA, 15 bp, Homo sapiens
agaaatattaatgtg

SEQ ID NO: 385159 - DNA, 15 bp, Homo sapiens
gaaatattaatgtgt

SEQ ID NO: 385160 - DNA, 15 bp, Homo sapiens
aaatattaatgtgtt

SEQ ID NO: 385161 - DNA, 15 bp, Homo sapiens
aatattaatgtgttt

SEQ ID NO: 385162 - DNA, 15 bp, Homo sapiens
atattaatgtgtttg

SEQ ID NO: 385163 - DNA, 15 bp, Homo sapiens
taatgtgtttgattg

SEQ ID NO: 385164 - DNA, 15 bp, Homo sapiens
aatgtgtttgattgc

SEQ ID NO: 385165 - DNA, 15 bp, Homo sapiens
atgtgtttgattgct

SEQ ID NO: 385166 - DNA, 15 bp, Homo sapiens
tgtgtttgattgctt

SEQ ID NO: 385167 - DNA, 15 bp, Homo sapiens
gtgtttgattgcttc

SEQ ID NO: 385168 - DNA, 15 bp, Homo sapiens
tgtttgattgcttcc

SEQ ID NO: 385169 - DNA, 15 bp, Homo sapiens
gtttgattgcttccc

SEQ ID NO: 385170 - DNA, 15 bp, Homo sapiens
tttgattgcttcccc

SEQ ID NO: 385171 - DNA, 15 bp, Homo sapiens
ttgattgcttcccca

SEQ ID NO: 385172 - DNA, 15 bp, Homo sapiens
tgattgcttccccag

SEQ ID NO: 385173 - DNA, 15 bp, Homo sapiens
gattgcttccccaga

SEQ ID NO: 385174 - DNA, 15 bp, Homo sapiens
attgcttccccagac

SEQ ID NO: 385175 - DNA, 15 bp, Homo sapiens
ttgcttccccagacc

SEQ ID NO: 385176 - DNA, 15 bp, Homo sapiens
tgcttccccagaccc

SEQ ID NO: 385177 - DNA, 15 bp, Homo sapiens
gcttccccagaccct

SEQ ID NO: 385178 - DNA, 15 bp, Homo sapiens
cttccccagaccctg

SEQ ID NO: 385179 - DNA, 15 bp, Homo sapiens
ttccccagaccctgt

SEQ ID NO: 385180 - DNA, 15 bp, Homo sapiens
tccccagaccctgtt

SEQ ID NO: 385181 - DNA, 15 bp, Homo sapiens
ccccagaccctgttc

SEQ ID NO: 385182 - DNA, 15 bp, Homo sapiens
cccagaccctgttca

SEQ ID NO: 385183 - DNA, 15 bp, Homo sapiens
ccagaccctgttcag

SEQ ID NO: 385184 - DNA, 15 bp, Homo sapiens
cagaccctgttcagg

SEQ ID NO: 385185 - DNA, 15 bp, Homo sapiens
agaccctgttcaggg

SEQ ID NO: 385186 - DNA, 15 bp, Homo sapiens
gaccctgttcagggg

SEQ ID NO: 385187 - DNA, 15 bp, Homo sapiens
accctgttcaggggt

SEQ ID NO: 385188 - DNA, 15 bp, Homo sapiens
ccctgttcaggggta

SEQ ID NO: 385189 - DNA, 15 bp, Homo sapiens
cctgttcaggggtag

SEQ ID NO: 385190 - DNA, 15 bp, Homo sapiens
ctgttcaggggtagt

SEQ ID NO: 385191 - DNA, 15 bp, Homo sapiens
tgttcaggggtagta

SEQ ID NO: 385192 - DNA, 15 bp, Homo sapiens
gttcaggggtagtaa

SEQ ID NO: 385193 - DNA, 15 bp, Homo sapiens
ttcaggggtagtaat

SEQ ID NO: 385194 - DNA, 15 bp, Homo sapiens
tcaggggtagtaatt

SEQ ID NO: 385195 - DNA, 15 bp, Homo sapiens
caggggtagtaatta

SEQ ID NO: 385196 - DNA, 15 bp, Homo sapiens
aggggtagtaattaa

SEQ ID NO: 385197 - DNA, 15 bp, Homo sapiens
ggggtagtaattaat

SEQ ID NO: 385198 - DNA, 15 bp, Homo sapiens
gggtagtaattaata

SEQ ID NO: 385199 - DNA, 15 bp, Homo sapiens
ggtagtaattaatat

SEQ ID NO: 385200 - DNA, 15 bp, Homo sapiens
gtagtaattaatata

SEQ ID NO: 385201 - DNA, 15 bp, Homo sapiens
tagtaattaatatag

SEQ ID NO: 385202 - DNA, 15 bp, Homo sapiens
agtaattaatatagt

SEQ ID NO: 385203 - DNA, 15 bp, Homo sapiens
gtaattaatatagtt

SEQ ID NO: 385204 - DNA, 15 bp, Homo sapiens
taattaatatagtta

SEQ ID NO: 385205 - DNA, 15 bp, Homo sapiens
aattaatatagttac

SEQ ID NO: 385206 - DNA, 15 bp, Homo sapiens
attaatatagttact

SEQ ID NO: 385207 - DNA, 15 bp, Homo sapiens
ttaatatagttactt

SEQ ID NO: 385208 - DNA, 15 bp, Homo sapiens
taatatagttacttt

SEQ ID NO: 385209 - DNA, 15 bp, Homo sapiens
aatatagttactttc

SEQ ID NO: 385210 - DNA, 15 bp, Homo sapiens
atatagttactttca

SEQ ID NO: 385211 - DNA, 15 bp, Homo sapiens
tatagttactttcat

SEQ ID NO: 385212 - DNA, 15 bp, Homo sapiens
atagttactttcata

SEQ ID NO: 385213 - DNA, 15 bp, Homo sapiens
tagttactttcataa

SEQ ID NO: 385214 - DNA, 15 bp, Homo sapiens
agttactttcataat

SEQ ID NO: 385215 - DNA, 15 bp, Homo sapiens
gttactttcataata

SEQ ID NO: 385216 - DNA, 15 bp, Homo sapiens
ttactttcataatat

SEQ ID NO: 385217 - DNA, 15 bp, Homo sapiens
tactttcataatatt

SEQ ID NO: 385218 - DNA, 15 bp, Homo sapiens
actttcataatatta

SEQ ID NO: 385219 - DNA, 15 bp, Homo sapiens
ctttcataatattag

SEQ ID NO: 385220 - DNA, 15 bp, Homo sapiens
tttcataatattagt

SEQ ID NO: 385221 - DNA, 15 bp, Homo sapiens
ttcataatattagtt

SEQ ID NO: 385222 - DNA, 15 bp, Homo sapiens
tcataatattagttt

SEQ ID NO: 385223 - DNA, 15 bp, Homo sapiens
cataatattagtttt

SEQ ID NO: 385224 - DNA, 15 bp, Homo sapiens
ataatattagttttc

SEQ ID NO: 385225 - DNA, 15 bp, Homo sapiens
taatattagttttct

SEQ ID NO: 385226 - DNA, 15 bp, Homo sapiens
aatattagttttcta

SEQ ID NO: 385227 - DNA, 15 bp, Homo sapiens
atattagttttctaa

SEQ ID NO: 385228 - DNA, 15 bp, Homo sapiens
tattagttttctaat

SEQ ID NO: 385229 - DNA, 15 bp, Homo sapiens
attagttttctaatg

SEQ ID NO: 385230 - DNA, 15 bp, Homo sapiens
ttagttttctaatgt

SEQ ID NO: 385231 - DNA, 15 bp, Homo sapiens
tagttttctaatgtt

SEQ ID NO: 385232 - DNA, 15 bp, Homo sapiens
agttttctaatgttc

SEQ ID NO: 385233 - DNA, 15 bp, Homo sapiens
gttttctaatgttca

SEQ ID NO: 385234 - DNA, 15 bp, Homo sapiens
ttttctaatgttcaa

SEQ ID NO: 385235 - DNA, 15 bp, Homo sapiens
tttctaatgttcaaa

SEQ ID NO: 385236 - DNA, 15 bp, Homo sapiens
ttctaatgttcaaaa

SEQ ID NO: 385237 - DNA, 15 bp, Homo sapiens
tctaatgttcaaaaa

SEQ ID NO: 385238 - DNA, 15 bp, Homo sapiens
ctaatgttcaaaaat

SEQ ID NO: 385239 - DNA, 15 bp, Homo sapiens
taatgttcaaaaata

SEQ ID NO: 385240 - DNA, 15 bp, Homo sapiens
aatgttcaaaaataa

SEQ ID NO: 385241 - DNA, 15 bp, Homo sapiens
atgttcaaaaataat

SEQ ID NO: 385242 - DNA, 15 bp, Homo sapiens
tgttcaaaaataata

SEQ ID NO: 385243 - DNA, 15 bp, Homo sapiens
gttcaaaaataatat

SEQ ID NO: 385244 - DNA, 15 bp, Homo sapiens
ttcaaaaataatatt

SEQ ID NO: 385245 - DNA, 15 bp, Homo sapiens
tcaaaaataatatta

SEQ ID NO: 385246 - DNA, 15 bp, Homo sapiens
caaaaataatattac

SEQ ID NO: 385247 - DNA, 15 bp, Homo sapiens
aaaaataatattact

SEQ ID NO: 385248 - DNA, 15 bp, Homo sapiens
aaaataatattactt

SEQ ID NO: 385249 - DNA, 15 bp, Homo sapiens
aaataatattacttc

SEQ ID NO: 385250 - DNA, 15 bp, Homo sapiens
aataatattacttct

SEQ ID NO: 385251 - DNA, 15 bp, Homo sapiens
ataatattacttctg

SEQ ID NO: 385252 - DNA, 15 bp, Homo sapiens
taatattacttctga

SEQ ID NO: 385253 - DNA, 15 bp, Homo sapiens
aatattacttctgaa

SEQ ID NO: 385254 - DNA, 15 bp, Homo sapiens
atattacttctgaaa

SEQ ID NO: 385255 - DNA, 15 bp, Homo sapiens
tattacttctgaaac

SEQ ID NO: 385256 - DNA, 15 bp, Homo sapiens
attacttctgaaacg

SEQ ID NO: 385257 - DNA, 15 bp, Homo sapiens
ttacttctgaaacgc

SEQ ID NO: 385258 - DNA, 15 bp, Homo sapiens
tacttctgaaacgca

SEQ ID NO: 385259 - DNA, 15 bp, Homo sapiens
acttctgaaacgcaa

SEQ ID NO: 385260 - DNA, 15 bp, Homo sapiens
cttctgaaacgcaac

SEQ ID NO: 385261 - DNA, 15 bp, Homo sapiens
ttctgaaacgcaact

SEQ ID NO: 385262 - DNA, 15 bp, Homo sapiens
tctgaaacgcaactg

SEQ ID NO: 385263 - DNA, 15 bp, Homo sapiens
ctgaaacgcaactga

SEQ ID NO: 385264 - DNA, 15 bp, Homo sapiens
tgaaacgcaactgaa

SEQ ID NO: 385265 - DNA, 15 bp, Homo sapiens
gaaacgcaactgaat

SEQ ID NO: 385266 - DNA, 15 bp, Homo sapiens
aaacgcaactgaatc

SEQ ID NO: 385267 - DNA, 15 bp, Homo sapiens
aacgcaactgaatcc

SEQ ID NO: 385268 - DNA, 15 bp, Homo sapiens
acgcaactgaatcct

SEQ ID NO: 385269 - DNA, 15 bp, Homo sapiens
cgcaactgaatcctg

SEQ ID NO: 385270 - DNA, 15 bp, Homo sapiens
gcaactgaatcctga

SEQ ID NO: 385271 - DNA, 15 bp, Homo sapiens
caactgaatcctgat

SEQ ID NO: 385272 - DNA, 15 bp, Homo sapiens
aactgaatcctgatt

SEQ ID NO: 385273 - DNA, 15 bp, Homo sapiens
actgaatcctgattt

SEQ ID NO: 385274 - DNA, 15 bp, Homo sapiens
ctgaatcctgatttt

SEQ ID NO: 385275 - DNA, 15 bp, Homo sapiens
tgaatcctgattttt

SEQ ID NO: 385276 - DNA, 15 bp, Homo sapiens
gaatcctgatttttt

SEQ ID NO: 385277 - DNA, 15 bp, Homo sapiens
aatcctgattttttg

SEQ ID NO: 385278 - DNA, 15 bp, Homo sapiens
atcctgattttttgg

SEQ ID NO: 385279 - DNA, 15 bp, Homo sapiens
tcctgattttttgga

SEQ ID NO: 385280 - DNA, 15 bp, Homo sapiens
cctgattttttggat

SEQ ID NO: 385281 - DNA, 15 bp, Homo sapiens
ctgattttttggatt

SEQ ID NO: 385282 - DNA, 15 bp, Homo sapiens
tgattttttggattc

SEQ ID NO: 385283 - DNA, 15 bp, Homo sapiens
gattttttggattct

SEQ ID NO: 385284 - DNA, 15 bp, Homo sapiens
attttttggattctt

SEQ ID NO: 385285 - DNA, 15 bp, Homo sapiens
ttttttggattcttt

SEQ ID NO: 385286 - DNA, 15 bp, Homo sapiens
tttttggattctttg

SEQ ID NO: 385287 - DNA, 15 bp, Homo sapiens
ttttggattctttga

SEQ ID NO: 385288 - DNA, 15 bp, Homo sapiens
tttggattctttgaa

SEQ ID NO: 385289 - DNA, 15 bp, Homo sapiens
ttggattctttgaaa

SEQ ID NO: 385290 - DNA, 15 bp, Homo sapiens
tggattctttgaaaa

SEQ ID NO: 385291 - DNA, 15 bp, Homo sapiens
ggattctttgaaaag

SEQ ID NO: 385292 - DNA, 15 bp, Homo sapiens
gattctttgaaaagt

SEQ ID NO: 385293 - DNA, 15 bp, Homo sapiens
attctttgaaaagta

SEQ ID NO: 385294 - DNA, 15 bp, Homo sapiens
ttctttgaaaagtag

SEQ ID NO: 385295 - DNA, 15 bp, Homo sapiens
tctttgaaaagtagg

SEQ ID NO: 385296 - DNA, 15 bp, Homo sapiens
ctttgaaaagtaggc

SEQ ID NO: 385297 - DNA, 15 bp, Homo sapiens
tttgaaaagtaggcc

SEQ ID NO: 385298 - DNA, 15 bp, Homo sapiens
ttgaaaagtaggcct

SEQ ID NO: 385299 - DNA, 15 bp, Homo sapiens
tgaaaagtaggcctg

SEQ ID NO: 385300 - DNA, 15 bp, Homo sapiens
gaaaagtaggcctgt

SEQ ID NO: 385301 - DNA, 15 bp, Homo sapiens
aaaagtaggcctgtc

SEQ ID NO: 385302 - DNA, 15 bp, Homo sapiens
aaagtaggcctgtct

SEQ ID NO: 385303 - DNA, 15 bp, Homo sapiens
aagtaggcctgtctc

SEQ ID NO: 385304 - DNA, 15 bp, Homo sapiens
agtaggcctgtctct

SEQ ID NO: 385305 - DNA, 15 bp, Homo sapiens
gtaggcctgtctcta

SEQ ID NO: 385306 - DNA, 15 bp, Homo sapiens
taggcctgtctctaa

SEQ ID NO: 385307 - DNA, 15 bp, Homo sapiens
aggcctgtctctaat

SEQ ID NO: 385308 - DNA, 15 bp, Homo sapiens
ggcctgtctctaatg

SEQ ID NO: 385309 - DNA, 15 bp, Homo sapiens
gcctgtctctaatgt

SEQ ID NO: 385310 - DNA, 15 bp, Homo sapiens
cctgtctctaatgtt

SEQ ID NO: 385311 - DNA, 15 bp, Homo sapiens
ctgtctctaatgttt

SEQ ID NO: 385312 - DNA, 15 bp, Homo sapiens
tgtctctaatgtttc

SEQ ID NO: 385313 - DNA, 15 bp, Homo sapiens
gtctctaatgtttct

SEQ ID NO: 385314 - DNA, 15 bp, Homo sapiens
tctctaatgtttcta

SEQ ID NO: 385315 - DNA, 15 bp, Homo sapiens
ctctaatgtttctaa

SEQ ID NO: 385316 - DNA, 15 bp, Homo sapiens
tctaatgtttctaac

SEQ ID NO: 385317 - DNA, 15 bp, Homo sapiens
ctaatgtttctaact

SEQ ID NO: 385318 - DNA, 15 bp, Homo sapiens
taatgtttctaacta

SEQ ID NO: 385319 - DNA, 15 bp, Homo sapiens
aatgtttctaactaa

SEQ ID NO: 385320 - DNA, 15 bp, Homo sapiens
atgtttctaactaat

SEQ ID NO: 385321 - DNA, 15 bp, Homo sapiens
tgtttctaactaatc

SEQ ID NO: 385322 - DNA, 15 bp, Homo sapiens
gtttctaactaatct

SEQ ID NO: 385323 - DNA, 15 bp, Homo sapiens
tttctaactaatcta

SEQ ID NO: 385324 - DNA, 15 bp, Homo sapiens
ttctaactaatctat

SEQ ID NO: 385325 - DNA, 15 bp, Homo sapiens
tctaactaatctata

SEQ ID NO: 385326 - DNA, 15 bp, Homo sapiens
ctaactaatctatat

SEQ ID NO: 385327 - DNA, 15 bp, Homo sapiens
taactaatctatata

SEQ ID NO: 385328 - DNA, 15 bp, Homo sapiens
aactaatctatatat

SEQ ID NO: 385329 - DNA, 15 bp, Homo sapiens
actaatctatatatc

SEQ ID NO: 385330 - DNA, 15 bp, Homo sapiens
ctaatctatatatcc

SEQ ID NO: 385331 - DNA, 15 bp, Homo sapiens
taatctatatatcct

SEQ ID NO: 385332 - DNA, 15 bp, Homo sapiens
aatctatatatcctg

SEQ ID NO: 385333 - DNA, 15 bp, Homo sapiens
atctatatatcctga

SEQ ID NO: 385334 - DNA, 15 bp, Homo sapiens
tctatatatcctgac

SEQ ID NO: 385335 - DNA, 15 bp, Homo sapiens
ctatatatcctgacc

SEQ ID NO: 385336 - DNA, 15 bp, Homo sapiens
tatatatcctgacca

SEQ ID NO: 385337 - DNA, 15 bp, Homo sapiens
atatatcctgaccac

SEQ ID NO: 385338 - DNA, 15 bp, Homo sapiens
tatatcctgaccact

SEQ ID NO: 385339 - DNA, 15 bp, Homo sapiens
atatcctgaccacta

SEQ ID NO: 385340 - DNA, 15 bp, Homo sapiens
tatcctgaccactac

SEQ ID NO: 385341 - DNA, 15 bp, Homo sapiens
atcctgaccactact

SEQ ID NO: 385342 - DNA, 15 bp, Homo sapiens
tcctgaccactactt

SEQ ID NO: 385343 - DNA, 15 bp, Homo sapiens
cctgaccactacttt

SEQ ID NO: 385344 - DNA, 15 bp, Homo sapiens
ctgaccactactttt

SEQ ID NO: 385345 - DNA, 15 bp, Homo sapiens
tgaccactacttttt

SEQ ID NO: 385346 - DNA, 15 bp, Homo sapiens
gaccactactttttt

SEQ ID NO: 385347 - DNA, 15 bp, Homo sapiens
accactacttttttt

SEQ ID NO: 385348 - DNA, 15 bp, Homo sapiens
ccactacttttttta

SEQ ID NO: 385349 - DNA, 15 bp, Homo sapiens
cactactttttttac

SEQ ID NO: 385350 - DNA, 15 bp, Homo sapiens
actactttttttact

SEQ ID NO: 385351 - DNA, 15 bp, Homo sapiens
ctactttttttactt

SEQ ID NO: 385352 - DNA, 15 bp, Homo sapiens
tactttttttactta

SEQ ID NO: 385353 - DNA, 15 bp, Homo sapiens
actttttttacttat

SEQ ID NO: 385354 - DNA, 15 bp, Homo sapiens
ctttttttacttatc

SEQ ID NO: 385355 - DNA, 15 bp, Homo sapiens
tttttttacttatca

SEQ ID NO: 385356 - DNA, 15 bp, Homo sapiens
ttttttacttatcac

SEQ ID NO: 385357 - DNA, 15 bp, Homo sapiens
tttttacttatcact

SEQ ID NO: 385358 - DNA, 15 bp, Homo sapiens
ttttacttatcactt

SEQ ID NO: 385359 - DNA, 15 bp, Homo sapiens
tttacttatcacttt

SEQ ID NO: 385360 - DNA, 15 bp, Homo sapiens
ttacttatcactttt

SEQ ID NO: 385361 - DNA, 15 bp, Homo sapiens
tacttatcacttttt

SEQ ID NO: 385362 - DNA, 15 bp, Homo sapiens
acttatcactttttt

SEQ ID NO: 385363 - DNA, 15 bp, Homo sapiens
cttatcacttttttt

SEQ ID NO: 385364 - DNA, 15 bp, Homo sapiens
ttatcactttttttc

SEQ ID NO: 385365 - DNA, 15 bp, Homo sapiens
tatcactttttttcc

SEQ ID NO: 385366 - DNA, 15 bp, Homo sapiens
atcactttttttcct

SEQ ID NO: 385367 - DNA, 15 bp, Homo sapiens
tcactttttttcctt

SEQ ID NO: 385368 - DNA, 15 bp, Homo sapiens
cactttttttccttc

SEQ ID NO: 385369 - DNA, 15 bp, Homo sapiens
actttttttccttcc

SEQ ID NO: 385370 - DNA, 15 bp, Homo sapiens
ctttttttccttcca

SEQ ID NO: 385371 - DNA, 15 bp, Homo sapiens
tttttttccttccat

SEQ ID NO: 385372 - DNA, 15 bp, Homo sapiens
ttttttccttccatc

SEQ ID NO: 385373 - DNA, 15 bp, Homo sapiens
tttttccttccatct

SEQ ID NO: 385374 - DNA, 15 bp, Homo sapiens
ttttccttccatctc

SEQ ID NO: 385375 - DNA, 15 bp, Homo sapiens
tttccttccatctct

SEQ ID NO: 385376 - DNA, 15 bp, Homo sapiens
ttccttccatctctt

SEQ ID NO: 385377 - DNA, 15 bp, Homo sapiens
tccttccatctctta

SEQ ID NO: 385378 - DNA, 15 bp, Homo sapiens
ccttccatctcttaa

SEQ ID NO: 385379 - DNA, 15 bp, Homo sapiens
cttccatctcttaat

SEQ ID NO: 385380 - DNA, 15 bp, Homo sapiens
ttccatctcttaatg

SEQ ID NO: 385381 - DNA, 15 bp, Homo sapiens
tccatctcttaatgc

SEQ ID NO: 385382 - DNA, 15 bp, Homo sapiens
ccatctcttaatgct

SEQ ID NO: 385383 - DNA, 15 bp, Homo sapiens
catctcttaatgcta

SEQ ID NO: 385384 - DNA, 15 bp, Homo sapiens
atctcttaatgctaa

SEQ ID NO: 385385 - DNA, 15 bp, Homo sapiens
tctcttaatgctaat

SEQ ID NO: 385386 - DNA, 15 bp, Homo sapiens
ctcttaatgctaatt

SEQ ID NO: 385387 - DNA, 15 bp, Homo sapiens
tcttaatgctaatta

SEQ ID NO: 385388 - DNA, 15 bp, Homo sapiens
cttaatgctaattaa

SEQ ID NO: 385389 - DNA, 15 bp, Homo sapiens
ttaatgctaattaac

SEQ ID NO: 385390 - DNA, 15 bp, Homo sapiens
taatgctaattaaca

SEQ ID NO: 385391 - DNA, 15 bp, Homo sapiens
aatgctaattaacaa

SEQ ID NO: 385392 - DNA, 15 bp, Homo sapiens
atgctaattaacaaa

SEQ ID NO: 385393 - DNA, 15 bp, Homo sapiens
tgctaattaacaaat

SEQ ID NO: 385394 - DNA, 15 bp, Homo sapiens
gctaattaacaaatt

SEQ ID NO: 385395 - DNA, 15 bp, Homo sapiens
ctaattaacaaattt

SEQ ID NO: 385396 - DNA, 15 bp, Homo sapiens
taattaacaaatttt

SEQ ID NO: 385397 - DNA, 15 bp, Homo sapiens
aattaacaaattttc

SEQ ID NO: 385398 - DNA, 15 bp, Homo sapiens
attaacaaattttct

SEQ ID NO: 385399 - DNA, 15 bp, Homo sapiens
ttaacaaattttcta

SEQ ID NO: 385400 - DNA, 15 bp, Homo sapiens
taacaaattttctag

SEQ ID NO: 385401 - DNA, 15 bp, Homo sapiens
aacaaattttctagt

SEQ ID NO: 385402 - DNA, 15 bp, Homo sapiens
acaaattttctagtg

SEQ ID NO: 385403 - DNA, 15 bp, Homo sapiens
caaattttctagtgc

SEQ ID NO: 385404 - DNA, 15 bp, Homo sapiens
aaattttctagtgcc

SEQ ID NO: 385405 - DNA, 15 bp, Homo sapiens
aattttctagtgcca

SEQ ID NO: 385406 - DNA, 15 bp, Homo sapiens
attttctagtgccag

SEQ ID NO: 385407 - DNA, 15 bp, Homo sapiens
ttttctagtgccagt

SEQ ID NO: 385408 - DNA, 15 bp, Homo sapiens
tttctagtgccagtt

SEQ ID NO: 385409 - DNA, 15 bp, Homo sapiens
ttctagtgccagttg

SEQ ID NO: 385410 - DNA, 15 bp, Homo sapiens
tctagtgccagttga

SEQ ID NO: 385411 - DNA, 15 bp, Homo sapiens
ctagtgccagttgag

SEQ ID NO: 385412 - DNA, 15 bp, Homo sapiens
tagtgccagttgaga

SEQ ID NO: 385413 - DNA, 15 bp, Homo sapiens
agtgccagttgagat

SEQ ID NO: 385414 - DNA, 15 bp, Homo sapiens
gtgccagttgagata

SEQ ID NO: 385415 - DNA, 15 bp, Homo sapiens
tgccagttgagatag

SEQ ID NO: 385416 - DNA, 15 bp, Homo sapiens
gccagttgagatagt

SEQ ID NO: 385417 - DNA, 15 bp, Homo sapiens
ccagttgagatagtg

SEQ ID NO: 385418 - DNA, 15 bp, Homo sapiens
cagttgagatagtga

SEQ ID NO: 385419 - DNA, 15 bp, Homo sapiens
agttgagatagtgat

SEQ ID NO: 385420 - DNA, 15 bp, Homo sapiens
gttgagatagtgatt

SEQ ID NO: 385421 - DNA, 15 bp, Homo sapiens
ttgagatagtgattg

SEQ ID NO: 385422 - DNA, 15 bp, Homo sapiens
tgagatagtgattgt

SEQ ID NO: 385423 - DNA, 15 bp, Homo sapiens
gagatagtgattgtt

SEQ ID NO: 385424 - DNA, 15 bp, Homo sapiens
agatagtgattgttg

SEQ ID NO: 385425 - DNA, 15 bp, Homo sapiens
gatagtgattgttga

SEQ ID NO: 385426 - DNA, 15 bp, Homo sapiens
atagtgattgttgaa

SEQ ID NO: 385427 - DNA, 15 bp, Homo sapiens
tagtgattgttgaaa

SEQ ID NO: 385428 - DNA, 15 bp, Homo sapiens
agtgattgttgaaat

SEQ ID NO: 385429 - DNA, 15 bp, Homo sapiens
gtgattgttgaaatg

SEQ ID NO: 385430 - DNA, 15 bp, Homo sapiens
tgattgttgaaatgt

SEQ ID NO: 385431 - DNA, 15 bp, Homo sapiens
gattgttgaaatgtg

SEQ ID NO: 385432 - DNA, 15 bp, Homo sapiens
attgttgaaatgtgt

SEQ ID NO: 385433 - DNA, 15 bp, Homo sapiens
ttgttgaaatgtgtt

SEQ ID NO: 385434 - DNA, 15 bp, Homo sapiens
tgttgaaatgtgttt

SEQ ID NO: 385435 - DNA, 15 bp, Homo sapiens
gttgaaatgtgttta

SEQ ID NO: 385436 - DNA, 15 bp, Homo sapiens
ttgaaatgtgtttat

SEQ ID NO: 385437 - DNA, 15 bp, Homo sapiens
tgaaatgtgtttata

SEQ ID NO: 385438 - DNA, 15 bp, Homo sapiens
gaaatgtgtttatag

SEQ ID NO: 385439 - DNA, 15 bp, Homo sapiens
aaatgtgtttatagc

SEQ ID NO: 385440 - DNA, 15 bp, Homo sapiens
aatgtgtttatagca

SEQ ID NO: 385441 - DNA, 15 bp, Homo sapiens
atgtgtttatagcac

SEQ ID NO: 385442 - DNA, 15 bp, Homo sapiens
tgtgtttatagcaca

SEQ ID NO: 385443 - DNA, 15 bp, Homo sapiens
gtgtttatagcacag

SEQ ID NO: 385444 - DNA, 15 bp, Homo sapiens
tgtttatagcacagt

SEQ ID NO: 385445 - DNA, 15 bp, Homo sapiens
gtttatagcacagtc

SEQ ID NO: 385446 - DNA, 15 bp, Homo sapiens
tttatagcacagtca

SEQ ID NO: 385447 - DNA, 15 bp, Homo sapiens
ttatagcacagtcag

SEQ ID NO: 385448 - DNA, 15 bp, Homo sapiens
tatagcacagtcagt

SEQ ID NO: 385449 - DNA, 15 bp, Homo sapiens
atagcacagtcagtg

SEQ ID NO: 385450 - DNA, 15 bp, Homo sapiens
tagcacagtcagtgt

SEQ ID NO: 385451 - DNA, 15 bp, Homo sapiens
agcacagtcagtgtg

SEQ ID NO: 385452 - DNA, 15 bp, Homo sapiens
gcacagtcagtgtgg

SEQ ID NO: 385453 - DNA, 15 bp, Homo sapiens
cacagtcagtgtgga

SEQ ID NO: 385454 - DNA, 15 bp, Homo sapiens
acagtcagtgtggat

SEQ ID NO: 385455 - DNA, 15 bp, Homo sapiens
cagtcagtgtggatg

SEQ ID NO: 385456 - DNA, 15 bp, Homo sapiens
agtcagtgtggatgc

SEQ ID NO: 385457 - DNA, 15 bp, Homo sapiens
gtcagtgtggatgcc

SEQ ID NO: 385458 - DNA, 15 bp, Homo sapiens
tcagtgtggatgcct

SEQ ID NO: 385459 - DNA, 15 bp, Homo sapiens
cagtgtggatgcctg

SEQ ID NO: 385460 - DNA, 15 bp, Homo sapiens
agtgtggatgcctga

SEQ ID NO: 385461 - DNA, 15 bp, Homo sapiens
gtgtggatgcctgat

SEQ ID NO: 385462 - DNA, 15 bp, Homo sapiens
tgtggatgcctgatt

SEQ ID NO: 385463 - DNA, 15 bp, Homo sapiens
gtggatgcctgattt

SEQ ID NO: 385464 - DNA, 15 bp, Homo sapiens
tggatgcctgatttg

SEQ ID NO: 385465 - DNA, 15 bp, Homo sapiens
ggatgcctgatttgg

SEQ ID NO: 385466 - DNA, 15 bp, Homo sapiens
gatgcctgatttggg

SEQ ID NO: 385467 - DNA, 15 bp, Homo sapiens
atgcctgatttgggt

SEQ ID NO: 385468 - DNA, 15 bp, Homo sapiens
tgcctgatttgggtc

SEQ ID NO: 385469 - DNA, 15 bp, Homo sapiens
gcctgatttgggtct

SEQ ID NO: 385470 - DNA, 15 bp, Homo sapiens
cctgatttgggtcta

SEQ ID NO: 385471 - DNA, 15 bp, Homo sapiens
ctgatttgggtctaa

SEQ ID NO: 385472 - DNA, 15 bp, Homo sapiens
tgatttgggtctaaa

SEQ ID NO: 385473 - DNA, 15 bp, Homo sapiens
gatttgggtctaaaa

SEQ ID NO: 385474 - DNA, 15 bp, Homo sapiens
atttgggtctaaaat

SEQ ID NO: 385475 - DNA, 15 bp, Homo sapiens
tttgggtctaaaatg

SEQ ID NO: 385476 - DNA, 15 bp, Homo sapiens
ttgggtctaaaatgc

SEQ ID NO: 385477 - DNA, 15 bp, Homo sapiens
tgggtctaaaatgct

SEQ ID NO: 385478 - DNA, 15 bp, Homo sapiens
gggtctaaaatgcta

SEQ ID NO: 385479 - DNA, 15 bp, Homo sapiens
ggtctaaaatgctat

SEQ ID NO: 385480 - DNA, 15 bp, Homo sapiens
gtctaaaatgctatt

SEQ ID NO: 385481 - DNA, 15 bp, Homo sapiens
tctaaaatgctattt

SEQ ID NO: 385482 - DNA, 15 bp, Homo sapiens
ctaaaatgctatttt

SEQ ID NO: 385483 - DNA, 15 bp, Homo sapiens
taaaatgctatttta

SEQ ID NO: 385484 - DNA, 15 bp, Homo sapiens
aaaatgctattttag

SEQ ID NO: 385485 - DNA, 15 bp, Homo sapiens
aaatgctattttagc

SEQ ID NO: 385486 - DNA, 15 bp, Homo sapiens
aatgctattttagct

SEQ ID NO: 385487 - DNA, 15 bp, Homo sapiens
atgctattttagctg

SEQ ID NO: 385488 - DNA, 15 bp, Homo sapiens
tgctattttagctgt

SEQ ID NO: 385489 - DNA, 15 bp, Homo sapiens
gctattttagctgta

SEQ ID NO: 385490 - DNA, 15 bp, Homo sapiens
ctattttagctgtat

SEQ ID NO: 385491 - DNA, 15 bp, Homo sapiens
tattttagctgtata

SEQ ID NO: 385492 - DNA, 15 bp, Homo sapiens
attttagctgtatat

SEQ ID NO: 385493 - DNA, 15 bp, Homo sapiens
ttttagctgtatata

SEQ ID NO: 385494 - DNA, 15 bp, Homo sapiens
tttagctgtatatat

SEQ ID NO: 385495 - DNA, 15 bp, Homo sapiens
ttagctgtatatatt

SEQ ID NO: 385496 - DNA, 15 bp, Homo sapiens
tagctgtatatattt

SEQ ID NO: 385497 - DNA, 15 bp, Homo sapiens
agctgtatatatttt

SEQ ID NO: 385498 - DNA, 15 bp, Homo sapiens
gctgtatatattttg

SEQ ID NO: 385499 - DNA, 15 bp, Homo sapiens
ctgtatatattttgg

SEQ ID NO: 385500 - DNA, 15 bp, Homo sapiens
tgtatatattttggc

SEQ ID NO: 385501 - DNA, 15 bp, Homo sapiens
gtatatattttggca

SEQ ID NO: 385502 - DNA, 15 bp, Homo sapiens
tatatattttggcac

SEQ ID NO: 385503 - DNA, 15 bp, Homo sapiens
atatattttggcact

SEQ ID NO: 385504 - DNA, 15 bp, Homo sapiens
tatattttggcactc

SEQ ID NO: 385505 - DNA, 15 bp, Homo sapiens
atattttggcactcc

SEQ ID NO: 385506 - DNA, 15 bp, Homo sapiens
tattttggcactcca

SEQ ID NO: 385507 - DNA, 15 bp, Homo sapiens
attttggcactccag

SEQ ID NO: 385508 - DNA, 15 bp, Homo sapiens
ttttggcactccagg

SEQ ID NO: 385509 - DNA, 15 bp, Homo sapiens
tttggcactccaggg

SEQ ID NO: 385510 - DNA, 15 bp, Homo sapiens
ttggcactccagggc

SEQ ID NO: 385511 - DNA, 15 bp, Homo sapiens
tggcactccagggca

SEQ ID NO: 385512 - DNA, 15 bp, Homo sapiens
ggcactccagggcaa

SEQ ID NO: 385513 - DNA, 15 bp, Homo sapiens
gcactccagggcaaa

SEQ ID NO: 385514 - DNA, 15 bp, Homo sapiens
cactccagggcaaaa

SEQ ID NO: 385515 - DNA, 15 bp, Homo sapiens
actccagggcaaaaa

SEQ ID NO: 385516 - DNA, 15 bp, Homo sapiens
ctccagggcaaaaat

SEQ ID NO: 385517 - DNA, 15 bp, Homo sapiens
tccagggcaaaaata

SEQ ID NO: 385518 - DNA, 15 bp, Homo sapiens
ccagggcaaaaataa

SEQ ID NO: 385519 - DNA, 15 bp, Homo sapiens
cagggcaaaaataac

SEQ ID NO: 385520 - DNA, 15 bp, Homo sapiens
agggcaaaaataaca

SEQ ID NO: 385521 - DNA, 15 bp, Homo sapiens
gggcaaaaataacat

SEQ ID NO: 385522 - DNA, 15 bp, Homo sapiens
ggcaaaaataacatt

SEQ ID NO: 385523 - DNA, 15 bp, Homo sapiens
gcaaaaataacatta

SEQ ID NO: 385524 - DNA, 15 bp, Homo sapiens
caaaaataacattat

SEQ ID NO: 385525 - DNA, 15 bp, Homo sapiens
aaaaataacattata

SEQ ID NO: 385526 - DNA, 15 bp, Homo sapiens
aaaataacattatat

SEQ ID NO: 385527 - DNA, 15 bp, Homo sapiens
aaataacattatata

SEQ ID NO: 385528 - DNA, 15 bp, Homo sapiens
aataacattatatat

SEQ ID NO: 385529 - DNA, 15 bp, Homo sapiens
ataacattatatata

SEQ ID NO: 385530 - DNA, 15 bp, Homo sapiens
taacattatatatat

SEQ ID NO: 385531 - DNA, 15 bp, Homo sapiens
aacattatatatata

SEQ ID NO: 385532 - DNA, 15 bp, Homo sapiens
acattatatatatat

SEQ ID NO: 385533 - DNA, 15 bp, Homo sapiens
cattatatatatata

SEQ ID NO: 385534 - DNA, 15 bp, Homo sapiens
attatatatatatat

SEQ ID NO: 385535 - DNA, 15 bp, Homo sapiens
tatatatatatacat

SEQ ID NO: 385536 - DNA, 15 bp, Homo sapiens
atatatatatacata

SEQ ID NO: 385537 - DNA, 15 bp, Homo sapiens
tatatatatacatac

SEQ ID NO: 385538 - DNA, 15 bp, Homo sapiens
atatatatacataca

SEQ ID NO: 385539 - DNA, 15 bp, Homo sapiens
tatatatacatacac

SEQ ID NO: 385540 - DNA, 15 bp, Homo sapiens
atatatacatacaca

SEQ ID NO: 385541 - DNA, 15 bp, Homo sapiens
tatatacatacacac

SEQ ID NO: 385542 - DNA, 15 bp, Homo sapiens
atatacatacacaca

SEQ ID NO: 385543 - DNA, 15 bp, Homo sapiens
tatacatacacacac

SEQ ID NO: 385544 - DNA, 15 bp, Homo sapiens
atacacacacacacg

SEQ ID NO: 385545 - DNA, 15 bp, Homo sapiens
tacacacacacacgt

SEQ ID NO: 385546 - DNA, 15 bp, Homo sapiens
acacacacacacgta

SEQ ID NO: 385547 - DNA, 15 bp, Homo sapiens
cacacacacacgtat

SEQ ID NO: 385548 - DNA, 15 bp, Homo sapiens
acacacacacgtata

SEQ ID NO: 385549 - DNA, 15 bp, Homo sapiens
cacacacacgtatac

SEQ ID NO: 385550 - DNA, 15 bp, Homo sapiens
acacacacgtataca

SEQ ID NO: 385551 - DNA, 15 bp, Homo sapiens
cacacacgtatacac

SEQ ID NO: 385552 - DNA, 15 bp, Homo sapiens
acacacgtatacaca

SEQ ID NO: 385553 - DNA, 15 bp, Homo sapiens
cacacgtatacacac

SEQ ID NO: 385554 - DNA, 15 bp, Homo sapiens
acacgtatacacacc

SEQ ID NO: 385555 - DNA, 15 bp, Homo sapiens
cacgtatacacacct

SEQ ID NO: 385556 - DNA, 15 bp, Homo sapiens
acgtatacacacctg

SEQ ID NO: 385557 - DNA, 15 bp, Homo sapiens
cgtatacacacctgt

SEQ ID NO: 385558 - DNA, 15 bp, Homo sapiens
gtatacacacctgtg

SEQ ID NO: 385559 - DNA, 15 bp, Homo sapiens
tatacacacctgtgt

SEQ ID NO: 385560 - DNA, 15 bp, Homo sapiens
atacacacctgtgta

SEQ ID NO: 385561 - DNA, 15 bp, Homo sapiens
tacacacctgtgtaa

SEQ ID NO: 385562 - DNA, 15 bp, Homo sapiens
acacacctgtgtaac

SEQ ID NO: 385563 - DNA, 15 bp, Homo sapiens
cacacctgtgtaaca

SEQ ID NO: 385564 - DNA, 15 bp, Homo sapiens
acacctgtgtaacac

SEQ ID NO: 385565 - DNA, 15 bp, Homo sapiens
cacctgtgtaacaca

SEQ ID NO: 385566 - DNA, 15 bp, Homo sapiens
acctgtgtaacacac

SEQ ID NO: 385567 - DNA, 15 bp, Homo sapiens
cctgtgtaacacaca

SEQ ID NO: 385568 - DNA, 15 bp, Homo sapiens
ctgtgtaacacacat

SEQ ID NO: 385569 - DNA, 15 bp, Homo sapiens
tgtgtaacacacatg

SEQ ID NO: 385570 - DNA, 15 bp, Homo sapiens
gtgtaacacacatgt

SEQ ID NO: 385571 - DNA, 15 bp, Homo sapiens
tgtaacacacatgta

SEQ ID NO: 385572 - DNA, 15 bp, Homo sapiens
gtaacacacatgtat

SEQ ID NO: 385573 - DNA, 15 bp, Homo sapiens
taacacacatgtata

SEQ ID NO: 385574 - DNA, 15 bp, Homo sapiens
aacacacatgtatat

SEQ ID NO: 385575 - DNA, 15 bp, Homo sapiens
acacacatgtatata

SEQ ID NO: 385576 - DNA, 15 bp, Homo sapiens
cacacatgtatatat

SEQ ID NO: 385577 - DNA, 15 bp, Homo sapiens
acacatgtatatata

SEQ ID NO: 385578 - DNA, 15 bp, Homo sapiens
cacatgtatatatac

SEQ ID NO: 385579 - DNA, 15 bp, Homo sapiens
acatgtatatataca

SEQ ID NO: 385580 - DNA, 15 bp, Homo sapiens
catgtatatatacat

SEQ ID NO: 385581 - DNA, 15 bp, Homo sapiens
atgtatatatacata

SEQ ID NO: 385582 - DNA, 15 bp, Homo sapiens
tgtatatatacatac

SEQ ID NO: 385583 - DNA, 15 bp, Homo sapiens
gtatatatacataca

SEQ ID NO: 385584 - DNA, 15 bp, Homo sapiens
tatatacatacacat

SEQ ID NO: 385585 - DNA, 15 bp, Homo sapiens
atatacatacacata

SEQ ID NO: 385586 - DNA, 15 bp, Homo sapiens
tatacatacacatat

SEQ ID NO: 385587 - DNA, 15 bp, Homo sapiens
atacatacacatata

SEQ ID NO: 385588 - DNA, 15 bp, Homo sapiens
tacatacacatatat

SEQ ID NO: 385589 - DNA, 15 bp, Homo sapiens
acatacacatatatg

SEQ ID NO: 385590 - DNA, 15 bp, Homo sapiens
catacacatatatgt

SEQ ID NO: 385591 - DNA, 15 bp, Homo sapiens
atacacatatatgtg

SEQ ID NO: 385592 - DNA, 15 bp, Homo sapiens
tacacatatatgtgt

SEQ ID NO: 385593 - DNA, 15 bp, Homo sapiens
acacatatatgtgtg

SEQ ID NO: 385594 - DNA, 15 bp, Homo sapiens
cacatatatgtgtgt

SEQ ID NO: 385595 - DNA, 15 bp, Homo sapiens
acatatatgtgtgtg

SEQ ID NO: 385596 - DNA, 15 bp, Homo sapiens
catatatgtgtgtgt

SEQ ID NO: 385597 - DNA, 15 bp, Homo sapiens
atatatgtgtgtgtt

SEQ ID NO: 385598 - DNA, 15 bp, Homo sapiens
tatatgtgtgtgttt

SEQ ID NO: 385599 - DNA, 15 bp, Homo sapiens
atatgtgtgtgttta

SEQ ID NO: 385600 - DNA, 15 bp, Homo sapiens
tatgtgtgtgtttat

SEQ ID NO: 385601 - DNA, 15 bp, Homo sapiens
atgtgtgtgtttata

SEQ ID NO: 385602 - DNA, 15 bp, Homo sapiens
tgtgtgtgtttatac

SEQ ID NO: 385603 - DNA, 15 bp, Homo sapiens
gtgtgtgtttataca

SEQ ID NO: 385604 - DNA, 15 bp, Homo sapiens
tgtgtgtttatacac

SEQ ID NO: 385605 - DNA, 15 bp, Homo sapiens
gtgtgtttatacaca

SEQ ID NO: 385606 - DNA, 15 bp, Homo sapiens
tgtgtttatacacac

SEQ ID NO: 385607 - DNA, 15 bp, Homo sapiens
gtgtttatacacaca

SEQ ID NO: 385608 - DNA, 15 bp, Homo sapiens
tgtttatacacacac

SEQ ID NO: 385609 - DNA, 15 bp, Homo sapiens
gtttatacacacaca

SEQ ID NO: 385610 - DNA, 15 bp, Homo sapiens
tttatacacacacat

SEQ ID NO: 385611 - DNA, 15 bp, Homo sapiens
ttatacacacacata

SEQ ID NO: 385612 - DNA, 15 bp, Homo sapiens
tatacacacacatat

SEQ ID NO: 385613 - DNA, 15 bp, Homo sapiens
acacacacatataca

SEQ ID NO: 385614 - DNA, 15 bp, Homo sapiens
cacacacatatacac

SEQ ID NO: 385615 - DNA, 15 bp, Homo sapiens
acacacatatacaca

SEQ ID NO: 385616 - DNA, 15 bp, Homo sapiens
cacacatatacacac

SEQ ID NO: 385617 - DNA, 15 bp, Homo sapiens
acacatatacacaca

SEQ ID NO: 385618 - DNA, 15 bp, Homo sapiens
cacatatacacacac

SEQ ID NO: 385619 - DNA, 15 bp, Homo sapiens
acatatacacacaca

SEQ ID NO: 385620 - DNA, 15 bp, Homo sapiens
catatacacacacat

SEQ ID NO: 385621 - DNA, 15 bp, Homo sapiens
atatacacacacata

SEQ ID NO: 385622 - DNA, 15 bp, Homo sapiens
tacacacacatataa

SEQ ID NO: 385623 - DNA, 15 bp, Homo sapiens
acacacacatataac

SEQ ID NO: 385624 - DNA, 15 bp, Homo sapiens
cacacacatataact

SEQ ID NO: 385625 - DNA, 15 bp, Homo sapiens
acacacatataactg

SEQ ID NO: 385626 - DNA, 15 bp, Homo sapiens
cacacatataactgt

SEQ ID NO: 385627 - DNA, 15 bp, Homo sapiens
acacatataactgtg

SEQ ID NO: 385628 - DNA, 15 bp, Homo sapiens
cacatataactgtgt

SEQ ID NO: 385629 - DNA, 15 bp, Homo sapiens
acatataactgtgtg

SEQ ID NO: 385630 - DNA, 15 bp, Homo sapiens
catataactgtgtgt

SEQ ID NO: 385631 - DNA, 15 bp, Homo sapiens
atataactgtgtgta

SEQ ID NO: 385632 - DNA, 15 bp, Homo sapiens
tataactgtgtgtat

SEQ ID NO: 385633 - DNA, 15 bp, Homo sapiens
ataactgtgtgtata

SEQ ID NO: 385634 - DNA, 15 bp, Homo sapiens
taactgtgtgtatag

SEQ ID NO: 385635 - DNA, 15 bp, Homo sapiens
aactgtgtgtataga

SEQ ID NO: 385636 - DNA, 15 bp, Homo sapiens
actgtgtgtatagac

SEQ ID NO: 385637 - DNA, 15 bp, Homo sapiens
ctgtgtgtatagacg

SEQ ID NO: 385638 - DNA, 15 bp, Homo sapiens
tgtgtgtatagacgt

SEQ ID NO: 385639 - DNA, 15 bp, Homo sapiens
gtgtgtatagacgtg

SEQ ID NO: 385640 - DNA, 15 bp, Homo sapiens
tgtgtatagacgtgt

SEQ ID NO: 385641 - DNA, 15 bp, Homo sapiens
gtgtatagacgtgtt

SEQ ID NO: 385642 - DNA, 15 bp, Homo sapiens
tgtatagacgtgttt

SEQ ID NO: 385643 - DNA, 15 bp, Homo sapiens
gtatagacgtgtttg

SEQ ID NO: 385644 - DNA, 15 bp, Homo sapiens
tatagacgtgtttgc

SEQ ID NO: 385645 - DNA, 15 bp, Homo sapiens
atagacgtgtttgca

SEQ ID NO: 385646 - DNA, 15 bp, Homo sapiens
tagacgtgtttgcac

SEQ ID NO: 385647 - DNA, 15 bp, Homo sapiens
agacgtgtttgcaca

SEQ ID NO: 385648 - DNA, 15 bp, Homo sapiens
gacgtgtttgcacat

SEQ ID NO: 385649 - DNA, 15 bp, Homo sapiens
acgtgtttgcacatg

SEQ ID NO: 385650 - DNA, 15 bp, Homo sapiens
cgtgtttgcacatgc

SEQ ID NO: 385651 - DNA, 15 bp, Homo sapiens
gtgtttgcacatgca

SEQ ID NO: 385652 - DNA, 15 bp, Homo sapiens
tgtttgcacatgcat

SEQ ID NO: 385653 - DNA, 15 bp, Homo sapiens
gtttgcacatgcatg

SEQ ID NO: 385654 - DNA, 15 bp, Homo sapiens
tttgcacatgcatgt

SEQ ID NO: 385655 - DNA, 15 bp, Homo sapiens
ttgcacatgcatgta

SEQ ID NO: 385656 - DNA, 15 bp, Homo sapiens
tgcacatgcatgtat

SEQ ID NO: 385657 - DNA, 15 bp, Homo sapiens
gcacatgcatgtata

SEQ ID NO: 385658 - DNA, 15 bp, Homo sapiens
cacatgcatgtatat

SEQ ID NO: 385659 - DNA, 15 bp, Homo sapiens
acatgcatgtatata

SEQ ID NO: 385660 - DNA, 15 bp, Homo sapiens
catgcatgtatatac

SEQ ID NO: 385661 - DNA, 15 bp, Homo sapiens
atgcatgtatataca

SEQ ID NO: 385662 - DNA, 15 bp, Homo sapiens
tgcatgtatatacag

SEQ ID NO: 385663 - DNA, 15 bp, Homo sapiens
gcatgtatatacagg

SEQ ID NO: 385664 - DNA, 15 bp, Homo sapiens
catgtatatacaggt

SEQ ID NO: 385665 - DNA, 15 bp, Homo sapiens
atgtatatacaggta

SEQ ID NO: 385666 - DNA, 15 bp, Homo sapiens
tgtatatacaggtat

SEQ ID NO: 385667 - DNA, 15 bp, Homo sapiens
gtatatacaggtatg

SEQ ID NO: 385668 - DNA, 15 bp, Homo sapiens
tatatacaggtatgt

SEQ ID NO: 385669 - DNA, 15 bp, Homo sapiens
atatacaggtatgta

SEQ ID NO: 385670 - DNA, 15 bp, Homo sapiens
tatacaggtatgtat

SEQ ID NO: 385671 - DNA, 15 bp, Homo sapiens
atacaggtatgtata

SEQ ID NO: 385672 - DNA, 15 bp, Homo sapiens
tacaggtatgtatat

SEQ ID NO: 385673 - DNA, 15 bp, Homo sapiens
acaggtatgtatata

SEQ ID NO: 385674 - DNA, 15 bp, Homo sapiens
caggtatgtatatat

SEQ ID NO: 385675 - DNA, 15 bp, Homo sapiens
aggtatgtatatata

SEQ ID NO: 385676 - DNA, 15 bp, Homo sapiens
ggtatgtatatatat

SEQ ID NO: 385677 - DNA, 15 bp, Homo sapiens
gtatgtatatatatg

SEQ ID NO: 385678 - DNA, 15 bp, Homo sapiens
tatgtatatatatgc

SEQ ID NO: 385679 - DNA, 15 bp, Homo sapiens
atgtatatatatgca

SEQ ID NO: 385680 - DNA, 15 bp, Homo sapiens
tgtatatatatgcac

SEQ ID NO: 385681 - DNA, 15 bp, Homo sapiens
gtatatatatgcaca

SEQ ID NO: 385682 - DNA, 15 bp, Homo sapiens
tatatatatgcacac

SEQ ID NO: 385683 - DNA, 15 bp, Homo sapiens
atatatatgcacact

SEQ ID NO: 385684 - DNA, 15 bp, Homo sapiens
tatatatgcacactc

SEQ ID NO: 385685 - DNA, 15 bp, Homo sapiens
atatatgcacactca

SEQ ID NO: 385686 - DNA, 15 bp, Homo sapiens
tatatgcacactcat

SEQ ID NO: 385687 - DNA, 15 bp, Homo sapiens
atatgcacactcatg

SEQ ID NO: 385688 - DNA, 15 bp, Homo sapiens
tatgcacactcatgt

SEQ ID NO: 385689 - DNA, 15 bp, Homo sapiens
atgcacactcatgta

SEQ ID NO: 385690 - DNA, 15 bp, Homo sapiens
tgcacactcatgtat

SEQ ID NO: 385691 - DNA, 15 bp, Homo sapiens
gcacactcatgtata

SEQ ID NO: 385692 - DNA, 15 bp, Homo sapiens
cacactcatgtatat

SEQ ID NO: 385693 - DNA, 15 bp, Homo sapiens
acactcatgtatata

SEQ ID NO: 385694 - DNA, 15 bp, Homo sapiens
cactcatgtatatac

SEQ ID NO: 385695 - DNA, 15 bp, Homo sapiens
actcatgtatataca

SEQ ID NO: 385696 - DNA, 15 bp, Homo sapiens
ctcatgtatatacac

SEQ ID NO: 385697 - DNA, 15 bp, Homo sapiens
tcatgtatatacaca

SEQ ID NO: 385698 - DNA, 15 bp, Homo sapiens
catgtatatacacac

SEQ ID NO: 385699 - DNA, 15 bp, Homo sapiens
atgtatatacacaca

SEQ ID NO: 385700 - DNA, 15 bp, Homo sapiens
tgtatatacacacat

SEQ ID NO: 385701 - DNA, 15 bp, Homo sapiens
gtatatacacacata

SEQ ID NO: 385702 - DNA, 15 bp, Homo sapiens
tatatacacacatag

SEQ ID NO: 385703 - DNA, 15 bp, Homo sapiens
atatacacacatagt

SEQ ID NO: 385704 - DNA, 15 bp, Homo sapiens
tatacacacatagtt

SEQ ID NO: 385705 - DNA, 15 bp, Homo sapiens
atacacacatagtta

SEQ ID NO: 385706 - DNA, 15 bp, Homo sapiens
tacacacatagttat

SEQ ID NO: 385707 - DNA, 15 bp, Homo sapiens
acacacatagttatc

SEQ ID NO: 385708 - DNA, 15 bp, Homo sapiens
cacacatagttatct

SEQ ID NO: 385709 - DNA, 15 bp, Homo sapiens
acacatagttatcta

SEQ ID NO: 385710 - DNA, 15 bp, Homo sapiens
cacatagttatctac

SEQ ID NO: 385711 - DNA, 15 bp, Homo sapiens
acatagttatctaca

SEQ ID NO: 385712 - DNA, 15 bp, Homo sapiens
catagttatctacac

SEQ ID NO: 385713 - DNA, 15 bp, Homo sapiens
atagttatctacact

SEQ ID NO: 385714 - DNA, 15 bp, Homo sapiens
tagttatctacactg

SEQ ID NO: 385715 - DNA, 15 bp, Homo sapiens
agttatctacactga

SEQ ID NO: 385716 - DNA, 15 bp, Homo sapiens
gttatctacactgaa

SEQ ID NO: 385717 - DNA, 15 bp, Homo sapiens
ttatctacactgaag

SEQ ID NO: 385718 - DNA, 15 bp, Homo sapiens
tatctacactgaagt

SEQ ID NO: 385719 - DNA, 15 bp, Homo sapiens
atctacactgaagta

SEQ ID NO: 385720 - DNA, 15 bp, Homo sapiens
tctacactgaagtat

SEQ ID NO: 385721 - DNA, 15 bp, Homo sapiens
ctacactgaagtatt

SEQ ID NO: 385722 - DNA, 15 bp, Homo sapiens
tacactgaagtattg

SEQ ID NO: 385723 - DNA, 15 bp, Homo sapiens
acactgaagtattgt

SEQ ID NO: 385724 - DNA, 15 bp, Homo sapiens
cactgaagtattgta

SEQ ID NO: 385725 - DNA, 15 bp, Homo sapiens
actgaagtattgtaa

SEQ ID NO: 385726 - DNA, 15 bp, Homo sapiens
ctgaagtattgtaaa

SEQ ID NO: 385727 - DNA, 15 bp, Homo sapiens
tgaagtattgtaaag

SEQ ID NO: 385728 - DNA, 15 bp, Homo sapiens
gaagtattgtaaagg

SEQ ID NO: 385729 - DNA, 15 bp, Homo sapiens
aagtattgtaaagga

SEQ ID NO: 385730 - DNA, 15 bp, Homo sapiens
agtattgtaaaggaa

SEQ ID NO: 385731 - DNA, 15 bp, Homo sapiens
gtattgtaaaggaaa

SEQ ID NO: 385732 - DNA, 15 bp, Homo sapiens
tattgtaaaggaaat

SEQ ID NO: 385733 - DNA, 15 bp, Homo sapiens
attgtaaaggaaatg

SEQ ID NO: 385734 - DNA, 15 bp, Homo sapiens
ttgtaaaggaaatga

SEQ ID NO: 385735 - DNA, 15 bp, Homo sapiens
tgtaaaggaaatgag

SEQ ID NO: 385736 - DNA, 15 bp, Homo sapiens
gtaaaggaaatgaga

SEQ ID NO: 385737 - DNA, 15 bp, Homo sapiens
taaaggaaatgagac

SEQ ID NO: 385738 - DNA, 15 bp, Homo sapiens
aaaggaaatgagaca

SEQ ID NO: 385739 - DNA, 15 bp, Homo sapiens
aaggaaatgagacag

SEQ ID NO: 385740 - DNA, 15 bp, Homo sapiens
aggaaatgagacagt

SEQ ID NO: 385741 - DNA, 15 bp, Homo sapiens
ggaaatgagacagta

SEQ ID NO: 385742 - DNA, 15 bp, Homo sapiens
gaaatgagacagtat

SEQ ID NO: 385743 - DNA, 15 bp, Homo sapiens
aaatgagacagtata

SEQ ID NO: 385744 - DNA, 15 bp, Homo sapiens
aatgagacagtataa

SEQ ID NO: 385745 - DNA, 15 bp, Homo sapiens
atgagacagtataac

SEQ ID NO: 385746 - DNA, 15 bp, Homo sapiens
tgagacagtataact

SEQ ID NO: 385747 - DNA, 15 bp, Homo sapiens
gagacagtataactg

SEQ ID NO: 385748 - DNA, 15 bp, Homo sapiens
agacagtataactgt

SEQ ID NO: 385749 - DNA, 15 bp, Homo sapiens
gacagtataactgtg

SEQ ID NO: 385750 - DNA, 15 bp, Homo sapiens
acagtataactgtgt

SEQ ID NO: 385751 - DNA, 15 bp, Homo sapiens
cagtataactgtgtg

SEQ ID NO: 385752 - DNA, 15 bp, Homo sapiens
agtataactgtgtgc

SEQ ID NO: 385753 - DNA, 15 bp, Homo sapiens
gtataactgtgtgct

SEQ ID NO: 385754 - DNA, 15 bp, Homo sapiens
tataactgtgtgcta

SEQ ID NO: 385755 - DNA, 15 bp, Homo sapiens
ataactgtgtgctat

SEQ ID NO: 385756 - DNA, 15 bp, Homo sapiens
taactgtgtgctata

SEQ ID NO: 385757 - DNA, 15 bp, Homo sapiens
aactgtgtgctataa

SEQ ID NO: 385758 - DNA, 15 bp, Homo sapiens
actgtgtgctataaa

SEQ ID NO: 385759 - DNA, 15 bp, Homo sapiens
ctgtgtgctataaat

SEQ ID NO: 385760 - DNA, 15 bp, Homo sapiens
tgtgtgctataaata

SEQ ID NO: 385761 - DNA, 15 bp, Homo sapiens
gtgtgctataaatag

SEQ ID NO: 385762 - DNA, 15 bp, Homo sapiens
tgtgctataaatagt

SEQ ID NO: 385763 - DNA, 15 bp, Homo sapiens
gtgctataaatagtt

SEQ ID NO: 385764 - DNA, 15 bp, Homo sapiens
tgctataaatagttt

SEQ ID NO: 385765 - DNA, 15 bp, Homo sapiens
gctataaatagtttc

SEQ ID NO: 385766 - DNA, 15 bp, Homo sapiens
ctataaatagtttct

SEQ ID NO: 385767 - DNA, 15 bp, Homo sapiens
tataaatagtttctt

SEQ ID NO: 385768 - DNA, 15 bp, Homo sapiens
ataaatagtttctta

SEQ ID NO: 385769 - DNA, 15 bp, Homo sapiens
taaatagtttcttag

SEQ ID NO: 385770 - DNA, 15 bp, Homo sapiens
aaatagtttcttaga

SEQ ID NO: 385771 - DNA, 15 bp, Homo sapiens
aatagtttcttagaa

SEQ ID NO: 385772 - DNA, 15 bp, Homo sapiens
atagtttcttagaaa

SEQ ID NO: 385773 - DNA, 15 bp, Homo sapiens
tagtttcttagaaat

SEQ ID NO: 385774 - DNA, 15 bp, Homo sapiens
agtttcttagaaatc

SEQ ID NO: 385775 - DNA, 15 bp, Homo sapiens
gtttcttagaaatca

SEQ ID NO: 385776 - DNA, 15 bp, Homo sapiens
tttcttagaaatcac

SEQ ID NO: 385777 - DNA, 15 bp, Homo sapiens
ttcttagaaatcact

SEQ ID NO: 385778 - DNA, 15 bp, Homo sapiens
tcttagaaatcacta

SEQ ID NO: 385779 - DNA, 15 bp, Homo sapiens
cttagaaatcactaa

SEQ ID NO: 385780 - DNA, 15 bp, Homo sapiens
ttagaaatcactaat

SEQ ID NO: 385781 - DNA, 15 bp, Homo sapiens
tagaaatcactaatt

SEQ ID NO: 385782 - DNA, 15 bp, Homo sapiens
agaaatcactaatta

SEQ ID NO: 385783 - DNA, 15 bp, Homo sapiens
gaaatcactaattac

SEQ ID NO: 385784 - DNA, 15 bp, Homo sapiens
aaatcactaattact

SEQ ID NO: 385785 - DNA, 15 bp, Homo sapiens
aatcactaattactc

SEQ ID NO: 385786 - DNA, 15 bp, Homo sapiens
atcactaattactct

SEQ ID NO: 385787 - DNA, 15 bp, Homo sapiens
tcactaattactctg

SEQ ID NO: 385788 - DNA, 15 bp, Homo sapiens
cactaattactctgt

SEQ ID NO: 385789 - DNA, 15 bp, Homo sapiens
actaattactctgtg

SEQ ID NO: 385790 - DNA, 15 bp, Homo sapiens
ctaattactctgtgt

SEQ ID NO: 385791 - DNA, 15 bp, Homo sapiens
taattactctgtgtt

SEQ ID NO: 385792 - DNA, 15 bp, Homo sapiens
aattactctgtgttt

SEQ ID NO: 385793 - DNA, 15 bp, Homo sapiens
attactctgtgtttt

SEQ ID NO: 385794 - DNA, 15 bp, Homo sapiens
ttactctgtgttttt

SEQ ID NO: 385795 - DNA, 15 bp, Homo sapiens
tactctgtgtttttc

SEQ ID NO: 385796 - DNA, 15 bp, Homo sapiens
actctgtgtttttct

SEQ ID NO: 385797 - DNA, 15 bp, Homo sapiens
ctctgtgtttttctc

SEQ ID NO: 385798 - DNA, 15 bp, Homo sapiens
tctgtgtttttctcc

SEQ ID NO: 385799 - DNA, 15 bp, Homo sapiens
ctgtgtttttctcct

SEQ ID NO: 385800 - DNA, 15 bp, Homo sapiens
tgtgtttttctcctt

SEQ ID NO: 385801 - DNA, 15 bp, Homo sapiens
gtgtttttctccttg

SEQ ID NO: 385802 - DNA, 15 bp, Homo sapiens
tgtttttctccttgt

SEQ ID NO: 385803 - DNA, 15 bp, Homo sapiens
gtttttctccttgtc

SEQ ID NO: 385804 - DNA, 15 bp, Homo sapiens
tttttctccttgtcc

SEQ ID NO: 385805 - DNA, 15 bp, Homo sapiens
ttttctccttgtcct

SEQ ID NO: 385806 - DNA, 15 bp, Homo sapiens
tttctccttgtcctt

SEQ ID NO: 385807 - DNA, 15 bp, Homo sapiens
ttctccttgtcctta

SEQ ID NO: 385808 - DNA, 15 bp, Homo sapiens
tctccttgtccttat

SEQ ID NO: 385809 - DNA, 15 bp, Homo sapiens
ctccttgtccttatc

SEQ ID NO: 385810 - DNA, 15 bp, Homo sapiens
tccttgtccttatcg

SEQ ID NO: 385811 - DNA, 15 bp, Homo sapiens
ccttgtccttatcgc

SEQ ID NO: 385812 - DNA, 15 bp, Homo sapiens
cttgtccttatcgca

SEQ ID NO: 385813 - DNA, 15 bp, Homo sapiens
ttgtccttatcgcat

SEQ ID NO: 385814 - DNA, 15 bp, Homo sapiens
tgtccttatcgcatt

SEQ ID NO: 385815 - DNA, 15 bp, Homo sapiens
gtccttatcgcattt

SEQ ID NO: 385816 - DNA, 15 bp, Homo sapiens
tccttatcgcatttt

SEQ ID NO: 385817 - DNA, 15 bp, Homo sapiens
ccttatcgcatttta

SEQ ID NO: 385818 - DNA, 15 bp, Homo sapiens
cttatcgcattttac

SEQ ID NO: 385819 - DNA, 15 bp, Homo sapiens
ttatcgcattttacc

SEQ ID NO: 385820 - DNA, 15 bp, Homo sapiens
tatcgcattttacct

SEQ ID NO: 385821 - DNA, 15 bp, Homo sapiens
atcgcattttacctt

SEQ ID NO: 385822 - DNA, 15 bp, Homo sapiens
tcgcattttaccttg

SEQ ID NO: 385823 - DNA, 15 bp, Homo sapiens
cgcattttaccttgc

SEQ ID NO: 385824 - DNA, 15 bp, Homo sapiens
gcattttaccttgcc

SEQ ID NO: 385825 - DNA, 15 bp, Homo sapiens
cattttaccttgcct

SEQ ID NO: 385826 - DNA, 15 bp, Homo sapiens
attttaccttgccta

SEQ ID NO: 385827 - DNA, 15 bp, Homo sapiens
ttttaccttgcctat

SEQ ID NO: 385828 - DNA, 15 bp, Homo sapiens
tttaccttgcctatg

SEQ ID NO: 385829 - DNA, 15 bp, Homo sapiens
ttaccttgcctatgt

SEQ ID NO: 385830 - DNA, 15 bp, Homo sapiens
taccttgcctatgtt

SEQ ID NO: 385831 - DNA, 15 bp, Homo sapiens
accttgcctatgtta

SEQ ID NO: 385832 - DNA, 15 bp, Homo sapiens
ccttgcctatgttaa

SEQ ID NO: 385833 - DNA, 15 bp, Homo sapiens
cttgcctatgttaag

SEQ ID NO: 385834 - DNA, 15 bp, Homo sapiens
ttgcctatgttaagg

SEQ ID NO: 385835 - DNA, 15 bp, Homo sapiens
tgcctatgttaaggt

SEQ ID NO: 385836 - DNA, 15 bp, Homo sapiens
gcctatgttaaggta

SEQ ID NO: 385837 - DNA, 15 bp, Homo sapiens
cctatgttaaggtat

SEQ ID NO: 385838 - DNA, 15 bp, Homo sapiens
ctatgttaaggtatt

SEQ ID NO: 385839 - DNA, 15 bp, Homo sapiens
tatgttaaggtattt

SEQ ID NO: 385840 - DNA, 15 bp, Homo sapiens
atgttaaggtatttc

SEQ ID NO: 385841 - DNA, 15 bp, Homo sapiens
tgttaaggtatttct

SEQ ID NO: 385842 - DNA, 15 bp, Homo sapiens
gttaaggtatttcta

SEQ ID NO: 385843 - DNA, 15 bp, Homo sapiens
ttaaggtatttctag

SEQ ID NO: 385844 - DNA, 15 bp, Homo sapiens
taaggtatttctagg

SEQ ID NO: 385845 - DNA, 15 bp, Homo sapiens
aaggtatttctaggt

SEQ ID NO: 385846 - DNA, 15 bp, Homo sapiens
aggtatttctaggtt

SEQ ID NO: 385847 - DNA, 15 bp, Homo sapiens
ggtatttctaggttt

SEQ ID NO: 385848 - DNA, 15 bp, Homo sapiens
gtatttctaggtttg

SEQ ID NO: 385849 - DNA, 15 bp, Homo sapiens
tatttctaggtttgt

SEQ ID NO: 385850 - DNA, 15 bp, Homo sapiens
atttctaggtttgta

SEQ ID NO: 385851 - DNA, 15 bp, Homo sapiens
tttctaggtttgtac

SEQ ID NO: 385852 - DNA, 15 bp, Homo sapiens
ttctaggtttgtaca

SEQ ID NO: 385853 - DNA, 15 bp, Homo sapiens
tctaggtttgtacag

SEQ ID NO: 385854 - DNA, 15 bp, Homo sapiens
ctaggtttgtacagg

SEQ ID NO: 385855 - DNA, 15 bp, Homo sapiens
taggtttgtacaggc

SEQ ID NO: 385856 - DNA, 15 bp, Homo sapiens
aggtttgtacaggca

SEQ ID NO: 385857 - DNA, 15 bp, Homo sapiens
ggtttgtacaggcag

SEQ ID NO: 385858 - DNA, 15 bp, Homo sapiens
gtttgtacaggcaga

SEQ ID NO: 385859 - DNA, 15 bp, Homo sapiens
tttgtacaggcagaa

SEQ ID NO: 385860 - DNA, 15 bp, Homo sapiens
ttgtacaggcagaac

SEQ ID NO: 385861 - DNA, 15 bp, Homo sapiens
tgtacaggcagaaca

SEQ ID NO: 385862 - DNA, 15 bp, Homo sapiens
gtacaggcagaacag

SEQ ID NO: 385863 - DNA, 15 bp, Homo sapiens
tacaggcagaacaga

SEQ ID NO: 385864 - DNA, 15 bp, Homo sapiens
acaggcagaacagaa

SEQ ID NO: 385865 - DNA, 15 bp, Homo sapiens
caggcagaacagaaa

SEQ ID NO: 385866 - DNA, 15 bp, Homo sapiens
aggcagaacagaaag

SEQ ID NO: 385867 - DNA, 15 bp, Homo sapiens
ggcagaacagaaagc

SEQ ID NO: 385868 - DNA, 15 bp, Homo sapiens
gcagaacagaaagca

SEQ ID NO: 385869 - DNA, 15 bp, Homo sapiens
cagaacagaaagcac

SEQ ID NO: 385870 - DNA, 15 bp, Homo sapiens
agaacagaaagcact

SEQ ID NO: 385871 - DNA, 15 bp, Homo sapiens
gaacagaaagcactg

SEQ ID NO: 385872 - DNA, 15 bp, Homo sapiens
aacagaaagcactga

SEQ ID NO: 385873 - DNA, 15 bp, Homo sapiens
acagaaagcactgag

SEQ ID NO: 385874 - DNA, 15 bp, Homo sapiens
cagaaagcactgagt

SEQ ID NO: 385875 - DNA, 15 bp, Homo sapiens
agaaagcactgagtg

SEQ ID NO: 385876 - DNA, 15 bp, Homo sapiens
gaaagcactgagtgt

SEQ ID NO: 385877 - DNA, 15 bp, Homo sapiens
aaagcactgagtgta

SEQ ID NO: 385878 - DNA, 15 bp, Homo sapiens
aagcactgagtgtaa

SEQ ID NO: 385879 - DNA, 15 bp, Homo sapiens
agcactgagtgtaag

SEQ ID NO: 385880 - DNA, 15 bp, Homo sapiens
gcactgagtgtaagg

SEQ ID NO: 385881 - DNA, 15 bp, Homo sapiens
cactgagtgtaaggt

SEQ ID NO: 385882 - DNA, 15 bp, Homo sapiens
actgagtgtaaggta

SEQ ID NO: 385883 - DNA, 15 bp, Homo sapiens
ctgagtgtaaggtat

SEQ ID NO: 385884 - DNA, 15 bp, Homo sapiens
tgagtgtaaggtata

SEQ ID NO: 385885 - DNA, 15 bp, Homo sapiens
gagtgtaaggtatat

SEQ ID NO: 385886 - DNA, 15 bp, Homo sapiens
agtgtaaggtatatg

SEQ ID NO: 385887 - DNA, 15 bp, Homo sapiens
gtgtaaggtatatgg
